United States Patent 7,888,497 (BIOINFORMATICALLY DETECTABLE GROUP OF NOVEL REGULATORY OLIGONUCLEOTIDES AND USES THEREOF) - sequence listing, part 123

SEQ ID NO: 5211453 - DNA, 21 bp, Homo sapiens
agggcccccctccccccactt

SEQ ID NO: 5211454 - DNA, 15 bp, Homo sapiens
agggcccccggccac

SEQ ID NO: 5211455 - DNA, 22 bp, Homo sapiens
agggcccccggccacgctccct

SEQ ID NO: 5211456 - DNA, 18 bp, Homo sapiens
agggcccccggctcggcc

SEQ ID NO: 5211457 - DNA, 13 bp, Homo sapiens
agggcccctagaa

SEQ ID NO: 5211458 - DNA, 14 bp, Homo sapiens
agggcccctcactg

SEQ ID NO: 5211459 - DNA, 17 bp, Homo sapiens
agggcccctccctctgc

SEQ ID NO: 5211460 - DNA, 13 bp, Homo sapiens
agggcccctctgc

SEQ ID NO: 5211461 - DNA, 14 bp, Homo sapiens
agggcccctctgcc

SEQ ID NO: 5211462 - DNA, 15 bp, Homo sapiens
agggcccctctgccc

SEQ ID NO: 5211463 - DNA, 19 bp, Homo sapiens
agggcccctctgcccagct

SEQ ID NO: 5211464 - DNA, 16 bp, Homo sapiens
agggcccctgaagtga

SEQ ID NO: 5211465 - DNA, 23 bp, Homo sapiens
agggcccctgaagtgaccccagc

SEQ ID NO: 5211466 - DNA, 12 bp, Homo sapiens
agggcccctgcg

SEQ ID NO: 5211467 - DNA, 22 bp, Homo sapiens
agggcccctggatctcctccct

SEQ ID NO: 5211468 - DNA, 16 bp, Homo sapiens
agggcccggccacacc

SEQ ID NO: 5211469 - DNA, 19 bp, Homo sapiens
agggcccgggcacccacaa

SEQ ID NO: 5211470 - DNA, 16 bp, Homo sapiens
agggcccgggcccagg

SEQ ID NO: 5211471 - DNA, 13 bp, Homo sapiens
agggccctaggcc

SEQ ID NO: 5211472 - DNA, 19 bp, Homo sapiens
agggccctcagaggaaagg

SEQ ID NO: 5211473 - DNA, 16 bp, Homo sapiens
agggccctcccagccc

SEQ ID NO: 5211474 - DNA, 11 bp, Homo sapiens
agggccctctg

SEQ ID NO: 5211475 - DNA, 16 bp, Homo sapiens
agggccctctggggct

SEQ ID NO: 5211476 - DNA, 19 bp, Homo sapiens
agggccctgaaatggcctg

SEQ ID NO: 5211477 - DNA, 18 bp, Homo sapiens
agggccctgagctgaggg

SEQ ID NO: 5211478 - DNA, 13 bp, Homo sapiens
agggccctgagga

SEQ ID NO: 5211479 - DNA, 15 bp, Homo sapiens
agggccctgaggaat

SEQ ID NO: 5211480 - DNA, 22 bp, Homo sapiens
agggccctgaggaataaagctt

SEQ ID NO: 5211481 - DNA, 15 bp, Homo sapiens
agggccctgccccag

SEQ ID NO: 5211482 - DNA, 20 bp, Homo sapiens
agggccctgccccaggcctg

SEQ ID NO: 5211483 - DNA, 20 bp, Homo sapiens
agggccctgctcaggcctca

SEQ ID NO: 5211484 - DNA, 12 bp, Homo sapiens
agggccctggag

SEQ ID NO: 5211485 - DNA, 14 bp, Homo sapiens
agggccctggccag

SEQ ID NO: 5211486 - DNA, 17 bp, Homo sapiens
agggccctggccagccg

SEQ ID NO: 5211487 - DNA, 18 bp, Homo sapiens
agggccctgggcctgcct

SEQ ID NO: 5211488 - DNA, 23 bp, Homo sapiens
agggccctggggtctctgagcag

SEQ ID NO: 5211489 - DNA, 13 bp, Homo sapiens
agggccctggtgt

SEQ ID NO: 5211490 - DNA, 14 bp, Homo sapiens
agggccctgtggag

SEQ ID NO: 5211491 - DNA, 19 bp, Homo sapiens
agggccctgtggagtccag

SEQ ID NO: 5211492 - DNA, 21 bp, Homo sapiens
agggccctgtggagtccagct

SEQ ID NO: 5211493 - DNA, 22 bp, Homo sapiens
agggccctgtggctccaggagc

SEQ ID NO: 5211494 - DNA, 20 bp, Homo sapiens
agggcccttcccaacctccc

SEQ ID NO: 5211495 - DNA, 17 bp, Homo sapiens
agggcccttcccctccc

SEQ ID NO: 5211496 - DNA, 17 bp, Homo sapiens
agggccctttttcaata

SEQ ID NO: 5211497 - DNA, 22 bp, Homo sapiens
agggccgaccagaggagccttt

SEQ ID NO: 5211498 - DNA, 14 bp, Homo sapiens
agggccgagacagg

SEQ ID NO: 5211499 - DNA, 20 bp, Homo sapiens
agggccgaggaggtgcctgg

SEQ ID NO: 5211500 - DNA, 15 bp, Homo sapiens
agggccgagtgagag

SEQ ID NO: 5211501 - DNA, 20 bp, Homo sapiens
agggccgccagggagacctg

SEQ ID NO: 5211502 - DNA, 14 bp, Homo sapiens
agggccgcctgcct

SEQ ID NO: 5211503 - DNA, 15 bp, Homo sapiens
agggccgcgagaggc

SEQ ID NO: 5211504 - DNA, 16 bp, Homo sapiens
agggccgcttctcctg

SEQ ID NO: 5211505 - DNA, 16 bp, Homo sapiens
agggccggcggctctg

SEQ ID NO: 5211506 - DNA, 21 bp, Homo sapiens
agggccggcggctctgagcag

SEQ ID NO: 5211507 - DNA, 22 bp, Homo sapiens
agggccggcggctctgagcagg

SEQ ID NO: 5211508 - DNA, 14 bp, Homo sapiens
agggccgggcaggg

SEQ ID NO: 5211509 - DNA, 19 bp, Homo sapiens
agggccggggaactggcca

SEQ ID NO: 5211510 - DNA, 23 bp, Homo sapiens
agggccggggaactggccaagct

SEQ ID NO: 5211511 - DNA, 14 bp, Homo sapiens
agggccggggatgg

SEQ ID NO: 5211512 - DNA, 18 bp, Homo sapiens
agggccggggatggatct

SEQ ID NO: 5211513 - DNA, 16 bp, Homo sapiens
agggccgtaccccacc

SEQ ID NO: 5211514 - DNA, 14 bp, Homo sapiens
agggccgtcaagga

SEQ ID NO: 5211515 - DNA, 22 bp, Homo sapiens
agggccgtgcccttgcccttgg

SEQ ID NO: 5211516 - DNA, 16 bp, Homo sapiens
agggcctactgccacc

SEQ ID NO: 5211517 - DNA, 19 bp, Homo sapiens
agggcctagctgctacaaa

SEQ ID NO: 5211518 - DNA, 17 bp, Homo sapiens
agggcctcacctttccc

SEQ ID NO: 5211519 - DNA, 20 bp, Homo sapiens
agggcctcactctgttgctc

SEQ ID NO: 5211520 - DNA, 14 bp, Homo sapiens
agggcctcagagcc

SEQ ID NO: 5211521 - DNA, 15 bp, Homo sapiens
agggcctcagagcct

SEQ ID NO: 5211522 - DNA, 17 bp, Homo sapiens
agggcctcagagcctga

SEQ ID NO: 5211523 - DNA, 21 bp, Homo sapiens
agggcctcagagcctgacctg

SEQ ID NO: 5211524 - DNA, 15 bp, Homo sapiens
agggcctccagccct

SEQ ID NO: 5211525 - DNA, 12 bp, Homo sapiens
agggcctccagg

SEQ ID NO: 5211526 - DNA, 13 bp, Homo sapiens
agggcctccagga

SEQ ID NO: 5211527 - DNA, 14 bp, Homo sapiens
agggcctccagggc

SEQ ID NO: 5211528 - DNA, 12 bp, Homo sapiens
agggcctcccag

SEQ ID NO: 5211529 - DNA, 17 bp, Homo sapiens
agggcctcccagccccc

SEQ ID NO: 5211530 - DNA, 20 bp, Homo sapiens
agggcctcccagcccccaac

SEQ ID NO: 5211531 - DNA, 15 bp, Homo sapiens
agggcctccctgttc

SEQ ID NO: 5211532 - DNA, 18 bp, Homo sapiens
agggcctcggaggctcct

SEQ ID NO: 5211533 - DNA, 19 bp, Homo sapiens
agggcctcggaggctcctc

SEQ ID NO: 5211534 - DNA, 21 bp, Homo sapiens
agggcctctccttggaaggtc

SEQ ID NO: 5211535 - DNA, 12 bp, Homo sapiens
agggcctctgga

SEQ ID NO: 5211536 - DNA, 17 bp, Homo sapiens
agggcctctggcttccc

SEQ ID NO: 5211537 - DNA, 22 bp, Homo sapiens
agggcctctggcttccctgccc

SEQ ID NO: 5211538 - DNA, 23 bp, Homo sapiens
agggcctctggcttccctgccca

SEQ ID NO: 5211539 - DNA, 20 bp, Homo sapiens
agggcctctggtgttcctgg

SEQ ID NO: 5211540 - DNA, 21 bp, Homo sapiens
agggcctctggtgttcctggc

SEQ ID NO: 5211541 - DNA, 21 bp, Homo sapiens
agggcctctgtcaattgtacg

SEQ ID NO: 5211542 - DNA, 22 bp, Homo sapiens
agggcctgaaacccgccctcag

SEQ ID NO: 5211543 - DNA, 17 bp, Homo sapiens
agggcctgacaccccct

SEQ ID NO: 5211544 - DNA, 20 bp, Homo sapiens
agggcctgacaccccctccc

SEQ ID NO: 5211545 - DNA, 12 bp, Homo sapiens
agggcctgactc

SEQ ID NO: 5211546 - DNA, 17 bp, Homo sapiens
agggcctgacttgagcc

SEQ ID NO: 5211547 - DNA, 20 bp, Homo sapiens
agggcctgacttgagccact

SEQ ID NO: 5211548 - DNA, 15 bp, Homo sapiens
agggcctgagcctgg

SEQ ID NO: 5211549 - DNA, 18 bp, Homo sapiens
agggcctgagcctggcca

SEQ ID NO: 5211550 - DNA, 20 bp, Homo sapiens
agggcctgagcctggccagc

SEQ ID NO: 5211551 - DNA, 16 bp, Homo sapiens
agggcctgaggtctgg

SEQ ID NO: 5211552 - DNA, 23 bp, Homo sapiens
agggcctgagtgctttaccttta

SEQ ID NO: 5211553 - DNA, 19 bp, Homo sapiens
agggcctgatggggtggaa

SEQ ID NO: 5211554 - DNA, 20 bp, Homo sapiens
agggcctgcaggacctgcct

SEQ ID NO: 5211555 - DNA, 19 bp, Homo sapiens
agggcctgcatggagaagg

SEQ ID NO: 5211556 - DNA, 23 bp, Homo sapiens
agggcctgcatggagaagggttc

SEQ ID NO: 5211557 - DNA, 14 bp, Homo sapiens
agggcctgccccct

SEQ ID NO: 5211558 - DNA, 17 bp, Homo sapiens
agggcctgccccctggg

SEQ ID NO: 5211559 - DNA, 19 bp, Homo sapiens
agggcctgccccctgggga

SEQ ID NO: 5211560 - DNA, 11 bp, Homo sapiens
agggcctgctc

SEQ ID NO: 5211561 - DNA, 15 bp, Homo sapiens
agggcctgctctgct

SEQ ID NO: 5211562 - DNA, 16 bp, Homo sapiens
agggcctgctctgctt

SEQ ID NO: 5211563 - DNA, 21 bp, Homo sapiens
agggcctgctgagttgcttct

SEQ ID NO: 5211564 - DNA, 14 bp, Homo sapiens
agggcctgctggag

SEQ ID NO: 5211565 - DNA, 18 bp, Homo sapiens
agggcctgctggaggcct

SEQ ID NO: 5211566 - DNA, 12 bp, Homo sapiens
agggcctggacg

SEQ ID NO: 5211567 - DNA, 13 bp, Homo sapiens
agggcctggagcc

SEQ ID NO: 5211568 - DNA, 14 bp, Homo sapiens
agggcctggagccc

SEQ ID NO: 5211569 - DNA, 15 bp, Homo sapiens
agggcctggcaggcc

SEQ ID NO: 5211570 - DNA, 23 bp, Homo sapiens
agggcctggcaggccagtgtctg

SEQ ID NO: 5211571 - DNA, 12 bp, Homo sapiens
agggcctggcat

SEQ ID NO: 5211572 - DNA, 13 bp, Homo sapiens
agggcctggccca

SEQ ID NO: 5211573 - DNA, 14 bp, Homo sapiens
agggcctggcctga

SEQ ID NO: 5211574 - DNA, 16 bp, Homo sapiens
agggcctggcctgagc

SEQ ID NO: 5211575 - DNA, 17 bp, Homo sapiens
agggcctggcctgagct

SEQ ID NO: 5211576 - DNA, 18 bp, Homo sapiens
agggcctggctcaggtgg

SEQ ID NO: 5211577 - DNA, 14 bp, Homo sapiens
aggcaatgccctgc

SEQ ID NO: 5211578 - DNA, 21 bp, Homo sapiens
aggcaatgctcaaacacccaa

SEQ ID NO: 5211579 - DNA, 17 bp, Homo sapiens
aggcaatgtcaggaaca

SEQ ID NO: 5211580 - DNA, 17 bp, Homo sapiens
aggcaattagagaaagt

SEQ ID NO: 5211581 - DNA, 14 bp, Homo sapiens
aggcaattctcctg

SEQ ID NO: 5211582 - DNA, 20 bp, Homo sapiens
aggcaattttagtgtattaa

SEQ ID NO: 5211583 - DNA, 21 bp, Homo sapiens
aggcaatttttacaacctgag

SEQ ID NO: 5211584 - DNA, 22 bp, Homo sapiens
aggcacaaaaccagaagtttct

SEQ ID NO: 5211585 - DNA, 16 bp, Homo sapiens
aggcacaaactctgca

SEQ ID NO: 5211586 - DNA, 20 bp, Homo sapiens
aggcacaaagggcaggcctg

SEQ ID NO: 5211587 - DNA, 20 bp, Homo sapiens
aggcacaacttcagcagggg

SEQ ID NO: 5211588 - DNA, 14 bp, Homo sapiens
aggcacacacagcc

SEQ ID NO: 5211589 - DNA, 15 bp, Homo sapiens
aggcacacacagccc

SEQ ID NO: 5211590 - DNA, 23 bp, Homo sapiens
aggcacacactgtgctttctatt

SEQ ID NO: 5211591 - DNA, 18 bp, Homo sapiens
aggcacacagatcccctg

SEQ ID NO: 5211592 - DNA, 14 bp, Homo sapiens
aggcacacagcagc

SEQ ID NO: 5211593 - DNA, 15 bp, Homo sapiens
aggcacacagcagcc

SEQ ID NO: 5211594 - DNA, 18 bp, Homo sapiens
aggcacacagcagccccc

SEQ ID NO: 5211595 - DNA, 20 bp, Homo sapiens
aggcacacagcagcccccca

SEQ ID NO: 5211596 - DNA, 18 bp, Homo sapiens
aggcacacagctgcagag

SEQ ID NO: 5211597 - DNA, 20 bp, Homo sapiens
aggcacacagggcccggcca

SEQ ID NO: 5211598 - DNA, 15 bp, Homo sapiens
aggcacacttcttct

SEQ ID NO: 5211599 - DNA, 16 bp, Homo sapiens
aggcacacttcttctt

SEQ ID NO: 5211600 - DNA, 13 bp, Homo sapiens
aggcacactttct

SEQ ID NO: 5211601 - DNA, 15 bp, Homo sapiens
aggcacactttctgg

SEQ ID NO: 5211602 - DNA, 12 bp, Homo sapiens
aggcacagagct

SEQ ID NO: 5211603 - DNA, 14 bp, Homo sapiens
aggcacagaggagg

SEQ ID NO: 5211604 - DNA, 12 bp, Homo sapiens
aggcacagcagt

SEQ ID NO: 5211605 - DNA, 14 bp, Homo sapiens
aggcacagctgagt

SEQ ID NO: 5211606 - DNA, 14 bp, Homo sapiens
aggcacaggcagga

SEQ ID NO: 5211607 - DNA, 18 bp, Homo sapiens
aggcacaggcaggaagag

SEQ ID NO: 5211608 - DNA, 20 bp, Homo sapiens
aggcacaggcaggaagagag

SEQ ID NO: 5211609 - DNA, 15 bp, Homo sapiens
aggcacagtgggagc

SEQ ID NO: 5211610 - DNA, 20 bp, Homo sapiens
aggcacagtgggagctgagc

SEQ ID NO: 5211611 - DNA, 22 bp, Homo sapiens
aggcacagtgggagctgagctg

SEQ ID NO: 5211612 - DNA, 13 bp, Homo sapiens
aggcacatggctg

SEQ ID NO: 5211613 - DNA, 16 bp, Homo sapiens
aggcacatgtcagcaa

SEQ ID NO: 5211614 - DNA, 14 bp, Homo sapiens
aggcacattaactg

SEQ ID NO: 5211615 - DNA, 15 bp, Homo sapiens
aggcacattaactgt

SEQ ID NO: 5211616 - DNA, 19 bp, Homo sapiens
aggcacattgaaatacttg

SEQ ID NO: 5211617 - DNA, 15 bp, Homo sapiens
aggcaccaccaggag

SEQ ID NO: 5211618 - DNA, 18 bp, Homo sapiens
aggcaccaccaggagcag

SEQ ID NO: 5211619 - DNA, 19 bp, Homo sapiens
aggcaccaccaggagcagc

SEQ ID NO: 5211620 - DNA, 22 bp, Homo sapiens
aggcaccaccaggagcagcagc

SEQ ID NO: 5211621 - DNA, 12 bp, Homo sapiens
aggcaccagcat

SEQ ID NO: 5211622 - DNA, 14 bp, Homo sapiens
aggcaccagcatcc

SEQ ID NO: 5211623 - DNA, 15 bp, Homo sapiens
aggcaccagcatcca

SEQ ID NO: 5211624 - DNA, 21 bp, Homo sapiens
aggcaccagctctgtggcctg

SEQ ID NO: 5211625 - DNA, 22 bp, Homo sapiens
aggcaccagctctgtggcctgt

SEQ ID NO: 5211626 - DNA, 15 bp, Homo sapiens
aggcaccagtccctg

SEQ ID NO: 5211627 - DNA, 20 bp, Homo sapiens
aggcaccagtgtcctcccct

SEQ ID NO: 5211628 - DNA, 16 bp, Homo sapiens
aggcaccatagaagaa

SEQ ID NO: 5211629 - DNA, 19 bp, Homo sapiens
aggcaccatagaagaacag

SEQ ID NO: 5211630 - DNA, 14 bp, Homo sapiens
aggcaccatctgcc

SEQ ID NO: 5211631 - DNA, 21 bp, Homo sapiens
aggcaccatctgccaatgcca

SEQ ID NO: 5211632 - DNA, 12 bp, Homo sapiens
aggcaccattca

SEQ ID NO: 5211633 - DNA, 22 bp, Homo sapiens
aggcacccaccaccatgcccag

SEQ ID NO: 5211634 - DNA, 14 bp, Homo sapiens
aggcacccccagaa

SEQ ID NO: 5211635 - DNA, 16 bp, Homo sapiens
aggcaccccctggaga

SEQ ID NO: 5211636 - DNA, 19 bp, Homo sapiens
aggcaccccctggagagaa

SEQ ID NO: 5211637 - DNA, 20 bp, Homo sapiens
aggcacccctccgtgtggag

SEQ ID NO: 5211638 - DNA, 23 bp, Homo sapiens
aggcacccctttccccagcctct

SEQ ID NO: 5211639 - DNA, 22 bp, Homo sapiens
aggcacccggggccagagacat

SEQ ID NO: 5211640 - DNA, 15 bp, Homo sapiens
aggcaccgcagcctg

SEQ ID NO: 5211641 - DNA, 20 bp, Homo sapiens
aggcaccgcagcctgtcagc

SEQ ID NO: 5211642 - DNA, 14 bp, Homo sapiens
aggcaccgccacgt

SEQ ID NO: 5211643 - DNA, 20 bp, Homo sapiens
aggcaccgccacgtcccagc

SEQ ID NO: 5211644 - DNA, 23 bp, Homo sapiens
aggcaccgccagagtgtcctgct

SEQ ID NO: 5211645 - DNA, 22 bp, Homo sapiens
aggcaccgctgggttctgactc

SEQ ID NO: 5211646 - DNA, 23 bp, Homo sapiens
aggcaccggacgctggagaccct

SEQ ID NO: 5211647 - DNA, 15 bp, Homo sapiens
aggcaccggcgctgc

SEQ ID NO: 5211648 - DNA, 12 bp, Homo sapiens
aggcacctcaag

SEQ ID NO: 5211649 - DNA, 19 bp, Homo sapiens
aggcacctcacagaaatga

SEQ ID NO: 5211650 - DNA, 20 bp, Homo sapiens
aggcacctcacaggccccag

SEQ ID NO: 5211651 - DNA, 12 bp, Homo sapiens
aggcacctccag

SEQ ID NO: 5211652 - DNA, 17 bp, Homo sapiens
aggcacctccaggcagg

SEQ ID NO: 5211653 - DNA, 23 bp, Homo sapiens
aggcacctccccgctctccctgt

SEQ ID NO: 5211654 - DNA, 14 bp, Homo sapiens
aggcacctcttcct

SEQ ID NO: 5211655 - DNA, 14 bp, Homo sapiens
aggcacctgcaggt

SEQ ID NO: 5211656 - DNA, 19 bp, Homo sapiens
aggcacctgcccccacagc

SEQ ID NO: 5211657 - DNA, 14 bp, Homo sapiens
aggcacctgctccc

SEQ ID NO: 5211658 - DNA, 16 bp, Homo sapiens
aggcacctgctggaaa

SEQ ID NO: 5211659 - DNA, 15 bp, Homo sapiens
aggcacctggcctgc

SEQ ID NO: 5211660 - DNA, 16 bp, Homo sapiens
aggcacctggcctgct

SEQ ID NO: 5211661 - DNA, 18 bp, Homo sapiens
aggcacctggcctgctgg

SEQ ID NO: 5211662 - DNA, 21 bp, Homo sapiens
aggcacctggtggccatgctc

SEQ ID NO: 5211663 - DNA, 16 bp, Homo sapiens
aggcaccttaactgga

SEQ ID NO: 5211664 - DNA, 19 bp, Homo sapiens
aggcaccttagtggctttt

SEQ ID NO: 5211665 - DNA, 15 bp, Homo sapiens
aggcacgaagcaatt

SEQ ID NO: 5211666 - DNA, 17 bp, Homo sapiens
aggcacgggtggtcccc

SEQ ID NO: 5211667 - DNA, 15 bp, Homo sapiens
aggcacgtctcctgc

SEQ ID NO: 5211668 - DNA, 20 bp, Homo sapiens
aggcactaagtcatggtcct

SEQ ID NO: 5211669 - DNA, 15 bp, Homo sapiens
aggcactagcctttg

SEQ ID NO: 5211670 - DNA, 15 bp, Homo sapiens
aggcactcagtgagc

SEQ ID NO: 5211671 - DNA, 19 bp, Homo sapiens
aggcactcagtgagcctcc

SEQ ID NO: 5211672 - DNA, 14 bp, Homo sapiens
aggcactctagatt

SEQ ID NO: 5211673 - DNA, 15 bp, Homo sapiens
aggcactctagattc

SEQ ID NO: 5211674 - DNA, 20 bp, Homo sapiens
aggcactctgttatttagac

SEQ ID NO: 5211675 - DNA, 18 bp, Homo sapiens
aggcactgaacaggctgg

SEQ ID NO: 5211676 - DNA, 11 bp, Homo sapiens
aggcactgaag

SEQ ID NO: 5211677 - DNA, 15 bp, Homo sapiens
aggcactgaccctcg

SEQ ID NO: 5211678 - DNA, 16 bp, Homo sapiens
aggcactgagcaggga

SEQ ID NO: 5211679 - DNA, 19 bp, Homo sapiens
aggcactgagcagggatct

SEQ ID NO: 5211680 - DNA, 12 bp, Homo sapiens
aggcactgagcg

SEQ ID NO: 5211681 - DNA, 19 bp, Homo sapiens
aggcactgagggatctgag

SEQ ID NO: 5211682 - DNA, 19 bp, Homo sapiens
aggcactgcaaaccgccac

SEQ ID NO: 5211683 - DNA, 15 bp, Homo sapiens
aggcactgccctggt

SEQ ID NO: 5211684 - DNA, 14 bp, Homo sapiens
aggcactgcctgat

SEQ ID NO: 5211685 - DNA, 20 bp, Homo sapiens
aggcactgccttctcctctc

SEQ ID NO: 5211686 - DNA, 14 bp, Homo sapiens
aggcactgctgccc

SEQ ID NO: 5211687 - DNA, 16 bp, Homo sapiens
aggcactgggcatgag

SEQ ID NO: 5211688 - DNA, 14 bp, Homo sapiens
aggcactgggctcc

SEQ ID NO: 5211689 - DNA, 23 bp, Homo sapiens
aggcactgggggcagcgggggcc

SEQ ID NO: 5211690 - DNA, 16 bp, Homo sapiens
aggcactgtactaggc

SEQ ID NO: 5211691 - DNA, 18 bp, Homo sapiens
aggcactgtggcccttct

SEQ ID NO: 5211692 - DNA, 19 bp, Homo sapiens
aggcactgtggcccttctg

SEQ ID NO: 5211693 - DNA, 16 bp, Homo sapiens
aggcacttaagcacaa

SEQ ID NO: 5211694 - DNA, 20 bp, Homo sapiens
aggcacttatcgaagctgat

SEQ ID NO: 5211695 - DNA, 14 bp, Homo sapiens
aggcacttattgta

SEQ ID NO: 5211696 - DNA, 19 bp, Homo sapiens
aggcacttgagggggaagg

SEQ ID NO: 5211697 - DNA, 15 bp, Homo sapiens
aggcacttggcagcc

SEQ ID NO: 5211698 - DNA, 18 bp, Homo sapiens
aggcacttggcagccttg

SEQ ID NO: 5211699 - DNA, 21 bp, Homo sapiens
aggcacttgtcactatgctat

SEQ ID NO: 5211700 - DNA, 15 bp, Homo sapiens
aggcactttaaaaca

SEQ ID NO: 5211701 - DNA, 15 bp, Homo sapiens
aggcactttagaaat

SEQ ID NO: 5211702 - DNA, 22 bp, Homo sapiens
aggcactttagggctgtaaaat

SEQ ID NO: 5211703 - DNA, 14 bp, Homo sapiens
aggcactttggggg

SEQ ID NO: 5211704 - DNA, 22 bp, Homo sapiens
aggcactttgggggtttgaggg

SEQ ID NO: 5211705 - DNA, 18 bp, Homo sapiens
aggcacttttattttcat

SEQ ID NO: 5211706 - DNA, 15 bp, Homo sapiens
aggcactttttaaca

SEQ ID NO: 5211707 - DNA, 19 bp, Homo sapiens
aggcactttttaacattct

SEQ ID NO: 5211708 - DNA, 23 bp, Homo sapiens
aggcactttttaacattctcaat

SEQ ID NO: 5211709 - DNA, 12 bp, Homo sapiens
aggcagaaagat

SEQ ID NO: 5211710 - DNA, 24 bp, Homo sapiens
aggcagaaagatacagacattcaa

SEQ ID NO: 5211711 - DNA, 20 bp, Homo sapiens
aggcagaaagatttggaaaa

SEQ ID NO: 5211712 - DNA, 14 bp, Homo sapiens
aggcagaaagcaaa

SEQ ID NO: 5211713 - DNA, 18 bp, Homo sapiens
aggcagaaagcagaggct

SEQ ID NO: 5211714 - DNA, 23 bp, Homo sapiens
aggcagaaagcagaggctggcct

SEQ ID NO: 5211715 - DNA, 15 bp, Homo sapiens
aggcagaaagggaaa

SEQ ID NO: 5211716 - DNA, 20 bp, Homo sapiens
aggcagaaatataaacacat

SEQ ID NO: 5211717 - DNA, 21 bp, Homo sapiens
aggcagaaccggtcccagcct

SEQ ID NO: 5211718 - DNA, 17 bp, Homo sapiens
aggcagaacctggtggc

SEQ ID NO: 5211719 - DNA, 22 bp, Homo sapiens
aggcagaactcatctaggtaaa

SEQ ID NO: 5211720 - DNA, 13 bp, Homo sapiens
aggcagaagaatc

SEQ ID NO: 5211721 - DNA, 15 bp, Homo sapiens
aggcagaagaattga

SEQ ID NO: 5211722 - DNA, 21 bp, Homo sapiens
aggcagaagaattgaacccag

SEQ ID NO: 5211723 - DNA, 22 bp, Homo sapiens
aggcagaagaattgaacccagg

SEQ ID NO: 5211724 - DNA, 23 bp, Homo sapiens
aggcagaagaattgaacccagga

SEQ ID NO: 5211725 - DNA, 16 bp, Homo sapiens
aggcagaatggctgca

SEQ ID NO: 5211726 - DNA, 18 bp, Homo sapiens
aggcagaatggctgcacg

SEQ ID NO: 5211727 - DNA, 14 bp, Homo sapiens
aggcagaatggtgg

SEQ ID NO: 5211728 - DNA, 20 bp, Homo sapiens
aggcagaatggtgggctcca

SEQ ID NO: 5211729 - DNA, 11 bp, Homo sapiens
aggcagacaca

SEQ ID NO: 5211730 - DNA, 21 bp, Homo sapiens
aggcagacacaccgcggccag

SEQ ID NO: 5211731 - DNA, 22 bp, Homo sapiens
aggcagacacaccgcggccagg

SEQ ID NO: 5211732 - DNA, 21 bp, Homo sapiens
aggcagacacagggacttgaa

SEQ ID NO: 5211733 - DNA, 18 bp, Homo sapiens
aggcagacacggatctga

SEQ ID NO: 5211734 - DNA, 13 bp, Homo sapiens
aggcagacagcag

SEQ ID NO: 5211735 - DNA, 19 bp, Homo sapiens
aggcagacagcagctcagg

SEQ ID NO: 5211736 - DNA, 15 bp, Homo sapiens
aggcagacagcaggc

SEQ ID NO: 5211737 - DNA, 22 bp, Homo sapiens
aggcagacagcaggcagcgcca

SEQ ID NO: 5211738 - DNA, 23 bp, Homo sapiens
aggcagacagcaggcagcgccaa

SEQ ID NO: 5211739 - DNA, 13 bp, Homo sapiens
aggcagacaggaa

SEQ ID NO: 5211740 - DNA, 16 bp, Homo sapiens
aggcagacgatgtcaa

SEQ ID NO: 5211741 - DNA, 21 bp, Homo sapiens
aggcagacgtctgtcaggggc

SEQ ID NO: 5211742 - DNA, 19 bp, Homo sapiens
aggcagacgtggggagggt

SEQ ID NO: 5211743 - DNA, 14 bp, Homo sapiens
aggcagactcgagg

SEQ ID NO: 5211744 - DNA, 20 bp, Homo sapiens
aggcagagaaaacacacgct

SEQ ID NO: 5211745 - DNA, 19 bp, Homo sapiens
aggcagagaaagaagagac

SEQ ID NO: 5211746 - DNA, 13 bp, Homo sapiens
aggcagagaaatc

SEQ ID NO: 5211747 - DNA, 18 bp, Homo sapiens
aggcagagaacagaactg

SEQ ID NO: 5211748 - DNA, 16 bp, Homo sapiens
aggcagagaatctctt

SEQ ID NO: 5211749 - DNA, 14 bp, Homo sapiens
aggcagagacaata

SEQ ID NO: 5211750 - DNA, 20 bp, Homo sapiens
aggcagagacaataaaacat

SEQ ID NO: 5211751 - DNA, 14 bp, Homo sapiens
aggcagagagggtc

SEQ ID NO: 5211752 - DNA, 20 bp, Homo sapiens
aggcagagagtacagactgc

SEQ ID NO: 5211753 - DNA, 21 bp, Homo sapiens
aggcagagagtacagactgca

SEQ ID NO: 5211754 - DNA, 22 bp, Homo sapiens
aggcagagattgggggggcttg

SEQ ID NO: 5211755 - DNA, 23 bp, Homo sapiens
aggcagagattgggggggcttgg

SEQ ID NO: 5211756 - DNA, 16 bp, Homo sapiens
agggcctgggcctggc

SEQ ID NO: 5211757 - DNA, 20 bp, Homo sapiens
agggcctggggcctgagaga

SEQ ID NO: 5211758 - DNA, 22 bp, Homo sapiens
agggcctgggttttcatgtttt

SEQ ID NO: 5211759 - DNA, 21 bp, Homo sapiens
agggcctggtccctgggagga

SEQ ID NO: 5211760 - DNA, 13 bp, Homo sapiens
agggcctgtctcc

SEQ ID NO: 5211761 - DNA, 19 bp, Homo sapiens
agggcctgtgggagcctgc

SEQ ID NO: 5211762 - DNA, 16 bp, Homo sapiens
agggccttaaaagcca

SEQ ID NO: 5211763 - DNA, 17 bp, Homo sapiens
agggccttaaaagccat

SEQ ID NO: 5211764 - DNA, 18 bp, Homo sapiens
agggccttaaaagccatc

SEQ ID NO: 5211765 - DNA, 23 bp, Homo sapiens
agggccttaaaagccatcatgta

SEQ ID NO: 5211766 - DNA, 15 bp, Homo sapiens
agggccttctgcctg

SEQ ID NO: 5211767 - DNA, 16 bp, Homo sapiens
agggccttctgcctgc

SEQ ID NO: 5211768 - DNA, 17 bp, Homo sapiens
agggccttgagcatctg

SEQ ID NO: 5211769 - DNA, 22 bp, Homo sapiens
agggccttgatttccagccgca

SEQ ID NO: 5211770 - DNA, 18 bp, Homo sapiens
agggccttgcccagagat

SEQ ID NO: 5211771 - DNA, 14 bp, Homo sapiens
agggccttgcttct

SEQ ID NO: 5211772 - DNA, 15 bp, Homo sapiens
agggccttggcccag

SEQ ID NO: 5211773 - DNA, 15 bp, Homo sapiens
agggcctttctcctc

SEQ ID NO: 5211774 - DNA, 16 bp, Homo sapiens
agggccttttgtggat

SEQ ID NO: 5211775 - DNA, 18 bp, Homo sapiens
agggcgacgtcttcagag

SEQ ID NO: 5211776 - DNA, 19 bp, Homo sapiens
agggcgagactctgtctca

SEQ ID NO: 5211777 - DNA, 15 bp, Homo sapiens
agggcgagctgcagg

SEQ ID NO: 5211778 - DNA, 21 bp, Homo sapiens
agggcgaggcgggggagcctg

SEQ ID NO: 5211779 - DNA, 22 bp, Homo sapiens
agggcgaggcgggggagcctgg

SEQ ID NO: 5211780 - DNA, 22 bp, Homo sapiens
agggcgaggcgggggatcctgg

SEQ ID NO: 5211781 - DNA, 19 bp, Homo sapiens
agggcgcaggaaccgagga

SEQ ID NO: 5211782 - DNA, 13 bp, Homo sapiens
agggcgcaggccg

SEQ ID NO: 5211783 - DNA, 13 bp, Homo sapiens
agggcgccaagtc

SEQ ID NO: 5211784 - DNA, 14 bp, Homo sapiens
agggcgccagggtg

SEQ ID NO: 5211785 - DNA, 19 bp, Homo sapiens
agggcgcccagcagcctgc

SEQ ID NO: 5211786 - DNA, 14 bp, Homo sapiens
agggcgcccagccc

SEQ ID NO: 5211787 - DNA, 17 bp, Homo sapiens
agggcgcccagcccagg

SEQ ID NO: 5211788 - DNA, 15 bp, Homo sapiens
agggcgcccagcgcc

SEQ ID NO: 5211789 - DNA, 22 bp, Homo sapiens
agggcgcccattcgtctgtccc

SEQ ID NO: 5211790 - DNA, 23 bp, Homo sapiens
agggcgcccattcgtctgtccca

SEQ ID NO: 5211791 - DNA, 15 bp, Homo sapiens
agggcgcccctggga

SEQ ID NO: 5211792 - DNA, 14 bp, Homo sapiens
agggcgcctgggtc

SEQ ID NO: 5211793 - DNA, 15 bp, Homo sapiens
agggcgctcagacgg

SEQ ID NO: 5211794 - DNA, 20 bp, Homo sapiens
agggcgctcagacggcggcc

SEQ ID NO: 5211795 - DNA, 21 bp, Homo sapiens
agggcgctcagacggcggcca

SEQ ID NO: 5211796 - DNA, 16 bp, Homo sapiens
agggcgctccggcaga

SEQ ID NO: 5211797 - DNA, 23 bp, Homo sapiens
agggcgctccggcagaggcaggg

SEQ ID NO: 5211798 - DNA, 15 bp, Homo sapiens
agggcgctgagggca

SEQ ID NO: 5211799 - DNA, 12 bp, Homo sapiens
agggcggaagag

SEQ ID NO: 5211800 - DNA, 13 bp, Homo sapiens
agggcggcactca

SEQ ID NO: 5211801 - DNA, 23 bp, Homo sapiens
agggcggcaggggcctggagatc

SEQ ID NO: 5211802 - DNA, 14 bp, Homo sapiens
agggcggccaggga

SEQ ID NO: 5211803 - DNA, 15 bp, Homo sapiens
agggcggccagggac

SEQ ID NO: 5211804 - DNA, 17 bp, Homo sapiens
agggcggccagggacag

SEQ ID NO: 5211805 - DNA, 18 bp, Homo sapiens
agggcggccagggacaga

SEQ ID NO: 5211806 - DNA, 20 bp, Homo sapiens
agggcggcccctctgttctg

SEQ ID NO: 5211807 - DNA, 12 bp, Homo sapiens
agggcggctgcc

SEQ ID NO: 5211808 - DNA, 15 bp, Homo sapiens
agggcgggcaaggag

SEQ ID NO: 5211809 - DNA, 19 bp, Homo sapiens
agggcgggcagagggctgg

SEQ ID NO: 5211810 - DNA, 14 bp, Homo sapiens
agggcgggccagga

SEQ ID NO: 5211811 - DNA, 12 bp, Homo sapiens
agggcgggcctg

SEQ ID NO: 5211812 - DNA, 23 bp, Homo sapiens
agggcggggcacagattggagag

SEQ ID NO: 5211813 - DNA, 21 bp, Homo sapiens
agggcggggctggccagctgt

SEQ ID NO: 5211814 - DNA, 17 bp, Homo sapiens
agggcgggggtggcggc

SEQ ID NO: 5211815 - DNA, 15 bp, Homo sapiens
agggcgtcaggcaga

SEQ ID NO: 5211816 - DNA, 13 bp, Homo sapiens
agggcgtcctctc

SEQ ID NO: 5211817 - DNA, 21 bp, Homo sapiens
agggcgtcgctggacaaccca

SEQ ID NO: 5211818 - DNA, 22 bp, Homo sapiens
agggcgtcgctggacaacccag

SEQ ID NO: 5211819 - DNA, 23 bp, Homo sapiens
agggcgtcgctggacaacccaga

SEQ ID NO: 5211820 - DNA, 15 bp, Homo sapiens
agggcgtgactcacc

SEQ ID NO: 5211821 - DNA, 19 bp, Homo sapiens
agggcgtggaaaggggcag

SEQ ID NO: 5211822 - DNA, 14 bp, Homo sapiens
agggcgtggctctg

SEQ ID NO: 5211823 - DNA, 17 bp, Homo sapiens
agggcgtggctctgggt

SEQ ID NO: 5211824 - DNA, 14 bp, Homo sapiens
agggcgtgggagcg

SEQ ID NO: 5211825 - DNA, 22 bp, Homo sapiens
agggcgtgggcatgggcgcaga

SEQ ID NO: 5211826 - DNA, 19 bp, Homo sapiens
agggcgtgtggtttccctg

SEQ ID NO: 5211827 - DNA, 20 bp, Homo sapiens
agggcgtgtggtttccctgc

SEQ ID NO: 5211828 - DNA, 21 bp, Homo sapiens
agggctaaaaaggtcctgtaa

SEQ ID NO: 5211829 - DNA, 22 bp, Homo sapiens
agggctaaaaaggtcctgtaag

SEQ ID NO: 5211830 - DNA, 15 bp, Homo sapiens
agggctaaataaaga

SEQ ID NO: 5211831 - DNA, 19 bp, Homo sapiens
agggctaaataaagaggag

SEQ ID NO: 5211832 - DNA, 13 bp, Homo sapiens
agggctaagagct

SEQ ID NO: 5211833 - DNA, 20 bp, Homo sapiens
agggctaaggcctcttgctg

SEQ ID NO: 5211834 - DNA, 13 bp, Homo sapiens
agggctaattaga

SEQ ID NO: 5211835 - DNA, 22 bp, Homo sapiens
agggctaattatatattttgtt

SEQ ID NO: 5211836 - DNA, 14 bp, Homo sapiens
agggctacacagac

SEQ ID NO: 5211837 - DNA, 19 bp, Homo sapiens
agggctaccctcccccagg

SEQ ID NO: 5211838 - DNA, 22 bp, Homo sapiens
agggctaccctgagctgaggca

SEQ ID NO: 5211839 - DNA, 21 bp, Homo sapiens
agggctactgcagctttacat

SEQ ID NO: 5211840 - DNA, 17 bp, Homo sapiens
agggctagaacctggaa

SEQ ID NO: 5211841 - DNA, 22 bp, Homo sapiens
agggctagaacctggagggcta

SEQ ID NO: 5211842 - DNA, 23 bp, Homo sapiens
agggctagaacctggaggggcta

SEQ ID NO: 5211843 - DNA, 18 bp, Homo sapiens
agggctagaactggagag

SEQ ID NO: 5211844 - DNA, 18 bp, Homo sapiens
agggctagaatctggaga

SEQ ID NO: 5211845 - DNA, 16 bp, Homo sapiens
agggctagcatccctg

SEQ ID NO: 5211846 - DNA, 17 bp, Homo sapiens
agggctagccctgagcc

SEQ ID NO: 5211847 - DNA, 22 bp, Homo sapiens
agggctagccctgagcccggcc

SEQ ID NO: 5211848 - DNA, 15 bp, Homo sapiens
agggctaggaatata

SEQ ID NO: 5211849 - DNA, 20 bp, Homo sapiens
agggctagggaggtggggta

SEQ ID NO: 5211850 - DNA, 18 bp, Homo sapiens
agggctagtagaactgga

SEQ ID NO: 5211851 - DNA, 20 bp, Homo sapiens
agggctagtagaactggatc

SEQ ID NO: 5211852 - DNA, 23 bp, Homo sapiens
agggctagtcttcccttacctca

SEQ ID NO: 5211853 - DNA, 24 bp, Homo sapiens
agggctagtgacttgtgtcccatg

SEQ ID NO: 5211854 - DNA, 15 bp, Homo sapiens
agggctatggtgtgg

SEQ ID NO: 5211855 - DNA, 14 bp, Homo sapiens
agggctcaacactg

SEQ ID NO: 5211856 - DNA, 24 bp, Homo sapiens
agggctcaatctctgggggctgag

SEQ ID NO: 5211857 - DNA, 17 bp, Homo sapiens
agggctcacactcctgg

SEQ ID NO: 5211858 - DNA, 14 bp, Homo sapiens
agggctcacagggc

SEQ ID NO: 5211859 - DNA, 16 bp, Homo sapiens
agggctcacagggcag

SEQ ID NO: 5211860 - DNA, 17 bp, Homo sapiens
agggctcaccagctggg

SEQ ID NO: 5211861 - DNA, 14 bp, Homo sapiens
agggctcagaagag

SEQ ID NO: 5211862 - DNA, 15 bp, Homo sapiens
agggctcagaagagc

SEQ ID NO: 5211863 - DNA, 16 bp, Homo sapiens
agggctcagaagagca

SEQ ID NO: 5211864 - DNA, 17 bp, Homo sapiens
agggctcagagaggaca

SEQ ID NO: 5211865 - DNA, 14 bp, Homo sapiens
agggctcagagctg

SEQ ID NO: 5211866 - DNA, 22 bp, Homo sapiens
agggctcagagtgaccctcagc

SEQ ID NO: 5211867 - DNA, 23 bp, Homo sapiens
agggctcagatggggcctgggct

SEQ ID NO: 5211868 - DNA, 24 bp, Homo sapiens
agggctcaggatttcgtgggtctg

SEQ ID NO: 5211869 - DNA, 14 bp, Homo sapiens
agggctcagggcag

SEQ ID NO: 5211870 - DNA, 13 bp, Homo sapiens
agggctcatgatt

SEQ ID NO: 5211871 - DNA, 17 bp, Homo sapiens
agggctccacgggggcc

SEQ ID NO: 5211872 - DNA, 20 bp, Homo sapiens
agggctccacgggggcctag

SEQ ID NO: 5211873 - DNA, 20 bp, Homo sapiens
agggctccagacacatgtcc

SEQ ID NO: 5211874 - DNA, 18 bp, Homo sapiens
agggctccagcatccagc

SEQ ID NO: 5211875 - DNA, 14 bp, Homo sapiens
agggctccagcccc

SEQ ID NO: 5211876 - DNA, 15 bp, Homo sapiens
agggctccagcccct

SEQ ID NO: 5211877 - DNA, 20 bp, Homo sapiens
agggctccagcccctcttgg

SEQ ID NO: 5211878 - DNA, 13 bp, Homo sapiens
agggctccagcct

SEQ ID NO: 5211879 - DNA, 15 bp, Homo sapiens
agggctccagcctgt

SEQ ID NO: 5211880 - DNA, 12 bp, Homo sapiens
agggctcccatg

SEQ ID NO: 5211881 - DNA, 16 bp, Homo sapiens
agggctccctcctgga

SEQ ID NO: 5211882 - DNA, 15 bp, Homo sapiens
agggctccctgccct

SEQ ID NO: 5211883 - DNA, 23 bp, Homo sapiens
agggctcccttatgtccaccact

SEQ ID NO: 5211884 - DNA, 19 bp, Homo sapiens
agggctccgaggagctggg

SEQ ID NO: 5211885 - DNA, 11 bp, Homo sapiens
agggctcctcc

SEQ ID NO: 5211886 - DNA, 15 bp, Homo sapiens
agggctcctccatgg

SEQ ID NO: 5211887 - DNA, 12 bp, Homo sapiens
agggctcctccc

SEQ ID NO: 5211888 - DNA, 17 bp, Homo sapiens
agggctcctccctggag

SEQ ID NO: 5211889 - DNA, 19 bp, Homo sapiens
agggctcctccctggagct

SEQ ID NO: 5211890 - DNA, 19 bp, Homo sapiens
agggctcctctccagtctg

SEQ ID NO: 5211891 - DNA, 11 bp, Homo sapiens
agggctcctgc

SEQ ID NO: 5211892 - DNA, 14 bp, Homo sapiens
agggctcctggggc

SEQ ID NO: 5211893 - DNA, 15 bp, Homo sapiens
agggctcctggggca

SEQ ID NO: 5211894 - DNA, 17 bp, Homo sapiens
agggctcctggggcaga

SEQ ID NO: 5211895 - DNA, 18 bp, Homo sapiens
agggctcgaggggtgggc

SEQ ID NO: 5211896 - DNA, 23 bp, Homo sapiens
agggctcgggcgctgtggctcct

SEQ ID NO: 5211897 - DNA, 13 bp, Homo sapiens
agggctctccaag

SEQ ID NO: 5211898 - DNA, 14 bp, Homo sapiens
agggctctccaagc

SEQ ID NO: 5211899 - DNA, 12 bp, Homo sapiens
agggctctcctg

SEQ ID NO: 5211900 - DNA, 21 bp, Homo sapiens
agggctctgagccaaccttgc

SEQ ID NO: 5211901 - DNA, 13 bp, Homo sapiens
agggctctgaggc

SEQ ID NO: 5211902 - DNA, 21 bp, Homo sapiens
agggctctgatattccatgaa

SEQ ID NO: 5211903 - DNA, 22 bp, Homo sapiens
agggctctgatattccatgaat

SEQ ID NO: 5211904 - DNA, 12 bp, Homo sapiens
agggctctgccc

SEQ ID NO: 5211905 - DNA, 12 bp, Homo sapiens
agggctctttct

SEQ ID NO: 5211906 - DNA, 22 bp, Homo sapiens
agggctgaaaacggagagggaa

SEQ ID NO: 5211907 - DNA, 13 bp, Homo sapiens
agggctgaaggga

SEQ ID NO: 5211908 - DNA, 14 bp, Homo sapiens
agggctgaagggag

SEQ ID NO: 5211909 - DNA, 19 bp, Homo sapiens
agggctgaagggagggcct

SEQ ID NO: 5211910 - DNA, 20 bp, Homo sapiens
agggctgacacgtccacccc

SEQ ID NO: 5211911 - DNA, 21 bp, Homo sapiens
agggctgacacgtccacccca

SEQ ID NO: 5211912 - DNA, 15 bp, Homo sapiens
agggctgacctgcct

SEQ ID NO: 5211913 - DNA, 16 bp, Homo sapiens
agggctgacctgcctc

SEQ ID NO: 5211914 - DNA, 13 bp, Homo sapiens
agggctgacttct

SEQ ID NO: 5211915 - DNA, 17 bp, Homo sapiens
agggctgacttctccag

SEQ ID NO: 5211916 - DNA, 15 bp, Homo sapiens
agggctgagccatgg

SEQ ID NO: 5211917 - DNA, 12 bp, Homo sapiens
agggctgagccc

SEQ ID NO: 5211918 - DNA, 13 bp, Homo sapiens
agggctgagcccc

SEQ ID NO: 5211919 - DNA, 15 bp, Homo sapiens
agggctgagcccctc

SEQ ID NO: 5211920 - DNA, 14 bp, Homo sapiens
agggctgaggagca

SEQ ID NO: 5211921 - DNA, 16 bp, Homo sapiens
agggctgaggagcagc

SEQ ID NO: 5211922 - DNA, 15 bp, Homo sapiens
agggctgaggggcct

SEQ ID NO: 5211923 - DNA, 17 bp, Homo sapiens
agggctgagtgttctgg

SEQ ID NO: 5211924 - DNA, 21 bp, Homo sapiens
agggctgagtttgcacagtgg

SEQ ID NO: 5211925 - DNA, 17 bp, Homo sapiens
agggctgatggaggaaa

SEQ ID NO: 5211926 - DNA, 19 bp, Homo sapiens
agggctgcacattgcctgt

SEQ ID NO: 5211927 - DNA, 11 bp, Homo sapiens
agggctgcagt

SEQ ID NO: 5211928 - DNA, 13 bp, Homo sapiens
agggctgcagtca

SEQ ID NO: 5211929 - DNA, 13 bp, Homo sapiens
agggctgccagca

SEQ ID NO: 5211930 - DNA, 14 bp, Homo sapiens
agggctgccaggag

SEQ ID NO: 5211931 - DNA, 13 bp, Homo sapiens
agggctgccctga

SEQ ID NO: 5211932 - DNA, 20 bp, Homo sapiens
agggctgccttctggccttg

SEQ ID NO: 5211933 - DNA, 21 bp, Homo sapiens
agggctgcggcgtacaggctg

SEQ ID NO: 5211934 - DNA, 23 bp, Homo sapiens
agggctgcggcgtacaggctggc

SEQ ID NO: 5211935 - DNA, 16 bp, Homo sapiens
agggctgctctttcca

SEQ ID NO: 5211936 - DNA, 14 bp, Homo sapiens
aggcagagcgggag

SEQ ID NO: 5211937 - DNA, 21 bp, Homo sapiens
aggcagagctcagcacagcct

SEQ ID NO: 5211938 - DNA, 11 bp, Homo sapiens
aggcagagctg

SEQ ID NO: 5211939 - DNA, 22 bp, Homo sapiens
aggcagagctgacgggaggccc

SEQ ID NO: 5211940 - DNA, 21 bp, Homo sapiens
aggcagagctgagggccctgt

SEQ ID NO: 5211941 - DNA, 17 bp, Homo sapiens
aggcagaggatgttctg

SEQ ID NO: 5211942 - DNA, 14 bp, Homo sapiens
aggcagaggcccag

SEQ ID NO: 5211943 - DNA, 19 bp, Homo sapiens
aggcagaggcccaggctgc

SEQ ID NO: 5211944 - DNA, 20 bp, Homo sapiens
aggcagaggcccaggctgcc

SEQ ID NO: 5211945 - DNA, 18 bp, Homo sapiens
aggcagaggcctgggctg

SEQ ID NO: 5211946 - DNA, 15 bp, Homo sapiens
aggcagaggctggca

SEQ ID NO: 5211947 - DNA, 14 bp, Homo sapiens
aggcagagtcttct

SEQ ID NO: 5211948 - DNA, 15 bp, Homo sapiens
aggcagagtcttctt

SEQ ID NO: 5211949 - DNA, 20 bp, Homo sapiens
aggcagagtgccccacctgc

SEQ ID NO: 5211950 - DNA, 22 bp, Homo sapiens
aggcagagtgccccacctgcca

SEQ ID NO: 5211951 - DNA, 16 bp, Homo sapiens
aggcagagttctgtgg

SEQ ID NO: 5211952 - DNA, 16 bp, Homo sapiens
aggcagatagcactgg

SEQ ID NO: 5211953 - DNA, 16 bp, Homo sapiens
aggcagatccaggact

SEQ ID NO: 5211954 - DNA, 17 bp, Homo sapiens
aggcagatccaggacta

SEQ ID NO: 5211955 - DNA, 15 bp, Homo sapiens
aggcagatctgtgcc

SEQ ID NO: 5211956 - DNA, 18 bp, Homo sapiens
aggcagatctttaaatac

SEQ ID NO: 5211957 - DNA, 18 bp, Homo sapiens
aggcagatgcccttgctg

SEQ ID NO: 5211958 - DNA, 20 bp, Homo sapiens
aggcagatgcccttgctggg

SEQ ID NO: 5211959 - DNA, 21 bp, Homo sapiens
aggcagatggccactgctctt

SEQ ID NO: 5211960 - DNA, 15 bp, Homo sapiens
aggcagattaataac

SEQ ID NO: 5211961 - DNA, 22 bp, Homo sapiens
aggcagattaataacagaaata

SEQ ID NO: 5211962 - DNA, 16 bp, Homo sapiens
aggcagattgaaaagg

SEQ ID NO: 5211963 - DNA, 16 bp, Homo sapiens
aggcagatttgaggtt

SEQ ID NO: 5211964 - DNA, 22 bp, Homo sapiens
aggcagattttacagagcgcac

SEQ ID NO: 5211965 - DNA, 20 bp, Homo sapiens
aggcagcaacaggaccagga

SEQ ID NO: 5211966 - DNA, 17 bp, Homo sapiens
aggcagcaaggcccgag

SEQ ID NO: 5211967 - DNA, 16 bp, Homo sapiens
aggcagcaccacactg

SEQ ID NO: 5211968 - DNA, 18 bp, Homo sapiens
aggcagcacgtgcacaaa

SEQ ID NO: 5211969 - DNA, 15 bp, Homo sapiens
aggcagcagacacat

SEQ ID NO: 5211970 - DNA, 13 bp, Homo sapiens
aggcagcagagag

SEQ ID NO: 5211971 - DNA, 22 bp, Homo sapiens
aggcagcagagagagaggacag

SEQ ID NO: 5211972 - DNA, 15 bp, Homo sapiens
aggcagcaggagcca

SEQ ID NO: 5211973 - DNA, 12 bp, Homo sapiens
aggcagcagggg

SEQ ID NO: 5211974 - DNA, 11 bp, Homo sapiens
aggcagcatgg

SEQ ID NO: 5211975 - DNA, 16 bp, Homo sapiens
aggcagcatgtatagt

SEQ ID NO: 5211976 - DNA, 14 bp, Homo sapiens
aggcagcatttgaa

SEQ ID NO: 5211977 - DNA, 15 bp, Homo sapiens
aggcagcatttgaat

SEQ ID NO: 5211978 - DNA, 19 bp, Homo sapiens
aggcagccaacctaagcaa

SEQ ID NO: 5211979 - DNA, 20 bp, Homo sapiens
aggcagccaccagtggacct

SEQ ID NO: 5211980 - DNA, 15 bp, Homo sapiens
aggcagccacggccc

SEQ ID NO: 5211981 - DNA, 19 bp, Homo sapiens
aggcagccagatccccagg

SEQ ID NO: 5211982 - DNA, 22 bp, Homo sapiens
aggcagccagatccccagggca

SEQ ID NO: 5211983 - DNA, 23 bp, Homo sapiens
aggcagccagatccccagggcag

SEQ ID NO: 5211984 - DNA, 15 bp, Homo sapiens
aggcagccagcatct

SEQ ID NO: 5211985 - DNA, 13 bp, Homo sapiens
aggcagccagcca

SEQ ID NO: 5211986 - DNA, 17 bp, Homo sapiens
aggcagccagccgtggc

SEQ ID NO: 5211987 - DNA, 15 bp, Homo sapiens
aggcagccaggccac

SEQ ID NO: 5211988 - DNA, 14 bp, Homo sapiens
aggcagccagggct

SEQ ID NO: 5211989 - DNA, 22 bp, Homo sapiens
aggcagccagtgccctgagcca

SEQ ID NO: 5211990 - DNA, 20 bp, Homo sapiens
aggcagcccagcagtgtgga

SEQ ID NO: 5211991 - DNA, 23 bp, Homo sapiens
aggcagcccagctcctgaataaa

SEQ ID NO: 5211992 - DNA, 21 bp, Homo sapiens
aggcagcccaggaagtctcat

SEQ ID NO: 5211993 - DNA, 16 bp, Homo sapiens
aggcagccccattctg

SEQ ID NO: 5211994 - DNA, 22 bp, Homo sapiens
aggcagccccattctgcctgcc

SEQ ID NO: 5211995 - DNA, 12 bp, Homo sapiens
aggcagccccct

SEQ ID NO: 5211996 - DNA, 14 bp, Homo sapiens
aggcagccccctcc

SEQ ID NO: 5211997 - DNA, 15 bp, Homo sapiens
aggcagccccctcca

SEQ ID NO: 5211998 - DNA, 20 bp, Homo sapiens
aggcagccctgtctgaagga

SEQ ID NO: 5211999 - DNA, 15 bp, Homo sapiens
aggcagccctttggg

SEQ ID NO: 5212000 - DNA, 20 bp, Homo sapiens
aggcagccgaggcctggcca

SEQ ID NO: 5212001 - DNA, 20 bp, Homo sapiens
aggcagccgaggtccctgct

SEQ ID NO: 5212002 - DNA, 13 bp, Homo sapiens
aggcagccgccct

SEQ ID NO: 5212003 - DNA, 23 bp, Homo sapiens
aggcagccgtgggccccaccctc

SEQ ID NO: 5212004 - DNA, 22 bp, Homo sapiens
aggcagcctagcctatgtctgg

SEQ ID NO: 5212005 - DNA, 22 bp, Homo sapiens
aggcagcctccagagccagcct

SEQ ID NO: 5212006 - DNA, 16 bp, Homo sapiens
aggcagcctccagcct

SEQ ID NO: 5212007 - DNA, 13 bp, Homo sapiens
aggcagcctcctt

SEQ ID NO: 5212008 - DNA, 21 bp, Homo sapiens
aggcagcctctggggggtggc

SEQ ID NO: 5212009 - DNA, 19 bp, Homo sapiens
aggcagcctgagagctggc

SEQ ID NO: 5212010 - DNA, 16 bp, Homo sapiens
aggcagcctgcaggga

SEQ ID NO: 5212011 - DNA, 14 bp, Homo sapiens
aggcagcctgccgc

SEQ ID NO: 5212012 - DNA, 22 bp, Homo sapiens
aggcagcctggacatagagagg

SEQ ID NO: 5212013 - DNA, 12 bp, Homo sapiens
aggcagcgaccc

SEQ ID NO: 5212014 - DNA, 16 bp, Homo sapiens
aggcagcgcagggctg

SEQ ID NO: 5212015 - DNA, 17 bp, Homo sapiens
aggcagcgcagggctgg

SEQ ID NO: 5212016 - DNA, 17 bp, Homo sapiens
aggcagcgcattgtttt

SEQ ID NO: 5212017 - DNA, 19 bp, Homo sapiens
aggcagcgccaagcaacct

SEQ ID NO: 5212018 - DNA, 17 bp, Homo sapiens
aggcagcgccactgtcc

SEQ ID NO: 5212019 - DNA, 16 bp, Homo sapiens
aggcagcgccccacca

SEQ ID NO: 5212020 - DNA, 15 bp, Homo sapiens
aggcagcgcctgtcc

SEQ ID NO: 5212021 - DNA, 19 bp, Homo sapiens
aggcagcgcctgtcccctc

SEQ ID NO: 5212022 - DNA, 16 bp, Homo sapiens
aggcagcgtgggctct

SEQ ID NO: 5212023 - DNA, 18 bp, Homo sapiens
aggcagcgtgggctctgc

SEQ ID NO: 5212024 - DNA, 22 bp, Homo sapiens
aggcagcgtgggctctgccaat

SEQ ID NO: 5212025 - DNA, 18 bp, Homo sapiens
aggcagcgttagggctgc

SEQ ID NO: 5212026 - DNA, 14 bp, Homo sapiens
aggcagctcaggat

SEQ ID NO: 5212027 - DNA, 14 bp, Homo sapiens
aggcagctcccagg

SEQ ID NO: 5212028 - DNA, 16 bp, Homo sapiens
aggcagctccctcctg

SEQ ID NO: 5212029 - DNA, 15 bp, Homo sapiens
aggcagctcctgttt

SEQ ID NO: 5212030 - DNA, 20 bp, Homo sapiens
aggcagctctaaatgtcaat

SEQ ID NO: 5212031 - DNA, 14 bp, Homo sapiens
aggcagctctgagc

SEQ ID NO: 5212032 - DNA, 15 bp, Homo sapiens
aggcagctctgagcc

SEQ ID NO: 5212033 - DNA, 15 bp, Homo sapiens
aggcagctgagacca

SEQ ID NO: 5212034 - DNA, 20 bp, Homo sapiens
aggcagctgagaccagggtc

SEQ ID NO: 5212035 - DNA, 13 bp, Homo sapiens
aggcagctgcagt

SEQ ID NO: 5212036 - DNA, 11 bp, Homo sapiens
aggcagctgcc

SEQ ID NO: 5212037 - DNA, 23 bp, Homo sapiens
aggcagctgcctctgctccctct

SEQ ID NO: 5212038 - DNA, 22 bp, Homo sapiens
aggcagctggatgagacttcca

SEQ ID NO: 5212039 - DNA, 12 bp, Homo sapiens
aggcagctggca

SEQ ID NO: 5212040 - DNA, 23 bp, Homo sapiens
aggcagctgtgtctgagcccaac

SEQ ID NO: 5212041 - DNA, 20 bp, Homo sapiens
aggcagcttctactcctgcc

SEQ ID NO: 5212042 - DNA, 15 bp, Homo sapiens
aggcagcttgaaact

SEQ ID NO: 5212043 - DNA, 22 bp, Homo sapiens
aggcagctttaaccattaaaac

SEQ ID NO: 5212044 - DNA, 19 bp, Homo sapiens
aggcaggaacaaacagggc

SEQ ID NO: 5212045 - DNA, 16 bp, Homo sapiens
aggcaggaacatacag

SEQ ID NO: 5212046 - DNA, 14 bp, Homo sapiens
aggcaggaagagag

SEQ ID NO: 5212047 - DNA, 23 bp, Homo sapiens
aggcaggaagagagagagagagg

SEQ ID NO: 5212048 - DNA, 16 bp, Homo sapiens
aggcaggaagggcagg

SEQ ID NO: 5212049 - DNA, 11 bp, Homo sapiens
aggcaggaagt

SEQ ID NO: 5212050 - DNA, 19 bp, Homo sapiens
aggcaggaagtcaggagcc

SEQ ID NO: 5212051 - DNA, 15 bp, Homo sapiens
aggcaggaatggggg

SEQ ID NO: 5212052 - DNA, 14 bp, Homo sapiens
aggcaggacatgct

SEQ ID NO: 5212053 - DNA, 22 bp, Homo sapiens
aggcaggaccttcgggctgtgc

SEQ ID NO: 5212054 - DNA, 18 bp, Homo sapiens
aggcaggacttctcacca

SEQ ID NO: 5212055 - DNA, 18 bp, Homo sapiens
aggcaggagaactacttg

SEQ ID NO: 5212056 - DNA, 22 bp, Homo sapiens
aggcaggagcatgtatgtctgc

SEQ ID NO: 5212057 - DNA, 13 bp, Homo sapiens
aggcaggagcctt

SEQ ID NO: 5212058 - DNA, 17 bp, Homo sapiens
aggcaggagggcatgtg

SEQ ID NO: 5212059 - DNA, 19 bp, Homo sapiens
aggcaggagttgggggcag

SEQ ID NO: 5212060 - DNA, 21 bp, Homo sapiens
aggcaggagttgggggcaggt

SEQ ID NO: 5212061 - DNA, 16 bp, Homo sapiens
aggcaggattggggaa

SEQ ID NO: 5212062 - DNA, 22 bp, Homo sapiens
aggcaggcacctgggctttctg

SEQ ID NO: 5212063 - DNA, 20 bp, Homo sapiens
aggcaggcatggccctgggc

SEQ ID NO: 5212064 - DNA, 13 bp, Homo sapiens
aggcaggcattga

SEQ ID NO: 5212065 - DNA, 19 bp, Homo sapiens
aggcaggccaggctgcctc

SEQ ID NO: 5212066 - DNA, 15 bp, Homo sapiens
aggcaggcccagcct

SEQ ID NO: 5212067 - DNA, 21 bp, Homo sapiens
aggcaggcccagcctctgccc

SEQ ID NO: 5212068 - DNA, 12 bp, Homo sapiens
aggcaggcctcc

SEQ ID NO: 5212069 - DNA, 12 bp, Homo sapiens
aggcaggcctga

SEQ ID NO: 5212070 - DNA, 14 bp, Homo sapiens
aggcaggcggctcc

SEQ ID NO: 5212071 - DNA, 17 bp, Homo sapiens
aggcaggcggctcctcc

SEQ ID NO: 5212072 - DNA, 20 bp, Homo sapiens
aggcaggcggctcctcctca

SEQ ID NO: 5212073 - DNA, 21 bp, Homo sapiens
aggcaggctgggtgggaggga

SEQ ID NO: 5212074 - DNA, 14 bp, Homo sapiens
aggcaggctttctg

SEQ ID NO: 5212075 - DNA, 21 bp, Homo sapiens
aggcagggaaaggaaaagaag

SEQ ID NO: 5212076 - DNA, 22 bp, Homo sapiens
aggcagggaaaggctctgaaag

SEQ ID NO: 5212077 - DNA, 21 bp, Homo sapiens
aggcagggaagtgtaagaaac

SEQ ID NO: 5212078 - DNA, 13 bp, Homo sapiens
aggcagggagaag

SEQ ID NO: 5212079 - DNA, 23 bp, Homo sapiens
aggcagggagagagtagctgcag

SEQ ID NO: 5212080 - DNA, 22 bp, Homo sapiens
aggcagggaggaggcagagaag

SEQ ID NO: 5212081 - DNA, 21 bp, Homo sapiens
aggcagggagggaaacccggg

SEQ ID NO: 5212082 - DNA, 23 bp, Homo sapiens
aggcagggagggaaacccgggga

SEQ ID NO: 5212083 - DNA, 13 bp, Homo sapiens
aggcagggagggg

SEQ ID NO: 5212084 - DNA, 14 bp, Homo sapiens
aggcagggagggga

SEQ ID NO: 5212085 - DNA, 16 bp, Homo sapiens
aggcagggagggggct

SEQ ID NO: 5212086 - DNA, 20 bp, Homo sapiens
aggcagggagggggctggga

SEQ ID NO: 5212087 - DNA, 23 bp, Homo sapiens
aggcagggagggggctgggaaag

SEQ ID NO: 5212088 - DNA, 15 bp, Homo sapiens
aggcagggatttgag

SEQ ID NO: 5212089 - DNA, 16 bp, Homo sapiens
aggcagggcaaatgac

SEQ ID NO: 5212090 - DNA, 14 bp, Homo sapiens
aggcagggcagagg

SEQ ID NO: 5212091 - DNA, 15 bp, Homo sapiens
aggcagggcaggacc

SEQ ID NO: 5212092 - DNA, 12 bp, Homo sapiens
aggcagggccct

SEQ ID NO: 5212093 - DNA, 16 bp, Homo sapiens
aggcagggccctgaaa

SEQ ID NO: 5212094 - DNA, 23 bp, Homo sapiens
aggcagggccttgcccagagatg

SEQ ID NO: 5212095 - DNA, 13 bp, Homo sapiens
aggcagggctcct

SEQ ID NO: 5212096 - DNA, 16 bp, Homo sapiens
aggcagggctcctccc

SEQ ID NO: 5212097 - DNA, 22 bp, Homo sapiens
aggcagggctcctccctggagc

SEQ ID NO: 5212098 - DNA, 17 bp, Homo sapiens
aggcagggctctcctgg

SEQ ID NO: 5212099 - DNA, 21 bp, Homo sapiens
aggcagggctctcctggcttc

SEQ ID NO: 5212100 - DNA, 22 bp, Homo sapiens
aggcagggctctcctggcttcc

SEQ ID NO: 5212101 - DNA, 23 bp, Homo sapiens
aggcagggctctcctggcttccc

SEQ ID NO: 5212102 - DNA, 13 bp, Homo sapiens
aggcagggctgga

SEQ ID NO: 5212103 - DNA, 15 bp, Homo sapiens
aggcagggctgggcc

SEQ ID NO: 5212104 - DNA, 17 bp, Homo sapiens
aggcagggctgggccag

SEQ ID NO: 5212105 - DNA, 23 bp, Homo sapiens
aggcagggctgggccaggtctcc

SEQ ID NO: 5212106 - DNA, 14 bp, Homo sapiens
aggcaggggaatgt

SEQ ID NO: 5212107 - DNA, 13 bp, Homo sapiens
aggcaggggccca

SEQ ID NO: 5212108 - DNA, 17 bp, Homo sapiens
aggcaggggccctgcag

SEQ ID NO: 5212109 - DNA, 18 bp, Homo sapiens
aggcaggggccctgcagc

SEQ ID NO: 5212110 - DNA, 21 bp, Homo sapiens
aggcaggggccctgcagctct

SEQ ID NO: 5212111 - DNA, 16 bp, Homo sapiens
aggcaggggcctccat

SEQ ID NO: 5212112 - DNA, 16 bp, Homo sapiens
aggcaggggctctgct

SEQ ID NO: 5212113 - DNA, 12 bp, Homo sapiens
aggcaggggctg

SEQ ID NO: 5212114 - DNA, 15 bp, Homo sapiens
aggcaggggctgctg

SEQ ID NO: 5212115 - DNA, 17 bp, Homo sapiens
agggctgctgcttctgc

SEQ ID NO: 5212116 - DNA, 19 bp, Homo sapiens
agggctgctgcttctgctc

SEQ ID NO: 5212117 - DNA, 22 bp, Homo sapiens
agggctgctgcttctgctccag

SEQ ID NO: 5212118 - DNA, 20 bp, Homo sapiens
agggctgctgggggcaactg

SEQ ID NO: 5212119 - DNA, 12 bp, Homo sapiens
agggctgctgtg

SEQ ID NO: 5212120 - DNA, 13 bp, Homo sapiens
agggctgctgtgg

SEQ ID NO: 5212121 - DNA, 14 bp, Homo sapiens
agggctgcttttct

SEQ ID NO: 5212122 - DNA, 18 bp, Homo sapiens
agggctggaaaagtcaca

SEQ ID NO: 5212123 - DNA, 24 bp, Homo sapiens
agggctggacatttgtggcagtgc

SEQ ID NO: 5212124 - DNA, 22 bp, Homo sapiens
agggctggactctggcacccag

SEQ ID NO: 5212125 - DNA, 14 bp, Homo sapiens
agggctggactgag

SEQ ID NO: 5212126 - DNA, 15 bp, Homo sapiens
agggctggactgagg

SEQ ID NO: 5212127 - DNA, 16 bp, Homo sapiens
agggctggactgaggc

SEQ ID NO: 5212128 - DNA, 17 bp, Homo sapiens
agggctggactgaggcc

SEQ ID NO: 5212129 - DNA, 18 bp, Homo sapiens
agggctggactgaggcct

SEQ ID NO: 5212130 - DNA, 21 bp, Homo sapiens
agggctggagacttcctctgg

SEQ ID NO: 5212131 - DNA, 16 bp, Homo sapiens
agggctggagcctggg

SEQ ID NO: 5212132 - DNA, 15 bp, Homo sapiens
agggctggaggccca

SEQ ID NO: 5212133 - DNA, 21 bp, Homo sapiens
agggctggaggcccaggctgg

SEQ ID NO: 5212134 - DNA, 14 bp, Homo sapiens
agggctggatggac

SEQ ID NO: 5212135 - DNA, 17 bp, Homo sapiens
agggctggatggacaga

SEQ ID NO: 5212136 - DNA, 18 bp, Homo sapiens
agggctggattggcaggt

SEQ ID NO: 5212137 - DNA, 22 bp, Homo sapiens
agggctggcacgtgacaggctc

SEQ ID NO: 5212138 - DNA, 14 bp, Homo sapiens
agggctggcccagc

SEQ ID NO: 5212139 - DNA, 15 bp, Homo sapiens
agggctggcccagcc

SEQ ID NO: 5212140 - DNA, 18 bp, Homo sapiens
agggctggcccagccctg

SEQ ID NO: 5212141 - DNA, 20 bp, Homo sapiens
agggctggcccagccctgct

SEQ ID NO: 5212142 - DNA, 16 bp, Homo sapiens
agggctggcccgggga

SEQ ID NO: 5212143 - DNA, 12 bp, Homo sapiens
agggctggccct

SEQ ID NO: 5212144 - DNA, 13 bp, Homo sapiens
agggctggcccta

SEQ ID NO: 5212145 - DNA, 11 bp, Homo sapiens
agggctggctc

SEQ ID NO: 5212146 - DNA, 13 bp, Homo sapiens
agggctggctccc

SEQ ID NO: 5212147 - DNA, 22 bp, Homo sapiens
agggctggctccccctccccag

SEQ ID NO: 5212148 - DNA, 14 bp, Homo sapiens
agggctggctctgc

SEQ ID NO: 5212149 - DNA, 23 bp, Homo sapiens
agggctggctctgcactaagaga

SEQ ID NO: 5212150 - DNA, 16 bp, Homo sapiens
agggctggctggagga

SEQ ID NO: 5212151 - DNA, 22 bp, Homo sapiens
agggctggctggaggaaggaaa

SEQ ID NO: 5212152 - DNA, 13 bp, Homo sapiens
agggctggctggc

SEQ ID NO: 5212153 - DNA, 17 bp, Homo sapiens
agggctggctggcctca

SEQ ID NO: 5212154 - DNA, 22 bp, Homo sapiens
agggctgggcaaggaaaaagaa

SEQ ID NO: 5212155 - DNA, 21 bp, Homo sapiens
agggctgggcactcctcccct

SEQ ID NO: 5212156 - DNA, 14 bp, Homo sapiens
agggctgggcagct

SEQ ID NO: 5212157 - DNA, 20 bp, Homo sapiens
agggctgggcaggtcctggg

SEQ ID NO: 5212158 - DNA, 11 bp, Homo sapiens
agggctgggcc

SEQ ID NO: 5212159 - DNA, 16 bp, Homo sapiens
agggctgggccaccag

SEQ ID NO: 5212160 - DNA, 20 bp, Homo sapiens
agggctgggccaccagggat

SEQ ID NO: 5212161 - DNA, 15 bp, Homo sapiens
agggctgggccaggt

SEQ ID NO: 5212162 - DNA, 13 bp, Homo sapiens
agggctgggcctg

SEQ ID NO: 5212163 - DNA, 20 bp, Homo sapiens
agggctgggcgcctctgtcc

SEQ ID NO: 5212164 - DNA, 22 bp, Homo sapiens
agggctgggctctgtcttcctg

SEQ ID NO: 5212165 - DNA, 10 bp, Homo sapiens
agggctgggg

SEQ ID NO: 5212166 - DNA, 15 bp, Homo sapiens
agggctggggacaga

SEQ ID NO: 5212167 - DNA, 15 bp, Homo sapiens
agggctggggactgg

SEQ ID NO: 5212168 - DNA, 17 bp, Homo sapiens
agggctggggatgcgcc

SEQ ID NO: 5212169 - DNA, 19 bp, Homo sapiens
agggctggggatgcgcctg

SEQ ID NO: 5212170 - DNA, 13 bp, Homo sapiens
agggctggggcca

SEQ ID NO: 5212171 - DNA, 17 bp, Homo sapiens
agggctggggtgagcct

SEQ ID NO: 5212172 - DNA, 18 bp, Homo sapiens
agggctggggtgagcctg

SEQ ID NO: 5212173 - DNA, 17 bp, Homo sapiens
agggctggggttgccag

SEQ ID NO: 5212174 - DNA, 19 bp, Homo sapiens
agggctggggttgccagag

SEQ ID NO: 5212175 - DNA, 20 bp, Homo sapiens
agggctggggttgccagagg

SEQ ID NO: 5212176 - DNA, 19 bp, Homo sapiens
agggctgggtaggcaggtg

SEQ ID NO: 5212177 - DNA, 15 bp, Homo sapiens
agggctgggtcacag

SEQ ID NO: 5212178 - DNA, 14 bp, Homo sapiens
agggctgggtcagg

SEQ ID NO: 5212179 - DNA, 15 bp, Homo sapiens
agggctgggtcaggg

SEQ ID NO: 5212180 - DNA, 17 bp, Homo sapiens
agggctgggtcaggggt

SEQ ID NO: 5212181 - DNA, 12 bp, Homo sapiens
agggctgggtgt

SEQ ID NO: 5212182 - DNA, 19 bp, Homo sapiens
agggctggtccttatttat

SEQ ID NO: 5212183 - DNA, 16 bp, Homo sapiens
agggctggttaatgta

SEQ ID NO: 5212184 - DNA, 15 bp, Homo sapiens
agggctggtttgttc

SEQ ID NO: 5212185 - DNA, 18 bp, Homo sapiens
agggctgtaactgccagg

SEQ ID NO: 5212186 - DNA, 14 bp, Homo sapiens
agggctgtcatctg

SEQ ID NO: 5212187 - DNA, 20 bp, Homo sapiens
agggctgtcatctgtgcact

SEQ ID NO: 5212188 - DNA, 19 bp, Homo sapiens
agggctgtggcctccctgc

SEQ ID NO: 5212189 - DNA, 22 bp, Homo sapiens
agggctgttataatctttcaca

SEQ ID NO: 5212190 - DNA, 17 bp, Homo sapiens
agggctgttccctccag

SEQ ID NO: 5212191 - DNA, 21 bp, Homo sapiens
agggctgttgatttatgcttt

SEQ ID NO: 5212192 - DNA, 12 bp, Homo sapiens
agggctgttgct

SEQ ID NO: 5212193 - DNA, 17 bp, Homo sapiens
agggctgttggacagct

SEQ ID NO: 5212194 - DNA, 21 bp, Homo sapiens
agggctgttggacagctgctt

SEQ ID NO: 5212195 - DNA, 22 bp, Homo sapiens
agggctgttggacagctgcttg

SEQ ID NO: 5212196 - DNA, 19 bp, Homo sapiens
agggctgttggaggacccc

SEQ ID NO: 5212197 - DNA, 15 bp, Homo sapiens
agggctgttttgcct

SEQ ID NO: 5212198 - DNA, 23 bp, Homo sapiens
agggcttacctgtacactgactt

SEQ ID NO: 5212199 - DNA, 20 bp, Homo sapiens
agggcttacggccctggcct

SEQ ID NO: 5212200 - DNA, 16 bp, Homo sapiens
agggcttattgactct

SEQ ID NO: 5212201 - DNA, 21 bp, Homo sapiens
agggcttccccatcagctccc

SEQ ID NO: 5212202 - DNA, 13 bp, Homo sapiens
agggcttcctcaa

SEQ ID NO: 5212203 - DNA, 22 bp, Homo sapiens
agggcttcctcaaatacatgca

SEQ ID NO: 5212204 - DNA, 21 bp, Homo sapiens
agggcttcctctagaagccaa

SEQ ID NO: 5212205 - DNA, 22 bp, Homo sapiens
agggcttctcctgcgggggcga

SEQ ID NO: 5212206 - DNA, 15 bp, Homo sapiens
agggcttctgcaccc

SEQ ID NO: 5212207 - DNA, 16 bp, Homo sapiens
agggcttctgcaccct

SEQ ID NO: 5212208 - DNA, 16 bp, Homo sapiens
agggcttcttcttata

SEQ ID NO: 5212209 - DNA, 21 bp, Homo sapiens
agggcttgatggtgacagctg

SEQ ID NO: 5212210 - DNA, 22 bp, Homo sapiens
agggcttggatcgtggaagaag

SEQ ID NO: 5212211 - DNA, 15 bp, Homo sapiens
agggcttggccagcg

SEQ ID NO: 5212212 - DNA, 17 bp, Homo sapiens
agggcttggcccagcgc

SEQ ID NO: 5212213 - DNA, 21 bp, Homo sapiens
agggcttggcccagcgccaag

SEQ ID NO: 5212214 - DNA, 22 bp, Homo sapiens
agggcttggggagcaggtctct

SEQ ID NO: 5212215 - DNA, 20 bp, Homo sapiens
agggcttggggctgcacctc

SEQ ID NO: 5212216 - DNA, 21 bp, Homo sapiens
agggcttggggctgcacctcc

SEQ ID NO: 5212217 - DNA, 21 bp, Homo sapiens
agggcttggtggccaagcctg

SEQ ID NO: 5212218 - DNA, 16 bp, Homo sapiens
agggcttgtagttctt

SEQ ID NO: 5212219 - DNA, 12 bp, Homo sapiens
agggcttgtttt

SEQ ID NO: 5212220 - DNA, 19 bp, Homo sapiens
agggcttgtttttcttcag

SEQ ID NO: 5212221 - DNA, 15 bp, Homo sapiens
agggctttaaaattc

SEQ ID NO: 5212222 - DNA, 16 bp, Homo sapiens
agggctttaaaattct

SEQ ID NO: 5212223 - DNA, 19 bp, Homo sapiens
agggctttaaaattctctt

SEQ ID NO: 5212224 - DNA, 20 bp, Homo sapiens
agggctttaaaattctcttc

SEQ ID NO: 5212225 - DNA, 19 bp, Homo sapiens
agggctttaaataaaagag

SEQ ID NO: 5212226 - DNA, 22 bp, Homo sapiens
agggctttcagcgcccccaggc

SEQ ID NO: 5212227 - DNA, 23 bp, Homo sapiens
agggctttctgggtgtgtccagg

SEQ ID NO: 5212228 - DNA, 16 bp, Homo sapiens
agggctttggggggca

SEQ ID NO: 5212229 - DNA, 19 bp, Homo sapiens
agggctttggggggcacta

SEQ ID NO: 5212230 - DNA, 21 bp, Homo sapiens
agggctttggggggcactaga

SEQ ID NO: 5212231 - DNA, 21 bp, Homo sapiens
agggctttggttccttctctg

SEQ ID NO: 5212232 - DNA, 18 bp, Homo sapiens
agggctttgttttgcaca

SEQ ID NO: 5212233 - DNA, 21 bp, Homo sapiens
agggcttttctctttcctcta

SEQ ID NO: 5212234 - DNA, 21 bp, Homo sapiens
agggcttttttttgagaatac

SEQ ID NO: 5212235 - DNA, 15 bp, Homo sapiens
aggggaaaaaatcat

SEQ ID NO: 5212236 - DNA, 22 bp, Homo sapiens
aggggaaaaaatcatattctaa

SEQ ID NO: 5212237 - DNA, 15 bp, Homo sapiens
aggggaaaacctcag

SEQ ID NO: 5212238 - DNA, 14 bp, Homo sapiens
aggggaaaatagta

SEQ ID NO: 5212239 - DNA, 18 bp, Homo sapiens
aggggaaaatcagcctgc

SEQ ID NO: 5212240 - DNA, 13 bp, Homo sapiens
aggggaaaatgaa

SEQ ID NO: 5212241 - DNA, 20 bp, Homo sapiens
aggggaaaccagtgtagcct

SEQ ID NO: 5212242 - DNA, 20 bp, Homo sapiens
aggggaaacctgtgaaagct

SEQ ID NO: 5212243 - DNA, 16 bp, Homo sapiens
aggggaaacgagaagg

SEQ ID NO: 5212244 - DNA, 17 bp, Homo sapiens
aggggaaacgtctccca

SEQ ID NO: 5212245 - DNA, 20 bp, Homo sapiens
aggggaaagacttccatcta

SEQ ID NO: 5212246 - DNA, 14 bp, Homo sapiens
aggggaaaggcctg

SEQ ID NO: 5212247 - DNA, 14 bp, Homo sapiens
aggggaaagtccag

SEQ ID NO: 5212248 - DNA, 16 bp, Homo sapiens
aggggaaatgaatgtg

SEQ ID NO: 5212249 - DNA, 13 bp, Homo sapiens
aggggaaatgtaa

SEQ ID NO: 5212250 - DNA, 17 bp, Homo sapiens
aggggaacactgccctc

SEQ ID NO: 5212251 - DNA, 16 bp, Homo sapiens
aggggaacagaccagt

SEQ ID NO: 5212252 - DNA, 14 bp, Homo sapiens
aggggaacagactg

SEQ ID NO: 5212253 - DNA, 14 bp, Homo sapiens
aggggaacctgcca

SEQ ID NO: 5212254 - DNA, 15 bp, Homo sapiens
aggggaagaaggaaa

SEQ ID NO: 5212255 - DNA, 15 bp, Homo sapiens
aggggaagaatgaaa

SEQ ID NO: 5212256 - DNA, 14 bp, Homo sapiens
aggggaagaattta

SEQ ID NO: 5212257 - DNA, 13 bp, Homo sapiens
aggggaagagaag

SEQ ID NO: 5212258 - DNA, 18 bp, Homo sapiens
aggggaagagaagacaaa

SEQ ID NO: 5212259 - DNA, 22 bp, Homo sapiens
aggggaagagacaaagtgggtg

SEQ ID NO: 5212260 - DNA, 16 bp, Homo sapiens
aggggaagagatgttt

SEQ ID NO: 5212261 - DNA, 14 bp, Homo sapiens
aggggaagccttgc

SEQ ID NO: 5212262 - DNA, 14 bp, Homo sapiens
aggggaagctgcag

SEQ ID NO: 5212263 - DNA, 14 bp, Homo sapiens
aggggaagctgggc

SEQ ID NO: 5212264 - DNA, 15 bp, Homo sapiens
aggggaagctgggcc

SEQ ID NO: 5212265 - DNA, 17 bp, Homo sapiens
aggggaagctgggccca

SEQ ID NO: 5212266 - DNA, 13 bp, Homo sapiens
aggggaagggcag

SEQ ID NO: 5212267 - DNA, 14 bp, Homo sapiens
aggggaagggccag

SEQ ID NO: 5212268 - DNA, 23 bp, Homo sapiens
aggggaagggccagtctgggctg

SEQ ID NO: 5212269 - DNA, 15 bp, Homo sapiens
aggggaaggggccgg

SEQ ID NO: 5212270 - DNA, 21 bp, Homo sapiens
aggggaaggggccggggaggg

SEQ ID NO: 5212271 - DNA, 20 bp, Homo sapiens
aggggaagtatgtgtgggta

SEQ ID NO: 5212272 - DNA, 23 bp, Homo sapiens
aggggaagtctcttcctgcctcc

SEQ ID NO: 5212273 - DNA, 17 bp, Homo sapiens
aggggaagtgtgctgag

SEQ ID NO: 5212274 - DNA, 21 bp, Homo sapiens
aggggaataaactgttgagtc

SEQ ID NO: 5212275 - DNA, 18 bp, Homo sapiens
aggggaataatagaagaa

SEQ ID NO: 5212276 - DNA, 19 bp, Homo sapiens
aggggaataatagaagaac

SEQ ID NO: 5212277 - DNA, 19 bp, Homo sapiens
aggggaatattttattcaa

SEQ ID NO: 5212278 - DNA, 22 bp, Homo sapiens
aggggaatattttattcaaggt

SEQ ID NO: 5212279 - DNA, 15 bp, Homo sapiens
aggggaatcagaact

SEQ ID NO: 5212280 - DNA, 23 bp, Homo sapiens
aggggaatgaaccatggcacctt

SEQ ID NO: 5212281 - DNA, 20 bp, Homo sapiens
aggggaatgagggggctcag

SEQ ID NO: 5212282 - DNA, 18 bp, Homo sapiens
aggggaatgtgtcctcct

SEQ ID NO: 5212283 - DNA, 12 bp, Homo sapiens
aggggaatgttt

SEQ ID NO: 5212284 - DNA, 13 bp, Homo sapiens
aggggaatgtttg

SEQ ID NO: 5212285 - DNA, 21 bp, Homo sapiens
aggggaatgtttgcctctgcc

SEQ ID NO: 5212286 - DNA, 16 bp, Homo sapiens
aggggaattttctctc

SEQ ID NO: 5212287 - DNA, 23 bp, Homo sapiens
aggggacaagggaggcagtggct

SEQ ID NO: 5212288 - DNA, 18 bp, Homo sapiens
aggggacacctgtacatt

SEQ ID NO: 5212289 - DNA, 14 bp, Homo sapiens
aggggacagagctg

SEQ ID NO: 5212290 - DNA, 15 bp, Homo sapiens
aggggacagaggccc

SEQ ID NO: 5212291 - DNA, 13 bp, Homo sapiens
aggggacaggcct

SEQ ID NO: 5212292 - DNA, 15 bp, Homo sapiens
aggggacaggcctca

SEQ ID NO: 5212293 - DNA, 17 bp, Homo sapiens
aggggacaggcctcacc

SEQ ID NO: 5212294 - DNA, 17 bp, Homo sapiens
aggcaggggctgggcag

SEQ ID NO: 5212295 - DNA, 16 bp, Homo sapiens
aggcaggggcttccca

SEQ ID NO: 5212296 - DNA, 19 bp, Homo sapiens
aggcaggggcttggctgcc

SEQ ID NO: 5212297 - DNA, 21 bp, Homo sapiens
aggcaggggcttggctgcccc

SEQ ID NO: 5212298 - DNA, 22 bp, Homo sapiens
aggcaggggcttggctgcccca

SEQ ID NO: 5212299 - DNA, 16 bp, Homo sapiens
aggcagggggccctgc

SEQ ID NO: 5212300 - DNA, 18 bp, Homo sapiens
aggcagggggccctgccc

SEQ ID NO: 5212301 - DNA, 20 bp, Homo sapiens
aggcagggggccctgcccca

SEQ ID NO: 5212302 - DNA, 18 bp, Homo sapiens
aggcaggggtcctgcagg

SEQ ID NO: 5212303 - DNA, 23 bp, Homo sapiens
aggcaggggtgagagcacccact

SEQ ID NO: 5212304 - DNA, 17 bp, Homo sapiens
aggcaggggtgggagag

SEQ ID NO: 5212305 - DNA, 18 bp, Homo sapiens
aggcaggggtgggagagc

SEQ ID NO: 5212306 - DNA, 19 bp, Homo sapiens
aggcaggggtgggggtgga

SEQ ID NO: 5212307 - DNA, 20 bp, Homo sapiens
aggcagggtcaggagagggg

SEQ ID NO: 5212308 - DNA, 18 bp, Homo sapiens
aggcagggtctcactctg

SEQ ID NO: 5212309 - DNA, 22 bp, Homo sapiens
aggcagggtctcactctgtcgc

SEQ ID NO: 5212310 - DNA, 14 bp, Homo sapiens
aggcagggtgcagt

SEQ ID NO: 5212311 - DNA, 15 bp, Homo sapiens
aggcaggtagccagg

SEQ ID NO: 5212312 - DNA, 18 bp, Homo sapiens
aggcaggtagggggtccc

SEQ ID NO: 5212313 - DNA, 11 bp, Homo sapiens
aggcaggtccc

SEQ ID NO: 5212314 - DNA, 16 bp, Homo sapiens
aggcaggtccccagac

SEQ ID NO: 5212315 - DNA, 22 bp, Homo sapiens
aggcaggtctgcaagggcccag

SEQ ID NO: 5212316 - DNA, 21 bp, Homo sapiens
aggcaggtcttgaactcctgg

SEQ ID NO: 5212317 - DNA, 22 bp, Homo sapiens
aggcaggtcttgaactcctggc

SEQ ID NO: 5212318 - DNA, 17 bp, Homo sapiens
aggcaggtgagaaccca

SEQ ID NO: 5212319 - DNA, 15 bp, Homo sapiens
aggcaggtgccagga

SEQ ID NO: 5212320 - DNA, 14 bp, Homo sapiens
aggcaggtgcctcc

SEQ ID NO: 5212321 - DNA, 20 bp, Homo sapiens
aggcaggtgcctccaggtgt

SEQ ID NO: 5212322 - DNA, 12 bp, Homo sapiens
aggcaggtgctt

SEQ ID NO: 5212323 - DNA, 14 bp, Homo sapiens
aggcaggtgctttt

SEQ ID NO: 5212324 - DNA, 21 bp, Homo sapiens
aggcaggtggacgctgcagac

SEQ ID NO: 5212325 - DNA, 17 bp, Homo sapiens
aggcaggtgggatggat

SEQ ID NO: 5212326 - DNA, 15 bp, Homo sapiens
aggcaggtgggcaga

SEQ ID NO: 5212327 - DNA, 16 bp, Homo sapiens
aggcaggtgggcagac

SEQ ID NO: 5212328 - DNA, 19 bp, Homo sapiens
aggcaggtgggggctgcgt

SEQ ID NO: 5212329 - DNA, 20 bp, Homo sapiens
aggcaggtttcatttcttat

SEQ ID NO: 5212330 - DNA, 17 bp, Homo sapiens
aggcaggtttgccagtg

SEQ ID NO: 5212331 - DNA, 22 bp, Homo sapiens
aggcagtagatcattttttgtc

SEQ ID NO: 5212332 - DNA, 17 bp, Homo sapiens
aggcagtagatgtgctt

SEQ ID NO: 5212333 - DNA, 15 bp, Homo sapiens
aggcagtagcctcct

SEQ ID NO: 5212334 - DNA, 19 bp, Homo sapiens
aggcagtatggcggaggcc

SEQ ID NO: 5212335 - DNA, 22 bp, Homo sapiens
aggcagtatggcggaggccatg

SEQ ID NO: 5212336 - DNA, 15 bp, Homo sapiens
aggcagtattccctt

SEQ ID NO: 5212337 - DNA, 14 bp, Homo sapiens
aggcagtccagagc

SEQ ID NO: 5212338 - DNA, 15 bp, Homo sapiens
aggcagtccagagct

SEQ ID NO: 5212339 - DNA, 19 bp, Homo sapiens
aggcagtccaggcctctct

SEQ ID NO: 5212340 - DNA, 23 bp, Homo sapiens
aggcagtccaggcctctctctgc

SEQ ID NO: 5212341 - DNA, 15 bp, Homo sapiens
aggcagtcccgggag

SEQ ID NO: 5212342 - DNA, 20 bp, Homo sapiens
aggcagtcccgggagaaaag

SEQ ID NO: 5212343 - DNA, 21 bp, Homo sapiens
aggcagtcccgggagaaaaga

SEQ ID NO: 5212344 - DNA, 18 bp, Homo sapiens
aggcagtcgggggctggc

SEQ ID NO: 5212345 - DNA, 23 bp, Homo sapiens
aggcagtcgggggctggcctagg

SEQ ID NO: 5212346 - DNA, 11 bp, Homo sapiens
aggcagtctct

SEQ ID NO: 5212347 - DNA, 20 bp, Homo sapiens
aggcagtctctatattatgt

SEQ ID NO: 5212348 - DNA, 21 bp, Homo sapiens
aggcagtctctatattatgtc

SEQ ID NO: 5212349 - DNA, 23 bp, Homo sapiens
aggcagtctctatattatgtctt

SEQ ID NO: 5212350 - DNA, 17 bp, Homo sapiens
aggcagtcttctaccaa

SEQ ID NO: 5212351 - DNA, 15 bp, Homo sapiens
aggcagtctttgctc

SEQ ID NO: 5212352 - DNA, 18 bp, Homo sapiens
aggcagtgatgacttgct

SEQ ID NO: 5212353 - DNA, 24 bp, Homo sapiens
aggcagtgatgacttgctgtccag

SEQ ID NO: 5212354 - DNA, 14 bp, Homo sapiens
aggcagtgcatgca

SEQ ID NO: 5212355 - DNA, 16 bp, Homo sapiens
aggcagtgcatgcatg

SEQ ID NO: 5212356 - DNA, 14 bp, Homo sapiens
aggcagtgcatgtg

SEQ ID NO: 5212357 - DNA, 22 bp, Homo sapiens
aggcagtgcatgtgaagcatgc

SEQ ID NO: 5212358 - DNA, 15 bp, Homo sapiens
aggcagtggcagcaa

SEQ ID NO: 5212359 - DNA, 14 bp, Homo sapiens
aggcagtggcaggg

SEQ ID NO: 5212360 - DNA, 17 bp, Homo sapiens
aggcagtggcaggggag

SEQ ID NO: 5212361 - DNA, 14 bp, Homo sapiens
aggcagtggcccag

SEQ ID NO: 5212362 - DNA, 16 bp, Homo sapiens
aggcagtggctagtgg

SEQ ID NO: 5212363 - DNA, 23 bp, Homo sapiens
aggcagtggcttggagcagaggt

SEQ ID NO: 5212364 - DNA, 22 bp, Homo sapiens
aggcagtggggctggaagcaga

SEQ ID NO: 5212365 - DNA, 23 bp, Homo sapiens
aggcagtggggctggaagcagaa

SEQ ID NO: 5212366 - DNA, 24 bp, Homo sapiens
aggcagtggggctggaagcagaaa

SEQ ID NO: 5212367 - DNA, 16 bp, Homo sapiens
aggcagtggggctggg

SEQ ID NO: 5212368 - DNA, 15 bp, Homo sapiens
aggcagtgtcatttg

SEQ ID NO: 5212369 - DNA, 19 bp, Homo sapiens
aggcagtgtcatttgctct

SEQ ID NO: 5212370 - DNA, 14 bp, Homo sapiens
aggcagtgtcttaa

SEQ ID NO: 5212371 - DNA, 21 bp, Homo sapiens
aggcagtgtggttatgttccc

SEQ ID NO: 5212372 - DNA, 22 bp, Homo sapiens
aggcagtgttcctcaccaataa

SEQ ID NO: 5212373 - DNA, 21 bp, Homo sapiens
aggcagttaccattaaaccat

SEQ ID NO: 5212374 - DNA, 21 bp, Homo sapiens
aggcagttagagatgcctccc

SEQ ID NO: 5212375 - DNA, 16 bp, Homo sapiens
aggcagttctgtgtcc

SEQ ID NO: 5212376 - DNA, 21 bp, Homo sapiens
aggcagttgacggggcagtca

SEQ ID NO: 5212377 - DNA, 16 bp, Homo sapiens
aggcagtttagtgcat

SEQ ID NO: 5212378 - DNA, 19 bp, Homo sapiens
aggcagtttagtgcatctt

SEQ ID NO: 5212379 - DNA, 22 bp, Homo sapiens
aggcagtttcagagatggacag

SEQ ID NO: 5212380 - DNA, 15 bp, Homo sapiens
aggcagtttgaggat

SEQ ID NO: 5212381 - DNA, 23 bp, Homo sapiens
aggcagtttttgttccttcctgc

SEQ ID NO: 5212382 - DNA, 13 bp, Homo sapiens
aggcataaattaa

SEQ ID NO: 5212383 - DNA, 17 bp, Homo sapiens
aggcataaattaaaatg

SEQ ID NO: 5212384 - DNA, 18 bp, Homo sapiens
aggcataaattagagaaa

SEQ ID NO: 5212385 - DNA, 21 bp, Homo sapiens
aggcatacctgtcctagcagg

SEQ ID NO: 5212386 - DNA, 20 bp, Homo sapiens
aggcatacgagagcagaggt

SEQ ID NO: 5212387 - DNA, 21 bp, Homo sapiens
aggcatacgagagcagaggtc

SEQ ID NO: 5212388 - DNA, 22 bp, Homo sapiens
aggcatagaggcttctccgcca

SEQ ID NO: 5212389 - DNA, 19 bp, Homo sapiens
aggcataggcctgggtgct

SEQ ID NO: 5212390 - DNA, 14 bp, Homo sapiens
aggcataggtctct

SEQ ID NO: 5212391 - DNA, 19 bp, Homo sapiens
aggcatatactttgtcttt

SEQ ID NO: 5212392 - DNA, 17 bp, Homo sapiens
aggcatattattttctg

SEQ ID NO: 5212393 - DNA, 20 bp, Homo sapiens
aggcatattccctgcacaca

SEQ ID NO: 5212394 - DNA, 22 bp, Homo sapiens
aggcatattccctgcacacaca

SEQ ID NO: 5212395 - DNA, 20 bp, Homo sapiens
aggcatattgctttttctaa

SEQ ID NO: 5212396 - DNA, 22 bp, Homo sapiens
aggcatattgctttttctaatg

SEQ ID NO: 5212397 - DNA, 21 bp, Homo sapiens
aggcatcagtccccctgtgca

SEQ ID NO: 5212398 - DNA, 15 bp, Homo sapiens
aggcatcattttcac

SEQ ID NO: 5212399 - DNA, 22 bp, Homo sapiens
aggcatccaaaggctcctgaga

SEQ ID NO: 5212400 - DNA, 23 bp, Homo sapiens
aggcatccagcagtctctgcctt

SEQ ID NO: 5212401 - DNA, 17 bp, Homo sapiens
aggcatcccagcctggg

SEQ ID NO: 5212402 - DNA, 23 bp, Homo sapiens
aggcatcccaggggaccacacct

SEQ ID NO: 5212403 - DNA, 20 bp, Homo sapiens
aggcatcctgcctgggtggg

SEQ ID NO: 5212404 - DNA, 15 bp, Homo sapiens
aggcatccttgtctt

SEQ ID NO: 5212405 - DNA, 16 bp, Homo sapiens
aggcatccttgtcttt

SEQ ID NO: 5212406 - DNA, 22 bp, Homo sapiens
aggcatccttgtcttttgagct

SEQ ID NO: 5212407 - DNA, 21 bp, Homo sapiens
aggcatcgggggtgaatcttg

SEQ ID NO: 5212408 - DNA, 19 bp, Homo sapiens
aggcatcgtcatgcacagt

SEQ ID NO: 5212409 - DNA, 18 bp, Homo sapiens
aggcatctacacagcctg

SEQ ID NO: 5212410 - DNA, 19 bp, Homo sapiens
aggcatctacacagcctgg

SEQ ID NO: 5212411 - DNA, 16 bp, Homo sapiens
aggcatctgatttgca

SEQ ID NO: 5212412 - DNA, 18 bp, Homo sapiens
aggcatctgtaagaagta

SEQ ID NO: 5212413 - DNA, 21 bp, Homo sapiens
aggcatctgtaagaagtagag

SEQ ID NO: 5212414 - DNA, 20 bp, Homo sapiens
aggcatctgttagcagagtc

SEQ ID NO: 5212415 - DNA, 21 bp, Homo sapiens
aggcatctgttagcagagtct

SEQ ID NO: 5212416 - DNA, 23 bp, Homo sapiens
aggcatctttctgaatttcattc

SEQ ID NO: 5212417 - DNA, 14 bp, Homo sapiens
aggcatcttttcta

SEQ ID NO: 5212418 - DNA, 22 bp, Homo sapiens
aggcatcttttctagagacaca

SEQ ID NO: 5212419 - DNA, 14 bp, Homo sapiens
aggcatgacagctg

SEQ ID NO: 5212420 - DNA, 18 bp, Homo sapiens
aggcatgactaatgcttt

SEQ ID NO: 5212421 - DNA, 18 bp, Homo sapiens
aggcatgagccactgagc

SEQ ID NO: 5212422 - DNA, 22 bp, Homo sapiens
aggcatgagggatcacagggcc

SEQ ID NO: 5212423 - DNA, 23 bp, Homo sapiens
aggcatgagggatcacagggccc

SEQ ID NO: 5212424 - DNA, 20 bp, Homo sapiens
aggcatgagttactgtgcat

SEQ ID NO: 5212425 - DNA, 13 bp, Homo sapiens
aggcatgcacatc

SEQ ID NO: 5212426 - DNA, 16 bp, Homo sapiens
aggcatgcagctgcct

SEQ ID NO: 5212427 - DNA, 19 bp, Homo sapiens
aggcatgcagctgcctggg

SEQ ID NO: 5212428 - DNA, 22 bp, Homo sapiens
aggcatgcagctgcctggggcc

SEQ ID NO: 5212429 - DNA, 15 bp, Homo sapiens
aggcatgcctctgat

SEQ ID NO: 5212430 - DNA, 17 bp, Homo sapiens
aggcatgcctctgatat

SEQ ID NO: 5212431 - DNA, 13 bp, Homo sapiens
aggcatgcctgtg

SEQ ID NO: 5212432 - DNA, 14 bp, Homo sapiens
aggcatgcctgtgt

SEQ ID NO: 5212433 - DNA, 19 bp, Homo sapiens
aggcatgcgaatgagctgg

SEQ ID NO: 5212434 - DNA, 15 bp, Homo sapiens
aggcatggaaagatg

SEQ ID NO: 5212435 - DNA, 18 bp, Homo sapiens
aggcatggagacagcgaa

SEQ ID NO: 5212436 - DNA, 16 bp, Homo sapiens
aggcatggcccagcct

SEQ ID NO: 5212437 - DNA, 18 bp, Homo sapiens
aggcatggcccagcctgg

SEQ ID NO: 5212438 - DNA, 19 bp, Homo sapiens
aggcatggcccagcctgga

SEQ ID NO: 5212439 - DNA, 22 bp, Homo sapiens
aggcatggcccagcctggagcc

SEQ ID NO: 5212440 - DNA, 13 bp, Homo sapiens
aggcatggccctg

SEQ ID NO: 5212441 - DNA, 16 bp, Homo sapiens
aggcatggccctgggg

SEQ ID NO: 5212442 - DNA, 12 bp, Homo sapiens
aggcatggctgg

SEQ ID NO: 5212443 - DNA, 19 bp, Homo sapiens
aggcatggctggtgcctga

SEQ ID NO: 5212444 - DNA, 20 bp, Homo sapiens
aggcatggctggtgcctgaa

SEQ ID NO: 5212445 - DNA, 18 bp, Homo sapiens
aggcatggggcatgtcct

SEQ ID NO: 5212446 - DNA, 18 bp, Homo sapiens
aggcatgggggcccaaag

SEQ ID NO: 5212447 - DNA, 19 bp, Homo sapiens
aggcatgggggcccaaagg

SEQ ID NO: 5212448 - DNA, 18 bp, Homo sapiens
aggcatgtacaaaaatta

SEQ ID NO: 5212449 - DNA, 19 bp, Homo sapiens
aggcatgtaggaccctgca

SEQ ID NO: 5212450 - DNA, 15 bp, Homo sapiens
aggcatgtcccaccc

SEQ ID NO: 5212451 - DNA, 16 bp, Homo sapiens
aggcatgtcccaccca

SEQ ID NO: 5212452 - DNA, 14 bp, Homo sapiens
aggcatgtcctgga

SEQ ID NO: 5212453 - DNA, 17 bp, Homo sapiens
aggcatgtgatgagagg

SEQ ID NO: 5212454 - DNA, 21 bp, Homo sapiens
aggcatgtgatgagaggaaat

SEQ ID NO: 5212455 - DNA, 22 bp, Homo sapiens
aggcatgtgccacccacccaac

SEQ ID NO: 5212456 - DNA, 14 bp, Homo sapiens
aggcatgttcaggg

SEQ ID NO: 5212457 - DNA, 17 bp, Homo sapiens
aggcatgttcagggatg

SEQ ID NO: 5212458 - DNA, 20 bp, Homo sapiens
aggcatgttctctgaggaca

SEQ ID NO: 5212459 - DNA, 20 bp, Homo sapiens
aggcatgttggactctgagc

SEQ ID NO: 5212460 - DNA, 14 bp, Homo sapiens
aggcattaaatgca

SEQ ID NO: 5212461 - DNA, 15 bp, Homo sapiens
aggcattaaatgcaa

SEQ ID NO: 5212462 - DNA, 22 bp, Homo sapiens
aggcattaaattttagcaaaga

SEQ ID NO: 5212463 - DNA, 19 bp, Homo sapiens
aggcattaatgtttctatc

SEQ ID NO: 5212464 - DNA, 20 bp, Homo sapiens
aggcattacttgctttcaat

SEQ ID NO: 5212465 - DNA, 22 bp, Homo sapiens
aggcattacttgctttcaattg

SEQ ID NO: 5212466 - DNA, 17 bp, Homo sapiens
aggcattatttaatgtt

SEQ ID NO: 5212467 - DNA, 16 bp, Homo sapiens
aggcattcagcaatta

SEQ ID NO: 5212468 - DNA, 13 bp, Homo sapiens
aggcattccacag

SEQ ID NO: 5212469 - DNA, 19 bp, Homo sapiens
aggggacaggcctcacctc

SEQ ID NO: 5212470 - DNA, 14 bp, Homo sapiens
aggggaccagaggg

SEQ ID NO: 5212471 - DNA, 18 bp, Homo sapiens
aggggaccagagggatgg

SEQ ID NO: 5212472 - DNA, 22 bp, Homo sapiens
aggggaccatgaagagactctc

SEQ ID NO: 5212473 - DNA, 12 bp, Homo sapiens
aggggacccagc

SEQ ID NO: 5212474 - DNA, 15 bp, Homo sapiens
aggggacccagctcc

SEQ ID NO: 5212475 - DNA, 17 bp, Homo sapiens
aggggacccatgggggc

SEQ ID NO: 5212476 - DNA, 16 bp, Homo sapiens
aggggaccccactccc

SEQ ID NO: 5212477 - DNA, 14 bp, Homo sapiens
aggggacccccgcc

SEQ ID NO: 5212478 - DNA, 15 bp, Homo sapiens
aggggacccccgccc

SEQ ID NO: 5212479 - DNA, 22 bp, Homo sapiens
aggggaccccgagaaccctgag

SEQ ID NO: 5212480 - DNA, 23 bp, Homo sapiens
aggggaccccgagaaccctgagc

SEQ ID NO: 5212481 - DNA, 23 bp, Homo sapiens
aggggacctggaagggaggtggg

SEQ ID NO: 5212482 - DNA, 20 bp, Homo sapiens
aggggacctggagctgccag

SEQ ID NO: 5212483 - DNA, 24 bp, Homo sapiens
aggggaccttggcgctctcagctt

SEQ ID NO: 5212484 - DNA, 20 bp, Homo sapiens
aggggacgcaggcccctctc

SEQ ID NO: 5212485 - DNA, 14 bp, Homo sapiens
aggggacgctggta

SEQ ID NO: 5212486 - DNA, 13 bp, Homo sapiens
aggggacgggaca

SEQ ID NO: 5212487 - DNA, 14 bp, Homo sapiens
aggggacgggcaag

SEQ ID NO: 5212488 - DNA, 16 bp, Homo sapiens
aggggacgggcaagtg

SEQ ID NO: 5212489 - DNA, 21 bp, Homo sapiens
aggggactaattcactggcga

SEQ ID NO: 5212490 - DNA, 23 bp, Homo sapiens
aggggactctgggctatggacac

SEQ ID NO: 5212491 - DNA, 20 bp, Homo sapiens
aggggactgagctggggagg

SEQ ID NO: 5212492 - DNA, 16 bp, Homo sapiens
aggggactgccacctc

SEQ ID NO: 5212493 - DNA, 17 bp, Homo sapiens
aggggactgccacctcc

SEQ ID NO: 5212494 - DNA, 12 bp, Homo sapiens
aggggactgggg

SEQ ID NO: 5212495 - DNA, 20 bp, Homo sapiens
aggggactgggggactggga

SEQ ID NO: 5212496 - DNA, 21 bp, Homo sapiens
aggggacttggataggagctt

SEQ ID NO: 5212497 - DNA, 16 bp, Homo sapiens
aggggacttgtgccag

SEQ ID NO: 5212498 - DNA, 18 bp, Homo sapiens
aggggacttgtgccagca

SEQ ID NO: 5212499 - DNA, 15 bp, Homo sapiens
aggggagaaactgaa

SEQ ID NO: 5212500 - DNA, 16 bp, Homo sapiens
aggggagaaaggaact

SEQ ID NO: 5212501 - DNA, 17 bp, Homo sapiens
aggggagaagccaaggg

SEQ ID NO: 5212502 - DNA, 15 bp, Homo sapiens
aggggagaagggcca

SEQ ID NO: 5212503 - DNA, 23 bp, Homo sapiens
aggggagaagggccagccctaca

SEQ ID NO: 5212504 - DNA, 14 bp, Homo sapiens
aggggagacagagc

SEQ ID NO: 5212505 - DNA, 17 bp, Homo sapiens
aggggagacagggcaat

SEQ ID NO: 5212506 - DNA, 20 bp, Homo sapiens
aggggagacattagaaaaaa

SEQ ID NO: 5212507 - DNA, 14 bp, Homo sapiens
aggggagacgaggc

SEQ ID NO: 5212508 - DNA, 23 bp, Homo sapiens
aggggagacttaggccagaggtg

SEQ ID NO: 5212509 - DNA, 13 bp, Homo sapiens
aggggagactttg

SEQ ID NO: 5212510 - DNA, 13 bp, Homo sapiens
aggggagagaagg

SEQ ID NO: 5212511 - DNA, 18 bp, Homo sapiens
aggggagagacaggcagc

SEQ ID NO: 5212512 - DNA, 22 bp, Homo sapiens
aggggagagagcagagaagtac

SEQ ID NO: 5212513 - DNA, 22 bp, Homo sapiens
aggggagagcctgctggcaccc

SEQ ID NO: 5212514 - DNA, 10 bp, Homo sapiens
aggggagagg

SEQ ID NO: 5212515 - DNA, 14 bp, Homo sapiens
aggggagaggggtc

SEQ ID NO: 5212516 - DNA, 19 bp, Homo sapiens
aggggagagtccagtgagt

SEQ ID NO: 5212517 - DNA, 12 bp, Homo sapiens
aggggagcaagc

SEQ ID NO: 5212518 - DNA, 13 bp, Homo sapiens
aggggagcagagg

SEQ ID NO: 5212519 - DNA, 16 bp, Homo sapiens
aggggagcagaggggc

SEQ ID NO: 5212520 - DNA, 20 bp, Homo sapiens
aggggagcagcggctctggt

SEQ ID NO: 5212521 - DNA, 23 bp, Homo sapiens
aggggagcatgcttccctgcagc

SEQ ID NO: 5212522 - DNA, 24 bp, Homo sapiens
aggggagcatgcttccctgcagct

SEQ ID NO: 5212523 - DNA, 12 bp, Homo sapiens
aggggagccaga

SEQ ID NO: 5212524 - DNA, 20 bp, Homo sapiens
aggggagccagaaatgggca

SEQ ID NO: 5212525 - DNA, 21 bp, Homo sapiens
aggggagccagaaatgggcag

SEQ ID NO: 5212526 - DNA, 22 bp, Homo sapiens
aggggagccagaaatgggcagt

SEQ ID NO: 5212527 - DNA, 13 bp, Homo sapiens
aggggagccagct

SEQ ID NO: 5212528 - DNA, 17 bp, Homo sapiens
aggggagccagctgctt

SEQ ID NO: 5212529 - DNA, 24 bp, Homo sapiens
aggggagcccactgtcctgggcct

SEQ ID NO: 5212530 - DNA, 17 bp, Homo sapiens
aggggagctctgtctgt

SEQ ID NO: 5212531 - DNA, 16 bp, Homo sapiens
aggggagctgctggcc

SEQ ID NO: 5212532 - DNA, 19 bp, Homo sapiens
aggggagcttgagggacaa

SEQ ID NO: 5212533 - DNA, 15 bp, Homo sapiens
aggggagcttgggac

SEQ ID NO: 5212534 - DNA, 17 bp, Homo sapiens
aggggaggaaaaaagaa

SEQ ID NO: 5212535 - DNA, 10 bp, Homo sapiens
aggggaggag

SEQ ID NO: 5212536 - DNA, 12 bp, Homo sapiens
aggggaggaggg

SEQ ID NO: 5212537 - DNA, 14 bp, Homo sapiens
aggggaggagggcg

SEQ ID NO: 5212538 - DNA, 15 bp, Homo sapiens
aggggaggccatctg

SEQ ID NO: 5212539 - DNA, 20 bp, Homo sapiens
aggggaggctgctttctgcc

SEQ ID NO: 5212540 - DNA, 17 bp, Homo sapiens
aggggagggaaaagcta

SEQ ID NO: 5212541 - DNA, 18 bp, Homo sapiens
aggggagggagggaagtc

SEQ ID NO: 5212542 - DNA, 13 bp, Homo sapiens
aggggagggcagg

SEQ ID NO: 5212543 - DNA, 16 bp, Homo sapiens
aggggagggctcctgg

SEQ ID NO: 5212544 - DNA, 20 bp, Homo sapiens
aggggagggctcctggggca

SEQ ID NO: 5212545 - DNA, 16 bp, Homo sapiens
aggggaggggcctagg

SEQ ID NO: 5212546 - DNA, 21 bp, Homo sapiens
aggggaggggcctagggagcc

SEQ ID NO: 5212547 - DNA, 15 bp, Homo sapiens
aggggaggggcctcc

SEQ ID NO: 5212548 - DNA, 17 bp, Homo sapiens
aggggaggggcgcaccc

SEQ ID NO: 5212549 - DNA, 22 bp, Homo sapiens
aggggaggggcgcaccccacag

SEQ ID NO: 5212550 - DNA, 23 bp, Homo sapiens
aggggaggggcgcaccccacagc

SEQ ID NO: 5212551 - DNA, 18 bp, Homo sapiens
aggggagggggatccgac

SEQ ID NO: 5212552 - DNA, 17 bp, Homo sapiens
aggggaggggggagcca

SEQ ID NO: 5212553 - DNA, 16 bp, Homo sapiens
aggggaggggggaggg

SEQ ID NO: 5212554 - DNA, 18 bp, Homo sapiens
aggggaggggggaggggg

SEQ ID NO: 5212555 - DNA, 16 bp, Homo sapiens
aggggaggtggccagc

SEQ ID NO: 5212556 - DNA, 20 bp, Homo sapiens
aggggaggtggccagcccgc

SEQ ID NO: 5212557 - DNA, 13 bp, Homo sapiens
aggggagtctgct

SEQ ID NO: 5212558 - DNA, 12 bp, Homo sapiens
aggggagtgtgg

SEQ ID NO: 5212559 - DNA, 13 bp, Homo sapiens
aggggagtgtggg

SEQ ID NO: 5212560 - DNA, 15 bp, Homo sapiens
aggggagtgtgggtg

SEQ ID NO: 5212561 - DNA, 16 bp, Homo sapiens
aggggatagagagaga

SEQ ID NO: 5212562 - DNA, 17 bp, Homo sapiens
aggggatataggagagg

SEQ ID NO: 5212563 - DNA, 14 bp, Homo sapiens
aggggatatatgtt

SEQ ID NO: 5212564 - DNA, 14 bp, Homo sapiens
aggggatatttaag

SEQ ID NO: 5212565 - DNA, 21 bp, Homo sapiens
aggggatatttaaggtagctt

SEQ ID NO: 5212566 - DNA, 14 bp, Homo sapiens
aggggatcaaagtt

SEQ ID NO: 5212567 - DNA, 19 bp, Homo sapiens
aggggatcataaagttaga

SEQ ID NO: 5212568 - DNA, 20 bp, Homo sapiens
aggggatctaaaaggaggac

SEQ ID NO: 5212569 - DNA, 13 bp, Homo sapiens
aggggatggaggc

SEQ ID NO: 5212570 - DNA, 15 bp, Homo sapiens
aggggatggaggcca

SEQ ID NO: 5212571 - DNA, 17 bp, Homo sapiens
aggggatggaggccaga

SEQ ID NO: 5212572 - DNA, 20 bp, Homo sapiens
aggggatggaggccagagtc

SEQ ID NO: 5212573 - DNA, 19 bp, Homo sapiens
aggggatggagtgagccca

SEQ ID NO: 5212574 - DNA, 14 bp, Homo sapiens
aggggatggcagac

SEQ ID NO: 5212575 - DNA, 24 bp, Homo sapiens
aggggatggcagacagtcaaggag

SEQ ID NO: 5212576 - DNA, 13 bp, Homo sapiens
aggggatgggtgt

SEQ ID NO: 5212577 - DNA, 15 bp, Homo sapiens
aggggatgggtgtgg

SEQ ID NO: 5212578 - DNA, 17 bp, Homo sapiens
aggggatggtagacctt

SEQ ID NO: 5212579 - DNA, 20 bp, Homo sapiens
aggggatggttagtcacctg

SEQ ID NO: 5212580 - DNA, 22 bp, Homo sapiens
aggggatgtatccatgggggca

SEQ ID NO: 5212581 - DNA, 20 bp, Homo sapiens
aggggatgtttacctggtgc

SEQ ID NO: 5212582 - DNA, 22 bp, Homo sapiens
aggggatgtttacctggtgctc

SEQ ID NO: 5212583 - DNA, 13 bp, Homo sapiens
aggggattctcta

SEQ ID NO: 5212584 - DNA, 14 bp, Homo sapiens
aggggattctctac

SEQ ID NO: 5212585 - DNA, 15 bp, Homo sapiens
aggggattctctact

SEQ ID NO: 5212586 - DNA, 19 bp, Homo sapiens
aggggattgaagccctcca

SEQ ID NO: 5212587 - DNA, 15 bp, Homo sapiens
aggggattttgctga

SEQ ID NO: 5212588 - DNA, 22 bp, Homo sapiens
aggggatttttttgatgtgcct

SEQ ID NO: 5212589 - DNA, 14 bp, Homo sapiens
aggggcaaaaatat

SEQ ID NO: 5212590 - DNA, 15 bp, Homo sapiens
aggggcaaaaatttg

SEQ ID NO: 5212591 - DNA, 18 bp, Homo sapiens
aggggcaaagaactgccc

SEQ ID NO: 5212592 - DNA, 18 bp, Homo sapiens
aggggcaacgaagaaaaa

SEQ ID NO: 5212593 - DNA, 19 bp, Homo sapiens
aggggcaacgaagaaaaaa

SEQ ID NO: 5212594 - DNA, 20 bp, Homo sapiens
aggggcaacgaagaaaaaaa

SEQ ID NO: 5212595 - DNA, 18 bp, Homo sapiens
aggggcaagctaggcccc

SEQ ID NO: 5212596 - DNA, 18 bp, Homo sapiens
aggggcacacaatgctat

SEQ ID NO: 5212597 - DNA, 11 bp, Homo sapiens
aggggcacacc

SEQ ID NO: 5212598 - DNA, 19 bp, Homo sapiens
aggggcacaccactgccct

SEQ ID NO: 5212599 - DNA, 22 bp, Homo sapiens
aggggcacaccactgccctgcc

SEQ ID NO: 5212600 - DNA, 16 bp, Homo sapiens
aggggcacactacaga

SEQ ID NO: 5212601 - DNA, 18 bp, Homo sapiens
aggggcacactacagagc

SEQ ID NO: 5212602 - DNA, 22 bp, Homo sapiens
aggggcacactacagagcagct

SEQ ID NO: 5212603 - DNA, 22 bp, Homo sapiens
aggggcacacttccccttggga

SEQ ID NO: 5212604 - DNA, 15 bp, Homo sapiens
aggggcacagggtct

SEQ ID NO: 5212605 - DNA, 18 bp, Homo sapiens
aggggcacctccggctgc

SEQ ID NO: 5212606 - DNA, 13 bp, Homo sapiens
aggggcacctgcc

SEQ ID NO: 5212607 - DNA, 14 bp, Homo sapiens
aggggcacctgcca

SEQ ID NO: 5212608 - DNA, 22 bp, Homo sapiens
aggggcacctgggaaaacagag

SEQ ID NO: 5212609 - DNA, 14 bp, Homo sapiens
aggggcactctccc

SEQ ID NO: 5212610 - DNA, 16 bp, Homo sapiens
aggggcactctcccct

SEQ ID NO: 5212611 - DNA, 19 bp, Homo sapiens
aggggcacttcattgagag

SEQ ID NO: 5212612 - DNA, 17 bp, Homo sapiens
aggggcagaaggaggaa

SEQ ID NO: 5212613 - DNA, 18 bp, Homo sapiens
aggggcagagaggaagtg

SEQ ID NO: 5212614 - DNA, 14 bp, Homo sapiens
aggggcagagccag

SEQ ID NO: 5212615 - DNA, 16 bp, Homo sapiens
aggggcagagccagga

SEQ ID NO: 5212616 - DNA, 15 bp, Homo sapiens
aggggcagaggaggc

SEQ ID NO: 5212617 - DNA, 13 bp, Homo sapiens
aggggcagaggcc

SEQ ID NO: 5212618 - DNA, 23 bp, Homo sapiens
aggggcagattggttcatgcctg

SEQ ID NO: 5212619 - DNA, 13 bp, Homo sapiens
aggggcagcaagg

SEQ ID NO: 5212620 - DNA, 18 bp, Homo sapiens
aggggcagcaaggccttg

SEQ ID NO: 5212621 - DNA, 12 bp, Homo sapiens
aggggcagcagg

SEQ ID NO: 5212622 - DNA, 22 bp, Homo sapiens
aggggcagcaggaggagtggaa

SEQ ID NO: 5212623 - DNA, 14 bp, Homo sapiens
aggggcagccagcc

SEQ ID NO: 5212624 - DNA, 11 bp, Homo sapiens
aggggcagccc

SEQ ID NO: 5212625 - DNA, 14 bp, Homo sapiens
aggggcagccctga

SEQ ID NO: 5212626 - DNA, 15 bp, Homo sapiens
aggggcagccctgag

SEQ ID NO: 5212627 - DNA, 21 bp, Homo sapiens
aggggcagccctgagtggtca

SEQ ID NO: 5212628 - DNA, 13 bp, Homo sapiens
aggggcagcctgc

SEQ ID NO: 5212629 - DNA, 17 bp, Homo sapiens
aggggcagcctgtgcct

SEQ ID NO: 5212630 - DNA, 20 bp, Homo sapiens
aggggcagcgcatgtgtgca

SEQ ID NO: 5212631 - DNA, 15 bp, Homo sapiens
aggggcagctcctga

SEQ ID NO: 5212632 - DNA, 15 bp, Homo sapiens
aggggcagctgacca

SEQ ID NO: 5212633 - DNA, 11 bp, Homo sapiens
aggggcagctt

SEQ ID NO: 5212634 - DNA, 14 bp, Homo sapiens
aggggcagcttcta

SEQ ID NO: 5212635 - DNA, 14 bp, Homo sapiens
aggggcaggactga

SEQ ID NO: 5212636 - DNA, 15 bp, Homo sapiens
aggggcaggactgag

SEQ ID NO: 5212637 - DNA, 19 bp, Homo sapiens
aggggcaggagaggctggg

SEQ ID NO: 5212638 - DNA, 12 bp, Homo sapiens
aggggcaggagc

SEQ ID NO: 5212639 - DNA, 13 bp, Homo sapiens
aggggcaggcaca

SEQ ID NO: 5212640 - DNA, 14 bp, Homo sapiens
aggggcaggcacag

SEQ ID NO: 5212641 - DNA, 14 bp, Homo sapiens
aggggcaggcagct

SEQ ID NO: 5212642 - DNA, 22 bp, Homo sapiens
aggggcaggcagctaggcaggg

SEQ ID NO: 5212643 - DNA, 14 bp, Homo sapiens
aggggcaggcaggg

SEQ ID NO: 5212644 - DNA, 15 bp, Homo sapiens
aggggcaggcagggc

SEQ ID NO: 5212645 - DNA, 16 bp, Homo sapiens
aggggcaggcagggct

SEQ ID NO: 5212646 - DNA, 19 bp, Homo sapiens
aggggcaggccctgcactg

SEQ ID NO: 5212647 - DNA, 12 bp, Homo sapiens
aggggcaggcct

SEQ ID NO: 5212648 - DNA, 15 bp, Homo sapiens
aggggcaggcctggg

SEQ ID NO: 5212649 - DNA, 13 bp, Homo sapiens
aggggcaggcctt

SEQ ID NO: 5212650 - DNA, 15 bp, Homo sapiens
aggcattccacagga

SEQ ID NO: 5212651 - DNA, 16 bp, Homo sapiens
aggcattccacaggat

SEQ ID NO: 5212652 - DNA, 17 bp, Homo sapiens
aggcattccccaggagg

SEQ ID NO: 5212653 - DNA, 20 bp, Homo sapiens
aggcattccccaggaggcca

SEQ ID NO: 5212654 - DNA, 22 bp, Homo sapiens
aggcattccccaggaggccagc

SEQ ID NO: 5212655 - DNA, 14 bp, Homo sapiens
aggcattcctcatc

SEQ ID NO: 5212656 - DNA, 14 bp, Homo sapiens
aggcattctcccag

SEQ ID NO: 5212657 - DNA, 20 bp, Homo sapiens
aggcattctcccagctctag

SEQ ID NO: 5212658 - DNA, 13 bp, Homo sapiens
aggcattctctga

SEQ ID NO: 5212659 - DNA, 21 bp, Homo sapiens
aggcattctgtataaatgcaa

SEQ ID NO: 5212660 - DNA, 19 bp, Homo sapiens
aggcattgacataggtcat

SEQ ID NO: 5212661 - DNA, 14 bp, Homo sapiens
aggcattgaggaag

SEQ ID NO: 5212662 - DNA, 19 bp, Homo sapiens
aggcattgaggaagagtct

SEQ ID NO: 5212663 - DNA, 21 bp, Homo sapiens
aggcattgcactaaaagtgat

SEQ ID NO: 5212664 - DNA, 16 bp, Homo sapiens
aggcattgccaagggc

SEQ ID NO: 5212665 - DNA, 20 bp, Homo sapiens
aggcattgccaagggctttg

SEQ ID NO: 5212666 - DNA, 21 bp, Homo sapiens
aggcattgccaagggctttgt

SEQ ID NO: 5212667 - DNA, 23 bp, Homo sapiens
aggcattgccttctctgcccaca

SEQ ID NO: 5212668 - DNA, 13 bp, Homo sapiens
aggcattggatat

SEQ ID NO: 5212669 - DNA, 20 bp, Homo sapiens
aggcatttaaaatggaaaag

SEQ ID NO: 5212670 - DNA, 15 bp, Homo sapiens
aggcatttaggaact

SEQ ID NO: 5212671 - DNA, 20 bp, Homo sapiens
aggcatttaggccatgggac

SEQ ID NO: 5212672 - DNA, 15 bp, Homo sapiens
aggcatttcctgctg

SEQ ID NO: 5212673 - DNA, 15 bp, Homo sapiens
aggcatttcctgggt

SEQ ID NO: 5212674 - DNA, 16 bp, Homo sapiens
aggcatttgagcagct

SEQ ID NO: 5212675 - DNA, 22 bp, Homo sapiens
aggcatttgattaaattatgaa

SEQ ID NO: 5212676 - DNA, 19 bp, Homo sapiens
aggcattttactatgcctg

SEQ ID NO: 5212677 - DNA, 23 bp, Homo sapiens
aggcattttatatgaattataaa

SEQ ID NO: 5212678 - DNA, 21 bp, Homo sapiens
aggcattttcccccttggctc

SEQ ID NO: 5212679 - DNA, 12 bp, Homo sapiens
aggcattttgtt

SEQ ID NO: 5212680 - DNA, 23 bp, Homo sapiens
aggcatttttgtaatgagccatt

SEQ ID NO: 5212681 - DNA, 15 bp, Homo sapiens
aggccaaaatcaaga

SEQ ID NO: 5212682 - DNA, 22 bp, Homo sapiens
aggccaaacacccaagcacaaa

SEQ ID NO: 5212683 - DNA, 16 bp, Homo sapiens
aggccaaacctctgtt

SEQ ID NO: 5212684 - DNA, 17 bp, Homo sapiens
aggccaaacctctgttc

SEQ ID NO: 5212685 - DNA, 16 bp, Homo sapiens
aggccaaactcacctg

SEQ ID NO: 5212686 - DNA, 17 bp, Homo sapiens
aggccaaactgctggac

SEQ ID NO: 5212687 - DNA, 21 bp, Homo sapiens
aggccaaactggcaaacttca

SEQ ID NO: 5212688 - DNA, 14 bp, Homo sapiens
aggccaaactgtcc

SEQ ID NO: 5212689 - DNA, 16 bp, Homo sapiens
aggccaaactgtccct

SEQ ID NO: 5212690 - DNA, 16 bp, Homo sapiens
aggccaaagaaggagg

SEQ ID NO: 5212691 - DNA, 21 bp, Homo sapiens
aggccaaagagtctccagttt

SEQ ID NO: 5212692 - DNA, 16 bp, Homo sapiens
aggccaaaggaagcac

SEQ ID NO: 5212693 - DNA, 18 bp, Homo sapiens
aggccaaaggaagcacat

SEQ ID NO: 5212694 - DNA, 21 bp, Homo sapiens
aggccaaaggggacctggaag

SEQ ID NO: 5212695 - DNA, 14 bp, Homo sapiens
aggccaaatgcaca

SEQ ID NO: 5212696 - DNA, 14 bp, Homo sapiens
aggccaacagcacc

SEQ ID NO: 5212697 - DNA, 14 bp, Homo sapiens
aggccaactgcctc

SEQ ID NO: 5212698 - DNA, 17 bp, Homo sapiens
aggccaagaaacgtctt

SEQ ID NO: 5212699 - DNA, 21 bp, Homo sapiens
aggccaagaaacgtcttctaa

SEQ ID NO: 5212700 - DNA, 14 bp, Homo sapiens
aggccaagagcaga

SEQ ID NO: 5212701 - DNA, 17 bp, Homo sapiens
aggccaagagcagaggc

SEQ ID NO: 5212702 - DNA, 20 bp, Homo sapiens
aggccaagagcagaggcagc

SEQ ID NO: 5212703 - DNA, 14 bp, Homo sapiens
aggccaagaggctg

SEQ ID NO: 5212704 - DNA, 13 bp, Homo sapiens
aggccaagaggtt

SEQ ID NO: 5212705 - DNA, 14 bp, Homo sapiens
aggccaagaggttt

SEQ ID NO: 5212706 - DNA, 21 bp, Homo sapiens
aggccaagaggtttggctcct

SEQ ID NO: 5212707 - DNA, 16 bp, Homo sapiens
aggccaagagtggccc

SEQ ID NO: 5212708 - DNA, 21 bp, Homo sapiens
aggccaagagtggccccacct

SEQ ID NO: 5212709 - DNA, 23 bp, Homo sapiens
aggccaagagtggccccacctgg

SEQ ID NO: 5212710 - DNA, 21 bp, Homo sapiens
aggccaagagtttgagaccaa

SEQ ID NO: 5212711 - DNA, 16 bp, Homo sapiens
aggccaagatcccctc

SEQ ID NO: 5212712 - DNA, 16 bp, Homo sapiens
aggccaagatggctgc

SEQ ID NO: 5212713 - DNA, 18 bp, Homo sapiens
aggccaagatggctgctg

SEQ ID NO: 5212714 - DNA, 23 bp, Homo sapiens
aggccaagatggctgctgcctgc

SEQ ID NO: 5212715 - DNA, 21 bp, Homo sapiens
aggccaagcagtgcctgccta

SEQ ID NO: 5212716 - DNA, 15 bp, Homo sapiens
aggccaagctgagga

SEQ ID NO: 5212717 - DNA, 18 bp, Homo sapiens
aggccaaggcgggtggat

SEQ ID NO: 5212718 - DNA, 13 bp, Homo sapiens
aggccaaggggag

SEQ ID NO: 5212719 - DNA, 22 bp, Homo sapiens
aggccaaggggagtcaccttcc

SEQ ID NO: 5212720 - DNA, 13 bp, Homo sapiens
aggccaaggtgct

SEQ ID NO: 5212721 - DNA, 17 bp, Homo sapiens
aggccaaggtgggcgga

SEQ ID NO: 5212722 - DNA, 21 bp, Homo sapiens
aggccaaggtgtcctacagaa

SEQ ID NO: 5212723 - DNA, 22 bp, Homo sapiens
aggccaagtctaatgaagagaa

SEQ ID NO: 5212724 - DNA, 15 bp, Homo sapiens
aggccaagtgcaggc

SEQ ID NO: 5212725 - DNA, 22 bp, Homo sapiens
aggccaagtgtgataaataaac

SEQ ID NO: 5212726 - DNA, 23 bp, Homo sapiens
aggccaagtttgtatcaggtgcc

SEQ ID NO: 5212727 - DNA, 15 bp, Homo sapiens
aggccaataaaaagt

SEQ ID NO: 5212728 - DNA, 18 bp, Homo sapiens
aggccaatagttttagat

SEQ ID NO: 5212729 - DNA, 22 bp, Homo sapiens
aggccaatatattttgaaatat

SEQ ID NO: 5212730 - DNA, 20 bp, Homo sapiens
aggccaatcccttctccact

SEQ ID NO: 5212731 - DNA, 22 bp, Homo sapiens
aggccaatgaaggctgaatcaa

SEQ ID NO: 5212732 - DNA, 14 bp, Homo sapiens
aggccacaaaaaca

SEQ ID NO: 5212733 - DNA, 15 bp, Homo sapiens
aggccacaaaaacaa

SEQ ID NO: 5212734 - DNA, 16 bp, Homo sapiens
aggccacaaaaacaat

SEQ ID NO: 5212735 - DNA, 21 bp, Homo sapiens
aggccacaccatctcctttca

SEQ ID NO: 5212736 - DNA, 22 bp, Homo sapiens
aggccacaccatctcctttcag

SEQ ID NO: 5212737 - DNA, 22 bp, Homo sapiens
aggccacacgcactggtgccaa

SEQ ID NO: 5212738 - DNA, 21 bp, Homo sapiens
aggccacacgctgcccaggct

SEQ ID NO: 5212739 - DNA, 12 bp, Homo sapiens
aggccacactgg

SEQ ID NO: 5212740 - DNA, 21 bp, Homo sapiens
aggccacacttcaaactactt

SEQ ID NO: 5212741 - DNA, 22 bp, Homo sapiens
aggccacagaaggtgaactttg

SEQ ID NO: 5212742 - DNA, 19 bp, Homo sapiens
aggccacagagaacctgag

SEQ ID NO: 5212743 - DNA, 15 bp, Homo sapiens
aggccacagcccctg

SEQ ID NO: 5212744 - DNA, 18 bp, Homo sapiens
aggccacagcccctggca

SEQ ID NO: 5212745 - DNA, 13 bp, Homo sapiens
aggccacagccgc

SEQ ID NO: 5212746 - DNA, 14 bp, Homo sapiens
aggccacaggccac

SEQ ID NO: 5212747 - DNA, 22 bp, Homo sapiens
aggccacagtggggctgcaggc

SEQ ID NO: 5212748 - DNA, 15 bp, Homo sapiens
aggccacatacctct

SEQ ID NO: 5212749 - DNA, 20 bp, Homo sapiens
aggccacatccacagtctcc

SEQ ID NO: 5212750 - DNA, 18 bp, Homo sapiens
aggccacatgagtcccag

SEQ ID NO: 5212751 - DNA, 19 bp, Homo sapiens
aggccacatgagtcccagt

SEQ ID NO: 5212752 - DNA, 21 bp, Homo sapiens
aggccacatgggagcagtcca

SEQ ID NO: 5212753 - DNA, 23 bp, Homo sapiens
aggccacatggggctgggcagct

SEQ ID NO: 5212754 - DNA, 24 bp, Homo sapiens
aggccacattactagagttggcat

SEQ ID NO: 5212755 - DNA, 18 bp, Homo sapiens
aggccacattgctggctg

SEQ ID NO: 5212756 - DNA, 12 bp, Homo sapiens
aggccacccact

SEQ ID NO: 5212757 - DNA, 13 bp, Homo sapiens
aggccacccactg

SEQ ID NO: 5212758 - DNA, 18 bp, Homo sapiens
aggccacccactgaccca

SEQ ID NO: 5212759 - DNA, 12 bp, Homo sapiens
aggccaccccaa

SEQ ID NO: 5212760 - DNA, 14 bp, Homo sapiens
aggccaccccaaac

SEQ ID NO: 5212761 - DNA, 16 bp, Homo sapiens
aggccaccccaacctc

SEQ ID NO: 5212762 - DNA, 12 bp, Homo sapiens
aggccaccccca

SEQ ID NO: 5212763 - DNA, 20 bp, Homo sapiens
aggccaccccctatcctctg

SEQ ID NO: 5212764 - DNA, 23 bp, Homo sapiens
aggccaccccctatcctctgagt

SEQ ID NO: 5212765 - DNA, 15 bp, Homo sapiens
aggccaccctgcctc

SEQ ID NO: 5212766 - DNA, 20 bp, Homo sapiens
aggccaccctgtgcagaagg

SEQ ID NO: 5212767 - DNA, 14 bp, Homo sapiens
aggccaccgggaca

SEQ ID NO: 5212768 - DNA, 21 bp, Homo sapiens
aggccacctcagtctcacctg

SEQ ID NO: 5212769 - DNA, 16 bp, Homo sapiens
aggccacctccagaaa

SEQ ID NO: 5212770 - DNA, 14 bp, Homo sapiens
aggccacctcccac

SEQ ID NO: 5212771 - DNA, 15 bp, Homo sapiens
aggccacctcccact

SEQ ID NO: 5212772 - DNA, 22 bp, Homo sapiens
aggccacctcccactcctgctg

SEQ ID NO: 5212773 - DNA, 15 bp, Homo sapiens
aggccacctccccag

SEQ ID NO: 5212774 - DNA, 22 bp, Homo sapiens
aggccacctcctaaaaggccca

SEQ ID NO: 5212775 - DNA, 13 bp, Homo sapiens
aggccacctctcc

SEQ ID NO: 5212776 - DNA, 16 bp, Homo sapiens
aggccacctctccaag

SEQ ID NO: 5212777 - DNA, 17 bp, Homo sapiens
aggccacctctgcctct

SEQ ID NO: 5212778 - DNA, 14 bp, Homo sapiens
aggccacctcttcc

SEQ ID NO: 5212779 - DNA, 11 bp, Homo sapiens
aggccacctgc

SEQ ID NO: 5212780 - DNA, 14 bp, Homo sapiens
aggccacctgcagg

SEQ ID NO: 5212781 - DNA, 15 bp, Homo sapiens
aggccacctgccccc

SEQ ID NO: 5212782 - DNA, 20 bp, Homo sapiens
aggccacctgtcttctctcc

SEQ ID NO: 5212783 - DNA, 16 bp, Homo sapiens
aggccaccttggagga

SEQ ID NO: 5212784 - DNA, 13 bp, Homo sapiens
aggccacggcagc

SEQ ID NO: 5212785 - DNA, 19 bp, Homo sapiens
aggccacgtatagtcctag

SEQ ID NO: 5212786 - DNA, 17 bp, Homo sapiens
aggccacgtccaggtcc

SEQ ID NO: 5212787 - DNA, 17 bp, Homo sapiens
aggccacgtcccacccc

SEQ ID NO: 5212788 - DNA, 21 bp, Homo sapiens
aggccacgtcccaccccacct

SEQ ID NO: 5212789 - DNA, 22 bp, Homo sapiens
aggccacgtcccaccccacctc

SEQ ID NO: 5212790 - DNA, 19 bp, Homo sapiens
aggccacgtgatgtggagg

SEQ ID NO: 5212791 - DNA, 15 bp, Homo sapiens
aggccactagtgaca

SEQ ID NO: 5212792 - DNA, 22 bp, Homo sapiens
aggccactcagaggcccccagt

SEQ ID NO: 5212793 - DNA, 14 bp, Homo sapiens
aggccactgaagag

SEQ ID NO: 5212794 - DNA, 18 bp, Homo sapiens
aggccactgaagaggagg

SEQ ID NO: 5212795 - DNA, 20 bp, Homo sapiens
aggccactgaagaggaggag

SEQ ID NO: 5212796 - DNA, 14 bp, Homo sapiens
aggccactgtgagc

SEQ ID NO: 5212797 - DNA, 18 bp, Homo sapiens
aggccactgtgagcgctg

SEQ ID NO: 5212798 - DNA, 14 bp, Homo sapiens
aggccactgtggcc

SEQ ID NO: 5212799 - DNA, 19 bp, Homo sapiens
aggccactgtggccagagc

SEQ ID NO: 5212800 - DNA, 22 bp, Homo sapiens
aggccactgtggccagagctgg

SEQ ID NO: 5212801 - DNA, 20 bp, Homo sapiens
aggccactgtgggtgaagcg

SEQ ID NO: 5212802 - DNA, 19 bp, Homo sapiens
aggccactgtttggaaata

SEQ ID NO: 5212803 - DNA, 16 bp, Homo sapiens
aggccacttgctcaga

SEQ ID NO: 5212804 - DNA, 15 bp, Homo sapiens
aggccagaaaaagaa

SEQ ID NO: 5212805 - DNA, 17 bp, Homo sapiens
aggccagaaaaggcagc

SEQ ID NO: 5212806 - DNA, 18 bp, Homo sapiens
aggccagaaaaggcagcc

SEQ ID NO: 5212807 - DNA, 19 bp, Homo sapiens
aggccagaaaaggcagcca

SEQ ID NO: 5212808 - DNA, 18 bp, Homo sapiens
aggccagaaggaggggga

SEQ ID NO: 5212809 - DNA, 14 bp, Homo sapiens
aggccagacacagg

SEQ ID NO: 5212810 - DNA, 19 bp, Homo sapiens
aggccagacacaggccgtg

SEQ ID NO: 5212811 - DNA, 20 bp, Homo sapiens
aggccagacacaggccgtgg

SEQ ID NO: 5212812 - DNA, 15 bp, Homo sapiens
aggccagacatggtg

SEQ ID NO: 5212813 - DNA, 16 bp, Homo sapiens
aggccagacatggtgt

SEQ ID NO: 5212814 - DNA, 17 bp, Homo sapiens
aggccagaccatggaca

SEQ ID NO: 5212815 - DNA, 12 bp, Homo sapiens
aggccagacctg

SEQ ID NO: 5212816 - DNA, 21 bp, Homo sapiens
aggccagagaaagcaaaggtg

SEQ ID NO: 5212817 - DNA, 13 bp, Homo sapiens
aggccagagacac

SEQ ID NO: 5212818 - DNA, 14 bp, Homo sapiens
aggccagagccaag

SEQ ID NO: 5212819 - DNA, 15 bp, Homo sapiens
aggccagagccatgc

SEQ ID NO: 5212820 - DNA, 11 bp, Homo sapiens
aggccagagga

SEQ ID NO: 5212821 - DNA, 13 bp, Homo sapiens
aggccagaggaag

SEQ ID NO: 5212822 - DNA, 16 bp, Homo sapiens
aggccagaggaaggga

SEQ ID NO: 5212823 - DNA, 16 bp, Homo sapiens
aggccagagtggcctg

SEQ ID NO: 5212824 - DNA, 19 bp, Homo sapiens
aggccagagtggcctggcc

SEQ ID NO: 5212825 - DNA, 22 bp, Homo sapiens
aggccagatggcccctccactg

SEQ ID NO: 5212826 - DNA, 18 bp, Homo sapiens
aggccagattacaaatta

SEQ ID NO: 5212827 - DNA, 19 bp, Homo sapiens
aggccagcaaatgttcctt

SEQ ID NO: 5212828 - DNA, 12 bp, Homo sapiens
aggggcaggcgc

SEQ ID NO: 5212829 - DNA, 15 bp, Homo sapiens
aggggcaggcgcaga

SEQ ID NO: 5212830 - DNA, 19 bp, Homo sapiens
aggggcaggcgcagaggtc

SEQ ID NO: 5212831 - DNA, 13 bp, Homo sapiens
aggggcagggaag

SEQ ID NO: 5212832 - DNA, 23 bp, Homo sapiens
aggggcagggaaggacaggaccc

SEQ ID NO: 5212833 - DNA, 16 bp, Homo sapiens
aggggcagggatgggg

SEQ ID NO: 5212834 - DNA, 19 bp, Homo sapiens
aggggcaggtggtggaggg

SEQ ID NO: 5212835 - DNA, 22 bp, Homo sapiens
aggggcaggtgtttctttcctg

SEQ ID NO: 5212836 - DNA, 13 bp, Homo sapiens
aggggcagtccca

SEQ ID NO: 5212837 - DNA, 20 bp, Homo sapiens
aggggcagtttgggaaggtg

SEQ ID NO: 5212838 - DNA, 16 bp, Homo sapiens
aggggcatctgcccct

SEQ ID NO: 5212839 - DNA, 18 bp, Homo sapiens
aggggcatggccagcagc

SEQ ID NO: 5212840 - DNA, 21 bp, Homo sapiens
aggggcatgtattggcctgga

SEQ ID NO: 5212841 - DNA, 23 bp, Homo sapiens
aggggcatttcacagtgcccaag

SEQ ID NO: 5212842 - DNA, 22 bp, Homo sapiens
aggggccaaatatattctcttt

SEQ ID NO: 5212843 - DNA, 23 bp, Homo sapiens
aggggccaaatatattctctttg

SEQ ID NO: 5212844 - DNA, 21 bp, Homo sapiens
aggggccaacctcaggctcct

SEQ ID NO: 5212845 - DNA, 16 bp, Homo sapiens
aggggccaataaaatg

SEQ ID NO: 5212846 - DNA, 15 bp, Homo sapiens
aggggccacctcctc

SEQ ID NO: 5212847 - DNA, 18 bp, Homo sapiens
aggggccacctcctcccc

SEQ ID NO: 5212848 - DNA, 13 bp, Homo sapiens
aggggccactggg

SEQ ID NO: 5212849 - DNA, 19 bp, Homo sapiens
aggggccactgggccccat

SEQ ID NO: 5212850 - DNA, 17 bp, Homo sapiens
aggggccagaagatgaa

SEQ ID NO: 5212851 - DNA, 12 bp, Homo sapiens
aggggccagacc

SEQ ID NO: 5212852 - DNA, 19 bp, Homo sapiens
aggggccagaccctgccca

SEQ ID NO: 5212853 - DNA, 12 bp, Homo sapiens
aggggccagagg

SEQ ID NO: 5212854 - DNA, 13 bp, Homo sapiens
aggggccagaggc

SEQ ID NO: 5212855 - DNA, 18 bp, Homo sapiens
aggggccagcggccctcc

SEQ ID NO: 5212856 - DNA, 21 bp, Homo sapiens
aggggccagcggccctcccag

SEQ ID NO: 5212857 - DNA, 13 bp, Homo sapiens
aggggccagctgc

SEQ ID NO: 5212858 - DNA, 14 bp, Homo sapiens
aggggccaggaagg

SEQ ID NO: 5212859 - DNA, 19 bp, Homo sapiens
aggggccaggagtggggag

SEQ ID NO: 5212860 - DNA, 17 bp, Homo sapiens
aggggccaggcccaggc

SEQ ID NO: 5212861 - DNA, 19 bp, Homo sapiens
aggggccaggcccaggcag

SEQ ID NO: 5212862 - DNA, 17 bp, Homo sapiens
aggggccaggggcaggc

SEQ ID NO: 5212863 - DNA, 24 bp, Homo sapiens
aggggccagtgagggctgggccca

SEQ ID NO: 5212864 - DNA, 18 bp, Homo sapiens
aggggccagtggattccc

SEQ ID NO: 5212865 - DNA, 12 bp, Homo sapiens
aggggccatgcc

SEQ ID NO: 5212866 - DNA, 19 bp, Homo sapiens
aggggccatgtcctctctt

SEQ ID NO: 5212867 - DNA, 16 bp, Homo sapiens
aggggccatttggcat

SEQ ID NO: 5212868 - DNA, 17 bp, Homo sapiens
aggggcccaagagagac

SEQ ID NO: 5212869 - DNA, 17 bp, Homo sapiens
aggggcccaagccccat

SEQ ID NO: 5212870 - DNA, 20 bp, Homo sapiens
aggggcccaaggcggcccct

SEQ ID NO: 5212871 - DNA, 12 bp, Homo sapiens
aggggcccacaa

SEQ ID NO: 5212872 - DNA, 13 bp, Homo sapiens
aggggcccacaaa

SEQ ID NO: 5212873 - DNA, 18 bp, Homo sapiens
aggggcccacaaagggga

SEQ ID NO: 5212874 - DNA, 19 bp, Homo sapiens
aggggcccacaaaggggag

SEQ ID NO: 5212875 - DNA, 14 bp, Homo sapiens
aggggcccacaggg

SEQ ID NO: 5212876 - DNA, 19 bp, Homo sapiens
aggggcccacagggaaccc

SEQ ID NO: 5212877 - DNA, 11 bp, Homo sapiens
aggggcccagg

SEQ ID NO: 5212878 - DNA, 15 bp, Homo sapiens
aggggcccaggctcc

SEQ ID NO: 5212879 - DNA, 20 bp, Homo sapiens
aggggcccaggctcccctgc

SEQ ID NO: 5212880 - DNA, 21 bp, Homo sapiens
aggggcccaggctcccctgcc

SEQ ID NO: 5212881 - DNA, 23 bp, Homo sapiens
aggggcccaggctcccctgcccg

SEQ ID NO: 5212882 - DNA, 20 bp, Homo sapiens
aggggccccagatctgcctg

SEQ ID NO: 5212883 - DNA, 20 bp, Homo sapiens
aggggccccagcgtctgcag

SEQ ID NO: 5212884 - DNA, 20 bp, Homo sapiens
aggggccccggggctggcaa

SEQ ID NO: 5212885 - DNA, 21 bp, Homo sapiens
aggggccccggggctggcaag

SEQ ID NO: 5212886 - DNA, 18 bp, Homo sapiens
aggggcccctcctccaga

SEQ ID NO: 5212887 - DNA, 22 bp, Homo sapiens
aggggcccctcctctgtgctcc

SEQ ID NO: 5212888 - DNA, 14 bp, Homo sapiens
aggggcccctctca

SEQ ID NO: 5212889 - DNA, 14 bp, Homo sapiens
aggggcccctggcc

SEQ ID NO: 5212890 - DNA, 18 bp, Homo sapiens
aggggcccctggcccagg

SEQ ID NO: 5212891 - DNA, 15 bp, Homo sapiens
aggggcccctgggga

SEQ ID NO: 5212892 - DNA, 23 bp, Homo sapiens
aggggcccggccagccatgtctg

SEQ ID NO: 5212893 - DNA, 22 bp, Homo sapiens
aggggcccgggaactcctgcca

SEQ ID NO: 5212894 - DNA, 17 bp, Homo sapiens
aggggcccggtggcggc

SEQ ID NO: 5212895 - DNA, 15 bp, Homo sapiens
aggggccctacctgg

SEQ ID NO: 5212896 - DNA, 19 bp, Homo sapiens
aggggccctcactcttgaa

SEQ ID NO: 5212897 - DNA, 19 bp, Homo sapiens
aggggccctccatgcgcag

SEQ ID NO: 5212898 - DNA, 14 bp, Homo sapiens
aggggccctgagcc

SEQ ID NO: 5212899 - DNA, 15 bp, Homo sapiens
aggggccctgagcca

SEQ ID NO: 5212900 - DNA, 15 bp, Homo sapiens
aggggccctggagca

SEQ ID NO: 5212901 - DNA, 17 bp, Homo sapiens
aggggccctggagcagc

SEQ ID NO: 5212902 - DNA, 12 bp, Homo sapiens
aggggccctggt

SEQ ID NO: 5212903 - DNA, 15 bp, Homo sapiens
aggggccctgtacag

SEQ ID NO: 5212904 - DNA, 17 bp, Homo sapiens
aggggcccttgggacag

SEQ ID NO: 5212905 - DNA, 23 bp, Homo sapiens
aggggcccttgggacagccagag

SEQ ID NO: 5212906 - DNA, 12 bp, Homo sapiens
aggggccgccct

SEQ ID NO: 5212907 - DNA, 16 bp, Homo sapiens
aggggccgctgccacc

SEQ ID NO: 5212908 - DNA, 19 bp, Homo sapiens
aggggccgcttcgccatgt

SEQ ID NO: 5212909 - DNA, 19 bp, Homo sapiens
aggggccggggagggggca

SEQ ID NO: 5212910 - DNA, 23 bp, Homo sapiens
aggggccggggagggggcacggc

SEQ ID NO: 5212911 - DNA, 17 bp, Homo sapiens
aggggcctagggagccg

SEQ ID NO: 5212912 - DNA, 16 bp, Homo sapiens
aggggcctcaggtcct

SEQ ID NO: 5212913 - DNA, 17 bp, Homo sapiens
aggggcctcatcttccc

SEQ ID NO: 5212914 - DNA, 22 bp, Homo sapiens
aggggcctccatgggccccagg

SEQ ID NO: 5212915 - DNA, 20 bp, Homo sapiens
aggggcctcccggggcccag

SEQ ID NO: 5212916 - DNA, 15 bp, Homo sapiens
aggggcctctctcct

SEQ ID NO: 5212917 - DNA, 16 bp, Homo sapiens
aggggcctctctcctg

SEQ ID NO: 5212918 - DNA, 13 bp, Homo sapiens
aggggcctctgaa

SEQ ID NO: 5212919 - DNA, 20 bp, Homo sapiens
aggggcctctgaaatttccc

SEQ ID NO: 5212920 - DNA, 20 bp, Homo sapiens
aggggcctcttatgggctgg

SEQ ID NO: 5212921 - DNA, 12 bp, Homo sapiens
aggggcctgagt

SEQ ID NO: 5212922 - DNA, 13 bp, Homo sapiens
aggggcctgagtg

SEQ ID NO: 5212923 - DNA, 19 bp, Homo sapiens
aggggcctgccacctggac

SEQ ID NO: 5212924 - DNA, 16 bp, Homo sapiens
aggggcctgccactct

SEQ ID NO: 5212925 - DNA, 22 bp, Homo sapiens
aggggcctgccactctcctgag

SEQ ID NO: 5212926 - DNA, 13 bp, Homo sapiens
aggggcctgccca

SEQ ID NO: 5212927 - DNA, 13 bp, Homo sapiens
aggggcctgccct

SEQ ID NO: 5212928 - DNA, 12 bp, Homo sapiens
aggggcctgcct

SEQ ID NO: 5212929 - DNA, 14 bp, Homo sapiens
aggggcctgcgccc

SEQ ID NO: 5212930 - DNA, 16 bp, Homo sapiens
aggggcctgcgcccag

SEQ ID NO: 5212931 - DNA, 11 bp, Homo sapiens
aggggcctgga

SEQ ID NO: 5212932 - DNA, 14 bp, Homo sapiens
aggggcctggagat

SEQ ID NO: 5212933 - DNA, 14 bp, Homo sapiens
aggggcctggaggt

SEQ ID NO: 5212934 - DNA, 13 bp, Homo sapiens
aggggcctggcag

SEQ ID NO: 5212935 - DNA, 23 bp, Homo sapiens
aggggcctggcagccgtgccttc

SEQ ID NO: 5212936 - DNA, 14 bp, Homo sapiens
aggggcctggcctg

SEQ ID NO: 5212937 - DNA, 15 bp, Homo sapiens
aggggcctgggcagc

SEQ ID NO: 5212938 - DNA, 17 bp, Homo sapiens
aggggcctgggcagccc

SEQ ID NO: 5212939 - DNA, 21 bp, Homo sapiens
aggggcctgggcagccccaca

SEQ ID NO: 5212940 - DNA, 13 bp, Homo sapiens
aggggcctgggcc

SEQ ID NO: 5212941 - DNA, 15 bp, Homo sapiens
aggggcctgggctgt

SEQ ID NO: 5212942 - DNA, 18 bp, Homo sapiens
aggggcctgggctgtgag

SEQ ID NO: 5212943 - DNA, 17 bp, Homo sapiens
aggggccttagggcact

SEQ ID NO: 5212944 - DNA, 20 bp, Homo sapiens
aggggccttagggcactggg

SEQ ID NO: 5212945 - DNA, 18 bp, Homo sapiens
aggggccttgctctgagc

SEQ ID NO: 5212946 - DNA, 19 bp, Homo sapiens
aggggccttgctctgagca

SEQ ID NO: 5212947 - DNA, 21 bp, Homo sapiens
aggggccttgctctgagcaca

SEQ ID NO: 5212948 - DNA, 14 bp, Homo sapiens
aggggccttgctga

SEQ ID NO: 5212949 - DNA, 16 bp, Homo sapiens
aggggcctttgctgcc

SEQ ID NO: 5212950 - DNA, 14 bp, Homo sapiens
aggggcgcacccca

SEQ ID NO: 5212951 - DNA, 16 bp, Homo sapiens
aggggcgcgggagggg

SEQ ID NO: 5212952 - DNA, 17 bp, Homo sapiens
aggggcgctcctcccag

SEQ ID NO: 5212953 - DNA, 22 bp, Homo sapiens
aggggcgctcctcccagctgta

SEQ ID NO: 5212954 - DNA, 20 bp, Homo sapiens
aggggcgctcgcttccgcat

SEQ ID NO: 5212955 - DNA, 13 bp, Homo sapiens
aggggcgctggcc

SEQ ID NO: 5212956 - DNA, 16 bp, Homo sapiens
aggggcgctggcccag

SEQ ID NO: 5212957 - DNA, 17 bp, Homo sapiens
aggggcgctggcccagc

SEQ ID NO: 5212958 - DNA, 21 bp, Homo sapiens
aggggcgctggcccagccggc

SEQ ID NO: 5212959 - DNA, 13 bp, Homo sapiens
aggggcgctgtcc

SEQ ID NO: 5212960 - DNA, 14 bp, Homo sapiens
aggggcgctgtcct

SEQ ID NO: 5212961 - DNA, 15 bp, Homo sapiens
aggggcgctgtcctg

SEQ ID NO: 5212962 - DNA, 16 bp, Homo sapiens
aggggcgctgtcctgc

SEQ ID NO: 5212963 - DNA, 14 bp, Homo sapiens
aggggcggcaggag

SEQ ID NO: 5212964 - DNA, 18 bp, Homo sapiens
aggggcgggacccaggca

SEQ ID NO: 5212965 - DNA, 19 bp, Homo sapiens
aggggcgggacccaggcac

SEQ ID NO: 5212966 - DNA, 16 bp, Homo sapiens
aggggcgggcggaggg

SEQ ID NO: 5212967 - DNA, 19 bp, Homo sapiens
aggggcgggcggagggagg

SEQ ID NO: 5212968 - DNA, 14 bp, Homo sapiens
aggggcggggcagg

SEQ ID NO: 5212969 - DNA, 14 bp, Homo sapiens
aggggcggggccag

SEQ ID NO: 5212970 - DNA, 20 bp, Homo sapiens
aggggcgggggcggaggagg

SEQ ID NO: 5212971 - DNA, 20 bp, Homo sapiens
aggggcgggtggatcacctg

SEQ ID NO: 5212972 - DNA, 22 bp, Homo sapiens
aggggcgtctgttcccccttca

SEQ ID NO: 5212973 - DNA, 20 bp, Homo sapiens
aggggcgtgggagtggcctg

SEQ ID NO: 5212974 - DNA, 14 bp, Homo sapiens
aggggcgtgtccct

SEQ ID NO: 5212975 - DNA, 21 bp, Homo sapiens
aggggcgtgtccctcctcttc

SEQ ID NO: 5212976 - DNA, 15 bp, Homo sapiens
aggggctacaagagg

SEQ ID NO: 5212977 - DNA, 17 bp, Homo sapiens
aggggctacaagaggga

SEQ ID NO: 5212978 - DNA, 18 bp, Homo sapiens
aggggctacaagagggaa

SEQ ID NO: 5212979 - DNA, 19 bp, Homo sapiens
aggggctaccctgggaagc

SEQ ID NO: 5212980 - DNA, 16 bp, Homo sapiens
aggggctatcctggga

SEQ ID NO: 5212981 - DNA, 17 bp, Homo sapiens
aggggctatcctgggac

SEQ ID NO: 5212982 - DNA, 20 bp, Homo sapiens
aggggctcagcaaggtgtga

SEQ ID NO: 5212983 - DNA, 15 bp, Homo sapiens
aggggctcagttctg

SEQ ID NO: 5212984 - DNA, 18 bp, Homo sapiens
aggggctccatgccagcc

SEQ ID NO: 5212985 - DNA, 13 bp, Homo sapiens
aggggctccctcc

SEQ ID NO: 5212986 - DNA, 15 bp, Homo sapiens
aggggctcctgagtg

SEQ ID NO: 5212987 - DNA, 23 bp, Homo sapiens
aggggctcctggaaaggctcagt

SEQ ID NO: 5212988 - DNA, 16 bp, Homo sapiens
aggggctcctgggttg

SEQ ID NO: 5212989 - DNA, 20 bp, Homo sapiens
aggggctcgagtgcccctgc

SEQ ID NO: 5212990 - DNA, 21 bp, Homo sapiens
aggggctcgagtgcccctgca

SEQ ID NO: 5212991 - DNA, 22 bp, Homo sapiens
aggggctcgagtgcccctgcag

SEQ ID NO: 5212992 - DNA, 18 bp, Homo sapiens
aggggctctgtgttagga

SEQ ID NO: 5212993 - DNA, 20 bp, Homo sapiens
aggggctgcagccccctgct

SEQ ID NO: 5212994 - DNA, 14 bp, Homo sapiens
aggggctgcaggga

SEQ ID NO: 5212995 - DNA, 19 bp, Homo sapiens
aggggctgcatcctcagcc

SEQ ID NO: 5212996 - DNA, 22 bp, Homo sapiens
aggggctgcatcctcagcccca

SEQ ID NO: 5212997 - DNA, 21 bp, Homo sapiens
aggggctgcccgagtctgttt

SEQ ID NO: 5212998 - DNA, 22 bp, Homo sapiens
aggggctgcgtctgacatcctg

SEQ ID NO: 5212999 - DNA, 22 bp, Homo sapiens
aggggctgcgtgtgggaggctg

SEQ ID NO: 5213000 - DNA, 20 bp, Homo sapiens
aggggctgctcatcacccag

SEQ ID NO: 5213001 - DNA, 21 bp, Homo sapiens
aggggctgctcatcacccagt

SEQ ID NO: 5213002 - DNA, 14 bp, Homo sapiens
aggggctgctccag

SEQ ID NO: 5213003 - DNA, 11 bp, Homo sapiens
aggggctgctg

SEQ ID NO: 5213004 - DNA, 15 bp, Homo sapiens
aggggctgctgcctt

SEQ ID NO: 5213005 - DNA, 12 bp, Homo sapiens
aggggctgctgg

SEQ ID NO: 5213006 - DNA, 16 bp, Homo sapiens
aggggctgctggggca

SEQ ID NO: 5213007 - DNA, 22 bp, Homo sapiens
aggccagcaaggtggagtggat

SEQ ID NO: 5213008 - DNA, 17 bp, Homo sapiens
aggccagcacccaaagg

SEQ ID NO: 5213009 - DNA, 21 bp, Homo sapiens
aggccagcacccaaagggtta

SEQ ID NO: 5213010 - DNA, 14 bp, Homo sapiens
aggccagcagcctt

SEQ ID NO: 5213011 - DNA, 15 bp, Homo sapiens
aggccagcagccttc

SEQ ID NO: 5213012 - DNA, 17 bp, Homo sapiens
aggccagcagccttcca

SEQ ID NO: 5213013 - DNA, 14 bp, Homo sapiens
aggccagcaggggc

SEQ ID NO: 5213014 - DNA, 13 bp, Homo sapiens
aggccagccagtg

SEQ ID NO: 5213015 - DNA, 22 bp, Homo sapiens
aggccagcccacacagcccgag

SEQ ID NO: 5213016 - DNA, 15 bp, Homo sapiens
aggccagcccactgg

SEQ ID NO: 5213017 - DNA, 22 bp, Homo sapiens
aggccagcccactgggccctgg

SEQ ID NO: 5213018 - DNA, 12 bp, Homo sapiens
aggccagcccag

SEQ ID NO: 5213019 - DNA, 13 bp, Homo sapiens
aggccagcccagc

SEQ ID NO: 5213020 - DNA, 15 bp, Homo sapiens
aggccagcccagcca

SEQ ID NO: 5213021 - DNA, 18 bp, Homo sapiens
aggccagcccagccaggc

SEQ ID NO: 5213022 - DNA, 13 bp, Homo sapiens
aggccagccccac

SEQ ID NO: 5213023 - DNA, 18 bp, Homo sapiens
aggccagccccacccagg

SEQ ID NO: 5213024 - DNA, 13 bp, Homo sapiens
aggccagccccat

SEQ ID NO: 5213025 - DNA, 15 bp, Homo sapiens
aggccagccccatct

SEQ ID NO: 5213026 - DNA, 20 bp, Homo sapiens
aggccagccccatcttggtc

SEQ ID NO: 5213027 - DNA, 14 bp, Homo sapiens
aggccagccccccc

SEQ ID NO: 5213028 - DNA, 21 bp, Homo sapiens
aggccagcccggacctctgga

SEQ ID NO: 5213029 - DNA, 18 bp, Homo sapiens
aggccagcctccgagagg

SEQ ID NO: 5213030 - DNA, 19 bp, Homo sapiens
aggccagcctggcctcctg

SEQ ID NO: 5213031 - DNA, 20 bp, Homo sapiens
aggccagcctggcctcctgc

SEQ ID NO: 5213032 - DNA, 22 bp, Homo sapiens
aggccagcctggcctcctgcct

SEQ ID NO: 5213033 - DNA, 16 bp, Homo sapiens
aggccagcctgtccct

SEQ ID NO: 5213034 - DNA, 21 bp, Homo sapiens
aggccagcctgtccctgaaag

SEQ ID NO: 5213035 - DNA, 13 bp, Homo sapiens
aggccagccttga

SEQ ID NO: 5213036 - DNA, 15 bp, Homo sapiens
aggccagccttgacc

SEQ ID NO: 5213037 - DNA, 15 bp, Homo sapiens
aggccagccttggca

SEQ ID NO: 5213038 - DNA, 19 bp, Homo sapiens
aggccagcgaggcgaggct

SEQ ID NO: 5213039 - DNA, 17 bp, Homo sapiens
aggccagcggtgaccag

SEQ ID NO: 5213040 - DNA, 17 bp, Homo sapiens
aggccagctatctgcct

SEQ ID NO: 5213041 - DNA, 20 bp, Homo sapiens
aggccagctatctgcctgac

SEQ ID NO: 5213042 - DNA, 16 bp, Homo sapiens
aggccagctcaggaat

SEQ ID NO: 5213043 - DNA, 12 bp, Homo sapiens
aggccagctcct

SEQ ID NO: 5213044 - DNA, 19 bp, Homo sapiens
aggccagctgccccagcca

SEQ ID NO: 5213045 - DNA, 23 bp, Homo sapiens
aggccagctgcttgggcttcatc

SEQ ID NO: 5213046 - DNA, 14 bp, Homo sapiens
aggccagctggcag

SEQ ID NO: 5213047 - DNA, 17 bp, Homo sapiens
aggccagctggcagcag

SEQ ID NO: 5213048 - DNA, 19 bp, Homo sapiens
aggccagctggcagcagag

SEQ ID NO: 5213049 - DNA, 20 bp, Homo sapiens
aggccagctgtggttttctt

SEQ ID NO: 5213050 - DNA, 18 bp, Homo sapiens
aggccagcttcgtgctgg

SEQ ID NO: 5213051 - DNA, 20 bp, Homo sapiens
aggccagcttcgtgctggag

SEQ ID NO: 5213052 - DNA, 21 bp, Homo sapiens
aggccaggaccaagggcagag

SEQ ID NO: 5213053 - DNA, 13 bp, Homo sapiens
aggccaggaccac

SEQ ID NO: 5213054 - DNA, 24 bp, Homo sapiens
aggccaggaccacacagtccccag

SEQ ID NO: 5213055 - DNA, 18 bp, Homo sapiens
aggccaggacgggccaca

SEQ ID NO: 5213056 - DNA, 18 bp, Homo sapiens
aggccaggactctgcagc

SEQ ID NO: 5213057 - DNA, 19 bp, Homo sapiens
aggccaggactctgcagcc

SEQ ID NO: 5213058 - DNA, 20 bp, Homo sapiens
aggccaggactctgcagcct

SEQ ID NO: 5213059 - DNA, 22 bp, Homo sapiens
aggccaggactctgcagcctca

SEQ ID NO: 5213060 - DNA, 21 bp, Homo sapiens
aggccaggagtttgagaccag

SEQ ID NO: 5213061 - DNA, 18 bp, Homo sapiens
aggccaggatgcctgagc

SEQ ID NO: 5213062 - DNA, 12 bp, Homo sapiens
aggccaggccct

SEQ ID NO: 5213063 - DNA, 16 bp, Homo sapiens
aggccaggccctctgc

SEQ ID NO: 5213064 - DNA, 17 bp, Homo sapiens
aggccaggccctctgcc

SEQ ID NO: 5213065 - DNA, 19 bp, Homo sapiens
aggccaggccctctgccca

SEQ ID NO: 5213066 - DNA, 23 bp, Homo sapiens
aggccaggctcccgaccccatcc

SEQ ID NO: 5213067 - DNA, 14 bp, Homo sapiens
aggccagggcacag

SEQ ID NO: 5213068 - DNA, 13 bp, Homo sapiens
aggccagggcaga

SEQ ID NO: 5213069 - DNA, 13 bp, Homo sapiens
aggccagggcagc

SEQ ID NO: 5213070 - DNA, 14 bp, Homo sapiens
aggccagggcagca

SEQ ID NO: 5213071 - DNA, 19 bp, Homo sapiens
aggccagggcagcaaggga

SEQ ID NO: 5213072 - DNA, 20 bp, Homo sapiens
aggccagggcagcaagggac

SEQ ID NO: 5213073 - DNA, 13 bp, Homo sapiens
aggccagggcagt

SEQ ID NO: 5213074 - DNA, 16 bp, Homo sapiens
aggccagggctcctgt

SEQ ID NO: 5213075 - DNA, 12 bp, Homo sapiens
aggccagggctg

SEQ ID NO: 5213076 - DNA, 13 bp, Homo sapiens
aggccagggctgg

SEQ ID NO: 5213077 - DNA, 23 bp, Homo sapiens
aggccagggctgggtcacaggaa

SEQ ID NO: 5213078 - DNA, 14 bp, Homo sapiens
aggccaggggaggg

SEQ ID NO: 5213079 - DNA, 19 bp, Homo sapiens
aggccagggggccagtccc

SEQ ID NO: 5213080 - DNA, 12 bp, Homo sapiens
aggccagggtca

SEQ ID NO: 5213081 - DNA, 23 bp, Homo sapiens
aggccagggtcactgaaggcctg

SEQ ID NO: 5213082 - DNA, 13 bp, Homo sapiens
aggccaggtagca

SEQ ID NO: 5213083 - DNA, 15 bp, Homo sapiens
aggccaggtccagag

SEQ ID NO: 5213084 - DNA, 18 bp, Homo sapiens
aggccaggtgcaaccagg

SEQ ID NO: 5213085 - DNA, 13 bp, Homo sapiens
aggccaggtgccc

SEQ ID NO: 5213086 - DNA, 17 bp, Homo sapiens
aggccaggtgcccagga

SEQ ID NO: 5213087 - DNA, 18 bp, Homo sapiens
aggccaggtgcccaggaa

SEQ ID NO: 5213088 - DNA, 17 bp, Homo sapiens
aggccaggtgggcggac

SEQ ID NO: 5213089 - DNA, 18 bp, Homo sapiens
aggccagtaatcccagtg

SEQ ID NO: 5213090 - DNA, 20 bp, Homo sapiens
aggccagtactactgctctc

SEQ ID NO: 5213091 - DNA, 13 bp, Homo sapiens
aggccagtacttt

SEQ ID NO: 5213092 - DNA, 20 bp, Homo sapiens
aggccagtccccatttctgc

SEQ ID NO: 5213093 - DNA, 14 bp, Homo sapiens
aggccagtgccagg

SEQ ID NO: 5213094 - DNA, 15 bp, Homo sapiens
aggccagtgccagga

SEQ ID NO: 5213095 - DNA, 16 bp, Homo sapiens
aggccagtgccaggac

SEQ ID NO: 5213096 - DNA, 18 bp, Homo sapiens
aggccagtgccaggacag

SEQ ID NO: 5213097 - DNA, 20 bp, Homo sapiens
aggccagtgccaggacagct

SEQ ID NO: 5213098 - DNA, 21 bp, Homo sapiens
aggccagtgccaggacagctg

SEQ ID NO: 5213099 - DNA, 17 bp, Homo sapiens
aggccagtgctgtgagc

SEQ ID NO: 5213100 - DNA, 15 bp, Homo sapiens
aggccagtggaagaa

SEQ ID NO: 5213101 - DNA, 17 bp, Homo sapiens
aggccagtggacagagg

SEQ ID NO: 5213102 - DNA, 21 bp, Homo sapiens
aggccagtggacagagggaga

SEQ ID NO: 5213103 - DNA, 22 bp, Homo sapiens
aggccagtggcccccgggcctg

SEQ ID NO: 5213104 - DNA, 14 bp, Homo sapiens
aggccagtgggcct

SEQ ID NO: 5213105 - DNA, 20 bp, Homo sapiens
aggccagtgggcctggtagc

SEQ ID NO: 5213106 - DNA, 14 bp, Homo sapiens
aggccagtgtggtg

SEQ ID NO: 5213107 - DNA, 19 bp, Homo sapiens
aggccagtgttgtgggctt

SEQ ID NO: 5213108 - DNA, 18 bp, Homo sapiens
aggccataccaggtgcta

SEQ ID NO: 5213109 - DNA, 12 bp, Homo sapiens
aggccatatttg

SEQ ID NO: 5213110 - DNA, 23 bp, Homo sapiens
aggccatattttaaaaaatcaaa

SEQ ID NO: 5213111 - DNA, 13 bp, Homo sapiens
aggccatcagggc

SEQ ID NO: 5213112 - DNA, 14 bp, Homo sapiens
aggccatcagggcc

SEQ ID NO: 5213113 - DNA, 20 bp, Homo sapiens
aggccatcagggccctgccc

SEQ ID NO: 5213114 - DNA, 21 bp, Homo sapiens
aggccatccttccctgtctgc

SEQ ID NO: 5213115 - DNA, 15 bp, Homo sapiens
aggccatctcaggag

SEQ ID NO: 5213116 - DNA, 18 bp, Homo sapiens
aggccatctcaggagatg

SEQ ID NO: 5213117 - DNA, 10 bp, Homo sapiens
aggccatctg

SEQ ID NO: 5213118 - DNA, 21 bp, Homo sapiens
aggccatctggagagcccaga

SEQ ID NO: 5213119 - DNA, 13 bp, Homo sapiens
aggccatctgtaa

SEQ ID NO: 5213120 - DNA, 18 bp, Homo sapiens
aggccatcttccaggtgg

SEQ ID NO: 5213121 - DNA, 15 bp, Homo sapiens
aggccatgcaagggt

SEQ ID NO: 5213122 - DNA, 18 bp, Homo sapiens
aggccatggactctgtcc

SEQ ID NO: 5213123 - DNA, 20 bp, Homo sapiens
aggccatggactctgtcctg

SEQ ID NO: 5213124 - DNA, 21 bp, Homo sapiens
aggccatggactctgtcctga

SEQ ID NO: 5213125 - DNA, 17 bp, Homo sapiens
aggccatggagagctgg

SEQ ID NO: 5213126 - DNA, 21 bp, Homo sapiens
aggccatggagagctggagcc

SEQ ID NO: 5213127 - DNA, 22 bp, Homo sapiens
aggccatggagagctggagcct

SEQ ID NO: 5213128 - DNA, 15 bp, Homo sapiens
aggccatggcagaat

SEQ ID NO: 5213129 - DNA, 13 bp, Homo sapiens
aggccatggccaa

SEQ ID NO: 5213130 - DNA, 21 bp, Homo sapiens
aggccatgggcactgtgggta

SEQ ID NO: 5213131 - DNA, 14 bp, Homo sapiens
aggccatgggcctc

SEQ ID NO: 5213132 - DNA, 16 bp, Homo sapiens
aggccatgggcctcct

SEQ ID NO: 5213133 - DNA, 14 bp, Homo sapiens
aggccatggggcag

SEQ ID NO: 5213134 - DNA, 15 bp, Homo sapiens
aggccatggggcagc

SEQ ID NO: 5213135 - DNA, 16 bp, Homo sapiens
aggccatggggcagcc

SEQ ID NO: 5213136 - DNA, 23 bp, Homo sapiens
aggccatggggcagcctccagtc

SEQ ID NO: 5213137 - DNA, 22 bp, Homo sapiens
aggccatgggggcccctcggca

SEQ ID NO: 5213138 - DNA, 15 bp, Homo sapiens
aggccatgtgagcca

SEQ ID NO: 5213139 - DNA, 16 bp, Homo sapiens
aggccatgtgagccac

SEQ ID NO: 5213140 - DNA, 20 bp, Homo sapiens
aggccatgtgagccaccgct

SEQ ID NO: 5213141 - DNA, 22 bp, Homo sapiens
aggccatgtgagccaccgctgc

SEQ ID NO: 5213142 - DNA, 18 bp, Homo sapiens
aggccatgtggcctgccc

SEQ ID NO: 5213143 - DNA, 19 bp, Homo sapiens
aggccatgtggcctgccca

SEQ ID NO: 5213144 - DNA, 23 bp, Homo sapiens
aggccatgttccaataaacagga

SEQ ID NO: 5213145 - DNA, 19 bp, Homo sapiens
aggccattatgcctggcta

SEQ ID NO: 5213146 - DNA, 23 bp, Homo sapiens
aggccattccccaacggggtggg

SEQ ID NO: 5213147 - DNA, 14 bp, Homo sapiens
aggccattctttcc

SEQ ID NO: 5213148 - DNA, 19 bp, Homo sapiens
aggccattgtgaaccaatg

SEQ ID NO: 5213149 - DNA, 21 bp, Homo sapiens
aggccatttgctgccctgggg

SEQ ID NO: 5213150 - DNA, 15 bp, Homo sapiens
aggccatttgtattt

SEQ ID NO: 5213151 - DNA, 13 bp, Homo sapiens
aggcccaaagcct

SEQ ID NO: 5213152 - DNA, 22 bp, Homo sapiens
aggcccaaattatcaagctaat

SEQ ID NO: 5213153 - DNA, 14 bp, Homo sapiens
aggcccaacctcct

SEQ ID NO: 5213154 - DNA, 14 bp, Homo sapiens
aggcccaactgtga

SEQ ID NO: 5213155 - DNA, 20 bp, Homo sapiens
aggcccaagagatgaagagt

SEQ ID NO: 5213156 - DNA, 22 bp, Homo sapiens
aggcccaagagcagagtctggg

SEQ ID NO: 5213157 - DNA, 13 bp, Homo sapiens
aggcccaaggagc

SEQ ID NO: 5213158 - DNA, 22 bp, Homo sapiens
aggcccaaggagcttacccaag

SEQ ID NO: 5213159 - DNA, 14 bp, Homo sapiens
aggcccaaggaggg

SEQ ID NO: 5213160 - DNA, 18 bp, Homo sapiens
aggcccaaggagggtcca

SEQ ID NO: 5213161 - DNA, 17 bp, Homo sapiens
aggcccaaggctcccgg

SEQ ID NO: 5213162 - DNA, 14 bp, Homo sapiens
aggcccacacacag

SEQ ID NO: 5213163 - DNA, 16 bp, Homo sapiens
aggcccacacacaggt

SEQ ID NO: 5213164 - DNA, 12 bp, Homo sapiens
aggcccacagga

SEQ ID NO: 5213165 - DNA, 13 bp, Homo sapiens
aggcccacaggag

SEQ ID NO: 5213166 - DNA, 19 bp, Homo sapiens
aggcccacattggaagagc

SEQ ID NO: 5213167 - DNA, 10 bp, Homo sapiens
aggcccacca

SEQ ID NO: 5213168 - DNA, 12 bp, Homo sapiens
aggcccaccctg

SEQ ID NO: 5213169 - DNA, 22 bp, Homo sapiens
aggcccacctaccttcaaagct

SEQ ID NO: 5213170 - DNA, 23 bp, Homo sapiens
aggcccacctaccttcaaagctg

SEQ ID NO: 5213171 - DNA, 17 bp, Homo sapiens
aggcccacgaggagcag

SEQ ID NO: 5213172 - DNA, 18 bp, Homo sapiens
aggcccacgaggagcagc

SEQ ID NO: 5213173 - DNA, 19 bp, Homo sapiens
aggcccacgaggagcagca

SEQ ID NO: 5213174 - DNA, 23 bp, Homo sapiens
aggcccacggtttcagctagaca

SEQ ID NO: 5213175 - DNA, 17 bp, Homo sapiens
aggcccactagagggcc

SEQ ID NO: 5213176 - DNA, 19 bp, Homo sapiens
aggcccactagagggccca

SEQ ID NO: 5213177 - DNA, 21 bp, Homo sapiens
aggcccactccccagccccag

SEQ ID NO: 5213178 - DNA, 20 bp, Homo sapiens
aggcccactgtgtctaggca

SEQ ID NO: 5213179 - DNA, 17 bp, Homo sapiens
aggcccagaagggtagc

SEQ ID NO: 5213180 - DNA, 14 bp, Homo sapiens
aggcccagacctgg

SEQ ID NO: 5213181 - DNA, 18 bp, Homo sapiens
aggcccagacctggcctc

SEQ ID NO: 5213182 - DNA, 21 bp, Homo sapiens
aggcccagacctggcctctgc

SEQ ID NO: 5213183 - DNA, 23 bp, Homo sapiens
aggcccagacctggcctctgcca

SEQ ID NO: 5213184 - DNA, 13 bp, Homo sapiens
aggcccagagagg

SEQ ID NO: 5213185 - DNA, 18 bp, Homo sapiens
aggcccagaggagccaag

SEQ ID NO: 5213186 - DNA, 15 bp, Homo sapiens
aggggctgctggggg

SEQ ID NO: 5213187 - DNA, 20 bp, Homo sapiens
aggggctgcttcctcctgga

SEQ ID NO: 5213188 - DNA, 17 bp, Homo sapiens
aggggctgcttctgggg

SEQ ID NO: 5213189 - DNA, 15 bp, Homo sapiens
aggggctggactggc

SEQ ID NO: 5213190 - DNA, 18 bp, Homo sapiens
aggggctggactggctgt

SEQ ID NO: 5213191 - DNA, 13 bp, Homo sapiens
aggggctggaggg

SEQ ID NO: 5213192 - DNA, 17 bp, Homo sapiens
aggggctggagggctgg

SEQ ID NO: 5213193 - DNA, 19 bp, Homo sapiens
aggggctggccttcctgcc

SEQ ID NO: 5213194 - DNA, 13 bp, Homo sapiens
aggggctgggcag

SEQ ID NO: 5213195 - DNA, 14 bp, Homo sapiens
aggggctgggcaga

SEQ ID NO: 5213196 - DNA, 16 bp, Homo sapiens
aggggctgggcagagg

SEQ ID NO: 5213197 - DNA, 18 bp, Homo sapiens
aggggctgggctgggctg

SEQ ID NO: 5213198 - DNA, 13 bp, Homo sapiens
aggggctggggac

SEQ ID NO: 5213199 - DNA, 13 bp, Homo sapiens
aggggctggggcc

SEQ ID NO: 5213200 - DNA, 16 bp, Homo sapiens
aggggctgtcctcctt

SEQ ID NO: 5213201 - DNA, 19 bp, Homo sapiens
aggggctgtcctccttcct

SEQ ID NO: 5213202 - DNA, 23 bp, Homo sapiens
aggggctgtcctccttcctggga

SEQ ID NO: 5213203 - DNA, 16 bp, Homo sapiens
aggggcttcaggtcca

SEQ ID NO: 5213204 - DNA, 22 bp, Homo sapiens
aggggcttcccacagcctcttc

SEQ ID NO: 5213205 - DNA, 21 bp, Homo sapiens
aggggcttctaatgacccaga

SEQ ID NO: 5213206 - DNA, 20 bp, Homo sapiens
aggggcttctccccctcagc

SEQ ID NO: 5213207 - DNA, 14 bp, Homo sapiens
aggggcttgagaag

SEQ ID NO: 5213208 - DNA, 23 bp, Homo sapiens
aggggcttgagaaggttactgag

SEQ ID NO: 5213209 - DNA, 20 bp, Homo sapiens
aggggcttggagcagagacg

SEQ ID NO: 5213210 - DNA, 14 bp, Homo sapiens
aggggcttggattt

SEQ ID NO: 5213211 - DNA, 18 bp, Homo sapiens
aggggcttggctgcccca

SEQ ID NO: 5213212 - DNA, 13 bp, Homo sapiens
aggggctttctct

SEQ ID NO: 5213213 - DNA, 14 bp, Homo sapiens
aggggctttctctt

SEQ ID NO: 5213214 - DNA, 16 bp, Homo sapiens
aggggctttctcttcc

SEQ ID NO: 5213215 - DNA, 21 bp, Homo sapiens
aggggctttctcttccccttc

SEQ ID NO: 5213216 - DNA, 14 bp, Homo sapiens
aggggctttctgga

SEQ ID NO: 5213217 - DNA, 20 bp, Homo sapiens
aggggctttctggagaggag

SEQ ID NO: 5213218 - DNA, 14 bp, Homo sapiens
aggggctttgggcc

SEQ ID NO: 5213219 - DNA, 15 bp, Homo sapiens
aggggctttgggccc

SEQ ID NO: 5213220 - DNA, 19 bp, Homo sapiens
aggggctttgggcccaaga

SEQ ID NO: 5213221 - DNA, 22 bp, Homo sapiens
aggggcttttcccaccttcacc

SEQ ID NO: 5213222 - DNA, 17 bp, Homo sapiens
agggggaaaaggtggga

SEQ ID NO: 5213223 - DNA, 19 bp, Homo sapiens
agggggaagaagcagagag

SEQ ID NO: 5213224 - DNA, 15 bp, Homo sapiens
agggggaagagaaat

SEQ ID NO: 5213225 - DNA, 16 bp, Homo sapiens
agggggaagagatccc

SEQ ID NO: 5213226 - DNA, 12 bp, Homo sapiens
agggggaagcaa

SEQ ID NO: 5213227 - DNA, 14 bp, Homo sapiens
agggggaagcaaag

SEQ ID NO: 5213228 - DNA, 15 bp, Homo sapiens
agggggaagcaaagg

SEQ ID NO: 5213229 - DNA, 18 bp, Homo sapiens
agggggaagcaccagcct

SEQ ID NO: 5213230 - DNA, 19 bp, Homo sapiens
agggggaagcaccagcctc

SEQ ID NO: 5213231 - DNA, 21 bp, Homo sapiens
agggggaagcaccagcctcag

SEQ ID NO: 5213232 - DNA, 19 bp, Homo sapiens
agggggaaggctgcaaagt

SEQ ID NO: 5213233 - DNA, 16 bp, Homo sapiens
agggggaatattttaa

SEQ ID NO: 5213234 - DNA, 17 bp, Homo sapiens
agggggaattcctggaa

SEQ ID NO: 5213235 - DNA, 16 bp, Homo sapiens
agggggacagcaggga

SEQ ID NO: 5213236 - DNA, 17 bp, Homo sapiens
agggggaccatggggag

SEQ ID NO: 5213237 - DNA, 16 bp, Homo sapiens
agggggacctcgggct

SEQ ID NO: 5213238 - DNA, 17 bp, Homo sapiens
agggggacctcgggctg

SEQ ID NO: 5213239 - DNA, 23 bp, Homo sapiens
agggggacctgccaccagggagc

SEQ ID NO: 5213240 - DNA, 16 bp, Homo sapiens
agggggacgtttctgg

SEQ ID NO: 5213241 - DNA, 15 bp, Homo sapiens
agggggaggagtcag

SEQ ID NO: 5213242 - DNA, 23 bp, Homo sapiens
agggggaggagtcaggggctctg

SEQ ID NO: 5213243 - DNA, 18 bp, Homo sapiens
agggggaggggagaagcc

SEQ ID NO: 5213244 - DNA, 18 bp, Homo sapiens
agggggaggggtggtact

SEQ ID NO: 5213245 - DNA, 20 bp, Homo sapiens
agggggaggtgaaaagggca

SEQ ID NO: 5213246 - DNA, 23 bp, Homo sapiens
agggggaggtgaaaagggcagag

SEQ ID NO: 5213247 - DNA, 18 bp, Homo sapiens
agggggagtagccaagct

SEQ ID NO: 5213248 - DNA, 21 bp, Homo sapiens
agggggagtttttagtttgtt

SEQ ID NO: 5213249 - DNA, 21 bp, Homo sapiens
agggggatatgggtcctctgg

SEQ ID NO: 5213250 - DNA, 16 bp, Homo sapiens
agggggatgccactcc

SEQ ID NO: 5213251 - DNA, 16 bp, Homo sapiens
agggggattctgagca

SEQ ID NO: 5213252 - DNA, 16 bp, Homo sapiens
agggggcaagaggaat

SEQ ID NO: 5213253 - DNA, 14 bp, Homo sapiens
agggggcagagtgg

SEQ ID NO: 5213254 - DNA, 22 bp, Homo sapiens
agggggcagagtggcctgtgag

SEQ ID NO: 5213255 - DNA, 13 bp, Homo sapiens
agggggcaggccc

SEQ ID NO: 5213256 - DNA, 12 bp, Homo sapiens
agggggcagggg

SEQ ID NO: 5213257 - DNA, 15 bp, Homo sapiens
agggggcattgccgg

SEQ ID NO: 5213258 - DNA, 10 bp, Homo sapiens
agggggccac

SEQ ID NO: 5213259 - DNA, 18 bp, Homo sapiens
agggggccagctggggag

SEQ ID NO: 5213260 - DNA, 13 bp, Homo sapiens
agggggccccgcc

SEQ ID NO: 5213261 - DNA, 18 bp, Homo sapiens
agggggccccgccagggc

SEQ ID NO: 5213262 - DNA, 13 bp, Homo sapiens
agggggccctgct

SEQ ID NO: 5213263 - DNA, 17 bp, Homo sapiens
agggggccctggcttgg

SEQ ID NO: 5213264 - DNA, 17 bp, Homo sapiens
agggggccctggggcct

SEQ ID NO: 5213265 - DNA, 16 bp, Homo sapiens
agggggcccttccaga

SEQ ID NO: 5213266 - DNA, 21 bp, Homo sapiens
agggggccggggggaggggac

SEQ ID NO: 5213267 - DNA, 19 bp, Homo sapiens
agggggcctttaaagactt

SEQ ID NO: 5213268 - DNA, 15 bp, Homo sapiens
agggggcgcctgtgg

SEQ ID NO: 5213269 - DNA, 18 bp, Homo sapiens
agggggcgctcaggaccc

SEQ ID NO: 5213270 - DNA, 16 bp, Homo sapiens
agggggcggcagggct

SEQ ID NO: 5213271 - DNA, 12 bp, Homo sapiens
agggggcggcct

SEQ ID NO: 5213272 - DNA, 21 bp, Homo sapiens
agggggcggtaggggctgcag

SEQ ID NO: 5213273 - DNA, 17 bp, Homo sapiens
agggggctaagctatgg

SEQ ID NO: 5213274 - DNA, 20 bp, Homo sapiens
agggggctattccctggaga

SEQ ID NO: 5213275 - DNA, 11 bp, Homo sapiens
agggggctctc

SEQ ID NO: 5213276 - DNA, 21 bp, Homo sapiens
agggggctctccaaaggggct

SEQ ID NO: 5213277 - DNA, 22 bp, Homo sapiens
agggggctctccaaaggggctg

SEQ ID NO: 5213278 - DNA, 14 bp, Homo sapiens
agggggctctgccc

SEQ ID NO: 5213279 - DNA, 21 bp, Homo sapiens
agggggctctgccccaggccc

SEQ ID NO: 5213280 - DNA, 16 bp, Homo sapiens
agggggctgcacggga

SEQ ID NO: 5213281 - DNA, 22 bp, Homo sapiens
agggggctgctcccacctggct

SEQ ID NO: 5213282 - DNA, 19 bp, Homo sapiens
agggggctggaggagccca

SEQ ID NO: 5213283 - DNA, 12 bp, Homo sapiens
agggggctggga

SEQ ID NO: 5213284 - DNA, 16 bp, Homo sapiens
agggggctgggctcac

SEQ ID NO: 5213285 - DNA, 16 bp, Homo sapiens
agggggcttgaagcca

SEQ ID NO: 5213286 - DNA, 18 bp, Homo sapiens
agggggcttgaagccaaa

SEQ ID NO: 5213287 - DNA, 16 bp, Homo sapiens
aggggggagccagagg

SEQ ID NO: 5213288 - DNA, 17 bp, Homo sapiens
aggggggagccagaggc

SEQ ID NO: 5213289 - DNA, 13 bp, Homo sapiens
aggggggagctgg

SEQ ID NO: 5213290 - DNA, 12 bp, Homo sapiens
aggggggagggt

SEQ ID NO: 5213291 - DNA, 13 bp, Homo sapiens
aggggggccaggg

SEQ ID NO: 5213292 - DNA, 17 bp, Homo sapiens
aggggggctgcctggcc

SEQ ID NO: 5213293 - DNA, 18 bp, Homo sapiens
agggggggctacattata

SEQ ID NO: 5213294 - DNA, 14 bp, Homo sapiens
aggggggggtgggg

SEQ ID NO: 5213295 - DNA, 24 bp, Homo sapiens
aggggggtcggaagcctgtcctca

SEQ ID NO: 5213296 - DNA, 16 bp, Homo sapiens
aggggggtgggagggg

SEQ ID NO: 5213297 - DNA, 21 bp, Homo sapiens
aggggggttgggttccagaca

SEQ ID NO: 5213298 - DNA, 15 bp, Homo sapiens
agggggtaggagagc

SEQ ID NO: 5213299 - DNA, 21 bp, Homo sapiens
agggggtaggagagcactgcc

SEQ ID NO: 5213300 - DNA, 18 bp, Homo sapiens
agggggtatgcagagctt

SEQ ID NO: 5213301 - DNA, 18 bp, Homo sapiens
agggggtcagttgggccc

SEQ ID NO: 5213302 - DNA, 16 bp, Homo sapiens
agggggtcccagtggg

SEQ ID NO: 5213303 - DNA, 24 bp, Homo sapiens
agggggtcccagtgggaggggcag

SEQ ID NO: 5213304 - DNA, 22 bp, Homo sapiens
agggggtccgtggtagaggcct

SEQ ID NO: 5213305 - DNA, 19 bp, Homo sapiens
agggggtcgtggagagcta

SEQ ID NO: 5213306 - DNA, 21 bp, Homo sapiens
agggggtgagaggcaggaatg

SEQ ID NO: 5213307 - DNA, 20 bp, Homo sapiens
agggggtgcaaagactctga

SEQ ID NO: 5213308 - DNA, 23 bp, Homo sapiens
agggggtgcaaagactctgagcc

SEQ ID NO: 5213309 - DNA, 15 bp, Homo sapiens
agggggtggcctccc

SEQ ID NO: 5213310 - DNA, 20 bp, Homo sapiens
agggggtggcctcccaactc

SEQ ID NO: 5213311 - DNA, 16 bp, Homo sapiens
agggggtgggctgtca

SEQ ID NO: 5213312 - DNA, 21 bp, Homo sapiens
agggggtggttattggactcc

SEQ ID NO: 5213313 - DNA, 21 bp, Homo sapiens
agggggtgtaatgaaaatgat

SEQ ID NO: 5213314 - DNA, 17 bp, Homo sapiens
agggggtgtcagaagct

SEQ ID NO: 5213315 - DNA, 21 bp, Homo sapiens
agggggtgtcagaagctggga

SEQ ID NO: 5213316 - DNA, 22 bp, Homo sapiens
agggggtgtctgcaccttagaa

SEQ ID NO: 5213317 - DNA, 21 bp, Homo sapiens
agggggttcttattttgcatt

SEQ ID NO: 5213318 - DNA, 20 bp, Homo sapiens
agggggtttgctggggaact

SEQ ID NO: 5213319 - DNA, 13 bp, Homo sapiens
aggggtaaatata

SEQ ID NO: 5213320 - DNA, 14 bp, Homo sapiens
aggggtaaatatat

SEQ ID NO: 5213321 - DNA, 16 bp, Homo sapiens
aggggtaacctggcca

SEQ ID NO: 5213322 - DNA, 23 bp, Homo sapiens
aggggtacacagagctaaggcca

SEQ ID NO: 5213323 - DNA, 23 bp, Homo sapiens
aggggtacattctagctgagaag

SEQ ID NO: 5213324 - DNA, 17 bp, Homo sapiens
aggggtagctggtggtt

SEQ ID NO: 5213325 - DNA, 18 bp, Homo sapiens
aggggtaggatgtacagg

SEQ ID NO: 5213326 - DNA, 15 bp, Homo sapiens
aggggtaggggctgg

SEQ ID NO: 5213327 - DNA, 19 bp, Homo sapiens
aggggtaggggctgggaac

SEQ ID NO: 5213328 - DNA, 21 bp, Homo sapiens
aggggtatcatgtatggtgat

SEQ ID NO: 5213329 - DNA, 22 bp, Homo sapiens
aggggtatgttccctcttgtcc

SEQ ID NO: 5213330 - DNA, 12 bp, Homo sapiens
aggggtatttaa

SEQ ID NO: 5213331 - DNA, 14 bp, Homo sapiens
aggggtcaaagaaa

SEQ ID NO: 5213332 - DNA, 20 bp, Homo sapiens
aggggtcagcagagcttcag

SEQ ID NO: 5213333 - DNA, 14 bp, Homo sapiens
aggggtcagctctg

SEQ ID NO: 5213334 - DNA, 24 bp, Homo sapiens
aggggtcagggaccaaggacccct

SEQ ID NO: 5213335 - DNA, 14 bp, Homo sapiens
aggggtcaggtgtc

SEQ ID NO: 5213336 - DNA, 17 bp, Homo sapiens
aggggtcaggtgtcagg

SEQ ID NO: 5213337 - DNA, 23 bp, Homo sapiens
aggggtccctgcaaaactccagg

SEQ ID NO: 5213338 - DNA, 23 bp, Homo sapiens
aggggtcctgatttcagggaaat

SEQ ID NO: 5213339 - DNA, 14 bp, Homo sapiens
aggggtcctgcagg

SEQ ID NO: 5213340 - DNA, 20 bp, Homo sapiens
aggggtcctgcaggtcctgg

SEQ ID NO: 5213341 - DNA, 19 bp, Homo sapiens
aggggtctccaggaggaga

SEQ ID NO: 5213342 - DNA, 18 bp, Homo sapiens
aggggtctccctgagcct

SEQ ID NO: 5213343 - DNA, 20 bp, Homo sapiens
aggggtctccctgagcctgc

SEQ ID NO: 5213344 - DNA, 23 bp, Homo sapiens
aggggtctccctgagcctgcccc

SEQ ID NO: 5213345 - DNA, 19 bp, Homo sapiens
aggggtctccctggagtgc

SEQ ID NO: 5213346 - DNA, 15 bp, Homo sapiens
aggggtctccctggc

SEQ ID NO: 5213347 - DNA, 17 bp, Homo sapiens
aggggtctccctggctc

SEQ ID NO: 5213348 - DNA, 16 bp, Homo sapiens
aggggtctgctcctgt

SEQ ID NO: 5213349 - DNA, 22 bp, Homo sapiens
aggggtctgggagtcaggcccg

SEQ ID NO: 5213350 - DNA, 22 bp, Homo sapiens
aggggtcttgcaaaattcctga

SEQ ID NO: 5213351 - DNA, 16 bp, Homo sapiens
aggggtgacacagact

SEQ ID NO: 5213352 - DNA, 16 bp, Homo sapiens
aggggtgacggccctc

SEQ ID NO: 5213353 - DNA, 20 bp, Homo sapiens
aggggtgagagacctgctca

SEQ ID NO: 5213354 - DNA, 14 bp, Homo sapiens
aggggtgagccccg

SEQ ID NO: 5213355 - DNA, 15 bp, Homo sapiens
aggggtgagccccgc

SEQ ID NO: 5213356 - DNA, 15 bp, Homo sapiens
aggggtgaggatagg

SEQ ID NO: 5213357 - DNA, 20 bp, Homo sapiens
aggggtgattgaaagaaaaa

SEQ ID NO: 5213358 - DNA, 13 bp, Homo sapiens
aggggtgatttca

SEQ ID NO: 5213359 - DNA, 14 bp, Homo sapiens
aggggtgcacaata

SEQ ID NO: 5213360 - DNA, 22 bp, Homo sapiens
aggggtgcacccactcaccagg

SEQ ID NO: 5213361 - DNA, 16 bp, Homo sapiens
aggggtgccccctcct

SEQ ID NO: 5213362 - DNA, 20 bp, Homo sapiens
aggggtgccccctcctctcc

SEQ ID NO: 5213363 - DNA, 13 bp, Homo sapiens
aggggtgccctct

SEQ ID NO: 5213364 - DNA, 15 bp, Homo sapiens
aggcccagagggcct

SEQ ID NO: 5213365 - DNA, 15 bp, Homo sapiens
aggcccagcatgcag

SEQ ID NO: 5213366 - DNA, 14 bp, Homo sapiens
aggcccagccctca

SEQ ID NO: 5213367 - DNA, 16 bp, Homo sapiens
aggcccagccctcaga

SEQ ID NO: 5213368 - DNA, 15 bp, Homo sapiens
aggcccagccctcct

SEQ ID NO: 5213369 - DNA, 13 bp, Homo sapiens
aggcccagccctg

SEQ ID NO: 5213370 - DNA, 15 bp, Homo sapiens
aggcccagccctggg

SEQ ID NO: 5213371 - DNA, 23 bp, Homo sapiens
aggcccagccgcaggaaggcaga

SEQ ID NO: 5213372 - DNA, 18 bp, Homo sapiens
aggcccagcctctctggc

SEQ ID NO: 5213373 - DNA, 14 bp, Homo sapiens
aggcccagcctctg

SEQ ID NO: 5213374 - DNA, 15 bp, Homo sapiens
aggcccagcctctgc

SEQ ID NO: 5213375 - DNA, 13 bp, Homo sapiens
aggcccagcctgt

SEQ ID NO: 5213376 - DNA, 14 bp, Homo sapiens
aggcccagcctgtc

SEQ ID NO: 5213377 - DNA, 18 bp, Homo sapiens
aggcccagcctgtcctgg

SEQ ID NO: 5213378 - DNA, 19 bp, Homo sapiens
aggcccagcctgtcctggt

SEQ ID NO: 5213379 - DNA, 24 bp, Homo sapiens
aggcccagctggggcccctcggct

SEQ ID NO: 5213380 - DNA, 22 bp, Homo sapiens
aggcccagctttccctgccagg

SEQ ID NO: 5213381 - DNA, 23 bp, Homo sapiens
aggcccagctttccctgccaggc

SEQ ID NO: 5213382 - DNA, 19 bp, Homo sapiens
aggcccaggagacctccag

SEQ ID NO: 5213383 - DNA, 21 bp, Homo sapiens
aggcccaggagacctccagct

SEQ ID NO: 5213384 - DNA, 23 bp, Homo sapiens
aggcccaggcaccaccaggagca

SEQ ID NO: 5213385 - DNA, 17 bp, Homo sapiens
aggcccaggcagagctg

SEQ ID NO: 5213386 - DNA, 14 bp, Homo sapiens
aggcccaggcaggc

SEQ ID NO: 5213387 - DNA, 18 bp, Homo sapiens
aggcccaggcaggcccag

SEQ ID NO: 5213388 - DNA, 11 bp, Homo sapiens
aggcccaggcc

SEQ ID NO: 5213389 - DNA, 12 bp, Homo sapiens
aggcccaggcca

SEQ ID NO: 5213390 - DNA, 19 bp, Homo sapiens
aggcccaggcctcaccacc

SEQ ID NO: 5213391 - DNA, 18 bp, Homo sapiens
aggcccaggctgccgtcc

SEQ ID NO: 5213392 - DNA, 13 bp, Homo sapiens
aggcccaggctgg

SEQ ID NO: 5213393 - DNA, 15 bp, Homo sapiens
aggcccaggctggga

SEQ ID NO: 5213394 - DNA, 13 bp, Homo sapiens
aggcccagggagg

SEQ ID NO: 5213395 - DNA, 22 bp, Homo sapiens
aggcccagggagggaagtgtga

SEQ ID NO: 5213396 - DNA, 19 bp, Homo sapiens
aggcccaggggtggggccc

SEQ ID NO: 5213397 - DNA, 24 bp, Homo sapiens
aggcccaggtcaacatctaagcct

SEQ ID NO: 5213398 - DNA, 22 bp, Homo sapiens
aggcccagtgacaaagactcct

SEQ ID NO: 5213399 - DNA, 22 bp, Homo sapiens
aggcccagttctcgtgccctta

SEQ ID NO: 5213400 - DNA, 20 bp, Homo sapiens
aggcccatctcaggtgccac

SEQ ID NO: 5213401 - DNA, 14 bp, Homo sapiens
aggcccatgccccc

SEQ ID NO: 5213402 - DNA, 16 bp, Homo sapiens
aggcccatgccccctt

SEQ ID NO: 5213403 - DNA, 16 bp, Homo sapiens
aggcccatgggaggct

SEQ ID NO: 5213404 - DNA, 18 bp, Homo sapiens
aggcccatgggcagaaga

SEQ ID NO: 5213405 - DNA, 23 bp, Homo sapiens
aggcccatgggcagaagatagag

SEQ ID NO: 5213406 - DNA, 21 bp, Homo sapiens
aggccccaaaaccacagccct

SEQ ID NO: 5213407 - DNA, 23 bp, Homo sapiens
aggccccaaaaccacagccctgt

SEQ ID NO: 5213408 - DNA, 22 bp, Homo sapiens
aggccccaactcaagtgtcacc

SEQ ID NO: 5213409 - DNA, 19 bp, Homo sapiens
aggccccaataccccatgg

SEQ ID NO: 5213410 - DNA, 15 bp, Homo sapiens
aggccccacaaggcc

SEQ ID NO: 5213411 - DNA, 17 bp, Homo sapiens
aggccccacaaggcctg

SEQ ID NO: 5213412 - DNA, 18 bp, Homo sapiens
aggccccacaaggcctgg

SEQ ID NO: 5213413 - DNA, 19 bp, Homo sapiens
aggccccacaaggcctggt

SEQ ID NO: 5213414 - DNA, 17 bp, Homo sapiens
aggccccacctgaaggg

SEQ ID NO: 5213415 - DNA, 13 bp, Homo sapiens
aggccccacgccc

SEQ ID NO: 5213416 - DNA, 20 bp, Homo sapiens
aggccccacgccctctcctc

SEQ ID NO: 5213417 - DNA, 16 bp, Homo sapiens
aggccccactccttcc

SEQ ID NO: 5213418 - DNA, 19 bp, Homo sapiens
aggccccactgatgctgtt

SEQ ID NO: 5213419 - DNA, 13 bp, Homo sapiens
aggccccactggg

SEQ ID NO: 5213420 - DNA, 17 bp, Homo sapiens
aggccccactggggaaa

SEQ ID NO: 5213421 - DNA, 23 bp, Homo sapiens
aggccccactttcaagaatcaga

SEQ ID NO: 5213422 - DNA, 17 bp, Homo sapiens
aggccccagacagggtg

SEQ ID NO: 5213423 - DNA, 17 bp, Homo sapiens
aggccccagaggccctg

SEQ ID NO: 5213424 - DNA, 22 bp, Homo sapiens
aggccccagaggccctggaggt

SEQ ID NO: 5213425 - DNA, 18 bp, Homo sapiens
aggccccagccaagtgcc

SEQ ID NO: 5213426 - DNA, 19 bp, Homo sapiens
aggccccagcctccaggcc

SEQ ID NO: 5213427 - DNA, 17 bp, Homo sapiens
aggccccagctctgagg

SEQ ID NO: 5213428 - DNA, 12 bp, Homo sapiens
aggccccaggaa

SEQ ID NO: 5213429 - DNA, 12 bp, Homo sapiens
aggccccaggct

SEQ ID NO: 5213430 - DNA, 14 bp, Homo sapiens
aggccccaggctgg

SEQ ID NO: 5213431 - DNA, 13 bp, Homo sapiens
aggccccagggac

SEQ ID NO: 5213432 - DNA, 15 bp, Homo sapiens
aggccccagggacag

SEQ ID NO: 5213433 - DNA, 20 bp, Homo sapiens
aggccccagggacagaggcc

SEQ ID NO: 5213434 - DNA, 13 bp, Homo sapiens
aggccccagggga

SEQ ID NO: 5213435 - DNA, 13 bp, Homo sapiens
aggccccaggtca

SEQ ID NO: 5213436 - DNA, 16 bp, Homo sapiens
aggccccatgacctcc

SEQ ID NO: 5213437 - DNA, 20 bp, Homo sapiens
aggccccatgacctccagct

SEQ ID NO: 5213438 - DNA, 22 bp, Homo sapiens
aggcccccaaacatagcccctg

SEQ ID NO: 5213439 - DNA, 22 bp, Homo sapiens
aggcccccaaattgccttcagc

SEQ ID NO: 5213440 - DNA, 14 bp, Homo sapiens
aggcccccaccaca

SEQ ID NO: 5213441 - DNA, 15 bp, Homo sapiens
aggcccccaccacac

SEQ ID NO: 5213442 - DNA, 18 bp, Homo sapiens
aggcccccaccacacatc

SEQ ID NO: 5213443 - DNA, 13 bp, Homo sapiens
aggcccccaccct

SEQ ID NO: 5213444 - DNA, 18 bp, Homo sapiens
aggcccccacccttgggc

SEQ ID NO: 5213445 - DNA, 16 bp, Homo sapiens
aggcccccacctctgt

SEQ ID NO: 5213446 - DNA, 17 bp, Homo sapiens
aggcccccacctggctc

SEQ ID NO: 5213447 - DNA, 20 bp, Homo sapiens
aggcccccacttgcctcttc

SEQ ID NO: 5213448 - DNA, 14 bp, Homo sapiens
aggcccccagccca

SEQ ID NO: 5213449 - DNA, 17 bp, Homo sapiens
aggcccccagcccaggg

SEQ ID NO: 5213450 - DNA, 19 bp, Homo sapiens
aggcccccagcccagggct

SEQ ID NO: 5213451 - DNA, 15 bp, Homo sapiens
aggcccccagcccct

SEQ ID NO: 5213452 - DNA, 23 bp, Homo sapiens
aggcccccagcccctcctccctc

SEQ ID NO: 5213453 - DNA, 19 bp, Homo sapiens
aggcccccatcatcctctg

SEQ ID NO: 5213454 - DNA, 22 bp, Homo sapiens
aggccccccgcagcaccctgca

SEQ ID NO: 5213455 - DNA, 15 bp, Homo sapiens
aggcccccctctgcc

SEQ ID NO: 5213456 - DNA, 21 bp, Homo sapiens
aggcccccgcacgcaagcctc

SEQ ID NO: 5213457 - DNA, 20 bp, Homo sapiens
aggcccccggctttcctccg

SEQ ID NO: 5213458 - DNA, 19 bp, Homo sapiens
aggcccccgtcagggagag

SEQ ID NO: 5213459 - DNA, 13 bp, Homo sapiens
aggccccctcctc

SEQ ID NO: 5213460 - DNA, 17 bp, Homo sapiens
aggccccgcccaggctt

SEQ ID NO: 5213461 - DNA, 21 bp, Homo sapiens
aggccccgccttttcccccac

SEQ ID NO: 5213462 - DNA, 21 bp, Homo sapiens
aggccccgcttgtccagcgcc

SEQ ID NO: 5213463 - DNA, 22 bp, Homo sapiens
aggccccgcttgtccagcgcct

SEQ ID NO: 5213464 - DNA, 14 bp, Homo sapiens
aggccccgggcttc

SEQ ID NO: 5213465 - DNA, 17 bp, Homo sapiens
aggccccggtatgtgat

SEQ ID NO: 5213466 - DNA, 21 bp, Homo sapiens
aggcccctatgtagtccgtgc

SEQ ID NO: 5213467 - DNA, 23 bp, Homo sapiens
aggcccctcctagacccaggtgg

SEQ ID NO: 5213468 - DNA, 16 bp, Homo sapiens
aggcccctctcctccg

SEQ ID NO: 5213469 - DNA, 21 bp, Homo sapiens
aggcccctctgcaactggaga

SEQ ID NO: 5213470 - DNA, 20 bp, Homo sapiens
aggcccctgaggcagcccag

SEQ ID NO: 5213471 - DNA, 13 bp, Homo sapiens
aggcccctgaggg

SEQ ID NO: 5213472 - DNA, 13 bp, Homo sapiens
aggcccctgccac

SEQ ID NO: 5213473 - DNA, 21 bp, Homo sapiens
aggcccctgccaccctgggga

SEQ ID NO: 5213474 - DNA, 14 bp, Homo sapiens
aggcccctgccccc

SEQ ID NO: 5213475 - DNA, 13 bp, Homo sapiens
aggcccctgccct

SEQ ID NO: 5213476 - DNA, 13 bp, Homo sapiens
aggcccctggagg

SEQ ID NO: 5213477 - DNA, 19 bp, Homo sapiens
aggcccctggaggctgcct

SEQ ID NO: 5213478 - DNA, 16 bp, Homo sapiens
aggcccctggagttgt

SEQ ID NO: 5213479 - DNA, 16 bp, Homo sapiens
aggcccctggcccagc

SEQ ID NO: 5213480 - DNA, 14 bp, Homo sapiens
aggcccctgggctc

SEQ ID NO: 5213481 - DNA, 20 bp, Homo sapiens
aggcccctgggctctcaccc

SEQ ID NO: 5213482 - DNA, 22 bp, Homo sapiens
aggcccctgggctctcacccag

SEQ ID NO: 5213483 - DNA, 12 bp, Homo sapiens
aggcccctgggg

SEQ ID NO: 5213484 - DNA, 17 bp, Homo sapiens
aggcccctggggctccc

SEQ ID NO: 5213485 - DNA, 19 bp, Homo sapiens
aggcccctggtctgccctg

SEQ ID NO: 5213486 - DNA, 18 bp, Homo sapiens
aggcccctgtgcagtaga

SEQ ID NO: 5213487 - DNA, 20 bp, Homo sapiens
aggccccttccacgggggct

SEQ ID NO: 5213488 - DNA, 23 bp, Homo sapiens
aggccccttcccacgtccctcga

SEQ ID NO: 5213489 - DNA, 16 bp, Homo sapiens
aggccccttgctgctg

SEQ ID NO: 5213490 - DNA, 19 bp, Homo sapiens
aggccccttgctgctggct

SEQ ID NO: 5213491 - DNA, 14 bp, Homo sapiens
aggcccgacagaga

SEQ ID NO: 5213492 - DNA, 17 bp, Homo sapiens
aggcccgacagagagat

SEQ ID NO: 5213493 - DNA, 21 bp, Homo sapiens
aggcccgacagagagatgaag

SEQ ID NO: 5213494 - DNA, 14 bp, Homo sapiens
aggcccgagcagct

SEQ ID NO: 5213495 - DNA, 19 bp, Homo sapiens
aggcccgagcagctgagca

SEQ ID NO: 5213496 - DNA, 21 bp, Homo sapiens
aggcccgagcagctgagcagg

SEQ ID NO: 5213497 - DNA, 17 bp, Homo sapiens
aggcccgcactgggggc

SEQ ID NO: 5213498 - DNA, 16 bp, Homo sapiens
aggcccgcgggcacag

SEQ ID NO: 5213499 - DNA, 17 bp, Homo sapiens
aggcccgcgggcacagc

SEQ ID NO: 5213500 - DNA, 21 bp, Homo sapiens
aggcccgcgggcacagccagc

SEQ ID NO: 5213501 - DNA, 20 bp, Homo sapiens
aggcccgctctacatcttct

SEQ ID NO: 5213502 - DNA, 19 bp, Homo sapiens
aggcccggaagcgccaggc

SEQ ID NO: 5213503 - DNA, 20 bp, Homo sapiens
aggcccggaagcgccaggct

SEQ ID NO: 5213504 - DNA, 21 bp, Homo sapiens
aggcccggaagcgccaggctg

SEQ ID NO: 5213505 - DNA, 14 bp, Homo sapiens
aggcccggccccat

SEQ ID NO: 5213506 - DNA, 13 bp, Homo sapiens
aggcccggcctat

SEQ ID NO: 5213507 - DNA, 15 bp, Homo sapiens
aggcccggcctctca

SEQ ID NO: 5213508 - DNA, 13 bp, Homo sapiens
aggcccggctcca

SEQ ID NO: 5213509 - DNA, 18 bp, Homo sapiens
aggcccggctccaggctc

SEQ ID NO: 5213510 - DNA, 20 bp, Homo sapiens
aggcccggctccaggctcct

SEQ ID NO: 5213511 - DNA, 18 bp, Homo sapiens
aggcccggctgagccccc

SEQ ID NO: 5213512 - DNA, 15 bp, Homo sapiens
aggcccgggaggagg

SEQ ID NO: 5213513 - DNA, 16 bp, Homo sapiens
aggcccgggaggagga

SEQ ID NO: 5213514 - DNA, 14 bp, Homo sapiens
aggcccggggctgg

SEQ ID NO: 5213515 - DNA, 16 bp, Homo sapiens
aggcccggtgaggcca

SEQ ID NO: 5213516 - DNA, 15 bp, Homo sapiens
aggcccgtcggagct

SEQ ID NO: 5213517 - DNA, 16 bp, Homo sapiens
aggcccgtcggagctg

SEQ ID NO: 5213518 - DNA, 20 bp, Homo sapiens
aggcccgtcggagctgcctg

SEQ ID NO: 5213519 - DNA, 15 bp, Homo sapiens
aggcccgtctgtcca

SEQ ID NO: 5213520 - DNA, 21 bp, Homo sapiens
aggcccgtctgtccatctgcc

SEQ ID NO: 5213521 - DNA, 23 bp, Homo sapiens
aggcccgtctgtccatctgcccg

SEQ ID NO: 5213522 - DNA, 21 bp, Homo sapiens
aggccctaccagagggaacac

SEQ ID NO: 5213523 - DNA, 22 bp, Homo sapiens
aggccctaggattcctccccca

SEQ ID NO: 5213524 - DNA, 19 bp, Homo sapiens
aggccctcaatccaccttc

SEQ ID NO: 5213525 - DNA, 12 bp, Homo sapiens
aggccctcagtg

SEQ ID NO: 5213526 - DNA, 14 bp, Homo sapiens
aggccctcagtgag

SEQ ID NO: 5213527 - DNA, 17 bp, Homo sapiens
aggccctccacacctgc

SEQ ID NO: 5213528 - DNA, 19 bp, Homo sapiens
aggccctccacacctgcgg

SEQ ID NO: 5213529 - DNA, 20 bp, Homo sapiens
aggccctccacacctgcggc

SEQ ID NO: 5213530 - DNA, 21 bp, Homo sapiens
aggccctccacacctgcggcc

SEQ ID NO: 5213531 - DNA, 13 bp, Homo sapiens
aggccctccagtg

SEQ ID NO: 5213532 - DNA, 15 bp, Homo sapiens
aggccctcccaaaga

SEQ ID NO: 5213533 - DNA, 23 bp, Homo sapiens
aggccctccctgactccctgtgg

SEQ ID NO: 5213534 - DNA, 16 bp, Homo sapiens
aggccctccctgtctc

SEQ ID NO: 5213535 - DNA, 20 bp, Homo sapiens
aggccctccctgttccccag

SEQ ID NO: 5213536 - DNA, 22 bp, Homo sapiens
aggccctccctgttccccagag

SEQ ID NO: 5213537 - DNA, 19 bp, Homo sapiens
aggccctcctccctcccag

SEQ ID NO: 5213538 - DNA, 21 bp, Homo sapiens
aggccctcctctcccatcctt

SEQ ID NO: 5213539 - DNA, 23 bp, Homo sapiens
aggccctcctctcccatccttga

SEQ ID NO: 5213540 - DNA, 23 bp, Homo sapiens
aggccctcctgctggctgaggct

SEQ ID NO: 5213541 - DNA, 21 bp, Homo sapiens
aggccctcctgtgctggggga

SEQ ID NO: 5213542 - DNA, 16 bp, Homo sapiens
aggggtgccctctgga

SEQ ID NO: 5213543 - DNA, 22 bp, Homo sapiens
aggggtgcggcggtcccagctc

SEQ ID NO: 5213544 - DNA, 12 bp, Homo sapiens
aggggtgctcct

SEQ ID NO: 5213545 - DNA, 20 bp, Homo sapiens
aggggtgctggggcagagtg

SEQ ID NO: 5213546 - DNA, 23 bp, Homo sapiens
aggggtgctggggcagagtggag

SEQ ID NO: 5213547 - DNA, 20 bp, Homo sapiens
aggggtgcttcctcctcagg

SEQ ID NO: 5213548 - DNA, 21 bp, Homo sapiens
aggggtggaagggcaggagct

SEQ ID NO: 5213549 - DNA, 23 bp, Homo sapiens
aggggtggaagggcaggagctca

SEQ ID NO: 5213550 - DNA, 14 bp, Homo sapiens
aggggtggagaagt

SEQ ID NO: 5213551 - DNA, 20 bp, Homo sapiens
aggggtggagactgcttccc

SEQ ID NO: 5213552 - DNA, 16 bp, Homo sapiens
aggggtggagtttctg

SEQ ID NO: 5213553 - DNA, 18 bp, Homo sapiens
aggggtggcccagagcca

SEQ ID NO: 5213554 - DNA, 21 bp, Homo sapiens
aggggtggccgggcacagtgg

SEQ ID NO: 5213555 - DNA, 18 bp, Homo sapiens
aggggtgggacaccctgt

SEQ ID NO: 5213556 - DNA, 15 bp, Homo sapiens
aggggtgggagagcc

SEQ ID NO: 5213557 - DNA, 18 bp, Homo sapiens
aggggtgggagagccagc

SEQ ID NO: 5213558 - DNA, 23 bp, Homo sapiens
aggggtgggcatccctcctggta

SEQ ID NO: 5213559 - DNA, 12 bp, Homo sapiens
aggggtggggag

SEQ ID NO: 5213560 - DNA, 17 bp, Homo sapiens
aggggtggggcccatgg

SEQ ID NO: 5213561 - DNA, 22 bp, Homo sapiens
aggggtgggggtgccgctctct

SEQ ID NO: 5213562 - DNA, 20 bp, Homo sapiens
aggggtgggttcctcttccc

SEQ ID NO: 5213563 - DNA, 17 bp, Homo sapiens
aggggtggtacttggca

SEQ ID NO: 5213564 - DNA, 23 bp, Homo sapiens
aggggtggtacttggcaccaata

SEQ ID NO: 5213565 - DNA, 15 bp, Homo sapiens
aggggtggtcctgac

SEQ ID NO: 5213566 - DNA, 21 bp, Homo sapiens
aggggtggtgagggcagttct

SEQ ID NO: 5213567 - DNA, 13 bp, Homo sapiens
aggggtgtcccag

SEQ ID NO: 5213568 - DNA, 22 bp, Homo sapiens
aggggtgtcccagtcccagcct

SEQ ID NO: 5213569 - DNA, 17 bp, Homo sapiens
aggggtgtccgagaggc

SEQ ID NO: 5213570 - DNA, 24 bp, Homo sapiens
aggggtgtcttgggcagagctggc

SEQ ID NO: 5213571 - DNA, 18 bp, Homo sapiens
aggggtgtggcagtggtt

SEQ ID NO: 5213572 - DNA, 15 bp, Homo sapiens
aggggtgtgggaaga

SEQ ID NO: 5213573 - DNA, 15 bp, Homo sapiens
aggggtgttaaaaca

SEQ ID NO: 5213574 - DNA, 21 bp, Homo sapiens
aggggtgttgtgagagctggg

SEQ ID NO: 5213575 - DNA, 18 bp, Homo sapiens
aggggttaacttggtcag

SEQ ID NO: 5213576 - DNA, 15 bp, Homo sapiens
aggggttacctccct

SEQ ID NO: 5213577 - DNA, 17 bp, Homo sapiens
aggggttacctccctcg

SEQ ID NO: 5213578 - DNA, 15 bp, Homo sapiens
aggggttagagcagg

SEQ ID NO: 5213579 - DNA, 19 bp, Homo sapiens
aggggttcccactggctcc

SEQ ID NO: 5213580 - DNA, 20 bp, Homo sapiens
aggggttcccactggctcct

SEQ ID NO: 5213581 - DNA, 18 bp, Homo sapiens
aggggttcccttgagggc

SEQ ID NO: 5213582 - DNA, 24 bp, Homo sapiens
aggggttcccttttttggctgctg

SEQ ID NO: 5213583 - DNA, 20 bp, Homo sapiens
aggggttcctcaaatttttt

SEQ ID NO: 5213584 - DNA, 22 bp, Homo sapiens
aggggttcctcccctccagctc

SEQ ID NO: 5213585 - DNA, 15 bp, Homo sapiens
aggggttcgagacca

SEQ ID NO: 5213586 - DNA, 20 bp, Homo sapiens
aggggttcgagaccagtctg

SEQ ID NO: 5213587 - DNA, 15 bp, Homo sapiens
aggggttgagggaag

SEQ ID NO: 5213588 - DNA, 21 bp, Homo sapiens
aggggttgccacaggcctccc

SEQ ID NO: 5213589 - DNA, 22 bp, Homo sapiens
aggggttgccacaggcctccct

SEQ ID NO: 5213590 - DNA, 17 bp, Homo sapiens
aggggttgcgggggagc

SEQ ID NO: 5213591 - DNA, 13 bp, Homo sapiens
aggggttggcagc

SEQ ID NO: 5213592 - DNA, 16 bp, Homo sapiens
aggggttggggaaaca

SEQ ID NO: 5213593 - DNA, 21 bp, Homo sapiens
aggggttggggtgacagtcat

SEQ ID NO: 5213594 - DNA, 19 bp, Homo sapiens
aggggttggtatctcaggt

SEQ ID NO: 5213595 - DNA, 20 bp, Homo sapiens
aggggttggtatctcaggtc

SEQ ID NO: 5213596 - DNA, 19 bp, Homo sapiens
aggggttggtgggagggtt

SEQ ID NO: 5213597 - DNA, 16 bp, Homo sapiens
aggggttgtcaagaga

SEQ ID NO: 5213598 - DNA, 15 bp, Homo sapiens
aggggtttacagtga

SEQ ID NO: 5213599 - DNA, 15 bp, Homo sapiens
aggggtttctaacac

SEQ ID NO: 5213600 - DNA, 21 bp, Homo sapiens
aggggtttgggagtcaggcct

SEQ ID NO: 5213601 - DNA, 14 bp, Homo sapiens
agggtaaacaatat

SEQ ID NO: 5213602 - DNA, 22 bp, Homo sapiens
agggtaaataaaccactgtgcg

SEQ ID NO: 5213603 - DNA, 22 bp, Homo sapiens
agggtaacttgtttttattgca

SEQ ID NO: 5213604 - DNA, 16 bp, Homo sapiens
agggtaattttctaac

SEQ ID NO: 5213605 - DNA, 20 bp, Homo sapiens
agggtacagatccccagccc

SEQ ID NO: 5213606 - DNA, 14 bp, Homo sapiens
agggtacagcccag

SEQ ID NO: 5213607 - DNA, 14 bp, Homo sapiens
agggtacatggtgc

SEQ ID NO: 5213608 - DNA, 18 bp, Homo sapiens
agggtacatggtgctggg

SEQ ID NO: 5213609 - DNA, 13 bp, Homo sapiens
agggtacatttat

SEQ ID NO: 5213610 - DNA, 21 bp, Homo sapiens
agggtaccaatcctggcagga

SEQ ID NO: 5213611 - DNA, 15 bp, Homo sapiens
agggtaccagcagaa

SEQ ID NO: 5213612 - DNA, 18 bp, Homo sapiens
agggtaccaggataaagc

SEQ ID NO: 5213613 - DNA, 18 bp, Homo sapiens
agggtaccctttggggag

SEQ ID NO: 5213614 - DNA, 21 bp, Homo sapiens
agggtaccctttggggagcag

SEQ ID NO: 5213615 - DNA, 15 bp, Homo sapiens
agggtacctgaaaga

SEQ ID NO: 5213616 - DNA, 19 bp, Homo sapiens
agggtactaaaagaaacta

SEQ ID NO: 5213617 - DNA, 13 bp, Homo sapiens
agggtactaaatt

SEQ ID NO: 5213618 - DNA, 17 bp, Homo sapiens
agggtactaaatttaaa

SEQ ID NO: 5213619 - DNA, 19 bp, Homo sapiens
agggtactttattttgctt

SEQ ID NO: 5213620 - DNA, 19 bp, Homo sapiens
agggtagaaaactccaggg

SEQ ID NO: 5213621 - DNA, 22 bp, Homo sapiens
agggtagaattgtttggcaatg

SEQ ID NO: 5213622 - DNA, 17 bp, Homo sapiens
agggtagagcaaaggag

SEQ ID NO: 5213623 - DNA, 21 bp, Homo sapiens
agggtagcagcagaggcagga

SEQ ID NO: 5213624 - DNA, 20 bp, Homo sapiens
agggtagccccctcatctgc

SEQ ID NO: 5213625 - DNA, 13 bp, Homo sapiens
agggtaggcaagg

SEQ ID NO: 5213626 - DNA, 18 bp, Homo sapiens
agggtaggcagcctgaga

SEQ ID NO: 5213627 - DNA, 16 bp, Homo sapiens
agggtaggcaggattg

SEQ ID NO: 5213628 - DNA, 14 bp, Homo sapiens
agggtagggcagca

SEQ ID NO: 5213629 - DNA, 17 bp, Homo sapiens
agggtagggcagcagat

SEQ ID NO: 5213630 - DNA, 19 bp, Homo sapiens
agggtaggggagggtgggg

SEQ ID NO: 5213631 - DNA, 14 bp, Homo sapiens
agggtaggggagtg

SEQ ID NO: 5213632 - DNA, 12 bp, Homo sapiens
agggtagggtgg

SEQ ID NO: 5213633 - DNA, 14 bp, Homo sapiens
agggtaggtggggc

SEQ ID NO: 5213634 - DNA, 21 bp, Homo sapiens
agggtatatacaaattaaaac

SEQ ID NO: 5213635 - DNA, 21 bp, Homo sapiens
agggtatcaggtgctgccatc

SEQ ID NO: 5213636 - DNA, 20 bp, Homo sapiens
agggtatccaagttggactg

SEQ ID NO: 5213637 - DNA, 16 bp, Homo sapiens
agggtatgaagagctg

SEQ ID NO: 5213638 - DNA, 17 bp, Homo sapiens
agggtatgggaagccat

SEQ ID NO: 5213639 - DNA, 21 bp, Homo sapiens
agggtatgtcagctacatgaa

SEQ ID NO: 5213640 - DNA, 20 bp, Homo sapiens
agggtcaacatcttttacat

SEQ ID NO: 5213641 - DNA, 15 bp, Homo sapiens
agggtcaagcctctt

SEQ ID NO: 5213642 - DNA, 22 bp, Homo sapiens
agggtcaccaggttgggaacat

SEQ ID NO: 5213643 - DNA, 20 bp, Homo sapiens
agggtcactggcctctcccc

SEQ ID NO: 5213644 - DNA, 19 bp, Homo sapiens
agggtcactggggcccaag

SEQ ID NO: 5213645 - DNA, 23 bp, Homo sapiens
agggtcagccagggcctgcgagg

SEQ ID NO: 5213646 - DNA, 13 bp, Homo sapiens
agggtcaggaagg

SEQ ID NO: 5213647 - DNA, 13 bp, Homo sapiens
agggtcaggcccg

SEQ ID NO: 5213648 - DNA, 14 bp, Homo sapiens
agggtcaggccttt

SEQ ID NO: 5213649 - DNA, 22 bp, Homo sapiens
agggtcaggcctttgagctcag

SEQ ID NO: 5213650 - DNA, 17 bp, Homo sapiens
agggtcaggcggagctg

SEQ ID NO: 5213651 - DNA, 12 bp, Homo sapiens
agggtcatttct

SEQ ID NO: 5213652 - DNA, 19 bp, Homo sapiens
agggtcattttcctttctg

SEQ ID NO: 5213653 - DNA, 13 bp, Homo sapiens
agggtccacagct

SEQ ID NO: 5213654 - DNA, 16 bp, Homo sapiens
agggtccacagctgga

SEQ ID NO: 5213655 - DNA, 23 bp, Homo sapiens
agggtccacaggaagtgaagaat

SEQ ID NO: 5213656 - DNA, 19 bp, Homo sapiens
agggtccagaaggagacag

SEQ ID NO: 5213657 - DNA, 14 bp, Homo sapiens
agggtccagactgt

SEQ ID NO: 5213658 - DNA, 13 bp, Homo sapiens
agggtccagccct

SEQ ID NO: 5213659 - DNA, 20 bp, Homo sapiens
agggtccaggaatggtgctt

SEQ ID NO: 5213660 - DNA, 17 bp, Homo sapiens
agggtcccaagctgggc

SEQ ID NO: 5213661 - DNA, 23 bp, Homo sapiens
agggtcccacccccaacccccag

SEQ ID NO: 5213662 - DNA, 13 bp, Homo sapiens
agggtcccagggc

SEQ ID NO: 5213663 - DNA, 15 bp, Homo sapiens
agggtcccagggctg

SEQ ID NO: 5213664 - DNA, 20 bp, Homo sapiens
agggtcccatttctcactga

SEQ ID NO: 5213665 - DNA, 15 bp, Homo sapiens
agggtccccagctgg

SEQ ID NO: 5213666 - DNA, 22 bp, Homo sapiens
agggtcccggtgtatcctggcc

SEQ ID NO: 5213667 - DNA, 12 bp, Homo sapiens
agggtccctctg

SEQ ID NO: 5213668 - DNA, 15 bp, Homo sapiens
agggtccctctgtgt

SEQ ID NO: 5213669 - DNA, 20 bp, Homo sapiens
agggtccctctgtgtatttg

SEQ ID NO: 5213670 - DNA, 21 bp, Homo sapiens
agggtccctgaacgccctggt

SEQ ID NO: 5213671 - DNA, 16 bp, Homo sapiens
agggtccctgcccact

SEQ ID NO: 5213672 - DNA, 12 bp, Homo sapiens
agggtccctggg

SEQ ID NO: 5213673 - DNA, 14 bp, Homo sapiens
agggtccctggtgg

SEQ ID NO: 5213674 - DNA, 16 bp, Homo sapiens
agggtccctggtggca

SEQ ID NO: 5213675 - DNA, 22 bp, Homo sapiens
agggtccgcaccagctgctctg

SEQ ID NO: 5213676 - DNA, 23 bp, Homo sapiens
agggtccgcaccagctgctctgc

SEQ ID NO: 5213677 - DNA, 24 bp, Homo sapiens
agggtccgcaccagctgctctgcc

SEQ ID NO: 5213678 - DNA, 22 bp, Homo sapiens
agggtcctcaggcagtggccca

SEQ ID NO: 5213679 - DNA, 21 bp, Homo sapiens
agggtcctctcttccacagtg

SEQ ID NO: 5213680 - DNA, 15 bp, Homo sapiens
agggtcctcttttcc

SEQ ID NO: 5213681 - DNA, 14 bp, Homo sapiens
agggtcctgctttc

SEQ ID NO: 5213682 - DNA, 22 bp, Homo sapiens
agggtcctgtcgaaggggaggc

SEQ ID NO: 5213683 - DNA, 23 bp, Homo sapiens
agggtcctgtcgaaggggaggca

SEQ ID NO: 5213684 - DNA, 14 bp, Homo sapiens
agggtccttccctc

SEQ ID NO: 5213685 - DNA, 20 bp, Homo sapiens
agggtcctttagtacctgaa

SEQ ID NO: 5213686 - DNA, 22 bp, Homo sapiens
agggtccttttgacactgctct

SEQ ID NO: 5213687 - DNA, 14 bp, Homo sapiens
agggtcgaaagctc

SEQ ID NO: 5213688 - DNA, 16 bp, Homo sapiens
agggtcgaaagctcta

SEQ ID NO: 5213689 - DNA, 22 bp, Homo sapiens
agggtcgaaagctctagaatct

SEQ ID NO: 5213690 - DNA, 16 bp, Homo sapiens
agggtcggggaggagg

SEQ ID NO: 5213691 - DNA, 22 bp, Homo sapiens
agggtcgtgggaaaggggagta

SEQ ID NO: 5213692 - DNA, 20 bp, Homo sapiens
agggtctagccgctgccctg

SEQ ID NO: 5213693 - DNA, 15 bp, Homo sapiens
agggtctagggagag

SEQ ID NO: 5213694 - DNA, 16 bp, Homo sapiens
agggtctatcttgtaa

SEQ ID NO: 5213695 - DNA, 19 bp, Homo sapiens
agggtctatcttgtaaata

SEQ ID NO: 5213696 - DNA, 23 bp, Homo sapiens
agggtctcactatgttgcccagg

SEQ ID NO: 5213697 - DNA, 15 bp, Homo sapiens
agggtctcactctgt

SEQ ID NO: 5213698 - DNA, 18 bp, Homo sapiens
agggtctcactctgttga

SEQ ID NO: 5213699 - DNA, 23 bp, Homo sapiens
agggtctccctatgttgcccagg

SEQ ID NO: 5213700 - DNA, 16 bp, Homo sapiens
agggtctccctgggca

SEQ ID NO: 5213701 - DNA, 21 bp, Homo sapiens
agggtctcgaactcctggcct

SEQ ID NO: 5213702 - DNA, 18 bp, Homo sapiens
agggtctcgctgtcactg

SEQ ID NO: 5213703 - DNA, 17 bp, Homo sapiens
agggtctctctccaggt

SEQ ID NO: 5213704 - DNA, 19 bp, Homo sapiens
agggtctctctccaggtca

SEQ ID NO: 5213705 - DNA, 20 bp, Homo sapiens
agggtctctctccaggtcag

SEQ ID NO: 5213706 - DNA, 14 bp, Homo sapiens
agggtctctgctcc

SEQ ID NO: 5213707 - DNA, 17 bp, Homo sapiens
agggtctctgctccagc

SEQ ID NO: 5213708 - DNA, 13 bp, Homo sapiens
agggtctctgctg

SEQ ID NO: 5213709 - DNA, 14 bp, Homo sapiens
agggtctctgctgc

SEQ ID NO: 5213710 - DNA, 15 bp, Homo sapiens
agggtctctgctgcc

SEQ ID NO: 5213711 - DNA, 15 bp, Homo sapiens
agggtctcttccttc

SEQ ID NO: 5213712 - DNA, 10 bp, Homo sapiens
agggtctgaa

SEQ ID NO: 5213713 - DNA, 13 bp, Homo sapiens
agggtctgaaagg

SEQ ID NO: 5213714 - DNA, 15 bp, Homo sapiens
agggtctgaaagggg

SEQ ID NO: 5213715 - DNA, 11 bp, Homo sapiens
agggtctgagt

SEQ ID NO: 5213716 - DNA, 17 bp, Homo sapiens
agggtctgcagggaatt

SEQ ID NO: 5213717 - DNA, 17 bp, Homo sapiens
agggtctgcctccagcc

SEQ ID NO: 5213718 - DNA, 18 bp, Homo sapiens
agggtctgcctccagcca

SEQ ID NO: 5213719 - DNA, 13 bp, Homo sapiens
aggccctcggagc

SEQ ID NO: 5213720 - DNA, 19 bp, Homo sapiens
aggccctcggagctggctg

SEQ ID NO: 5213721 - DNA, 18 bp, Homo sapiens
aggccctcgggcccagcc

SEQ ID NO: 5213722 - DNA, 15 bp, Homo sapiens
aggccctctctgcag

SEQ ID NO: 5213723 - DNA, 12 bp, Homo sapiens
aggccctctgcc

SEQ ID NO: 5213724 - DNA, 15 bp, Homo sapiens
aggccctctgcccac

SEQ ID NO: 5213725 - DNA, 17 bp, Homo sapiens
aggccctctgcccactc

SEQ ID NO: 5213726 - DNA, 21 bp, Homo sapiens
aggccctctgcccactccctg

SEQ ID NO: 5213727 - DNA, 22 bp, Homo sapiens
aggccctctgcccactccctgc

SEQ ID NO: 5213728 - DNA, 13 bp, Homo sapiens
aggccctctggag

SEQ ID NO: 5213729 - DNA, 13 bp, Homo sapiens
aggccctctgtgg

SEQ ID NO: 5213730 - DNA, 16 bp, Homo sapiens
aggccctgactcctct

SEQ ID NO: 5213731 - DNA, 17 bp, Homo sapiens
aggccctgactcctctg

SEQ ID NO: 5213732 - DNA, 18 bp, Homo sapiens
aggccctgactcctctgg

SEQ ID NO: 5213733 - DNA, 19 bp, Homo sapiens
aggccctgactcctctggc

SEQ ID NO: 5213734 - DNA, 16 bp, Homo sapiens
aggccctgcactgtcc

SEQ ID NO: 5213735 - DNA, 23 bp, Homo sapiens
aggccctgcactgtcctgctcca

SEQ ID NO: 5213736 - DNA, 11 bp, Homo sapiens
aggccctgcat

SEQ ID NO: 5213737 - DNA, 18 bp, Homo sapiens
aggccctgcatctgtctg

SEQ ID NO: 5213738 - DNA, 19 bp, Homo sapiens
aggccctgcatctgtctgc

SEQ ID NO: 5213739 - DNA, 12 bp, Homo sapiens
aggccctgcatg

SEQ ID NO: 5213740 - DNA, 20 bp, Homo sapiens
aggccctgccattggcctct

SEQ ID NO: 5213741 - DNA, 11 bp, Homo sapiens
aggccctgccc

SEQ ID NO: 5213742 - DNA, 12 bp, Homo sapiens
aggccctgccca

SEQ ID NO: 5213743 - DNA, 21 bp, Homo sapiens
aggccctgcccagccagccat

SEQ ID NO: 5213744 - DNA, 14 bp, Homo sapiens
aggccctgccccca

SEQ ID NO: 5213745 - DNA, 14 bp, Homo sapiens
aggccctgccctgc

SEQ ID NO: 5213746 - DNA, 17 bp, Homo sapiens
aggccctgccctgccca

SEQ ID NO: 5213747 - DNA, 14 bp, Homo sapiens
aggccctgcctccg

SEQ ID NO: 5213748 - DNA, 13 bp, Homo sapiens
aggccctgcctga

SEQ ID NO: 5213749 - DNA, 16 bp, Homo sapiens
aggccctgccttcagc

SEQ ID NO: 5213750 - DNA, 18 bp, Homo sapiens
aggccctgctcctgcagc

SEQ ID NO: 5213751 - DNA, 19 bp, Homo sapiens
aggccctgctcctgcagca

SEQ ID NO: 5213752 - DNA, 21 bp, Homo sapiens
aggccctgctcctgcagcatg

SEQ ID NO: 5213753 - DNA, 22 bp, Homo sapiens
aggccctgctcctgcagcatgg

SEQ ID NO: 5213754 - DNA, 15 bp, Homo sapiens
aggccctgctgccca

SEQ ID NO: 5213755 - DNA, 13 bp, Homo sapiens
aggccctggaggg

SEQ ID NO: 5213756 - DNA, 17 bp, Homo sapiens
aggccctggagggaagg

SEQ ID NO: 5213757 - DNA, 14 bp, Homo sapiens
aggccctggagggc

SEQ ID NO: 5213758 - DNA, 17 bp, Homo sapiens
aggccctggagggcaga

SEQ ID NO: 5213759 - DNA, 21 bp, Homo sapiens
aggccctggatcagcgtggcc

SEQ ID NO: 5213760 - DNA, 23 bp, Homo sapiens
aggccctggatcagcgtggcctt

SEQ ID NO: 5213761 - DNA, 22 bp, Homo sapiens
aggccctggatgtgcccacagg

SEQ ID NO: 5213762 - DNA, 10 bp, Homo sapiens
aggccctggc

SEQ ID NO: 5213763 - DNA, 13 bp, Homo sapiens
aggccctggccct

SEQ ID NO: 5213764 - DNA, 19 bp, Homo sapiens
aggccctggccctttcccc

SEQ ID NO: 5213765 - DNA, 22 bp, Homo sapiens
aggccctggcctcccctgccac

SEQ ID NO: 5213766 - DNA, 23 bp, Homo sapiens
aggccctggcctcccctgccacc

SEQ ID NO: 5213767 - DNA, 17 bp, Homo sapiens
aggccctgggcctccac

SEQ ID NO: 5213768 - DNA, 13 bp, Homo sapiens
aggccctgggctg

SEQ ID NO: 5213769 - DNA, 17 bp, Homo sapiens
aggccctgggtaagaag

SEQ ID NO: 5213770 - DNA, 13 bp, Homo sapiens
aggccctggtctg

SEQ ID NO: 5213771 - DNA, 16 bp, Homo sapiens
aggccctggtctggct

SEQ ID NO: 5213772 - DNA, 17 bp, Homo sapiens
aggccctggtctggctt

SEQ ID NO: 5213773 - DNA, 20 bp, Homo sapiens
aggccctggtgtcaggcagg

SEQ ID NO: 5213774 - DNA, 13 bp, Homo sapiens
aggccctgtccca

SEQ ID NO: 5213775 - DNA, 14 bp, Homo sapiens
aggccctgtcccag

SEQ ID NO: 5213776 - DNA, 14 bp, Homo sapiens
aggccctgtctgta

SEQ ID NO: 5213777 - DNA, 11 bp, Homo sapiens
aggccctgtga

SEQ ID NO: 5213778 - DNA, 17 bp, Homo sapiens
aggccctgtgagcacaa

SEQ ID NO: 5213779 - DNA, 18 bp, Homo sapiens
aggccctgtgagcacaaa

SEQ ID NO: 5213780 - DNA, 13 bp, Homo sapiens
aggccctgtgccc

SEQ ID NO: 5213781 - DNA, 19 bp, Homo sapiens
aggccctgtggtctgggga

SEQ ID NO: 5213782 - DNA, 17 bp, Homo sapiens
aggccctgttccctgga

SEQ ID NO: 5213783 - DNA, 16 bp, Homo sapiens
aggcccttagagggaa

SEQ ID NO: 5213784 - DNA, 17 bp, Homo sapiens
aggcccttagggaagtt

SEQ ID NO: 5213785 - DNA, 16 bp, Homo sapiens
aggcccttattttcaa

SEQ ID NO: 5213786 - DNA, 18 bp, Homo sapiens
aggcccttcctctccact

SEQ ID NO: 5213787 - DNA, 19 bp, Homo sapiens
aggcccttctctccagccc

SEQ ID NO: 5213788 - DNA, 20 bp, Homo sapiens
aggcccttctctccagcccc

SEQ ID NO: 5213789 - DNA, 23 bp, Homo sapiens
aggcccttctctccagcccctgg

SEQ ID NO: 5213790 - DNA, 22 bp, Homo sapiens
aggcccttggggttcccccaga

SEQ ID NO: 5213791 - DNA, 23 bp, Homo sapiens
aggcccttggggttcccccagac

SEQ ID NO: 5213792 - DNA, 13 bp, Homo sapiens
aggcccttgtcct

SEQ ID NO: 5213793 - DNA, 15 bp, Homo sapiens
aggcccttgtcctgc

SEQ ID NO: 5213794 - DNA, 17 bp, Homo sapiens
aggcccttgtcgtggga

SEQ ID NO: 5213795 - DNA, 16 bp, Homo sapiens
aggccctttcctcagg

SEQ ID NO: 5213796 - DNA, 16 bp, Homo sapiens
aggccctttcctttgg

SEQ ID NO: 5213797 - DNA, 13 bp, Homo sapiens
aggccctttggct

SEQ ID NO: 5213798 - DNA, 16 bp, Homo sapiens
aggccctttggcttct

SEQ ID NO: 5213799 - DNA, 17 bp, Homo sapiens
aggccctttggcttctg

SEQ ID NO: 5213800 - DNA, 14 bp, Homo sapiens
aggcccttttctgg

SEQ ID NO: 5213801 - DNA, 17 bp, Homo sapiens
aggcccttttctggctc

SEQ ID NO: 5213802 - DNA, 18 bp, Homo sapiens
aggcccttttctggctcc

SEQ ID NO: 5213803 - DNA, 17 bp, Homo sapiens
aggccgaagaagggtcc

SEQ ID NO: 5213804 - DNA, 22 bp, Homo sapiens
aggccgaagaagggtccttccc

SEQ ID NO: 5213805 - DNA, 16 bp, Homo sapiens
aggccgaagctctggc

SEQ ID NO: 5213806 - DNA, 17 bp, Homo sapiens
aggccgaagctctggct

SEQ ID NO: 5213807 - DNA, 18 bp, Homo sapiens
aggccgaaggtgcctcag

SEQ ID NO: 5213808 - DNA, 20 bp, Homo sapiens
aggccgacaggaggccatgc

SEQ ID NO: 5213809 - DNA, 22 bp, Homo sapiens
aggccgacaggaggccatgccc

SEQ ID NO: 5213810 - DNA, 18 bp, Homo sapiens
aggccgacgttttctccg

SEQ ID NO: 5213811 - DNA, 22 bp, Homo sapiens
aggccgactgggctgctggggc

SEQ ID NO: 5213812 - DNA, 17 bp, Homo sapiens
aggccgagaagccagtg

SEQ ID NO: 5213813 - DNA, 15 bp, Homo sapiens
aggccgagagcctta

SEQ ID NO: 5213814 - DNA, 17 bp, Homo sapiens
aggccgagcccacacca

SEQ ID NO: 5213815 - DNA, 18 bp, Homo sapiens
aggccgagcgttcccagc

SEQ ID NO: 5213816 - DNA, 21 bp, Homo sapiens
aggccgagcgttcccagcagg

SEQ ID NO: 5213817 - DNA, 23 bp, Homo sapiens
aggccgagcgttcccagcagggg

SEQ ID NO: 5213818 - DNA, 20 bp, Homo sapiens
aggccgaggaccaccagcag

SEQ ID NO: 5213819 - DNA, 16 bp, Homo sapiens
aggccgaggagagagg

SEQ ID NO: 5213820 - DNA, 14 bp, Homo sapiens
aggccgaggcaggg

SEQ ID NO: 5213821 - DNA, 19 bp, Homo sapiens
aggccgaggcaggggctgg

SEQ ID NO: 5213822 - DNA, 16 bp, Homo sapiens
aggccgaggcaggtgg

SEQ ID NO: 5213823 - DNA, 13 bp, Homo sapiens
aggccgagggcca

SEQ ID NO: 5213824 - DNA, 13 bp, Homo sapiens
aggccgaggtagg

SEQ ID NO: 5213825 - DNA, 16 bp, Homo sapiens
aggccgaggtgggcag

SEQ ID NO: 5213826 - DNA, 16 bp, Homo sapiens
aggccgagtctgtcct

SEQ ID NO: 5213827 - DNA, 14 bp, Homo sapiens
aggccgcaagggga

SEQ ID NO: 5213828 - DNA, 14 bp, Homo sapiens
aggccgcatggccc

SEQ ID NO: 5213829 - DNA, 12 bp, Homo sapiens
aggccgccagcg

SEQ ID NO: 5213830 - DNA, 21 bp, Homo sapiens
aggccgccagcgtgtggagca

SEQ ID NO: 5213831 - DNA, 22 bp, Homo sapiens
aggccgccagcgtgtggagcag

SEQ ID NO: 5213832 - DNA, 24 bp, Homo sapiens
aggccgccctgagcatcctggttc

SEQ ID NO: 5213833 - DNA, 15 bp, Homo sapiens
aggccgccgtgacct

SEQ ID NO: 5213834 - DNA, 13 bp, Homo sapiens
aggccgcctgcca

SEQ ID NO: 5213835 - DNA, 14 bp, Homo sapiens
aggccgcctgccat

SEQ ID NO: 5213836 - DNA, 12 bp, Homo sapiens
aggccgcgccca

SEQ ID NO: 5213837 - DNA, 16 bp, Homo sapiens
aggccgcgcccagcag

SEQ ID NO: 5213838 - DNA, 14 bp, Homo sapiens
aggccgctgcaggg

SEQ ID NO: 5213839 - DNA, 19 bp, Homo sapiens
aggccgctgccccagcccc

SEQ ID NO: 5213840 - DNA, 14 bp, Homo sapiens
aggccgctgcccct

SEQ ID NO: 5213841 - DNA, 16 bp, Homo sapiens
aggccgctgctgacca

SEQ ID NO: 5213842 - DNA, 16 bp, Homo sapiens
aggccgcttagtgctg

SEQ ID NO: 5213843 - DNA, 23 bp, Homo sapiens
aggccgcttagtgctgctttgct

SEQ ID NO: 5213844 - DNA, 18 bp, Homo sapiens
aggccggaaccacagggc

SEQ ID NO: 5213845 - DNA, 20 bp, Homo sapiens
aggccggaaccacagggcca

SEQ ID NO: 5213846 - DNA, 21 bp, Homo sapiens
aggccggaaccacagggccag

SEQ ID NO: 5213847 - DNA, 23 bp, Homo sapiens
aggccggaaccacagggccagag

SEQ ID NO: 5213848 - DNA, 19 bp, Homo sapiens
aggccggagacccacagcc

SEQ ID NO: 5213849 - DNA, 16 bp, Homo sapiens
aggccggagagctggt

SEQ ID NO: 5213850 - DNA, 23 bp, Homo sapiens
aggccggagaggagttcaggaac

SEQ ID NO: 5213851 - DNA, 13 bp, Homo sapiens
aggccggagccca

SEQ ID NO: 5213852 - DNA, 16 bp, Homo sapiens
aggccggcagccccag

SEQ ID NO: 5213853 - DNA, 22 bp, Homo sapiens
aggccggcagccccagcctgct

SEQ ID NO: 5213854 - DNA, 18 bp, Homo sapiens
aggccggcagcgggcgga

SEQ ID NO: 5213855 - DNA, 15 bp, Homo sapiens
aggccggccagctcc

SEQ ID NO: 5213856 - DNA, 14 bp, Homo sapiens
aggccggccctgcc

SEQ ID NO: 5213857 - DNA, 15 bp, Homo sapiens
aggccggccctgccc

SEQ ID NO: 5213858 - DNA, 19 bp, Homo sapiens
aggccggccctgcccctcc

SEQ ID NO: 5213859 - DNA, 21 bp, Homo sapiens
aggccggccctgcccctccct

SEQ ID NO: 5213860 - DNA, 24 bp, Homo sapiens
aggccggccctgcccctccctaga

SEQ ID NO: 5213861 - DNA, 21 bp, Homo sapiens
aggccgggaagagccacctgg

SEQ ID NO: 5213862 - DNA, 14 bp, Homo sapiens
aggccgggcagagc

SEQ ID NO: 5213863 - DNA, 20 bp, Homo sapiens
aggccgggcctgtacagtct

SEQ ID NO: 5213864 - DNA, 17 bp, Homo sapiens
aggccgggcttgggccc

SEQ ID NO: 5213865 - DNA, 23 bp, Homo sapiens
aggccgggcttgggccctgcaca

SEQ ID NO: 5213866 - DNA, 17 bp, Homo sapiens
aggccggggggagcagg

SEQ ID NO: 5213867 - DNA, 14 bp, Homo sapiens
aggccggtgtgcct

SEQ ID NO: 5213868 - DNA, 23 bp, Homo sapiens
aggccgtatgaagacagaggcag

SEQ ID NO: 5213869 - DNA, 13 bp, Homo sapiens
aggccgtcctccc

SEQ ID NO: 5213870 - DNA, 23 bp, Homo sapiens
aggccgtgcctggtggggcggac

SEQ ID NO: 5213871 - DNA, 18 bp, Homo sapiens
aggccgtgggacccaggc

SEQ ID NO: 5213872 - DNA, 23 bp, Homo sapiens
aggccgtgggacccaggctccca

SEQ ID NO: 5213873 - DNA, 14 bp, Homo sapiens
aggccgtgtctctg

SEQ ID NO: 5213874 - DNA, 13 bp, Homo sapiens
aggccgttcccct

SEQ ID NO: 5213875 - DNA, 21 bp, Homo sapiens
aggccgttccccttggcttcc

SEQ ID NO: 5213876 - DNA, 14 bp, Homo sapiens
aggccgtttgcttt

SEQ ID NO: 5213877 - DNA, 15 bp, Homo sapiens
aggccgtttgctttt

SEQ ID NO: 5213878 - DNA, 16 bp, Homo sapiens
aggcctaaaagtaaac

SEQ ID NO: 5213879 - DNA, 13 bp, Homo sapiens
aggcctaagacat

SEQ ID NO: 5213880 - DNA, 16 bp, Homo sapiens
aggcctaccccagttc

SEQ ID NO: 5213881 - DNA, 23 bp, Homo sapiens
aggcctaccccagttcctagcac

SEQ ID NO: 5213882 - DNA, 20 bp, Homo sapiens
aggcctacctcaagttcttg

SEQ ID NO: 5213883 - DNA, 21 bp, Homo sapiens
aggcctacctcaagttcttgg

SEQ ID NO: 5213884 - DNA, 22 bp, Homo sapiens
aggcctacctcaagttcttgga

SEQ ID NO: 5213885 - DNA, 18 bp, Homo sapiens
aggcctacctgctcccct

SEQ ID NO: 5213886 - DNA, 16 bp, Homo sapiens
aggcctagactctgtc

SEQ ID NO: 5213887 - DNA, 17 bp, Homo sapiens
aggcctagagtggcagc

SEQ ID NO: 5213888 - DNA, 17 bp, Homo sapiens
aggcctaggacctatgt

SEQ ID NO: 5213889 - DNA, 18 bp, Homo sapiens
aggcctaggacctatgtt

SEQ ID NO: 5213890 - DNA, 20 bp, Homo sapiens
aggcctaggctaggacgttg

SEQ ID NO: 5213891 - DNA, 21 bp, Homo sapiens
aggcctagtacaatcttggga

SEQ ID NO: 5213892 - DNA, 20 bp, Homo sapiens
aggcctagtcagccacatgg

SEQ ID NO: 5213893 - DNA, 22 bp, Homo sapiens
aggcctataatgaagctttata

SEQ ID NO: 5213894 - DNA, 14 bp, Homo sapiens
aggcctatcaacct

SEQ ID NO: 5213895 - DNA, 22 bp, Homo sapiens
aggcctatgcagacatctctgg

SEQ ID NO: 5213896 - DNA, 18 bp, Homo sapiens
aggcctatttaacaagat

SEQ ID NO: 5213897 - DNA, 14 bp, Homo sapiens
aggcctatttcatc

SEQ ID NO: 5213898 - DNA, 21 bp, Homo sapiens
agggtctgctctttctctgcc

SEQ ID NO: 5213899 - DNA, 14 bp, Homo sapiens
agggtctggagaag

SEQ ID NO: 5213900 - DNA, 12 bp, Homo sapiens
agggtctggcag

SEQ ID NO: 5213901 - DNA, 20 bp, Homo sapiens
agggtctggcagagcctctg

SEQ ID NO: 5213902 - DNA, 23 bp, Homo sapiens
agggtctggcagagcctctgaga

SEQ ID NO: 5213903 - DNA, 22 bp, Homo sapiens
agggtctgggaaatgagcaggg

SEQ ID NO: 5213904 - DNA, 12 bp, Homo sapiens
agggtctgggac

SEQ ID NO: 5213905 - DNA, 13 bp, Homo sapiens
agggtctgggatc

SEQ ID NO: 5213906 - DNA, 15 bp, Homo sapiens
agggtctgggatgaa

SEQ ID NO: 5213907 - DNA, 18 bp, Homo sapiens
agggtctgggggcagctg

SEQ ID NO: 5213908 - DNA, 21 bp, Homo sapiens
agggtctgggggcagctgtcc

SEQ ID NO: 5213909 - DNA, 23 bp, Homo sapiens
agggtctgggggcagctgtcctg

SEQ ID NO: 5213910 - DNA, 20 bp, Homo sapiens
agggtctgtaggttgcacac

SEQ ID NO: 5213911 - DNA, 13 bp, Homo sapiens
agggtctgtgtga

SEQ ID NO: 5213912 - DNA, 18 bp, Homo sapiens
agggtctgtgtgaatgtg

SEQ ID NO: 5213913 - DNA, 15 bp, Homo sapiens
agggtctgttgtaaa

SEQ ID NO: 5213914 - DNA, 17 bp, Homo sapiens
agggtcttccctacctc

SEQ ID NO: 5213915 - DNA, 18 bp, Homo sapiens
agggtcttcttggcagct

SEQ ID NO: 5213916 - DNA, 15 bp, Homo sapiens
agggtcttgagggga

SEQ ID NO: 5213917 - DNA, 23 bp, Homo sapiens
agggtcttgggctactggcagct

SEQ ID NO: 5213918 - DNA, 22 bp, Homo sapiens
agggtctttctgatgacgcctg

SEQ ID NO: 5213919 - DNA, 14 bp, Homo sapiens
agggtctttgcaga

SEQ ID NO: 5213920 - DNA, 19 bp, Homo sapiens
agggtcttttaccctgtgt

SEQ ID NO: 5213921 - DNA, 18 bp, Homo sapiens
agggtcttttcatctggg

SEQ ID NO: 5213922 - DNA, 18 bp, Homo sapiens
agggtctttttctagggt

SEQ ID NO: 5213923 - DNA, 15 bp, Homo sapiens
agggtgaaaattatt

SEQ ID NO: 5213924 - DNA, 19 bp, Homo sapiens
agggtgaaacttaaaaaaa

SEQ ID NO: 5213925 - DNA, 14 bp, Homo sapiens
agggtgaaggagaa

SEQ ID NO: 5213926 - DNA, 15 bp, Homo sapiens
agggtgaataaagca

SEQ ID NO: 5213927 - DNA, 19 bp, Homo sapiens
agggtgaataaagcaggga

SEQ ID NO: 5213928 - DNA, 17 bp, Homo sapiens
agggtgacatcccagga

SEQ ID NO: 5213929 - DNA, 22 bp, Homo sapiens
agggtgacccacagctctgggc

SEQ ID NO: 5213930 - DNA, 15 bp, Homo sapiens
agggtgacgcccagc

SEQ ID NO: 5213931 - DNA, 16 bp, Homo sapiens
agggtgacgcccagct

SEQ ID NO: 5213932 - DNA, 15 bp, Homo sapiens
agggtgacgcctgag

SEQ ID NO: 5213933 - DNA, 16 bp, Homo sapiens
agggtgacgcctgaga

SEQ ID NO: 5213934 - DNA, 21 bp, Homo sapiens
agggtgacgcctgagacagca

SEQ ID NO: 5213935 - DNA, 14 bp, Homo sapiens
agggtgagaagcta

SEQ ID NO: 5213936 - DNA, 13 bp, Homo sapiens
agggtgagaaggg

SEQ ID NO: 5213937 - DNA, 17 bp, Homo sapiens
agggtgagaagggcagg

SEQ ID NO: 5213938 - DNA, 23 bp, Homo sapiens
agggtgagcagggccctcagagg

SEQ ID NO: 5213939 - DNA, 24 bp, Homo sapiens
agggtgagcagggccctcagagga

SEQ ID NO: 5213940 - DNA, 21 bp, Homo sapiens
agggtgagcagggtcaagcct

SEQ ID NO: 5213941 - DNA, 12 bp, Homo sapiens
agggtgagccca

SEQ ID NO: 5213942 - DNA, 19 bp, Homo sapiens
agggtgagctggtgcctgc

SEQ ID NO: 5213943 - DNA, 20 bp, Homo sapiens
agggtgagctggtgcctgct

SEQ ID NO: 5213944 - DNA, 19 bp, Homo sapiens
agggtgagggccttcttaa

SEQ ID NO: 5213945 - DNA, 17 bp, Homo sapiens
agggtgagttaaagaga

SEQ ID NO: 5213946 - DNA, 18 bp, Homo sapiens
agggtgagtttgaagagg

SEQ ID NO: 5213947 - DNA, 19 bp, Homo sapiens
agggtgatgccaggttcta

SEQ ID NO: 5213948 - DNA, 19 bp, Homo sapiens
agggtgatggaacaagaga

SEQ ID NO: 5213949 - DNA, 23 bp, Homo sapiens
agggtgcaagccccattcacggc

SEQ ID NO: 5213950 - DNA, 14 bp, Homo sapiens
agggtgcagcccaa

SEQ ID NO: 5213951 - DNA, 17 bp, Homo sapiens
agggtgcagccctcttg

SEQ ID NO: 5213952 - DNA, 13 bp, Homo sapiens
agggtgcagggac

SEQ ID NO: 5213953 - DNA, 19 bp, Homo sapiens
agggtgcagtatctcttgc

SEQ ID NO: 5213954 - DNA, 21 bp, Homo sapiens
agggtgcagtatctcttgctg

SEQ ID NO: 5213955 - DNA, 18 bp, Homo sapiens
agggtgccagttgggctc

SEQ ID NO: 5213956 - DNA, 23 bp, Homo sapiens
agggtgccctctgctcaggcctc

SEQ ID NO: 5213957 - DNA, 18 bp, Homo sapiens
agggtgcccttttccagc

SEQ ID NO: 5213958 - DNA, 20 bp, Homo sapiens
agggtgccggaaagagagct

SEQ ID NO: 5213959 - DNA, 15 bp, Homo sapiens
agggtgccgtgtccc

SEQ ID NO: 5213960 - DNA, 14 bp, Homo sapiens
agggtgcctgctct

SEQ ID NO: 5213961 - DNA, 14 bp, Homo sapiens
agggtgcctggctg

SEQ ID NO: 5213962 - DNA, 18 bp, Homo sapiens
agggtgccttaaaaataa

SEQ ID NO: 5213963 - DNA, 16 bp, Homo sapiens
agggtgcggggcctgc

SEQ ID NO: 5213964 - DNA, 20 bp, Homo sapiens
agggtgctaacgtatctcta

SEQ ID NO: 5213965 - DNA, 22 bp, Homo sapiens
agggtgctacgtacatgtgagg

SEQ ID NO: 5213966 - DNA, 19 bp, Homo sapiens
agggtgctcagtctccttg

SEQ ID NO: 5213967 - DNA, 19 bp, Homo sapiens
agggtgctctgaggtcaat

SEQ ID NO: 5213968 - DNA, 17 bp, Homo sapiens
agggtgctgcttccctc

SEQ ID NO: 5213969 - DNA, 21 bp, Homo sapiens
agggtgctgcttccctctgcc

SEQ ID NO: 5213970 - DNA, 20 bp, Homo sapiens
agggtgctgtcccctcccct

SEQ ID NO: 5213971 - DNA, 12 bp, Homo sapiens
agggtggaaata

SEQ ID NO: 5213972 - DNA, 19 bp, Homo sapiens
agggtggaaataatttgaa

SEQ ID NO: 5213973 - DNA, 12 bp, Homo sapiens
agggtggacaga

SEQ ID NO: 5213974 - DNA, 14 bp, Homo sapiens
agggtggacagaag

SEQ ID NO: 5213975 - DNA, 16 bp, Homo sapiens
agggtggacagaagct

SEQ ID NO: 5213976 - DNA, 15 bp, Homo sapiens
agggtggaccaggcc

SEQ ID NO: 5213977 - DNA, 19 bp, Homo sapiens
agggtggaccaggcctgga

SEQ ID NO: 5213978 - DNA, 20 bp, Homo sapiens
agggtggaccaggcctggag

SEQ ID NO: 5213979 - DNA, 16 bp, Homo sapiens
agggtggacttagaaa

SEQ ID NO: 5213980 - DNA, 16 bp, Homo sapiens
agggtggagagggaga

SEQ ID NO: 5213981 - DNA, 19 bp, Homo sapiens
agggtggaggaaggtgact

SEQ ID NO: 5213982 - DNA, 20 bp, Homo sapiens
agggtggatccactgtgcag

SEQ ID NO: 5213983 - DNA, 20 bp, Homo sapiens
agggtggatgacagggcaga

SEQ ID NO: 5213984 - DNA, 15 bp, Homo sapiens
agggtggcacatctg

SEQ ID NO: 5213985 - DNA, 16 bp, Homo sapiens
agggtggcagagacag

SEQ ID NO: 5213986 - DNA, 21 bp, Homo sapiens
agggtggcagagacagtgggc

SEQ ID NO: 5213987 - DNA, 16 bp, Homo sapiens
agggtggcagcaacaa

SEQ ID NO: 5213988 - DNA, 14 bp, Homo sapiens
agggtggcaggtca

SEQ ID NO: 5213989 - DNA, 22 bp, Homo sapiens
agggtggcaggtcactgtcact

SEQ ID NO: 5213990 - DNA, 14 bp, Homo sapiens
agggtggcaggtga

SEQ ID NO: 5213991 - DNA, 21 bp, Homo sapiens
agggtggcatcccagtggcct

SEQ ID NO: 5213992 - DNA, 15 bp, Homo sapiens
agggtggccacacag

SEQ ID NO: 5213993 - DNA, 21 bp, Homo sapiens
agggtggccacacaggcaggg

SEQ ID NO: 5213994 - DNA, 22 bp, Homo sapiens
agggtggccacacctctatccc

SEQ ID NO: 5213995 - DNA, 13 bp, Homo sapiens
agggtggccagca

SEQ ID NO: 5213996 - DNA, 22 bp, Homo sapiens
agggtggccccctgtgccagct

SEQ ID NO: 5213997 - DNA, 16 bp, Homo sapiens
agggtggcctcaagaa

SEQ ID NO: 5213998 - DNA, 19 bp, Homo sapiens
agggtggcctgttccctag

SEQ ID NO: 5213999 - DNA, 16 bp, Homo sapiens
agggtggctgccagcc

SEQ ID NO: 5214000 - DNA, 17 bp, Homo sapiens
agggtggctgccagccc

SEQ ID NO: 5214001 - DNA, 16 bp, Homo sapiens
agggtggctttaattg

SEQ ID NO: 5214002 - DNA, 18 bp, Homo sapiens
agggtggctttaattgta

SEQ ID NO: 5214003 - DNA, 19 bp, Homo sapiens
agggtggctttaattgtat

SEQ ID NO: 5214004 - DNA, 12 bp, Homo sapiens
agggtggctttg

SEQ ID NO: 5214005 - DNA, 18 bp, Homo sapiens
agggtggctttgctgttg

SEQ ID NO: 5214006 - DNA, 13 bp, Homo sapiens
agggtgggaggga

SEQ ID NO: 5214007 - DNA, 15 bp, Homo sapiens
agggtgggagggagg

SEQ ID NO: 5214008 - DNA, 16 bp, Homo sapiens
agggtgggaggggcca

SEQ ID NO: 5214009 - DNA, 18 bp, Homo sapiens
agggtgggatgagcctct

SEQ ID NO: 5214010 - DNA, 17 bp, Homo sapiens
agggtgggatggaggag

SEQ ID NO: 5214011 - DNA, 17 bp, Homo sapiens
agggtgggccactctcc

SEQ ID NO: 5214012 - DNA, 12 bp, Homo sapiens
agggtgggccag

SEQ ID NO: 5214013 - DNA, 18 bp, Homo sapiens
agggtgggccccagccgt

SEQ ID NO: 5214014 - DNA, 15 bp, Homo sapiens
agggtgggccctgga

SEQ ID NO: 5214015 - DNA, 22 bp, Homo sapiens
agggtgggctctaaatccatta

SEQ ID NO: 5214016 - DNA, 15 bp, Homo sapiens
agggtgggctgggga

SEQ ID NO: 5214017 - DNA, 16 bp, Homo sapiens
agggtgggctggggac

SEQ ID NO: 5214018 - DNA, 12 bp, Homo sapiens
agggtggggaga

SEQ ID NO: 5214019 - DNA, 20 bp, Homo sapiens
agggtggggcaatggggaga

SEQ ID NO: 5214020 - DNA, 18 bp, Homo sapiens
agggtgggggagggaggt

SEQ ID NO: 5214021 - DNA, 18 bp, Homo sapiens
agggtgggggccacctgc

SEQ ID NO: 5214022 - DNA, 23 bp, Homo sapiens
agggtgggggccacctgcctgcg

SEQ ID NO: 5214023 - DNA, 11 bp, Homo sapiens
agggtgggggg

SEQ ID NO: 5214024 - DNA, 23 bp, Homo sapiens
agggtggggggatttgtagcata

SEQ ID NO: 5214025 - DNA, 14 bp, Homo sapiens
agggtggggggcca

SEQ ID NO: 5214026 - DNA, 12 bp, Homo sapiens
agggtggggggt

SEQ ID NO: 5214027 - DNA, 22 bp, Homo sapiens
agggtgggggtgctctctctga

SEQ ID NO: 5214028 - DNA, 21 bp, Homo sapiens
agggtggggtctgggaggggg

SEQ ID NO: 5214029 - DNA, 22 bp, Homo sapiens
agggtggggtgggatttgcagg

SEQ ID NO: 5214030 - DNA, 23 bp, Homo sapiens
agggtggggttttatgtgtggga

SEQ ID NO: 5214031 - DNA, 21 bp, Homo sapiens
agggtgggtgagctctcaggc

SEQ ID NO: 5214032 - DNA, 15 bp, Homo sapiens
agggtgggtgctcag

SEQ ID NO: 5214033 - DNA, 18 bp, Homo sapiens
agggtgggtttgagatgt

SEQ ID NO: 5214034 - DNA, 19 bp, Homo sapiens
agggtgggtttgagatgtt

SEQ ID NO: 5214035 - DNA, 19 bp, Homo sapiens
agggtggtagttttcccta

SEQ ID NO: 5214036 - DNA, 23 bp, Homo sapiens
agggtggtctcttcttggggccc

SEQ ID NO: 5214037 - DNA, 20 bp, Homo sapiens
agggtggtctgagcaccccc

SEQ ID NO: 5214038 - DNA, 23 bp, Homo sapiens
agggtggtcttcaagcctggccc

SEQ ID NO: 5214039 - DNA, 16 bp, Homo sapiens
agggtggtgacctctg

SEQ ID NO: 5214040 - DNA, 18 bp, Homo sapiens
agggtggtgacctctgcc

SEQ ID NO: 5214041 - DNA, 19 bp, Homo sapiens
agggtggtgacctctgcct

SEQ ID NO: 5214042 - DNA, 17 bp, Homo sapiens
agggtggtgctgggact

SEQ ID NO: 5214043 - DNA, 23 bp, Homo sapiens
agggtggttcctgttctcagcat

SEQ ID NO: 5214044 - DNA, 12 bp, Homo sapiens
agggtggtttac

SEQ ID NO: 5214045 - DNA, 19 bp, Homo sapiens
agggtgtagcctacagaca

SEQ ID NO: 5214046 - DNA, 15 bp, Homo sapiens
agggtgtaggggcca

SEQ ID NO: 5214047 - DNA, 18 bp, Homo sapiens
agggtgtaggggccacct

SEQ ID NO: 5214048 - DNA, 19 bp, Homo sapiens
agggtgtaggggccacctc

SEQ ID NO: 5214049 - DNA, 21 bp, Homo sapiens
agggtgtaggggccacctcct

SEQ ID NO: 5214050 - DNA, 15 bp, Homo sapiens
agggtgtatagtgtt

SEQ ID NO: 5214051 - DNA, 19 bp, Homo sapiens
agggtgtatagtgttcaca

SEQ ID NO: 5214052 - DNA, 17 bp, Homo sapiens
agggtgtatctagctct

SEQ ID NO: 5214053 - DNA, 17 bp, Homo sapiens
agggtgtcacgagccca

SEQ ID NO: 5214054 - DNA, 15 bp, Homo sapiens
agggtgtcctgaggt

SEQ ID NO: 5214055 - DNA, 22 bp, Homo sapiens
agggtgtcgtcctgcagtgtga

SEQ ID NO: 5214056 - DNA, 23 bp, Homo sapiens
agggtgtgactcgggagctgcac

SEQ ID NO: 5214057 - DNA, 24 bp, Homo sapiens
agggtgtgactcgggagctgcaca

SEQ ID NO: 5214058 - DNA, 16 bp, Homo sapiens
agggtgtgaggccaca

SEQ ID NO: 5214059 - DNA, 15 bp, Homo sapiens
agggtgtgccctcac

SEQ ID NO: 5214060 - DNA, 16 bp, Homo sapiens
agggtgtggcatttgg

SEQ ID NO: 5214061 - DNA, 15 bp, Homo sapiens
agggtgtggctccta

SEQ ID NO: 5214062 - DNA, 19 bp, Homo sapiens
agggtgtggctcctaccag

SEQ ID NO: 5214063 - DNA, 13 bp, Homo sapiens
agggtgtggcttg

SEQ ID NO: 5214064 - DNA, 16 bp, Homo sapiens
agggtgtggctttcca

SEQ ID NO: 5214065 - DNA, 23 bp, Homo sapiens
agggtgtggggccatgcctcctc

SEQ ID NO: 5214066 - DNA, 17 bp, Homo sapiens
agggtgtgggtgccctg

SEQ ID NO: 5214067 - DNA, 20 bp, Homo sapiens
agggtgtgtgccacacccca

SEQ ID NO: 5214068 - DNA, 22 bp, Homo sapiens
agggtgtgtgcccccagattta

SEQ ID NO: 5214069 - DNA, 20 bp, Homo sapiens
agggtgtgtgttcaccttca

SEQ ID NO: 5214070 - DNA, 20 bp, Homo sapiens
agggtgtgtttgaaatcatc

SEQ ID NO: 5214071 - DNA, 17 bp, Homo sapiens
agggtgtttcctctaaa

SEQ ID NO: 5214072 - DNA, 17 bp, Homo sapiens
agggttaagaaaagaga

SEQ ID NO: 5214073 - DNA, 15 bp, Homo sapiens
agggttaaggcctga

SEQ ID NO: 5214074 - DNA, 20 bp, Homo sapiens
agggttagacaagcctggag

SEQ ID NO: 5214075 - DNA, 22 bp, Homo sapiens
aggcctcaaatgacagtagcat

SEQ ID NO: 5214076 - DNA, 20 bp, Homo sapiens
aggcctcaactcctcccata

SEQ ID NO: 5214077 - DNA, 20 bp, Homo sapiens
aggcctcacacccagagggt

SEQ ID NO: 5214078 - DNA, 16 bp, Homo sapiens
aggcctcaccacctga

SEQ ID NO: 5214079 - DNA, 18 bp, Homo sapiens
aggcctcacccctcccct

SEQ ID NO: 5214080 - DNA, 19 bp, Homo sapiens
aggcctcacccctcccctg

SEQ ID NO: 5214081 - DNA, 23 bp, Homo sapiens
aggcctcaccctgcttggggcct

SEQ ID NO: 5214082 - DNA, 21 bp, Homo sapiens
aggcctcacctcccagggcta

SEQ ID NO: 5214083 - DNA, 22 bp, Homo sapiens
aggcctcacctcccagggctac

SEQ ID NO: 5214084 - DNA, 17 bp, Homo sapiens
aggcctcacctctaccc

SEQ ID NO: 5214085 - DNA, 19 bp, Homo sapiens
aggcctcacctctacccaa

SEQ ID NO: 5214086 - DNA, 22 bp, Homo sapiens
aggcctcacctggcttcccagg

SEQ ID NO: 5214087 - DNA, 23 bp, Homo sapiens
aggcctcactactcgagcccacc

SEQ ID NO: 5214088 - DNA, 13 bp, Homo sapiens
aggcctcactggc

SEQ ID NO: 5214089 - DNA, 19 bp, Homo sapiens
aggcctcagatagacctgt

SEQ ID NO: 5214090 - DNA, 21 bp, Homo sapiens
aggcctcagatagacctgtga

SEQ ID NO: 5214091 - DNA, 13 bp, Homo sapiens
aggcctcagccag

SEQ ID NO: 5214092 - DNA, 14 bp, Homo sapiens
aggcctcagccaga

SEQ ID NO: 5214093 - DNA, 13 bp, Homo sapiens
aggcctcagcctc

SEQ ID NO: 5214094 - DNA, 12 bp, Homo sapiens
aggcctcaggag

SEQ ID NO: 5214095 - DNA, 15 bp, Homo sapiens
aggcctcaggcctcc

SEQ ID NO: 5214096 - DNA, 21 bp, Homo sapiens
aggcctcaggtgctgtccatg

SEQ ID NO: 5214097 - DNA, 13 bp, Homo sapiens
aggcctcagtgga

SEQ ID NO: 5214098 - DNA, 12 bp, Homo sapiens
aggcctcagtgt

SEQ ID NO: 5214099 - DNA, 21 bp, Homo sapiens
aggcctcagtttctccatcag

SEQ ID NO: 5214100 - DNA, 14 bp, Homo sapiens
aggcctcatcctcc

SEQ ID NO: 5214101 - DNA, 14 bp, Homo sapiens
aggcctcatctcct

SEQ ID NO: 5214102 - DNA, 18 bp, Homo sapiens
aggcctcatctcctttat

SEQ ID NO: 5214103 - DNA, 17 bp, Homo sapiens
aggcctcatgcctgctg

SEQ ID NO: 5214104 - DNA, 20 bp, Homo sapiens
aggcctcatgcctgctgaga

SEQ ID NO: 5214105 - DNA, 14 bp, Homo sapiens
aggcctcatttctt

SEQ ID NO: 5214106 - DNA, 15 bp, Homo sapiens
aggcctcatttcttt

SEQ ID NO: 5214107 - DNA, 18 bp, Homo sapiens
aggcctccaacgcccctg

SEQ ID NO: 5214108 - DNA, 21 bp, Homo sapiens
aggcctccaacgcccctgtgg

SEQ ID NO: 5214109 - DNA, 14 bp, Homo sapiens
aggcctccactcct

SEQ ID NO: 5214110 - DNA, 12 bp, Homo sapiens
aggcctccagaa

SEQ ID NO: 5214111 - DNA, 15 bp, Homo sapiens
aggcctccagcccca

SEQ ID NO: 5214112 - DNA, 13 bp, Homo sapiens
aggcctccagcct

SEQ ID NO: 5214113 - DNA, 14 bp, Homo sapiens
aggcctccagcctc

SEQ ID NO: 5214114 - DNA, 15 bp, Homo sapiens
aggcctccagcctct

SEQ ID NO: 5214115 - DNA, 21 bp, Homo sapiens
aggcctccagcctctcccggc

SEQ ID NO: 5214116 - DNA, 18 bp, Homo sapiens
aggcctccagctcagcag

SEQ ID NO: 5214117 - DNA, 17 bp, Homo sapiens
aggcctccatctcatgt

SEQ ID NO: 5214118 - DNA, 18 bp, Homo sapiens
aggcctccatcttctcat

SEQ ID NO: 5214119 - DNA, 15 bp, Homo sapiens
aggcctcccaagctg

SEQ ID NO: 5214120 - DNA, 15 bp, Homo sapiens
aggcctcccacagtg

SEQ ID NO: 5214121 - DNA, 12 bp, Homo sapiens
aggcctccccaa

SEQ ID NO: 5214122 - DNA, 20 bp, Homo sapiens
aggcctcccccagccaggac

SEQ ID NO: 5214123 - DNA, 13 bp, Homo sapiens
aggcctcccctga

SEQ ID NO: 5214124 - DNA, 23 bp, Homo sapiens
aggcctcccgcatgctgcctgcc

SEQ ID NO: 5214125 - DNA, 22 bp, Homo sapiens
aggcctccctagcacctccccc

SEQ ID NO: 5214126 - DNA, 15 bp, Homo sapiens
aggcctccctagcca

SEQ ID NO: 5214127 - DNA, 13 bp, Homo sapiens
aggcctccctcaa

SEQ ID NO: 5214128 - DNA, 19 bp, Homo sapiens
aggcctccctcgggctggt

SEQ ID NO: 5214129 - DNA, 21 bp, Homo sapiens
aggcctccctcgggctggtgt

SEQ ID NO: 5214130 - DNA, 15 bp, Homo sapiens
aggcctccctgcaga

SEQ ID NO: 5214131 - DNA, 22 bp, Homo sapiens
aggcctcccttgagtaggccct

SEQ ID NO: 5214132 - DNA, 20 bp, Homo sapiens
aggcctccctttggggagag

SEQ ID NO: 5214133 - DNA, 16 bp, Homo sapiens
aggcctccgtcttccc

SEQ ID NO: 5214134 - DNA, 15 bp, Homo sapiens
aggcctccgttgtct

SEQ ID NO: 5214135 - DNA, 19 bp, Homo sapiens
aggcctcctaggggaaggg

SEQ ID NO: 5214136 - DNA, 20 bp, Homo sapiens
aggcctcctaggggaagggg

SEQ ID NO: 5214137 - DNA, 21 bp, Homo sapiens
aggcctcctgtggcctgccag

SEQ ID NO: 5214138 - DNA, 23 bp, Homo sapiens
aggcctcctgtggcctgccagtc

SEQ ID NO: 5214139 - DNA, 16 bp, Homo sapiens
aggcctcgagcagaga

SEQ ID NO: 5214140 - DNA, 17 bp, Homo sapiens
aggcctcgagcagagag

SEQ ID NO: 5214141 - DNA, 22 bp, Homo sapiens
aggcctcgcacttgcagaggag

SEQ ID NO: 5214142 - DNA, 17 bp, Homo sapiens
aggcctcgcaggaagac

SEQ ID NO: 5214143 - DNA, 13 bp, Homo sapiens
aggcctcgcctgc

SEQ ID NO: 5214144 - DNA, 15 bp, Homo sapiens
aggcctcgcctgccc

SEQ ID NO: 5214145 - DNA, 23 bp, Homo sapiens
aggcctcggcagaactctctgtc

SEQ ID NO: 5214146 - DNA, 21 bp, Homo sapiens
aggcctcggctgtctcctgtc

SEQ ID NO: 5214147 - DNA, 20 bp, Homo sapiens
aggcctcgtaccagccagga

SEQ ID NO: 5214148 - DNA, 13 bp, Homo sapiens
aggcctctctctg

SEQ ID NO: 5214149 - DNA, 14 bp, Homo sapiens
aggcctctctctgc

SEQ ID NO: 5214150 - DNA, 16 bp, Homo sapiens
aggcctctctgcctgg

SEQ ID NO: 5214151 - DNA, 11 bp, Homo sapiens
aggcctctctt

SEQ ID NO: 5214152 - DNA, 19 bp, Homo sapiens
aggcctctgaggagcccac

SEQ ID NO: 5214153 - DNA, 20 bp, Homo sapiens
aggcctctgaggagcccacg

SEQ ID NO: 5214154 - DNA, 13 bp, Homo sapiens
aggcctctgcaga

SEQ ID NO: 5214155 - DNA, 11 bp, Homo sapiens
aggcctctgcc

SEQ ID NO: 5214156 - DNA, 23 bp, Homo sapiens
aggcctctgggacccacagaact

SEQ ID NO: 5214157 - DNA, 11 bp, Homo sapiens
aggcctctggt

SEQ ID NO: 5214158 - DNA, 12 bp, Homo sapiens
aggcctctggtt

SEQ ID NO: 5214159 - DNA, 21 bp, Homo sapiens
aggcctctggttgcctccccc

SEQ ID NO: 5214160 - DNA, 15 bp, Homo sapiens
aggcctctgtgccgc

SEQ ID NO: 5214161 - DNA, 23 bp, Homo sapiens
aggcctctgtgctgtcctgccct

SEQ ID NO: 5214162 - DNA, 13 bp, Homo sapiens
aggcctctgtgtc

SEQ ID NO: 5214163 - DNA, 22 bp, Homo sapiens
aggcctctgtgtccttccctgc

SEQ ID NO: 5214164 - DNA, 14 bp, Homo sapiens
aggcctcttcctgt

SEQ ID NO: 5214165 - DNA, 22 bp, Homo sapiens
aggcctcttcctgttgtgactg

SEQ ID NO: 5214166 - DNA, 22 bp, Homo sapiens
aggcctcttgctggtgcacatg

SEQ ID NO: 5214167 - DNA, 22 bp, Homo sapiens
aggcctcttggacctctgctct

SEQ ID NO: 5214168 - DNA, 21 bp, Homo sapiens
aggcctcttgtgctcacgctc

SEQ ID NO: 5214169 - DNA, 21 bp, Homo sapiens
aggcctgaaagaggctgaggc

SEQ ID NO: 5214170 - DNA, 17 bp, Homo sapiens
aggcctgaaatcctggt

SEQ ID NO: 5214171 - DNA, 19 bp, Homo sapiens
aggcctgaaatgacatttc

SEQ ID NO: 5214172 - DNA, 21 bp, Homo sapiens
aggcctgaaatgacatttcac

SEQ ID NO: 5214173 - DNA, 18 bp, Homo sapiens
aggcctgaaatgtttcca

SEQ ID NO: 5214174 - DNA, 19 bp, Homo sapiens
aggcctgaaatgtttccag

SEQ ID NO: 5214175 - DNA, 12 bp, Homo sapiens
aggcctgaacta

SEQ ID NO: 5214176 - DNA, 20 bp, Homo sapiens
aggcctgaactaggtgctgg

SEQ ID NO: 5214177 - DNA, 21 bp, Homo sapiens
aggcctgaagccagctgccct

SEQ ID NO: 5214178 - DNA, 14 bp, Homo sapiens
aggcctgaagtctt

SEQ ID NO: 5214179 - DNA, 19 bp, Homo sapiens
aggcctgaatcatgagcct

SEQ ID NO: 5214180 - DNA, 22 bp, Homo sapiens
aggcctgaatcatgagcctgct

SEQ ID NO: 5214181 - DNA, 23 bp, Homo sapiens
aggcctgaatccaaaagaaaaac

SEQ ID NO: 5214182 - DNA, 17 bp, Homo sapiens
aggcctgacacaggcca

SEQ ID NO: 5214183 - DNA, 13 bp, Homo sapiens
aggcctgaccagg

SEQ ID NO: 5214184 - DNA, 15 bp, Homo sapiens
aggcctgacctcaag

SEQ ID NO: 5214185 - DNA, 21 bp, Homo sapiens
aggcctgacctcaagcaacca

SEQ ID NO: 5214186 - DNA, 18 bp, Homo sapiens
aggcctgactactgccca

SEQ ID NO: 5214187 - DNA, 22 bp, Homo sapiens
aggcctgactgccaagccatgg

SEQ ID NO: 5214188 - DNA, 21 bp, Homo sapiens
aggcctgacttctgctggcat

SEQ ID NO: 5214189 - DNA, 13 bp, Homo sapiens
aggcctgacttgg

SEQ ID NO: 5214190 - DNA, 16 bp, Homo sapiens
aggcctgagacccagg

SEQ ID NO: 5214191 - DNA, 16 bp, Homo sapiens
aggcctgagatttcat

SEQ ID NO: 5214192 - DNA, 17 bp, Homo sapiens
aggcctgagatttcatc

SEQ ID NO: 5214193 - DNA, 14 bp, Homo sapiens
aggcctgagcccct

SEQ ID NO: 5214194 - DNA, 21 bp, Homo sapiens
aggcctgagcgctcctgccgc

SEQ ID NO: 5214195 - DNA, 18 bp, Homo sapiens
aggcctgagctgcttcac

SEQ ID NO: 5214196 - DNA, 24 bp, Homo sapiens
aggcctgagctgcttcactaggga

SEQ ID NO: 5214197 - DNA, 18 bp, Homo sapiens
aggcctgaggatgagctg

SEQ ID NO: 5214198 - DNA, 13 bp, Homo sapiens
aggcctgaggcct

SEQ ID NO: 5214199 - DNA, 17 bp, Homo sapiens
aggcctgagggaagccc

SEQ ID NO: 5214200 - DNA, 20 bp, Homo sapiens
aggcctgagggaagcccacc

SEQ ID NO: 5214201 - DNA, 21 bp, Homo sapiens
aggcctgagggaagcccaccc

SEQ ID NO: 5214202 - DNA, 20 bp, Homo sapiens
aggcctgagttagctgttta

SEQ ID NO: 5214203 - DNA, 16 bp, Homo sapiens
aggcctgatctgccca

SEQ ID NO: 5214204 - DNA, 16 bp, Homo sapiens
aggcctgatgctgccc

SEQ ID NO: 5214205 - DNA, 19 bp, Homo sapiens
aggcctgattcactggcct

SEQ ID NO: 5214206 - DNA, 20 bp, Homo sapiens
aggcctgattcactggcctg

SEQ ID NO: 5214207 - DNA, 23 bp, Homo sapiens
aggcctgattcactggcctggcg

SEQ ID NO: 5214208 - DNA, 20 bp, Homo sapiens
aggcctgcaaaccttcctgg

SEQ ID NO: 5214209 - DNA, 12 bp, Homo sapiens
aggcctgcacac

SEQ ID NO: 5214210 - DNA, 18 bp, Homo sapiens
aggcctgcagacagacct

SEQ ID NO: 5214211 - DNA, 14 bp, Homo sapiens
aggcctgcagggcc

SEQ ID NO: 5214212 - DNA, 15 bp, Homo sapiens
aggcctgcagggcct

SEQ ID NO: 5214213 - DNA, 18 bp, Homo sapiens
aggcctgcagggcctctg

SEQ ID NO: 5214214 - DNA, 22 bp, Homo sapiens
aggcctgccccccttcccaccc

SEQ ID NO: 5214215 - DNA, 23 bp, Homo sapiens
aggcctgccccccttcccacccc

SEQ ID NO: 5214216 - DNA, 19 bp, Homo sapiens
aggcctgccctcccatgtt

SEQ ID NO: 5214217 - DNA, 17 bp, Homo sapiens
aggcctgccgctttgat

SEQ ID NO: 5214218 - DNA, 20 bp, Homo sapiens
aggcctgccgctttgatgga

SEQ ID NO: 5214219 - DNA, 22 bp, Homo sapiens
aggcctgcctcccacttcactg

SEQ ID NO: 5214220 - DNA, 18 bp, Homo sapiens
aggcctgccttctcaggg

SEQ ID NO: 5214221 - DNA, 20 bp, Homo sapiens
aggcctgcgaccctgggggc

SEQ ID NO: 5214222 - DNA, 21 bp, Homo sapiens
aggcctgcgaccctgggggca

SEQ ID NO: 5214223 - DNA, 21 bp, Homo sapiens
aggcctgcgggcccctggtga

SEQ ID NO: 5214224 - DNA, 18 bp, Homo sapiens
aggcctgcgtgcgctggt

SEQ ID NO: 5214225 - DNA, 16 bp, Homo sapiens
aggcctgctagtcact

SEQ ID NO: 5214226 - DNA, 18 bp, Homo sapiens
aggcctgctcagggactg

SEQ ID NO: 5214227 - DNA, 12 bp, Homo sapiens
aggcctgctccc

SEQ ID NO: 5214228 - DNA, 22 bp, Homo sapiens
aggcctgctgccagtgcagcca

SEQ ID NO: 5214229 - DNA, 12 bp, Homo sapiens
aggcctgctggc

SEQ ID NO: 5214230 - DNA, 12 bp, Homo sapiens
aggcctgcttcc

SEQ ID NO: 5214231 - DNA, 17 bp, Homo sapiens
aggcctgcttccccctc

SEQ ID NO: 5214232 - DNA, 18 bp, Homo sapiens
aggcctgcttccccctcc

SEQ ID NO: 5214233 - DNA, 19 bp, Homo sapiens
aggcctgcttccccctccc

SEQ ID NO: 5214234 - DNA, 23 bp, Homo sapiens
aggcctgcttgactttccagaat

SEQ ID NO: 5214235 - DNA, 19 bp, Homo sapiens
aggcctgctttgtctcctc

SEQ ID NO: 5214236 - DNA, 20 bp, Homo sapiens
aggcctgctttgtctcctct

SEQ ID NO: 5214237 - DNA, 20 bp, Homo sapiens
aggcctgcttttgtgtccca

SEQ ID NO: 5214238 - DNA, 22 bp, Homo sapiens
aggcctggaagagctgagacct

SEQ ID NO: 5214239 - DNA, 20 bp, Homo sapiens
aggcctggaccgagatgtga

SEQ ID NO: 5214240 - DNA, 22 bp, Homo sapiens
aggcctggaccgagatgtgagt

SEQ ID NO: 5214241 - DNA, 13 bp, Homo sapiens
aggcctggagttg

SEQ ID NO: 5214242 - DNA, 19 bp, Homo sapiens
aggcctggagttgggctgg

SEQ ID NO: 5214243 - DNA, 15 bp, Homo sapiens
aggcctggcacagtg

SEQ ID NO: 5214244 - DNA, 17 bp, Homo sapiens
aggcctggcatcttctg

SEQ ID NO: 5214245 - DNA, 20 bp, Homo sapiens
aggcctggcatcttctggag

SEQ ID NO: 5214246 - DNA, 12 bp, Homo sapiens
aggcctggccca

SEQ ID NO: 5214247 - DNA, 15 bp, Homo sapiens
aggcctggcccagcc

SEQ ID NO: 5214248 - DNA, 16 bp, Homo sapiens
aggcctggcccagcca

SEQ ID NO: 5214249 - DNA, 18 bp, Homo sapiens
aggcctggcccagccagc

SEQ ID NO: 5214250 - DNA, 20 bp, Homo sapiens
aggcctggcccagccagcag

SEQ ID NO: 5214251 - DNA, 12 bp, Homo sapiens
aggcctggccct

SEQ ID NO: 5214252 - DNA, 21 bp, Homo sapiens
agggttagacaagcctggagg

SEQ ID NO: 5214253 - DNA, 22 bp, Homo sapiens
agggttagacaagcctggagga

SEQ ID NO: 5214254 - DNA, 16 bp, Homo sapiens
agggttagcctgcacc

SEQ ID NO: 5214255 - DNA, 21 bp, Homo sapiens
agggttaggaatcctagcact

SEQ ID NO: 5214256 - DNA, 18 bp, Homo sapiens
agggttaggaatctcttc

SEQ ID NO: 5214257 - DNA, 19 bp, Homo sapiens
agggttaggaatctcttca

SEQ ID NO: 5214258 - DNA, 16 bp, Homo sapiens
agggttcagagactca

SEQ ID NO: 5214259 - DNA, 19 bp, Homo sapiens
agggttcatcatccctccc

SEQ ID NO: 5214260 - DNA, 13 bp, Homo sapiens
agggttcatctgt

SEQ ID NO: 5214261 - DNA, 12 bp, Homo sapiens
agggttccagac

SEQ ID NO: 5214262 - DNA, 15 bp, Homo sapiens
agggttcccccagcc

SEQ ID NO: 5214263 - DNA, 18 bp, Homo sapiens
agggttcccccagccctg

SEQ ID NO: 5214264 - DNA, 13 bp, Homo sapiens
agggttcccctgg

SEQ ID NO: 5214265 - DNA, 15 bp, Homo sapiens
agggttcccctggcc

SEQ ID NO: 5214266 - DNA, 18 bp, Homo sapiens
agggttcctcttaggtca

SEQ ID NO: 5214267 - DNA, 21 bp, Homo sapiens
agggttcctgtagacctaggg

SEQ ID NO: 5214268 - DNA, 22 bp, Homo sapiens
agggttctaaatgcaataagat

SEQ ID NO: 5214269 - DNA, 13 bp, Homo sapiens
agggttctagaag

SEQ ID NO: 5214270 - DNA, 22 bp, Homo sapiens
agggttctagaaggggcgaggc

SEQ ID NO: 5214271 - DNA, 18 bp, Homo sapiens
agggttctatatttactg

SEQ ID NO: 5214272 - DNA, 14 bp, Homo sapiens
agggttctgccctg

SEQ ID NO: 5214273 - DNA, 18 bp, Homo sapiens
agggttctgccctgcctg

SEQ ID NO: 5214274 - DNA, 20 bp, Homo sapiens
agggttctgcctctccaggc

SEQ ID NO: 5214275 - DNA, 18 bp, Homo sapiens
agggttctgcttttaagt

SEQ ID NO: 5214276 - DNA, 14 bp, Homo sapiens
agggttctggctgc

SEQ ID NO: 5214277 - DNA, 21 bp, Homo sapiens
agggttctggtgtttggtttc

SEQ ID NO: 5214278 - DNA, 21 bp, Homo sapiens
agggttgaagacggaaaacaa

SEQ ID NO: 5214279 - DNA, 21 bp, Homo sapiens
agggttgaaggcagtctgaac

SEQ ID NO: 5214280 - DNA, 16 bp, Homo sapiens
agggttgaccccagag

SEQ ID NO: 5214281 - DNA, 17 bp, Homo sapiens
agggttgaccccagagg

SEQ ID NO: 5214282 - DNA, 18 bp, Homo sapiens
agggttgatatattcttt

SEQ ID NO: 5214283 - DNA, 15 bp, Homo sapiens
agggttgattaaggc

SEQ ID NO: 5214284 - DNA, 23 bp, Homo sapiens
agggttgctggtcctgcacatga

SEQ ID NO: 5214285 - DNA, 14 bp, Homo sapiens
agggttggagaagg

SEQ ID NO: 5214286 - DNA, 12 bp, Homo sapiens
agggttggcacc

SEQ ID NO: 5214287 - DNA, 17 bp, Homo sapiens
agggttggcccctgccc

SEQ ID NO: 5214288 - DNA, 23 bp, Homo sapiens
agggttggcccctgcccggctgc

SEQ ID NO: 5214289 - DNA, 18 bp, Homo sapiens
agggttggcctgagttag

SEQ ID NO: 5214290 - DNA, 22 bp, Homo sapiens
agggttggtgggctggcccagc

SEQ ID NO: 5214291 - DNA, 19 bp, Homo sapiens
agggttgtgattttgtctg

SEQ ID NO: 5214292 - DNA, 21 bp, Homo sapiens
agggttgttctgggagtcctg

SEQ ID NO: 5214293 - DNA, 22 bp, Homo sapiens
agggtttaatccccagtaaaat

SEQ ID NO: 5214294 - DNA, 18 bp, Homo sapiens
agggtttacccagtggga

SEQ ID NO: 5214295 - DNA, 20 bp, Homo sapiens
agggtttatgtttaggatgt

SEQ ID NO: 5214296 - DNA, 15 bp, Homo sapiens
agggtttcaccatgt

SEQ ID NO: 5214297 - DNA, 22 bp, Homo sapiens
agggtttccctactgaagccct

SEQ ID NO: 5214298 - DNA, 19 bp, Homo sapiens
agggtttcgactggtccag

SEQ ID NO: 5214299 - DNA, 17 bp, Homo sapiens
agggtttcgagaagctg

SEQ ID NO: 5214300 - DNA, 12 bp, Homo sapiens
agggtttctctc

SEQ ID NO: 5214301 - DNA, 17 bp, Homo sapiens
agggtttcttaaatata

SEQ ID NO: 5214302 - DNA, 23 bp, Homo sapiens
agggtttgaattgttttctttaa

SEQ ID NO: 5214303 - DNA, 17 bp, Homo sapiens
agggtttgacatttcat

SEQ ID NO: 5214304 - DNA, 13 bp, Homo sapiens
agggtttgagcac

SEQ ID NO: 5214305 - DNA, 14 bp, Homo sapiens
agggtttggaccac

SEQ ID NO: 5214306 - DNA, 15 bp, Homo sapiens
agggtttgggcagag

SEQ ID NO: 5214307 - DNA, 16 bp, Homo sapiens
agggtttgggcagagc

SEQ ID NO: 5214308 - DNA, 19 bp, Homo sapiens
agggtttgtaatggtgctt

SEQ ID NO: 5214309 - DNA, 15 bp, Homo sapiens
agggtttgtgacagg

SEQ ID NO: 5214310 - DNA, 21 bp, Homo sapiens
agggtttgtttgctgcttttg

SEQ ID NO: 5214311 - DNA, 14 bp, Homo sapiens
agggttttccaatg

SEQ ID NO: 5214312 - DNA, 18 bp, Homo sapiens
agggttttccaccctgga

SEQ ID NO: 5214313 - DNA, 15 bp, Homo sapiens
agggttttcttttct

SEQ ID NO: 5214314 - DNA, 16 bp, Homo sapiens
agggttttcttttctt

SEQ ID NO: 5214315 - DNA, 20 bp, Homo sapiens
agggttttcttttttaaatg

SEQ ID NO: 5214316 - DNA, 17 bp, Homo sapiens
agggttttgcaataact

SEQ ID NO: 5214317 - DNA, 14 bp, Homo sapiens
agggttttggcctg

SEQ ID NO: 5214318 - DNA, 16 bp, Homo sapiens
agggttttggcctgcc

SEQ ID NO: 5214319 - DNA, 19 bp, Homo sapiens
agggttttggggtcctggg

SEQ ID NO: 5214320 - DNA, 13 bp, Homo sapiens
agggttttgtatt

SEQ ID NO: 5214321 - DNA, 21 bp, Homo sapiens
agggttttttcttctttcttt

SEQ ID NO: 5214322 - DNA, 20 bp, Homo sapiens
agggttttttttttttcctt

SEQ ID NO: 5214323 - DNA, 16 bp, Homo sapiens
aggtaaaaaaaagaag

SEQ ID NO: 5214324 - DNA, 16 bp, Homo sapiens
aggtaaaaacccagcg

SEQ ID NO: 5214325 - DNA, 12 bp, Homo sapiens
aggtaaaaagtt

SEQ ID NO: 5214326 - DNA, 22 bp, Homo sapiens
aggtaaaacaaaacaaaacaac

SEQ ID NO: 5214327 - DNA, 22 bp, Homo sapiens
aggtaaaagagccaagttcaaa

SEQ ID NO: 5214328 - DNA, 17 bp, Homo sapiens
aggtaaaagtgtgagca

SEQ ID NO: 5214329 - DNA, 13 bp, Homo sapiens
aggtaaaatcact

SEQ ID NO: 5214330 - DNA, 18 bp, Homo sapiens
aggtaaaatcacttcaga

SEQ ID NO: 5214331 - DNA, 20 bp, Homo sapiens
aggtaaaatcacttcagatc

SEQ ID NO: 5214332 - DNA, 13 bp, Homo sapiens
aggtaaaattcta

SEQ ID NO: 5214333 - DNA, 13 bp, Homo sapiens
aggtaaacagttc

SEQ ID NO: 5214334 - DNA, 14 bp, Homo sapiens
aggtaaactcctgt

SEQ ID NO: 5214335 - DNA, 15 bp, Homo sapiens
aggtaaactcctgtc

SEQ ID NO: 5214336 - DNA, 16 bp, Homo sapiens
aggtaaactgatgctt

SEQ ID NO: 5214337 - DNA, 18 bp, Homo sapiens
aggtaaagggacactgga

SEQ ID NO: 5214338 - DNA, 18 bp, Homo sapiens
aggtaaagggcaaataat

SEQ ID NO: 5214339 - DNA, 19 bp, Homo sapiens
aggtaaagggcaaataatg

SEQ ID NO: 5214340 - DNA, 16 bp, Homo sapiens
aggtaaataatcatac

SEQ ID NO: 5214341 - DNA, 14 bp, Homo sapiens
aggtaaatacaagt

SEQ ID NO: 5214342 - DNA, 16 bp, Homo sapiens
aggtaaatacaagtga

SEQ ID NO: 5214343 - DNA, 21 bp, Homo sapiens
aggtaaatagagtgcataaat

SEQ ID NO: 5214344 - DNA, 16 bp, Homo sapiens
aggtaaatcttagtga

SEQ ID NO: 5214345 - DNA, 19 bp, Homo sapiens
aggtaaatggttaaatttt

SEQ ID NO: 5214346 - DNA, 21 bp, Homo sapiens
aggtaaatggttaaattttac

SEQ ID NO: 5214347 - DNA, 14 bp, Homo sapiens
aggtaacactacag

SEQ ID NO: 5214348 - DNA, 16 bp, Homo sapiens
aggtaacaggtgtgta

SEQ ID NO: 5214349 - DNA, 20 bp, Homo sapiens
aggtaacatttatagaagaa

SEQ ID NO: 5214350 - DNA, 21 bp, Homo sapiens
aggtaacatttatagaagaaa

SEQ ID NO: 5214351 - DNA, 22 bp, Homo sapiens
aggtaacgtgattgattcagta

SEQ ID NO: 5214352 - DNA, 23 bp, Homo sapiens
aggtaacgtgattgattcagtat

SEQ ID NO: 5214353 - DNA, 19 bp, Homo sapiens
aggtaactaactgcttcat

SEQ ID NO: 5214354 - DNA, 20 bp, Homo sapiens
aggtaactactgctaatgtt

SEQ ID NO: 5214355 - DNA, 13 bp, Homo sapiens
aggtaactaggta

SEQ ID NO: 5214356 - DNA, 17 bp, Homo sapiens
aggtaactatcaatatt

SEQ ID NO: 5214357 - DNA, 22 bp, Homo sapiens
aggtaactggctttcctgctgg

SEQ ID NO: 5214358 - DNA, 19 bp, Homo sapiens
aggtaacttctcccttctc

SEQ ID NO: 5214359 - DNA, 23 bp, Homo sapiens
aggtaagaagtaataatgagtaa

SEQ ID NO: 5214360 - DNA, 16 bp, Homo sapiens
aggtaagatgttaatc

SEQ ID NO: 5214361 - DNA, 17 bp, Homo sapiens
aggtaagctcaggatat

SEQ ID NO: 5214362 - DNA, 15 bp, Homo sapiens
aggtaagctgtgcct

SEQ ID NO: 5214363 - DNA, 18 bp, Homo sapiens
aggtaaggaaaaggattt

SEQ ID NO: 5214364 - DNA, 16 bp, Homo sapiens
aggtaagggccgccgg

SEQ ID NO: 5214365 - DNA, 19 bp, Homo sapiens
aggtaagggtgacaaatgg

SEQ ID NO: 5214366 - DNA, 13 bp, Homo sapiens
aggtaagtggcag

SEQ ID NO: 5214367 - DNA, 14 bp, Homo sapiens
aggtaataaaactc

SEQ ID NO: 5214368 - DNA, 15 bp, Homo sapiens
aggtaataaatacac

SEQ ID NO: 5214369 - DNA, 20 bp, Homo sapiens
aggtaataggaagaacagta

SEQ ID NO: 5214370 - DNA, 17 bp, Homo sapiens
aggtaatcgacctgcct

SEQ ID NO: 5214371 - DNA, 17 bp, Homo sapiens
aggtaatgagggactgg

SEQ ID NO: 5214372 - DNA, 13 bp, Homo sapiens
aggtaatgcacat

SEQ ID NO: 5214373 - DNA, 22 bp, Homo sapiens
aggtaatgcacatcctcattca

SEQ ID NO: 5214374 - DNA, 14 bp, Homo sapiens
aggtaatggatatg

SEQ ID NO: 5214375 - DNA, 22 bp, Homo sapiens
aggtaatggatatgaaagagaa

SEQ ID NO: 5214376 - DNA, 16 bp, Homo sapiens
aggtaatgtgaataaa

SEQ ID NO: 5214377 - DNA, 19 bp, Homo sapiens
aggtaatgttttgtatata

SEQ ID NO: 5214378 - DNA, 21 bp, Homo sapiens
aggtaatgttttgtatataca

SEQ ID NO: 5214379 - DNA, 21 bp, Homo sapiens
aggtaattgttttttaaagca

SEQ ID NO: 5214380 - DNA, 16 bp, Homo sapiens
aggtaatttcttgtgc

SEQ ID NO: 5214381 - DNA, 16 bp, Homo sapiens
aggtaattttttgtct

SEQ ID NO: 5214382 - DNA, 17 bp, Homo sapiens
aggtaatttttttcacc

SEQ ID NO: 5214383 - DNA, 15 bp, Homo sapiens
aggtacaaaagttac

SEQ ID NO: 5214384 - DNA, 15 bp, Homo sapiens
aggtacaaaatcttg

SEQ ID NO: 5214385 - DNA, 23 bp, Homo sapiens
aggtacaaataatttagaaataa

SEQ ID NO: 5214386 - DNA, 17 bp, Homo sapiens
aggtacaacctgttctg

SEQ ID NO: 5214387 - DNA, 13 bp, Homo sapiens
aggtacacctccc

SEQ ID NO: 5214388 - DNA, 16 bp, Homo sapiens
aggtacactgtttcca

SEQ ID NO: 5214389 - DNA, 14 bp, Homo sapiens
aggtacacttgtga

SEQ ID NO: 5214390 - DNA, 17 bp, Homo sapiens
aggtacacttgtgaata

SEQ ID NO: 5214391 - DNA, 14 bp, Homo sapiens
aggtacagaaaaca

SEQ ID NO: 5214392 - DNA, 18 bp, Homo sapiens
aggtacagcgggctgtgc

SEQ ID NO: 5214393 - DNA, 21 bp, Homo sapiens
aggtacagcgggctgtgcccg

SEQ ID NO: 5214394 - DNA, 22 bp, Homo sapiens
aggtacaggagaggcagcatgc

SEQ ID NO: 5214395 - DNA, 22 bp, Homo sapiens
aggtaccaaacaaggaagccaa

SEQ ID NO: 5214396 - DNA, 20 bp, Homo sapiens
aggtaccacccttcagaccc

SEQ ID NO: 5214397 - DNA, 20 bp, Homo sapiens
aggtacccaatagctgccca

SEQ ID NO: 5214398 - DNA, 14 bp, Homo sapiens
aggtaccctgggtg

SEQ ID NO: 5214399 - DNA, 20 bp, Homo sapiens
aggtaccctgggtgtccccg

SEQ ID NO: 5214400 - DNA, 19 bp, Homo sapiens
aggtacctttcacatagag

SEQ ID NO: 5214401 - DNA, 19 bp, Homo sapiens
aggtacctttccacccaga

SEQ ID NO: 5214402 - DNA, 20 bp, Homo sapiens
aggtacctttccacccagac

SEQ ID NO: 5214403 - DNA, 21 bp, Homo sapiens
aggtacctttccacccagacc

SEQ ID NO: 5214404 - DNA, 19 bp, Homo sapiens
aggtacgattatacttgag

SEQ ID NO: 5214405 - DNA, 13 bp, Homo sapiens
aggtacgcacaga

SEQ ID NO: 5214406 - DNA, 15 bp, Homo sapiens
aggtacgcacagaca

SEQ ID NO: 5214407 - DNA, 15 bp, Homo sapiens
aggtacggagaagaa

SEQ ID NO: 5214408 - DNA, 19 bp, Homo sapiens
aggtactacctatgtactt

SEQ ID NO: 5214409 - DNA, 17 bp, Homo sapiens
aggtactatctgtgaag

SEQ ID NO: 5214410 - DNA, 22 bp, Homo sapiens
aggtactcctgccagggaactg

SEQ ID NO: 5214411 - DNA, 21 bp, Homo sapiens
aggtactgcattctctcccat

SEQ ID NO: 5214412 - DNA, 18 bp, Homo sapiens
aggtactggtgagggcaa

SEQ ID NO: 5214413 - DNA, 19 bp, Homo sapiens
aggtactggtgagggcaag

SEQ ID NO: 5214414 - DNA, 19 bp, Homo sapiens
aggtactgtatgatcaaat

SEQ ID NO: 5214415 - DNA, 22 bp, Homo sapiens
aggtactgtatgatcaaatgtt

SEQ ID NO: 5214416 - DNA, 13 bp, Homo sapiens
aggtacttcctcc

SEQ ID NO: 5214417 - DNA, 17 bp, Homo sapiens
aggtacttggagggctc

SEQ ID NO: 5214418 - DNA, 17 bp, Homo sapiens
aggtacttttggaatct

SEQ ID NO: 5214419 - DNA, 13 bp, Homo sapiens
aggtagaaaaagg

SEQ ID NO: 5214420 - DNA, 18 bp, Homo sapiens
aggtagaaaaagggtcaa

SEQ ID NO: 5214421 - DNA, 15 bp, Homo sapiens
aggtagaacgccagg

SEQ ID NO: 5214422 - DNA, 14 bp, Homo sapiens
aggtagaaggcaca

SEQ ID NO: 5214423 - DNA, 14 bp, Homo sapiens
aggtagaatgtaaa

SEQ ID NO: 5214424 - DNA, 19 bp, Homo sapiens
aggtagaatgtaaagcttg

SEQ ID NO: 5214425 - DNA, 22 bp, Homo sapiens
aggtagaattatctaatttata

SEQ ID NO: 5214426 - DNA, 20 bp, Homo sapiens
aggtagaccaggatttctaa

SEQ ID NO: 5214427 - DNA, 20 bp, Homo sapiens
aggtagacttttatgagaac

SEQ ID NO: 5214428 - DNA, 12 bp, Homo sapiens
aggtagaggaaa

SEQ ID NO: 5214429 - DNA, 16 bp, Homo sapiens
aggtagaggaaaatca

SEQ ID NO: 5214430 - DNA, 22 bp, Homo sapiens
aggcctggccctttcacccctc

SEQ ID NO: 5214431 - DNA, 16 bp, Homo sapiens
aggcctggccgcagtc

SEQ ID NO: 5214432 - DNA, 12 bp, Homo sapiens
aggcctggcctc

SEQ ID NO: 5214433 - DNA, 13 bp, Homo sapiens
aggcctggcctca

SEQ ID NO: 5214434 - DNA, 22 bp, Homo sapiens
aggcctggcctcggggcagggc

SEQ ID NO: 5214435 - DNA, 23 bp, Homo sapiens
aggcctggcctcggggcagggca

SEQ ID NO: 5214436 - DNA, 16 bp, Homo sapiens
aggcctggcctctggg

SEQ ID NO: 5214437 - DNA, 21 bp, Homo sapiens
aggcctggcctctgggcagtg

SEQ ID NO: 5214438 - DNA, 12 bp, Homo sapiens
aggcctggcctt

SEQ ID NO: 5214439 - DNA, 23 bp, Homo sapiens
aggcctggcgtcggccagagggg

SEQ ID NO: 5214440 - DNA, 18 bp, Homo sapiens
aggcctggctccccgagg

SEQ ID NO: 5214441 - DNA, 16 bp, Homo sapiens
aggcctggctctggag

SEQ ID NO: 5214442 - DNA, 18 bp, Homo sapiens
aggcctggctctggagcc

SEQ ID NO: 5214443 - DNA, 22 bp, Homo sapiens
aggcctggctggaggagcagca

SEQ ID NO: 5214444 - DNA, 15 bp, Homo sapiens
aggcctgggacccag

SEQ ID NO: 5214445 - DNA, 23 bp, Homo sapiens
aggcctgggacccagctactctg

SEQ ID NO: 5214446 - DNA, 16 bp, Homo sapiens
aggcctgggatgcagt

SEQ ID NO: 5214447 - DNA, 16 bp, Homo sapiens
aggcctgggcaggacc

SEQ ID NO: 5214448 - DNA, 19 bp, Homo sapiens
aggcctgggcaggaccctg

SEQ ID NO: 5214449 - DNA, 22 bp, Homo sapiens
aggcctgggcaggaccctgctg

SEQ ID NO: 5214450 - DNA, 13 bp, Homo sapiens
aggcctgggcagt

SEQ ID NO: 5214451 - DNA, 14 bp, Homo sapiens
aggcctgggcagtg

SEQ ID NO: 5214452 - DNA, 12 bp, Homo sapiens
aggcctgggccg

SEQ ID NO: 5214453 - DNA, 19 bp, Homo sapiens
aggcctgggccgctgccac

SEQ ID NO: 5214454 - DNA, 21 bp, Homo sapiens
aggcctggggccggtagaggc

SEQ ID NO: 5214455 - DNA, 22 bp, Homo sapiens
aggcctgggggacccctggctc

SEQ ID NO: 5214456 - DNA, 20 bp, Homo sapiens
aggcctgggggctgggcaga

SEQ ID NO: 5214457 - DNA, 15 bp, Homo sapiens
aggcctggggtggga

SEQ ID NO: 5214458 - DNA, 21 bp, Homo sapiens
aggcctggggtgggacaggga

SEQ ID NO: 5214459 - DNA, 22 bp, Homo sapiens
aggcctgggtcacgctcaagga

SEQ ID NO: 5214460 - DNA, 16 bp, Homo sapiens
aggcctgggtgctggc

SEQ ID NO: 5214461 - DNA, 12 bp, Homo sapiens
aggcctgggtgt

SEQ ID NO: 5214462 - DNA, 18 bp, Homo sapiens
aggcctggtcagcagagc

SEQ ID NO: 5214463 - DNA, 14 bp, Homo sapiens
aggcctggtctgga

SEQ ID NO: 5214464 - DNA, 16 bp, Homo sapiens
aggcctggtctggagc

SEQ ID NO: 5214465 - DNA, 22 bp, Homo sapiens
aggcctggtctggagcccctat

SEQ ID NO: 5214466 - DNA, 23 bp, Homo sapiens
aggcctggtctggagcccctatc

SEQ ID NO: 5214467 - DNA, 20 bp, Homo sapiens
aggcctggtgccctggccca

SEQ ID NO: 5214468 - DNA, 16 bp, Homo sapiens
aggcctgtccaccctg

SEQ ID NO: 5214469 - DNA, 18 bp, Homo sapiens
aggcctgtccaccctgcc

SEQ ID NO: 5214470 - DNA, 12 bp, Homo sapiens
aggcctgtgccc

SEQ ID NO: 5214471 - DNA, 17 bp, Homo sapiens
aggcctgtgcccactcc

SEQ ID NO: 5214472 - DNA, 17 bp, Homo sapiens
aggcctgtggctccctt

SEQ ID NO: 5214473 - DNA, 17 bp, Homo sapiens
aggcctgtggggagccg

SEQ ID NO: 5214474 - DNA, 22 bp, Homo sapiens
aggcctgtgtagctgtgacctg

SEQ ID NO: 5214475 - DNA, 17 bp, Homo sapiens
aggcctgttccctgagg

SEQ ID NO: 5214476 - DNA, 18 bp, Homo sapiens
aggcctgtttggcctctc

SEQ ID NO: 5214477 - DNA, 21 bp, Homo sapiens
aggccttagtacggctgctgc

SEQ ID NO: 5214478 - DNA, 21 bp, Homo sapiens
aggccttcagggttcagcagt

SEQ ID NO: 5214479 - DNA, 14 bp, Homo sapiens
aggccttcagttta

SEQ ID NO: 5214480 - DNA, 22 bp, Homo sapiens
aggccttcatcctcctccccag

SEQ ID NO: 5214481 - DNA, 13 bp, Homo sapiens
aggccttccactg

SEQ ID NO: 5214482 - DNA, 22 bp, Homo sapiens
aggccttccagaaagcaggagc

SEQ ID NO: 5214483 - DNA, 15 bp, Homo sapiens
aggccttccagctgc

SEQ ID NO: 5214484 - DNA, 15 bp, Homo sapiens
aggccttccctggcc

SEQ ID NO: 5214485 - DNA, 19 bp, Homo sapiens
aggccttcctcctctcaaa

SEQ ID NO: 5214486 - DNA, 18 bp, Homo sapiens
aggccttctctgaaggac

SEQ ID NO: 5214487 - DNA, 17 bp, Homo sapiens
aggccttctgtggggct

SEQ ID NO: 5214488 - DNA, 20 bp, Homo sapiens
aggccttctgtggggctggg

SEQ ID NO: 5214489 - DNA, 21 bp, Homo sapiens
aggccttctgtggggctgggc

SEQ ID NO: 5214490 - DNA, 18 bp, Homo sapiens
aggccttcttgtgatctt

SEQ ID NO: 5214491 - DNA, 15 bp, Homo sapiens
aggccttgagcacaa

SEQ ID NO: 5214492 - DNA, 16 bp, Homo sapiens
aggccttgcctggcct

SEQ ID NO: 5214493 - DNA, 12 bp, Homo sapiens
aggccttgcctt

SEQ ID NO: 5214494 - DNA, 14 bp, Homo sapiens
aggccttgccttgt

SEQ ID NO: 5214495 - DNA, 15 bp, Homo sapiens
aggccttgcgctgtt

SEQ ID NO: 5214496 - DNA, 11 bp, Homo sapiens
aggccttgctc

SEQ ID NO: 5214497 - DNA, 24 bp, Homo sapiens
aggccttgctcactcactcactcc

SEQ ID NO: 5214498 - DNA, 14 bp, Homo sapiens
aggccttgctgact

SEQ ID NO: 5214499 - DNA, 22 bp, Homo sapiens
aggccttgctggggtccagggc

SEQ ID NO: 5214500 - DNA, 23 bp, Homo sapiens
aggccttggggcatgacccagtg

SEQ ID NO: 5214501 - DNA, 21 bp, Homo sapiens
aggccttgggtgttccacctg

SEQ ID NO: 5214502 - DNA, 14 bp, Homo sapiens
aggccttgtcccag

SEQ ID NO: 5214503 - DNA, 17 bp, Homo sapiens
aggccttgtgtgtcagg

SEQ ID NO: 5214504 - DNA, 15 bp, Homo sapiens
aggcctttaaaattt

SEQ ID NO: 5214505 - DNA, 15 bp, Homo sapiens
aggcctttccccagt

SEQ ID NO: 5214506 - DNA, 16 bp, Homo sapiens
aggcctttccctaagc

SEQ ID NO: 5214507 - DNA, 16 bp, Homo sapiens
aggcctttcctctgca

SEQ ID NO: 5214508 - DNA, 18 bp, Homo sapiens
aggcctttcctctgcacg

SEQ ID NO: 5214509 - DNA, 20 bp, Homo sapiens
aggcctttcctctgcacgct

SEQ ID NO: 5214510 - DNA, 22 bp, Homo sapiens
aggcctttctagaattttcttt

SEQ ID NO: 5214511 - DNA, 15 bp, Homo sapiens
aggcctttcttctgt

SEQ ID NO: 5214512 - DNA, 18 bp, Homo sapiens
aggcctttcttctgtgtt

SEQ ID NO: 5214513 - DNA, 19 bp, Homo sapiens
aggcctttcttctgtgtta

SEQ ID NO: 5214514 - DNA, 20 bp, Homo sapiens
aggcctttcttctgtgttaa

SEQ ID NO: 5214515 - DNA, 10 bp, Homo sapiens
aggcctttgg

SEQ ID NO: 5214516 - DNA, 17 bp, Homo sapiens
aggcctttggaggggaa

SEQ ID NO: 5214517 - DNA, 17 bp, Homo sapiens
aggccttttaacatttt

SEQ ID NO: 5214518 - DNA, 22 bp, Homo sapiens
aggccttttatgtaatttcttt

SEQ ID NO: 5214519 - DNA, 16 bp, Homo sapiens
aggccttttggaatgt

SEQ ID NO: 5214520 - DNA, 21 bp, Homo sapiens
aggcgaaagaaaactctattt

SEQ ID NO: 5214521 - DNA, 12 bp, Homo sapiens
aggcgaataaat

SEQ ID NO: 5214522 - DNA, 13 bp, Homo sapiens
aggcgaataaatg

SEQ ID NO: 5214523 - DNA, 18 bp, Homo sapiens
aggcgacaaaatctcctg

SEQ ID NO: 5214524 - DNA, 15 bp, Homo sapiens
aggcgaccaccgccc

SEQ ID NO: 5214525 - DNA, 17 bp, Homo sapiens
aggcgaccgggcctccc

SEQ ID NO: 5214526 - DNA, 18 bp, Homo sapiens
aggcgacgcggttttttc

SEQ ID NO: 5214527 - DNA, 18 bp, Homo sapiens
aggcgacttcctctccag

SEQ ID NO: 5214528 - DNA, 23 bp, Homo sapiens
aggcgacttcctctccagccttc

SEQ ID NO: 5214529 - DNA, 18 bp, Homo sapiens
aggcgagaagggctgctt

SEQ ID NO: 5214530 - DNA, 14 bp, Homo sapiens
aggcgagcagggca

SEQ ID NO: 5214531 - DNA, 13 bp, Homo sapiens
aggcgagccaggc

SEQ ID NO: 5214532 - DNA, 14 bp, Homo sapiens
aggcgagcctggcc

SEQ ID NO: 5214533 - DNA, 18 bp, Homo sapiens
aggcgagcctggccaaca

SEQ ID NO: 5214534 - DNA, 13 bp, Homo sapiens
aggcgaggccctt

SEQ ID NO: 5214535 - DNA, 14 bp, Homo sapiens
aggcgaggctgccc

SEQ ID NO: 5214536 - DNA, 17 bp, Homo sapiens
aggcgaggctgcctctg

SEQ ID NO: 5214537 - DNA, 22 bp, Homo sapiens
aggcgaggctgcctctgggtga

SEQ ID NO: 5214538 - DNA, 22 bp, Homo sapiens
aggcgaggggacagcccagcgc

SEQ ID NO: 5214539 - DNA, 18 bp, Homo sapiens
aggcgagtcaccctcctc

SEQ ID NO: 5214540 - DNA, 22 bp, Homo sapiens
aggcgagtcaccctcctcacag

SEQ ID NO: 5214541 - DNA, 23 bp, Homo sapiens
aggcgagtctggggacctggcac

SEQ ID NO: 5214542 - DNA, 20 bp, Homo sapiens
aggcgatcacaacgtgcatt

SEQ ID NO: 5214543 - DNA, 21 bp, Homo sapiens
aggcgatcacaacgtgcattg

SEQ ID NO: 5214544 - DNA, 15 bp, Homo sapiens
aggcgatgccacgct

SEQ ID NO: 5214545 - DNA, 20 bp, Homo sapiens
aggcgatggggcaagacaga

SEQ ID NO: 5214546 - DNA, 22 bp, Homo sapiens
aggcgatgtggtgaccccaccc

SEQ ID NO: 5214547 - DNA, 19 bp, Homo sapiens
aggcgcaagggaggcccag

SEQ ID NO: 5214548 - DNA, 22 bp, Homo sapiens
aggcgcactttcctcctggcag

SEQ ID NO: 5214549 - DNA, 22 bp, Homo sapiens
aggcgcagaggtcccagcccca

SEQ ID NO: 5214550 - DNA, 22 bp, Homo sapiens
aggcgcagcccgaagcccagtt

SEQ ID NO: 5214551 - DNA, 20 bp, Homo sapiens
aggcgcagggacatggggca

SEQ ID NO: 5214552 - DNA, 20 bp, Homo sapiens
aggcgcatgagtatctgtgg

SEQ ID NO: 5214553 - DNA, 14 bp, Homo sapiens
aggcgcatgtctgc

SEQ ID NO: 5214554 - DNA, 16 bp, Homo sapiens
aggcgcatgtctgcac

SEQ ID NO: 5214555 - DNA, 18 bp, Homo sapiens
aggcgcatgtgccagttg

SEQ ID NO: 5214556 - DNA, 12 bp, Homo sapiens
aggcgcccacct

SEQ ID NO: 5214557 - DNA, 13 bp, Homo sapiens
aggcgcccacctg

SEQ ID NO: 5214558 - DNA, 15 bp, Homo sapiens
aggcgcccacctgcc

SEQ ID NO: 5214559 - DNA, 17 bp, Homo sapiens
aggcgcccacctgccca

SEQ ID NO: 5214560 - DNA, 12 bp, Homo sapiens
aggcgcccccgc

SEQ ID NO: 5214561 - DNA, 13 bp, Homo sapiens
aggcgcccctggg

SEQ ID NO: 5214562 - DNA, 15 bp, Homo sapiens
aggcgcccctggggt

SEQ ID NO: 5214563 - DNA, 18 bp, Homo sapiens
aggcgcccctggggtggg

SEQ ID NO: 5214564 - DNA, 16 bp, Homo sapiens
aggcgccctcccttcc

SEQ ID NO: 5214565 - DNA, 20 bp, Homo sapiens
aggcgcctataatcccagct

SEQ ID NO: 5214566 - DNA, 13 bp, Homo sapiens
aggcgcctggcac

SEQ ID NO: 5214567 - DNA, 19 bp, Homo sapiens
aggcgcctggcacatttca

SEQ ID NO: 5214568 - DNA, 14 bp, Homo sapiens
aggcgcctggtgtg

SEQ ID NO: 5214569 - DNA, 15 bp, Homo sapiens
aggcgccttcctggg

SEQ ID NO: 5214570 - DNA, 22 bp, Homo sapiens
aggcgcgcacaccacgcccagc

SEQ ID NO: 5214571 - DNA, 12 bp, Homo sapiens
aggcgcgcaccg

SEQ ID NO: 5214572 - DNA, 14 bp, Homo sapiens
aggcgcgcaccgcc

SEQ ID NO: 5214573 - DNA, 21 bp, Homo sapiens
aggcgcgcaccgcccaacccc

SEQ ID NO: 5214574 - DNA, 19 bp, Homo sapiens
aggcgcggcggctctgccc

SEQ ID NO: 5214575 - DNA, 16 bp, Homo sapiens
aggcgcgtctgcccca

SEQ ID NO: 5214576 - DNA, 19 bp, Homo sapiens
aggcgcgtctgccccaccc

SEQ ID NO: 5214577 - DNA, 22 bp, Homo sapiens
aggcgcgtctgccccaccctca

SEQ ID NO: 5214578 - DNA, 17 bp, Homo sapiens
aggcgcgtttgtgcata

SEQ ID NO: 5214579 - DNA, 14 bp, Homo sapiens
aggcgctaatttat

SEQ ID NO: 5214580 - DNA, 19 bp, Homo sapiens
aggcgctgagactgtgctg

SEQ ID NO: 5214581 - DNA, 18 bp, Homo sapiens
aggcgctgggtgcctgca

SEQ ID NO: 5214582 - DNA, 15 bp, Homo sapiens
aggcgcttcccaact

SEQ ID NO: 5214583 - DNA, 17 bp, Homo sapiens
aggcggaaaccttgcag

SEQ ID NO: 5214584 - DNA, 19 bp, Homo sapiens
aggcggacaaagttcagtg

SEQ ID NO: 5214585 - DNA, 20 bp, Homo sapiens
aggcggagagtacagtgagc

SEQ ID NO: 5214586 - DNA, 24 bp, Homo sapiens
aggcggagagtacagtgagccaag

SEQ ID NO: 5214587 - DNA, 17 bp, Homo sapiens
aggcggagcccagccct

SEQ ID NO: 5214588 - DNA, 20 bp, Homo sapiens
aggcggagggtctccctggg

SEQ ID NO: 5214589 - DNA, 15 bp, Homo sapiens
aggcggcacagaggc

SEQ ID NO: 5214590 - DNA, 19 bp, Homo sapiens
aggcggcacattggcagtg

SEQ ID NO: 5214591 - DNA, 23 bp, Homo sapiens
aggcggcactccaacctaacctg

SEQ ID NO: 5214592 - DNA, 14 bp, Homo sapiens
aggcggcagctctt

SEQ ID NO: 5214593 - DNA, 12 bp, Homo sapiens
aggcggcagctg

SEQ ID NO: 5214594 - DNA, 15 bp, Homo sapiens
aggcggcagctgggg

SEQ ID NO: 5214595 - DNA, 17 bp, Homo sapiens
aggcggcaggcagagaa

SEQ ID NO: 5214596 - DNA, 11 bp, Homo sapiens
aggcggccagg

SEQ ID NO: 5214597 - DNA, 14 bp, Homo sapiens
aggcggccagggcg

SEQ ID NO: 5214598 - DNA, 15 bp, Homo sapiens
aggcggcccggccag

SEQ ID NO: 5214599 - DNA, 13 bp, Homo sapiens
aggcggccctggg

SEQ ID NO: 5214600 - DNA, 21 bp, Homo sapiens
aggcggccggccgcactggga

SEQ ID NO: 5214601 - DNA, 16 bp, Homo sapiens
aggcggcgatttttgt

SEQ ID NO: 5214602 - DNA, 18 bp, Homo sapiens
aggcggcgtgggcgaggc

SEQ ID NO: 5214603 - DNA, 16 bp, Homo sapiens
aggcggctcctcctca

SEQ ID NO: 5214604 - DNA, 21 bp, Homo sapiens
aggcggctctggttcctccag

SEQ ID NO: 5214605 - DNA, 14 bp, Homo sapiens
aggcgggaaggagg

SEQ ID NO: 5214606 - DNA, 20 bp, Homo sapiens
aggcgggaggaggtgtgagg

SEQ ID NO: 5214607 - DNA, 19 bp, Homo sapiens
aggcgggaggatcacttga

SEQ ID NO: 5214608 - DNA, 18 bp, Homo sapiens
aggtagaggaaaatcaat

SEQ ID NO: 5214609 - DNA, 16 bp, Homo sapiens
aggtagagtcattcat

SEQ ID NO: 5214610 - DNA, 17 bp, Homo sapiens
aggtagagtcattcata

SEQ ID NO: 5214611 - DNA, 18 bp, Homo sapiens
aggtagagtcattcatat

SEQ ID NO: 5214612 - DNA, 21 bp, Homo sapiens
aggtagagtggtcagttgaac

SEQ ID NO: 5214613 - DNA, 21 bp, Homo sapiens
aggtagagtttgaaggaggtg

SEQ ID NO: 5214614 - DNA, 20 bp, Homo sapiens
aggtagatcgcttgagccca

SEQ ID NO: 5214615 - DNA, 15 bp, Homo sapiens
aggtagcaacaacag

SEQ ID NO: 5214616 - DNA, 17 bp, Homo sapiens
aggtagcaagagagcag

SEQ ID NO: 5214617 - DNA, 13 bp, Homo sapiens
aggtagcacagtg

SEQ ID NO: 5214618 - DNA, 22 bp, Homo sapiens
aggtagcactctcagagtgttt

SEQ ID NO: 5214619 - DNA, 15 bp, Homo sapiens
aggtagcagcaaata

SEQ ID NO: 5214620 - DNA, 21 bp, Homo sapiens
aggtagcatgggtccaagaga

SEQ ID NO: 5214621 - DNA, 16 bp, Homo sapiens
aggtagcattgaaaaa

SEQ ID NO: 5214622 - DNA, 15 bp, Homo sapiens
aggtagcccagcact

SEQ ID NO: 5214623 - DNA, 17 bp, Homo sapiens
aggtagcccagcactgt

SEQ ID NO: 5214624 - DNA, 18 bp, Homo sapiens
aggtagccccctcttccc

SEQ ID NO: 5214625 - DNA, 15 bp, Homo sapiens
aggtagccgggctct

SEQ ID NO: 5214626 - DNA, 17 bp, Homo sapiens
aggtagccgggctctgc

SEQ ID NO: 5214627 - DNA, 13 bp, Homo sapiens
aggtagcctgctg

SEQ ID NO: 5214628 - DNA, 15 bp, Homo sapiens
aggtagcctgctggt

SEQ ID NO: 5214629 - DNA, 17 bp, Homo sapiens
aggtagcctgctgtggg

SEQ ID NO: 5214630 - DNA, 16 bp, Homo sapiens
aggtagccttgtgttc

SEQ ID NO: 5214631 - DNA, 19 bp, Homo sapiens
aggtagccttgtgttctga

SEQ ID NO: 5214632 - DNA, 15 bp, Homo sapiens
aggtagcgagctgct

SEQ ID NO: 5214633 - DNA, 17 bp, Homo sapiens
aggtagcgagctgctct

SEQ ID NO: 5214634 - DNA, 23 bp, Homo sapiens
aggtagctatagttgcagcccaa

SEQ ID NO: 5214635 - DNA, 19 bp, Homo sapiens
aggtagctgaaaggggaag

SEQ ID NO: 5214636 - DNA, 18 bp, Homo sapiens
aggtaggaagcaacagct

SEQ ID NO: 5214637 - DNA, 20 bp, Homo sapiens
aggtaggaatattatatttg

SEQ ID NO: 5214638 - DNA, 20 bp, Homo sapiens
aggtaggcaccacagagaag

SEQ ID NO: 5214639 - DNA, 20 bp, Homo sapiens
aggtaggcccttgtcctgcc

SEQ ID NO: 5214640 - DNA, 22 bp, Homo sapiens
aggtaggcccttgtcctgccag

SEQ ID NO: 5214641 - DNA, 20 bp, Homo sapiens
aggtagggccagctcacaag

SEQ ID NO: 5214642 - DNA, 13 bp, Homo sapiens
aggtagggctggc

SEQ ID NO: 5214643 - DNA, 12 bp, Homo sapiens
aggtagggttta

SEQ ID NO: 5214644 - DNA, 15 bp, Homo sapiens
aggtagggtttaatc

SEQ ID NO: 5214645 - DNA, 14 bp, Homo sapiens
aggtaggtgtattc

SEQ ID NO: 5214646 - DNA, 14 bp, Homo sapiens
aggtaggttttaaa

SEQ ID NO: 5214647 - DNA, 17 bp, Homo sapiens
aggtagtcatgctgtgc

SEQ ID NO: 5214648 - DNA, 21 bp, Homo sapiens
aggtagtcatgctgtgcattt

SEQ ID NO: 5214649 - DNA, 19 bp, Homo sapiens
aggtagttcaagaaatgaa

SEQ ID NO: 5214650 - DNA, 18 bp, Homo sapiens
aggtagttgggtagaaaa

SEQ ID NO: 5214651 - DNA, 19 bp, Homo sapiens
aggtagttgggtagaaaaa

SEQ ID NO: 5214652 - DNA, 20 bp, Homo sapiens
aggtagttgggtagaaaaat

SEQ ID NO: 5214653 - DNA, 23 bp, Homo sapiens
aggtagttgggtagaaaaattat

SEQ ID NO: 5214654 - DNA, 15 bp, Homo sapiens
aggtagtttcaaagg

SEQ ID NO: 5214655 - DNA, 19 bp, Homo sapiens
aggtagtttcaaaggccac

SEQ ID NO: 5214656 - DNA, 19 bp, Homo sapiens
aggtagtttggatattttt

SEQ ID NO: 5214657 - DNA, 21 bp, Homo sapiens
aggtagtttggatatttttgt

SEQ ID NO: 5214658 - DNA, 15 bp, Homo sapiens
aggtataaaaaataa

SEQ ID NO: 5214659 - DNA, 19 bp, Homo sapiens
aggtataaaaaataagtaa

SEQ ID NO: 5214660 - DNA, 16 bp, Homo sapiens
aggtataaggatcttt

SEQ ID NO: 5214661 - DNA, 13 bp, Homo sapiens
aggtataattaaa

SEQ ID NO: 5214662 - DNA, 15 bp, Homo sapiens
aggtataattgtgtg

SEQ ID NO: 5214663 - DNA, 15 bp, Homo sapiens
aggtataattttatg

SEQ ID NO: 5214664 - DNA, 15 bp, Homo sapiens
aggtatacaatgttc

SEQ ID NO: 5214665 - DNA, 13 bp, Homo sapiens
aggtatactatgt

SEQ ID NO: 5214666 - DNA, 17 bp, Homo sapiens
aggtatactatgtaagg

SEQ ID NO: 5214667 - DNA, 14 bp, Homo sapiens
aggtatatactttg

SEQ ID NO: 5214668 - DNA, 16 bp, Homo sapiens
aggtatatagaacaca

SEQ ID NO: 5214669 - DNA, 21 bp, Homo sapiens
aggtatatgatgagcagactt

SEQ ID NO: 5214670 - DNA, 17 bp, Homo sapiens
aggtatcaaaatagttt

SEQ ID NO: 5214671 - DNA, 22 bp, Homo sapiens
aggtatcaactaggggaggaga

SEQ ID NO: 5214672 - DNA, 21 bp, Homo sapiens
aggtatcacacactttctgac

SEQ ID NO: 5214673 - DNA, 20 bp, Homo sapiens
aggtatcaggcacaggcagg

SEQ ID NO: 5214674 - DNA, 18 bp, Homo sapiens
aggtatcctgggggaaga

SEQ ID NO: 5214675 - DNA, 19 bp, Homo sapiens
aggtatcctgggggaagag

SEQ ID NO: 5214676 - DNA, 21 bp, Homo sapiens
aggtatcctgggggaagagga

SEQ ID NO: 5214677 - DNA, 15 bp, Homo sapiens
aggtatctagagctt

SEQ ID NO: 5214678 - DNA, 17 bp, Homo sapiens
aggtatctgatgatgtt

SEQ ID NO: 5214679 - DNA, 21 bp, Homo sapiens
aggtatctgatgatgttctga

SEQ ID NO: 5214680 - DNA, 15 bp, Homo sapiens
aggtatctggtatct

SEQ ID NO: 5214681 - DNA, 18 bp, Homo sapiens
aggtatcttttttaaatg

SEQ ID NO: 5214682 - DNA, 20 bp, Homo sapiens
aggtatgaccttctaggaag

SEQ ID NO: 5214683 - DNA, 23 bp, Homo sapiens
aggtatgaccttctaggaagctc

SEQ ID NO: 5214684 - DNA, 18 bp, Homo sapiens
aggtatgatctcttctgg

SEQ ID NO: 5214685 - DNA, 15 bp, Homo sapiens
aggtatgatgtgctg

SEQ ID NO: 5214686 - DNA, 19 bp, Homo sapiens
aggtatgatgtgctgctgg

SEQ ID NO: 5214687 - DNA, 17 bp, Homo sapiens
aggtatgcaatcaaatc

SEQ ID NO: 5214688 - DNA, 21 bp, Homo sapiens
aggtatgcaatcaaatctgct

SEQ ID NO: 5214689 - DNA, 12 bp, Homo sapiens
aggtatggccat

SEQ ID NO: 5214690 - DNA, 16 bp, Homo sapiens
aggtatggccatgccc

SEQ ID NO: 5214691 - DNA, 20 bp, Homo sapiens
aggtatggccatgccctaga

SEQ ID NO: 5214692 - DNA, 23 bp, Homo sapiens
aggtatggctctgcacccctctg

SEQ ID NO: 5214693 - DNA, 14 bp, Homo sapiens
aggtatgggacctg

SEQ ID NO: 5214694 - DNA, 13 bp, Homo sapiens
aggtatgggctgg

SEQ ID NO: 5214695 - DNA, 14 bp, Homo sapiens
aggtatgggctggg

SEQ ID NO: 5214696 - DNA, 17 bp, Homo sapiens
aggtatgggctgggggc

SEQ ID NO: 5214697 - DNA, 18 bp, Homo sapiens
aggtatgggctgggggct

SEQ ID NO: 5214698 - DNA, 17 bp, Homo sapiens
aggtatgtctgtgccat

SEQ ID NO: 5214699 - DNA, 21 bp, Homo sapiens
aggtatgtgcccctcctgggt

SEQ ID NO: 5214700 - DNA, 14 bp, Homo sapiens
aggtatgttgcctt

SEQ ID NO: 5214701 - DNA, 20 bp, Homo sapiens
aggtatgttgcctttatggt

SEQ ID NO: 5214702 - DNA, 23 bp, Homo sapiens
aggtattaaaggttaaattgctt

SEQ ID NO: 5214703 - DNA, 19 bp, Homo sapiens
aggtattacaagtaatgta

SEQ ID NO: 5214704 - DNA, 18 bp, Homo sapiens
aggtattattatctttaa

SEQ ID NO: 5214705 - DNA, 23 bp, Homo sapiens
aggtattgattgaaaaaagagaa

SEQ ID NO: 5214706 - DNA, 14 bp, Homo sapiens
aggtattgcactac

SEQ ID NO: 5214707 - DNA, 17 bp, Homo sapiens
aggtattggcctgttca

SEQ ID NO: 5214708 - DNA, 19 bp, Homo sapiens
aggtattggtaggttactc

SEQ ID NO: 5214709 - DNA, 21 bp, Homo sapiens
aggtattgtctactctgaaga

SEQ ID NO: 5214710 - DNA, 15 bp, Homo sapiens
aggtatttaagactg

SEQ ID NO: 5214711 - DNA, 17 bp, Homo sapiens
aggtatttaagactgat

SEQ ID NO: 5214712 - DNA, 17 bp, Homo sapiens
aggtatttagaagcaga

SEQ ID NO: 5214713 - DNA, 19 bp, Homo sapiens
aggtatttcagaaggagaa

SEQ ID NO: 5214714 - DNA, 12 bp, Homo sapiens
aggtatttgaaa

SEQ ID NO: 5214715 - DNA, 23 bp, Homo sapiens
aggtatttgggaaacttgtcact

SEQ ID NO: 5214716 - DNA, 19 bp, Homo sapiens
aggtattttgtttctttta

SEQ ID NO: 5214717 - DNA, 20 bp, Homo sapiens
aggtattttgtttcttttaa

SEQ ID NO: 5214718 - DNA, 17 bp, Homo sapiens
aggtatttttgaaagca

SEQ ID NO: 5214719 - DNA, 15 bp, Homo sapiens
aggtatttttgaagt

SEQ ID NO: 5214720 - DNA, 17 bp, Homo sapiens
aggtatttttttaaatc

SEQ ID NO: 5214721 - DNA, 22 bp, Homo sapiens
aggtatttttttaaatcaagga

SEQ ID NO: 5214722 - DNA, 17 bp, Homo sapiens
aggtcaaaaacaaacta

SEQ ID NO: 5214723 - DNA, 20 bp, Homo sapiens
aggtcaaaatagtgccacta

SEQ ID NO: 5214724 - DNA, 18 bp, Homo sapiens
aggtcaaacaggctgtaa

SEQ ID NO: 5214725 - DNA, 13 bp, Homo sapiens
aggtcaacagaat

SEQ ID NO: 5214726 - DNA, 22 bp, Homo sapiens
aggtcaacagaatgaaaaatga

SEQ ID NO: 5214727 - DNA, 17 bp, Homo sapiens
aggtcaacagagaaggc

SEQ ID NO: 5214728 - DNA, 19 bp, Homo sapiens
aggtcaacagagaaggcag

SEQ ID NO: 5214729 - DNA, 21 bp, Homo sapiens
aggtcaacagagaaggcagga

SEQ ID NO: 5214730 - DNA, 13 bp, Homo sapiens
aggtcaacatcta

SEQ ID NO: 5214731 - DNA, 18 bp, Homo sapiens
aggtcaagaaatgtgact

SEQ ID NO: 5214732 - DNA, 17 bp, Homo sapiens
aggtcaagaccagcctg

SEQ ID NO: 5214733 - DNA, 15 bp, Homo sapiens
aggtcaagactgtgg

SEQ ID NO: 5214734 - DNA, 16 bp, Homo sapiens
aggtcaagactgtggt

SEQ ID NO: 5214735 - DNA, 14 bp, Homo sapiens
aggtcaagcccaga

SEQ ID NO: 5214736 - DNA, 16 bp, Homo sapiens
aggtcaagcccaggag

SEQ ID NO: 5214737 - DNA, 15 bp, Homo sapiens
aggtcaaggaaggaa

SEQ ID NO: 5214738 - DNA, 16 bp, Homo sapiens
aggtcaagttgtcagg

SEQ ID NO: 5214739 - DNA, 17 bp, Homo sapiens
aggtcaagttgtcaggt

SEQ ID NO: 5214740 - DNA, 19 bp, Homo sapiens
aggtcaagttgtcaggtta

SEQ ID NO: 5214741 - DNA, 14 bp, Homo sapiens
aggtcaataaactt

SEQ ID NO: 5214742 - DNA, 22 bp, Homo sapiens
aggtcaataaagcagagccaag

SEQ ID NO: 5214743 - DNA, 13 bp, Homo sapiens
aggtcaataacac

SEQ ID NO: 5214744 - DNA, 17 bp, Homo sapiens
aggtcaataaggtcaag

SEQ ID NO: 5214745 - DNA, 21 bp, Homo sapiens
aggtcaatacagtacaggcag

SEQ ID NO: 5214746 - DNA, 15 bp, Homo sapiens
aggtcaatgaaatat

SEQ ID NO: 5214747 - DNA, 19 bp, Homo sapiens
aggtcaatgaaatatttgc

SEQ ID NO: 5214748 - DNA, 22 bp, Homo sapiens
aggtcacacgaccggggccagc

SEQ ID NO: 5214749 - DNA, 23 bp, Homo sapiens
aggtcacacgaggggccccgtgt

SEQ ID NO: 5214750 - DNA, 18 bp, Homo sapiens
aggtcacagctggatctg

SEQ ID NO: 5214751 - DNA, 20 bp, Homo sapiens
aggtcacatatgtctgtatc

SEQ ID NO: 5214752 - DNA, 18 bp, Homo sapiens
aggtcacattcaggaaga

SEQ ID NO: 5214753 - DNA, 19 bp, Homo sapiens
aggtcacattcaggaagat

SEQ ID NO: 5214754 - DNA, 14 bp, Homo sapiens
aggtcaccagctgc

SEQ ID NO: 5214755 - DNA, 15 bp, Homo sapiens
aggtcaccagctgct

SEQ ID NO: 5214756 - DNA, 22 bp, Homo sapiens
aggtcaccaggggaggagcctg

SEQ ID NO: 5214757 - DNA, 16 bp, Homo sapiens
aggtcaccatcctcag

SEQ ID NO: 5214758 - DNA, 16 bp, Homo sapiens
aggtcacccatcagga

SEQ ID NO: 5214759 - DNA, 14 bp, Homo sapiens
aggtcacctcactc

SEQ ID NO: 5214760 - DNA, 18 bp, Homo sapiens
aggtcacgttggccctca

SEQ ID NO: 5214761 - DNA, 14 bp, Homo sapiens
aggtcactccacca

SEQ ID NO: 5214762 - DNA, 18 bp, Homo sapiens
aggtcactccaccatccc

SEQ ID NO: 5214763 - DNA, 14 bp, Homo sapiens
aggtcactcctggg

SEQ ID NO: 5214764 - DNA, 15 bp, Homo sapiens
aggtcactctccagc

SEQ ID NO: 5214765 - DNA, 17 bp, Homo sapiens
aggtcactctccagcag

SEQ ID NO: 5214766 - DNA, 18 bp, Homo sapiens
aggtcactctgggcctgg

SEQ ID NO: 5214767 - DNA, 21 bp, Homo sapiens
aggtcactcttcctgcaagga

SEQ ID NO: 5214768 - DNA, 12 bp, Homo sapiens
aggtcactgcta

SEQ ID NO: 5214769 - DNA, 16 bp, Homo sapiens
aggtcactggaaaggg

SEQ ID NO: 5214770 - DNA, 20 bp, Homo sapiens
aggtcactggaaaggggaga

SEQ ID NO: 5214771 - DNA, 14 bp, Homo sapiens
aggtcactggctct

SEQ ID NO: 5214772 - DNA, 15 bp, Homo sapiens
aggtcactggctctc

SEQ ID NO: 5214773 - DNA, 17 bp, Homo sapiens
aggtcactggctctcca

SEQ ID NO: 5214774 - DNA, 19 bp, Homo sapiens
aggtcactggctctccaag

SEQ ID NO: 5214775 - DNA, 16 bp, Homo sapiens
aggtcactgtttcctg

SEQ ID NO: 5214776 - DNA, 23 bp, Homo sapiens
aggtcactttttttttttttccc

SEQ ID NO: 5214777 - DNA, 12 bp, Homo sapiens
aggtcagagatg

SEQ ID NO: 5214778 - DNA, 18 bp, Homo sapiens
aggtcagagatgggctga

SEQ ID NO: 5214779 - DNA, 15 bp, Homo sapiens
aggtcagagcccagg

SEQ ID NO: 5214780 - DNA, 16 bp, Homo sapiens
aggtcagagcccagga

SEQ ID NO: 5214781 - DNA, 14 bp, Homo sapiens
aggtcagagcctgc

SEQ ID NO: 5214782 - DNA, 15 bp, Homo sapiens
aggtcagagcctgca

SEQ ID NO: 5214783 - DNA, 17 bp, Homo sapiens
aggtcagagcctgcagt

SEQ ID NO: 5214784 - DNA, 21 bp, Homo sapiens
aggtcagcacatctcaacagg

SEQ ID NO: 5214785 - DNA, 12 bp, Homo sapiens
aggtcagcccat

SEQ ID NO: 5214786 - DNA, 17 bp, Homo sapiens
aggtcagcccatggagg

SEQ ID NO: 5214787 - DNA, 14 bp, Homo sapiens
aggcgggagggcct

SEQ ID NO: 5214788 - DNA, 14 bp, Homo sapiens
aggcgggagtggag

SEQ ID NO: 5214789 - DNA, 13 bp, Homo sapiens
aggcgggccagcc

SEQ ID NO: 5214790 - DNA, 16 bp, Homo sapiens
aggcgggccagccagg

SEQ ID NO: 5214791 - DNA, 14 bp, Homo sapiens
aggcgggcccatga

SEQ ID NO: 5214792 - DNA, 15 bp, Homo sapiens
aggcgggcggtcagg

SEQ ID NO: 5214793 - DNA, 14 bp, Homo sapiens
aggcgggctcaagg

SEQ ID NO: 5214794 - DNA, 14 bp, Homo sapiens
aggcgggcttggaa

SEQ ID NO: 5214795 - DNA, 15 bp, Homo sapiens
aggcggggcgcccca

SEQ ID NO: 5214796 - DNA, 13 bp, Homo sapiens
aggcggggctcta

SEQ ID NO: 5214797 - DNA, 16 bp, Homo sapiens
aggcggggcttgcctt

SEQ ID NO: 5214798 - DNA, 23 bp, Homo sapiens
aggcgggggagcctggagcccct

SEQ ID NO: 5214799 - DNA, 17 bp, Homo sapiens
aggcgggggctgccctt

SEQ ID NO: 5214800 - DNA, 21 bp, Homo sapiens
aggcggggggggcgcctggag

SEQ ID NO: 5214801 - DNA, 20 bp, Homo sapiens
aggcgggggtttgagccctg

SEQ ID NO: 5214802 - DNA, 21 bp, Homo sapiens
aggcgggggtttgagccctgg

SEQ ID NO: 5214803 - DNA, 22 bp, Homo sapiens
aggcgggggtttgagccctgga

SEQ ID NO: 5214804 - DNA, 20 bp, Homo sapiens
aggcggggtggcggtggacc

SEQ ID NO: 5214805 - DNA, 17 bp, Homo sapiens
aggcggtatccagaggt

SEQ ID NO: 5214806 - DNA, 21 bp, Homo sapiens
aggcggtccccatccccacca

SEQ ID NO: 5214807 - DNA, 23 bp, Homo sapiens
aggcggtccccatccccaccagc

SEQ ID NO: 5214808 - DNA, 14 bp, Homo sapiens
aggcggtgggcacc

SEQ ID NO: 5214809 - DNA, 15 bp, Homo sapiens
aggcggtttccagga

SEQ ID NO: 5214810 - DNA, 18 bp, Homo sapiens
aggcggtttccaggaaga

SEQ ID NO: 5214811 - DNA, 18 bp, Homo sapiens
aggcgtagggccagggct

SEQ ID NO: 5214812 - DNA, 21 bp, Homo sapiens
aggcgtagggccagggctctg

SEQ ID NO: 5214813 - DNA, 17 bp, Homo sapiens
aggcgtcccgcacctgt

SEQ ID NO: 5214814 - DNA, 19 bp, Homo sapiens
aggcgtcccgcacctgtct

SEQ ID NO: 5214815 - DNA, 21 bp, Homo sapiens
aggcgtcccgcacctgtctga

SEQ ID NO: 5214816 - DNA, 17 bp, Homo sapiens
aggcgtcctggtgagga

SEQ ID NO: 5214817 - DNA, 19 bp, Homo sapiens
aggcgtcttcatctccctg

SEQ ID NO: 5214818 - DNA, 20 bp, Homo sapiens
aggcgtcttcatctccctgc

SEQ ID NO: 5214819 - DNA, 16 bp, Homo sapiens
aggcgtcttgtatttt

SEQ ID NO: 5214820 - DNA, 15 bp, Homo sapiens
aggcgtgactcagca

SEQ ID NO: 5214821 - DNA, 21 bp, Homo sapiens
aggcgtgagccaccgtgcctg

SEQ ID NO: 5214822 - DNA, 16 bp, Homo sapiens
aggcgtgcaaggggct

SEQ ID NO: 5214823 - DNA, 20 bp, Homo sapiens
aggcgtgcccccctcctcca

SEQ ID NO: 5214824 - DNA, 16 bp, Homo sapiens
aggcgtggagctgcct

SEQ ID NO: 5214825 - DNA, 17 bp, Homo sapiens
aggcgtggaggagagga

SEQ ID NO: 5214826 - DNA, 18 bp, Homo sapiens
aggcgtggcttctgcagg

SEQ ID NO: 5214827 - DNA, 23 bp, Homo sapiens
aggcgtgggatccagagagaagc

SEQ ID NO: 5214828 - DNA, 14 bp, Homo sapiens
aggcgtgtggcagc

SEQ ID NO: 5214829 - DNA, 15 bp, Homo sapiens
aggcgtgtggcagcc

SEQ ID NO: 5214830 - DNA, 19 bp, Homo sapiens
aggcgttagtgggcaggtg

SEQ ID NO: 5214831 - DNA, 18 bp, Homo sapiens
aggcgttcttcgaggtgg

SEQ ID NO: 5214832 - DNA, 17 bp, Homo sapiens
aggcgttgctttcactc

SEQ ID NO: 5214833 - DNA, 14 bp, Homo sapiens
aggcgtttggagaa

SEQ ID NO: 5214834 - DNA, 21 bp, Homo sapiens
aggcgtttggagaaggtctgt

SEQ ID NO: 5214835 - DNA, 21 bp, Homo sapiens
aggctaaaacaaatctcagaa

SEQ ID NO: 5214836 - DNA, 18 bp, Homo sapiens
aggctaaaaggcttccag

SEQ ID NO: 5214837 - DNA, 19 bp, Homo sapiens
aggctaaaaggcttccagg

SEQ ID NO: 5214838 - DNA, 17 bp, Homo sapiens
aggctaaaatgttttca

SEQ ID NO: 5214839 - DNA, 18 bp, Homo sapiens
aggctaaaatgttttcag

SEQ ID NO: 5214840 - DNA, 13 bp, Homo sapiens
aggctaaaattag

SEQ ID NO: 5214841 - DNA, 21 bp, Homo sapiens
aggctaaacatccaatatttt

SEQ ID NO: 5214842 - DNA, 19 bp, Homo sapiens
aggctaaagaagacacaca

SEQ ID NO: 5214843 - DNA, 22 bp, Homo sapiens
aggctaaagaagacacacagcc

SEQ ID NO: 5214844 - DNA, 21 bp, Homo sapiens
aggctaaagcccagagacagc

SEQ ID NO: 5214845 - DNA, 19 bp, Homo sapiens
aggctaaattactcaggaa

SEQ ID NO: 5214846 - DNA, 17 bp, Homo sapiens
aggctaacatcccactt

SEQ ID NO: 5214847 - DNA, 14 bp, Homo sapiens
aggctaagaaagaa

SEQ ID NO: 5214848 - DNA, 16 bp, Homo sapiens
aggctaagaccctgtg

SEQ ID NO: 5214849 - DNA, 14 bp, Homo sapiens
aggctaagctgccg

SEQ ID NO: 5214850 - DNA, 19 bp, Homo sapiens
aggctaaggcgtggagctg

SEQ ID NO: 5214851 - DNA, 18 bp, Homo sapiens
aggctaagttcagttctg

SEQ ID NO: 5214852 - DNA, 16 bp, Homo sapiens
aggctaatacaggaaa

SEQ ID NO: 5214853 - DNA, 15 bp, Homo sapiens
aggctaatcaatacc

SEQ ID NO: 5214854 - DNA, 20 bp, Homo sapiens
aggctaatcaatacccttgg

SEQ ID NO: 5214855 - DNA, 23 bp, Homo sapiens
aggctaatgttggcagatgcagc

SEQ ID NO: 5214856 - DNA, 21 bp, Homo sapiens
aggctaattcagtgtcacatg

SEQ ID NO: 5214857 - DNA, 18 bp, Homo sapiens
aggctaatttttatattt

SEQ ID NO: 5214858 - DNA, 22 bp, Homo sapiens
aggctaatttttttgtatttta

SEQ ID NO: 5214859 - DNA, 13 bp, Homo sapiens
aggctacactgac

SEQ ID NO: 5214860 - DNA, 15 bp, Homo sapiens
aggctacagaactaa

SEQ ID NO: 5214861 - DNA, 13 bp, Homo sapiens
aggctacagaatg

SEQ ID NO: 5214862 - DNA, 14 bp, Homo sapiens
aggctacagagaag

SEQ ID NO: 5214863 - DNA, 16 bp, Homo sapiens
aggctacagagaagcc

SEQ ID NO: 5214864 - DNA, 17 bp, Homo sapiens
aggctacagagaagcct

SEQ ID NO: 5214865 - DNA, 19 bp, Homo sapiens
aggctacagagaagccttc

SEQ ID NO: 5214866 - DNA, 14 bp, Homo sapiens
aggctacagctcca

SEQ ID NO: 5214867 - DNA, 20 bp, Homo sapiens
aggctacagctccacacgcc

SEQ ID NO: 5214868 - DNA, 14 bp, Homo sapiens
aggctacagggcca

SEQ ID NO: 5214869 - DNA, 22 bp, Homo sapiens
aggctacaggggttagcctgga

SEQ ID NO: 5214870 - DNA, 15 bp, Homo sapiens
aggctacaggtgccc

SEQ ID NO: 5214871 - DNA, 15 bp, Homo sapiens
aggctaccagaagag

SEQ ID NO: 5214872 - DNA, 12 bp, Homo sapiens
aggctacccctt

SEQ ID NO: 5214873 - DNA, 17 bp, Homo sapiens
aggctacccgctgtggc

SEQ ID NO: 5214874 - DNA, 18 bp, Homo sapiens
aggctacccgctgtggcc

SEQ ID NO: 5214875 - DNA, 22 bp, Homo sapiens
aggctacccgctgtggccggtg

SEQ ID NO: 5214876 - DNA, 22 bp, Homo sapiens
aggctaccctcctctagaaggc

SEQ ID NO: 5214877 - DNA, 21 bp, Homo sapiens
aggctactacagagaaggctg

SEQ ID NO: 5214878 - DNA, 22 bp, Homo sapiens
aggctactagaattctgtattg

SEQ ID NO: 5214879 - DNA, 13 bp, Homo sapiens
aggctactcacct

SEQ ID NO: 5214880 - DNA, 21 bp, Homo sapiens
aggctactgtaatgctgcctc

SEQ ID NO: 5214881 - DNA, 23 bp, Homo sapiens
aggctactgtaatgctgcctcag

SEQ ID NO: 5214882 - DNA, 17 bp, Homo sapiens
aggctactgtcagctcc

SEQ ID NO: 5214883 - DNA, 17 bp, Homo sapiens
aggctacttcggggctg

SEQ ID NO: 5214884 - DNA, 23 bp, Homo sapiens
aggctagaagtgtgaagtgcaga

SEQ ID NO: 5214885 - DNA, 15 bp, Homo sapiens
aggctagacagaaac

SEQ ID NO: 5214886 - DNA, 21 bp, Homo sapiens
aggctagacttagattcatta

SEQ ID NO: 5214887 - DNA, 20 bp, Homo sapiens
aggctagagtgcagtggcgt

SEQ ID NO: 5214888 - DNA, 15 bp, Homo sapiens
aggctagatgtatgt

SEQ ID NO: 5214889 - DNA, 17 bp, Homo sapiens
aggctagatgtatgtac

SEQ ID NO: 5214890 - DNA, 14 bp, Homo sapiens
aggctagccccagg

SEQ ID NO: 5214891 - DNA, 15 bp, Homo sapiens
aggctagccccaggg

SEQ ID NO: 5214892 - DNA, 18 bp, Homo sapiens
aggctagccccagggtga

SEQ ID NO: 5214893 - DNA, 16 bp, Homo sapiens
aggctagccctgccct

SEQ ID NO: 5214894 - DNA, 16 bp, Homo sapiens
aggctagctggagcct

SEQ ID NO: 5214895 - DNA, 15 bp, Homo sapiens
aggctagctgtgctg

SEQ ID NO: 5214896 - DNA, 16 bp, Homo sapiens
aggctaggaagaactt

SEQ ID NO: 5214897 - DNA, 14 bp, Homo sapiens
aggctaggacgttg

SEQ ID NO: 5214898 - DNA, 16 bp, Homo sapiens
aggctaggccagcagg

SEQ ID NO: 5214899 - DNA, 15 bp, Homo sapiens
aggctagggtgggga

SEQ ID NO: 5214900 - DNA, 16 bp, Homo sapiens
aggctagggtggggag

SEQ ID NO: 5214901 - DNA, 19 bp, Homo sapiens
aggctagggtggggagaga

SEQ ID NO: 5214902 - DNA, 14 bp, Homo sapiens
aggctagttccttt

SEQ ID NO: 5214903 - DNA, 17 bp, Homo sapiens
aggctagtttattttgt

SEQ ID NO: 5214904 - DNA, 21 bp, Homo sapiens
aggctatgaagggacagctgc

SEQ ID NO: 5214905 - DNA, 16 bp, Homo sapiens
aggctatgagtgggat

SEQ ID NO: 5214906 - DNA, 15 bp, Homo sapiens
aggctatgccatgtg

SEQ ID NO: 5214907 - DNA, 15 bp, Homo sapiens
aggctatggttgcca

SEQ ID NO: 5214908 - DNA, 19 bp, Homo sapiens
aggctatggttgccacccc

SEQ ID NO: 5214909 - DNA, 16 bp, Homo sapiens
aggctatgtataaaat

SEQ ID NO: 5214910 - DNA, 20 bp, Homo sapiens
aggctatgtataaaatacat

SEQ ID NO: 5214911 - DNA, 17 bp, Homo sapiens
aggctatgtgattacaa

SEQ ID NO: 5214912 - DNA, 16 bp, Homo sapiens
aggctattattttcac

SEQ ID NO: 5214913 - DNA, 19 bp, Homo sapiens
aggctattattttcactgt

SEQ ID NO: 5214914 - DNA, 16 bp, Homo sapiens
aggctattcctaggcc

SEQ ID NO: 5214915 - DNA, 14 bp, Homo sapiens
aggctattttctaa

SEQ ID NO: 5214916 - DNA, 15 bp, Homo sapiens
aggctcaactaggga

SEQ ID NO: 5214917 - DNA, 15 bp, Homo sapiens
aggctcaagaggccc

SEQ ID NO: 5214918 - DNA, 18 bp, Homo sapiens
aggctcaagaggcccagg

SEQ ID NO: 5214919 - DNA, 19 bp, Homo sapiens
aggctcaagaggcccaggg

SEQ ID NO: 5214920 - DNA, 20 bp, Homo sapiens
aggctcaagaggcccaggga

SEQ ID NO: 5214921 - DNA, 13 bp, Homo sapiens
aggctcaagctat

SEQ ID NO: 5214922 - DNA, 15 bp, Homo sapiens
aggctcaaggctgtg

SEQ ID NO: 5214923 - DNA, 18 bp, Homo sapiens
aggctcaaggctgtgcag

SEQ ID NO: 5214924 - DNA, 19 bp, Homo sapiens
aggctcacccccttctcca

SEQ ID NO: 5214925 - DNA, 21 bp, Homo sapiens
aggctcacccccttctccatc

SEQ ID NO: 5214926 - DNA, 15 bp, Homo sapiens
aggctcactctttcc

SEQ ID NO: 5214927 - DNA, 15 bp, Homo sapiens
aggctcactgcagcg

SEQ ID NO: 5214928 - DNA, 16 bp, Homo sapiens
aggctcactgccaggc

SEQ ID NO: 5214929 - DNA, 23 bp, Homo sapiens
aggctcactgccaggccagcctc

SEQ ID NO: 5214930 - DNA, 13 bp, Homo sapiens
aggctcagagact

SEQ ID NO: 5214931 - DNA, 20 bp, Homo sapiens
aggctcagagactgcaagct

SEQ ID NO: 5214932 - DNA, 14 bp, Homo sapiens
aggctcagagatgt

SEQ ID NO: 5214933 - DNA, 18 bp, Homo sapiens
aggctcagccctgagctg

SEQ ID NO: 5214934 - DNA, 19 bp, Homo sapiens
aggctcagccctgagctgg

SEQ ID NO: 5214935 - DNA, 20 bp, Homo sapiens
aggctcagccttggaagcaa

SEQ ID NO: 5214936 - DNA, 20 bp, Homo sapiens
aggctcaggcaggggcctcc

SEQ ID NO: 5214937 - DNA, 21 bp, Homo sapiens
aggctcaggcaggggcctcca

SEQ ID NO: 5214938 - DNA, 13 bp, Homo sapiens
aggctcaggccat

SEQ ID NO: 5214939 - DNA, 19 bp, Homo sapiens
aggctcagtctcaggagca

SEQ ID NO: 5214940 - DNA, 23 bp, Homo sapiens
aggctcagtctcaggagcatggg

SEQ ID NO: 5214941 - DNA, 20 bp, Homo sapiens
aggctcatagggaagacctg

SEQ ID NO: 5214942 - DNA, 15 bp, Homo sapiens
aggctcatctttctg

SEQ ID NO: 5214943 - DNA, 15 bp, Homo sapiens
aggctcatttaaaac

SEQ ID NO: 5214944 - DNA, 14 bp, Homo sapiens
aggctcatttactg

SEQ ID NO: 5214945 - DNA, 17 bp, Homo sapiens
aggctccaatggggcgg

SEQ ID NO: 5214946 - DNA, 21 bp, Homo sapiens
aggctccaatggggcggggct

SEQ ID NO: 5214947 - DNA, 14 bp, Homo sapiens
aggctccagagggc

SEQ ID NO: 5214948 - DNA, 18 bp, Homo sapiens
aggctccagcacatcccc

SEQ ID NO: 5214949 - DNA, 16 bp, Homo sapiens
aggctccaggactcca

SEQ ID NO: 5214950 - DNA, 20 bp, Homo sapiens
aggctccaggactccactgg

SEQ ID NO: 5214951 - DNA, 17 bp, Homo sapiens
aggctccaggagcagcc

SEQ ID NO: 5214952 - DNA, 23 bp, Homo sapiens
aggctccaggagcagccacattc

SEQ ID NO: 5214953 - DNA, 15 bp, Homo sapiens
aggctccaggcagca

SEQ ID NO: 5214954 - DNA, 14 bp, Homo sapiens
aggctccaggctga

SEQ ID NO: 5214955 - DNA, 22 bp, Homo sapiens
aggctccaggctgactgggggc

SEQ ID NO: 5214956 - DNA, 22 bp, Homo sapiens
aggctccatccttctccccaag

SEQ ID NO: 5214957 - DNA, 15 bp, Homo sapiens
aggctccatgcacct

SEQ ID NO: 5214958 - DNA, 22 bp, Homo sapiens
aggctccatgcacctcccttcc

SEQ ID NO: 5214959 - DNA, 14 bp, Homo sapiens
aggctcccagaccc

SEQ ID NO: 5214960 - DNA, 15 bp, Homo sapiens
aggctcccagaccca

SEQ ID NO: 5214961 - DNA, 12 bp, Homo sapiens
aggctcccagcc

SEQ ID NO: 5214962 - DNA, 23 bp, Homo sapiens
aggctcccagcctaagggagaca

SEQ ID NO: 5214963 - DNA, 20 bp, Homo sapiens
aggctccccagaactggctg

SEQ ID NO: 5214964 - DNA, 13 bp, Homo sapiens
aggctcccctgcc

SEQ ID NO: 5214965 - DNA, 12 bp, Homo sapiens
aggtcagcctgg

SEQ ID NO: 5214966 - DNA, 21 bp, Homo sapiens
aggtcagcctggaagggacag

SEQ ID NO: 5214967 - DNA, 12 bp, Homo sapiens
aggtcagccttg

SEQ ID NO: 5214968 - DNA, 15 bp, Homo sapiens
aggtcagctcagagc

SEQ ID NO: 5214969 - DNA, 18 bp, Homo sapiens
aggtcagctgggagccag

SEQ ID NO: 5214970 - DNA, 20 bp, Homo sapiens
aggtcagctgggagccagtg

SEQ ID NO: 5214971 - DNA, 20 bp, Homo sapiens
aggtcagctgttactttctt

SEQ ID NO: 5214972 - DNA, 21 bp, Homo sapiens
aggtcaggaagcaggggtggg

SEQ ID NO: 5214973 - DNA, 18 bp, Homo sapiens
aggtcaggaccaggaccc

SEQ ID NO: 5214974 - DNA, 17 bp, Homo sapiens
aggtcaggacggctcct

SEQ ID NO: 5214975 - DNA, 15 bp, Homo sapiens
aggtcaggagttcct

SEQ ID NO: 5214976 - DNA, 20 bp, Homo sapiens
aggtcaggagttcctaacca

SEQ ID NO: 5214977 - DNA, 15 bp, Homo sapiens
aggtcaggagttcga

SEQ ID NO: 5214978 - DNA, 21 bp, Homo sapiens
aggtcaggagttcgagaccag

SEQ ID NO: 5214979 - DNA, 22 bp, Homo sapiens
aggtcaggagttcgagaccagc

SEQ ID NO: 5214980 - DNA, 17 bp, Homo sapiens
aggtcaggccccactcc

SEQ ID NO: 5214981 - DNA, 14 bp, Homo sapiens
aggtcaggccctgg

SEQ ID NO: 5214982 - DNA, 15 bp, Homo sapiens
aggtcaggccctgga

SEQ ID NO: 5214983 - DNA, 15 bp, Homo sapiens
aggtcagggacttgg

SEQ ID NO: 5214984 - DNA, 18 bp, Homo sapiens
aggtcagggctcagagtg

SEQ ID NO: 5214985 - DNA, 16 bp, Homo sapiens
aggtcaggggctccct

SEQ ID NO: 5214986 - DNA, 22 bp, Homo sapiens
aggtcaggggtgacacagactc

SEQ ID NO: 5214987 - DNA, 15 bp, Homo sapiens
aggtcagtacccacc

SEQ ID NO: 5214988 - DNA, 19 bp, Homo sapiens
aggtcagtacccacctgag

SEQ ID NO: 5214989 - DNA, 20 bp, Homo sapiens
aggtcagtagactgtgattc

SEQ ID NO: 5214990 - DNA, 15 bp, Homo sapiens
aggtcagtgcaaata

SEQ ID NO: 5214991 - DNA, 21 bp, Homo sapiens
aggtcagtgttataaaatctg

SEQ ID NO: 5214992 - DNA, 20 bp, Homo sapiens
aggtcatacaatccattctt

SEQ ID NO: 5214993 - DNA, 21 bp, Homo sapiens
aggtcatacaatccattctta

SEQ ID NO: 5214994 - DNA, 22 bp, Homo sapiens
aggtcatactatctactctcct

SEQ ID NO: 5214995 - DNA, 16 bp, Homo sapiens
aggtcatagattcttg

SEQ ID NO: 5214996 - DNA, 14 bp, Homo sapiens
aggtcatatgttgt

SEQ ID NO: 5214997 - DNA, 18 bp, Homo sapiens
aggtcatattaatatatt

SEQ ID NO: 5214998 - DNA, 19 bp, Homo sapiens
aggtcatattaatatattt

SEQ ID NO: 5214999 - DNA, 17 bp, Homo sapiens
aggtcatcccttcctcc

SEQ ID NO: 5215000 - DNA, 15 bp, Homo sapiens
aggtcatctgtaaaa

SEQ ID NO: 5215001 - DNA, 16 bp, Homo sapiens
aggtcatctgtaaaat

SEQ ID NO: 5215002 - DNA, 18 bp, Homo sapiens
aggtcatgaacatggtca

SEQ ID NO: 5215003 - DNA, 12 bp, Homo sapiens
aggtcatgaagg

SEQ ID NO: 5215004 - DNA, 21 bp, Homo sapiens
aggtcatgaaggacactctgc

SEQ ID NO: 5215005 - DNA, 18 bp, Homo sapiens
aggtcatgatttctgtga

SEQ ID NO: 5215006 - DNA, 21 bp, Homo sapiens
aggtcatgatttctgtgaagc

SEQ ID NO: 5215007 - DNA, 23 bp, Homo sapiens
aggtcatgatttctgtgaagcaa

SEQ ID NO: 5215008 - DNA, 16 bp, Homo sapiens
aggtcatggagcagcc

SEQ ID NO: 5215009 - DNA, 21 bp, Homo sapiens
aggtcatggagcagcccccaa

SEQ ID NO: 5215010 - DNA, 19 bp, Homo sapiens
aggtcatggccacactgtg

SEQ ID NO: 5215011 - DNA, 22 bp, Homo sapiens
aggtcatgtctgtaatcccagc

SEQ ID NO: 5215012 - DNA, 13 bp, Homo sapiens
aggtcatttgtag

SEQ ID NO: 5215013 - DNA, 16 bp, Homo sapiens
aggtcatttgtagata

SEQ ID NO: 5215014 - DNA, 15 bp, Homo sapiens
aggtcattttctatt

SEQ ID NO: 5215015 - DNA, 21 bp, Homo sapiens
aggtccaaaaaaggctgccct

SEQ ID NO: 5215016 - DNA, 19 bp, Homo sapiens
aggtccaaacccttcaact

SEQ ID NO: 5215017 - DNA, 14 bp, Homo sapiens
aggtccaaatgttt

SEQ ID NO: 5215018 - DNA, 20 bp, Homo sapiens
aggtccaaattcaccttccc

SEQ ID NO: 5215019 - DNA, 14 bp, Homo sapiens
aggtccaagatacc

SEQ ID NO: 5215020 - DNA, 16 bp, Homo sapiens
aggtccaagattctgg

SEQ ID NO: 5215021 - DNA, 17 bp, Homo sapiens
aggtccaagccccccac

SEQ ID NO: 5215022 - DNA, 17 bp, Homo sapiens
aggtccaaggctggtcc

SEQ ID NO: 5215023 - DNA, 18 bp, Homo sapiens
aggtccaaggctggtccc

SEQ ID NO: 5215024 - DNA, 13 bp, Homo sapiens
aggtccaagggcc

SEQ ID NO: 5215025 - DNA, 19 bp, Homo sapiens
aggtccaatgagctttctg

SEQ ID NO: 5215026 - DNA, 14 bp, Homo sapiens
aggtccaattctcg

SEQ ID NO: 5215027 - DNA, 16 bp, Homo sapiens
aggtccaatttgtaaa

SEQ ID NO: 5215028 - DNA, 19 bp, Homo sapiens
aggtccacaacacacagat

SEQ ID NO: 5215029 - DNA, 20 bp, Homo sapiens
aggtccaccccgttgttgtc

SEQ ID NO: 5215030 - DNA, 18 bp, Homo sapiens
aggtccaccggcccctgg

SEQ ID NO: 5215031 - DNA, 22 bp, Homo sapiens
aggtccacggtctgttcttgaa

SEQ ID NO: 5215032 - DNA, 15 bp, Homo sapiens
aggtccagacccact

SEQ ID NO: 5215033 - DNA, 21 bp, Homo sapiens
aggtccagagtcctggccctt

SEQ ID NO: 5215034 - DNA, 12 bp, Homo sapiens
aggtccagccca

SEQ ID NO: 5215035 - DNA, 21 bp, Homo sapiens
aggtccagccctggctgaagg

SEQ ID NO: 5215036 - DNA, 13 bp, Homo sapiens
aggtccagctctg

SEQ ID NO: 5215037 - DNA, 15 bp, Homo sapiens
aggtccagctctgtg

SEQ ID NO: 5215038 - DNA, 16 bp, Homo sapiens
aggtccagctctgtgg

SEQ ID NO: 5215039 - DNA, 17 bp, Homo sapiens
aggtccagctgggcctc

SEQ ID NO: 5215040 - DNA, 19 bp, Homo sapiens
aggtccagctgggcctcct

SEQ ID NO: 5215041 - DNA, 22 bp, Homo sapiens
aggtccagctgggcctcctgcc

SEQ ID NO: 5215042 - DNA, 23 bp, Homo sapiens
aggtccagctgggcctcctgcct

SEQ ID NO: 5215043 - DNA, 24 bp, Homo sapiens
aggtccagctgggcctcctgcctc

SEQ ID NO: 5215044 - DNA, 16 bp, Homo sapiens
aggtccaggcaggagg

SEQ ID NO: 5215045 - DNA, 21 bp, Homo sapiens
aggtcccaattcggggcctgc

SEQ ID NO: 5215046 - DNA, 22 bp, Homo sapiens
aggtcccaattcggggcctgct

SEQ ID NO: 5215047 - DNA, 19 bp, Homo sapiens
aggtcccacagccctgaga

SEQ ID NO: 5215048 - DNA, 16 bp, Homo sapiens
aggtcccacctccagc

SEQ ID NO: 5215049 - DNA, 18 bp, Homo sapiens
aggtcccacgccaggcca

SEQ ID NO: 5215050 - DNA, 15 bp, Homo sapiens
aggtcccagaatgga

SEQ ID NO: 5215051 - DNA, 13 bp, Homo sapiens
aggtcccagcccc

SEQ ID NO: 5215052 - DNA, 20 bp, Homo sapiens
aggtcccagcccctcctccc

SEQ ID NO: 5215053 - DNA, 16 bp, Homo sapiens
aggtcccagccctggg

SEQ ID NO: 5215054 - DNA, 16 bp, Homo sapiens
aggtcccagcgagcca

SEQ ID NO: 5215055 - DNA, 13 bp, Homo sapiens
aggtcccaggcag

SEQ ID NO: 5215056 - DNA, 20 bp, Homo sapiens
aggtcccagttgctgtcaca

SEQ ID NO: 5215057 - DNA, 14 bp, Homo sapiens
aggtccccagcaga

SEQ ID NO: 5215058 - DNA, 17 bp, Homo sapiens
aggtccccagctttggc

SEQ ID NO: 5215059 - DNA, 13 bp, Homo sapiens
aggtccccatggc

SEQ ID NO: 5215060 - DNA, 15 bp, Homo sapiens
aggtccccccaccgc

SEQ ID NO: 5215061 - DNA, 19 bp, Homo sapiens
aggtcccccgactgcctgt

SEQ ID NO: 5215062 - DNA, 14 bp, Homo sapiens
aggtccccctgcag

SEQ ID NO: 5215063 - DNA, 22 bp, Homo sapiens
aggtccccggttgctggtcagg

SEQ ID NO: 5215064 - DNA, 14 bp, Homo sapiens
aggtcccctgccct

SEQ ID NO: 5215065 - DNA, 19 bp, Homo sapiens
aggtcccctgccctgaggc

SEQ ID NO: 5215066 - DNA, 13 bp, Homo sapiens
aggtcccctttca

SEQ ID NO: 5215067 - DNA, 19 bp, Homo sapiens
aggtcccgagccccctgtc

SEQ ID NO: 5215068 - DNA, 21 bp, Homo sapiens
aggtcccgagccccctgtcct

SEQ ID NO: 5215069 - DNA, 23 bp, Homo sapiens
aggtcccgagccccctgtccttc

SEQ ID NO: 5215070 - DNA, 23 bp, Homo sapiens
aggtcccgagccctcacaccctg

SEQ ID NO: 5215071 - DNA, 20 bp, Homo sapiens
aggtcccggccagctctgga

SEQ ID NO: 5215072 - DNA, 22 bp, Homo sapiens
aggtcccggccagctctggagt

SEQ ID NO: 5215073 - DNA, 10 bp, Homo sapiens
aggtccctaa

SEQ ID NO: 5215074 - DNA, 13 bp, Homo sapiens
aggtccctaataa

SEQ ID NO: 5215075 - DNA, 17 bp, Homo sapiens
aggtccctaataaagct

SEQ ID NO: 5215076 - DNA, 19 bp, Homo sapiens
aggtccctaataaagctgt

SEQ ID NO: 5215077 - DNA, 23 bp, Homo sapiens
aggtccctaataaagctgtgtgg

SEQ ID NO: 5215078 - DNA, 21 bp, Homo sapiens
aggtccctccgcggctggagc

SEQ ID NO: 5215079 - DNA, 22 bp, Homo sapiens
aggtccctcctttggaccctgt

SEQ ID NO: 5215080 - DNA, 15 bp, Homo sapiens
aggtccctgccagtg

SEQ ID NO: 5215081 - DNA, 14 bp, Homo sapiens
aggtccctgctgcc

SEQ ID NO: 5215082 - DNA, 20 bp, Homo sapiens
aggtccctgcttacctgacg

SEQ ID NO: 5215083 - DNA, 15 bp, Homo sapiens
aggtccctggaccag

SEQ ID NO: 5215084 - DNA, 13 bp, Homo sapiens
aggtccctggggg

SEQ ID NO: 5215085 - DNA, 20 bp, Homo sapiens
aggtccctggtcggagaggg

SEQ ID NO: 5215086 - DNA, 21 bp, Homo sapiens
aggtccctgtatgtctacctc

SEQ ID NO: 5215087 - DNA, 22 bp, Homo sapiens
aggtccctgtgtgtaggctggg

SEQ ID NO: 5215088 - DNA, 20 bp, Homo sapiens
aggtcccttcaaggcctccc

SEQ ID NO: 5215089 - DNA, 21 bp, Homo sapiens
aggtcccttcccgacccagcc

SEQ ID NO: 5215090 - DNA, 16 bp, Homo sapiens
aggtccgagctctgtc

SEQ ID NO: 5215091 - DNA, 22 bp, Homo sapiens
aggtccgatggcccgagagctg

SEQ ID NO: 5215092 - DNA, 15 bp, Homo sapiens
aggtccgcaccctgt

SEQ ID NO: 5215093 - DNA, 19 bp, Homo sapiens
aggtccggtgttctaagat

SEQ ID NO: 5215094 - DNA, 18 bp, Homo sapiens
aggtccgtagctcccctg

SEQ ID NO: 5215095 - DNA, 23 bp, Homo sapiens
aggtccgtagctcccctggctgg

SEQ ID NO: 5215096 - DNA, 19 bp, Homo sapiens
aggtccgtgggccgtatct

SEQ ID NO: 5215097 - DNA, 16 bp, Homo sapiens
aggtcctacagggcca

SEQ ID NO: 5215098 - DNA, 13 bp, Homo sapiens
aggtcctcaataa

SEQ ID NO: 5215099 - DNA, 15 bp, Homo sapiens
aggtcctcacagcag

SEQ ID NO: 5215100 - DNA, 16 bp, Homo sapiens
aggtcctcacagcagt

SEQ ID NO: 5215101 - DNA, 20 bp, Homo sapiens
aggtcctcacttctgtctcc

SEQ ID NO: 5215102 - DNA, 21 bp, Homo sapiens
aggtcctcacttctgtctcct

SEQ ID NO: 5215103 - DNA, 15 bp, Homo sapiens
aggtcctcagagaat

SEQ ID NO: 5215104 - DNA, 16 bp, Homo sapiens
aggtcctcaggtcagc

SEQ ID NO: 5215105 - DNA, 17 bp, Homo sapiens
aggtcctcaggtcagct

SEQ ID NO: 5215106 - DNA, 22 bp, Homo sapiens
aggtcctccgtagggtctttct

SEQ ID NO: 5215107 - DNA, 15 bp, Homo sapiens
aggtcctcctggcct

SEQ ID NO: 5215108 - DNA, 16 bp, Homo sapiens
aggtcctcctggcctg

SEQ ID NO: 5215109 - DNA, 20 bp, Homo sapiens
aggtcctctgatacccagag

SEQ ID NO: 5215110 - DNA, 14 bp, Homo sapiens
aggtcctctgtcag

SEQ ID NO: 5215111 - DNA, 19 bp, Homo sapiens
aggtcctctgtcagtcaca

SEQ ID NO: 5215112 - DNA, 23 bp, Homo sapiens
aggtcctctgtcagtcacagcca

SEQ ID NO: 5215113 - DNA, 17 bp, Homo sapiens
aggtcctcttaggtccc

SEQ ID NO: 5215114 - DNA, 20 bp, Homo sapiens
aggtcctcttaggtcccggg

SEQ ID NO: 5215115 - DNA, 21 bp, Homo sapiens
aggtcctgaaagtaactcata

SEQ ID NO: 5215116 - DNA, 13 bp, Homo sapiens
aggtcctgagcac

SEQ ID NO: 5215117 - DNA, 19 bp, Homo sapiens
aggtcctgatttctagaac

SEQ ID NO: 5215118 - DNA, 20 bp, Homo sapiens
aggtcctgcagtctggctga

SEQ ID NO: 5215119 - DNA, 13 bp, Homo sapiens
aggtcctgccctc

SEQ ID NO: 5215120 - DNA, 21 bp, Homo sapiens
aggtcctgctccgctgcctgg

SEQ ID NO: 5215121 - DNA, 22 bp, Homo sapiens
aggtcctgcttgaactgctgcc

SEQ ID NO: 5215122 - DNA, 12 bp, Homo sapiens
aggtcctggctt

SEQ ID NO: 5215123 - DNA, 15 bp, Homo sapiens
aggtcctggcttcta

SEQ ID NO: 5215124 - DNA, 18 bp, Homo sapiens
aggtcctgggggcctgac

SEQ ID NO: 5215125 - DNA, 19 bp, Homo sapiens
aggtcctgggggcctgacc

SEQ ID NO: 5215126 - DNA, 23 bp, Homo sapiens
aggtcctggtgcctatctgcctg

SEQ ID NO: 5215127 - DNA, 19 bp, Homo sapiens
aggtcctggtggggcagct

SEQ ID NO: 5215128 - DNA, 21 bp, Homo sapiens
aggtcctggtgggtcagccca

SEQ ID NO: 5215129 - DNA, 22 bp, Homo sapiens
aggtcctggtgggtcagcccag

SEQ ID NO: 5215130 - DNA, 21 bp, Homo sapiens
aggtcctgtcctggctcccag

SEQ ID NO: 5215131 - DNA, 22 bp, Homo sapiens
aggtcctgtcctggctcccagg

SEQ ID NO: 5215132 - DNA, 20 bp, Homo sapiens
aggtcctgtctctgcacaga

SEQ ID NO: 5215133 - DNA, 16 bp, Homo sapiens
aggtcctgtgagcaaa

SEQ ID NO: 5215134 - DNA, 12 bp, Homo sapiens
aggtccttgccc

SEQ ID NO: 5215135 - DNA, 15 bp, Homo sapiens
aggtcctttccttct

SEQ ID NO: 5215136 - DNA, 21 bp, Homo sapiens
aggtcgaccccaaagcccctt

SEQ ID NO: 5215137 - DNA, 13 bp, Homo sapiens
aggtcgaggactg

SEQ ID NO: 5215138 - DNA, 14 bp, Homo sapiens
aggtcgccagtgaa

SEQ ID NO: 5215139 - DNA, 18 bp, Homo sapiens
aggtcggagtgcctggag

SEQ ID NO: 5215140 - DNA, 19 bp, Homo sapiens
aggtcggagtgcctggagt

SEQ ID NO: 5215141 - DNA, 18 bp, Homo sapiens
aggtcgggagtttgagac

SEQ ID NO: 5215142 - DNA, 20 bp, Homo sapiens
aggtcgggcagtggaggctg

SEQ ID NO: 5215143 - DNA, 14 bp, Homo sapiens
aggtcgggctcagc

SEQ ID NO: 5215144 - DNA, 18 bp, Homo sapiens
aggtcgggctcagctctg

SEQ ID NO: 5215145 - DNA, 22 bp, Homo sapiens
aggtcgggctgccagcccagct

SEQ ID NO: 5215146 - DNA, 21 bp, Homo sapiens
aggtcgttttaaaaacaaaaa

SEQ ID NO: 5215147 - DNA, 12 bp, Homo sapiens
aggtctaactgt

SEQ ID NO: 5215148 - DNA, 16 bp, Homo sapiens
aggtctaatcagtgat

SEQ ID NO: 5215149 - DNA, 17 bp, Homo sapiens
aggtctagaaggccagg

SEQ ID NO: 5215150 - DNA, 13 bp, Homo sapiens
aggtctagacttt

SEQ ID NO: 5215151 - DNA, 15 bp, Homo sapiens
aggtctagactttct

SEQ ID NO: 5215152 - DNA, 20 bp, Homo sapiens
aggtctagactttctcagtg

SEQ ID NO: 5215153 - DNA, 22 bp, Homo sapiens
aggtctagtatccaaaatattt

SEQ ID NO: 5215154 - DNA, 19 bp, Homo sapiens
aggtctattacgtgggtgc

SEQ ID NO: 5215155 - DNA, 14 bp, Homo sapiens
aggtctatttggat

SEQ ID NO: 5215156 - DNA, 18 bp, Homo sapiens
aggtctcacactcctcct

SEQ ID NO: 5215157 - DNA, 19 bp, Homo sapiens
aggtctcacactcctcctg

SEQ ID NO: 5215158 - DNA, 22 bp, Homo sapiens
aggtctcacactcctcctgcca

SEQ ID NO: 5215159 - DNA, 17 bp, Homo sapiens
aggtctcaccttcgcct

SEQ ID NO: 5215160 - DNA, 16 bp, Homo sapiens
aggtctcagcccggga

SEQ ID NO: 5215161 - DNA, 23 bp, Homo sapiens
aggtctcatctcccaggccccag

SEQ ID NO: 5215162 - DNA, 13 bp, Homo sapiens
aggtctcatgccc

SEQ ID NO: 5215163 - DNA, 14 bp, Homo sapiens
aggtctcatgcctg

SEQ ID NO: 5215164 - DNA, 16 bp, Homo sapiens
aggtctcatgcctgag

SEQ ID NO: 5215165 - DNA, 13 bp, Homo sapiens
aggtctcattcat

SEQ ID NO: 5215166 - DNA, 21 bp, Homo sapiens
aggtctccaaaccagacggtg

SEQ ID NO: 5215167 - DNA, 14 bp, Homo sapiens
aggtctccaaggga

SEQ ID NO: 5215168 - DNA, 23 bp, Homo sapiens
aggtctccaagggagggtgcagc

SEQ ID NO: 5215169 - DNA, 12 bp, Homo sapiens
aggtctccaccc

SEQ ID NO: 5215170 - DNA, 13 bp, Homo sapiens
aggtctccacccc

SEQ ID NO: 5215171 - DNA, 14 bp, Homo sapiens
aggtctccacctgc

SEQ ID NO: 5215172 - DNA, 19 bp, Homo sapiens
aggtctccactgaggatgt

SEQ ID NO: 5215173 - DNA, 17 bp, Homo sapiens
aggtctccaggggcctg

SEQ ID NO: 5215174 - DNA, 21 bp, Homo sapiens
aggtctccagttggctttact

SEQ ID NO: 5215175 - DNA, 16 bp, Homo sapiens
aggtctccccatcccc

SEQ ID NO: 5215176 - DNA, 19 bp, Homo sapiens
aggtctcccctgatccaga

SEQ ID NO: 5215177 - DNA, 15 bp, Homo sapiens
aggtctcctcagggt

SEQ ID NO: 5215178 - DNA, 19 bp, Homo sapiens
aggtctcctcagggtgggg

SEQ ID NO: 5215179 - DNA, 12 bp, Homo sapiens
aggtctcctcca

SEQ ID NO: 5215180 - DNA, 18 bp, Homo sapiens
aggtctcctccaccgcca

SEQ ID NO: 5215181 - DNA, 23 bp, Homo sapiens
aggtctcctccaccgccatggct

SEQ ID NO: 5215182 - DNA, 11 bp, Homo sapiens
aggtctcctct

SEQ ID NO: 5215183 - DNA, 14 bp, Homo sapiens
aggtctcctcttaa

SEQ ID NO: 5215184 - DNA, 15 bp, Homo sapiens
aggtctcctcttaaa

SEQ ID NO: 5215185 - DNA, 17 bp, Homo sapiens
aggtctcctcttaaaaa

SEQ ID NO: 5215186 - DNA, 13 bp, Homo sapiens
aggtctcctggga

SEQ ID NO: 5215187 - DNA, 14 bp, Homo sapiens
aggtctcctgggca

SEQ ID NO: 5215188 - DNA, 19 bp, Homo sapiens
aggtctccttactctgagc

SEQ ID NO: 5215189 - DNA, 24 bp, Homo sapiens
aggtctccttactctgagcccagg

SEQ ID NO: 5215190 - DNA, 19 bp, Homo sapiens
aggtctcgctgatgctggg

SEQ ID NO: 5215191 - DNA, 20 bp, Homo sapiens
aggtctcgctgatgctgggc

SEQ ID NO: 5215192 - DNA, 23 bp, Homo sapiens
aggtctcgggggtccggaagggt

SEQ ID NO: 5215193 - DNA, 16 bp, Homo sapiens
aggtctctccactgct

SEQ ID NO: 5215194 - DNA, 13 bp, Homo sapiens
aggtctctctggc

SEQ ID NO: 5215195 - DNA, 16 bp, Homo sapiens
aggtctctctttggac

SEQ ID NO: 5215196 - DNA, 23 bp, Homo sapiens
aggtctctctttggactctcccc

SEQ ID NO: 5215197 - DNA, 19 bp, Homo sapiens
aggtctctgccggctcttt

SEQ ID NO: 5215198 - DNA, 13 bp, Homo sapiens
aggtctctgggag

SEQ ID NO: 5215199 - DNA, 18 bp, Homo sapiens
aggtctcttctcccagaa

SEQ ID NO: 5215200 - DNA, 14 bp, Homo sapiens
aggtctcttctggg

SEQ ID NO: 5215201 - DNA, 15 bp, Homo sapiens
aggtctcttgaggga

SEQ ID NO: 5215202 - DNA, 10 bp, Homo sapiens
aggtctcttt

SEQ ID NO: 5215203 - DNA, 15 bp, Homo sapiens
aggtctcttttctct

SEQ ID NO: 5215204 - DNA, 15 bp, Homo sapiens
aggtctgaaatggag

SEQ ID NO: 5215205 - DNA, 17 bp, Homo sapiens
aggtctgaaggcctcca

SEQ ID NO: 5215206 - DNA, 21 bp, Homo sapiens
aggtctgaaggcctccatttg

SEQ ID NO: 5215207 - DNA, 20 bp, Homo sapiens
aggtctgacagtagctctta

SEQ ID NO: 5215208 - DNA, 20 bp, Homo sapiens
aggtctgaccaaaaccagag

SEQ ID NO: 5215209 - DNA, 22 bp, Homo sapiens
aggtctgaccaaaaccagaggg

SEQ ID NO: 5215210 - DNA, 13 bp, Homo sapiens
aggtctgactcca

SEQ ID NO: 5215211 - DNA, 16 bp, Homo sapiens
aggtctgactccaaag

SEQ ID NO: 5215212 - DNA, 18 bp, Homo sapiens
aggtctgagccacagcag

SEQ ID NO: 5215213 - DNA, 12 bp, Homo sapiens
aggtctgagccc

SEQ ID NO: 5215214 - DNA, 23 bp, Homo sapiens
aggtctgagccctggtgtgtttc

SEQ ID NO: 5215215 - DNA, 16 bp, Homo sapiens
aggtctgattggctgc

SEQ ID NO: 5215216 - DNA, 13 bp, Homo sapiens
aggtctgatttgc

SEQ ID NO: 5215217 - DNA, 15 bp, Homo sapiens
aggtctgatttgcag

SEQ ID NO: 5215218 - DNA, 21 bp, Homo sapiens
aggtctgcaagggcccagagt

SEQ ID NO: 5215219 - DNA, 22 bp, Homo sapiens
aggtctgcacacataacacaca

SEQ ID NO: 5215220 - DNA, 22 bp, Homo sapiens
aggtctgcactcctttatctgt

SEQ ID NO: 5215221 - DNA, 14 bp, Homo sapiens
aggtctgcaggcca

SEQ ID NO: 5215222 - DNA, 20 bp, Homo sapiens
aggtctgcaggccaccagct

SEQ ID NO: 5215223 - DNA, 15 bp, Homo sapiens
aggtctgcattttct

SEQ ID NO: 5215224 - DNA, 20 bp, Homo sapiens
aggtctgcattttctcaggc

SEQ ID NO: 5215225 - DNA, 11 bp, Homo sapiens
aggtctgcctg

SEQ ID NO: 5215226 - DNA, 14 bp, Homo sapiens
aggtctgctcctga

SEQ ID NO: 5215227 - DNA, 18 bp, Homo sapiens
aggtctgctcctgaacca

SEQ ID NO: 5215228 - DNA, 17 bp, Homo sapiens
aggtctggattttcaaa

SEQ ID NO: 5215229 - DNA, 12 bp, Homo sapiens
aggtctggctga

SEQ ID NO: 5215230 - DNA, 15 bp, Homo sapiens
aggtctggctgagcc

SEQ ID NO: 5215231 - DNA, 18 bp, Homo sapiens
aggtctgggagaggcaga

SEQ ID NO: 5215232 - DNA, 22 bp, Homo sapiens
aggtctgggagaggcagagtgc

SEQ ID NO: 5215233 - DNA, 22 bp, Homo sapiens
aggtctgggcaagtagcaggac

SEQ ID NO: 5215234 - DNA, 23 bp, Homo sapiens
aggtctgggcaagtagcaggact

SEQ ID NO: 5215235 - DNA, 18 bp, Homo sapiens
aggtctgggtggggccca

SEQ ID NO: 5215236 - DNA, 13 bp, Homo sapiens
aggtctgtaactg

SEQ ID NO: 5215237 - DNA, 15 bp, Homo sapiens
aggtctgtaactgcc

SEQ ID NO: 5215238 - DNA, 11 bp, Homo sapiens
aggtctgtgct

SEQ ID NO: 5215239 - DNA, 14 bp, Homo sapiens
aggtctgtgctgag

SEQ ID NO: 5215240 - DNA, 14 bp, Homo sapiens
aggtctgtggtgca

SEQ ID NO: 5215241 - DNA, 22 bp, Homo sapiens
aggtctgttctttccaaagtac

SEQ ID NO: 5215242 - DNA, 20 bp, Homo sapiens
aggtctgttgaagtgcatgt

SEQ ID NO: 5215243 - DNA, 21 bp, Homo sapiens
aggtctgttgaagtgcatgtt

SEQ ID NO: 5215244 - DNA, 14 bp, Homo sapiens
aggtctgtttgctg

SEQ ID NO: 5215245 - DNA, 16 bp, Homo sapiens
aggtctgtttgctgtt

SEQ ID NO: 5215246 - DNA, 17 bp, Homo sapiens
aggtctgtttgctgttg

SEQ ID NO: 5215247 - DNA, 18 bp, Homo sapiens
aggtcttacattgcctga

SEQ ID NO: 5215248 - DNA, 16 bp, Homo sapiens
aggtcttcagccatca

SEQ ID NO: 5215249 - DNA, 21 bp, Homo sapiens
aggtcttcatcgaatctacta

SEQ ID NO: 5215250 - DNA, 21 bp, Homo sapiens
aggtcttcccgcaaggcctct

SEQ ID NO: 5215251 - DNA, 21 bp, Homo sapiens
aggtcttcctgtggctccctc

SEQ ID NO: 5215252 - DNA, 22 bp, Homo sapiens
aggtcttcctgtggctccctct

SEQ ID NO: 5215253 - DNA, 17 bp, Homo sapiens
aggtcttcttgtgtcct

SEQ ID NO: 5215254 - DNA, 21 bp, Homo sapiens
aggtcttcttgtgtcctgatg

SEQ ID NO: 5215255 - DNA, 20 bp, Homo sapiens
aggtcttgaactcctggcct

SEQ ID NO: 5215256 - DNA, 16 bp, Homo sapiens
aggtcttgacctgaac

SEQ ID NO: 5215257 - DNA, 21 bp, Homo sapiens
aggtcttgagtttcatttttc

SEQ ID NO: 5215258 - DNA, 20 bp, Homo sapiens
aggtcttgatttgttttaga

SEQ ID NO: 5215259 - DNA, 15 bp, Homo sapiens
aggtcttgctctcct

SEQ ID NO: 5215260 - DNA, 11 bp, Homo sapiens
aggtctttaaa

SEQ ID NO: 5215261 - DNA, 14 bp, Homo sapiens
aggtctttcagaag

SEQ ID NO: 5215262 - DNA, 18 bp, Homo sapiens
aggtctttcagtactttt

SEQ ID NO: 5215263 - DNA, 21 bp, Homo sapiens
aggtctttgaaatatgcatgt

SEQ ID NO: 5215264 - DNA, 22 bp, Homo sapiens
aggtctttgaaatatgcatgta

SEQ ID NO: 5215265 - DNA, 18 bp, Homo sapiens
aggtctttgcacatgtga

SEQ ID NO: 5215266 - DNA, 23 bp, Homo sapiens
aggtctttgtaagaactaaagaa

SEQ ID NO: 5215267 - DNA, 21 bp, Homo sapiens
aggtcttttacatacagtgat

SEQ ID NO: 5215268 - DNA, 21 bp, Homo sapiens
aggtcttttctttgggaccct

SEQ ID NO: 5215269 - DNA, 15 bp, Homo sapiens
aggtcttttgacatg

SEQ ID NO: 5215270 - DNA, 22 bp, Homo sapiens
aggtgaaaacagcccaggtcct

SEQ ID NO: 5215271 - DNA, 19 bp, Homo sapiens
aggtgaaaagggcagaggc

SEQ ID NO: 5215272 - DNA, 17 bp, Homo sapiens
aggtgaaaatgaagaag

SEQ ID NO: 5215273 - DNA, 20 bp, Homo sapiens
aggtgaaaatgaagaaggaa

SEQ ID NO: 5215274 - DNA, 15 bp, Homo sapiens
aggtgaaacacacac

SEQ ID NO: 5215275 - DNA, 22 bp, Homo sapiens
aggtgaaacgactcaaaatgac

SEQ ID NO: 5215276 - DNA, 21 bp, Homo sapiens
aggtgaaactccagatgccac

SEQ ID NO: 5215277 - DNA, 21 bp, Homo sapiens
aggtgaaagaaagggacccac

SEQ ID NO: 5215278 - DNA, 19 bp, Homo sapiens
aggtgaaagttaatccact

SEQ ID NO: 5215279 - DNA, 21 bp, Homo sapiens
aggtgaaatccctgcctcagg

SEQ ID NO: 5215280 - DNA, 15 bp, Homo sapiens
aggtgaacaaggtaa

SEQ ID NO: 5215281 - DNA, 19 bp, Homo sapiens
aggtgaacaccactttgtc

SEQ ID NO: 5215282 - DNA, 17 bp, Homo sapiens
aggtgaacacttagtga

SEQ ID NO: 5215283 - DNA, 17 bp, Homo sapiens
aggtgaacagcaggatg

SEQ ID NO: 5215284 - DNA, 22 bp, Homo sapiens
aggtgaacagtcacgcctgaaa

SEQ ID NO: 5215285 - DNA, 22 bp, Homo sapiens
aggtgaacattcatgtgtagga

SEQ ID NO: 5215286 - DNA, 21 bp, Homo sapiens
aggtgaacattggttctttca

SEQ ID NO: 5215287 - DNA, 20 bp, Homo sapiens
aggtgaacgctcagcgctgg

SEQ ID NO: 5215288 - DNA, 13 bp, Homo sapiens
aggtgaactccag

SEQ ID NO: 5215289 - DNA, 14 bp, Homo sapiens
aggtgaactccagg

SEQ ID NO: 5215290 - DNA, 15 bp, Homo sapiens
aggtgaactccaggc

SEQ ID NO: 5215291 - DNA, 14 bp, Homo sapiens
aggtgaagaatctt

SEQ ID NO: 5215292 - DNA, 16 bp, Homo sapiens
aggtgaagatgaagaa

SEQ ID NO: 5215293 - DNA, 17 bp, Homo sapiens
aggtgaaggaatatatg

SEQ ID NO: 5215294 - DNA, 23 bp, Homo sapiens
aggtgaaggaatatatggcagag

SEQ ID NO: 5215295 - DNA, 13 bp, Homo sapiens
aggtgaaggaggc

SEQ ID NO: 5215296 - DNA, 15 bp, Homo sapiens
aggtgaagtccctgt

SEQ ID NO: 5215297 - DNA, 16 bp, Homo sapiens
aggtgaagtccctgtt

SEQ ID NO: 5215298 - DNA, 22 bp, Homo sapiens
aggtgaagtccctgttctcagc

SEQ ID NO: 5215299 - DNA, 20 bp, Homo sapiens
aggtgaagtgaggacaaaat

SEQ ID NO: 5215300 - DNA, 11 bp, Homo sapiens
aggtgaataac

SEQ ID NO: 5215301 - DNA, 14 bp, Homo sapiens
aggtgaataataaa

SEQ ID NO: 5215302 - DNA, 19 bp, Homo sapiens
aggtgaataataaaatcaa

SEQ ID NO: 5215303 - DNA, 21 bp, Homo sapiens
aggtgaatagccatatttgta

SEQ ID NO: 5215304 - DNA, 13 bp, Homo sapiens
aggtgaatttcat

SEQ ID NO: 5215305 - DNA, 21 bp, Homo sapiens
aggtgaattttccgggaactt

SEQ ID NO: 5215306 - DNA, 13 bp, Homo sapiens
aggtgacaagcgt

SEQ ID NO: 5215307 - DNA, 17 bp, Homo sapiens
aggtgacacgcttctga

SEQ ID NO: 5215308 - DNA, 15 bp, Homo sapiens
aggtgacagcagtcg

SEQ ID NO: 5215309 - DNA, 13 bp, Homo sapiens
aggtgacagtgaa

SEQ ID NO: 5215310 - DNA, 19 bp, Homo sapiens
aggtgacagtggctgctct

SEQ ID NO: 5215311 - DNA, 21 bp, Homo sapiens
aggtgacagtggctgctctgg

SEQ ID NO: 5215312 - DNA, 15 bp, Homo sapiens
aggtgacatatacat

SEQ ID NO: 5215313 - DNA, 19 bp, Homo sapiens
aggtgaccaaatcagtgtg

SEQ ID NO: 5215314 - DNA, 20 bp, Homo sapiens
aggtgacccaatgctcctgg

SEQ ID NO: 5215315 - DNA, 21 bp, Homo sapiens
aggtgacccaatgctcctgga

SEQ ID NO: 5215316 - DNA, 21 bp, Homo sapiens
aggtgaccccatctctgctgc

SEQ ID NO: 5215317 - DNA, 18 bp, Homo sapiens
aggtgaccctgatgaaaa

SEQ ID NO: 5215318 - DNA, 15 bp, Homo sapiens
aggtgacgatttagc

SEQ ID NO: 5215319 - DNA, 14 bp, Homo sapiens
aggtgactgtctgg

SEQ ID NO: 5215320 - DNA, 18 bp, Homo sapiens
aggctcccctggtctcct

SEQ ID NO: 5215321 - DNA, 19 bp, Homo sapiens
aggctcccgagtggggcct

SEQ ID NO: 5215322 - DNA, 16 bp, Homo sapiens
aggctcccggggcctg

SEQ ID NO: 5215323 - DNA, 18 bp, Homo sapiens
aggctcccggggcctgga

SEQ ID NO: 5215324 - DNA, 14 bp, Homo sapiens
aggctccctcctgt

SEQ ID NO: 5215325 - DNA, 14 bp, Homo sapiens
aggctccctcgccc

SEQ ID NO: 5215326 - DNA, 17 bp, Homo sapiens
aggctccctgaggtacc

SEQ ID NO: 5215327 - DNA, 17 bp, Homo sapiens
aggctccgggcaccagg

SEQ ID NO: 5215328 - DNA, 23 bp, Homo sapiens
aggctccgggctttcccccaggc

SEQ ID NO: 5215329 - DNA, 16 bp, Homo sapiens
aggctccgtgagccct

SEQ ID NO: 5215330 - DNA, 16 bp, Homo sapiens
aggctcctacaggcgc

SEQ ID NO: 5215331 - DNA, 18 bp, Homo sapiens
aggctcctacctgtctgc

SEQ ID NO: 5215332 - DNA, 20 bp, Homo sapiens
aggctcctacctgtctgctg

SEQ ID NO: 5215333 - DNA, 21 bp, Homo sapiens
aggctcctacctgtctgctgc

SEQ ID NO: 5215334 - DNA, 19 bp, Homo sapiens
aggctcctccctctgcctc

SEQ ID NO: 5215335 - DNA, 19 bp, Homo sapiens
aggctcctccttgcccaga

SEQ ID NO: 5215336 - DNA, 22 bp, Homo sapiens
aggctcctctaggccctgtgag

SEQ ID NO: 5215337 - DNA, 19 bp, Homo sapiens
aggctcctctcaggctggg

SEQ ID NO: 5215338 - DNA, 23 bp, Homo sapiens
aggctcctgaccccgccatgcat

SEQ ID NO: 5215339 - DNA, 18 bp, Homo sapiens
aggctcctgacctacctg

SEQ ID NO: 5215340 - DNA, 13 bp, Homo sapiens
aggctcctgccac

SEQ ID NO: 5215341 - DNA, 13 bp, Homo sapiens
aggctcctgcccc

SEQ ID NO: 5215342 - DNA, 18 bp, Homo sapiens
aggctcctggagccagcc

SEQ ID NO: 5215343 - DNA, 18 bp, Homo sapiens
aggctcctggctgtgccc

SEQ ID NO: 5215344 - DNA, 21 bp, Homo sapiens
aggctcctggctgtgcccagc

SEQ ID NO: 5215345 - DNA, 22 bp, Homo sapiens
aggctcctggctgtgcccagca

SEQ ID NO: 5215346 - DNA, 23 bp, Homo sapiens
aggctcctggctgtgcccagcag

SEQ ID NO: 5215347 - DNA, 14 bp, Homo sapiens
aggctcctgtggta

SEQ ID NO: 5215348 - DNA, 22 bp, Homo sapiens
aggctcctgttttgcacagcca

SEQ ID NO: 5215349 - DNA, 15 bp, Homo sapiens
aggctccttcatgtg

SEQ ID NO: 5215350 - DNA, 15 bp, Homo sapiens
aggctccttcctgtc

SEQ ID NO: 5215351 - DNA, 16 bp, Homo sapiens
aggctccttcctgtct

SEQ ID NO: 5215352 - DNA, 21 bp, Homo sapiens
aggctccttcctgtgggtggg

SEQ ID NO: 5215353 - DNA, 22 bp, Homo sapiens
aggctccttcctgtgggtgggg

SEQ ID NO: 5215354 - DNA, 18 bp, Homo sapiens
aggctcgagcatgcctgg

SEQ ID NO: 5215355 - DNA, 20 bp, Homo sapiens
aggctcgagctcggggctgg

SEQ ID NO: 5215356 - DNA, 16 bp, Homo sapiens
aggctcgattttgtat

SEQ ID NO: 5215357 - DNA, 16 bp, Homo sapiens
aggctcgccttccctc

SEQ ID NO: 5215358 - DNA, 24 bp, Homo sapiens
aggctcgccttccctcctgctttg

SEQ ID NO: 5215359 - DNA, 19 bp, Homo sapiens
aggctcggaggaccctgga

SEQ ID NO: 5215360 - DNA, 21 bp, Homo sapiens
aggctcggccgtgggccggga

SEQ ID NO: 5215361 - DNA, 15 bp, Homo sapiens
aggctcggggctccc

SEQ ID NO: 5215362 - DNA, 16 bp, Homo sapiens
aggctcggggctcccc

SEQ ID NO: 5215363 - DNA, 20 bp, Homo sapiens
aggctctaaccacacagcct

SEQ ID NO: 5215364 - DNA, 23 bp, Homo sapiens
aggctctaaccacacagcctaca

SEQ ID NO: 5215365 - DNA, 16 bp, Homo sapiens
aggctctagagagagg

SEQ ID NO: 5215366 - DNA, 20 bp, Homo sapiens
aggctctagagagagggaga

SEQ ID NO: 5215367 - DNA, 21 bp, Homo sapiens
aggctctagagagagggagaa

SEQ ID NO: 5215368 - DNA, 15 bp, Homo sapiens
aggctctatctgctg

SEQ ID NO: 5215369 - DNA, 17 bp, Homo sapiens
aggctctatctgctggg

SEQ ID NO: 5215370 - DNA, 21 bp, Homo sapiens
aggctctatctgctgggctgg

SEQ ID NO: 5215371 - DNA, 20 bp, Homo sapiens
aggctctatgagtctagatg

SEQ ID NO: 5215372 - DNA, 22 bp, Homo sapiens
aggctctatttcggaaatacac

SEQ ID NO: 5215373 - DNA, 15 bp, Homo sapiens
aggctctcaccccca

SEQ ID NO: 5215374 - DNA, 20 bp, Homo sapiens
aggctctcaggccagctgct

SEQ ID NO: 5215375 - DNA, 22 bp, Homo sapiens
aggctctcgggtgggggagcca

SEQ ID NO: 5215376 - DNA, 23 bp, Homo sapiens
aggctctcgggtgggggagccag

SEQ ID NO: 5215377 - DNA, 16 bp, Homo sapiens
aggctctctcctctct

SEQ ID NO: 5215378 - DNA, 15 bp, Homo sapiens
aggctctctgggctg

SEQ ID NO: 5215379 - DNA, 13 bp, Homo sapiens
aggctctctggtc

SEQ ID NO: 5215380 - DNA, 19 bp, Homo sapiens
aggctctgacccagtgaga

SEQ ID NO: 5215381 - DNA, 23 bp, Homo sapiens
aggctctgagactaaatgagagg

SEQ ID NO: 5215382 - DNA, 16 bp, Homo sapiens
aggctctgagagtcta

SEQ ID NO: 5215383 - DNA, 22 bp, Homo sapiens
aggctctgagagtctagattct

SEQ ID NO: 5215384 - DNA, 23 bp, Homo sapiens
aggctctgccctgccctagctcc

SEQ ID NO: 5215385 - DNA, 15 bp, Homo sapiens
aggctctgcccttgg

SEQ ID NO: 5215386 - DNA, 16 bp, Homo sapiens
aggctctgcccttggt

SEQ ID NO: 5215387 - DNA, 16 bp, Homo sapiens
aggctctgcctggagg

SEQ ID NO: 5215388 - DNA, 22 bp, Homo sapiens
aggctctgccttcgaggtcaga

SEQ ID NO: 5215389 - DNA, 11 bp, Homo sapiens
aggctctgctg

SEQ ID NO: 5215390 - DNA, 13 bp, Homo sapiens
aggctctgctgac

SEQ ID NO: 5215391 - DNA, 12 bp, Homo sapiens
aggctctgctgg

SEQ ID NO: 5215392 - DNA, 22 bp, Homo sapiens
aggctctgcttctccaaggaaa

SEQ ID NO: 5215393 - DNA, 19 bp, Homo sapiens
aggctctggagccagagag

SEQ ID NO: 5215394 - DNA, 14 bp, Homo sapiens
aggctctggagccc

SEQ ID NO: 5215395 - DNA, 19 bp, Homo sapiens
aggctctggagcccactgt

SEQ ID NO: 5215396 - DNA, 18 bp, Homo sapiens
aggctctggcccttgcct

SEQ ID NO: 5215397 - DNA, 19 bp, Homo sapiens
aggctctggcccttgcctt

SEQ ID NO: 5215398 - DNA, 22 bp, Homo sapiens
aggctctggcccttgcctttgt

SEQ ID NO: 5215399 - DNA, 16 bp, Homo sapiens
aggctctgggcacagt

SEQ ID NO: 5215400 - DNA, 23 bp, Homo sapiens
aggctctgggcacagtgctgccc

SEQ ID NO: 5215401 - DNA, 14 bp, Homo sapiens
aggctctgggctca

SEQ ID NO: 5215402 - DNA, 18 bp, Homo sapiens
aggctctgggctcagggc

SEQ ID NO: 5215403 - DNA, 21 bp, Homo sapiens
aggctctgggctcagggctgg

SEQ ID NO: 5215404 - DNA, 22 bp, Homo sapiens
aggctctgggctcagggctgga

SEQ ID NO: 5215405 - DNA, 12 bp, Homo sapiens
aggctctggggc

SEQ ID NO: 5215406 - DNA, 17 bp, Homo sapiens
aggctctgtcactccag

SEQ ID NO: 5215407 - DNA, 14 bp, Homo sapiens
aggctctgtcactg

SEQ ID NO: 5215408 - DNA, 15 bp, Homo sapiens
aggctctgtcactga

SEQ ID NO: 5215409 - DNA, 15 bp, Homo sapiens
aggctctgtctggaa

SEQ ID NO: 5215410 - DNA, 10 bp, Homo sapiens
aggctctgtg

SEQ ID NO: 5215411 - DNA, 13 bp, Homo sapiens
aggctctgtgcct

SEQ ID NO: 5215412 - DNA, 13 bp, Homo sapiens
aggctctgtgctg

SEQ ID NO: 5215413 - DNA, 21 bp, Homo sapiens
aggctctgtgctgaccctcct

SEQ ID NO: 5215414 - DNA, 22 bp, Homo sapiens
aggctctgtgctgaccctcctg

SEQ ID NO: 5215415 - DNA, 14 bp, Homo sapiens
aggctctgttcctc

SEQ ID NO: 5215416 - DNA, 16 bp, Homo sapiens
aggctctgtttatgct

SEQ ID NO: 5215417 - DNA, 19 bp, Homo sapiens
aggctcttagcagcttcca

SEQ ID NO: 5215418 - DNA, 17 bp, Homo sapiens
aggctcttccatcccca

SEQ ID NO: 5215419 - DNA, 17 bp, Homo sapiens
aggctcttcctggacct

SEQ ID NO: 5215420 - DNA, 18 bp, Homo sapiens
aggctcttcctggacctg

SEQ ID NO: 5215421 - DNA, 22 bp, Homo sapiens
aggctcttcctggacctgagtc

SEQ ID NO: 5215422 - DNA, 23 bp, Homo sapiens
aggctcttctccttggaggacag

SEQ ID NO: 5215423 - DNA, 15 bp, Homo sapiens
aggctcttctgacta

SEQ ID NO: 5215424 - DNA, 18 bp, Homo sapiens
aggctcttctttcccaaa

SEQ ID NO: 5215425 - DNA, 18 bp, Homo sapiens
aggctcttggtatctttc

SEQ ID NO: 5215426 - DNA, 22 bp, Homo sapiens
aggctctttggggtcagccagg

SEQ ID NO: 5215427 - DNA, 13 bp, Homo sapiens
aggctgaaaagaa

SEQ ID NO: 5215428 - DNA, 16 bp, Homo sapiens
aggctgaaagaggcca

SEQ ID NO: 5215429 - DNA, 21 bp, Homo sapiens
aggctgaacataaatcagtta

SEQ ID NO: 5215430 - DNA, 17 bp, Homo sapiens
aggctgaactcttcaga

SEQ ID NO: 5215431 - DNA, 20 bp, Homo sapiens
aggctgaacttgttttctgg

SEQ ID NO: 5215432 - DNA, 21 bp, Homo sapiens
aggctgaacttgttttctggg

SEQ ID NO: 5215433 - DNA, 17 bp, Homo sapiens
aggctgaatcaaagaca

SEQ ID NO: 5215434 - DNA, 22 bp, Homo sapiens
aggctgaatcaaagacatttca

SEQ ID NO: 5215435 - DNA, 23 bp, Homo sapiens
aggctgaatcaaagacatttcat

SEQ ID NO: 5215436 - DNA, 16 bp, Homo sapiens
aggctgaattacagtg

SEQ ID NO: 5215437 - DNA, 17 bp, Homo sapiens
aggctgaattacagtga

SEQ ID NO: 5215438 - DNA, 15 bp, Homo sapiens
aggctgacacagcca

SEQ ID NO: 5215439 - DNA, 21 bp, Homo sapiens
aggctgacatgctcacacatt

SEQ ID NO: 5215440 - DNA, 19 bp, Homo sapiens
aggctgacattcactgagt

SEQ ID NO: 5215441 - DNA, 14 bp, Homo sapiens
aggctgaccaagag

SEQ ID NO: 5215442 - DNA, 17 bp, Homo sapiens
aggctgaccaagagaga

SEQ ID NO: 5215443 - DNA, 18 bp, Homo sapiens
aggctgaccaagagagaa

SEQ ID NO: 5215444 - DNA, 19 bp, Homo sapiens
aggctgaccaagagagaaa

SEQ ID NO: 5215445 - DNA, 22 bp, Homo sapiens
aggctgaccaagagagaaagaa

SEQ ID NO: 5215446 - DNA, 14 bp, Homo sapiens
aggctgaccacagc

SEQ ID NO: 5215447 - DNA, 14 bp, Homo sapiens
aggctgacctcaac

SEQ ID NO: 5215448 - DNA, 14 bp, Homo sapiens
aggctgactggggg

SEQ ID NO: 5215449 - DNA, 20 bp, Homo sapiens
aggctgactgggggcctctg

SEQ ID NO: 5215450 - DNA, 22 bp, Homo sapiens
aggctgactgggggcctctgcc

SEQ ID NO: 5215451 - DNA, 22 bp, Homo sapiens
aggctgacttctctgaatcaga

SEQ ID NO: 5215452 - DNA, 17 bp, Homo sapiens
aggctgacttttccaaa

SEQ ID NO: 5215453 - DNA, 13 bp, Homo sapiens
aggctgagaaagc

SEQ ID NO: 5215454 - DNA, 16 bp, Homo sapiens
aggctgagaacactgt

SEQ ID NO: 5215455 - DNA, 20 bp, Homo sapiens
aggctgagaaggaacaggga

SEQ ID NO: 5215456 - DNA, 16 bp, Homo sapiens
aggctgagacacagcc

SEQ ID NO: 5215457 - DNA, 19 bp, Homo sapiens
aggctgagactgcagagga

SEQ ID NO: 5215458 - DNA, 23 bp, Homo sapiens
aggctgagagccggccgtggaag

SEQ ID NO: 5215459 - DNA, 15 bp, Homo sapiens
aggctgagagctctc

SEQ ID NO: 5215460 - DNA, 18 bp, Homo sapiens
aggctgagccatgaggag

SEQ ID NO: 5215461 - DNA, 13 bp, Homo sapiens
aggctgagcccag

SEQ ID NO: 5215462 - DNA, 21 bp, Homo sapiens
aggctgagcccagccacctcc

SEQ ID NO: 5215463 - DNA, 13 bp, Homo sapiens
aggctgagccctg

SEQ ID NO: 5215464 - DNA, 13 bp, Homo sapiens
aggctgagctggc

SEQ ID NO: 5215465 - DNA, 20 bp, Homo sapiens
aggctgaggaaaggccagct

SEQ ID NO: 5215466 - DNA, 12 bp, Homo sapiens
aggctgaggcag

SEQ ID NO: 5215467 - DNA, 17 bp, Homo sapiens
aggctgaggcagaagaa

SEQ ID NO: 5215468 - DNA, 17 bp, Homo sapiens
aggctgaggcagcagac

SEQ ID NO: 5215469 - DNA, 23 bp, Homo sapiens
aggctgaggcaggagaatggcat

SEQ ID NO: 5215470 - DNA, 11 bp, Homo sapiens
aggctgaggcg

SEQ ID NO: 5215471 - DNA, 21 bp, Homo sapiens
aggctgaggcgggtggatcac

SEQ ID NO: 5215472 - DNA, 17 bp, Homo sapiens
aggctgagggaggcaga

SEQ ID NO: 5215473 - DNA, 16 bp, Homo sapiens
aggctgagggctgcca

SEQ ID NO: 5215474 - DNA, 20 bp, Homo sapiens
aggctgagggctgccagcag

SEQ ID NO: 5215475 - DNA, 21 bp, Homo sapiens
aggctgagggctgccagcagc

SEQ ID NO: 5215476 - DNA, 21 bp, Homo sapiens
aggctgagggtcgtgggaaag

SEQ ID NO: 5215477 - DNA, 15 bp, Homo sapiens
aggctgaggtggcta

SEQ ID NO: 5215478 - DNA, 21 bp, Homo sapiens
aggctgaggtggctaaggggg

SEQ ID NO: 5215479 - DNA, 17 bp, Homo sapiens
aggctgaggtggggaag

SEQ ID NO: 5215480 - DNA, 14 bp, Homo sapiens
aggctgaggtgtct

SEQ ID NO: 5215481 - DNA, 17 bp, Homo sapiens
aggctgagtgagccaca

SEQ ID NO: 5215482 - DNA, 19 bp, Homo sapiens
aggctgagtgagccacaga

SEQ ID NO: 5215483 - DNA, 19 bp, Homo sapiens
aggctgagtgcaggcccac

SEQ ID NO: 5215484 - DNA, 23 bp, Homo sapiens
aggctgagtgcaggcccaccctg

SEQ ID NO: 5215485 - DNA, 24 bp, Homo sapiens
aggctgagtgcaggcccaccctgc

SEQ ID NO: 5215486 - DNA, 23 bp, Homo sapiens
aggctgatgccaagttgtttgag

SEQ ID NO: 5215487 - DNA, 14 bp, Homo sapiens
aggctgatgggcaa

SEQ ID NO: 5215488 - DNA, 15 bp, Homo sapiens
aggctgatgggcaaa

SEQ ID NO: 5215489 - DNA, 18 bp, Homo sapiens
aggctgatgggcaaaaaa

SEQ ID NO: 5215490 - DNA, 19 bp, Homo sapiens
aggctgattcctctcattt

SEQ ID NO: 5215491 - DNA, 22 bp, Homo sapiens
aggctgattcctctcatttcca

SEQ ID NO: 5215492 - DNA, 17 bp, Homo sapiens
aggctgcaaaattaaat

SEQ ID NO: 5215493 - DNA, 20 bp, Homo sapiens
aggctgcaaaattaaatcta

SEQ ID NO: 5215494 - DNA, 21 bp, Homo sapiens
aggctgcaaaattaaatctag

SEQ ID NO: 5215495 - DNA, 15 bp, Homo sapiens
aggctgcactgcagt

SEQ ID NO: 5215496 - DNA, 17 bp, Homo sapiens
aggtgactgtctgggga

SEQ ID NO: 5215497 - DNA, 21 bp, Homo sapiens
aggtgactgtctggggagcgg

SEQ ID NO: 5215498 - DNA, 21 bp, Homo sapiens
aggtgactgtgctgtgcagct

SEQ ID NO: 5215499 - DNA, 15 bp, Homo sapiens
aggtgacttcctctg

SEQ ID NO: 5215500 - DNA, 15 bp, Homo sapiens
aggtgagaaaaaaac

SEQ ID NO: 5215501 - DNA, 18 bp, Homo sapiens
aggtgagaaaaggggcat

SEQ ID NO: 5215502 - DNA, 13 bp, Homo sapiens
aggtgagaaactg

SEQ ID NO: 5215503 - DNA, 13 bp, Homo sapiens
aggtgagaaattt

SEQ ID NO: 5215504 - DNA, 16 bp, Homo sapiens
aggtgagaacatccat

SEQ ID NO: 5215505 - DNA, 14 bp, Homo sapiens
aggtgagaacccag

SEQ ID NO: 5215506 - DNA, 16 bp, Homo sapiens
aggtgagaagcagagg

SEQ ID NO: 5215507 - DNA, 14 bp, Homo sapiens
aggtgagaccacct

SEQ ID NO: 5215508 - DNA, 16 bp, Homo sapiens
aggtgagaccacctct

SEQ ID NO: 5215509 - DNA, 14 bp, Homo sapiens
aggtgagagtggga

SEQ ID NO: 5215510 - DNA, 20 bp, Homo sapiens
aggtgagatcacagcctcca

SEQ ID NO: 5215511 - DNA, 15 bp, Homo sapiens
aggtgagatggccag

SEQ ID NO: 5215512 - DNA, 22 bp, Homo sapiens
aggtgagcaagcccaggagaat

SEQ ID NO: 5215513 - DNA, 15 bp, Homo sapiens
aggtgagcagaggag

SEQ ID NO: 5215514 - DNA, 22 bp, Homo sapiens
aggtgagcaggcagggctgggc

SEQ ID NO: 5215515 - DNA, 14 bp, Homo sapiens
aggtgagcctgggc

SEQ ID NO: 5215516 - DNA, 14 bp, Homo sapiens
aggtgagctacttt

SEQ ID NO: 5215517 - DNA, 21 bp, Homo sapiens
aggtgagctatagtgaagaat

SEQ ID NO: 5215518 - DNA, 15 bp, Homo sapiens
aggtgagctcagctc

SEQ ID NO: 5215519 - DNA, 18 bp, Homo sapiens
aggtgaggaatttgaagc

SEQ ID NO: 5215520 - DNA, 18 bp, Homo sapiens
aggtgaggagcagagcag

SEQ ID NO: 5215521 - DNA, 16 bp, Homo sapiens
aggtgaggattccaaa

SEQ ID NO: 5215522 - DNA, 21 bp, Homo sapiens
aggtgaggcatggcaattctg

SEQ ID NO: 5215523 - DNA, 13 bp, Homo sapiens
aggtgaggcctgt

SEQ ID NO: 5215524 - DNA, 21 bp, Homo sapiens
aggtgaggcgttctcctgctt

SEQ ID NO: 5215525 - DNA, 15 bp, Homo sapiens
aggtgagggaggcct

SEQ ID NO: 5215526 - DNA, 16 bp, Homo sapiens
aggtgagggaggcctg

SEQ ID NO: 5215527 - DNA, 13 bp, Homo sapiens
aggtgagggatgt

SEQ ID NO: 5215528 - DNA, 14 bp, Homo sapiens
aggtgaggggcagg

SEQ ID NO: 5215529 - DNA, 15 bp, Homo sapiens
aggtgaggggcagga

SEQ ID NO: 5215530 - DNA, 22 bp, Homo sapiens
aggtgagggtggggtgccccag

SEQ ID NO: 5215531 - DNA, 15 bp, Homo sapiens
aggtgagtggcctgt

SEQ ID NO: 5215532 - DNA, 14 bp, Homo sapiens
aggtgataaaatca

SEQ ID NO: 5215533 - DNA, 15 bp, Homo sapiens
aggtgataaaatttt

SEQ ID NO: 5215534 - DNA, 18 bp, Homo sapiens
aggtgatatccattcttt

SEQ ID NO: 5215535 - DNA, 19 bp, Homo sapiens
aggtgatatttttatgtgc

SEQ ID NO: 5215536 - DNA, 18 bp, Homo sapiens
aggtgatatttttcttat

SEQ ID NO: 5215537 - DNA, 14 bp, Homo sapiens
aggtgatccaccca

SEQ ID NO: 5215538 - DNA, 22 bp, Homo sapiens
aggtgatccactcgccttcatc

SEQ ID NO: 5215539 - DNA, 21 bp, Homo sapiens
aggtgatccatgtaactgcct

SEQ ID NO: 5215540 - DNA, 23 bp, Homo sapiens
aggtgatcccccaaacagcatgt

SEQ ID NO: 5215541 - DNA, 22 bp, Homo sapiens
aggtgatctgctgcagagcagt

SEQ ID NO: 5215542 - DNA, 21 bp, Homo sapiens
aggtgatctgtttgaggagag

SEQ ID NO: 5215543 - DNA, 16 bp, Homo sapiens
aggtgatgaagacagc

SEQ ID NO: 5215544 - DNA, 13 bp, Homo sapiens
aggtgatgagttt

SEQ ID NO: 5215545 - DNA, 21 bp, Homo sapiens
aggtgatgccattacagaacc

SEQ ID NO: 5215546 - DNA, 20 bp, Homo sapiens
aggtgatggaggtatttgaa

SEQ ID NO: 5215547 - DNA, 16 bp, Homo sapiens
aggtgatgggggacga

SEQ ID NO: 5215548 - DNA, 20 bp, Homo sapiens
aggtgatgtttccagctgcc

SEQ ID NO: 5215549 - DNA, 21 bp, Homo sapiens
aggtgatgtttccagctgcca

SEQ ID NO: 5215550 - DNA, 15 bp, Homo sapiens
aggtgattaaatatt

SEQ ID NO: 5215551 - DNA, 18 bp, Homo sapiens
aggtgattaaatatttaa

SEQ ID NO: 5215552 - DNA, 17 bp, Homo sapiens
aggtgattccagtgaag

SEQ ID NO: 5215553 - DNA, 23 bp, Homo sapiens
aggtgattctaatcatctgcagt

SEQ ID NO: 5215554 - DNA, 19 bp, Homo sapiens
aggtgattctcagggctgg

SEQ ID NO: 5215555 - DNA, 20 bp, Homo sapiens
aggtgatttttttattattt

SEQ ID NO: 5215556 - DNA, 23 bp, Homo sapiens
aggtgatttttttattattttta

SEQ ID NO: 5215557 - DNA, 15 bp, Homo sapiens
aggtgcaaccaggga

SEQ ID NO: 5215558 - DNA, 16 bp, Homo sapiens
aggtgcaagagacaga

SEQ ID NO: 5215559 - DNA, 19 bp, Homo sapiens
aggtgcaagagacagagcc

SEQ ID NO: 5215560 - DNA, 23 bp, Homo sapiens
aggtgcaagagacagagccccca

SEQ ID NO: 5215561 - DNA, 17 bp, Homo sapiens
aggtgcaagtgccccag

SEQ ID NO: 5215562 - DNA, 15 bp, Homo sapiens
aggtgcaattatttc

SEQ ID NO: 5215563 - DNA, 17 bp, Homo sapiens
aggtgcacaagctccaa

SEQ ID NO: 5215564 - DNA, 20 bp, Homo sapiens
aggtgcacacatcaccaggt

SEQ ID NO: 5215565 - DNA, 17 bp, Homo sapiens
aggtgcacctgccccag

SEQ ID NO: 5215566 - DNA, 20 bp, Homo sapiens
aggtgcacctgccccaggct

SEQ ID NO: 5215567 - DNA, 13 bp, Homo sapiens
aggtgcactccag

SEQ ID NO: 5215568 - DNA, 15 bp, Homo sapiens
aggtgcactgggagg

SEQ ID NO: 5215569 - DNA, 22 bp, Homo sapiens
aggtgcactgggaggctcccct

SEQ ID NO: 5215570 - DNA, 22 bp, Homo sapiens
aggtgcacttggggcacaggga

SEQ ID NO: 5215571 - DNA, 11 bp, Homo sapiens
aggtgcagagg

SEQ ID NO: 5215572 - DNA, 20 bp, Homo sapiens
aggtgcagagtgcccagaac

SEQ ID NO: 5215573 - DNA, 16 bp, Homo sapiens
aggtgcagatgggctg

SEQ ID NO: 5215574 - DNA, 17 bp, Homo sapiens
aggtgcagatgggctgt

SEQ ID NO: 5215575 - DNA, 17 bp, Homo sapiens
aggtgcagccagaggca

SEQ ID NO: 5215576 - DNA, 18 bp, Homo sapiens
aggtgcagccagaggcac

SEQ ID NO: 5215577 - DNA, 17 bp, Homo sapiens
aggtgcagccccagggc

SEQ ID NO: 5215578 - DNA, 17 bp, Homo sapiens
aggtgcagctcctcagc

SEQ ID NO: 5215579 - DNA, 15 bp, Homo sapiens
aggtgcagctgcgtt

SEQ ID NO: 5215580 - DNA, 22 bp, Homo sapiens
aggtgcagctgcgttctgaggg

SEQ ID NO: 5215581 - DNA, 13 bp, Homo sapiens
aggtgcaggcagg

SEQ ID NO: 5215582 - DNA, 15 bp, Homo sapiens
aggtgcagggaagtg

SEQ ID NO: 5215583 - DNA, 17 bp, Homo sapiens
aggtgcagtcccagtcc

SEQ ID NO: 5215584 - DNA, 21 bp, Homo sapiens
aggtgcagtcccagtccttga

SEQ ID NO: 5215585 - DNA, 14 bp, Homo sapiens
aggtgcagtggagg

SEQ ID NO: 5215586 - DNA, 17 bp, Homo sapiens
aggtgcagtggaggggg

SEQ ID NO: 5215587 - DNA, 20 bp, Homo sapiens
aggtgcagtttcattcaaca

SEQ ID NO: 5215588 - DNA, 19 bp, Homo sapiens
aggtgcatatagaaaacaa

SEQ ID NO: 5215589 - DNA, 21 bp, Homo sapiens
aggtgcatctggggaactaga

SEQ ID NO: 5215590 - DNA, 23 bp, Homo sapiens
aggtgcatgcatgccctctctga

SEQ ID NO: 5215591 - DNA, 22 bp, Homo sapiens
aggtgcatgccttcataaatta

SEQ ID NO: 5215592 - DNA, 17 bp, Homo sapiens
aggtgccaccaataaaa

SEQ ID NO: 5215593 - DNA, 22 bp, Homo sapiens
aggtgccaccaataaaaatcct

SEQ ID NO: 5215594 - DNA, 20 bp, Homo sapiens
aggtgccacccagtagccca

SEQ ID NO: 5215595 - DNA, 15 bp, Homo sapiens
aggtgccactccctg

SEQ ID NO: 5215596 - DNA, 23 bp, Homo sapiens
aggtgccactttacccacctaga

SEQ ID NO: 5215597 - DNA, 18 bp, Homo sapiens
aggtgccagcaaagcccc

SEQ ID NO: 5215598 - DNA, 18 bp, Homo sapiens
aggtgccagcaactgaat

SEQ ID NO: 5215599 - DNA, 21 bp, Homo sapiens
aggtgccagcctgaggcagcc

SEQ ID NO: 5215600 - DNA, 12 bp, Homo sapiens
aggtgccaggaa

SEQ ID NO: 5215601 - DNA, 15 bp, Homo sapiens
aggtgccaggaactc

SEQ ID NO: 5215602 - DNA, 15 bp, Homo sapiens
aggtgccatctcagg

SEQ ID NO: 5215603 - DNA, 19 bp, Homo sapiens
aggtgccatgcctgctccc

SEQ ID NO: 5215604 - DNA, 14 bp, Homo sapiens
aggtgccattttaa

SEQ ID NO: 5215605 - DNA, 22 bp, Homo sapiens
aggtgcccagaatgaggctgct

SEQ ID NO: 5215606 - DNA, 16 bp, Homo sapiens
aggtgcccaggaaagg

SEQ ID NO: 5215607 - DNA, 20 bp, Homo sapiens
aggtgcccagtcttgagtgg

SEQ ID NO: 5215608 - DNA, 22 bp, Homo sapiens
aggtgcccagtcttgagtgggc

SEQ ID NO: 5215609 - DNA, 17 bp, Homo sapiens
aggtgcccatccctgga

SEQ ID NO: 5215610 - DNA, 17 bp, Homo sapiens
aggtgccccaaaatgca

SEQ ID NO: 5215611 - DNA, 14 bp, Homo sapiens
aggtgcccccaggt

SEQ ID NO: 5215612 - DNA, 14 bp, Homo sapiens
aggtgccccgtggt

SEQ ID NO: 5215613 - DNA, 15 bp, Homo sapiens
aggtgcccgccacca

SEQ ID NO: 5215614 - DNA, 18 bp, Homo sapiens
aggtgcccgcgccaggcc

SEQ ID NO: 5215615 - DNA, 21 bp, Homo sapiens
aggtgcccttggaggccagcc

SEQ ID NO: 5215616 - DNA, 18 bp, Homo sapiens
aggtgccctttagccaga

SEQ ID NO: 5215617 - DNA, 19 bp, Homo sapiens
aggtgccctttagccagat

SEQ ID NO: 5215618 - DNA, 19 bp, Homo sapiens
aggtgccgatttcatgcat

SEQ ID NO: 5215619 - DNA, 16 bp, Homo sapiens
aggtgccgctacagtt

SEQ ID NO: 5215620 - DNA, 15 bp, Homo sapiens
aggtgccggggaggg

SEQ ID NO: 5215621 - DNA, 12 bp, Homo sapiens
aggtgcctcaga

SEQ ID NO: 5215622 - DNA, 13 bp, Homo sapiens
aggtgcctcagac

SEQ ID NO: 5215623 - DNA, 14 bp, Homo sapiens
aggtgcctcagact

SEQ ID NO: 5215624 - DNA, 11 bp, Homo sapiens
aggtgcctcat

SEQ ID NO: 5215625 - DNA, 21 bp, Homo sapiens
aggtgcctccaattggtgctt

SEQ ID NO: 5215626 - DNA, 18 bp, Homo sapiens
aggtgcctccaggtgtgc

SEQ ID NO: 5215627 - DNA, 13 bp, Homo sapiens
aggtgcctcccag

SEQ ID NO: 5215628 - DNA, 14 bp, Homo sapiens
aggtgcctcccagt

SEQ ID NO: 5215629 - DNA, 17 bp, Homo sapiens
aggtgcctgagagcaga

SEQ ID NO: 5215630 - DNA, 23 bp, Homo sapiens
aggtgcctgagctggggcctgga

SEQ ID NO: 5215631 - DNA, 14 bp, Homo sapiens
aggtgcctgccata

SEQ ID NO: 5215632 - DNA, 22 bp, Homo sapiens
aggtgcctgccatagccaggag

SEQ ID NO: 5215633 - DNA, 23 bp, Homo sapiens
aggtgcctgccatagccaggagc

SEQ ID NO: 5215634 - DNA, 13 bp, Homo sapiens
aggtgcctgctca

SEQ ID NO: 5215635 - DNA, 15 bp, Homo sapiens
aggtgcctggccctt

SEQ ID NO: 5215636 - DNA, 13 bp, Homo sapiens
aggtgcctgggag

SEQ ID NO: 5215637 - DNA, 13 bp, Homo sapiens
aggtgcctggggc

SEQ ID NO: 5215638 - DNA, 16 bp, Homo sapiens
aggtgcctggggctgg

SEQ ID NO: 5215639 - DNA, 19 bp, Homo sapiens
aggtgcctgtgaggcaggg

SEQ ID NO: 5215640 - DNA, 13 bp, Homo sapiens
aggtgccttctta

SEQ ID NO: 5215641 - DNA, 23 bp, Homo sapiens
aggtgccttcttattctcactcc

SEQ ID NO: 5215642 - DNA, 20 bp, Homo sapiens
aggtgccttcttcagggcct

SEQ ID NO: 5215643 - DNA, 21 bp, Homo sapiens
aggtgccttcttcagggcctg

SEQ ID NO: 5215644 - DNA, 23 bp, Homo sapiens
aggtgccttcttcagggcctggt

SEQ ID NO: 5215645 - DNA, 10 bp, Homo sapiens
aggtgccttg

SEQ ID NO: 5215646 - DNA, 18 bp, Homo sapiens
aggtgcctttcaaattta

SEQ ID NO: 5215647 - DNA, 19 bp, Homo sapiens
aggtgcctttcaaatttag

SEQ ID NO: 5215648 - DNA, 18 bp, Homo sapiens
aggtgcgcacttacctgc

SEQ ID NO: 5215649 - DNA, 13 bp, Homo sapiens
aggtgcgcagtgg

SEQ ID NO: 5215650 - DNA, 20 bp, Homo sapiens
aggtgcgcgccaccgtgcct

SEQ ID NO: 5215651 - DNA, 22 bp, Homo sapiens
aggtgcgcgccaccgtgcctgg

SEQ ID NO: 5215652 - DNA, 17 bp, Homo sapiens
aggtgcgctcacctcag

SEQ ID NO: 5215653 - DNA, 18 bp, Homo sapiens
aggtgcggaccggagcgg

SEQ ID NO: 5215654 - DNA, 21 bp, Homo sapiens
aggtgcggaccggagcggctg

SEQ ID NO: 5215655 - DNA, 13 bp, Homo sapiens
aggtgcggggaga

SEQ ID NO: 5215656 - DNA, 23 bp, Homo sapiens
aggtgcgtcccccgttgtgcctg

SEQ ID NO: 5215657 - DNA, 20 bp, Homo sapiens
aggtgcgtgttcagcagaac

SEQ ID NO: 5215658 - DNA, 16 bp, Homo sapiens
aggtgctaaaaggaat

SEQ ID NO: 5215659 - DNA, 17 bp, Homo sapiens
aggtgctaaaattcaga

SEQ ID NO: 5215660 - DNA, 23 bp, Homo sapiens
aggtgctaaatggtcgcccagga

SEQ ID NO: 5215661 - DNA, 17 bp, Homo sapiens
aggtgctaatttgtttt

SEQ ID NO: 5215662 - DNA, 23 bp, Homo sapiens
aggtgctacaaaaacacagcaag

SEQ ID NO: 5215663 - DNA, 20 bp, Homo sapiens
aggtgctacacccttttcca

SEQ ID NO: 5215664 - DNA, 21 bp, Homo sapiens
aggtgctacacccttttccag

SEQ ID NO: 5215665 - DNA, 15 bp, Homo sapiens
aggtgctagctctta

SEQ ID NO: 5215666 - DNA, 23 bp, Homo sapiens
aggtgctaggaacactccttcac

SEQ ID NO: 5215667 - DNA, 14 bp, Homo sapiens
aggtgctatataat

SEQ ID NO: 5215668 - DNA, 17 bp, Homo sapiens
aggtgctatcctgccca

SEQ ID NO: 5215669 - DNA, 21 bp, Homo sapiens
aggtgctatctgttcagtgat

SEQ ID NO: 5215670 - DNA, 16 bp, Homo sapiens
aggtgctatgaagcca

SEQ ID NO: 5215671 - DNA, 15 bp, Homo sapiens
aggtgctcaaagatg

SEQ ID NO: 5215672 - DNA, 18 bp, Homo sapiens
aggtgctcacaccccatt

SEQ ID NO: 5215673 - DNA, 19 bp, Homo sapiens
aggtgctcagacatgaaat

SEQ ID NO: 5215674 - DNA, 21 bp, Homo sapiens
aggctgcactgcagtgatggc

SEQ ID NO: 5215675 - DNA, 17 bp, Homo sapiens
aggctgcactggagcca

SEQ ID NO: 5215676 - DNA, 17 bp, Homo sapiens
aggctgcagaaggccaa

SEQ ID NO: 5215677 - DNA, 20 bp, Homo sapiens
aggctgcagaaggccaagaa

SEQ ID NO: 5215678 - DNA, 14 bp, Homo sapiens
aggctgcagagccc

SEQ ID NO: 5215679 - DNA, 15 bp, Homo sapiens
aggctgcagagcccg

SEQ ID NO: 5215680 - DNA, 19 bp, Homo sapiens
aggctgcagagctgaccca

SEQ ID NO: 5215681 - DNA, 11 bp, Homo sapiens
aggctgcagca

SEQ ID NO: 5215682 - DNA, 13 bp, Homo sapiens
aggctgcagcagg

SEQ ID NO: 5215683 - DNA, 21 bp, Homo sapiens
aggctgcagcaggtgctgggc

SEQ ID NO: 5215684 - DNA, 13 bp, Homo sapiens
aggctgcagccag

SEQ ID NO: 5215685 - DNA, 19 bp, Homo sapiens
aggctgcagccaggcctcg

SEQ ID NO: 5215686 - DNA, 20 bp, Homo sapiens
aggctgcagccaggcctcgc

SEQ ID NO: 5215687 - DNA, 14 bp, Homo sapiens
aggctgcagcctcc

SEQ ID NO: 5215688 - DNA, 15 bp, Homo sapiens
aggctgcagcctcca

SEQ ID NO: 5215689 - DNA, 15 bp, Homo sapiens
aggctgcagcgagct

SEQ ID NO: 5215690 - DNA, 15 bp, Homo sapiens
aggctgcagctggac

SEQ ID NO: 5215691 - DNA, 17 bp, Homo sapiens
aggctgcagctggacag

SEQ ID NO: 5215692 - DNA, 19 bp, Homo sapiens
aggctgcagctggacagag

SEQ ID NO: 5215693 - DNA, 16 bp, Homo sapiens
aggctgcaggagggca

SEQ ID NO: 5215694 - DNA, 18 bp, Homo sapiens
aggctgcagtcagccctg

SEQ ID NO: 5215695 - DNA, 21 bp, Homo sapiens
aggctgcagtcagtcatgatg

SEQ ID NO: 5215696 - DNA, 15 bp, Homo sapiens
aggctgcagtggctc

SEQ ID NO: 5215697 - DNA, 16 bp, Homo sapiens
aggctgcagtggctcc

SEQ ID NO: 5215698 - DNA, 17 bp, Homo sapiens
aggctgcagtggctccc

SEQ ID NO: 5215699 - DNA, 13 bp, Homo sapiens
aggctgcatagaa

SEQ ID NO: 5215700 - DNA, 23 bp, Homo sapiens
aggctgcatagaaggaggagagg

SEQ ID NO: 5215701 - DNA, 16 bp, Homo sapiens
aggctgcatgctctgg

SEQ ID NO: 5215702 - DNA, 22 bp, Homo sapiens
aggctgccacacggaagcaagc

SEQ ID NO: 5215703 - DNA, 19 bp, Homo sapiens
aggctgccagacatggacc

SEQ ID NO: 5215704 - DNA, 14 bp, Homo sapiens
aggctgccagagaa

SEQ ID NO: 5215705 - DNA, 16 bp, Homo sapiens
aggctgccagtgcctg

SEQ ID NO: 5215706 - DNA, 20 bp, Homo sapiens
aggctgccagtgcctgggtg

SEQ ID NO: 5215707 - DNA, 16 bp, Homo sapiens
aggctgcccaatctga

SEQ ID NO: 5215708 - DNA, 18 bp, Homo sapiens
aggctgcccaatctgagc

SEQ ID NO: 5215709 - DNA, 17 bp, Homo sapiens
aggctgcccactctggg

SEQ ID NO: 5215710 - DNA, 20 bp, Homo sapiens
aggctgcccagagctgctgg

SEQ ID NO: 5215711 - DNA, 14 bp, Homo sapiens
aggctgccccaccc

SEQ ID NO: 5215712 - DNA, 16 bp, Homo sapiens
aggctgccccaggccg

SEQ ID NO: 5215713 - DNA, 17 bp, Homo sapiens
aggctgccccaggggca

SEQ ID NO: 5215714 - DNA, 19 bp, Homo sapiens
aggctgcccccaacactcc

SEQ ID NO: 5215715 - DNA, 20 bp, Homo sapiens
aggctgcccccaacactcca

SEQ ID NO: 5215716 - DNA, 22 bp, Homo sapiens
aggctgcccccaacactccagg

SEQ ID NO: 5215717 - DNA, 18 bp, Homo sapiens
aggctgcccccatccagc

SEQ ID NO: 5215718 - DNA, 20 bp, Homo sapiens
aggctgcccccggccccctg

SEQ ID NO: 5215719 - DNA, 22 bp, Homo sapiens
aggctgcccccggccccctggt

SEQ ID NO: 5215720 - DNA, 12 bp, Homo sapiens
aggctgcccctc

SEQ ID NO: 5215721 - DNA, 23 bp, Homo sapiens
aggctgccctgaggggctgggga

SEQ ID NO: 5215722 - DNA, 13 bp, Homo sapiens
aggctgccctgtc

SEQ ID NO: 5215723 - DNA, 16 bp, Homo sapiens
aggctgccggagggag

SEQ ID NO: 5215724 - DNA, 19 bp, Homo sapiens
aggctgccggctgcaccct

SEQ ID NO: 5215725 - DNA, 15 bp, Homo sapiens
aggctgcctcagcca

SEQ ID NO: 5215726 - DNA, 18 bp, Homo sapiens
aggctgcctcagccagtg

SEQ ID NO: 5215727 - DNA, 19 bp, Homo sapiens
aggctgcctcatgaccctc

SEQ ID NO: 5215728 - DNA, 22 bp, Homo sapiens
aggctgcctcatgaccctcctg

SEQ ID NO: 5215729 - DNA, 13 bp, Homo sapiens
aggctgcctccca

SEQ ID NO: 5215730 - DNA, 15 bp, Homo sapiens
aggctgcctccgcac

SEQ ID NO: 5215731 - DNA, 16 bp, Homo sapiens
aggctgcctcctgccc

SEQ ID NO: 5215732 - DNA, 20 bp, Homo sapiens
aggctgcctcggactccatg

SEQ ID NO: 5215733 - DNA, 23 bp, Homo sapiens
aggctgcctgagcacctcccagc

SEQ ID NO: 5215734 - DNA, 18 bp, Homo sapiens
aggctgcctgctgtgctg

SEQ ID NO: 5215735 - DNA, 22 bp, Homo sapiens
aggctgcctgctgtgctgggag

SEQ ID NO: 5215736 - DNA, 12 bp, Homo sapiens
aggctgcctgga

SEQ ID NO: 5215737 - DNA, 15 bp, Homo sapiens
aggctgcctggagaa

SEQ ID NO: 5215738 - DNA, 17 bp, Homo sapiens
aggctgcctggagaaag

SEQ ID NO: 5215739 - DNA, 14 bp, Homo sapiens
aggctgcgcctgcc

SEQ ID NO: 5215740 - DNA, 16 bp, Homo sapiens
aggctgcggcccctcc

SEQ ID NO: 5215741 - DNA, 17 bp, Homo sapiens
aggctgcggtgggcagc

SEQ ID NO: 5215742 - DNA, 19 bp, Homo sapiens
aggctgcgtccctccgagc

SEQ ID NO: 5215743 - DNA, 14 bp, Homo sapiens
aggctgcgtcctga

SEQ ID NO: 5215744 - DNA, 17 bp, Homo sapiens
aggctgcgtcctgagga

SEQ ID NO: 5215745 - DNA, 18 bp, Homo sapiens
aggctgcgtcctgaggag

SEQ ID NO: 5215746 - DNA, 16 bp, Homo sapiens
aggctgcgtctggagg

SEQ ID NO: 5215747 - DNA, 17 bp, Homo sapiens
aggctgcgtctggaggg

SEQ ID NO: 5215748 - DNA, 15 bp, Homo sapiens
aggctgctaacctgg

SEQ ID NO: 5215749 - DNA, 20 bp, Homo sapiens
aggctgctaagtggaagaca

SEQ ID NO: 5215750 - DNA, 24 bp, Homo sapiens
aggctgctaagtggaagacagaga

SEQ ID NO: 5215751 - DNA, 15 bp, Homo sapiens
aggctgctcagaggg

SEQ ID NO: 5215752 - DNA, 21 bp, Homo sapiens
aggctgctcagaggggccccg

SEQ ID NO: 5215753 - DNA, 14 bp, Homo sapiens
aggctgctccctga

SEQ ID NO: 5215754 - DNA, 23 bp, Homo sapiens
aggctgctcttgaactcctgacc

SEQ ID NO: 5215755 - DNA, 14 bp, Homo sapiens
aggctgctgcacac

SEQ ID NO: 5215756 - DNA, 16 bp, Homo sapiens
aggctgctgcacacca

SEQ ID NO: 5215757 - DNA, 21 bp, Homo sapiens
aggctgctgcacaccaaggcc

SEQ ID NO: 5215758 - DNA, 23 bp, Homo sapiens
aggctgctgcacaccaaggccct

SEQ ID NO: 5215759 - DNA, 11 bp, Homo sapiens
aggctgctgcc

SEQ ID NO: 5215760 - DNA, 12 bp, Homo sapiens
aggctgctgcca

SEQ ID NO: 5215761 - DNA, 14 bp, Homo sapiens
aggctgctgccagg

SEQ ID NO: 5215762 - DNA, 15 bp, Homo sapiens
aggctgctgccaggc

SEQ ID NO: 5215763 - DNA, 13 bp, Homo sapiens
aggctgctggagg

SEQ ID NO: 5215764 - DNA, 14 bp, Homo sapiens
aggctgctggagga

SEQ ID NO: 5215765 - DNA, 16 bp, Homo sapiens
aggctgctggagtgca

SEQ ID NO: 5215766 - DNA, 23 bp, Homo sapiens
aggctgctggagtgcagtggcac

SEQ ID NO: 5215767 - DNA, 15 bp, Homo sapiens
aggctgctggcgcct

SEQ ID NO: 5215768 - DNA, 19 bp, Homo sapiens
aggctgctggcgcctctgc

SEQ ID NO: 5215769 - DNA, 12 bp, Homo sapiens
aggctgctggct

SEQ ID NO: 5215770 - DNA, 15 bp, Homo sapiens
aggctgctggcttca

SEQ ID NO: 5215771 - DNA, 15 bp, Homo sapiens
aggctgctgtaaagt

SEQ ID NO: 5215772 - DNA, 13 bp, Homo sapiens
aggctgctgtcac

SEQ ID NO: 5215773 - DNA, 22 bp, Homo sapiens
aggctgctgtgaaaactctggt

SEQ ID NO: 5215774 - DNA, 20 bp, Homo sapiens
aggctgctgtgtagctctgt

SEQ ID NO: 5215775 - DNA, 14 bp, Homo sapiens
aggctgcttagaat

SEQ ID NO: 5215776 - DNA, 22 bp, Homo sapiens
aggctgcttagaatccaaactt

SEQ ID NO: 5215777 - DNA, 21 bp, Homo sapiens
aggctgctttccaaagccaat

SEQ ID NO: 5215778 - DNA, 17 bp, Homo sapiens
aggctgctttctgccct

SEQ ID NO: 5215779 - DNA, 15 bp, Homo sapiens
aggctggaagagcca

SEQ ID NO: 5215780 - DNA, 23 bp, Homo sapiens
aggctggaaggaaagcaaggcag

SEQ ID NO: 5215781 - DNA, 18 bp, Homo sapiens
aggctggaaggaggaaga

SEQ ID NO: 5215782 - DNA, 19 bp, Homo sapiens
aggctggaaggcagcaggc

SEQ ID NO: 5215783 - DNA, 19 bp, Homo sapiens
aggctggaatgagggaggc

SEQ ID NO: 5215784 - DNA, 17 bp, Homo sapiens
aggctggaatgcagtgg

SEQ ID NO: 5215785 - DNA, 16 bp, Homo sapiens
aggctggaccaactgc

SEQ ID NO: 5215786 - DNA, 20 bp, Homo sapiens
aggctggactgcagtggcct

SEQ ID NO: 5215787 - DNA, 13 bp, Homo sapiens
aggctggagaagg

SEQ ID NO: 5215788 - DNA, 12 bp, Homo sapiens
aggctggagaca

SEQ ID NO: 5215789 - DNA, 21 bp, Homo sapiens
aggctggagataacagcctct

SEQ ID NO: 5215790 - DNA, 13 bp, Homo sapiens
aggctggagccca

SEQ ID NO: 5215791 - DNA, 16 bp, Homo sapiens
aggctggaggcagggc

SEQ ID NO: 5215792 - DNA, 17 bp, Homo sapiens
aggctggaggcagggcc

SEQ ID NO: 5215793 - DNA, 23 bp, Homo sapiens
aggctggaggcagggccttgccc

SEQ ID NO: 5215794 - DNA, 18 bp, Homo sapiens
aggctggagtacagtggt

SEQ ID NO: 5215795 - DNA, 17 bp, Homo sapiens
aggctggagtgaagtgg

SEQ ID NO: 5215796 - DNA, 21 bp, Homo sapiens
aggctggagtgaagtggtgtg

SEQ ID NO: 5215797 - DNA, 18 bp, Homo sapiens
aggctggagtgcaatggt

SEQ ID NO: 5215798 - DNA, 14 bp, Homo sapiens
aggctggagtgcag

SEQ ID NO: 5215799 - DNA, 15 bp, Homo sapiens
aggctggagtgcagt

SEQ ID NO: 5215800 - DNA, 17 bp, Homo sapiens
aggctggagtgcagtga

SEQ ID NO: 5215801 - DNA, 20 bp, Homo sapiens
aggctggagtgcagtggcgt

SEQ ID NO: 5215802 - DNA, 19 bp, Homo sapiens
aggctggagtgcagtggct

SEQ ID NO: 5215803 - DNA, 18 bp, Homo sapiens
aggctggataggagagga

SEQ ID NO: 5215804 - DNA, 22 bp, Homo sapiens
aggctggatcctagccttatcc

SEQ ID NO: 5215805 - DNA, 14 bp, Homo sapiens
aggctggatgctgg

SEQ ID NO: 5215806 - DNA, 16 bp, Homo sapiens
aggctggatgctgggt

SEQ ID NO: 5215807 - DNA, 18 bp, Homo sapiens
aggctggatgctgggttc

SEQ ID NO: 5215808 - DNA, 16 bp, Homo sapiens
aggctggatggcacct

SEQ ID NO: 5215809 - DNA, 21 bp, Homo sapiens
aggctggatggctcccctgag

SEQ ID NO: 5215810 - DNA, 16 bp, Homo sapiens
aggctggatgtgcttt

SEQ ID NO: 5215811 - DNA, 21 bp, Homo sapiens
aggctggcaagataaacactt

SEQ ID NO: 5215812 - DNA, 17 bp, Homo sapiens
aggctggcacaggacat

SEQ ID NO: 5215813 - DNA, 18 bp, Homo sapiens
aggctggcacaggacatg

SEQ ID NO: 5215814 - DNA, 19 bp, Homo sapiens
aggctggcaccgccttctc

SEQ ID NO: 5215815 - DNA, 13 bp, Homo sapiens
aggctggcactcc

SEQ ID NO: 5215816 - DNA, 15 bp, Homo sapiens
aggctggcagggtcc

SEQ ID NO: 5215817 - DNA, 18 bp, Homo sapiens
aggctggcagtacagagt

SEQ ID NO: 5215818 - DNA, 17 bp, Homo sapiens
aggctggcatcctggct

SEQ ID NO: 5215819 - DNA, 18 bp, Homo sapiens
aggctggcatcctggctg

SEQ ID NO: 5215820 - DNA, 20 bp, Homo sapiens
aggctggcatcctggctggc

SEQ ID NO: 5215821 - DNA, 21 bp, Homo sapiens
aggctggcatcctggctggct

SEQ ID NO: 5215822 - DNA, 22 bp, Homo sapiens
aggctggcatctcccccaccct

SEQ ID NO: 5215823 - DNA, 22 bp, Homo sapiens
aggctggccaaggtgtccaggg

SEQ ID NO: 5215824 - DNA, 22 bp, Homo sapiens
aggctggccagcaaggcaggtt

SEQ ID NO: 5215825 - DNA, 15 bp, Homo sapiens
aggctggccagcccc

SEQ ID NO: 5215826 - DNA, 18 bp, Homo sapiens
aggctggccagccccaca

SEQ ID NO: 5215827 - DNA, 22 bp, Homo sapiens
aggctggccagccccacagccc

SEQ ID NO: 5215828 - DNA, 16 bp, Homo sapiens
aggctggccagccgct

SEQ ID NO: 5215829 - DNA, 18 bp, Homo sapiens
aggctggccagccgctct

SEQ ID NO: 5215830 - DNA, 23 bp, Homo sapiens
aggctggcccccacccaccttcc

SEQ ID NO: 5215831 - DNA, 14 bp, Homo sapiens
aggctggccctgcc

SEQ ID NO: 5215832 - DNA, 16 bp, Homo sapiens
aggctggcctcagact

SEQ ID NO: 5215833 - DNA, 11 bp, Homo sapiens
aggctggcctg

SEQ ID NO: 5215834 - DNA, 23 bp, Homo sapiens
aggctggcctgatcttggctcac

SEQ ID NO: 5215835 - DNA, 20 bp, Homo sapiens
aggctggcgagagtctggcc

SEQ ID NO: 5215836 - DNA, 14 bp, Homo sapiens
aggctggcgcagcc

SEQ ID NO: 5215837 - DNA, 17 bp, Homo sapiens
aggctggcgcagccaag

SEQ ID NO: 5215838 - DNA, 19 bp, Homo sapiens
aggctggcgcagccaaggc

SEQ ID NO: 5215839 - DNA, 15 bp, Homo sapiens
aggctggctgagtgg

SEQ ID NO: 5215840 - DNA, 15 bp, Homo sapiens
aggctggctggggcc

SEQ ID NO: 5215841 - DNA, 19 bp, Homo sapiens
aggctggcttgcccgcgct

SEQ ID NO: 5215842 - DNA, 22 bp, Homo sapiens
aggctggcttgtcccctcctca

SEQ ID NO: 5215843 - DNA, 17 bp, Homo sapiens
aggctggctttcagagt

SEQ ID NO: 5215844 - DNA, 18 bp, Homo sapiens
aggctgggaactcatctg

SEQ ID NO: 5215845 - DNA, 22 bp, Homo sapiens
aggctgggaatggaggggcaga

SEQ ID NO: 5215846 - DNA, 18 bp, Homo sapiens
aggctgggacgctctgct

SEQ ID NO: 5215847 - DNA, 14 bp, Homo sapiens
aggctgggagagcc

SEQ ID NO: 5215848 - DNA, 16 bp, Homo sapiens
aggctgggagagcctt

SEQ ID NO: 5215849 - DNA, 19 bp, Homo sapiens
aggctgggagagccttcca

SEQ ID NO: 5215850 - DNA, 16 bp, Homo sapiens
aggctgggaggagccc

SEQ ID NO: 5215851 - DNA, 23 bp, Homo sapiens
aggctgggaggagcccctggaca

SEQ ID NO: 5215852 - DNA, 21 bp, Homo sapiens
aggtgctcataactagagtat

SEQ ID NO: 5215853 - DNA, 14 bp, Homo sapiens
aggtgctcatgctg

SEQ ID NO: 5215854 - DNA, 16 bp, Homo sapiens
aggtgctcatgctgct

SEQ ID NO: 5215855 - DNA, 17 bp, Homo sapiens
aggtgctcccctgacag

SEQ ID NO: 5215856 - DNA, 20 bp, Homo sapiens
aggtgctcctcttttttctt

SEQ ID NO: 5215857 - DNA, 18 bp, Homo sapiens
aggtgctctctttctgtc

SEQ ID NO: 5215858 - DNA, 13 bp, Homo sapiens
aggtgctctgtgt

SEQ ID NO: 5215859 - DNA, 14 bp, Homo sapiens
aggtgctctgtgtc

SEQ ID NO: 5215860 - DNA, 13 bp, Homo sapiens
aggtgctcttctc

SEQ ID NO: 5215861 - DNA, 16 bp, Homo sapiens
aggtgctcttctcatt

SEQ ID NO: 5215862 - DNA, 17 bp, Homo sapiens
aggtgctcttctcattt

SEQ ID NO: 5215863 - DNA, 22 bp, Homo sapiens
aggtgctgaatgaagctgccat

SEQ ID NO: 5215864 - DNA, 14 bp, Homo sapiens
aggtgctgaatggg

SEQ ID NO: 5215865 - DNA, 17 bp, Homo sapiens
aggtgctgacggccagg

SEQ ID NO: 5215866 - DNA, 21 bp, Homo sapiens
aggtgctgagcaaagggaaca

SEQ ID NO: 5215867 - DNA, 17 bp, Homo sapiens
aggtgctgatggccctc

SEQ ID NO: 5215868 - DNA, 18 bp, Homo sapiens
aggtgctgatgtcaaagt

SEQ ID NO: 5215869 - DNA, 15 bp, Homo sapiens
aggtgctgccacccc

SEQ ID NO: 5215870 - DNA, 14 bp, Homo sapiens
aggtgctgctttgc

SEQ ID NO: 5215871 - DNA, 19 bp, Homo sapiens
aggtgctgctttgcttctt

SEQ ID NO: 5215872 - DNA, 21 bp, Homo sapiens
aggtgctggaaagggagggag

SEQ ID NO: 5215873 - DNA, 21 bp, Homo sapiens
aggtgctggagcactgggctc

SEQ ID NO: 5215874 - DNA, 22 bp, Homo sapiens
aggtgctggagcactgggctcc

SEQ ID NO: 5215875 - DNA, 14 bp, Homo sapiens
aggtgctggaggca

SEQ ID NO: 5215876 - DNA, 15 bp, Homo sapiens
aggtgctggaggcag

SEQ ID NO: 5215877 - DNA, 20 bp, Homo sapiens
aggtgctggaggcagactcg

SEQ ID NO: 5215878 - DNA, 14 bp, Homo sapiens
aggtgctggaggtg

SEQ ID NO: 5215879 - DNA, 19 bp, Homo sapiens
aggtgctggaggtgggagc

SEQ ID NO: 5215880 - DNA, 21 bp, Homo sapiens
aggtgctggcatgtctgggtc

SEQ ID NO: 5215881 - DNA, 11 bp, Homo sapiens
aggtgctggcc

SEQ ID NO: 5215882 - DNA, 13 bp, Homo sapiens
aggtgctggccca

SEQ ID NO: 5215883 - DNA, 19 bp, Homo sapiens
aggtgctggcccagcatgg

SEQ ID NO: 5215884 - DNA, 15 bp, Homo sapiens
aggtgctgggaggga

SEQ ID NO: 5215885 - DNA, 17 bp, Homo sapiens
aggtgctgggctggact

SEQ ID NO: 5215886 - DNA, 17 bp, Homo sapiens
aggtgctggggcctggt

SEQ ID NO: 5215887 - DNA, 19 bp, Homo sapiens
aggtgctggtagctgaggg

SEQ ID NO: 5215888 - DNA, 20 bp, Homo sapiens
aggtgctggtagctgagggg

SEQ ID NO: 5215889 - DNA, 15 bp, Homo sapiens
aggtgctgtccccac

SEQ ID NO: 5215890 - DNA, 19 bp, Homo sapiens
aggtgctgtccccactgcc

SEQ ID NO: 5215891 - DNA, 19 bp, Homo sapiens
aggtgctgttgtcattgct

SEQ ID NO: 5215892 - DNA, 21 bp, Homo sapiens
aggtgctgttgtcattgcttt

SEQ ID NO: 5215893 - DNA, 23 bp, Homo sapiens
aggtgcttctagttctgccagga

SEQ ID NO: 5215894 - DNA, 17 bp, Homo sapiens
aggtgcttgaggccccg

SEQ ID NO: 5215895 - DNA, 14 bp, Homo sapiens
aggtgcttgctccc

SEQ ID NO: 5215896 - DNA, 21 bp, Homo sapiens
aggtgctttagagataattgc

SEQ ID NO: 5215897 - DNA, 23 bp, Homo sapiens
aggtgctttagagataattgctt

SEQ ID NO: 5215898 - DNA, 11 bp, Homo sapiens
aggtgctttct

SEQ ID NO: 5215899 - DNA, 13 bp, Homo sapiens
aggtgctttctcc

SEQ ID NO: 5215900 - DNA, 19 bp, Homo sapiens
aggtgcttttccctatcca

SEQ ID NO: 5215901 - DNA, 17 bp, Homo sapiens
aggtgcttttggcagag

SEQ ID NO: 5215902 - DNA, 13 bp, Homo sapiens
aggtggaaaaaca

SEQ ID NO: 5215903 - DNA, 18 bp, Homo sapiens
aggtggaaaaacatctga

SEQ ID NO: 5215904 - DNA, 13 bp, Homo sapiens
aggtggaaaaact

SEQ ID NO: 5215905 - DNA, 22 bp, Homo sapiens
aggtggaaaaactgagacaggc

SEQ ID NO: 5215906 - DNA, 19 bp, Homo sapiens
aggtggaaaaggaacccaa

SEQ ID NO: 5215907 - DNA, 23 bp, Homo sapiens
aggtggaacaaacagaaatgact

SEQ ID NO: 5215908 - DNA, 16 bp, Homo sapiens
aggtggaacaggagga

SEQ ID NO: 5215909 - DNA, 21 bp, Homo sapiens
aggtggaacaggaggaactgg

SEQ ID NO: 5215910 - DNA, 15 bp, Homo sapiens
aggtggaagaaggga

SEQ ID NO: 5215911 - DNA, 17 bp, Homo sapiens
aggtggaagaagggaga

SEQ ID NO: 5215912 - DNA, 22 bp, Homo sapiens
aggtggaagaagggagaagaaa

SEQ ID NO: 5215913 - DNA, 13 bp, Homo sapiens
aggtggaagcaga

SEQ ID NO: 5215914 - DNA, 17 bp, Homo sapiens
aggtggaagcagaggcc

SEQ ID NO: 5215915 - DNA, 20 bp, Homo sapiens
aggtggaagcagaggccctg

SEQ ID NO: 5215916 - DNA, 22 bp, Homo sapiens
aggtggaagcagaggccctgcc

SEQ ID NO: 5215917 - DNA, 15 bp, Homo sapiens
aggtggaagccctcc

SEQ ID NO: 5215918 - DNA, 20 bp, Homo sapiens
aggtggaagccctccttcca

SEQ ID NO: 5215919 - DNA, 16 bp, Homo sapiens
aggtggaaggcagaca

SEQ ID NO: 5215920 - DNA, 17 bp, Homo sapiens
aggtggaaggcagacag

SEQ ID NO: 5215921 - DNA, 18 bp, Homo sapiens
aggtggaaggcagacagc

SEQ ID NO: 5215922 - DNA, 14 bp, Homo sapiens
aggtggaattactt

SEQ ID NO: 5215923 - DNA, 17 bp, Homo sapiens
aggtggaccctgtaaat

SEQ ID NO: 5215924 - DNA, 13 bp, Homo sapiens
aggtggacctggc

SEQ ID NO: 5215925 - DNA, 18 bp, Homo sapiens
aggtggaccttttaaagt

SEQ ID NO: 5215926 - DNA, 20 bp, Homo sapiens
aggtggacgctgcagacccc

SEQ ID NO: 5215927 - DNA, 23 bp, Homo sapiens
aggtggagagacacacctgctcc

SEQ ID NO: 5215928 - DNA, 21 bp, Homo sapiens
aggtggagagggagatgtgtg

SEQ ID NO: 5215929 - DNA, 20 bp, Homo sapiens
aggtggagattgcagtgagc

SEQ ID NO: 5215930 - DNA, 17 bp, Homo sapiens
aggtggagccaagtggt

SEQ ID NO: 5215931 - DNA, 19 bp, Homo sapiens
aggtggagggaaggataaa

SEQ ID NO: 5215932 - DNA, 17 bp, Homo sapiens
aggtggagggcacagcc

SEQ ID NO: 5215933 - DNA, 13 bp, Homo sapiens
aggtggaggtggg

SEQ ID NO: 5215934 - DNA, 19 bp, Homo sapiens
aggtggaggttgtgcatgt

SEQ ID NO: 5215935 - DNA, 17 bp, Homo sapiens
aggtggagtttctctgt

SEQ ID NO: 5215936 - DNA, 22 bp, Homo sapiens
aggtggatactggggggcaggc

SEQ ID NO: 5215937 - DNA, 16 bp, Homo sapiens
aggtggatcacagagg

SEQ ID NO: 5215938 - DNA, 16 bp, Homo sapiens
aggtggatggccccag

SEQ ID NO: 5215939 - DNA, 18 bp, Homo sapiens
aggtggattcctgggcaa

SEQ ID NO: 5215940 - DNA, 16 bp, Homo sapiens
aggtggcaaggctgtg

SEQ ID NO: 5215941 - DNA, 17 bp, Homo sapiens
aggtggcaatgcttaaa

SEQ ID NO: 5215942 - DNA, 14 bp, Homo sapiens
aggtggcacctgca

SEQ ID NO: 5215943 - DNA, 23 bp, Homo sapiens
aggtggcacctgcagcggctgcc

SEQ ID NO: 5215944 - DNA, 22 bp, Homo sapiens
aggtggcactaccccaaaccca

SEQ ID NO: 5215945 - DNA, 23 bp, Homo sapiens
aggtggcagatgtcttccctggg

SEQ ID NO: 5215946 - DNA, 13 bp, Homo sapiens
aggtggcagcaag

SEQ ID NO: 5215947 - DNA, 17 bp, Homo sapiens
aggtggcaggaccagga

SEQ ID NO: 5215948 - DNA, 19 bp, Homo sapiens
aggtggcaggaccaggact

SEQ ID NO: 5215949 - DNA, 14 bp, Homo sapiens
aggtggcagggctg

SEQ ID NO: 5215950 - DNA, 16 bp, Homo sapiens
aggtggcatttgcagg

SEQ ID NO: 5215951 - DNA, 16 bp, Homo sapiens
aggtggccaagttcct

SEQ ID NO: 5215952 - DNA, 15 bp, Homo sapiens
aggtggccacagcag

SEQ ID NO: 5215953 - DNA, 21 bp, Homo sapiens
aggtggccacagtgtcactgg

SEQ ID NO: 5215954 - DNA, 14 bp, Homo sapiens
aggtggccactcca

SEQ ID NO: 5215955 - DNA, 17 bp, Homo sapiens
aggtggccagaagagct

SEQ ID NO: 5215956 - DNA, 19 bp, Homo sapiens
aggtggccagcccgcagag

SEQ ID NO: 5215957 - DNA, 14 bp, Homo sapiens
aggtggccaggcag

SEQ ID NO: 5215958 - DNA, 16 bp, Homo sapiens
aggtggccaggcaggc

SEQ ID NO: 5215959 - DNA, 19 bp, Homo sapiens
aggtggccaggcctgccag

SEQ ID NO: 5215960 - DNA, 17 bp, Homo sapiens
aggtggccagggctcca

SEQ ID NO: 5215961 - DNA, 18 bp, Homo sapiens
aggtggccagggctccac

SEQ ID NO: 5215962 - DNA, 11 bp, Homo sapiens
aggtggccatc

SEQ ID NO: 5215963 - DNA, 18 bp, Homo sapiens
aggtggccatgcctcagc

SEQ ID NO: 5215964 - DNA, 19 bp, Homo sapiens
aggtggccatgcctcagcc

SEQ ID NO: 5215965 - DNA, 15 bp, Homo sapiens
aggtggccatgttat

SEQ ID NO: 5215966 - DNA, 12 bp, Homo sapiens
aggtggcccagg

SEQ ID NO: 5215967 - DNA, 18 bp, Homo sapiens
aggtggcccaggcccccg

SEQ ID NO: 5215968 - DNA, 14 bp, Homo sapiens
aggtggccctactg

SEQ ID NO: 5215969 - DNA, 12 bp, Homo sapiens
aggtggccgcca

SEQ ID NO: 5215970 - DNA, 20 bp, Homo sapiens
aggtggccgcccctgaggct

SEQ ID NO: 5215971 - DNA, 15 bp, Homo sapiens
aggtggccgctcctc

SEQ ID NO: 5215972 - DNA, 20 bp, Homo sapiens
aggtggccgctcctccctgc

SEQ ID NO: 5215973 - DNA, 16 bp, Homo sapiens
aggtggcctaaggctg

SEQ ID NO: 5215974 - DNA, 21 bp, Homo sapiens
aggtggcctccttgcttgtta

SEQ ID NO: 5215975 - DNA, 17 bp, Homo sapiens
aggtggcctctgcctgg

SEQ ID NO: 5215976 - DNA, 14 bp, Homo sapiens
aggtggcctctgct

SEQ ID NO: 5215977 - DNA, 15 bp, Homo sapiens
aggtggcctctgctg

SEQ ID NO: 5215978 - DNA, 16 bp, Homo sapiens
aggtggcctctgctgg

SEQ ID NO: 5215979 - DNA, 14 bp, Homo sapiens
aggtggcctttgtg

SEQ ID NO: 5215980 - DNA, 19 bp, Homo sapiens
aggtggcctttgtgctgcg

SEQ ID NO: 5215981 - DNA, 20 bp, Homo sapiens
aggtggcctttgtgctgcgc

SEQ ID NO: 5215982 - DNA, 17 bp, Homo sapiens
aggtggctatggccacc

SEQ ID NO: 5215983 - DNA, 14 bp, Homo sapiens
aggtggctattttg

SEQ ID NO: 5215984 - DNA, 16 bp, Homo sapiens
aggtggctcatgcctg

SEQ ID NO: 5215985 - DNA, 22 bp, Homo sapiens
aggtggctcccacctgtagtcc

SEQ ID NO: 5215986 - DNA, 23 bp, Homo sapiens
aggtggctctggaatgacatgtg

SEQ ID NO: 5215987 - DNA, 20 bp, Homo sapiens
aggtggctgacccagtccct

SEQ ID NO: 5215988 - DNA, 14 bp, Homo sapiens
aggtggctgagccc

SEQ ID NO: 5215989 - DNA, 21 bp, Homo sapiens
aggtggctgcgcccccagctt

SEQ ID NO: 5215990 - DNA, 23 bp, Homo sapiens
aggtggctgtagatggtgacctg

SEQ ID NO: 5215991 - DNA, 17 bp, Homo sapiens
aggtggcttaccaagat

SEQ ID NO: 5215992 - DNA, 15 bp, Homo sapiens
aggtggcttcatgtg

SEQ ID NO: 5215993 - DNA, 11 bp, Homo sapiens
aggtggcttct

SEQ ID NO: 5215994 - DNA, 21 bp, Homo sapiens
aggtggcttctccttggctga

SEQ ID NO: 5215995 - DNA, 16 bp, Homo sapiens
aggtgggaaacattag

SEQ ID NO: 5215996 - DNA, 20 bp, Homo sapiens
aggtgggacttagcagtgag

SEQ ID NO: 5215997 - DNA, 21 bp, Homo sapiens
aggtgggactttgttgtttgg

SEQ ID NO: 5215998 - DNA, 23 bp, Homo sapiens
aggtgggactttgttgtttggat

SEQ ID NO: 5215999 - DNA, 12 bp, Homo sapiens
aggtgggagaga

SEQ ID NO: 5216000 - DNA, 22 bp, Homo sapiens
aggtgggagagacactcccagg

SEQ ID NO: 5216001 - DNA, 13 bp, Homo sapiens
aggtgggagcagg

SEQ ID NO: 5216002 - DNA, 20 bp, Homo sapiens
aggtgggagcaggagattga

SEQ ID NO: 5216003 - DNA, 22 bp, Homo sapiens
aggtgggagccaccactcctgc

SEQ ID NO: 5216004 - DNA, 23 bp, Homo sapiens
aggtgggagcggggctgggagga

SEQ ID NO: 5216005 - DNA, 14 bp, Homo sapiens
aggtgggagctgaa

SEQ ID NO: 5216006 - DNA, 13 bp, Homo sapiens
aggtgggagcttg

SEQ ID NO: 5216007 - DNA, 11 bp, Homo sapiens
aggtgggagga

SEQ ID NO: 5216008 - DNA, 16 bp, Homo sapiens
aggtgggaggccaggc

SEQ ID NO: 5216009 - DNA, 19 bp, Homo sapiens
aggtgggaggccaggcgag

SEQ ID NO: 5216010 - DNA, 21 bp, Homo sapiens
aggtgggaggcccctggtggc

SEQ ID NO: 5216011 - DNA, 23 bp, Homo sapiens
aggtgggatatccctatgctgcc

SEQ ID NO: 5216012 - DNA, 20 bp, Homo sapiens
aggtgggatcctccaggtgc

SEQ ID NO: 5216013 - DNA, 14 bp, Homo sapiens
aggtgggcagatca

SEQ ID NO: 5216014 - DNA, 12 bp, Homo sapiens
aggtgggcagca

SEQ ID NO: 5216015 - DNA, 15 bp, Homo sapiens
aggtgggcagcagct

SEQ ID NO: 5216016 - DNA, 22 bp, Homo sapiens
aggtgggcaggtggtggcactg

SEQ ID NO: 5216017 - DNA, 19 bp, Homo sapiens
aggtgggcatgccaccctc

SEQ ID NO: 5216018 - DNA, 16 bp, Homo sapiens
aggtgggccagcccct

SEQ ID NO: 5216019 - DNA, 17 bp, Homo sapiens
aggtgggccagcccctc

SEQ ID NO: 5216020 - DNA, 18 bp, Homo sapiens
aggtgggcccaggaccag

SEQ ID NO: 5216021 - DNA, 16 bp, Homo sapiens
aggtgggcctggcggc

SEQ ID NO: 5216022 - DNA, 15 bp, Homo sapiens
aggtgggccttgcta

SEQ ID NO: 5216023 - DNA, 19 bp, Homo sapiens
aggtgggccttgctacctc

SEQ ID NO: 5216024 - DNA, 15 bp, Homo sapiens
aggtgggcggacaaa

SEQ ID NO: 5216025 - DNA, 22 bp, Homo sapiens
aggtgggcggacaaaagggcca

SEQ ID NO: 5216026 - DNA, 16 bp, Homo sapiens
aggtgggcgggcaggg

SEQ ID NO: 5216027 - DNA, 17 bp, Homo sapiens
aggtgggctgagccctg

SEQ ID NO: 5216028 - DNA, 14 bp, Homo sapiens
aggtgggctgcctg

SEQ ID NO: 5216029 - DNA, 14 bp, Homo sapiens
aggtgggctgctga

SEQ ID NO: 5216030 - DNA, 14 bp, Homo sapiens
aggtgggctgggcc

SEQ ID NO: 5216031 - DNA, 14 bp, Homo sapiens
aggctgggagtccc

SEQ ID NO: 5216032 - DNA, 16 bp, Homo sapiens
aggctgggcagcccca

SEQ ID NO: 5216033 - DNA, 18 bp, Homo sapiens
aggctgggcagccccaga

SEQ ID NO: 5216034 - DNA, 19 bp, Homo sapiens
aggctgggcagccccagag

SEQ ID NO: 5216035 - DNA, 14 bp, Homo sapiens
aggctgggcccaga

SEQ ID NO: 5216036 - DNA, 22 bp, Homo sapiens
aggctgggcccagaggcacagc

SEQ ID NO: 5216037 - DNA, 12 bp, Homo sapiens
aggctgggcccc

SEQ ID NO: 5216038 - DNA, 15 bp, Homo sapiens
aggctgggcccctgg

SEQ ID NO: 5216039 - DNA, 16 bp, Homo sapiens
aggctgggcccctggg

SEQ ID NO: 5216040 - DNA, 13 bp, Homo sapiens
aggctgggccgca

SEQ ID NO: 5216041 - DNA, 24 bp, Homo sapiens
aggctgggccgcaagggcctggac

SEQ ID NO: 5216042 - DNA, 23 bp, Homo sapiens
aggctgggctcccttcccacctc

SEQ ID NO: 5216043 - DNA, 17 bp, Homo sapiens
aggctgggctctgcctg

SEQ ID NO: 5216044 - DNA, 12 bp, Homo sapiens
aggctgggctga

SEQ ID NO: 5216045 - DNA, 13 bp, Homo sapiens
aggctgggctgag

SEQ ID NO: 5216046 - DNA, 15 bp, Homo sapiens
aggctgggctgggca

SEQ ID NO: 5216047 - DNA, 18 bp, Homo sapiens
aggctgggctgggtggca

SEQ ID NO: 5216048 - DNA, 14 bp, Homo sapiens
aggctgggcttcag

SEQ ID NO: 5216049 - DNA, 18 bp, Homo sapiens
aggctggggaagtcctct

SEQ ID NO: 5216050 - DNA, 21 bp, Homo sapiens
aggctggggaagtcctctggg

SEQ ID NO: 5216051 - DNA, 22 bp, Homo sapiens
aggctggggaagtcctctgggt

SEQ ID NO: 5216052 - DNA, 15 bp, Homo sapiens
aggctggggacacag

SEQ ID NO: 5216053 - DNA, 21 bp, Homo sapiens
aggctggggacacaggatcct

SEQ ID NO: 5216054 - DNA, 14 bp, Homo sapiens
aggctggggaccca

SEQ ID NO: 5216055 - DNA, 16 bp, Homo sapiens
aggctggggaggccag

SEQ ID NO: 5216056 - DNA, 14 bp, Homo sapiens
aggctggggcatgg

SEQ ID NO: 5216057 - DNA, 13 bp, Homo sapiens
aggctggggccag

SEQ ID NO: 5216058 - DNA, 15 bp, Homo sapiens
aggctggggcctggc

SEQ ID NO: 5216059 - DNA, 17 bp, Homo sapiens
aggctggggcctggcct

SEQ ID NO: 5216060 - DNA, 20 bp, Homo sapiens
aggctggggcggggcccagg

SEQ ID NO: 5216061 - DNA, 22 bp, Homo sapiens
aggctggggcggggctggaggt

SEQ ID NO: 5216062 - DNA, 12 bp, Homo sapiens
aggctggggctg

SEQ ID NO: 5216063 - DNA, 17 bp, Homo sapiens
aggctgggggaagaagc

SEQ ID NO: 5216064 - DNA, 23 bp, Homo sapiens
aggctgggggcgggggagccaac

SEQ ID NO: 5216065 - DNA, 13 bp, Homo sapiens
aggctgggtccag

SEQ ID NO: 5216066 - DNA, 19 bp, Homo sapiens
aggctgggtccaggggagg

SEQ ID NO: 5216067 - DNA, 15 bp, Homo sapiens
aggctgggtcctgcc

SEQ ID NO: 5216068 - DNA, 16 bp, Homo sapiens
aggctgggtcctgcca

SEQ ID NO: 5216069 - DNA, 15 bp, Homo sapiens
aggctgggtcgccct

SEQ ID NO: 5216070 - DNA, 14 bp, Homo sapiens
aggctgggtgccca

SEQ ID NO: 5216071 - DNA, 17 bp, Homo sapiens
aggctggtaagagaagt

SEQ ID NO: 5216072 - DNA, 23 bp, Homo sapiens
aggctggtaagggaccttcaggg

SEQ ID NO: 5216073 - DNA, 23 bp, Homo sapiens
aggctggtccctatgtcatgtct

SEQ ID NO: 5216074 - DNA, 19 bp, Homo sapiens
aggctggtccgagctgagg

SEQ ID NO: 5216075 - DNA, 20 bp, Homo sapiens
aggctggtccgagctgagga

SEQ ID NO: 5216076 - DNA, 20 bp, Homo sapiens
aggctggtctcaaactcctg

SEQ ID NO: 5216077 - DNA, 21 bp, Homo sapiens
aggctggtctcaaactcctgg

SEQ ID NO: 5216078 - DNA, 23 bp, Homo sapiens
aggctggtctccctccagctgga

SEQ ID NO: 5216079 - DNA, 15 bp, Homo sapiens
aggctggtctgaaac

SEQ ID NO: 5216080 - DNA, 13 bp, Homo sapiens
aggctggtcttga

SEQ ID NO: 5216081 - DNA, 15 bp, Homo sapiens
aggctggtcttgaag

SEQ ID NO: 5216082 - DNA, 15 bp, Homo sapiens
aggctggtggacaga

SEQ ID NO: 5216083 - DNA, 20 bp, Homo sapiens
aggctggtggacagacccag

SEQ ID NO: 5216084 - DNA, 22 bp, Homo sapiens
aggctggtggacagacccaggg

SEQ ID NO: 5216085 - DNA, 15 bp, Homo sapiens
aggctggtggcccag

SEQ ID NO: 5216086 - DNA, 16 bp, Homo sapiens
aggctggtggcccagg

SEQ ID NO: 5216087 - DNA, 15 bp, Homo sapiens
aggctggtggccttg

SEQ ID NO: 5216088 - DNA, 18 bp, Homo sapiens
aggctggtgggaggggcg

SEQ ID NO: 5216089 - DNA, 22 bp, Homo sapiens
aggctggtggttttcagagcag

SEQ ID NO: 5216090 - DNA, 21 bp, Homo sapiens
aggctggttttgatggctggg

SEQ ID NO: 5216091 - DNA, 20 bp, Homo sapiens
aggctggttttggcatctct

SEQ ID NO: 5216092 - DNA, 19 bp, Homo sapiens
aggctgtaaatgagggcag

SEQ ID NO: 5216093 - DNA, 12 bp, Homo sapiens
aggctgtacata

SEQ ID NO: 5216094 - DNA, 15 bp, Homo sapiens
aggctgtacatcaga

SEQ ID NO: 5216095 - DNA, 18 bp, Homo sapiens
aggctgtatcccatgagc

SEQ ID NO: 5216096 - DNA, 23 bp, Homo sapiens
aggctgtatcccatgagcctcag

SEQ ID NO: 5216097 - DNA, 14 bp, Homo sapiens
aggctgtattttct

SEQ ID NO: 5216098 - DNA, 15 bp, Homo sapiens
aggctgtcagcgcct

SEQ ID NO: 5216099 - DNA, 16 bp, Homo sapiens
aggctgtcatttcatt

SEQ ID NO: 5216100 - DNA, 22 bp, Homo sapiens
aggctgtcccaagctcccaaga

SEQ ID NO: 5216101 - DNA, 15 bp, Homo sapiens
aggctgtctgcgaag

SEQ ID NO: 5216102 - DNA, 14 bp, Homo sapiens
aggctgtctggggc

SEQ ID NO: 5216103 - DNA, 17 bp, Homo sapiens
aggctgtctgtgccatg

SEQ ID NO: 5216104 - DNA, 16 bp, Homo sapiens
aggctgtctgttgtat

SEQ ID NO: 5216105 - DNA, 23 bp, Homo sapiens
aggctgtcttctcaggctctgcc

SEQ ID NO: 5216106 - DNA, 17 bp, Homo sapiens
aggctgtgactcttctc

SEQ ID NO: 5216107 - DNA, 23 bp, Homo sapiens
aggctgtgactcttctctcaacc

SEQ ID NO: 5216108 - DNA, 20 bp, Homo sapiens
aggctgtgcacctattctgt

SEQ ID NO: 5216109 - DNA, 12 bp, Homo sapiens
aggctgtgccag

SEQ ID NO: 5216110 - DNA, 18 bp, Homo sapiens
aggctgtgccaggctggg

SEQ ID NO: 5216111 - DNA, 14 bp, Homo sapiens
aggctgtgctccct

SEQ ID NO: 5216112 - DNA, 18 bp, Homo sapiens
aggctgtgctcttcctct

SEQ ID NO: 5216113 - DNA, 20 bp, Homo sapiens
aggctgtgctcttcctctgg

SEQ ID NO: 5216114 - DNA, 17 bp, Homo sapiens
aggctgtgctgccctga

SEQ ID NO: 5216115 - DNA, 22 bp, Homo sapiens
aggctgtgctgccctgaagaat

SEQ ID NO: 5216116 - DNA, 12 bp, Homo sapiens
aggctgtggaga

SEQ ID NO: 5216117 - DNA, 13 bp, Homo sapiens
aggctgtggagag

SEQ ID NO: 5216118 - DNA, 15 bp, Homo sapiens
aggctgtggctggtg

SEQ ID NO: 5216119 - DNA, 17 bp, Homo sapiens
aggctgtggctggtgag

SEQ ID NO: 5216120 - DNA, 13 bp, Homo sapiens
aggctgtgggact

SEQ ID NO: 5216121 - DNA, 13 bp, Homo sapiens
aggctgtggtcag

SEQ ID NO: 5216122 - DNA, 20 bp, Homo sapiens
aggctgtggtcagagaggga

SEQ ID NO: 5216123 - DNA, 14 bp, Homo sapiens
aggctgtgtccctg

SEQ ID NO: 5216124 - DNA, 18 bp, Homo sapiens
aggctgtgtccctgctgg

SEQ ID NO: 5216125 - DNA, 21 bp, Homo sapiens
aggctgtgtccctgctggggt

SEQ ID NO: 5216126 - DNA, 12 bp, Homo sapiens
aggctgtgtctc

SEQ ID NO: 5216127 - DNA, 22 bp, Homo sapiens
aggctgtgtgtcttctgcccca

SEQ ID NO: 5216128 - DNA, 18 bp, Homo sapiens
aggctgtgtttggctttc

SEQ ID NO: 5216129 - DNA, 21 bp, Homo sapiens
aggctgtgtttggctttcagg

SEQ ID NO: 5216130 - DNA, 15 bp, Homo sapiens
aggctgttaccattt

SEQ ID NO: 5216131 - DNA, 21 bp, Homo sapiens
aggctgttccatgttctattt

SEQ ID NO: 5216132 - DNA, 13 bp, Homo sapiens
aggctgttccctt

SEQ ID NO: 5216133 - DNA, 12 bp, Homo sapiens
aggctgttctca

SEQ ID NO: 5216134 - DNA, 15 bp, Homo sapiens
aggctgttctccagg

SEQ ID NO: 5216135 - DNA, 17 bp, Homo sapiens
aggctgttctcgaactc

SEQ ID NO: 5216136 - DNA, 20 bp, Homo sapiens
aggctgttctcgaactcctg

SEQ ID NO: 5216137 - DNA, 21 bp, Homo sapiens
aggctgttctcgaactcctga

SEQ ID NO: 5216138 - DNA, 22 bp, Homo sapiens
aggctgttctttaaatgtctga

SEQ ID NO: 5216139 - DNA, 21 bp, Homo sapiens
aggctgttggttcaaactttt

SEQ ID NO: 5216140 - DNA, 12 bp, Homo sapiens
aggctgtttgct

SEQ ID NO: 5216141 - DNA, 19 bp, Homo sapiens
aggctgtttgcttcaccgt

SEQ ID NO: 5216142 - DNA, 19 bp, Homo sapiens
aggctgtttttggctgttt

SEQ ID NO: 5216143 - DNA, 22 bp, Homo sapiens
aggctgtttttggctgttttcc

SEQ ID NO: 5216144 - DNA, 14 bp, Homo sapiens
aggcttaaaaactg

SEQ ID NO: 5216145 - DNA, 20 bp, Homo sapiens
aggcttaataaaaatgacag

SEQ ID NO: 5216146 - DNA, 21 bp, Homo sapiens
aggcttaatgagcataggtag

SEQ ID NO: 5216147 - DNA, 23 bp, Homo sapiens
aggcttaattctgagctggccct

SEQ ID NO: 5216148 - DNA, 23 bp, Homo sapiens
aggcttagaccctcatgctgcca

SEQ ID NO: 5216149 - DNA, 24 bp, Homo sapiens
aggcttagaccctcatgctgccaa

SEQ ID NO: 5216150 - DNA, 17 bp, Homo sapiens
aggcttagagaggaaaa

SEQ ID NO: 5216151 - DNA, 13 bp, Homo sapiens
aggcttaggactt

SEQ ID NO: 5216152 - DNA, 17 bp, Homo sapiens
aggcttaggacttcaaa

SEQ ID NO: 5216153 - DNA, 19 bp, Homo sapiens
aggcttaggcctatagatt

SEQ ID NO: 5216154 - DNA, 17 bp, Homo sapiens
aggcttagtgatgtaat

SEQ ID NO: 5216155 - DNA, 19 bp, Homo sapiens
aggcttagtgatgtaatta

SEQ ID NO: 5216156 - DNA, 14 bp, Homo sapiens
aggcttagtttgtg

SEQ ID NO: 5216157 - DNA, 16 bp, Homo sapiens
aggcttataaaacaga

SEQ ID NO: 5216158 - DNA, 16 bp, Homo sapiens
aggcttatattcaacc

SEQ ID NO: 5216159 - DNA, 18 bp, Homo sapiens
aggcttatattcaaccat

SEQ ID NO: 5216160 - DNA, 18 bp, Homo sapiens
aggcttatttttaaaata

SEQ ID NO: 5216161 - DNA, 19 bp, Homo sapiens
aggcttatttttaaaataa

SEQ ID NO: 5216162 - DNA, 18 bp, Homo sapiens
aggcttcaatttattgca

SEQ ID NO: 5216163 - DNA, 12 bp, Homo sapiens
aggcttcaccct

SEQ ID NO: 5216164 - DNA, 16 bp, Homo sapiens
aggcttcacgccggga

SEQ ID NO: 5216165 - DNA, 17 bp, Homo sapiens
aggcttcacgccgggag

SEQ ID NO: 5216166 - DNA, 24 bp, Homo sapiens
aggcttcacgccgggagaagccac

SEQ ID NO: 5216167 - DNA, 22 bp, Homo sapiens
aggcttcagggagcatatgaaa

SEQ ID NO: 5216168 - DNA, 13 bp, Homo sapiens
aggcttcagggga

SEQ ID NO: 5216169 - DNA, 23 bp, Homo sapiens
aggcttccacgtactgcagcctc

SEQ ID NO: 5216170 - DNA, 21 bp, Homo sapiens
aggcttccagaggagagtggc

SEQ ID NO: 5216171 - DNA, 13 bp, Homo sapiens
aggcttccagctc

SEQ ID NO: 5216172 - DNA, 15 bp, Homo sapiens
aggcttccagctcag

SEQ ID NO: 5216173 - DNA, 16 bp, Homo sapiens
aggcttccaggctctt

SEQ ID NO: 5216174 - DNA, 21 bp, Homo sapiens
aggcttcccaaaccaagtgcc

SEQ ID NO: 5216175 - DNA, 19 bp, Homo sapiens
aggcttccctacacagggc

SEQ ID NO: 5216176 - DNA, 20 bp, Homo sapiens
aggcttccctgacttgcttt

SEQ ID NO: 5216177 - DNA, 17 bp, Homo sapiens
aggcttccggctgagct

SEQ ID NO: 5216178 - DNA, 18 bp, Homo sapiens
aggcttccggctgagctg

SEQ ID NO: 5216179 - DNA, 18 bp, Homo sapiens
aggcttccgtgtcctctc

SEQ ID NO: 5216180 - DNA, 13 bp, Homo sapiens
aggcttcctgact

SEQ ID NO: 5216181 - DNA, 14 bp, Homo sapiens
aggcttcctgactg

SEQ ID NO: 5216182 - DNA, 13 bp, Homo sapiens
aggcttcctgccc

SEQ ID NO: 5216183 - DNA, 17 bp, Homo sapiens
aggcttcctgccctagc

SEQ ID NO: 5216184 - DNA, 22 bp, Homo sapiens
aggcttcctgcgtcctcctcac

SEQ ID NO: 5216185 - DNA, 14 bp, Homo sapiens
aggcttcctggtga

SEQ ID NO: 5216186 - DNA, 14 bp, Homo sapiens
aggcttccttcatt

SEQ ID NO: 5216187 - DNA, 18 bp, Homo sapiens
aggcttccttcatttcct

SEQ ID NO: 5216188 - DNA, 13 bp, Homo sapiens
aggcttccttggc

SEQ ID NO: 5216189 - DNA, 22 bp, Homo sapiens
aggcttcgtctcagaaggctct

SEQ ID NO: 5216190 - DNA, 20 bp, Homo sapiens
aggcttcgtttgcctccaga

SEQ ID NO: 5216191 - DNA, 13 bp, Homo sapiens
aggcttctacctg

SEQ ID NO: 5216192 - DNA, 21 bp, Homo sapiens
aggcttctatgtccaacagag

SEQ ID NO: 5216193 - DNA, 19 bp, Homo sapiens
aggcttctcagtctctgtc

SEQ ID NO: 5216194 - DNA, 17 bp, Homo sapiens
aggcttctcccggacct

SEQ ID NO: 5216195 - DNA, 23 bp, Homo sapiens
aggcttctccgccagcctcctct

SEQ ID NO: 5216196 - DNA, 13 bp, Homo sapiens
aggcttctccttc

SEQ ID NO: 5216197 - DNA, 16 bp, Homo sapiens
aggcttctccttctcc

SEQ ID NO: 5216198 - DNA, 19 bp, Homo sapiens
aggcttctctccacagtgt

SEQ ID NO: 5216199 - DNA, 18 bp, Homo sapiens
aggcttctctctcaccag

SEQ ID NO: 5216200 - DNA, 14 bp, Homo sapiens
aggcttctgcagct

SEQ ID NO: 5216201 - DNA, 19 bp, Homo sapiens
aggcttctgctggggcctg

SEQ ID NO: 5216202 - DNA, 21 bp, Homo sapiens
aggcttctgctggggcctggg

SEQ ID NO: 5216203 - DNA, 17 bp, Homo sapiens
aggcttctgtaatcaat

SEQ ID NO: 5216204 - DNA, 20 bp, Homo sapiens
aggcttctgttcctctcttt

SEQ ID NO: 5216205 - DNA, 13 bp, Homo sapiens
aggcttcttcctg

SEQ ID NO: 5216206 - DNA, 15 bp, Homo sapiens
aggcttcttgcccag

SEQ ID NO: 5216207 - DNA, 16 bp, Homo sapiens
aggcttgaaggccagc

SEQ ID NO: 5216208 - DNA, 18 bp, Homo sapiens
aggcttgagttttcattt

SEQ ID NO: 5216209 - DNA, 15 bp, Homo sapiens
aggcttgattccaac

SEQ ID NO: 5216210 - DNA, 14 bp, Homo sapiens
aggtgggctggggc

SEQ ID NO: 5216211 - DNA, 15 bp, Homo sapiens
aggtgggctggggct

SEQ ID NO: 5216212 - DNA, 16 bp, Homo sapiens
aggtgggctgtattca

SEQ ID NO: 5216213 - DNA, 20 bp, Homo sapiens
aggtggggaagagagcctgc

SEQ ID NO: 5216214 - DNA, 20 bp, Homo sapiens
aggtggggaaggagggactt

SEQ ID NO: 5216215 - DNA, 17 bp, Homo sapiens
aggtggggacagggatg

SEQ ID NO: 5216216 - DNA, 19 bp, Homo sapiens
aggtggggacctgggggga

SEQ ID NO: 5216217 - DNA, 13 bp, Homo sapiens
aggtggggactgg

SEQ ID NO: 5216218 - DNA, 11 bp, Homo sapiens
aggtggggagg

SEQ ID NO: 5216219 - DNA, 21 bp, Homo sapiens
aggtggggagggcctctggac

SEQ ID NO: 5216220 - DNA, 23 bp, Homo sapiens
aggtggggagggggtttgggggc

SEQ ID NO: 5216221 - DNA, 17 bp, Homo sapiens
aggtggggatcctgcct

SEQ ID NO: 5216222 - DNA, 22 bp, Homo sapiens
aggtggggattgcccctggctt

SEQ ID NO: 5216223 - DNA, 13 bp, Homo sapiens
aggtggggcagct

SEQ ID NO: 5216224 - DNA, 14 bp, Homo sapiens
aggtggggcagctt

SEQ ID NO: 5216225 - DNA, 17 bp, Homo sapiens
aggtggggcctcagcct

SEQ ID NO: 5216226 - DNA, 22 bp, Homo sapiens
aggtggggcctcagcctggggc

SEQ ID NO: 5216227 - DNA, 23 bp, Homo sapiens
aggtggggcctcagcctggggct

SEQ ID NO: 5216228 - DNA, 17 bp, Homo sapiens
aggtggggcgaggcagg

SEQ ID NO: 5216229 - DNA, 14 bp, Homo sapiens
aggtggggctgtca

SEQ ID NO: 5216230 - DNA, 16 bp, Homo sapiens
aggtgggggaaaatga

SEQ ID NO: 5216231 - DNA, 17 bp, Homo sapiens
aggtgggggaaaatgaa

SEQ ID NO: 5216232 - DNA, 21 bp, Homo sapiens
aggtgggggagcctggagccc

SEQ ID NO: 5216233 - DNA, 13 bp, Homo sapiens
aggtgggggcagc

SEQ ID NO: 5216234 - DNA, 19 bp, Homo sapiens
aggtgggggcctcctcagc

SEQ ID NO: 5216235 - DNA, 18 bp, Homo sapiens
aggtgggggcggggagta

SEQ ID NO: 5216236 - DNA, 21 bp, Homo sapiens
aggtgggggctgcgtccctgc

SEQ ID NO: 5216237 - DNA, 20 bp, Homo sapiens
aggtgggggtcaggctacag

SEQ ID NO: 5216238 - DNA, 21 bp, Homo sapiens
aggtggggtacatttctctga

SEQ ID NO: 5216239 - DNA, 23 bp, Homo sapiens
aggtggggtatttaccacagcag

SEQ ID NO: 5216240 - DNA, 22 bp, Homo sapiens
aggtggggtctttgtgagagtg

SEQ ID NO: 5216241 - DNA, 15 bp, Homo sapiens
aggtggggtgaagct

SEQ ID NO: 5216242 - DNA, 17 bp, Homo sapiens
aggtggggtgaagctgg

SEQ ID NO: 5216243 - DNA, 15 bp, Homo sapiens
aggtggggtgagaat

SEQ ID NO: 5216244 - DNA, 17 bp, Homo sapiens
aggtggggtgatggcca

SEQ ID NO: 5216245 - DNA, 21 bp, Homo sapiens
aggtggggtgatggccagagg

SEQ ID NO: 5216246 - DNA, 22 bp, Homo sapiens
aggtggggtgatggccagagga

SEQ ID NO: 5216247 - DNA, 13 bp, Homo sapiens
aggtggggtgctg

SEQ ID NO: 5216248 - DNA, 17 bp, Homo sapiens
aggtggggtgctggggc

SEQ ID NO: 5216249 - DNA, 19 bp, Homo sapiens
aggtggggtgctggggctg

SEQ ID NO: 5216250 - DNA, 20 bp, Homo sapiens
aggtggggtggagtcccaga

SEQ ID NO: 5216251 - DNA, 23 bp, Homo sapiens
aggtggggtttcctgcatggaca

SEQ ID NO: 5216252 - DNA, 19 bp, Homo sapiens
aggtgggtcaactccaagg

SEQ ID NO: 5216253 - DNA, 22 bp, Homo sapiens
aggtgggtcaactccaaggcaa

SEQ ID NO: 5216254 - DNA, 13 bp, Homo sapiens
aggtgggtccagg

SEQ ID NO: 5216255 - DNA, 14 bp, Homo sapiens
aggtgggtccagga

SEQ ID NO: 5216256 - DNA, 14 bp, Homo sapiens
aggtgggtcccggc

SEQ ID NO: 5216257 - DNA, 14 bp, Homo sapiens
aggtgggtcttgga

SEQ ID NO: 5216258 - DNA, 19 bp, Homo sapiens
aggtgggtgagcgggtggg

SEQ ID NO: 5216259 - DNA, 19 bp, Homo sapiens
aggtgggtgaggctgggca

SEQ ID NO: 5216260 - DNA, 20 bp, Homo sapiens
aggtgggtgattcctcccag

SEQ ID NO: 5216261 - DNA, 20 bp, Homo sapiens
aggtgggtgctgccctgtgt

SEQ ID NO: 5216262 - DNA, 17 bp, Homo sapiens
aggtgggtgggcctgac

SEQ ID NO: 5216263 - DNA, 20 bp, Homo sapiens
aggtgggtgtgggacacctg

SEQ ID NO: 5216264 - DNA, 18 bp, Homo sapiens
aggtgggttgaaagccaa

SEQ ID NO: 5216265 - DNA, 23 bp, Homo sapiens
aggtgggttttcatcaagactgg

SEQ ID NO: 5216266 - DNA, 22 bp, Homo sapiens
aggtgggttttcttcccatcac

SEQ ID NO: 5216267 - DNA, 21 bp, Homo sapiens
aggtggtaaattcagacaaca

SEQ ID NO: 5216268 - DNA, 20 bp, Homo sapiens
aggtggtagctctgagccct

SEQ ID NO: 5216269 - DNA, 18 bp, Homo sapiens
aggtggtatgtgtgtgta

SEQ ID NO: 5216270 - DNA, 19 bp, Homo sapiens
aggtggtctgaatgttctg

SEQ ID NO: 5216271 - DNA, 14 bp, Homo sapiens
aggtggtctgcacc

SEQ ID NO: 5216272 - DNA, 16 bp, Homo sapiens
aggtggtctgcacccc

SEQ ID NO: 5216273 - DNA, 18 bp, Homo sapiens
aggtggtctggtgccacc

SEQ ID NO: 5216274 - DNA, 17 bp, Homo sapiens
aggtggtcttggagagg

SEQ ID NO: 5216275 - DNA, 18 bp, Homo sapiens
aggtggtcttggagagga

SEQ ID NO: 5216276 - DNA, 21 bp, Homo sapiens
aggtggtgagaaatttctgtg

SEQ ID NO: 5216277 - DNA, 17 bp, Homo sapiens
aggtggtggaggaggag

SEQ ID NO: 5216278 - DNA, 18 bp, Homo sapiens
aggtggtggaggggcgcc

SEQ ID NO: 5216279 - DNA, 21 bp, Homo sapiens
aggtggtggcacgggccctcc

SEQ ID NO: 5216280 - DNA, 20 bp, Homo sapiens
aggtggtggcactgagcccc

SEQ ID NO: 5216281 - DNA, 19 bp, Homo sapiens
aggtggtgggcattctctc

SEQ ID NO: 5216282 - DNA, 21 bp, Homo sapiens
aggtggtggtagagaagcaag

SEQ ID NO: 5216283 - DNA, 20 bp, Homo sapiens
aggtggtgtccttcttcctc

SEQ ID NO: 5216284 - DNA, 18 bp, Homo sapiens
aggtggtgtcgggccctt

SEQ ID NO: 5216285 - DNA, 13 bp, Homo sapiens
aggtggtgtttct

SEQ ID NO: 5216286 - DNA, 21 bp, Homo sapiens
aggtggttaccaggcactggt

SEQ ID NO: 5216287 - DNA, 22 bp, Homo sapiens
aggtggttcagacaagacagag

SEQ ID NO: 5216288 - DNA, 18 bp, Homo sapiens
aggtggttcgtgctgtgc

SEQ ID NO: 5216289 - DNA, 19 bp, Homo sapiens
aggtggttcgtgctgtgct

SEQ ID NO: 5216290 - DNA, 19 bp, Homo sapiens
aggtggttgtcttattgca

SEQ ID NO: 5216291 - DNA, 19 bp, Homo sapiens
aggtgtaaaatatctacct

SEQ ID NO: 5216292 - DNA, 14 bp, Homo sapiens
aggtgtaaagttgt

SEQ ID NO: 5216293 - DNA, 11 bp, Homo sapiens
aggtgtaaata

SEQ ID NO: 5216294 - DNA, 14 bp, Homo sapiens
aggtgtaaatatag

SEQ ID NO: 5216295 - DNA, 16 bp, Homo sapiens
aggtgtacactaacat

SEQ ID NO: 5216296 - DNA, 18 bp, Homo sapiens
aggtgtacactaacattt

SEQ ID NO: 5216297 - DNA, 20 bp, Homo sapiens
aggtgtacactaacatttcc

SEQ ID NO: 5216298 - DNA, 19 bp, Homo sapiens
aggtgtagccacaccagga

SEQ ID NO: 5216299 - DNA, 20 bp, Homo sapiens
aggtgtagccacaccaggat

SEQ ID NO: 5216300 - DNA, 14 bp, Homo sapiens
aggtgtataaatgt

SEQ ID NO: 5216301 - DNA, 22 bp, Homo sapiens
aggtgtatagggaattttcatt

SEQ ID NO: 5216302 - DNA, 23 bp, Homo sapiens
aggtgtatagggaattttcattt

SEQ ID NO: 5216303 - DNA, 21 bp, Homo sapiens
aggtgtattggtgttgcagcc

SEQ ID NO: 5216304 - DNA, 16 bp, Homo sapiens
aggtgtcaacttttga

SEQ ID NO: 5216305 - DNA, 21 bp, Homo sapiens
aggtgtcaacttttgaccaaa

SEQ ID NO: 5216306 - DNA, 17 bp, Homo sapiens
aggtgtcaccctgcaga

SEQ ID NO: 5216307 - DNA, 19 bp, Homo sapiens
aggtgtcaggctgctggcg

SEQ ID NO: 5216308 - DNA, 21 bp, Homo sapiens
aggtgtcatacagatttgcaa

SEQ ID NO: 5216309 - DNA, 16 bp, Homo sapiens
aggtgtcatttgacaa

SEQ ID NO: 5216310 - DNA, 14 bp, Homo sapiens
aggtgtccaaattt

SEQ ID NO: 5216311 - DNA, 16 bp, Homo sapiens
aggtgtccagggtcct

SEQ ID NO: 5216312 - DNA, 14 bp, Homo sapiens
aggtgtcccaagct

SEQ ID NO: 5216313 - DNA, 12 bp, Homo sapiens
aggtgtccccaa

SEQ ID NO: 5216314 - DNA, 21 bp, Homo sapiens
aggtgtccccaacgtcccctc

SEQ ID NO: 5216315 - DNA, 16 bp, Homo sapiens
aggtgtccccagccca

SEQ ID NO: 5216316 - DNA, 17 bp, Homo sapiens
aggtgtccccagcccac

SEQ ID NO: 5216317 - DNA, 19 bp, Homo sapiens
aggtgtccccagcccactg

SEQ ID NO: 5216318 - DNA, 14 bp, Homo sapiens
aggtgtcctacaga

SEQ ID NO: 5216319 - DNA, 19 bp, Homo sapiens
aggtgtcctacagaaaaac

SEQ ID NO: 5216320 - DNA, 20 bp, Homo sapiens
aggtgtcctacagaaaaacc

SEQ ID NO: 5216321 - DNA, 16 bp, Homo sapiens
aggtgtcctttcccct

SEQ ID NO: 5216322 - DNA, 14 bp, Homo sapiens
aggtgtcgaggcca

SEQ ID NO: 5216323 - DNA, 21 bp, Homo sapiens
aggtgtctatccacctggggt

SEQ ID NO: 5216324 - DNA, 19 bp, Homo sapiens
aggtgtctcaggctgcctg

SEQ ID NO: 5216325 - DNA, 20 bp, Homo sapiens
aggtgtctcaggctgcctga

SEQ ID NO: 5216326 - DNA, 13 bp, Homo sapiens
aggtgtctctggg

SEQ ID NO: 5216327 - DNA, 19 bp, Homo sapiens
aggtgtctctgggcctgtg

SEQ ID NO: 5216328 - DNA, 16 bp, Homo sapiens
aggtgtctgcctagat

SEQ ID NO: 5216329 - DNA, 14 bp, Homo sapiens
aggtgtctggcctg

SEQ ID NO: 5216330 - DNA, 16 bp, Homo sapiens
aggtgtctggcctgag

SEQ ID NO: 5216331 - DNA, 20 bp, Homo sapiens
aggtgtctggggtgagggag

SEQ ID NO: 5216332 - DNA, 22 bp, Homo sapiens
aggtgtctggggtgagggagtt

SEQ ID NO: 5216333 - DNA, 13 bp, Homo sapiens
aggtgtctgtatc

SEQ ID NO: 5216334 - DNA, 14 bp, Homo sapiens
aggtgtcttcctcc

SEQ ID NO: 5216335 - DNA, 21 bp, Homo sapiens
aggtgtgaacctacctgcctt

SEQ ID NO: 5216336 - DNA, 14 bp, Homo sapiens
aggtgtgaccctga

SEQ ID NO: 5216337 - DNA, 18 bp, Homo sapiens
aggtgtgactgaatttct

SEQ ID NO: 5216338 - DNA, 14 bp, Homo sapiens
aggtgtgagccact

SEQ ID NO: 5216339 - DNA, 20 bp, Homo sapiens
aggtgtgagccactgcaccc

SEQ ID NO: 5216340 - DNA, 22 bp, Homo sapiens
aggtgtgagccactgcgcccag

SEQ ID NO: 5216341 - DNA, 17 bp, Homo sapiens
aggtgtgaggagagagg

SEQ ID NO: 5216342 - DNA, 17 bp, Homo sapiens
aggtgtgaggaggaggc

SEQ ID NO: 5216343 - DNA, 17 bp, Homo sapiens
aggtgtgaggcaggaga

SEQ ID NO: 5216344 - DNA, 20 bp, Homo sapiens
aggtgtgagtcaccaagccc

SEQ ID NO: 5216345 - DNA, 21 bp, Homo sapiens
aggtgtgagtcaccaagccca

SEQ ID NO: 5216346 - DNA, 22 bp, Homo sapiens
aggtgtgatttcctaatatgat

SEQ ID NO: 5216347 - DNA, 16 bp, Homo sapiens
aggtgtgcaagaacca

SEQ ID NO: 5216348 - DNA, 15 bp, Homo sapiens
aggtgtgcccctcca

SEQ ID NO: 5216349 - DNA, 19 bp, Homo sapiens
aggtgtgcctggcctctgc

SEQ ID NO: 5216350 - DNA, 16 bp, Homo sapiens
aggtgtgcctgtgctc

SEQ ID NO: 5216351 - DNA, 23 bp, Homo sapiens
aggtgtgcctgtgctcctgccca

SEQ ID NO: 5216352 - DNA, 12 bp, Homo sapiens
aggtgtgctctg

SEQ ID NO: 5216353 - DNA, 17 bp, Homo sapiens
aggtgtgctctgagcca

SEQ ID NO: 5216354 - DNA, 15 bp, Homo sapiens
aggtgtgctctgatc

SEQ ID NO: 5216355 - DNA, 20 bp, Homo sapiens
aggtgtgctctgatcatcca

SEQ ID NO: 5216356 - DNA, 13 bp, Homo sapiens
aggtgtggaggct

SEQ ID NO: 5216357 - DNA, 20 bp, Homo sapiens
aggtgtggaggctcctgtgg

SEQ ID NO: 5216358 - DNA, 22 bp, Homo sapiens
aggtgtggaggctcctgtggta

SEQ ID NO: 5216359 - DNA, 14 bp, Homo sapiens
aggtgtggagtgga

SEQ ID NO: 5216360 - DNA, 17 bp, Homo sapiens
aggtgtgggagggaaga

SEQ ID NO: 5216361 - DNA, 13 bp, Homo sapiens
aggtgtgggctcc

SEQ ID NO: 5216362 - DNA, 22 bp, Homo sapiens
aggtgtgggctcccacgccctc

SEQ ID NO: 5216363 - DNA, 16 bp, Homo sapiens
aggtgtgggggctgca

SEQ ID NO: 5216364 - DNA, 17 bp, Homo sapiens
aggtgtggtagcaggca

SEQ ID NO: 5216365 - DNA, 16 bp, Homo sapiens
aggtgtggtggctcat

SEQ ID NO: 5216366 - DNA, 18 bp, Homo sapiens
aggtgtgtccttgaactg

SEQ ID NO: 5216367 - DNA, 16 bp, Homo sapiens
aggtgtgtgagactac

SEQ ID NO: 5216368 - DNA, 22 bp, Homo sapiens
aggtgtgtgggccaccgtgcct

SEQ ID NO: 5216369 - DNA, 20 bp, Homo sapiens
aggtgtgtgtgaactgggca

SEQ ID NO: 5216370 - DNA, 15 bp, Homo sapiens
aggtgtgttgcagtg

SEQ ID NO: 5216371 - DNA, 17 bp, Homo sapiens
aggtgttaaaaaccatt

SEQ ID NO: 5216372 - DNA, 18 bp, Homo sapiens
aggtgttaaaaaccatta

SEQ ID NO: 5216373 - DNA, 15 bp, Homo sapiens
aggtgttactgtaat

SEQ ID NO: 5216374 - DNA, 12 bp, Homo sapiens
aggtgttatttt

SEQ ID NO: 5216375 - DNA, 15 bp, Homo sapiens
aggtgttattttcaa

SEQ ID NO: 5216376 - DNA, 15 bp, Homo sapiens
aggtgttccgtggga

SEQ ID NO: 5216377 - DNA, 20 bp, Homo sapiens
aggtgttctacactcatctt

SEQ ID NO: 5216378 - DNA, 13 bp, Homo sapiens
aggtgttctgctg

SEQ ID NO: 5216379 - DNA, 14 bp, Homo sapiens
aggtgttctgctga

SEQ ID NO: 5216380 - DNA, 21 bp, Homo sapiens
aggtgttgaagaaattataaa

SEQ ID NO: 5216381 - DNA, 21 bp, Homo sapiens
aggtgttgattttctgttgta

SEQ ID NO: 5216382 - DNA, 22 bp, Homo sapiens
aggtgttgccaaatatgtcctg

SEQ ID NO: 5216383 - DNA, 15 bp, Homo sapiens
aggtgttgccagtgc

SEQ ID NO: 5216384 - DNA, 20 bp, Homo sapiens
aggtgttgccatttctctgc

SEQ ID NO: 5216385 - DNA, 21 bp, Homo sapiens
aggtgttgggtcagtggccag

SEQ ID NO: 5216386 - DNA, 22 bp, Homo sapiens
aggtgttgggtcagtggccagg

SEQ ID NO: 5216387 - DNA, 15 bp, Homo sapiens
aggtgttggtgacaa

SEQ ID NO: 5216388 - DNA, 16 bp, Homo sapiens
aggtgttggtgacaat

SEQ ID NO: 5216389 - DNA, 16 bp, Homo sapiens
aggtgttgtcccttct

SEQ ID NO: 5216390 - DNA, 15 bp, Homo sapiens
aggtgttgtgcattt

SEQ ID NO: 5216391 - DNA, 22 bp, Homo sapiens
aggtgttgttaaaacacaaaat

SEQ ID NO: 5216392 - DNA, 13 bp, Homo sapiens
aggtgtttaaaga

SEQ ID NO: 5216393 - DNA, 17 bp, Homo sapiens
aggtgtttaaagagagg

SEQ ID NO: 5216394 - DNA, 18 bp, Homo sapiens
aggtgtttaaagagaggt

SEQ ID NO: 5216395 - DNA, 23 bp, Homo sapiens
aggtgtttaacggcactgtggcc

SEQ ID NO: 5216396 - DNA, 11 bp, Homo sapiens
aggtgtttata

SEQ ID NO: 5216397 - DNA, 12 bp, Homo sapiens
aggtgtttatac

SEQ ID NO: 5216398 - DNA, 16 bp, Homo sapiens
aggtgtttccatttct

SEQ ID NO: 5216399 - DNA, 20 bp, Homo sapiens
aggtgtttccatttctcaat

SEQ ID NO: 5216400 - DNA, 13 bp, Homo sapiens
aggtgtttgaaaa

SEQ ID NO: 5216401 - DNA, 15 bp, Homo sapiens
aggtgtttgaaaata

SEQ ID NO: 5216402 - DNA, 17 bp, Homo sapiens
aggtgtttgaaaatagt

SEQ ID NO: 5216403 - DNA, 15 bp, Homo sapiens
aggtgttttctgtgt

SEQ ID NO: 5216404 - DNA, 23 bp, Homo sapiens
aggtgttttttatgaagtgcgtg

SEQ ID NO: 5216405 - DNA, 16 bp, Homo sapiens
aggttaaagctaaact

SEQ ID NO: 5216406 - DNA, 19 bp, Homo sapiens
aggttaaagctaaactgaa

SEQ ID NO: 5216407 - DNA, 20 bp, Homo sapiens
aggttaaagctaaactgaat

SEQ ID NO: 5216408 - DNA, 20 bp, Homo sapiens
aggttaaatatataaacaaa

SEQ ID NO: 5216409 - DNA, 12 bp, Homo sapiens
aggttaaatgtt

SEQ ID NO: 5216410 - DNA, 16 bp, Homo sapiens
aggttaacagatttat

SEQ ID NO: 5216411 - DNA, 15 bp, Homo sapiens
aggttaacagtaaaa

SEQ ID NO: 5216412 - DNA, 21 bp, Homo sapiens
aggttaacagtaaaaatttct

SEQ ID NO: 5216413 - DNA, 16 bp, Homo sapiens
aggttaactatgtaca

SEQ ID NO: 5216414 - DNA, 16 bp, Homo sapiens
aggttaaggctgagga

SEQ ID NO: 5216415 - DNA, 17 bp, Homo sapiens
aggttaataaagatgat

SEQ ID NO: 5216416 - DNA, 15 bp, Homo sapiens
aggttaataaagtaa

SEQ ID NO: 5216417 - DNA, 13 bp, Homo sapiens
aggttaatattta

SEQ ID NO: 5216418 - DNA, 20 bp, Homo sapiens
aggttaattctctagggcta

SEQ ID NO: 5216419 - DNA, 23 bp, Homo sapiens
aggttaatttttccttcctctgt

SEQ ID NO: 5216420 - DNA, 19 bp, Homo sapiens
aggttacaacagatttgtg

SEQ ID NO: 5216421 - DNA, 21 bp, Homo sapiens
aggttacaacagatttgtgaa

SEQ ID NO: 5216422 - DNA, 22 bp, Homo sapiens
aggttacaacagatttgtgaac

SEQ ID NO: 5216423 - DNA, 21 bp, Homo sapiens
aggttacagattatcacatta

SEQ ID NO: 5216424 - DNA, 16 bp, Homo sapiens
aggttacgaagacaaa

SEQ ID NO: 5216425 - DNA, 23 bp, Homo sapiens
aggttactacctatacaatgtat

SEQ ID NO: 5216426 - DNA, 19 bp, Homo sapiens
aggttactacttaatgctt

SEQ ID NO: 5216427 - DNA, 20 bp, Homo sapiens
aggttactcagcagcagaga

SEQ ID NO: 5216428 - DNA, 14 bp, Homo sapiens
aggttactgagtga

SEQ ID NO: 5216429 - DNA, 17 bp, Homo sapiens
aggttactgggagtgtg

SEQ ID NO: 5216430 - DNA, 13 bp, Homo sapiens
aggttactttagt

SEQ ID NO: 5216431 - DNA, 22 bp, Homo sapiens
aggttagaaaggcagccctcac

SEQ ID NO: 5216432 - DNA, 14 bp, Homo sapiens
aggttagaaatact

SEQ ID NO: 5216433 - DNA, 18 bp, Homo sapiens
aggttagaacctagaagg

SEQ ID NO: 5216434 - DNA, 20 bp, Homo sapiens
aggttagaacctagaagggc

SEQ ID NO: 5216435 - DNA, 13 bp, Homo sapiens
aggttagaatgat

SEQ ID NO: 5216436 - DNA, 22 bp, Homo sapiens
aggttagatatttcgaccctgg

SEQ ID NO: 5216437 - DNA, 24 bp, Homo sapiens
aggttagatgctattaagaaggca

SEQ ID NO: 5216438 - DNA, 15 bp, Homo sapiens
aggttagattctcat

SEQ ID NO: 5216439 - DNA, 22 bp, Homo sapiens
aggttagattttgtattcaggg

SEQ ID NO: 5216440 - DNA, 18 bp, Homo sapiens
aggttagcatcctgcccg

SEQ ID NO: 5216441 - DNA, 22 bp, Homo sapiens
aggttagcccaatggagaaatg

SEQ ID NO: 5216442 - DNA, 23 bp, Homo sapiens
aggttagcccaatggagaaatga

SEQ ID NO: 5216443 - DNA, 17 bp, Homo sapiens
aggttaggaaggcagca

SEQ ID NO: 5216444 - DNA, 19 bp, Homo sapiens
aggttaggcagtataaaga

SEQ ID NO: 5216445 - DNA, 20 bp, Homo sapiens
aggttatacaataacccagt

SEQ ID NO: 5216446 - DNA, 19 bp, Homo sapiens
aggttataggtcactcctg

SEQ ID NO: 5216447 - DNA, 16 bp, Homo sapiens
aggttatcaaaactgt

SEQ ID NO: 5216448 - DNA, 16 bp, Homo sapiens
aggttatcagaaagat

SEQ ID NO: 5216449 - DNA, 18 bp, Homo sapiens
aggttatcgaaataacaa

SEQ ID NO: 5216450 - DNA, 14 bp, Homo sapiens
aggttatctgcctg

SEQ ID NO: 5216451 - DNA, 16 bp, Homo sapiens
aggttatctgcctggc

SEQ ID NO: 5216452 - DNA, 19 bp, Homo sapiens
aggttatctgcctggcctg

SEQ ID NO: 5216453 - DNA, 16 bp, Homo sapiens
aggttatctgtcccag

SEQ ID NO: 5216454 - DNA, 18 bp, Homo sapiens
aggttatgaaacatatca

SEQ ID NO: 5216455 - DNA, 17 bp, Homo sapiens
aggttatgagaaaaaaa

SEQ ID NO: 5216456 - DNA, 14 bp, Homo sapiens
aggttatgattgaa

SEQ ID NO: 5216457 - DNA, 15 bp, Homo sapiens
aggttatgctatttg

SEQ ID NO: 5216458 - DNA, 18 bp, Homo sapiens
aggttatggtttaatgtt

SEQ ID NO: 5216459 - DNA, 19 bp, Homo sapiens
aggttatggtttaatgtta

SEQ ID NO: 5216460 - DNA, 13 bp, Homo sapiens
aggttatgttcat

SEQ ID NO: 5216461 - DNA, 22 bp, Homo sapiens
aggttatgttcatttttcaaaa

SEQ ID NO: 5216462 - DNA, 18 bp, Homo sapiens
aggttattatgattagct

SEQ ID NO: 5216463 - DNA, 21 bp, Homo sapiens
aggttattcacaacctcacca

SEQ ID NO: 5216464 - DNA, 16 bp, Homo sapiens
aggttattttctcctg

SEQ ID NO: 5216465 - DNA, 19 bp, Homo sapiens
aggttattttgctttggtt

SEQ ID NO: 5216466 - DNA, 21 bp, Homo sapiens
aggttatttttatttttttac

SEQ ID NO: 5216467 - DNA, 19 bp, Homo sapiens
aggttcaagcaatcctccc

SEQ ID NO: 5216468 - DNA, 21 bp, Homo sapiens
aggttcaagcgactctcctgc

SEQ ID NO: 5216469 - DNA, 15 bp, Homo sapiens
aggttcaatgagatg

SEQ ID NO: 5216470 - DNA, 20 bp, Homo sapiens
aggttcaatgagatggtggc

SEQ ID NO: 5216471 - DNA, 16 bp, Homo sapiens
aggttcactaaagcag

SEQ ID NO: 5216472 - DNA, 21 bp, Homo sapiens
aggttcacttaaaagctggct

SEQ ID NO: 5216473 - DNA, 16 bp, Homo sapiens
aggttcagaaaattaa

SEQ ID NO: 5216474 - DNA, 19 bp, Homo sapiens
aggttcagccaaggtttta

SEQ ID NO: 5216475 - DNA, 17 bp, Homo sapiens
aggttcagtgcggcccc

SEQ ID NO: 5216476 - DNA, 17 bp, Homo sapiens
aggttccaactgtatat

SEQ ID NO: 5216477 - DNA, 12 bp, Homo sapiens
aggttccacaga

SEQ ID NO: 5216478 - DNA, 14 bp, Homo sapiens
aggttccacagagt

SEQ ID NO: 5216479 - DNA, 15 bp, Homo sapiens
aggttccagtgagcc

SEQ ID NO: 5216480 - DNA, 17 bp, Homo sapiens
aggttccatccaccacc

SEQ ID NO: 5216481 - DNA, 21 bp, Homo sapiens
aggttccatccaccaccttgc

SEQ ID NO: 5216482 - DNA, 16 bp, Homo sapiens
aggttccatcctttac

SEQ ID NO: 5216483 - DNA, 14 bp, Homo sapiens
aggttccattcagt

SEQ ID NO: 5216484 - DNA, 13 bp, Homo sapiens
aggttcccaagga

SEQ ID NO: 5216485 - DNA, 14 bp, Homo sapiens
aggttcccaaggac

SEQ ID NO: 5216486 - DNA, 16 bp, Homo sapiens
aggttcccagcagctg

SEQ ID NO: 5216487 - DNA, 19 bp, Homo sapiens
aggttcccagggctggaga

SEQ ID NO: 5216488 - DNA, 18 bp, Homo sapiens
aggttccccaagggccct

SEQ ID NO: 5216489 - DNA, 21 bp, Homo sapiens
aggttccccaagggccctggc

SEQ ID NO: 5216490 - DNA, 22 bp, Homo sapiens
aggttccccaagggccctggca

SEQ ID NO: 5216491 - DNA, 15 bp, Homo sapiens
aggttccccaatcca

SEQ ID NO: 5216492 - DNA, 14 bp, Homo sapiens
aggttccccagaga

SEQ ID NO: 5216493 - DNA, 14 bp, Homo sapiens
aggttcccctgtca

SEQ ID NO: 5216494 - DNA, 15 bp, Homo sapiens
aggttcccgacacca

SEQ ID NO: 5216495 - DNA, 19 bp, Homo sapiens
aggttcccgacaccagaag

SEQ ID NO: 5216496 - DNA, 22 bp, Homo sapiens
aggttcccgacaccagaagctg

SEQ ID NO: 5216497 - DNA, 11 bp, Homo sapiens
aggttccctgt

SEQ ID NO: 5216498 - DNA, 22 bp, Homo sapiens
aggttccctttgacgccatccc

SEQ ID NO: 5216499 - DNA, 23 bp, Homo sapiens
aggttccctttgacgccatccca

SEQ ID NO: 5216500 - DNA, 17 bp, Homo sapiens
aggttccggtgtctgga

SEQ ID NO: 5216501 - DNA, 22 bp, Homo sapiens
aggttccgtatctccctggaga

SEQ ID NO: 5216502 - DNA, 17 bp, Homo sapiens
aggttcctaggttttga

SEQ ID NO: 5216503 - DNA, 14 bp, Homo sapiens
aggttcctcctagg

SEQ ID NO: 5216504 - DNA, 14 bp, Homo sapiens
aggttcctctgcct

SEQ ID NO: 5216505 - DNA, 17 bp, Homo sapiens
aggttcctctgcctgcc

SEQ ID NO: 5216506 - DNA, 19 bp, Homo sapiens
aggttcctctgcctgcccc

SEQ ID NO: 5216507 - DNA, 22 bp, Homo sapiens
aggttcctgaaatatccaggaa

SEQ ID NO: 5216508 - DNA, 13 bp, Homo sapiens
aggttcctggggc

SEQ ID NO: 5216509 - DNA, 21 bp, Homo sapiens
aggttcgagacccaaaccccc

SEQ ID NO: 5216510 - DNA, 21 bp, Homo sapiens
aggttcgggattccctggtgg

SEQ ID NO: 5216511 - DNA, 11 bp, Homo sapiens
aggttctaaaa

SEQ ID NO: 5216512 - DNA, 17 bp, Homo sapiens
aggttctaaagttctaa

SEQ ID NO: 5216513 - DNA, 18 bp, Homo sapiens
aggttctaaagttctaag

SEQ ID NO: 5216514 - DNA, 19 bp, Homo sapiens
aggttctaaagttctaaga

SEQ ID NO: 5216515 - DNA, 23 bp, Homo sapiens
aggttctaaagttctaagattct

SEQ ID NO: 5216516 - DNA, 14 bp, Homo sapiens
aggttctaacccta

SEQ ID NO: 5216517 - DNA, 13 bp, Homo sapiens
aggttctaacttc

SEQ ID NO: 5216518 - DNA, 12 bp, Homo sapiens
aggttctaaggc

SEQ ID NO: 5216519 - DNA, 13 bp, Homo sapiens
aggttctaaggcc

SEQ ID NO: 5216520 - DNA, 19 bp, Homo sapiens
aggttctaaggcctaggat

SEQ ID NO: 5216521 - DNA, 13 bp, Homo sapiens
aggttctaggtcc

SEQ ID NO: 5216522 - DNA, 12 bp, Homo sapiens
aggttctatgat

SEQ ID NO: 5216523 - DNA, 17 bp, Homo sapiens
aggttctatttggaatt

SEQ ID NO: 5216524 - DNA, 13 bp, Homo sapiens
aggttctcagcaa

SEQ ID NO: 5216525 - DNA, 15 bp, Homo sapiens
aggttctcagcaagt

SEQ ID NO: 5216526 - DNA, 20 bp, Homo sapiens
aggttctccgttagctcctg

SEQ ID NO: 5216527 - DNA, 22 bp, Homo sapiens
aggttctccgttagctcctgtg

SEQ ID NO: 5216528 - DNA, 14 bp, Homo sapiens
aggttctgcctgct

SEQ ID NO: 5216529 - DNA, 17 bp, Homo sapiens
aggttctgcctgctttg

SEQ ID NO: 5216530 - DNA, 17 bp, Homo sapiens
aggttctgggcctctga

SEQ ID NO: 5216531 - DNA, 18 bp, Homo sapiens
aggttctgggcctctgaa

SEQ ID NO: 5216532 - DNA, 19 bp, Homo sapiens
aggttctggggctgggcct

SEQ ID NO: 5216533 - DNA, 18 bp, Homo sapiens
aggttctgggtgcaggag

SEQ ID NO: 5216534 - DNA, 19 bp, Homo sapiens
aggttctggttagctcagc

SEQ ID NO: 5216535 - DNA, 21 bp, Homo sapiens
aggttctggttagctcagccc

SEQ ID NO: 5216536 - DNA, 16 bp, Homo sapiens
aggttctggttccatt

SEQ ID NO: 5216537 - DNA, 22 bp, Homo sapiens
aggttctgtagagccaattaga

SEQ ID NO: 5216538 - DNA, 17 bp, Homo sapiens
aggttctgtgcaaaact

SEQ ID NO: 5216539 - DNA, 22 bp, Homo sapiens
aggttctgtttatggccacatt

SEQ ID NO: 5216540 - DNA, 15 bp, Homo sapiens
aggttcttaaaagtg

SEQ ID NO: 5216541 - DNA, 15 bp, Homo sapiens
aggttcttcagaagt

SEQ ID NO: 5216542 - DNA, 19 bp, Homo sapiens
aggttcttcccttttacat

SEQ ID NO: 5216543 - DNA, 17 bp, Homo sapiens
aggttcttctggtgagt

SEQ ID NO: 5216544 - DNA, 16 bp, Homo sapiens
aggttcttcttcctga

SEQ ID NO: 5216545 - DNA, 21 bp, Homo sapiens
aggttcttcttcctgaagctg

SEQ ID NO: 5216546 - DNA, 23 bp, Homo sapiens
aggttcttcttgggagtatgttg

SEQ ID NO: 5216547 - DNA, 18 bp, Homo sapiens
aggttcttgatgtcatgt

SEQ ID NO: 5216548 - DNA, 19 bp, Homo sapiens
aggttcttgatttttacat

SEQ ID NO: 5216549 - DNA, 11 bp, Homo sapiens
aggttcttgct

SEQ ID NO: 5216550 - DNA, 18 bp, Homo sapiens
aggttcttgttggtgcac

SEQ ID NO: 5216551 - DNA, 22 bp, Homo sapiens
aggttctttcccacactgaaat

SEQ ID NO: 5216552 - DNA, 19 bp, Homo sapiens
aggttcttttccattgtca

SEQ ID NO: 5216553 - DNA, 20 bp, Homo sapiens
aggttgaagacctaaccagg

SEQ ID NO: 5216554 - DNA, 14 bp, Homo sapiens
aggttgaagcacca

SEQ ID NO: 5216555 - DNA, 23 bp, Homo sapiens
aggttgaagccaagtggggtgct

SEQ ID NO: 5216556 - DNA, 20 bp, Homo sapiens
aggttgacagtcccttgctg

SEQ ID NO: 5216557 - DNA, 17 bp, Homo sapiens
aggttgacattcagaaa

SEQ ID NO: 5216558 - DNA, 15 bp, Homo sapiens
aggttgacctgtttc

SEQ ID NO: 5216559 - DNA, 16 bp, Homo sapiens
aggttgactcaagttt

SEQ ID NO: 5216560 - DNA, 22 bp, Homo sapiens
aggttgaggaaaagactgtggg

SEQ ID NO: 5216561 - DNA, 23 bp, Homo sapiens
aggttgaggaaaagactgtgggt

SEQ ID NO: 5216562 - DNA, 16 bp, Homo sapiens
aggttgaggaatatca

SEQ ID NO: 5216563 - DNA, 18 bp, Homo sapiens
aggttgaggatgcactgg

SEQ ID NO: 5216564 - DNA, 16 bp, Homo sapiens
aggttgagtgagccgg

SEQ ID NO: 5216565 - DNA, 21 bp, Homo sapiens
aggcttgcattaaaagactgt

SEQ ID NO: 5216566 - DNA, 19 bp, Homo sapiens
aggcttgcccaggagcaag

SEQ ID NO: 5216567 - DNA, 21 bp, Homo sapiens
aggcttgcccagtacatttaa

SEQ ID NO: 5216568 - DNA, 20 bp, Homo sapiens
aggcttgccgcacatgaaac

SEQ ID NO: 5216569 - DNA, 16 bp, Homo sapiens
aggcttgcctgggctg

SEQ ID NO: 5216570 - DNA, 22 bp, Homo sapiens
aggcttggagaggtatgtgccc

SEQ ID NO: 5216571 - DNA, 19 bp, Homo sapiens
aggcttggatggaacatgc

SEQ ID NO: 5216572 - DNA, 23 bp, Homo sapiens
aggcttggcggagggagcggcat

SEQ ID NO: 5216573 - DNA, 21 bp, Homo sapiens
aggcttgggatttgctgtgta

SEQ ID NO: 5216574 - DNA, 17 bp, Homo sapiens
aggcttgggcccagtag

SEQ ID NO: 5216575 - DNA, 12 bp, Homo sapiens
aggcttggtgtc

SEQ ID NO: 5216576 - DNA, 23 bp, Homo sapiens
aggcttgtgtaatttcctgctcc

SEQ ID NO: 5216577 - DNA, 21 bp, Homo sapiens
aggcttgttccaatgccacat

SEQ ID NO: 5216578 - DNA, 15 bp, Homo sapiens
aggcttgttgtgctt

SEQ ID NO: 5216579 - DNA, 22 bp, Homo sapiens
aggcttgtttacctttctctct

SEQ ID NO: 5216580 - DNA, 21 bp, Homo sapiens
aggctttacttagcttatcaa

SEQ ID NO: 5216581 - DNA, 22 bp, Homo sapiens
aggctttatgataatagattct

SEQ ID NO: 5216582 - DNA, 19 bp, Homo sapiens
aggctttatttataaaata

SEQ ID NO: 5216583 - DNA, 20 bp, Homo sapiens
aggctttatttataaaataa

SEQ ID NO: 5216584 - DNA, 13 bp, Homo sapiens
aggctttcaaaat

SEQ ID NO: 5216585 - DNA, 19 bp, Homo sapiens
aggctttcactatttcctt

SEQ ID NO: 5216586 - DNA, 13 bp, Homo sapiens
aggctttcagctt

SEQ ID NO: 5216587 - DNA, 23 bp, Homo sapiens
aggctttcaggctacctttttct

SEQ ID NO: 5216588 - DNA, 15 bp, Homo sapiens
aggctttcctgccct

SEQ ID NO: 5216589 - DNA, 14 bp, Homo sapiens
aggctttctgggct

SEQ ID NO: 5216590 - DNA, 16 bp, Homo sapiens
aggctttctgggctct

SEQ ID NO: 5216591 - DNA, 18 bp, Homo sapiens
aggctttctgggctctgg

SEQ ID NO: 5216592 - DNA, 19 bp, Homo sapiens
aggctttctgggctctgga

SEQ ID NO: 5216593 - DNA, 20 bp, Homo sapiens
aggctttctgggctctggac

SEQ ID NO: 5216594 - DNA, 21 bp, Homo sapiens
aggctttctgggctctggact

SEQ ID NO: 5216595 - DNA, 17 bp, Homo sapiens
aggctttgagcaactaa

SEQ ID NO: 5216596 - DNA, 19 bp, Homo sapiens
aggctttgagcaactaact

SEQ ID NO: 5216597 - DNA, 18 bp, Homo sapiens
aggctttgccctgctgcc

SEQ ID NO: 5216598 - DNA, 18 bp, Homo sapiens
aggctttgggatatgctg

SEQ ID NO: 5216599 - DNA, 20 bp, Homo sapiens
aggctttggggtcctagccc

SEQ ID NO: 5216600 - DNA, 22 bp, Homo sapiens
aggctttggggtcctagcccag

SEQ ID NO: 5216601 - DNA, 23 bp, Homo sapiens
aggctttgggtggctcactactg

SEQ ID NO: 5216602 - DNA, 19 bp, Homo sapiens
aggctttgtctgctcccaa

SEQ ID NO: 5216603 - DNA, 14 bp, Homo sapiens
aggctttgtgagag

SEQ ID NO: 5216604 - DNA, 17 bp, Homo sapiens
aggctttgtgagagagg

SEQ ID NO: 5216605 - DNA, 13 bp, Homo sapiens
aggctttgtgttg

SEQ ID NO: 5216606 - DNA, 17 bp, Homo sapiens
aggctttgtgttgtaat

SEQ ID NO: 5216607 - DNA, 17 bp, Homo sapiens
aggcttttattagaaag

SEQ ID NO: 5216608 - DNA, 18 bp, Homo sapiens
aggcttttattagaaagc

SEQ ID NO: 5216609 - DNA, 19 bp, Homo sapiens
aggcttttctcaggagctt

SEQ ID NO: 5216610 - DNA, 16 bp, Homo sapiens
aggcttttgggccaaa

SEQ ID NO: 5216611 - DNA, 17 bp, Homo sapiens
aggcttttttccagact

SEQ ID NO: 5216612 - DNA, 16 bp, Homo sapiens
agggaaaaaaaatgta

SEQ ID NO: 5216613 - DNA, 13 bp, Homo sapiens
agggaaaaaagag

SEQ ID NO: 5216614 - DNA, 19 bp, Homo sapiens
agggaaaaatttttatgta

SEQ ID NO: 5216615 - DNA, 22 bp, Homo sapiens
agggaaaaatttttatgtaaaa

SEQ ID NO: 5216616 - DNA, 16 bp, Homo sapiens
agggaaaacagaaaac

SEQ ID NO: 5216617 - DNA, 18 bp, Homo sapiens
agggaaaacccaatgtca

SEQ ID NO: 5216618 - DNA, 16 bp, Homo sapiens
agggaaaactcttcat

SEQ ID NO: 5216619 - DNA, 22 bp, Homo sapiens
agggaaaagataaagaccagaa

SEQ ID NO: 5216620 - DNA, 18 bp, Homo sapiens
agggaaaaggcaggtgct

SEQ ID NO: 5216621 - DNA, 23 bp, Homo sapiens
agggaaaataaaaaaagaaaaaa

SEQ ID NO: 5216622 - DNA, 14 bp, Homo sapiens
agggaaaatcttca

SEQ ID NO: 5216623 - DNA, 12 bp, Homo sapiens
agggaaacaaaa

SEQ ID NO: 5216624 - DNA, 22 bp, Homo sapiens
agggaaacaaaatatttatttg

SEQ ID NO: 5216625 - DNA, 17 bp, Homo sapiens
agggaaacagcctctct

SEQ ID NO: 5216626 - DNA, 23 bp, Homo sapiens
agggaaaccaatagtccccatca

SEQ ID NO: 5216627 - DNA, 21 bp, Homo sapiens
agggaaacccggggaactggt

SEQ ID NO: 5216628 - DNA, 15 bp, Homo sapiens
agggaaaccttggag

SEQ ID NO: 5216629 - DNA, 16 bp, Homo sapiens
agggaaaccttggaga

SEQ ID NO: 5216630 - DNA, 19 bp, Homo sapiens
agggaaaccttggagagga

SEQ ID NO: 5216631 - DNA, 16 bp, Homo sapiens
agggaaactattgtcc

SEQ ID NO: 5216632 - DNA, 14 bp, Homo sapiens
agggaaactctgga

SEQ ID NO: 5216633 - DNA, 19 bp, Homo sapiens
agggaaactctggagagcc

SEQ ID NO: 5216634 - DNA, 20 bp, Homo sapiens
agggaaactctggagagcct

SEQ ID NO: 5216635 - DNA, 22 bp, Homo sapiens
agggaaactctggagagcctgc

SEQ ID NO: 5216636 - DNA, 21 bp, Homo sapiens
agggaaactgccagcaacgca

SEQ ID NO: 5216637 - DNA, 16 bp, Homo sapiens
agggaaactgtgaatg

SEQ ID NO: 5216638 - DNA, 13 bp, Homo sapiens
agggaaagaaatt

SEQ ID NO: 5216639 - DNA, 19 bp, Homo sapiens
agggaaagatgtagaaaga

SEQ ID NO: 5216640 - DNA, 13 bp, Homo sapiens
agggaaagccagc

SEQ ID NO: 5216641 - DNA, 14 bp, Homo sapiens
agggaaagccagcc

SEQ ID NO: 5216642 - DNA, 17 bp, Homo sapiens
agggaaagccagcctgg

SEQ ID NO: 5216643 - DNA, 18 bp, Homo sapiens
agggaaagccagcctggg

SEQ ID NO: 5216644 - DNA, 13 bp, Homo sapiens
agggaaagcccat

SEQ ID NO: 5216645 - DNA, 22 bp, Homo sapiens
agggaaagcccatatgctacca

SEQ ID NO: 5216646 - DNA, 15 bp, Homo sapiens
agggaaagcctctgg

SEQ ID NO: 5216647 - DNA, 16 bp, Homo sapiens
agggaaagcctctggc

SEQ ID NO: 5216648 - DNA, 14 bp, Homo sapiens
agggaaaggcaagc

SEQ ID NO: 5216649 - DNA, 16 bp, Homo sapiens
agggaaagggaagcac

SEQ ID NO: 5216650 - DNA, 16 bp, Homo sapiens
agggaaagggagaggg

SEQ ID NO: 5216651 - DNA, 19 bp, Homo sapiens
agggaaagggatggtcagg

SEQ ID NO: 5216652 - DNA, 15 bp, Homo sapiens
agggaaaggggtgct

SEQ ID NO: 5216653 - DNA, 17 bp, Homo sapiens
agggaaaggtaaataca

SEQ ID NO: 5216654 - DNA, 19 bp, Homo sapiens
agggaaaggtaggaagaga

SEQ ID NO: 5216655 - DNA, 21 bp, Homo sapiens
agggaaaggtaggaagagagg

SEQ ID NO: 5216656 - DNA, 15 bp, Homo sapiens
agggaaaggttttgt

SEQ ID NO: 5216657 - DNA, 18 bp, Homo sapiens
agggaaaggttttgtatt

SEQ ID NO: 5216658 - DNA, 19 bp, Homo sapiens
agggaaaggttttgtattt

SEQ ID NO: 5216659 - DNA, 15 bp, Homo sapiens
agggaaatatcattt

SEQ ID NO: 5216660 - DNA, 19 bp, Homo sapiens
agggaaatctgtaaagcca

SEQ ID NO: 5216661 - DNA, 20 bp, Homo sapiens
agggaaatctgtaaagccag

SEQ ID NO: 5216662 - DNA, 17 bp, Homo sapiens
agggaaatctttcaact

SEQ ID NO: 5216663 - DNA, 16 bp, Homo sapiens
agggaaatgatcagtt

SEQ ID NO: 5216664 - DNA, 19 bp, Homo sapiens
agggaaatgctgttggtga

SEQ ID NO: 5216665 - DNA, 14 bp, Homo sapiens
agggaaatggaggg

SEQ ID NO: 5216666 - DNA, 15 bp, Homo sapiens
agggaaatggccttc

SEQ ID NO: 5216667 - DNA, 16 bp, Homo sapiens
agggaaatggccttcc

SEQ ID NO: 5216668 - DNA, 23 bp, Homo sapiens
agggaaatgtacactttttacag

SEQ ID NO: 5216669 - DNA, 13 bp, Homo sapiens
agggaaatgtttt

SEQ ID NO: 5216670 - DNA, 17 bp, Homo sapiens
agggaaatgttttgtaa

SEQ ID NO: 5216671 - DNA, 18 bp, Homo sapiens
agggaaatgttttgtaaa

SEQ ID NO: 5216672 - DNA, 21 bp, Homo sapiens
agggaaattgtaaatcctgtg

SEQ ID NO: 5216673 - DNA, 20 bp, Homo sapiens
agggaacaaaactgttcttt

SEQ ID NO: 5216674 - DNA, 16 bp, Homo sapiens
agggaacaaattttca

SEQ ID NO: 5216675 - DNA, 14 bp, Homo sapiens
agggaacagacagg

SEQ ID NO: 5216676 - DNA, 15 bp, Homo sapiens
agggaacagacagga

SEQ ID NO: 5216677 - DNA, 19 bp, Homo sapiens
agggaacagacaggagaaa

SEQ ID NO: 5216678 - DNA, 20 bp, Homo sapiens
agggaacagacaggagaaat

SEQ ID NO: 5216679 - DNA, 21 bp, Homo sapiens
agggaacagacaggagaaatg

SEQ ID NO: 5216680 - DNA, 15 bp, Homo sapiens
agggaacagggcgga

SEQ ID NO: 5216681 - DNA, 13 bp, Homo sapiens
agggaacatcctg

SEQ ID NO: 5216682 - DNA, 21 bp, Homo sapiens
agggaacatcctgctgcatga

SEQ ID NO: 5216683 - DNA, 17 bp, Homo sapiens
agggaaccactttctta

SEQ ID NO: 5216684 - DNA, 13 bp, Homo sapiens
agggaaccagagc

SEQ ID NO: 5216685 - DNA, 15 bp, Homo sapiens
agggaaccagagcga

SEQ ID NO: 5216686 - DNA, 14 bp, Homo sapiens
agggaaccagccct

SEQ ID NO: 5216687 - DNA, 19 bp, Homo sapiens
agggaacccccaaatttaa

SEQ ID NO: 5216688 - DNA, 19 bp, Homo sapiens
agggaaccgttattataat

SEQ ID NO: 5216689 - DNA, 14 bp, Homo sapiens
agggaacctgtgtc

SEQ ID NO: 5216690 - DNA, 14 bp, Homo sapiens
agggaactagaggt

SEQ ID NO: 5216691 - DNA, 14 bp, Homo sapiens
agggaactctgggg

SEQ ID NO: 5216692 - DNA, 19 bp, Homo sapiens
agggaactgaccctcaggc

SEQ ID NO: 5216693 - DNA, 14 bp, Homo sapiens
agggaactgcttgc

SEQ ID NO: 5216694 - DNA, 23 bp, Homo sapiens
agggaactgcttgcccagggtgc

SEQ ID NO: 5216695 - DNA, 13 bp, Homo sapiens
agggaactgggaa

SEQ ID NO: 5216696 - DNA, 13 bp, Homo sapiens
agggaactgggga

SEQ ID NO: 5216697 - DNA, 23 bp, Homo sapiens
agggaactttgatacaaatggga

SEQ ID NO: 5216698 - DNA, 20 bp, Homo sapiens
agggaagaaaaagcaagtgt

SEQ ID NO: 5216699 - DNA, 23 bp, Homo sapiens
agggaagaaaaagcaagtgttca

SEQ ID NO: 5216700 - DNA, 18 bp, Homo sapiens
agggaagaaggaggaatg

SEQ ID NO: 5216701 - DNA, 15 bp, Homo sapiens
agggaagaaggggcc

SEQ ID NO: 5216702 - DNA, 20 bp, Homo sapiens
agggaagacagagcaggctt

SEQ ID NO: 5216703 - DNA, 21 bp, Homo sapiens
agggaagacaggtctagactt

SEQ ID NO: 5216704 - DNA, 18 bp, Homo sapiens
agggaagaccagaattcc

SEQ ID NO: 5216705 - DNA, 22 bp, Homo sapiens
agggaagacctgaaagagagga

SEQ ID NO: 5216706 - DNA, 13 bp, Homo sapiens
agggaagagaaac

SEQ ID NO: 5216707 - DNA, 15 bp, Homo sapiens
agggaagagaaacag

SEQ ID NO: 5216708 - DNA, 12 bp, Homo sapiens
agggaagagcag

SEQ ID NO: 5216709 - DNA, 12 bp, Homo sapiens
agggaagagggc

SEQ ID NO: 5216710 - DNA, 14 bp, Homo sapiens
agggaagagggcag

SEQ ID NO: 5216711 - DNA, 15 bp, Homo sapiens
agggaagagtagctg

SEQ ID NO: 5216712 - DNA, 14 bp, Homo sapiens
agggaagagtgcat

SEQ ID NO: 5216713 - DNA, 19 bp, Homo sapiens
agggaagagtggaggtgga

SEQ ID NO: 5216714 - DNA, 16 bp, Homo sapiens
agggaagatctaacat

SEQ ID NO: 5216715 - DNA, 20 bp, Homo sapiens
agggaagatgacctgcccca

SEQ ID NO: 5216716 - DNA, 13 bp, Homo sapiens
agggaagcaggca

SEQ ID NO: 5216717 - DNA, 14 bp, Homo sapiens
agggaagcaggcag

SEQ ID NO: 5216718 - DNA, 16 bp, Homo sapiens
agggaagcaggcagag

SEQ ID NO: 5216719 - DNA, 13 bp, Homo sapiens
agggaagcaggga

SEQ ID NO: 5216720 - DNA, 14 bp, Homo sapiens
agggaagcccaccc

SEQ ID NO: 5216721 - DNA, 16 bp, Homo sapiens
agggaagcccacccgc

SEQ ID NO: 5216722 - DNA, 23 bp, Homo sapiens
agggaagcccacccgccccagag

SEQ ID NO: 5216723 - DNA, 12 bp, Homo sapiens
agggaagcccag

SEQ ID NO: 5216724 - DNA, 13 bp, Homo sapiens
agggaagcccagc

SEQ ID NO: 5216725 - DNA, 16 bp, Homo sapiens
agggaagcccagcctg

SEQ ID NO: 5216726 - DNA, 17 bp, Homo sapiens
agggaagcccagcctgc

SEQ ID NO: 5216727 - DNA, 16 bp, Homo sapiens
agggaagccctcggcc

SEQ ID NO: 5216728 - DNA, 14 bp, Homo sapiens
agggaagcctgact

SEQ ID NO: 5216729 - DNA, 19 bp, Homo sapiens
agggaagcctgactgctcg

SEQ ID NO: 5216730 - DNA, 16 bp, Homo sapiens
agggaagccttttgca

SEQ ID NO: 5216731 - DNA, 16 bp, Homo sapiens
agggaagcgtatatac

SEQ ID NO: 5216732 - DNA, 16 bp, Homo sapiens
agggaagctacaggtt

SEQ ID NO: 5216733 - DNA, 17 bp, Homo sapiens
agggaagctgtcctgga

SEQ ID NO: 5216734 - DNA, 19 bp, Homo sapiens
agggaagctttcaccagcc

SEQ ID NO: 5216735 - DNA, 13 bp, Homo sapiens
agggaaggaaaaa

SEQ ID NO: 5216736 - DNA, 14 bp, Homo sapiens
agggaaggacagaa

SEQ ID NO: 5216737 - DNA, 15 bp, Homo sapiens
agggaaggacagaaa

SEQ ID NO: 5216738 - DNA, 19 bp, Homo sapiens
agggaaggacagctgtgcc

SEQ ID NO: 5216739 - DNA, 14 bp, Homo sapiens
agggaaggacagga

SEQ ID NO: 5216740 - DNA, 15 bp, Homo sapiens
agggaaggagacagg

SEQ ID NO: 5216741 - DNA, 16 bp, Homo sapiens
agggaaggagcccagc

SEQ ID NO: 5216742 - DNA, 12 bp, Homo sapiens
agggaaggagct

SEQ ID NO: 5216743 - DNA, 15 bp, Homo sapiens
agggaaggagctgtt

SEQ ID NO: 5216744 - DNA, 11 bp, Homo sapiens
aggttgataac

SEQ ID NO: 5216745 - DNA, 16 bp, Homo sapiens
aggttgataactttgc

SEQ ID NO: 5216746 - DNA, 17 bp, Homo sapiens
aggttgataactttgct

SEQ ID NO: 5216747 - DNA, 18 bp, Homo sapiens
aggttgataactttgctt

SEQ ID NO: 5216748 - DNA, 20 bp, Homo sapiens
aggttgataactttgcttgc

SEQ ID NO: 5216749 - DNA, 19 bp, Homo sapiens
aggttgatatcggtgctat

SEQ ID NO: 5216750 - DNA, 23 bp, Homo sapiens
aggttgatcttgaactcctgacc

SEQ ID NO: 5216751 - DNA, 14 bp, Homo sapiens
aggttgattctcat

SEQ ID NO: 5216752 - DNA, 19 bp, Homo sapiens
aggttgcacacagtacaca

SEQ ID NO: 5216753 - DNA, 12 bp, Homo sapiens
aggttgcacact

SEQ ID NO: 5216754 - DNA, 17 bp, Homo sapiens
aggttgcacactttggt

SEQ ID NO: 5216755 - DNA, 19 bp, Homo sapiens
aggttgcacactttggtac

SEQ ID NO: 5216756 - DNA, 14 bp, Homo sapiens
aggttgcacagcaa

SEQ ID NO: 5216757 - DNA, 15 bp, Homo sapiens
aggttgcacagcaag

SEQ ID NO: 5216758 - DNA, 23 bp, Homo sapiens
aggttgcagagaagcatcctcca

SEQ ID NO: 5216759 - DNA, 14 bp, Homo sapiens
aggttgcagctgct

SEQ ID NO: 5216760 - DNA, 17 bp, Homo sapiens
aggttgcagctgctctt

SEQ ID NO: 5216761 - DNA, 18 bp, Homo sapiens
aggttgcagggagccgag

SEQ ID NO: 5216762 - DNA, 11 bp, Homo sapiens
aggttgcagta

SEQ ID NO: 5216763 - DNA, 14 bp, Homo sapiens
aggttgcagtgagc

SEQ ID NO: 5216764 - DNA, 18 bp, Homo sapiens
aggttgcagtgagcagag

SEQ ID NO: 5216765 - DNA, 15 bp, Homo sapiens
aggttgcagtgagcc

SEQ ID NO: 5216766 - DNA, 19 bp, Homo sapiens
aggttgcagtgagccaaga

SEQ ID NO: 5216767 - DNA, 19 bp, Homo sapiens
aggttgcagtgagctgaga

SEQ ID NO: 5216768 - DNA, 17 bp, Homo sapiens
aggttgccaaattgctg

SEQ ID NO: 5216769 - DNA, 18 bp, Homo sapiens
aggttgccaatgtctgat

SEQ ID NO: 5216770 - DNA, 17 bp, Homo sapiens
aggttgctggttgctgt

SEQ ID NO: 5216771 - DNA, 15 bp, Homo sapiens
aggttggaaaagaaa

SEQ ID NO: 5216772 - DNA, 23 bp, Homo sapiens
aggttggaaaagaaatcaatttt

SEQ ID NO: 5216773 - DNA, 14 bp, Homo sapiens
aggttggaagagaa

SEQ ID NO: 5216774 - DNA, 17 bp, Homo sapiens
aggttggaatcttttat

SEQ ID NO: 5216775 - DNA, 12 bp, Homo sapiens
aggttggatggg

SEQ ID NO: 5216776 - DNA, 20 bp, Homo sapiens
aggttggcaaacgggcttga

SEQ ID NO: 5216777 - DNA, 16 bp, Homo sapiens
aggttggcaccccagc

SEQ ID NO: 5216778 - DNA, 20 bp, Homo sapiens
aggttggcgtgccctggagg

SEQ ID NO: 5216779 - DNA, 22 bp, Homo sapiens
aggttggctctgccagtcctgt

SEQ ID NO: 5216780 - DNA, 18 bp, Homo sapiens
aggttgggaacatgctgg

SEQ ID NO: 5216781 - DNA, 12 bp, Homo sapiens
aggttgggaagg

SEQ ID NO: 5216782 - DNA, 19 bp, Homo sapiens
aggttgggaaggcacctgc

SEQ ID NO: 5216783 - DNA, 22 bp, Homo sapiens
aggttgggaatgaggcttgctg

SEQ ID NO: 5216784 - DNA, 20 bp, Homo sapiens
aggttgggaggctgtggaga

SEQ ID NO: 5216785 - DNA, 22 bp, Homo sapiens
aggttgggccatactggcctcg

SEQ ID NO: 5216786 - DNA, 18 bp, Homo sapiens
aggttgggctagagaaat

SEQ ID NO: 5216787 - DNA, 18 bp, Homo sapiens
aggttgggcttccatgcc

SEQ ID NO: 5216788 - DNA, 19 bp, Homo sapiens
aggttgggcttccatgcct

SEQ ID NO: 5216789 - DNA, 20 bp, Homo sapiens
aggttggggagacttggggc

SEQ ID NO: 5216790 - DNA, 23 bp, Homo sapiens
aggttggggagacttggggccag

SEQ ID NO: 5216791 - DNA, 17 bp, Homo sapiens
aggttggggataggttt

SEQ ID NO: 5216792 - DNA, 15 bp, Homo sapiens
aggttggtgaagtgt

SEQ ID NO: 5216793 - DNA, 17 bp, Homo sapiens
aggttgtaaatgtgttt

SEQ ID NO: 5216794 - DNA, 14 bp, Homo sapiens
aggttgtagcatgg

SEQ ID NO: 5216795 - DNA, 16 bp, Homo sapiens
aggttgtctgaagtca

SEQ ID NO: 5216796 - DNA, 22 bp, Homo sapiens
aggttgtctgtagagaatgaaa

SEQ ID NO: 5216797 - DNA, 22 bp, Homo sapiens
aggttgtgaaaacagcagcaat

SEQ ID NO: 5216798 - DNA, 14 bp, Homo sapiens
aggttgtgcagggt

SEQ ID NO: 5216799 - DNA, 23 bp, Homo sapiens
aggttgtgcagggtgtgtactgc

SEQ ID NO: 5216800 - DNA, 15 bp, Homo sapiens
aggttgtgctgcctg

SEQ ID NO: 5216801 - DNA, 18 bp, Homo sapiens
aggttgtggggaggctgc

SEQ ID NO: 5216802 - DNA, 18 bp, Homo sapiens
aggttgtggggcctcagg

SEQ ID NO: 5216803 - DNA, 19 bp, Homo sapiens
aggttgttaaaacagaaaa

SEQ ID NO: 5216804 - DNA, 14 bp, Homo sapiens
aggttgttctgtat

SEQ ID NO: 5216805 - DNA, 22 bp, Homo sapiens
aggttgttttgttttatagtat

SEQ ID NO: 5216806 - DNA, 22 bp, Homo sapiens
aggtttaaaaatccccaaaaaa

SEQ ID NO: 5216807 - DNA, 13 bp, Homo sapiens
aggtttaaaacag

SEQ ID NO: 5216808 - DNA, 13 bp, Homo sapiens
aggtttaaaacta

SEQ ID NO: 5216809 - DNA, 16 bp, Homo sapiens
aggtttaaagagtcta

SEQ ID NO: 5216810 - DNA, 14 bp, Homo sapiens
aggtttaaatgaac

SEQ ID NO: 5216811 - DNA, 15 bp, Homo sapiens
aggtttaacataaag

SEQ ID NO: 5216812 - DNA, 17 bp, Homo sapiens
aggtttaactcagatca

SEQ ID NO: 5216813 - DNA, 18 bp, Homo sapiens
aggtttaactcagatcac

SEQ ID NO: 5216814 - DNA, 16 bp, Homo sapiens
aggtttacaatttaca

SEQ ID NO: 5216815 - DNA, 16 bp, Homo sapiens
aggtttacactgcgga

SEQ ID NO: 5216816 - DNA, 15 bp, Homo sapiens
aggtttagagattaa

SEQ ID NO: 5216817 - DNA, 15 bp, Homo sapiens
aggtttataaagcag

SEQ ID NO: 5216818 - DNA, 14 bp, Homo sapiens
aggtttatctgaag

SEQ ID NO: 5216819 - DNA, 14 bp, Homo sapiens
aggtttatgaaaaa

SEQ ID NO: 5216820 - DNA, 14 bp, Homo sapiens
aggtttatgacagt

SEQ ID NO: 5216821 - DNA, 23 bp, Homo sapiens
aggtttatttatctgagcaataa

SEQ ID NO: 5216822 - DNA, 14 bp, Homo sapiens
aggtttcaaagatg

SEQ ID NO: 5216823 - DNA, 20 bp, Homo sapiens
aggtttcaacaaatttcatt

SEQ ID NO: 5216824 - DNA, 21 bp, Homo sapiens
aggtttcaacaaatttcattg

SEQ ID NO: 5216825 - DNA, 22 bp, Homo sapiens
aggtttcaacaaatttcattgc

SEQ ID NO: 5216826 - DNA, 18 bp, Homo sapiens
aggtttcaagacttgata

SEQ ID NO: 5216827 - DNA, 19 bp, Homo sapiens
aggtttcactgttcatgaa

SEQ ID NO: 5216828 - DNA, 22 bp, Homo sapiens
aggtttcagcaacaagactgcc

SEQ ID NO: 5216829 - DNA, 12 bp, Homo sapiens
aggtttcagtag

SEQ ID NO: 5216830 - DNA, 13 bp, Homo sapiens
aggtttcatttct

SEQ ID NO: 5216831 - DNA, 16 bp, Homo sapiens
aggtttccactattat

SEQ ID NO: 5216832 - DNA, 16 bp, Homo sapiens
aggtttccattctgca

SEQ ID NO: 5216833 - DNA, 17 bp, Homo sapiens
aggtttcccaaaacaat

SEQ ID NO: 5216834 - DNA, 16 bp, Homo sapiens
aggtttcccaatggtg

SEQ ID NO: 5216835 - DNA, 23 bp, Homo sapiens
aggtttccttttggaacatttct

SEQ ID NO: 5216836 - DNA, 11 bp, Homo sapiens
aggtttcttct

SEQ ID NO: 5216837 - DNA, 12 bp, Homo sapiens
aggtttcttctc

SEQ ID NO: 5216838 - DNA, 14 bp, Homo sapiens
aggtttcttctctg

SEQ ID NO: 5216839 - DNA, 16 bp, Homo sapiens
aggtttcttctctgga

SEQ ID NO: 5216840 - DNA, 17 bp, Homo sapiens
aggtttcttctctggag

SEQ ID NO: 5216841 - DNA, 19 bp, Homo sapiens
aggtttctttttttttcct

SEQ ID NO: 5216842 - DNA, 13 bp, Homo sapiens
aggtttgaaaagc

SEQ ID NO: 5216843 - DNA, 22 bp, Homo sapiens
aggtttgaaaggcaatttttga

SEQ ID NO: 5216844 - DNA, 22 bp, Homo sapiens
aggtttgaagacacagcctccc

SEQ ID NO: 5216845 - DNA, 16 bp, Homo sapiens
aggtttgaaggagaat

SEQ ID NO: 5216846 - DNA, 14 bp, Homo sapiens
aggtttgagtagag

SEQ ID NO: 5216847 - DNA, 23 bp, Homo sapiens
aggtttgatgccaaagcagacat

SEQ ID NO: 5216848 - DNA, 11 bp, Homo sapiens
aggtttgcaaa

SEQ ID NO: 5216849 - DNA, 14 bp, Homo sapiens
aggtttgccctgcc

SEQ ID NO: 5216850 - DNA, 13 bp, Homo sapiens
aggtttgcctgtg

SEQ ID NO: 5216851 - DNA, 14 bp, Homo sapiens
aggtttggaaggag

SEQ ID NO: 5216852 - DNA, 21 bp, Homo sapiens
aggtttggagccgggaaagct

SEQ ID NO: 5216853 - DNA, 21 bp, Homo sapiens
aggtttggatgggagtgagac

SEQ ID NO: 5216854 - DNA, 14 bp, Homo sapiens
aggtttggctcctg

SEQ ID NO: 5216855 - DNA, 21 bp, Homo sapiens
aggtttggggagggggaagag

SEQ ID NO: 5216856 - DNA, 22 bp, Homo sapiens
aggtttggggagggggaagaga

SEQ ID NO: 5216857 - DNA, 14 bp, Homo sapiens
aggtttgtcaacac

SEQ ID NO: 5216858 - DNA, 20 bp, Homo sapiens
aggtttgtcaacacaaagac

SEQ ID NO: 5216859 - DNA, 21 bp, Homo sapiens
aggtttgtcaacacaaagaca

SEQ ID NO: 5216860 - DNA, 16 bp, Homo sapiens
aggtttgtcatcagat

SEQ ID NO: 5216861 - DNA, 23 bp, Homo sapiens
aggtttgtcgggcaccagccagc

SEQ ID NO: 5216862 - DNA, 22 bp, Homo sapiens
aggtttgtgagagcgaggctga

SEQ ID NO: 5216863 - DNA, 21 bp, Homo sapiens
aggtttgttcctttgaagaat

SEQ ID NO: 5216864 - DNA, 23 bp, Homo sapiens
aggtttgttcctttgaagaattg

SEQ ID NO: 5216865 - DNA, 23 bp, Homo sapiens
aggtttgtttagaagaagtgtgt

SEQ ID NO: 5216866 - DNA, 22 bp, Homo sapiens
aggtttgttttcattaaattag

SEQ ID NO: 5216867 - DNA, 15 bp, Homo sapiens
aggttttaaagtgat

SEQ ID NO: 5216868 - DNA, 17 bp, Homo sapiens
aggttttaaagtgatta

SEQ ID NO: 5216869 - DNA, 18 bp, Homo sapiens
aggttttaagctaaaatg

SEQ ID NO: 5216870 - DNA, 20 bp, Homo sapiens
aggttttaaggattctgcag

SEQ ID NO: 5216871 - DNA, 19 bp, Homo sapiens
aggttttaagtggtttgat

SEQ ID NO: 5216872 - DNA, 17 bp, Homo sapiens
aggttttaatgtctgtt

SEQ ID NO: 5216873 - DNA, 14 bp, Homo sapiens
aggttttacagatt

SEQ ID NO: 5216874 - DNA, 14 bp, Homo sapiens
aggttttaggttct

SEQ ID NO: 5216875 - DNA, 17 bp, Homo sapiens
aggttttataaggctga

SEQ ID NO: 5216876 - DNA, 14 bp, Homo sapiens
aggttttcagagaa

SEQ ID NO: 5216877 - DNA, 17 bp, Homo sapiens
aggttttcagagaatta

SEQ ID NO: 5216878 - DNA, 22 bp, Homo sapiens
aggttttcccctcttttgttaa

SEQ ID NO: 5216879 - DNA, 18 bp, Homo sapiens
aggttttctatgtgactc

SEQ ID NO: 5216880 - DNA, 13 bp, Homo sapiens
aggttttctccac

SEQ ID NO: 5216881 - DNA, 14 bp, Homo sapiens
aggttttgaataaa

SEQ ID NO: 5216882 - DNA, 20 bp, Homo sapiens
aggttttgaataaaaagtga

SEQ ID NO: 5216883 - DNA, 24 bp, Homo sapiens
aggttttgaataaaaagtgaactt

SEQ ID NO: 5216884 - DNA, 17 bp, Homo sapiens
aggttttggagagtttg

SEQ ID NO: 5216885 - DNA, 13 bp, Homo sapiens
aggttttggttat

SEQ ID NO: 5216886 - DNA, 21 bp, Homo sapiens
aggttttggttatggagtctt

SEQ ID NO: 5216887 - DNA, 16 bp, Homo sapiens
aggttttgtaaaactg

SEQ ID NO: 5216888 - DNA, 14 bp, Homo sapiens
aggttttgttgcta

SEQ ID NO: 5216889 - DNA, 16 bp, Homo sapiens
aggttttgttgtgttc

SEQ ID NO: 5216890 - DNA, 23 bp, Homo sapiens
aggttttgtttgctatcttaatt

SEQ ID NO: 5216891 - DNA, 15 bp, Homo sapiens
aggttttgtttttag

SEQ ID NO: 5216892 - DNA, 15 bp, Homo sapiens
aggtttttaaagact

SEQ ID NO: 5216893 - DNA, 20 bp, Homo sapiens
aggtttttcaattaaacgga

SEQ ID NO: 5216894 - DNA, 20 bp, Homo sapiens
aggtttttctcatgtatctt

SEQ ID NO: 5216895 - DNA, 16 bp, Homo sapiens
aggtttttctggcatt

SEQ ID NO: 5216896 - DNA, 13 bp, Homo sapiens
aggtttttcttaa

SEQ ID NO: 5216897 - DNA, 19 bp, Homo sapiens
aggtttttcttgctatgtt

SEQ ID NO: 5216898 - DNA, 23 bp, Homo sapiens
aggtttttgatagcattgtaagc

SEQ ID NO: 5216899 - DNA, 22 bp, Homo sapiens
aggtttttgtaaagatttctgt

SEQ ID NO: 5216900 - DNA, 19 bp, Homo sapiens
aggtttttgtagtgatttt

SEQ ID NO: 5216901 - DNA, 21 bp, Homo sapiens
aggtttttttgtatagtaaag

SEQ ID NO: 5216902 - DNA, 22 bp, Homo sapiens
aggtttttttgtatagtaaagt

SEQ ID NO: 5216903 - DNA, 16 bp, Homo sapiens
aggttttttttcagtt

SEQ ID NO: 5216904 - DNA, 17 bp, Homo sapiens
aggttttttttcagttg

SEQ ID NO: 5216905 - DNA, 18 bp, Homo sapiens
aggttttttttgtacgca

SEQ ID NO: 5216906 - DNA, 18 bp, Homo sapiens
agtaaaaaagagaattgt

SEQ ID NO: 5216907 - DNA, 13 bp, Homo sapiens
agtaaaaaagtta

SEQ ID NO: 5216908 - DNA, 18 bp, Homo sapiens
agtaaaaaagttaaatgt

SEQ ID NO: 5216909 - DNA, 12 bp, Homo sapiens
agtaaaaacact

SEQ ID NO: 5216910 - DNA, 18 bp, Homo sapiens
agtaaaaacatttaaata

SEQ ID NO: 5216911 - DNA, 11 bp, Homo sapiens
agtaaaaagaa

SEQ ID NO: 5216912 - DNA, 17 bp, Homo sapiens
agtaaaaattaaaaaat

SEQ ID NO: 5216913 - DNA, 13 bp, Homo sapiens
agtaaaaatttct

SEQ ID NO: 5216914 - DNA, 16 bp, Homo sapiens
agtaaaacattttatt

SEQ ID NO: 5216915 - DNA, 17 bp, Homo sapiens
agtaaaaccacagcagt

SEQ ID NO: 5216916 - DNA, 20 bp, Homo sapiens
agtaaaaccacagcagttga

SEQ ID NO: 5216917 - DNA, 16 bp, Homo sapiens
agtaaaaccttgttct

SEQ ID NO: 5216918 - DNA, 17 bp, Homo sapiens
agtaaaaccttgttcta

SEQ ID NO: 5216919 - DNA, 19 bp, Homo sapiens
agtaaaaccttgttctatt

SEQ ID NO: 5216920 - DNA, 12 bp, Homo sapiens
agtaaaagcaaa

SEQ ID NO: 5216921 - DNA, 16 bp, Homo sapiens
agtaaaagcaaaaaag

SEQ ID NO: 5216922 - DNA, 16 bp, Homo sapiens
agtaaaagtcataaat

SEQ ID NO: 5216923 - DNA, 19 bp, Homo sapiens
agggaaggaggagcctgtc

SEQ ID NO: 5216924 - DNA, 15 bp, Homo sapiens
agggaaggatcccat

SEQ ID NO: 5216925 - DNA, 16 bp, Homo sapiens
agggaaggatgacaaa

SEQ ID NO: 5216926 - DNA, 14 bp, Homo sapiens
agggaaggatttaa

SEQ ID NO: 5216927 - DNA, 16 bp, Homo sapiens
agggaaggatttagga

SEQ ID NO: 5216928 - DNA, 17 bp, Homo sapiens
agggaaggcaaaggcag

SEQ ID NO: 5216929 - DNA, 19 bp, Homo sapiens
agggaaggcaaaggcagag

SEQ ID NO: 5216930 - DNA, 21 bp, Homo sapiens
agggaaggcaaaggcagagga

SEQ ID NO: 5216931 - DNA, 15 bp, Homo sapiens
agggaaggcaggcag

SEQ ID NO: 5216932 - DNA, 16 bp, Homo sapiens
agggaaggccccacag

SEQ ID NO: 5216933 - DNA, 17 bp, Homo sapiens
agggaaggctctctggt

SEQ ID NO: 5216934 - DNA, 13 bp, Homo sapiens
agggaaggctgct

SEQ ID NO: 5216935 - DNA, 14 bp, Homo sapiens
agggaagggagcca

SEQ ID NO: 5216936 - DNA, 16 bp, Homo sapiens
agggaagggagccaag

SEQ ID NO: 5216937 - DNA, 16 bp, Homo sapiens
agggaagggccaccct

SEQ ID NO: 5216938 - DNA, 19 bp, Homo sapiens
agggaagggccaccctgct

SEQ ID NO: 5216939 - DNA, 21 bp, Homo sapiens
agggaagggccaccctgctgc

SEQ ID NO: 5216940 - DNA, 17 bp, Homo sapiens
agggaaggggatggagg

SEQ ID NO: 5216941 - DNA, 17 bp, Homo sapiens
agggaaggggcctccct

SEQ ID NO: 5216942 - DNA, 17 bp, Homo sapiens
agggaagggtgcctggc

SEQ ID NO: 5216943 - DNA, 21 bp, Homo sapiens
agggaaggtatatcaggaggg

SEQ ID NO: 5216944 - DNA, 16 bp, Homo sapiens
agggaaggtgaagatg

SEQ ID NO: 5216945 - DNA, 20 bp, Homo sapiens
agggaaggtgaccgcccagc

SEQ ID NO: 5216946 - DNA, 17 bp, Homo sapiens
agggaaggtggaccaga

SEQ ID NO: 5216947 - DNA, 12 bp, Homo sapiens
agggaaggtggg

SEQ ID NO: 5216948 - DNA, 16 bp, Homo sapiens
agggaaggtggggccc

SEQ ID NO: 5216949 - DNA, 22 bp, Homo sapiens
agggaaggtggggccctgcccc

SEQ ID NO: 5216950 - DNA, 15 bp, Homo sapiens
agggaagtagtcctt

SEQ ID NO: 5216951 - DNA, 15 bp, Homo sapiens
agggaagtagttatc

SEQ ID NO: 5216952 - DNA, 21 bp, Homo sapiens
agggaagtcacttcaccatca

SEQ ID NO: 5216953 - DNA, 15 bp, Homo sapiens
agggaagtgaggccc

SEQ ID NO: 5216954 - DNA, 20 bp, Homo sapiens
agggaagtgaggcccaagga

SEQ ID NO: 5216955 - DNA, 21 bp, Homo sapiens
agggaagtgcagagcttgtgg

SEQ ID NO: 5216956 - DNA, 13 bp, Homo sapiens
agggaagtggagg

SEQ ID NO: 5216957 - DNA, 15 bp, Homo sapiens
agggaagtggggagt

SEQ ID NO: 5216958 - DNA, 12 bp, Homo sapiens
agggaagtgtgt

SEQ ID NO: 5216959 - DNA, 23 bp, Homo sapiens
agggaagtgtgtgtgtgtccatg

SEQ ID NO: 5216960 - DNA, 18 bp, Homo sapiens
agggaagttgtctccttc

SEQ ID NO: 5216961 - DNA, 18 bp, Homo sapiens
agggaagtttaaaaccca

SEQ ID NO: 5216962 - DNA, 19 bp, Homo sapiens
agggaataaggtacaagaa

SEQ ID NO: 5216963 - DNA, 12 bp, Homo sapiens
agggaataatta

SEQ ID NO: 5216964 - DNA, 22 bp, Homo sapiens
agggaatatgcattgtctgcaa

SEQ ID NO: 5216965 - DNA, 14 bp, Homo sapiens
agggaatcagaaag

SEQ ID NO: 5216966 - DNA, 16 bp, Homo sapiens
agggaatcagggagca

SEQ ID NO: 5216967 - DNA, 16 bp, Homo sapiens
agggaatccaagcctc

SEQ ID NO: 5216968 - DNA, 22 bp, Homo sapiens
agggaatccaagcctccacagc

SEQ ID NO: 5216969 - DNA, 21 bp, Homo sapiens
agggaatccatatcagctctg

SEQ ID NO: 5216970 - DNA, 16 bp, Homo sapiens
agggaatccccgaagg

SEQ ID NO: 5216971 - DNA, 21 bp, Homo sapiens
agggaatccgcctgcagagga

SEQ ID NO: 5216972 - DNA, 15 bp, Homo sapiens
agggaatcctcctcc

SEQ ID NO: 5216973 - DNA, 16 bp, Homo sapiens
agggaatcctcctcca

SEQ ID NO: 5216974 - DNA, 18 bp, Homo sapiens
agggaatcctcctccagg

SEQ ID NO: 5216975 - DNA, 21 bp, Homo sapiens
agggaatcctgcggcaggact

SEQ ID NO: 5216976 - DNA, 16 bp, Homo sapiens
agggaatgcaatcctt

SEQ ID NO: 5216977 - DNA, 14 bp, Homo sapiens
agggaatgcctgag

SEQ ID NO: 5216978 - DNA, 21 bp, Homo sapiens
agggaatgcctgagtgcctgg

SEQ ID NO: 5216979 - DNA, 13 bp, Homo sapiens
agggaatgcctgg

SEQ ID NO: 5216980 - DNA, 14 bp, Homo sapiens
agggaatgggacag

SEQ ID NO: 5216981 - DNA, 15 bp, Homo sapiens
agggaatgggacagg

SEQ ID NO: 5216982 - DNA, 21 bp, Homo sapiens
agggaatggggaacccgctct

SEQ ID NO: 5216983 - DNA, 13 bp, Homo sapiens
agggaatgtgaaa

SEQ ID NO: 5216984 - DNA, 23 bp, Homo sapiens
agggaatgttccctgcaccctgg

SEQ ID NO: 5216985 - DNA, 14 bp, Homo sapiens
agggaattctcttg

SEQ ID NO: 5216986 - DNA, 15 bp, Homo sapiens
agggaattctcttgg

SEQ ID NO: 5216987 - DNA, 14 bp, Homo sapiens
agggaattcttaca

SEQ ID NO: 5216988 - DNA, 16 bp, Homo sapiens
agggaattcttacagc

SEQ ID NO: 5216989 - DNA, 18 bp, Homo sapiens
agggaattgaggtctgct

SEQ ID NO: 5216990 - DNA, 16 bp, Homo sapiens
agggaattgcagagta

SEQ ID NO: 5216991 - DNA, 13 bp, Homo sapiens
agggaattgctca

SEQ ID NO: 5216992 - DNA, 19 bp, Homo sapiens
agggaatttaatacttttc

SEQ ID NO: 5216993 - DNA, 20 bp, Homo sapiens
agggaatttaatacttttcc

SEQ ID NO: 5216994 - DNA, 15 bp, Homo sapiens
agggaatttcaggaa

SEQ ID NO: 5216995 - DNA, 23 bp, Homo sapiens
agggaattttcattggatgcagt

SEQ ID NO: 5216996 - DNA, 16 bp, Homo sapiens
agggaattttcatttt

SEQ ID NO: 5216997 - DNA, 15 bp, Homo sapiens
agggacaaaggagcc

SEQ ID NO: 5216998 - DNA, 16 bp, Homo sapiens
agggacaaaggagcct

SEQ ID NO: 5216999 - DNA, 20 bp, Homo sapiens
agggacaaaggagcctgtga

SEQ ID NO: 5217000 - DNA, 21 bp, Homo sapiens
agggacaaccagaaggccctt

SEQ ID NO: 5217001 - DNA, 21 bp, Homo sapiens
agggacaagtctttctcctct

SEQ ID NO: 5217002 - DNA, 22 bp, Homo sapiens
agggacaagtggactcagggca

SEQ ID NO: 5217003 - DNA, 12 bp, Homo sapiens
agggacacacac

SEQ ID NO: 5217004 - DNA, 13 bp, Homo sapiens
agggacacagagg

SEQ ID NO: 5217005 - DNA, 18 bp, Homo sapiens
agggacacaggagaccac

SEQ ID NO: 5217006 - DNA, 16 bp, Homo sapiens
agggacacatatcaaa

SEQ ID NO: 5217007 - DNA, 16 bp, Homo sapiens
agggacacatgcccct

SEQ ID NO: 5217008 - DNA, 21 bp, Homo sapiens
agggacacatgcccctccccc

SEQ ID NO: 5217009 - DNA, 16 bp, Homo sapiens
agggacaccagccagg

SEQ ID NO: 5217010 - DNA, 14 bp, Homo sapiens
agggacacctggga

SEQ ID NO: 5217011 - DNA, 17 bp, Homo sapiens
agggacactacaaacat

SEQ ID NO: 5217012 - DNA, 14 bp, Homo sapiens
agggacagaagcag

SEQ ID NO: 5217013 - DNA, 18 bp, Homo sapiens
agggacagagacacctgc

SEQ ID NO: 5217014 - DNA, 14 bp, Homo sapiens
agggacagagccat

SEQ ID NO: 5217015 - DNA, 14 bp, Homo sapiens
agggacagagcccg

SEQ ID NO: 5217016 - DNA, 18 bp, Homo sapiens
agggacagagcccgggag

SEQ ID NO: 5217017 - DNA, 21 bp, Homo sapiens
agggacagaggccaaggactg

SEQ ID NO: 5217018 - DNA, 22 bp, Homo sapiens
agggacagaggccaaggactga

SEQ ID NO: 5217019 - DNA, 21 bp, Homo sapiens
agggacagaggccccagcctc

SEQ ID NO: 5217020 - DNA, 22 bp, Homo sapiens
agggacagaggccccagcctcc

SEQ ID NO: 5217021 - DNA, 12 bp, Homo sapiens
agggacagaggg

SEQ ID NO: 5217022 - DNA, 20 bp, Homo sapiens
agggacagagggggtggcct

SEQ ID NO: 5217023 - DNA, 22 bp, Homo sapiens
agggacagagggggtggcctcc

SEQ ID NO: 5217024 - DNA, 19 bp, Homo sapiens
agggacagcaagtgagcag

SEQ ID NO: 5217025 - DNA, 15 bp, Homo sapiens
agggacagcagcctc

SEQ ID NO: 5217026 - DNA, 23 bp, Homo sapiens
agggacagcagcctccctgtcac

SEQ ID NO: 5217027 - DNA, 20 bp, Homo sapiens
agggacagccaaaagtaagt

SEQ ID NO: 5217028 - DNA, 22 bp, Homo sapiens
agggacagcccacggtctggag

SEQ ID NO: 5217029 - DNA, 21 bp, Homo sapiens
agggacagcgggtaaaaagag

SEQ ID NO: 5217030 - DNA, 15 bp, Homo sapiens
agggacagctgctgg

SEQ ID NO: 5217031 - DNA, 13 bp, Homo sapiens
agggacaggaccc

SEQ ID NO: 5217032 - DNA, 18 bp, Homo sapiens
agggacaggaccccagct

SEQ ID NO: 5217033 - DNA, 17 bp, Homo sapiens
agggacaggagaagaga

SEQ ID NO: 5217034 - DNA, 13 bp, Homo sapiens
agggacaggctga

SEQ ID NO: 5217035 - DNA, 16 bp, Homo sapiens
agggacaggctgaaga

SEQ ID NO: 5217036 - DNA, 18 bp, Homo sapiens
agggacaggctgaagaga

SEQ ID NO: 5217037 - DNA, 19 bp, Homo sapiens
agggacaggctgaagagag

SEQ ID NO: 5217038 - DNA, 16 bp, Homo sapiens
agggacagggcaggcg

SEQ ID NO: 5217039 - DNA, 13 bp, Homo sapiens
agggacagggtct

SEQ ID NO: 5217040 - DNA, 19 bp, Homo sapiens
agggacaggtgggcctggc

SEQ ID NO: 5217041 - DNA, 20 bp, Homo sapiens
agggacaggtgggcctggcg

SEQ ID NO: 5217042 - DNA, 21 bp, Homo sapiens
agggacaggtgggcctggcgg

SEQ ID NO: 5217043 - DNA, 23 bp, Homo sapiens
agggacaggtgggcctggcggcc

SEQ ID NO: 5217044 - DNA, 15 bp, Homo sapiens
agggacagtgggcta

SEQ ID NO: 5217045 - DNA, 20 bp, Homo sapiens
agggacagttgggtgtgaga

SEQ ID NO: 5217046 - DNA, 23 bp, Homo sapiens
agggacagttgggtgtgagaata

SEQ ID NO: 5217047 - DNA, 16 bp, Homo sapiens
agggacagtttgtaac

SEQ ID NO: 5217048 - DNA, 17 bp, Homo sapiens
agggacatatcagtgac

SEQ ID NO: 5217049 - DNA, 15 bp, Homo sapiens
agggacatattcatt

SEQ ID NO: 5217050 - DNA, 23 bp, Homo sapiens
agggacatattcatttggaaata

SEQ ID NO: 5217051 - DNA, 16 bp, Homo sapiens
agggacatgccctgtg

SEQ ID NO: 5217052 - DNA, 18 bp, Homo sapiens
agggacatgccctgtgtg

SEQ ID NO: 5217053 - DNA, 20 bp, Homo sapiens
agggacatgccctgtgtggc

SEQ ID NO: 5217054 - DNA, 22 bp, Homo sapiens
agggacatgccctgtgtggctg

SEQ ID NO: 5217055 - DNA, 19 bp, Homo sapiens
agggacatgcttagcagtc

SEQ ID NO: 5217056 - DNA, 12 bp, Homo sapiens
agggacatgggg

SEQ ID NO: 5217057 - DNA, 23 bp, Homo sapiens
agggacatggggcaagccagggc

SEQ ID NO: 5217058 - DNA, 24 bp, Homo sapiens
agggacatgttttgataaagtagt

SEQ ID NO: 5217059 - DNA, 17 bp, Homo sapiens
agggacattgaagtgtt

SEQ ID NO: 5217060 - DNA, 17 bp, Homo sapiens
agggacattgcagagtg

SEQ ID NO: 5217061 - DNA, 16 bp, Homo sapiens
agggacatttccaagc

SEQ ID NO: 5217062 - DNA, 18 bp, Homo sapiens
agggacatttccaagctg

SEQ ID NO: 5217063 - DNA, 19 bp, Homo sapiens
agggacatttccaagctgt

SEQ ID NO: 5217064 - DNA, 19 bp, Homo sapiens
agggaccaaggacccctca

SEQ ID NO: 5217065 - DNA, 13 bp, Homo sapiens
agggaccaaggca

SEQ ID NO: 5217066 - DNA, 19 bp, Homo sapiens
agggaccacatccacccca

SEQ ID NO: 5217067 - DNA, 21 bp, Homo sapiens
agggaccacatccaccccagc

SEQ ID NO: 5217068 - DNA, 23 bp, Homo sapiens
agggaccacatccaccccagccc

SEQ ID NO: 5217069 - DNA, 13 bp, Homo sapiens
agggaccaccctc

SEQ ID NO: 5217070 - DNA, 20 bp, Homo sapiens
agggaccagccaagagggct

SEQ ID NO: 5217071 - DNA, 11 bp, Homo sapiens
agggaccagct

SEQ ID NO: 5217072 - DNA, 13 bp, Homo sapiens
agggaccagctcc

SEQ ID NO: 5217073 - DNA, 14 bp, Homo sapiens
agggaccagctccc

SEQ ID NO: 5217074 - DNA, 20 bp, Homo sapiens
agggaccaggtgtctagagg

SEQ ID NO: 5217075 - DNA, 17 bp, Homo sapiens
agggaccatctgctgca

SEQ ID NO: 5217076 - DNA, 20 bp, Homo sapiens
agggaccatctgctgcagtt

SEQ ID NO: 5217077 - DNA, 15 bp, Homo sapiens
agggacccaaagcag

SEQ ID NO: 5217078 - DNA, 17 bp, Homo sapiens
agggacccacctgctag

SEQ ID NO: 5217079 - DNA, 17 bp, Homo sapiens
agggacccaggtgtgcc

SEQ ID NO: 5217080 - DNA, 13 bp, Homo sapiens
agggaccccagat

SEQ ID NO: 5217081 - DNA, 20 bp, Homo sapiens
agggaccccagatacctgtg

SEQ ID NO: 5217082 - DNA, 15 bp, Homo sapiens
agggacccccagaac

SEQ ID NO: 5217083 - DNA, 16 bp, Homo sapiens
agggacccccgaggcc

SEQ ID NO: 5217084 - DNA, 13 bp, Homo sapiens
agggacccctcct

SEQ ID NO: 5217085 - DNA, 15 bp, Homo sapiens
agggacccctcctcc

SEQ ID NO: 5217086 - DNA, 19 bp, Homo sapiens
agggacccctcgccccagc

SEQ ID NO: 5217087 - DNA, 18 bp, Homo sapiens
agggacccgaagcccagg

SEQ ID NO: 5217088 - DNA, 19 bp, Homo sapiens
agggacccttgcctgcctc

SEQ ID NO: 5217089 - DNA, 21 bp, Homo sapiens
agggacccttgcctgcctcct

SEQ ID NO: 5217090 - DNA, 15 bp, Homo sapiens
agggaccctttgggg

SEQ ID NO: 5217091 - DNA, 16 bp, Homo sapiens
agggaccctttggggg

SEQ ID NO: 5217092 - DNA, 15 bp, Homo sapiens
agggaccggcagagc

SEQ ID NO: 5217093 - DNA, 21 bp, Homo sapiens
agggaccggtgctgcaggagt

SEQ ID NO: 5217094 - DNA, 19 bp, Homo sapiens
agggacctactgaacccag

SEQ ID NO: 5217095 - DNA, 13 bp, Homo sapiens
agggacctcaggg

SEQ ID NO: 5217096 - DNA, 21 bp, Homo sapiens
agggacctgagagcatctcag

SEQ ID NO: 5217097 - DNA, 14 bp, Homo sapiens
agggacctgctgct

SEQ ID NO: 5217098 - DNA, 14 bp, Homo sapiens
agggacctggggaa

SEQ ID NO: 5217099 - DNA, 22 bp, Homo sapiens
agggacgagcagagcgcagccc

SEQ ID NO: 5217100 - DNA, 19 bp, Homo sapiens
agggacgcacagcactgcc

SEQ ID NO: 5217101 - DNA, 13 bp, Homo sapiens
agggacgcctggg

SEQ ID NO: 5217102 - DNA, 19 bp, Homo sapiens
agtaaaagtcataaatgca

SEQ ID NO: 5217103 - DNA, 16 bp, Homo sapiens
agtaaaagtcttctcc

SEQ ID NO: 5217104 - DNA, 18 bp, Homo sapiens
agtaaaagtggtctctgc

SEQ ID NO: 5217105 - DNA, 22 bp, Homo sapiens
agtaaaagtggtctctgctggg

SEQ ID NO: 5217106 - DNA, 17 bp, Homo sapiens
agtaaaagttatatcta

SEQ ID NO: 5217107 - DNA, 22 bp, Homo sapiens
agtaaaataaatattgtctttt

SEQ ID NO: 5217108 - DNA, 17 bp, Homo sapiens
agtaaaataataatttt

SEQ ID NO: 5217109 - DNA, 17 bp, Homo sapiens
agtaaaatactcttttt

SEQ ID NO: 5217110 - DNA, 11 bp, Homo sapiens
agtaaaatatg

SEQ ID NO: 5217111 - DNA, 13 bp, Homo sapiens
agtaaaatccaca

SEQ ID NO: 5217112 - DNA, 16 bp, Homo sapiens
agtaaaatgtggcagg

SEQ ID NO: 5217113 - DNA, 15 bp, Homo sapiens
agtaaaattacagaa

SEQ ID NO: 5217114 - DNA, 16 bp, Homo sapiens
agtaaaattacagaag

SEQ ID NO: 5217115 - DNA, 18 bp, Homo sapiens
agtaaaattacagaagaa

SEQ ID NO: 5217116 - DNA, 22 bp, Homo sapiens
agtaaaattagaaaaaaacaaa

SEQ ID NO: 5217117 - DNA, 13 bp, Homo sapiens
agtaaaattagag

SEQ ID NO: 5217118 - DNA, 12 bp, Homo sapiens
agtaaaattatc

SEQ ID NO: 5217119 - DNA, 18 bp, Homo sapiens
agtaaaattatcctcttt

SEQ ID NO: 5217120 - DNA, 20 bp, Homo sapiens
agtaaaattatcctctttgt

SEQ ID NO: 5217121 - DNA, 21 bp, Homo sapiens
agtaaaattatcctctttgta

SEQ ID NO: 5217122 - DNA, 19 bp, Homo sapiens
agtaaaattatctgttcta

SEQ ID NO: 5217123 - DNA, 23 bp, Homo sapiens
agtaaaattatctgttctatgga

SEQ ID NO: 5217124 - DNA, 12 bp, Homo sapiens
agtaaaattcag

SEQ ID NO: 5217125 - DNA, 18 bp, Homo sapiens
agtaaaattcagtttttt

SEQ ID NO: 5217126 - DNA, 19 bp, Homo sapiens
agtaaaattgccatattgc

SEQ ID NO: 5217127 - DNA, 15 bp, Homo sapiens
agtaaaattgtttca

SEQ ID NO: 5217128 - DNA, 13 bp, Homo sapiens
agtaaaatttatt

SEQ ID NO: 5217129 - DNA, 16 bp, Homo sapiens
agtaaaatttcaggat

SEQ ID NO: 5217130 - DNA, 15 bp, Homo sapiens
agtaaacaacttgta

SEQ ID NO: 5217131 - DNA, 11 bp, Homo sapiens
agtaaacacca

SEQ ID NO: 5217132 - DNA, 16 bp, Homo sapiens
agtaaacactgtgtat

SEQ ID NO: 5217133 - DNA, 20 bp, Homo sapiens
agtaaacataaaaactgatt

SEQ ID NO: 5217134 - DNA, 17 bp, Homo sapiens
agtaaacggcccaggcc

SEQ ID NO: 5217135 - DNA, 20 bp, Homo sapiens
agtaaacggcccaggccagg

SEQ ID NO: 5217136 - DNA, 21 bp, Homo sapiens
agtaaactactgttaggaaca

SEQ ID NO: 5217137 - DNA, 14 bp, Homo sapiens
agtaaactgaggcc

SEQ ID NO: 5217138 - DNA, 22 bp, Homo sapiens
agtaaactggatactgtactga

SEQ ID NO: 5217139 - DNA, 19 bp, Homo sapiens
agtaaacttcctattttct

SEQ ID NO: 5217140 - DNA, 12 bp, Homo sapiens
agtaaacttgaa

SEQ ID NO: 5217141 - DNA, 13 bp, Homo sapiens
agtaaacttgaaa

SEQ ID NO: 5217142 - DNA, 14 bp, Homo sapiens
agtaaacttgaaaa

SEQ ID NO: 5217143 - DNA, 12 bp, Homo sapiens
agtaaactttct

SEQ ID NO: 5217144 - DNA, 14 bp, Homo sapiens
agtaaactttttgt

SEQ ID NO: 5217145 - DNA, 12 bp, Homo sapiens
agtaaagaaatt

SEQ ID NO: 5217146 - DNA, 22 bp, Homo sapiens
agtaaagaacgtggtcagagta

SEQ ID NO: 5217147 - DNA, 23 bp, Homo sapiens
agtaaagaactgcacatgaagaa

SEQ ID NO: 5217148 - DNA, 13 bp, Homo sapiens
agtaaagacatag

SEQ ID NO: 5217149 - DNA, 14 bp, Homo sapiens
agtaaagagaaact

SEQ ID NO: 5217150 - DNA, 18 bp, Homo sapiens
agtaaagagaaactttgt

SEQ ID NO: 5217151 - DNA, 18 bp, Homo sapiens
agtaaagaggcttccaag

SEQ ID NO: 5217152 - DNA, 22 bp, Homo sapiens
agtaaagaggcttccaagcatt

SEQ ID NO: 5217153 - DNA, 17 bp, Homo sapiens
agtaaagagtacactca

SEQ ID NO: 5217154 - DNA, 18 bp, Homo sapiens
agtaaagagtacactcag

SEQ ID NO: 5217155 - DNA, 13 bp, Homo sapiens
agtaaagataaaa

SEQ ID NO: 5217156 - DNA, 14 bp, Homo sapiens
agtaaagataaaag

SEQ ID NO: 5217157 - DNA, 16 bp, Homo sapiens
agtaaagataaaagga

SEQ ID NO: 5217158 - DNA, 22 bp, Homo sapiens
agtaaagatatttgaatatgta

SEQ ID NO: 5217159 - DNA, 18 bp, Homo sapiens
agtaaagccgttgtttac

SEQ ID NO: 5217160 - DNA, 17 bp, Homo sapiens
agtaaagcttttctttt

SEQ ID NO: 5217161 - DNA, 18 bp, Homo sapiens
agtaaaggcattccacag

SEQ ID NO: 5217162 - DNA, 20 bp, Homo sapiens
agtaaaggcctcatctcctt

SEQ ID NO: 5217163 - DNA, 17 bp, Homo sapiens
agtaaaggcctcctccc

SEQ ID NO: 5217164 - DNA, 18 bp, Homo sapiens
agtaaagtacaagctgta

SEQ ID NO: 5217165 - DNA, 16 bp, Homo sapiens
agtaaagtcaaggaga

SEQ ID NO: 5217166 - DNA, 13 bp, Homo sapiens
agtaaagtctggg

SEQ ID NO: 5217167 - DNA, 14 bp, Homo sapiens
agtaaagtgaagaa

SEQ ID NO: 5217168 - DNA, 20 bp, Homo sapiens
agtaaagtgaagaatttatc

SEQ ID NO: 5217169 - DNA, 21 bp, Homo sapiens
agtaaagtgtaacatatgcaa

SEQ ID NO: 5217170 - DNA, 23 bp, Homo sapiens
agtaaagttccacttagagaaca

SEQ ID NO: 5217171 - DNA, 12 bp, Homo sapiens
agtaaagtttaa

SEQ ID NO: 5217172 - DNA, 16 bp, Homo sapiens
agtaaagtttaaaaaa

SEQ ID NO: 5217173 - DNA, 18 bp, Homo sapiens
agtaaagtttaaaaaata

SEQ ID NO: 5217174 - DNA, 21 bp, Homo sapiens
agtaaagtttaaaaaatacac

SEQ ID NO: 5217175 - DNA, 18 bp, Homo sapiens
agtaaagtttatttcatg

SEQ ID NO: 5217176 - DNA, 23 bp, Homo sapiens
agtaaataaactcttcaaggcca

SEQ ID NO: 5217177 - DNA, 14 bp, Homo sapiens
agtaaataaactgt

SEQ ID NO: 5217178 - DNA, 16 bp, Homo sapiens
agtaaataaactgttt

SEQ ID NO: 5217179 - DNA, 17 bp, Homo sapiens
agtaaataaactgttta

SEQ ID NO: 5217180 - DNA, 16 bp, Homo sapiens
agtaaataaattgttt

SEQ ID NO: 5217181 - DNA, 14 bp, Homo sapiens
agtaaataatgaaa

SEQ ID NO: 5217182 - DNA, 21 bp, Homo sapiens
agtaaataatgattcaatgtg

SEQ ID NO: 5217183 - DNA, 15 bp, Homo sapiens
agtaaataattggaa

SEQ ID NO: 5217184 - DNA, 20 bp, Homo sapiens
agtaaatacaagactgttgt

SEQ ID NO: 5217185 - DNA, 15 bp, Homo sapiens
agtaaatatacactt

SEQ ID NO: 5217186 - DNA, 20 bp, Homo sapiens
agtaaatatacactttacat

SEQ ID NO: 5217187 - DNA, 21 bp, Homo sapiens
agtaaatatatatgtcaatat

SEQ ID NO: 5217188 - DNA, 16 bp, Homo sapiens
agtaaatatattatat

SEQ ID NO: 5217189 - DNA, 18 bp, Homo sapiens
agtaaatatgtgaagaaa

SEQ ID NO: 5217190 - DNA, 20 bp, Homo sapiens
agtaaatattatgattttat

SEQ ID NO: 5217191 - DNA, 23 bp, Homo sapiens
agtaaatattatgattttattta

SEQ ID NO: 5217192 - DNA, 17 bp, Homo sapiens
agtaaatcagaaagtaa

SEQ ID NO: 5217193 - DNA, 17 bp, Homo sapiens
agtaaatcagatgttga

SEQ ID NO: 5217194 - DNA, 17 bp, Homo sapiens
agtaaatccacagccaa

SEQ ID NO: 5217195 - DNA, 20 bp, Homo sapiens
agtaaatccaggctttatgt

SEQ ID NO: 5217196 - DNA, 18 bp, Homo sapiens
agtaaatctaaattaact

SEQ ID NO: 5217197 - DNA, 16 bp, Homo sapiens
agtaaatctatctcta

SEQ ID NO: 5217198 - DNA, 17 bp, Homo sapiens
agtaaatctatctctat

SEQ ID NO: 5217199 - DNA, 16 bp, Homo sapiens
agtaaatctcttctgt

SEQ ID NO: 5217200 - DNA, 14 bp, Homo sapiens
agtaaatctctttt

SEQ ID NO: 5217201 - DNA, 20 bp, Homo sapiens
agtaaatctctttttaagat

SEQ ID NO: 5217202 - DNA, 15 bp, Homo sapiens
agtaaatcttttaca

SEQ ID NO: 5217203 - DNA, 20 bp, Homo sapiens
agtaaatgggggtgcatttg

SEQ ID NO: 5217204 - DNA, 21 bp, Homo sapiens
agtaaatgggggtgcatttga

SEQ ID NO: 5217205 - DNA, 12 bp, Homo sapiens
agtaaatgtagt

SEQ ID NO: 5217206 - DNA, 14 bp, Homo sapiens
agtaaatgtagttc

SEQ ID NO: 5217207 - DNA, 16 bp, Homo sapiens
agtaaatgtatattga

SEQ ID NO: 5217208 - DNA, 18 bp, Homo sapiens
agtaaatgtctttgtaag

SEQ ID NO: 5217209 - DNA, 19 bp, Homo sapiens
agtaaatgtctttgtaagt

SEQ ID NO: 5217210 - DNA, 16 bp, Homo sapiens
agtaaatgttacttct

SEQ ID NO: 5217211 - DNA, 23 bp, Homo sapiens
agtaaatgttatcttatactgta

SEQ ID NO: 5217212 - DNA, 17 bp, Homo sapiens
agtaaattaaacatttt

SEQ ID NO: 5217213 - DNA, 14 bp, Homo sapiens
agtaaattaagagc

SEQ ID NO: 5217214 - DNA, 15 bp, Homo sapiens
agtaaattaagagca

SEQ ID NO: 5217215 - DNA, 17 bp, Homo sapiens
agtaaattcctaattct

SEQ ID NO: 5217216 - DNA, 13 bp, Homo sapiens
agtaaattgcctt

SEQ ID NO: 5217217 - DNA, 14 bp, Homo sapiens
agtaaattgctctg

SEQ ID NO: 5217218 - DNA, 16 bp, Homo sapiens
agtaaatttgtccaat

SEQ ID NO: 5217219 - DNA, 17 bp, Homo sapiens
agtaaattttgtgatga

SEQ ID NO: 5217220 - DNA, 22 bp, Homo sapiens
agtaaattttgtgatgaataaa

SEQ ID NO: 5217221 - DNA, 12 bp, Homo sapiens
agtaacaaaaat

SEQ ID NO: 5217222 - DNA, 15 bp, Homo sapiens
agtaacaaaaataaa

SEQ ID NO: 5217223 - DNA, 22 bp, Homo sapiens
agtaacaaaagtatagttttga

SEQ ID NO: 5217224 - DNA, 15 bp, Homo sapiens
agtaacaaataaata

SEQ ID NO: 5217225 - DNA, 20 bp, Homo sapiens
agtaacaatacaaatggatt

SEQ ID NO: 5217226 - DNA, 17 bp, Homo sapiens
agtaacacagattattc

SEQ ID NO: 5217227 - DNA, 22 bp, Homo sapiens
agtaacacagattattcatctt

SEQ ID NO: 5217228 - DNA, 13 bp, Homo sapiens
agtaacacataaa

SEQ ID NO: 5217229 - DNA, 21 bp, Homo sapiens
agtaacactgtgatttatctt

SEQ ID NO: 5217230 - DNA, 12 bp, Homo sapiens
agtaacagggca

SEQ ID NO: 5217231 - DNA, 20 bp, Homo sapiens
agtaacagtcatcatttatc

SEQ ID NO: 5217232 - DNA, 15 bp, Homo sapiens
agtaacataataaat

SEQ ID NO: 5217233 - DNA, 11 bp, Homo sapiens
agtaacatata

SEQ ID NO: 5217234 - DNA, 19 bp, Homo sapiens
agtaacatataaattaata

SEQ ID NO: 5217235 - DNA, 20 bp, Homo sapiens
agtaacatgacttccttatt

SEQ ID NO: 5217236 - DNA, 17 bp, Homo sapiens
agtaacatgcaacaaaa

SEQ ID NO: 5217237 - DNA, 16 bp, Homo sapiens
agtaacatgccagctt

SEQ ID NO: 5217238 - DNA, 18 bp, Homo sapiens
agtaacattcatgttcta

SEQ ID NO: 5217239 - DNA, 16 bp, Homo sapiens
agtaacatttctgttc

SEQ ID NO: 5217240 - DNA, 17 bp, Homo sapiens
agtaacattttttggaa

SEQ ID NO: 5217241 - DNA, 18 bp, Homo sapiens
agtaaccaaaacagcata

SEQ ID NO: 5217242 - DNA, 20 bp, Homo sapiens
agtaaccaatttctttctaa

SEQ ID NO: 5217243 - DNA, 16 bp, Homo sapiens
agtaaccagaaatctt

SEQ ID NO: 5217244 - DNA, 21 bp, Homo sapiens
agtaaccatttcagtgtattg

SEQ ID NO: 5217245 - DNA, 16 bp, Homo sapiens
agtaaccattttcctt

SEQ ID NO: 5217246 - DNA, 17 bp, Homo sapiens
agtaaccattttccttt

SEQ ID NO: 5217247 - DNA, 20 bp, Homo sapiens
agtaacccccactggactga

SEQ ID NO: 5217248 - DNA, 19 bp, Homo sapiens
agtaacccccttaaattta

SEQ ID NO: 5217249 - DNA, 21 bp, Homo sapiens
agtaacccccttaaatttaat

SEQ ID NO: 5217250 - DNA, 14 bp, Homo sapiens
agtaacccctcctg

SEQ ID NO: 5217251 - DNA, 17 bp, Homo sapiens
agtaacccctcctggct

SEQ ID NO: 5217252 - DNA, 16 bp, Homo sapiens
agtaacctagtgaatt

SEQ ID NO: 5217253 - DNA, 20 bp, Homo sapiens
agtaacctctacaggcattt

SEQ ID NO: 5217254 - DNA, 12 bp, Homo sapiens
agtaacctgggt

SEQ ID NO: 5217255 - DNA, 16 bp, Homo sapiens
agtaacctttaaaaat

SEQ ID NO: 5217256 - DNA, 20 bp, Homo sapiens
agtaacctttaaaaatgtat

SEQ ID NO: 5217257 - DNA, 23 bp, Homo sapiens
agtaaccttttgcacctgctctc

SEQ ID NO: 5217258 - DNA, 14 bp, Homo sapiens
agtaacgagaagac

SEQ ID NO: 5217259 - DNA, 17 bp, Homo sapiens
agtaacgagaagtgctt

SEQ ID NO: 5217260 - DNA, 18 bp, Homo sapiens
agtaacgagaagtgcttt

SEQ ID NO: 5217261 - DNA, 18 bp, Homo sapiens
agtaacgcgtcttcctga

SEQ ID NO: 5217262 - DNA, 22 bp, Homo sapiens
agtaacgcgtcttcctgagtgg

SEQ ID NO: 5217263 - DNA, 20 bp, Homo sapiens
agtaacgtacatttgtgctg

SEQ ID NO: 5217264 - DNA, 17 bp, Homo sapiens
agtaacgtgctcactgt

SEQ ID NO: 5217265 - DNA, 18 bp, Homo sapiens
agtaacgtgctcactgtg

SEQ ID NO: 5217266 - DNA, 17 bp, Homo sapiens
agtaacgtgctgctcaa

SEQ ID NO: 5217267 - DNA, 17 bp, Homo sapiens
agtaacgttttccttgt

SEQ ID NO: 5217268 - DNA, 16 bp, Homo sapiens
agtaactaattttgtt

SEQ ID NO: 5217269 - DNA, 19 bp, Homo sapiens
agtaactaattttgttgaa

SEQ ID NO: 5217270 - DNA, 19 bp, Homo sapiens
agtaactacagttagggct

SEQ ID NO: 5217271 - DNA, 19 bp, Homo sapiens
agtaactactttttatact

SEQ ID NO: 5217272 - DNA, 20 bp, Homo sapiens
agtaactactttttatactc

SEQ ID NO: 5217273 - DNA, 21 bp, Homo sapiens
agtaactactttttatactcc

SEQ ID NO: 5217274 - DNA, 17 bp, Homo sapiens
agtaactcattgctctg

SEQ ID NO: 5217275 - DNA, 14 bp, Homo sapiens
agtaactgacaact

SEQ ID NO: 5217276 - DNA, 14 bp, Homo sapiens
agtaactgacatga

SEQ ID NO: 5217277 - DNA, 13 bp, Homo sapiens
agtaactgctgtc

SEQ ID NO: 5217278 - DNA, 23 bp, Homo sapiens
agtaactggttgtcacctatgag

SEQ ID NO: 5217279 - DNA, 14 bp, Homo sapiens
agtaactgtccctg

SEQ ID NO: 5217280 - DNA, 12 bp, Homo sapiens
agtaactgtgct

SEQ ID NO: 5217281 - DNA, 24 bp, Homo sapiens
agtaactgtgctgtactgagcact

SEQ ID NO: 5217282 - DNA, 22 bp, Homo sapiens
agggacgcctgggggtgccagg

SEQ ID NO: 5217283 - DNA, 16 bp, Homo sapiens
agggacgcggaggagg

SEQ ID NO: 5217284 - DNA, 14 bp, Homo sapiens
agggacgctttgtc

SEQ ID NO: 5217285 - DNA, 19 bp, Homo sapiens
agggacgtctcatctccca

SEQ ID NO: 5217286 - DNA, 17 bp, Homo sapiens
agggactcaagggaaag

SEQ ID NO: 5217287 - DNA, 17 bp, Homo sapiens
agggactcatctttccc

SEQ ID NO: 5217288 - DNA, 18 bp, Homo sapiens
agggactcatctttccct

SEQ ID NO: 5217289 - DNA, 13 bp, Homo sapiens
agggactccaagc

SEQ ID NO: 5217290 - DNA, 20 bp, Homo sapiens
agggactccaagccctgggg

SEQ ID NO: 5217291 - DNA, 22 bp, Homo sapiens
agggactccaagccctggggca

SEQ ID NO: 5217292 - DNA, 19 bp, Homo sapiens
agggactccagaagcagca

SEQ ID NO: 5217293 - DNA, 21 bp, Homo sapiens
agggactccagaagcagcagc

SEQ ID NO: 5217294 - DNA, 12 bp, Homo sapiens
agggactctcca

SEQ ID NO: 5217295 - DNA, 19 bp, Homo sapiens
agggactctgaagcctctg

SEQ ID NO: 5217296 - DNA, 20 bp, Homo sapiens
agggactctgaagcctctgg

SEQ ID NO: 5217297 - DNA, 15 bp, Homo sapiens
agggactctgggctg

SEQ ID NO: 5217298 - DNA, 14 bp, Homo sapiens
agggactctgtctg

SEQ ID NO: 5217299 - DNA, 15 bp, Homo sapiens
agggactgagaaatt

SEQ ID NO: 5217300 - DNA, 16 bp, Homo sapiens
agggactgaggcaagc

SEQ ID NO: 5217301 - DNA, 15 bp, Homo sapiens
agggactgaggggag

SEQ ID NO: 5217302 - DNA, 20 bp, Homo sapiens
agggactgcagctgcaccag

SEQ ID NO: 5217303 - DNA, 18 bp, Homo sapiens
agggactgcctctgccac

SEQ ID NO: 5217304 - DNA, 22 bp, Homo sapiens
agggactgctgacccaccaagg

SEQ ID NO: 5217305 - DNA, 17 bp, Homo sapiens
agggactggacagccag

SEQ ID NO: 5217306 - DNA, 17 bp, Homo sapiens
agggactggtccaggca

SEQ ID NO: 5217307 - DNA, 19 bp, Homo sapiens
agggactggtccaggcatg

SEQ ID NO: 5217308 - DNA, 18 bp, Homo sapiens
agggactgtacctgtagg

SEQ ID NO: 5217309 - DNA, 21 bp, Homo sapiens
agggactgtacctgtaggaaa

SEQ ID NO: 5217310 - DNA, 16 bp, Homo sapiens
agggactgtatttctg

SEQ ID NO: 5217311 - DNA, 20 bp, Homo sapiens
agggactgtatttctgtgga

SEQ ID NO: 5217312 - DNA, 21 bp, Homo sapiens
agggactgtatttctgtggaa

SEQ ID NO: 5217313 - DNA, 21 bp, Homo sapiens
agggactgtcacactggtgct

SEQ ID NO: 5217314 - DNA, 13 bp, Homo sapiens
agggactgtccta

SEQ ID NO: 5217315 - DNA, 19 bp, Homo sapiens
agggactgtcctagccagg

SEQ ID NO: 5217316 - DNA, 12 bp, Homo sapiens
agggacttaaaa

SEQ ID NO: 5217317 - DNA, 17 bp, Homo sapiens
agggacttaaaaaactt

SEQ ID NO: 5217318 - DNA, 20 bp, Homo sapiens
agggacttccctagaagtct

SEQ ID NO: 5217319 - DNA, 21 bp, Homo sapiens
agggacttcctctttctctcc

SEQ ID NO: 5217320 - DNA, 21 bp, Homo sapiens
agggacttcgcagaggcaagc

SEQ ID NO: 5217321 - DNA, 16 bp, Homo sapiens
agggacttgaagttgt

SEQ ID NO: 5217322 - DNA, 18 bp, Homo sapiens
agggacttgcctccactc

SEQ ID NO: 5217323 - DNA, 18 bp, Homo sapiens
agggacttggaagctccg

SEQ ID NO: 5217324 - DNA, 19 bp, Homo sapiens
agggacttggaagctccgc

SEQ ID NO: 5217325 - DNA, 16 bp, Homo sapiens
agggacttggctgtcc

SEQ ID NO: 5217326 - DNA, 23 bp, Homo sapiens
agggacttggctgtccttcccct

SEQ ID NO: 5217327 - DNA, 12 bp, Homo sapiens
agggagaaaaga

SEQ ID NO: 5217328 - DNA, 15 bp, Homo sapiens
agggagaaaagagaa

SEQ ID NO: 5217329 - DNA, 14 bp, Homo sapiens
agggagaaacccac

SEQ ID NO: 5217330 - DNA, 13 bp, Homo sapiens
agggagaaactcc

SEQ ID NO: 5217331 - DNA, 21 bp, Homo sapiens
agggagaaaggaggagacaga

SEQ ID NO: 5217332 - DNA, 12 bp, Homo sapiens
agggagaaatgc

SEQ ID NO: 5217333 - DNA, 13 bp, Homo sapiens
agggagaaatgtt

SEQ ID NO: 5217334 - DNA, 17 bp, Homo sapiens
agggagaagaaatccat

SEQ ID NO: 5217335 - DNA, 15 bp, Homo sapiens
agggagaagaagtca

SEQ ID NO: 5217336 - DNA, 14 bp, Homo sapiens
agggagaagacact

SEQ ID NO: 5217337 - DNA, 19 bp, Homo sapiens
agggagaagacactgcagt

SEQ ID NO: 5217338 - DNA, 16 bp, Homo sapiens
agggagaagagaaaat

SEQ ID NO: 5217339 - DNA, 13 bp, Homo sapiens
agggagaagctcc

SEQ ID NO: 5217340 - DNA, 18 bp, Homo sapiens
agggagaaggaagggcag

SEQ ID NO: 5217341 - DNA, 14 bp, Homo sapiens
agggagaagggaga

SEQ ID NO: 5217342 - DNA, 16 bp, Homo sapiens
agggagaatcctccct

SEQ ID NO: 5217343 - DNA, 23 bp, Homo sapiens
agggagaatcctcccttcccagg

SEQ ID NO: 5217344 - DNA, 14 bp, Homo sapiens
agggagaatgttgt

SEQ ID NO: 5217345 - DNA, 20 bp, Homo sapiens
agggagacactggcccctca

SEQ ID NO: 5217346 - DNA, 14 bp, Homo sapiens
agggagacagacca

SEQ ID NO: 5217347 - DNA, 16 bp, Homo sapiens
agggagacagaccact

SEQ ID NO: 5217348 - DNA, 23 bp, Homo sapiens
agggagacagccaggtggcacct

SEQ ID NO: 5217349 - DNA, 13 bp, Homo sapiens
agggagacaggcc

SEQ ID NO: 5217350 - DNA, 21 bp, Homo sapiens
agggagacctggacacaggcc

SEQ ID NO: 5217351 - DNA, 15 bp, Homo sapiens
agggagacggccctg

SEQ ID NO: 5217352 - DNA, 14 bp, Homo sapiens
agggagactcctgg

SEQ ID NO: 5217353 - DNA, 23 bp, Homo sapiens
agggagactgaccatcatgccct

SEQ ID NO: 5217354 - DNA, 18 bp, Homo sapiens
agggagactgcatctcaa

SEQ ID NO: 5217355 - DNA, 23 bp, Homo sapiens
agggagactgtggtaggggcagg

SEQ ID NO: 5217356 - DNA, 15 bp, Homo sapiens
agggagactttctga

SEQ ID NO: 5217357 - DNA, 12 bp, Homo sapiens
agggagagaaaa

SEQ ID NO: 5217358 - DNA, 20 bp, Homo sapiens
agggagagaactgagcatct

SEQ ID NO: 5217359 - DNA, 13 bp, Homo sapiens
agggagagaagat

SEQ ID NO: 5217360 - DNA, 14 bp, Homo sapiens
agggagagaagata

SEQ ID NO: 5217361 - DNA, 10 bp, Homo sapiens
agggagagag

SEQ ID NO: 5217362 - DNA, 14 bp, Homo sapiens
agggagagagaagc

SEQ ID NO: 5217363 - DNA, 22 bp, Homo sapiens
agggagagagagagagagagga

SEQ ID NO: 5217364 - DNA, 23 bp, Homo sapiens
agggagagagagagagagaggac

SEQ ID NO: 5217365 - DNA, 23 bp, Homo sapiens
agggagagcacctgttgtgtgcc

SEQ ID NO: 5217366 - DNA, 14 bp, Homo sapiens
agggagagccctgt

SEQ ID NO: 5217367 - DNA, 23 bp, Homo sapiens
agggagagccctgtccctgccct

SEQ ID NO: 5217368 - DNA, 14 bp, Homo sapiens
agggagagcctctg

SEQ ID NO: 5217369 - DNA, 20 bp, Homo sapiens
agggagagctcaccatggaa

SEQ ID NO: 5217370 - DNA, 23 bp, Homo sapiens
agggagagctgggcagacaggtg

SEQ ID NO: 5217371 - DNA, 17 bp, Homo sapiens
agggagaggaagcacac

SEQ ID NO: 5217372 - DNA, 23 bp, Homo sapiens
agggagaggctgtggtggctgtc

SEQ ID NO: 5217373 - DNA, 19 bp, Homo sapiens
agggagaggctgtgtccct

SEQ ID NO: 5217374 - DNA, 15 bp, Homo sapiens
agggagagggaggga

SEQ ID NO: 5217375 - DNA, 15 bp, Homo sapiens
agggagagggcctct

SEQ ID NO: 5217376 - DNA, 13 bp, Homo sapiens
agggagaggtcac

SEQ ID NO: 5217377 - DNA, 21 bp, Homo sapiens
agggagaggttattcacaacc

SEQ ID NO: 5217378 - DNA, 19 bp, Homo sapiens
agggagagtcatattttga

SEQ ID NO: 5217379 - DNA, 22 bp, Homo sapiens
agggagagtctcccagggagca

SEQ ID NO: 5217380 - DNA, 15 bp, Homo sapiens
agggagcaagacaga

SEQ ID NO: 5217381 - DNA, 17 bp, Homo sapiens
agggagcaagacagaga

SEQ ID NO: 5217382 - DNA, 16 bp, Homo sapiens
agggagcacctgtctg

SEQ ID NO: 5217383 - DNA, 14 bp, Homo sapiens
agggagcagccccc

SEQ ID NO: 5217384 - DNA, 19 bp, Homo sapiens
agggagcaggcggtgggca

SEQ ID NO: 5217385 - DNA, 14 bp, Homo sapiens
agggagcatggctg

SEQ ID NO: 5217386 - DNA, 10 bp, Homo sapiens
agggagccaa

SEQ ID NO: 5217387 - DNA, 17 bp, Homo sapiens
agggagccatttgagag

SEQ ID NO: 5217388 - DNA, 19 bp, Homo sapiens
agggagcccctaggaaagc

SEQ ID NO: 5217389 - DNA, 13 bp, Homo sapiens
agggagcccctcc

SEQ ID NO: 5217390 - DNA, 23 bp, Homo sapiens
agggagcccctcctctgagcagc

SEQ ID NO: 5217391 - DNA, 12 bp, Homo sapiens
agggagccctga

SEQ ID NO: 5217392 - DNA, 21 bp, Homo sapiens
agggagccggcggcctctcga

SEQ ID NO: 5217393 - DNA, 16 bp, Homo sapiens
agggagcctcctgccc

SEQ ID NO: 5217394 - DNA, 15 bp, Homo sapiens
agggagcgaggtcag

SEQ ID NO: 5217395 - DNA, 16 bp, Homo sapiens
agggagcgaggtcaga

SEQ ID NO: 5217396 - DNA, 22 bp, Homo sapiens
agggagcgatccaggggaagcc

SEQ ID NO: 5217397 - DNA, 13 bp, Homo sapiens
agggagcggcatg

SEQ ID NO: 5217398 - DNA, 19 bp, Homo sapiens
agggagcggccggccagcc

SEQ ID NO: 5217399 - DNA, 21 bp, Homo sapiens
agggagcggccggccagcccc

SEQ ID NO: 5217400 - DNA, 20 bp, Homo sapiens
agggagctaaattgaataca

SEQ ID NO: 5217401 - DNA, 15 bp, Homo sapiens
agggagctagccaga

SEQ ID NO: 5217402 - DNA, 21 bp, Homo sapiens
agggagctcttgacagaaagc

SEQ ID NO: 5217403 - DNA, 14 bp, Homo sapiens
agggagctgaggcc

SEQ ID NO: 5217404 - DNA, 23 bp, Homo sapiens
agggagctgaggccattccctgt

SEQ ID NO: 5217405 - DNA, 21 bp, Homo sapiens
agggagctgaggcctcccttg

SEQ ID NO: 5217406 - DNA, 21 bp, Homo sapiens
agggagctgatgccccttctc

SEQ ID NO: 5217407 - DNA, 20 bp, Homo sapiens
agggagctgctggctgacct

SEQ ID NO: 5217408 - DNA, 16 bp, Homo sapiens
agggagctggctccag

SEQ ID NO: 5217409 - DNA, 21 bp, Homo sapiens
agggagctggctccagcctgg

SEQ ID NO: 5217410 - DNA, 16 bp, Homo sapiens
agggagctgggcccga

SEQ ID NO: 5217411 - DNA, 18 bp, Homo sapiens
agggagcttcctggctct

SEQ ID NO: 5217412 - DNA, 17 bp, Homo sapiens
agggagcttgccacact

SEQ ID NO: 5217413 - DNA, 18 bp, Homo sapiens
agggagcttgccacactc

SEQ ID NO: 5217414 - DNA, 22 bp, Homo sapiens
agggagcttgccacactcttct

SEQ ID NO: 5217415 - DNA, 17 bp, Homo sapiens
agggaggaacacctgat

SEQ ID NO: 5217416 - DNA, 23 bp, Homo sapiens
agggaggaagaagcttaggcagg

SEQ ID NO: 5217417 - DNA, 18 bp, Homo sapiens
agggaggaccacaggtgt

SEQ ID NO: 5217418 - DNA, 22 bp, Homo sapiens
agggaggaccagggcagggcca

SEQ ID NO: 5217419 - DNA, 13 bp, Homo sapiens
agggaggacctgg

SEQ ID NO: 5217420 - DNA, 22 bp, Homo sapiens
agggaggacgctctctggcctt

SEQ ID NO: 5217421 - DNA, 23 bp, Homo sapiens
agggaggagaggaaatgctattg

SEQ ID NO: 5217422 - DNA, 13 bp, Homo sapiens
agggaggagcccc

SEQ ID NO: 5217423 - DNA, 16 bp, Homo sapiens
agggaggaggccacct

SEQ ID NO: 5217424 - DNA, 20 bp, Homo sapiens
agggaggaggccacctctcc

SEQ ID NO: 5217425 - DNA, 14 bp, Homo sapiens
agggaggagtggag

SEQ ID NO: 5217426 - DNA, 15 bp, Homo sapiens
agggaggagtggagg

SEQ ID NO: 5217427 - DNA, 21 bp, Homo sapiens
agggaggatgccacagcccca

SEQ ID NO: 5217428 - DNA, 13 bp, Homo sapiens
agggaggcactag

SEQ ID NO: 5217429 - DNA, 19 bp, Homo sapiens
agggaggcactagtcaccg

SEQ ID NO: 5217430 - DNA, 17 bp, Homo sapiens
agggaggcagaaaggga

SEQ ID NO: 5217431 - DNA, 12 bp, Homo sapiens
agggaggcagcc

SEQ ID NO: 5217432 - DNA, 13 bp, Homo sapiens
agggaggcagcgt

SEQ ID NO: 5217433 - DNA, 14 bp, Homo sapiens
agggaggcatctgc

SEQ ID NO: 5217434 - DNA, 15 bp, Homo sapiens
agggaggcatctgca

SEQ ID NO: 5217435 - DNA, 17 bp, Homo sapiens
agggaggcatggtctgc

SEQ ID NO: 5217436 - DNA, 15 bp, Homo sapiens
agggaggccacacgc

SEQ ID NO: 5217437 - DNA, 17 bp, Homo sapiens
agggaggccaggcgggc

SEQ ID NO: 5217438 - DNA, 14 bp, Homo sapiens
agggaggcccagcc

SEQ ID NO: 5217439 - DNA, 14 bp, Homo sapiens
agggaggccgaagc

SEQ ID NO: 5217440 - DNA, 13 bp, Homo sapiens
agggaggcctgag

SEQ ID NO: 5217441 - DNA, 17 bp, Homo sapiens
agggaggcctgaggggc

SEQ ID NO: 5217442 - DNA, 18 bp, Homo sapiens
agggaggcctgaggggca

SEQ ID NO: 5217443 - DNA, 13 bp, Homo sapiens
agggaggcgcagg

SEQ ID NO: 5217444 - DNA, 15 bp, Homo sapiens
agggaggcgcaggga

SEQ ID NO: 5217445 - DNA, 13 bp, Homo sapiens
agggaggcgggga

SEQ ID NO: 5217446 - DNA, 16 bp, Homo sapiens
agggaggcggggagga

SEQ ID NO: 5217447 - DNA, 17 bp, Homo sapiens
agggaggcggggaggag

SEQ ID NO: 5217448 - DNA, 18 bp, Homo sapiens
agggaggcggggaggagg

SEQ ID NO: 5217449 - DNA, 18 bp, Homo sapiens
agggaggctcccggggcc

SEQ ID NO: 5217450 - DNA, 19 bp, Homo sapiens
agggaggctcccggggcct

SEQ ID NO: 5217451 - DNA, 21 bp, Homo sapiens
agggaggctcccggggcctgg

SEQ ID NO: 5217452 - DNA, 22 bp, Homo sapiens
agggaggctcccggggcctgga

SEQ ID NO: 5217453 - DNA, 17 bp, Homo sapiens
agggaggctgggcgggt

SEQ ID NO: 5217454 - DNA, 14 bp, Homo sapiens
agggaggctggtcc

SEQ ID NO: 5217455 - DNA, 14 bp, Homo sapiens
agggaggcttcctg

SEQ ID NO: 5217456 - DNA, 18 bp, Homo sapiens
agggaggcttcctgactg

SEQ ID NO: 5217457 - DNA, 17 bp, Homo sapiens
agggagggaagggccac

SEQ ID NO: 5217458 - DNA, 18 bp, Homo sapiens
agggagggaagggccacc

SEQ ID NO: 5217459 - DNA, 19 bp, Homo sapiens
agggagggaagggccaccc

SEQ ID NO: 5217460 - DNA, 22 bp, Homo sapiens
agggagggaagggccaccctgc

SEQ ID NO: 5217461 - DNA, 16 bp, Homo sapiens
agtaactgttcctact

SEQ ID NO: 5217462 - DNA, 17 bp, Homo sapiens
agtaactgttttttaag

SEQ ID NO: 5217463 - DNA, 23 bp, Homo sapiens
agtaactgttttttaagtctctc

SEQ ID NO: 5217464 - DNA, 14 bp, Homo sapiens
agtaacttaagtta

SEQ ID NO: 5217465 - DNA, 12 bp, Homo sapiens
agtaacttagaa

SEQ ID NO: 5217466 - DNA, 22 bp, Homo sapiens
agtaacttatttgactatgaat

SEQ ID NO: 5217467 - DNA, 16 bp, Homo sapiens
agtaacttattttgta

SEQ ID NO: 5217468 - DNA, 19 bp, Homo sapiens
agtaacttcttatggaatt

SEQ ID NO: 5217469 - DNA, 18 bp, Homo sapiens
agtaacttggttatacat

SEQ ID NO: 5217470 - DNA, 19 bp, Homo sapiens
agtaacttggttatacatg

SEQ ID NO: 5217471 - DNA, 22 bp, Homo sapiens
agtaactttactctgtgtttaa

SEQ ID NO: 5217472 - DNA, 23 bp, Homo sapiens
agtaactttactctgtgtttaaa

SEQ ID NO: 5217473 - DNA, 16 bp, Homo sapiens
agtaactttatgtgta

SEQ ID NO: 5217474 - DNA, 20 bp, Homo sapiens
agtaacttttttgtgtatgt

SEQ ID NO: 5217475 - DNA, 21 bp, Homo sapiens
agtaacttttttgtgtatgta

SEQ ID NO: 5217476 - DNA, 12 bp, Homo sapiens
agtaagaaaata

SEQ ID NO: 5217477 - DNA, 23 bp, Homo sapiens
agtaagaaaatattttgtctaaa

SEQ ID NO: 5217478 - DNA, 12 bp, Homo sapiens
agtaagaaacac

SEQ ID NO: 5217479 - DNA, 17 bp, Homo sapiens
agtaagaaatgggcctc

SEQ ID NO: 5217480 - DNA, 19 bp, Homo sapiens
agtaagaaatgggcctcag

SEQ ID NO: 5217481 - DNA, 18 bp, Homo sapiens
agtaagaaatttcaggtt

SEQ ID NO: 5217482 - DNA, 17 bp, Homo sapiens
agtaagaaatttgcagt

SEQ ID NO: 5217483 - DNA, 14 bp, Homo sapiens
agtaagaacagctc

SEQ ID NO: 5217484 - DNA, 17 bp, Homo sapiens
agtaagaaccttgcctg

SEQ ID NO: 5217485 - DNA, 16 bp, Homo sapiens
agtaagaagacatgaa

SEQ ID NO: 5217486 - DNA, 21 bp, Homo sapiens
agtaagaataccacatcaaat

SEQ ID NO: 5217487 - DNA, 15 bp, Homo sapiens
agtaagaatggccaa

SEQ ID NO: 5217488 - DNA, 22 bp, Homo sapiens
agtaagaccggaagctcctggt

SEQ ID NO: 5217489 - DNA, 12 bp, Homo sapiens
agtaagagctgg

SEQ ID NO: 5217490 - DNA, 11 bp, Homo sapiens
agtaagagctt

SEQ ID NO: 5217491 - DNA, 21 bp, Homo sapiens
agtaagagtactattaataga

SEQ ID NO: 5217492 - DNA, 16 bp, Homo sapiens
agtaagagtggtggcc

SEQ ID NO: 5217493 - DNA, 16 bp, Homo sapiens
agtaagagtttacaag

SEQ ID NO: 5217494 - DNA, 18 bp, Homo sapiens
agtaagagtttacaagaa

SEQ ID NO: 5217495 - DNA, 18 bp, Homo sapiens
agtaagatggttttcaaa

SEQ ID NO: 5217496 - DNA, 12 bp, Homo sapiens
agtaagattgat

SEQ ID NO: 5217497 - DNA, 22 bp, Homo sapiens
agtaagattgatatctataaaa

SEQ ID NO: 5217498 - DNA, 21 bp, Homo sapiens
agtaagattttatccctttct

SEQ ID NO: 5217499 - DNA, 22 bp, Homo sapiens
agtaagattttatccctttctc

SEQ ID NO: 5217500 - DNA, 17 bp, Homo sapiens
agtaagcaccagctgcc

SEQ ID NO: 5217501 - DNA, 21 bp, Homo sapiens
agtaagcaccagctgcctctt

SEQ ID NO: 5217502 - DNA, 22 bp, Homo sapiens
agtaagcaccagctgcctcttt

SEQ ID NO: 5217503 - DNA, 18 bp, Homo sapiens
agtaagcagagttctttg

SEQ ID NO: 5217504 - DNA, 17 bp, Homo sapiens
agtaagcagatgggaac

SEQ ID NO: 5217505 - DNA, 12 bp, Homo sapiens
agtaagcctcat

SEQ ID NO: 5217506 - DNA, 18 bp, Homo sapiens
agtaagcctccctcctcg

SEQ ID NO: 5217507 - DNA, 18 bp, Homo sapiens
agtaagctgctctattgt

SEQ ID NO: 5217508 - DNA, 15 bp, Homo sapiens
agtaaggattttatg

SEQ ID NO: 5217509 - DNA, 21 bp, Homo sapiens
agtaagggaacaagttgagct

SEQ ID NO: 5217510 - DNA, 15 bp, Homo sapiens
agtaagggaagcaga

SEQ ID NO: 5217511 - DNA, 22 bp, Homo sapiens
agtaagggagtcattgccttgg

SEQ ID NO: 5217512 - DNA, 23 bp, Homo sapiens
agtaagggagtcattgccttggg

SEQ ID NO: 5217513 - DNA, 22 bp, Homo sapiens
agtaagggcactgacggactca

SEQ ID NO: 5217514 - DNA, 19 bp, Homo sapiens
agtaagggcgtggctctgg

SEQ ID NO: 5217515 - DNA, 20 bp, Homo sapiens
agtaagggcgtggctctggg

SEQ ID NO: 5217516 - DNA, 20 bp, Homo sapiens
agtaagggtaaaaaagataa

SEQ ID NO: 5217517 - DNA, 15 bp, Homo sapiens
agtaagtaaccatat

SEQ ID NO: 5217518 - DNA, 15 bp, Homo sapiens
agtaagtaagaaaga

SEQ ID NO: 5217519 - DNA, 14 bp, Homo sapiens
agtaagtattatgc

SEQ ID NO: 5217520 - DNA, 12 bp, Homo sapiens
agtaagtcagga

SEQ ID NO: 5217521 - DNA, 20 bp, Homo sapiens
agtaagtcaggacagcttgt

SEQ ID NO: 5217522 - DNA, 15 bp, Homo sapiens
agtaagtctcaaggt

SEQ ID NO: 5217523 - DNA, 23 bp, Homo sapiens
agtaagtcttttttttttccaaa

SEQ ID NO: 5217524 - DNA, 18 bp, Homo sapiens
agtaagtgacactttgaa

SEQ ID NO: 5217525 - DNA, 17 bp, Homo sapiens
agtaagtgataaatcta

SEQ ID NO: 5217526 - DNA, 12 bp, Homo sapiens
agtaagtgctta

SEQ ID NO: 5217527 - DNA, 23 bp, Homo sapiens
agtaagtgtgtcttcctagaatt

SEQ ID NO: 5217528 - DNA, 15 bp, Homo sapiens
agtaagttaatgtat

SEQ ID NO: 5217529 - DNA, 14 bp, Homo sapiens
agtaagttcagcac

SEQ ID NO: 5217530 - DNA, 21 bp, Homo sapiens
agtaagttctgaaaactgttt

SEQ ID NO: 5217531 - DNA, 12 bp, Homo sapiens
agtaagttctgt

SEQ ID NO: 5217532 - DNA, 22 bp, Homo sapiens
agtaagttctgtggttccagta

SEQ ID NO: 5217533 - DNA, 13 bp, Homo sapiens
agtaagtttcatt

SEQ ID NO: 5217534 - DNA, 19 bp, Homo sapiens
agtaagtttcattctaaaa

SEQ ID NO: 5217535 - DNA, 14 bp, Homo sapiens
agtaagtttcccct

SEQ ID NO: 5217536 - DNA, 16 bp, Homo sapiens
agtaagtttcttcctg

SEQ ID NO: 5217537 - DNA, 13 bp, Homo sapiens
agtaataaaacat

SEQ ID NO: 5217538 - DNA, 16 bp, Homo sapiens
agtaataaaacatctt

SEQ ID NO: 5217539 - DNA, 22 bp, Homo sapiens
agtaataaaattcaacaaacat

SEQ ID NO: 5217540 - DNA, 15 bp, Homo sapiens
agtaataaagagaaa

SEQ ID NO: 5217541 - DNA, 15 bp, Homo sapiens
agtaataactgttag

SEQ ID NO: 5217542 - DNA, 14 bp, Homo sapiens
agtaataatgtaat

SEQ ID NO: 5217543 - DNA, 14 bp, Homo sapiens
agtaataatttgta

SEQ ID NO: 5217544 - DNA, 13 bp, Homo sapiens
agtaatacaaact

SEQ ID NO: 5217545 - DNA, 18 bp, Homo sapiens
agtaatacaggattattt

SEQ ID NO: 5217546 - DNA, 20 bp, Homo sapiens
agtaatacattccattgttt

SEQ ID NO: 5217547 - DNA, 22 bp, Homo sapiens
agtaatacctctaatagtataa

SEQ ID NO: 5217548 - DNA, 17 bp, Homo sapiens
agtaatactttttaaat

SEQ ID NO: 5217549 - DNA, 13 bp, Homo sapiens
agtaatagagcaa

SEQ ID NO: 5217550 - DNA, 13 bp, Homo sapiens
agtaatagattgt

SEQ ID NO: 5217551 - DNA, 18 bp, Homo sapiens
agtaatagattgttttgc

SEQ ID NO: 5217552 - DNA, 14 bp, Homo sapiens
agtaatagcctggg

SEQ ID NO: 5217553 - DNA, 12 bp, Homo sapiens
agtaatagctga

SEQ ID NO: 5217554 - DNA, 21 bp, Homo sapiens
agtaatagctgaacctgttca

SEQ ID NO: 5217555 - DNA, 17 bp, Homo sapiens
agtaataggcattttaa

SEQ ID NO: 5217556 - DNA, 14 bp, Homo sapiens
agtaatataataca

SEQ ID NO: 5217557 - DNA, 20 bp, Homo sapiens
agtaatataatggaagagaa

SEQ ID NO: 5217558 - DNA, 15 bp, Homo sapiens
agtaatatattctga

SEQ ID NO: 5217559 - DNA, 17 bp, Homo sapiens
agtaatatatttaaagg

SEQ ID NO: 5217560 - DNA, 14 bp, Homo sapiens
agtaatatgaaagc

SEQ ID NO: 5217561 - DNA, 17 bp, Homo sapiens
agtaatatgaaagccac

SEQ ID NO: 5217562 - DNA, 11 bp, Homo sapiens
agtaatattac

SEQ ID NO: 5217563 - DNA, 14 bp, Homo sapiens
agtaatattacatt

SEQ ID NO: 5217564 - DNA, 17 bp, Homo sapiens
agtaatattacatttca

SEQ ID NO: 5217565 - DNA, 21 bp, Homo sapiens
agtaatattacatttcattta

SEQ ID NO: 5217566 - DNA, 15 bp, Homo sapiens
agtaatatttattaa

SEQ ID NO: 5217567 - DNA, 19 bp, Homo sapiens
agtaatatttattaaattt

SEQ ID NO: 5217568 - DNA, 19 bp, Homo sapiens
agtaatattttactttgag

SEQ ID NO: 5217569 - DNA, 22 bp, Homo sapiens
agtaatcaatacagacaaggtt

SEQ ID NO: 5217570 - DNA, 18 bp, Homo sapiens
agtaatcacttaaaggca

SEQ ID NO: 5217571 - DNA, 21 bp, Homo sapiens
agtaatcagaatgaaccctcc

SEQ ID NO: 5217572 - DNA, 16 bp, Homo sapiens
agtaatcaggcagcct

SEQ ID NO: 5217573 - DNA, 17 bp, Homo sapiens
agtaatcatctaagtca

SEQ ID NO: 5217574 - DNA, 22 bp, Homo sapiens
agtaatcatctaagtcagtacc

SEQ ID NO: 5217575 - DNA, 17 bp, Homo sapiens
agtaatcccagaacaat

SEQ ID NO: 5217576 - DNA, 16 bp, Homo sapiens
agtaatcccatttccc

SEQ ID NO: 5217577 - DNA, 22 bp, Homo sapiens
agtaatctaggtgtggctgtga

SEQ ID NO: 5217578 - DNA, 24 bp, Homo sapiens
agtaatctatgtgtttctgtaaca

SEQ ID NO: 5217579 - DNA, 13 bp, Homo sapiens
agtaatctgcatt

SEQ ID NO: 5217580 - DNA, 21 bp, Homo sapiens
agtaatctgtacattttgttg

SEQ ID NO: 5217581 - DNA, 23 bp, Homo sapiens
agtaatctgtacattttgttgta

SEQ ID NO: 5217582 - DNA, 14 bp, Homo sapiens
agtaatctgtataa

SEQ ID NO: 5217583 - DNA, 19 bp, Homo sapiens
agtaatctgtataatactt

SEQ ID NO: 5217584 - DNA, 22 bp, Homo sapiens
agtaatctgtataatactttgt

SEQ ID NO: 5217585 - DNA, 18 bp, Homo sapiens
agtaatctgtcagtgttt

SEQ ID NO: 5217586 - DNA, 19 bp, Homo sapiens
agtaatctgtcagtgtttg

SEQ ID NO: 5217587 - DNA, 19 bp, Homo sapiens
agtaatctgtgtacaaaga

SEQ ID NO: 5217588 - DNA, 16 bp, Homo sapiens
agtaatctttatactg

SEQ ID NO: 5217589 - DNA, 17 bp, Homo sapiens
agtaatgaaatgtttac

SEQ ID NO: 5217590 - DNA, 20 bp, Homo sapiens
agtaatgaaggcatatttcc

SEQ ID NO: 5217591 - DNA, 23 bp, Homo sapiens
agtaatgaaggcatatttccaat

SEQ ID NO: 5217592 - DNA, 14 bp, Homo sapiens
agtaatgaatttta

SEQ ID NO: 5217593 - DNA, 17 bp, Homo sapiens
agtaatgacagattgtt

SEQ ID NO: 5217594 - DNA, 21 bp, Homo sapiens
agtaatgagtttaaaaatcaa

SEQ ID NO: 5217595 - DNA, 22 bp, Homo sapiens
agtaatgatgtaacagtgcaag

SEQ ID NO: 5217596 - DNA, 16 bp, Homo sapiens
agtaatgatttcttga

SEQ ID NO: 5217597 - DNA, 21 bp, Homo sapiens
agtaatgcagacatttacatg

SEQ ID NO: 5217598 - DNA, 16 bp, Homo sapiens
agtaatgcagttttta

SEQ ID NO: 5217599 - DNA, 18 bp, Homo sapiens
agtaatgcatacagaaat

SEQ ID NO: 5217600 - DNA, 19 bp, Homo sapiens
agtaatgctaaatgtgtaa

SEQ ID NO: 5217601 - DNA, 21 bp, Homo sapiens
agtaatgctaaatgtgtaata

SEQ ID NO: 5217602 - DNA, 16 bp, Homo sapiens
agtaatggaggtccca

SEQ ID NO: 5217603 - DNA, 19 bp, Homo sapiens
agtaatggaggtcccagcc

SEQ ID NO: 5217604 - DNA, 23 bp, Homo sapiens
agtaatggaggtcccagccctgg

SEQ ID NO: 5217605 - DNA, 13 bp, Homo sapiens
agtaatggcagag

SEQ ID NO: 5217606 - DNA, 21 bp, Homo sapiens
agtaatgggtttcatatttct

SEQ ID NO: 5217607 - DNA, 23 bp, Homo sapiens
agtaatgggtttcatatttctta

SEQ ID NO: 5217608 - DNA, 19 bp, Homo sapiens
agtaatggtattttctaga

SEQ ID NO: 5217609 - DNA, 22 bp, Homo sapiens
agtaatggtgtagaacactaat

SEQ ID NO: 5217610 - DNA, 15 bp, Homo sapiens
agtaatggttctaga

SEQ ID NO: 5217611 - DNA, 15 bp, Homo sapiens
agtaatgtaaagatg

SEQ ID NO: 5217612 - DNA, 19 bp, Homo sapiens
agtaatgtgactaaaggaa

SEQ ID NO: 5217613 - DNA, 21 bp, Homo sapiens
agtaatgttattttcttctaa

SEQ ID NO: 5217614 - DNA, 13 bp, Homo sapiens
agtaattaacata

SEQ ID NO: 5217615 - DNA, 14 bp, Homo sapiens
agtaattaataaag

SEQ ID NO: 5217616 - DNA, 18 bp, Homo sapiens
agtaattaatatctcctg

SEQ ID NO: 5217617 - DNA, 21 bp, Homo sapiens
agtaattaatatctcctggaa

SEQ ID NO: 5217618 - DNA, 23 bp, Homo sapiens
agtaattaatatctcctggaaca

SEQ ID NO: 5217619 - DNA, 17 bp, Homo sapiens
agtaattactttcagaa

SEQ ID NO: 5217620 - DNA, 20 bp, Homo sapiens
agtaattactttcagaatgt

SEQ ID NO: 5217621 - DNA, 23 bp, Homo sapiens
agtaattactttcagaatgttgt

SEQ ID NO: 5217622 - DNA, 18 bp, Homo sapiens
agtaattaggataactaa

SEQ ID NO: 5217623 - DNA, 16 bp, Homo sapiens
agtaattataggaagt

SEQ ID NO: 5217624 - DNA, 22 bp, Homo sapiens
agtaattatcgggaacagtgtt

SEQ ID NO: 5217625 - DNA, 12 bp, Homo sapiens
agtaattatctg

SEQ ID NO: 5217626 - DNA, 15 bp, Homo sapiens
agtaattatgcacta

SEQ ID NO: 5217627 - DNA, 14 bp, Homo sapiens
agtaattattttct

SEQ ID NO: 5217628 - DNA, 19 bp, Homo sapiens
agtaattcagtgggaattg

SEQ ID NO: 5217629 - DNA, 20 bp, Homo sapiens
agtaattcatacaaagtact

SEQ ID NO: 5217630 - DNA, 22 bp, Homo sapiens
agtaattcatacaaagtactgt

SEQ ID NO: 5217631 - DNA, 17 bp, Homo sapiens
agtaattcatctgtgaa

SEQ ID NO: 5217632 - DNA, 18 bp, Homo sapiens
agtaattcatctgtgaat

SEQ ID NO: 5217633 - DNA, 17 bp, Homo sapiens
agtaattctgctgtctc

SEQ ID NO: 5217634 - DNA, 13 bp, Homo sapiens
agtaattgaaaaa

SEQ ID NO: 5217635 - DNA, 20 bp, Homo sapiens
agtaattgacatgtgccagg

SEQ ID NO: 5217636 - DNA, 15 bp, Homo sapiens
agtaattgcacattt

SEQ ID NO: 5217637 - DNA, 17 bp, Homo sapiens
agtaattgcatttctgc

SEQ ID NO: 5217638 - DNA, 21 bp, Homo sapiens
agggagggaaggggaatggaa

SEQ ID NO: 5217639 - DNA, 19 bp, Homo sapiens
agggagggaaggggatgga

SEQ ID NO: 5217640 - DNA, 13 bp, Homo sapiens
agggagggaattt

SEQ ID NO: 5217641 - DNA, 12 bp, Homo sapiens
agggagggagca

SEQ ID NO: 5217642 - DNA, 14 bp, Homo sapiens
agggagggagccat

SEQ ID NO: 5217643 - DNA, 15 bp, Homo sapiens
agggagggagctgag

SEQ ID NO: 5217644 - DNA, 15 bp, Homo sapiens
agggagggagggctc

SEQ ID NO: 5217645 - DNA, 13 bp, Homo sapiens
agggagggagtgg

SEQ ID NO: 5217646 - DNA, 21 bp, Homo sapiens
agggagggatgaccttcccag

SEQ ID NO: 5217647 - DNA, 12 bp, Homo sapiens
agggagggcaga

SEQ ID NO: 5217648 - DNA, 18 bp, Homo sapiens
agggagggcagagctggt

SEQ ID NO: 5217649 - DNA, 19 bp, Homo sapiens
agggagggcagagctggtg

SEQ ID NO: 5217650 - DNA, 16 bp, Homo sapiens
agggagggcagctggc

SEQ ID NO: 5217651 - DNA, 17 bp, Homo sapiens
agggagggcagctggcc

SEQ ID NO: 5217652 - DNA, 17 bp, Homo sapiens
agggagggcagttttct

SEQ ID NO: 5217653 - DNA, 20 bp, Homo sapiens
agggagggccagggaggcag

SEQ ID NO: 5217654 - DNA, 20 bp, Homo sapiens
agggagggccggcggctctg

SEQ ID NO: 5217655 - DNA, 20 bp, Homo sapiens
agggagggcggtggacaata

SEQ ID NO: 5217656 - DNA, 14 bp, Homo sapiens
agggagggctccag

SEQ ID NO: 5217657 - DNA, 15 bp, Homo sapiens
agggagggctgaccc

SEQ ID NO: 5217658 - DNA, 13 bp, Homo sapiens
agggaggggaaga

SEQ ID NO: 5217659 - DNA, 17 bp, Homo sapiens
agggaggggaaggggcc

SEQ ID NO: 5217660 - DNA, 14 bp, Homo sapiens
agggaggggacaga

SEQ ID NO: 5217661 - DNA, 16 bp, Homo sapiens
agggaggggacagagg

SEQ ID NO: 5217662 - DNA, 19 bp, Homo sapiens
agggaggggacagaggccc

SEQ ID NO: 5217663 - DNA, 20 bp, Homo sapiens
agggaggggacagaggccct

SEQ ID NO: 5217664 - DNA, 12 bp, Homo sapiens
agggaggggact

SEQ ID NO: 5217665 - DNA, 17 bp, Homo sapiens
agggaggggagaaagga

SEQ ID NO: 5217666 - DNA, 19 bp, Homo sapiens
agggaggggagagaccaca

SEQ ID NO: 5217667 - DNA, 12 bp, Homo sapiens
agggaggggagg

SEQ ID NO: 5217668 - DNA, 14 bp, Homo sapiens
agggaggggaggtg

SEQ ID NO: 5217669 - DNA, 14 bp, Homo sapiens
agggaggggccctg

SEQ ID NO: 5217670 - DNA, 20 bp, Homo sapiens
agggaggggccggctggcct

SEQ ID NO: 5217671 - DNA, 21 bp, Homo sapiens
agggaggggccggctggcctg

SEQ ID NO: 5217672 - DNA, 12 bp, Homo sapiens
agggaggggcct

SEQ ID NO: 5217673 - DNA, 19 bp, Homo sapiens
agggaggggcctaggcctc

SEQ ID NO: 5217674 - DNA, 21 bp, Homo sapiens
agggaggggctgagtctggct

SEQ ID NO: 5217675 - DNA, 22 bp, Homo sapiens
agggaggggctgagtctggcta

SEQ ID NO: 5217676 - DNA, 14 bp, Homo sapiens
agggaggggctggg

SEQ ID NO: 5217677 - DNA, 23 bp, Homo sapiens
agggaggggctggggcaggctct

SEQ ID NO: 5217678 - DNA, 18 bp, Homo sapiens
agggagggggaggtgaaa

SEQ ID NO: 5217679 - DNA, 22 bp, Homo sapiens
agggagggggaggtgaaaaggg

SEQ ID NO: 5217680 - DNA, 19 bp, Homo sapiens
agggagggggcgctcagga

SEQ ID NO: 5217681 - DNA, 21 bp, Homo sapiens
agggagggggcgctcaggacc

SEQ ID NO: 5217682 - DNA, 15 bp, Homo sapiens
agggagggggctggc

SEQ ID NO: 5217683 - DNA, 17 bp, Homo sapiens
agggagggtgagctggt

SEQ ID NO: 5217684 - DNA, 15 bp, Homo sapiens
agggagggtgcagcc

SEQ ID NO: 5217685 - DNA, 21 bp, Homo sapiens
agggagggtgcagccctcttg

SEQ ID NO: 5217686 - DNA, 15 bp, Homo sapiens
agggagggtggcaga

SEQ ID NO: 5217687 - DNA, 23 bp, Homo sapiens
agggagggtggcagagacagtgg

SEQ ID NO: 5217688 - DNA, 18 bp, Homo sapiens
agggagggtttctctccc

SEQ ID NO: 5217689 - DNA, 17 bp, Homo sapiens
agggaggtgaccccagg

SEQ ID NO: 5217690 - DNA, 21 bp, Homo sapiens
agggaggtggggatgagaaga

SEQ ID NO: 5217691 - DNA, 13 bp, Homo sapiens
agggaggtggggc

SEQ ID NO: 5217692 - DNA, 13 bp, Homo sapiens
agggaggtttgtg

SEQ ID NO: 5217693 - DNA, 16 bp, Homo sapiens
agggagtaagtagagg

SEQ ID NO: 5217694 - DNA, 19 bp, Homo sapiens
agggagtaagtagaggtgg

SEQ ID NO: 5217695 - DNA, 16 bp, Homo sapiens
agggagtacaaagaca

SEQ ID NO: 5217696 - DNA, 20 bp, Homo sapiens
agggagtacaaagacaggga

SEQ ID NO: 5217697 - DNA, 15 bp, Homo sapiens
agggagtacctgctg

SEQ ID NO: 5217698 - DNA, 23 bp, Homo sapiens
agggagtagaaagcttctgagtt

SEQ ID NO: 5217699 - DNA, 22 bp, Homo sapiens
agggagtaggctgtattttctt

SEQ ID NO: 5217700 - DNA, 14 bp, Homo sapiens
agggagtcagctgt

SEQ ID NO: 5217701 - DNA, 21 bp, Homo sapiens
agggagtccagggtttctctg

SEQ ID NO: 5217702 - DNA, 18 bp, Homo sapiens
agggagtcccagagccct

SEQ ID NO: 5217703 - DNA, 23 bp, Homo sapiens
agggagtccgaaagggacttgga

SEQ ID NO: 5217704 - DNA, 19 bp, Homo sapiens
agggagtgacagaggcagc

SEQ ID NO: 5217705 - DNA, 14 bp, Homo sapiens
agggagtgagcagc

SEQ ID NO: 5217706 - DNA, 18 bp, Homo sapiens
agggagtgagcagctact

SEQ ID NO: 5217707 - DNA, 20 bp, Homo sapiens
agggagtgagttgatagcac

SEQ ID NO: 5217708 - DNA, 14 bp, Homo sapiens
agggagtgcagaac

SEQ ID NO: 5217709 - DNA, 20 bp, Homo sapiens
agggagtgcagaacacctgg

SEQ ID NO: 5217710 - DNA, 16 bp, Homo sapiens
agggagtgctggctca

SEQ ID NO: 5217711 - DNA, 23 bp, Homo sapiens
agggagtgctggctcacagtaca

SEQ ID NO: 5217712 - DNA, 12 bp, Homo sapiens
agggagtgggga

SEQ ID NO: 5217713 - DNA, 15 bp, Homo sapiens
agggagtggggagga

SEQ ID NO: 5217714 - DNA, 17 bp, Homo sapiens
agggagtgtctgcagtc

SEQ ID NO: 5217715 - DNA, 18 bp, Homo sapiens
agggagtgttcaaaatac

SEQ ID NO: 5217716 - DNA, 18 bp, Homo sapiens
agggagttagggagagag

SEQ ID NO: 5217717 - DNA, 20 bp, Homo sapiens
agggagttcatctggagggt

SEQ ID NO: 5217718 - DNA, 21 bp, Homo sapiens
agggagttgctcactcaggac

SEQ ID NO: 5217719 - DNA, 16 bp, Homo sapiens
agggagttttgtctgt

SEQ ID NO: 5217720 - DNA, 20 bp, Homo sapiens
agggataatagacacatcaa

SEQ ID NO: 5217721 - DNA, 14 bp, Homo sapiens
agggataattcaaa

SEQ ID NO: 5217722 - DNA, 16 bp, Homo sapiens
agggatacccatccca

SEQ ID NO: 5217723 - DNA, 22 bp, Homo sapiens
agggatacgagcggagtcccct

SEQ ID NO: 5217724 - DNA, 16 bp, Homo sapiens
agggatagagacgcag

SEQ ID NO: 5217725 - DNA, 13 bp, Homo sapiens
agggatagagggg

SEQ ID NO: 5217726 - DNA, 16 bp, Homo sapiens
agggatatatatatat

SEQ ID NO: 5217727 - DNA, 18 bp, Homo sapiens
agggatatggcaggactc

SEQ ID NO: 5217728 - DNA, 20 bp, Homo sapiens
agggatatggcaggactcct

SEQ ID NO: 5217729 - DNA, 19 bp, Homo sapiens
agggatattgccttatttg

SEQ ID NO: 5217730 - DNA, 20 bp, Homo sapiens
agggatattgccttatttgt

SEQ ID NO: 5217731 - DNA, 18 bp, Homo sapiens
agggatcacagaccacag

SEQ ID NO: 5217732 - DNA, 20 bp, Homo sapiens
agggatcacagaccacagga

SEQ ID NO: 5217733 - DNA, 18 bp, Homo sapiens
agggatcagccctgccct

SEQ ID NO: 5217734 - DNA, 13 bp, Homo sapiens
agggatccagaga

SEQ ID NO: 5217735 - DNA, 14 bp, Homo sapiens
agggatccagagac

SEQ ID NO: 5217736 - DNA, 17 bp, Homo sapiens
agggatccagagacctg

SEQ ID NO: 5217737 - DNA, 22 bp, Homo sapiens
agggatccccaggaggcctggg

SEQ ID NO: 5217738 - DNA, 13 bp, Homo sapiens
agggatccctaac

SEQ ID NO: 5217739 - DNA, 16 bp, Homo sapiens
agggatcgtagatttt

SEQ ID NO: 5217740 - DNA, 18 bp, Homo sapiens
agggatctatacttgctt

SEQ ID NO: 5217741 - DNA, 16 bp, Homo sapiens
agggatctgaaatcca

SEQ ID NO: 5217742 - DNA, 18 bp, Homo sapiens
agggatctgaaatccata

SEQ ID NO: 5217743 - DNA, 14 bp, Homo sapiens
agggatctgcttga

SEQ ID NO: 5217744 - DNA, 22 bp, Homo sapiens
agggatctgcttgatatcccaa

SEQ ID NO: 5217745 - DNA, 13 bp, Homo sapiens
agggatctgggga

SEQ ID NO: 5217746 - DNA, 16 bp, Homo sapiens
agggatctggggaagg

SEQ ID NO: 5217747 - DNA, 18 bp, Homo sapiens
agggatctggggaaggac

SEQ ID NO: 5217748 - DNA, 22 bp, Homo sapiens
agggatctggggaaggaccaac

SEQ ID NO: 5217749 - DNA, 19 bp, Homo sapiens
agggatcttgcattcccag

SEQ ID NO: 5217750 - DNA, 17 bp, Homo sapiens
agggatgaaagagaagg

SEQ ID NO: 5217751 - DNA, 12 bp, Homo sapiens
agggatgaaatg

SEQ ID NO: 5217752 - DNA, 22 bp, Homo sapiens
agggatgaaatgccaagactct

SEQ ID NO: 5217753 - DNA, 18 bp, Homo sapiens
agggatgaaggcctccct

SEQ ID NO: 5217754 - DNA, 16 bp, Homo sapiens
agggatgaattgtaaa

SEQ ID NO: 5217755 - DNA, 16 bp, Homo sapiens
agggatgaccttccca

SEQ ID NO: 5217756 - DNA, 22 bp, Homo sapiens
agggatgactaaaatatttatt

SEQ ID NO: 5217757 - DNA, 22 bp, Homo sapiens
agggatgagagtggcttaaaaa

SEQ ID NO: 5217758 - DNA, 14 bp, Homo sapiens
agggatgagccaaa

SEQ ID NO: 5217759 - DNA, 16 bp, Homo sapiens
agggatgaggtgctgg

SEQ ID NO: 5217760 - DNA, 17 bp, Homo sapiens
agggatgagttgaggtg

SEQ ID NO: 5217761 - DNA, 15 bp, Homo sapiens
agggatgatgaggga

SEQ ID NO: 5217762 - DNA, 18 bp, Homo sapiens
agggatgatgccacacca

SEQ ID NO: 5217763 - DNA, 18 bp, Homo sapiens
agggatgattcaagccat

SEQ ID NO: 5217764 - DNA, 21 bp, Homo sapiens
agggatgcaaaggttgcagtg

SEQ ID NO: 5217765 - DNA, 20 bp, Homo sapiens
agggatgccataccttgaga

SEQ ID NO: 5217766 - DNA, 18 bp, Homo sapiens
agggatgccatctgtggg

SEQ ID NO: 5217767 - DNA, 17 bp, Homo sapiens
agggatgccctggaggt

SEQ ID NO: 5217768 - DNA, 21 bp, Homo sapiens
agggatgccctggaggtggct

SEQ ID NO: 5217769 - DNA, 20 bp, Homo sapiens
agggatgcggatcctgctgg

SEQ ID NO: 5217770 - DNA, 23 bp, Homo sapiens
agggatgcggatcctgctggggc

SEQ ID NO: 5217771 - DNA, 22 bp, Homo sapiens
agggatgctatctcgctagcca

SEQ ID NO: 5217772 - DNA, 23 bp, Homo sapiens
agggatgctatctcgctagccat

SEQ ID NO: 5217773 - DNA, 15 bp, Homo sapiens
agggatgctgctccg

SEQ ID NO: 5217774 - DNA, 22 bp, Homo sapiens
agggatgctgctccgcccgctc

SEQ ID NO: 5217775 - DNA, 16 bp, Homo sapiens
agggatgctgggctgg

SEQ ID NO: 5217776 - DNA, 17 bp, Homo sapiens
agggatgctggtggctg

SEQ ID NO: 5217777 - DNA, 15 bp, Homo sapiens
agggatgctgtgagc

SEQ ID NO: 5217778 - DNA, 18 bp, Homo sapiens
agggatggccacaagttc

SEQ ID NO: 5217779 - DNA, 19 bp, Homo sapiens
agggatggccgttggccac

SEQ ID NO: 5217780 - DNA, 15 bp, Homo sapiens
agggatggcgaggcc

SEQ ID NO: 5217781 - DNA, 18 bp, Homo sapiens
agggatggcgggtggggg

SEQ ID NO: 5217782 - DNA, 22 bp, Homo sapiens
agggatgggacctgatgacctg

SEQ ID NO: 5217783 - DNA, 17 bp, Homo sapiens
agggatgggatttcatg

SEQ ID NO: 5217784 - DNA, 17 bp, Homo sapiens
agggatgggcagcccaa

SEQ ID NO: 5217785 - DNA, 17 bp, Homo sapiens
agggatgggcctggcat

SEQ ID NO: 5217786 - DNA, 22 bp, Homo sapiens
agggatgggcctggcattcttg

SEQ ID NO: 5217787 - DNA, 15 bp, Homo sapiens
agggatggggagcag

SEQ ID NO: 5217788 - DNA, 20 bp, Homo sapiens
agggatggggagcagctggg

SEQ ID NO: 5217789 - DNA, 16 bp, Homo sapiens
agggatgggggatggg

SEQ ID NO: 5217790 - DNA, 15 bp, Homo sapiens
agggatgggggtggc

SEQ ID NO: 5217791 - DNA, 16 bp, Homo sapiens
agggatgtctgttgaa

SEQ ID NO: 5217792 - DNA, 21 bp, Homo sapiens
agggatgttattatccttggg

SEQ ID NO: 5217793 - DNA, 16 bp, Homo sapiens
agggatgttctagccc

SEQ ID NO: 5217794 - DNA, 19 bp, Homo sapiens
agggattaacctctgcact

SEQ ID NO: 5217795 - DNA, 17 bp, Homo sapiens
agggattacaggcgtga

SEQ ID NO: 5217796 - DNA, 18 bp, Homo sapiens
agggattacccaagcaaa

SEQ ID NO: 5217797 - DNA, 22 bp, Homo sapiens
agggattcctaatcactcagag

SEQ ID NO: 5217798 - DNA, 13 bp, Homo sapiens
agggattctggga

SEQ ID NO: 5217799 - DNA, 22 bp, Homo sapiens
agggattctgggcttggggtgt

SEQ ID NO: 5217800 - DNA, 17 bp, Homo sapiens
agggattgaacacaggc

SEQ ID NO: 5217801 - DNA, 18 bp, Homo sapiens
agggattgaacacaggca

SEQ ID NO: 5217802 - DNA, 19 bp, Homo sapiens
agggattgaacacaggcaa

SEQ ID NO: 5217803 - DNA, 13 bp, Homo sapiens
agggattgaagtt

SEQ ID NO: 5217804 - DNA, 14 bp, Homo sapiens
agggattgatttta

SEQ ID NO: 5217805 - DNA, 17 bp, Homo sapiens
agggattgattttaaaa

SEQ ID NO: 5217806 - DNA, 14 bp, Homo sapiens
agggattgctgagg

SEQ ID NO: 5217807 - DNA, 16 bp, Homo sapiens
agggattgctgccact

SEQ ID NO: 5217808 - DNA, 17 bp, Homo sapiens
agggattgtccctgtgt

SEQ ID NO: 5217809 - DNA, 13 bp, Homo sapiens
agggatttccctg

SEQ ID NO: 5217810 - DNA, 15 bp, Homo sapiens
agggatttcttaggg

SEQ ID NO: 5217811 - DNA, 20 bp, Homo sapiens
agggatttgcctcaccttgg

SEQ ID NO: 5217812 - DNA, 23 bp, Homo sapiens
agggcaaaatattcactgggcca

SEQ ID NO: 5217813 - DNA, 19 bp, Homo sapiens
agggcaaacccaaaacctc

SEQ ID NO: 5217814 - DNA, 13 bp, Homo sapiens
agggcaaagccag

SEQ ID NO: 5217815 - DNA, 14 bp, Homo sapiens
agggcaaagccagg

SEQ ID NO: 5217816 - DNA, 18 bp, Homo sapiens
agtaattgcatttgcttt

SEQ ID NO: 5217817 - DNA, 17 bp, Homo sapiens
agtaattgggaaaaaag

SEQ ID NO: 5217818 - DNA, 22 bp, Homo sapiens
agtaattggtccgatctttgac

SEQ ID NO: 5217819 - DNA, 23 bp, Homo sapiens
agtaattggttatcatgggaaag

SEQ ID NO: 5217820 - DNA, 23 bp, Homo sapiens
agtaattgtattaattatttaaa

SEQ ID NO: 5217821 - DNA, 23 bp, Homo sapiens
agtaattgtgtttacattttatg

SEQ ID NO: 5217822 - DNA, 15 bp, Homo sapiens
agtaattgttacaat

SEQ ID NO: 5217823 - DNA, 19 bp, Homo sapiens
agtaattgttggttatctt

SEQ ID NO: 5217824 - DNA, 22 bp, Homo sapiens
agtaatttattgtttttccttg

SEQ ID NO: 5217825 - DNA, 13 bp, Homo sapiens
agtaatttcaaga

SEQ ID NO: 5217826 - DNA, 13 bp, Homo sapiens
agtaatttcagtg

SEQ ID NO: 5217827 - DNA, 12 bp, Homo sapiens
agtaatttccta

SEQ ID NO: 5217828 - DNA, 14 bp, Homo sapiens
agtaatttcctaga

SEQ ID NO: 5217829 - DNA, 13 bp, Homo sapiens
agtaatttctgag

SEQ ID NO: 5217830 - DNA, 14 bp, Homo sapiens
agtaatttcttctc

SEQ ID NO: 5217831 - DNA, 23 bp, Homo sapiens
agtaatttgggaaaagaagctgt

SEQ ID NO: 5217832 - DNA, 13 bp, Homo sapiens
agtaattttctga

SEQ ID NO: 5217833 - DNA, 18 bp, Homo sapiens
agtaattttcttctcatt

SEQ ID NO: 5217834 - DNA, 19 bp, Homo sapiens
agtaattttgcacagacat

SEQ ID NO: 5217835 - DNA, 20 bp, Homo sapiens
agtaattttttacattttcc

SEQ ID NO: 5217836 - DNA, 15 bp, Homo sapiens
agtacaaacatgaaa

SEQ ID NO: 5217837 - DNA, 16 bp, Homo sapiens
agtacaaacatgaaaa

SEQ ID NO: 5217838 - DNA, 15 bp, Homo sapiens
agtacaaagacaggg

SEQ ID NO: 5217839 - DNA, 13 bp, Homo sapiens
agtacaaatgtgt

SEQ ID NO: 5217840 - DNA, 14 bp, Homo sapiens
agtacaaattataa

SEQ ID NO: 5217841 - DNA, 21 bp, Homo sapiens
agtacaacccataatcatgta

SEQ ID NO: 5217842 - DNA, 14 bp, Homo sapiens
agtacaagttccaa

SEQ ID NO: 5217843 - DNA, 14 bp, Homo sapiens
agtacaataaataa

SEQ ID NO: 5217844 - DNA, 15 bp, Homo sapiens
agtacaataagcaga

SEQ ID NO: 5217845 - DNA, 20 bp, Homo sapiens
agtacaataataaatcctca

SEQ ID NO: 5217846 - DNA, 16 bp, Homo sapiens
agtacaataatgtact

SEQ ID NO: 5217847 - DNA, 20 bp, Homo sapiens
agtacaataatgtactcaca

SEQ ID NO: 5217848 - DNA, 21 bp, Homo sapiens
agtacaataatgtactcacat

SEQ ID NO: 5217849 - DNA, 13 bp, Homo sapiens
agtacaatcttgg

SEQ ID NO: 5217850 - DNA, 14 bp, Homo sapiens
agtacaatcttggg

SEQ ID NO: 5217851 - DNA, 18 bp, Homo sapiens
agtacaatgaactgcttt

SEQ ID NO: 5217852 - DNA, 18 bp, Homo sapiens
agtacaatgtgtttttct

SEQ ID NO: 5217853 - DNA, 15 bp, Homo sapiens
agtacaattcattgt

SEQ ID NO: 5217854 - DNA, 19 bp, Homo sapiens
agtacaattctttgttgct

SEQ ID NO: 5217855 - DNA, 13 bp, Homo sapiens
agtacaatttcaa

SEQ ID NO: 5217856 - DNA, 16 bp, Homo sapiens
agtacacaataagcaa

SEQ ID NO: 5217857 - DNA, 18 bp, Homo sapiens
agtacacaataagcaaaa

SEQ ID NO: 5217858 - DNA, 19 bp, Homo sapiens
agtacacacaaaaaccttg

SEQ ID NO: 5217859 - DNA, 18 bp, Homo sapiens
agtacacaccagaagatg

SEQ ID NO: 5217860 - DNA, 20 bp, Homo sapiens
agtacacagcaccagaatgt

SEQ ID NO: 5217861 - DNA, 19 bp, Homo sapiens
agtacaccacaagggtcac

SEQ ID NO: 5217862 - DNA, 16 bp, Homo sapiens
agtacaccccacctct

SEQ ID NO: 5217863 - DNA, 15 bp, Homo sapiens
agtacactcagccac

SEQ ID NO: 5217864 - DNA, 16 bp, Homo sapiens
agtacactcagccact

SEQ ID NO: 5217865 - DNA, 17 bp, Homo sapiens
agtacactcagccactg

SEQ ID NO: 5217866 - DNA, 15 bp, Homo sapiens
agtacactctgctgt

SEQ ID NO: 5217867 - DNA, 17 bp, Homo sapiens
agtacactctgctgttt

SEQ ID NO: 5217868 - DNA, 12 bp, Homo sapiens
agtacactgcct

SEQ ID NO: 5217869 - DNA, 14 bp, Homo sapiens
agtacactgtgtct

SEQ ID NO: 5217870 - DNA, 15 bp, Homo sapiens
agtacactgtgtctc

SEQ ID NO: 5217871 - DNA, 14 bp, Homo sapiens
agtacactgtttca

SEQ ID NO: 5217872 - DNA, 21 bp, Homo sapiens
agtacactgtttcaaacttta

SEQ ID NO: 5217873 - DNA, 19 bp, Homo sapiens
agtacacttttatgagctt

SEQ ID NO: 5217874 - DNA, 22 bp, Homo sapiens
agtacagaacagtaaagttaaa

SEQ ID NO: 5217875 - DNA, 17 bp, Homo sapiens
agtacagagaagccatc

SEQ ID NO: 5217876 - DNA, 15 bp, Homo sapiens
agtacagatactgtg

SEQ ID NO: 5217877 - DNA, 15 bp, Homo sapiens
agtacagcatgtgcc

SEQ ID NO: 5217878 - DNA, 16 bp, Homo sapiens
agtacagcatgtgcct

SEQ ID NO: 5217879 - DNA, 13 bp, Homo sapiens
agtacagccttca

SEQ ID NO: 5217880 - DNA, 14 bp, Homo sapiens
agtacagcggctcc

SEQ ID NO: 5217881 - DNA, 23 bp, Homo sapiens
agtacagcggctcccctctgctt

SEQ ID NO: 5217882 - DNA, 21 bp, Homo sapiens
agtacagctgacggtttctcc

SEQ ID NO: 5217883 - DNA, 19 bp, Homo sapiens
agtacaggcagcacagaga

SEQ ID NO: 5217884 - DNA, 12 bp, Homo sapiens
agtacagggcag

SEQ ID NO: 5217885 - DNA, 22 bp, Homo sapiens
agtacaggggtgctgcaggtgg

SEQ ID NO: 5217886 - DNA, 18 bp, Homo sapiens
agtacaggtgcatattaa

SEQ ID NO: 5217887 - DNA, 21 bp, Homo sapiens
agtacagtagcttaaataaat

SEQ ID NO: 5217888 - DNA, 12 bp, Homo sapiens
agtacagtatat

SEQ ID NO: 5217889 - DNA, 23 bp, Homo sapiens
agtacagtattttttaaggcaaa

SEQ ID NO: 5217890 - DNA, 15 bp, Homo sapiens
agtacagtcttatca

SEQ ID NO: 5217891 - DNA, 19 bp, Homo sapiens
agtacagtggttctacaat

SEQ ID NO: 5217892 - DNA, 13 bp, Homo sapiens
agtacagtgtgtg

SEQ ID NO: 5217893 - DNA, 16 bp, Homo sapiens
agtacataaagtaata

SEQ ID NO: 5217894 - DNA, 22 bp, Homo sapiens
agtacataattgattaaaatct

SEQ ID NO: 5217895 - DNA, 23 bp, Homo sapiens
agtacataattgattaaaatctc

SEQ ID NO: 5217896 - DNA, 17 bp, Homo sapiens
agtacatatttattttc

SEQ ID NO: 5217897 - DNA, 22 bp, Homo sapiens
agtacatatttattttcttttg

SEQ ID NO: 5217898 - DNA, 20 bp, Homo sapiens
agtacatcacctaacagaat

SEQ ID NO: 5217899 - DNA, 14 bp, Homo sapiens
agtacatccagaaa

SEQ ID NO: 5217900 - DNA, 22 bp, Homo sapiens
agtacatcttgtgcatgcaaaa

SEQ ID NO: 5217901 - DNA, 22 bp, Homo sapiens
agtacatgacccggatgaactc

SEQ ID NO: 5217902 - DNA, 15 bp, Homo sapiens
agtacatggagctca

SEQ ID NO: 5217903 - DNA, 17 bp, Homo sapiens
agtacatggagctcagg

SEQ ID NO: 5217904 - DNA, 16 bp, Homo sapiens
agtacatgggtgacta

SEQ ID NO: 5217905 - DNA, 22 bp, Homo sapiens
agtacatgggtgactatctccc

SEQ ID NO: 5217906 - DNA, 20 bp, Homo sapiens
agtacattcatctggaggct

SEQ ID NO: 5217907 - DNA, 21 bp, Homo sapiens
agtacattcatctggaggctg

SEQ ID NO: 5217908 - DNA, 14 bp, Homo sapiens
agtacattccaact

SEQ ID NO: 5217909 - DNA, 13 bp, Homo sapiens
agtacattctcag

SEQ ID NO: 5217910 - DNA, 16 bp, Homo sapiens
agtacattctcagttt

SEQ ID NO: 5217911 - DNA, 13 bp, Homo sapiens
agtacattgctta

SEQ ID NO: 5217912 - DNA, 20 bp, Homo sapiens
agtacattgtaaaataaagt

SEQ ID NO: 5217913 - DNA, 14 bp, Homo sapiens
agtacattgttacc

SEQ ID NO: 5217914 - DNA, 16 bp, Homo sapiens
agtacatttaaatttt

SEQ ID NO: 5217915 - DNA, 16 bp, Homo sapiens
agtacatttgctttaa

SEQ ID NO: 5217916 - DNA, 16 bp, Homo sapiens
agtacatttggagaca

SEQ ID NO: 5217917 - DNA, 18 bp, Homo sapiens
agtacattttttgaaatg

SEQ ID NO: 5217918 - DNA, 15 bp, Homo sapiens
agtaccaaagtttta

SEQ ID NO: 5217919 - DNA, 14 bp, Homo sapiens
agtaccaaatgctt

SEQ ID NO: 5217920 - DNA, 19 bp, Homo sapiens
agtaccaatgctgttgtaa

SEQ ID NO: 5217921 - DNA, 17 bp, Homo sapiens
agtaccaatgggaagca

SEQ ID NO: 5217922 - DNA, 18 bp, Homo sapiens
agtaccaatgggaagcag

SEQ ID NO: 5217923 - DNA, 21 bp, Homo sapiens
agtaccaatgggaagcaggga

SEQ ID NO: 5217924 - DNA, 15 bp, Homo sapiens
agtaccactcttggt

SEQ ID NO: 5217925 - DNA, 14 bp, Homo sapiens
agtaccagaagcaa

SEQ ID NO: 5217926 - DNA, 14 bp, Homo sapiens
agtaccagcgctct

SEQ ID NO: 5217927 - DNA, 22 bp, Homo sapiens
agtaccagcgctctaaaagcac

SEQ ID NO: 5217928 - DNA, 21 bp, Homo sapiens
agtaccaggccgtttgctttt

SEQ ID NO: 5217929 - DNA, 23 bp, Homo sapiens
agtaccaggggctgggctccctg

SEQ ID NO: 5217930 - DNA, 19 bp, Homo sapiens
agtaccagtgtaaattcag

SEQ ID NO: 5217931 - DNA, 15 bp, Homo sapiens
agtaccataatctta

SEQ ID NO: 5217932 - DNA, 21 bp, Homo sapiens
agtaccatagtaccatttata

SEQ ID NO: 5217933 - DNA, 16 bp, Homo sapiens
agtaccatcccactga

SEQ ID NO: 5217934 - DNA, 15 bp, Homo sapiens
agtacccaaaagctc

SEQ ID NO: 5217935 - DNA, 21 bp, Homo sapiens
agtacccaaaagctcagccag

SEQ ID NO: 5217936 - DNA, 21 bp, Homo sapiens
agtacccaacctggtaattat

SEQ ID NO: 5217937 - DNA, 13 bp, Homo sapiens
agtacccacctga

SEQ ID NO: 5217938 - DNA, 22 bp, Homo sapiens
agtacccacctgagctttggac

SEQ ID NO: 5217939 - DNA, 19 bp, Homo sapiens
agtacccagcaaatgggca

SEQ ID NO: 5217940 - DNA, 14 bp, Homo sapiens
agtacccagggcca

SEQ ID NO: 5217941 - DNA, 22 bp, Homo sapiens
agtaccccagccactcctcaac

SEQ ID NO: 5217942 - DNA, 15 bp, Homo sapiens
agtacccccctgaga

SEQ ID NO: 5217943 - DNA, 19 bp, Homo sapiens
agtacccccctgagagcat

SEQ ID NO: 5217944 - DNA, 23 bp, Homo sapiens
agtaccccctcaaaccctgccct

SEQ ID NO: 5217945 - DNA, 18 bp, Homo sapiens
agtacccctaaaatccca

SEQ ID NO: 5217946 - DNA, 12 bp, Homo sapiens
agtaccctgcag

SEQ ID NO: 5217947 - DNA, 17 bp, Homo sapiens
agtaccctgcaggccag

SEQ ID NO: 5217948 - DNA, 19 bp, Homo sapiens
agtaccctgcaggccaggc

SEQ ID NO: 5217949 - DNA, 12 bp, Homo sapiens
agtacccttggg

SEQ ID NO: 5217950 - DNA, 17 bp, Homo sapiens
agtaccctttggcctac

SEQ ID NO: 5217951 - DNA, 15 bp, Homo sapiens
agtacctatatgcta

SEQ ID NO: 5217952 - DNA, 23 bp, Homo sapiens
agtacctatattgatttaaaagt

SEQ ID NO: 5217953 - DNA, 13 bp, Homo sapiens
agtacctccaagc

SEQ ID NO: 5217954 - DNA, 23 bp, Homo sapiens
agtacctcccctccccgccccct

SEQ ID NO: 5217955 - DNA, 22 bp, Homo sapiens
agtacctcctgtctctggcctg

SEQ ID NO: 5217956 - DNA, 22 bp, Homo sapiens
agtacctctgtatagaaatcta

SEQ ID NO: 5217957 - DNA, 17 bp, Homo sapiens
agtacctgaaaaaatgc

SEQ ID NO: 5217958 - DNA, 16 bp, Homo sapiens
agtacctgagggtctg

SEQ ID NO: 5217959 - DNA, 19 bp, Homo sapiens
agtacctgagggtctgtag

SEQ ID NO: 5217960 - DNA, 17 bp, Homo sapiens
agtacctgattgtattt

SEQ ID NO: 5217961 - DNA, 13 bp, Homo sapiens
agtacctgcaaaa

SEQ ID NO: 5217962 - DNA, 17 bp, Homo sapiens
agtacctgcaaaaatga

SEQ ID NO: 5217963 - DNA, 18 bp, Homo sapiens
agtacctgcaaaaatgag

SEQ ID NO: 5217964 - DNA, 19 bp, Homo sapiens
agtacctgcaaaaatgagt

SEQ ID NO: 5217965 - DNA, 20 bp, Homo sapiens
agtacctgcaaaaatgagtt

SEQ ID NO: 5217966 - DNA, 12 bp, Homo sapiens
agtacctgctgc

SEQ ID NO: 5217967 - DNA, 17 bp, Homo sapiens
agtacctgctgccccag

SEQ ID NO: 5217968 - DNA, 19 bp, Homo sapiens
agtacctgctgccccagct

SEQ ID NO: 5217969 - DNA, 19 bp, Homo sapiens
agtacctgggcaagctggc

SEQ ID NO: 5217970 - DNA, 19 bp, Homo sapiens
agtacctgggtccccagcc

SEQ ID NO: 5217971 - DNA, 21 bp, Homo sapiens
agtacctgggtccccagccct

SEQ ID NO: 5217972 - DNA, 12 bp, Homo sapiens
agtacctgtcca

SEQ ID NO: 5217973 - DNA, 15 bp, Homo sapiens
agtacctgtgtgttt

SEQ ID NO: 5217974 - DNA, 19 bp, Homo sapiens
agtaccttaggttctttct

SEQ ID NO: 5217975 - DNA, 16 bp, Homo sapiens
agtaccttcagatcct

SEQ ID NO: 5217976 - DNA, 20 bp, Homo sapiens
agtaccttcagatcctaccc

SEQ ID NO: 5217977 - DNA, 17 bp, Homo sapiens
agtaccttgaactctta

SEQ ID NO: 5217978 - DNA, 12 bp, Homo sapiens
agtaccttgctt

SEQ ID NO: 5217979 - DNA, 22 bp, Homo sapiens
agtacctttcctacattttctt

SEQ ID NO: 5217980 - DNA, 13 bp, Homo sapiens
agtacctttgctc

SEQ ID NO: 5217981 - DNA, 14 bp, Homo sapiens
agtacctttgctct

SEQ ID NO: 5217982 - DNA, 21 bp, Homo sapiens
agtacctttgctcttgcagag

SEQ ID NO: 5217983 - DNA, 13 bp, Homo sapiens
agtacctttgtca

SEQ ID NO: 5217984 - DNA, 21 bp, Homo sapiens
agtacgaatcttatttttcct

SEQ ID NO: 5217985 - DNA, 13 bp, Homo sapiens
agtacggctgctg

SEQ ID NO: 5217986 - DNA, 21 bp, Homo sapiens
agtacgtcccgctgctgtgct

SEQ ID NO: 5217987 - DNA, 14 bp, Homo sapiens
agtacgttaaaagc

SEQ ID NO: 5217988 - DNA, 17 bp, Homo sapiens
agtactaacacaaggac

SEQ ID NO: 5217989 - DNA, 17 bp, Homo sapiens
agtactaagacccacaa

SEQ ID NO: 5217990 - DNA, 21 bp, Homo sapiens
agtactaagacccacaaactg

SEQ ID NO: 5217991 - DNA, 20 bp, Homo sapiens
agtactaaggtgactttctg

SEQ ID NO: 5217992 - DNA, 23 bp, Homo sapiens
agtactaaggtgactttctgaaa

SEQ ID NO: 5217993 - DNA, 16 bp, Homo sapiens
agtactacacattttt

SEQ ID NO: 5217994 - DNA, 22 bp, Homo sapiens
agtactacacatttttaaattg

SEQ ID NO: 5217995 - DNA, 15 bp, Homo sapiens
agggcaaagccaggt

SEQ ID NO: 5217996 - DNA, 11 bp, Homo sapiens
agggcaaagct

SEQ ID NO: 5217997 - DNA, 21 bp, Homo sapiens
agggcaaagtagggcgtgtgg

SEQ ID NO: 5217998 - DNA, 20 bp, Homo sapiens
agggcaaatgtttacatttt

SEQ ID NO: 5217999 - DNA, 22 bp, Homo sapiens
agggcaacaatacatgctgcta

SEQ ID NO: 5218000 - DNA, 13 bp, Homo sapiens
agggcaaccaata

SEQ ID NO: 5218001 - DNA, 13 bp, Homo sapiens
agggcaagaggat

SEQ ID NO: 5218002 - DNA, 14 bp, Homo sapiens
agggcaagaggtgc

SEQ ID NO: 5218003 - DNA, 13 bp, Homo sapiens
agggcaagccacc

SEQ ID NO: 5218004 - DNA, 14 bp, Homo sapiens
agggcaagccctgc

SEQ ID NO: 5218005 - DNA, 18 bp, Homo sapiens
agggcaagccctgcccac

SEQ ID NO: 5218006 - DNA, 21 bp, Homo sapiens
agggcaagccctgcccacaga

SEQ ID NO: 5218007 - DNA, 14 bp, Homo sapiens
agggcaagcctcta

SEQ ID NO: 5218008 - DNA, 20 bp, Homo sapiens
agggcaagctcatagcacat

SEQ ID NO: 5218009 - DNA, 19 bp, Homo sapiens
agggcaagctccgcaggac

SEQ ID NO: 5218010 - DNA, 21 bp, Homo sapiens
agggcaagctccgcaggactt

SEQ ID NO: 5218011 - DNA, 14 bp, Homo sapiens
agggcaaggagttt

SEQ ID NO: 5218012 - DNA, 17 bp, Homo sapiens
agggcaagggaggggtg

SEQ ID NO: 5218013 - DNA, 13 bp, Homo sapiens
agggcaagggcca

SEQ ID NO: 5218014 - DNA, 17 bp, Homo sapiens
agggcaagggtgcctca

SEQ ID NO: 5218015 - DNA, 21 bp, Homo sapiens
agggcaagggttaaggcctga

SEQ ID NO: 5218016 - DNA, 22 bp, Homo sapiens
agggcaagtggatgggaatttg

SEQ ID NO: 5218017 - DNA, 13 bp, Homo sapiens
agggcaatgccat

SEQ ID NO: 5218018 - DNA, 14 bp, Homo sapiens
agggcaatgccatc

SEQ ID NO: 5218019 - DNA, 16 bp, Homo sapiens
agggcaatgccatcag

SEQ ID NO: 5218020 - DNA, 21 bp, Homo sapiens
agggcaatgccatcagcccct

SEQ ID NO: 5218021 - DNA, 22 bp, Homo sapiens
agggcaatgccatcagcccctg

SEQ ID NO: 5218022 - DNA, 23 bp, Homo sapiens
agggcaatgccatcagcccctgg

SEQ ID NO: 5218023 - DNA, 18 bp, Homo sapiens
agggcaattaattccttc

SEQ ID NO: 5218024 - DNA, 22 bp, Homo sapiens
agggcaattaattccttcagca

SEQ ID NO: 5218025 - DNA, 21 bp, Homo sapiens
agggcaattgagggactgagc

SEQ ID NO: 5218026 - DNA, 18 bp, Homo sapiens
agggcacaaactgcagct

SEQ ID NO: 5218027 - DNA, 22 bp, Homo sapiens
agggcacaaactgcagctgtga

SEQ ID NO: 5218028 - DNA, 16 bp, Homo sapiens
agggcacaaagatggg

SEQ ID NO: 5218029 - DNA, 19 bp, Homo sapiens
agggcacacccctggggct

SEQ ID NO: 5218030 - DNA, 17 bp, Homo sapiens
agggcacaccgggcact

SEQ ID NO: 5218031 - DNA, 20 bp, Homo sapiens
agggcacaccgggcactcag

SEQ ID NO: 5218032 - DNA, 21 bp, Homo sapiens
agggcacaccgggcactcaga

SEQ ID NO: 5218033 - DNA, 18 bp, Homo sapiens
agggcacagaaggctggg

SEQ ID NO: 5218034 - DNA, 13 bp, Homo sapiens
agggcacagccct

SEQ ID NO: 5218035 - DNA, 14 bp, Homo sapiens
agggcacagccctc

SEQ ID NO: 5218036 - DNA, 14 bp, Homo sapiens
agggcacagctgcc

SEQ ID NO: 5218037 - DNA, 13 bp, Homo sapiens
agggcacagctgg

SEQ ID NO: 5218038 - DNA, 14 bp, Homo sapiens
agggcacaggagct

SEQ ID NO: 5218039 - DNA, 17 bp, Homo sapiens
agggcacaggagctacc

SEQ ID NO: 5218040 - DNA, 18 bp, Homo sapiens
agggcacaggagctacct

SEQ ID NO: 5218041 - DNA, 14 bp, Homo sapiens
agggcacagggcct

SEQ ID NO: 5218042 - DNA, 16 bp, Homo sapiens
agggcacagggcctgg

SEQ ID NO: 5218043 - DNA, 20 bp, Homo sapiens
agggcacagggcctggccca

SEQ ID NO: 5218044 - DNA, 15 bp, Homo sapiens
agggcacatgatctg

SEQ ID NO: 5218045 - DNA, 19 bp, Homo sapiens
agggcacatgatctggccc

SEQ ID NO: 5218046 - DNA, 22 bp, Homo sapiens
agggcacattgcccatggctgg

SEQ ID NO: 5218047 - DNA, 20 bp, Homo sapiens
agggcaccaagcccacaggt

SEQ ID NO: 5218048 - DNA, 19 bp, Homo sapiens
agggcaccaggggtttctc

SEQ ID NO: 5218049 - DNA, 18 bp, Homo sapiens
agggcacccaccagaaat

SEQ ID NO: 5218050 - DNA, 19 bp, Homo sapiens
agggcaccccttgtttctg

SEQ ID NO: 5218051 - DNA, 23 bp, Homo sapiens
agggcacgaggctctagaaatgc

SEQ ID NO: 5218052 - DNA, 17 bp, Homo sapiens
agggcacgcaggaccag

SEQ ID NO: 5218053 - DNA, 21 bp, Homo sapiens
agggcacgcaggaccagtttg

SEQ ID NO: 5218054 - DNA, 14 bp, Homo sapiens
agggcacggggacc

SEQ ID NO: 5218055 - DNA, 13 bp, Homo sapiens
agggcactcacat

SEQ ID NO: 5218056 - DNA, 17 bp, Homo sapiens
agggcactcacatgccg

SEQ ID NO: 5218057 - DNA, 21 bp, Homo sapiens
agggcactcccaaccctgggc

SEQ ID NO: 5218058 - DNA, 17 bp, Homo sapiens
agggcactctctgccag

SEQ ID NO: 5218059 - DNA, 18 bp, Homo sapiens
agggcactctctgccagc

SEQ ID NO: 5218060 - DNA, 20 bp, Homo sapiens
agggcactctgttcccctcc

SEQ ID NO: 5218061 - DNA, 14 bp, Homo sapiens
agggcactgccagc

SEQ ID NO: 5218062 - DNA, 15 bp, Homo sapiens
agggcactgccagcc

SEQ ID NO: 5218063 - DNA, 23 bp, Homo sapiens
agggcactgccagcccaccccct

SEQ ID NO: 5218064 - DNA, 15 bp, Homo sapiens
agggcactggagctg

SEQ ID NO: 5218065 - DNA, 14 bp, Homo sapiens
agggcactgggctg

SEQ ID NO: 5218066 - DNA, 15 bp, Homo sapiens
agggcactgggctgt

SEQ ID NO: 5218067 - DNA, 18 bp, Homo sapiens
agggcactgtgatacagt

SEQ ID NO: 5218068 - DNA, 20 bp, Homo sapiens
agggcactgtgatacagttt

SEQ ID NO: 5218069 - DNA, 20 bp, Homo sapiens
agggcacttaatttgtaaac

SEQ ID NO: 5218070 - DNA, 21 bp, Homo sapiens
agggcacttaatttgtaaact

SEQ ID NO: 5218071 - DNA, 22 bp, Homo sapiens
agggcacttaatttgtaaactt

SEQ ID NO: 5218072 - DNA, 17 bp, Homo sapiens
agggcacttcacagagt

SEQ ID NO: 5218073 - DNA, 14 bp, Homo sapiens
agggcacttcaggt

SEQ ID NO: 5218074 - DNA, 17 bp, Homo sapiens
agggcacttcaggtccg

SEQ ID NO: 5218075 - DNA, 19 bp, Homo sapiens
agggcacttcctccacagt

SEQ ID NO: 5218076 - DNA, 20 bp, Homo sapiens
agggcacttcctccacagtc

SEQ ID NO: 5218077 - DNA, 19 bp, Homo sapiens
agggcagaaaggttctgcc

SEQ ID NO: 5218078 - DNA, 20 bp, Homo sapiens
agggcagaaaggttctgccc

SEQ ID NO: 5218079 - DNA, 15 bp, Homo sapiens
agggcagaaagtaga

SEQ ID NO: 5218080 - DNA, 13 bp, Homo sapiens
agggcagaagggg

SEQ ID NO: 5218081 - DNA, 17 bp, Homo sapiens
agggcagaaggggaaga

SEQ ID NO: 5218082 - DNA, 17 bp, Homo sapiens
agggcagacatgccttg

SEQ ID NO: 5218083 - DNA, 20 bp, Homo sapiens
agggcagagaggttaacaga

SEQ ID NO: 5218084 - DNA, 19 bp, Homo sapiens
agggcagagccatgggcct

SEQ ID NO: 5218085 - DNA, 20 bp, Homo sapiens
agggcagagccatgggcctg

SEQ ID NO: 5218086 - DNA, 16 bp, Homo sapiens
agggcagagctggtgc

SEQ ID NO: 5218087 - DNA, 13 bp, Homo sapiens
agggcagaggaat

SEQ ID NO: 5218088 - DNA, 12 bp, Homo sapiens
agggcagaggca

SEQ ID NO: 5218089 - DNA, 19 bp, Homo sapiens
agggcagaggcaaggatgg

SEQ ID NO: 5218090 - DNA, 17 bp, Homo sapiens
agggcagaggctggagg

SEQ ID NO: 5218091 - DNA, 20 bp, Homo sapiens
agggcagaggctggaggcag

SEQ ID NO: 5218092 - DNA, 20 bp, Homo sapiens
agggcagaggtcccctgagg

SEQ ID NO: 5218093 - DNA, 20 bp, Homo sapiens
agggcagagtgggctgcctg

SEQ ID NO: 5218094 - DNA, 15 bp, Homo sapiens
agggcagagttactt

SEQ ID NO: 5218095 - DNA, 15 bp, Homo sapiens
agggcagcaagggac

SEQ ID NO: 5218096 - DNA, 12 bp, Homo sapiens
agggcagcactg

SEQ ID NO: 5218097 - DNA, 18 bp, Homo sapiens
agggcagcactgggaagc

SEQ ID NO: 5218098 - DNA, 21 bp, Homo sapiens
agggcagcactgggaagctgg

SEQ ID NO: 5218099 - DNA, 22 bp, Homo sapiens
agggcagcactgggaagctgga

SEQ ID NO: 5218100 - DNA, 15 bp, Homo sapiens
agggcagcagaaggg

SEQ ID NO: 5218101 - DNA, 21 bp, Homo sapiens
agggcagcagaagggggtggt

SEQ ID NO: 5218102 - DNA, 12 bp, Homo sapiens
agggcagcagcc

SEQ ID NO: 5218103 - DNA, 13 bp, Homo sapiens
agggcagcagcca

SEQ ID NO: 5218104 - DNA, 14 bp, Homo sapiens
agggcagcagccag

SEQ ID NO: 5218105 - DNA, 16 bp, Homo sapiens
agggcagcagccagcc

SEQ ID NO: 5218106 - DNA, 13 bp, Homo sapiens
agggcagcaggcc

SEQ ID NO: 5218107 - DNA, 15 bp, Homo sapiens
agggcagcaggccag

SEQ ID NO: 5218108 - DNA, 22 bp, Homo sapiens
agggcagcaggccagagaaagc

SEQ ID NO: 5218109 - DNA, 14 bp, Homo sapiens
agggcagcagggta

SEQ ID NO: 5218110 - DNA, 14 bp, Homo sapiens
agggcagcagtggg

SEQ ID NO: 5218111 - DNA, 13 bp, Homo sapiens
agggcagccaggg

SEQ ID NO: 5218112 - DNA, 21 bp, Homo sapiens
agggcagccaggggctgctca

SEQ ID NO: 5218113 - DNA, 13 bp, Homo sapiens
agggcagccccac

SEQ ID NO: 5218114 - DNA, 13 bp, Homo sapiens
agggcagccccct

SEQ ID NO: 5218115 - DNA, 15 bp, Homo sapiens
agggcagccccctcc

SEQ ID NO: 5218116 - DNA, 13 bp, Homo sapiens
agggcagcccctc

SEQ ID NO: 5218117 - DNA, 14 bp, Homo sapiens
agggcagcccctcc

SEQ ID NO: 5218118 - DNA, 15 bp, Homo sapiens
agggcagcccctgca

SEQ ID NO: 5218119 - DNA, 17 bp, Homo sapiens
agggcagcccctgcaga

SEQ ID NO: 5218120 - DNA, 21 bp, Homo sapiens
agggcagcccgtcctctctct

SEQ ID NO: 5218121 - DNA, 15 bp, Homo sapiens
agggcagccctccat

SEQ ID NO: 5218122 - DNA, 18 bp, Homo sapiens
agggcagccctccatggt

SEQ ID NO: 5218123 - DNA, 17 bp, Homo sapiens
agggcagcctgtgggag

SEQ ID NO: 5218124 - DNA, 19 bp, Homo sapiens
agggcagcctgtgggagaa

SEQ ID NO: 5218125 - DNA, 21 bp, Homo sapiens
agggcagcctgtgggagaagg

SEQ ID NO: 5218126 - DNA, 23 bp, Homo sapiens
agggcagcctgtgggagaaggga

SEQ ID NO: 5218127 - DNA, 15 bp, Homo sapiens
agggcagcggctcca

SEQ ID NO: 5218128 - DNA, 14 bp, Homo sapiens
agggcagctgcctg

SEQ ID NO: 5218129 - DNA, 12 bp, Homo sapiens
agggcagctgct

SEQ ID NO: 5218130 - DNA, 13 bp, Homo sapiens
agggcagctgcta

SEQ ID NO: 5218131 - DNA, 13 bp, Homo sapiens
agggcagctggcc

SEQ ID NO: 5218132 - DNA, 14 bp, Homo sapiens
agggcagctggccc

SEQ ID NO: 5218133 - DNA, 19 bp, Homo sapiens
agggcagctggcccccagc

SEQ ID NO: 5218134 - DNA, 16 bp, Homo sapiens
agggcagctgggccca

SEQ ID NO: 5218135 - DNA, 18 bp, Homo sapiens
agggcagctgggcccaac

SEQ ID NO: 5218136 - DNA, 14 bp, Homo sapiens
agggcagctgtgat

SEQ ID NO: 5218137 - DNA, 21 bp, Homo sapiens
agggcagcttcagtctctgca

SEQ ID NO: 5218138 - DNA, 23 bp, Homo sapiens
agggcagcttgccccggccccgg

SEQ ID NO: 5218139 - DNA, 16 bp, Homo sapiens
agggcaggaagacttc

SEQ ID NO: 5218140 - DNA, 19 bp, Homo sapiens
agggcaggaagacttccag

SEQ ID NO: 5218141 - DNA, 20 bp, Homo sapiens
agggcaggaagacttccagc

SEQ ID NO: 5218142 - DNA, 23 bp, Homo sapiens
agggcaggaaggagagcctgctg

SEQ ID NO: 5218143 - DNA, 14 bp, Homo sapiens
agggcaggaccagc

SEQ ID NO: 5218144 - DNA, 17 bp, Homo sapiens
agggcaggaccagccca

SEQ ID NO: 5218145 - DNA, 19 bp, Homo sapiens
agggcaggaccagcccacg

SEQ ID NO: 5218146 - DNA, 16 bp, Homo sapiens
agggcaggagcctaga

SEQ ID NO: 5218147 - DNA, 22 bp, Homo sapiens
agggcaggagcctagaggagga

SEQ ID NO: 5218148 - DNA, 19 bp, Homo sapiens
agggcaggagctcacaccg

SEQ ID NO: 5218149 - DNA, 14 bp, Homo sapiens
agggcaggagctgc

SEQ ID NO: 5218150 - DNA, 15 bp, Homo sapiens
agggcaggcagagct

SEQ ID NO: 5218151 - DNA, 17 bp, Homo sapiens
agggcaggcagagctca

SEQ ID NO: 5218152 - DNA, 20 bp, Homo sapiens
agggcaggcccaaattatca

SEQ ID NO: 5218153 - DNA, 14 bp, Homo sapiens
agggcaggccttgc

SEQ ID NO: 5218154 - DNA, 14 bp, Homo sapiens
agggcaggctgagg

SEQ ID NO: 5218155 - DNA, 12 bp, Homo sapiens
agggcagggact

SEQ ID NO: 5218156 - DNA, 17 bp, Homo sapiens
agggcagggcatctcct

SEQ ID NO: 5218157 - DNA, 14 bp, Homo sapiens
agggcagggccacc

SEQ ID NO: 5218158 - DNA, 15 bp, Homo sapiens
agggcagggccaccc

SEQ ID NO: 5218159 - DNA, 17 bp, Homo sapiens
agggcagggcgagctgc

SEQ ID NO: 5218160 - DNA, 16 bp, Homo sapiens
agggcagggctctgat

SEQ ID NO: 5218161 - DNA, 16 bp, Homo sapiens
agggcagggggcccct

SEQ ID NO: 5218162 - DNA, 14 bp, Homo sapiens
agggcaggggtggt

SEQ ID NO: 5218163 - DNA, 13 bp, Homo sapiens
agggcagggtggg

SEQ ID NO: 5218164 - DNA, 18 bp, Homo sapiens
agggcagggttctagaag

SEQ ID NO: 5218165 - DNA, 22 bp, Homo sapiens
agggcaggtccagctctgtggg

SEQ ID NO: 5218166 - DNA, 19 bp, Homo sapiens
agggcaggtggggtgagaa

SEQ ID NO: 5218167 - DNA, 15 bp, Homo sapiens
agggcagtaccctcc

SEQ ID NO: 5218168 - DNA, 17 bp, Homo sapiens
agggcagtacctgggaa

SEQ ID NO: 5218169 - DNA, 20 bp, Homo sapiens
agggcagtcattggctgtct

SEQ ID NO: 5218170 - DNA, 23 bp, Homo sapiens
agggcagtccttactcccccacc

SEQ ID NO: 5218171 - DNA, 20 bp, Homo sapiens
agggcagtgacaagtggagg

SEQ ID NO: 5218172 - DNA, 12 bp, Homo sapiens
agggcagtgaga

SEQ ID NO: 5218173 - DNA, 19 bp, Homo sapiens
agggcagtgcaaggaggga

SEQ ID NO: 5218174 - DNA, 22 bp, Homo sapiens
agggcagtgcccatgtgtacat

SEQ ID NO: 5218175 - DNA, 13 bp, Homo sapiens
agtactactgtag

SEQ ID NO: 5218176 - DNA, 17 bp, Homo sapiens
agtactagaatttgtat

SEQ ID NO: 5218177 - DNA, 14 bp, Homo sapiens
agtactataattta

SEQ ID NO: 5218178 - DNA, 14 bp, Homo sapiens
agtactatctttgt

SEQ ID NO: 5218179 - DNA, 20 bp, Homo sapiens
agtactatctttgtctaaac

SEQ ID NO: 5218180 - DNA, 12 bp, Homo sapiens
agtactatgtat

SEQ ID NO: 5218181 - DNA, 21 bp, Homo sapiens
agtactatgtattaccagccc

SEQ ID NO: 5218182 - DNA, 14 bp, Homo sapiens
agtactattactat

SEQ ID NO: 5218183 - DNA, 17 bp, Homo sapiens
agtactcaaattcaatg

SEQ ID NO: 5218184 - DNA, 16 bp, Homo sapiens
agtactcaatgtttct

SEQ ID NO: 5218185 - DNA, 19 bp, Homo sapiens
agtactcaatgtttctgga

SEQ ID NO: 5218186 - DNA, 17 bp, Homo sapiens
agtactcaggccactcc

SEQ ID NO: 5218187 - DNA, 22 bp, Homo sapiens
agtactcataaaggacactgga

SEQ ID NO: 5218188 - DNA, 13 bp, Homo sapiens
agtactcatacat

SEQ ID NO: 5218189 - DNA, 19 bp, Homo sapiens
agtactccacactgcacaa

SEQ ID NO: 5218190 - DNA, 21 bp, Homo sapiens
agtactcctcacttttcaatt

SEQ ID NO: 5218191 - DNA, 18 bp, Homo sapiens
agtactcctgcaaaattt

SEQ ID NO: 5218192 - DNA, 19 bp, Homo sapiens
agtactcctgcaaaatttt

SEQ ID NO: 5218193 - DNA, 20 bp, Homo sapiens
agtactcctgcaaaatttta

SEQ ID NO: 5218194 - DNA, 21 bp, Homo sapiens
agtactcctgcaaaattttat

SEQ ID NO: 5218195 - DNA, 15 bp, Homo sapiens
agtactccttaagaa

SEQ ID NO: 5218196 - DNA, 18 bp, Homo sapiens
agtactccttaagaacac

SEQ ID NO: 5218197 - DNA, 17 bp, Homo sapiens
agtactctacaattcct

SEQ ID NO: 5218198 - DNA, 15 bp, Homo sapiens
agtactctctgctct

SEQ ID NO: 5218199 - DNA, 16 bp, Homo sapiens
agtactctctgctcta

SEQ ID NO: 5218200 - DNA, 20 bp, Homo sapiens
agtactctctgctctagcca

SEQ ID NO: 5218201 - DNA, 22 bp, Homo sapiens
agtactctctgctctagccagg

SEQ ID NO: 5218202 - DNA, 21 bp, Homo sapiens
agtactctgaaggaataggca

SEQ ID NO: 5218203 - DNA, 20 bp, Homo sapiens
agtactcttctagcatttag

SEQ ID NO: 5218204 - DNA, 15 bp, Homo sapiens
agtactctttaacat

SEQ ID NO: 5218205 - DNA, 22 bp, Homo sapiens
agtactctttaacatacaagaa

SEQ ID NO: 5218206 - DNA, 12 bp, Homo sapiens
agtactctttct

SEQ ID NO: 5218207 - DNA, 19 bp, Homo sapiens
agtactctttctctcccct

SEQ ID NO: 5218208 - DNA, 20 bp, Homo sapiens
agtactgaagccaaatgaaa

SEQ ID NO: 5218209 - DNA, 22 bp, Homo sapiens
agtactgaagccaaatgaaact

SEQ ID NO: 5218210 - DNA, 19 bp, Homo sapiens
agtactgagcagtgatatt

SEQ ID NO: 5218211 - DNA, 20 bp, Homo sapiens
agtactgattattcttctta

SEQ ID NO: 5218212 - DNA, 13 bp, Homo sapiens
agtactgcaaaat

SEQ ID NO: 5218213 - DNA, 15 bp, Homo sapiens
agtactgcaaaatgc

SEQ ID NO: 5218214 - DNA, 15 bp, Homo sapiens
agtactggcatggta

SEQ ID NO: 5218215 - DNA, 20 bp, Homo sapiens
agtactggctgatggagtaa

SEQ ID NO: 5218216 - DNA, 20 bp, Homo sapiens
agtactgggattacaggcgt

SEQ ID NO: 5218217 - DNA, 23 bp, Homo sapiens
agtactggggagaaataattgtt

SEQ ID NO: 5218218 - DNA, 23 bp, Homo sapiens
agtactggtaagattgttattaa

SEQ ID NO: 5218219 - DNA, 12 bp, Homo sapiens
agtactgtacta

SEQ ID NO: 5218220 - DNA, 13 bp, Homo sapiens
agtactgtactat

SEQ ID NO: 5218221 - DNA, 18 bp, Homo sapiens
agtactgtcccaggaata

SEQ ID NO: 5218222 - DNA, 18 bp, Homo sapiens
agtactgtgggcaattta

SEQ ID NO: 5218223 - DNA, 23 bp, Homo sapiens
agtactgtgggcaatttagaaaa

SEQ ID NO: 5218224 - DNA, 17 bp, Homo sapiens
agtactgtttaccattt

SEQ ID NO: 5218225 - DNA, 18 bp, Homo sapiens
agtactgttttgaagctg

SEQ ID NO: 5218226 - DNA, 13 bp, Homo sapiens
agtacttaatata

SEQ ID NO: 5218227 - DNA, 18 bp, Homo sapiens
agtacttacattccagta

SEQ ID NO: 5218228 - DNA, 12 bp, Homo sapiens
agtacttatctt

SEQ ID NO: 5218229 - DNA, 15 bp, Homo sapiens
agtacttcagcaaga

SEQ ID NO: 5218230 - DNA, 21 bp, Homo sapiens
agtacttcagcaagagagaac

SEQ ID NO: 5218231 - DNA, 15 bp, Homo sapiens
agtacttcaggcacg

SEQ ID NO: 5218232 - DNA, 14 bp, Homo sapiens
agtacttcctccca

SEQ ID NO: 5218233 - DNA, 12 bp, Homo sapiens
agtacttctaag

SEQ ID NO: 5218234 - DNA, 20 bp, Homo sapiens
agtacttctccaccctgctc

SEQ ID NO: 5218235 - DNA, 21 bp, Homo sapiens
agtacttctccaccctgctct

SEQ ID NO: 5218236 - DNA, 17 bp, Homo sapiens
agtacttcttctgtaat

SEQ ID NO: 5218237 - DNA, 12 bp, Homo sapiens
agtacttctttt

SEQ ID NO: 5218238 - DNA, 16 bp, Homo sapiens
agtacttgaaaaagta

SEQ ID NO: 5218239 - DNA, 19 bp, Homo sapiens
agtacttgaaatctaggat

SEQ ID NO: 5218240 - DNA, 14 bp, Homo sapiens
agtacttgaaatgt

SEQ ID NO: 5218241 - DNA, 16 bp, Homo sapiens
agtacttgctcaataa

SEQ ID NO: 5218242 - DNA, 21 bp, Homo sapiens
agtacttgctcaataaaggtc

SEQ ID NO: 5218243 - DNA, 22 bp, Homo sapiens
agtacttgctctctgagagcac

SEQ ID NO: 5218244 - DNA, 13 bp, Homo sapiens
agtacttgtagtt

SEQ ID NO: 5218245 - DNA, 14 bp, Homo sapiens
agtacttgtagttc

SEQ ID NO: 5218246 - DNA, 14 bp, Homo sapiens
agtacttgtcatat

SEQ ID NO: 5218247 - DNA, 17 bp, Homo sapiens
agtacttgtcatatgta

SEQ ID NO: 5218248 - DNA, 18 bp, Homo sapiens
agtacttgtgaaacacag

SEQ ID NO: 5218249 - DNA, 20 bp, Homo sapiens
agtacttgtgaaacacagct

SEQ ID NO: 5218250 - DNA, 21 bp, Homo sapiens
agtactttaaaaaggaaattt

SEQ ID NO: 5218251 - DNA, 19 bp, Homo sapiens
agtactttagactaattgt

SEQ ID NO: 5218252 - DNA, 22 bp, Homo sapiens
agtactttataaccaaagcaat

SEQ ID NO: 5218253 - DNA, 13 bp, Homo sapiens
agtactttataga

SEQ ID NO: 5218254 - DNA, 17 bp, Homo sapiens
agtactttatagaagaa

SEQ ID NO: 5218255 - DNA, 19 bp, Homo sapiens
agtactttattagtttaaa

SEQ ID NO: 5218256 - DNA, 15 bp, Homo sapiens
agtactttattgtac

SEQ ID NO: 5218257 - DNA, 22 bp, Homo sapiens
agtactttattgtacagactgt

SEQ ID NO: 5218258 - DNA, 19 bp, Homo sapiens
agtactttgatgctccctt

SEQ ID NO: 5218259 - DNA, 17 bp, Homo sapiens
agtactttgtgctcata

SEQ ID NO: 5218260 - DNA, 23 bp, Homo sapiens
agtacttttttaaatattttcta

SEQ ID NO: 5218261 - DNA, 19 bp, Homo sapiens
agtagaaaaaaaaataaca

SEQ ID NO: 5218262 - DNA, 19 bp, Homo sapiens
agtagaaaaatctcattcc

SEQ ID NO: 5218263 - DNA, 19 bp, Homo sapiens
agtagaaaaattgtttcca

SEQ ID NO: 5218264 - DNA, 20 bp, Homo sapiens
agtagaaaatacattattag

SEQ ID NO: 5218265 - DNA, 14 bp, Homo sapiens
agtagaaagaaaat

SEQ ID NO: 5218266 - DNA, 22 bp, Homo sapiens
agtagaaagaaaatgtctgttt

SEQ ID NO: 5218267 - DNA, 20 bp, Homo sapiens
agtagaaagacagagctggg

SEQ ID NO: 5218268 - DNA, 20 bp, Homo sapiens
agtagaaagacatctgcctg

SEQ ID NO: 5218269 - DNA, 12 bp, Homo sapiens
agtagaaagcta

SEQ ID NO: 5218270 - DNA, 19 bp, Homo sapiens
agtagaaagctaaagtgat

SEQ ID NO: 5218271 - DNA, 15 bp, Homo sapiens
agtagaaaggccttt

SEQ ID NO: 5218272 - DNA, 14 bp, Homo sapiens
agtagaaattgttc

SEQ ID NO: 5218273 - DNA, 15 bp, Homo sapiens
agtagaacccaggtc

SEQ ID NO: 5218274 - DNA, 22 bp, Homo sapiens
agtagaacccaggtctgatgcc

SEQ ID NO: 5218275 - DNA, 22 bp, Homo sapiens
agtagaactcttaaatactttt

SEQ ID NO: 5218276 - DNA, 14 bp, Homo sapiens
agtagaactggatc

SEQ ID NO: 5218277 - DNA, 11 bp, Homo sapiens
agtagaactgt

SEQ ID NO: 5218278 - DNA, 14 bp, Homo sapiens
agtagaactttgta

SEQ ID NO: 5218279 - DNA, 15 bp, Homo sapiens
agtagaagcatgttt

SEQ ID NO: 5218280 - DNA, 19 bp, Homo sapiens
agtagaagtctcttccagt

SEQ ID NO: 5218281 - DNA, 14 bp, Homo sapiens
agtagaataaaaac

SEQ ID NO: 5218282 - DNA, 19 bp, Homo sapiens
agtagaataacctttcaga

SEQ ID NO: 5218283 - DNA, 18 bp, Homo sapiens
agtagaatctcttttctg

SEQ ID NO: 5218284 - DNA, 17 bp, Homo sapiens
agtagaatggcagctgg

SEQ ID NO: 5218285 - DNA, 21 bp, Homo sapiens
agtagaatggttgagtgcaaa

SEQ ID NO: 5218286 - DNA, 22 bp, Homo sapiens
agtagaattaccattaattaca

SEQ ID NO: 5218287 - DNA, 14 bp, Homo sapiens
agtagaattatatc

SEQ ID NO: 5218288 - DNA, 16 bp, Homo sapiens
agtagaattatatcta

SEQ ID NO: 5218289 - DNA, 22 bp, Homo sapiens
agtagaattatatctaatttat

SEQ ID NO: 5218290 - DNA, 14 bp, Homo sapiens
agtagaattgcatt

SEQ ID NO: 5218291 - DNA, 23 bp, Homo sapiens
agtagaatttcaatgtccagtga

SEQ ID NO: 5218292 - DNA, 19 bp, Homo sapiens
agtagacatgaattttaaa

SEQ ID NO: 5218293 - DNA, 12 bp, Homo sapiens
agtagacattta

SEQ ID NO: 5218294 - DNA, 22 bp, Homo sapiens
agtagacatttctcttactgca

SEQ ID NO: 5218295 - DNA, 14 bp, Homo sapiens
agtagacatttgtg

SEQ ID NO: 5218296 - DNA, 17 bp, Homo sapiens
agtagacattttaacaa

SEQ ID NO: 5218297 - DNA, 23 bp, Homo sapiens
agtagacattttaacaagaagat

SEQ ID NO: 5218298 - DNA, 18 bp, Homo sapiens
agtagacctgattttcaa

SEQ ID NO: 5218299 - DNA, 14 bp, Homo sapiens
agtagactgtgatt

SEQ ID NO: 5218300 - DNA, 13 bp, Homo sapiens
agtagagacaggg

SEQ ID NO: 5218301 - DNA, 15 bp, Homo sapiens
agtagagacagtgtt

SEQ ID NO: 5218302 - DNA, 22 bp, Homo sapiens
agtagagacgaggtttcactgt

SEQ ID NO: 5218303 - DNA, 19 bp, Homo sapiens
agtagagatggggaaagaa

SEQ ID NO: 5218304 - DNA, 13 bp, Homo sapiens
agtagagccagct

SEQ ID NO: 5218305 - DNA, 12 bp, Homo sapiens
agtagagctggg

SEQ ID NO: 5218306 - DNA, 18 bp, Homo sapiens
agtagagcttgtaataaa

SEQ ID NO: 5218307 - DNA, 18 bp, Homo sapiens
agtagaggtactagaatg

SEQ ID NO: 5218308 - DNA, 20 bp, Homo sapiens
agtagaggtataattgtgtg

SEQ ID NO: 5218309 - DNA, 20 bp, Homo sapiens
agtagaggtttaaagaaaaa

SEQ ID NO: 5218310 - DNA, 14 bp, Homo sapiens
agtagagtcatctc

SEQ ID NO: 5218311 - DNA, 23 bp, Homo sapiens
agtagagtcatctccatcagctg

SEQ ID NO: 5218312 - DNA, 14 bp, Homo sapiens
agtagataagcaga

SEQ ID NO: 5218313 - DNA, 16 bp, Homo sapiens
agtagatagaaagcaa

SEQ ID NO: 5218314 - DNA, 14 bp, Homo sapiens
agtagatattactt

SEQ ID NO: 5218315 - DNA, 16 bp, Homo sapiens
agtagatattacttta

SEQ ID NO: 5218316 - DNA, 18 bp, Homo sapiens
agtagatattactttatc

SEQ ID NO: 5218317 - DNA, 16 bp, Homo sapiens
agtagatcacctcctc

SEQ ID NO: 5218318 - DNA, 23 bp, Homo sapiens
agtagatccatttccattgctta

SEQ ID NO: 5218319 - DNA, 17 bp, Homo sapiens
agtagatctgctttctg

SEQ ID NO: 5218320 - DNA, 19 bp, Homo sapiens
agtagatctgctttctgtt

SEQ ID NO: 5218321 - DNA, 21 bp, Homo sapiens
agtagatctgctttctgttca

SEQ ID NO: 5218322 - DNA, 22 bp, Homo sapiens
agtagatctgctttctgttcat

SEQ ID NO: 5218323 - DNA, 17 bp, Homo sapiens
agtagatggtgaaattt

SEQ ID NO: 5218324 - DNA, 21 bp, Homo sapiens
agtagatgtggcctttgaatt

SEQ ID NO: 5218325 - DNA, 18 bp, Homo sapiens
agtagattaaaatatttg

SEQ ID NO: 5218326 - DNA, 21 bp, Homo sapiens
agtagattaaaatatttgcct

SEQ ID NO: 5218327 - DNA, 15 bp, Homo sapiens
agtagattcatgaaa

SEQ ID NO: 5218328 - DNA, 18 bp, Homo sapiens
agtagattcatgaaaatg

SEQ ID NO: 5218329 - DNA, 21 bp, Homo sapiens
agtagattcatgaaaatgtat

SEQ ID NO: 5218330 - DNA, 13 bp, Homo sapiens
agtagatttcatg

SEQ ID NO: 5218331 - DNA, 15 bp, Homo sapiens
agtagattttccaaa

SEQ ID NO: 5218332 - DNA, 19 bp, Homo sapiens
agtagatttttaacaaaaa

SEQ ID NO: 5218333 - DNA, 20 bp, Homo sapiens
agtagatttttaacaaaaaa

SEQ ID NO: 5218334 - DNA, 20 bp, Homo sapiens
agtagcaaaacaaattcaaa

SEQ ID NO: 5218335 - DNA, 22 bp, Homo sapiens
agtagcaaccttcattttacat

SEQ ID NO: 5218336 - DNA, 16 bp, Homo sapiens
agtagcaactgctggt

SEQ ID NO: 5218337 - DNA, 16 bp, Homo sapiens
agtagcaagttctaga

SEQ ID NO: 5218338 - DNA, 22 bp, Homo sapiens
agtagcaagttctagagaagag

SEQ ID NO: 5218339 - DNA, 14 bp, Homo sapiens
agtagcaatgtgcc

SEQ ID NO: 5218340 - DNA, 23 bp, Homo sapiens
agtagcacaagttatttaaatct

SEQ ID NO: 5218341 - DNA, 19 bp, Homo sapiens
agtagcaccaaataaatta

SEQ ID NO: 5218342 - DNA, 22 bp, Homo sapiens
agtagcaccaaataaattacac

SEQ ID NO: 5218343 - DNA, 14 bp, Homo sapiens
agtagcagaaatat

SEQ ID NO: 5218344 - DNA, 16 bp, Homo sapiens
agtagcagaaatatat

SEQ ID NO: 5218345 - DNA, 17 bp, Homo sapiens
agtagcagaaatatatt

SEQ ID NO: 5218346 - DNA, 20 bp, Homo sapiens
agtagcaggacctgccaaga

SEQ ID NO: 5218347 - DNA, 13 bp, Homo sapiens
agtagcaggcccg

SEQ ID NO: 5218348 - DNA, 16 bp, Homo sapiens
agtagcagggaattga

SEQ ID NO: 5218349 - DNA, 20 bp, Homo sapiens
agtagcatactgatgagaca

SEQ ID NO: 5218350 - DNA, 17 bp, Homo sapiens
agtagcatctcagtggt

SEQ ID NO: 5218351 - DNA, 23 bp, Homo sapiens
agtagcatgagagaattgtatca

SEQ ID NO: 5218352 - DNA, 19 bp, Homo sapiens
agtagcatgttgagccagg

SEQ ID NO: 5218353 - DNA, 14 bp, Homo sapiens
agggcagtggaggt

SEQ ID NO: 5218354 - DNA, 12 bp, Homo sapiens
agggcagtggcc

SEQ ID NO: 5218355 - DNA, 18 bp, Homo sapiens
agggcagtggccaagcct

SEQ ID NO: 5218356 - DNA, 19 bp, Homo sapiens
agggcagtggccaagcctg

SEQ ID NO: 5218357 - DNA, 13 bp, Homo sapiens
agggcagtgtttc

SEQ ID NO: 5218358 - DNA, 15 bp, Homo sapiens
agggcagtgtttcct

SEQ ID NO: 5218359 - DNA, 16 bp, Homo sapiens
agggcagtgtttcctt

SEQ ID NO: 5218360 - DNA, 14 bp, Homo sapiens
agggcagttcgcag

SEQ ID NO: 5218361 - DNA, 20 bp, Homo sapiens
agggcagttcgcagccaccc

SEQ ID NO: 5218362 - DNA, 21 bp, Homo sapiens
agggcagttcgcagccaccct

SEQ ID NO: 5218363 - DNA, 19 bp, Homo sapiens
agggcagttctgcacccag

SEQ ID NO: 5218364 - DNA, 14 bp, Homo sapiens
agggcataaagtaa

SEQ ID NO: 5218365 - DNA, 19 bp, Homo sapiens
agggcataaagtaaataca

SEQ ID NO: 5218366 - DNA, 16 bp, Homo sapiens
agggcatatacagtga

SEQ ID NO: 5218367 - DNA, 22 bp, Homo sapiens
agggcatcagctttccctggct

SEQ ID NO: 5218368 - DNA, 23 bp, Homo sapiens
agggcatcagctttccctggctc

SEQ ID NO: 5218369 - DNA, 16 bp, Homo sapiens
agggcatcaggcactg

SEQ ID NO: 5218370 - DNA, 19 bp, Homo sapiens
agggcatccgcagcccagg

SEQ ID NO: 5218371 - DNA, 20 bp, Homo sapiens
agggcatctcaatggcatgg

SEQ ID NO: 5218372 - DNA, 13 bp, Homo sapiens
agggcatctccag

SEQ ID NO: 5218373 - DNA, 16 bp, Homo sapiens
agggcatctccaggaa

SEQ ID NO: 5218374 - DNA, 19 bp, Homo sapiens
agggcatctccaggaaggc

SEQ ID NO: 5218375 - DNA, 14 bp, Homo sapiens
agggcatctcctgt

SEQ ID NO: 5218376 - DNA, 23 bp, Homo sapiens
agggcatctcctgtgcatgggtg

SEQ ID NO: 5218377 - DNA, 15 bp, Homo sapiens
agggcatctctgagt

SEQ ID NO: 5218378 - DNA, 16 bp, Homo sapiens
agggcatctctgagtg

SEQ ID NO: 5218379 - DNA, 18 bp, Homo sapiens
agggcatcttgctggcta

SEQ ID NO: 5218380 - DNA, 22 bp, Homo sapiens
agggcatcttggtccaggaaat

SEQ ID NO: 5218381 - DNA, 13 bp, Homo sapiens
agggcatgaaatg

SEQ ID NO: 5218382 - DNA, 19 bp, Homo sapiens
agggcatgaagctgcatat

SEQ ID NO: 5218383 - DNA, 22 bp, Homo sapiens
agggcatgccccggccacctct

SEQ ID NO: 5218384 - DNA, 17 bp, Homo sapiens
agggcatgcctggcctg

SEQ ID NO: 5218385 - DNA, 14 bp, Homo sapiens
agggcatgggtcgg

SEQ ID NO: 5218386 - DNA, 16 bp, Homo sapiens
agggcatgggtcggga

SEQ ID NO: 5218387 - DNA, 21 bp, Homo sapiens
agggcatgtgcggctgaactg

SEQ ID NO: 5218388 - DNA, 16 bp, Homo sapiens
agggcatgttgggata

SEQ ID NO: 5218389 - DNA, 19 bp, Homo sapiens
agggcattcgggccacagg

SEQ ID NO: 5218390 - DNA, 16 bp, Homo sapiens
agggcattgcctgtga

SEQ ID NO: 5218391 - DNA, 22 bp, Homo sapiens
agggcattgcctgtgactgagg

SEQ ID NO: 5218392 - DNA, 16 bp, Homo sapiens
agggcattgctcagcc

SEQ ID NO: 5218393 - DNA, 13 bp, Homo sapiens
agggcatttggct

SEQ ID NO: 5218394 - DNA, 16 bp, Homo sapiens
agggcatttggcttcc

SEQ ID NO: 5218395 - DNA, 18 bp, Homo sapiens
agggcatttggcttcctc

SEQ ID NO: 5218396 - DNA, 20 bp, Homo sapiens
agggcatttttatactcaga

SEQ ID NO: 5218397 - DNA, 19 bp, Homo sapiens
agggccaaaagcttccctc

SEQ ID NO: 5218398 - DNA, 23 bp, Homo sapiens
agggccaaacgctgagccacctg

SEQ ID NO: 5218399 - DNA, 13 bp, Homo sapiens
agggccaaagaac

SEQ ID NO: 5218400 - DNA, 23 bp, Homo sapiens
agggccaaagaaccaaagaagaa

SEQ ID NO: 5218401 - DNA, 16 bp, Homo sapiens
agggccaaagcacagc

SEQ ID NO: 5218402 - DNA, 21 bp, Homo sapiens
agggccaacccttctcctctt

SEQ ID NO: 5218403 - DNA, 23 bp, Homo sapiens
agggccaacttgagggcccagag

SEQ ID NO: 5218404 - DNA, 14 bp, Homo sapiens
agggccaagccggc

SEQ ID NO: 5218405 - DNA, 20 bp, Homo sapiens
agggccaagccggcccaacc

SEQ ID NO: 5218406 - DNA, 23 bp, Homo sapiens
agggccaagccggcccaacccaa

SEQ ID NO: 5218407 - DNA, 16 bp, Homo sapiens
agggccaagtcccacc

SEQ ID NO: 5218408 - DNA, 23 bp, Homo sapiens
agggccaataccctactgtgggg

SEQ ID NO: 5218409 - DNA, 16 bp, Homo sapiens
agggccaatggagaaa

SEQ ID NO: 5218410 - DNA, 19 bp, Homo sapiens
agggccaatggagaaaatg

SEQ ID NO: 5218411 - DNA, 21 bp, Homo sapiens
agggccacatgggaggctcac

SEQ ID NO: 5218412 - DNA, 21 bp, Homo sapiens
agggccaccaggaagcacagg

SEQ ID NO: 5218413 - DNA, 18 bp, Homo sapiens
agggccaccctgagcaga

SEQ ID NO: 5218414 - DNA, 18 bp, Homo sapiens
agggccaccggtgggcag

SEQ ID NO: 5218415 - DNA, 19 bp, Homo sapiens
agggccaccggtgggcagt

SEQ ID NO: 5218416 - DNA, 22 bp, Homo sapiens
agggccacctacaatacatctg

SEQ ID NO: 5218417 - DNA, 15 bp, Homo sapiens
agggccacgctccag

SEQ ID NO: 5218418 - DNA, 16 bp, Homo sapiens
agggccacgctccagc

SEQ ID NO: 5218419 - DNA, 16 bp, Homo sapiens
agggccacgtgccagg

SEQ ID NO: 5218420 - DNA, 20 bp, Homo sapiens
agggccacgtgccaggcccg

SEQ ID NO: 5218421 - DNA, 21 bp, Homo sapiens
agggccactcaacagagagga

SEQ ID NO: 5218422 - DNA, 14 bp, Homo sapiens
agggccactctgcc

SEQ ID NO: 5218423 - DNA, 14 bp, Homo sapiens
agggccactgaaga

SEQ ID NO: 5218424 - DNA, 22 bp, Homo sapiens
agggccagaaaaaagtgtttat

SEQ ID NO: 5218425 - DNA, 23 bp, Homo sapiens
agggccagaaaaaagtgtttata

SEQ ID NO: 5218426 - DNA, 12 bp, Homo sapiens
agggccagaagg

SEQ ID NO: 5218427 - DNA, 17 bp, Homo sapiens
agggccagaaggagggc

SEQ ID NO: 5218428 - DNA, 18 bp, Homo sapiens
agggccagaaggagggca

SEQ ID NO: 5218429 - DNA, 19 bp, Homo sapiens
agggccagaaggagggcag

SEQ ID NO: 5218430 - DNA, 20 bp, Homo sapiens
agggccagaaggagggcaga

SEQ ID NO: 5218431 - DNA, 22 bp, Homo sapiens
agggccagacagaccttcacag

SEQ ID NO: 5218432 - DNA, 13 bp, Homo sapiens
agggccagagcag

SEQ ID NO: 5218433 - DNA, 17 bp, Homo sapiens
agggccagagcagctcc

SEQ ID NO: 5218434 - DNA, 14 bp, Homo sapiens
agggccagagccag

SEQ ID NO: 5218435 - DNA, 16 bp, Homo sapiens
agggccagagccaggg

SEQ ID NO: 5218436 - DNA, 16 bp, Homo sapiens
agggccagagcctggt

SEQ ID NO: 5218437 - DNA, 15 bp, Homo sapiens
agggccagagggagc

SEQ ID NO: 5218438 - DNA, 16 bp, Homo sapiens
agggccagagggagct

SEQ ID NO: 5218439 - DNA, 17 bp, Homo sapiens
agggccagcaggcagcg

SEQ ID NO: 5218440 - DNA, 19 bp, Homo sapiens
agggccagcaggcagcgcc

SEQ ID NO: 5218441 - DNA, 16 bp, Homo sapiens
agggccagcaggctcc

SEQ ID NO: 5218442 - DNA, 18 bp, Homo sapiens
agggccagcaggctcctg

SEQ ID NO: 5218443 - DNA, 15 bp, Homo sapiens
agggccagcatatat

SEQ ID NO: 5218444 - DNA, 21 bp, Homo sapiens
agggccagccctacatcttca

SEQ ID NO: 5218445 - DNA, 23 bp, Homo sapiens
agggccagccctacatcttcagc

SEQ ID NO: 5218446 - DNA, 22 bp, Homo sapiens
agggccagctcacaagcccagg

SEQ ID NO: 5218447 - DNA, 14 bp, Homo sapiens
agggccaggaagga

SEQ ID NO: 5218448 - DNA, 12 bp, Homo sapiens
agggccaggaga

SEQ ID NO: 5218449 - DNA, 17 bp, Homo sapiens
agggccaggagagagat

SEQ ID NO: 5218450 - DNA, 19 bp, Homo sapiens
agggccaggattcaggcct

SEQ ID NO: 5218451 - DNA, 21 bp, Homo sapiens
agggccaggattcaggcctct

SEQ ID NO: 5218452 - DNA, 22 bp, Homo sapiens
agggccaggcaggtgcctggac

SEQ ID NO: 5218453 - DNA, 13 bp, Homo sapiens
agggccaggccca

SEQ ID NO: 5218454 - DNA, 23 bp, Homo sapiens
agggccaggcccaggcctcacca

SEQ ID NO: 5218455 - DNA, 15 bp, Homo sapiens
agggccaggcctctg

SEQ ID NO: 5218456 - DNA, 11 bp, Homo sapiens
agggccaggct

SEQ ID NO: 5218457 - DNA, 17 bp, Homo sapiens
agggccagggacccagg

SEQ ID NO: 5218458 - DNA, 16 bp, Homo sapiens
agggccagggcaatgc

SEQ ID NO: 5218459 - DNA, 20 bp, Homo sapiens
agggccagggcaatgccatc

SEQ ID NO: 5218460 - DNA, 12 bp, Homo sapiens
agggccagggcc

SEQ ID NO: 5218461 - DNA, 15 bp, Homo sapiens
agggccagggccctg

SEQ ID NO: 5218462 - DNA, 16 bp, Homo sapiens
agggccagggctctgg

SEQ ID NO: 5218463 - DNA, 12 bp, Homo sapiens
agggccagggtt

SEQ ID NO: 5218464 - DNA, 13 bp, Homo sapiens
agggccagggttg

SEQ ID NO: 5218465 - DNA, 18 bp, Homo sapiens
agggccaggtgcagacct

SEQ ID NO: 5218466 - DNA, 17 bp, Homo sapiens
agggccaggtgcggcct

SEQ ID NO: 5218467 - DNA, 17 bp, Homo sapiens
agggccagtagagagtg

SEQ ID NO: 5218468 - DNA, 18 bp, Homo sapiens
agggccagtagagagtgc

SEQ ID NO: 5218469 - DNA, 22 bp, Homo sapiens
agggccagtagagagtgccctt

SEQ ID NO: 5218470 - DNA, 22 bp, Homo sapiens
agggccagtcctcctgggagcc

SEQ ID NO: 5218471 - DNA, 17 bp, Homo sapiens
agggccagtcctgcctg

SEQ ID NO: 5218472 - DNA, 22 bp, Homo sapiens
agggccagtcctgcctggccag

SEQ ID NO: 5218473 - DNA, 12 bp, Homo sapiens
agggccagtgat

SEQ ID NO: 5218474 - DNA, 22 bp, Homo sapiens
agggccagtgatgatgttttga

SEQ ID NO: 5218475 - DNA, 15 bp, Homo sapiens
agggccagtggggcc

SEQ ID NO: 5218476 - DNA, 17 bp, Homo sapiens
agggccagtggggcctg

SEQ ID NO: 5218477 - DNA, 19 bp, Homo sapiens
agggccagtggggcctgtg

SEQ ID NO: 5218478 - DNA, 23 bp, Homo sapiens
agggccagtggggcctgtggaat

SEQ ID NO: 5218479 - DNA, 18 bp, Homo sapiens
agggccagttggtgttcc

SEQ ID NO: 5218480 - DNA, 22 bp, Homo sapiens
agggccatacttttgagagggg

SEQ ID NO: 5218481 - DNA, 14 bp, Homo sapiens
agggccatccactg

SEQ ID NO: 5218482 - DNA, 15 bp, Homo sapiens
agggccatctgactg

SEQ ID NO: 5218483 - DNA, 17 bp, Homo sapiens
agggccatgcctgcccc

SEQ ID NO: 5218484 - DNA, 21 bp, Homo sapiens
agggccatgctgaggcctggg

SEQ ID NO: 5218485 - DNA, 18 bp, Homo sapiens
agggccattttggtgctt

SEQ ID NO: 5218486 - DNA, 17 bp, Homo sapiens
agggcccaagtccctgt

SEQ ID NO: 5218487 - DNA, 15 bp, Homo sapiens
agggcccacacctgg

SEQ ID NO: 5218488 - DNA, 13 bp, Homo sapiens
agggcccacccca

SEQ ID NO: 5218489 - DNA, 17 bp, Homo sapiens
agggcccaccccagcct

SEQ ID NO: 5218490 - DNA, 18 bp, Homo sapiens
agggcccaccccagcctc

SEQ ID NO: 5218491 - DNA, 19 bp, Homo sapiens
agggcccaccccagcctcg

SEQ ID NO: 5218492 - DNA, 20 bp, Homo sapiens
agggcccaccccagcctcgc

SEQ ID NO: 5218493 - DNA, 22 bp, Homo sapiens
agggcccaccccagcctcgcct

SEQ ID NO: 5218494 - DNA, 19 bp, Homo sapiens
agggcccacctcctccagc

SEQ ID NO: 5218495 - DNA, 15 bp, Homo sapiens
agggcccacttgtat

SEQ ID NO: 5218496 - DNA, 16 bp, Homo sapiens
agggcccagaccctgg

SEQ ID NO: 5218497 - DNA, 17 bp, Homo sapiens
agggcccagagcccagc

SEQ ID NO: 5218498 - DNA, 20 bp, Homo sapiens
agggcccagagcccagctcc

SEQ ID NO: 5218499 - DNA, 18 bp, Homo sapiens
agggcccagagcccttga

SEQ ID NO: 5218500 - DNA, 13 bp, Homo sapiens
agggcccagcagg

SEQ ID NO: 5218501 - DNA, 18 bp, Homo sapiens
agggcccagccaggagca

SEQ ID NO: 5218502 - DNA, 14 bp, Homo sapiens
agggcccagcccag

SEQ ID NO: 5218503 - DNA, 23 bp, Homo sapiens
agggcccagcccagagccacctg

SEQ ID NO: 5218504 - DNA, 14 bp, Homo sapiens
agggcccagctgta

SEQ ID NO: 5218505 - DNA, 20 bp, Homo sapiens
agggcccagggaggtggcag

SEQ ID NO: 5218506 - DNA, 13 bp, Homo sapiens
agggcccatctgc

SEQ ID NO: 5218507 - DNA, 18 bp, Homo sapiens
agggccccagaaggcagg

SEQ ID NO: 5218508 - DNA, 18 bp, Homo sapiens
agggccccaggggcagca

SEQ ID NO: 5218509 - DNA, 20 bp, Homo sapiens
agggcccccaataaaccagt

SEQ ID NO: 5218510 - DNA, 13 bp, Homo sapiens
agggcccccctcc

SEQ ID NO: 5218511 - DNA, 23 bp, Homo sapiens
agggccccgtgggtgggcctggc

SEQ ID NO: 5218512 - DNA, 16 bp, Homo sapiens
agggcccctcactggc

SEQ ID NO: 5218513 - DNA, 21 bp, Homo sapiens
agggcccctcactggctggac

SEQ ID NO: 5218514 - DNA, 16 bp, Homo sapiens
agggcccctccctctg

SEQ ID NO: 5218515 - DNA, 16 bp, Homo sapiens
agggcccctctccaag

SEQ ID NO: 5218516 - DNA, 18 bp, Homo sapiens
agggcccctctccccagg

SEQ ID NO: 5218517 - DNA, 17 bp, Homo sapiens
agggcccctctgcccag

SEQ ID NO: 5218518 - DNA, 18 bp, Homo sapiens
agggcccctctgcccagc

SEQ ID NO: 5218519 - DNA, 20 bp, Homo sapiens
agggcccctctgcccagctt

SEQ ID NO: 5218520 - DNA, 13 bp, Homo sapiens
agggcccctgaag

SEQ ID NO: 5218521 - DNA, 15 bp, Homo sapiens
agggcccctgaccct

SEQ ID NO: 5218522 - DNA, 15 bp, Homo sapiens
agggcccctggatct

SEQ ID NO: 5218523 - DNA, 23 bp, Homo sapiens
agggcccctgttcccccgctggc

SEQ ID NO: 5218524 - DNA, 19 bp, Homo sapiens
agggcccgagcgcgtgcct

SEQ ID NO: 5218525 - DNA, 19 bp, Homo sapiens
agggcccgcagtgctggga

SEQ ID NO: 5218526 - DNA, 17 bp, Homo sapiens
agggcccggccacaccc

SEQ ID NO: 5218527 - DNA, 18 bp, Homo sapiens
agggcccggccacaccca

SEQ ID NO: 5218528 - DNA, 20 bp, Homo sapiens
agggcccggccacacccagc

SEQ ID NO: 5218529 - DNA, 17 bp, Homo sapiens
agggcccgggcccaggc

SEQ ID NO: 5218530 - DNA, 23 bp, Homo sapiens
agggccctcactcaggaaccctg

SEQ ID NO: 5218531 - DNA, 13 bp, Homo sapiens
agtagcatttcat

SEQ ID NO: 5218532 - DNA, 20 bp, Homo sapiens
agtagcattttaatagtttc

SEQ ID NO: 5218533 - DNA, 17 bp, Homo sapiens
agtagccaaaaggaatg

SEQ ID NO: 5218534 - DNA, 20 bp, Homo sapiens
agtagccaaagttaaatgta

SEQ ID NO: 5218535 - DNA, 20 bp, Homo sapiens
agtagccagagttgttctca

SEQ ID NO: 5218536 - DNA, 22 bp, Homo sapiens
agtagccagggtgtggccctgc

SEQ ID NO: 5218537 - DNA, 14 bp, Homo sapiens
agtagccatgagga

SEQ ID NO: 5218538 - DNA, 21 bp, Homo sapiens
agtagccatgttaacatgaca

SEQ ID NO: 5218539 - DNA, 22 bp, Homo sapiens
agtagccatgttaacatgacat

SEQ ID NO: 5218540 - DNA, 18 bp, Homo sapiens
agtagccattttgtaact

SEQ ID NO: 5218541 - DNA, 23 bp, Homo sapiens
agtagccccaacccaaacctgga

SEQ ID NO: 5218542 - DNA, 15 bp, Homo sapiens
agtagccctttctgt

SEQ ID NO: 5218543 - DNA, 16 bp, Homo sapiens
agtagccctttctgtg

SEQ ID NO: 5218544 - DNA, 20 bp, Homo sapiens
agtagccctttctgtgtgca

SEQ ID NO: 5218545 - DNA, 21 bp, Homo sapiens
agtagccctttctgtgtgcac

SEQ ID NO: 5218546 - DNA, 18 bp, Homo sapiens
agtagccgagagcctgct

SEQ ID NO: 5218547 - DNA, 20 bp, Homo sapiens
agtagcctcctcctgggctc

SEQ ID NO: 5218548 - DNA, 22 bp, Homo sapiens
agtagcctcctcctgggctcca

SEQ ID NO: 5218549 - DNA, 17 bp, Homo sapiens
agtagcctggactgttt

SEQ ID NO: 5218550 - DNA, 18 bp, Homo sapiens
agtagcctggactgtttc

SEQ ID NO: 5218551 - DNA, 21 bp, Homo sapiens
agtagcgctatagttactgtc

SEQ ID NO: 5218552 - DNA, 19 bp, Homo sapiens
agtagcgttttttaaatgt

SEQ ID NO: 5218553 - DNA, 20 bp, Homo sapiens
agtagcgttttttaaatgta

SEQ ID NO: 5218554 - DNA, 22 bp, Homo sapiens
agtagctaatgaaattgagaag

SEQ ID NO: 5218555 - DNA, 21 bp, Homo sapiens
agtagctcaaaaatactcttg

SEQ ID NO: 5218556 - DNA, 17 bp, Homo sapiens
agtagctcattcttgtg

SEQ ID NO: 5218557 - DNA, 22 bp, Homo sapiens
agtagctctgcctttgctctgg

SEQ ID NO: 5218558 - DNA, 21 bp, Homo sapiens
agtagctgagaggaagatgaa

SEQ ID NO: 5218559 - DNA, 11 bp, Homo sapiens
agtagctgagc

SEQ ID NO: 5218560 - DNA, 18 bp, Homo sapiens
agtagctgagtgcactcc

SEQ ID NO: 5218561 - DNA, 24 bp, Homo sapiens
agtagctgagtgcactcctggtga

SEQ ID NO: 5218562 - DNA, 15 bp, Homo sapiens
agtagctgataaaga

SEQ ID NO: 5218563 - DNA, 14 bp, Homo sapiens
agtagctgcagcct

SEQ ID NO: 5218564 - DNA, 17 bp, Homo sapiens
agtagctgcagccttca

SEQ ID NO: 5218565 - DNA, 23 bp, Homo sapiens
agtagctgcagccttcatcagaa

SEQ ID NO: 5218566 - DNA, 16 bp, Homo sapiens
agtagctgccaaaaag

SEQ ID NO: 5218567 - DNA, 20 bp, Homo sapiens
agtagctgccaaaaagaaca

SEQ ID NO: 5218568 - DNA, 17 bp, Homo sapiens
agtagctgcccttcctg

SEQ ID NO: 5218569 - DNA, 11 bp, Homo sapiens
agtagctgcta

SEQ ID NO: 5218570 - DNA, 15 bp, Homo sapiens
agtagctgcttcctg

SEQ ID NO: 5218571 - DNA, 17 bp, Homo sapiens
agtagctgcttcctgga

SEQ ID NO: 5218572 - DNA, 19 bp, Homo sapiens
agtagctgggactacaggc

SEQ ID NO: 5218573 - DNA, 21 bp, Homo sapiens
agtagctgggactacaggcgc

SEQ ID NO: 5218574 - DNA, 14 bp, Homo sapiens
agtagctgggatta

SEQ ID NO: 5218575 - DNA, 18 bp, Homo sapiens
agtagctgggattacagg

SEQ ID NO: 5218576 - DNA, 21 bp, Homo sapiens
agtagctgggattacaggcgc

SEQ ID NO: 5218577 - DNA, 21 bp, Homo sapiens
agtagctgggattttaaacta

SEQ ID NO: 5218578 - DNA, 12 bp, Homo sapiens
agtagctgggcc

SEQ ID NO: 5218579 - DNA, 14 bp, Homo sapiens
agtagctgggcctg

SEQ ID NO: 5218580 - DNA, 14 bp, Homo sapiens
agtagctgtatgag

SEQ ID NO: 5218581 - DNA, 13 bp, Homo sapiens
agtagctgtgggg

SEQ ID NO: 5218582 - DNA, 21 bp, Homo sapiens
agtagctgttttgaataacat

SEQ ID NO: 5218583 - DNA, 16 bp, Homo sapiens
agtagcttaagaaaaa

SEQ ID NO: 5218584 - DNA, 16 bp, Homo sapiens
agtagcttgctccctg

SEQ ID NO: 5218585 - DNA, 18 bp, Homo sapiens
agtagcttgctccctgtg

SEQ ID NO: 5218586 - DNA, 12 bp, Homo sapiens
agtaggaaagaa

SEQ ID NO: 5218587 - DNA, 14 bp, Homo sapiens
agtaggaaagaatt

SEQ ID NO: 5218588 - DNA, 20 bp, Homo sapiens
agtaggaaatacaataaata

SEQ ID NO: 5218589 - DNA, 17 bp, Homo sapiens
agtaggaaatcaggcag

SEQ ID NO: 5218590 - DNA, 22 bp, Homo sapiens
agtaggaacaagctggcttctg

SEQ ID NO: 5218591 - DNA, 20 bp, Homo sapiens
agtaggaacccagctctcag

SEQ ID NO: 5218592 - DNA, 19 bp, Homo sapiens
agtaggaagactttggaaa

SEQ ID NO: 5218593 - DNA, 17 bp, Homo sapiens
agtaggaaggaaaaaat

SEQ ID NO: 5218594 - DNA, 15 bp, Homo sapiens
agtaggaccaggcca

SEQ ID NO: 5218595 - DNA, 16 bp, Homo sapiens
agtaggaccaggccac

SEQ ID NO: 5218596 - DNA, 23 bp, Homo sapiens
agtaggactccttatttggcgtg

SEQ ID NO: 5218597 - DNA, 13 bp, Homo sapiens
agtaggagacaca

SEQ ID NO: 5218598 - DNA, 14 bp, Homo sapiens
agtaggagacacag

SEQ ID NO: 5218599 - DNA, 16 bp, Homo sapiens
agtaggagtggctgac

SEQ ID NO: 5218600 - DNA, 23 bp, Homo sapiens
agtaggatatagcgaaaggcgag

SEQ ID NO: 5218601 - DNA, 20 bp, Homo sapiens
agtaggatgtctcttggaaa

SEQ ID NO: 5218602 - DNA, 15 bp, Homo sapiens
agtaggcaagatggc

SEQ ID NO: 5218603 - DNA, 22 bp, Homo sapiens
agtaggcatttttaccatcact

SEQ ID NO: 5218604 - DNA, 13 bp, Homo sapiens
agtaggccctgct

SEQ ID NO: 5218605 - DNA, 20 bp, Homo sapiens
agtaggccgctgatgatata

SEQ ID NO: 5218606 - DNA, 23 bp, Homo sapiens
agtaggccgctgatgatatattc

SEQ ID NO: 5218607 - DNA, 17 bp, Homo sapiens
agtaggctccagacagg

SEQ ID NO: 5218608 - DNA, 11 bp, Homo sapiens
agtaggctgcc

SEQ ID NO: 5218609 - DNA, 21 bp, Homo sapiens
agtagggaggaccacaggtgt

SEQ ID NO: 5218610 - DNA, 21 bp, Homo sapiens
agtagggatgcggatcctgct

SEQ ID NO: 5218611 - DNA, 20 bp, Homo sapiens
agtagggccctgacaggcct

SEQ ID NO: 5218612 - DNA, 18 bp, Homo sapiens
agtagggcttagtgtttt

SEQ ID NO: 5218613 - DNA, 23 bp, Homo sapiens
agtaggggaggagcacagtttgt

SEQ ID NO: 5218614 - DNA, 17 bp, Homo sapiens
agtaggggcatggtata

SEQ ID NO: 5218615 - DNA, 20 bp, Homo sapiens
agtaggggtctgtcttttaa

SEQ ID NO: 5218616 - DNA, 21 bp, Homo sapiens
agtaggggttgaagaaaacaa

SEQ ID NO: 5218617 - DNA, 13 bp, Homo sapiens
agtagggtcaggc

SEQ ID NO: 5218618 - DNA, 14 bp, Homo sapiens
agtaggtattaatc

SEQ ID NO: 5218619 - DNA, 13 bp, Homo sapiens
agtaggtccaagg

SEQ ID NO: 5218620 - DNA, 16 bp, Homo sapiens
agtaggtcccggccag

SEQ ID NO: 5218621 - DNA, 21 bp, Homo sapiens
agtaggtcccggccagctctg

SEQ ID NO: 5218622 - DNA, 17 bp, Homo sapiens
agtaggtcctcaataaa

SEQ ID NO: 5218623 - DNA, 19 bp, Homo sapiens
agtaggtcctcaataaata

SEQ ID NO: 5218624 - DNA, 14 bp, Homo sapiens
agtaggtctgcaca

SEQ ID NO: 5218625 - DNA, 12 bp, Homo sapiens
agtaggtctggg

SEQ ID NO: 5218626 - DNA, 14 bp, Homo sapiens
agtaggtgatgagt

SEQ ID NO: 5218627 - DNA, 13 bp, Homo sapiens
agtaggtgcttga

SEQ ID NO: 5218628 - DNA, 22 bp, Homo sapiens
agtaggtggcttgagctagaga

SEQ ID NO: 5218629 - DNA, 20 bp, Homo sapiens
agtaggtgggggaacactga

SEQ ID NO: 5218630 - DNA, 20 bp, Homo sapiens
agtaggtgggtcttggattg

SEQ ID NO: 5218631 - DNA, 20 bp, Homo sapiens
agtaggttggaagctagctc

SEQ ID NO: 5218632 - DNA, 13 bp, Homo sapiens
agtagtaaaaatt

SEQ ID NO: 5218633 - DNA, 18 bp, Homo sapiens
agtagtaaatcagaaagt

SEQ ID NO: 5218634 - DNA, 19 bp, Homo sapiens
agtagtaattgatttgacc

SEQ ID NO: 5218635 - DNA, 13 bp, Homo sapiens
agtagtaccttgt

SEQ ID NO: 5218636 - DNA, 21 bp, Homo sapiens
agtagtacttcttctgtaata

SEQ ID NO: 5218637 - DNA, 16 bp, Homo sapiens
agtagtagtatggcac

SEQ ID NO: 5218638 - DNA, 21 bp, Homo sapiens
agtagtatatttaattttgac

SEQ ID NO: 5218639 - DNA, 20 bp, Homo sapiens
agtagtatgttattcctggt

SEQ ID NO: 5218640 - DNA, 20 bp, Homo sapiens
agtagtcaaaaacaaagctg

SEQ ID NO: 5218641 - DNA, 22 bp, Homo sapiens
agtagtcaaaaacaaagctgat

SEQ ID NO: 5218642 - DNA, 15 bp, Homo sapiens
agtagtcaattagta

SEQ ID NO: 5218643 - DNA, 17 bp, Homo sapiens
agtagtcacaaactgat

SEQ ID NO: 5218644 - DNA, 13 bp, Homo sapiens
agtagtcatttca

SEQ ID NO: 5218645 - DNA, 14 bp, Homo sapiens
agtagtcatttcat

SEQ ID NO: 5218646 - DNA, 15 bp, Homo sapiens
agtagtccaccttca

SEQ ID NO: 5218647 - DNA, 13 bp, Homo sapiens
agtagtctctgtg

SEQ ID NO: 5218648 - DNA, 13 bp, Homo sapiens
agtagtctgctca

SEQ ID NO: 5218649 - DNA, 13 bp, Homo sapiens
agtagtgaccaat

SEQ ID NO: 5218650 - DNA, 15 bp, Homo sapiens
agtagtgagaagaat

SEQ ID NO: 5218651 - DNA, 18 bp, Homo sapiens
agtagtgagaagaatatt

SEQ ID NO: 5218652 - DNA, 18 bp, Homo sapiens
agtagtgcctttacttca

SEQ ID NO: 5218653 - DNA, 13 bp, Homo sapiens
agtagtggccact

SEQ ID NO: 5218654 - DNA, 22 bp, Homo sapiens
agtagtggccactggggtgcct

SEQ ID NO: 5218655 - DNA, 15 bp, Homo sapiens
agtagtggtttgctt

SEQ ID NO: 5218656 - DNA, 21 bp, Homo sapiens
agtagtgtcttcctagtatat

SEQ ID NO: 5218657 - DNA, 14 bp, Homo sapiens
agtagtgttacatg

SEQ ID NO: 5218658 - DNA, 17 bp, Homo sapiens
agtagtgttacatgtat

SEQ ID NO: 5218659 - DNA, 22 bp, Homo sapiens
agtagtgttgggtggaggatgg

SEQ ID NO: 5218660 - DNA, 12 bp, Homo sapiens
agtagttaaaaa

SEQ ID NO: 5218661 - DNA, 12 bp, Homo sapiens
agtagttaaaac

SEQ ID NO: 5218662 - DNA, 19 bp, Homo sapiens
agtagttaaaacagctatt

SEQ ID NO: 5218663 - DNA, 13 bp, Homo sapiens
agtagttaaaagt

SEQ ID NO: 5218664 - DNA, 14 bp, Homo sapiens
agtagttaattctg

SEQ ID NO: 5218665 - DNA, 19 bp, Homo sapiens
agtagttactaaaattatg

SEQ ID NO: 5218666 - DNA, 14 bp, Homo sapiens
agtagttagaacta

SEQ ID NO: 5218667 - DNA, 21 bp, Homo sapiens
agtagttccacacaggtttgt

SEQ ID NO: 5218668 - DNA, 18 bp, Homo sapiens
agtagttcctattttcta

SEQ ID NO: 5218669 - DNA, 19 bp, Homo sapiens
agtagttctcttggtgtta

SEQ ID NO: 5218670 - DNA, 20 bp, Homo sapiens
agtagttgattcagccctca

SEQ ID NO: 5218671 - DNA, 21 bp, Homo sapiens
agtagttgggattacaggtga

SEQ ID NO: 5218672 - DNA, 16 bp, Homo sapiens
agtagttggtttgtat

SEQ ID NO: 5218673 - DNA, 21 bp, Homo sapiens
agtagttgtattcttctgtat

SEQ ID NO: 5218674 - DNA, 21 bp, Homo sapiens
agtagtttcatgtaaagaaaa

SEQ ID NO: 5218675 - DNA, 13 bp, Homo sapiens
agtagtttgaatg

SEQ ID NO: 5218676 - DNA, 17 bp, Homo sapiens
agtagtttgagaccagc

SEQ ID NO: 5218677 - DNA, 19 bp, Homo sapiens
agtagtttgagaccagcct

SEQ ID NO: 5218678 - DNA, 20 bp, Homo sapiens
agtagtttgcatttcagaaa

SEQ ID NO: 5218679 - DNA, 15 bp, Homo sapiens
agtagtttggtttga

SEQ ID NO: 5218680 - DNA, 14 bp, Homo sapiens
agtagttttcaaaa

SEQ ID NO: 5218681 - DNA, 17 bp, Homo sapiens
agtagttttgttcatga

SEQ ID NO: 5218682 - DNA, 21 bp, Homo sapiens
agtagtttttacagctgtgtt

SEQ ID NO: 5218683 - DNA, 21 bp, Homo sapiens
agtagtttttctgtaacacag

SEQ ID NO: 5218684 - DNA, 15 bp, Homo sapiens
agtataaaactgctt

SEQ ID NO: 5218685 - DNA, 22 bp, Homo sapiens
agtataaaatagtatgaaaatg

SEQ ID NO: 5218686 - DNA, 13 bp, Homo sapiens
agtataaacaaag

SEQ ID NO: 5218687 - DNA, 17 bp, Homo sapiens
agtataaacccattttg

SEQ ID NO: 5218688 - DNA, 15 bp, Homo sapiens
agtataaagtaaaat

SEQ ID NO: 5218689 - DNA, 19 bp, Homo sapiens
agtataaagtcacttccag

SEQ ID NO: 5218690 - DNA, 18 bp, Homo sapiens
agtataaatggttgtctg

SEQ ID NO: 5218691 - DNA, 14 bp, Homo sapiens
agtataaattacat

SEQ ID NO: 5218692 - DNA, 15 bp, Homo sapiens
agtataaattacatg

SEQ ID NO: 5218693 - DNA, 17 bp, Homo sapiens
agtataaattacatgca

SEQ ID NO: 5218694 - DNA, 18 bp, Homo sapiens
agtataaattacatgcat

SEQ ID NO: 5218695 - DNA, 20 bp, Homo sapiens
agtataaattacatgcatga

SEQ ID NO: 5218696 - DNA, 16 bp, Homo sapiens
agtataaattatctta

SEQ ID NO: 5218697 - DNA, 19 bp, Homo sapiens
agtataacaattaaaatct

SEQ ID NO: 5218698 - DNA, 22 bp, Homo sapiens
agtataacagttttgagtaatt

SEQ ID NO: 5218699 - DNA, 15 bp, Homo sapiens
agtataactttaaat

SEQ ID NO: 5218700 - DNA, 14 bp, Homo sapiens
agtataagaaatgc

SEQ ID NO: 5218701 - DNA, 16 bp, Homo sapiens
agtataagaaatgcat

SEQ ID NO: 5218702 - DNA, 18 bp, Homo sapiens
agtataagaaatgcatat

SEQ ID NO: 5218703 - DNA, 12 bp, Homo sapiens
agtataagattt

SEQ ID NO: 5218704 - DNA, 14 bp, Homo sapiens
agtataagcttttc

SEQ ID NO: 5218705 - DNA, 22 bp, Homo sapiens
agtataagggtcacaagtctaa

SEQ ID NO: 5218706 - DNA, 10 bp, Homo sapiens
agtataattg

SEQ ID NO: 5218707 - DNA, 20 bp, Homo sapiens
agtatacaacaggagagaga

SEQ ID NO: 5218708 - DNA, 15 bp, Homo sapiens
agtatacaagataag

SEQ ID NO: 5218709 - DNA, 14 bp, Homo sapiens
agggccctcagagg

SEQ ID NO: 5218710 - DNA, 13 bp, Homo sapiens
agggccctcccag

SEQ ID NO: 5218711 - DNA, 20 bp, Homo sapiens
agggccctctggggctcagc

SEQ ID NO: 5218712 - DNA, 17 bp, Homo sapiens
agggccctgaggaataa

SEQ ID NO: 5218713 - DNA, 12 bp, Homo sapiens
agggccctgcag

SEQ ID NO: 5218714 - DNA, 13 bp, Homo sapiens
agggccctgcaga

SEQ ID NO: 5218715 - DNA, 14 bp, Homo sapiens
agggccctgcccca

SEQ ID NO: 5218716 - DNA, 19 bp, Homo sapiens
agggccctgccccaggcct

SEQ ID NO: 5218717 - DNA, 23 bp, Homo sapiens
agggccctgccccaggcctggac

SEQ ID NO: 5218718 - DNA, 13 bp, Homo sapiens
agggccctgccct

SEQ ID NO: 5218719 - DNA, 11 bp, Homo sapiens
agggccctgct

SEQ ID NO: 5218720 - DNA, 16 bp, Homo sapiens
agggccctgctcaggc

SEQ ID NO: 5218721 - DNA, 17 bp, Homo sapiens
agggccctgctcaggcc

SEQ ID NO: 5218722 - DNA, 18 bp, Homo sapiens
agggccctgctcaggcct

SEQ ID NO: 5218723 - DNA, 19 bp, Homo sapiens
agggccctgctcaggcctc

SEQ ID NO: 5218724 - DNA, 15 bp, Homo sapiens
agggccctggccagc

SEQ ID NO: 5218725 - DNA, 16 bp, Homo sapiens
agggccctggccagcc

SEQ ID NO: 5218726 - DNA, 16 bp, Homo sapiens
agggccctgggcctgc

SEQ ID NO: 5218727 - DNA, 20 bp, Homo sapiens
agggccctggggtctctgag

SEQ ID NO: 5218728 - DNA, 22 bp, Homo sapiens
agggccctggggtctctgagca

SEQ ID NO: 5218729 - DNA, 22 bp, Homo sapiens
agggccctgtggagtccagctc

SEQ ID NO: 5218730 - DNA, 15 bp, Homo sapiens
agggccctgtgtctg

SEQ ID NO: 5218731 - DNA, 15 bp, Homo sapiens
agggcccttcactgc

SEQ ID NO: 5218732 - DNA, 23 bp, Homo sapiens
agggcccttcccaacctcccctg

SEQ ID NO: 5218733 - DNA, 22 bp, Homo sapiens
agggccgaggaatgtgaagcca

SEQ ID NO: 5218734 - DNA, 21 bp, Homo sapiens
agggccgaggaggtgcctgga

SEQ ID NO: 5218735 - DNA, 14 bp, Homo sapiens
agggccgcagggcc

SEQ ID NO: 5218736 - DNA, 15 bp, Homo sapiens
agggccgcagggccc

SEQ ID NO: 5218737 - DNA, 20 bp, Homo sapiens
agggccgcccgctcccttcc

SEQ ID NO: 5218738 - DNA, 19 bp, Homo sapiens
agggccgcccgggcccaga

SEQ ID NO: 5218739 - DNA, 13 bp, Homo sapiens
agggccgcttctc

SEQ ID NO: 5218740 - DNA, 17 bp, Homo sapiens
agggccggcggctctga

SEQ ID NO: 5218741 - DNA, 20 bp, Homo sapiens
agggccggcggctctgagca

SEQ ID NO: 5218742 - DNA, 18 bp, Homo sapiens
agggccggcttctgcctg

SEQ ID NO: 5218743 - DNA, 21 bp, Homo sapiens
agggccggcttctgcctgggg

SEQ ID NO: 5218744 - DNA, 16 bp, Homo sapiens
agggccgggcagaggg

SEQ ID NO: 5218745 - DNA, 20 bp, Homo sapiens
agggccgggcagaggggcag

SEQ ID NO: 5218746 - DNA, 21 bp, Homo sapiens
agggccggggaactggccaag

SEQ ID NO: 5218747 - DNA, 20 bp, Homo sapiens
agggccggggggggtaggag

SEQ ID NO: 5218748 - DNA, 22 bp, Homo sapiens
agggccggggggggtaggagag

SEQ ID NO: 5218749 - DNA, 18 bp, Homo sapiens
agggccgtaccccaccct

SEQ ID NO: 5218750 - DNA, 19 bp, Homo sapiens
agggccgtaccccaccctc

SEQ ID NO: 5218751 - DNA, 20 bp, Homo sapiens
agggccgtaccccaccctca

SEQ ID NO: 5218752 - DNA, 16 bp, Homo sapiens
agggccgtgcccttgc

SEQ ID NO: 5218753 - DNA, 20 bp, Homo sapiens
agggcctcaaaggcccgctc

SEQ ID NO: 5218754 - DNA, 14 bp, Homo sapiens
agggcctcagagac

SEQ ID NO: 5218755 - DNA, 15 bp, Homo sapiens
agggcctcagagaca

SEQ ID NO: 5218756 - DNA, 16 bp, Homo sapiens
agggcctcagagcctg

SEQ ID NO: 5218757 - DNA, 20 bp, Homo sapiens
agggcctcagagcctgacct

SEQ ID NO: 5218758 - DNA, 13 bp, Homo sapiens
agggcctcagttt

SEQ ID NO: 5218759 - DNA, 15 bp, Homo sapiens
agggcctcatctcac

SEQ ID NO: 5218760 - DNA, 16 bp, Homo sapiens
agggcctcatctcacc

SEQ ID NO: 5218761 - DNA, 13 bp, Homo sapiens
agggcctccaggg

SEQ ID NO: 5218762 - DNA, 17 bp, Homo sapiens
agggcctcccagcccaa

SEQ ID NO: 5218763 - DNA, 20 bp, Homo sapiens
agggcctcctgggggacctt

SEQ ID NO: 5218764 - DNA, 20 bp, Homo sapiens
agggcctcggaggctcctcc

SEQ ID NO: 5218765 - DNA, 19 bp, Homo sapiens
agggcctctccaaccactg

SEQ ID NO: 5218766 - DNA, 13 bp, Homo sapiens
agggcctctgcct

SEQ ID NO: 5218767 - DNA, 15 bp, Homo sapiens
agggcctctgcctgg

SEQ ID NO: 5218768 - DNA, 13 bp, Homo sapiens
agggcctctggac

SEQ ID NO: 5218769 - DNA, 15 bp, Homo sapiens
agggcctctggacag

SEQ ID NO: 5218770 - DNA, 12 bp, Homo sapiens
agggcctctggt

SEQ ID NO: 5218771 - DNA, 19 bp, Homo sapiens
agggcctctggtgttcctg

SEQ ID NO: 5218772 - DNA, 22 bp, Homo sapiens
agggcctctgtgcagacagtgt

SEQ ID NO: 5218773 - DNA, 19 bp, Homo sapiens
agggcctgaaacccgccct

SEQ ID NO: 5218774 - DNA, 18 bp, Homo sapiens
agggcctgacaccccctc

SEQ ID NO: 5218775 - DNA, 19 bp, Homo sapiens
agggcctgacaccccctcc

SEQ ID NO: 5218776 - DNA, 21 bp, Homo sapiens
agggcctgactccttctgcca

SEQ ID NO: 5218777 - DNA, 18 bp, Homo sapiens
agggcctgacttgagcca

SEQ ID NO: 5218778 - DNA, 15 bp, Homo sapiens
agggcctgagcagct

SEQ ID NO: 5218779 - DNA, 22 bp, Homo sapiens
agggcctgagcctggccagcct

SEQ ID NO: 5218780 - DNA, 21 bp, Homo sapiens
agggcctgaggtctggctgct

SEQ ID NO: 5218781 - DNA, 19 bp, Homo sapiens
agggcctgagtgacctcct

SEQ ID NO: 5218782 - DNA, 20 bp, Homo sapiens
agggcctgagtgacctcctt

SEQ ID NO: 5218783 - DNA, 23 bp, Homo sapiens
agggcctgagtgacctccttctg

SEQ ID NO: 5218784 - DNA, 14 bp, Homo sapiens
agggcctgcaaggg

SEQ ID NO: 5218785 - DNA, 22 bp, Homo sapiens
agggcctgcaggacctgcctgt

SEQ ID NO: 5218786 - DNA, 23 bp, Homo sapiens
agggcctgcagtgattcagcagg

SEQ ID NO: 5218787 - DNA, 13 bp, Homo sapiens
agggcctgctgga

SEQ ID NO: 5218788 - DNA, 16 bp, Homo sapiens
agggcctgctggaggc

SEQ ID NO: 5218789 - DNA, 17 bp, Homo sapiens
agggcctgctggaggcc

SEQ ID NO: 5218790 - DNA, 23 bp, Homo sapiens
agggcctgctggaggcctcaggt

SEQ ID NO: 5218791 - DNA, 23 bp, Homo sapiens
agggcctgcttccccttcctaag

SEQ ID NO: 5218792 - DNA, 16 bp, Homo sapiens
agggcctggcaggcca

SEQ ID NO: 5218793 - DNA, 11 bp, Homo sapiens
agggcctggcc

SEQ ID NO: 5218794 - DNA, 14 bp, Homo sapiens
agggcctggccagt

SEQ ID NO: 5218795 - DNA, 15 bp, Homo sapiens
agggcctggccagtc

SEQ ID NO: 5218796 - DNA, 14 bp, Homo sapiens
agggcctggcccat

SEQ ID NO: 5218797 - DNA, 12 bp, Homo sapiens
agggcctggcct

SEQ ID NO: 5218798 - DNA, 18 bp, Homo sapiens
agggcctggcctgagctg

SEQ ID NO: 5218799 - DNA, 17 bp, Homo sapiens
agggcctggccttgtcc

SEQ ID NO: 5218800 - DNA, 14 bp, Homo sapiens
agggcctggctcca

SEQ ID NO: 5218801 - DNA, 17 bp, Homo sapiens
agggcctgggcctcatg

SEQ ID NO: 5218802 - DNA, 17 bp, Homo sapiens
agggcctgggcctggct

SEQ ID NO: 5218803 - DNA, 17 bp, Homo sapiens
agggcctggggaaacca

SEQ ID NO: 5218804 - DNA, 15 bp, Homo sapiens
agggcctggggcctg

SEQ ID NO: 5218805 - DNA, 16 bp, Homo sapiens
agggcctggggcctga

SEQ ID NO: 5218806 - DNA, 17 bp, Homo sapiens
agggcctggggcctgag

SEQ ID NO: 5218807 - DNA, 18 bp, Homo sapiens
agggcctggggcctgaga

SEQ ID NO: 5218808 - DNA, 19 bp, Homo sapiens
agggcctggggcctgagag

SEQ ID NO: 5218809 - DNA, 22 bp, Homo sapiens
agggcctggggcctgagagaat

SEQ ID NO: 5218810 - DNA, 23 bp, Homo sapiens
agggcctgggggcagtgactggc

SEQ ID NO: 5218811 - DNA, 17 bp, Homo sapiens
agggcctggttgaagaa

SEQ ID NO: 5218812 - DNA, 17 bp, Homo sapiens
agggcctgtatgcctgg

SEQ ID NO: 5218813 - DNA, 18 bp, Homo sapiens
agggcctgtgggagcctg

SEQ ID NO: 5218814 - DNA, 21 bp, Homo sapiens
agggccttcccctcccagccc

SEQ ID NO: 5218815 - DNA, 22 bp, Homo sapiens
agggccttcccctcccagccct

SEQ ID NO: 5218816 - DNA, 14 bp, Homo sapiens
agggccttgcccag

SEQ ID NO: 5218817 - DNA, 12 bp, Homo sapiens
agggccttgcta

SEQ ID NO: 5218818 - DNA, 16 bp, Homo sapiens
agggccttgcttctct

SEQ ID NO: 5218819 - DNA, 17 bp, Homo sapiens
agggccttgcttctctt

SEQ ID NO: 5218820 - DNA, 19 bp, Homo sapiens
agggccttttctggcaccg

SEQ ID NO: 5218821 - DNA, 15 bp, Homo sapiens
agggccttttctgtg

SEQ ID NO: 5218822 - DNA, 13 bp, Homo sapiens
agggcgaaggcca

SEQ ID NO: 5218823 - DNA, 14 bp, Homo sapiens
agggcgaaggccat

SEQ ID NO: 5218824 - DNA, 20 bp, Homo sapiens
agggcgacctgcacgcactg

SEQ ID NO: 5218825 - DNA, 13 bp, Homo sapiens
agggcgagactcc

SEQ ID NO: 5218826 - DNA, 18 bp, Homo sapiens
agggcgagcggcaaaggc

SEQ ID NO: 5218827 - DNA, 21 bp, Homo sapiens
agggcgaggattataaatgaa

SEQ ID NO: 5218828 - DNA, 21 bp, Homo sapiens
agggcgaggcgggggatcctg

SEQ ID NO: 5218829 - DNA, 13 bp, Homo sapiens
agggcgaggggag

SEQ ID NO: 5218830 - DNA, 20 bp, Homo sapiens
agggcgaggggttggtggga

SEQ ID NO: 5218831 - DNA, 13 bp, Homo sapiens
agggcgagtgaat

SEQ ID NO: 5218832 - DNA, 17 bp, Homo sapiens
agggcgcaaagggcatg

SEQ ID NO: 5218833 - DNA, 18 bp, Homo sapiens
agggcgcaaagggcatgg

SEQ ID NO: 5218834 - DNA, 14 bp, Homo sapiens
agggcgcccagcag

SEQ ID NO: 5218835 - DNA, 22 bp, Homo sapiens
agggcgcccagcagcctgccag

SEQ ID NO: 5218836 - DNA, 23 bp, Homo sapiens
agggcgcccagcagcctgccagc

SEQ ID NO: 5218837 - DNA, 16 bp, Homo sapiens
agggcgcccagcccag

SEQ ID NO: 5218838 - DNA, 19 bp, Homo sapiens
agggcgcccagcccaggcc

SEQ ID NO: 5218839 - DNA, 21 bp, Homo sapiens
agggcgcccagcccaggcctg

SEQ ID NO: 5218840 - DNA, 22 bp, Homo sapiens
agggcgcccctgggagacaact

SEQ ID NO: 5218841 - DNA, 12 bp, Homo sapiens
agggcgcctggg

SEQ ID NO: 5218842 - DNA, 23 bp, Homo sapiens
agggcgcctgggtcctcccagct

SEQ ID NO: 5218843 - DNA, 14 bp, Homo sapiens
agggcgctcagacg

SEQ ID NO: 5218844 - DNA, 19 bp, Homo sapiens
agggcgctcagacggcggc

SEQ ID NO: 5218845 - DNA, 23 bp, Homo sapiens
agggcgctcagacggcggccagg

SEQ ID NO: 5218846 - DNA, 20 bp, Homo sapiens
agggcgctccggcagaggca

SEQ ID NO: 5218847 - DNA, 14 bp, Homo sapiens
agggcggagcgcct

SEQ ID NO: 5218848 - DNA, 18 bp, Homo sapiens
agggcggagcgcctcctt

SEQ ID NO: 5218849 - DNA, 15 bp, Homo sapiens
agggcggcaggggcc

SEQ ID NO: 5218850 - DNA, 18 bp, Homo sapiens
agggcggcaggggcctgg

SEQ ID NO: 5218851 - DNA, 13 bp, Homo sapiens
agggcggccaggg

SEQ ID NO: 5218852 - DNA, 17 bp, Homo sapiens
agggcggcctccttctg

SEQ ID NO: 5218853 - DNA, 18 bp, Homo sapiens
agggcggcggggcctggg

SEQ ID NO: 5218854 - DNA, 21 bp, Homo sapiens
agggcggctaggccggccagc

SEQ ID NO: 5218855 - DNA, 23 bp, Homo sapiens
agggcggctaggccggccagctc

SEQ ID NO: 5218856 - DNA, 13 bp, Homo sapiens
agggcggggctgg

SEQ ID NO: 5218857 - DNA, 16 bp, Homo sapiens
agggcggggctggcca

SEQ ID NO: 5218858 - DNA, 23 bp, Homo sapiens
agggcggggtgtctgtcttcctt

SEQ ID NO: 5218859 - DNA, 14 bp, Homo sapiens
agggcgtcaggcag

SEQ ID NO: 5218860 - DNA, 19 bp, Homo sapiens
agggcgtcaggcagaggca

SEQ ID NO: 5218861 - DNA, 15 bp, Homo sapiens
agggcgtgaaacaca

SEQ ID NO: 5218862 - DNA, 20 bp, Homo sapiens
agggcgtggctctgggtggg

SEQ ID NO: 5218863 - DNA, 21 bp, Homo sapiens
agggcgtgtggtttccctgcc

SEQ ID NO: 5218864 - DNA, 22 bp, Homo sapiens
agggcgtgtggtttccctgccc

SEQ ID NO: 5218865 - DNA, 14 bp, Homo sapiens
agggctaaatgttt

SEQ ID NO: 5218866 - DNA, 16 bp, Homo sapiens
agggctaaccagttct

SEQ ID NO: 5218867 - DNA, 21 bp, Homo sapiens
agggctaagagctagcgctgc

SEQ ID NO: 5218868 - DNA, 21 bp, Homo sapiens
agggctaattctgggaaggga

SEQ ID NO: 5218869 - DNA, 23 bp, Homo sapiens
agggctaattctgggaagggaga

SEQ ID NO: 5218870 - DNA, 20 bp, Homo sapiens
agggctacaaaggaggacaa

SEQ ID NO: 5218871 - DNA, 16 bp, Homo sapiens
agggctacacagaccc

SEQ ID NO: 5218872 - DNA, 22 bp, Homo sapiens
agggctacacagaccctgccca

SEQ ID NO: 5218873 - DNA, 17 bp, Homo sapiens
agggctaccctgagctg

SEQ ID NO: 5218874 - DNA, 21 bp, Homo sapiens
agggctaccctgagctgaggc

SEQ ID NO: 5218875 - DNA, 23 bp, Homo sapiens
agggctaccctgagctgaggcag

SEQ ID NO: 5218876 - DNA, 15 bp, Homo sapiens
agggctactcagcag

SEQ ID NO: 5218877 - DNA, 17 bp, Homo sapiens
agggctagaacctagaa

SEQ ID NO: 5218878 - DNA, 19 bp, Homo sapiens
agggctagaacctggaagg

SEQ ID NO: 5218879 - DNA, 22 bp, Homo sapiens
agggctagaacctggaagggct

SEQ ID NO: 5218880 - DNA, 17 bp, Homo sapiens
agggctagaacctggag

SEQ ID NO: 5218881 - DNA, 19 bp, Homo sapiens
agggctagaacctggagag

SEQ ID NO: 5218882 - DNA, 20 bp, Homo sapiens
agggctagaacctggagagc

SEQ ID NO: 5218883 - DNA, 22 bp, Homo sapiens
agggctagaacctgtagagcta

SEQ ID NO: 5218884 - DNA, 14 bp, Homo sapiens
agggctagccctga

SEQ ID NO: 5218885 - DNA, 21 bp, Homo sapiens
agggctagccctgagcccggc

SEQ ID NO: 5218886 - DNA, 15 bp, Homo sapiens
agtatacaatatata

SEQ ID NO: 5218887 - DNA, 20 bp, Homo sapiens
agtatacacatcataaacaa

SEQ ID NO: 5218888 - DNA, 14 bp, Homo sapiens
agtataccagagaa

SEQ ID NO: 5218889 - DNA, 16 bp, Homo sapiens
agtataccagagaagg

SEQ ID NO: 5218890 - DNA, 14 bp, Homo sapiens
agtatacctggctt

SEQ ID NO: 5218891 - DNA, 21 bp, Homo sapiens
agtatacctggctttttaaaa

SEQ ID NO: 5218892 - DNA, 17 bp, Homo sapiens
agtatactcttaggcca

SEQ ID NO: 5218893 - DNA, 18 bp, Homo sapiens
agtatagaagtctggaaa

SEQ ID NO: 5218894 - DNA, 17 bp, Homo sapiens
agtatagagaaaagtgt

SEQ ID NO: 5218895 - DNA, 14 bp, Homo sapiens
agtatagagagaag

SEQ ID NO: 5218896 - DNA, 15 bp, Homo sapiens
agtatagataaatcc

SEQ ID NO: 5218897 - DNA, 19 bp, Homo sapiens
agtatagatacaaaacctt

SEQ ID NO: 5218898 - DNA, 16 bp, Homo sapiens
agtatagcattgaaca

SEQ ID NO: 5218899 - DNA, 21 bp, Homo sapiens
agtatagccacaaatgccttg

SEQ ID NO: 5218900 - DNA, 20 bp, Homo sapiens
agtataggataaattacatt

SEQ ID NO: 5218901 - DNA, 23 bp, Homo sapiens
agtatagtttaaaaatctgccac

SEQ ID NO: 5218902 - DNA, 17 bp, Homo sapiens
agtatataaagttttgc

SEQ ID NO: 5218903 - DNA, 16 bp, Homo sapiens
agtatataaatactat

SEQ ID NO: 5218904 - DNA, 14 bp, Homo sapiens
agtatataagctgt

SEQ ID NO: 5218905 - DNA, 17 bp, Homo sapiens
agtatataagctgttta

SEQ ID NO: 5218906 - DNA, 23 bp, Homo sapiens
agtatataataactttattgcat

SEQ ID NO: 5218907 - DNA, 18 bp, Homo sapiens
agtatataatatgtcacc

SEQ ID NO: 5218908 - DNA, 23 bp, Homo sapiens
agtatatacagagcctgttttaa

SEQ ID NO: 5218909 - DNA, 19 bp, Homo sapiens
agtatatacttttaaatta

SEQ ID NO: 5218910 - DNA, 21 bp, Homo sapiens
agtatatagtatatttatact

SEQ ID NO: 5218911 - DNA, 12 bp, Homo sapiens
agtatatatgta

SEQ ID NO: 5218912 - DNA, 16 bp, Homo sapiens
agtatatatgtacagt

SEQ ID NO: 5218913 - DNA, 13 bp, Homo sapiens
agtatatattcta

SEQ ID NO: 5218914 - DNA, 15 bp, Homo sapiens
agtatatattctaca

SEQ ID NO: 5218915 - DNA, 19 bp, Homo sapiens
agtatatattctttcacaa

SEQ ID NO: 5218916 - DNA, 17 bp, Homo sapiens
agtatatcatgtaaaga

SEQ ID NO: 5218917 - DNA, 22 bp, Homo sapiens
agtatatctatctatatataca

SEQ ID NO: 5218918 - DNA, 15 bp, Homo sapiens
agtatatctcagttt

SEQ ID NO: 5218919 - DNA, 16 bp, Homo sapiens
agtatatctggacaag

SEQ ID NO: 5218920 - DNA, 14 bp, Homo sapiens
agtatatcttaaga

SEQ ID NO: 5218921 - DNA, 15 bp, Homo sapiens
agtatatcttaagaa

SEQ ID NO: 5218922 - DNA, 16 bp, Homo sapiens
agtatatcttaagaat

SEQ ID NO: 5218923 - DNA, 18 bp, Homo sapiens
agtatatgaaatattttg

SEQ ID NO: 5218924 - DNA, 21 bp, Homo sapiens
agtatatgcatttttaataca

SEQ ID NO: 5218925 - DNA, 12 bp, Homo sapiens
agtatatgtaac

SEQ ID NO: 5218926 - DNA, 23 bp, Homo sapiens
agtatatgtcagacatgaaaact

SEQ ID NO: 5218927 - DNA, 12 bp, Homo sapiens
agtatatgtgag

SEQ ID NO: 5218928 - DNA, 14 bp, Homo sapiens
agtatatgtgcagt

SEQ ID NO: 5218929 - DNA, 15 bp, Homo sapiens
agtatattaaaaatg

SEQ ID NO: 5218930 - DNA, 18 bp, Homo sapiens
agtatattcaaaaattat

SEQ ID NO: 5218931 - DNA, 11 bp, Homo sapiens
agtatattctt

SEQ ID NO: 5218932 - DNA, 16 bp, Homo sapiens
agtatattgaaaagaa

SEQ ID NO: 5218933 - DNA, 14 bp, Homo sapiens
agtatattgaaagt

SEQ ID NO: 5218934 - DNA, 13 bp, Homo sapiens
agtatatttatac

SEQ ID NO: 5218935 - DNA, 14 bp, Homo sapiens
agtatatttatact

SEQ ID NO: 5218936 - DNA, 18 bp, Homo sapiens
agtatatttatagtcaca

SEQ ID NO: 5218937 - DNA, 18 bp, Homo sapiens
agtatatttccattcaga

SEQ ID NO: 5218938 - DNA, 15 bp, Homo sapiens
agtatatttctgaaa

SEQ ID NO: 5218939 - DNA, 13 bp, Homo sapiens
agtatatttggtt

SEQ ID NO: 5218940 - DNA, 13 bp, Homo sapiens
agtatattttatt

SEQ ID NO: 5218941 - DNA, 18 bp, Homo sapiens
agtatattttcttttcct

SEQ ID NO: 5218942 - DNA, 23 bp, Homo sapiens
agtatatttttgtctgcagctgt

SEQ ID NO: 5218943 - DNA, 15 bp, Homo sapiens
agtatcaaaggcaga

SEQ ID NO: 5218944 - DNA, 20 bp, Homo sapiens
agtatcaaaggcagaaagga

SEQ ID NO: 5218945 - DNA, 15 bp, Homo sapiens
agtatcaaatattag

SEQ ID NO: 5218946 - DNA, 22 bp, Homo sapiens
agtatcaaatattagatgtgat

SEQ ID NO: 5218947 - DNA, 16 bp, Homo sapiens
agtatcaacttcccag

SEQ ID NO: 5218948 - DNA, 14 bp, Homo sapiens
agtatcaaggctgc

SEQ ID NO: 5218949 - DNA, 23 bp, Homo sapiens
agtatcaaggctgcctggagaaa

SEQ ID NO: 5218950 - DNA, 17 bp, Homo sapiens
agtatcacgatttgcag

SEQ ID NO: 5218951 - DNA, 13 bp, Homo sapiens
agtatcactctaa

SEQ ID NO: 5218952 - DNA, 18 bp, Homo sapiens
agtatcactctaaaaaac

SEQ ID NO: 5218953 - DNA, 23 bp, Homo sapiens
agtatcactctaatataatatgg

SEQ ID NO: 5218954 - DNA, 15 bp, Homo sapiens
agtatcacttttctg

SEQ ID NO: 5218955 - DNA, 15 bp, Homo sapiens
agtatcagaatactt

SEQ ID NO: 5218956 - DNA, 13 bp, Homo sapiens
agtatcagaattg

SEQ ID NO: 5218957 - DNA, 18 bp, Homo sapiens
agtatcagaattgaaaca

SEQ ID NO: 5218958 - DNA, 12 bp, Homo sapiens
agtatcagaggg

SEQ ID NO: 5218959 - DNA, 13 bp, Homo sapiens
agtatcagagggt

SEQ ID NO: 5218960 - DNA, 16 bp, Homo sapiens
agtatcaggggaaaaa

SEQ ID NO: 5218961 - DNA, 19 bp, Homo sapiens
agtatcagtattttcacac

SEQ ID NO: 5218962 - DNA, 13 bp, Homo sapiens
agtatcagtgttt

SEQ ID NO: 5218963 - DNA, 16 bp, Homo sapiens
agtatcagtgttttaa

SEQ ID NO: 5218964 - DNA, 18 bp, Homo sapiens
agtatcagtgttttaaat

SEQ ID NO: 5218965 - DNA, 12 bp, Homo sapiens
agtatcagttgc

SEQ ID NO: 5218966 - DNA, 13 bp, Homo sapiens
agtatcataatat

SEQ ID NO: 5218967 - DNA, 13 bp, Homo sapiens
agtatcatctaaa

SEQ ID NO: 5218968 - DNA, 13 bp, Homo sapiens
agtatcatgaagc

SEQ ID NO: 5218969 - DNA, 11 bp, Homo sapiens
agtatcatgca

SEQ ID NO: 5218970 - DNA, 19 bp, Homo sapiens
agtatcatgccctgtgcaa

SEQ ID NO: 5218971 - DNA, 14 bp, Homo sapiens
agtatcattttagg

SEQ ID NO: 5218972 - DNA, 15 bp, Homo sapiens
agtatccaatgtctt

SEQ ID NO: 5218973 - DNA, 13 bp, Homo sapiens
agtatccaattat

SEQ ID NO: 5218974 - DNA, 21 bp, Homo sapiens
agtatccaattatgtgacaac

SEQ ID NO: 5218975 - DNA, 15 bp, Homo sapiens
agtatccacaggata

SEQ ID NO: 5218976 - DNA, 22 bp, Homo sapiens
agtatccctgatttattctggt

SEQ ID NO: 5218977 - DNA, 15 bp, Homo sapiens
agtatcctccaggtt

SEQ ID NO: 5218978 - DNA, 16 bp, Homo sapiens
agtatcctccaggttt

SEQ ID NO: 5218979 - DNA, 22 bp, Homo sapiens
agtatcctccaggtttttcaat

SEQ ID NO: 5218980 - DNA, 23 bp, Homo sapiens
agtatcctccaggtttttcaatt

SEQ ID NO: 5218981 - DNA, 14 bp, Homo sapiens
agtatcctgctggt

SEQ ID NO: 5218982 - DNA, 17 bp, Homo sapiens
agtatcctttatacagt

SEQ ID NO: 5218983 - DNA, 12 bp, Homo sapiens
agtatctaaatt

SEQ ID NO: 5218984 - DNA, 14 bp, Homo sapiens
agtatctaaatttg

SEQ ID NO: 5218985 - DNA, 19 bp, Homo sapiens
agtatctaaatttggaact

SEQ ID NO: 5218986 - DNA, 22 bp, Homo sapiens
agtatctaactcttctggaaac

SEQ ID NO: 5218987 - DNA, 18 bp, Homo sapiens
agtatctatatatgtgta

SEQ ID NO: 5218988 - DNA, 22 bp, Homo sapiens
agtatctatatatgtgtatgta

SEQ ID NO: 5218989 - DNA, 15 bp, Homo sapiens
agtatctattagcag

SEQ ID NO: 5218990 - DNA, 19 bp, Homo sapiens
agtatctattgtgttggct

SEQ ID NO: 5218991 - DNA, 15 bp, Homo sapiens
agtatctcagggcct

SEQ ID NO: 5218992 - DNA, 11 bp, Homo sapiens
agtatctccat

SEQ ID NO: 5218993 - DNA, 20 bp, Homo sapiens
agtatctccatccttaactg

SEQ ID NO: 5218994 - DNA, 23 bp, Homo sapiens
agtatctccatccttaactgtcc

SEQ ID NO: 5218995 - DNA, 18 bp, Homo sapiens
agtatctcctcgcaagct

SEQ ID NO: 5218996 - DNA, 22 bp, Homo sapiens
agtatctcggacctttcagctg

SEQ ID NO: 5218997 - DNA, 23 bp, Homo sapiens
agtatctcgtaatagcttctgtg

SEQ ID NO: 5218998 - DNA, 19 bp, Homo sapiens
agtatctctactttcctga

SEQ ID NO: 5218999 - DNA, 15 bp, Homo sapiens
agtatctctggcctc

SEQ ID NO: 5219000 - DNA, 20 bp, Homo sapiens
agtatctgaagggaattgtt

SEQ ID NO: 5219001 - DNA, 23 bp, Homo sapiens
agtatctgagaccccaaactctc

SEQ ID NO: 5219002 - DNA, 13 bp, Homo sapiens
agtatctgctgtt

SEQ ID NO: 5219003 - DNA, 14 bp, Homo sapiens
agtatctgctgttc

SEQ ID NO: 5219004 - DNA, 16 bp, Homo sapiens
agtatctgctgttctt

SEQ ID NO: 5219005 - DNA, 15 bp, Homo sapiens
agtatctggctgggt

SEQ ID NO: 5219006 - DNA, 21 bp, Homo sapiens
agtatctgggattattctttg

SEQ ID NO: 5219007 - DNA, 12 bp, Homo sapiens
agtatctgtaac

SEQ ID NO: 5219008 - DNA, 18 bp, Homo sapiens
agtatctgtaacccttga

SEQ ID NO: 5219009 - DNA, 19 bp, Homo sapiens
agtatctgtaacccttgaa

SEQ ID NO: 5219010 - DNA, 20 bp, Homo sapiens
agtatctgtatataagttgc

SEQ ID NO: 5219011 - DNA, 21 bp, Homo sapiens
agtatctgtatataagttgct

SEQ ID NO: 5219012 - DNA, 15 bp, Homo sapiens
agtatctgtatctct

SEQ ID NO: 5219013 - DNA, 18 bp, Homo sapiens
agtatctgtatctctctc

SEQ ID NO: 5219014 - DNA, 14 bp, Homo sapiens
agtatcttcatgta

SEQ ID NO: 5219015 - DNA, 20 bp, Homo sapiens
agtatcttctatttttatca

SEQ ID NO: 5219016 - DNA, 14 bp, Homo sapiens
agtatcttgtgctt

SEQ ID NO: 5219017 - DNA, 18 bp, Homo sapiens
agtatctttaaaattttt

SEQ ID NO: 5219018 - DNA, 16 bp, Homo sapiens
agtatctttttattca

SEQ ID NO: 5219019 - DNA, 12 bp, Homo sapiens
agtatgaaaata

SEQ ID NO: 5219020 - DNA, 16 bp, Homo sapiens
agtatgaacttgagat

SEQ ID NO: 5219021 - DNA, 20 bp, Homo sapiens
agtatgaacttgagatctgt

SEQ ID NO: 5219022 - DNA, 16 bp, Homo sapiens
agtatgaataaagaca

SEQ ID NO: 5219023 - DNA, 13 bp, Homo sapiens
agtatgaatctat

SEQ ID NO: 5219024 - DNA, 18 bp, Homo sapiens
agtatgaatctatgccaa

SEQ ID NO: 5219025 - DNA, 22 bp, Homo sapiens
agtatgaattattcaatttatt

SEQ ID NO: 5219026 - DNA, 23 bp, Homo sapiens
agtatgaatttgagcaggtctca

SEQ ID NO: 5219027 - DNA, 22 bp, Homo sapiens
agtatgacgctgatacataact

SEQ ID NO: 5219028 - DNA, 13 bp, Homo sapiens
agtatgagaaata

SEQ ID NO: 5219029 - DNA, 23 bp, Homo sapiens
agtatgagtcttctgtaattcat

SEQ ID NO: 5219030 - DNA, 21 bp, Homo sapiens
agtatgagtgcaagcaaagca

SEQ ID NO: 5219031 - DNA, 14 bp, Homo sapiens
agtatgcaaaataa

SEQ ID NO: 5219032 - DNA, 18 bp, Homo sapiens
agtatgcactatatacat

SEQ ID NO: 5219033 - DNA, 21 bp, Homo sapiens
agtatgcattattaaattgta

SEQ ID NO: 5219034 - DNA, 22 bp, Homo sapiens
agtatgccccacctatctttgg

SEQ ID NO: 5219035 - DNA, 21 bp, Homo sapiens
agtatgccttaagcagaacaa

SEQ ID NO: 5219036 - DNA, 22 bp, Homo sapiens
agtatgccttaagcagaacaaa

SEQ ID NO: 5219037 - DNA, 22 bp, Homo sapiens
agtatgctgtggagtcccaacc

SEQ ID NO: 5219038 - DNA, 16 bp, Homo sapiens
agtatgcttgctctaa

SEQ ID NO: 5219039 - DNA, 19 bp, Homo sapiens
agtatgctttccctgagga

SEQ ID NO: 5219040 - DNA, 20 bp, Homo sapiens
agtatgctttccctgaggaa

SEQ ID NO: 5219041 - DNA, 14 bp, Homo sapiens
agtatggaagggag

SEQ ID NO: 5219042 - DNA, 15 bp, Homo sapiens
agtatggaagggagg

SEQ ID NO: 5219043 - DNA, 19 bp, Homo sapiens
agtatggagctcagagagg

SEQ ID NO: 5219044 - DNA, 17 bp, Homo sapiens
agtatggcagtgggaga

SEQ ID NO: 5219045 - DNA, 16 bp, Homo sapiens
agtatggcctgtgtca

SEQ ID NO: 5219046 - DNA, 20 bp, Homo sapiens
agtatgggactggcctctgc

SEQ ID NO: 5219047 - DNA, 12 bp, Homo sapiens
agtatgggctac

SEQ ID NO: 5219048 - DNA, 19 bp, Homo sapiens
agtatgggggttgtaaatt

SEQ ID NO: 5219049 - DNA, 23 bp, Homo sapiens
agtatggtaatctttacctgtat

SEQ ID NO: 5219050 - DNA, 14 bp, Homo sapiens
agtatggtacattt

SEQ ID NO: 5219051 - DNA, 23 bp, Homo sapiens
agtatggtacatttttcaacttt

SEQ ID NO: 5219052 - DNA, 12 bp, Homo sapiens
agtatggtgcta

SEQ ID NO: 5219053 - DNA, 16 bp, Homo sapiens
agtatggtgctaatgt

SEQ ID NO: 5219054 - DNA, 15 bp, Homo sapiens
agtatggttcaagat

SEQ ID NO: 5219055 - DNA, 14 bp, Homo sapiens
agtatgtaatttct

SEQ ID NO: 5219056 - DNA, 15 bp, Homo sapiens
agtatgtatattaaa

SEQ ID NO: 5219057 - DNA, 14 bp, Homo sapiens
agtatgtcactctg

SEQ ID NO: 5219058 - DNA, 20 bp, Homo sapiens
agtatgtctactcctcacag

SEQ ID NO: 5219059 - DNA, 14 bp, Homo sapiens
agtatgtctgatgg

SEQ ID NO: 5219060 - DNA, 19 bp, Homo sapiens
agtatgtctgtttttgtat

SEQ ID NO: 5219061 - DNA, 19 bp, Homo sapiens
agtatgtgacttttctgat

SEQ ID NO: 5219062 - DNA, 13 bp, Homo sapiens
agtatgtgatgga

SEQ ID NO: 5219063 - DNA, 16 bp, Homo sapiens
agtatgtgcagtgtgg

SEQ ID NO: 5219064 - DNA, 14 bp, Homo sapiens
agtatgtgccagga

SEQ ID NO: 5219065 - DNA, 17 bp, Homo sapiens
agtatgtggaagtgtgg

SEQ ID NO: 5219066 - DNA, 21 bp, Homo sapiens
agggctaggaatatagattaa

SEQ ID NO: 5219067 - DNA, 11 bp, Homo sapiens
agggctagtga

SEQ ID NO: 5219068 - DNA, 18 bp, Homo sapiens
agggctagtgaagtggcc

SEQ ID NO: 5219069 - DNA, 21 bp, Homo sapiens
agggctagtgaagtggcctct

SEQ ID NO: 5219070 - DNA, 14 bp, Homo sapiens
agggctatggcaag

SEQ ID NO: 5219071 - DNA, 19 bp, Homo sapiens
agggctatggtgtggactg

SEQ ID NO: 5219072 - DNA, 20 bp, Homo sapiens
agggctcacactcctgggct

SEQ ID NO: 5219073 - DNA, 17 bp, Homo sapiens
agggctcacagggcagg

SEQ ID NO: 5219074 - DNA, 21 bp, Homo sapiens
agggctcacagggcaggcctt

SEQ ID NO: 5219075 - DNA, 16 bp, Homo sapiens
agggctcagagaggac

SEQ ID NO: 5219076 - DNA, 12 bp, Homo sapiens
agggctcagagg

SEQ ID NO: 5219077 - DNA, 13 bp, Homo sapiens
agggctcagaggg

SEQ ID NO: 5219078 - DNA, 17 bp, Homo sapiens
agggctcagaggggcct

SEQ ID NO: 5219079 - DNA, 23 bp, Homo sapiens
agggctcagaggggcctcatctt

SEQ ID NO: 5219080 - DNA, 17 bp, Homo sapiens
agggctcagagtgaccc

SEQ ID NO: 5219081 - DNA, 17 bp, Homo sapiens
agggctcagatggggcc

SEQ ID NO: 5219082 - DNA, 21 bp, Homo sapiens
agggctcagatggggcctggg

SEQ ID NO: 5219083 - DNA, 12 bp, Homo sapiens
agggctcagcct

SEQ ID NO: 5219084 - DNA, 13 bp, Homo sapiens
agggctcagcctg

SEQ ID NO: 5219085 - DNA, 19 bp, Homo sapiens
agggctcagcggggacagc

SEQ ID NO: 5219086 - DNA, 23 bp, Homo sapiens
agggctcagcggggacagctcct

SEQ ID NO: 5219087 - DNA, 16 bp, Homo sapiens
agggctcagctccttg

SEQ ID NO: 5219088 - DNA, 23 bp, Homo sapiens
agggctcaggatttcgtgggtct

SEQ ID NO: 5219089 - DNA, 13 bp, Homo sapiens
agggctcagggca

SEQ ID NO: 5219090 - DNA, 15 bp, Homo sapiens
agggctcagggcagt

SEQ ID NO: 5219091 - DNA, 19 bp, Homo sapiens
agggctcagggcagtggct

SEQ ID NO: 5219092 - DNA, 17 bp, Homo sapiens
agggctcagtcttttga

SEQ ID NO: 5219093 - DNA, 19 bp, Homo sapiens
agggctcatttttgcactt

SEQ ID NO: 5219094 - DNA, 22 bp, Homo sapiens
agggctccaaatctgcctagaa

SEQ ID NO: 5219095 - DNA, 15 bp, Homo sapiens
agggctccagacaca

SEQ ID NO: 5219096 - DNA, 13 bp, Homo sapiens
agggctccagagt

SEQ ID NO: 5219097 - DNA, 17 bp, Homo sapiens
agggctccagagtggag

SEQ ID NO: 5219098 - DNA, 13 bp, Homo sapiens
agggctccagcat

SEQ ID NO: 5219099 - DNA, 15 bp, Homo sapiens
agggctccagcatcc

SEQ ID NO: 5219100 - DNA, 21 bp, Homo sapiens
agggctccagcatccagcctg

SEQ ID NO: 5219101 - DNA, 13 bp, Homo sapiens
agggctccaggag

SEQ ID NO: 5219102 - DNA, 14 bp, Homo sapiens
agggctcccagggg

SEQ ID NO: 5219103 - DNA, 20 bp, Homo sapiens
agggctccccactgcctact

SEQ ID NO: 5219104 - DNA, 21 bp, Homo sapiens
agggctccctgctccctccct

SEQ ID NO: 5219105 - DNA, 13 bp, Homo sapiens
agggctcctccca

SEQ ID NO: 5219106 - DNA, 17 bp, Homo sapiens
agggctcctcccagctt

SEQ ID NO: 5219107 - DNA, 15 bp, Homo sapiens
agggctcctgaagga

SEQ ID NO: 5219108 - DNA, 14 bp, Homo sapiens
agggctcctgcagg

SEQ ID NO: 5219109 - DNA, 14 bp, Homo sapiens
agggctcctgcctt

SEQ ID NO: 5219110 - DNA, 13 bp, Homo sapiens
agggctcctgggg

SEQ ID NO: 5219111 - DNA, 21 bp, Homo sapiens
agggctcctgtggcagctgcc

SEQ ID NO: 5219112 - DNA, 20 bp, Homo sapiens
agggctccttgtgggcctgg

SEQ ID NO: 5219113 - DNA, 22 bp, Homo sapiens
agggctccttgtgggcctgggc

SEQ ID NO: 5219114 - DNA, 14 bp, Homo sapiens
agggctcgggcgct

SEQ ID NO: 5219115 - DNA, 22 bp, Homo sapiens
agggctcgggcgctgtggctcc

SEQ ID NO: 5219116 - DNA, 18 bp, Homo sapiens
agggctcggggtgtgtca

SEQ ID NO: 5219117 - DNA, 19 bp, Homo sapiens
agggctctccaagcactag

SEQ ID NO: 5219118 - DNA, 15 bp, Homo sapiens
agggctctcctggct

SEQ ID NO: 5219119 - DNA, 17 bp, Homo sapiens
agggctctcctggcttc

SEQ ID NO: 5219120 - DNA, 14 bp, Homo sapiens
agggctctctggac

SEQ ID NO: 5219121 - DNA, 11 bp, Homo sapiens
agggctctgag

SEQ ID NO: 5219122 - DNA, 19 bp, Homo sapiens
agggctctgagccaacctt

SEQ ID NO: 5219123 - DNA, 14 bp, Homo sapiens
agggctctgaggcg

SEQ ID NO: 5219124 - DNA, 15 bp, Homo sapiens
agggctctgatattc

SEQ ID NO: 5219125 - DNA, 17 bp, Homo sapiens
agggctctgatattcca

SEQ ID NO: 5219126 - DNA, 20 bp, Homo sapiens
agggctctgatctaacaaaa

SEQ ID NO: 5219127 - DNA, 14 bp, Homo sapiens
agggctctgcccca

SEQ ID NO: 5219128 - DNA, 22 bp, Homo sapiens
agggctctggcaggtggccagg

SEQ ID NO: 5219129 - DNA, 19 bp, Homo sapiens
agggctctgtttgtgggac

SEQ ID NO: 5219130 - DNA, 18 bp, Homo sapiens
agggctctttctctctgc

SEQ ID NO: 5219131 - DNA, 21 bp, Homo sapiens
agggctgaaccctcagccttg

SEQ ID NO: 5219132 - DNA, 18 bp, Homo sapiens
agggctgaataaagggaa

SEQ ID NO: 5219133 - DNA, 23 bp, Homo sapiens
agggctgacctgcctctcacaca

SEQ ID NO: 5219134 - DNA, 18 bp, Homo sapiens
agggctgacttctccagg

SEQ ID NO: 5219135 - DNA, 19 bp, Homo sapiens
agggctgacttctccagga

SEQ ID NO: 5219136 - DNA, 21 bp, Homo sapiens
agggctgagagggctgtggct

SEQ ID NO: 5219137 - DNA, 14 bp, Homo sapiens
agggctgagccatg

SEQ ID NO: 5219138 - DNA, 16 bp, Homo sapiens
agggctgagcccctcc

SEQ ID NO: 5219139 - DNA, 17 bp, Homo sapiens
agggctgagcccctcct

SEQ ID NO: 5219140 - DNA, 19 bp, Homo sapiens
agggctgagcccctcctct

SEQ ID NO: 5219141 - DNA, 20 bp, Homo sapiens
agggctgagcccctcctctc

SEQ ID NO: 5219142 - DNA, 17 bp, Homo sapiens
agggctgagcctggtcc

SEQ ID NO: 5219143 - DNA, 17 bp, Homo sapiens
agggctgagctctctgt

SEQ ID NO: 5219144 - DNA, 13 bp, Homo sapiens
agggctgaggagc

SEQ ID NO: 5219145 - DNA, 18 bp, Homo sapiens
agggctgaggagcagcca

SEQ ID NO: 5219146 - DNA, 19 bp, Homo sapiens
agggctgaggagcagccag

SEQ ID NO: 5219147 - DNA, 21 bp, Homo sapiens
agggctgaggagcagccagga

SEQ ID NO: 5219148 - DNA, 18 bp, Homo sapiens
agggctgatggaggaaaa

SEQ ID NO: 5219149 - DNA, 19 bp, Homo sapiens
agggctgatggaggaaaaa

SEQ ID NO: 5219150 - DNA, 18 bp, Homo sapiens
agggctgcaatgccctca

SEQ ID NO: 5219151 - DNA, 14 bp, Homo sapiens
agggctgcagagcc

SEQ ID NO: 5219152 - DNA, 12 bp, Homo sapiens
agggctgcaggg

SEQ ID NO: 5219153 - DNA, 15 bp, Homo sapiens
agggctgcatgatgt

SEQ ID NO: 5219154 - DNA, 17 bp, Homo sapiens
agggctgccagcagccc

SEQ ID NO: 5219155 - DNA, 19 bp, Homo sapiens
agggctgccagcagccccg

SEQ ID NO: 5219156 - DNA, 14 bp, Homo sapiens
agggctgcccctgt

SEQ ID NO: 5219157 - DNA, 23 bp, Homo sapiens
agggctgccctgagaagctgctc

SEQ ID NO: 5219158 - DNA, 17 bp, Homo sapiens
agggctgctagacggag

SEQ ID NO: 5219159 - DNA, 12 bp, Homo sapiens
agggctgctggg

SEQ ID NO: 5219160 - DNA, 21 bp, Homo sapiens
agggctgctgggagcctctcc

SEQ ID NO: 5219161 - DNA, 20 bp, Homo sapiens
agggctgcttccctgaagct

SEQ ID NO: 5219162 - DNA, 20 bp, Homo sapiens
agggctggaaaagtcacaca

SEQ ID NO: 5219163 - DNA, 21 bp, Homo sapiens
agggctggaaaagtcacacag

SEQ ID NO: 5219164 - DNA, 22 bp, Homo sapiens
agggctggaatctggagagcta

SEQ ID NO: 5219165 - DNA, 20 bp, Homo sapiens
agggctggactgaggcctga

SEQ ID NO: 5219166 - DNA, 16 bp, Homo sapiens
agggctggagaccaga

SEQ ID NO: 5219167 - DNA, 18 bp, Homo sapiens
agggctggagcctggggt

SEQ ID NO: 5219168 - DNA, 17 bp, Homo sapiens
agggctggaggcccagg

SEQ ID NO: 5219169 - DNA, 18 bp, Homo sapiens
agggctggaggcccaggc

SEQ ID NO: 5219170 - DNA, 16 bp, Homo sapiens
agggctggatggacag

SEQ ID NO: 5219171 - DNA, 19 bp, Homo sapiens
agggctggatggacagaca

SEQ ID NO: 5219172 - DNA, 22 bp, Homo sapiens
agggctggatggacagacacct

SEQ ID NO: 5219173 - DNA, 20 bp, Homo sapiens
agggctggcacgtgacaggc

SEQ ID NO: 5219174 - DNA, 16 bp, Homo sapiens
agggctggcccagccc

SEQ ID NO: 5219175 - DNA, 19 bp, Homo sapiens
agggctggcccagccctgc

SEQ ID NO: 5219176 - DNA, 22 bp, Homo sapiens
agggctggcccagccctgctgg

SEQ ID NO: 5219177 - DNA, 23 bp, Homo sapiens
agggctggcccagccctgctggc

SEQ ID NO: 5219178 - DNA, 16 bp, Homo sapiens
agggctggccctaggc

SEQ ID NO: 5219179 - DNA, 20 bp, Homo sapiens
agggctggccgggactgctg

SEQ ID NO: 5219180 - DNA, 14 bp, Homo sapiens
agggctggctcctg

SEQ ID NO: 5219181 - DNA, 18 bp, Homo sapiens
agggctggctggaggaag

SEQ ID NO: 5219182 - DNA, 20 bp, Homo sapiens
agggctggctggaggaagga

SEQ ID NO: 5219183 - DNA, 21 bp, Homo sapiens
agggctggctggaggaaggaa

SEQ ID NO: 5219184 - DNA, 20 bp, Homo sapiens
agggctggctggcctcaccc

SEQ ID NO: 5219185 - DNA, 12 bp, Homo sapiens
agggctgggagg

SEQ ID NO: 5219186 - DNA, 20 bp, Homo sapiens
agggctgggcaaggaaaaag

SEQ ID NO: 5219187 - DNA, 21 bp, Homo sapiens
agggctgggcaaggaaaaaga

SEQ ID NO: 5219188 - DNA, 13 bp, Homo sapiens
agggctgggccac

SEQ ID NO: 5219189 - DNA, 17 bp, Homo sapiens
agggctgggccaccagg

SEQ ID NO: 5219190 - DNA, 19 bp, Homo sapiens
agggctgggccaccaggga

SEQ ID NO: 5219191 - DNA, 21 bp, Homo sapiens
agggctgggccaccagggatc

SEQ ID NO: 5219192 - DNA, 14 bp, Homo sapiens
agggctgggccagg

SEQ ID NO: 5219193 - DNA, 17 bp, Homo sapiens
agggctgggccaggtct

SEQ ID NO: 5219194 - DNA, 12 bp, Homo sapiens
agggctgggccc

SEQ ID NO: 5219195 - DNA, 19 bp, Homo sapiens
agggctgggcgcctctgtc

SEQ ID NO: 5219196 - DNA, 22 bp, Homo sapiens
agggctgggcgcctctgtcctg

SEQ ID NO: 5219197 - DNA, 17 bp, Homo sapiens
agggctgggctctgtct

SEQ ID NO: 5219198 - DNA, 18 bp, Homo sapiens
agggctggggatgcgcct

SEQ ID NO: 5219199 - DNA, 16 bp, Homo sapiens
agggctggggccaaga

SEQ ID NO: 5219200 - DNA, 17 bp, Homo sapiens
agggctggggccaagag

SEQ ID NO: 5219201 - DNA, 20 bp, Homo sapiens
agggctggggccaagaggaa

SEQ ID NO: 5219202 - DNA, 21 bp, Homo sapiens
agggctggggccaagaggaaa

SEQ ID NO: 5219203 - DNA, 13 bp, Homo sapiens
agggctggggcgg

SEQ ID NO: 5219204 - DNA, 19 bp, Homo sapiens
agggctggggtgagcctga

SEQ ID NO: 5219205 - DNA, 21 bp, Homo sapiens
agggctggggttgccagaggc

SEQ ID NO: 5219206 - DNA, 22 bp, Homo sapiens
agggctggggttgccagaggcc

SEQ ID NO: 5219207 - DNA, 18 bp, Homo sapiens
agggctgggtcacaggaa

SEQ ID NO: 5219208 - DNA, 20 bp, Homo sapiens
agggctgggtcacaggaagg

SEQ ID NO: 5219209 - DNA, 19 bp, Homo sapiens
agggctggtcacctcccat

SEQ ID NO: 5219210 - DNA, 17 bp, Homo sapiens
agggctggttaatgtag

SEQ ID NO: 5219211 - DNA, 12 bp, Homo sapiens
agggctggtttg

SEQ ID NO: 5219212 - DNA, 19 bp, Homo sapiens
agggctgtaactgccaggc

SEQ ID NO: 5219213 - DNA, 20 bp, Homo sapiens
agggctgtaactgccaggct

SEQ ID NO: 5219214 - DNA, 15 bp, Homo sapiens
agggctgtcatctga

SEQ ID NO: 5219215 - DNA, 15 bp, Homo sapiens
agggctgtcattgca

SEQ ID NO: 5219216 - DNA, 12 bp, Homo sapiens
agggctgtccca

SEQ ID NO: 5219217 - DNA, 12 bp, Homo sapiens
agggctgtgggt

SEQ ID NO: 5219218 - DNA, 13 bp, Homo sapiens
agggctgtgggtg

SEQ ID NO: 5219219 - DNA, 14 bp, Homo sapiens
agggctgtgggtgg

SEQ ID NO: 5219220 - DNA, 18 bp, Homo sapiens
agggctgtgtcccagatg

SEQ ID NO: 5219221 - DNA, 17 bp, Homo sapiens
agggctgtgtgaaacat

SEQ ID NO: 5219222 - DNA, 19 bp, Homo sapiens
agggctgttgctagggaga

SEQ ID NO: 5219223 - DNA, 16 bp, Homo sapiens
agggctgttggacagc

SEQ ID NO: 5219224 - DNA, 20 bp, Homo sapiens
agggctgttggacagctgct

SEQ ID NO: 5219225 - DNA, 24 bp, Homo sapiens
agggctgttggacagctgcttgtg

SEQ ID NO: 5219226 - DNA, 15 bp, Homo sapiens
agggcttacggccct

SEQ ID NO: 5219227 - DNA, 20 bp, Homo sapiens
agggcttatctagccaaaga

SEQ ID NO: 5219228 - DNA, 23 bp, Homo sapiens
agggcttcaaggccctcagagat

SEQ ID NO: 5219229 - DNA, 23 bp, Homo sapiens
agggcttcctcaaatacatgcac

SEQ ID NO: 5219230 - DNA, 12 bp, Homo sapiens
agggcttcctct

SEQ ID NO: 5219231 - DNA, 16 bp, Homo sapiens
agggcttctcctcctc

SEQ ID NO: 5219232 - DNA, 16 bp, Homo sapiens
agggcttctcctctgc

SEQ ID NO: 5219233 - DNA, 13 bp, Homo sapiens
agggcttctgcac

SEQ ID NO: 5219234 - DNA, 23 bp, Homo sapiens
agggcttgagagctcagcctgcc

SEQ ID NO: 5219235 - DNA, 16 bp, Homo sapiens
agggcttgaggtgaat

SEQ ID NO: 5219236 - DNA, 21 bp, Homo sapiens
agggcttgaggtgaatttcat

SEQ ID NO: 5219237 - DNA, 15 bp, Homo sapiens
agggcttgatggtga

SEQ ID NO: 5219238 - DNA, 15 bp, Homo sapiens
agggcttggcccagc

SEQ ID NO: 5219239 - DNA, 14 bp, Homo sapiens
agggcttggggagc

SEQ ID NO: 5219240 - DNA, 16 bp, Homo sapiens
agggcttggggagcag

SEQ ID NO: 5219241 - DNA, 20 bp, Homo sapiens
agggcttggggagcaggtct

SEQ ID NO: 5219242 - DNA, 20 bp, Homo sapiens
agggcttggtaaaacacaga

SEQ ID NO: 5219243 - DNA, 21 bp, Homo sapiens
agggcttggtaaaacacagat

SEQ ID NO: 5219244 - DNA, 23 bp, Homo sapiens
agtatgtgggggcttcatctctt

SEQ ID NO: 5219245 - DNA, 14 bp, Homo sapiens
agtatgtgtaaaat

SEQ ID NO: 5219246 - DNA, 14 bp, Homo sapiens
agtatgtgtatgta

SEQ ID NO: 5219247 - DNA, 15 bp, Homo sapiens
agtatgtgtatgtac

SEQ ID NO: 5219248 - DNA, 12 bp, Homo sapiens
agtatgtgtcta

SEQ ID NO: 5219249 - DNA, 20 bp, Homo sapiens
agtatgtgtgcgtgagctgg

SEQ ID NO: 5219250 - DNA, 12 bp, Homo sapiens
agtatgtgtggg

SEQ ID NO: 5219251 - DNA, 15 bp, Homo sapiens
agtatgttaatatgt

SEQ ID NO: 5219252 - DNA, 21 bp, Homo sapiens
agtatgttctaacctttacat

SEQ ID NO: 5219253 - DNA, 11 bp, Homo sapiens
agtatgttctt

SEQ ID NO: 5219254 - DNA, 17 bp, Homo sapiens
agtatgttcttgaagaa

SEQ ID NO: 5219255 - DNA, 14 bp, Homo sapiens
agtatgttttactt

SEQ ID NO: 5219256 - DNA, 16 bp, Homo sapiens
agtatgttttagcatg

SEQ ID NO: 5219257 - DNA, 19 bp, Homo sapiens
agtatgttttagcatgtgt

SEQ ID NO: 5219258 - DNA, 21 bp, Homo sapiens
agtatgtttttacattatgca

SEQ ID NO: 5219259 - DNA, 17 bp, Homo sapiens
agtatgttttttatgtt

SEQ ID NO: 5219260 - DNA, 13 bp, Homo sapiens
agtattaaaacat

SEQ ID NO: 5219261 - DNA, 14 bp, Homo sapiens
agtattaaaacatt

SEQ ID NO: 5219262 - DNA, 15 bp, Homo sapiens
agtattaaaacattg

SEQ ID NO: 5219263 - DNA, 16 bp, Homo sapiens
agtattaaaacattgg

SEQ ID NO: 5219264 - DNA, 19 bp, Homo sapiens
agtattaaaacattggatt

SEQ ID NO: 5219265 - DNA, 22 bp, Homo sapiens
agtattaaaacattggattatc

SEQ ID NO: 5219266 - DNA, 23 bp, Homo sapiens
agtattaaaacattggattatcc

SEQ ID NO: 5219267 - DNA, 19 bp, Homo sapiens
agtattaaaagttgcattt

SEQ ID NO: 5219268 - DNA, 12 bp, Homo sapiens
agtattaaaatc

SEQ ID NO: 5219269 - DNA, 16 bp, Homo sapiens
agtattaaaatgcata

SEQ ID NO: 5219270 - DNA, 20 bp, Homo sapiens
agtattaaaatgcatatttc

SEQ ID NO: 5219271 - DNA, 14 bp, Homo sapiens
agtattaaaatgta

SEQ ID NO: 5219272 - DNA, 15 bp, Homo sapiens
agtattaaaatgtat

SEQ ID NO: 5219273 - DNA, 18 bp, Homo sapiens
agtattaaaatgtatgca

SEQ ID NO: 5219274 - DNA, 20 bp, Homo sapiens
agtattaaactctcctttga

SEQ ID NO: 5219275 - DNA, 17 bp, Homo sapiens
agtattaaactgtaaat

SEQ ID NO: 5219276 - DNA, 16 bp, Homo sapiens
agtattaaatatttaa

SEQ ID NO: 5219277 - DNA, 22 bp, Homo sapiens
agtattaacactaaattgcagt

SEQ ID NO: 5219278 - DNA, 20 bp, Homo sapiens
agtattaacagaaatgtttc

SEQ ID NO: 5219279 - DNA, 17 bp, Homo sapiens
agtattaacatcaaaga

SEQ ID NO: 5219280 - DNA, 14 bp, Homo sapiens
agtattaagaatat

SEQ ID NO: 5219281 - DNA, 13 bp, Homo sapiens
agtattaagcagt

SEQ ID NO: 5219282 - DNA, 12 bp, Homo sapiens
agtattaagcat

SEQ ID NO: 5219283 - DNA, 14 bp, Homo sapiens
agtattaagcatat

SEQ ID NO: 5219284 - DNA, 15 bp, Homo sapiens
agtattaagtgaaat

SEQ ID NO: 5219285 - DNA, 17 bp, Homo sapiens
agtattaagtgaaattt

SEQ ID NO: 5219286 - DNA, 23 bp, Homo sapiens
agtattaagtgaaattttaaatg

SEQ ID NO: 5219287 - DNA, 18 bp, Homo sapiens
agtattaatactaaaata

SEQ ID NO: 5219288 - DNA, 13 bp, Homo sapiens
agtattaatgtaa

SEQ ID NO: 5219289 - DNA, 16 bp, Homo sapiens
agtattacacattaaa

SEQ ID NO: 5219290 - DNA, 14 bp, Homo sapiens
agtattacatgatt

SEQ ID NO: 5219291 - DNA, 17 bp, Homo sapiens
agtattactaaattgac

SEQ ID NO: 5219292 - DNA, 21 bp, Homo sapiens
agtattactaaattgaccttt

SEQ ID NO: 5219293 - DNA, 18 bp, Homo sapiens
agtattacttctgctaca

SEQ ID NO: 5219294 - DNA, 20 bp, Homo sapiens
agtattagactggaagttca

SEQ ID NO: 5219295 - DNA, 23 bp, Homo sapiens
agtattagcaatgaattagttgc

SEQ ID NO: 5219296 - DNA, 19 bp, Homo sapiens
agtattataaattatgttt

SEQ ID NO: 5219297 - DNA, 20 bp, Homo sapiens
agtattataaattatgttta

SEQ ID NO: 5219298 - DNA, 23 bp, Homo sapiens
agtattataggactttcttctaa

SEQ ID NO: 5219299 - DNA, 12 bp, Homo sapiens
agtattatatgt

SEQ ID NO: 5219300 - DNA, 17 bp, Homo sapiens
agtattatcaaagggat

SEQ ID NO: 5219301 - DNA, 19 bp, Homo sapiens
agtattatctaaatgaatg

SEQ ID NO: 5219302 - DNA, 12 bp, Homo sapiens
agtattatgcat

SEQ ID NO: 5219303 - DNA, 18 bp, Homo sapiens
agtattatgcatatataa

SEQ ID NO: 5219304 - DNA, 18 bp, Homo sapiens
agtattattctactatac

SEQ ID NO: 5219305 - DNA, 15 bp, Homo sapiens
agtattattttccaa

SEQ ID NO: 5219306 - DNA, 23 bp, Homo sapiens
agtattcaagaaagccagtctta

SEQ ID NO: 5219307 - DNA, 13 bp, Homo sapiens
agtattcagaaat

SEQ ID NO: 5219308 - DNA, 18 bp, Homo sapiens
agtattcagaaattaaaa

SEQ ID NO: 5219309 - DNA, 22 bp, Homo sapiens
agtattcagttccaatacttca

SEQ ID NO: 5219310 - DNA, 14 bp, Homo sapiens
agtattccacctta

SEQ ID NO: 5219311 - DNA, 22 bp, Homo sapiens
agtattccaccttaaattaaac

SEQ ID NO: 5219312 - DNA, 23 bp, Homo sapiens
agtattccaccttaaattaaaca

SEQ ID NO: 5219313 - DNA, 20 bp, Homo sapiens
agtattccagacctgaagaa

SEQ ID NO: 5219314 - DNA, 21 bp, Homo sapiens
agtattccatgagctgctcat

SEQ ID NO: 5219315 - DNA, 20 bp, Homo sapiens
agtattccattgtgtgagtg

SEQ ID NO: 5219316 - DNA, 14 bp, Homo sapiens
agtattcccactct

SEQ ID NO: 5219317 - DNA, 20 bp, Homo sapiens
agtattccctttttaaatga

SEQ ID NO: 5219318 - DNA, 21 bp, Homo sapiens
agtattccctttttaaatgag

SEQ ID NO: 5219319 - DNA, 17 bp, Homo sapiens
agtattcctgtaatact

SEQ ID NO: 5219320 - DNA, 14 bp, Homo sapiens
agtattcctgttgc

SEQ ID NO: 5219321 - DNA, 17 bp, Homo sapiens
agtattctaaagttttg

SEQ ID NO: 5219322 - DNA, 16 bp, Homo sapiens
agtattctaataagct

SEQ ID NO: 5219323 - DNA, 15 bp, Homo sapiens
agtattctcagagca

SEQ ID NO: 5219324 - DNA, 15 bp, Homo sapiens
agtattctcattctt

SEQ ID NO: 5219325 - DNA, 16 bp, Homo sapiens
agtattctccatcctc

SEQ ID NO: 5219326 - DNA, 22 bp, Homo sapiens
agtattctgcctttgcagaaac

SEQ ID NO: 5219327 - DNA, 12 bp, Homo sapiens
agtattctgtag

SEQ ID NO: 5219328 - DNA, 12 bp, Homo sapiens
agtattcttcat

SEQ ID NO: 5219329 - DNA, 20 bp, Homo sapiens
agtattcttcatcagcattt

SEQ ID NO: 5219330 - DNA, 14 bp, Homo sapiens
agtattcttctctt

SEQ ID NO: 5219331 - DNA, 15 bp, Homo sapiens
agtattcttgtcaaa

SEQ ID NO: 5219332 - DNA, 12 bp, Homo sapiens
agtattcttttt

SEQ ID NO: 5219333 - DNA, 21 bp, Homo sapiens
agtattgaaaaattatcagtt

SEQ ID NO: 5219334 - DNA, 21 bp, Homo sapiens
agtattgaaagccaacaactc

SEQ ID NO: 5219335 - DNA, 14 bp, Homo sapiens
agtattgaagcatt

SEQ ID NO: 5219336 - DNA, 15 bp, Homo sapiens
agtattgaagcattt

SEQ ID NO: 5219337 - DNA, 13 bp, Homo sapiens
agtattgacaaaa

SEQ ID NO: 5219338 - DNA, 17 bp, Homo sapiens
agtattgacaaaatgtt

SEQ ID NO: 5219339 - DNA, 21 bp, Homo sapiens
agtattgacaaaatgttattt

SEQ ID NO: 5219340 - DNA, 22 bp, Homo sapiens
agtattgacaaaatgttatttc

SEQ ID NO: 5219341 - DNA, 21 bp, Homo sapiens
agtattgacaataagaaacag

SEQ ID NO: 5219342 - DNA, 19 bp, Homo sapiens
agtattgagaacctggcct

SEQ ID NO: 5219343 - DNA, 14 bp, Homo sapiens
agtattgagacact

SEQ ID NO: 5219344 - DNA, 18 bp, Homo sapiens
agtattgagacactgtca

SEQ ID NO: 5219345 - DNA, 18 bp, Homo sapiens
agtattgagctttgcatt

SEQ ID NO: 5219346 - DNA, 23 bp, Homo sapiens
agtattgattctgcttgagaata

SEQ ID NO: 5219347 - DNA, 12 bp, Homo sapiens
agtattgcaaag

SEQ ID NO: 5219348 - DNA, 16 bp, Homo sapiens
agtattgcaaagtcag

SEQ ID NO: 5219349 - DNA, 17 bp, Homo sapiens
agtattgcatctgtata

SEQ ID NO: 5219350 - DNA, 21 bp, Homo sapiens
agtattgccacctctggccaa

SEQ ID NO: 5219351 - DNA, 14 bp, Homo sapiens
agtattgctattta

SEQ ID NO: 5219352 - DNA, 15 bp, Homo sapiens
agtattgctatttat

SEQ ID NO: 5219353 - DNA, 16 bp, Homo sapiens
agtattgggcaggagg

SEQ ID NO: 5219354 - DNA, 17 bp, Homo sapiens
agtattgggcaggagga

SEQ ID NO: 5219355 - DNA, 12 bp, Homo sapiens
agtattggggcc

SEQ ID NO: 5219356 - DNA, 15 bp, Homo sapiens
agtattgtaaattat

SEQ ID NO: 5219357 - DNA, 17 bp, Homo sapiens
agtattgtaaattatat

SEQ ID NO: 5219358 - DNA, 22 bp, Homo sapiens
agtattgtacaaagtattaagc

SEQ ID NO: 5219359 - DNA, 23 bp, Homo sapiens
agtattgtacaaagtattaagca

SEQ ID NO: 5219360 - DNA, 17 bp, Homo sapiens
agtattgtagaaagcta

SEQ ID NO: 5219361 - DNA, 16 bp, Homo sapiens
agtattgtccaggtct

SEQ ID NO: 5219362 - DNA, 15 bp, Homo sapiens
agtattgtgaaagta

SEQ ID NO: 5219363 - DNA, 16 bp, Homo sapiens
agtattgttgtccttt

SEQ ID NO: 5219364 - DNA, 20 bp, Homo sapiens
agtattgttgtccttttcat

SEQ ID NO: 5219365 - DNA, 21 bp, Homo sapiens
agtattgttgtccttttcata

SEQ ID NO: 5219366 - DNA, 14 bp, Homo sapiens
agtattgtttaaaa

SEQ ID NO: 5219367 - DNA, 16 bp, Homo sapiens
agtattgtttaaaatg

SEQ ID NO: 5219368 - DNA, 20 bp, Homo sapiens
agtatttaaactttcaatat

SEQ ID NO: 5219369 - DNA, 22 bp, Homo sapiens
agtatttaaatccttttcccat

SEQ ID NO: 5219370 - DNA, 15 bp, Homo sapiens
agtatttaaatgttc

SEQ ID NO: 5219371 - DNA, 13 bp, Homo sapiens
agtatttaacatt

SEQ ID NO: 5219372 - DNA, 22 bp, Homo sapiens
agtatttaactacatctgcctc

SEQ ID NO: 5219373 - DNA, 19 bp, Homo sapiens
agtatttaagcctaaagat

SEQ ID NO: 5219374 - DNA, 14 bp, Homo sapiens
agtatttaattagt

SEQ ID NO: 5219375 - DNA, 16 bp, Homo sapiens
agtatttaattagtgc

SEQ ID NO: 5219376 - DNA, 19 bp, Homo sapiens
agtatttaattagtgctaa

SEQ ID NO: 5219377 - DNA, 21 bp, Homo sapiens
agtatttaattagtgctaagt

SEQ ID NO: 5219378 - DNA, 21 bp, Homo sapiens
agtatttaattcatgttgcct

SEQ ID NO: 5219379 - DNA, 17 bp, Homo sapiens
agtatttaattgtttca

SEQ ID NO: 5219380 - DNA, 18 bp, Homo sapiens
agtatttacaagctattt

SEQ ID NO: 5219381 - DNA, 24 bp, Homo sapiens
agtatttactgactgcttataaac

SEQ ID NO: 5219382 - DNA, 22 bp, Homo sapiens
agtatttataaaaatataaatt

SEQ ID NO: 5219383 - DNA, 19 bp, Homo sapiens
agtatttataatataaatc

SEQ ID NO: 5219384 - DNA, 13 bp, Homo sapiens
agtatttatatat

SEQ ID NO: 5219385 - DNA, 14 bp, Homo sapiens
agtatttatatatt

SEQ ID NO: 5219386 - DNA, 17 bp, Homo sapiens
agtatttatatatttat

SEQ ID NO: 5219387 - DNA, 19 bp, Homo sapiens
agtatttatatatttataa

SEQ ID NO: 5219388 - DNA, 20 bp, Homo sapiens
agtatttatatatttataac

SEQ ID NO: 5219389 - DNA, 18 bp, Homo sapiens
agtatttatatttaaatt

SEQ ID NO: 5219390 - DNA, 22 bp, Homo sapiens
agtatttatgtaatttgtacag

SEQ ID NO: 5219391 - DNA, 12 bp, Homo sapiens
agtatttattcc

SEQ ID NO: 5219392 - DNA, 16 bp, Homo sapiens
agtatttattgtcagt

SEQ ID NO: 5219393 - DNA, 15 bp, Homo sapiens
agtatttatttatgt

SEQ ID NO: 5219394 - DNA, 16 bp, Homo sapiens
agtatttatttatgta

SEQ ID NO: 5219395 - DNA, 20 bp, Homo sapiens
agtatttatttatgtacttt

SEQ ID NO: 5219396 - DNA, 15 bp, Homo sapiens
agtatttattttgta

SEQ ID NO: 5219397 - DNA, 17 bp, Homo sapiens
agtatttattttgtaat

SEQ ID NO: 5219398 - DNA, 22 bp, Homo sapiens
agtatttattttgtaattatga

SEQ ID NO: 5219399 - DNA, 18 bp, Homo sapiens
agtatttattttttcaaa

SEQ ID NO: 5219400 - DNA, 21 bp, Homo sapiens
agtatttattttttcaaaaac

SEQ ID NO: 5219401 - DNA, 18 bp, Homo sapiens
agtatttcagtgttttca

SEQ ID NO: 5219402 - DNA, 20 bp, Homo sapiens
agtatttcagtgttttcatt

SEQ ID NO: 5219403 - DNA, 19 bp, Homo sapiens
agtatttcattgcctgtgt

SEQ ID NO: 5219404 - DNA, 22 bp, Homo sapiens
agtatttccatagtcaatgatg

SEQ ID NO: 5219405 - DNA, 16 bp, Homo sapiens
agtatttctacattac

SEQ ID NO: 5219406 - DNA, 15 bp, Homo sapiens
agtatttctatgaaa

SEQ ID NO: 5219407 - DNA, 22 bp, Homo sapiens
agtatttctatgaaatattatg

SEQ ID NO: 5219408 - DNA, 13 bp, Homo sapiens
agtatttctcagg

SEQ ID NO: 5219409 - DNA, 14 bp, Homo sapiens
agtatttctcagga

SEQ ID NO: 5219410 - DNA, 15 bp, Homo sapiens
agtatttctcaggaa

SEQ ID NO: 5219411 - DNA, 19 bp, Homo sapiens
agtatttctcctttgcaat

SEQ ID NO: 5219412 - DNA, 13 bp, Homo sapiens
agtatttctcttt

SEQ ID NO: 5219413 - DNA, 22 bp, Homo sapiens
agtatttctgggttaaatgaaa

SEQ ID NO: 5219414 - DNA, 21 bp, Homo sapiens
agtatttctttgttatacatt

SEQ ID NO: 5219415 - DNA, 17 bp, Homo sapiens
agtatttgaaaacagaa

SEQ ID NO: 5219416 - DNA, 22 bp, Homo sapiens
agtatttgaaaacagaaattgg

SEQ ID NO: 5219417 - DNA, 16 bp, Homo sapiens
agtatttgagagttct

SEQ ID NO: 5219418 - DNA, 16 bp, Homo sapiens
agtatttgcatattct

SEQ ID NO: 5219419 - DNA, 14 bp, Homo sapiens
agtatttgctgttt

SEQ ID NO: 5219420 - DNA, 18 bp, Homo sapiens
agtatttggaaaaagaaa

SEQ ID NO: 5219421 - DNA, 17 bp, Homo sapiens
agtatttgggaagtgaa

SEQ ID NO: 5219422 - DNA, 19 bp, Homo sapiens
agtatttgtacaaatactg

SEQ ID NO: 5219423 - DNA, 14 bp, Homo sapiens
agggcttgtagttc

SEQ ID NO: 5219424 - DNA, 17 bp, Homo sapiens
agggcttgtagttcttt

SEQ ID NO: 5219425 - DNA, 21 bp, Homo sapiens
agggcttgtttttcttcagca

SEQ ID NO: 5219426 - DNA, 14 bp, Homo sapiens
agggctttaaaatt

SEQ ID NO: 5219427 - DNA, 17 bp, Homo sapiens
agggctttaaaattctc

SEQ ID NO: 5219428 - DNA, 18 bp, Homo sapiens
agggctttaaaattctct

SEQ ID NO: 5219429 - DNA, 18 bp, Homo sapiens
agggctttaaataaaaga

SEQ ID NO: 5219430 - DNA, 20 bp, Homo sapiens
agggctttcagcgcccccag

SEQ ID NO: 5219431 - DNA, 21 bp, Homo sapiens
agggctttcagcgcccccagg

SEQ ID NO: 5219432 - DNA, 18 bp, Homo sapiens
agggctttcctgtgccag

SEQ ID NO: 5219433 - DNA, 18 bp, Homo sapiens
agggctttggttccttct

SEQ ID NO: 5219434 - DNA, 20 bp, Homo sapiens
agggctttggttccttctct

SEQ ID NO: 5219435 - DNA, 18 bp, Homo sapiens
agggctttgtgtctggcc

SEQ ID NO: 5219436 - DNA, 18 bp, Homo sapiens
agggcttttattttttaa

SEQ ID NO: 5219437 - DNA, 22 bp, Homo sapiens
agggcttttattttttcttttg

SEQ ID NO: 5219438 - DNA, 13 bp, Homo sapiens
agggcttttcaaa

SEQ ID NO: 5219439 - DNA, 14 bp, Homo sapiens
agggcttttcaaaa

SEQ ID NO: 5219440 - DNA, 16 bp, Homo sapiens
agggctttttaaattt

SEQ ID NO: 5219441 - DNA, 17 bp, Homo sapiens
aggggaaaaaaatgttg

SEQ ID NO: 5219442 - DNA, 13 bp, Homo sapiens
aggggaaaaatgg

SEQ ID NO: 5219443 - DNA, 18 bp, Homo sapiens
aggggaaaaatgggaaat

SEQ ID NO: 5219444 - DNA, 22 bp, Homo sapiens
aggggaaaatcagcctgctcca

SEQ ID NO: 5219445 - DNA, 18 bp, Homo sapiens
aggggaaacgtctcccag

SEQ ID NO: 5219446 - DNA, 21 bp, Homo sapiens
aggggaaagaaagggaaaagg

SEQ ID NO: 5219447 - DNA, 18 bp, Homo sapiens
aggggaacactgccctcg

SEQ ID NO: 5219448 - DNA, 23 bp, Homo sapiens
aggggaacatcaccctatatata

SEQ ID NO: 5219449 - DNA, 13 bp, Homo sapiens
aggggaacctgcc

SEQ ID NO: 5219450 - DNA, 11 bp, Homo sapiens
aggggaagaaa

SEQ ID NO: 5219451 - DNA, 13 bp, Homo sapiens
aggggaagaaaaa

SEQ ID NO: 5219452 - DNA, 16 bp, Homo sapiens
aggggaagaataattt

SEQ ID NO: 5219453 - DNA, 23 bp, Homo sapiens
aggggaagagacaaagtgggtgt

SEQ ID NO: 5219454 - DNA, 21 bp, Homo sapiens
aggggaagagagaggcctggg

SEQ ID NO: 5219455 - DNA, 18 bp, Homo sapiens
aggggaagagtgtactgg

SEQ ID NO: 5219456 - DNA, 22 bp, Homo sapiens
aggggaagagtgtactgggggt

SEQ ID NO: 5219457 - DNA, 21 bp, Homo sapiens
aggggaagcagaaatccaagc

SEQ ID NO: 5219458 - DNA, 12 bp, Homo sapiens
aggggaagctgc

SEQ ID NO: 5219459 - DNA, 13 bp, Homo sapiens
aggggaagctgca

SEQ ID NO: 5219460 - DNA, 20 bp, Homo sapiens
aggggaagctgcagcttggg

SEQ ID NO: 5219461 - DNA, 12 bp, Homo sapiens
aggggaaggaag

SEQ ID NO: 5219462 - DNA, 15 bp, Homo sapiens
aggggaaggaaggag

SEQ ID NO: 5219463 - DNA, 14 bp, Homo sapiens
aggggaaggactgg

SEQ ID NO: 5219464 - DNA, 21 bp, Homo sapiens
aggggaaggccctgaggcgga

SEQ ID NO: 5219465 - DNA, 11 bp, Homo sapiens
aggggaagggc

SEQ ID NO: 5219466 - DNA, 20 bp, Homo sapiens
aggggaagggctttgagggt

SEQ ID NO: 5219467 - DNA, 21 bp, Homo sapiens
aggggaagggctttgagggtg

SEQ ID NO: 5219468 - DNA, 12 bp, Homo sapiens
aggggaaggggc

SEQ ID NO: 5219469 - DNA, 13 bp, Homo sapiens
aggggaaggggct

SEQ ID NO: 5219470 - DNA, 17 bp, Homo sapiens
aggggaaggggctgagg

SEQ ID NO: 5219471 - DNA, 16 bp, Homo sapiens
aggggaagggggtgca

SEQ ID NO: 5219472 - DNA, 18 bp, Homo sapiens
aggggaagtaaaacagtc

SEQ ID NO: 5219473 - DNA, 19 bp, Homo sapiens
aggggaagtaaaacagtca

SEQ ID NO: 5219474 - DNA, 18 bp, Homo sapiens
aggggaagtgtgctgagg

SEQ ID NO: 5219475 - DNA, 20 bp, Homo sapiens
aggggaatatacacattgct

SEQ ID NO: 5219476 - DNA, 11 bp, Homo sapiens
aggggaatatt

SEQ ID NO: 5219477 - DNA, 16 bp, Homo sapiens
aggggaatattttatt

SEQ ID NO: 5219478 - DNA, 23 bp, Homo sapiens
aggggaatattttattcaaggta

SEQ ID NO: 5219479 - DNA, 19 bp, Homo sapiens
aggggaatgagggggctca

SEQ ID NO: 5219480 - DNA, 16 bp, Homo sapiens
aggggaatgtgtcctc

SEQ ID NO: 5219481 - DNA, 20 bp, Homo sapiens
aggggaatgtgtcctcctgc

SEQ ID NO: 5219482 - DNA, 21 bp, Homo sapiens
aggggaatgtgtcctcctgct

SEQ ID NO: 5219483 - DNA, 22 bp, Homo sapiens
aggggaatgtgtcctcctgctc

SEQ ID NO: 5219484 - DNA, 19 bp, Homo sapiens
aggggaatgtttgcctctg

SEQ ID NO: 5219485 - DNA, 20 bp, Homo sapiens
aggggaatgtttgcctctgc

SEQ ID NO: 5219486 - DNA, 14 bp, Homo sapiens
aggggacaaggaag

SEQ ID NO: 5219487 - DNA, 22 bp, Homo sapiens
aggggacaagggatttgaggtg

SEQ ID NO: 5219488 - DNA, 14 bp, Homo sapiens
aggggacactggcc

SEQ ID NO: 5219489 - DNA, 20 bp, Homo sapiens
aggggacactggccccacag

SEQ ID NO: 5219490 - DNA, 16 bp, Homo sapiens
aggggacactttgtta

SEQ ID NO: 5219491 - DNA, 18 bp, Homo sapiens
aggggacagagctgagga

SEQ ID NO: 5219492 - DNA, 21 bp, Homo sapiens
aggggacagatcttgagcaag

SEQ ID NO: 5219493 - DNA, 23 bp, Homo sapiens
aggggacagcccagcgccatcct

SEQ ID NO: 5219494 - DNA, 16 bp, Homo sapiens
aggggacagcgccacc

SEQ ID NO: 5219495 - DNA, 18 bp, Homo sapiens
aggggacaggcctcacct

SEQ ID NO: 5219496 - DNA, 13 bp, Homo sapiens
aggggacatttcc

SEQ ID NO: 5219497 - DNA, 14 bp, Homo sapiens
aggggacatttccc

SEQ ID NO: 5219498 - DNA, 15 bp, Homo sapiens
aggggacatttccct

SEQ ID NO: 5219499 - DNA, 21 bp, Homo sapiens
aggggacattttctggattct

SEQ ID NO: 5219500 - DNA, 16 bp, Homo sapiens
aggggaccaggagtgg

SEQ ID NO: 5219501 - DNA, 17 bp, Homo sapiens
aggggaccaggagtggg

SEQ ID NO: 5219502 - DNA, 17 bp, Homo sapiens
aggggacccaagaaacc

SEQ ID NO: 5219503 - DNA, 16 bp, Homo sapiens
aggggacccatggggg

SEQ ID NO: 5219504 - DNA, 11 bp, Homo sapiens
aggggacccca

SEQ ID NO: 5219505 - DNA, 13 bp, Homo sapiens
aggggaccccact

SEQ ID NO: 5219506 - DNA, 18 bp, Homo sapiens
aggggacccccgccccct

SEQ ID NO: 5219507 - DNA, 19 bp, Homo sapiens
aggggacccccgccccctg

SEQ ID NO: 5219508 - DNA, 20 bp, Homo sapiens
aggggaccccgagaaccctg

SEQ ID NO: 5219509 - DNA, 22 bp, Homo sapiens
aggggacctggagctgccagca

SEQ ID NO: 5219510 - DNA, 24 bp, Homo sapiens
aggggacgcaggcccctctcctcc

SEQ ID NO: 5219511 - DNA, 17 bp, Homo sapiens
aggggacgcgggctgtg

SEQ ID NO: 5219512 - DNA, 23 bp, Homo sapiens
aggggacgctggtagagatggag

SEQ ID NO: 5219513 - DNA, 19 bp, Homo sapiens
aggggacgctttgaaggaa

SEQ ID NO: 5219514 - DNA, 16 bp, Homo sapiens
aggggacgggacagac

SEQ ID NO: 5219515 - DNA, 18 bp, Homo sapiens
aggggacgtgagagaagg

SEQ ID NO: 5219516 - DNA, 17 bp, Homo sapiens
aggggactcagccctga

SEQ ID NO: 5219517 - DNA, 22 bp, Homo sapiens
aggggactcagccctgaggtga

SEQ ID NO: 5219518 - DNA, 19 bp, Homo sapiens
aggggactgagctggggag

SEQ ID NO: 5219519 - DNA, 12 bp, Homo sapiens
aggggactgcat

SEQ ID NO: 5219520 - DNA, 16 bp, Homo sapiens
aggggactgcatgcaa

SEQ ID NO: 5219521 - DNA, 13 bp, Homo sapiens
aggggactgggcc

SEQ ID NO: 5219522 - DNA, 13 bp, Homo sapiens
aggggactggtcc

SEQ ID NO: 5219523 - DNA, 15 bp, Homo sapiens
aggggagaaaggaac

SEQ ID NO: 5219524 - DNA, 14 bp, Homo sapiens
aggggagaagccaa

SEQ ID NO: 5219525 - DNA, 15 bp, Homo sapiens
aggggagaagccaag

SEQ ID NO: 5219526 - DNA, 16 bp, Homo sapiens
aggggagaagccaagg

SEQ ID NO: 5219527 - DNA, 18 bp, Homo sapiens
aggggagaatgcagccca

SEQ ID NO: 5219528 - DNA, 15 bp, Homo sapiens
aggggagacagagca

SEQ ID NO: 5219529 - DNA, 15 bp, Homo sapiens
aggggagacaggagc

SEQ ID NO: 5219530 - DNA, 20 bp, Homo sapiens
aggggagacttaggccagag

SEQ ID NO: 5219531 - DNA, 22 bp, Homo sapiens
aggggagacttaggccagaggt

SEQ ID NO: 5219532 - DNA, 17 bp, Homo sapiens
aggggagagacaggcag

SEQ ID NO: 5219533 - DNA, 16 bp, Homo sapiens
aggggagagcctgctg

SEQ ID NO: 5219534 - DNA, 19 bp, Homo sapiens
aggggagagctttgtgctt

SEQ ID NO: 5219535 - DNA, 19 bp, Homo sapiens
aggggagaggtcagccttg

SEQ ID NO: 5219536 - DNA, 17 bp, Homo sapiens
aggggagcacaaggcct

SEQ ID NO: 5219537 - DNA, 22 bp, Homo sapiens
aggggagcagcggctctggtcc

SEQ ID NO: 5219538 - DNA, 14 bp, Homo sapiens
aggggagcatgctt

SEQ ID NO: 5219539 - DNA, 13 bp, Homo sapiens
aggggagccaagg

SEQ ID NO: 5219540 - DNA, 11 bp, Homo sapiens
aggggagccag

SEQ ID NO: 5219541 - DNA, 23 bp, Homo sapiens
aggggagccagaaatgggcagtt

SEQ ID NO: 5219542 - DNA, 14 bp, Homo sapiens
aggggagccagctg

SEQ ID NO: 5219543 - DNA, 15 bp, Homo sapiens
aggggagccagctgc

SEQ ID NO: 5219544 - DNA, 18 bp, Homo sapiens
aggggagccagctgcttg

SEQ ID NO: 5219545 - DNA, 12 bp, Homo sapiens
aggggagccagg

SEQ ID NO: 5219546 - DNA, 16 bp, Homo sapiens
aggggagccaggaggg

SEQ ID NO: 5219547 - DNA, 11 bp, Homo sapiens
aggggagccct

SEQ ID NO: 5219548 - DNA, 12 bp, Homo sapiens
aggggagccctc

SEQ ID NO: 5219549 - DNA, 16 bp, Homo sapiens
aggggagccctccacg

SEQ ID NO: 5219550 - DNA, 21 bp, Homo sapiens
aggggagcctttggggggcca

SEQ ID NO: 5219551 - DNA, 16 bp, Homo sapiens
aggggagcgtgttcct

SEQ ID NO: 5219552 - DNA, 17 bp, Homo sapiens
aggggagcttgagggac

SEQ ID NO: 5219553 - DNA, 18 bp, Homo sapiens
aggggagcttgagggaca

SEQ ID NO: 5219554 - DNA, 19 bp, Homo sapiens
aggggagcttgggactcag

SEQ ID NO: 5219555 - DNA, 15 bp, Homo sapiens
aggggaggaaaaaag

SEQ ID NO: 5219556 - DNA, 11 bp, Homo sapiens
aggggaggagg

SEQ ID NO: 5219557 - DNA, 13 bp, Homo sapiens
aggggaggagggc

SEQ ID NO: 5219558 - DNA, 20 bp, Homo sapiens
aggggaggatagcgagaaga

SEQ ID NO: 5219559 - DNA, 19 bp, Homo sapiens
aggggaggatcactggagc

SEQ ID NO: 5219560 - DNA, 20 bp, Homo sapiens
aggggaggcacactttctgg

SEQ ID NO: 5219561 - DNA, 22 bp, Homo sapiens
aggggaggcacctccaggcagg

SEQ ID NO: 5219562 - DNA, 14 bp, Homo sapiens
aggggaggcagatg

SEQ ID NO: 5219563 - DNA, 12 bp, Homo sapiens
aggggaggccaa

SEQ ID NO: 5219564 - DNA, 18 bp, Homo sapiens
aggggaggccagaggaga

SEQ ID NO: 5219565 - DNA, 20 bp, Homo sapiens
aggggaggccatctggagag

SEQ ID NO: 5219566 - DNA, 11 bp, Homo sapiens
aggggaggctg

SEQ ID NO: 5219567 - DNA, 14 bp, Homo sapiens
aggggagggaaaag

SEQ ID NO: 5219568 - DNA, 13 bp, Homo sapiens
aggggagggaggg

SEQ ID NO: 5219569 - DNA, 17 bp, Homo sapiens
aggggagggctcctggg

SEQ ID NO: 5219570 - DNA, 19 bp, Homo sapiens
aggggagggctcctggggc

SEQ ID NO: 5219571 - DNA, 21 bp, Homo sapiens
aggggagggctcctggggcag

SEQ ID NO: 5219572 - DNA, 12 bp, Homo sapiens
aggggaggggcc

SEQ ID NO: 5219573 - DNA, 22 bp, Homo sapiens
aggggaggggcctagggagccg

SEQ ID NO: 5219574 - DNA, 17 bp, Homo sapiens
aggggaggggctccttt

SEQ ID NO: 5219575 - DNA, 15 bp, Homo sapiens
aggggaggggggagc

SEQ ID NO: 5219576 - DNA, 18 bp, Homo sapiens
aggggaggggggagccag

SEQ ID NO: 5219577 - DNA, 19 bp, Homo sapiens
aggggaggggggaggggga

SEQ ID NO: 5219578 - DNA, 22 bp, Homo sapiens
aggggaggggggagggggaagc

SEQ ID NO: 5219579 - DNA, 16 bp, Homo sapiens
aggggaggggggcaca

SEQ ID NO: 5219580 - DNA, 19 bp, Homo sapiens
aggggagggtggcaggtga

SEQ ID NO: 5219581 - DNA, 22 bp, Homo sapiens
aggggagggtgttcagaggcag

SEQ ID NO: 5219582 - DNA, 12 bp, Homo sapiens
aggggaggtggc

SEQ ID NO: 5219583 - DNA, 14 bp, Homo sapiens
aggggaggtggcca

SEQ ID NO: 5219584 - DNA, 22 bp, Homo sapiens
aggggaggtggccagcccgcag

SEQ ID NO: 5219585 - DNA, 18 bp, Homo sapiens
aggggagtcaccttccct

SEQ ID NO: 5219586 - DNA, 22 bp, Homo sapiens
aggggagtcaccttcccttgcc

SEQ ID NO: 5219587 - DNA, 16 bp, Homo sapiens
aggggagtctgcttgt

SEQ ID NO: 5219588 - DNA, 17 bp, Homo sapiens
aggggagtgtgggtgat

SEQ ID NO: 5219589 - DNA, 21 bp, Homo sapiens
aggggatagagagagaccact

SEQ ID NO: 5219590 - DNA, 19 bp, Homo sapiens
aggggatccagctcaaggg

SEQ ID NO: 5219591 - DNA, 16 bp, Homo sapiens
aggggatctaaaaaaa

SEQ ID NO: 5219592 - DNA, 21 bp, Homo sapiens
aggggatctaaaaggaggaca

SEQ ID NO: 5219593 - DNA, 19 bp, Homo sapiens
aggggatgaggggcttcct

SEQ ID NO: 5219594 - DNA, 18 bp, Homo sapiens
aggggatggaggccagag

SEQ ID NO: 5219595 - DNA, 15 bp, Homo sapiens
aggggatggagtgag

SEQ ID NO: 5219596 - DNA, 18 bp, Homo sapiens
aggggatggagtgagccc

SEQ ID NO: 5219597 - DNA, 20 bp, Homo sapiens
aggggatggcccattaagag

SEQ ID NO: 5219598 - DNA, 16 bp, Homo sapiens
aggggatgggaaataa

SEQ ID NO: 5219599 - DNA, 14 bp, Homo sapiens
aggggatgggaggt

SEQ ID NO: 5219600 - DNA, 21 bp, Homo sapiens
aggggatgtttacctggtgct

SEQ ID NO: 5219601 - DNA, 15 bp, Homo sapiens
aggggattacagttc

SEQ ID NO: 5219602 - DNA, 14 bp, Homo sapiens
agtatttgtgggga

SEQ ID NO: 5219603 - DNA, 15 bp, Homo sapiens
agtatttgttaattt

SEQ ID NO: 5219604 - DNA, 17 bp, Homo sapiens
agtattttaaaatagcg

SEQ ID NO: 5219605 - DNA, 19 bp, Homo sapiens
agtattttaagtctacaaa

SEQ ID NO: 5219606 - DNA, 19 bp, Homo sapiens
agtattttaattttaaaga

SEQ ID NO: 5219607 - DNA, 21 bp, Homo sapiens
agtattttcagtgtcaaatat

SEQ ID NO: 5219608 - DNA, 14 bp, Homo sapiens
agtattttcccaat

SEQ ID NO: 5219609 - DNA, 12 bp, Homo sapiens
agtattttcctg

SEQ ID NO: 5219610 - DNA, 21 bp, Homo sapiens
agtattttcctgttgtcaaga

SEQ ID NO: 5219611 - DNA, 13 bp, Homo sapiens
agtattttctaaa

SEQ ID NO: 5219612 - DNA, 17 bp, Homo sapiens
agtattttctccacttc

SEQ ID NO: 5219613 - DNA, 12 bp, Homo sapiens
agtattttctgt

SEQ ID NO: 5219614 - DNA, 21 bp, Homo sapiens
agtattttctgtttttatgtt

SEQ ID NO: 5219615 - DNA, 19 bp, Homo sapiens
agtattttgaagtttacat

SEQ ID NO: 5219616 - DNA, 17 bp, Homo sapiens
agtattttgctggaata

SEQ ID NO: 5219617 - DNA, 18 bp, Homo sapiens
agtattttggttcttagt

SEQ ID NO: 5219618 - DNA, 17 bp, Homo sapiens
agtattttgtttcagtg

SEQ ID NO: 5219619 - DNA, 14 bp, Homo sapiens
agtatttttaaagg

SEQ ID NO: 5219620 - DNA, 14 bp, Homo sapiens
agtatttttataat

SEQ ID NO: 5219621 - DNA, 17 bp, Homo sapiens
agtatttttataatttt

SEQ ID NO: 5219622 - DNA, 18 bp, Homo sapiens
agtatttttataatttta

SEQ ID NO: 5219623 - DNA, 21 bp, Homo sapiens
agtatttttatatttaaatgt

SEQ ID NO: 5219624 - DNA, 18 bp, Homo sapiens
agtatttttcagatataa

SEQ ID NO: 5219625 - DNA, 20 bp, Homo sapiens
agtatttttgaaagaattct

SEQ ID NO: 5219626 - DNA, 21 bp, Homo sapiens
agtatttttgaaagaattcta

SEQ ID NO: 5219627 - DNA, 13 bp, Homo sapiens
agtatttttgaca

SEQ ID NO: 5219628 - DNA, 16 bp, Homo sapiens
agtatttttgacagaa

SEQ ID NO: 5219629 - DNA, 20 bp, Homo sapiens
agtatttttgggctattgca

SEQ ID NO: 5219630 - DNA, 16 bp, Homo sapiens
agtatttttgtattca

SEQ ID NO: 5219631 - DNA, 19 bp, Homo sapiens
agtattttttacattttac

SEQ ID NO: 5219632 - DNA, 22 bp, Homo sapiens
agtattttttatttaattatat

SEQ ID NO: 5219633 - DNA, 16 bp, Homo sapiens
agtattttttcagtat

SEQ ID NO: 5219634 - DNA, 13 bp, Homo sapiens
agtattttttgta

SEQ ID NO: 5219635 - DNA, 19 bp, Homo sapiens
agtattttttgtataattg

SEQ ID NO: 5219636 - DNA, 22 bp, Homo sapiens
agtattttttgtataattggat

SEQ ID NO: 5219637 - DNA, 21 bp, Homo sapiens
agtatttttttaagttagaga

SEQ ID NO: 5219638 - DNA, 23 bp, Homo sapiens
agtatttttttaagttagagaat

SEQ ID NO: 5219639 - DNA, 15 bp, Homo sapiens
agtatttttttaatt

SEQ ID NO: 5219640 - DNA, 18 bp, Homo sapiens
agtatttttttaatttct

SEQ ID NO: 5219641 - DNA, 15 bp, Homo sapiens
agtatttttttctta

SEQ ID NO: 5219642 - DNA, 20 bp, Homo sapiens
agtatttttttcttaccaaa

SEQ ID NO: 5219643 - DNA, 13 bp, Homo sapiens
agtcaaaaaatta

SEQ ID NO: 5219644 - DNA, 12 bp, Homo sapiens
agtcaaaaagaa

SEQ ID NO: 5219645 - DNA, 14 bp, Homo sapiens
agtcaaaacagaga

SEQ ID NO: 5219646 - DNA, 21 bp, Homo sapiens
agtcaaaacagagatgtgata

SEQ ID NO: 5219647 - DNA, 15 bp, Homo sapiens
agtcaaaactatttt

SEQ ID NO: 5219648 - DNA, 19 bp, Homo sapiens
agtcaaaactatttttgta

SEQ ID NO: 5219649 - DNA, 23 bp, Homo sapiens
agtcaaaagatccttcattttag

SEQ ID NO: 5219650 - DNA, 14 bp, Homo sapiens
agtcaaaagcctgg

SEQ ID NO: 5219651 - DNA, 19 bp, Homo sapiens
agtcaaaaggcaaatcatt

SEQ ID NO: 5219652 - DNA, 17 bp, Homo sapiens
agtcaaaaggtgcctgt

SEQ ID NO: 5219653 - DNA, 14 bp, Homo sapiens
agtcaaaataattc

SEQ ID NO: 5219654 - DNA, 19 bp, Homo sapiens
agtcaaaatatttttaaaa

SEQ ID NO: 5219655 - DNA, 22 bp, Homo sapiens
agtcaaaatatttttaaaagat

SEQ ID NO: 5219656 - DNA, 22 bp, Homo sapiens
agtcaaagacaaagtgtgtaat

SEQ ID NO: 5219657 - DNA, 22 bp, Homo sapiens
agtcaaagagagtttttaatag

SEQ ID NO: 5219658 - DNA, 23 bp, Homo sapiens
agtcaaagagagtttttaataga

SEQ ID NO: 5219659 - DNA, 19 bp, Homo sapiens
agtcaaagcggatgctggc

SEQ ID NO: 5219660 - DNA, 17 bp, Homo sapiens
agtcaaataaatgtttc

SEQ ID NO: 5219661 - DNA, 19 bp, Homo sapiens
agtcaaataaatgtttccc

SEQ ID NO: 5219662 - DNA, 22 bp, Homo sapiens
agtcaaataaatgtttccccca

SEQ ID NO: 5219663 - DNA, 14 bp, Homo sapiens
agtcaaatatttat

SEQ ID NO: 5219664 - DNA, 14 bp, Homo sapiens
agtcaaatccagtg

SEQ ID NO: 5219665 - DNA, 14 bp, Homo sapiens
agtcaaatgccaaa

SEQ ID NO: 5219666 - DNA, 23 bp, Homo sapiens
agtcaaatgccaaacactagctc

SEQ ID NO: 5219667 - DNA, 23 bp, Homo sapiens
agtcaaatggagaaacaggccca

SEQ ID NO: 5219668 - DNA, 13 bp, Homo sapiens
agtcaaatgggaa

SEQ ID NO: 5219669 - DNA, 14 bp, Homo sapiens
agtcaaatgggaaa

SEQ ID NO: 5219670 - DNA, 14 bp, Homo sapiens
agtcaaattaataa

SEQ ID NO: 5219671 - DNA, 15 bp, Homo sapiens
agtcaaattaataat

SEQ ID NO: 5219672 - DNA, 20 bp, Homo sapiens
agtcaaattaataatcttat

SEQ ID NO: 5219673 - DNA, 15 bp, Homo sapiens
agtcaaattgtgtga

SEQ ID NO: 5219674 - DNA, 17 bp, Homo sapiens
agtcaaattgtgtgaaa

SEQ ID NO: 5219675 - DNA, 13 bp, Homo sapiens
agtcaaatttact

SEQ ID NO: 5219676 - DNA, 19 bp, Homo sapiens
agtcaacaaattaaataaa

SEQ ID NO: 5219677 - DNA, 19 bp, Homo sapiens
agtcaacaaccatgccagg

SEQ ID NO: 5219678 - DNA, 21 bp, Homo sapiens
agtcaacactcttcttgagca

SEQ ID NO: 5219679 - DNA, 19 bp, Homo sapiens
agtcaacagagaggggcag

SEQ ID NO: 5219680 - DNA, 23 bp, Homo sapiens
agtcaacagagaggggcagggaa

SEQ ID NO: 5219681 - DNA, 18 bp, Homo sapiens
agtcaacaggtcacttga

SEQ ID NO: 5219682 - DNA, 17 bp, Homo sapiens
agtcaacagtaaaccac

SEQ ID NO: 5219683 - DNA, 20 bp, Homo sapiens
agtcaacagtaaaccactga

SEQ ID NO: 5219684 - DNA, 22 bp, Homo sapiens
agtcaacagtaaaccactgaaa

SEQ ID NO: 5219685 - DNA, 18 bp, Homo sapiens
agtcaacagttcaaagaa

SEQ ID NO: 5219686 - DNA, 19 bp, Homo sapiens
agtcaacagttcaaagaag

SEQ ID NO: 5219687 - DNA, 13 bp, Homo sapiens
agtcaacatcttc

SEQ ID NO: 5219688 - DNA, 15 bp, Homo sapiens
agtcaaccaacccca

SEQ ID NO: 5219689 - DNA, 15 bp, Homo sapiens
agtcaacctgggcaa

SEQ ID NO: 5219690 - DNA, 18 bp, Homo sapiens
agtcaacggggggctcct

SEQ ID NO: 5219691 - DNA, 23 bp, Homo sapiens
agtcaacggggggctcctgccca

SEQ ID NO: 5219692 - DNA, 24 bp, Homo sapiens
agtcaacggggggctcctgcccag

SEQ ID NO: 5219693 - DNA, 12 bp, Homo sapiens
agtcaactggct

SEQ ID NO: 5219694 - DNA, 18 bp, Homo sapiens
agtcaactggctggccag

SEQ ID NO: 5219695 - DNA, 20 bp, Homo sapiens
agtcaactggctggccagtc

SEQ ID NO: 5219696 - DNA, 22 bp, Homo sapiens
agtcaactggggaaaaggatga

SEQ ID NO: 5219697 - DNA, 14 bp, Homo sapiens
agtcaacttacggt

SEQ ID NO: 5219698 - DNA, 21 bp, Homo sapiens
agtcaacttattctttgagta

SEQ ID NO: 5219699 - DNA, 13 bp, Homo sapiens
agtcaagaaaaat

SEQ ID NO: 5219700 - DNA, 14 bp, Homo sapiens
agtcaagaagaaaa

SEQ ID NO: 5219701 - DNA, 15 bp, Homo sapiens
agtcaagaagaaaaa

SEQ ID NO: 5219702 - DNA, 13 bp, Homo sapiens
agtcaagaagaat

SEQ ID NO: 5219703 - DNA, 21 bp, Homo sapiens
agtcaagacggatccacagta

SEQ ID NO: 5219704 - DNA, 21 bp, Homo sapiens
agtcaagagcaatcaaagcag

SEQ ID NO: 5219705 - DNA, 17 bp, Homo sapiens
agtcaagatcaacattc

SEQ ID NO: 5219706 - DNA, 19 bp, Homo sapiens
agtcaagatcacgccattg

SEQ ID NO: 5219707 - DNA, 15 bp, Homo sapiens
agtcaagcacatgta

SEQ ID NO: 5219708 - DNA, 16 bp, Homo sapiens
agtcaagcacatgtaa

SEQ ID NO: 5219709 - DNA, 13 bp, Homo sapiens
agtcaagctccta

SEQ ID NO: 5219710 - DNA, 13 bp, Homo sapiens
agtcaagctcctc

SEQ ID NO: 5219711 - DNA, 22 bp, Homo sapiens
agtcaagctgttgaagtctcag

SEQ ID NO: 5219712 - DNA, 20 bp, Homo sapiens
agtcaaggactggtaaaata

SEQ ID NO: 5219713 - DNA, 23 bp, Homo sapiens
agtcaaggactggtaaaatacat

SEQ ID NO: 5219714 - DNA, 13 bp, Homo sapiens
agtcaaggagatg

SEQ ID NO: 5219715 - DNA, 16 bp, Homo sapiens
agtcaaggattcttct

SEQ ID NO: 5219716 - DNA, 13 bp, Homo sapiens
agtcaaggcctgc

SEQ ID NO: 5219717 - DNA, 14 bp, Homo sapiens
agtcaaggcttaga

SEQ ID NO: 5219718 - DNA, 16 bp, Homo sapiens
agtcaaggtgctcaat

SEQ ID NO: 5219719 - DNA, 20 bp, Homo sapiens
agtcaagtgcgtccacgagc

SEQ ID NO: 5219720 - DNA, 21 bp, Homo sapiens
agtcaagttccctcctgcagc

SEQ ID NO: 5219721 - DNA, 17 bp, Homo sapiens
agtcaataaaagagctg

SEQ ID NO: 5219722 - DNA, 20 bp, Homo sapiens
agtcaataaaagagctgtct

SEQ ID NO: 5219723 - DNA, 20 bp, Homo sapiens
agtcaataaaatgaacctga

SEQ ID NO: 5219724 - DNA, 17 bp, Homo sapiens
agtcaataactctgatt

SEQ ID NO: 5219725 - DNA, 10 bp, Homo sapiens
agtcaataca

SEQ ID NO: 5219726 - DNA, 17 bp, Homo sapiens
agtcaatagcttgtctt

SEQ ID NO: 5219727 - DNA, 12 bp, Homo sapiens
agtcaatattga

SEQ ID NO: 5219728 - DNA, 20 bp, Homo sapiens
agtcaatattgattttaaat

SEQ ID NO: 5219729 - DNA, 18 bp, Homo sapiens
agtcaatcaagtctgttt

SEQ ID NO: 5219730 - DNA, 12 bp, Homo sapiens
agtcaatcactg

SEQ ID NO: 5219731 - DNA, 13 bp, Homo sapiens
agtcaatcactgc

SEQ ID NO: 5219732 - DNA, 19 bp, Homo sapiens
agtcaatcagcctttaggt

SEQ ID NO: 5219733 - DNA, 16 bp, Homo sapiens
agtcaatcatttctca

SEQ ID NO: 5219734 - DNA, 22 bp, Homo sapiens
agtcaatcatttctcactgtgt

SEQ ID NO: 5219735 - DNA, 15 bp, Homo sapiens
agtcaatgacatgaa

SEQ ID NO: 5219736 - DNA, 18 bp, Homo sapiens
agtcaatgacatgaattt

SEQ ID NO: 5219737 - DNA, 13 bp, Homo sapiens
agtcaatgcattg

SEQ ID NO: 5219738 - DNA, 20 bp, Homo sapiens
agtcaatggaagaaatggct

SEQ ID NO: 5219739 - DNA, 13 bp, Homo sapiens
agtcaatgtactt

SEQ ID NO: 5219740 - DNA, 23 bp, Homo sapiens
agtcaatgttttcagttctcttg

SEQ ID NO: 5219741 - DNA, 19 bp, Homo sapiens
agtcaattaaacagctggt

SEQ ID NO: 5219742 - DNA, 14 bp, Homo sapiens
agtcaattaactct

SEQ ID NO: 5219743 - DNA, 15 bp, Homo sapiens
agtcaattagtacag

SEQ ID NO: 5219744 - DNA, 17 bp, Homo sapiens
agtcaattagtacagta

SEQ ID NO: 5219745 - DNA, 19 bp, Homo sapiens
agtcaattgtttaatgttg

SEQ ID NO: 5219746 - DNA, 16 bp, Homo sapiens
agtcaatttgcctctg

SEQ ID NO: 5219747 - DNA, 19 bp, Homo sapiens
agtcacaaaccagcctggg

SEQ ID NO: 5219748 - DNA, 20 bp, Homo sapiens
agtcacaaaccagcctgggg

SEQ ID NO: 5219749 - DNA, 19 bp, Homo sapiens
agtcacaaagagatgtcct

SEQ ID NO: 5219750 - DNA, 13 bp, Homo sapiens
agtcacaaaggaa

SEQ ID NO: 5219751 - DNA, 15 bp, Homo sapiens
agtcacaacaaaagg

SEQ ID NO: 5219752 - DNA, 18 bp, Homo sapiens
agtcacaacagagtgaaa

SEQ ID NO: 5219753 - DNA, 16 bp, Homo sapiens
agtcacaatgttcttt

SEQ ID NO: 5219754 - DNA, 18 bp, Homo sapiens
agtcacaatgttctttat

SEQ ID NO: 5219755 - DNA, 15 bp, Homo sapiens
agtcacacagacaca

SEQ ID NO: 5219756 - DNA, 16 bp, Homo sapiens
agtcacacagctagtg

SEQ ID NO: 5219757 - DNA, 12 bp, Homo sapiens
agtcacacatta

SEQ ID NO: 5219758 - DNA, 20 bp, Homo sapiens
agtcacacattatagaaatt

SEQ ID NO: 5219759 - DNA, 21 bp, Homo sapiens
agtcacacattatagaaatta

SEQ ID NO: 5219760 - DNA, 22 bp, Homo sapiens
agtcacaccatcttaaatgaca

SEQ ID NO: 5219761 - DNA, 23 bp, Homo sapiens
agtcacaccatcttaaatgacag

SEQ ID NO: 5219762 - DNA, 16 bp, Homo sapiens
agtcacacgggggcag

SEQ ID NO: 5219763 - DNA, 19 bp, Homo sapiens
agtcacacgggggcagctg

SEQ ID NO: 5219764 - DNA, 16 bp, Homo sapiens
agtcacactgctagca

SEQ ID NO: 5219765 - DNA, 14 bp, Homo sapiens
agtcacagaaaatg

SEQ ID NO: 5219766 - DNA, 21 bp, Homo sapiens
agtcacagaacaaatgtttgt

SEQ ID NO: 5219767 - DNA, 13 bp, Homo sapiens
agtcacagccatt

SEQ ID NO: 5219768 - DNA, 17 bp, Homo sapiens
agtcacagccatttcaa

SEQ ID NO: 5219769 - DNA, 21 bp, Homo sapiens
agtcacagccgtttgaatata

SEQ ID NO: 5219770 - DNA, 12 bp, Homo sapiens
agtcacagctgc

SEQ ID NO: 5219771 - DNA, 16 bp, Homo sapiens
agtcacagctgcagct

SEQ ID NO: 5219772 - DNA, 14 bp, Homo sapiens
agtcacaggcccag

SEQ ID NO: 5219773 - DNA, 14 bp, Homo sapiens
agtcacagggcagt

SEQ ID NO: 5219774 - DNA, 17 bp, Homo sapiens
agtcacagggcagtacc

SEQ ID NO: 5219775 - DNA, 11 bp, Homo sapiens
agtcacagtgg

SEQ ID NO: 5219776 - DNA, 23 bp, Homo sapiens
agtcacataaatggattaattac

SEQ ID NO: 5219777 - DNA, 16 bp, Homo sapiens
agtcacatctcttcct

SEQ ID NO: 5219778 - DNA, 12 bp, Homo sapiens
agtcacatgccc

SEQ ID NO: 5219779 - DNA, 21 bp, Homo sapiens
agtcacattccacatctgttt

SEQ ID NO: 5219780 - DNA, 13 bp, Homo sapiens
agtcaccaagccc

SEQ ID NO: 5219781 - DNA, 15 bp, Homo sapiens
aggggcaaaaatatt

SEQ ID NO: 5219782 - DNA, 16 bp, Homo sapiens
aggggcaaaaatattt

SEQ ID NO: 5219783 - DNA, 16 bp, Homo sapiens
aggggcaaaaatttga

SEQ ID NO: 5219784 - DNA, 19 bp, Homo sapiens
aggggcaaaaatttgacat

SEQ ID NO: 5219785 - DNA, 23 bp, Homo sapiens
aggggcaaaaatttgacattgtc

SEQ ID NO: 5219786 - DNA, 12 bp, Homo sapiens
aggggcaaacat

SEQ ID NO: 5219787 - DNA, 20 bp, Homo sapiens
aggggcaaccaactgcccca

SEQ ID NO: 5219788 - DNA, 19 bp, Homo sapiens
aggggcaagctaggcccca

SEQ ID NO: 5219789 - DNA, 22 bp, Homo sapiens
aggggcaagctaggccccagag

SEQ ID NO: 5219790 - DNA, 23 bp, Homo sapiens
aggggcaagctcttgccccactc

SEQ ID NO: 5219791 - DNA, 15 bp, Homo sapiens
aggggcacaccactg

SEQ ID NO: 5219792 - DNA, 16 bp, Homo sapiens
aggggcacaccactgc

SEQ ID NO: 5219793 - DNA, 20 bp, Homo sapiens
aggggcacaccactgccctg

SEQ ID NO: 5219794 - DNA, 17 bp, Homo sapiens
aggggcacacttcccct

SEQ ID NO: 5219795 - DNA, 20 bp, Homo sapiens
aggggcaccctccaaacact

SEQ ID NO: 5219796 - DNA, 22 bp, Homo sapiens
aggggcacctccggctgcctag

SEQ ID NO: 5219797 - DNA, 22 bp, Homo sapiens
aggggcacctctcttgaacccc

SEQ ID NO: 5219798 - DNA, 21 bp, Homo sapiens
aggggcacctgccaccgccag

SEQ ID NO: 5219799 - DNA, 14 bp, Homo sapiens
aggggcacctggga

SEQ ID NO: 5219800 - DNA, 20 bp, Homo sapiens
aggggcacctgggaaaacag

SEQ ID NO: 5219801 - DNA, 16 bp, Homo sapiens
aggggcacgcctgccc

SEQ ID NO: 5219802 - DNA, 22 bp, Homo sapiens
aggggcacgcctgcccagcctc

SEQ ID NO: 5219803 - DNA, 17 bp, Homo sapiens
aggggcagaaaaactct

SEQ ID NO: 5219804 - DNA, 14 bp, Homo sapiens
aggggcagaacagc

SEQ ID NO: 5219805 - DNA, 18 bp, Homo sapiens
aggggcagaaggaggaag

SEQ ID NO: 5219806 - DNA, 19 bp, Homo sapiens
aggggcagatggaaaggag

SEQ ID NO: 5219807 - DNA, 14 bp, Homo sapiens
aggggcagcaaggc

SEQ ID NO: 5219808 - DNA, 13 bp, Homo sapiens
aggggcagcagga

SEQ ID NO: 5219809 - DNA, 17 bp, Homo sapiens
aggggcagccagccctg

SEQ ID NO: 5219810 - DNA, 12 bp, Homo sapiens
aggggcagcccc

SEQ ID NO: 5219811 - DNA, 16 bp, Homo sapiens
aggggcagccctgagt

SEQ ID NO: 5219812 - DNA, 18 bp, Homo sapiens
aggggcagcctgccttgc

SEQ ID NO: 5219813 - DNA, 14 bp, Homo sapiens
aggggcagctcctg

SEQ ID NO: 5219814 - DNA, 18 bp, Homo sapiens
aggggcagctcctgacca

SEQ ID NO: 5219815 - DNA, 21 bp, Homo sapiens
aggggcagctcctgaccaaag

SEQ ID NO: 5219816 - DNA, 22 bp, Homo sapiens
aggggcagctcctgaccaaaga

SEQ ID NO: 5219817 - DNA, 14 bp, Homo sapiens
aggggcaggagctc

SEQ ID NO: 5219818 - DNA, 17 bp, Homo sapiens
aggggcaggagctcaga

SEQ ID NO: 5219819 - DNA, 19 bp, Homo sapiens
aggggcaggagctcagatg

SEQ ID NO: 5219820 - DNA, 13 bp, Homo sapiens
aggggcaggaggg

SEQ ID NO: 5219821 - DNA, 18 bp, Homo sapiens
aggggcaggcagctaggc

SEQ ID NO: 5219822 - DNA, 23 bp, Homo sapiens
aggggcaggcagctaggcaggga

SEQ ID NO: 5219823 - DNA, 13 bp, Homo sapiens
aggggcaggcctg

SEQ ID NO: 5219824 - DNA, 14 bp, Homo sapiens
aggggcaggcctgg

SEQ ID NO: 5219825 - DNA, 16 bp, Homo sapiens
aggggcaggcctggga

SEQ ID NO: 5219826 - DNA, 21 bp, Homo sapiens
aggggcaggcctgggacccag

SEQ ID NO: 5219827 - DNA, 14 bp, Homo sapiens
aggggcaggccttt

SEQ ID NO: 5219828 - DNA, 14 bp, Homo sapiens
aggggcaggcgcag

SEQ ID NO: 5219829 - DNA, 11 bp, Homo sapiens
aggggcaggga

SEQ ID NO: 5219830 - DNA, 12 bp, Homo sapiens
aggggcagggag

SEQ ID NO: 5219831 - DNA, 17 bp, Homo sapiens
aggggcagggagagcgc

SEQ ID NO: 5219832 - DNA, 23 bp, Homo sapiens
aggggcaggtaaactcctgtcct

SEQ ID NO: 5219833 - DNA, 17 bp, Homo sapiens
aggggcaggtggtggag

SEQ ID NO: 5219834 - DNA, 17 bp, Homo sapiens
aggggcagtcagtggag

SEQ ID NO: 5219835 - DNA, 21 bp, Homo sapiens
aggggcatccaaggcaaacaa

SEQ ID NO: 5219836 - DNA, 16 bp, Homo sapiens
aggggcatctctgggc

SEQ ID NO: 5219837 - DNA, 15 bp, Homo sapiens
aggggcattgctgac

SEQ ID NO: 5219838 - DNA, 23 bp, Homo sapiens
aggggccaaactggtgggaggca

SEQ ID NO: 5219839 - DNA, 19 bp, Homo sapiens
aggggccaacctcaggctc

SEQ ID NO: 5219840 - DNA, 14 bp, Homo sapiens
aggggccaagcagg

SEQ ID NO: 5219841 - DNA, 16 bp, Homo sapiens
aggggccaagcaggca

SEQ ID NO: 5219842 - DNA, 20 bp, Homo sapiens
aggggccaattttggatgag

SEQ ID NO: 5219843 - DNA, 11 bp, Homo sapiens
aggggccacct

SEQ ID NO: 5219844 - DNA, 12 bp, Homo sapiens
aggggccacctc

SEQ ID NO: 5219845 - DNA, 13 bp, Homo sapiens
aggggccacctcc

SEQ ID NO: 5219846 - DNA, 21 bp, Homo sapiens
aggggccacgtggatgggcaa

SEQ ID NO: 5219847 - DNA, 21 bp, Homo sapiens
aggggccactgacccacctgc

SEQ ID NO: 5219848 - DNA, 16 bp, Homo sapiens
aggggccagaccacgc

SEQ ID NO: 5219849 - DNA, 22 bp, Homo sapiens
aggggccagagagcaggggagc

SEQ ID NO: 5219850 - DNA, 22 bp, Homo sapiens
aggggccagaggaactgtccag

SEQ ID NO: 5219851 - DNA, 14 bp, Homo sapiens
aggggccagcagag

SEQ ID NO: 5219852 - DNA, 16 bp, Homo sapiens
aggggccagcagaggg

SEQ ID NO: 5219853 - DNA, 19 bp, Homo sapiens
aggggccagcggccctccc

SEQ ID NO: 5219854 - DNA, 22 bp, Homo sapiens
aggggccagcggccctcccagg

SEQ ID NO: 5219855 - DNA, 14 bp, Homo sapiens
aggggccagctgcc

SEQ ID NO: 5219856 - DNA, 16 bp, Homo sapiens
aggggccagctgcccc

SEQ ID NO: 5219857 - DNA, 19 bp, Homo sapiens
aggggccaggaaggggaca

SEQ ID NO: 5219858 - DNA, 13 bp, Homo sapiens
aggggccaggcca

SEQ ID NO: 5219859 - DNA, 13 bp, Homo sapiens
aggggccagggct

SEQ ID NO: 5219860 - DNA, 23 bp, Homo sapiens
aggggccaggggcaggcagggct

SEQ ID NO: 5219861 - DNA, 17 bp, Homo sapiens
aggggccagtgagggct

SEQ ID NO: 5219862 - DNA, 21 bp, Homo sapiens
aggggccagtgagggctgggc

SEQ ID NO: 5219863 - DNA, 15 bp, Homo sapiens
aggggccatcacagg

SEQ ID NO: 5219864 - DNA, 13 bp, Homo sapiens
aggggccatgccc

SEQ ID NO: 5219865 - DNA, 18 bp, Homo sapiens
aggggccatgccccaccc

SEQ ID NO: 5219866 - DNA, 22 bp, Homo sapiens
aggggcccaaattctttcagtg

SEQ ID NO: 5219867 - DNA, 16 bp, Homo sapiens
aggggcccaagagaga

SEQ ID NO: 5219868 - DNA, 17 bp, Homo sapiens
aggggcccaaggcggcc

SEQ ID NO: 5219869 - DNA, 22 bp, Homo sapiens
aggggcccacaaaggggagaag

SEQ ID NO: 5219870 - DNA, 21 bp, Homo sapiens
aggggcccacagggaaccctg

SEQ ID NO: 5219871 - DNA, 14 bp, Homo sapiens
aggggcccacccac

SEQ ID NO: 5219872 - DNA, 19 bp, Homo sapiens
aggggcccacttggggcct

SEQ ID NO: 5219873 - DNA, 19 bp, Homo sapiens
aggggcccagtcctggcct

SEQ ID NO: 5219874 - DNA, 19 bp, Homo sapiens
aggggcccagtgctggcca

SEQ ID NO: 5219875 - DNA, 15 bp, Homo sapiens
aggggccccagatct

SEQ ID NO: 5219876 - DNA, 20 bp, Homo sapiens
aggggccccggtcctggccc

SEQ ID NO: 5219877 - DNA, 18 bp, Homo sapiens
aggggccccgtgtcctgc

SEQ ID NO: 5219878 - DNA, 20 bp, Homo sapiens
aggggccccgtgtcctgcct

SEQ ID NO: 5219879 - DNA, 13 bp, Homo sapiens
aggggcccctgct

SEQ ID NO: 5219880 - DNA, 21 bp, Homo sapiens
aggggcccctgcttctccagc

SEQ ID NO: 5219881 - DNA, 16 bp, Homo sapiens
aggggcccctggggac

SEQ ID NO: 5219882 - DNA, 17 bp, Homo sapiens
aggggcccggccagcca

SEQ ID NO: 5219883 - DNA, 21 bp, Homo sapiens
aggggcccggccagccatgtc

SEQ ID NO: 5219884 - DNA, 13 bp, Homo sapiens
aggggcccgggaa

SEQ ID NO: 5219885 - DNA, 18 bp, Homo sapiens
aggggcccggtggcggca

SEQ ID NO: 5219886 - DNA, 22 bp, Homo sapiens
aggggcccggtggcggcagggc

SEQ ID NO: 5219887 - DNA, 20 bp, Homo sapiens
aggggcccgttgtctccctg

SEQ ID NO: 5219888 - DNA, 14 bp, Homo sapiens
aggggccctacctg

SEQ ID NO: 5219889 - DNA, 18 bp, Homo sapiens
aggggccctacctgggga

SEQ ID NO: 5219890 - DNA, 17 bp, Homo sapiens
aggggccctcaggccat

SEQ ID NO: 5219891 - DNA, 19 bp, Homo sapiens
aggggcccttgggacagcc

SEQ ID NO: 5219892 - DNA, 22 bp, Homo sapiens
aggggccctttgcatagctctc

SEQ ID NO: 5219893 - DNA, 16 bp, Homo sapiens
aggggccgagtccagg

SEQ ID NO: 5219894 - DNA, 19 bp, Homo sapiens
aggggccgagtccaggagc

SEQ ID NO: 5219895 - DNA, 18 bp, Homo sapiens
aggggccgatgcccagag

SEQ ID NO: 5219896 - DNA, 17 bp, Homo sapiens
aggggccgctgccaccc

SEQ ID NO: 5219897 - DNA, 14 bp, Homo sapiens
aggggccggccctg

SEQ ID NO: 5219898 - DNA, 21 bp, Homo sapiens
aggggccggccctgtgtgcag

SEQ ID NO: 5219899 - DNA, 16 bp, Homo sapiens
aggggccggctggcct

SEQ ID NO: 5219900 - DNA, 18 bp, Homo sapiens
aggggccggctgtttcct

SEQ ID NO: 5219901 - DNA, 15 bp, Homo sapiens
aggggccggggaagc

SEQ ID NO: 5219902 - DNA, 15 bp, Homo sapiens
aggggccggggaggg

SEQ ID NO: 5219903 - DNA, 17 bp, Homo sapiens
aggggccggggaggggg

SEQ ID NO: 5219904 - DNA, 18 bp, Homo sapiens
aggggccggggagggggc

SEQ ID NO: 5219905 - DNA, 21 bp, Homo sapiens
aggggccggggagggggcacg

SEQ ID NO: 5219906 - DNA, 23 bp, Homo sapiens
aggggcctaggcctcagccagag

SEQ ID NO: 5219907 - DNA, 14 bp, Homo sapiens
aggggcctagggag

SEQ ID NO: 5219908 - DNA, 21 bp, Homo sapiens
aggggcctcaggggagccccc

SEQ ID NO: 5219909 - DNA, 21 bp, Homo sapiens
aggggcctcatcttccccagc

SEQ ID NO: 5219910 - DNA, 16 bp, Homo sapiens
aggggcctccatgggc

SEQ ID NO: 5219911 - DNA, 21 bp, Homo sapiens
aggggcctcccggggcccagg

SEQ ID NO: 5219912 - DNA, 20 bp, Homo sapiens
aggggcctctctcctgcctg

SEQ ID NO: 5219913 - DNA, 23 bp, Homo sapiens
aggggcctctctcctgcctgccc

SEQ ID NO: 5219914 - DNA, 23 bp, Homo sapiens
aggggcctctgaaatttcccaca

SEQ ID NO: 5219915 - DNA, 14 bp, Homo sapiens
aggggcctctggct

SEQ ID NO: 5219916 - DNA, 18 bp, Homo sapiens
aggggcctctggctgcct

SEQ ID NO: 5219917 - DNA, 22 bp, Homo sapiens
aggggcctctggctgcctggcc

SEQ ID NO: 5219918 - DNA, 12 bp, Homo sapiens
aggggcctctgt

SEQ ID NO: 5219919 - DNA, 20 bp, Homo sapiens
aggggcctctgttcctttct

SEQ ID NO: 5219920 - DNA, 23 bp, Homo sapiens
aggggcctctgttcctttctctg

SEQ ID NO: 5219921 - DNA, 21 bp, Homo sapiens
aggggcctcttatgggctggg

SEQ ID NO: 5219922 - DNA, 13 bp, Homo sapiens
aggggcctgcaga

SEQ ID NO: 5219923 - DNA, 17 bp, Homo sapiens
aggggcctgccacctgg

SEQ ID NO: 5219924 - DNA, 20 bp, Homo sapiens
aggggcctgccacctggacc

SEQ ID NO: 5219925 - DNA, 15 bp, Homo sapiens
aggggcctgcgcagg

SEQ ID NO: 5219926 - DNA, 13 bp, Homo sapiens
aggggcctgcgcc

SEQ ID NO: 5219927 - DNA, 20 bp, Homo sapiens
aggggcctgcgcccagagct

SEQ ID NO: 5219928 - DNA, 21 bp, Homo sapiens
aggggcctgcgcccagagctg

SEQ ID NO: 5219929 - DNA, 22 bp, Homo sapiens
aggggcctgcgcccagagctgg

SEQ ID NO: 5219930 - DNA, 12 bp, Homo sapiens
aggggcctggag

SEQ ID NO: 5219931 - DNA, 21 bp, Homo sapiens
aggggcctggagatcctcctg

SEQ ID NO: 5219932 - DNA, 13 bp, Homo sapiens
aggggcctggagg

SEQ ID NO: 5219933 - DNA, 15 bp, Homo sapiens
aggggcctggaggaa

SEQ ID NO: 5219934 - DNA, 22 bp, Homo sapiens
aggggcctggaggtctggctga

SEQ ID NO: 5219935 - DNA, 18 bp, Homo sapiens
aggggcctggcagccgtg

SEQ ID NO: 5219936 - DNA, 12 bp, Homo sapiens
aggggcctggcc

SEQ ID NO: 5219937 - DNA, 17 bp, Homo sapiens
aggggcctggcctgggt

SEQ ID NO: 5219938 - DNA, 18 bp, Homo sapiens
aggggcctgggaaaggaa

SEQ ID NO: 5219939 - DNA, 19 bp, Homo sapiens
aggggcctgggcagcccca

SEQ ID NO: 5219940 - DNA, 20 bp, Homo sapiens
aggggcctgggcagccccac

SEQ ID NO: 5219941 - DNA, 17 bp, Homo sapiens
aggggcctgggctgtga

SEQ ID NO: 5219942 - DNA, 14 bp, Homo sapiens
aggggcctgtgtgg

SEQ ID NO: 5219943 - DNA, 19 bp, Homo sapiens
aggggccttagggcactgg

SEQ ID NO: 5219944 - DNA, 17 bp, Homo sapiens
aggggccttgctctgag

SEQ ID NO: 5219945 - DNA, 22 bp, Homo sapiens
aggggccttgctctgagcacag

SEQ ID NO: 5219946 - DNA, 13 bp, Homo sapiens
aggggcgagcacc

SEQ ID NO: 5219947 - DNA, 12 bp, Homo sapiens
aggggcgcaccc

SEQ ID NO: 5219948 - DNA, 18 bp, Homo sapiens
aggggcgcaccccacagc

SEQ ID NO: 5219949 - DNA, 14 bp, Homo sapiens
aggggcgcccacct

SEQ ID NO: 5219950 - DNA, 15 bp, Homo sapiens
aggggcgcccagggt

SEQ ID NO: 5219951 - DNA, 16 bp, Homo sapiens
aggggcgccttttcag

SEQ ID NO: 5219952 - DNA, 21 bp, Homo sapiens
aggggcgccttttcagccctt

SEQ ID NO: 5219953 - DNA, 15 bp, Homo sapiens
aggggcgcgcgcccc

SEQ ID NO: 5219954 - DNA, 16 bp, Homo sapiens
aggggcgctcctccca

SEQ ID NO: 5219955 - DNA, 18 bp, Homo sapiens
aggggcgctcctcccagc

SEQ ID NO: 5219956 - DNA, 20 bp, Homo sapiens
aggggcgctcctcccagctg

SEQ ID NO: 5219957 - DNA, 21 bp, Homo sapiens
aggggcgctcctcccagctgt

SEQ ID NO: 5219958 - DNA, 20 bp, Homo sapiens
aggggcgctgcccccacaga

SEQ ID NO: 5219959 - DNA, 15 bp, Homo sapiens
agtcaccacccagcc

SEQ ID NO: 5219960 - DNA, 16 bp, Homo sapiens
agtcaccacccagccc

SEQ ID NO: 5219961 - DNA, 17 bp, Homo sapiens
agtcaccacccagccct

SEQ ID NO: 5219962 - DNA, 20 bp, Homo sapiens
agtcaccacccagcccttcc

SEQ ID NO: 5219963 - DNA, 18 bp, Homo sapiens
agtcaccactccattccc

SEQ ID NO: 5219964 - DNA, 13 bp, Homo sapiens
agtcaccaggaat

SEQ ID NO: 5219965 - DNA, 14 bp, Homo sapiens
agtcaccatgcaag

SEQ ID NO: 5219966 - DNA, 15 bp, Homo sapiens
agtcaccatgcaagg

SEQ ID NO: 5219967 - DNA, 17 bp, Homo sapiens
agtcaccattctgcatt

SEQ ID NO: 5219968 - DNA, 21 bp, Homo sapiens
agtcaccattctgcatttagc

SEQ ID NO: 5219969 - DNA, 21 bp, Homo sapiens
agtcacccaaacacttctgct

SEQ ID NO: 5219970 - DNA, 23 bp, Homo sapiens
agtcacccaaacacttctgcttt

SEQ ID NO: 5219971 - DNA, 16 bp, Homo sapiens
agtcacccagagcaca

SEQ ID NO: 5219972 - DNA, 17 bp, Homo sapiens
agtcacccagagcacag

SEQ ID NO: 5219973 - DNA, 18 bp, Homo sapiens
agtcacccagagcacagg

SEQ ID NO: 5219974 - DNA, 20 bp, Homo sapiens
agtcacccagggacactcca

SEQ ID NO: 5219975 - DNA, 16 bp, Homo sapiens
agtcacccatgaagac

SEQ ID NO: 5219976 - DNA, 20 bp, Homo sapiens
agtcacccatgaagacagga

SEQ ID NO: 5219977 - DNA, 13 bp, Homo sapiens
agtcaccccagga

SEQ ID NO: 5219978 - DNA, 15 bp, Homo sapiens
agtcacccctctgtc

SEQ ID NO: 5219979 - DNA, 14 bp, Homo sapiens
agtcacccctgtct

SEQ ID NO: 5219980 - DNA, 21 bp, Homo sapiens
agtcacccctttctgtcccac

SEQ ID NO: 5219981 - DNA, 15 bp, Homo sapiens
agtcaccctcctcac

SEQ ID NO: 5219982 - DNA, 21 bp, Homo sapiens
agtcaccctcctcacagacct

SEQ ID NO: 5219983 - DNA, 14 bp, Homo sapiens
agtcaccctgtgac

SEQ ID NO: 5219984 - DNA, 16 bp, Homo sapiens
agtcaccctgtggcaa

SEQ ID NO: 5219985 - DNA, 24 bp, Homo sapiens
agtcacccttccaccattgtccta

SEQ ID NO: 5219986 - DNA, 15 bp, Homo sapiens
agtcacctaagcaat

SEQ ID NO: 5219987 - DNA, 14 bp, Homo sapiens
agtcacctcatgga

SEQ ID NO: 5219988 - DNA, 17 bp, Homo sapiens
agtcacctcatggaatt

SEQ ID NO: 5219989 - DNA, 14 bp, Homo sapiens
agtcacctcctcca

SEQ ID NO: 5219990 - DNA, 18 bp, Homo sapiens
agtcacctcgtctccctg

SEQ ID NO: 5219991 - DNA, 13 bp, Homo sapiens
agtcacctgcaag

SEQ ID NO: 5219992 - DNA, 17 bp, Homo sapiens
agtcacctgcaagcccc

SEQ ID NO: 5219993 - DNA, 19 bp, Homo sapiens
agtcacctgcaagccccag

SEQ ID NO: 5219994 - DNA, 18 bp, Homo sapiens
agtcacctgccccagcac

SEQ ID NO: 5219995 - DNA, 13 bp, Homo sapiens
agtcacctgctcc

SEQ ID NO: 5219996 - DNA, 17 bp, Homo sapiens
agtcacctgctccagaa

SEQ ID NO: 5219997 - DNA, 13 bp, Homo sapiens
agtcaccttccag

SEQ ID NO: 5219998 - DNA, 15 bp, Homo sapiens
agtcaccttcccttg

SEQ ID NO: 5219999 - DNA, 17 bp, Homo sapiens
agtcaccttcccttgcc

SEQ ID NO: 5220000 - DNA, 18 bp, Homo sapiens
agtcaccttcccttgcca

SEQ ID NO: 5220001 - DNA, 13 bp, Homo sapiens
agtcaccttctgg

SEQ ID NO: 5220002 - DNA, 17 bp, Homo sapiens
agtcaccttctgggcaa

SEQ ID NO: 5220003 - DNA, 22 bp, Homo sapiens
agtcaccttctgggcaagggct

SEQ ID NO: 5220004 - DNA, 13 bp, Homo sapiens
agtcacctttctg

SEQ ID NO: 5220005 - DNA, 19 bp, Homo sapiens
agtcaccttttaaatcctg

SEQ ID NO: 5220006 - DNA, 20 bp, Homo sapiens
agtcaccttttaaatcctgt

SEQ ID NO: 5220007 - DNA, 18 bp, Homo sapiens
agtcacgcatgcagtgtt

SEQ ID NO: 5220008 - DNA, 16 bp, Homo sapiens
agtcacgctggggctc

SEQ ID NO: 5220009 - DNA, 20 bp, Homo sapiens
agtcacgctggggctctctg

SEQ ID NO: 5220010 - DNA, 22 bp, Homo sapiens
agtcacgctggggctctctgag

SEQ ID NO: 5220011 - DNA, 23 bp, Homo sapiens
agtcacgctggggctctctgaga

SEQ ID NO: 5220012 - DNA, 21 bp, Homo sapiens
agtcacggctgcgcactgtgt

SEQ ID NO: 5220013 - DNA, 17 bp, Homo sapiens
agtcacggtctaaacac

SEQ ID NO: 5220014 - DNA, 19 bp, Homo sapiens
agtcacggtctaaacacac

SEQ ID NO: 5220015 - DNA, 16 bp, Homo sapiens
agtcacgtgaggcccc

SEQ ID NO: 5220016 - DNA, 18 bp, Homo sapiens
agtcacgtggaggagcag

SEQ ID NO: 5220017 - DNA, 16 bp, Homo sapiens
agtcactaaaaggaag

SEQ ID NO: 5220018 - DNA, 21 bp, Homo sapiens
agtcactaaaaggaagacagt

SEQ ID NO: 5220019 - DNA, 22 bp, Homo sapiens
agtcactaatatagtagatttt

SEQ ID NO: 5220020 - DNA, 19 bp, Homo sapiens
agtcactagaagtcctgct

SEQ ID NO: 5220021 - DNA, 17 bp, Homo sapiens
agtcactcacactggcc

SEQ ID NO: 5220022 - DNA, 22 bp, Homo sapiens
agtcactcctctctagggcaga

SEQ ID NO: 5220023 - DNA, 22 bp, Homo sapiens
agtcactctaggactctgcact

SEQ ID NO: 5220024 - DNA, 23 bp, Homo sapiens
agtcactctaggactctgcactg

SEQ ID NO: 5220025 - DNA, 15 bp, Homo sapiens
agtcactgaacaaaa

SEQ ID NO: 5220026 - DNA, 16 bp, Homo sapiens
agtcactgagacagcc

SEQ ID NO: 5220027 - DNA, 16 bp, Homo sapiens
agtcactgatgtacaa

SEQ ID NO: 5220028 - DNA, 21 bp, Homo sapiens
agtcactgcacgttttcatct

SEQ ID NO: 5220029 - DNA, 15 bp, Homo sapiens
agtcactgcagaggg

SEQ ID NO: 5220030 - DNA, 12 bp, Homo sapiens
agtcactgcatt

SEQ ID NO: 5220031 - DNA, 19 bp, Homo sapiens
agtcactgcatttgcctgc

SEQ ID NO: 5220032 - DNA, 20 bp, Homo sapiens
agtcactgccactttgcaca

SEQ ID NO: 5220033 - DNA, 14 bp, Homo sapiens
agtcactgcctctc

SEQ ID NO: 5220034 - DNA, 22 bp, Homo sapiens
agtcactggaggttgaagccaa

SEQ ID NO: 5220035 - DNA, 23 bp, Homo sapiens
agtcactggcatactgagaatat

SEQ ID NO: 5220036 - DNA, 14 bp, Homo sapiens
agtcacttaactat

SEQ ID NO: 5220037 - DNA, 15 bp, Homo sapiens
agtcacttaatcttt

SEQ ID NO: 5220038 - DNA, 16 bp, Homo sapiens
agtcacttccccaaga

SEQ ID NO: 5220039 - DNA, 13 bp, Homo sapiens
agtcacttctcca

SEQ ID NO: 5220040 - DNA, 14 bp, Homo sapiens
agtcacttctccat

SEQ ID NO: 5220041 - DNA, 15 bp, Homo sapiens
agtcacttctccatc

SEQ ID NO: 5220042 - DNA, 23 bp, Homo sapiens
agtcactttctttgtaacaactt

SEQ ID NO: 5220043 - DNA, 12 bp, Homo sapiens
agtcactttgac

SEQ ID NO: 5220044 - DNA, 15 bp, Homo sapiens
agtcactttgcttaa

SEQ ID NO: 5220045 - DNA, 17 bp, Homo sapiens
agtcagaaactgtttct

SEQ ID NO: 5220046 - DNA, 11 bp, Homo sapiens
agtcagaaatg

SEQ ID NO: 5220047 - DNA, 16 bp, Homo sapiens
agtcagaaatgattca

SEQ ID NO: 5220048 - DNA, 12 bp, Homo sapiens
agtcagaacagc

SEQ ID NO: 5220049 - DNA, 15 bp, Homo sapiens
agtcagaacagcaga

SEQ ID NO: 5220050 - DNA, 22 bp, Homo sapiens
agtcagaacagcagactcagct

SEQ ID NO: 5220051 - DNA, 14 bp, Homo sapiens
agtcagaagatctt

SEQ ID NO: 5220052 - DNA, 17 bp, Homo sapiens
agtcagaaggacggcag

SEQ ID NO: 5220053 - DNA, 19 bp, Homo sapiens
agtcagaaggacggcagga

SEQ ID NO: 5220054 - DNA, 22 bp, Homo sapiens
agtcagaagtttctgccgcagc

SEQ ID NO: 5220055 - DNA, 19 bp, Homo sapiens
agtcagaattagctgcttc

SEQ ID NO: 5220056 - DNA, 11 bp, Homo sapiens
agtcagacaga

SEQ ID NO: 5220057 - DNA, 16 bp, Homo sapiens
agtcagacagatgtgg

SEQ ID NO: 5220058 - DNA, 21 bp, Homo sapiens
agtcagactgatagacaccat

SEQ ID NO: 5220059 - DNA, 15 bp, Homo sapiens
agtcagactgctggg

SEQ ID NO: 5220060 - DNA, 12 bp, Homo sapiens
agtcagagaaaa

SEQ ID NO: 5220061 - DNA, 13 bp, Homo sapiens
agtcagagaaaac

SEQ ID NO: 5220062 - DNA, 16 bp, Homo sapiens
agtcagagaaaacact

SEQ ID NO: 5220063 - DNA, 23 bp, Homo sapiens
agtcagagccatgtcttctccct

SEQ ID NO: 5220064 - DNA, 22 bp, Homo sapiens
agtcagagcccctacagcattg

SEQ ID NO: 5220065 - DNA, 14 bp, Homo sapiens
agtcagagccctgg

SEQ ID NO: 5220066 - DNA, 19 bp, Homo sapiens
agtcagagccctggctggg

SEQ ID NO: 5220067 - DNA, 14 bp, Homo sapiens
agtcagagctcagg

SEQ ID NO: 5220068 - DNA, 13 bp, Homo sapiens
agtcagaggagaa

SEQ ID NO: 5220069 - DNA, 20 bp, Homo sapiens
agtcagaggagaagagacat

SEQ ID NO: 5220070 - DNA, 17 bp, Homo sapiens
agtcagaggatggccag

SEQ ID NO: 5220071 - DNA, 20 bp, Homo sapiens
agtcagaggatggccagtgt

SEQ ID NO: 5220072 - DNA, 15 bp, Homo sapiens
agtcagagtataatt

SEQ ID NO: 5220073 - DNA, 18 bp, Homo sapiens
agtcagagtcacttgtag

SEQ ID NO: 5220074 - DNA, 18 bp, Homo sapiens
agtcagagttaaaatata

SEQ ID NO: 5220075 - DNA, 17 bp, Homo sapiens
agtcagatcctgttact

SEQ ID NO: 5220076 - DNA, 17 bp, Homo sapiens
agtcagatctgcctaag

SEQ ID NO: 5220077 - DNA, 22 bp, Homo sapiens
agtcagatctgcctaaggactt

SEQ ID NO: 5220078 - DNA, 23 bp, Homo sapiens
agtcagatctgcctaaggacttc

SEQ ID NO: 5220079 - DNA, 20 bp, Homo sapiens
agtcagatgaggcaaacagc

SEQ ID NO: 5220080 - DNA, 23 bp, Homo sapiens
agtcagatggaaaattcattttt

SEQ ID NO: 5220081 - DNA, 15 bp, Homo sapiens
agtcagatggatgta

SEQ ID NO: 5220082 - DNA, 21 bp, Homo sapiens
agtcagatggatgtagataca

SEQ ID NO: 5220083 - DNA, 21 bp, Homo sapiens
agtcagatggtagacgagctg

SEQ ID NO: 5220084 - DNA, 12 bp, Homo sapiens
agtcagatgttt

SEQ ID NO: 5220085 - DNA, 17 bp, Homo sapiens
agtcagattcttgcatc

SEQ ID NO: 5220086 - DNA, 18 bp, Homo sapiens
agtcagattgctgggagg

SEQ ID NO: 5220087 - DNA, 14 bp, Homo sapiens
agtcagatttgtat

SEQ ID NO: 5220088 - DNA, 18 bp, Homo sapiens
agtcagatttttaaagtt

SEQ ID NO: 5220089 - DNA, 19 bp, Homo sapiens
agtcagatttttatttatg

SEQ ID NO: 5220090 - DNA, 16 bp, Homo sapiens
agtcagcaccttggcc

SEQ ID NO: 5220091 - DNA, 17 bp, Homo sapiens
agtcagcatgcttccca

SEQ ID NO: 5220092 - DNA, 18 bp, Homo sapiens
agtcagcatgcttcccag

SEQ ID NO: 5220093 - DNA, 16 bp, Homo sapiens
agtcagccacactggg

SEQ ID NO: 5220094 - DNA, 17 bp, Homo sapiens
agtcagccacactgggc

SEQ ID NO: 5220095 - DNA, 18 bp, Homo sapiens
agtcagccacactgggcc

SEQ ID NO: 5220096 - DNA, 20 bp, Homo sapiens
agtcagccacactgggcctg

SEQ ID NO: 5220097 - DNA, 20 bp, Homo sapiens
agtcagccattcctgttctc

SEQ ID NO: 5220098 - DNA, 14 bp, Homo sapiens
agtcagcccagtgg

SEQ ID NO: 5220099 - DNA, 18 bp, Homo sapiens
agtcagcctctctcccag

SEQ ID NO: 5220100 - DNA, 23 bp, Homo sapiens
agtcagccttccccctcccaggg

SEQ ID NO: 5220101 - DNA, 16 bp, Homo sapiens
agtcagcgtgacaata

SEQ ID NO: 5220102 - DNA, 19 bp, Homo sapiens
agtcagctacaaaagttaa

SEQ ID NO: 5220103 - DNA, 19 bp, Homo sapiens
agtcagctccgagtggctc

SEQ ID NO: 5220104 - DNA, 13 bp, Homo sapiens
agtcagctctctg

SEQ ID NO: 5220105 - DNA, 14 bp, Homo sapiens
agtcagctctctgc

SEQ ID NO: 5220106 - DNA, 16 bp, Homo sapiens
agtcagctgaccccct

SEQ ID NO: 5220107 - DNA, 17 bp, Homo sapiens
agtcagctgaccccctc

SEQ ID NO: 5220108 - DNA, 18 bp, Homo sapiens
agtcagctgaccccctcc

SEQ ID NO: 5220109 - DNA, 21 bp, Homo sapiens
agtcagctgaccccctccccc

SEQ ID NO: 5220110 - DNA, 15 bp, Homo sapiens
agtcagctggccaga

SEQ ID NO: 5220111 - DNA, 18 bp, Homo sapiens
agtcagctttcatctttg

SEQ ID NO: 5220112 - DNA, 19 bp, Homo sapiens
agtcagctttgccttccac

SEQ ID NO: 5220113 - DNA, 22 bp, Homo sapiens
agtcagctttgccttccacgct

SEQ ID NO: 5220114 - DNA, 13 bp, Homo sapiens
agtcagctttttt

SEQ ID NO: 5220115 - DNA, 23 bp, Homo sapiens
agtcaggaaagacaggctgagct

SEQ ID NO: 5220116 - DNA, 12 bp, Homo sapiens
agtcaggaaagg

SEQ ID NO: 5220117 - DNA, 19 bp, Homo sapiens
agtcaggaagcctcctgct

SEQ ID NO: 5220118 - DNA, 20 bp, Homo sapiens
agtcaggaatcattaatttc

SEQ ID NO: 5220119 - DNA, 19 bp, Homo sapiens
agtcaggacagcttgtatg

SEQ ID NO: 5220120 - DNA, 11 bp, Homo sapiens
agtcaggatga

SEQ ID NO: 5220121 - DNA, 16 bp, Homo sapiens
agtcaggcactggctg

SEQ ID NO: 5220122 - DNA, 14 bp, Homo sapiens
agtcaggccaggtg

SEQ ID NO: 5220123 - DNA, 17 bp, Homo sapiens
agtcaggccaggtgggc

SEQ ID NO: 5220124 - DNA, 20 bp, Homo sapiens
agtcaggcctgggcaggacc

SEQ ID NO: 5220125 - DNA, 21 bp, Homo sapiens
agtcaggcctgggcaggaccc

SEQ ID NO: 5220126 - DNA, 22 bp, Homo sapiens
agtcaggccttaattttcagta

SEQ ID NO: 5220127 - DNA, 20 bp, Homo sapiens
agtcaggctagctgtgctgg

SEQ ID NO: 5220128 - DNA, 16 bp, Homo sapiens
agtcaggctgcagagg

SEQ ID NO: 5220129 - DNA, 12 bp, Homo sapiens
agtcaggcttct

SEQ ID NO: 5220130 - DNA, 21 bp, Homo sapiens
agtcagggacctgctgctcag

SEQ ID NO: 5220131 - DNA, 15 bp, Homo sapiens
agtcagggagccctg

SEQ ID NO: 5220132 - DNA, 16 bp, Homo sapiens
agtcagggagccctgg

SEQ ID NO: 5220133 - DNA, 17 bp, Homo sapiens
agtcagggagccctggg

SEQ ID NO: 5220134 - DNA, 21 bp, Homo sapiens
agtcagggcacagctgccctg

SEQ ID NO: 5220135 - DNA, 18 bp, Homo sapiens
agtcagggcggggctggc

SEQ ID NO: 5220136 - DNA, 21 bp, Homo sapiens
agtcagggcggggctggccag

SEQ ID NO: 5220137 - DNA, 22 bp, Homo sapiens
agtcagggcggggctggccagc

SEQ ID NO: 5220138 - DNA, 23 bp, Homo sapiens
aggggcgctgcccccacagatcc

SEQ ID NO: 5220139 - DNA, 14 bp, Homo sapiens
aggggcgctggccc

SEQ ID NO: 5220140 - DNA, 15 bp, Homo sapiens
aggggcgctggccca

SEQ ID NO: 5220141 - DNA, 17 bp, Homo sapiens
aggggcggcaggaggga

SEQ ID NO: 5220142 - DNA, 20 bp, Homo sapiens
aggggcggcaggagggaggt

SEQ ID NO: 5220143 - DNA, 21 bp, Homo sapiens
aggggcgggaatattgtttct

SEQ ID NO: 5220144 - DNA, 16 bp, Homo sapiens
aggggcgggctcagag

SEQ ID NO: 5220145 - DNA, 23 bp, Homo sapiens
aggggcgggctcagagctttgtc

SEQ ID NO: 5220146 - DNA, 13 bp, Homo sapiens
aggggcggggcca

SEQ ID NO: 5220147 - DNA, 22 bp, Homo sapiens
aggggcggggttagagccaagc

SEQ ID NO: 5220148 - DNA, 22 bp, Homo sapiens
aggggcgggtggatcacctgag

SEQ ID NO: 5220149 - DNA, 18 bp, Homo sapiens
aggggcggtgcccacacc

SEQ ID NO: 5220150 - DNA, 22 bp, Homo sapiens
aggggcgtggagggcgtggagg

SEQ ID NO: 5220151 - DNA, 17 bp, Homo sapiens
aggggcgtgtggctcac

SEQ ID NO: 5220152 - DNA, 20 bp, Homo sapiens
aggggcgtgtgttccccagc

SEQ ID NO: 5220153 - DNA, 21 bp, Homo sapiens
aggggcgttctcccaaagatt

SEQ ID NO: 5220154 - DNA, 22 bp, Homo sapiens
aggggctaaaggggagaaactg

SEQ ID NO: 5220155 - DNA, 15 bp, Homo sapiens
aggggctaccaggaa

SEQ ID NO: 5220156 - DNA, 20 bp, Homo sapiens
aggggctagaacctagagaa

SEQ ID NO: 5220157 - DNA, 18 bp, Homo sapiens
aggggctagctaagccaa

SEQ ID NO: 5220158 - DNA, 18 bp, Homo sapiens
aggggctagggaggacca

SEQ ID NO: 5220159 - DNA, 14 bp, Homo sapiens
aggggctagggctg

SEQ ID NO: 5220160 - DNA, 17 bp, Homo sapiens
aggggctattgggccct

SEQ ID NO: 5220161 - DNA, 16 bp, Homo sapiens
aggggctcagcaaggt

SEQ ID NO: 5220162 - DNA, 19 bp, Homo sapiens
aggggctcagggcctcagg

SEQ ID NO: 5220163 - DNA, 14 bp, Homo sapiens
aggggctccacctg

SEQ ID NO: 5220164 - DNA, 21 bp, Homo sapiens
aggggctccatgctgggtctg

SEQ ID NO: 5220165 - DNA, 23 bp, Homo sapiens
aggggctccctacattccccaga

SEQ ID NO: 5220166 - DNA, 21 bp, Homo sapiens
aggggctccgggtcactgctg

SEQ ID NO: 5220167 - DNA, 14 bp, Homo sapiens
aggggctcctgggt

SEQ ID NO: 5220168 - DNA, 15 bp, Homo sapiens
aggggctcctgggtt

SEQ ID NO: 5220169 - DNA, 22 bp, Homo sapiens
aggggctctcagctcagcgcca

SEQ ID NO: 5220170 - DNA, 15 bp, Homo sapiens
aggggctctggagag

SEQ ID NO: 5220171 - DNA, 12 bp, Homo sapiens
aggggctctgtg

SEQ ID NO: 5220172 - DNA, 13 bp, Homo sapiens
aggggctctgtgg

SEQ ID NO: 5220173 - DNA, 20 bp, Homo sapiens
aggggctgaaagaacatgga

SEQ ID NO: 5220174 - DNA, 13 bp, Homo sapiens
aggggctgacact

SEQ ID NO: 5220175 - DNA, 20 bp, Homo sapiens
aggggctgaggacgagaccc

SEQ ID NO: 5220176 - DNA, 18 bp, Homo sapiens
aggggctgagtctggcta

SEQ ID NO: 5220177 - DNA, 14 bp, Homo sapiens
aggggctgagtgag

SEQ ID NO: 5220178 - DNA, 17 bp, Homo sapiens
aggggctgcagccccct

SEQ ID NO: 5220179 - DNA, 21 bp, Homo sapiens
aggggctgcagccccctgctt

SEQ ID NO: 5220180 - DNA, 16 bp, Homo sapiens
aggggctgcatcctca

SEQ ID NO: 5220181 - DNA, 13 bp, Homo sapiens
aggggctgcccgc

SEQ ID NO: 5220182 - DNA, 15 bp, Homo sapiens
aggggctgcccgctc

SEQ ID NO: 5220183 - DNA, 17 bp, Homo sapiens
aggggctgcccgctccc

SEQ ID NO: 5220184 - DNA, 18 bp, Homo sapiens
aggggctgctggggcatg

SEQ ID NO: 5220185 - DNA, 16 bp, Homo sapiens
aggggctgcttcctcc

SEQ ID NO: 5220186 - DNA, 15 bp, Homo sapiens
aggggctggacctgg

SEQ ID NO: 5220187 - DNA, 14 bp, Homo sapiens
aggggctggagggc

SEQ ID NO: 5220188 - DNA, 16 bp, Homo sapiens
aggggctggagggctg

SEQ ID NO: 5220189 - DNA, 19 bp, Homo sapiens
aggggctggcttcaggagg

SEQ ID NO: 5220190 - DNA, 13 bp, Homo sapiens
aggggctgggaac

SEQ ID NO: 5220191 - DNA, 14 bp, Homo sapiens
aggggctgggaaca

SEQ ID NO: 5220192 - DNA, 14 bp, Homo sapiens
aggggctggggact

SEQ ID NO: 5220193 - DNA, 17 bp, Homo sapiens
aggggctggggacttcg

SEQ ID NO: 5220194 - DNA, 18 bp, Homo sapiens
aggggctggggacttgtg

SEQ ID NO: 5220195 - DNA, 22 bp, Homo sapiens
aggggctggggagggggtacct

SEQ ID NO: 5220196 - DNA, 13 bp, Homo sapiens
aggggctggggca

SEQ ID NO: 5220197 - DNA, 14 bp, Homo sapiens
aggggctggtggag

SEQ ID NO: 5220198 - DNA, 15 bp, Homo sapiens
aggggctggtggaga

SEQ ID NO: 5220199 - DNA, 20 bp, Homo sapiens
aggggctgtccaatcacatt

SEQ ID NO: 5220200 - DNA, 15 bp, Homo sapiens
aggggctgtcctcct

SEQ ID NO: 5220201 - DNA, 21 bp, Homo sapiens
aggggctgtcctccttcctgg

SEQ ID NO: 5220202 - DNA, 19 bp, Homo sapiens
aggggctgtggccgtctcc

SEQ ID NO: 5220203 - DNA, 21 bp, Homo sapiens
aggggcttaattattgatgtt

SEQ ID NO: 5220204 - DNA, 12 bp, Homo sapiens
aggggcttcagg

SEQ ID NO: 5220205 - DNA, 23 bp, Homo sapiens
aggggcttgactttttcaacttc

SEQ ID NO: 5220206 - DNA, 15 bp, Homo sapiens
aggggcttggagcag

SEQ ID NO: 5220207 - DNA, 16 bp, Homo sapiens
aggggcttggagcaga

SEQ ID NO: 5220208 - DNA, 19 bp, Homo sapiens
aggggcttggagcagagac

SEQ ID NO: 5220209 - DNA, 17 bp, Homo sapiens
aggggcttggctgcccc

SEQ ID NO: 5220210 - DNA, 12 bp, Homo sapiens
aggggcttggga

SEQ ID NO: 5220211 - DNA, 20 bp, Homo sapiens
aggggcttgggcctgcaccc

SEQ ID NO: 5220212 - DNA, 15 bp, Homo sapiens
aggggctttctcttc

SEQ ID NO: 5220213 - DNA, 19 bp, Homo sapiens
aggggctttctcttcccct

SEQ ID NO: 5220214 - DNA, 22 bp, Homo sapiens
aggggctttctcttccccttcc

SEQ ID NO: 5220215 - DNA, 23 bp, Homo sapiens
aggggctttctcttccccttcct

SEQ ID NO: 5220216 - DNA, 16 bp, Homo sapiens
aggggctttgggccca

SEQ ID NO: 5220217 - DNA, 17 bp, Homo sapiens
agggggaacgcaagagg

SEQ ID NO: 5220218 - DNA, 15 bp, Homo sapiens
agggggaagaagcag

SEQ ID NO: 5220219 - DNA, 22 bp, Homo sapiens
agggggaagatggttcaaagat

SEQ ID NO: 5220220 - DNA, 23 bp, Homo sapiens
agggggaagcaaaggggggaggt

SEQ ID NO: 5220221 - DNA, 22 bp, Homo sapiens
agggggaagcaccagcctcagt

SEQ ID NO: 5220222 - DNA, 15 bp, Homo sapiens
agggggaaggcaggg

SEQ ID NO: 5220223 - DNA, 14 bp, Homo sapiens
agggggaagtgaga

SEQ ID NO: 5220224 - DNA, 17 bp, Homo sapiens
agggggaagtgagaagg

SEQ ID NO: 5220225 - DNA, 23 bp, Homo sapiens
agggggaagtgagaagggctcag

SEQ ID NO: 5220226 - DNA, 16 bp, Homo sapiens
agggggaattcctgga

SEQ ID NO: 5220227 - DNA, 20 bp, Homo sapiens
agggggacaaccccccaaga

SEQ ID NO: 5220228 - DNA, 14 bp, Homo sapiens
agggggacagtgat

SEQ ID NO: 5220229 - DNA, 18 bp, Homo sapiens
agggggaccatggggagg

SEQ ID NO: 5220230 - DNA, 22 bp, Homo sapiens
agggggacctgccaccagggag

SEQ ID NO: 5220231 - DNA, 21 bp, Homo sapiens
agggggacgcgcacacacacc

SEQ ID NO: 5220232 - DNA, 20 bp, Homo sapiens
agggggacggggctgacatc

SEQ ID NO: 5220233 - DNA, 20 bp, Homo sapiens
agggggactgctgctgcctg

SEQ ID NO: 5220234 - DNA, 22 bp, Homo sapiens
agggggactgctgctgcctggc

SEQ ID NO: 5220235 - DNA, 12 bp, Homo sapiens
agggggagaaaa

SEQ ID NO: 5220236 - DNA, 21 bp, Homo sapiens
agggggagaaaaggaaaagaa

SEQ ID NO: 5220237 - DNA, 21 bp, Homo sapiens
agggggagccccttctgctca

SEQ ID NO: 5220238 - DNA, 22 bp, Homo sapiens
agggggagccccttctgctcag

SEQ ID NO: 5220239 - DNA, 21 bp, Homo sapiens
agggggaggaagttggctgag

SEQ ID NO: 5220240 - DNA, 15 bp, Homo sapiens
agggggaggggaagc

SEQ ID NO: 5220241 - DNA, 15 bp, Homo sapiens
agggggaggggaagt

SEQ ID NO: 5220242 - DNA, 22 bp, Homo sapiens
agggggagggggttacaaactg

SEQ ID NO: 5220243 - DNA, 22 bp, Homo sapiens
agggggaggttggttccttggg

SEQ ID NO: 5220244 - DNA, 23 bp, Homo sapiens
agggggagtccctcgtctcttgt

SEQ ID NO: 5220245 - DNA, 23 bp, Homo sapiens
agggggagtgaaacagagaaaga

SEQ ID NO: 5220246 - DNA, 14 bp, Homo sapiens
agggggataaggtc

SEQ ID NO: 5220247 - DNA, 17 bp, Homo sapiens
agggggatatgaatgga

SEQ ID NO: 5220248 - DNA, 19 bp, Homo sapiens
agggggatccgactgcttt

SEQ ID NO: 5220249 - DNA, 22 bp, Homo sapiens
agggggattctgagcagtgcct

SEQ ID NO: 5220250 - DNA, 16 bp, Homo sapiens
agggggcaaggagaaa

SEQ ID NO: 5220251 - DNA, 21 bp, Homo sapiens
agggggcacggcaggcgtgtg

SEQ ID NO: 5220252 - DNA, 12 bp, Homo sapiens
agggggcagagt

SEQ ID NO: 5220253 - DNA, 15 bp, Homo sapiens
agggggcaggggcag

SEQ ID NO: 5220254 - DNA, 12 bp, Homo sapiens
agggggccagag

SEQ ID NO: 5220255 - DNA, 17 bp, Homo sapiens
agggggccagagggact

SEQ ID NO: 5220256 - DNA, 12 bp, Homo sapiens
agggggccagct

SEQ ID NO: 5220257 - DNA, 14 bp, Homo sapiens
agggggccagctgg

SEQ ID NO: 5220258 - DNA, 15 bp, Homo sapiens
agggggccagctggg

SEQ ID NO: 5220259 - DNA, 19 bp, Homo sapiens
agggggccagctggggaga

SEQ ID NO: 5220260 - DNA, 15 bp, Homo sapiens
agggggccaggtgca

SEQ ID NO: 5220261 - DNA, 20 bp, Homo sapiens
agggggcccgaacagggact

SEQ ID NO: 5220262 - DNA, 16 bp, Homo sapiens
agggggccctgcccca

SEQ ID NO: 5220263 - DNA, 20 bp, Homo sapiens
agggggccctgccccacccc

SEQ ID NO: 5220264 - DNA, 21 bp, Homo sapiens
agggggccctgccccacccca

SEQ ID NO: 5220265 - DNA, 14 bp, Homo sapiens
agggggccctgcct

SEQ ID NO: 5220266 - DNA, 18 bp, Homo sapiens
agggggccctggcttgga

SEQ ID NO: 5220267 - DNA, 21 bp, Homo sapiens
agggggcccttccagattggg

SEQ ID NO: 5220268 - DNA, 20 bp, Homo sapiens
agggggccggggggagggga

SEQ ID NO: 5220269 - DNA, 13 bp, Homo sapiens
agggggcctcatt

SEQ ID NO: 5220270 - DNA, 17 bp, Homo sapiens
agggggcctgagttgag

SEQ ID NO: 5220271 - DNA, 12 bp, Homo sapiens
agggggcctgga

SEQ ID NO: 5220272 - DNA, 17 bp, Homo sapiens
agggggcctggatgccc

SEQ ID NO: 5220273 - DNA, 20 bp, Homo sapiens
agggggcctttaaagactta

SEQ ID NO: 5220274 - DNA, 20 bp, Homo sapiens
agggggcgcctgtggttctg

SEQ ID NO: 5220275 - DNA, 15 bp, Homo sapiens
agggggcgctcagga

SEQ ID NO: 5220276 - DNA, 19 bp, Homo sapiens
agggggcgctcaggaccca

SEQ ID NO: 5220277 - DNA, 20 bp, Homo sapiens
agggggcggggactgctggc

SEQ ID NO: 5220278 - DNA, 12 bp, Homo sapiens
agggggctccat

SEQ ID NO: 5220279 - DNA, 14 bp, Homo sapiens
agggggctccatgg

SEQ ID NO: 5220280 - DNA, 16 bp, Homo sapiens
agggggctccatggag

SEQ ID NO: 5220281 - DNA, 18 bp, Homo sapiens
agggggctccatggagga

SEQ ID NO: 5220282 - DNA, 20 bp, Homo sapiens
agggggctccatggaggagg

SEQ ID NO: 5220283 - DNA, 16 bp, Homo sapiens
agggggctctgcccca

SEQ ID NO: 5220284 - DNA, 18 bp, Homo sapiens
agggggctctgccccagg

SEQ ID NO: 5220285 - DNA, 20 bp, Homo sapiens
agggggctctgccccaggcc

SEQ ID NO: 5220286 - DNA, 18 bp, Homo sapiens
agggggctgaaacttgaa

SEQ ID NO: 5220287 - DNA, 14 bp, Homo sapiens
agggggctgctgct

SEQ ID NO: 5220288 - DNA, 16 bp, Homo sapiens
agggggctgctgctcc

SEQ ID NO: 5220289 - DNA, 12 bp, Homo sapiens
agggggctggag

SEQ ID NO: 5220290 - DNA, 14 bp, Homo sapiens
agggggctggagga

SEQ ID NO: 5220291 - DNA, 16 bp, Homo sapiens
agggggctggccatgg

SEQ ID NO: 5220292 - DNA, 21 bp, Homo sapiens
agggggctggccatggggccc

SEQ ID NO: 5220293 - DNA, 13 bp, Homo sapiens
agggggctgggac

SEQ ID NO: 5220294 - DNA, 21 bp, Homo sapiens
agggggctgggctcacaggcc

SEQ ID NO: 5220295 - DNA, 22 bp, Homo sapiens
agggggctgggctcacaggcct

SEQ ID NO: 5220296 - DNA, 17 bp, Homo sapiens
agggggctggtgggtgc

SEQ ID NO: 5220297 - DNA, 12 bp, Homo sapiens
agggggcttcct

SEQ ID NO: 5220298 - DNA, 23 bp, Homo sapiens
agggggcttggctcgcaccccca

SEQ ID NO: 5220299 - DNA, 15 bp, Homo sapiens
agggggctttcacta

SEQ ID NO: 5220300 - DNA, 18 bp, Homo sapiens
aggggggagccagaggcc

SEQ ID NO: 5220301 - DNA, 13 bp, Homo sapiens
aggggggagggaa

SEQ ID NO: 5220302 - DNA, 15 bp, Homo sapiens
aggggggcggtgagg

SEQ ID NO: 5220303 - DNA, 13 bp, Homo sapiens
aggggggctgtgc

SEQ ID NO: 5220304 - DNA, 16 bp, Homo sapiens
aggggggctgtgccaa

SEQ ID NO: 5220305 - DNA, 19 bp, Homo sapiens
agggggggaaatgcattta

SEQ ID NO: 5220306 - DNA, 23 bp, Homo sapiens
aggggggggtatttcaattacct

SEQ ID NO: 5220307 - DNA, 15 bp, Homo sapiens
aggggggtgggaggg

SEQ ID NO: 5220308 - DNA, 21 bp, Homo sapiens
aggggggttgtgaggcctggc

SEQ ID NO: 5220309 - DNA, 18 bp, Homo sapiens
aggggggtttcagggctg

SEQ ID NO: 5220310 - DNA, 17 bp, Homo sapiens
agggggtaaagcagttc

SEQ ID NO: 5220311 - DNA, 23 bp, Homo sapiens
agggggtaatggaggccaagcct

SEQ ID NO: 5220312 - DNA, 12 bp, Homo sapiens
agggggtaggag

SEQ ID NO: 5220313 - DNA, 16 bp, Homo sapiens
agggggtaggagagca

SEQ ID NO: 5220314 - DNA, 19 bp, Homo sapiens
agggggtcagttgggcccc

SEQ ID NO: 5220315 - DNA, 21 bp, Homo sapiens
agggggtccgtggtagaggcc

SEQ ID NO: 5220316 - DNA, 16 bp, Homo sapiens
agtcagggctgtgctt

SEQ ID NO: 5220317 - DNA, 15 bp, Homo sapiens
agtcaggggctctgt

SEQ ID NO: 5220318 - DNA, 14 bp, Homo sapiens
agtcaggggctggg

SEQ ID NO: 5220319 - DNA, 21 bp, Homo sapiens
agtcaggggtcaggtgtcagg

SEQ ID NO: 5220320 - DNA, 19 bp, Homo sapiens
agtcaggggttcccttttt

SEQ ID NO: 5220321 - DNA, 17 bp, Homo sapiens
agtcagggtgaattgtg

SEQ ID NO: 5220322 - DNA, 21 bp, Homo sapiens
agtcagggtgggaagaaagaa

SEQ ID NO: 5220323 - DNA, 18 bp, Homo sapiens
agtcagggtttgtcagag

SEQ ID NO: 5220324 - DNA, 22 bp, Homo sapiens
agtcagggtttgtcagaggaac

SEQ ID NO: 5220325 - DNA, 18 bp, Homo sapiens
agtcaggtgcagtcccag

SEQ ID NO: 5220326 - DNA, 19 bp, Homo sapiens
agtcaggtgggcggtgtgt

SEQ ID NO: 5220327 - DNA, 18 bp, Homo sapiens
agtcagtacccaccacct

SEQ ID NO: 5220328 - DNA, 14 bp, Homo sapiens
agtcagtagccaga

SEQ ID NO: 5220329 - DNA, 16 bp, Homo sapiens
agtcagtagccagagt

SEQ ID NO: 5220330 - DNA, 18 bp, Homo sapiens
agtcagtagccagagttg

SEQ ID NO: 5220331 - DNA, 19 bp, Homo sapiens
agtcagtaggactccttat

SEQ ID NO: 5220332 - DNA, 14 bp, Homo sapiens
agtcagtaggagag

SEQ ID NO: 5220333 - DNA, 12 bp, Homo sapiens
agtcagtattcc

SEQ ID NO: 5220334 - DNA, 14 bp, Homo sapiens
agtcagtattgttt

SEQ ID NO: 5220335 - DNA, 21 bp, Homo sapiens
agtcagtcacaaaccagcctg

SEQ ID NO: 5220336 - DNA, 22 bp, Homo sapiens
agtcagtcacaaaccagcctgg

SEQ ID NO: 5220337 - DNA, 21 bp, Homo sapiens
agtcagtccagctcatctgcc

SEQ ID NO: 5220338 - DNA, 14 bp, Homo sapiens
agtcagtctctttc

SEQ ID NO: 5220339 - DNA, 16 bp, Homo sapiens
agtcagtgcaaatgtc

SEQ ID NO: 5220340 - DNA, 21 bp, Homo sapiens
agtcagtgcactaaccccagc

SEQ ID NO: 5220341 - DNA, 15 bp, Homo sapiens
agtcagtgcatttca

SEQ ID NO: 5220342 - DNA, 22 bp, Homo sapiens
agtcagtgcatttcaaggaaca

SEQ ID NO: 5220343 - DNA, 21 bp, Homo sapiens
agtcagtgcccatgtgtatgg

SEQ ID NO: 5220344 - DNA, 22 bp, Homo sapiens
agtcagtgcccatgtgtatgga

SEQ ID NO: 5220345 - DNA, 22 bp, Homo sapiens
agtcagtgctctcagctggcag

SEQ ID NO: 5220346 - DNA, 13 bp, Homo sapiens
agtcagtgctgga

SEQ ID NO: 5220347 - DNA, 17 bp, Homo sapiens
agtcagtgctggagaaa

SEQ ID NO: 5220348 - DNA, 15 bp, Homo sapiens
agtcagtgttgagat

SEQ ID NO: 5220349 - DNA, 18 bp, Homo sapiens
agtcagtgtttcttttaa

SEQ ID NO: 5220350 - DNA, 17 bp, Homo sapiens
agtcagttcccggagca

SEQ ID NO: 5220351 - DNA, 19 bp, Homo sapiens
agtcagttcccggagcaca

SEQ ID NO: 5220352 - DNA, 20 bp, Homo sapiens
agtcagttcccggagcacag

SEQ ID NO: 5220353 - DNA, 22 bp, Homo sapiens
agtcagttcccggagcacagcc

SEQ ID NO: 5220354 - DNA, 23 bp, Homo sapiens
agtcagttcccggagcacagccc

SEQ ID NO: 5220355 - DNA, 16 bp, Homo sapiens
agtcagttgaaattct

SEQ ID NO: 5220356 - DNA, 17 bp, Homo sapiens
agtcataaacagcattt

SEQ ID NO: 5220357 - DNA, 14 bp, Homo sapiens
agtcataaacctta

SEQ ID NO: 5220358 - DNA, 15 bp, Homo sapiens
agtcataaaccttaa

SEQ ID NO: 5220359 - DNA, 21 bp, Homo sapiens
agtcataacggttaagaaagc

SEQ ID NO: 5220360 - DNA, 13 bp, Homo sapiens
agtcataattgca

SEQ ID NO: 5220361 - DNA, 17 bp, Homo sapiens
agtcataattgcattga

SEQ ID NO: 5220362 - DNA, 23 bp, Homo sapiens
agtcataccaatgaaaaaatgta

SEQ ID NO: 5220363 - DNA, 22 bp, Homo sapiens
agtcatagaaatacctcattcg

SEQ ID NO: 5220364 - DNA, 14 bp, Homo sapiens
agtcatagaagaac

SEQ ID NO: 5220365 - DNA, 18 bp, Homo sapiens
agtcatataaaagctatg

SEQ ID NO: 5220366 - DNA, 20 bp, Homo sapiens
agtcatattttgattattgt

SEQ ID NO: 5220367 - DNA, 21 bp, Homo sapiens
agtcatattttgattattgta

SEQ ID NO: 5220368 - DNA, 19 bp, Homo sapiens
agtcatcaaaaagagtctt

SEQ ID NO: 5220369 - DNA, 15 bp, Homo sapiens
agtcatcaatgcaat

SEQ ID NO: 5220370 - DNA, 15 bp, Homo sapiens
agtcatcatcagggc

SEQ ID NO: 5220371 - DNA, 19 bp, Homo sapiens
agtcatcatcagggcctgg

SEQ ID NO: 5220372 - DNA, 22 bp, Homo sapiens
agtcatcatcagggcctggggc

SEQ ID NO: 5220373 - DNA, 13 bp, Homo sapiens
agtcatcatctca

SEQ ID NO: 5220374 - DNA, 20 bp, Homo sapiens
agtcatcatctcttgataaa

SEQ ID NO: 5220375 - DNA, 23 bp, Homo sapiens
agtcatcatgggggatttttcat

SEQ ID NO: 5220376 - DNA, 13 bp, Homo sapiens
agtcatcattact

SEQ ID NO: 5220377 - DNA, 13 bp, Homo sapiens
agtcatcatttat

SEQ ID NO: 5220378 - DNA, 13 bp, Homo sapiens
agtcatccaatct

SEQ ID NO: 5220379 - DNA, 16 bp, Homo sapiens
agtcatccacagccca

SEQ ID NO: 5220380 - DNA, 21 bp, Homo sapiens
agtcatcccctctcaggagag

SEQ ID NO: 5220381 - DNA, 14 bp, Homo sapiens
agtcatcctcctgg

SEQ ID NO: 5220382 - DNA, 18 bp, Homo sapiens
agtcatcctgccctgcag

SEQ ID NO: 5220383 - DNA, 16 bp, Homo sapiens
agtcatcgactcagtt

SEQ ID NO: 5220384 - DNA, 19 bp, Homo sapiens
agtcatctccatcagctgt

SEQ ID NO: 5220385 - DNA, 11 bp, Homo sapiens
agtcatctccc

SEQ ID NO: 5220386 - DNA, 15 bp, Homo sapiens
agtcatctcccctcc

SEQ ID NO: 5220387 - DNA, 19 bp, Homo sapiens
agtcatctcccctcctggc

SEQ ID NO: 5220388 - DNA, 19 bp, Homo sapiens
agtcatctcctaatttgtt

SEQ ID NO: 5220389 - DNA, 15 bp, Homo sapiens
agtcatctgatgaga

SEQ ID NO: 5220390 - DNA, 15 bp, Homo sapiens
agtcatctgtaagag

SEQ ID NO: 5220391 - DNA, 19 bp, Homo sapiens
agtcatctgttagggcctt

SEQ ID NO: 5220392 - DNA, 14 bp, Homo sapiens
agtcatctgtttaa

SEQ ID NO: 5220393 - DNA, 20 bp, Homo sapiens
agtcatcttctctactgtgt

SEQ ID NO: 5220394 - DNA, 20 bp, Homo sapiens
agtcatcttgcacacacttt

SEQ ID NO: 5220395 - DNA, 23 bp, Homo sapiens
agtcatcttgcacacactttcat

SEQ ID NO: 5220396 - DNA, 13 bp, Homo sapiens
agtcatcttgcta

SEQ ID NO: 5220397 - DNA, 23 bp, Homo sapiens
agtcatcttgctaccagtattta

SEQ ID NO: 5220398 - DNA, 14 bp, Homo sapiens
agtcatctttgaga

SEQ ID NO: 5220399 - DNA, 14 bp, Homo sapiens
agtcatgaagccca

SEQ ID NO: 5220400 - DNA, 13 bp, Homo sapiens
agtcatgaagctc

SEQ ID NO: 5220401 - DNA, 13 bp, Homo sapiens
agtcatgacagat

SEQ ID NO: 5220402 - DNA, 15 bp, Homo sapiens
agtcatgacagatga

SEQ ID NO: 5220403 - DNA, 18 bp, Homo sapiens
agtcatgacatttctcaa

SEQ ID NO: 5220404 - DNA, 19 bp, Homo sapiens
agtcatgacatttctcaaa

SEQ ID NO: 5220405 - DNA, 15 bp, Homo sapiens
agtcatgatctccct

SEQ ID NO: 5220406 - DNA, 17 bp, Homo sapiens
agtcatgatctccctgc

SEQ ID NO: 5220407 - DNA, 19 bp, Homo sapiens
agtcatgatctccctgccg

SEQ ID NO: 5220408 - DNA, 23 bp, Homo sapiens
agtcatgatctccctgccgcctc

SEQ ID NO: 5220409 - DNA, 13 bp, Homo sapiens
agtcatgatgttt

SEQ ID NO: 5220410 - DNA, 17 bp, Homo sapiens
agtcatgatgtttttaa

SEQ ID NO: 5220411 - DNA, 17 bp, Homo sapiens
agtcatgcaaaggctgg

SEQ ID NO: 5220412 - DNA, 19 bp, Homo sapiens
agtcatgcaaaggctggga

SEQ ID NO: 5220413 - DNA, 20 bp, Homo sapiens
agtcatgcaaaggctgggac

SEQ ID NO: 5220414 - DNA, 14 bp, Homo sapiens
agtcatgcataaat

SEQ ID NO: 5220415 - DNA, 16 bp, Homo sapiens
agtcatggaatcttgc

SEQ ID NO: 5220416 - DNA, 22 bp, Homo sapiens
agtcatggcattcgcagtgccc

SEQ ID NO: 5220417 - DNA, 21 bp, Homo sapiens
agtcatggctaatttaacacc

SEQ ID NO: 5220418 - DNA, 12 bp, Homo sapiens
agtcatggctgt

SEQ ID NO: 5220419 - DNA, 17 bp, Homo sapiens
agtcatggctgtcccct

SEQ ID NO: 5220420 - DNA, 18 bp, Homo sapiens
agtcatggctgtcccctg

SEQ ID NO: 5220421 - DNA, 22 bp, Homo sapiens
agtcatggctgtcccctgcaag

SEQ ID NO: 5220422 - DNA, 16 bp, Homo sapiens
agtcatgggagaagag

SEQ ID NO: 5220423 - DNA, 17 bp, Homo sapiens
agtcatgggagaagagg

SEQ ID NO: 5220424 - DNA, 15 bp, Homo sapiens
agtcatgggagagta

SEQ ID NO: 5220425 - DNA, 12 bp, Homo sapiens
agtcatggtcct

SEQ ID NO: 5220426 - DNA, 15 bp, Homo sapiens
agtcatgtaaatact

SEQ ID NO: 5220427 - DNA, 22 bp, Homo sapiens
agtcatgtagccccagtcagaa

SEQ ID NO: 5220428 - DNA, 16 bp, Homo sapiens
agtcatgtcagaagga

SEQ ID NO: 5220429 - DNA, 14 bp, Homo sapiens
agtcattaaactgg

SEQ ID NO: 5220430 - DNA, 23 bp, Homo sapiens
agtcattaaagacaggagacaaa

SEQ ID NO: 5220431 - DNA, 16 bp, Homo sapiens
agtcattaaattacta

SEQ ID NO: 5220432 - DNA, 15 bp, Homo sapiens
agtcattagaatgtc

SEQ ID NO: 5220433 - DNA, 20 bp, Homo sapiens
agtcattagactcctcctcc

SEQ ID NO: 5220434 - DNA, 21 bp, Homo sapiens
agtcattatagatcccccaga

SEQ ID NO: 5220435 - DNA, 23 bp, Homo sapiens
agtcattatagatcccccagact

SEQ ID NO: 5220436 - DNA, 20 bp, Homo sapiens
agtcattatccttgctatga

SEQ ID NO: 5220437 - DNA, 20 bp, Homo sapiens
agtcattatgtagctgtcgt

SEQ ID NO: 5220438 - DNA, 17 bp, Homo sapiens
agtcattccaagaacta

SEQ ID NO: 5220439 - DNA, 18 bp, Homo sapiens
agtcattccacacatttc

SEQ ID NO: 5220440 - DNA, 12 bp, Homo sapiens
agtcattcctaa

SEQ ID NO: 5220441 - DNA, 12 bp, Homo sapiens
agtcattccttc

SEQ ID NO: 5220442 - DNA, 22 bp, Homo sapiens
agtcattcgcgtggctcgggac

SEQ ID NO: 5220443 - DNA, 17 bp, Homo sapiens
agtcattcgttctgtgg

SEQ ID NO: 5220444 - DNA, 22 bp, Homo sapiens
agtcattctagaccctatacat

SEQ ID NO: 5220445 - DNA, 18 bp, Homo sapiens
agtcattctaggatgtgg

SEQ ID NO: 5220446 - DNA, 15 bp, Homo sapiens
agtcattgacttcat

SEQ ID NO: 5220447 - DNA, 16 bp, Homo sapiens
agtcattgacttcatt

SEQ ID NO: 5220448 - DNA, 18 bp, Homo sapiens
agtcattgacttcatttt

SEQ ID NO: 5220449 - DNA, 17 bp, Homo sapiens
agtcattgccatgggag

SEQ ID NO: 5220450 - DNA, 20 bp, Homo sapiens
agtcattgctgacagagccc

SEQ ID NO: 5220451 - DNA, 22 bp, Homo sapiens
agtcattgctgacagagcccta

SEQ ID NO: 5220452 - DNA, 15 bp, Homo sapiens
agtcattggcaaagt

SEQ ID NO: 5220453 - DNA, 20 bp, Homo sapiens
agtcattggctttatcctct

SEQ ID NO: 5220454 - DNA, 22 bp, Homo sapiens
agtcattggctttatcctcttt

SEQ ID NO: 5220455 - DNA, 19 bp, Homo sapiens
agtcattgggttttatcag

SEQ ID NO: 5220456 - DNA, 20 bp, Homo sapiens
agtcattgggttttatcagt

SEQ ID NO: 5220457 - DNA, 17 bp, Homo sapiens
agtcattgtaacctcgt

SEQ ID NO: 5220458 - DNA, 12 bp, Homo sapiens
agtcattgtaat

SEQ ID NO: 5220459 - DNA, 20 bp, Homo sapiens
agtcattgtaatgttgtgaa

SEQ ID NO: 5220460 - DNA, 22 bp, Homo sapiens
agtcatttaactgaagatgttg

SEQ ID NO: 5220461 - DNA, 14 bp, Homo sapiens
agtcatttaagaat

SEQ ID NO: 5220462 - DNA, 15 bp, Homo sapiens
agtcatttactaaac

SEQ ID NO: 5220463 - DNA, 23 bp, Homo sapiens
agtcatttactaaacatatgatt

SEQ ID NO: 5220464 - DNA, 15 bp, Homo sapiens
agtcatttattttaa

SEQ ID NO: 5220465 - DNA, 20 bp, Homo sapiens
agtcatttattttaaaaaat

SEQ ID NO: 5220466 - DNA, 22 bp, Homo sapiens
agtcatttattttaaaaaatga

SEQ ID NO: 5220467 - DNA, 21 bp, Homo sapiens
agtcatttcaaaatatgtgta

SEQ ID NO: 5220468 - DNA, 13 bp, Homo sapiens
agtcatttctgat

SEQ ID NO: 5220469 - DNA, 14 bp, Homo sapiens
agtcatttctgatt

SEQ ID NO: 5220470 - DNA, 16 bp, Homo sapiens
agtcatttgagtctct

SEQ ID NO: 5220471 - DNA, 22 bp, Homo sapiens
agtcatttgcgcacaacttaaa

SEQ ID NO: 5220472 - DNA, 19 bp, Homo sapiens
agtcatttgctgagcatgt

SEQ ID NO: 5220473 - DNA, 18 bp, Homo sapiens
agtcattttattttgtaa

SEQ ID NO: 5220474 - DNA, 19 bp, Homo sapiens
agtcattttattttgtaat

SEQ ID NO: 5220475 - DNA, 20 bp, Homo sapiens
agtcattttgtaatatttga

SEQ ID NO: 5220476 - DNA, 23 bp, Homo sapiens
agtcattttgtaatatttgaatt

SEQ ID NO: 5220477 - DNA, 14 bp, Homo sapiens
agtcatttttacaa

SEQ ID NO: 5220478 - DNA, 13 bp, Homo sapiens
agtcatttttgta

SEQ ID NO: 5220479 - DNA, 14 bp, Homo sapiens
agtcatttttgttt

SEQ ID NO: 5220480 - DNA, 18 bp, Homo sapiens
agtcattttttacttgaa

SEQ ID NO: 5220481 - DNA, 13 bp, Homo sapiens
agtccaaaatact

SEQ ID NO: 5220482 - DNA, 16 bp, Homo sapiens
agtccaaaatcattcc

SEQ ID NO: 5220483 - DNA, 11 bp, Homo sapiens
agtccaaagtc

SEQ ID NO: 5220484 - DNA, 15 bp, Homo sapiens
agtccaaatctccaa

SEQ ID NO: 5220485 - DNA, 23 bp, Homo sapiens
agtccaaatgtcctccagaagcc

SEQ ID NO: 5220486 - DNA, 23 bp, Homo sapiens
agtccaaattgtctgtctgctct

SEQ ID NO: 5220487 - DNA, 15 bp, Homo sapiens
agtccaacctgcctg

SEQ ID NO: 5220488 - DNA, 16 bp, Homo sapiens
agtccaacctgcctgt

SEQ ID NO: 5220489 - DNA, 22 bp, Homo sapiens
agtccaacgtggggcagcacag

SEQ ID NO: 5220490 - DNA, 23 bp, Homo sapiens
agtccaactcttccacctctggg

SEQ ID NO: 5220491 - DNA, 14 bp, Homo sapiens
agtccaagaatcca

SEQ ID NO: 5220492 - DNA, 23 bp, Homo sapiens
agtccaagcaacagcctttgaat

SEQ ID NO: 5220493 - DNA, 22 bp, Homo sapiens
agtccaagcagaagggcagatg

SEQ ID NO: 5220494 - DNA, 23 bp, Homo sapiens
agggggtccgtggtagaggcctg

SEQ ID NO: 5220495 - DNA, 15 bp, Homo sapiens
agggggtcgtggaga

SEQ ID NO: 5220496 - DNA, 17 bp, Homo sapiens
agggggtcgtggagagc

SEQ ID NO: 5220497 - DNA, 11 bp, Homo sapiens
agggggtctgg

SEQ ID NO: 5220498 - DNA, 15 bp, Homo sapiens
agggggtctggctgg

SEQ ID NO: 5220499 - DNA, 16 bp, Homo sapiens
agggggtctggctggt

SEQ ID NO: 5220500 - DNA, 13 bp, Homo sapiens
agggggtgactgg

SEQ ID NO: 5220501 - DNA, 17 bp, Homo sapiens
agggggtgagaggcagg

SEQ ID NO: 5220502 - DNA, 19 bp, Homo sapiens
agggggtgcaaagactctg

SEQ ID NO: 5220503 - DNA, 21 bp, Homo sapiens
agggggtgcaaagactctgag

SEQ ID NO: 5220504 - DNA, 18 bp, Homo sapiens
agggggtggcctcccaac

SEQ ID NO: 5220505 - DNA, 19 bp, Homo sapiens
agggggtggttattggact

SEQ ID NO: 5220506 - DNA, 14 bp, Homo sapiens
agggggtgtcagaa

SEQ ID NO: 5220507 - DNA, 15 bp, Homo sapiens
agggggtgtcagaag

SEQ ID NO: 5220508 - DNA, 12 bp, Homo sapiens
agggggttacaa

SEQ ID NO: 5220509 - DNA, 14 bp, Homo sapiens
agggggttacaaac

SEQ ID NO: 5220510 - DNA, 20 bp, Homo sapiens
agggggttacaaactgcaat

SEQ ID NO: 5220511 - DNA, 23 bp, Homo sapiens
agggggttcacggtcaaactgaa

SEQ ID NO: 5220512 - DNA, 22 bp, Homo sapiens
agggggttcgcaccgtgctggg

SEQ ID NO: 5220513 - DNA, 18 bp, Homo sapiens
agggggttgggtttgggg

SEQ ID NO: 5220514 - DNA, 14 bp, Homo sapiens
agggggttgtggca

SEQ ID NO: 5220515 - DNA, 16 bp, Homo sapiens
agggggtttgggggct

SEQ ID NO: 5220516 - DNA, 22 bp, Homo sapiens
agggggtttgggggcttgcaag

SEQ ID NO: 5220517 - DNA, 12 bp, Homo sapiens
aggggtaaatat

SEQ ID NO: 5220518 - DNA, 17 bp, Homo sapiens
aggggtaaatatatgtt

SEQ ID NO: 5220519 - DNA, 15 bp, Homo sapiens
aggggtaattgcatt

SEQ ID NO: 5220520 - DNA, 15 bp, Homo sapiens
aggggtacacagagc

SEQ ID NO: 5220521 - DNA, 16 bp, Homo sapiens
aggggtacacagagct

SEQ ID NO: 5220522 - DNA, 18 bp, Homo sapiens
aggggtagaaaatgtttt

SEQ ID NO: 5220523 - DNA, 16 bp, Homo sapiens
aggggtagggagcctc

SEQ ID NO: 5220524 - DNA, 14 bp, Homo sapiens
aggggtataggaca

SEQ ID NO: 5220525 - DNA, 15 bp, Homo sapiens
aggggtatgtcttta

SEQ ID NO: 5220526 - DNA, 15 bp, Homo sapiens
aggggtcaagttatt

SEQ ID NO: 5220527 - DNA, 16 bp, Homo sapiens
aggggtcaccttgaga

SEQ ID NO: 5220528 - DNA, 13 bp, Homo sapiens
aggggtcagcagg

SEQ ID NO: 5220529 - DNA, 15 bp, Homo sapiens
aggggtcagcagggg

SEQ ID NO: 5220530 - DNA, 15 bp, Homo sapiens
aggggtcagctctgg

SEQ ID NO: 5220531 - DNA, 16 bp, Homo sapiens
aggggtcaggctccat

SEQ ID NO: 5220532 - DNA, 14 bp, Homo sapiens
aggggtcagggacc

SEQ ID NO: 5220533 - DNA, 17 bp, Homo sapiens
aggggtcatccttgccc

SEQ ID NO: 5220534 - DNA, 23 bp, Homo sapiens
aggggtccagcacagccctaccc

SEQ ID NO: 5220535 - DNA, 15 bp, Homo sapiens
aggggtcccagccac

SEQ ID NO: 5220536 - DNA, 19 bp, Homo sapiens
aggggtcccagccaccccg

SEQ ID NO: 5220537 - DNA, 14 bp, Homo sapiens
aggggtccctagca

SEQ ID NO: 5220538 - DNA, 23 bp, Homo sapiens
aggggtccctagcagcccaccct

SEQ ID NO: 5220539 - DNA, 13 bp, Homo sapiens
aggggtcctgcag

SEQ ID NO: 5220540 - DNA, 16 bp, Homo sapiens
aggggtccttggtgtg

SEQ ID NO: 5220541 - DNA, 19 bp, Homo sapiens
aggggtcgacttcgggctg

SEQ ID NO: 5220542 - DNA, 21 bp, Homo sapiens
aggggtcggctgaccatgctc

SEQ ID NO: 5220543 - DNA, 14 bp, Homo sapiens
aggggtctccctga

SEQ ID NO: 5220544 - DNA, 16 bp, Homo sapiens
aggggtctccctgagc

SEQ ID NO: 5220545 - DNA, 15 bp, Homo sapiens
aggggtctccctgga

SEQ ID NO: 5220546 - DNA, 17 bp, Homo sapiens
aggggtctccctggagt

SEQ ID NO: 5220547 - DNA, 18 bp, Homo sapiens
aggggtctccctggctcc

SEQ ID NO: 5220548 - DNA, 15 bp, Homo sapiens
aggggtctccttgga

SEQ ID NO: 5220549 - DNA, 14 bp, Homo sapiens
aggggtctgagcca

SEQ ID NO: 5220550 - DNA, 17 bp, Homo sapiens
aggggtctgctcctgtg

SEQ ID NO: 5220551 - DNA, 20 bp, Homo sapiens
aggggtctgggagtcaggcc

SEQ ID NO: 5220552 - DNA, 21 bp, Homo sapiens
aggggtctgggagtcaggccc

SEQ ID NO: 5220553 - DNA, 21 bp, Homo sapiens
aggggtctgtatatacatttc

SEQ ID NO: 5220554 - DNA, 13 bp, Homo sapiens
aggggtctgtctg

SEQ ID NO: 5220555 - DNA, 14 bp, Homo sapiens
aggggtgacacaga

SEQ ID NO: 5220556 - DNA, 23 bp, Homo sapiens
aggggtgactttgtctctcctgg

SEQ ID NO: 5220557 - DNA, 15 bp, Homo sapiens
aggggtgagacagtg

SEQ ID NO: 5220558 - DNA, 19 bp, Homo sapiens
aggggtgagtcccctactc

SEQ ID NO: 5220559 - DNA, 23 bp, Homo sapiens
aggggtgcacccactcaccaggg

SEQ ID NO: 5220560 - DNA, 14 bp, Homo sapiens
aggggtgcaggtgg

SEQ ID NO: 5220561 - DNA, 11 bp, Homo sapiens
aggggtgcccc

SEQ ID NO: 5220562 - DNA, 23 bp, Homo sapiens
aggggtgccccctcctctcccat

SEQ ID NO: 5220563 - DNA, 15 bp, Homo sapiens
aggggtgccctctgg

SEQ ID NO: 5220564 - DNA, 22 bp, Homo sapiens
aggggtgcgctcacctgcagcc

SEQ ID NO: 5220565 - DNA, 19 bp, Homo sapiens
aggggtgctggggcagagt

SEQ ID NO: 5220566 - DNA, 14 bp, Homo sapiens
aggggtgctgtgga

SEQ ID NO: 5220567 - DNA, 18 bp, Homo sapiens
aggggtggaagggcagga

SEQ ID NO: 5220568 - DNA, 20 bp, Homo sapiens
aggggtggaagggcaggagc

SEQ ID NO: 5220569 - DNA, 13 bp, Homo sapiens
aggggtggaggga

SEQ ID NO: 5220570 - DNA, 22 bp, Homo sapiens
aggggtggccatctcctgccct

SEQ ID NO: 5220571 - DNA, 12 bp, Homo sapiens
aggggtggccca

SEQ ID NO: 5220572 - DNA, 19 bp, Homo sapiens
aggggtggcccagagccat

SEQ ID NO: 5220573 - DNA, 17 bp, Homo sapiens
aggggtggccgggcaca

SEQ ID NO: 5220574 - DNA, 16 bp, Homo sapiens
aggggtggccgtcctg

SEQ ID NO: 5220575 - DNA, 17 bp, Homo sapiens
aggggtggccgtcctga

SEQ ID NO: 5220576 - DNA, 19 bp, Homo sapiens
aggggtggccgtcctgagg

SEQ ID NO: 5220577 - DNA, 21 bp, Homo sapiens
aggggtggccgtcctgagggg

SEQ ID NO: 5220578 - DNA, 19 bp, Homo sapiens
aggggtggcgctcagaccc

SEQ ID NO: 5220579 - DNA, 21 bp, Homo sapiens
aggggtggctgcctcatttag

SEQ ID NO: 5220580 - DNA, 20 bp, Homo sapiens
aggggtgggacaccctgtga

SEQ ID NO: 5220581 - DNA, 22 bp, Homo sapiens
aggggtgggacaccctgtgatg

SEQ ID NO: 5220582 - DNA, 19 bp, Homo sapiens
aggggtgggaggaagcaaa

SEQ ID NO: 5220583 - DNA, 19 bp, Homo sapiens
aggggtgggcctgtgaatc

SEQ ID NO: 5220584 - DNA, 14 bp, Homo sapiens
aggggtgggctggt

SEQ ID NO: 5220585 - DNA, 13 bp, Homo sapiens
aggggtggggagc

SEQ ID NO: 5220586 - DNA, 14 bp, Homo sapiens
aggggtggggagct

SEQ ID NO: 5220587 - DNA, 19 bp, Homo sapiens
aggggtggggcccatgggg

SEQ ID NO: 5220588 - DNA, 11 bp, Homo sapiens
aggggtggggg

SEQ ID NO: 5220589 - DNA, 17 bp, Homo sapiens
aggggtgggggagaatg

SEQ ID NO: 5220590 - DNA, 23 bp, Homo sapiens
aggggtgggggagaatggctctg

SEQ ID NO: 5220591 - DNA, 16 bp, Homo sapiens
aggggtgggggtgccg

SEQ ID NO: 5220592 - DNA, 19 bp, Homo sapiens
aggggtgggggtggaggct

SEQ ID NO: 5220593 - DNA, 21 bp, Homo sapiens
aggggtgggtcagaacatgtt

SEQ ID NO: 5220594 - DNA, 16 bp, Homo sapiens
aggggtggtacttggc

SEQ ID NO: 5220595 - DNA, 18 bp, Homo sapiens
aggggtggtacttggcac

SEQ ID NO: 5220596 - DNA, 13 bp, Homo sapiens
aggggtggtcctg

SEQ ID NO: 5220597 - DNA, 22 bp, Homo sapiens
aggggtggtggagggggctggg

SEQ ID NO: 5220598 - DNA, 18 bp, Homo sapiens
aggggtgtcccagtccca

SEQ ID NO: 5220599 - DNA, 22 bp, Homo sapiens
aggggtgtcttgggcagagctg

SEQ ID NO: 5220600 - DNA, 22 bp, Homo sapiens
aggggtgtgggcacccccggcc

SEQ ID NO: 5220601 - DNA, 15 bp, Homo sapiens
aggggtgtgggtcaa

SEQ ID NO: 5220602 - DNA, 13 bp, Homo sapiens
aggggtgttgtat

SEQ ID NO: 5220603 - DNA, 15 bp, Homo sapiens
aggggtgttgtatgg

SEQ ID NO: 5220604 - DNA, 21 bp, Homo sapiens
aggggttaacttggtcagagc

SEQ ID NO: 5220605 - DNA, 17 bp, Homo sapiens
aggggttcctcccctcc

SEQ ID NO: 5220606 - DNA, 19 bp, Homo sapiens
aggggttccttctgggcat

SEQ ID NO: 5220607 - DNA, 18 bp, Homo sapiens
aggggttgcagtgagcgg

SEQ ID NO: 5220608 - DNA, 16 bp, Homo sapiens
aggggttgccacaggc

SEQ ID NO: 5220609 - DNA, 19 bp, Homo sapiens
aggggttgccacaggcctc

SEQ ID NO: 5220610 - DNA, 20 bp, Homo sapiens
aggggttgccacaggcctcc

SEQ ID NO: 5220611 - DNA, 21 bp, Homo sapiens
aggggttgcgggggagctgga

SEQ ID NO: 5220612 - DNA, 15 bp, Homo sapiens
aggggttggcagcgc

SEQ ID NO: 5220613 - DNA, 22 bp, Homo sapiens
aggggttggtatctcaggtctg

SEQ ID NO: 5220614 - DNA, 19 bp, Homo sapiens
aggggttggtcaaggccac

SEQ ID NO: 5220615 - DNA, 18 bp, Homo sapiens
aggggttggtgggagggt

SEQ ID NO: 5220616 - DNA, 23 bp, Homo sapiens
aggggtttcagaattttgcattg

SEQ ID NO: 5220617 - DNA, 20 bp, Homo sapiens
aggggttttaggtctcttcc

SEQ ID NO: 5220618 - DNA, 22 bp, Homo sapiens
aggggttttaggtctcttcccc

SEQ ID NO: 5220619 - DNA, 21 bp, Homo sapiens
aggggttttcgaagctcagcc

SEQ ID NO: 5220620 - DNA, 21 bp, Homo sapiens
aggggttttttggttcctttt

SEQ ID NO: 5220621 - DNA, 11 bp, Homo sapiens
agggtaaatca

SEQ ID NO: 5220622 - DNA, 23 bp, Homo sapiens
agggtaaatcagtaagaggtgtt

SEQ ID NO: 5220623 - DNA, 15 bp, Homo sapiens
agggtaaattattca

SEQ ID NO: 5220624 - DNA, 13 bp, Homo sapiens
agggtaacagaag

SEQ ID NO: 5220625 - DNA, 16 bp, Homo sapiens
agggtaacagaagagg

SEQ ID NO: 5220626 - DNA, 17 bp, Homo sapiens
agggtaacagaagagga

SEQ ID NO: 5220627 - DNA, 18 bp, Homo sapiens
agggtaactaactaaaac

SEQ ID NO: 5220628 - DNA, 23 bp, Homo sapiens
agggtaactggggggccaccatg

SEQ ID NO: 5220629 - DNA, 22 bp, Homo sapiens
agggtaagctagagagaaaaag

SEQ ID NO: 5220630 - DNA, 15 bp, Homo sapiens
agggtaaggctgtgg

SEQ ID NO: 5220631 - DNA, 14 bp, Homo sapiens
agggtaaggtgcct

SEQ ID NO: 5220632 - DNA, 15 bp, Homo sapiens
agggtaaggtgcctt

SEQ ID NO: 5220633 - DNA, 12 bp, Homo sapiens
agggtaagtatt

SEQ ID NO: 5220634 - DNA, 22 bp, Homo sapiens
agggtaataaacttagaataaa

SEQ ID NO: 5220635 - DNA, 16 bp, Homo sapiens
agggtacactcttctc

SEQ ID NO: 5220636 - DNA, 13 bp, Homo sapiens
agggtacagatcc

SEQ ID NO: 5220637 - DNA, 23 bp, Homo sapiens
agggtacagatccccagcccctc

SEQ ID NO: 5220638 - DNA, 13 bp, Homo sapiens
agggtacagctgg

SEQ ID NO: 5220639 - DNA, 14 bp, Homo sapiens
agggtacagtttgg

SEQ ID NO: 5220640 - DNA, 18 bp, Homo sapiens
agggtacatttataattg

SEQ ID NO: 5220641 - DNA, 14 bp, Homo sapiens
agggtaccagcaga

SEQ ID NO: 5220642 - DNA, 17 bp, Homo sapiens
agggtacccgcctgagc

SEQ ID NO: 5220643 - DNA, 20 bp, Homo sapiens
agggtaccctttggggagca

SEQ ID NO: 5220644 - DNA, 15 bp, Homo sapiens
agggtactaaattta

SEQ ID NO: 5220645 - DNA, 20 bp, Homo sapiens
agggtacttccactgatgga

SEQ ID NO: 5220646 - DNA, 19 bp, Homo sapiens
agggtacttttcctgggtt

SEQ ID NO: 5220647 - DNA, 22 bp, Homo sapiens
agggtagaattcaatcagagct

SEQ ID NO: 5220648 - DNA, 23 bp, Homo sapiens
agggtagaattctggctggtaga

SEQ ID NO: 5220649 - DNA, 17 bp, Homo sapiens
agggtagatttctcttg

SEQ ID NO: 5220650 - DNA, 22 bp, Homo sapiens
agggtagatttctcttgggcag

SEQ ID NO: 5220651 - DNA, 21 bp, Homo sapiens
agggtagccccctcatctgca

SEQ ID NO: 5220652 - DNA, 14 bp, Homo sapiens
agggtagccctggg

SEQ ID NO: 5220653 - DNA, 15 bp, Homo sapiens
agggtagcctggctt

SEQ ID NO: 5220654 - DNA, 21 bp, Homo sapiens
agggtaggaggtttggatggg

SEQ ID NO: 5220655 - DNA, 14 bp, Homo sapiens
agggtaggatgttg

SEQ ID NO: 5220656 - DNA, 18 bp, Homo sapiens
agggtaggcaggattggg

SEQ ID NO: 5220657 - DNA, 15 bp, Homo sapiens
agggtaggggagggt

SEQ ID NO: 5220658 - DNA, 20 bp, Homo sapiens
agggtaggggagtgtgggtg

SEQ ID NO: 5220659 - DNA, 17 bp, Homo sapiens
agggtagtctggtttct

SEQ ID NO: 5220660 - DNA, 18 bp, Homo sapiens
agggtagtttgcaaacaa

SEQ ID NO: 5220661 - DNA, 22 bp, Homo sapiens
agggtataagttgctgtaaaat

SEQ ID NO: 5220662 - DNA, 14 bp, Homo sapiens
agggtataatgtgt

SEQ ID NO: 5220663 - DNA, 18 bp, Homo sapiens
agggtatcaaataaaatt

SEQ ID NO: 5220664 - DNA, 16 bp, Homo sapiens
agggtatcaggtgctg

SEQ ID NO: 5220665 - DNA, 18 bp, Homo sapiens
agggtatcaggtgctgcc

SEQ ID NO: 5220666 - DNA, 21 bp, Homo sapiens
agggtatcccagacccctctc

SEQ ID NO: 5220667 - DNA, 22 bp, Homo sapiens
agggtatgaagagctgtcttcc

SEQ ID NO: 5220668 - DNA, 16 bp, Homo sapiens
agggtatgaagagtgt

SEQ ID NO: 5220669 - DNA, 14 bp, Homo sapiens
agggtatgagctgg

SEQ ID NO: 5220670 - DNA, 18 bp, Homo sapiens
agggtatgagctggagct

SEQ ID NO: 5220671 - DNA, 22 bp, Homo sapiens
agggtattaagaattaagagga

SEQ ID NO: 5220672 - DNA, 16 bp, Homo sapiens
agtccaagcatttaga

SEQ ID NO: 5220673 - DNA, 21 bp, Homo sapiens
agtccaagcatttagatgtat

SEQ ID NO: 5220674 - DNA, 11 bp, Homo sapiens
agtccaagctg

SEQ ID NO: 5220675 - DNA, 14 bp, Homo sapiens
agtccaagctgtgc

SEQ ID NO: 5220676 - DNA, 18 bp, Homo sapiens
agtccaaggaaaccacag

SEQ ID NO: 5220677 - DNA, 12 bp, Homo sapiens
agtccaaggtat

SEQ ID NO: 5220678 - DNA, 15 bp, Homo sapiens
agtccaataaattat

SEQ ID NO: 5220679 - DNA, 14 bp, Homo sapiens
agtccaatgaagat

SEQ ID NO: 5220680 - DNA, 22 bp, Homo sapiens
agtccaatgaagataaatgctt

SEQ ID NO: 5220681 - DNA, 23 bp, Homo sapiens
agtccaatgaagataaatgcttt

SEQ ID NO: 5220682 - DNA, 23 bp, Homo sapiens
agtccaatgtaccatgttgccca

SEQ ID NO: 5220683 - DNA, 17 bp, Homo sapiens
agtccaatgtcttttta

SEQ ID NO: 5220684 - DNA, 14 bp, Homo sapiens
agtccaatttaagg

SEQ ID NO: 5220685 - DNA, 19 bp, Homo sapiens
agtccaattttaatttagt

SEQ ID NO: 5220686 - DNA, 17 bp, Homo sapiens
agtccaatttttactca

SEQ ID NO: 5220687 - DNA, 12 bp, Homo sapiens
agtccacagaca

SEQ ID NO: 5220688 - DNA, 17 bp, Homo sapiens
agtccacagctgaagag

SEQ ID NO: 5220689 - DNA, 13 bp, Homo sapiens
agtccacaggggc

SEQ ID NO: 5220690 - DNA, 14 bp, Homo sapiens
agtccacaggggcc

SEQ ID NO: 5220691 - DNA, 16 bp, Homo sapiens
agtccacagtggaacc

SEQ ID NO: 5220692 - DNA, 10 bp, Homo sapiens
agtccacccc

SEQ ID NO: 5220693 - DNA, 21 bp, Homo sapiens
agtccacccccattgtgaatg

SEQ ID NO: 5220694 - DNA, 16 bp, Homo sapiens
agtccaccctgcctgc

SEQ ID NO: 5220695 - DNA, 18 bp, Homo sapiens
agtccacccttggttcct

SEQ ID NO: 5220696 - DNA, 12 bp, Homo sapiens
agtccacctgag

SEQ ID NO: 5220697 - DNA, 15 bp, Homo sapiens
agtccaccttcattt

SEQ ID NO: 5220698 - DNA, 20 bp, Homo sapiens
agtccacgcccaccagcctt

SEQ ID NO: 5220699 - DNA, 21 bp, Homo sapiens
agtccacgcccaccagccttg

SEQ ID NO: 5220700 - DNA, 23 bp, Homo sapiens
agtccacgcccaccagccttgct

SEQ ID NO: 5220701 - DNA, 22 bp, Homo sapiens
agtccacgccgggtcgcctgcc

SEQ ID NO: 5220702 - DNA, 14 bp, Homo sapiens
agtccactcccagt

SEQ ID NO: 5220703 - DNA, 14 bp, Homo sapiens
agtccactctgagt

SEQ ID NO: 5220704 - DNA, 13 bp, Homo sapiens
agtccactgcctc

SEQ ID NO: 5220705 - DNA, 20 bp, Homo sapiens
agtccactgcctccatgatg

SEQ ID NO: 5220706 - DNA, 15 bp, Homo sapiens
agtccactgtcctcc

SEQ ID NO: 5220707 - DNA, 19 bp, Homo sapiens
agtccactgtcctccttgg

SEQ ID NO: 5220708 - DNA, 20 bp, Homo sapiens
agtccactgtcctccttggc

SEQ ID NO: 5220709 - DNA, 21 bp, Homo sapiens
agtccacttaaataatcctct

SEQ ID NO: 5220710 - DNA, 20 bp, Homo sapiens
agtccacttctgacagcctc

SEQ ID NO: 5220711 - DNA, 12 bp, Homo sapiens
agtccactttcc

SEQ ID NO: 5220712 - DNA, 15 bp, Homo sapiens
agtccactttcctct

SEQ ID NO: 5220713 - DNA, 17 bp, Homo sapiens
agtccactttcctctct

SEQ ID NO: 5220714 - DNA, 20 bp, Homo sapiens
agtccactttcctctctctc

SEQ ID NO: 5220715 - DNA, 12 bp, Homo sapiens
agtccagacacc

SEQ ID NO: 5220716 - DNA, 11 bp, Homo sapiens
agtccagaccc

SEQ ID NO: 5220717 - DNA, 19 bp, Homo sapiens
agtccagaccccccagccc

SEQ ID NO: 5220718 - DNA, 13 bp, Homo sapiens
agtccagagcttg

SEQ ID NO: 5220719 - DNA, 15 bp, Homo sapiens
agtccagatgccttc

SEQ ID NO: 5220720 - DNA, 16 bp, Homo sapiens
agtccagatggcaggc

SEQ ID NO: 5220721 - DNA, 15 bp, Homo sapiens
agtccagatttacac

SEQ ID NO: 5220722 - DNA, 23 bp, Homo sapiens
agtccagatttacactgggagag

SEQ ID NO: 5220723 - DNA, 21 bp, Homo sapiens
agtccagcccctcctccctca

SEQ ID NO: 5220724 - DNA, 19 bp, Homo sapiens
agtccagctccccccaaga

SEQ ID NO: 5220725 - DNA, 13 bp, Homo sapiens
agtccagctctac

SEQ ID NO: 5220726 - DNA, 16 bp, Homo sapiens
agtccagctctcccct

SEQ ID NO: 5220727 - DNA, 16 bp, Homo sapiens
agtccagctctttaga

SEQ ID NO: 5220728 - DNA, 17 bp, Homo sapiens
agtccagctttctgcag

SEQ ID NO: 5220729 - DNA, 17 bp, Homo sapiens
agtccaggactgggtct

SEQ ID NO: 5220730 - DNA, 14 bp, Homo sapiens
agtccaggagctca

SEQ ID NO: 5220731 - DNA, 16 bp, Homo sapiens
agtccaggcccccagc

SEQ ID NO: 5220732 - DNA, 17 bp, Homo sapiens
agtccaggcccccagcc

SEQ ID NO: 5220733 - DNA, 18 bp, Homo sapiens
agtccaggcccccagccc

SEQ ID NO: 5220734 - DNA, 22 bp, Homo sapiens
agtccaggcccccagcccctcc

SEQ ID NO: 5220735 - DNA, 16 bp, Homo sapiens
agtccaggcctctctc

SEQ ID NO: 5220736 - DNA, 17 bp, Homo sapiens
agtccaggcctctctct

SEQ ID NO: 5220737 - DNA, 22 bp, Homo sapiens
agtccaggcctctctctgctcc

SEQ ID NO: 5220738 - DNA, 22 bp, Homo sapiens
agtccaggctaattagaggatg

SEQ ID NO: 5220739 - DNA, 14 bp, Homo sapiens
agtccaggctgccg

SEQ ID NO: 5220740 - DNA, 20 bp, Homo sapiens
agtccagggcgggagtgggg

SEQ ID NO: 5220741 - DNA, 17 bp, Homo sapiens
agtccagggtttctctg

SEQ ID NO: 5220742 - DNA, 18 bp, Homo sapiens
agtccagggtttctctgc

SEQ ID NO: 5220743 - DNA, 13 bp, Homo sapiens
agtccaggtcctg

SEQ ID NO: 5220744 - DNA, 15 bp, Homo sapiens
agtccaggtcctggt

SEQ ID NO: 5220745 - DNA, 19 bp, Homo sapiens
agtccaggtcctggtgggg

SEQ ID NO: 5220746 - DNA, 17 bp, Homo sapiens
agtccaggtcgggctca

SEQ ID NO: 5220747 - DNA, 18 bp, Homo sapiens
agtccaggtcgggctcag

SEQ ID NO: 5220748 - DNA, 19 bp, Homo sapiens
agtccagtgaccctggagc

SEQ ID NO: 5220749 - DNA, 22 bp, Homo sapiens
agtccagtgaccctggagctag

SEQ ID NO: 5220750 - DNA, 17 bp, Homo sapiens
agtccagtgacctgctg

SEQ ID NO: 5220751 - DNA, 17 bp, Homo sapiens
agtccagtgagaaatta

SEQ ID NO: 5220752 - DNA, 15 bp, Homo sapiens
agtccagtgctctgc

SEQ ID NO: 5220753 - DNA, 16 bp, Homo sapiens
agtccagtgctctgcc

SEQ ID NO: 5220754 - DNA, 20 bp, Homo sapiens
agtccagtgctttctttccg

SEQ ID NO: 5220755 - DNA, 23 bp, Homo sapiens
agtccagttgtgttgacacatat

SEQ ID NO: 5220756 - DNA, 19 bp, Homo sapiens
agtccagtttgtgcaagac

SEQ ID NO: 5220757 - DNA, 15 bp, Homo sapiens
agtccataccttata

SEQ ID NO: 5220758 - DNA, 23 bp, Homo sapiens
agtccatatttcaatttccaaga

SEQ ID NO: 5220759 - DNA, 18 bp, Homo sapiens
agtccatcaccatttctt

SEQ ID NO: 5220760 - DNA, 21 bp, Homo sapiens
agtccatcaccctttccggca

SEQ ID NO: 5220761 - DNA, 13 bp, Homo sapiens
agtccatcagcct

SEQ ID NO: 5220762 - DNA, 16 bp, Homo sapiens
agtccatcagcctcca

SEQ ID NO: 5220763 - DNA, 13 bp, Homo sapiens
agtccatgaaaat

SEQ ID NO: 5220764 - DNA, 16 bp, Homo sapiens
agtccatgaatgttca

SEQ ID NO: 5220765 - DNA, 17 bp, Homo sapiens
agtccatgaatgttcat

SEQ ID NO: 5220766 - DNA, 18 bp, Homo sapiens
agtccatgaatgttcata

SEQ ID NO: 5220767 - DNA, 20 bp, Homo sapiens
agtccatgctccagggtcag

SEQ ID NO: 5220768 - DNA, 17 bp, Homo sapiens
agtccatgtgataattg

SEQ ID NO: 5220769 - DNA, 13 bp, Homo sapiens
agtccattaactg

SEQ ID NO: 5220770 - DNA, 17 bp, Homo sapiens
agtccattatttgagtt

SEQ ID NO: 5220771 - DNA, 16 bp, Homo sapiens
agtccattctcccagg

SEQ ID NO: 5220772 - DNA, 16 bp, Homo sapiens
agtccatttatatatg

SEQ ID NO: 5220773 - DNA, 13 bp, Homo sapiens
agtccatttttga

SEQ ID NO: 5220774 - DNA, 15 bp, Homo sapiens
agtccatttttgagt

SEQ ID NO: 5220775 - DNA, 19 bp, Homo sapiens
agtccatttttgagtaaaa

SEQ ID NO: 5220776 - DNA, 20 bp, Homo sapiens
agtcccaagcggtgtctctc

SEQ ID NO: 5220777 - DNA, 12 bp, Homo sapiens
agtcccacactg

SEQ ID NO: 5220778 - DNA, 18 bp, Homo sapiens
agtcccacactgtggcca

SEQ ID NO: 5220779 - DNA, 13 bp, Homo sapiens
agtcccacagccc

SEQ ID NO: 5220780 - DNA, 15 bp, Homo sapiens
agtcccacagcccct

SEQ ID NO: 5220781 - DNA, 19 bp, Homo sapiens
agtcccaccctatggccac

SEQ ID NO: 5220782 - DNA, 17 bp, Homo sapiens
agtcccaccctgctgct

SEQ ID NO: 5220783 - DNA, 20 bp, Homo sapiens
agtcccaccggttgcttctg

SEQ ID NO: 5220784 - DNA, 22 bp, Homo sapiens
agtcccaccttggagcatttat

SEQ ID NO: 5220785 - DNA, 19 bp, Homo sapiens
agtcccaccttggctgcag

SEQ ID NO: 5220786 - DNA, 20 bp, Homo sapiens
agtcccaccttggctgcagg

SEQ ID NO: 5220787 - DNA, 18 bp, Homo sapiens
agtcccactccaagccag

SEQ ID NO: 5220788 - DNA, 19 bp, Homo sapiens
agtcccactccaagccagc

SEQ ID NO: 5220789 - DNA, 17 bp, Homo sapiens
agtcccactgcctcagg

SEQ ID NO: 5220790 - DNA, 19 bp, Homo sapiens
agtcccagagcacctcacc

SEQ ID NO: 5220791 - DNA, 20 bp, Homo sapiens
agtcccagagcacctcacct

SEQ ID NO: 5220792 - DNA, 16 bp, Homo sapiens
agtcccagagctgcac

SEQ ID NO: 5220793 - DNA, 15 bp, Homo sapiens
agtcccagcagccag

SEQ ID NO: 5220794 - DNA, 18 bp, Homo sapiens
agtcccagcagccagcca

SEQ ID NO: 5220795 - DNA, 19 bp, Homo sapiens
agtcccagcagccagccaa

SEQ ID NO: 5220796 - DNA, 17 bp, Homo sapiens
agtcccagcagcctccc

SEQ ID NO: 5220797 - DNA, 22 bp, Homo sapiens
agtcccagcagcctccccacgt

SEQ ID NO: 5220798 - DNA, 12 bp, Homo sapiens
agtcccagcctc

SEQ ID NO: 5220799 - DNA, 19 bp, Homo sapiens
agtcccagcctctggggca

SEQ ID NO: 5220800 - DNA, 17 bp, Homo sapiens
agtcccagctactcgat

SEQ ID NO: 5220801 - DNA, 20 bp, Homo sapiens
agtcccagctacttgggagg

SEQ ID NO: 5220802 - DNA, 19 bp, Homo sapiens
agtcccaggggcagccaca

SEQ ID NO: 5220803 - DNA, 21 bp, Homo sapiens
agtcccaggggcagccacacc

SEQ ID NO: 5220804 - DNA, 18 bp, Homo sapiens
agtcccaggttggctctg

SEQ ID NO: 5220805 - DNA, 20 bp, Homo sapiens
agtcccaggttggctctgcc

SEQ ID NO: 5220806 - DNA, 23 bp, Homo sapiens
agtcccaggttggctctgccagt

SEQ ID NO: 5220807 - DNA, 16 bp, Homo sapiens
agtcccagtatacctc

SEQ ID NO: 5220808 - DNA, 18 bp, Homo sapiens
agtcccagtatacctcat

SEQ ID NO: 5220809 - DNA, 20 bp, Homo sapiens
agtcccagtattctcagagc

SEQ ID NO: 5220810 - DNA, 18 bp, Homo sapiens
agtcccatccctgcgtga

SEQ ID NO: 5220811 - DNA, 17 bp, Homo sapiens
agtcccatctcacctct

SEQ ID NO: 5220812 - DNA, 17 bp, Homo sapiens
agtcccatctgcttcag

SEQ ID NO: 5220813 - DNA, 19 bp, Homo sapiens
agtcccatgctggctgaag

SEQ ID NO: 5220814 - DNA, 20 bp, Homo sapiens
agtcccatgctggctgaaga

SEQ ID NO: 5220815 - DNA, 17 bp, Homo sapiens
agtcccattcagtggca

SEQ ID NO: 5220816 - DNA, 13 bp, Homo sapiens
agtcccattcata

SEQ ID NO: 5220817 - DNA, 20 bp, Homo sapiens
agtcccattgtcagaaatat

SEQ ID NO: 5220818 - DNA, 11 bp, Homo sapiens
agtccccaccc

SEQ ID NO: 5220819 - DNA, 12 bp, Homo sapiens
agtccccacccc

SEQ ID NO: 5220820 - DNA, 20 bp, Homo sapiens
agtccccacccgcctgcaga

SEQ ID NO: 5220821 - DNA, 13 bp, Homo sapiens
agtccccaggccc

SEQ ID NO: 5220822 - DNA, 19 bp, Homo sapiens
agtccccaggccccaggaa

SEQ ID NO: 5220823 - DNA, 22 bp, Homo sapiens
agtccccatcagcaccatggag

SEQ ID NO: 5220824 - DNA, 18 bp, Homo sapiens
agtccccatttctgcctc

SEQ ID NO: 5220825 - DNA, 19 bp, Homo sapiens
agtcccccaaagggcctcc

SEQ ID NO: 5220826 - DNA, 18 bp, Homo sapiens
agtcccccaaccccagcc

SEQ ID NO: 5220827 - DNA, 14 bp, Homo sapiens
agtcccccaccaca

SEQ ID NO: 5220828 - DNA, 18 bp, Homo sapiens
agtcccccaccacactga

SEQ ID NO: 5220829 - DNA, 17 bp, Homo sapiens
agtcccccacccacctc

SEQ ID NO: 5220830 - DNA, 18 bp, Homo sapiens
agtcccccagagatgtca

SEQ ID NO: 5220831 - DNA, 22 bp, Homo sapiens
agtcccccagcagaaccagcct

SEQ ID NO: 5220832 - DNA, 23 bp, Homo sapiens
agtcccccagcagaaccagcctc

SEQ ID NO: 5220833 - DNA, 12 bp, Homo sapiens
agtcccccaggg

SEQ ID NO: 5220834 - DNA, 14 bp, Homo sapiens
agtccccccacccc

SEQ ID NO: 5220835 - DNA, 20 bp, Homo sapiens
agtccccccacccctcccca

SEQ ID NO: 5220836 - DNA, 22 bp, Homo sapiens
agtcccccctcgccccaaagtt

SEQ ID NO: 5220837 - DNA, 22 bp, Homo sapiens
agtccccctatccttggcacca

SEQ ID NO: 5220838 - DNA, 13 bp, Homo sapiens
agtccccctcctc

SEQ ID NO: 5220839 - DNA, 17 bp, Homo sapiens
agtccccctcctcagcc

SEQ ID NO: 5220840 - DNA, 19 bp, Homo sapiens
agtccccctcctcagccag

SEQ ID NO: 5220841 - DNA, 16 bp, Homo sapiens
agtccccctgccccag

SEQ ID NO: 5220842 - DNA, 13 bp, Homo sapiens
agtccccctggtc

SEQ ID NO: 5220843 - DNA, 14 bp, Homo sapiens
agtccccctgtgca

SEQ ID NO: 5220844 - DNA, 16 bp, Homo sapiens
agtcccccttcaatct

SEQ ID NO: 5220845 - DNA, 22 bp, Homo sapiens
agtccccgaggagctgggcccc

SEQ ID NO: 5220846 - DNA, 20 bp, Homo sapiens
agtccccgagggcgaaggcc

SEQ ID NO: 5220847 - DNA, 19 bp, Homo sapiens
agtccccgagtttccccag

SEQ ID NO: 5220848 - DNA, 19 bp, Homo sapiens
agtccccgggaaaggccgg

SEQ ID NO: 5220849 - DNA, 16 bp, Homo sapiens
agtccccgtcccccag

SEQ ID NO: 5220850 - DNA, 18 bp, Homo sapiens
agtccccgtcccccagaa

SEQ ID NO: 5220851 - DNA, 13 bp, Homo sapiens
agggtattccaga

SEQ ID NO: 5220852 - DNA, 18 bp, Homo sapiens
agggtattgcttgccact

SEQ ID NO: 5220853 - DNA, 12 bp, Homo sapiens
agggtatttatt

SEQ ID NO: 5220854 - DNA, 23 bp, Homo sapiens
agggtcaaagacagaatggtgga

SEQ ID NO: 5220855 - DNA, 20 bp, Homo sapiens
agggtcaacggccctgttta

SEQ ID NO: 5220856 - DNA, 13 bp, Homo sapiens
agggtcaccctgg

SEQ ID NO: 5220857 - DNA, 17 bp, Homo sapiens
agggtcaccctggcctg

SEQ ID NO: 5220858 - DNA, 15 bp, Homo sapiens
agggtcactggcctc

SEQ ID NO: 5220859 - DNA, 19 bp, Homo sapiens
agggtcagaaacaggaccg

SEQ ID NO: 5220860 - DNA, 13 bp, Homo sapiens
agggtcagagagg

SEQ ID NO: 5220861 - DNA, 14 bp, Homo sapiens
agggtcagatgcac

SEQ ID NO: 5220862 - DNA, 15 bp, Homo sapiens
agggtcagccagggc

SEQ ID NO: 5220863 - DNA, 14 bp, Homo sapiens
agggtcaggagagg

SEQ ID NO: 5220864 - DNA, 13 bp, Homo sapiens
agggtcaggcctt

SEQ ID NO: 5220865 - DNA, 16 bp, Homo sapiens
agggtcagtggaagcc

SEQ ID NO: 5220866 - DNA, 19 bp, Homo sapiens
agggtccaatcctaggaca

SEQ ID NO: 5220867 - DNA, 15 bp, Homo sapiens
agggtccacagctgg

SEQ ID NO: 5220868 - DNA, 16 bp, Homo sapiens
agggtccacctggaga

SEQ ID NO: 5220869 - DNA, 17 bp, Homo sapiens
agggtccacctggagag

SEQ ID NO: 5220870 - DNA, 21 bp, Homo sapiens
agggtccactttggtaatgtg

SEQ ID NO: 5220871 - DNA, 18 bp, Homo sapiens
agggtccagaaggagaca

SEQ ID NO: 5220872 - DNA, 12 bp, Homo sapiens
agggtccagccc

SEQ ID NO: 5220873 - DNA, 15 bp, Homo sapiens
agggtccagccctcc

SEQ ID NO: 5220874 - DNA, 16 bp, Homo sapiens
agggtccagccctccg

SEQ ID NO: 5220875 - DNA, 17 bp, Homo sapiens
agggtccagccctccgc

SEQ ID NO: 5220876 - DNA, 20 bp, Homo sapiens
agggtccatttttcttccag

SEQ ID NO: 5220877 - DNA, 19 bp, Homo sapiens
agggtcccaagctgggccc

SEQ ID NO: 5220878 - DNA, 14 bp, Homo sapiens
agggtcccaccccc

SEQ ID NO: 5220879 - DNA, 19 bp, Homo sapiens
agggtcccacccccaaccc

SEQ ID NO: 5220880 - DNA, 20 bp, Homo sapiens
agggtcccagcctggccacc

SEQ ID NO: 5220881 - DNA, 14 bp, Homo sapiens
agggtcccaggaag

SEQ ID NO: 5220882 - DNA, 20 bp, Homo sapiens
agggtccccgagtgcctagg

SEQ ID NO: 5220883 - DNA, 13 bp, Homo sapiens
agggtcccctccc

SEQ ID NO: 5220884 - DNA, 14 bp, Homo sapiens
agggtcccctgcca

SEQ ID NO: 5220885 - DNA, 15 bp, Homo sapiens
agggtcccctgccac

SEQ ID NO: 5220886 - DNA, 14 bp, Homo sapiens
agggtccctctgtg

SEQ ID NO: 5220887 - DNA, 18 bp, Homo sapiens
agggtccctctgtgtatt

SEQ ID NO: 5220888 - DNA, 14 bp, Homo sapiens
agggtccctgacct

SEQ ID NO: 5220889 - DNA, 14 bp, Homo sapiens
agggtccctgccca

SEQ ID NO: 5220890 - DNA, 11 bp, Homo sapiens
agggtccctgg

SEQ ID NO: 5220891 - DNA, 17 bp, Homo sapiens
agggtccctggtggcag

SEQ ID NO: 5220892 - DNA, 22 bp, Homo sapiens
agggtccctggtggcagctcac

SEQ ID NO: 5220893 - DNA, 15 bp, Homo sapiens
agggtcccttttgca

SEQ ID NO: 5220894 - DNA, 16 bp, Homo sapiens
agggtcccttttgcat

SEQ ID NO: 5220895 - DNA, 15 bp, Homo sapiens
agggtcctccacaat

SEQ ID NO: 5220896 - DNA, 16 bp, Homo sapiens
agggtcctctagccca

SEQ ID NO: 5220897 - DNA, 17 bp, Homo sapiens
agggtcctctcttccac

SEQ ID NO: 5220898 - DNA, 18 bp, Homo sapiens
agggtcctctcttccaca

SEQ ID NO: 5220899 - DNA, 20 bp, Homo sapiens
agggtcctctcttccacagt

SEQ ID NO: 5220900 - DNA, 16 bp, Homo sapiens
agggtcctcttcctca

SEQ ID NO: 5220901 - DNA, 17 bp, Homo sapiens
agggtcctgattctccc

SEQ ID NO: 5220902 - DNA, 18 bp, Homo sapiens
agggtcctgattctccct

SEQ ID NO: 5220903 - DNA, 19 bp, Homo sapiens
agggtcctgattctccctg

SEQ ID NO: 5220904 - DNA, 13 bp, Homo sapiens
agggtcctgccct

SEQ ID NO: 5220905 - DNA, 17 bp, Homo sapiens
agggtcctggctcctga

SEQ ID NO: 5220906 - DNA, 21 bp, Homo sapiens
agggtcctggctcctgagggg

SEQ ID NO: 5220907 - DNA, 12 bp, Homo sapiens
agggtcctgggg

SEQ ID NO: 5220908 - DNA, 21 bp, Homo sapiens
agggtcctggggaacctgacc

SEQ ID NO: 5220909 - DNA, 23 bp, Homo sapiens
agggtcctgggggctgctgcact

SEQ ID NO: 5220910 - DNA, 23 bp, Homo sapiens
agggtcctggtcctaaagagtta

SEQ ID NO: 5220911 - DNA, 14 bp, Homo sapiens
agggtcctgtgcct

SEQ ID NO: 5220912 - DNA, 17 bp, Homo sapiens
agggtccttttgacact

SEQ ID NO: 5220913 - DNA, 15 bp, Homo sapiens
agggtcgaaagctct

SEQ ID NO: 5220914 - DNA, 19 bp, Homo sapiens
agggtcgccacacccggct

SEQ ID NO: 5220915 - DNA, 22 bp, Homo sapiens
agggtcgccacacccggctccc

SEQ ID NO: 5220916 - DNA, 16 bp, Homo sapiens
agggtcggaggtgctg

SEQ ID NO: 5220917 - DNA, 15 bp, Homo sapiens
agggtcggtgccttc

SEQ ID NO: 5220918 - DNA, 16 bp, Homo sapiens
agggtcggtgccttca

SEQ ID NO: 5220919 - DNA, 14 bp, Homo sapiens
agggtcgtctttgt

SEQ ID NO: 5220920 - DNA, 19 bp, Homo sapiens
agggtcgtctttgtgtatg

SEQ ID NO: 5220921 - DNA, 16 bp, Homo sapiens
agggtctaaagagaac

SEQ ID NO: 5220922 - DNA, 20 bp, Homo sapiens
agggtctaccaatacaaaat

SEQ ID NO: 5220923 - DNA, 22 bp, Homo sapiens
agggtctaccaatacaaaatgt

SEQ ID NO: 5220924 - DNA, 19 bp, Homo sapiens
agggtctagccgctgccct

SEQ ID NO: 5220925 - DNA, 16 bp, Homo sapiens
agggtctagggagaga

SEQ ID NO: 5220926 - DNA, 23 bp, Homo sapiens
agggtctagggagagacccttgt

SEQ ID NO: 5220927 - DNA, 14 bp, Homo sapiens
agggtctataattc

SEQ ID NO: 5220928 - DNA, 15 bp, Homo sapiens
agggtctatggggag

SEQ ID NO: 5220929 - DNA, 21 bp, Homo sapiens
agggtctcactctgtcgccca

SEQ ID NO: 5220930 - DNA, 23 bp, Homo sapiens
agggtctcactctgttgaccagg

SEQ ID NO: 5220931 - DNA, 23 bp, Homo sapiens
agggtctcactgtgttgcccagg

SEQ ID NO: 5220932 - DNA, 17 bp, Homo sapiens
agggtctcagggtgtcc

SEQ ID NO: 5220933 - DNA, 17 bp, Homo sapiens
agggtctcccctcctgc

SEQ ID NO: 5220934 - DNA, 16 bp, Homo sapiens
agggtctcgaactcct

SEQ ID NO: 5220935 - DNA, 21 bp, Homo sapiens
agggtctctagtgctgtgaaa

SEQ ID NO: 5220936 - DNA, 22 bp, Homo sapiens
agggtctctagtgctgtgaaaa

SEQ ID NO: 5220937 - DNA, 17 bp, Homo sapiens
agggtctctccctcagg

SEQ ID NO: 5220938 - DNA, 15 bp, Homo sapiens
agggtctctgctcca

SEQ ID NO: 5220939 - DNA, 16 bp, Homo sapiens
agggtctctgctgccg

SEQ ID NO: 5220940 - DNA, 18 bp, Homo sapiens
agggtctgcagcctgctg

SEQ ID NO: 5220941 - DNA, 19 bp, Homo sapiens
agggtctgcagcctgctgg

SEQ ID NO: 5220942 - DNA, 22 bp, Homo sapiens
agggtctgcagcctgctggggc

SEQ ID NO: 5220943 - DNA, 14 bp, Homo sapiens
agggtctgcaggga

SEQ ID NO: 5220944 - DNA, 16 bp, Homo sapiens
agggtctgcagggaat

SEQ ID NO: 5220945 - DNA, 13 bp, Homo sapiens
agggtctgcctcc

SEQ ID NO: 5220946 - DNA, 15 bp, Homo sapiens
agggtctgcctccag

SEQ ID NO: 5220947 - DNA, 16 bp, Homo sapiens
agggtctgcctccagc

SEQ ID NO: 5220948 - DNA, 17 bp, Homo sapiens
agggtctgctctttctc

SEQ ID NO: 5220949 - DNA, 20 bp, Homo sapiens
agggtctgctctttctctgc

SEQ ID NO: 5220950 - DNA, 23 bp, Homo sapiens
agggtctgctctttctctgccag

SEQ ID NO: 5220951 - DNA, 19 bp, Homo sapiens
agggtctggagaagcagtg

SEQ ID NO: 5220952 - DNA, 17 bp, Homo sapiens
agggtctggcagagcct

SEQ ID NO: 5220953 - DNA, 22 bp, Homo sapiens
agggtctggcagagcctctgag

SEQ ID NO: 5220954 - DNA, 12 bp, Homo sapiens
agggtctgggct

SEQ ID NO: 5220955 - DNA, 17 bp, Homo sapiens
agggtctgggctgggca

SEQ ID NO: 5220956 - DNA, 18 bp, Homo sapiens
agggtctgggctgggcac

SEQ ID NO: 5220957 - DNA, 23 bp, Homo sapiens
agggtctgggctgggcacctgac

SEQ ID NO: 5220958 - DNA, 23 bp, Homo sapiens
agggtctgggggcacaagactga

SEQ ID NO: 5220959 - DNA, 19 bp, Homo sapiens
agggtctgtaggttgcaca

SEQ ID NO: 5220960 - DNA, 22 bp, Homo sapiens
agggtctgtaggttgcacactt

SEQ ID NO: 5220961 - DNA, 21 bp, Homo sapiens
agggtctgttgtaaatgacca

SEQ ID NO: 5220962 - DNA, 17 bp, Homo sapiens
agggtctgtttggactg

SEQ ID NO: 5220963 - DNA, 19 bp, Homo sapiens
agggtctgtttggactgca

SEQ ID NO: 5220964 - DNA, 23 bp, Homo sapiens
agggtcttacctctctgggacct

SEQ ID NO: 5220965 - DNA, 16 bp, Homo sapiens
agggtcttccttctca

SEQ ID NO: 5220966 - DNA, 13 bp, Homo sapiens
agggtcttcttgg

SEQ ID NO: 5220967 - DNA, 16 bp, Homo sapiens
agggtcttcttggcag

SEQ ID NO: 5220968 - DNA, 17 bp, Homo sapiens
agggtcttcttggcagc

SEQ ID NO: 5220969 - DNA, 18 bp, Homo sapiens
agggtcttgactctaaat

SEQ ID NO: 5220970 - DNA, 14 bp, Homo sapiens
agggtcttgagggg

SEQ ID NO: 5220971 - DNA, 20 bp, Homo sapiens
agggtcttgaggggaagctg

SEQ ID NO: 5220972 - DNA, 23 bp, Homo sapiens
agggtcttgctctgtcccccagg

SEQ ID NO: 5220973 - DNA, 13 bp, Homo sapiens
agggtcttgctgt

SEQ ID NO: 5220974 - DNA, 19 bp, Homo sapiens
agggtcttggctgcctgtg

SEQ ID NO: 5220975 - DNA, 17 bp, Homo sapiens
agggtcttgggctactg

SEQ ID NO: 5220976 - DNA, 18 bp, Homo sapiens
agggtcttgggctactgg

SEQ ID NO: 5220977 - DNA, 22 bp, Homo sapiens
agggtcttggttccagcctgcc

SEQ ID NO: 5220978 - DNA, 17 bp, Homo sapiens
agggtctttgcagatgt

SEQ ID NO: 5220979 - DNA, 18 bp, Homo sapiens
agggtctttggtgttttt

SEQ ID NO: 5220980 - DNA, 16 bp, Homo sapiens
agggtctttttctagg

SEQ ID NO: 5220981 - DNA, 18 bp, Homo sapiens
agggtgaaaggcagggcc

SEQ ID NO: 5220982 - DNA, 15 bp, Homo sapiens
agggtgaagcaccag

SEQ ID NO: 5220983 - DNA, 17 bp, Homo sapiens
agggtgaaggaggtcag

SEQ ID NO: 5220984 - DNA, 18 bp, Homo sapiens
agggtgaataaagcaggg

SEQ ID NO: 5220985 - DNA, 18 bp, Homo sapiens
agggtgacaaggcctgct

SEQ ID NO: 5220986 - DNA, 19 bp, Homo sapiens
agggtgacagagggacagt

SEQ ID NO: 5220987 - DNA, 17 bp, Homo sapiens
agggtgacagcttcctt

SEQ ID NO: 5220988 - DNA, 23 bp, Homo sapiens
agggtgacatcccaggaggggcc

SEQ ID NO: 5220989 - DNA, 20 bp, Homo sapiens
agggtgacccacagctctgg

SEQ ID NO: 5220990 - DNA, 23 bp, Homo sapiens
agggtgacccacagctctgggcc

SEQ ID NO: 5220991 - DNA, 17 bp, Homo sapiens
agggtgacctgcttccc

SEQ ID NO: 5220992 - DNA, 14 bp, Homo sapiens
agggtgacgcccag

SEQ ID NO: 5220993 - DNA, 22 bp, Homo sapiens
agggtgacgcctgagacagcac

SEQ ID NO: 5220994 - DNA, 20 bp, Homo sapiens
agggtgagactccatctcaa

SEQ ID NO: 5220995 - DNA, 14 bp, Homo sapiens
agggtgagagctgc

SEQ ID NO: 5220996 - DNA, 15 bp, Homo sapiens
agggtgagcagggcc

SEQ ID NO: 5220997 - DNA, 16 bp, Homo sapiens
agggtgagctggtgcc

SEQ ID NO: 5220998 - DNA, 13 bp, Homo sapiens
agggtgaggcgtg

SEQ ID NO: 5220999 - DNA, 15 bp, Homo sapiens
agggtgaggcgtggg

SEQ ID NO: 5221000 - DNA, 16 bp, Homo sapiens
agggtgaggcgtggga

SEQ ID NO: 5221001 - DNA, 13 bp, Homo sapiens
agggtgagggcct

SEQ ID NO: 5221002 - DNA, 14 bp, Homo sapiens
agggtgagggcctt

SEQ ID NO: 5221003 - DNA, 20 bp, Homo sapiens
agggtgagggccttcttaag

SEQ ID NO: 5221004 - DNA, 21 bp, Homo sapiens
agggtgagtcctccagaactc

SEQ ID NO: 5221005 - DNA, 22 bp, Homo sapiens
agggtgagttggcttacctggc

SEQ ID NO: 5221006 - DNA, 21 bp, Homo sapiens
agggtgataaatcagactctt

SEQ ID NO: 5221007 - DNA, 21 bp, Homo sapiens
agggtgatgcattaattaatg

SEQ ID NO: 5221008 - DNA, 20 bp, Homo sapiens
agggtgcacacaggatggca

SEQ ID NO: 5221009 - DNA, 20 bp, Homo sapiens
agggtgcagtatcatgccct

SEQ ID NO: 5221010 - DNA, 14 bp, Homo sapiens
agggtgcatggctt

SEQ ID NO: 5221011 - DNA, 22 bp, Homo sapiens
agggtgcatggcttggggagca

SEQ ID NO: 5221012 - DNA, 21 bp, Homo sapiens
agggtgccatccacattttaa

SEQ ID NO: 5221013 - DNA, 17 bp, Homo sapiens
agggtgcccatttgtga

SEQ ID NO: 5221014 - DNA, 14 bp, Homo sapiens
agggtgcccctggg

SEQ ID NO: 5221015 - DNA, 21 bp, Homo sapiens
agggtgccctttggggtcccg

SEQ ID NO: 5221016 - DNA, 21 bp, Homo sapiens
agggtgccggaaagagagctg

SEQ ID NO: 5221017 - DNA, 22 bp, Homo sapiens
agggtgccggaaagagagctgg

SEQ ID NO: 5221018 - DNA, 23 bp, Homo sapiens
agggtgctacgtacatgtgaggc

SEQ ID NO: 5221019 - DNA, 20 bp, Homo sapiens
agggtgctaggcccctgtgt

SEQ ID NO: 5221020 - DNA, 19 bp, Homo sapiens
agggtgctagtggtgggca

SEQ ID NO: 5221021 - DNA, 22 bp, Homo sapiens
agggtgctctgaatctgtacat

SEQ ID NO: 5221022 - DNA, 17 bp, Homo sapiens
agggtggaaaaatgccc

SEQ ID NO: 5221023 - DNA, 18 bp, Homo sapiens
agggtggaccaggcctgg

SEQ ID NO: 5221024 - DNA, 21 bp, Homo sapiens
agggtggacttagaaagcagg

SEQ ID NO: 5221025 - DNA, 22 bp, Homo sapiens
agggtggacttagaaagcaggg

SEQ ID NO: 5221026 - DNA, 23 bp, Homo sapiens
agggtggagagggagactcctgg

SEQ ID NO: 5221027 - DNA, 15 bp, Homo sapiens
agggtggagagttgg

SEQ ID NO: 5221028 - DNA, 17 bp, Homo sapiens
agtccccgtctgcctgg

SEQ ID NO: 5221029 - DNA, 16 bp, Homo sapiens
agtccccgtggccatc

SEQ ID NO: 5221030 - DNA, 17 bp, Homo sapiens
agtcccctactccctct

SEQ ID NO: 5221031 - DNA, 13 bp, Homo sapiens
agtcccctcccat

SEQ ID NO: 5221032 - DNA, 18 bp, Homo sapiens
agtcccctcccatctggg

SEQ ID NO: 5221033 - DNA, 21 bp, Homo sapiens
agtcccctcccatctgggagt

SEQ ID NO: 5221034 - DNA, 18 bp, Homo sapiens
agtcccctccccggccct

SEQ ID NO: 5221035 - DNA, 16 bp, Homo sapiens
agtcccctgggcctgg

SEQ ID NO: 5221036 - DNA, 14 bp, Homo sapiens
agtccccttctgtg

SEQ ID NO: 5221037 - DNA, 22 bp, Homo sapiens
agtcccgcgaaacccggtgcat

SEQ ID NO: 5221038 - DNA, 13 bp, Homo sapiens
agtcccgtcagga

SEQ ID NO: 5221039 - DNA, 15 bp, Homo sapiens
agtcccgtcaggacg

SEQ ID NO: 5221040 - DNA, 19 bp, Homo sapiens
agtcccgtcgtgcagtcag

SEQ ID NO: 5221041 - DNA, 14 bp, Homo sapiens
agtcccgtggaggg

SEQ ID NO: 5221042 - DNA, 18 bp, Homo sapiens
agtccctataataaaggc

SEQ ID NO: 5221043 - DNA, 15 bp, Homo sapiens
agtccctccctcctg

SEQ ID NO: 5221044 - DNA, 18 bp, Homo sapiens
agtccctccctcctggct

SEQ ID NO: 5221045 - DNA, 14 bp, Homo sapiens
agtccctccctgcc

SEQ ID NO: 5221046 - DNA, 17 bp, Homo sapiens
agtccctccctgcctga

SEQ ID NO: 5221047 - DNA, 19 bp, Homo sapiens
agtccctccctgcctgagg

SEQ ID NO: 5221048 - DNA, 22 bp, Homo sapiens
agtccctcttctggtttccctt

SEQ ID NO: 5221049 - DNA, 21 bp, Homo sapiens
agtccctgccacgaatttctg

SEQ ID NO: 5221050 - DNA, 12 bp, Homo sapiens
agtccctggaaa

SEQ ID NO: 5221051 - DNA, 13 bp, Homo sapiens
agtccctggagct

SEQ ID NO: 5221052 - DNA, 14 bp, Homo sapiens
agtccctgggggaa

SEQ ID NO: 5221053 - DNA, 17 bp, Homo sapiens
agtccctgggggaagcc

SEQ ID NO: 5221054 - DNA, 16 bp, Homo sapiens
agtccctggttcattg

SEQ ID NO: 5221055 - DNA, 16 bp, Homo sapiens
agtccctgtaattgtt

SEQ ID NO: 5221056 - DNA, 20 bp, Homo sapiens
agtccctgtaattgttgttt

SEQ ID NO: 5221057 - DNA, 19 bp, Homo sapiens
agtccctgtcacctcttcc

SEQ ID NO: 5221058 - DNA, 22 bp, Homo sapiens
agtccctgtgatggccaggcca

SEQ ID NO: 5221059 - DNA, 13 bp, Homo sapiens
agtccctgttttc

SEQ ID NO: 5221060 - DNA, 17 bp, Homo sapiens
agtccctgttttctgag

SEQ ID NO: 5221061 - DNA, 19 bp, Homo sapiens
agtccctgttttctgagcc

SEQ ID NO: 5221062 - DNA, 21 bp, Homo sapiens
agtccctgttttctgagcccg

SEQ ID NO: 5221063 - DNA, 23 bp, Homo sapiens
agtcccttaatcttatggggccg

SEQ ID NO: 5221064 - DNA, 19 bp, Homo sapiens
agtcccttccacaccccca

SEQ ID NO: 5221065 - DNA, 14 bp, Homo sapiens
agtcccttccaggc

SEQ ID NO: 5221066 - DNA, 14 bp, Homo sapiens
agtcccttccagtc

SEQ ID NO: 5221067 - DNA, 14 bp, Homo sapiens
agtcccttcccctc

SEQ ID NO: 5221068 - DNA, 15 bp, Homo sapiens
agtcccttcccctcc

SEQ ID NO: 5221069 - DNA, 19 bp, Homo sapiens
agtcccttcccctccctgg

SEQ ID NO: 5221070 - DNA, 21 bp, Homo sapiens
agtcccttcccctccctggct

SEQ ID NO: 5221071 - DNA, 23 bp, Homo sapiens
agtcccttcccctccctggctcc

SEQ ID NO: 5221072 - DNA, 12 bp, Homo sapiens
agtcccttccta

SEQ ID NO: 5221073 - DNA, 20 bp, Homo sapiens
agtcccttcctattctcctg

SEQ ID NO: 5221074 - DNA, 13 bp, Homo sapiens
agtcccttcctgt

SEQ ID NO: 5221075 - DNA, 20 bp, Homo sapiens
agtcccttcctgtcctgctc

SEQ ID NO: 5221076 - DNA, 12 bp, Homo sapiens
agtcccttctct

SEQ ID NO: 5221077 - DNA, 15 bp, Homo sapiens
agtcccttctctctt

SEQ ID NO: 5221078 - DNA, 19 bp, Homo sapiens
agtcccttgagactcccca

SEQ ID NO: 5221079 - DNA, 19 bp, Homo sapiens
agtcccttttcattctcct

SEQ ID NO: 5221080 - DNA, 12 bp, Homo sapiens
agtccgaggcct

SEQ ID NO: 5221081 - DNA, 16 bp, Homo sapiens
agtccgaggcctggct

SEQ ID NO: 5221082 - DNA, 20 bp, Homo sapiens
agtccgcaagttcagggaag

SEQ ID NO: 5221083 - DNA, 18 bp, Homo sapiens
agtccgcagaagccctga

SEQ ID NO: 5221084 - DNA, 14 bp, Homo sapiens
agtccgccagtgtt

SEQ ID NO: 5221085 - DNA, 17 bp, Homo sapiens
agtccgcctgcgcctcc

SEQ ID NO: 5221086 - DNA, 12 bp, Homo sapiens
agtccgcctggc

SEQ ID NO: 5221087 - DNA, 19 bp, Homo sapiens
agtccgctgaagatggagg

SEQ ID NO: 5221088 - DNA, 17 bp, Homo sapiens
agtccggacccacctca

SEQ ID NO: 5221089 - DNA, 14 bp, Homo sapiens
agtccggaggcagc

SEQ ID NO: 5221090 - DNA, 22 bp, Homo sapiens
agtccggaggcagcagacacgc

SEQ ID NO: 5221091 - DNA, 21 bp, Homo sapiens
agtccggccccagtacacagg

SEQ ID NO: 5221092 - DNA, 16 bp, Homo sapiens
agtccgggagaatgct

SEQ ID NO: 5221093 - DNA, 13 bp, Homo sapiens
agtccggtgcctt

SEQ ID NO: 5221094 - DNA, 16 bp, Homo sapiens
agtccggtgccttcca

SEQ ID NO: 5221095 - DNA, 14 bp, Homo sapiens
agtccgtcaaaaca

SEQ ID NO: 5221096 - DNA, 12 bp, Homo sapiens
agtccgtccacc

SEQ ID NO: 5221097 - DNA, 15 bp, Homo sapiens
agtccgtcctggcac

SEQ ID NO: 5221098 - DNA, 22 bp, Homo sapiens
agtccgtgctgacagctgctcc

SEQ ID NO: 5221099 - DNA, 23 bp, Homo sapiens
agtccgtgggacgggatggttct

SEQ ID NO: 5221100 - DNA, 15 bp, Homo sapiens
agtccgttgctgaaa

SEQ ID NO: 5221101 - DNA, 19 bp, Homo sapiens
agtcctaaaagttctcaat

SEQ ID NO: 5221102 - DNA, 23 bp, Homo sapiens
agtcctaagaagtggggcagatg

SEQ ID NO: 5221103 - DNA, 14 bp, Homo sapiens
agtcctaatttgaa

SEQ ID NO: 5221104 - DNA, 20 bp, Homo sapiens
agtcctacaagctaaaatta

SEQ ID NO: 5221105 - DNA, 16 bp, Homo sapiens
agtcctacaatgtgaa

SEQ ID NO: 5221106 - DNA, 19 bp, Homo sapiens
agtcctagaatgtttcatt

SEQ ID NO: 5221107 - DNA, 16 bp, Homo sapiens
agtcctagagctcctg

SEQ ID NO: 5221108 - DNA, 20 bp, Homo sapiens
agtcctagagctcctgtccc

SEQ ID NO: 5221109 - DNA, 22 bp, Homo sapiens
agtcctagagctcctgtcccta

SEQ ID NO: 5221110 - DNA, 15 bp, Homo sapiens
agtcctagctgacgc

SEQ ID NO: 5221111 - DNA, 17 bp, Homo sapiens
agtcctagctgacgcca

SEQ ID NO: 5221112 - DNA, 20 bp, Homo sapiens
agtcctagctgcacagggca

SEQ ID NO: 5221113 - DNA, 22 bp, Homo sapiens
agtcctagctgcacagggcagc

SEQ ID NO: 5221114 - DNA, 16 bp, Homo sapiens
agtcctatagtcgtgg

SEQ ID NO: 5221115 - DNA, 19 bp, Homo sapiens
agtcctatctgggcttcct

SEQ ID NO: 5221116 - DNA, 15 bp, Homo sapiens
agtcctatgtacaga

SEQ ID NO: 5221117 - DNA, 13 bp, Homo sapiens
agtcctatttcag

SEQ ID NO: 5221118 - DNA, 15 bp, Homo sapiens
agtcctcaaagcttt

SEQ ID NO: 5221119 - DNA, 16 bp, Homo sapiens
agtcctcacagcctag

SEQ ID NO: 5221120 - DNA, 16 bp, Homo sapiens
agtcctcacagcctct

SEQ ID NO: 5221121 - DNA, 18 bp, Homo sapiens
agtcctcacagcctctcc

SEQ ID NO: 5221122 - DNA, 19 bp, Homo sapiens
agtcctcacagcctctccc

SEQ ID NO: 5221123 - DNA, 16 bp, Homo sapiens
agtcctcacatgcccg

SEQ ID NO: 5221124 - DNA, 17 bp, Homo sapiens
agtcctcactcccagtc

SEQ ID NO: 5221125 - DNA, 14 bp, Homo sapiens
agtcctcactgtcc

SEQ ID NO: 5221126 - DNA, 15 bp, Homo sapiens
agtcctcactgtcct

SEQ ID NO: 5221127 - DNA, 17 bp, Homo sapiens
agtcctcagagctccat

SEQ ID NO: 5221128 - DNA, 14 bp, Homo sapiens
agtcctcaggaagg

SEQ ID NO: 5221129 - DNA, 14 bp, Homo sapiens
agtcctcaggcagc

SEQ ID NO: 5221130 - DNA, 20 bp, Homo sapiens
agtcctcaggtacagcgggc

SEQ ID NO: 5221131 - DNA, 17 bp, Homo sapiens
agtcctcataaaaagca

SEQ ID NO: 5221132 - DNA, 20 bp, Homo sapiens
agtcctcattgaatcctcat

SEQ ID NO: 5221133 - DNA, 18 bp, Homo sapiens
agtcctcattgttcagaa

SEQ ID NO: 5221134 - DNA, 17 bp, Homo sapiens
agtcctccaaaacacaa

SEQ ID NO: 5221135 - DNA, 19 bp, Homo sapiens
agtcctccagaactcttcc

SEQ ID NO: 5221136 - DNA, 20 bp, Homo sapiens
agtcctccagaactcttcct

SEQ ID NO: 5221137 - DNA, 18 bp, Homo sapiens
agtcctccagcctcggcc

SEQ ID NO: 5221138 - DNA, 14 bp, Homo sapiens
agtcctccatccac

SEQ ID NO: 5221139 - DNA, 18 bp, Homo sapiens
agtcctcccaagctgtgc

SEQ ID NO: 5221140 - DNA, 19 bp, Homo sapiens
agtcctcccaagctgtgct

SEQ ID NO: 5221141 - DNA, 16 bp, Homo sapiens
agtcctcccatctcac

SEQ ID NO: 5221142 - DNA, 13 bp, Homo sapiens
agtcctcccctca

SEQ ID NO: 5221143 - DNA, 16 bp, Homo sapiens
agtcctcccctcacag

SEQ ID NO: 5221144 - DNA, 18 bp, Homo sapiens
agtcctcccctcacagcc

SEQ ID NO: 5221145 - DNA, 12 bp, Homo sapiens
agtcctccctag

SEQ ID NO: 5221146 - DNA, 20 bp, Homo sapiens
agtcctccctagctcttccc

SEQ ID NO: 5221147 - DNA, 18 bp, Homo sapiens
agtcctccctcctgcagg

SEQ ID NO: 5221148 - DNA, 17 bp, Homo sapiens
agtcctccctgactttt

SEQ ID NO: 5221149 - DNA, 19 bp, Homo sapiens
agtcctccctgacttttct

SEQ ID NO: 5221150 - DNA, 16 bp, Homo sapiens
agtcctcctagaactc

SEQ ID NO: 5221151 - DNA, 13 bp, Homo sapiens
agtcctcctattc

SEQ ID NO: 5221152 - DNA, 14 bp, Homo sapiens
agtcctccttccca

SEQ ID NO: 5221153 - DNA, 22 bp, Homo sapiens
agtcctctcttctctattcctg

SEQ ID NO: 5221154 - DNA, 14 bp, Homo sapiens
agtcctctgaatga

SEQ ID NO: 5221155 - DNA, 13 bp, Homo sapiens
agtcctctgcctc

SEQ ID NO: 5221156 - DNA, 13 bp, Homo sapiens
agtcctctgctcc

SEQ ID NO: 5221157 - DNA, 14 bp, Homo sapiens
agtcctctgctcca

SEQ ID NO: 5221158 - DNA, 16 bp, Homo sapiens
agtcctcttattccta

SEQ ID NO: 5221159 - DNA, 14 bp, Homo sapiens
agtcctcttttctg

SEQ ID NO: 5221160 - DNA, 19 bp, Homo sapiens
agtcctcttttctgagagg

SEQ ID NO: 5221161 - DNA, 21 bp, Homo sapiens
agtcctgaacctttcaaaatg

SEQ ID NO: 5221162 - DNA, 19 bp, Homo sapiens
agtcctgaagaggcgggcc

SEQ ID NO: 5221163 - DNA, 21 bp, Homo sapiens
agtcctgaagaggcgggccag

SEQ ID NO: 5221164 - DNA, 23 bp, Homo sapiens
agtcctgaagaggcgggccagcc

SEQ ID NO: 5221165 - DNA, 18 bp, Homo sapiens
agtcctgactgggctggg

SEQ ID NO: 5221166 - DNA, 19 bp, Homo sapiens
agtcctgactgggctgggt

SEQ ID NO: 5221167 - DNA, 14 bp, Homo sapiens
agtcctgaggcaga

SEQ ID NO: 5221168 - DNA, 19 bp, Homo sapiens
agtcctgagtgggtgttgc

SEQ ID NO: 5221169 - DNA, 21 bp, Homo sapiens
agtcctgatcctaaccctggg

SEQ ID NO: 5221170 - DNA, 17 bp, Homo sapiens
agtcctgcaaccaaact

SEQ ID NO: 5221171 - DNA, 23 bp, Homo sapiens
agtcctgcacagttttctggctg

SEQ ID NO: 5221172 - DNA, 17 bp, Homo sapiens
agtcctgcagaggattt

SEQ ID NO: 5221173 - DNA, 19 bp, Homo sapiens
agtcctgcaggagtgctgg

SEQ ID NO: 5221174 - DNA, 22 bp, Homo sapiens
agtcctgccaccaccctgtctt

SEQ ID NO: 5221175 - DNA, 23 bp, Homo sapiens
agtcctgccaccaccctgtcttc

SEQ ID NO: 5221176 - DNA, 16 bp, Homo sapiens
agtcctgcctcagcct

SEQ ID NO: 5221177 - DNA, 15 bp, Homo sapiens
agtcctgcctgaaca

SEQ ID NO: 5221178 - DNA, 16 bp, Homo sapiens
agtcctgcctggccag

SEQ ID NO: 5221179 - DNA, 24 bp, Homo sapiens
agtcctgctacctcccttgccttt

SEQ ID NO: 5221180 - DNA, 13 bp, Homo sapiens
agtcctgctccag

SEQ ID NO: 5221181 - DNA, 12 bp, Homo sapiens
agtcctgctggc

SEQ ID NO: 5221182 - DNA, 13 bp, Homo sapiens
agtcctgctttcc

SEQ ID NO: 5221183 - DNA, 23 bp, Homo sapiens
agtcctggaagccagctttccct

SEQ ID NO: 5221184 - DNA, 23 bp, Homo sapiens
agtcctggactcctgccaccagc

SEQ ID NO: 5221185 - DNA, 21 bp, Homo sapiens
agtcctggagcaatcacagat

SEQ ID NO: 5221186 - DNA, 22 bp, Homo sapiens
agtcctggagcaatcacagatg

SEQ ID NO: 5221187 - DNA, 11 bp, Homo sapiens
agtcctggagg

SEQ ID NO: 5221188 - DNA, 17 bp, Homo sapiens
agtcctggatgatacta

SEQ ID NO: 5221189 - DNA, 18 bp, Homo sapiens
agtcctggatgttgtgtg

SEQ ID NO: 5221190 - DNA, 17 bp, Homo sapiens
agtcctggcacagtttt

SEQ ID NO: 5221191 - DNA, 22 bp, Homo sapiens
agtcctggcagctggaccatct

SEQ ID NO: 5221192 - DNA, 21 bp, Homo sapiens
agtcctggcatgggaatgaat

SEQ ID NO: 5221193 - DNA, 20 bp, Homo sapiens
agtcctggcctggcttctcc

SEQ ID NO: 5221194 - DNA, 21 bp, Homo sapiens
agtcctgggagaacctcaggc

SEQ ID NO: 5221195 - DNA, 22 bp, Homo sapiens
agtcctgggggtaaagccctca

SEQ ID NO: 5221196 - DNA, 23 bp, Homo sapiens
agtcctgggtaaatgtggtgaga

SEQ ID NO: 5221197 - DNA, 15 bp, Homo sapiens
agtcctggtccctct

SEQ ID NO: 5221198 - DNA, 16 bp, Homo sapiens
agtcctggtccctctg

SEQ ID NO: 5221199 - DNA, 17 bp, Homo sapiens
agtcctggtcctggctg

SEQ ID NO: 5221200 - DNA, 19 bp, Homo sapiens
agtcctggtcctggctgca

SEQ ID NO: 5221201 - DNA, 20 bp, Homo sapiens
agtcctggtctgctcaggaa

SEQ ID NO: 5221202 - DNA, 16 bp, Homo sapiens
agtcctggttgtctga

SEQ ID NO: 5221203 - DNA, 17 bp, Homo sapiens
agtcctggttgtctgaa

SEQ ID NO: 5221204 - DNA, 20 bp, Homo sapiens
agtcctggtttcctcagcct

SEQ ID NO: 5221205 - DNA, 15 bp, Homo sapiens
agtcctggtttcctg

SEQ ID NO: 5221206 - DNA, 17 bp, Homo sapiens
agtcctggtttcctggc

SEQ ID NO: 5221207 - DNA, 22 bp, Homo sapiens
agggtggagagttgggggccag

SEQ ID NO: 5221208 - DNA, 13 bp, Homo sapiens
agggtggagtcag

SEQ ID NO: 5221209 - DNA, 16 bp, Homo sapiens
agggtggatgctctca

SEQ ID NO: 5221210 - DNA, 16 bp, Homo sapiens
agggtggatgtgctgg

SEQ ID NO: 5221211 - DNA, 17 bp, Homo sapiens
agggtggatgtgctgga

SEQ ID NO: 5221212 - DNA, 21 bp, Homo sapiens
agggtggatgtgctggagggg

SEQ ID NO: 5221213 - DNA, 13 bp, Homo sapiens
agggtggcaccca

SEQ ID NO: 5221214 - DNA, 15 bp, Homo sapiens
agggtggcactggga

SEQ ID NO: 5221215 - DNA, 13 bp, Homo sapiens
agggtggcagcaa

SEQ ID NO: 5221216 - DNA, 11 bp, Homo sapiens
agggtggcagg

SEQ ID NO: 5221217 - DNA, 17 bp, Homo sapiens
agggtggcaggtcactg

SEQ ID NO: 5221218 - DNA, 20 bp, Homo sapiens
agggtggcaggtcactgtca

SEQ ID NO: 5221219 - DNA, 12 bp, Homo sapiens
agggtggcatca

SEQ ID NO: 5221220 - DNA, 15 bp, Homo sapiens
agggtggcatcccag

SEQ ID NO: 5221221 - DNA, 20 bp, Homo sapiens
agggtggccacacaggcagg

SEQ ID NO: 5221222 - DNA, 23 bp, Homo sapiens
agggtggccacacaggcagggcc

SEQ ID NO: 5221223 - DNA, 19 bp, Homo sapiens
agggtggccccctgtgcca

SEQ ID NO: 5221224 - DNA, 21 bp, Homo sapiens
agggtggccccctgtgccagc

SEQ ID NO: 5221225 - DNA, 24 bp, Homo sapiens
agggtggccccctgtgccagctca

SEQ ID NO: 5221226 - DNA, 18 bp, Homo sapiens
agggtggcccttgcagtt

SEQ ID NO: 5221227 - DNA, 17 bp, Homo sapiens
agggtggcctcaagaaa

SEQ ID NO: 5221228 - DNA, 18 bp, Homo sapiens
agggtggcctgttcccta

SEQ ID NO: 5221229 - DNA, 20 bp, Homo sapiens
agggtggcctgttccctaga

SEQ ID NO: 5221230 - DNA, 23 bp, Homo sapiens
agggtggcctgttccctagagag

SEQ ID NO: 5221231 - DNA, 14 bp, Homo sapiens
agggtggcgccctg

SEQ ID NO: 5221232 - DNA, 21 bp, Homo sapiens
agggtggctgggtccagggga

SEQ ID NO: 5221233 - DNA, 19 bp, Homo sapiens
agggtggctttgcatttct

SEQ ID NO: 5221234 - DNA, 12 bp, Homo sapiens
agggtgggaaga

SEQ ID NO: 5221235 - DNA, 17 bp, Homo sapiens
agggtgggaagaaagaa

SEQ ID NO: 5221236 - DNA, 17 bp, Homo sapiens
agggtgggaaggggcta

SEQ ID NO: 5221237 - DNA, 18 bp, Homo sapiens
agggtgggaaggggctag

SEQ ID NO: 5221238 - DNA, 19 bp, Homo sapiens
agggtgggagagcccagcc

SEQ ID NO: 5221239 - DNA, 20 bp, Homo sapiens
agggtgggagtggggccttt

SEQ ID NO: 5221240 - DNA, 18 bp, Homo sapiens
agggtgggatggaggaga

SEQ ID NO: 5221241 - DNA, 16 bp, Homo sapiens
agggtgggcaaactct

SEQ ID NO: 5221242 - DNA, 23 bp, Homo sapiens
agggtgggccactctcccctccc

SEQ ID NO: 5221243 - DNA, 14 bp, Homo sapiens
agggtgggccagca

SEQ ID NO: 5221244 - DNA, 18 bp, Homo sapiens
agggtgggccctggaggg

SEQ ID NO: 5221245 - DNA, 20 bp, Homo sapiens
agggtgggccctggaggggc

SEQ ID NO: 5221246 - DNA, 22 bp, Homo sapiens
agggtgggctggggactctggc

SEQ ID NO: 5221247 - DNA, 17 bp, Homo sapiens
agggtgggcttcctgcc

SEQ ID NO: 5221248 - DNA, 19 bp, Homo sapiens
agggtgggcttcctgccct

SEQ ID NO: 5221249 - DNA, 23 bp, Homo sapiens
agggtgggcttgtggggcctggg

SEQ ID NO: 5221250 - DNA, 23 bp, Homo sapiens
agggtggggcaatggggagaggc

SEQ ID NO: 5221251 - DNA, 15 bp, Homo sapiens
agggtggggcttaga

SEQ ID NO: 5221252 - DNA, 15 bp, Homo sapiens
agggtgggggaggga

SEQ ID NO: 5221253 - DNA, 17 bp, Homo sapiens
agggtgggggagggagg

SEQ ID NO: 5221254 - DNA, 22 bp, Homo sapiens
agggtgggggccacctgcctgc

SEQ ID NO: 5221255 - DNA, 22 bp, Homo sapiens
agggtgggggggaccgggcccc

SEQ ID NO: 5221256 - DNA, 18 bp, Homo sapiens
agggtgggggtgctctct

SEQ ID NO: 5221257 - DNA, 17 bp, Homo sapiens
agggtggggtctgggag

SEQ ID NO: 5221258 - DNA, 20 bp, Homo sapiens
agggtggggtgccccagcta

SEQ ID NO: 5221259 - DNA, 22 bp, Homo sapiens
agggtgggtgagctctcaggcc

SEQ ID NO: 5221260 - DNA, 16 bp, Homo sapiens
agggtgggtgctcaga

SEQ ID NO: 5221261 - DNA, 18 bp, Homo sapiens
agggtgggtgctcagaat

SEQ ID NO: 5221262 - DNA, 17 bp, Homo sapiens
agggtggtaaatatttt

SEQ ID NO: 5221263 - DNA, 20 bp, Homo sapiens
agggtggtcttcaagcctgg

SEQ ID NO: 5221264 - DNA, 21 bp, Homo sapiens
agggtggtcttcaagcctggc

SEQ ID NO: 5221265 - DNA, 22 bp, Homo sapiens
agggtggtcttcaagcctggcc

SEQ ID NO: 5221266 - DNA, 14 bp, Homo sapiens
agggtggtgctggg

SEQ ID NO: 5221267 - DNA, 23 bp, Homo sapiens
agggtggtgctgggactgagcca

SEQ ID NO: 5221268 - DNA, 17 bp, Homo sapiens
agggtggtggagccagt

SEQ ID NO: 5221269 - DNA, 12 bp, Homo sapiens
agggtggtggta

SEQ ID NO: 5221270 - DNA, 19 bp, Homo sapiens
agggtggtggtattctgtc

SEQ ID NO: 5221271 - DNA, 16 bp, Homo sapiens
agggtggttcctgttc

SEQ ID NO: 5221272 - DNA, 20 bp, Homo sapiens
agggtggtttacctgcaccg

SEQ ID NO: 5221273 - DNA, 14 bp, Homo sapiens
agggtgtaggggcc

SEQ ID NO: 5221274 - DNA, 14 bp, Homo sapiens
agggtgtcctgagg

SEQ ID NO: 5221275 - DNA, 14 bp, Homo sapiens
agggtgtctgggga

SEQ ID NO: 5221276 - DNA, 14 bp, Homo sapiens
agggtgtgaggcca

SEQ ID NO: 5221277 - DNA, 15 bp, Homo sapiens
agggtgtgaggccac

SEQ ID NO: 5221278 - DNA, 18 bp, Homo sapiens
agggtgtggcatttggaa

SEQ ID NO: 5221279 - DNA, 14 bp, Homo sapiens
agggtgtggcttgg

SEQ ID NO: 5221280 - DNA, 15 bp, Homo sapiens
agggtgtggctttcc

SEQ ID NO: 5221281 - DNA, 21 bp, Homo sapiens
agggtgtggctttccaggcac

SEQ ID NO: 5221282 - DNA, 23 bp, Homo sapiens
agggtgtggctttccaggcaccc

SEQ ID NO: 5221283 - DNA, 19 bp, Homo sapiens
agggtgtgggtgccctgtt

SEQ ID NO: 5221284 - DNA, 18 bp, Homo sapiens
agggtgtggtatgagggg

SEQ ID NO: 5221285 - DNA, 12 bp, Homo sapiens
agggtgtgtgct

SEQ ID NO: 5221286 - DNA, 14 bp, Homo sapiens
agggtgtgtgttca

SEQ ID NO: 5221287 - DNA, 16 bp, Homo sapiens
agggtgttaaactttt

SEQ ID NO: 5221288 - DNA, 16 bp, Homo sapiens
agggtgttctggcttt

SEQ ID NO: 5221289 - DNA, 21 bp, Homo sapiens
agggtgttgggatactgcagg

SEQ ID NO: 5221290 - DNA, 19 bp, Homo sapiens
agggtgttttgggtggcat

SEQ ID NO: 5221291 - DNA, 15 bp, Homo sapiens
agggttaaagaaagg

SEQ ID NO: 5221292 - DNA, 21 bp, Homo sapiens
agggttaaagaaaggcagaga

SEQ ID NO: 5221293 - DNA, 13 bp, Homo sapiens
agggttaagaaaa

SEQ ID NO: 5221294 - DNA, 16 bp, Homo sapiens
agggttaaggcctgaa

SEQ ID NO: 5221295 - DNA, 19 bp, Homo sapiens
agggttaatcatatttgaa

SEQ ID NO: 5221296 - DNA, 13 bp, Homo sapiens
agggttagggagg

SEQ ID NO: 5221297 - DNA, 13 bp, Homo sapiens
agggttataataa

SEQ ID NO: 5221298 - DNA, 18 bp, Homo sapiens
agggttattgcatttgga

SEQ ID NO: 5221299 - DNA, 20 bp, Homo sapiens
agggttatttagtaaagttt

SEQ ID NO: 5221300 - DNA, 14 bp, Homo sapiens
agggttcaaaatgt

SEQ ID NO: 5221301 - DNA, 22 bp, Homo sapiens
agggttcaaattcctgcaaaat

SEQ ID NO: 5221302 - DNA, 16 bp, Homo sapiens
agggttcacacagccc

SEQ ID NO: 5221303 - DNA, 19 bp, Homo sapiens
agggttcacataggctctc

SEQ ID NO: 5221304 - DNA, 18 bp, Homo sapiens
agggttcagagactcagg

SEQ ID NO: 5221305 - DNA, 15 bp, Homo sapiens
agggttccagacagg

SEQ ID NO: 5221306 - DNA, 17 bp, Homo sapiens
agggttcccccagccct

SEQ ID NO: 5221307 - DNA, 19 bp, Homo sapiens
agggttcccccagccctgt

SEQ ID NO: 5221308 - DNA, 23 bp, Homo sapiens
agggttcctgtagacctagggag

SEQ ID NO: 5221309 - DNA, 15 bp, Homo sapiens
agggttctaaatgca

SEQ ID NO: 5221310 - DNA, 16 bp, Homo sapiens
agggttctaacctttc

SEQ ID NO: 5221311 - DNA, 19 bp, Homo sapiens
agggttctaacctttctaa

SEQ ID NO: 5221312 - DNA, 14 bp, Homo sapiens
agggttctagaagg

SEQ ID NO: 5221313 - DNA, 15 bp, Homo sapiens
agggttctgccctgc

SEQ ID NO: 5221314 - DNA, 21 bp, Homo sapiens
agggttctgccctgcctgagg

SEQ ID NO: 5221315 - DNA, 22 bp, Homo sapiens
agggttctgccctgcctgagga

SEQ ID NO: 5221316 - DNA, 23 bp, Homo sapiens
agggttctgccctgcctgaggag

SEQ ID NO: 5221317 - DNA, 14 bp, Homo sapiens
agggttctgcctct

SEQ ID NO: 5221318 - DNA, 19 bp, Homo sapiens
agggttctgcctctccagg

SEQ ID NO: 5221319 - DNA, 14 bp, Homo sapiens
agggttgagagcca

SEQ ID NO: 5221320 - DNA, 21 bp, Homo sapiens
agggttgagttacttcctatc

SEQ ID NO: 5221321 - DNA, 14 bp, Homo sapiens
agggttgatcacac

SEQ ID NO: 5221322 - DNA, 15 bp, Homo sapiens
agggttgctggagcc

SEQ ID NO: 5221323 - DNA, 15 bp, Homo sapiens
agggttgcttcaatg

SEQ ID NO: 5221324 - DNA, 17 bp, Homo sapiens
agggttgcttctgagtg

SEQ ID NO: 5221325 - DNA, 20 bp, Homo sapiens
agggttggcacctgcacact

SEQ ID NO: 5221326 - DNA, 13 bp, Homo sapiens
agggttgggctgg

SEQ ID NO: 5221327 - DNA, 20 bp, Homo sapiens
agggttggtgggctggccca

SEQ ID NO: 5221328 - DNA, 21 bp, Homo sapiens
agggttgtactattgtttaaa

SEQ ID NO: 5221329 - DNA, 14 bp, Homo sapiens
agggttgtgatttt

SEQ ID NO: 5221330 - DNA, 12 bp, Homo sapiens
agggttgtgctt

SEQ ID NO: 5221331 - DNA, 21 bp, Homo sapiens
agggtttaatccccagtaaaa

SEQ ID NO: 5221332 - DNA, 21 bp, Homo sapiens
agggtttacatgaagcagaac

SEQ ID NO: 5221333 - DNA, 14 bp, Homo sapiens
agggtttagtgctt

SEQ ID NO: 5221334 - DNA, 17 bp, Homo sapiens
agggtttccaccttggc

SEQ ID NO: 5221335 - DNA, 15 bp, Homo sapiens
agggtttcgactggt

SEQ ID NO: 5221336 - DNA, 17 bp, Homo sapiens
agggtttcgactggtcc

SEQ ID NO: 5221337 - DNA, 18 bp, Homo sapiens
agggtttcgactggtcca

SEQ ID NO: 5221338 - DNA, 23 bp, Homo sapiens
agggtttcgactggtccagctct

SEQ ID NO: 5221339 - DNA, 14 bp, Homo sapiens
agggtttctctatt

SEQ ID NO: 5221340 - DNA, 13 bp, Homo sapiens
agggtttctctcc

SEQ ID NO: 5221341 - DNA, 12 bp, Homo sapiens
agggtttctctg

SEQ ID NO: 5221342 - DNA, 17 bp, Homo sapiens
agggtttctgagctgct

SEQ ID NO: 5221343 - DNA, 18 bp, Homo sapiens
agggtttctgagctgctc

SEQ ID NO: 5221344 - DNA, 22 bp, Homo sapiens
agggtttgaattgttttcttta

SEQ ID NO: 5221345 - DNA, 12 bp, Homo sapiens
agggtttgacat

SEQ ID NO: 5221346 - DNA, 19 bp, Homo sapiens
agggtttgaggattcctga

SEQ ID NO: 5221347 - DNA, 15 bp, Homo sapiens
agggtttgcactcca

SEQ ID NO: 5221348 - DNA, 16 bp, Homo sapiens
agggtttgcagagtgg

SEQ ID NO: 5221349 - DNA, 15 bp, Homo sapiens
agggtttggcccaag

SEQ ID NO: 5221350 - DNA, 20 bp, Homo sapiens
agggtttggctgtgtctaaa

SEQ ID NO: 5221351 - DNA, 23 bp, Homo sapiens
agggtttggttagctcacaggac

SEQ ID NO: 5221352 - DNA, 18 bp, Homo sapiens
agggtttgtaatacttta

SEQ ID NO: 5221353 - DNA, 20 bp, Homo sapiens
agggtttgtcagaggaacaa

SEQ ID NO: 5221354 - DNA, 18 bp, Homo sapiens
agggtttgtgacagggcg

SEQ ID NO: 5221355 - DNA, 16 bp, Homo sapiens
agggttttaatgtaga

SEQ ID NO: 5221356 - DNA, 17 bp, Homo sapiens
agggttttatctctgtc

SEQ ID NO: 5221357 - DNA, 13 bp, Homo sapiens
agggttttccagg

SEQ ID NO: 5221358 - DNA, 15 bp, Homo sapiens
agggttttctcataa

SEQ ID NO: 5221359 - DNA, 13 bp, Homo sapiens
agggttttctttt

SEQ ID NO: 5221360 - DNA, 13 bp, Homo sapiens
agggttttgcccc

SEQ ID NO: 5221361 - DNA, 18 bp, Homo sapiens
agggttttttagaaaacc

SEQ ID NO: 5221362 - DNA, 15 bp, Homo sapiens
aggtaaaaaaaagaa

SEQ ID NO: 5221363 - DNA, 16 bp, Homo sapiens
aggtaaaaatataaga

SEQ ID NO: 5221364 - DNA, 13 bp, Homo sapiens
aggtaaaacaaaa

SEQ ID NO: 5221365 - DNA, 14 bp, Homo sapiens
aggtaaaagagcca

SEQ ID NO: 5221366 - DNA, 17 bp, Homo sapiens
aggtaaaatattttcca

SEQ ID NO: 5221367 - DNA, 16 bp, Homo sapiens
aggtaaaatcacttca

SEQ ID NO: 5221368 - DNA, 21 bp, Homo sapiens
aggtaaaatcacttcagatct

SEQ ID NO: 5221369 - DNA, 14 bp, Homo sapiens
aggtaaaatgccat

SEQ ID NO: 5221370 - DNA, 15 bp, Homo sapiens
aggtaaaatgccatg

SEQ ID NO: 5221371 - DNA, 15 bp, Homo sapiens
aggtaaaatgtagct

SEQ ID NO: 5221372 - DNA, 19 bp, Homo sapiens
aggtaaaatgtatttttct

SEQ ID NO: 5221373 - DNA, 14 bp, Homo sapiens
aggtaaaattctaa

SEQ ID NO: 5221374 - DNA, 15 bp, Homo sapiens
aggtaaaattctaaa

SEQ ID NO: 5221375 - DNA, 19 bp, Homo sapiens
aggtaaaattctaaataaa

SEQ ID NO: 5221376 - DNA, 19 bp, Homo sapiens
aggtaaaattgaaaggcat

SEQ ID NO: 5221377 - DNA, 17 bp, Homo sapiens
aggtaaacacataaatg

SEQ ID NO: 5221378 - DNA, 19 bp, Homo sapiens
aggtaaacacataaatgaa

SEQ ID NO: 5221379 - DNA, 20 bp, Homo sapiens
aggtaaacacataaatgaaa

SEQ ID NO: 5221380 - DNA, 20 bp, Homo sapiens
aggtaaataaaaagaaaggc

SEQ ID NO: 5221381 - DNA, 14 bp, Homo sapiens
aggtaaataaagct

SEQ ID NO: 5221382 - DNA, 15 bp, Homo sapiens
aggtaaataaagctc

SEQ ID NO: 5221383 - DNA, 16 bp, Homo sapiens
aggtaaatacaatggt

SEQ ID NO: 5221384 - DNA, 18 bp, Homo sapiens
aggtaaatcagactatga

SEQ ID NO: 5221385 - DNA, 16 bp, Homo sapiens
aggtaaatcccacatc

SEQ ID NO: 5221386 - DNA, 17 bp, Homo sapiens
agtcctgtatgtctgtc

SEQ ID NO: 5221387 - DNA, 16 bp, Homo sapiens
agtcctgtctctgcct

SEQ ID NO: 5221388 - DNA, 13 bp, Homo sapiens
agtcctgtgaatg

SEQ ID NO: 5221389 - DNA, 20 bp, Homo sapiens
agtcctgtgaatgccactgc

SEQ ID NO: 5221390 - DNA, 22 bp, Homo sapiens
agtcctgtgaatgccactgcct

SEQ ID NO: 5221391 - DNA, 16 bp, Homo sapiens
agtcctgtgaatttct

SEQ ID NO: 5221392 - DNA, 22 bp, Homo sapiens
agtcctgtgcggtgtcaccatg

SEQ ID NO: 5221393 - DNA, 12 bp, Homo sapiens
agtcctgttctc

SEQ ID NO: 5221394 - DNA, 14 bp, Homo sapiens
agtcctgttctcag

SEQ ID NO: 5221395 - DNA, 19 bp, Homo sapiens
agtcctgttctcagagctc

SEQ ID NO: 5221396 - DNA, 21 bp, Homo sapiens
agtcctgttctcagagctcca

SEQ ID NO: 5221397 - DNA, 16 bp, Homo sapiens
agtcctgttgaagact

SEQ ID NO: 5221398 - DNA, 14 bp, Homo sapiens
agtccttaaaaatc

SEQ ID NO: 5221399 - DNA, 18 bp, Homo sapiens
agtccttaaacagggcat

SEQ ID NO: 5221400 - DNA, 21 bp, Homo sapiens
agtccttaatgtcaccatgct

SEQ ID NO: 5221401 - DNA, 19 bp, Homo sapiens
agtccttaccagcagagca

SEQ ID NO: 5221402 - DNA, 13 bp, Homo sapiens
agtccttacctcg

SEQ ID NO: 5221403 - DNA, 15 bp, Homo sapiens
agtccttacctcttc

SEQ ID NO: 5221404 - DNA, 21 bp, Homo sapiens
agtccttacctcttccggaga

SEQ ID NO: 5221405 - DNA, 23 bp, Homo sapiens
agtccttacctcttccggagatg

SEQ ID NO: 5221406 - DNA, 14 bp, Homo sapiens
agtccttagaatga

SEQ ID NO: 5221407 - DNA, 17 bp, Homo sapiens
agtccttagaatgaggg

SEQ ID NO: 5221408 - DNA, 15 bp, Homo sapiens
agtccttagcctggg

SEQ ID NO: 5221409 - DNA, 17 bp, Homo sapiens
agtccttagcctgggcc

SEQ ID NO: 5221410 - DNA, 14 bp, Homo sapiens
agtccttaggctac

SEQ ID NO: 5221411 - DNA, 16 bp, Homo sapiens
agtccttatctagctg

SEQ ID NO: 5221412 - DNA, 18 bp, Homo sapiens
agtccttatctagctgca

SEQ ID NO: 5221413 - DNA, 15 bp, Homo sapiens
agtccttattcttct

SEQ ID NO: 5221414 - DNA, 20 bp, Homo sapiens
agtccttcaagattccattt

SEQ ID NO: 5221415 - DNA, 16 bp, Homo sapiens
agtccttcacctcact

SEQ ID NO: 5221416 - DNA, 13 bp, Homo sapiens
agtccttcagtga

SEQ ID NO: 5221417 - DNA, 15 bp, Homo sapiens
agtccttccacctgc

SEQ ID NO: 5221418 - DNA, 17 bp, Homo sapiens
agtccttgaaaatattt

SEQ ID NO: 5221419 - DNA, 15 bp, Homo sapiens
agtccttgaacccag

SEQ ID NO: 5221420 - DNA, 15 bp, Homo sapiens
agtccttgcaagaat

SEQ ID NO: 5221421 - DNA, 18 bp, Homo sapiens
agtccttgcttggctgct

SEQ ID NO: 5221422 - DNA, 16 bp, Homo sapiens
agtccttggtctgctg

SEQ ID NO: 5221423 - DNA, 21 bp, Homo sapiens
agtccttggtctgctggtgtc

SEQ ID NO: 5221424 - DNA, 20 bp, Homo sapiens
agtcctttataagttgcttt

SEQ ID NO: 5221425 - DNA, 17 bp, Homo sapiens
agtcctttatgtggaaa

SEQ ID NO: 5221426 - DNA, 20 bp, Homo sapiens
agtcctttctgtgaagctaa

SEQ ID NO: 5221427 - DNA, 18 bp, Homo sapiens
agtcctttgattccattt

SEQ ID NO: 5221428 - DNA, 19 bp, Homo sapiens
agtcctttgtctttctttg

SEQ ID NO: 5221429 - DNA, 21 bp, Homo sapiens
agtcctttgtctttctttgtc

SEQ ID NO: 5221430 - DNA, 22 bp, Homo sapiens
agtcctttgtgaatattttcaa

SEQ ID NO: 5221431 - DNA, 16 bp, Homo sapiens
agtcctttgttataat

SEQ ID NO: 5221432 - DNA, 18 bp, Homo sapiens
agtcctttgttataattt

SEQ ID NO: 5221433 - DNA, 15 bp, Homo sapiens
agtcctttgttgctg

SEQ ID NO: 5221434 - DNA, 20 bp, Homo sapiens
agtccttttactacagctat

SEQ ID NO: 5221435 - DNA, 18 bp, Homo sapiens
agtccttttatctccttg

SEQ ID NO: 5221436 - DNA, 12 bp, Homo sapiens
agtccttttgta

SEQ ID NO: 5221437 - DNA, 22 bp, Homo sapiens
agtccttttgtaaagtgaagaa

SEQ ID NO: 5221438 - DNA, 23 bp, Homo sapiens
agtccttttgtaaagtgaagaat

SEQ ID NO: 5221439 - DNA, 13 bp, Homo sapiens
agtcctttttcca

SEQ ID NO: 5221440 - DNA, 15 bp, Homo sapiens
agtcctttttccaat

SEQ ID NO: 5221441 - DNA, 17 bp, Homo sapiens
agtcctttttgtaacta

SEQ ID NO: 5221442 - DNA, 13 bp, Homo sapiens
agtcgaaggatgc

SEQ ID NO: 5221443 - DNA, 18 bp, Homo sapiens
agtcgaaggatgctcttt

SEQ ID NO: 5221444 - DNA, 17 bp, Homo sapiens
agtcgaccgcacttatg

SEQ ID NO: 5221445 - DNA, 23 bp, Homo sapiens
agtcgaccgcacttatggtaatc

SEQ ID NO: 5221446 - DNA, 23 bp, Homo sapiens
agtcgaggctgcagtcagccctg

SEQ ID NO: 5221447 - DNA, 22 bp, Homo sapiens
agtcgaggctggtaagggacct

SEQ ID NO: 5221448 - DNA, 19 bp, Homo sapiens
agtcgatagagctgtatta

SEQ ID NO: 5221449 - DNA, 16 bp, Homo sapiens
agtcgatattcccagg

SEQ ID NO: 5221450 - DNA, 19 bp, Homo sapiens
agtcgcatctcagtgcagg

SEQ ID NO: 5221451 - DNA, 18 bp, Homo sapiens
agtcgccctctgtgccta

SEQ ID NO: 5221452 - DNA, 19 bp, Homo sapiens
agtcgccctctgtgcctaa

SEQ ID NO: 5221453 - DNA, 15 bp, Homo sapiens
agtcgcctgcctgca

SEQ ID NO: 5221454 - DNA, 13 bp, Homo sapiens
agtcgctgaacaa

SEQ ID NO: 5221455 - DNA, 16 bp, Homo sapiens
agtcgctgaggaaaaa

SEQ ID NO: 5221456 - DNA, 24 bp, Homo sapiens
agtcgctggcatgtttcactcctg

SEQ ID NO: 5221457 - DNA, 22 bp, Homo sapiens
agtcgcttttggtgcctggctg

SEQ ID NO: 5221458 - DNA, 20 bp, Homo sapiens
agtcggatctagccatggct

SEQ ID NO: 5221459 - DNA, 16 bp, Homo sapiens
agtcggcatgccagga

SEQ ID NO: 5221460 - DNA, 17 bp, Homo sapiens
agtcggctgggcagggc

SEQ ID NO: 5221461 - DNA, 18 bp, Homo sapiens
agtcggctgggcagggcc

SEQ ID NO: 5221462 - DNA, 16 bp, Homo sapiens
agtcgggaggagcagc

SEQ ID NO: 5221463 - DNA, 12 bp, Homo sapiens
agtcgggcatga

SEQ ID NO: 5221464 - DNA, 13 bp, Homo sapiens
agtcggggcaggc

SEQ ID NO: 5221465 - DNA, 16 bp, Homo sapiens
agtcgggggaaaaaat

SEQ ID NO: 5221466 - DNA, 15 bp, Homo sapiens
agtcgggggctggcc

SEQ ID NO: 5221467 - DNA, 17 bp, Homo sapiens
agtcgggggctggccta

SEQ ID NO: 5221468 - DNA, 15 bp, Homo sapiens
agtcgggtgccagga

SEQ ID NO: 5221469 - DNA, 13 bp, Homo sapiens
agtcggtcaccaa

SEQ ID NO: 5221470 - DNA, 14 bp, Homo sapiens
agtcggtctgcttt

SEQ ID NO: 5221471 - DNA, 16 bp, Homo sapiens
agtcgtaaaagagata

SEQ ID NO: 5221472 - DNA, 17 bp, Homo sapiens
agtcgtccgctcagcca

SEQ ID NO: 5221473 - DNA, 20 bp, Homo sapiens
agtcgtccttactcctgtgg

SEQ ID NO: 5221474 - DNA, 22 bp, Homo sapiens
agtcgtccttactcctgtggga

SEQ ID NO: 5221475 - DNA, 16 bp, Homo sapiens
agtcgtcgcacagtct

SEQ ID NO: 5221476 - DNA, 12 bp, Homo sapiens
agtcgtgcctgt

SEQ ID NO: 5221477 - DNA, 15 bp, Homo sapiens
agtcgtgcctgtgtc

SEQ ID NO: 5221478 - DNA, 18 bp, Homo sapiens
agtcgtggagatgtcttc

SEQ ID NO: 5221479 - DNA, 14 bp, Homo sapiens
agtcgtggggaacg

SEQ ID NO: 5221480 - DNA, 15 bp, Homo sapiens
agtcgttatatttga

SEQ ID NO: 5221481 - DNA, 12 bp, Homo sapiens
agtcgttatttc

SEQ ID NO: 5221482 - DNA, 16 bp, Homo sapiens
agtcgttgatgctaat

SEQ ID NO: 5221483 - DNA, 17 bp, Homo sapiens
agtcgttggagactgaa

SEQ ID NO: 5221484 - DNA, 18 bp, Homo sapiens
agtcgttggagactgaag

SEQ ID NO: 5221485 - DNA, 16 bp, Homo sapiens
agtcgttttagtgtct

SEQ ID NO: 5221486 - DNA, 21 bp, Homo sapiens
agtcgttttagtgtctgacct

SEQ ID NO: 5221487 - DNA, 13 bp, Homo sapiens
agtcgttttccaa

SEQ ID NO: 5221488 - DNA, 20 bp, Homo sapiens
agtctaaactgttaaacaac

SEQ ID NO: 5221489 - DNA, 20 bp, Homo sapiens
agtctaaagctggtttaatg

SEQ ID NO: 5221490 - DNA, 21 bp, Homo sapiens
agtctaaagctggtttaatgt

SEQ ID NO: 5221491 - DNA, 18 bp, Homo sapiens
agtctaaagtttacagta

SEQ ID NO: 5221492 - DNA, 23 bp, Homo sapiens
agtctaaagtttacagtaaataa

SEQ ID NO: 5221493 - DNA, 23 bp, Homo sapiens
agtctaaatattcagaatctttg

SEQ ID NO: 5221494 - DNA, 20 bp, Homo sapiens
agtctaaatttattatttaa

SEQ ID NO: 5221495 - DNA, 20 bp, Homo sapiens
agtctaacacagttgaccct

SEQ ID NO: 5221496 - DNA, 16 bp, Homo sapiens
agtctaaccaaatgca

SEQ ID NO: 5221497 - DNA, 21 bp, Homo sapiens
agtctaagaacccatggaaaa

SEQ ID NO: 5221498 - DNA, 18 bp, Homo sapiens
agtctaagatgattcaaa

SEQ ID NO: 5221499 - DNA, 15 bp, Homo sapiens
agtctaagcaagatg

SEQ ID NO: 5221500 - DNA, 16 bp, Homo sapiens
agtctaagcaagatgt

SEQ ID NO: 5221501 - DNA, 17 bp, Homo sapiens
agtctaagcaagatgtt

SEQ ID NO: 5221502 - DNA, 18 bp, Homo sapiens
agtctaagcaagatgttt

SEQ ID NO: 5221503 - DNA, 17 bp, Homo sapiens
agtctaatgaagagaaa

SEQ ID NO: 5221504 - DNA, 13 bp, Homo sapiens
agtctaattttta

SEQ ID NO: 5221505 - DNA, 22 bp, Homo sapiens
agtctacaaaaaggtataaata

SEQ ID NO: 5221506 - DNA, 13 bp, Homo sapiens
agtctacaggcct

SEQ ID NO: 5221507 - DNA, 11 bp, Homo sapiens
agtctaccaat

SEQ ID NO: 5221508 - DNA, 17 bp, Homo sapiens
agtctacctcttcagta

SEQ ID NO: 5221509 - DNA, 18 bp, Homo sapiens
agtctacctgagcattca

SEQ ID NO: 5221510 - DNA, 15 bp, Homo sapiens
agtctacctgctgga

SEQ ID NO: 5221511 - DNA, 20 bp, Homo sapiens
agtctacgctctcctttctt

SEQ ID NO: 5221512 - DNA, 20 bp, Homo sapiens
agtctacgttctccagccca

SEQ ID NO: 5221513 - DNA, 21 bp, Homo sapiens
agtctactcttaagccatctt

SEQ ID NO: 5221514 - DNA, 23 bp, Homo sapiens
agtctagaaaataatgcaaatgt

SEQ ID NO: 5221515 - DNA, 14 bp, Homo sapiens
agtctagaaaccag

SEQ ID NO: 5221516 - DNA, 18 bp, Homo sapiens
agtctagaatgttattgt

SEQ ID NO: 5221517 - DNA, 24 bp, Homo sapiens
agtctagacacaatttcatttcca

SEQ ID NO: 5221518 - DNA, 18 bp, Homo sapiens
agtctagatggctcctct

SEQ ID NO: 5221519 - DNA, 18 bp, Homo sapiens
agtctagattcaaaggtt

SEQ ID NO: 5221520 - DNA, 21 bp, Homo sapiens
agtctagattcaaaggttcta

SEQ ID NO: 5221521 - DNA, 22 bp, Homo sapiens
agtctagattcaaaggttctag

SEQ ID NO: 5221522 - DNA, 14 bp, Homo sapiens
agtctagattctct

SEQ ID NO: 5221523 - DNA, 16 bp, Homo sapiens
agtctagcactcattt

SEQ ID NO: 5221524 - DNA, 21 bp, Homo sapiens
agtctagcgtagtgcagcagg

SEQ ID NO: 5221525 - DNA, 20 bp, Homo sapiens
agtctaggaatggagtctcc

SEQ ID NO: 5221526 - DNA, 16 bp, Homo sapiens
agtctaggagctggga

SEQ ID NO: 5221527 - DNA, 18 bp, Homo sapiens
agtctaggagctgggagg

SEQ ID NO: 5221528 - DNA, 22 bp, Homo sapiens
agtctaggagctgggaggaaaa

SEQ ID NO: 5221529 - DNA, 20 bp, Homo sapiens
agtctaggttggtagagttt

SEQ ID NO: 5221530 - DNA, 16 bp, Homo sapiens
agtctagtcagtgtag

SEQ ID NO: 5221531 - DNA, 17 bp, Homo sapiens
agtctagtgaagatgtt

SEQ ID NO: 5221532 - DNA, 15 bp, Homo sapiens
agtctagtgtagtat

SEQ ID NO: 5221533 - DNA, 16 bp, Homo sapiens
agtctagtttcattat

SEQ ID NO: 5221534 - DNA, 22 bp, Homo sapiens
agtctatatggttctccaagaa

SEQ ID NO: 5221535 - DNA, 15 bp, Homo sapiens
agtctatcaaatgaa

SEQ ID NO: 5221536 - DNA, 23 bp, Homo sapiens
agtctatcaaccccagacactgg

SEQ ID NO: 5221537 - DNA, 11 bp, Homo sapiens
agtctatggcc

SEQ ID NO: 5221538 - DNA, 14 bp, Homo sapiens
agtctatggtcagt

SEQ ID NO: 5221539 - DNA, 17 bp, Homo sapiens
agtctattcattaagta

SEQ ID NO: 5221540 - DNA, 23 bp, Homo sapiens
agtctattcattaagtaatcttt

SEQ ID NO: 5221541 - DNA, 14 bp, Homo sapiens
agtctattcattat

SEQ ID NO: 5221542 - DNA, 21 bp, Homo sapiens
agtctattgaataatgtagtt

SEQ ID NO: 5221543 - DNA, 13 bp, Homo sapiens
agtctattgtctc

SEQ ID NO: 5221544 - DNA, 15 bp, Homo sapiens
agtctatttacggaa

SEQ ID NO: 5221545 - DNA, 14 bp, Homo sapiens
agtctattttatta

SEQ ID NO: 5221546 - DNA, 15 bp, Homo sapiens
agtctatttttaatg

SEQ ID NO: 5221547 - DNA, 16 bp, Homo sapiens
agtctatttttaatgc

SEQ ID NO: 5221548 - DNA, 20 bp, Homo sapiens
agtctatttttattccttga

SEQ ID NO: 5221549 - DNA, 20 bp, Homo sapiens
agtctatttttttaactgaa

SEQ ID NO: 5221550 - DNA, 23 bp, Homo sapiens
agtctatttttttaactgaaaat

SEQ ID NO: 5221551 - DNA, 17 bp, Homo sapiens
agtctcaaaaatacaaa

SEQ ID NO: 5221552 - DNA, 15 bp, Homo sapiens
agtctcaaaatcaac

SEQ ID NO: 5221553 - DNA, 23 bp, Homo sapiens
agtctcaaaatcaactctcttat

SEQ ID NO: 5221554 - DNA, 20 bp, Homo sapiens
agtctcaaaggtaattctga

SEQ ID NO: 5221555 - DNA, 20 bp, Homo sapiens
agtctcaaatttttcatctc

SEQ ID NO: 5221556 - DNA, 18 bp, Homo sapiens
agtctcaacatgtgtttc

SEQ ID NO: 5221557 - DNA, 17 bp, Homo sapiens
agtctcaattttgtatt

SEQ ID NO: 5221558 - DNA, 15 bp, Homo sapiens
agtctcacagagaag

SEQ ID NO: 5221559 - DNA, 21 bp, Homo sapiens
agtctcacagagaagctcctg

SEQ ID NO: 5221560 - DNA, 16 bp, Homo sapiens
agtctcacatattcat

SEQ ID NO: 5221561 - DNA, 18 bp, Homo sapiens
agtctcacatattcatca

SEQ ID NO: 5221562 - DNA, 20 bp, Homo sapiens
agtctcacatgtccctgtcc

SEQ ID NO: 5221563 - DNA, 21 bp, Homo sapiens
agtctcaccatttccccaggg

SEQ ID NO: 5221564 - DNA, 23 bp, Homo sapiens
aggtaaatggttaaattttacat

SEQ ID NO: 5221565 - DNA, 14 bp, Homo sapiens
aggtaacagaacag

SEQ ID NO: 5221566 - DNA, 17 bp, Homo sapiens
aggtaacagaacagctt

SEQ ID NO: 5221567 - DNA, 19 bp, Homo sapiens
aggtaacagaacagcttca

SEQ ID NO: 5221568 - DNA, 21 bp, Homo sapiens
aggtaacagaacagcttcagg

SEQ ID NO: 5221569 - DNA, 23 bp, Homo sapiens
aggtaacagaacagcttcaggtt

SEQ ID NO: 5221570 - DNA, 19 bp, Homo sapiens
aggtaacatagatgcctgg

SEQ ID NO: 5221571 - DNA, 15 bp, Homo sapiens
aggtaacatgtttat

SEQ ID NO: 5221572 - DNA, 20 bp, Homo sapiens
aggtaaccttatatttacaa

SEQ ID NO: 5221573 - DNA, 21 bp, Homo sapiens
aggtaaccttatatttacaat

SEQ ID NO: 5221574 - DNA, 15 bp, Homo sapiens
aggtaacgtgattga

SEQ ID NO: 5221575 - DNA, 18 bp, Homo sapiens
aggtaactaactgcatac

SEQ ID NO: 5221576 - DNA, 22 bp, Homo sapiens
aggtaactatcaatatttaagt

SEQ ID NO: 5221577 - DNA, 15 bp, Homo sapiens
aggtaactattagaa

SEQ ID NO: 5221578 - DNA, 20 bp, Homo sapiens
aggtaacttctcccttctcc

SEQ ID NO: 5221579 - DNA, 22 bp, Homo sapiens
aggtaagaagttttaaaaagcc

SEQ ID NO: 5221580 - DNA, 13 bp, Homo sapiens
aggtaagctgtgc

SEQ ID NO: 5221581 - DNA, 18 bp, Homo sapiens
aggtaagtgggggcgggg

SEQ ID NO: 5221582 - DNA, 21 bp, Homo sapiens
aggtaatacagcttgtgagga

SEQ ID NO: 5221583 - DNA, 21 bp, Homo sapiens
aggtaatatacctggtttact

SEQ ID NO: 5221584 - DNA, 15 bp, Homo sapiens
aggtaatcattttaa

SEQ ID NO: 5221585 - DNA, 18 bp, Homo sapiens
aggtaatcgacctgcctc

SEQ ID NO: 5221586 - DNA, 21 bp, Homo sapiens
aggtaatcgacctgcctcggc

SEQ ID NO: 5221587 - DNA, 15 bp, Homo sapiens
aggtaatctgaaaca

SEQ ID NO: 5221588 - DNA, 18 bp, Homo sapiens
aggtaatgaagctatttg

SEQ ID NO: 5221589 - DNA, 21 bp, Homo sapiens
aggtaatgtagggttatattt

SEQ ID NO: 5221590 - DNA, 22 bp, Homo sapiens
aggtaatgttttgtatatacag

SEQ ID NO: 5221591 - DNA, 22 bp, Homo sapiens
aggtaattctccctaaggaatc

SEQ ID NO: 5221592 - DNA, 20 bp, Homo sapiens
aggtaattgttttttaaagc

SEQ ID NO: 5221593 - DNA, 23 bp, Homo sapiens
aggtaatttttaccctaatgtct

SEQ ID NO: 5221594 - DNA, 12 bp, Homo sapiens
aggtaatttttc

SEQ ID NO: 5221595 - DNA, 16 bp, Homo sapiens
aggtaatttttcacct

SEQ ID NO: 5221596 - DNA, 18 bp, Homo sapiens
aggtaatttttttttgta

SEQ ID NO: 5221597 - DNA, 19 bp, Homo sapiens
aggtacaaataatttagaa

SEQ ID NO: 5221598 - DNA, 21 bp, Homo sapiens
aggtacaaataatttagaaat

SEQ ID NO: 5221599 - DNA, 19 bp, Homo sapiens
aggtacaaccggatgccag

SEQ ID NO: 5221600 - DNA, 21 bp, Homo sapiens
aggtacaatctttcaccaagt

SEQ ID NO: 5221601 - DNA, 15 bp, Homo sapiens
aggtacacctccccc

SEQ ID NO: 5221602 - DNA, 16 bp, Homo sapiens
aggtacacctccccct

SEQ ID NO: 5221603 - DNA, 17 bp, Homo sapiens
aggtacacctccccctg

SEQ ID NO: 5221604 - DNA, 19 bp, Homo sapiens
aggtacacctccccctgcg

SEQ ID NO: 5221605 - DNA, 16 bp, Homo sapiens
aggtacacttgtgaat

SEQ ID NO: 5221606 - DNA, 18 bp, Homo sapiens
aggtacagagacctccct

SEQ ID NO: 5221607 - DNA, 22 bp, Homo sapiens
aggtacagcaacaggaatctca

SEQ ID NO: 5221608 - DNA, 15 bp, Homo sapiens
aggtacagcgggctg

SEQ ID NO: 5221609 - DNA, 16 bp, Homo sapiens
aggtacaggagaggca

SEQ ID NO: 5221610 - DNA, 19 bp, Homo sapiens
aggtacagggtttttacct

SEQ ID NO: 5221611 - DNA, 18 bp, Homo sapiens
aggtacagtaaaacaatt

SEQ ID NO: 5221612 - DNA, 21 bp, Homo sapiens
aggtacatttctgattctgat

SEQ ID NO: 5221613 - DNA, 16 bp, Homo sapiens
aggtaccaaaaaagaa

SEQ ID NO: 5221614 - DNA, 20 bp, Homo sapiens
aggtaccaaacaaggaagcc

SEQ ID NO: 5221615 - DNA, 21 bp, Homo sapiens
aggtaccaaacaaggaagcca

SEQ ID NO: 5221616 - DNA, 24 bp, Homo sapiens
aggtaccaagatcacaaatagtgt

SEQ ID NO: 5221617 - DNA, 22 bp, Homo sapiens
aggtaccagcaatatgtaaata

SEQ ID NO: 5221618 - DNA, 12 bp, Homo sapiens
aggtaccatcct

SEQ ID NO: 5221619 - DNA, 18 bp, Homo sapiens
aggtacccaatagctgcc

SEQ ID NO: 5221620 - DNA, 21 bp, Homo sapiens
aggtacccctttctggctctc

SEQ ID NO: 5221621 - DNA, 13 bp, Homo sapiens
aggtaccctgggt

SEQ ID NO: 5221622 - DNA, 15 bp, Homo sapiens
aggtaccgatttctg

SEQ ID NO: 5221623 - DNA, 16 bp, Homo sapiens
aggtaccgatttctgc

SEQ ID NO: 5221624 - DNA, 21 bp, Homo sapiens
aggtaccttgacctttgtaca

SEQ ID NO: 5221625 - DNA, 22 bp, Homo sapiens
aggtaccttgacctttgtacag

SEQ ID NO: 5221626 - DNA, 17 bp, Homo sapiens
aggtacctttccaccca

SEQ ID NO: 5221627 - DNA, 22 bp, Homo sapiens
aggtacctttccacccagaccc

SEQ ID NO: 5221628 - DNA, 19 bp, Homo sapiens
aggtacgatgacagtgttc

SEQ ID NO: 5221629 - DNA, 16 bp, Homo sapiens
aggtacgcacagacag

SEQ ID NO: 5221630 - DNA, 17 bp, Homo sapiens
aggtacggagaagaata

SEQ ID NO: 5221631 - DNA, 21 bp, Homo sapiens
aggtacggtgagactctgagg

SEQ ID NO: 5221632 - DNA, 14 bp, Homo sapiens
aggtactagaatgc

SEQ ID NO: 5221633 - DNA, 12 bp, Homo sapiens
aggtactattat

SEQ ID NO: 5221634 - DNA, 14 bp, Homo sapiens
aggtactattctga

SEQ ID NO: 5221635 - DNA, 23 bp, Homo sapiens
aggtactcctgccagggaactgg

SEQ ID NO: 5221636 - DNA, 18 bp, Homo sapiens
aggtactgagtggggagt

SEQ ID NO: 5221637 - DNA, 21 bp, Homo sapiens
aggtactgatcctgtttcttg

SEQ ID NO: 5221638 - DNA, 16 bp, Homo sapiens
aggtactgccatattt

SEQ ID NO: 5221639 - DNA, 19 bp, Homo sapiens
aggtactggtcccttcctt

SEQ ID NO: 5221640 - DNA, 22 bp, Homo sapiens
aggtactggtgagggcaagagg

SEQ ID NO: 5221641 - DNA, 21 bp, Homo sapiens
aggtactgtatgatcaaatgt

SEQ ID NO: 5221642 - DNA, 23 bp, Homo sapiens
aggtactgtatgatcaaatgttt

SEQ ID NO: 5221643 - DNA, 23 bp, Homo sapiens
aggtacttcaaatccttgaagat

SEQ ID NO: 5221644 - DNA, 19 bp, Homo sapiens
aggtacttcctcctgatgg

SEQ ID NO: 5221645 - DNA, 16 bp, Homo sapiens
aggtactttgtctaag

SEQ ID NO: 5221646 - DNA, 12 bp, Homo sapiens
aggtagaaactt

SEQ ID NO: 5221647 - DNA, 23 bp, Homo sapiens
aggtagaaatatctgaaaatgta

SEQ ID NO: 5221648 - DNA, 18 bp, Homo sapiens
aggtagaacgccagggac

SEQ ID NO: 5221649 - DNA, 15 bp, Homo sapiens
aggtagactttgctt

SEQ ID NO: 5221650 - DNA, 19 bp, Homo sapiens
aggtagacttttatgagaa

SEQ ID NO: 5221651 - DNA, 14 bp, Homo sapiens
aggtagagatgtgt

SEQ ID NO: 5221652 - DNA, 15 bp, Homo sapiens
aggtagagatgtgtg

SEQ ID NO: 5221653 - DNA, 18 bp, Homo sapiens
aggtagagccacaaaaga

SEQ ID NO: 5221654 - DNA, 16 bp, Homo sapiens
aggtagagcccactgc

SEQ ID NO: 5221655 - DNA, 15 bp, Homo sapiens
aggtagatccagatc

SEQ ID NO: 5221656 - DNA, 20 bp, Homo sapiens
aggtagcattctttggagtt

SEQ ID NO: 5221657 - DNA, 14 bp, Homo sapiens
aggtagccaccacc

SEQ ID NO: 5221658 - DNA, 21 bp, Homo sapiens
aggtagcccagcactgtgaag

SEQ ID NO: 5221659 - DNA, 22 bp, Homo sapiens
aggtagcccagcactgtgaaga

SEQ ID NO: 5221660 - DNA, 17 bp, Homo sapiens
aggtagccccctcttcc

SEQ ID NO: 5221661 - DNA, 19 bp, Homo sapiens
aggtagccctggccagagg

SEQ ID NO: 5221662 - DNA, 18 bp, Homo sapiens
aggtagccgggctctgca

SEQ ID NO: 5221663 - DNA, 19 bp, Homo sapiens
aggtagccgggctctgcac

SEQ ID NO: 5221664 - DNA, 12 bp, Homo sapiens
aggtagcctatt

SEQ ID NO: 5221665 - DNA, 18 bp, Homo sapiens
aggtagcctgctgtgggg

SEQ ID NO: 5221666 - DNA, 20 bp, Homo sapiens
aggtagcgagctgctctgct

SEQ ID NO: 5221667 - DNA, 21 bp, Homo sapiens
aggtagctatagttgcagccc

SEQ ID NO: 5221668 - DNA, 14 bp, Homo sapiens
aggtagctcccagc

SEQ ID NO: 5221669 - DNA, 16 bp, Homo sapiens
aggtagctcggcacca

SEQ ID NO: 5221670 - DNA, 14 bp, Homo sapiens
aggtagctggggag

SEQ ID NO: 5221671 - DNA, 17 bp, Homo sapiens
aggtagctggggagccc

SEQ ID NO: 5221672 - DNA, 18 bp, Homo sapiens
aggtagcttacctgacac

SEQ ID NO: 5221673 - DNA, 17 bp, Homo sapiens
aggtaggcccttgtcct

SEQ ID NO: 5221674 - DNA, 21 bp, Homo sapiens
aggtaggcccttgtcctgcca

SEQ ID NO: 5221675 - DNA, 18 bp, Homo sapiens
aggtaggctgcaaaatta

SEQ ID NO: 5221676 - DNA, 17 bp, Homo sapiens
aggtaggcttctacctg

SEQ ID NO: 5221677 - DNA, 18 bp, Homo sapiens
aggtaggcttctacctgc

SEQ ID NO: 5221678 - DNA, 18 bp, Homo sapiens
aggtagggctggctggag

SEQ ID NO: 5221679 - DNA, 16 bp, Homo sapiens
aggtaggggcacagtg

SEQ ID NO: 5221680 - DNA, 17 bp, Homo sapiens
aggtaggggcccctctc

SEQ ID NO: 5221681 - DNA, 22 bp, Homo sapiens
aggtaggggcccctctcagccc

SEQ ID NO: 5221682 - DNA, 13 bp, Homo sapiens
aggtaggtaaata

SEQ ID NO: 5221683 - DNA, 20 bp, Homo sapiens
aggtaggtggatcacctgag

SEQ ID NO: 5221684 - DNA, 19 bp, Homo sapiens
aggtagtaagcaccagctg

SEQ ID NO: 5221685 - DNA, 18 bp, Homo sapiens
aggtagtattacaccacc

SEQ ID NO: 5221686 - DNA, 14 bp, Homo sapiens
aggtagtgagtaat

SEQ ID NO: 5221687 - DNA, 13 bp, Homo sapiens
aggtagtgggctc

SEQ ID NO: 5221688 - DNA, 23 bp, Homo sapiens
aggtagttcaagaaatgaagagc

SEQ ID NO: 5221689 - DNA, 18 bp, Homo sapiens
aggtagttggtgaacaga

SEQ ID NO: 5221690 - DNA, 22 bp, Homo sapiens
aggtagtttggatatttttgta

SEQ ID NO: 5221691 - DNA, 23 bp, Homo sapiens
aggtagtttggatatttttgtac

SEQ ID NO: 5221692 - DNA, 18 bp, Homo sapiens
aggtataaaaaataagta

SEQ ID NO: 5221693 - DNA, 14 bp, Homo sapiens
aggtataaagacaa

SEQ ID NO: 5221694 - DNA, 21 bp, Homo sapiens
aggtataaggatcttttgtaa

SEQ ID NO: 5221695 - DNA, 20 bp, Homo sapiens
aggtataagtggtgtgtgta

SEQ ID NO: 5221696 - DNA, 23 bp, Homo sapiens
aggtataattcacattgtattca

SEQ ID NO: 5221697 - DNA, 21 bp, Homo sapiens
aggtatactttagtagacatt

SEQ ID NO: 5221698 - DNA, 21 bp, Homo sapiens
aggtatagctgacatctcctc

SEQ ID NO: 5221699 - DNA, 22 bp, Homo sapiens
aggtatagctgacatctcctct

SEQ ID NO: 5221700 - DNA, 22 bp, Homo sapiens
aggtatatagaacacaagggat

SEQ ID NO: 5221701 - DNA, 15 bp, Homo sapiens
aggtatatcattcta

SEQ ID NO: 5221702 - DNA, 18 bp, Homo sapiens
aggtatatcattctaaag

SEQ ID NO: 5221703 - DNA, 20 bp, Homo sapiens
aggtatatcattctaaagat

SEQ ID NO: 5221704 - DNA, 21 bp, Homo sapiens
aggtatatcattctaaagata

SEQ ID NO: 5221705 - DNA, 22 bp, Homo sapiens
aggtatatcattctaaagatag

SEQ ID NO: 5221706 - DNA, 20 bp, Homo sapiens
aggtatatcgatgatggaaa

SEQ ID NO: 5221707 - DNA, 20 bp, Homo sapiens
aggtatcacacactttctga

SEQ ID NO: 5221708 - DNA, 17 bp, Homo sapiens
aggtatcaggcacaggc

SEQ ID NO: 5221709 - DNA, 22 bp, Homo sapiens
aggtatcaggcacaggcaggaa

SEQ ID NO: 5221710 - DNA, 18 bp, Homo sapiens
aggtatcagttatatgat

SEQ ID NO: 5221711 - DNA, 17 bp, Homo sapiens
aggtatcagttgcaata

SEQ ID NO: 5221712 - DNA, 13 bp, Homo sapiens
aggtatctccagg

SEQ ID NO: 5221713 - DNA, 14 bp, Homo sapiens
aggtatctccagga

SEQ ID NO: 5221714 - DNA, 18 bp, Homo sapiens
aggtatctggtatctgca

SEQ ID NO: 5221715 - DNA, 22 bp, Homo sapiens
aggtatgaccttctaggaagct

SEQ ID NO: 5221716 - DNA, 21 bp, Homo sapiens
aggtatgattataagagagct

SEQ ID NO: 5221717 - DNA, 14 bp, Homo sapiens
aggtatggcagagg

SEQ ID NO: 5221718 - DNA, 16 bp, Homo sapiens
aggtatgggctggggg

SEQ ID NO: 5221719 - DNA, 13 bp, Homo sapiens
aggtatgtctgtg

SEQ ID NO: 5221720 - DNA, 16 bp, Homo sapiens
aggtatgtctgtgcca

SEQ ID NO: 5221721 - DNA, 20 bp, Homo sapiens
aggtatgtgcccctcctggg

SEQ ID NO: 5221722 - DNA, 14 bp, Homo sapiens
aggtatgtttgtaa

SEQ ID NO: 5221723 - DNA, 17 bp, Homo sapiens
aggtatgtttgtaactt

SEQ ID NO: 5221724 - DNA, 17 bp, Homo sapiens
aggtattaaagatgtgt

SEQ ID NO: 5221725 - DNA, 13 bp, Homo sapiens
aggtattaagatt

SEQ ID NO: 5221726 - DNA, 17 bp, Homo sapiens
aggtattacatccctgg

SEQ ID NO: 5221727 - DNA, 14 bp, Homo sapiens
aggtattagtgcta

SEQ ID NO: 5221728 - DNA, 17 bp, Homo sapiens
aggtattcgtgcagcat

SEQ ID NO: 5221729 - DNA, 18 bp, Homo sapiens
aggtattcgttatctaat

SEQ ID NO: 5221730 - DNA, 22 bp, Homo sapiens
aggtattgattgaaaaaagaga

SEQ ID NO: 5221731 - DNA, 18 bp, Homo sapiens
aggtattgcaaggtcact

SEQ ID NO: 5221732 - DNA, 15 bp, Homo sapiens
aggtattggcctgtt

SEQ ID NO: 5221733 - DNA, 18 bp, Homo sapiens
aggtattgtctactctga

SEQ ID NO: 5221734 - DNA, 17 bp, Homo sapiens
aggtatttcagaaggag

SEQ ID NO: 5221735 - DNA, 21 bp, Homo sapiens
aggtatttcagaaggagaagg

SEQ ID NO: 5221736 - DNA, 17 bp, Homo sapiens
aggtatttcgaaactgc

SEQ ID NO: 5221737 - DNA, 18 bp, Homo sapiens
aggtatttcgaaactgcc

SEQ ID NO: 5221738 - DNA, 14 bp, Homo sapiens
aggtattttgaata

SEQ ID NO: 5221739 - DNA, 20 bp, Homo sapiens
agtctcacccattatctgga

SEQ ID NO: 5221740 - DNA, 22 bp, Homo sapiens
agtctcacctgccggctctggg

SEQ ID NO: 5221741 - DNA, 19 bp, Homo sapiens
agtctcactagcacatgga

SEQ ID NO: 5221742 - DNA, 14 bp, Homo sapiens
agtctcactcccct

SEQ ID NO: 5221743 - DNA, 16 bp, Homo sapiens
agtctcactcccctcc

SEQ ID NO: 5221744 - DNA, 14 bp, Homo sapiens
agtctcactctgtt

SEQ ID NO: 5221745 - DNA, 19 bp, Homo sapiens
agtctcactctgttgccca

SEQ ID NO: 5221746 - DNA, 20 bp, Homo sapiens
agtctcactgcagtcttatt

SEQ ID NO: 5221747 - DNA, 18 bp, Homo sapiens
agtctcactgcttgaact

SEQ ID NO: 5221748 - DNA, 20 bp, Homo sapiens
agtctcactgtctgctggca

SEQ ID NO: 5221749 - DNA, 14 bp, Homo sapiens
agtctcagagacca

SEQ ID NO: 5221750 - DNA, 18 bp, Homo sapiens
agtctcagagaccagcac

SEQ ID NO: 5221751 - DNA, 19 bp, Homo sapiens
agtctcagagaccagcact

SEQ ID NO: 5221752 - DNA, 20 bp, Homo sapiens
agtctcagagaccagcactc

SEQ ID NO: 5221753 - DNA, 23 bp, Homo sapiens
agtctcagagaccagcactcagc

SEQ ID NO: 5221754 - DNA, 13 bp, Homo sapiens
agtctcagagcac

SEQ ID NO: 5221755 - DNA, 17 bp, Homo sapiens
agtctcagagcacagag

SEQ ID NO: 5221756 - DNA, 12 bp, Homo sapiens
agtctcagcctg

SEQ ID NO: 5221757 - DNA, 22 bp, Homo sapiens
agtctcagcctgggcccctcag

SEQ ID NO: 5221758 - DNA, 23 bp, Homo sapiens
agtctcagcctgggcccctcagc

SEQ ID NO: 5221759 - DNA, 18 bp, Homo sapiens
agtctcagctgctgaaat

SEQ ID NO: 5221760 - DNA, 13 bp, Homo sapiens
agtctcaggaaat

SEQ ID NO: 5221761 - DNA, 13 bp, Homo sapiens
agtctcaggagca

SEQ ID NO: 5221762 - DNA, 15 bp, Homo sapiens
agtctcaggaggagg

SEQ ID NO: 5221763 - DNA, 14 bp, Homo sapiens
agtctcaggccctg

SEQ ID NO: 5221764 - DNA, 21 bp, Homo sapiens
agtctcagtgctagcttattt

SEQ ID NO: 5221765 - DNA, 19 bp, Homo sapiens
agtctcagttcgtgtttga

SEQ ID NO: 5221766 - DNA, 16 bp, Homo sapiens
agtctcagttctcttg

SEQ ID NO: 5221767 - DNA, 18 bp, Homo sapiens
agtctcagttctcttgct

SEQ ID NO: 5221768 - DNA, 21 bp, Homo sapiens
agtctcagtttgtgtgtctta

SEQ ID NO: 5221769 - DNA, 14 bp, Homo sapiens
agtctcatcctccc

SEQ ID NO: 5221770 - DNA, 16 bp, Homo sapiens
agtctcatcctcccat

SEQ ID NO: 5221771 - DNA, 19 bp, Homo sapiens
agtctcatcctcccattgc

SEQ ID NO: 5221772 - DNA, 18 bp, Homo sapiens
agtctcatctatgtcata

SEQ ID NO: 5221773 - DNA, 23 bp, Homo sapiens
agtctcattcgcctttgtcttgt

SEQ ID NO: 5221774 - DNA, 21 bp, Homo sapiens
agtctcattctgttgcccagg

SEQ ID NO: 5221775 - DNA, 19 bp, Homo sapiens
agtctcattgtcacctctg

SEQ ID NO: 5221776 - DNA, 15 bp, Homo sapiens
agtctcatttctcat

SEQ ID NO: 5221777 - DNA, 20 bp, Homo sapiens
agtctcatttgggctagact

SEQ ID NO: 5221778 - DNA, 22 bp, Homo sapiens
agtctccaacatgtttctgttt

SEQ ID NO: 5221779 - DNA, 15 bp, Homo sapiens
agtctccaagagaac

SEQ ID NO: 5221780 - DNA, 18 bp, Homo sapiens
agtctccagcccacgttc

SEQ ID NO: 5221781 - DNA, 12 bp, Homo sapiens
agtctccagggc

SEQ ID NO: 5221782 - DNA, 23 bp, Homo sapiens
agtctcccactgcaacttgtgaa

SEQ ID NO: 5221783 - DNA, 13 bp, Homo sapiens
agtctcccaggcc

SEQ ID NO: 5221784 - DNA, 23 bp, Homo sapiens
agtctccccgcagccctctccac

SEQ ID NO: 5221785 - DNA, 16 bp, Homo sapiens
agtctccccttcctgg

SEQ ID NO: 5221786 - DNA, 19 bp, Homo sapiens
agtctccccttcctggcac

SEQ ID NO: 5221787 - DNA, 23 bp, Homo sapiens
agtctccctcacagcacagagaa

SEQ ID NO: 5221788 - DNA, 14 bp, Homo sapiens
agtctccctccctt

SEQ ID NO: 5221789 - DNA, 19 bp, Homo sapiens
agtctccctccgactccag

SEQ ID NO: 5221790 - DNA, 13 bp, Homo sapiens
agtctccctgcac

SEQ ID NO: 5221791 - DNA, 16 bp, Homo sapiens
agtctccctgcacagc

SEQ ID NO: 5221792 - DNA, 18 bp, Homo sapiens
agtctccctgcacagcct

SEQ ID NO: 5221793 - DNA, 20 bp, Homo sapiens
agtctccctgcacagcctct

SEQ ID NO: 5221794 - DNA, 12 bp, Homo sapiens
agtctcccttct

SEQ ID NO: 5221795 - DNA, 15 bp, Homo sapiens
agtctcccttttata

SEQ ID NO: 5221796 - DNA, 22 bp, Homo sapiens
agtctccggcctctccagcctc

SEQ ID NO: 5221797 - DNA, 16 bp, Homo sapiens
agtctcctaataagtt

SEQ ID NO: 5221798 - DNA, 20 bp, Homo sapiens
agtctcctaggggcttggtc

SEQ ID NO: 5221799 - DNA, 21 bp, Homo sapiens
agtctcctatacccagcagag

SEQ ID NO: 5221800 - DNA, 15 bp, Homo sapiens
agtctcctcactctg

SEQ ID NO: 5221801 - DNA, 14 bp, Homo sapiens
agtctcctcactgc

SEQ ID NO: 5221802 - DNA, 21 bp, Homo sapiens
agtctcctcccctactctgcc

SEQ ID NO: 5221803 - DNA, 15 bp, Homo sapiens
agtctcctctctgag

SEQ ID NO: 5221804 - DNA, 15 bp, Homo sapiens
agtctcctctttaaa

SEQ ID NO: 5221805 - DNA, 21 bp, Homo sapiens
agtctcctctttaaaacaaaa

SEQ ID NO: 5221806 - DNA, 12 bp, Homo sapiens
agtctcctgggt

SEQ ID NO: 5221807 - DNA, 23 bp, Homo sapiens
agtctcctgtcttatggtccaga

SEQ ID NO: 5221808 - DNA, 15 bp, Homo sapiens
agtctccttcagcac

SEQ ID NO: 5221809 - DNA, 14 bp, Homo sapiens
agtctccttcccct

SEQ ID NO: 5221810 - DNA, 23 bp, Homo sapiens
agtctccttctcttctcttcttt

SEQ ID NO: 5221811 - DNA, 14 bp, Homo sapiens
agtctccttggtga

SEQ ID NO: 5221812 - DNA, 19 bp, Homo sapiens
agtctcctttgcactgagg

SEQ ID NO: 5221813 - DNA, 15 bp, Homo sapiens
agtctcgctctgtcg

SEQ ID NO: 5221814 - DNA, 23 bp, Homo sapiens
agtctcgctctgtcgcccaggct

SEQ ID NO: 5221815 - DNA, 23 bp, Homo sapiens
agtctcggcatagtccccagagc

SEQ ID NO: 5221816 - DNA, 16 bp, Homo sapiens
agtctctatcattaaa

SEQ ID NO: 5221817 - DNA, 12 bp, Homo sapiens
agtctctattta

SEQ ID NO: 5221818 - DNA, 18 bp, Homo sapiens
agtctctatttaaattct

SEQ ID NO: 5221819 - DNA, 21 bp, Homo sapiens
agtctctatttaaattctttt

SEQ ID NO: 5221820 - DNA, 20 bp, Homo sapiens
agtctctatttgatttgcaa

SEQ ID NO: 5221821 - DNA, 18 bp, Homo sapiens
agtctctcatttctttca

SEQ ID NO: 5221822 - DNA, 17 bp, Homo sapiens
agtctctccagcctcac

SEQ ID NO: 5221823 - DNA, 15 bp, Homo sapiens
agtctctccctgggg

SEQ ID NO: 5221824 - DNA, 13 bp, Homo sapiens
agtctctcctgta

SEQ ID NO: 5221825 - DNA, 14 bp, Homo sapiens
agtctctctctccc

SEQ ID NO: 5221826 - DNA, 22 bp, Homo sapiens
agtctctctctctccatccctc

SEQ ID NO: 5221827 - DNA, 22 bp, Homo sapiens
agtctctctggggccacacaga

SEQ ID NO: 5221828 - DNA, 19 bp, Homo sapiens
agtctctcttacccttctg

SEQ ID NO: 5221829 - DNA, 11 bp, Homo sapiens
agtctctcttc

SEQ ID NO: 5221830 - DNA, 15 bp, Homo sapiens
agtctctcttctctc

SEQ ID NO: 5221831 - DNA, 18 bp, Homo sapiens
agtctctcttctctccag

SEQ ID NO: 5221832 - DNA, 12 bp, Homo sapiens
agtctctgaaca

SEQ ID NO: 5221833 - DNA, 15 bp, Homo sapiens
agtctctgaatttgt

SEQ ID NO: 5221834 - DNA, 18 bp, Homo sapiens
agtctctgactcttgcct

SEQ ID NO: 5221835 - DNA, 22 bp, Homo sapiens
agtctctgaggggctaccagga

SEQ ID NO: 5221836 - DNA, 23 bp, Homo sapiens
agtctctgattagttgacagtat

SEQ ID NO: 5221837 - DNA, 23 bp, Homo sapiens
agtctctgatttgcaaatgcaca

SEQ ID NO: 5221838 - DNA, 16 bp, Homo sapiens
agtctctgccacccac

SEQ ID NO: 5221839 - DNA, 20 bp, Homo sapiens
agtctctgccagttacttgg

SEQ ID NO: 5221840 - DNA, 12 bp, Homo sapiens
agtctctgctcc

SEQ ID NO: 5221841 - DNA, 13 bp, Homo sapiens
agtctctgctcca

SEQ ID NO: 5221842 - DNA, 21 bp, Homo sapiens
agtctctggctcagctgtggt

SEQ ID NO: 5221843 - DNA, 23 bp, Homo sapiens
agtctctgtataatctatttaca

SEQ ID NO: 5221844 - DNA, 15 bp, Homo sapiens
agtctctgttgtaaa

SEQ ID NO: 5221845 - DNA, 17 bp, Homo sapiens
agtctcttaattctgat

SEQ ID NO: 5221846 - DNA, 17 bp, Homo sapiens
agtctcttacaaaagct

SEQ ID NO: 5221847 - DNA, 22 bp, Homo sapiens
agtctcttagaatttgtttcat

SEQ ID NO: 5221848 - DNA, 12 bp, Homo sapiens
agtctcttcaga

SEQ ID NO: 5221849 - DNA, 12 bp, Homo sapiens
agtctcttccac

SEQ ID NO: 5221850 - DNA, 13 bp, Homo sapiens
agtctcttcctgc

SEQ ID NO: 5221851 - DNA, 16 bp, Homo sapiens
agtctcttcctgcctc

SEQ ID NO: 5221852 - DNA, 14 bp, Homo sapiens
agtctcttctcaga

SEQ ID NO: 5221853 - DNA, 18 bp, Homo sapiens
agtctcttctcagagcag

SEQ ID NO: 5221854 - DNA, 19 bp, Homo sapiens
agtctcttctcagagcagc

SEQ ID NO: 5221855 - DNA, 16 bp, Homo sapiens
agtctcttgattcata

SEQ ID NO: 5221856 - DNA, 22 bp, Homo sapiens
agtctcttggtgatggagtgtg

SEQ ID NO: 5221857 - DNA, 20 bp, Homo sapiens
agtctctttcttcctttcta

SEQ ID NO: 5221858 - DNA, 22 bp, Homo sapiens
agtctcttttctttagagcatt

SEQ ID NO: 5221859 - DNA, 18 bp, Homo sapiens
agtctcttttttacaaag

SEQ ID NO: 5221860 - DNA, 21 bp, Homo sapiens
agtctcttttttacaaaggct

SEQ ID NO: 5221861 - DNA, 18 bp, Homo sapiens
agtctgaaaatagaactt

SEQ ID NO: 5221862 - DNA, 14 bp, Homo sapiens
agtctgaaactggc

SEQ ID NO: 5221863 - DNA, 11 bp, Homo sapiens
agtctgaaatg

SEQ ID NO: 5221864 - DNA, 12 bp, Homo sapiens
agtctgaaatgg

SEQ ID NO: 5221865 - DNA, 13 bp, Homo sapiens
agtctgaaatggg

SEQ ID NO: 5221866 - DNA, 17 bp, Homo sapiens
agtctgaaccaatagaa

SEQ ID NO: 5221867 - DNA, 19 bp, Homo sapiens
agtctgaacccttgtgctt

SEQ ID NO: 5221868 - DNA, 13 bp, Homo sapiens
agtctgaagcctg

SEQ ID NO: 5221869 - DNA, 16 bp, Homo sapiens
agtctgaaggctgggt

SEQ ID NO: 5221870 - DNA, 16 bp, Homo sapiens
agtctgaagtctggaa

SEQ ID NO: 5221871 - DNA, 17 bp, Homo sapiens
agtctgaatgctgccac

SEQ ID NO: 5221872 - DNA, 17 bp, Homo sapiens
agtctgaatggcatgga

SEQ ID NO: 5221873 - DNA, 21 bp, Homo sapiens
agtctgaattgttgaaactaa

SEQ ID NO: 5221874 - DNA, 17 bp, Homo sapiens
agtctgacagccagagc

SEQ ID NO: 5221875 - DNA, 23 bp, Homo sapiens
agtctgacttccccgcattccag

SEQ ID NO: 5221876 - DNA, 15 bp, Homo sapiens
agtctgagaaattta

SEQ ID NO: 5221877 - DNA, 23 bp, Homo sapiens
agtctgagaaggctaaagaagac

SEQ ID NO: 5221878 - DNA, 16 bp, Homo sapiens
agtctgagatgccccg

SEQ ID NO: 5221879 - DNA, 19 bp, Homo sapiens
agtctgagatgccccgagc

SEQ ID NO: 5221880 - DNA, 20 bp, Homo sapiens
agtctgagcccatttctggg

SEQ ID NO: 5221881 - DNA, 15 bp, Homo sapiens
agtctgaggactgtc

SEQ ID NO: 5221882 - DNA, 17 bp, Homo sapiens
agtctgaggactgtcct

SEQ ID NO: 5221883 - DNA, 20 bp, Homo sapiens
agtctgaggccccaggccct

SEQ ID NO: 5221884 - DNA, 18 bp, Homo sapiens
agtctgaggccgttgctg

SEQ ID NO: 5221885 - DNA, 14 bp, Homo sapiens
agtctgaggtcctg

SEQ ID NO: 5221886 - DNA, 13 bp, Homo sapiens
agtctgagtcctg

SEQ ID NO: 5221887 - DNA, 15 bp, Homo sapiens
agtctgatccaggag

SEQ ID NO: 5221888 - DNA, 22 bp, Homo sapiens
agtctgatccaggaggccgggg

SEQ ID NO: 5221889 - DNA, 14 bp, Homo sapiens
agtctgatccctgc

SEQ ID NO: 5221890 - DNA, 20 bp, Homo sapiens
agtctgatcgtgacgctgaa

SEQ ID NO: 5221891 - DNA, 21 bp, Homo sapiens
agtctgatcgtgacgctgaat

SEQ ID NO: 5221892 - DNA, 19 bp, Homo sapiens
agtctgatgatttcttgaa

SEQ ID NO: 5221893 - DNA, 17 bp, Homo sapiens
agtctgatgttctttcc

SEQ ID NO: 5221894 - DNA, 19 bp, Homo sapiens
agtctgatgttctttccat

SEQ ID NO: 5221895 - DNA, 23 bp, Homo sapiens
agtctgattataccatgtgtgct

SEQ ID NO: 5221896 - DNA, 17 bp, Homo sapiens
agtctgatttttaagat

SEQ ID NO: 5221897 - DNA, 22 bp, Homo sapiens
agtctgcaaaatgaggaatgta

SEQ ID NO: 5221898 - DNA, 23 bp, Homo sapiens
agtctgcaactttaagcagctct

SEQ ID NO: 5221899 - DNA, 15 bp, Homo sapiens
agtctgcacagagca

SEQ ID NO: 5221900 - DNA, 22 bp, Homo sapiens
agtctgcagctattcacacaca

SEQ ID NO: 5221901 - DNA, 23 bp, Homo sapiens
agtctgcagctattcacacacac

SEQ ID NO: 5221902 - DNA, 14 bp, Homo sapiens
agtctgcataaact

SEQ ID NO: 5221903 - DNA, 19 bp, Homo sapiens
agtctgcataaacttcatc

SEQ ID NO: 5221904 - DNA, 15 bp, Homo sapiens
agtctgcatttcata

SEQ ID NO: 5221905 - DNA, 17 bp, Homo sapiens
agtctgcatttcatatt

SEQ ID NO: 5221906 - DNA, 18 bp, Homo sapiens
agtctgcatttcatatta

SEQ ID NO: 5221907 - DNA, 20 bp, Homo sapiens
agtctgccaagtgggaatgt

SEQ ID NO: 5221908 - DNA, 13 bp, Homo sapiens
agtctgccagggc

SEQ ID NO: 5221909 - DNA, 22 bp, Homo sapiens
agtctgccagggcccctctccc

SEQ ID NO: 5221910 - DNA, 16 bp, Homo sapiens
agtctgctatattttc

SEQ ID NO: 5221911 - DNA, 18 bp, Homo sapiens
agtctgctcattccgagg

SEQ ID NO: 5221912 - DNA, 14 bp, Homo sapiens
agtctgctccacca

SEQ ID NO: 5221913 - DNA, 13 bp, Homo sapiens
agtctgctcctct

SEQ ID NO: 5221914 - DNA, 14 bp, Homo sapiens
agtctgctcctctt

SEQ ID NO: 5221915 - DNA, 23 bp, Homo sapiens
agtctgctcctcttgttcctgaa

SEQ ID NO: 5221916 - DNA, 13 bp, Homo sapiens
agtctgctgccct

SEQ ID NO: 5221917 - DNA, 16 bp, Homo sapiens
aggtattttttaactc

SEQ ID NO: 5221918 - DNA, 23 bp, Homo sapiens
aggtatttttttaaatcaaggaa

SEQ ID NO: 5221919 - DNA, 14 bp, Homo sapiens
aggtcaaaaacaaa

SEQ ID NO: 5221920 - DNA, 17 bp, Homo sapiens
aggtcaaacaggctgta

SEQ ID NO: 5221921 - DNA, 15 bp, Homo sapiens
aggtcaaactcccta

SEQ ID NO: 5221922 - DNA, 16 bp, Homo sapiens
aggtcaaactccctag

SEQ ID NO: 5221923 - DNA, 19 bp, Homo sapiens
aggtcaacagaatgaaaaa

SEQ ID NO: 5221924 - DNA, 14 bp, Homo sapiens
aggtcaacagagaa

SEQ ID NO: 5221925 - DNA, 18 bp, Homo sapiens
aggtcaagcccaggagga

SEQ ID NO: 5221926 - DNA, 18 bp, Homo sapiens
aggtcaagcctgcagcga

SEQ ID NO: 5221927 - DNA, 22 bp, Homo sapiens
aggtcaagctatttctctggat

SEQ ID NO: 5221928 - DNA, 21 bp, Homo sapiens
aggtcaaggcctgtccctggc

SEQ ID NO: 5221929 - DNA, 13 bp, Homo sapiens
aggtcaagggaaa

SEQ ID NO: 5221930 - DNA, 14 bp, Homo sapiens
aggtcaagggaaaa

SEQ ID NO: 5221931 - DNA, 20 bp, Homo sapiens
aggtcaagggcttactattt

SEQ ID NO: 5221932 - DNA, 14 bp, Homo sapiens
aggtcaaggtcatt

SEQ ID NO: 5221933 - DNA, 17 bp, Homo sapiens
aggtcaagtaagaagac

SEQ ID NO: 5221934 - DNA, 22 bp, Homo sapiens
aggtcaagtaagaagacatgaa

SEQ ID NO: 5221935 - DNA, 17 bp, Homo sapiens
aggtcaataaagcagag

SEQ ID NO: 5221936 - DNA, 19 bp, Homo sapiens
aggtcaataaagcagagcc

SEQ ID NO: 5221937 - DNA, 21 bp, Homo sapiens
aggtcaataaagcagagccaa

SEQ ID NO: 5221938 - DNA, 22 bp, Homo sapiens
aggtcaataaggtcaagggaaa

SEQ ID NO: 5221939 - DNA, 18 bp, Homo sapiens
aggtcaatacagtacagg

SEQ ID NO: 5221940 - DNA, 23 bp, Homo sapiens
aggtcaatacagtacaggcagca

SEQ ID NO: 5221941 - DNA, 20 bp, Homo sapiens
aggtcaatgacacccctggc

SEQ ID NO: 5221942 - DNA, 14 bp, Homo sapiens
aggtcaatgtcaag

SEQ ID NO: 5221943 - DNA, 20 bp, Homo sapiens
aggtcacaacccttctctgt

SEQ ID NO: 5221944 - DNA, 23 bp, Homo sapiens
aggtcacacgaccggggccagca

SEQ ID NO: 5221945 - DNA, 19 bp, Homo sapiens
aggtcacagaaaggcaggt

SEQ ID NO: 5221946 - DNA, 18 bp, Homo sapiens
aggtcacagctaataagt

SEQ ID NO: 5221947 - DNA, 12 bp, Homo sapiens
aggtcacagctg

SEQ ID NO: 5221948 - DNA, 13 bp, Homo sapiens
aggtcacagctgg

SEQ ID NO: 5221949 - DNA, 15 bp, Homo sapiens
aggtcacattcagga

SEQ ID NO: 5221950 - DNA, 12 bp, Homo sapiens
aggtcaccagca

SEQ ID NO: 5221951 - DNA, 15 bp, Homo sapiens
aggtcaccagcctga

SEQ ID NO: 5221952 - DNA, 19 bp, Homo sapiens
aggtcaccagcctgactgc

SEQ ID NO: 5221953 - DNA, 21 bp, Homo sapiens
aggtcaccagctgctgtgccc

SEQ ID NO: 5221954 - DNA, 20 bp, Homo sapiens
aggtcaccaggggaggagcc

SEQ ID NO: 5221955 - DNA, 23 bp, Homo sapiens
aggtcaccatcctcagaggctga

SEQ ID NO: 5221956 - DNA, 21 bp, Homo sapiens
aggtcaccattatgctggtgt

SEQ ID NO: 5221957 - DNA, 17 bp, Homo sapiens
aggtcacccatcaggac

SEQ ID NO: 5221958 - DNA, 15 bp, Homo sapiens
aggtcaccctttgct

SEQ ID NO: 5221959 - DNA, 17 bp, Homo sapiens
aggtcacctcactcagc

SEQ ID NO: 5221960 - DNA, 18 bp, Homo sapiens
aggtcacctcactcagca

SEQ ID NO: 5221961 - DNA, 20 bp, Homo sapiens
aggtcacctgccgccctgtg

SEQ ID NO: 5221962 - DNA, 18 bp, Homo sapiens
aggtcacctttattctgg

SEQ ID NO: 5221963 - DNA, 19 bp, Homo sapiens
aggtcacctttattctggc

SEQ ID NO: 5221964 - DNA, 15 bp, Homo sapiens
aggtcactcctgggg

SEQ ID NO: 5221965 - DNA, 14 bp, Homo sapiens
aggtcactctccag

SEQ ID NO: 5221966 - DNA, 20 bp, Homo sapiens
aggtcactctccagcagtta

SEQ ID NO: 5221967 - DNA, 23 bp, Homo sapiens
aggtcactcttcctgcaaggact

SEQ ID NO: 5221968 - DNA, 13 bp, Homo sapiens
aggtcactgggtt

SEQ ID NO: 5221969 - DNA, 14 bp, Homo sapiens
aggtcactgggttc

SEQ ID NO: 5221970 - DNA, 15 bp, Homo sapiens
aggtcactgtcactg

SEQ ID NO: 5221971 - DNA, 16 bp, Homo sapiens
aggtcactgtcactgc

SEQ ID NO: 5221972 - DNA, 18 bp, Homo sapiens
aggtcactgtcactgccg

SEQ ID NO: 5221973 - DNA, 19 bp, Homo sapiens
aggtcagactaagaaatat

SEQ ID NO: 5221974 - DNA, 15 bp, Homo sapiens
aggtcagaggagggc

SEQ ID NO: 5221975 - DNA, 23 bp, Homo sapiens
aggtcagatggaggttctcagag

SEQ ID NO: 5221976 - DNA, 13 bp, Homo sapiens
aggtcagcagtat

SEQ ID NO: 5221977 - DNA, 15 bp, Homo sapiens
aggtcagcatgtcta

SEQ ID NO: 5221978 - DNA, 19 bp, Homo sapiens
aggtcagcatttgatctgt

SEQ ID NO: 5221979 - DNA, 14 bp, Homo sapiens
aggtcagccaggct

SEQ ID NO: 5221980 - DNA, 18 bp, Homo sapiens
aggtcagcccatggaggc

SEQ ID NO: 5221981 - DNA, 20 bp, Homo sapiens
aggtcagcccgtttcagaag

SEQ ID NO: 5221982 - DNA, 13 bp, Homo sapiens
aggtcagccctgt

SEQ ID NO: 5221983 - DNA, 20 bp, Homo sapiens
aggtcagccctgtgtctgtc

SEQ ID NO: 5221984 - DNA, 14 bp, Homo sapiens
aggtcagcctggaa

SEQ ID NO: 5221985 - DNA, 15 bp, Homo sapiens
aggtcagcctggaag

SEQ ID NO: 5221986 - DNA, 22 bp, Homo sapiens
aggtcagcgcggtcctgactcc

SEQ ID NO: 5221987 - DNA, 19 bp, Homo sapiens
aggtcagcgtgcttagcct

SEQ ID NO: 5221988 - DNA, 21 bp, Homo sapiens
aggtcagctgttactttcttt

SEQ ID NO: 5221989 - DNA, 15 bp, Homo sapiens
aggtcaggaagcagg

SEQ ID NO: 5221990 - DNA, 23 bp, Homo sapiens
aggtcaggaccaggacccaggga

SEQ ID NO: 5221991 - DNA, 22 bp, Homo sapiens
aggtcaggacggctcctcagag

SEQ ID NO: 5221992 - DNA, 21 bp, Homo sapiens
aggtcaggagatcgagaccat

SEQ ID NO: 5221993 - DNA, 13 bp, Homo sapiens
aggtcaggccctg

SEQ ID NO: 5221994 - DNA, 14 bp, Homo sapiens
aggtcagggacttg

SEQ ID NO: 5221995 - DNA, 18 bp, Homo sapiens
aggtcagggacttggaca

SEQ ID NO: 5221996 - DNA, 19 bp, Homo sapiens
aggtcagggacttggacag

SEQ ID NO: 5221997 - DNA, 20 bp, Homo sapiens
aggtcagggagtgctggctc

SEQ ID NO: 5221998 - DNA, 13 bp, Homo sapiens
aggtcagggctca

SEQ ID NO: 5221999 - DNA, 15 bp, Homo sapiens
aggtcagggctcaga

SEQ ID NO: 5222000 - DNA, 18 bp, Homo sapiens
aggtcaggggtgacacag

SEQ ID NO: 5222001 - DNA, 19 bp, Homo sapiens
aggtcaggggtgacacaga

SEQ ID NO: 5222002 - DNA, 20 bp, Homo sapiens
aggtcaggggtgacacagac

SEQ ID NO: 5222003 - DNA, 22 bp, Homo sapiens
aggtcatatgttgtgtttggtt

SEQ ID NO: 5222004 - DNA, 13 bp, Homo sapiens
aggtcatcccggg

SEQ ID NO: 5222005 - DNA, 19 bp, Homo sapiens
aggtcatcccttcctcctc

SEQ ID NO: 5222006 - DNA, 15 bp, Homo sapiens
aggtcatctggcgga

SEQ ID NO: 5222007 - DNA, 20 bp, Homo sapiens
aggtcatgaacatggtcaga

SEQ ID NO: 5222008 - DNA, 22 bp, Homo sapiens
aggtcatgaacatggtcagaac

SEQ ID NO: 5222009 - DNA, 14 bp, Homo sapiens
aggtcatgatttct

SEQ ID NO: 5222010 - DNA, 17 bp, Homo sapiens
aggtcatgatttctgtg

SEQ ID NO: 5222011 - DNA, 14 bp, Homo sapiens
aggtcatggagcag

SEQ ID NO: 5222012 - DNA, 17 bp, Homo sapiens
aggtcatggagcagccc

SEQ ID NO: 5222013 - DNA, 19 bp, Homo sapiens
aggtcatggagcagccccc

SEQ ID NO: 5222014 - DNA, 20 bp, Homo sapiens
aggtcatggagcagccccca

SEQ ID NO: 5222015 - DNA, 16 bp, Homo sapiens
aggtcatggccacact

SEQ ID NO: 5222016 - DNA, 18 bp, Homo sapiens
aggtcatggccacactgt

SEQ ID NO: 5222017 - DNA, 22 bp, Homo sapiens
aggtcatggtctgagtggggct

SEQ ID NO: 5222018 - DNA, 14 bp, Homo sapiens
aggtcatgtctgta

SEQ ID NO: 5222019 - DNA, 23 bp, Homo sapiens
aggtcattaaaacagaagcaaat

SEQ ID NO: 5222020 - DNA, 14 bp, Homo sapiens
aggtcattttctat

SEQ ID NO: 5222021 - DNA, 19 bp, Homo sapiens
aggtcattttctattcacc

SEQ ID NO: 5222022 - DNA, 21 bp, Homo sapiens
aggtccaaatgtttatgtttt

SEQ ID NO: 5222023 - DNA, 16 bp, Homo sapiens
aggtccaatgagcttt

SEQ ID NO: 5222024 - DNA, 15 bp, Homo sapiens
aggtccaatgttgtt

SEQ ID NO: 5222025 - DNA, 14 bp, Homo sapiens
aggtccacaggtct

SEQ ID NO: 5222026 - DNA, 19 bp, Homo sapiens
aggtccacaggtctagact

SEQ ID NO: 5222027 - DNA, 22 bp, Homo sapiens
aggtccaccggcccctggcagc

SEQ ID NO: 5222028 - DNA, 17 bp, Homo sapiens
aggtccactccctgctc

SEQ ID NO: 5222029 - DNA, 19 bp, Homo sapiens
aggtccagatccgctccag

SEQ ID NO: 5222030 - DNA, 23 bp, Homo sapiens
aggtccagccctggctgaaggac

SEQ ID NO: 5222031 - DNA, 14 bp, Homo sapiens
aggtccagctctgg

SEQ ID NO: 5222032 - DNA, 15 bp, Homo sapiens
aggtccagctctgga

SEQ ID NO: 5222033 - DNA, 18 bp, Homo sapiens
aggtccagctctggaggg

SEQ ID NO: 5222034 - DNA, 23 bp, Homo sapiens
aggtccagctctggaggggaggg

SEQ ID NO: 5222035 - DNA, 18 bp, Homo sapiens
aggtccagctctgtgggc

SEQ ID NO: 5222036 - DNA, 15 bp, Homo sapiens
aggtccagctgggcc

SEQ ID NO: 5222037 - DNA, 21 bp, Homo sapiens
aggtccagctgggcctcctgc

SEQ ID NO: 5222038 - DNA, 18 bp, Homo sapiens
aggtccagctttactgtg

SEQ ID NO: 5222039 - DNA, 13 bp, Homo sapiens
aggtccaggcagg

SEQ ID NO: 5222040 - DNA, 14 bp, Homo sapiens
aggtccaggcagga

SEQ ID NO: 5222041 - DNA, 23 bp, Homo sapiens
aggtccaggcccccaacccctcc

SEQ ID NO: 5222042 - DNA, 18 bp, Homo sapiens
aggtccaggtcccagccc

SEQ ID NO: 5222043 - DNA, 20 bp, Homo sapiens
aggtccattattttgtattc

SEQ ID NO: 5222044 - DNA, 19 bp, Homo sapiens
aggtccattcattaattag

SEQ ID NO: 5222045 - DNA, 20 bp, Homo sapiens
aggtccattctgtttaaatc

SEQ ID NO: 5222046 - DNA, 14 bp, Homo sapiens
aggtcccacagccc

SEQ ID NO: 5222047 - DNA, 23 bp, Homo sapiens
aggtcccacagccctgagatggg

SEQ ID NO: 5222048 - DNA, 14 bp, Homo sapiens
aggtcccacctcca

SEQ ID NO: 5222049 - DNA, 15 bp, Homo sapiens
aggtcccacctccag

SEQ ID NO: 5222050 - DNA, 17 bp, Homo sapiens
aggtcccacgccaggcc

SEQ ID NO: 5222051 - DNA, 14 bp, Homo sapiens
aggtcccacgtctg

SEQ ID NO: 5222052 - DNA, 18 bp, Homo sapiens
aggtcccacgtctggcca

SEQ ID NO: 5222053 - DNA, 19 bp, Homo sapiens
aggtcccacgtctggccag

SEQ ID NO: 5222054 - DNA, 19 bp, Homo sapiens
aggtcccagacatgctgcc

SEQ ID NO: 5222055 - DNA, 21 bp, Homo sapiens
aggtcccagacatgctgccca

SEQ ID NO: 5222056 - DNA, 19 bp, Homo sapiens
aggtcccagccccaggcct

SEQ ID NO: 5222057 - DNA, 20 bp, Homo sapiens
aggtcccagccccaggcctg

SEQ ID NO: 5222058 - DNA, 21 bp, Homo sapiens
aggtcccagccccaggcctgg

SEQ ID NO: 5222059 - DNA, 22 bp, Homo sapiens
aggtcccagccccaggcctggc

SEQ ID NO: 5222060 - DNA, 16 bp, Homo sapiens
aggtcccagcccctcc

SEQ ID NO: 5222061 - DNA, 21 bp, Homo sapiens
aggtcccagcccctcctccct

SEQ ID NO: 5222062 - DNA, 22 bp, Homo sapiens
aggtcccagcccctcctccctc

SEQ ID NO: 5222063 - DNA, 23 bp, Homo sapiens
aggtcccagcccctcctccctca

SEQ ID NO: 5222064 - DNA, 14 bp, Homo sapiens
aggtcccagccctg

SEQ ID NO: 5222065 - DNA, 11 bp, Homo sapiens
aggtcccaggc

SEQ ID NO: 5222066 - DNA, 14 bp, Homo sapiens
aggtcccaggcaga

SEQ ID NO: 5222067 - DNA, 14 bp, Homo sapiens
aggtcccagttgct

SEQ ID NO: 5222068 - DNA, 16 bp, Homo sapiens
aggtcccagttgctgt

SEQ ID NO: 5222069 - DNA, 15 bp, Homo sapiens
aggtcccatgctcca

SEQ ID NO: 5222070 - DNA, 19 bp, Homo sapiens
aggtcccatgctccacccg

SEQ ID NO: 5222071 - DNA, 23 bp, Homo sapiens
aggtcccatggcctgctgggctt

SEQ ID NO: 5222072 - DNA, 21 bp, Homo sapiens
aggtcccattgttggcgctga

SEQ ID NO: 5222073 - DNA, 21 bp, Homo sapiens
aggtcccattttccccctgtg

SEQ ID NO: 5222074 - DNA, 11 bp, Homo sapiens
aggtccccaga

SEQ ID NO: 5222075 - DNA, 15 bp, Homo sapiens
aggtccccagcagaa

SEQ ID NO: 5222076 - DNA, 18 bp, Homo sapiens
aggtccccagctttggct

SEQ ID NO: 5222077 - DNA, 16 bp, Homo sapiens
aggtcccccaagcatg

SEQ ID NO: 5222078 - DNA, 19 bp, Homo sapiens
aggtccccccaccgctcag

SEQ ID NO: 5222079 - DNA, 20 bp, Homo sapiens
aggtccccccaccgctcagt

SEQ ID NO: 5222080 - DNA, 21 bp, Homo sapiens
aggtccccccaccgctcagtg

SEQ ID NO: 5222081 - DNA, 23 bp, Homo sapiens
aggtcccccgaccaatccccagc

SEQ ID NO: 5222082 - DNA, 17 bp, Homo sapiens
aggtcccccgactgcct

SEQ ID NO: 5222083 - DNA, 20 bp, Homo sapiens
aggtccccggttgctggtca

SEQ ID NO: 5222084 - DNA, 12 bp, Homo sapiens
aggtcccctcac

SEQ ID NO: 5222085 - DNA, 21 bp, Homo sapiens
aggtcccctccacatcccagc

SEQ ID NO: 5222086 - DNA, 22 bp, Homo sapiens
aggtcccctcgtcccatccagc

SEQ ID NO: 5222087 - DNA, 18 bp, Homo sapiens
aggtcccctgccctgagg

SEQ ID NO: 5222088 - DNA, 15 bp, Homo sapiens
aggtcccctggcagt

SEQ ID NO: 5222089 - DNA, 16 bp, Homo sapiens
aggtcccctggccctt

SEQ ID NO: 5222090 - DNA, 21 bp, Homo sapiens
aggtcccctggcccttccttc

SEQ ID NO: 5222091 - DNA, 19 bp, Homo sapiens
aggtcccctttcagagata

SEQ ID NO: 5222092 - DNA, 18 bp, Homo sapiens
aggtcccgaatggagtcc

SEQ ID NO: 5222093 - DNA, 22 bp, Homo sapiens
aggtcccgaggatgctgtcagg

SEQ ID NO: 5222094 - DNA, 16 bp, Homo sapiens
agtctgctgccctcca

SEQ ID NO: 5222095 - DNA, 17 bp, Homo sapiens
agtctggaactgctgct

SEQ ID NO: 5222096 - DNA, 20 bp, Homo sapiens
agtctggaagaagaggagga

SEQ ID NO: 5222097 - DNA, 14 bp, Homo sapiens
agtctggacctcca

SEQ ID NO: 5222098 - DNA, 20 bp, Homo sapiens
agtctggacctccatccctg

SEQ ID NO: 5222099 - DNA, 21 bp, Homo sapiens
agtctggacctccatccctgc

SEQ ID NO: 5222100 - DNA, 11 bp, Homo sapiens
agtctggactt

SEQ ID NO: 5222101 - DNA, 14 bp, Homo sapiens
agtctggagaccag

SEQ ID NO: 5222102 - DNA, 16 bp, Homo sapiens
agtctggagcaaagca

SEQ ID NO: 5222103 - DNA, 18 bp, Homo sapiens
agtctggagcaaagcaga

SEQ ID NO: 5222104 - DNA, 22 bp, Homo sapiens
agtctggaggggcatggccagc

SEQ ID NO: 5222105 - DNA, 16 bp, Homo sapiens
agtctggagtgaacca

SEQ ID NO: 5222106 - DNA, 13 bp, Homo sapiens
agtctggagtggg

SEQ ID NO: 5222107 - DNA, 16 bp, Homo sapiens
agtctggagtgggcag

SEQ ID NO: 5222108 - DNA, 18 bp, Homo sapiens
agtctggagtgggcagag

SEQ ID NO: 5222109 - DNA, 19 bp, Homo sapiens
agtctggagtgggcagagc

SEQ ID NO: 5222110 - DNA, 21 bp, Homo sapiens
agtctggcaaacatgtgcaac

SEQ ID NO: 5222111 - DNA, 18 bp, Homo sapiens
agtctggcccttcctttt

SEQ ID NO: 5222112 - DNA, 16 bp, Homo sapiens
agtctggcctgccagg

SEQ ID NO: 5222113 - DNA, 19 bp, Homo sapiens
agtctggctgtacccagga

SEQ ID NO: 5222114 - DNA, 21 bp, Homo sapiens
agtctggctgtacccaggaat

SEQ ID NO: 5222115 - DNA, 14 bp, Homo sapiens
agtctggctttacc

SEQ ID NO: 5222116 - DNA, 19 bp, Homo sapiens
agtctggctttgctctatt

SEQ ID NO: 5222117 - DNA, 21 bp, Homo sapiens
agtctgggaaggggcgtgtcc

SEQ ID NO: 5222118 - DNA, 22 bp, Homo sapiens
agtctgggaaggggcgtgtccc

SEQ ID NO: 5222119 - DNA, 13 bp, Homo sapiens
agtctgggccagg

SEQ ID NO: 5222120 - DNA, 17 bp, Homo sapiens
agtctgggcctctgact

SEQ ID NO: 5222121 - DNA, 21 bp, Homo sapiens
agtctgggtcagacccatctc

SEQ ID NO: 5222122 - DNA, 16 bp, Homo sapiens
agtctggtctgcgcct

SEQ ID NO: 5222123 - DNA, 15 bp, Homo sapiens
agtctggtgaagctc

SEQ ID NO: 5222124 - DNA, 17 bp, Homo sapiens
agtctggtggaggagct

SEQ ID NO: 5222125 - DNA, 23 bp, Homo sapiens
agtctgtaactctttctgaggag

SEQ ID NO: 5222126 - DNA, 12 bp, Homo sapiens
agtctgtaattt

SEQ ID NO: 5222127 - DNA, 18 bp, Homo sapiens
agtctgtacttcagttct

SEQ ID NO: 5222128 - DNA, 19 bp, Homo sapiens
agtctgtacttcagttctc

SEQ ID NO: 5222129 - DNA, 17 bp, Homo sapiens
agtctgtattttccacc

SEQ ID NO: 5222130 - DNA, 14 bp, Homo sapiens
agtctgtcataata

SEQ ID NO: 5222131 - DNA, 23 bp, Homo sapiens
agtctgtcataatatttgaacaa

SEQ ID NO: 5222132 - DNA, 15 bp, Homo sapiens
agtctgtcatcctct

SEQ ID NO: 5222133 - DNA, 17 bp, Homo sapiens
agtctgtccatatgaaa

SEQ ID NO: 5222134 - DNA, 11 bp, Homo sapiens
agtctgtcctg

SEQ ID NO: 5222135 - DNA, 13 bp, Homo sapiens
agtctgtccttga

SEQ ID NO: 5222136 - DNA, 14 bp, Homo sapiens
agtctgtcctttcc

SEQ ID NO: 5222137 - DNA, 15 bp, Homo sapiens
agtctgtctctgtca

SEQ ID NO: 5222138 - DNA, 23 bp, Homo sapiens
agtctgtctcttggctttgtcac

SEQ ID NO: 5222139 - DNA, 18 bp, Homo sapiens
agtctgtcttcctgcctt

SEQ ID NO: 5222140 - DNA, 17 bp, Homo sapiens
agtctgtcttctgtata

SEQ ID NO: 5222141 - DNA, 22 bp, Homo sapiens
agtctgtcttgagatctgattt

SEQ ID NO: 5222142 - DNA, 23 bp, Homo sapiens
agtctgtctttctatagaaatat

SEQ ID NO: 5222143 - DNA, 21 bp, Homo sapiens
agtctgtgaataaagccacat

SEQ ID NO: 5222144 - DNA, 14 bp, Homo sapiens
agtctgtgcctcag

SEQ ID NO: 5222145 - DNA, 23 bp, Homo sapiens
agtctgtgcctggagctcctggg

SEQ ID NO: 5222146 - DNA, 14 bp, Homo sapiens
agtctgtggaactt

SEQ ID NO: 5222147 - DNA, 18 bp, Homo sapiens
agtctgtggacactgtgg

SEQ ID NO: 5222148 - DNA, 17 bp, Homo sapiens
agtctgtggagcgtcct

SEQ ID NO: 5222149 - DNA, 23 bp, Homo sapiens
agtctgtggcccaagagagagac

SEQ ID NO: 5222150 - DNA, 17 bp, Homo sapiens
agtctgtgggagctcag

SEQ ID NO: 5222151 - DNA, 18 bp, Homo sapiens
agtctgtgggagctcagc

SEQ ID NO: 5222152 - DNA, 20 bp, Homo sapiens
agtctgtgtaactttaaaca

SEQ ID NO: 5222153 - DNA, 11 bp, Homo sapiens
agtctgtgtga

SEQ ID NO: 5222154 - DNA, 11 bp, Homo sapiens
agtctgtgtgc

SEQ ID NO: 5222155 - DNA, 20 bp, Homo sapiens
agtctgtgtggccagcagcc

SEQ ID NO: 5222156 - DNA, 18 bp, Homo sapiens
agtctgtgtgggactgta

SEQ ID NO: 5222157 - DNA, 19 bp, Homo sapiens
agtctgtgtgggactgtac

SEQ ID NO: 5222158 - DNA, 13 bp, Homo sapiens
agtctgttatgca

SEQ ID NO: 5222159 - DNA, 14 bp, Homo sapiens
agtctgttatgcac

SEQ ID NO: 5222160 - DNA, 15 bp, Homo sapiens
agtctgttattgttt

SEQ ID NO: 5222161 - DNA, 18 bp, Homo sapiens
agtctgttattgttttgt

SEQ ID NO: 5222162 - DNA, 14 bp, Homo sapiens
agtctgttgcattt

SEQ ID NO: 5222163 - DNA, 17 bp, Homo sapiens
agtctgttgctgctcca

SEQ ID NO: 5222164 - DNA, 17 bp, Homo sapiens
agtctgtttactgcaag

SEQ ID NO: 5222165 - DNA, 18 bp, Homo sapiens
agtctgtttcccaagcta

SEQ ID NO: 5222166 - DNA, 12 bp, Homo sapiens
agtctgttttat

SEQ ID NO: 5222167 - DNA, 17 bp, Homo sapiens
agtctgttttatgactt

SEQ ID NO: 5222168 - DNA, 23 bp, Homo sapiens
agtctgttttcccaacctcctgt

SEQ ID NO: 5222169 - DNA, 17 bp, Homo sapiens
agtcttaaaataactta

SEQ ID NO: 5222170 - DNA, 15 bp, Homo sapiens
agtcttaacaaacca

SEQ ID NO: 5222171 - DNA, 23 bp, Homo sapiens
agtcttaacaaaccaacatcttt

SEQ ID NO: 5222172 - DNA, 14 bp, Homo sapiens
agtcttaactggtc

SEQ ID NO: 5222173 - DNA, 17 bp, Homo sapiens
agtcttaactgtatttc

SEQ ID NO: 5222174 - DNA, 18 bp, Homo sapiens
agtcttaactgtatttca

SEQ ID NO: 5222175 - DNA, 21 bp, Homo sapiens
agtcttaagggtcactggcct

SEQ ID NO: 5222176 - DNA, 22 bp, Homo sapiens
agtcttaatatatatatccaga

SEQ ID NO: 5222177 - DNA, 18 bp, Homo sapiens
agtcttaattgtgtttat

SEQ ID NO: 5222178 - DNA, 17 bp, Homo sapiens
agtcttaattttctaaa

SEQ ID NO: 5222179 - DNA, 19 bp, Homo sapiens
agtcttactacagaaatga

SEQ ID NO: 5222180 - DNA, 18 bp, Homo sapiens
agtcttactctgttgcca

SEQ ID NO: 5222181 - DNA, 17 bp, Homo sapiens
agtcttacttaaaaaaa

SEQ ID NO: 5222182 - DNA, 19 bp, Homo sapiens
agtcttagatcatagtttt

SEQ ID NO: 5222183 - DNA, 13 bp, Homo sapiens
agtcttagatgta

SEQ ID NO: 5222184 - DNA, 16 bp, Homo sapiens
agtcttagatgtatat

SEQ ID NO: 5222185 - DNA, 17 bp, Homo sapiens
agtcttatatcccaggt

SEQ ID NO: 5222186 - DNA, 17 bp, Homo sapiens
agtcttatgtaaagtat

SEQ ID NO: 5222187 - DNA, 14 bp, Homo sapiens
agtcttatttttct

SEQ ID NO: 5222188 - DNA, 16 bp, Homo sapiens
agtcttatttttctag

SEQ ID NO: 5222189 - DNA, 17 bp, Homo sapiens
agtcttatttttctagt

SEQ ID NO: 5222190 - DNA, 16 bp, Homo sapiens
agtcttcaaatttgat

SEQ ID NO: 5222191 - DNA, 13 bp, Homo sapiens
agtcttcaactgg

SEQ ID NO: 5222192 - DNA, 16 bp, Homo sapiens
agtcttcaagggctgc

SEQ ID NO: 5222193 - DNA, 17 bp, Homo sapiens
agtcttcactaaccttt

SEQ ID NO: 5222194 - DNA, 14 bp, Homo sapiens
agtcttcagaccca

SEQ ID NO: 5222195 - DNA, 15 bp, Homo sapiens
agtcttcagacccag

SEQ ID NO: 5222196 - DNA, 16 bp, Homo sapiens
agtcttcagacccaga

SEQ ID NO: 5222197 - DNA, 14 bp, Homo sapiens
agtcttcagtttca

SEQ ID NO: 5222198 - DNA, 18 bp, Homo sapiens
agtcttcagtttgcagag

SEQ ID NO: 5222199 - DNA, 20 bp, Homo sapiens
agtcttcagtttgcagagta

SEQ ID NO: 5222200 - DNA, 22 bp, Homo sapiens
agtcttcataccccagaaatta

SEQ ID NO: 5222201 - DNA, 15 bp, Homo sapiens
agtcttcatgaaatg

SEQ ID NO: 5222202 - DNA, 21 bp, Homo sapiens
agtcttcatggtctcttccag

SEQ ID NO: 5222203 - DNA, 15 bp, Homo sapiens
agtcttccaattaat

SEQ ID NO: 5222204 - DNA, 19 bp, Homo sapiens
agtcttccacaaagaaaat

SEQ ID NO: 5222205 - DNA, 21 bp, Homo sapiens
agtcttccacaaagaaaattc

SEQ ID NO: 5222206 - DNA, 16 bp, Homo sapiens
agtcttccacctggaa

SEQ ID NO: 5222207 - DNA, 24 bp, Homo sapiens
agtcttccagaaagcaaggactgc

SEQ ID NO: 5222208 - DNA, 18 bp, Homo sapiens
agtcttccatcagcagtg

SEQ ID NO: 5222209 - DNA, 12 bp, Homo sapiens
agtcttccctca

SEQ ID NO: 5222210 - DNA, 13 bp, Homo sapiens
agtcttccctgat

SEQ ID NO: 5222211 - DNA, 12 bp, Homo sapiens
agtcttcctgac

SEQ ID NO: 5222212 - DNA, 17 bp, Homo sapiens
agtcttcctgacacttt

SEQ ID NO: 5222213 - DNA, 12 bp, Homo sapiens
agtcttccttaa

SEQ ID NO: 5222214 - DNA, 18 bp, Homo sapiens
agtcttctaatgtaaatt

SEQ ID NO: 5222215 - DNA, 21 bp, Homo sapiens
agtcttctaatgtaaatttta

SEQ ID NO: 5222216 - DNA, 14 bp, Homo sapiens
agtcttctatttat

SEQ ID NO: 5222217 - DNA, 13 bp, Homo sapiens
agtcttctcatag

SEQ ID NO: 5222218 - DNA, 18 bp, Homo sapiens
agtcttctcatagcatta

SEQ ID NO: 5222219 - DNA, 15 bp, Homo sapiens
agtcttctcccaact

SEQ ID NO: 5222220 - DNA, 22 bp, Homo sapiens
agtcttctcccaactcagcctg

SEQ ID NO: 5222221 - DNA, 23 bp, Homo sapiens
agtcttctcctccatgaacatca

SEQ ID NO: 5222222 - DNA, 17 bp, Homo sapiens
agtcttctgacaaactg

SEQ ID NO: 5222223 - DNA, 19 bp, Homo sapiens
agtcttctgacaaactgtg

SEQ ID NO: 5222224 - DNA, 17 bp, Homo sapiens
agtcttcttcacccgct

SEQ ID NO: 5222225 - DNA, 21 bp, Homo sapiens
agtcttcttcacccgctgcag

SEQ ID NO: 5222226 - DNA, 16 bp, Homo sapiens
agtcttctttcatgta

SEQ ID NO: 5222227 - DNA, 15 bp, Homo sapiens
agtcttctttcccaa

SEQ ID NO: 5222228 - DNA, 15 bp, Homo sapiens
agtcttgaaatgaaa

SEQ ID NO: 5222229 - DNA, 17 bp, Homo sapiens
agtcttgaaatgaaagg

SEQ ID NO: 5222230 - DNA, 16 bp, Homo sapiens
agtcttgaatttctga

SEQ ID NO: 5222231 - DNA, 10 bp, Homo sapiens
agtcttgacc

SEQ ID NO: 5222232 - DNA, 17 bp, Homo sapiens
agtcttgagtgggcccc

SEQ ID NO: 5222233 - DNA, 16 bp, Homo sapiens
agtcttgcagtgatta

SEQ ID NO: 5222234 - DNA, 16 bp, Homo sapiens
agtcttgcattcatgg

SEQ ID NO: 5222235 - DNA, 18 bp, Homo sapiens
agtcttgcctatattttc

SEQ ID NO: 5222236 - DNA, 17 bp, Homo sapiens
agtcttgctctgtcacc

SEQ ID NO: 5222237 - DNA, 23 bp, Homo sapiens
agtcttgctctgttgcccaagct

SEQ ID NO: 5222238 - DNA, 16 bp, Homo sapiens
agtcttgctgtgcttt

SEQ ID NO: 5222239 - DNA, 14 bp, Homo sapiens
agtcttgcttacaa

SEQ ID NO: 5222240 - DNA, 22 bp, Homo sapiens
agtcttggaagctgtttggaaa

SEQ ID NO: 5222241 - DNA, 15 bp, Homo sapiens
agtcttggctcactg

SEQ ID NO: 5222242 - DNA, 17 bp, Homo sapiens
agtcttggggcaggatg

SEQ ID NO: 5222243 - DNA, 23 bp, Homo sapiens
agtcttgggtactcgcacctctt

SEQ ID NO: 5222244 - DNA, 19 bp, Homo sapiens
agtcttgggtctgaattta

SEQ ID NO: 5222245 - DNA, 16 bp, Homo sapiens
agtcttggttctaaag

SEQ ID NO: 5222246 - DNA, 21 bp, Homo sapiens
agtcttggttctaaaggtacc

SEQ ID NO: 5222247 - DNA, 22 bp, Homo sapiens
agtcttgtcccaattaaaatac

SEQ ID NO: 5222248 - DNA, 10 bp, Homo sapiens
agtcttgtct

SEQ ID NO: 5222249 - DNA, 17 bp, Homo sapiens
agtcttgtctcagattt

SEQ ID NO: 5222250 - DNA, 19 bp, Homo sapiens
agtcttgtctcagatttta

SEQ ID NO: 5222251 - DNA, 17 bp, Homo sapiens
agtcttgtctcatttag

SEQ ID NO: 5222252 - DNA, 20 bp, Homo sapiens
agtcttgtcttagctctgga

SEQ ID NO: 5222253 - DNA, 16 bp, Homo sapiens
agtcttgtgaaagtgt

SEQ ID NO: 5222254 - DNA, 14 bp, Homo sapiens
agtcttgtgaactt

SEQ ID NO: 5222255 - DNA, 15 bp, Homo sapiens
agtcttgttgttcat

SEQ ID NO: 5222256 - DNA, 16 bp, Homo sapiens
agtcttgttgttcata

SEQ ID NO: 5222257 - DNA, 17 bp, Homo sapiens
agtcttgttgttcatat

SEQ ID NO: 5222258 - DNA, 19 bp, Homo sapiens
agtctttaaaggcccagcc

SEQ ID NO: 5222259 - DNA, 20 bp, Homo sapiens
agtctttaaaggcccagccc

SEQ ID NO: 5222260 - DNA, 21 bp, Homo sapiens
agtctttaaaggcccagcccc

SEQ ID NO: 5222261 - DNA, 23 bp, Homo sapiens
agtctttaaaggcccagccccta

SEQ ID NO: 5222262 - DNA, 19 bp, Homo sapiens
agtctttaggtctttgtaa

SEQ ID NO: 5222263 - DNA, 23 bp, Homo sapiens
agtctttatttttttcccatgag

SEQ ID NO: 5222264 - DNA, 17 bp, Homo sapiens
agtctttcaactgtttc

SEQ ID NO: 5222265 - DNA, 15 bp, Homo sapiens
agtctttcatggctg

SEQ ID NO: 5222266 - DNA, 17 bp, Homo sapiens
agtctttcatggctgct

SEQ ID NO: 5222267 - DNA, 17 bp, Homo sapiens
agtctttcccaatctct

SEQ ID NO: 5222268 - DNA, 19 bp, Homo sapiens
agtctttcccccaggaaaa

SEQ ID NO: 5222269 - DNA, 14 bp, Homo sapiens
agtctttctcactg

SEQ ID NO: 5222270 - DNA, 16 bp, Homo sapiens
agtctttctcactgcc

SEQ ID NO: 5222271 - DNA, 18 bp, Homo sapiens
agtctttctcactgcctt

SEQ ID NO: 5222272 - DNA, 14 bp, Homo sapiens
agtctttctcctct

SEQ ID NO: 5222273 - DNA, 13 bp, Homo sapiens
aggtcccggccag

SEQ ID NO: 5222274 - DNA, 18 bp, Homo sapiens
aggtcccggccagctctg

SEQ ID NO: 5222275 - DNA, 18 bp, Homo sapiens
aggtccctaataaagctg

SEQ ID NO: 5222276 - DNA, 16 bp, Homo sapiens
aggtccctgctgccag

SEQ ID NO: 5222277 - DNA, 12 bp, Homo sapiens
aggtccctgggg

SEQ ID NO: 5222278 - DNA, 21 bp, Homo sapiens
aggtccctgtgtgtaggctgg

SEQ ID NO: 5222279 - DNA, 17 bp, Homo sapiens
aggtcccttcaaggcct

SEQ ID NO: 5222280 - DNA, 19 bp, Homo sapiens
aggtcccttcaaggcctcc

SEQ ID NO: 5222281 - DNA, 17 bp, Homo sapiens
aggtcccttcccgaccc

SEQ ID NO: 5222282 - DNA, 18 bp, Homo sapiens
aggtccgagctctgtcct

SEQ ID NO: 5222283 - DNA, 17 bp, Homo sapiens
aggtccgagtcttttta

SEQ ID NO: 5222284 - DNA, 15 bp, Homo sapiens
aggtccgatggcccg

SEQ ID NO: 5222285 - DNA, 14 bp, Homo sapiens
aggtccgcaccctg

SEQ ID NO: 5222286 - DNA, 21 bp, Homo sapiens
aggtccgcaccctgtcctgca

SEQ ID NO: 5222287 - DNA, 14 bp, Homo sapiens
aggtccgtgggccg

SEQ ID NO: 5222288 - DNA, 23 bp, Homo sapiens
aggtcctagctttatattgtccc

SEQ ID NO: 5222289 - DNA, 19 bp, Homo sapiens
aggtcctcaataaatattt

SEQ ID NO: 5222290 - DNA, 13 bp, Homo sapiens
aggtcctcacagc

SEQ ID NO: 5222291 - DNA, 23 bp, Homo sapiens
aggtcctcacagcagtcacaggc

SEQ ID NO: 5222292 - DNA, 12 bp, Homo sapiens
aggtcctcaggt

SEQ ID NO: 5222293 - DNA, 13 bp, Homo sapiens
aggtcctcaggtc

SEQ ID NO: 5222294 - DNA, 20 bp, Homo sapiens
aggtcctcaggtcagctggg

SEQ ID NO: 5222295 - DNA, 21 bp, Homo sapiens
aggtcctcagtgtcctcaggg

SEQ ID NO: 5222296 - DNA, 14 bp, Homo sapiens
aggtcctcatgggt

SEQ ID NO: 5222297 - DNA, 17 bp, Homo sapiens
aggtcctcccctctctt

SEQ ID NO: 5222298 - DNA, 17 bp, Homo sapiens
aggtcctcctctctcta

SEQ ID NO: 5222299 - DNA, 21 bp, Homo sapiens
aggtcctctacttaatgagat

SEQ ID NO: 5222300 - DNA, 13 bp, Homo sapiens
aggtcctctcagt

SEQ ID NO: 5222301 - DNA, 15 bp, Homo sapiens
aggtcctctggagcc

SEQ ID NO: 5222302 - DNA, 12 bp, Homo sapiens
aggtcctgagca

SEQ ID NO: 5222303 - DNA, 20 bp, Homo sapiens
aggtcctgagcactgccagg

SEQ ID NO: 5222304 - DNA, 21 bp, Homo sapiens
aggtcctgagcactgccagga

SEQ ID NO: 5222305 - DNA, 22 bp, Homo sapiens
aggtcctgagcactgccaggag

SEQ ID NO: 5222306 - DNA, 23 bp, Homo sapiens
aggtcctgagcactgccaggagg

SEQ ID NO: 5222307 - DNA, 15 bp, Homo sapiens
aggtcctgcccatgt

SEQ ID NO: 5222308 - DNA, 17 bp, Homo sapiens
aggtcctgcccatgtgt

SEQ ID NO: 5222309 - DNA, 20 bp, Homo sapiens
aggtcctgcccatgtgtccc

SEQ ID NO: 5222310 - DNA, 19 bp, Homo sapiens
aggtcctgctcagcagtga

SEQ ID NO: 5222311 - DNA, 14 bp, Homo sapiens
aggtcctggcttct

SEQ ID NO: 5222312 - DNA, 17 bp, Homo sapiens
aggtcctggggaggctg

SEQ ID NO: 5222313 - DNA, 15 bp, Homo sapiens
aggtcctggtgccta

SEQ ID NO: 5222314 - DNA, 20 bp, Homo sapiens
aggtcctggtggggcagctc

SEQ ID NO: 5222315 - DNA, 23 bp, Homo sapiens
aggtcctggtgggtcagcccagc

SEQ ID NO: 5222316 - DNA, 15 bp, Homo sapiens
aggtcctgtcctggc

SEQ ID NO: 5222317 - DNA, 23 bp, Homo sapiens
aggtcctgtcctggctcccaggg

SEQ ID NO: 5222318 - DNA, 14 bp, Homo sapiens
aggtcctgtctctg

SEQ ID NO: 5222319 - DNA, 18 bp, Homo sapiens
aggtcctgtctctgcaca

SEQ ID NO: 5222320 - DNA, 20 bp, Homo sapiens
aggtcctgtgagcaaagtgc

SEQ ID NO: 5222321 - DNA, 16 bp, Homo sapiens
aggtcctgtgttaaac

SEQ ID NO: 5222322 - DNA, 16 bp, Homo sapiens
aggtccttctgctgga

SEQ ID NO: 5222323 - DNA, 16 bp, Homo sapiens
aggtccttgcctcctg

SEQ ID NO: 5222324 - DNA, 22 bp, Homo sapiens
aggtccttgcctgaactccaga

SEQ ID NO: 5222325 - DNA, 12 bp, Homo sapiens
aggtccttggtt

SEQ ID NO: 5222326 - DNA, 15 bp, Homo sapiens
aggtcctttagaaac

SEQ ID NO: 5222327 - DNA, 21 bp, Homo sapiens
aggtcctttccttctcgtctt

SEQ ID NO: 5222328 - DNA, 19 bp, Homo sapiens
aggtcgaagcaatcagcaa

SEQ ID NO: 5222329 - DNA, 21 bp, Homo sapiens
aggtcgaagcaatcagcaaac

SEQ ID NO: 5222330 - DNA, 15 bp, Homo sapiens
aggtcgagctgtgct

SEQ ID NO: 5222331 - DNA, 16 bp, Homo sapiens
aggtcgagctgtgctc

SEQ ID NO: 5222332 - DNA, 15 bp, Homo sapiens
aggtcgcacctcctt

SEQ ID NO: 5222333 - DNA, 20 bp, Homo sapiens
aggtcgcagctaccctcagc

SEQ ID NO: 5222334 - DNA, 12 bp, Homo sapiens
aggtcgccattc

SEQ ID NO: 5222335 - DNA, 13 bp, Homo sapiens
aggtcgctgcagc

SEQ ID NO: 5222336 - DNA, 15 bp, Homo sapiens
aggtcggagtgcctg

SEQ ID NO: 5222337 - DNA, 16 bp, Homo sapiens
aggtcggagtgcctgg

SEQ ID NO: 5222338 - DNA, 18 bp, Homo sapiens
aggtcgggacagctgtgc

SEQ ID NO: 5222339 - DNA, 19 bp, Homo sapiens
aggtcgggagttggagacc

SEQ ID NO: 5222340 - DNA, 15 bp, Homo sapiens
aggtcgggctcagct

SEQ ID NO: 5222341 - DNA, 23 bp, Homo sapiens
aggtcgggctgccagcccagctg

SEQ ID NO: 5222342 - DNA, 17 bp, Homo sapiens
aggtcgtataatttagt

SEQ ID NO: 5222343 - DNA, 16 bp, Homo sapiens
aggtcgttcttatcta

SEQ ID NO: 5222344 - DNA, 18 bp, Homo sapiens
aggtctaaataggatcct

SEQ ID NO: 5222345 - DNA, 15 bp, Homo sapiens
aggtctaatttagta

SEQ ID NO: 5222346 - DNA, 20 bp, Homo sapiens
aggtctacattcttggttgt

SEQ ID NO: 5222347 - DNA, 13 bp, Homo sapiens
aggtctagaaaag

SEQ ID NO: 5222348 - DNA, 20 bp, Homo sapiens
aggtctagaaggccaggcct

SEQ ID NO: 5222349 - DNA, 13 bp, Homo sapiens
aggtctagagaga

SEQ ID NO: 5222350 - DNA, 15 bp, Homo sapiens
aggtctagagagaac

SEQ ID NO: 5222351 - DNA, 11 bp, Homo sapiens
aggtctagcct

SEQ ID NO: 5222352 - DNA, 22 bp, Homo sapiens
aggtctaggaacatacttcagc

SEQ ID NO: 5222353 - DNA, 14 bp, Homo sapiens
aggtctagtttctt

SEQ ID NO: 5222354 - DNA, 21 bp, Homo sapiens
aggtctatttaaaaaaaaagt

SEQ ID NO: 5222355 - DNA, 22 bp, Homo sapiens
aggtctatttggattattcttt

SEQ ID NO: 5222356 - DNA, 22 bp, Homo sapiens
aggtctcaacccttttgtctgc

SEQ ID NO: 5222357 - DNA, 14 bp, Homo sapiens
aggtctcaatattt

SEQ ID NO: 5222358 - DNA, 17 bp, Homo sapiens
aggtctcaatatttatt

SEQ ID NO: 5222359 - DNA, 20 bp, Homo sapiens
aggtctcacactcctcctgc

SEQ ID NO: 5222360 - DNA, 20 bp, Homo sapiens
aggtctcaccttcgcctttg

SEQ ID NO: 5222361 - DNA, 13 bp, Homo sapiens
aggtctcactgct

SEQ ID NO: 5222362 - DNA, 13 bp, Homo sapiens
aggtctcagcccc

SEQ ID NO: 5222363 - DNA, 20 bp, Homo sapiens
aggtctcataggttgagcaa

SEQ ID NO: 5222364 - DNA, 15 bp, Homo sapiens
aggtctcatctccca

SEQ ID NO: 5222365 - DNA, 19 bp, Homo sapiens
aggtctcatctcccaggcc

SEQ ID NO: 5222366 - DNA, 20 bp, Homo sapiens
aggtctcatctcccaggccc

SEQ ID NO: 5222367 - DNA, 16 bp, Homo sapiens
aggtctcatctcttca

SEQ ID NO: 5222368 - DNA, 21 bp, Homo sapiens
aggtctcatctcttcaggttc

SEQ ID NO: 5222369 - DNA, 22 bp, Homo sapiens
aggtctcatctcttcaggttct

SEQ ID NO: 5222370 - DNA, 18 bp, Homo sapiens
aggtctcatgcctgagaa

SEQ ID NO: 5222371 - DNA, 12 bp, Homo sapiens
aggtctcattca

SEQ ID NO: 5222372 - DNA, 15 bp, Homo sapiens
aggtctccacccctc

SEQ ID NO: 5222373 - DNA, 19 bp, Homo sapiens
aggtctccacccctcaagc

SEQ ID NO: 5222374 - DNA, 15 bp, Homo sapiens
aggtctccacctgca

SEQ ID NO: 5222375 - DNA, 16 bp, Homo sapiens
aggtctccacctgcac

SEQ ID NO: 5222376 - DNA, 21 bp, Homo sapiens
aggtctccaggggcctgcaga

SEQ ID NO: 5222377 - DNA, 22 bp, Homo sapiens
aggtctccaggggcctgcagaa

SEQ ID NO: 5222378 - DNA, 15 bp, Homo sapiens
aggtctccatgaaga

SEQ ID NO: 5222379 - DNA, 17 bp, Homo sapiens
aggtctcccacgtggga

SEQ ID NO: 5222380 - DNA, 17 bp, Homo sapiens
aggtctccccatcccca

SEQ ID NO: 5222381 - DNA, 16 bp, Homo sapiens
aggtctcccgggaagc

SEQ ID NO: 5222382 - DNA, 23 bp, Homo sapiens
aggtctcccgggaagccaccctc

SEQ ID NO: 5222383 - DNA, 20 bp, Homo sapiens
aggtctcctcagggtggggg

SEQ ID NO: 5222384 - DNA, 15 bp, Homo sapiens
aggtctcctccaccg

SEQ ID NO: 5222385 - DNA, 17 bp, Homo sapiens
aggtctcctgggaaagg

SEQ ID NO: 5222386 - DNA, 23 bp, Homo sapiens
aggtctcctgggcatctggccct

SEQ ID NO: 5222387 - DNA, 22 bp, Homo sapiens
aggtctccttactctgagccca

SEQ ID NO: 5222388 - DNA, 23 bp, Homo sapiens
aggtctccttactctgagcccag

SEQ ID NO: 5222389 - DNA, 14 bp, Homo sapiens
aggtctcgaccctg

SEQ ID NO: 5222390 - DNA, 21 bp, Homo sapiens
aggtctcggactaagcctacc

SEQ ID NO: 5222391 - DNA, 21 bp, Homo sapiens
aggtctcgggggtccggaagg

SEQ ID NO: 5222392 - DNA, 15 bp, Homo sapiens
aggtctcgtcccagc

SEQ ID NO: 5222393 - DNA, 14 bp, Homo sapiens
aggtctctccactg

SEQ ID NO: 5222394 - DNA, 15 bp, Homo sapiens
aggtctctccctccc

SEQ ID NO: 5222395 - DNA, 20 bp, Homo sapiens
aggtctctctggctctagga

SEQ ID NO: 5222396 - DNA, 15 bp, Homo sapiens
aggtctctctttgga

SEQ ID NO: 5222397 - DNA, 14 bp, Homo sapiens
aggtctctggcaga

SEQ ID NO: 5222398 - DNA, 22 bp, Homo sapiens
aggtctctggcagagaaggatg

SEQ ID NO: 5222399 - DNA, 18 bp, Homo sapiens
aggtctctgggagcccag

SEQ ID NO: 5222400 - DNA, 15 bp, Homo sapiens
aggtctcttcccctc

SEQ ID NO: 5222401 - DNA, 22 bp, Homo sapiens
aggtctgaaaagaggagccaga

SEQ ID NO: 5222402 - DNA, 18 bp, Homo sapiens
aggtctgaaggcctccat

SEQ ID NO: 5222403 - DNA, 15 bp, Homo sapiens
aggtctgaatctgcg

SEQ ID NO: 5222404 - DNA, 20 bp, Homo sapiens
aggtctgacacgtctgccta

SEQ ID NO: 5222405 - DNA, 19 bp, Homo sapiens
aggtctgacagtagctctt

SEQ ID NO: 5222406 - DNA, 21 bp, Homo sapiens
aggtctgaccaaaaccagagg

SEQ ID NO: 5222407 - DNA, 19 bp, Homo sapiens
aggtctgactccaaagctg

SEQ ID NO: 5222408 - DNA, 22 bp, Homo sapiens
aggtctgagcactggagtggct

SEQ ID NO: 5222409 - DNA, 23 bp, Homo sapiens
aggtctgagccacagcagcattt

SEQ ID NO: 5222410 - DNA, 14 bp, Homo sapiens
aggtctgagccctg

SEQ ID NO: 5222411 - DNA, 16 bp, Homo sapiens
aggtctgatctgggtt

SEQ ID NO: 5222412 - DNA, 18 bp, Homo sapiens
aggtctgatgccaaagct

SEQ ID NO: 5222413 - DNA, 23 bp, Homo sapiens
aggtctgatgccaaagctgcttt

SEQ ID NO: 5222414 - DNA, 15 bp, Homo sapiens
aggtctgattggctg

SEQ ID NO: 5222415 - DNA, 18 bp, Homo sapiens
aggtctgattggctgctt

SEQ ID NO: 5222416 - DNA, 17 bp, Homo sapiens
aggtctgatttgcagga

SEQ ID NO: 5222417 - DNA, 18 bp, Homo sapiens
aggtctgcaagggcccag

SEQ ID NO: 5222418 - DNA, 19 bp, Homo sapiens
aggtctgcaagggcccaga

SEQ ID NO: 5222419 - DNA, 20 bp, Homo sapiens
aggtctgcaagggcccagag

SEQ ID NO: 5222420 - DNA, 17 bp, Homo sapiens
aggtctgcaggccacca

SEQ ID NO: 5222421 - DNA, 18 bp, Homo sapiens
aggtctgcattttctcag

SEQ ID NO: 5222422 - DNA, 19 bp, Homo sapiens
aggtctgcattttctcagg

SEQ ID NO: 5222423 - DNA, 14 bp, Homo sapiens
aggtctgctcggcc

SEQ ID NO: 5222424 - DNA, 22 bp, Homo sapiens
aggtctggagaagctcccagga

SEQ ID NO: 5222425 - DNA, 24 bp, Homo sapiens
aggtctggattttcaaagattgtt

SEQ ID NO: 5222426 - DNA, 16 bp, Homo sapiens
aggtctggcctcaggt

SEQ ID NO: 5222427 - DNA, 23 bp, Homo sapiens
aggtctggcgccaggggcaggca

SEQ ID NO: 5222428 - DNA, 16 bp, Homo sapiens
aggtctggctgagccc

SEQ ID NO: 5222429 - DNA, 19 bp, Homo sapiens
aggtctggctgagcccctg

SEQ ID NO: 5222430 - DNA, 20 bp, Homo sapiens
aggtctggctgagcccctgg

SEQ ID NO: 5222431 - DNA, 19 bp, Homo sapiens
aggtctgggagaggcagag

SEQ ID NO: 5222432 - DNA, 21 bp, Homo sapiens
aggtctgggagtgttctgttt

SEQ ID NO: 5222433 - DNA, 16 bp, Homo sapiens
aggtctgggatggaca

SEQ ID NO: 5222434 - DNA, 22 bp, Homo sapiens
aggtctgggccagatgctgggc

SEQ ID NO: 5222435 - DNA, 18 bp, Homo sapiens
aggtctggtcggcaaact

SEQ ID NO: 5222436 - DNA, 13 bp, Homo sapiens
aggtctgtaaaga

SEQ ID NO: 5222437 - DNA, 13 bp, Homo sapiens
aggtctgtatgtc

SEQ ID NO: 5222438 - DNA, 19 bp, Homo sapiens
aggtctgtggaaagtggtg

SEQ ID NO: 5222439 - DNA, 20 bp, Homo sapiens
aggtctgtggctcctcccga

SEQ ID NO: 5222440 - DNA, 18 bp, Homo sapiens
aggtctgtggtgcagtgt

SEQ ID NO: 5222441 - DNA, 20 bp, Homo sapiens
aggtctgtggtgcagtgtgt

SEQ ID NO: 5222442 - DNA, 16 bp, Homo sapiens
aggtctgttctttcca

SEQ ID NO: 5222443 - DNA, 18 bp, Homo sapiens
aggtctgttctttccaaa

SEQ ID NO: 5222444 - DNA, 22 bp, Homo sapiens
aggtctgttgaagtgcatgtta

SEQ ID NO: 5222445 - DNA, 12 bp, Homo sapiens
aggtctgtttaa

SEQ ID NO: 5222446 - DNA, 22 bp, Homo sapiens
aggtctgttttgtgtactttta

SEQ ID NO: 5222447 - DNA, 14 bp, Homo sapiens
aggtctgtttttat

SEQ ID NO: 5222448 - DNA, 17 bp, Homo sapiens
aggtcttacattgcctg

SEQ ID NO: 5222449 - DNA, 18 bp, Homo sapiens
aggtcttatctgttcagt

SEQ ID NO: 5222450 - DNA, 20 bp, Homo sapiens
agtctttctctttccctggt

SEQ ID NO: 5222451 - DNA, 13 bp, Homo sapiens
agtctttcttgaa

SEQ ID NO: 5222452 - DNA, 15 bp, Homo sapiens
agtctttcttgaaat

SEQ ID NO: 5222453 - DNA, 17 bp, Homo sapiens
agtctttcttgaaattg

SEQ ID NO: 5222454 - DNA, 19 bp, Homo sapiens
agtctttcttgaaattgaa

SEQ ID NO: 5222455 - DNA, 17 bp, Homo sapiens
agtctttgaagctgaaa

SEQ ID NO: 5222456 - DNA, 13 bp, Homo sapiens
agtctttgctcag

SEQ ID NO: 5222457 - DNA, 19 bp, Homo sapiens
agtctttgctcagtgtcca

SEQ ID NO: 5222458 - DNA, 17 bp, Homo sapiens
agtctttggaaccctaa

SEQ ID NO: 5222459 - DNA, 19 bp, Homo sapiens
agtctttgggggattcaaa

SEQ ID NO: 5222460 - DNA, 21 bp, Homo sapiens
agtctttggtacaagtttaca

SEQ ID NO: 5222461 - DNA, 18 bp, Homo sapiens
agtctttggttctaagga

SEQ ID NO: 5222462 - DNA, 22 bp, Homo sapiens
agtctttgtaagtaaactgccc

SEQ ID NO: 5222463 - DNA, 22 bp, Homo sapiens
agtctttgtgtgttatattcca

SEQ ID NO: 5222464 - DNA, 13 bp, Homo sapiens
agtcttttaaaaa

SEQ ID NO: 5222465 - DNA, 13 bp, Homo sapiens
agtcttttccatg

SEQ ID NO: 5222466 - DNA, 14 bp, Homo sapiens
agtcttttctctga

SEQ ID NO: 5222467 - DNA, 15 bp, Homo sapiens
agtcttttctctgaa

SEQ ID NO: 5222468 - DNA, 16 bp, Homo sapiens
agtcttttctctgaaa

SEQ ID NO: 5222469 - DNA, 23 bp, Homo sapiens
agtcttttgcatgtcgcacaatg

SEQ ID NO: 5222470 - DNA, 18 bp, Homo sapiens
agtcttttgcttttggca

SEQ ID NO: 5222471 - DNA, 11 bp, Homo sapiens
agtcttttgtc

SEQ ID NO: 5222472 - DNA, 20 bp, Homo sapiens
agtctttttataggttttat

SEQ ID NO: 5222473 - DNA, 21 bp, Homo sapiens
agtctttttataggttttata

SEQ ID NO: 5222474 - DNA, 15 bp, Homo sapiens
agtctttttcatttt

SEQ ID NO: 5222475 - DNA, 21 bp, Homo sapiens
agtctttttcattttgcagaa

SEQ ID NO: 5222476 - DNA, 13 bp, Homo sapiens
agtctttttctgt

SEQ ID NO: 5222477 - DNA, 14 bp, Homo sapiens
agtctttttctgtt

SEQ ID NO: 5222478 - DNA, 18 bp, Homo sapiens
agtctttttctgttgtaa

SEQ ID NO: 5222479 - DNA, 19 bp, Homo sapiens
agtctttttctgttgtaac

SEQ ID NO: 5222480 - DNA, 21 bp, Homo sapiens
agtctttttctgttgtaactt

SEQ ID NO: 5222481 - DNA, 19 bp, Homo sapiens
agtctttttctttttttgg

SEQ ID NO: 5222482 - DNA, 21 bp, Homo sapiens
agtctttttctttttttggta

SEQ ID NO: 5222483 - DNA, 22 bp, Homo sapiens
agtctttttctttttttggtaa

SEQ ID NO: 5222484 - DNA, 18 bp, Homo sapiens
agtcttttttttttaagt

SEQ ID NO: 5222485 - DNA, 16 bp, Homo sapiens
agtgaaaaaaagaaac

SEQ ID NO: 5222486 - DNA, 18 bp, Homo sapiens
agtgaaaaaaagaaacga

SEQ ID NO: 5222487 - DNA, 14 bp, Homo sapiens
agtgaaaaacagaa

SEQ ID NO: 5222488 - DNA, 14 bp, Homo sapiens
agtgaaaaactgct

SEQ ID NO: 5222489 - DNA, 15 bp, Homo sapiens
agtgaaaaactgctg

SEQ ID NO: 5222490 - DNA, 16 bp, Homo sapiens
agtgaaaaactgctgt

SEQ ID NO: 5222491 - DNA, 17 bp, Homo sapiens
agtgaaaaactgctgta

SEQ ID NO: 5222492 - DNA, 19 bp, Homo sapiens
agtgaaaaagacttcaaat

SEQ ID NO: 5222493 - DNA, 23 bp, Homo sapiens
agtgaaaaagacttcaaatgtta

SEQ ID NO: 5222494 - DNA, 12 bp, Homo sapiens
agtgaaaaagat

SEQ ID NO: 5222495 - DNA, 17 bp, Homo sapiens
agtgaaaaaggaggaag

SEQ ID NO: 5222496 - DNA, 20 bp, Homo sapiens
agtgaaaacaagtgctggca

SEQ ID NO: 5222497 - DNA, 17 bp, Homo sapiens
agtgaaaagattttatt

SEQ ID NO: 5222498 - DNA, 15 bp, Homo sapiens
agtgaaaattctgtt

SEQ ID NO: 5222499 - DNA, 21 bp, Homo sapiens
agtgaaaatttttacattcat

SEQ ID NO: 5222500 - DNA, 15 bp, Homo sapiens
agtgaaacaaattta

SEQ ID NO: 5222501 - DNA, 12 bp, Homo sapiens
agtgaaacagag

SEQ ID NO: 5222502 - DNA, 14 bp, Homo sapiens
agtgaaacagagaa

SEQ ID NO: 5222503 - DNA, 15 bp, Homo sapiens
agtgaaacagagaaa

SEQ ID NO: 5222504 - DNA, 18 bp, Homo sapiens
agtgaaacagagaaagaa

SEQ ID NO: 5222505 - DNA, 21 bp, Homo sapiens
agtgaaacagagaaagaaaag

SEQ ID NO: 5222506 - DNA, 18 bp, Homo sapiens
agtgaaacatcatagaaa

SEQ ID NO: 5222507 - DNA, 19 bp, Homo sapiens
agtgaaacctttagggcag

SEQ ID NO: 5222508 - DNA, 22 bp, Homo sapiens
agtgaaacctttagggcagctt

SEQ ID NO: 5222509 - DNA, 24 bp, Homo sapiens
agtgaaactgcttgtttcctagca

SEQ ID NO: 5222510 - DNA, 13 bp, Homo sapiens
agtgaaacttgtg

SEQ ID NO: 5222511 - DNA, 12 bp, Homo sapiens
agtgaaactttt

SEQ ID NO: 5222512 - DNA, 17 bp, Homo sapiens
agtgaaagacaagctgc

SEQ ID NO: 5222513 - DNA, 17 bp, Homo sapiens
agtgaaagagattactt

SEQ ID NO: 5222514 - DNA, 13 bp, Homo sapiens
agtgaaagtactt

SEQ ID NO: 5222515 - DNA, 19 bp, Homo sapiens
agtgaaataacaaaatgga

SEQ ID NO: 5222516 - DNA, 14 bp, Homo sapiens
agtgaaataataga

SEQ ID NO: 5222517 - DNA, 13 bp, Homo sapiens
agtgaaataatgt

SEQ ID NO: 5222518 - DNA, 16 bp, Homo sapiens
agtgaaataatgtgta

SEQ ID NO: 5222519 - DNA, 20 bp, Homo sapiens
agtgaaataattacagaata

SEQ ID NO: 5222520 - DNA, 20 bp, Homo sapiens
agtgaaataatttgtgtctg

SEQ ID NO: 5222521 - DNA, 22 bp, Homo sapiens
agtgaaattaggccttatgtaa

SEQ ID NO: 5222522 - DNA, 19 bp, Homo sapiens
agtgaaattagtattttga

SEQ ID NO: 5222523 - DNA, 20 bp, Homo sapiens
agtgaaattcaattcataga

SEQ ID NO: 5222524 - DNA, 13 bp, Homo sapiens
agtgaaatttatt

SEQ ID NO: 5222525 - DNA, 16 bp, Homo sapiens
agtgaaattttaaatg

SEQ ID NO: 5222526 - DNA, 16 bp, Homo sapiens
agtgaacaaatttaca

SEQ ID NO: 5222527 - DNA, 20 bp, Homo sapiens
agtgaacaaatttacagaga

SEQ ID NO: 5222528 - DNA, 17 bp, Homo sapiens
agtgaacaaatttcaaa

SEQ ID NO: 5222529 - DNA, 15 bp, Homo sapiens
agtgaacacagcaga

SEQ ID NO: 5222530 - DNA, 18 bp, Homo sapiens
agtgaacacattgtgtca

SEQ ID NO: 5222531 - DNA, 14 bp, Homo sapiens
agtgaacacatttt

SEQ ID NO: 5222532 - DNA, 20 bp, Homo sapiens
agtgaacataattcttatta

SEQ ID NO: 5222533 - DNA, 15 bp, Homo sapiens
agtgaacattcccag

SEQ ID NO: 5222534 - DNA, 20 bp, Homo sapiens
agtgaaccaaaaatagaaat

SEQ ID NO: 5222535 - DNA, 16 bp, Homo sapiens
agtgaacccatatttt

SEQ ID NO: 5222536 - DNA, 17 bp, Homo sapiens
agtgaacctaccttcat

SEQ ID NO: 5222537 - DNA, 22 bp, Homo sapiens
agtgaacctcaccccgaggccc

SEQ ID NO: 5222538 - DNA, 15 bp, Homo sapiens
agtgaactaagttat

SEQ ID NO: 5222539 - DNA, 21 bp, Homo sapiens
agtgaactaagttattgttaa

SEQ ID NO: 5222540 - DNA, 14 bp, Homo sapiens
agtgaactcctgcc

SEQ ID NO: 5222541 - DNA, 15 bp, Homo sapiens
agtgaactcctgcca

SEQ ID NO: 5222542 - DNA, 13 bp, Homo sapiens
agtgaactctcaa

SEQ ID NO: 5222543 - DNA, 16 bp, Homo sapiens
agtgaacttgggccac

SEQ ID NO: 5222544 - DNA, 19 bp, Homo sapiens
agtgaacttttgtaatttg

SEQ ID NO: 5222545 - DNA, 21 bp, Homo sapiens
agtgaacttttgtaatttgaa

SEQ ID NO: 5222546 - DNA, 19 bp, Homo sapiens
agtgaagaaaagtgaatgc

SEQ ID NO: 5222547 - DNA, 13 bp, Homo sapiens
agtgaagaaaatg

SEQ ID NO: 5222548 - DNA, 23 bp, Homo sapiens
agtgaagaaccctatttaaaact

SEQ ID NO: 5222549 - DNA, 13 bp, Homo sapiens
agtgaagaataca

SEQ ID NO: 5222550 - DNA, 22 bp, Homo sapiens
agtgaagaataggtgcaaacaa

SEQ ID NO: 5222551 - DNA, 13 bp, Homo sapiens
agtgaagaatctt

SEQ ID NO: 5222552 - DNA, 15 bp, Homo sapiens
agtgaagaatttatc

SEQ ID NO: 5222553 - DNA, 14 bp, Homo sapiens
agtgaagacaatga

SEQ ID NO: 5222554 - DNA, 16 bp, Homo sapiens
agtgaagacaatgact

SEQ ID NO: 5222555 - DNA, 13 bp, Homo sapiens
agtgaagacagaa

SEQ ID NO: 5222556 - DNA, 20 bp, Homo sapiens
agtgaagacagaaccacagg

SEQ ID NO: 5222557 - DNA, 19 bp, Homo sapiens
agtgaagaccagagcagtt

SEQ ID NO: 5222558 - DNA, 16 bp, Homo sapiens
agtgaagactggaagc

SEQ ID NO: 5222559 - DNA, 16 bp, Homo sapiens
agtgaagacttcttgg

SEQ ID NO: 5222560 - DNA, 16 bp, Homo sapiens
agtgaagagcatttgg

SEQ ID NO: 5222561 - DNA, 21 bp, Homo sapiens
agtgaagagcatttggtacac

SEQ ID NO: 5222562 - DNA, 17 bp, Homo sapiens
agtgaagaggggcagcc

SEQ ID NO: 5222563 - DNA, 20 bp, Homo sapiens
agtgaagaggggcagccctt

SEQ ID NO: 5222564 - DNA, 17 bp, Homo sapiens
agtgaagatgctgtaaa

SEQ ID NO: 5222565 - DNA, 18 bp, Homo sapiens
agtgaagatgctgtaaat

SEQ ID NO: 5222566 - DNA, 19 bp, Homo sapiens
agtgaagatgctgtaaata

SEQ ID NO: 5222567 - DNA, 15 bp, Homo sapiens
agtgaagatgtgtaa

SEQ ID NO: 5222568 - DNA, 16 bp, Homo sapiens
agtgaagatgtgtaaa

SEQ ID NO: 5222569 - DNA, 22 bp, Homo sapiens
agtgaagccagctgcaggaatc

SEQ ID NO: 5222570 - DNA, 16 bp, Homo sapiens
agtgaagcccaggagg

SEQ ID NO: 5222571 - DNA, 23 bp, Homo sapiens
agtgaagccccttgtcctctccc

SEQ ID NO: 5222572 - DNA, 16 bp, Homo sapiens
agtgaagctctcaccc

SEQ ID NO: 5222573 - DNA, 20 bp, Homo sapiens
agtgaaggagccacgtgaat

SEQ ID NO: 5222574 - DNA, 16 bp, Homo sapiens
agtgaagggttttgtg

SEQ ID NO: 5222575 - DNA, 23 bp, Homo sapiens
agtgaaggtctttgttatgacag

SEQ ID NO: 5222576 - DNA, 22 bp, Homo sapiens
agtgaaggtggggagaagctga

SEQ ID NO: 5222577 - DNA, 20 bp, Homo sapiens
agtgaaggttcccaaggaca

SEQ ID NO: 5222578 - DNA, 16 bp, Homo sapiens
agtgaagtaaaagtta

SEQ ID NO: 5222579 - DNA, 18 bp, Homo sapiens
agtgaagtctagaatcat

SEQ ID NO: 5222580 - DNA, 19 bp, Homo sapiens
agtgaagtgccacatgaca

SEQ ID NO: 5222581 - DNA, 16 bp, Homo sapiens
agtgaagttgtgcaac

SEQ ID NO: 5222582 - DNA, 15 bp, Homo sapiens
agtgaataaaaatta

SEQ ID NO: 5222583 - DNA, 14 bp, Homo sapiens
agtgaataaacttc

SEQ ID NO: 5222584 - DNA, 17 bp, Homo sapiens
agtgaataaacttcagc

SEQ ID NO: 5222585 - DNA, 18 bp, Homo sapiens
agtgaataaacttcagca

SEQ ID NO: 5222586 - DNA, 13 bp, Homo sapiens
agtgaataaatat

SEQ ID NO: 5222587 - DNA, 17 bp, Homo sapiens
agtgaataaatgtcttg

SEQ ID NO: 5222588 - DNA, 22 bp, Homo sapiens
agtgaatacatggtagcagggt

SEQ ID NO: 5222589 - DNA, 14 bp, Homo sapiens
agtgaatataaatg

SEQ ID NO: 5222590 - DNA, 19 bp, Homo sapiens
agtgaatataaatgtacta

SEQ ID NO: 5222591 - DNA, 17 bp, Homo sapiens
agtgaatatttttgtat

SEQ ID NO: 5222592 - DNA, 14 bp, Homo sapiens
agtgaatccctggg

SEQ ID NO: 5222593 - DNA, 15 bp, Homo sapiens
agtgaatccctggga

SEQ ID NO: 5222594 - DNA, 23 bp, Homo sapiens
agtgaatctaaaagcttttgctt

SEQ ID NO: 5222595 - DNA, 13 bp, Homo sapiens
agtgaatctgatt

SEQ ID NO: 5222596 - DNA, 15 bp, Homo sapiens
agtgaatctgattgc

SEQ ID NO: 5222597 - DNA, 15 bp, Homo sapiens
agtgaatctgtttca

SEQ ID NO: 5222598 - DNA, 21 bp, Homo sapiens
agtgaatcttatggtggaaga

SEQ ID NO: 5222599 - DNA, 23 bp, Homo sapiens
agtgaatctttctcctggtgact

SEQ ID NO: 5222600 - DNA, 20 bp, Homo sapiens
agtgaatgagtttccagcta

SEQ ID NO: 5222601 - DNA, 13 bp, Homo sapiens
agtgaatgattca

SEQ ID NO: 5222602 - DNA, 19 bp, Homo sapiens
agtgaatgctgggactcag

SEQ ID NO: 5222603 - DNA, 23 bp, Homo sapiens
agtgaatggcatttgctggttat

SEQ ID NO: 5222604 - DNA, 15 bp, Homo sapiens
agtgaatgggaaagg

SEQ ID NO: 5222605 - DNA, 22 bp, Homo sapiens
agtgaatggggaagggagtctc

SEQ ID NO: 5222606 - DNA, 15 bp, Homo sapiens
agtgaatgtaatagt

SEQ ID NO: 5222607 - DNA, 12 bp, Homo sapiens
agtgaatgtggc

SEQ ID NO: 5222608 - DNA, 12 bp, Homo sapiens
agtgaatgttaa

SEQ ID NO: 5222609 - DNA, 19 bp, Homo sapiens
agtgaattagacctttatt

SEQ ID NO: 5222610 - DNA, 17 bp, Homo sapiens
agtgaattccctcactc

SEQ ID NO: 5222611 - DNA, 21 bp, Homo sapiens
agtgaattgtacctatttctg

SEQ ID NO: 5222612 - DNA, 23 bp, Homo sapiens
agtgaattgtacctatttctgat

SEQ ID NO: 5222613 - DNA, 14 bp, Homo sapiens
agtgaattgtcttt

SEQ ID NO: 5222614 - DNA, 20 bp, Homo sapiens
agtgaattgtcttttagaca

SEQ ID NO: 5222615 - DNA, 18 bp, Homo sapiens
agtgaatttatgagattt

SEQ ID NO: 5222616 - DNA, 14 bp, Homo sapiens
agtgaatttcagta

SEQ ID NO: 5222617 - DNA, 15 bp, Homo sapiens
agtgaatttcagtat

SEQ ID NO: 5222618 - DNA, 14 bp, Homo sapiens
agtgaatttctgat

SEQ ID NO: 5222619 - DNA, 20 bp, Homo sapiens
agtgaatttctgatttcact

SEQ ID NO: 5222620 - DNA, 15 bp, Homo sapiens
agtgaatttgaatga

SEQ ID NO: 5222621 - DNA, 20 bp, Homo sapiens
agtgaatttgaatgaaaaat

SEQ ID NO: 5222622 - DNA, 19 bp, Homo sapiens
agtgaatttgggctgctgt

SEQ ID NO: 5222623 - DNA, 20 bp, Homo sapiens
agtgaatttgtccattgtaa

SEQ ID NO: 5222624 - DNA, 16 bp, Homo sapiens
agtgaatttttctcta

SEQ ID NO: 5222625 - DNA, 23 bp, Homo sapiens
agtgaatttttctctaactcaga

SEQ ID NO: 5222626 - DNA, 23 bp, Homo sapiens
agtgaatttttgcaataatgcag

SEQ ID NO: 5222627 - DNA, 19 bp, Homo sapiens
agtgacaaaattggccaga

SEQ ID NO: 5222628 - DNA, 23 bp, Homo sapiens
agtgacaaaattggccagagagt

SEQ ID NO: 5222629 - DNA, 19 bp, Homo sapiens
aggtcttcttaatatgttc

SEQ ID NO: 5222630 - DNA, 16 bp, Homo sapiens
aggtcttgaactcctg

SEQ ID NO: 5222631 - DNA, 18 bp, Homo sapiens
aggtcttgaactcctggc

SEQ ID NO: 5222632 - DNA, 22 bp, Homo sapiens
aggtcttgaactcctggcctca

SEQ ID NO: 5222633 - DNA, 19 bp, Homo sapiens
aggtcttgactcatggcag

SEQ ID NO: 5222634 - DNA, 18 bp, Homo sapiens
aggtcttgagtttcattt

SEQ ID NO: 5222635 - DNA, 21 bp, Homo sapiens
aggtcttgcagtggcttttca

SEQ ID NO: 5222636 - DNA, 13 bp, Homo sapiens
aggtcttgcctga

SEQ ID NO: 5222637 - DNA, 23 bp, Homo sapiens
aggtcttgctctcctaggtagcc

SEQ ID NO: 5222638 - DNA, 14 bp, Homo sapiens
aggtcttggccgac

SEQ ID NO: 5222639 - DNA, 23 bp, Homo sapiens
aggtcttggccgactcagggacc

SEQ ID NO: 5222640 - DNA, 19 bp, Homo sapiens
aggtcttgttcaagcagcg

SEQ ID NO: 5222641 - DNA, 16 bp, Homo sapiens
aggtctttaaaccttt

SEQ ID NO: 5222642 - DNA, 18 bp, Homo sapiens
aggtctttacttatgcac

SEQ ID NO: 5222643 - DNA, 13 bp, Homo sapiens
aggtctttcagaa

SEQ ID NO: 5222644 - DNA, 12 bp, Homo sapiens
aggtctttctct

SEQ ID NO: 5222645 - DNA, 16 bp, Homo sapiens
aggtctttgcacatgt

SEQ ID NO: 5222646 - DNA, 19 bp, Homo sapiens
aggtctttgtaaaatcttg

SEQ ID NO: 5222647 - DNA, 21 bp, Homo sapiens
aggtctttgtaagaactaaag

SEQ ID NO: 5222648 - DNA, 17 bp, Homo sapiens
aggtctttgttatgaca

SEQ ID NO: 5222649 - DNA, 12 bp, Homo sapiens
aggtcttttcaa

SEQ ID NO: 5222650 - DNA, 13 bp, Homo sapiens
aggtcttttcaaa

SEQ ID NO: 5222651 - DNA, 14 bp, Homo sapiens
aggtcttttcaaat

SEQ ID NO: 5222652 - DNA, 18 bp, Homo sapiens
aggtcttttctagtctga

SEQ ID NO: 5222653 - DNA, 12 bp, Homo sapiens
aggtcttttctt

SEQ ID NO: 5222654 - DNA, 14 bp, Homo sapiens
aggtcttttgacat

SEQ ID NO: 5222655 - DNA, 21 bp, Homo sapiens
aggtcttttgacatgtggaaa

SEQ ID NO: 5222656 - DNA, 23 bp, Homo sapiens
aggtctttttttttcttcattgt

SEQ ID NO: 5222657 - DNA, 21 bp, Homo sapiens
aggtgaaaaaagcttttatga

SEQ ID NO: 5222658 - DNA, 20 bp, Homo sapiens
aggtgaaaagggcagaggca

SEQ ID NO: 5222659 - DNA, 13 bp, Homo sapiens
aggtgaaaatgtt

SEQ ID NO: 5222660 - DNA, 14 bp, Homo sapiens
aggtgaaacacaca

SEQ ID NO: 5222661 - DNA, 16 bp, Homo sapiens
aggtgaaacattttct

SEQ ID NO: 5222662 - DNA, 20 bp, Homo sapiens
aggtgaaactccagatgcca

SEQ ID NO: 5222663 - DNA, 22 bp, Homo sapiens
aggtgaaactccagatgccaca

SEQ ID NO: 5222664 - DNA, 13 bp, Homo sapiens
aggtgaaagaaaa

SEQ ID NO: 5222665 - DNA, 15 bp, Homo sapiens
aggtgaaaggaaatt

SEQ ID NO: 5222666 - DNA, 14 bp, Homo sapiens
aggtgaaagggagc

SEQ ID NO: 5222667 - DNA, 21 bp, Homo sapiens
aggtgaaagggagctatcagg

SEQ ID NO: 5222668 - DNA, 15 bp, Homo sapiens
aggtgaaatgaagca

SEQ ID NO: 5222669 - DNA, 16 bp, Homo sapiens
aggtgaaatgaagcaa

SEQ ID NO: 5222670 - DNA, 15 bp, Homo sapiens
aggtgaacagtcacg

SEQ ID NO: 5222671 - DNA, 14 bp, Homo sapiens
aggtgaacattggt

SEQ ID NO: 5222672 - DNA, 17 bp, Homo sapiens
aggtgaactccaggcat

SEQ ID NO: 5222673 - DNA, 18 bp, Homo sapiens
aggtgaagatgaagaagc

SEQ ID NO: 5222674 - DNA, 18 bp, Homo sapiens
aggtgaaggaggctccag

SEQ ID NO: 5222675 - DNA, 21 bp, Homo sapiens
aggtgaaggaggctccaggca

SEQ ID NO: 5222676 - DNA, 22 bp, Homo sapiens
aggtgaaggctctcacccccat

SEQ ID NO: 5222677 - DNA, 14 bp, Homo sapiens
aggtgaagggatgg

SEQ ID NO: 5222678 - DNA, 15 bp, Homo sapiens
aggtgaagggatggg

SEQ ID NO: 5222679 - DNA, 16 bp, Homo sapiens
aggtgaagggatgggg

SEQ ID NO: 5222680 - DNA, 17 bp, Homo sapiens
aggtgaagggatggggg

SEQ ID NO: 5222681 - DNA, 20 bp, Homo sapiens
aggtgaaggtaactattaga

SEQ ID NO: 5222682 - DNA, 17 bp, Homo sapiens
aggtgaagtccctgttc

SEQ ID NO: 5222683 - DNA, 21 bp, Homo sapiens
aggtgaagtcgagcactctaa

SEQ ID NO: 5222684 - DNA, 19 bp, Homo sapiens
aggtgaatagccatatttg

SEQ ID NO: 5222685 - DNA, 22 bp, Homo sapiens
aggtgaatagccatatttgtaa

SEQ ID NO: 5222686 - DNA, 17 bp, Homo sapiens
aggtgaatgtcttcctt

SEQ ID NO: 5222687 - DNA, 23 bp, Homo sapiens
aggtgaattaattaaacattgtg

SEQ ID NO: 5222688 - DNA, 18 bp, Homo sapiens
aggtgacaaaccatttcc

SEQ ID NO: 5222689 - DNA, 20 bp, Homo sapiens
aggtgacaaaccatttccaa

SEQ ID NO: 5222690 - DNA, 21 bp, Homo sapiens
aggtgacactccagttgcaga

SEQ ID NO: 5222691 - DNA, 15 bp, Homo sapiens
aggtgacagtggctg

SEQ ID NO: 5222692 - DNA, 18 bp, Homo sapiens
aggtgacagtggctgctc

SEQ ID NO: 5222693 - DNA, 14 bp, Homo sapiens
aggtgaccccaggg

SEQ ID NO: 5222694 - DNA, 16 bp, Homo sapiens
aggtgaccccagggca

SEQ ID NO: 5222695 - DNA, 22 bp, Homo sapiens
aggtgaccccatctctgctgct

SEQ ID NO: 5222696 - DNA, 21 bp, Homo sapiens
aggtgacccttctgtctgtaa

SEQ ID NO: 5222697 - DNA, 13 bp, Homo sapiens
aggtgaccgccca

SEQ ID NO: 5222698 - DNA, 21 bp, Homo sapiens
aggtgaccgcccagctctccc

SEQ ID NO: 5222699 - DNA, 22 bp, Homo sapiens
aggtgaccgcccagctctccca

SEQ ID NO: 5222700 - DNA, 22 bp, Homo sapiens
aggtgactcgagtgtttaaatg

SEQ ID NO: 5222701 - DNA, 19 bp, Homo sapiens
aggtgacttgagagtggaa

SEQ ID NO: 5222702 - DNA, 19 bp, Homo sapiens
aggtgacttgcctggggcc

SEQ ID NO: 5222703 - DNA, 16 bp, Homo sapiens
aggtgagaacccagag

SEQ ID NO: 5222704 - DNA, 16 bp, Homo sapiens
aggtgagaactcagaa

SEQ ID NO: 5222705 - DNA, 21 bp, Homo sapiens
aggtgagaactcagaagagaa

SEQ ID NO: 5222706 - DNA, 13 bp, Homo sapiens
aggtgagaattca

SEQ ID NO: 5222707 - DNA, 21 bp, Homo sapiens
aggtgagacagcggtcccagg

SEQ ID NO: 5222708 - DNA, 23 bp, Homo sapiens
aggtgagaccaaaggatccagag

SEQ ID NO: 5222709 - DNA, 22 bp, Homo sapiens
aggtgagacttcccagaccccg

SEQ ID NO: 5222710 - DNA, 22 bp, Homo sapiens
aggtgagcaaccagttggctag

SEQ ID NO: 5222711 - DNA, 18 bp, Homo sapiens
aggtgagcacggccaaca

SEQ ID NO: 5222712 - DNA, 15 bp, Homo sapiens
aggtgagcaggcagg

SEQ ID NO: 5222713 - DNA, 23 bp, Homo sapiens
aggtgagcaggcagggctgggcc

SEQ ID NO: 5222714 - DNA, 20 bp, Homo sapiens
aggtgagcccatggccctcc

SEQ ID NO: 5222715 - DNA, 16 bp, Homo sapiens
aggtgagcctgggcag

SEQ ID NO: 5222716 - DNA, 13 bp, Homo sapiens
aggtgagctactt

SEQ ID NO: 5222717 - DNA, 13 bp, Homo sapiens
aggtgaggcagaa

SEQ ID NO: 5222718 - DNA, 17 bp, Homo sapiens
aggtgaggcctgtctgt

SEQ ID NO: 5222719 - DNA, 22 bp, Homo sapiens
aggtgaggcgttctcctgcttg

SEQ ID NO: 5222720 - DNA, 23 bp, Homo sapiens
aggtgaggtccaccggcccctgg

SEQ ID NO: 5222721 - DNA, 17 bp, Homo sapiens
aggtgaggtctgttcct

SEQ ID NO: 5222722 - DNA, 19 bp, Homo sapiens
aggtgagtgtgagggcagc

SEQ ID NO: 5222723 - DNA, 19 bp, Homo sapiens
aggtgagtttgagctgcct

SEQ ID NO: 5222724 - DNA, 22 bp, Homo sapiens
aggtgagtttgagctgccttcc

SEQ ID NO: 5222725 - DNA, 19 bp, Homo sapiens
aggtgagttttaaagaagt

SEQ ID NO: 5222726 - DNA, 12 bp, Homo sapiens
aggtgataaaga

SEQ ID NO: 5222727 - DNA, 16 bp, Homo sapiens
aggtgatagcattgct

SEQ ID NO: 5222728 - DNA, 16 bp, Homo sapiens
aggtgataggcaagga

SEQ ID NO: 5222729 - DNA, 21 bp, Homo sapiens
aggtgatatataatttcctca

SEQ ID NO: 5222730 - DNA, 18 bp, Homo sapiens
aggtgatatatttaaaaa

SEQ ID NO: 5222731 - DNA, 20 bp, Homo sapiens
aggtgatatttttatgtgca

SEQ ID NO: 5222732 - DNA, 23 bp, Homo sapiens
aggtgatcaaaataaaggcgcta

SEQ ID NO: 5222733 - DNA, 20 bp, Homo sapiens
aggtgatccacccacctcag

SEQ ID NO: 5222734 - DNA, 21 bp, Homo sapiens
aggtgatccacccacctcagc

SEQ ID NO: 5222735 - DNA, 23 bp, Homo sapiens
aggtgatccacccacctcagcct

SEQ ID NO: 5222736 - DNA, 15 bp, Homo sapiens
aggtgatccacctgc

SEQ ID NO: 5222737 - DNA, 21 bp, Homo sapiens
aggtgatccacctgcctcggc

SEQ ID NO: 5222738 - DNA, 15 bp, Homo sapiens
aggtgatcccgtttt

SEQ ID NO: 5222739 - DNA, 22 bp, Homo sapiens
aggtgatccgcccgcctctgcc

SEQ ID NO: 5222740 - DNA, 18 bp, Homo sapiens
aggtgatgaatttaccat

SEQ ID NO: 5222741 - DNA, 18 bp, Homo sapiens
aggtgatgccattacaga

SEQ ID NO: 5222742 - DNA, 21 bp, Homo sapiens
aggtgatggccagtcatgtgc

SEQ ID NO: 5222743 - DNA, 17 bp, Homo sapiens
aggtgattaaatattta

SEQ ID NO: 5222744 - DNA, 22 bp, Homo sapiens
aggtgattaaatatttaatgat

SEQ ID NO: 5222745 - DNA, 16 bp, Homo sapiens
aggtgattctaatcat

SEQ ID NO: 5222746 - DNA, 21 bp, Homo sapiens
aggtgattctaatcatctgca

SEQ ID NO: 5222747 - DNA, 19 bp, Homo sapiens
aggtgattcttacatatga

SEQ ID NO: 5222748 - DNA, 16 bp, Homo sapiens
aggtgatttcagactg

SEQ ID NO: 5222749 - DNA, 17 bp, Homo sapiens
aggtgatttcctctaaa

SEQ ID NO: 5222750 - DNA, 20 bp, Homo sapiens
aggtgattttcctgtgtcca

SEQ ID NO: 5222751 - DNA, 22 bp, Homo sapiens
aggtgcaacaaggtcctctgtc

SEQ ID NO: 5222752 - DNA, 14 bp, Homo sapiens
aggtgcaagagaca

SEQ ID NO: 5222753 - DNA, 15 bp, Homo sapiens
aggtgcaagagacag

SEQ ID NO: 5222754 - DNA, 16 bp, Homo sapiens
aggtgcaatttcaagg

SEQ ID NO: 5222755 - DNA, 18 bp, Homo sapiens
aggtgcaatttcaaggtt

SEQ ID NO: 5222756 - DNA, 19 bp, Homo sapiens
aggtgcaatttcaaggttc

SEQ ID NO: 5222757 - DNA, 16 bp, Homo sapiens
aggtgcacaagctcca

SEQ ID NO: 5222758 - DNA, 18 bp, Homo sapiens
aggtgcacaagctccaag

SEQ ID NO: 5222759 - DNA, 21 bp, Homo sapiens
aggtgcacaagctccaagctc

SEQ ID NO: 5222760 - DNA, 14 bp, Homo sapiens
aggtgcacattttc

SEQ ID NO: 5222761 - DNA, 20 bp, Homo sapiens
aggtgcaccggtttcataga

SEQ ID NO: 5222762 - DNA, 18 bp, Homo sapiens
aggtgcacctgccccagg

SEQ ID NO: 5222763 - DNA, 21 bp, Homo sapiens
aggtgcacgccaccacacctg

SEQ ID NO: 5222764 - DNA, 23 bp, Homo sapiens
aggtgcactgggaggctcccctt

SEQ ID NO: 5222765 - DNA, 23 bp, Homo sapiens
aggtgcacttggggcacagggag

SEQ ID NO: 5222766 - DNA, 12 bp, Homo sapiens
aggtgcagaggt

SEQ ID NO: 5222767 - DNA, 18 bp, Homo sapiens
aggtgcagagtgcccaga

SEQ ID NO: 5222768 - DNA, 13 bp, Homo sapiens
aggtgcagccaga

SEQ ID NO: 5222769 - DNA, 15 bp, Homo sapiens
aggtgcagccagagg

SEQ ID NO: 5222770 - DNA, 16 bp, Homo sapiens
aggtgcagccagaggc

SEQ ID NO: 5222771 - DNA, 15 bp, Homo sapiens
aggtgcaggcaggct

SEQ ID NO: 5222772 - DNA, 14 bp, Homo sapiens
aggtgcagtcccag

SEQ ID NO: 5222773 - DNA, 11 bp, Homo sapiens
aggtgcagtgg

SEQ ID NO: 5222774 - DNA, 20 bp, Homo sapiens
aggtgcagtggagggggcaa

SEQ ID NO: 5222775 - DNA, 23 bp, Homo sapiens
aggtgcagtggagggggcaagct

SEQ ID NO: 5222776 - DNA, 16 bp, Homo sapiens
aggtgcagtggctcac

SEQ ID NO: 5222777 - DNA, 16 bp, Homo sapiens
aggtgcagttccccca

SEQ ID NO: 5222778 - DNA, 20 bp, Homo sapiens
aggtgcatatttataaaaat

SEQ ID NO: 5222779 - DNA, 17 bp, Homo sapiens
aggtgcatctgcaggca

SEQ ID NO: 5222780 - DNA, 18 bp, Homo sapiens
aggtgcatctgcaggcac

SEQ ID NO: 5222781 - DNA, 23 bp, Homo sapiens
aggtgcatctggggaactagagg

SEQ ID NO: 5222782 - DNA, 20 bp, Homo sapiens
aggtgcatgcatgccctctc

SEQ ID NO: 5222783 - DNA, 13 bp, Homo sapiens
aggtgcatttctt

SEQ ID NO: 5222784 - DNA, 15 bp, Homo sapiens
aggtgccaccaataa

SEQ ID NO: 5222785 - DNA, 20 bp, Homo sapiens
aggtgccaccaataaaaatc

SEQ ID NO: 5222786 - DNA, 12 bp, Homo sapiens
aggtgccaccac

SEQ ID NO: 5222787 - DNA, 18 bp, Homo sapiens
aggtgccaccaccctgcc

SEQ ID NO: 5222788 - DNA, 19 bp, Homo sapiens
aggtgccaccaccctgccc

SEQ ID NO: 5222789 - DNA, 12 bp, Homo sapiens
aggtgccactcc

SEQ ID NO: 5222790 - DNA, 19 bp, Homo sapiens
aggtgccactccctgagct

SEQ ID NO: 5222791 - DNA, 20 bp, Homo sapiens
aggtgccactccctgagctt

SEQ ID NO: 5222792 - DNA, 14 bp, Homo sapiens
aggtgccactgacc

SEQ ID NO: 5222793 - DNA, 18 bp, Homo sapiens
aggtgccactggagtgtg

SEQ ID NO: 5222794 - DNA, 16 bp, Homo sapiens
aggtgccagcaaagcc

SEQ ID NO: 5222795 - DNA, 14 bp, Homo sapiens
aggtgccagcaact

SEQ ID NO: 5222796 - DNA, 15 bp, Homo sapiens
aggtgccagcaactg

SEQ ID NO: 5222797 - DNA, 19 bp, Homo sapiens
aggtgccagcaactgaata

SEQ ID NO: 5222798 - DNA, 14 bp, Homo sapiens
aggtgccatgcctg

SEQ ID NO: 5222799 - DNA, 15 bp, Homo sapiens
aggtgccatgcctgc

SEQ ID NO: 5222800 - DNA, 16 bp, Homo sapiens
aggtgccatggaagag

SEQ ID NO: 5222801 - DNA, 21 bp, Homo sapiens
aggtgccatggaagaggctac

SEQ ID NO: 5222802 - DNA, 13 bp, Homo sapiens
aggtgccatgtct

SEQ ID NO: 5222803 - DNA, 15 bp, Homo sapiens
aggtgcccaccacca

SEQ ID NO: 5222804 - DNA, 16 bp, Homo sapiens
aggtgcccactccgcc

SEQ ID NO: 5222805 - DNA, 17 bp, Homo sapiens
aggtgcccactccgcca

SEQ ID NO: 5222806 - DNA, 15 bp, Homo sapiens
agtgacaaagcaatt

SEQ ID NO: 5222807 - DNA, 21 bp, Homo sapiens
agtgacaaataagattaataa

SEQ ID NO: 5222808 - DNA, 17 bp, Homo sapiens
agtgacaaattgtaact

SEQ ID NO: 5222809 - DNA, 21 bp, Homo sapiens
agtgacaaattgtaactacac

SEQ ID NO: 5222810 - DNA, 17 bp, Homo sapiens
agtgacaagatgctctg

SEQ ID NO: 5222811 - DNA, 15 bp, Homo sapiens
agtgacaaggcccca

SEQ ID NO: 5222812 - DNA, 23 bp, Homo sapiens
agtgacaaggccccagagactca

SEQ ID NO: 5222813 - DNA, 15 bp, Homo sapiens
agtgacaagtgaaga

SEQ ID NO: 5222814 - DNA, 14 bp, Homo sapiens
agtgacacacactg

SEQ ID NO: 5222815 - DNA, 15 bp, Homo sapiens
agtgacacacactgt

SEQ ID NO: 5222816 - DNA, 24 bp, Homo sapiens
agtgacacacctcacgcaggctga

SEQ ID NO: 5222817 - DNA, 18 bp, Homo sapiens
agtgacacagcagcttca

SEQ ID NO: 5222818 - DNA, 17 bp, Homo sapiens
agtgacaccaataaatg

SEQ ID NO: 5222819 - DNA, 16 bp, Homo sapiens
agtgacacccagaggg

SEQ ID NO: 5222820 - DNA, 23 bp, Homo sapiens
agtgacacccagagggagtagaa

SEQ ID NO: 5222821 - DNA, 17 bp, Homo sapiens
agtgacacctcagtcat

SEQ ID NO: 5222822 - DNA, 21 bp, Homo sapiens
agtgacacttcagagagctgg

SEQ ID NO: 5222823 - DNA, 22 bp, Homo sapiens
agtgacacttcagagagctggt

SEQ ID NO: 5222824 - DNA, 14 bp, Homo sapiens
agtgacactttgaa

SEQ ID NO: 5222825 - DNA, 17 bp, Homo sapiens
agtgacagacaggctct

SEQ ID NO: 5222826 - DNA, 19 bp, Homo sapiens
agtgacagagttcactata

SEQ ID NO: 5222827 - DNA, 16 bp, Homo sapiens
agtgacagatcacagg

SEQ ID NO: 5222828 - DNA, 15 bp, Homo sapiens
agtgacagatgttat

SEQ ID NO: 5222829 - DNA, 20 bp, Homo sapiens
agtgacagatgttatttttg

SEQ ID NO: 5222830 - DNA, 22 bp, Homo sapiens
agtgacagatgttatttttgta

SEQ ID NO: 5222831 - DNA, 11 bp, Homo sapiens
agtgacagcta

SEQ ID NO: 5222832 - DNA, 12 bp, Homo sapiens
agtgacagctag

SEQ ID NO: 5222833 - DNA, 16 bp, Homo sapiens
agtgacagctttctgg

SEQ ID NO: 5222834 - DNA, 21 bp, Homo sapiens
agtgacagtcataaatactgt

SEQ ID NO: 5222835 - DNA, 19 bp, Homo sapiens
agtgacagttgcagccctt

SEQ ID NO: 5222836 - DNA, 21 bp, Homo sapiens
agtgacagtttcttttgtgtt

SEQ ID NO: 5222837 - DNA, 20 bp, Homo sapiens
agtgacataatatattctat

SEQ ID NO: 5222838 - DNA, 19 bp, Homo sapiens
agtgacatcaaagcctggc

SEQ ID NO: 5222839 - DNA, 22 bp, Homo sapiens
agtgacatctctttgatgtcat

SEQ ID NO: 5222840 - DNA, 14 bp, Homo sapiens
agtgacatgaagca

SEQ ID NO: 5222841 - DNA, 17 bp, Homo sapiens
agtgacatgcagttata

SEQ ID NO: 5222842 - DNA, 20 bp, Homo sapiens
agtgacatgtcctctctgct

SEQ ID NO: 5222843 - DNA, 22 bp, Homo sapiens
agtgacatgtcctctctgcttg

SEQ ID NO: 5222844 - DNA, 21 bp, Homo sapiens
agtgaccaatcgggagtagca

SEQ ID NO: 5222845 - DNA, 18 bp, Homo sapiens
agtgaccagcacactgga

SEQ ID NO: 5222846 - DNA, 21 bp, Homo sapiens
agtgaccagcataccagttct

SEQ ID NO: 5222847 - DNA, 22 bp, Homo sapiens
agtgaccagcataccagttctt

SEQ ID NO: 5222848 - DNA, 21 bp, Homo sapiens
agtgaccataaaggcatggca

SEQ ID NO: 5222849 - DNA, 18 bp, Homo sapiens
agtgaccatactaattat

SEQ ID NO: 5222850 - DNA, 18 bp, Homo sapiens
agtgaccatgaaaaataa

SEQ ID NO: 5222851 - DNA, 17 bp, Homo sapiens
agtgaccccagatgacc

SEQ ID NO: 5222852 - DNA, 18 bp, Homo sapiens
agtgaccccagctccagg

SEQ ID NO: 5222853 - DNA, 15 bp, Homo sapiens
agtgacccggaggcc

SEQ ID NO: 5222854 - DNA, 13 bp, Homo sapiens
agtgaccctcagc

SEQ ID NO: 5222855 - DNA, 16 bp, Homo sapiens
agtgaccctcagctgt

SEQ ID NO: 5222856 - DNA, 17 bp, Homo sapiens
agtgaccctgctctcac

SEQ ID NO: 5222857 - DNA, 16 bp, Homo sapiens
agtgaccctggagcta

SEQ ID NO: 5222858 - DNA, 17 bp, Homo sapiens
agtgaccctggagctag

SEQ ID NO: 5222859 - DNA, 17 bp, Homo sapiens
agtgaccgactcattta

SEQ ID NO: 5222860 - DNA, 20 bp, Homo sapiens
agtgaccgactcatttacaa

SEQ ID NO: 5222861 - DNA, 22 bp, Homo sapiens
agtgaccgcttccccgatgtga

SEQ ID NO: 5222862 - DNA, 13 bp, Homo sapiens
agtgaccgggggc

SEQ ID NO: 5222863 - DNA, 23 bp, Homo sapiens
agtgaccgggggctgctgggcgt

SEQ ID NO: 5222864 - DNA, 17 bp, Homo sapiens
agtgacctcacttctgg

SEQ ID NO: 5222865 - DNA, 15 bp, Homo sapiens
agtgacctcggacag

SEQ ID NO: 5222866 - DNA, 13 bp, Homo sapiens
agtgacctctctc

SEQ ID NO: 5222867 - DNA, 12 bp, Homo sapiens
agtgacctgacc

SEQ ID NO: 5222868 - DNA, 15 bp, Homo sapiens
agtgacctgaggaag

SEQ ID NO: 5222869 - DNA, 18 bp, Homo sapiens
agtgacctgaggaagcgt

SEQ ID NO: 5222870 - DNA, 22 bp, Homo sapiens
agtgacctggaaggcccagcac

SEQ ID NO: 5222871 - DNA, 17 bp, Homo sapiens
agtgaccttttcttcat

SEQ ID NO: 5222872 - DNA, 18 bp, Homo sapiens
agtgaccttttcttcatt

SEQ ID NO: 5222873 - DNA, 19 bp, Homo sapiens
agtgacgaaaacattgtcc

SEQ ID NO: 5222874 - DNA, 16 bp, Homo sapiens
agtgacgggagcctcc

SEQ ID NO: 5222875 - DNA, 20 bp, Homo sapiens
agtgacgtgactcagagctt

SEQ ID NO: 5222876 - DNA, 16 bp, Homo sapiens
agtgacgtgagtgggg

SEQ ID NO: 5222877 - DNA, 22 bp, Homo sapiens
agtgactaaaccattgtgcatt

SEQ ID NO: 5222878 - DNA, 21 bp, Homo sapiens
agtgactaccacttatttcta

SEQ ID NO: 5222879 - DNA, 16 bp, Homo sapiens
agtgactagtacaaat

SEQ ID NO: 5222880 - DNA, 23 bp, Homo sapiens
agtgactcatcctcttgaagatg

SEQ ID NO: 5222881 - DNA, 10 bp, Homo sapiens
agtgactcca

SEQ ID NO: 5222882 - DNA, 16 bp, Homo sapiens
agtgactccaagaaca

SEQ ID NO: 5222883 - DNA, 17 bp, Homo sapiens
agtgactccccagccca

SEQ ID NO: 5222884 - DNA, 15 bp, Homo sapiens
agtgactcctgctgg

SEQ ID NO: 5222885 - DNA, 14 bp, Homo sapiens
agtgactcgagggt

SEQ ID NO: 5222886 - DNA, 21 bp, Homo sapiens
agtgactcgggctcctgtgcc

SEQ ID NO: 5222887 - DNA, 17 bp, Homo sapiens
agtgactcggtgtaaaa

SEQ ID NO: 5222888 - DNA, 19 bp, Homo sapiens
agtgactcggtgtaaaacc

SEQ ID NO: 5222889 - DNA, 21 bp, Homo sapiens
agtgactcggtgtaaaaccat

SEQ ID NO: 5222890 - DNA, 13 bp, Homo sapiens
agtgactctcctg

SEQ ID NO: 5222891 - DNA, 22 bp, Homo sapiens
agtgactctcctgcctcagcct

SEQ ID NO: 5222892 - DNA, 20 bp, Homo sapiens
agtgactctggctgccaaga

SEQ ID NO: 5222893 - DNA, 22 bp, Homo sapiens
agtgactgaattctgccttggt

SEQ ID NO: 5222894 - DNA, 14 bp, Homo sapiens
agtgactgaccatg

SEQ ID NO: 5222895 - DNA, 18 bp, Homo sapiens
agtgactgaccatgcact

SEQ ID NO: 5222896 - DNA, 20 bp, Homo sapiens
agtgactgacggctgtgtat

SEQ ID NO: 5222897 - DNA, 16 bp, Homo sapiens
agtgactgctgcgctg

SEQ ID NO: 5222898 - DNA, 17 bp, Homo sapiens
agtgactgctgcgctgt

SEQ ID NO: 5222899 - DNA, 14 bp, Homo sapiens
agtgactggcaggt

SEQ ID NO: 5222900 - DNA, 15 bp, Homo sapiens
agtgactggcaggtg

SEQ ID NO: 5222901 - DNA, 18 bp, Homo sapiens
agtgactgggccctgtcc

SEQ ID NO: 5222902 - DNA, 16 bp, Homo sapiens
agtgactgtatctgtg

SEQ ID NO: 5222903 - DNA, 22 bp, Homo sapiens
agtgactgtcgtgtttacaaaa

SEQ ID NO: 5222904 - DNA, 23 bp, Homo sapiens
agtgactgtcgtgtttacaaaag

SEQ ID NO: 5222905 - DNA, 20 bp, Homo sapiens
agtgactgtggccatggtcc

SEQ ID NO: 5222906 - DNA, 13 bp, Homo sapiens
agtgactgttgta

SEQ ID NO: 5222907 - DNA, 23 bp, Homo sapiens
agtgactgtttggcttataaaca

SEQ ID NO: 5222908 - DNA, 21 bp, Homo sapiens
agtgacttagcagatgctggt

SEQ ID NO: 5222909 - DNA, 20 bp, Homo sapiens
agtgacttagttcttagaag

SEQ ID NO: 5222910 - DNA, 19 bp, Homo sapiens
agtgacttattttgtctta

SEQ ID NO: 5222911 - DNA, 15 bp, Homo sapiens
agtgacttcctgggg

SEQ ID NO: 5222912 - DNA, 15 bp, Homo sapiens
agtgacttcctggtg

SEQ ID NO: 5222913 - DNA, 18 bp, Homo sapiens
agtgacttcctggtgagg

SEQ ID NO: 5222914 - DNA, 12 bp, Homo sapiens
agtgacttctga

SEQ ID NO: 5222915 - DNA, 17 bp, Homo sapiens
agtgacttctgagatct

SEQ ID NO: 5222916 - DNA, 17 bp, Homo sapiens
agtgacttcttccctaa

SEQ ID NO: 5222917 - DNA, 22 bp, Homo sapiens
agtgacttcttccctaaaatgt

SEQ ID NO: 5222918 - DNA, 23 bp, Homo sapiens
agtgacttgaatgtacaaagata

SEQ ID NO: 5222919 - DNA, 14 bp, Homo sapiens
agtgacttgcccag

SEQ ID NO: 5222920 - DNA, 15 bp, Homo sapiens
agtgacttgcccagt

SEQ ID NO: 5222921 - DNA, 17 bp, Homo sapiens
agtgacttggagagaga

SEQ ID NO: 5222922 - DNA, 21 bp, Homo sapiens
agtgacttggccccagacgca

SEQ ID NO: 5222923 - DNA, 16 bp, Homo sapiens
agtgacttgtgtccca

SEQ ID NO: 5222924 - DNA, 18 bp, Homo sapiens
agtgactttacaggaggt

SEQ ID NO: 5222925 - DNA, 14 bp, Homo sapiens
agtgactttgtata

SEQ ID NO: 5222926 - DNA, 20 bp, Homo sapiens
agtgagaaaaagctcctgtc

SEQ ID NO: 5222927 - DNA, 13 bp, Homo sapiens
agtgagaaagaca

SEQ ID NO: 5222928 - DNA, 21 bp, Homo sapiens
agtgagaaatttttttccaga

SEQ ID NO: 5222929 - DNA, 12 bp, Homo sapiens
agtgagaagaat

SEQ ID NO: 5222930 - DNA, 19 bp, Homo sapiens
agtgagaagaatattgttc

SEQ ID NO: 5222931 - DNA, 23 bp, Homo sapiens
agtgagaagaatattgttcctaa

SEQ ID NO: 5222932 - DNA, 18 bp, Homo sapiens
agtgagaagctgaggcct

SEQ ID NO: 5222933 - DNA, 19 bp, Homo sapiens
agtgagaagctgaggccta

SEQ ID NO: 5222934 - DNA, 20 bp, Homo sapiens
agtgagaagctttgccctcc

SEQ ID NO: 5222935 - DNA, 18 bp, Homo sapiens
agtgagaagggcctgctc

SEQ ID NO: 5222936 - DNA, 19 bp, Homo sapiens
agtgagaataattgtgtac

SEQ ID NO: 5222937 - DNA, 23 bp, Homo sapiens
agtgagacacagagtggagccct

SEQ ID NO: 5222938 - DNA, 19 bp, Homo sapiens
agtgagacatcagggagta

SEQ ID NO: 5222939 - DNA, 13 bp, Homo sapiens
agtgagacccagg

SEQ ID NO: 5222940 - DNA, 18 bp, Homo sapiens
agtgagacccctgtctcc

SEQ ID NO: 5222941 - DNA, 16 bp, Homo sapiens
agtgagaccctgtctc

SEQ ID NO: 5222942 - DNA, 17 bp, Homo sapiens
agtgagaccctgtctca

SEQ ID NO: 5222943 - DNA, 21 bp, Homo sapiens
agtgagaccctgtctcaaaaa

SEQ ID NO: 5222944 - DNA, 23 bp, Homo sapiens
agtgagacctccctgtctctaca

SEQ ID NO: 5222945 - DNA, 15 bp, Homo sapiens
agtgagactgtacat

SEQ ID NO: 5222946 - DNA, 19 bp, Homo sapiens
agtgagactgtacataatt

SEQ ID NO: 5222947 - DNA, 17 bp, Homo sapiens
agtgagagaaatgaagt

SEQ ID NO: 5222948 - DNA, 22 bp, Homo sapiens
agtgagagacattaactcatta

SEQ ID NO: 5222949 - DNA, 13 bp, Homo sapiens
agtgagagagaca

SEQ ID NO: 5222950 - DNA, 18 bp, Homo sapiens
agtgagagagacaagaag

SEQ ID NO: 5222951 - DNA, 12 bp, Homo sapiens
agtgagagagag

SEQ ID NO: 5222952 - DNA, 22 bp, Homo sapiens
agtgagagagatgggagctcct

SEQ ID NO: 5222953 - DNA, 15 bp, Homo sapiens
agtgagagaggaggc

SEQ ID NO: 5222954 - DNA, 17 bp, Homo sapiens
agtgagagcacaaagat

SEQ ID NO: 5222955 - DNA, 12 bp, Homo sapiens
agtgagagcaga

SEQ ID NO: 5222956 - DNA, 12 bp, Homo sapiens
agtgagagccag

SEQ ID NO: 5222957 - DNA, 13 bp, Homo sapiens
agtgagagccttt

SEQ ID NO: 5222958 - DNA, 17 bp, Homo sapiens
agtgagagcctttgcct

SEQ ID NO: 5222959 - DNA, 23 bp, Homo sapiens
agtgagagcgtgctccagcctgg

SEQ ID NO: 5222960 - DNA, 19 bp, Homo sapiens
agtgagaggcccccaccct

SEQ ID NO: 5222961 - DNA, 14 bp, Homo sapiens
agtgagagggcatg

SEQ ID NO: 5222962 - DNA, 17 bp, Homo sapiens
agtgagaggggaggcca

SEQ ID NO: 5222963 - DNA, 19 bp, Homo sapiens
agtgagaggggaggccaag

SEQ ID NO: 5222964 - DNA, 23 bp, Homo sapiens
agtgagaggggagggctcctggg

SEQ ID NO: 5222965 - DNA, 13 bp, Homo sapiens
agtgagagtttgg

SEQ ID NO: 5222966 - DNA, 14 bp, Homo sapiens
agtgagatagcttc

SEQ ID NO: 5222967 - DNA, 21 bp, Homo sapiens
agtgagatataggataaaata

SEQ ID NO: 5222968 - DNA, 16 bp, Homo sapiens
agtgagatatcataga

SEQ ID NO: 5222969 - DNA, 14 bp, Homo sapiens
agtgagatattttt

SEQ ID NO: 5222970 - DNA, 22 bp, Homo sapiens
agtgagatcttacaggtatcag

SEQ ID NO: 5222971 - DNA, 19 bp, Homo sapiens
agtgagatgggaagggctt

SEQ ID NO: 5222972 - DNA, 17 bp, Homo sapiens
agtgagatgtagaaagt

SEQ ID NO: 5222973 - DNA, 17 bp, Homo sapiens
agtgagatgtcagacaa

SEQ ID NO: 5222974 - DNA, 21 bp, Homo sapiens
agtgagatgtttggcaagaaa

SEQ ID NO: 5222975 - DNA, 23 bp, Homo sapiens
agtgagatgtttggcaagaaatc

SEQ ID NO: 5222976 - DNA, 16 bp, Homo sapiens
agtgagatttgtattt

SEQ ID NO: 5222977 - DNA, 20 bp, Homo sapiens
agtgagatttgtatttatat

SEQ ID NO: 5222978 - DNA, 14 bp, Homo sapiens
agtgagcaaggggg

SEQ ID NO: 5222979 - DNA, 20 bp, Homo sapiens
agtgagcaaggtgctcttga

SEQ ID NO: 5222980 - DNA, 20 bp, Homo sapiens
agtgagcacacccgtgtgca

SEQ ID NO: 5222981 - DNA, 15 bp, Homo sapiens
agtgagcactcccaa

SEQ ID NO: 5222982 - DNA, 15 bp, Homo sapiens
agtgagcagaacagg

SEQ ID NO: 5222983 - DNA, 21 bp, Homo sapiens
aaacttttgttagggctgctt

SEQ ID NO: 5222984 - DNA, 22 bp, Homo sapiens
aaacttttgtttagagccctcc

SEQ ID NO: 5222985 - DNA, 16 bp, Homo sapiens
aaacttttgttttttg

SEQ ID NO: 5222986 - DNA, 14 bp, Homo sapiens
aaactttttaatgg

SEQ ID NO: 5222987 - DNA, 15 bp, Homo sapiens
aaactttttaattgt

SEQ ID NO: 5222988 - DNA, 14 bp, Homo sapiens
aaactttttccagc

SEQ ID NO: 5222989 - DNA, 21 bp, Homo sapiens
aaactttttgaccagtttctt

SEQ ID NO: 5222990 - DNA, 14 bp, Homo sapiens
aaacttttttattt

SEQ ID NO: 5222991 - DNA, 17 bp, Homo sapiens
aaacttttttatttaaa

SEQ ID NO: 5222992 - DNA, 19 bp, Homo sapiens
aaacttttttatttaaaaa

SEQ ID NO: 5222993 - DNA, 15 bp, Homo sapiens
aaacttttttatttt

SEQ ID NO: 5222994 - DNA, 22 bp, Homo sapiens
aaacttttttctttgaaatgct

SEQ ID NO: 5222995 - DNA, 16 bp, Homo sapiens
aaactttttttcaatg

SEQ ID NO: 5222996 - DNA, 15 bp, Homo sapiens
aaactttttttctgt

SEQ ID NO: 5222997 - DNA, 22 bp, Homo sapiens
aaactttttttctgtaccagtt

SEQ ID NO: 5222998 - DNA, 11 bp, Homo sapiens
aaagaaaaaaa

SEQ ID NO: 5222999 - DNA, 22 bp, Homo sapiens
aaagaaaaaaaaaaaagccagc

SEQ ID NO: 5223000 - DNA, 19 bp, Homo sapiens
aaagaaaaaaaaaagaaga

SEQ ID NO: 5223001 - DNA, 18 bp, Homo sapiens
aaagaaaaaaatatattt

SEQ ID NO: 5223002 - DNA, 22 bp, Homo sapiens
aaagaaaaaaatatattttatg

SEQ ID NO: 5223003 - DNA, 17 bp, Homo sapiens
aaagaaaaaaatgtatt

SEQ ID NO: 5223004 - DNA, 22 bp, Homo sapiens
aaagaaaaaaatgtattttatg

SEQ ID NO: 5223005 - DNA, 15 bp, Homo sapiens
aaagaaaaaaattga

SEQ ID NO: 5223006 - DNA, 19 bp, Homo sapiens
aaagaaaaaaattgaaatg

SEQ ID NO: 5223007 - DNA, 18 bp, Homo sapiens
aaagaaaaaataattgat

SEQ ID NO: 5223008 - DNA, 14 bp, Homo sapiens
aaagaaaaaatatt

SEQ ID NO: 5223009 - DNA, 13 bp, Homo sapiens
aaagaaaaacatt

SEQ ID NO: 5223010 - DNA, 23 bp, Homo sapiens
aaagaaaaaccacagatactgaa

SEQ ID NO: 5223011 - DNA, 16 bp, Homo sapiens
aaagaaaaagaagtac

SEQ ID NO: 5223012 - DNA, 13 bp, Homo sapiens
aaagaaaaaggaa

SEQ ID NO: 5223013 - DNA, 13 bp, Homo sapiens
aaagaaaaatcaa

SEQ ID NO: 5223014 - DNA, 18 bp, Homo sapiens
aaagaaaaatccggaaaa

SEQ ID NO: 5223015 - DNA, 20 bp, Homo sapiens
aaagaaaaatctcattattt

SEQ ID NO: 5223016 - DNA, 23 bp, Homo sapiens
aaagaaaaatctcattatttcaa

SEQ ID NO: 5223017 - DNA, 12 bp, Homo sapiens
aaagaaaaattt

SEQ ID NO: 5223018 - DNA, 13 bp, Homo sapiens
aaagaaaaatttc

SEQ ID NO: 5223019 - DNA, 14 bp, Homo sapiens
aaagaaaaatttct

SEQ ID NO: 5223020 - DNA, 13 bp, Homo sapiens
aaagaaaacattc

SEQ ID NO: 5223021 - DNA, 16 bp, Homo sapiens
aaagaaaacattccag

SEQ ID NO: 5223022 - DNA, 13 bp, Homo sapiens
aaagaaaaccttt

SEQ ID NO: 5223023 - DNA, 16 bp, Homo sapiens
aaagaaaacctttcta

SEQ ID NO: 5223024 - DNA, 18 bp, Homo sapiens
aaagaaaagaatgtacat

SEQ ID NO: 5223025 - DNA, 14 bp, Homo sapiens
aaagaaaagataaa

SEQ ID NO: 5223026 - DNA, 23 bp, Homo sapiens
aaagaaaagataaagatgatcta

SEQ ID NO: 5223027 - DNA, 11 bp, Homo sapiens
aaagaaaagga

SEQ ID NO: 5223028 - DNA, 20 bp, Homo sapiens
aaagaaaaggaatgcaagag

SEQ ID NO: 5223029 - DNA, 20 bp, Homo sapiens
aaagaaaagtattgtttgga

SEQ ID NO: 5223030 - DNA, 12 bp, Homo sapiens
aaagaaaataaa

SEQ ID NO: 5223031 - DNA, 23 bp, Homo sapiens
aaagaaaataatggagaatcact

SEQ ID NO: 5223032 - DNA, 13 bp, Homo sapiens
aaagaaaatatgc

SEQ ID NO: 5223033 - DNA, 13 bp, Homo sapiens
aaagaaaatcaat

SEQ ID NO: 5223034 - DNA, 17 bp, Homo sapiens
aaagaaaatggaaagaa

SEQ ID NO: 5223035 - DNA, 19 bp, Homo sapiens
aaagaaaatggaaagaagg

SEQ ID NO: 5223036 - DNA, 18 bp, Homo sapiens
aaagaaaatgtaaaaaac

SEQ ID NO: 5223037 - DNA, 13 bp, Homo sapiens
aaagaaaatgtct

SEQ ID NO: 5223038 - DNA, 16 bp, Homo sapiens
aaagaaaatgtgtctg

SEQ ID NO: 5223039 - DNA, 17 bp, Homo sapiens
aaagaaaattatattct

SEQ ID NO: 5223040 - DNA, 20 bp, Homo sapiens
aaagaaaattatattctgtt

SEQ ID NO: 5223041 - DNA, 16 bp, Homo sapiens
aaagaaaattcctata

SEQ ID NO: 5223042 - DNA, 18 bp, Homo sapiens
aaagaaaattcttggaat

SEQ ID NO: 5223043 - DNA, 12 bp, Homo sapiens
aaagaaaattga

SEQ ID NO: 5223044 - DNA, 13 bp, Homo sapiens
aaagaaaattttt

SEQ ID NO: 5223045 - DNA, 13 bp, Homo sapiens
aaagaaacaagct

SEQ ID NO: 5223046 - DNA, 14 bp, Homo sapiens
aaagaaacaagctg

SEQ ID NO: 5223047 - DNA, 16 bp, Homo sapiens
aaagaaacaagctgtg

SEQ ID NO: 5223048 - DNA, 19 bp, Homo sapiens
aaagaaacaccacttaatc

SEQ ID NO: 5223049 - DNA, 22 bp, Homo sapiens
aaagaaacaccacttaatcttc

SEQ ID NO: 5223050 - DNA, 16 bp, Homo sapiens
aaagaaacaccagtgt

SEQ ID NO: 5223051 - DNA, 14 bp, Homo sapiens
aaagaaacactttc

SEQ ID NO: 5223052 - DNA, 16 bp, Homo sapiens
aaagaaacactttctt

SEQ ID NO: 5223053 - DNA, 13 bp, Homo sapiens
aaagaaacagctt

SEQ ID NO: 5223054 - DNA, 15 bp, Homo sapiens
aaagaaacagctttc

SEQ ID NO: 5223055 - DNA, 12 bp, Homo sapiens
aaagaaacatgg

SEQ ID NO: 5223056 - DNA, 15 bp, Homo sapiens
aaagaaacattgtta

SEQ ID NO: 5223057 - DNA, 15 bp, Homo sapiens
aaagaaaccatgaca

SEQ ID NO: 5223058 - DNA, 16 bp, Homo sapiens
aaagaaaccatgacaa

SEQ ID NO: 5223059 - DNA, 10 bp, Homo sapiens
aaagaaacta

SEQ ID NO: 5223060 - DNA, 17 bp, Homo sapiens
aaagaaactaagattta

SEQ ID NO: 5223061 - DNA, 22 bp, Homo sapiens
aaagaaactgacatgccctccc

SEQ ID NO: 5223062 - DNA, 18 bp, Homo sapiens
aaagaaacttgtgcttta

SEQ ID NO: 5223063 - DNA, 16 bp, Homo sapiens
aaagaaacttttctga

SEQ ID NO: 5223064 - DNA, 14 bp, Homo sapiens
aaagaaacttttga

SEQ ID NO: 5223065 - DNA, 19 bp, Homo sapiens
aaagaaacttttgaaaaag

SEQ ID NO: 5223066 - DNA, 15 bp, Homo sapiens
aaagaaagagagaaa

SEQ ID NO: 5223067 - DNA, 16 bp, Homo sapiens
aaagaaagagagaaaa

SEQ ID NO: 5223068 - DNA, 17 bp, Homo sapiens
aaagaaagagagaaaat

SEQ ID NO: 5223069 - DNA, 22 bp, Homo sapiens
aaagaaagcaaattatttttaa

SEQ ID NO: 5223070 - DNA, 13 bp, Homo sapiens
aaagaaagcactt

SEQ ID NO: 5223071 - DNA, 12 bp, Homo sapiens
aaagaaagctaa

SEQ ID NO: 5223072 - DNA, 12 bp, Homo sapiens
aaagaaaggaaa

SEQ ID NO: 5223073 - DNA, 13 bp, Homo sapiens
aaagaaaggaaag

SEQ ID NO: 5223074 - DNA, 16 bp, Homo sapiens
aaagaaaggaaagaag

SEQ ID NO: 5223075 - DNA, 19 bp, Homo sapiens
aaagaaaggaaagaaggag

SEQ ID NO: 5223076 - DNA, 18 bp, Homo sapiens
aaagaaagggacccacct

SEQ ID NO: 5223077 - DNA, 10 bp, Homo sapiens
aaagaaagtg

SEQ ID NO: 5223078 - DNA, 13 bp, Homo sapiens
aaagaaagtgaaa

SEQ ID NO: 5223079 - DNA, 13 bp, Homo sapiens
aaagaaagtgagt

SEQ ID NO: 5223080 - DNA, 13 bp, Homo sapiens
aaagaaagtgtat

SEQ ID NO: 5223081 - DNA, 16 bp, Homo sapiens
aaagaaagtgtatttg

SEQ ID NO: 5223082 - DNA, 13 bp, Homo sapiens
aaagaaataaacc

SEQ ID NO: 5223083 - DNA, 16 bp, Homo sapiens
aaagaaataataatat

SEQ ID NO: 5223084 - DNA, 12 bp, Homo sapiens
aaagaaataatt

SEQ ID NO: 5223085 - DNA, 14 bp, Homo sapiens
aaagaaataccttg

SEQ ID NO: 5223086 - DNA, 10 bp, Homo sapiens
aaagaaatat

SEQ ID NO: 5223087 - DNA, 13 bp, Homo sapiens
aaagaaatatatc

SEQ ID NO: 5223088 - DNA, 13 bp, Homo sapiens
aaagaaatatatt

SEQ ID NO: 5223089 - DNA, 11 bp, Homo sapiens
aaagaaatatt

SEQ ID NO: 5223090 - DNA, 18 bp, Homo sapiens
aaagaaatcatgttatga

SEQ ID NO: 5223091 - DNA, 11 bp, Homo sapiens
aaagaaatcct

SEQ ID NO: 5223092 - DNA, 19 bp, Homo sapiens
aaagaaatctgtttcaaca

SEQ ID NO: 5223093 - DNA, 22 bp, Homo sapiens
aaagaaatctgtttcaacagat

SEQ ID NO: 5223094 - DNA, 11 bp, Homo sapiens
aaagaaatctt

SEQ ID NO: 5223095 - DNA, 16 bp, Homo sapiens
aaagaaatgaaattga

SEQ ID NO: 5223096 - DNA, 16 bp, Homo sapiens
aaagaaatgaacattc

SEQ ID NO: 5223097 - DNA, 12 bp, Homo sapiens
aaagaaatgcac

SEQ ID NO: 5223098 - DNA, 15 bp, Homo sapiens
aaagaaatggctttt

SEQ ID NO: 5223099 - DNA, 14 bp, Homo sapiens
aaagaaatgggcct

SEQ ID NO: 5223100 - DNA, 12 bp, Homo sapiens
aaagaaattaac

SEQ ID NO: 5223101 - DNA, 16 bp, Homo sapiens
aaagaaattatcttta

SEQ ID NO: 5223102 - DNA, 13 bp, Homo sapiens
aaagaaattatgt

SEQ ID NO: 5223103 - DNA, 15 bp, Homo sapiens
aaagaaattatgtgc

SEQ ID NO: 5223104 - DNA, 14 bp, Homo sapiens
aaagaaattctgaa

SEQ ID NO: 5223105 - DNA, 15 bp, Homo sapiens
aaagaaattctgtta

SEQ ID NO: 5223106 - DNA, 15 bp, Homo sapiens
aaagaaattgtcctt

SEQ ID NO: 5223107 - DNA, 14 bp, Homo sapiens
aaagaaatttacta

SEQ ID NO: 5223108 - DNA, 17 bp, Homo sapiens
aaagaaatttactatat

SEQ ID NO: 5223109 - DNA, 15 bp, Homo sapiens
aaagaaatttggtac

SEQ ID NO: 5223110 - DNA, 12 bp, Homo sapiens
aaagaacaaaaa

SEQ ID NO: 5223111 - DNA, 18 bp, Homo sapiens
aaagaacaaacaaaactt

SEQ ID NO: 5223112 - DNA, 14 bp, Homo sapiens
aaagaacaaagctg

SEQ ID NO: 5223113 - DNA, 23 bp, Homo sapiens
aaagaacagcacagtcttttcct

SEQ ID NO: 5223114 - DNA, 15 bp, Homo sapiens
aaagaacagctaaca

SEQ ID NO: 5223115 - DNA, 13 bp, Homo sapiens
aaagaacagtgtt

SEQ ID NO: 5223116 - DNA, 16 bp, Homo sapiens
aaagaacatacatgat

SEQ ID NO: 5223117 - DNA, 13 bp, Homo sapiens
aaagaacatgctt

SEQ ID NO: 5223118 - DNA, 14 bp, Homo sapiens
aaagaacattctaa

SEQ ID NO: 5223119 - DNA, 11 bp, Homo sapiens
aaagaacattt

SEQ ID NO: 5223120 - DNA, 12 bp, Homo sapiens
aaagaacattta

SEQ ID NO: 5223121 - DNA, 13 bp, Homo sapiens
aaagaacatttaa

SEQ ID NO: 5223122 - DNA, 22 bp, Homo sapiens
aaagaaccaaaagttttcctga

SEQ ID NO: 5223123 - DNA, 13 bp, Homo sapiens
aaagaaccacttg

SEQ ID NO: 5223124 - DNA, 21 bp, Homo sapiens
aaagaaccaggaggcctggga

SEQ ID NO: 5223125 - DNA, 16 bp, Homo sapiens
aaagaacccccctccc

SEQ ID NO: 5223126 - DNA, 18 bp, Homo sapiens
aaagaacctaacatttat

SEQ ID NO: 5223127 - DNA, 17 bp, Homo sapiens
aaagaactagtttctag

SEQ ID NO: 5223128 - DNA, 22 bp, Homo sapiens
aaagaactatcttcatctgaga

SEQ ID NO: 5223129 - DNA, 14 bp, Homo sapiens
aaagaactgtactg

SEQ ID NO: 5223130 - DNA, 21 bp, Homo sapiens
aaagaactgtccgtccccctt

SEQ ID NO: 5223131 - DNA, 12 bp, Homo sapiens
aaagaacttact

SEQ ID NO: 5223132 - DNA, 17 bp, Homo sapiens
aaagaacttactgatta

SEQ ID NO: 5223133 - DNA, 18 bp, Homo sapiens
aaagaacttgatttgcat

SEQ ID NO: 5223134 - DNA, 20 bp, Homo sapiens
aaagaacttgctgctgcctt

SEQ ID NO: 5223135 - DNA, 12 bp, Homo sapiens
aaagaagaaaag

SEQ ID NO: 5223136 - DNA, 14 bp, Homo sapiens
aaagaagaaacttt

SEQ ID NO: 5223137 - DNA, 13 bp, Homo sapiens
aaagaagaaagtc

SEQ ID NO: 5223138 - DNA, 17 bp, Homo sapiens
aaagaagaaagtctatg

SEQ ID NO: 5223139 - DNA, 16 bp, Homo sapiens
aaagaagaaccatctt

SEQ ID NO: 5223140 - DNA, 10 bp, Homo sapiens
aaagaagaag

SEQ ID NO: 5223141 - DNA, 19 bp, Homo sapiens
aaagaagaagaagaaggag

SEQ ID NO: 5223142 - DNA, 10 bp, Homo sapiens
aaagaagaca

SEQ ID NO: 5223143 - DNA, 19 bp, Homo sapiens
aaagaagacaacattaaaa

SEQ ID NO: 5223144 - DNA, 15 bp, Homo sapiens
aaagaagacacagaa

SEQ ID NO: 5223145 - DNA, 21 bp, Homo sapiens
aaagaagacatgttttagaca

SEQ ID NO: 5223146 - DNA, 14 bp, Homo sapiens
aaagaagacctgag

SEQ ID NO: 5223147 - DNA, 21 bp, Homo sapiens
aaagaagagaggggaagaatt

SEQ ID NO: 5223148 - DNA, 12 bp, Homo sapiens
aaagaagagcct

SEQ ID NO: 5223149 - DNA, 22 bp, Homo sapiens
aaagaagagcgagagatcaaag

SEQ ID NO: 5223150 - DNA, 18 bp, Homo sapiens
aaagaagaggagaaaaag

SEQ ID NO: 5223151 - DNA, 22 bp, Homo sapiens
aaagaagagtgacttattttgt

SEQ ID NO: 5223152 - DNA, 15 bp, Homo sapiens
aaagaagatctgtaa

SEQ ID NO: 5223153 - DNA, 17 bp, Homo sapiens
aaagaagcactctgctg

SEQ ID NO: 5223154 - DNA, 17 bp, Homo sapiens
aaagaagctgaggaagc

SEQ ID NO: 5223155 - DNA, 12 bp, Homo sapiens
aaagaagcttta

SEQ ID NO: 5223156 - DNA, 13 bp, Homo sapiens
aaagaagctttat

SEQ ID NO: 5223157 - DNA, 12 bp, Homo sapiens
aaagaaggaaaa

SEQ ID NO: 5223158 - DNA, 13 bp, Homo sapiens
aaagaaggaaaaa

SEQ ID NO: 5223159 - DNA, 13 bp, Homo sapiens
aaagaaggaaata

SEQ ID NO: 5223160 - DNA, 15 bp, Homo sapiens
aaagaaggacccaga

SEQ ID NO: 5223161 - DNA, 23 bp, Homo sapiens
aaagaaggaccctttttggacta

SEQ ID NO: 5223162 - DNA, 21 bp, Homo sapiens
aaagaaggagatgaatagaag

SEQ ID NO: 5223163 - DNA, 12 bp, Homo sapiens
aaagaaggaggt

SEQ ID NO: 5223164 - DNA, 23 bp, Homo sapiens
aaagaaggctgcctaaggaggag

SEQ ID NO: 5223165 - DNA, 18 bp, Homo sapiens
aaagaagggatccctaac

SEQ ID NO: 5223166 - DNA, 19 bp, Homo sapiens
aaagaagggggccctgcta

SEQ ID NO: 5223167 - DNA, 23 bp, Homo sapiens
aaagaagggggccctgctacctg

SEQ ID NO: 5223168 - DNA, 21 bp, Homo sapiens
aggtgcccactccgccagcca

SEQ ID NO: 5223169 - DNA, 21 bp, Homo sapiens
aggtgcccagaataagttatt

SEQ ID NO: 5223170 - DNA, 16 bp, Homo sapiens
aggtgcccagtcttga

SEQ ID NO: 5223171 - DNA, 18 bp, Homo sapiens
aggtgcccagtcttgagt

SEQ ID NO: 5223172 - DNA, 21 bp, Homo sapiens
aggtgcccccaggtgagacag

SEQ ID NO: 5223173 - DNA, 17 bp, Homo sapiens
aggtgcccctctctcca

SEQ ID NO: 5223174 - DNA, 23 bp, Homo sapiens
aggtgcccctcttccaaaggcag

SEQ ID NO: 5223175 - DNA, 14 bp, Homo sapiens
aggtgccctgtggg

SEQ ID NO: 5223176 - DNA, 18 bp, Homo sapiens
aggtgccctgtgggagag

SEQ ID NO: 5223177 - DNA, 19 bp, Homo sapiens
aggtgcccttggaggccag

SEQ ID NO: 5223178 - DNA, 20 bp, Homo sapiens
aggtgccgccagctgccgca

SEQ ID NO: 5223179 - DNA, 18 bp, Homo sapiens
aggtgcctcaagagaagg

SEQ ID NO: 5223180 - DNA, 15 bp, Homo sapiens
aggtgcctcagactc

SEQ ID NO: 5223181 - DNA, 16 bp, Homo sapiens
aggtgcctcagactcc

SEQ ID NO: 5223182 - DNA, 19 bp, Homo sapiens
aggtgcctcagactccgcc

SEQ ID NO: 5223183 - DNA, 23 bp, Homo sapiens
aggtgcctcagttttccttctgt

SEQ ID NO: 5223184 - DNA, 17 bp, Homo sapiens
aggtgcctcccagtggc

SEQ ID NO: 5223185 - DNA, 20 bp, Homo sapiens
aggtgcctcccagtggcctg

SEQ ID NO: 5223186 - DNA, 20 bp, Homo sapiens
aggtgcctgaaagctgggag

SEQ ID NO: 5223187 - DNA, 17 bp, Homo sapiens
aggtgcctgaactagtt

SEQ ID NO: 5223188 - DNA, 16 bp, Homo sapiens
aggtgcctgagagcag

SEQ ID NO: 5223189 - DNA, 17 bp, Homo sapiens
aggtgcctgccatagcc

SEQ ID NO: 5223190 - DNA, 19 bp, Homo sapiens
aggtgcctgccatagccag

SEQ ID NO: 5223191 - DNA, 16 bp, Homo sapiens
aggtgcctgctcaggt

SEQ ID NO: 5223192 - DNA, 18 bp, Homo sapiens
aggtgcctgctcaggtgc

SEQ ID NO: 5223193 - DNA, 19 bp, Homo sapiens
aggtgcctgctcaggtgct

SEQ ID NO: 5223194 - DNA, 20 bp, Homo sapiens
aggtgcctgctcaggtgcta

SEQ ID NO: 5223195 - DNA, 15 bp, Homo sapiens
aggtgcctggcttgc

SEQ ID NO: 5223196 - DNA, 22 bp, Homo sapiens
aggtgcctggcttgctgtggct

SEQ ID NO: 5223197 - DNA, 18 bp, Homo sapiens
aggtgcctgtgaggcagg

SEQ ID NO: 5223198 - DNA, 22 bp, Homo sapiens
aggtgcctgtgaggcaggggcg

SEQ ID NO: 5223199 - DNA, 22 bp, Homo sapiens
aggtgccttacatcttttctaa

SEQ ID NO: 5223200 - DNA, 23 bp, Homo sapiens
aggtgccttacatcttttctaat

SEQ ID NO: 5223201 - DNA, 22 bp, Homo sapiens
aggtgccttcttattctcactc

SEQ ID NO: 5223202 - DNA, 16 bp, Homo sapiens
aggtgccttcttcagg

SEQ ID NO: 5223203 - DNA, 18 bp, Homo sapiens
aggtgccttggggaaatg

SEQ ID NO: 5223204 - DNA, 21 bp, Homo sapiens
aggtgccttggggaaatgtgg

SEQ ID NO: 5223205 - DNA, 15 bp, Homo sapiens
aggtgcctttcaaat

SEQ ID NO: 5223206 - DNA, 21 bp, Homo sapiens
aggtgcgaatgacagtagcat

SEQ ID NO: 5223207 - DNA, 23 bp, Homo sapiens
aggtgcgcgccaccgtgcctggc

SEQ ID NO: 5223208 - DNA, 22 bp, Homo sapiens
aggtgcggaccggagcggctga

SEQ ID NO: 5223209 - DNA, 18 bp, Homo sapiens
aggtgcggcctgggggga

SEQ ID NO: 5223210 - DNA, 20 bp, Homo sapiens
aggtgcgtgtgtctctgtct

SEQ ID NO: 5223211 - DNA, 22 bp, Homo sapiens
aggtgcgtgttcagcagaacct

SEQ ID NO: 5223212 - DNA, 20 bp, Homo sapiens
aggtgctaatttgttttgga

SEQ ID NO: 5223213 - DNA, 23 bp, Homo sapiens
aggtgctaatttgttttggatat

SEQ ID NO: 5223214 - DNA, 16 bp, Homo sapiens
aggtgctacaaaaaca

SEQ ID NO: 5223215 - DNA, 18 bp, Homo sapiens
aggtgctacaaaaacaca

SEQ ID NO: 5223216 - DNA, 19 bp, Homo sapiens
aggtgctacaaaaacacag

SEQ ID NO: 5223217 - DNA, 20 bp, Homo sapiens
aggtgctacaaaaacacagc

SEQ ID NO: 5223218 - DNA, 22 bp, Homo sapiens
aggtgctacaaaaacacagcaa

SEQ ID NO: 5223219 - DNA, 22 bp, Homo sapiens
aggtgctacaacatgtgaggca

SEQ ID NO: 5223220 - DNA, 17 bp, Homo sapiens
aggtgctagggtgcctg

SEQ ID NO: 5223221 - DNA, 20 bp, Homo sapiens
aggtgctcaaagatgtactg

SEQ ID NO: 5223222 - DNA, 17 bp, Homo sapiens
aggtgctcaataaatat

SEQ ID NO: 5223223 - DNA, 14 bp, Homo sapiens
aggtgctcagacat

SEQ ID NO: 5223224 - DNA, 18 bp, Homo sapiens
aggtgctcatgctgctcc

SEQ ID NO: 5223225 - DNA, 12 bp, Homo sapiens
aggtgctctgtg

SEQ ID NO: 5223226 - DNA, 20 bp, Homo sapiens
aggtgctcttcctcatctca

SEQ ID NO: 5223227 - DNA, 18 bp, Homo sapiens
aggtgctgaatgaagctg

SEQ ID NO: 5223228 - DNA, 16 bp, Homo sapiens
aggtgctgacggccag

SEQ ID NO: 5223229 - DNA, 20 bp, Homo sapiens
aggtgctgacggccagggag

SEQ ID NO: 5223230 - DNA, 13 bp, Homo sapiens
aggtgctgagctt

SEQ ID NO: 5223231 - DNA, 18 bp, Homo sapiens
aggtgctgagcttagcct

SEQ ID NO: 5223232 - DNA, 23 bp, Homo sapiens
aggtgctgagcttagccttgtgc

SEQ ID NO: 5223233 - DNA, 16 bp, Homo sapiens
aggtgctgatggccct

SEQ ID NO: 5223234 - DNA, 18 bp, Homo sapiens
aggtgctgatggccctca

SEQ ID NO: 5223235 - DNA, 20 bp, Homo sapiens
aggtgctgctaccctccctg

SEQ ID NO: 5223236 - DNA, 22 bp, Homo sapiens
aggtgctgctaccctccctgct

SEQ ID NO: 5223237 - DNA, 13 bp, Homo sapiens
aggtgctgctcta

SEQ ID NO: 5223238 - DNA, 16 bp, Homo sapiens
aggtgctgctttgctt

SEQ ID NO: 5223239 - DNA, 13 bp, Homo sapiens
aggtgctggactg

SEQ ID NO: 5223240 - DNA, 17 bp, Homo sapiens
aggtgctggaggtggga

SEQ ID NO: 5223241 - DNA, 23 bp, Homo sapiens
aggtgctggaggtgggagcagga

SEQ ID NO: 5223242 - DNA, 19 bp, Homo sapiens
aggtgctggcatgtctggg

SEQ ID NO: 5223243 - DNA, 14 bp, Homo sapiens
aggtgctggcccag

SEQ ID NO: 5223244 - DNA, 16 bp, Homo sapiens
aggtgctggcccagca

SEQ ID NO: 5223245 - DNA, 18 bp, Homo sapiens
aggtgctggcccagcatg

SEQ ID NO: 5223246 - DNA, 20 bp, Homo sapiens
aggtgctggcccagcatgga

SEQ ID NO: 5223247 - DNA, 12 bp, Homo sapiens
aggtgctgggag

SEQ ID NO: 5223248 - DNA, 23 bp, Homo sapiens
aggtgctgggctggactggccat

SEQ ID NO: 5223249 - DNA, 12 bp, Homo sapiens
aggtgctggggg

SEQ ID NO: 5223250 - DNA, 21 bp, Homo sapiens
aggtgctggtagctgagggga

SEQ ID NO: 5223251 - DNA, 23 bp, Homo sapiens
aggtgctggtagctgaggggacg

SEQ ID NO: 5223252 - DNA, 17 bp, Homo sapiens
aggtgctggtgggtctg

SEQ ID NO: 5223253 - DNA, 22 bp, Homo sapiens
aggtgctggtgggtctgagctg

SEQ ID NO: 5223254 - DNA, 14 bp, Homo sapiens
aggtgctgtccatg

SEQ ID NO: 5223255 - DNA, 14 bp, Homo sapiens
aggtgctgttatgt

SEQ ID NO: 5223256 - DNA, 14 bp, Homo sapiens
aggtgctgttgtca

SEQ ID NO: 5223257 - DNA, 19 bp, Homo sapiens
aggtgcttaagcagaagca

SEQ ID NO: 5223258 - DNA, 21 bp, Homo sapiens
aggtgcttcaggataccatat

SEQ ID NO: 5223259 - DNA, 16 bp, Homo sapiens
aggtgcttgatctatc

SEQ ID NO: 5223260 - DNA, 15 bp, Homo sapiens
aggtgcttgccccca

SEQ ID NO: 5223261 - DNA, 20 bp, Homo sapiens
aggtgcttgggcttctgcgg

SEQ ID NO: 5223262 - DNA, 15 bp, Homo sapiens
aggtgctttctccat

SEQ ID NO: 5223263 - DNA, 23 bp, Homo sapiens
aggtgctttgctagatgctgtga

SEQ ID NO: 5223264 - DNA, 18 bp, Homo sapiens
aggtgcttttccctatcc

SEQ ID NO: 5223265 - DNA, 14 bp, Homo sapiens
aggtgcttttgatg

SEQ ID NO: 5223266 - DNA, 20 bp, Homo sapiens
aggtgcttttggcagagacc

SEQ ID NO: 5223267 - DNA, 17 bp, Homo sapiens
aggtggaaaaactgaga

SEQ ID NO: 5223268 - DNA, 17 bp, Homo sapiens
aggtggaaagagaaatg

SEQ ID NO: 5223269 - DNA, 20 bp, Homo sapiens
aggtggaaagagaaatgatg

SEQ ID NO: 5223270 - DNA, 17 bp, Homo sapiens
aggtggaaagtgttcat

SEQ ID NO: 5223271 - DNA, 16 bp, Homo sapiens
aggtggaagaagggag

SEQ ID NO: 5223272 - DNA, 16 bp, Homo sapiens
aggtggaagcagaggc

SEQ ID NO: 5223273 - DNA, 19 bp, Homo sapiens
aggtggaagcagaggccct

SEQ ID NO: 5223274 - DNA, 21 bp, Homo sapiens
aggtggaagcagaggccctgc

SEQ ID NO: 5223275 - DNA, 14 bp, Homo sapiens
aggtggaagccctc

SEQ ID NO: 5223276 - DNA, 21 bp, Homo sapiens
aggtggaagccctccttccac

SEQ ID NO: 5223277 - DNA, 19 bp, Homo sapiens
aggtggaaggaccctgtgc

SEQ ID NO: 5223278 - DNA, 20 bp, Homo sapiens
aggtggaagttgcagtgagt

SEQ ID NO: 5223279 - DNA, 17 bp, Homo sapiens
aggtggaataaacatta

SEQ ID NO: 5223280 - DNA, 22 bp, Homo sapiens
aggtggaattacttaaatttta

SEQ ID NO: 5223281 - DNA, 17 bp, Homo sapiens
aggtggaattattttaa

SEQ ID NO: 5223282 - DNA, 14 bp, Homo sapiens
aggtggacacacaa

SEQ ID NO: 5223283 - DNA, 16 bp, Homo sapiens
aggtggacctggcagt

SEQ ID NO: 5223284 - DNA, 19 bp, Homo sapiens
aggtggacctggcagtggt

SEQ ID NO: 5223285 - DNA, 22 bp, Homo sapiens
aggtggaccttttaaagtgttt

SEQ ID NO: 5223286 - DNA, 17 bp, Homo sapiens
aggtggacgctgcagac

SEQ ID NO: 5223287 - DNA, 16 bp, Homo sapiens
aggtggactctgggat

SEQ ID NO: 5223288 - DNA, 22 bp, Homo sapiens
aggtggagccaagtggtccagc

SEQ ID NO: 5223289 - DNA, 22 bp, Homo sapiens
aggtggagcgttcaccagtgac

SEQ ID NO: 5223290 - DNA, 20 bp, Homo sapiens
aggtggagcttgcagtgagc

SEQ ID NO: 5223291 - DNA, 15 bp, Homo sapiens
aggtggaggcgagcc

SEQ ID NO: 5223292 - DNA, 16 bp, Homo sapiens
aggtggaggcgagcca

SEQ ID NO: 5223293 - DNA, 20 bp, Homo sapiens
aggtggaggctgcagtgagc

SEQ ID NO: 5223294 - DNA, 15 bp, Homo sapiens
aggtggagggcacag

SEQ ID NO: 5223295 - DNA, 18 bp, Homo sapiens
aggtggagggcacagccc

SEQ ID NO: 5223296 - DNA, 19 bp, Homo sapiens
aggtggagggcacagccct

SEQ ID NO: 5223297 - DNA, 15 bp, Homo sapiens
aggtggaggtgccag

SEQ ID NO: 5223298 - DNA, 17 bp, Homo sapiens
aggtggaggtgggctga

SEQ ID NO: 5223299 - DNA, 20 bp, Homo sapiens
aggtggaggttacagtgagc

SEQ ID NO: 5223300 - DNA, 23 bp, Homo sapiens
aggtggaggttgcagtgagctga

SEQ ID NO: 5223301 - DNA, 15 bp, Homo sapiens
aggtggaggttgcat

SEQ ID NO: 5223302 - DNA, 13 bp, Homo sapiens
aggtggagtctca

SEQ ID NO: 5223303 - DNA, 16 bp, Homo sapiens
aggtggagtttctctg

SEQ ID NO: 5223304 - DNA, 22 bp, Homo sapiens
aggtggatcatgaggtcaggag

SEQ ID NO: 5223305 - DNA, 15 bp, Homo sapiens
aggtggatcctgtag

SEQ ID NO: 5223306 - DNA, 23 bp, Homo sapiens
aggtggattttgtttaaaaaatc

SEQ ID NO: 5223307 - DNA, 14 bp, Homo sapiens
aggtggcaaggctg

SEQ ID NO: 5223308 - DNA, 21 bp, Homo sapiens
aggtggcaatgcttaaactaa

SEQ ID NO: 5223309 - DNA, 15 bp, Homo sapiens
aggtggcacctgcag

SEQ ID NO: 5223310 - DNA, 23 bp, Homo sapiens
aggtggcactttttcatttgcct

SEQ ID NO: 5223311 - DNA, 15 bp, Homo sapiens
aggtggcagagtgaa

SEQ ID NO: 5223312 - DNA, 13 bp, Homo sapiens
aggtggcagccct

SEQ ID NO: 5223313 - DNA, 13 bp, Homo sapiens
aggtggcaggaca

SEQ ID NO: 5223314 - DNA, 14 bp, Homo sapiens
aggtggcaggacca

SEQ ID NO: 5223315 - DNA, 16 bp, Homo sapiens
aggtggcagggaaggg

SEQ ID NO: 5223316 - DNA, 23 bp, Homo sapiens
aggtggcagggaagggtgcctgg

SEQ ID NO: 5223317 - DNA, 20 bp, Homo sapiens
aggtggcagggctgttccct

SEQ ID NO: 5223318 - DNA, 22 bp, Homo sapiens
aggtggcatcagtgtctttcca

SEQ ID NO: 5223319 - DNA, 17 bp, Homo sapiens
aggtggccacagcagga

SEQ ID NO: 5223320 - DNA, 13 bp, Homo sapiens
aggtggccaccgg

SEQ ID NO: 5223321 - DNA, 21 bp, Homo sapiens
aggtggccactttaagagaga

SEQ ID NO: 5223322 - DNA, 19 bp, Homo sapiens
aggtggccagggctccacg

SEQ ID NO: 5223323 - DNA, 12 bp, Homo sapiens
aggtggccatgc

SEQ ID NO: 5223324 - DNA, 20 bp, Homo sapiens
aggtggccatgttatgctgg

SEQ ID NO: 5223325 - DNA, 14 bp, Homo sapiens
aggtggcccaggcc

SEQ ID NO: 5223326 - DNA, 15 bp, Homo sapiens
aggtggcccaggccc

SEQ ID NO: 5223327 - DNA, 16 bp, Homo sapiens
aggtggcccaggcccc

SEQ ID NO: 5223328 - DNA, 23 bp, Homo sapiens
aggtggccccatattaacaaatt

SEQ ID NO: 5223329 - DNA, 16 bp, Homo sapiens
aggtggccctcccagg

SEQ ID NO: 5223330 - DNA, 15 bp, Homo sapiens
aggtggccgccatgc

SEQ ID NO: 5223331 - DNA, 15 bp, Homo sapiens
aggtggccgcccctg

SEQ ID NO: 5223332 - DNA, 17 bp, Homo sapiens
aggtggccgctcctccc

SEQ ID NO: 5223333 - DNA, 18 bp, Homo sapiens
aggtggccgctcctccct

SEQ ID NO: 5223334 - DNA, 19 bp, Homo sapiens
aggtggccgctcctccctg

SEQ ID NO: 5223335 - DNA, 21 bp, Homo sapiens
aggtggccgctcctccctgct

SEQ ID NO: 5223336 - DNA, 16 bp, Homo sapiens
aggtggcctcctggcc

SEQ ID NO: 5223337 - DNA, 23 bp, Homo sapiens
aggtggcctctccttgtggcctg

SEQ ID NO: 5223338 - DNA, 13 bp, Homo sapiens
aggtggcctttgt

SEQ ID NO: 5223339 - DNA, 19 bp, Homo sapiens
aggtggcgccccctggtgg

SEQ ID NO: 5223340 - DNA, 22 bp, Homo sapiens
aggtggctaagggggaccatgg

SEQ ID NO: 5223341 - DNA, 19 bp, Homo sapiens
aggtggctgacccagtccc

SEQ ID NO: 5223342 - DNA, 19 bp, Homo sapiens
aggtggctgagcccctgtc

SEQ ID NO: 5223343 - DNA, 21 bp, Homo sapiens
aaagaagtaacaagagtgatt

SEQ ID NO: 5223344 - DNA, 16 bp, Homo sapiens
aaagaagtatttttag

SEQ ID NO: 5223345 - DNA, 14 bp, Homo sapiens
aaagaagtcaaatg

SEQ ID NO: 5223346 - DNA, 17 bp, Homo sapiens
aaagaagtccatgtgat

SEQ ID NO: 5223347 - DNA, 23 bp, Homo sapiens
aaagaagtctcttaattctgatg

SEQ ID NO: 5223348 - DNA, 13 bp, Homo sapiens
aaagaagtggaga

SEQ ID NO: 5223349 - DNA, 15 bp, Homo sapiens
aaagaagtggagaca

SEQ ID NO: 5223350 - DNA, 13 bp, Homo sapiens
aaagaagttactt

SEQ ID NO: 5223351 - DNA, 18 bp, Homo sapiens
aaagaagttattttccag

SEQ ID NO: 5223352 - DNA, 23 bp, Homo sapiens
aaagaagtttgggctaacattta

SEQ ID NO: 5223353 - DNA, 17 bp, Homo sapiens
aaagaataaatgaatct

SEQ ID NO: 5223354 - DNA, 21 bp, Homo sapiens
aaagaataagtgtctttctgg

SEQ ID NO: 5223355 - DNA, 14 bp, Homo sapiens
aaagaatacatttt

SEQ ID NO: 5223356 - DNA, 14 bp, Homo sapiens
aaagaatacttgaa

SEQ ID NO: 5223357 - DNA, 16 bp, Homo sapiens
aaagaatacttgaact

SEQ ID NO: 5223358 - DNA, 19 bp, Homo sapiens
aaagaataggacttgtttt

SEQ ID NO: 5223359 - DNA, 21 bp, Homo sapiens
aaagaatagggagacaatcta

SEQ ID NO: 5223360 - DNA, 17 bp, Homo sapiens
aaagaatagtttggttc

SEQ ID NO: 5223361 - DNA, 20 bp, Homo sapiens
aaagaatataaagttaaaaa

SEQ ID NO: 5223362 - DNA, 21 bp, Homo sapiens
aaagaatataaagttaaaaaa

SEQ ID NO: 5223363 - DNA, 19 bp, Homo sapiens
aaagaatattccattttcc

SEQ ID NO: 5223364 - DNA, 23 bp, Homo sapiens
aaagaatatttagaaaaacatcc

SEQ ID NO: 5223365 - DNA, 13 bp, Homo sapiens
aaagaatattttg

SEQ ID NO: 5223366 - DNA, 23 bp, Homo sapiens
aaagaatcattatttattaaatt

SEQ ID NO: 5223367 - DNA, 14 bp, Homo sapiens
aaagaatcccaccc

SEQ ID NO: 5223368 - DNA, 16 bp, Homo sapiens
aaagaatccctgttca

SEQ ID NO: 5223369 - DNA, 23 bp, Homo sapiens
aaagaatcggcagtattttctgt

SEQ ID NO: 5223370 - DNA, 19 bp, Homo sapiens
aaagaatctactatacttt

SEQ ID NO: 5223371 - DNA, 13 bp, Homo sapiens
aaagaatgaaagt

SEQ ID NO: 5223372 - DNA, 15 bp, Homo sapiens
aaagaatgagaaaca

SEQ ID NO: 5223373 - DNA, 16 bp, Homo sapiens
aaagaatgagaaacat

SEQ ID NO: 5223374 - DNA, 17 bp, Homo sapiens
aaagaatgagaaacata

SEQ ID NO: 5223375 - DNA, 13 bp, Homo sapiens
aaagaatgatgct

SEQ ID NO: 5223376 - DNA, 16 bp, Homo sapiens
aaagaatgattatgaa

SEQ ID NO: 5223377 - DNA, 20 bp, Homo sapiens
aaagaatgccatttctcacg

SEQ ID NO: 5223378 - DNA, 23 bp, Homo sapiens
aaagaatgctgcaacttttttat

SEQ ID NO: 5223379 - DNA, 22 bp, Homo sapiens
aaagaatggctgactgttgcct

SEQ ID NO: 5223380 - DNA, 23 bp, Homo sapiens
aaagaatgggcagttacatgcat

SEQ ID NO: 5223381 - DNA, 15 bp, Homo sapiens
aaagaattaaaaact

SEQ ID NO: 5223382 - DNA, 23 bp, Homo sapiens
aaagaattatttttgtgtttcta

SEQ ID NO: 5223383 - DNA, 15 bp, Homo sapiens
aaagaattcaaattt

SEQ ID NO: 5223384 - DNA, 16 bp, Homo sapiens
aaagaattcaaatttt

SEQ ID NO: 5223385 - DNA, 22 bp, Homo sapiens
aaagaattcacacaactacttt

SEQ ID NO: 5223386 - DNA, 13 bp, Homo sapiens
aaagaattctatt

SEQ ID NO: 5223387 - DNA, 14 bp, Homo sapiens
aaagaattctattt

SEQ ID NO: 5223388 - DNA, 19 bp, Homo sapiens
aaagaattgtggtttatat

SEQ ID NO: 5223389 - DNA, 19 bp, Homo sapiens
aaagaatttaagctgtaaa

SEQ ID NO: 5223390 - DNA, 15 bp, Homo sapiens
aaagaatttcataga

SEQ ID NO: 5223391 - DNA, 20 bp, Homo sapiens
aaagaatttgtatcatgttt

SEQ ID NO: 5223392 - DNA, 23 bp, Homo sapiens
aaagaatttttgcccatatctgg

SEQ ID NO: 5223393 - DNA, 17 bp, Homo sapiens
aaagaatttttttgtct

SEQ ID NO: 5223394 - DNA, 15 bp, Homo sapiens
aaagacaaaaatcaa

SEQ ID NO: 5223395 - DNA, 21 bp, Homo sapiens
aaagacaaaaatcaaagaaca

SEQ ID NO: 5223396 - DNA, 22 bp, Homo sapiens
aaagacaaaaatccttgttgaa

SEQ ID NO: 5223397 - DNA, 18 bp, Homo sapiens
aaagacaaaagtctgtct

SEQ ID NO: 5223398 - DNA, 13 bp, Homo sapiens
aaagacaaaatgt

SEQ ID NO: 5223399 - DNA, 15 bp, Homo sapiens
aaagacaaaatgtga

SEQ ID NO: 5223400 - DNA, 17 bp, Homo sapiens
aaagacaaacaccttat

SEQ ID NO: 5223401 - DNA, 14 bp, Homo sapiens
aaagacaaatagta

SEQ ID NO: 5223402 - DNA, 16 bp, Homo sapiens
aaagacaaattctgtt

SEQ ID NO: 5223403 - DNA, 19 bp, Homo sapiens
aaagacaaattctgtttct

SEQ ID NO: 5223404 - DNA, 16 bp, Homo sapiens
aaagacaacaaaagaa

SEQ ID NO: 5223405 - DNA, 14 bp, Homo sapiens
aaagacaagaaaat

SEQ ID NO: 5223406 - DNA, 13 bp, Homo sapiens
aaagacaagactt

SEQ ID NO: 5223407 - DNA, 17 bp, Homo sapiens
aaagacaagacttcagt

SEQ ID NO: 5223408 - DNA, 22 bp, Homo sapiens
aaagacaagtatgaatattact

SEQ ID NO: 5223409 - DNA, 14 bp, Homo sapiens
aaagacaagtgctc

SEQ ID NO: 5223410 - DNA, 13 bp, Homo sapiens
aaagacaattctt

SEQ ID NO: 5223411 - DNA, 15 bp, Homo sapiens
aaagacaattcttta

SEQ ID NO: 5223412 - DNA, 17 bp, Homo sapiens
aaagacaattctttata

SEQ ID NO: 5223413 - DNA, 15 bp, Homo sapiens
aaagacacaggaaga

SEQ ID NO: 5223414 - DNA, 16 bp, Homo sapiens
aaagacacctgcctta

SEQ ID NO: 5223415 - DNA, 17 bp, Homo sapiens
aaagacactgcctgggc

SEQ ID NO: 5223416 - DNA, 16 bp, Homo sapiens
aaagacactggtgtat

SEQ ID NO: 5223417 - DNA, 14 bp, Homo sapiens
aaagacagaatggt

SEQ ID NO: 5223418 - DNA, 13 bp, Homo sapiens
aaagacagaatgt

SEQ ID NO: 5223419 - DNA, 16 bp, Homo sapiens
aaagacagacattcct

SEQ ID NO: 5223420 - DNA, 17 bp, Homo sapiens
aaagacagagtgaattt

SEQ ID NO: 5223421 - DNA, 22 bp, Homo sapiens
aaagacagcgataagctttcaa

SEQ ID NO: 5223422 - DNA, 19 bp, Homo sapiens
aaagacagctagattttgc

SEQ ID NO: 5223423 - DNA, 16 bp, Homo sapiens
aaagacaggaagacca

SEQ ID NO: 5223424 - DNA, 22 bp, Homo sapiens
aaagacagggctgataagctaa

SEQ ID NO: 5223425 - DNA, 18 bp, Homo sapiens
aaagacagggtcttgcta

SEQ ID NO: 5223426 - DNA, 14 bp, Homo sapiens
aaagacagtattta

SEQ ID NO: 5223427 - DNA, 22 bp, Homo sapiens
aaagacagtggatcatgaaaag

SEQ ID NO: 5223428 - DNA, 13 bp, Homo sapiens
aaagacagtttct

SEQ ID NO: 5223429 - DNA, 14 bp, Homo sapiens
aaagacagtttctt

SEQ ID NO: 5223430 - DNA, 11 bp, Homo sapiens
aaagacatcaa

SEQ ID NO: 5223431 - DNA, 12 bp, Homo sapiens
aaagacatcaat

SEQ ID NO: 5223432 - DNA, 16 bp, Homo sapiens
aaagacatcaatgaaa

SEQ ID NO: 5223433 - DNA, 19 bp, Homo sapiens
aaagacatccataaagaag

SEQ ID NO: 5223434 - DNA, 15 bp, Homo sapiens
aaagacatctgagga

SEQ ID NO: 5223435 - DNA, 20 bp, Homo sapiens
aaagacatctgcctgtaatt

SEQ ID NO: 5223436 - DNA, 13 bp, Homo sapiens
aaagacatctttc

SEQ ID NO: 5223437 - DNA, 23 bp, Homo sapiens
aaagacatctttctcttttctaa

SEQ ID NO: 5223438 - DNA, 14 bp, Homo sapiens
aaagacatgaaatt

SEQ ID NO: 5223439 - DNA, 16 bp, Homo sapiens
aaagacatgaagccac

SEQ ID NO: 5223440 - DNA, 14 bp, Homo sapiens
aaagacatggaagg

SEQ ID NO: 5223441 - DNA, 10 bp, Homo sapiens
aaagacatta

SEQ ID NO: 5223442 - DNA, 19 bp, Homo sapiens
aaagacattcaggactgct

SEQ ID NO: 5223443 - DNA, 16 bp, Homo sapiens
aaagacattgaaagct

SEQ ID NO: 5223444 - DNA, 15 bp, Homo sapiens
aaagacattgacagc

SEQ ID NO: 5223445 - DNA, 20 bp, Homo sapiens
aaagacattttaagtttgta

SEQ ID NO: 5223446 - DNA, 22 bp, Homo sapiens
aaagaccaaacttcactctggg

SEQ ID NO: 5223447 - DNA, 20 bp, Homo sapiens
aaagaccaataaacttcctt

SEQ ID NO: 5223448 - DNA, 17 bp, Homo sapiens
aaagaccaatgtgaaga

SEQ ID NO: 5223449 - DNA, 19 bp, Homo sapiens
aaagaccaatgtgaagaca

SEQ ID NO: 5223450 - DNA, 12 bp, Homo sapiens
aaagaccacctc

SEQ ID NO: 5223451 - DNA, 13 bp, Homo sapiens
aaagaccacctcc

SEQ ID NO: 5223452 - DNA, 23 bp, Homo sapiens
aaagaccacctccaacccaaccc

SEQ ID NO: 5223453 - DNA, 17 bp, Homo sapiens
aaagacccaacttgcca

SEQ ID NO: 5223454 - DNA, 22 bp, Homo sapiens
aaagacccactgaatctgagaa

SEQ ID NO: 5223455 - DNA, 18 bp, Homo sapiens
aaagaccctaggtgctca

SEQ ID NO: 5223456 - DNA, 15 bp, Homo sapiens
aaagacctgcctgtg

SEQ ID NO: 5223457 - DNA, 23 bp, Homo sapiens
aaagacctgctgtaataaatgta

SEQ ID NO: 5223458 - DNA, 19 bp, Homo sapiens
aaagaccttgtgtgtatgt

SEQ ID NO: 5223459 - DNA, 19 bp, Homo sapiens
aaagacgatttgtcagtta

SEQ ID NO: 5223460 - DNA, 18 bp, Homo sapiens
aaagacgtaataaaatta

SEQ ID NO: 5223461 - DNA, 16 bp, Homo sapiens
aaagactaactaaaat

SEQ ID NO: 5223462 - DNA, 14 bp, Homo sapiens
aaagactaatttaa

SEQ ID NO: 5223463 - DNA, 20 bp, Homo sapiens
aaagactaatttaaaaaata

SEQ ID NO: 5223464 - DNA, 20 bp, Homo sapiens
aaagactagccagccaggaa

SEQ ID NO: 5223465 - DNA, 15 bp, Homo sapiens
aaagactattcaaac

SEQ ID NO: 5223466 - DNA, 18 bp, Homo sapiens
aaagactattcaaacagt

SEQ ID NO: 5223467 - DNA, 21 bp, Homo sapiens
aaagactattcaaacagtctc

SEQ ID NO: 5223468 - DNA, 23 bp, Homo sapiens
aaagactattcaaacagtctcag

SEQ ID NO: 5223469 - DNA, 17 bp, Homo sapiens
aaagactcaagagaatt

SEQ ID NO: 5223470 - DNA, 14 bp, Homo sapiens
aaagactcagccaa

SEQ ID NO: 5223471 - DNA, 21 bp, Homo sapiens
aaagactccaaagaaatgtaa

SEQ ID NO: 5223472 - DNA, 22 bp, Homo sapiens
aaagactccacataagtccatt

SEQ ID NO: 5223473 - DNA, 23 bp, Homo sapiens
aaagactccagtactattttaat

SEQ ID NO: 5223474 - DNA, 23 bp, Homo sapiens
aaagactcctaatagcttttcct

SEQ ID NO: 5223475 - DNA, 22 bp, Homo sapiens
aaagactcctttcctgcatctt

SEQ ID NO: 5223476 - DNA, 12 bp, Homo sapiens
aaagactctgag

SEQ ID NO: 5223477 - DNA, 13 bp, Homo sapiens
aaagactctgagc

SEQ ID NO: 5223478 - DNA, 16 bp, Homo sapiens
aaagactgaacatgtt

SEQ ID NO: 5223479 - DNA, 12 bp, Homo sapiens
aaagactggccc

SEQ ID NO: 5223480 - DNA, 19 bp, Homo sapiens
aaagactggtttgtttgct

SEQ ID NO: 5223481 - DNA, 14 bp, Homo sapiens
aaagactgtacaaa

SEQ ID NO: 5223482 - DNA, 17 bp, Homo sapiens
aaagactgtcaaatgaa

SEQ ID NO: 5223483 - DNA, 19 bp, Homo sapiens
aaagactgtcaaatgaact

SEQ ID NO: 5223484 - DNA, 16 bp, Homo sapiens
aaagactgtgctgaga

SEQ ID NO: 5223485 - DNA, 20 bp, Homo sapiens
aaagactgtggaaatgccaa

SEQ ID NO: 5223486 - DNA, 19 bp, Homo sapiens
aaagacttaagattaaatt

SEQ ID NO: 5223487 - DNA, 15 bp, Homo sapiens
aaagacttaatcata

SEQ ID NO: 5223488 - DNA, 18 bp, Homo sapiens
aaagacttaatcatatca

SEQ ID NO: 5223489 - DNA, 19 bp, Homo sapiens
aaagacttaatcatatcaa

SEQ ID NO: 5223490 - DNA, 20 bp, Homo sapiens
aaagacttagtatattttct

SEQ ID NO: 5223491 - DNA, 18 bp, Homo sapiens
aaagacttcaaatgttat

SEQ ID NO: 5223492 - DNA, 14 bp, Homo sapiens
aaagacttcattta

SEQ ID NO: 5223493 - DNA, 21 bp, Homo sapiens
aaagacttcatttaacactga

SEQ ID NO: 5223494 - DNA, 22 bp, Homo sapiens
aaagacttcatttaacactgag

SEQ ID NO: 5223495 - DNA, 16 bp, Homo sapiens
aaagacttccaaagaa

SEQ ID NO: 5223496 - DNA, 19 bp, Homo sapiens
aaagacttccaaagaatgt

SEQ ID NO: 5223497 - DNA, 14 bp, Homo sapiens
aaagacttgatgaa

SEQ ID NO: 5223498 - DNA, 22 bp, Homo sapiens
aaagacttgatgaataaacact

SEQ ID NO: 5223499 - DNA, 15 bp, Homo sapiens
aaagacttgctttaa

SEQ ID NO: 5223500 - DNA, 20 bp, Homo sapiens
aaagacttggttggtagggt

SEQ ID NO: 5223501 - DNA, 19 bp, Homo sapiens
aaagacttgtaatattttt

SEQ ID NO: 5223502 - DNA, 14 bp, Homo sapiens
aaagacttgttaaa

SEQ ID NO: 5223503 - DNA, 17 bp, Homo sapiens
aaagacttgttaaatgt

SEQ ID NO: 5223504 - DNA, 19 bp, Homo sapiens
aaagactttgatgtgtttt

SEQ ID NO: 5223505 - DNA, 12 bp, Homo sapiens
aaagacttttgt

SEQ ID NO: 5223506 - DNA, 12 bp, Homo sapiens
aaagagaaaaaa

SEQ ID NO: 5223507 - DNA, 15 bp, Homo sapiens
aaagagaaaaaccaa

SEQ ID NO: 5223508 - DNA, 12 bp, Homo sapiens
aaagagaaaaga

SEQ ID NO: 5223509 - DNA, 16 bp, Homo sapiens
aaagagaaaagggaaa

SEQ ID NO: 5223510 - DNA, 19 bp, Homo sapiens
aaagagaaaatatatattt

SEQ ID NO: 5223511 - DNA, 11 bp, Homo sapiens
aaagagaaaga

SEQ ID NO: 5223512 - DNA, 17 bp, Homo sapiens
aaagagaaatacataaa

SEQ ID NO: 5223513 - DNA, 16 bp, Homo sapiens
aaagagaaatcagaaa

SEQ ID NO: 5223514 - DNA, 22 bp, Homo sapiens
aaagagaaatcagaaaaattaa

SEQ ID NO: 5223515 - DNA, 18 bp, Homo sapiens
aaagagaactccagtgtt

SEQ ID NO: 5223516 - DNA, 13 bp, Homo sapiens
aaagagaagaaag

SEQ ID NO: 5223517 - DNA, 20 bp, Homo sapiens
aaagagaatgagtccttgat

SEQ ID NO: 5223518 - DNA, 14 bp, Homo sapiens
aaagagaatgtatt

SEQ ID NO: 5223519 - DNA, 21 bp, Homo sapiens
aaagagaattgggggcttagg

SEQ ID NO: 5223520 - DNA, 22 bp, Homo sapiens
aaagagacaaactgtaaaaaat

SEQ ID NO: 5223521 - DNA, 15 bp, Homo sapiens
aaagagacaaagctt

SEQ ID NO: 5223522 - DNA, 18 bp, Homo sapiens
aggtggctgcctggagcc

SEQ ID NO: 5223523 - DNA, 17 bp, Homo sapiens
aggtggctgcgccccca

SEQ ID NO: 5223524 - DNA, 22 bp, Homo sapiens
aggtggctgcgcccccagcttc

SEQ ID NO: 5223525 - DNA, 19 bp, Homo sapiens
aggtgggaacatggtcacc

SEQ ID NO: 5223526 - DNA, 13 bp, Homo sapiens
aggtgggactttg

SEQ ID NO: 5223527 - DNA, 16 bp, Homo sapiens
aggtgggagacaagga

SEQ ID NO: 5223528 - DNA, 13 bp, Homo sapiens
aggtgggagagac

SEQ ID NO: 5223529 - DNA, 18 bp, Homo sapiens
aggtgggagagagtgcat

SEQ ID NO: 5223530 - DNA, 17 bp, Homo sapiens
aggtgggagatggaggt

SEQ ID NO: 5223531 - DNA, 21 bp, Homo sapiens
aggtgggagatttggaataca

SEQ ID NO: 5223532 - DNA, 14 bp, Homo sapiens
aggtgggagcagga

SEQ ID NO: 5223533 - DNA, 15 bp, Homo sapiens
aggtgggagcaggag

SEQ ID NO: 5223534 - DNA, 17 bp, Homo sapiens
aggtgggagcaggagat

SEQ ID NO: 5223535 - DNA, 17 bp, Homo sapiens
aggtgggaggacagtta

SEQ ID NO: 5223536 - DNA, 20 bp, Homo sapiens
aggtgggaggacagttagac

SEQ ID NO: 5223537 - DNA, 13 bp, Homo sapiens
aggtgggaggatg

SEQ ID NO: 5223538 - DNA, 20 bp, Homo sapiens
aggtgggaggatgtgaattg

SEQ ID NO: 5223539 - DNA, 13 bp, Homo sapiens
aggtgggaggccc

SEQ ID NO: 5223540 - DNA, 16 bp, Homo sapiens
aggtgggatcctccct

SEQ ID NO: 5223541 - DNA, 17 bp, Homo sapiens
aggtgggatcctccctc

SEQ ID NO: 5223542 - DNA, 19 bp, Homo sapiens
aggtgggcactggattagt

SEQ ID NO: 5223543 - DNA, 18 bp, Homo sapiens
aggtgggcagcagctcag

SEQ ID NO: 5223544 - DNA, 17 bp, Homo sapiens
aggtgggcagctgggcc

SEQ ID NO: 5223545 - DNA, 13 bp, Homo sapiens
aggtgggcaggtg

SEQ ID NO: 5223546 - DNA, 17 bp, Homo sapiens
aggtgggcatgccaccc

SEQ ID NO: 5223547 - DNA, 16 bp, Homo sapiens
aggtgggccacaccca

SEQ ID NO: 5223548 - DNA, 14 bp, Homo sapiens
aggtgggccagccc

SEQ ID NO: 5223549 - DNA, 15 bp, Homo sapiens
aggtgggccagcccc

SEQ ID NO: 5223550 - DNA, 19 bp, Homo sapiens
aggtgggccagcccctccc

SEQ ID NO: 5223551 - DNA, 22 bp, Homo sapiens
aggtgggccagcccctcccacc

SEQ ID NO: 5223552 - DNA, 22 bp, Homo sapiens
aggtgggcccaggaccagctgg

SEQ ID NO: 5223553 - DNA, 23 bp, Homo sapiens
aggtgggcccaggaccagctggg

SEQ ID NO: 5223554 - DNA, 19 bp, Homo sapiens
aggtgggcctggcggcctg

SEQ ID NO: 5223555 - DNA, 15 bp, Homo sapiens
aggtgggccttccat

SEQ ID NO: 5223556 - DNA, 16 bp, Homo sapiens
aggtgggccttccatg

SEQ ID NO: 5223557 - DNA, 23 bp, Homo sapiens
aggtgggccttccatgggcatgg

SEQ ID NO: 5223558 - DNA, 22 bp, Homo sapiens
aggtgggccttgctacctcaag

SEQ ID NO: 5223559 - DNA, 18 bp, Homo sapiens
aggtgggcggacaaaagg

SEQ ID NO: 5223560 - DNA, 16 bp, Homo sapiens
aggtgggcgggcagca

SEQ ID NO: 5223561 - DNA, 18 bp, Homo sapiens
aggtgggcgggcagcaca

SEQ ID NO: 5223562 - DNA, 20 bp, Homo sapiens
aggtgggcgggcagcacagc

SEQ ID NO: 5223563 - DNA, 22 bp, Homo sapiens
aggtgggcgggcagcacagcaa

SEQ ID NO: 5223564 - DNA, 23 bp, Homo sapiens
aggtgggctgaagggaagcccag

SEQ ID NO: 5223565 - DNA, 16 bp, Homo sapiens
aggtgggctgagccct

SEQ ID NO: 5223566 - DNA, 18 bp, Homo sapiens
aggtgggctgagccctgg

SEQ ID NO: 5223567 - DNA, 19 bp, Homo sapiens
aggtgggctgagccctggc

SEQ ID NO: 5223568 - DNA, 20 bp, Homo sapiens
aggtgggctgagccctggca

SEQ ID NO: 5223569 - DNA, 20 bp, Homo sapiens
aggtgggctgatggcctggc

SEQ ID NO: 5223570 - DNA, 23 bp, Homo sapiens
aggtgggctgatggcctggctgc

SEQ ID NO: 5223571 - DNA, 17 bp, Homo sapiens
aggtgggctgcctgctg

SEQ ID NO: 5223572 - DNA, 15 bp, Homo sapiens
aggtgggctggactt

SEQ ID NO: 5223573 - DNA, 13 bp, Homo sapiens
aggtgggctgggc

SEQ ID NO: 5223574 - DNA, 21 bp, Homo sapiens
aggtgggctgggccctctctt

SEQ ID NO: 5223575 - DNA, 22 bp, Homo sapiens
aggtgggctggggctgctcccc

SEQ ID NO: 5223576 - DNA, 18 bp, Homo sapiens
aggtgggcttcagtaagt

SEQ ID NO: 5223577 - DNA, 21 bp, Homo sapiens
aggtggggaagagagcctgcc

SEQ ID NO: 5223578 - DNA, 23 bp, Homo sapiens
aggtggggaagagagcctgcccg

SEQ ID NO: 5223579 - DNA, 23 bp, Homo sapiens
aggtggggacctggggggaggga

SEQ ID NO: 5223580 - DNA, 14 bp, Homo sapiens
aggtggggactggg

SEQ ID NO: 5223581 - DNA, 18 bp, Homo sapiens
aggtggggactgggcaca

SEQ ID NO: 5223582 - DNA, 14 bp, Homo sapiens
aggtggggagaagg

SEQ ID NO: 5223583 - DNA, 18 bp, Homo sapiens
aggtggggagactgggct

SEQ ID NO: 5223584 - DNA, 16 bp, Homo sapiens
aggtggggagggcctc

SEQ ID NO: 5223585 - DNA, 22 bp, Homo sapiens
aggtggggagtccagggctccc

SEQ ID NO: 5223586 - DNA, 16 bp, Homo sapiens
aggtggggcagcttga

SEQ ID NO: 5223587 - DNA, 15 bp, Homo sapiens
aggtggggccctgcc

SEQ ID NO: 5223588 - DNA, 22 bp, Homo sapiens
aggtggggccctgcccctagga

SEQ ID NO: 5223589 - DNA, 23 bp, Homo sapiens
aggtggggcctcaatctaaggcc

SEQ ID NO: 5223590 - DNA, 20 bp, Homo sapiens
aggtggggcctcagcctggg

SEQ ID NO: 5223591 - DNA, 18 bp, Homo sapiens
aggtggggcgaggcaggc

SEQ ID NO: 5223592 - DNA, 16 bp, Homo sapiens
aggtgggggagcctgg

SEQ ID NO: 5223593 - DNA, 18 bp, Homo sapiens
aggtgggggagcctggag

SEQ ID NO: 5223594 - DNA, 15 bp, Homo sapiens
aggtgggggatgctg

SEQ ID NO: 5223595 - DNA, 12 bp, Homo sapiens
aggtgggggcag

SEQ ID NO: 5223596 - DNA, 14 bp, Homo sapiens
aggtgggggcagcg

SEQ ID NO: 5223597 - DNA, 20 bp, Homo sapiens
aggtgggggcagcggccccg

SEQ ID NO: 5223598 - DNA, 21 bp, Homo sapiens
aggtgggggcagcggccccgc

SEQ ID NO: 5223599 - DNA, 17 bp, Homo sapiens
aggtgggggcctcctca

SEQ ID NO: 5223600 - DNA, 17 bp, Homo sapiens
aggtgggggtgggctgc

SEQ ID NO: 5223601 - DNA, 15 bp, Homo sapiens
aggtgggggttgctg

SEQ ID NO: 5223602 - DNA, 18 bp, Homo sapiens
aggtgggggttggctggg

SEQ ID NO: 5223603 - DNA, 20 bp, Homo sapiens
aggtgggggttggctgggta

SEQ ID NO: 5223604 - DNA, 20 bp, Homo sapiens
aggtggggtgaagctgggga

SEQ ID NO: 5223605 - DNA, 16 bp, Homo sapiens
aggtggggtgatggcc

SEQ ID NO: 5223606 - DNA, 20 bp, Homo sapiens
aggtggggtgctggggctgc

SEQ ID NO: 5223607 - DNA, 22 bp, Homo sapiens
aggtggggttgggattgggggc

SEQ ID NO: 5223608 - DNA, 17 bp, Homo sapiens
aggtgggtaggagccct

SEQ ID NO: 5223609 - DNA, 21 bp, Homo sapiens
aggtgggtcaactccaaggca

SEQ ID NO: 5223610 - DNA, 21 bp, Homo sapiens
aggtgggtccaggaaggcagc

SEQ ID NO: 5223611 - DNA, 23 bp, Homo sapiens
aggtgggtctacctcatctctga

SEQ ID NO: 5223612 - DNA, 15 bp, Homo sapiens
aggtgggtgaggctg

SEQ ID NO: 5223613 - DNA, 15 bp, Homo sapiens
aggtgggtgggcctg

SEQ ID NO: 5223614 - DNA, 16 bp, Homo sapiens
aggtgggtgtgggtgg

SEQ ID NO: 5223615 - DNA, 17 bp, Homo sapiens
aggtgggttagagatgg

SEQ ID NO: 5223616 - DNA, 17 bp, Homo sapiens
aggtggtagatattgag

SEQ ID NO: 5223617 - DNA, 16 bp, Homo sapiens
aggtggtagctctgag

SEQ ID NO: 5223618 - DNA, 16 bp, Homo sapiens
aggtggtaggaggagg

SEQ ID NO: 5223619 - DNA, 15 bp, Homo sapiens
aggtggtcagtaaat

SEQ ID NO: 5223620 - DNA, 19 bp, Homo sapiens
aggtggtcctgagacctga

SEQ ID NO: 5223621 - DNA, 18 bp, Homo sapiens
aggtggtctgaatgttct

SEQ ID NO: 5223622 - DNA, 12 bp, Homo sapiens
aggtggtctgca

SEQ ID NO: 5223623 - DNA, 22 bp, Homo sapiens
aggtggtctgcaccccacagga

SEQ ID NO: 5223624 - DNA, 14 bp, Homo sapiens
aggtggtctggtgc

SEQ ID NO: 5223625 - DNA, 13 bp, Homo sapiens
aggtggtcttgga

SEQ ID NO: 5223626 - DNA, 15 bp, Homo sapiens
aggtggtcttggaga

SEQ ID NO: 5223627 - DNA, 19 bp, Homo sapiens
aggtggtcttggagaggag

SEQ ID NO: 5223628 - DNA, 22 bp, Homo sapiens
aggtggtcttggagaggaggtg

SEQ ID NO: 5223629 - DNA, 14 bp, Homo sapiens
aggtggtggaggag

SEQ ID NO: 5223630 - DNA, 15 bp, Homo sapiens
aggtggtggaggagg

SEQ ID NO: 5223631 - DNA, 19 bp, Homo sapiens
aggtggtggcactgagccc

SEQ ID NO: 5223632 - DNA, 18 bp, Homo sapiens
aggtggtgggcattctct

SEQ ID NO: 5223633 - DNA, 21 bp, Homo sapiens
aggtggtgggcattctctctc

SEQ ID NO: 5223634 - DNA, 21 bp, Homo sapiens
aggtggtgtcactgtccctcc

SEQ ID NO: 5223635 - DNA, 23 bp, Homo sapiens
aggtggtgtcactgtccctcctg

SEQ ID NO: 5223636 - DNA, 19 bp, Homo sapiens
aggtggtgtccctttcaca

SEQ ID NO: 5223637 - DNA, 16 bp, Homo sapiens
aggtggtgtccttctt

SEQ ID NO: 5223638 - DNA, 20 bp, Homo sapiens
aggtggttcgtgctgtgctc

SEQ ID NO: 5223639 - DNA, 19 bp, Homo sapiens
aggtggttctaatattttt

SEQ ID NO: 5223640 - DNA, 15 bp, Homo sapiens
aggtggttttaaagg

SEQ ID NO: 5223641 - DNA, 22 bp, Homo sapiens
aggtggtttttggttacatgga

SEQ ID NO: 5223642 - DNA, 15 bp, Homo sapiens
aggtgtaaaacagta

SEQ ID NO: 5223643 - DNA, 18 bp, Homo sapiens
aggtgtaaatgagaagac

SEQ ID NO: 5223644 - DNA, 19 bp, Homo sapiens
aggtgtaaccatttgttaa

SEQ ID NO: 5223645 - DNA, 19 bp, Homo sapiens
aggtgtaagactttaagaa

SEQ ID NO: 5223646 - DNA, 24 bp, Homo sapiens
aggtgtaagactttaagaagcgaa

SEQ ID NO: 5223647 - DNA, 14 bp, Homo sapiens
aggtgtaataagac

SEQ ID NO: 5223648 - DNA, 21 bp, Homo sapiens
aggtgtacacatgccaacact

SEQ ID NO: 5223649 - DNA, 17 bp, Homo sapiens
aggtgtacactaacatt

SEQ ID NO: 5223650 - DNA, 15 bp, Homo sapiens
aggtgtagctgagct

SEQ ID NO: 5223651 - DNA, 23 bp, Homo sapiens
aggtgtatgccacacctggcctt

SEQ ID NO: 5223652 - DNA, 20 bp, Homo sapiens
aggtgtatggagagaaaaca

SEQ ID NO: 5223653 - DNA, 13 bp, Homo sapiens
aggtgtcacatgg

SEQ ID NO: 5223654 - DNA, 20 bp, Homo sapiens
aggtgtcaccctgcagagct

SEQ ID NO: 5223655 - DNA, 23 bp, Homo sapiens
aggtgtcagccattgcacccagc

SEQ ID NO: 5223656 - DNA, 13 bp, Homo sapiens
aggtgtcaggccc

SEQ ID NO: 5223657 - DNA, 14 bp, Homo sapiens
aggtgtcatgcttt

SEQ ID NO: 5223658 - DNA, 21 bp, Homo sapiens
aggtgtcatggatagattttc

SEQ ID NO: 5223659 - DNA, 17 bp, Homo sapiens
aggtgtcatttccatta

SEQ ID NO: 5223660 - DNA, 22 bp, Homo sapiens
aggtgtcatttgacaacacatg

SEQ ID NO: 5223661 - DNA, 20 bp, Homo sapiens
aggtgtccagcattgctgga

SEQ ID NO: 5223662 - DNA, 20 bp, Homo sapiens
aggtgtccccaacgtcccct

SEQ ID NO: 5223663 - DNA, 22 bp, Homo sapiens
aggtgtccccaacgtcccctcc

SEQ ID NO: 5223664 - DNA, 15 bp, Homo sapiens
aggtgtcctgactgt

SEQ ID NO: 5223665 - DNA, 15 bp, Homo sapiens
aggtgtcctgagcac

SEQ ID NO: 5223666 - DNA, 17 bp, Homo sapiens
aggtgtctagaggcaac

SEQ ID NO: 5223667 - DNA, 17 bp, Homo sapiens
aggtgtctcaggctgcc

SEQ ID NO: 5223668 - DNA, 14 bp, Homo sapiens
aggtgtctctgggc

SEQ ID NO: 5223669 - DNA, 16 bp, Homo sapiens
aggtgtctctgggcct

SEQ ID NO: 5223670 - DNA, 17 bp, Homo sapiens
aggtgtctgcacccagg

SEQ ID NO: 5223671 - DNA, 15 bp, Homo sapiens
aggtgtctgccactt

SEQ ID NO: 5223672 - DNA, 15 bp, Homo sapiens
aggtgtctggcctga

SEQ ID NO: 5223673 - DNA, 17 bp, Homo sapiens
aggtgtctggggtgagg

SEQ ID NO: 5223674 - DNA, 15 bp, Homo sapiens
aggtgtcttcctccc

SEQ ID NO: 5223675 - DNA, 19 bp, Homo sapiens
aggtgtcttcctcccaagt

SEQ ID NO: 5223676 - DNA, 23 bp, Homo sapiens
aggtgtcttttccactcctatgg

SEQ ID NO: 5223677 - DNA, 14 bp, Homo sapiens
aggtgtgaaatcat

SEQ ID NO: 5223678 - DNA, 17 bp, Homo sapiens
aggtgtgaaccaccaca

SEQ ID NO: 5223679 - DNA, 12 bp, Homo sapiens
aggtgtgaatgc

SEQ ID NO: 5223680 - DNA, 20 bp, Homo sapiens
aggtgtgaatgcacgtttca

SEQ ID NO: 5223681 - DNA, 15 bp, Homo sapiens
aggtgtgagccacag

SEQ ID NO: 5223682 - DNA, 19 bp, Homo sapiens
aggtgtgagccacagcact

SEQ ID NO: 5223683 - DNA, 21 bp, Homo sapiens
aggtgtgaggagagaggagga

SEQ ID NO: 5223684 - DNA, 21 bp, Homo sapiens
aggtgtgcaaagatctctaga

SEQ ID NO: 5223685 - DNA, 16 bp, Homo sapiens
aggtgtgcacagaaaa

SEQ ID NO: 5223686 - DNA, 18 bp, Homo sapiens
aggtgtgcacagaaaacc

SEQ ID NO: 5223687 - DNA, 13 bp, Homo sapiens
aggtgtgccaaac

SEQ ID NO: 5223688 - DNA, 15 bp, Homo sapiens
aggtgtgcctggcct

SEQ ID NO: 5223689 - DNA, 14 bp, Homo sapiens
aggtgtgcctgtgc

SEQ ID NO: 5223690 - DNA, 15 bp, Homo sapiens
aggtgtgcctgtgct

SEQ ID NO: 5223691 - DNA, 20 bp, Homo sapiens
aggtgtgcctgtgctcctgc

SEQ ID NO: 5223692 - DNA, 21 bp, Homo sapiens
aggtgtgcctgtgctcctgcc

SEQ ID NO: 5223693 - DNA, 16 bp, Homo sapiens
aggtgtgctctgagcc

SEQ ID NO: 5223694 - DNA, 19 bp, Homo sapiens
aggtgtggaccggccgcag

SEQ ID NO: 5223695 - DNA, 23 bp, Homo sapiens
aggtgtggaccggccgcagcccc

SEQ ID NO: 5223696 - DNA, 20 bp, Homo sapiens
aggtgtggagccgaggccta

SEQ ID NO: 5223697 - DNA, 19 bp, Homo sapiens
aggtgtggaggctcctgtg

SEQ ID NO: 5223698 - DNA, 15 bp, Homo sapiens
aggtgtggagtggag

SEQ ID NO: 5223699 - DNA, 20 bp, Homo sapiens
agtgagcagctactgtaact

SEQ ID NO: 5223700 - DNA, 21 bp, Homo sapiens
agtgagcagggtggggtctgg

SEQ ID NO: 5223701 - DNA, 21 bp, Homo sapiens
agtgagcagtcgcctgcctgc

SEQ ID NO: 5223702 - DNA, 14 bp, Homo sapiens
agtgagcatatctg

SEQ ID NO: 5223703 - DNA, 21 bp, Homo sapiens
agtgagcatgctttctgaact

SEQ ID NO: 5223704 - DNA, 16 bp, Homo sapiens
agtgagccaaaatcat

SEQ ID NO: 5223705 - DNA, 20 bp, Homo sapiens
agtgagccaagatcgcacca

SEQ ID NO: 5223706 - DNA, 16 bp, Homo sapiens
agtgagccacagacca

SEQ ID NO: 5223707 - DNA, 21 bp, Homo sapiens
agtgagccagaaattgattaa

SEQ ID NO: 5223708 - DNA, 19 bp, Homo sapiens
agtgagcccagattgtgcc

SEQ ID NO: 5223709 - DNA, 21 bp, Homo sapiens
agtgagcccagattgtgccac

SEQ ID NO: 5223710 - DNA, 18 bp, Homo sapiens
agtgagcccctccccagc

SEQ ID NO: 5223711 - DNA, 19 bp, Homo sapiens
agtgagcccctccccagcc

SEQ ID NO: 5223712 - DNA, 20 bp, Homo sapiens
agtgagcccctccccagcca

SEQ ID NO: 5223713 - DNA, 18 bp, Homo sapiens
agtgagccgagatagcac

SEQ ID NO: 5223714 - DNA, 23 bp, Homo sapiens
agtgagccgagattgcaccactg

SEQ ID NO: 5223715 - DNA, 20 bp, Homo sapiens
agtgagcctcctgtgcctgg

SEQ ID NO: 5223716 - DNA, 14 bp, Homo sapiens
agtgagcctctgcg

SEQ ID NO: 5223717 - DNA, 11 bp, Homo sapiens
agtgagcctga

SEQ ID NO: 5223718 - DNA, 13 bp, Homo sapiens
agtgagcctggct

SEQ ID NO: 5223719 - DNA, 14 bp, Homo sapiens
agtgagcctggctc

SEQ ID NO: 5223720 - DNA, 12 bp, Homo sapiens
agtgagcctggg

SEQ ID NO: 5223721 - DNA, 16 bp, Homo sapiens
agtgagccttcccatt

SEQ ID NO: 5223722 - DNA, 15 bp, Homo sapiens
agtgagctaccagga

SEQ ID NO: 5223723 - DNA, 15 bp, Homo sapiens
agtgagctcctgcct

SEQ ID NO: 5223724 - DNA, 17 bp, Homo sapiens
agtgagctctatgggca

SEQ ID NO: 5223725 - DNA, 15 bp, Homo sapiens
agtgagctctctcag

SEQ ID NO: 5223726 - DNA, 16 bp, Homo sapiens
agtgagctctctcaga

SEQ ID NO: 5223727 - DNA, 19 bp, Homo sapiens
agtgagctctggtggagac

SEQ ID NO: 5223728 - DNA, 23 bp, Homo sapiens
agtgagctgagatcgtgccgtta

SEQ ID NO: 5223729 - DNA, 15 bp, Homo sapiens
agtgagctgcactga

SEQ ID NO: 5223730 - DNA, 19 bp, Homo sapiens
agtgagctggaattctaaa

SEQ ID NO: 5223731 - DNA, 21 bp, Homo sapiens
agtgagctgggcatggtacca

SEQ ID NO: 5223732 - DNA, 21 bp, Homo sapiens
agtgagcttggaaaggaccag

SEQ ID NO: 5223733 - DNA, 19 bp, Homo sapiens
agtgagctttgctgctaca

SEQ ID NO: 5223734 - DNA, 20 bp, Homo sapiens
agtgagctttgctgctacag

SEQ ID NO: 5223735 - DNA, 15 bp, Homo sapiens
agtgaggaaatcaaa

SEQ ID NO: 5223736 - DNA, 20 bp, Homo sapiens
agtgaggaaatcaaagtgct

SEQ ID NO: 5223737 - DNA, 18 bp, Homo sapiens
agtgaggaaatggcaaca

SEQ ID NO: 5223738 - DNA, 16 bp, Homo sapiens
agtgaggaaccctgat

SEQ ID NO: 5223739 - DNA, 20 bp, Homo sapiens
agtgaggaatagttgagccc

SEQ ID NO: 5223740 - DNA, 21 bp, Homo sapiens
agtgaggaatagttgagcccc

SEQ ID NO: 5223741 - DNA, 19 bp, Homo sapiens
agtgaggactcggccactg

SEQ ID NO: 5223742 - DNA, 23 bp, Homo sapiens
agtgaggactcggccactgtgtc

SEQ ID NO: 5223743 - DNA, 23 bp, Homo sapiens
agtgaggactctttccgactgcc

SEQ ID NO: 5223744 - DNA, 14 bp, Homo sapiens
agtgaggagaatga

SEQ ID NO: 5223745 - DNA, 14 bp, Homo sapiens
agtgaggagatgcg

SEQ ID NO: 5223746 - DNA, 18 bp, Homo sapiens
agtgaggatcttgatttg

SEQ ID NO: 5223747 - DNA, 18 bp, Homo sapiens
agtgaggatgagacccag

SEQ ID NO: 5223748 - DNA, 19 bp, Homo sapiens
agtgaggatgagacccagc

SEQ ID NO: 5223749 - DNA, 17 bp, Homo sapiens
agtgaggatgctgcagt

SEQ ID NO: 5223750 - DNA, 22 bp, Homo sapiens
agtgaggcattgcacagggaga

SEQ ID NO: 5223751 - DNA, 12 bp, Homo sapiens
agtgaggccact

SEQ ID NO: 5223752 - DNA, 20 bp, Homo sapiens
agtgaggctcagattaaatt

SEQ ID NO: 5223753 - DNA, 12 bp, Homo sapiens
agtgaggctctg

SEQ ID NO: 5223754 - DNA, 19 bp, Homo sapiens
agtgaggctctgcccttgg

SEQ ID NO: 5223755 - DNA, 13 bp, Homo sapiens
agtgaggctggga

SEQ ID NO: 5223756 - DNA, 16 bp, Homo sapiens
agtgaggcttccaggc

SEQ ID NO: 5223757 - DNA, 19 bp, Homo sapiens
agtgagggagggctgtcat

SEQ ID NO: 5223758 - DNA, 14 bp, Homo sapiens
agtgagggattatc

SEQ ID NO: 5223759 - DNA, 22 bp, Homo sapiens
agtgagggcctcagagcctgac

SEQ ID NO: 5223760 - DNA, 24 bp, Homo sapiens
agtgagggcctcagagcctgacct

SEQ ID NO: 5223761 - DNA, 12 bp, Homo sapiens
agtgagggcctg

SEQ ID NO: 5223762 - DNA, 22 bp, Homo sapiens
agtgaggggtaaaagctgatct

SEQ ID NO: 5223763 - DNA, 20 bp, Homo sapiens
agtgaggggttacctccctc

SEQ ID NO: 5223764 - DNA, 13 bp, Homo sapiens
agtgagggtcaga

SEQ ID NO: 5223765 - DNA, 23 bp, Homo sapiens
agtgagggtcagagaggagtcag

SEQ ID NO: 5223766 - DNA, 17 bp, Homo sapiens
agtgagggtttctgagc

SEQ ID NO: 5223767 - DNA, 21 bp, Homo sapiens
agtgaggtatgatgtgctgct

SEQ ID NO: 5223768 - DNA, 18 bp, Homo sapiens
agtgaggtcctgggggcc

SEQ ID NO: 5223769 - DNA, 18 bp, Homo sapiens
agtgagtaattctttgat

SEQ ID NO: 5223770 - DNA, 17 bp, Homo sapiens
agtgagtaattttggat

SEQ ID NO: 5223771 - DNA, 17 bp, Homo sapiens
agtgagtacctgcaaaa

SEQ ID NO: 5223772 - DNA, 22 bp, Homo sapiens
agtgagtacctgcaaaaatgag

SEQ ID NO: 5223773 - DNA, 23 bp, Homo sapiens
agtgagtactcataaaggacact

SEQ ID NO: 5223774 - DNA, 16 bp, Homo sapiens
agtgagtactgttaag

SEQ ID NO: 5223775 - DNA, 22 bp, Homo sapiens
agtgagtatgcttgggccctgc

SEQ ID NO: 5223776 - DNA, 15 bp, Homo sapiens
agtgagtcacctgct

SEQ ID NO: 5223777 - DNA, 21 bp, Homo sapiens
agtgagtcacctgctccagaa

SEQ ID NO: 5223778 - DNA, 22 bp, Homo sapiens
agtgagtcacctgctccagaag

SEQ ID NO: 5223779 - DNA, 16 bp, Homo sapiens
agtgagtcgaggacag

SEQ ID NO: 5223780 - DNA, 13 bp, Homo sapiens
agtgagtctctct

SEQ ID NO: 5223781 - DNA, 17 bp, Homo sapiens
agtgagtctggtggagg

SEQ ID NO: 5223782 - DNA, 22 bp, Homo sapiens
agtgagtctggtggaggagctg

SEQ ID NO: 5223783 - DNA, 14 bp, Homo sapiens
agtgagtctgtcag

SEQ ID NO: 5223784 - DNA, 18 bp, Homo sapiens
agtgagtctgtcataata

SEQ ID NO: 5223785 - DNA, 16 bp, Homo sapiens
agtgagtgatcactgg

SEQ ID NO: 5223786 - DNA, 18 bp, Homo sapiens
agtgagtgccatgctttt

SEQ ID NO: 5223787 - DNA, 16 bp, Homo sapiens
agtgagtggcatgtgg

SEQ ID NO: 5223788 - DNA, 18 bp, Homo sapiens
agtgagtggcatgtgggt

SEQ ID NO: 5223789 - DNA, 17 bp, Homo sapiens
agtgagtgtatgtgtgt

SEQ ID NO: 5223790 - DNA, 19 bp, Homo sapiens
agtgagtgtatgtgtgtgt

SEQ ID NO: 5223791 - DNA, 18 bp, Homo sapiens
agtgagtgtgctgacttt

SEQ ID NO: 5223792 - DNA, 17 bp, Homo sapiens
agtgagtgtgctgctgt

SEQ ID NO: 5223793 - DNA, 14 bp, Homo sapiens
agtgagtgtttcta

SEQ ID NO: 5223794 - DNA, 18 bp, Homo sapiens
agtgagttcaactacatg

SEQ ID NO: 5223795 - DNA, 23 bp, Homo sapiens
agtgagttcaactacatgttctg

SEQ ID NO: 5223796 - DNA, 21 bp, Homo sapiens
agtgagttgatagcacagacc

SEQ ID NO: 5223797 - DNA, 23 bp, Homo sapiens
agtgagttgatagcacagaccct

SEQ ID NO: 5223798 - DNA, 18 bp, Homo sapiens
agtgagttgttgccctgg

SEQ ID NO: 5223799 - DNA, 19 bp, Homo sapiens
agtgagttgttgccctggg

SEQ ID NO: 5223800 - DNA, 17 bp, Homo sapiens
agtgagtttgtaaatat

SEQ ID NO: 5223801 - DNA, 22 bp, Homo sapiens
agtgataaatcgggaaatttac

SEQ ID NO: 5223802 - DNA, 17 bp, Homo sapiens
agtgataactcctaaga

SEQ ID NO: 5223803 - DNA, 19 bp, Homo sapiens
agtgataatttctggaatt

SEQ ID NO: 5223804 - DNA, 19 bp, Homo sapiens
agtgataattttatttata

SEQ ID NO: 5223805 - DNA, 23 bp, Homo sapiens
agtgatacaacttcaagtgcatg

SEQ ID NO: 5223806 - DNA, 18 bp, Homo sapiens
agtgatacactgtatcta

SEQ ID NO: 5223807 - DNA, 20 bp, Homo sapiens
agtgatactatccagttact

SEQ ID NO: 5223808 - DNA, 18 bp, Homo sapiens
agtgatactggctcagaa

SEQ ID NO: 5223809 - DNA, 15 bp, Homo sapiens
agtgatagtcttttg

SEQ ID NO: 5223810 - DNA, 15 bp, Homo sapiens
agtgatatatgtatt

SEQ ID NO: 5223811 - DNA, 17 bp, Homo sapiens
agtgatatatgtattta

SEQ ID NO: 5223812 - DNA, 16 bp, Homo sapiens
agtgatatatttctat

SEQ ID NO: 5223813 - DNA, 15 bp, Homo sapiens
agtgatatcacctct

SEQ ID NO: 5223814 - DNA, 18 bp, Homo sapiens
agtgatatctagaaaggg

SEQ ID NO: 5223815 - DNA, 17 bp, Homo sapiens
agtgatatgatccagag

SEQ ID NO: 5223816 - DNA, 20 bp, Homo sapiens
agtgatatgatccagagcag

SEQ ID NO: 5223817 - DNA, 17 bp, Homo sapiens
agtgatatggcagaaga

SEQ ID NO: 5223818 - DNA, 19 bp, Homo sapiens
agtgatatggcagaagaca

SEQ ID NO: 5223819 - DNA, 21 bp, Homo sapiens
agtgatatggcagaagacacc

SEQ ID NO: 5223820 - DNA, 15 bp, Homo sapiens
agtgatatggcttgt

SEQ ID NO: 5223821 - DNA, 17 bp, Homo sapiens
agtgatatggtgaaggg

SEQ ID NO: 5223822 - DNA, 18 bp, Homo sapiens
agtgatatggtgaaggga

SEQ ID NO: 5223823 - DNA, 15 bp, Homo sapiens
agtgatattacattt

SEQ ID NO: 5223824 - DNA, 17 bp, Homo sapiens
agtgatattctttgtta

SEQ ID NO: 5223825 - DNA, 15 bp, Homo sapiens
agtgatatttctcta

SEQ ID NO: 5223826 - DNA, 16 bp, Homo sapiens
agtgatatttctctag

SEQ ID NO: 5223827 - DNA, 17 bp, Homo sapiens
agtgatcaataaaatgt

SEQ ID NO: 5223828 - DNA, 15 bp, Homo sapiens
agtgatcacagcagc

SEQ ID NO: 5223829 - DNA, 16 bp, Homo sapiens
agtgatcagcaatgaa

SEQ ID NO: 5223830 - DNA, 21 bp, Homo sapiens
agtgatcagtatgctgtttta

SEQ ID NO: 5223831 - DNA, 19 bp, Homo sapiens
agtgatcagttgctctctg

SEQ ID NO: 5223832 - DNA, 14 bp, Homo sapiens
agtgatcatttaaa

SEQ ID NO: 5223833 - DNA, 20 bp, Homo sapiens
agtgatcatttaaaaagctc

SEQ ID NO: 5223834 - DNA, 21 bp, Homo sapiens
agtgatcatttaaaaagctca

SEQ ID NO: 5223835 - DNA, 12 bp, Homo sapiens
agtgatccaggg

SEQ ID NO: 5223836 - DNA, 19 bp, Homo sapiens
agtgatcctcaaacacaca

SEQ ID NO: 5223837 - DNA, 15 bp, Homo sapiens
agtgatcctcacgcc

SEQ ID NO: 5223838 - DNA, 20 bp, Homo sapiens
agtgatcctcacgccttggc

SEQ ID NO: 5223839 - DNA, 22 bp, Homo sapiens
agtgatcctcccacctcagcct

SEQ ID NO: 5223840 - DNA, 24 bp, Homo sapiens
agtgatcctcccacctcagcctcc

SEQ ID NO: 5223841 - DNA, 22 bp, Homo sapiens
agtgatcctcccgccccagcct

SEQ ID NO: 5223842 - DNA, 23 bp, Homo sapiens
agtgatcctcccgccccagcctc

SEQ ID NO: 5223843 - DNA, 15 bp, Homo sapiens
agtgatctatgtttg

SEQ ID NO: 5223844 - DNA, 21 bp, Homo sapiens
agtgatctcaaatccactgac

SEQ ID NO: 5223845 - DNA, 16 bp, Homo sapiens
agtgatctcagggcag

SEQ ID NO: 5223846 - DNA, 13 bp, Homo sapiens
agtgatctgtcca

SEQ ID NO: 5223847 - DNA, 19 bp, Homo sapiens
agtgatctgtcccctctcc

SEQ ID NO: 5223848 - DNA, 19 bp, Homo sapiens
agtgatcttaggtttgttt

SEQ ID NO: 5223849 - DNA, 23 bp, Homo sapiens
agtgatcttaggtttgttttttc

SEQ ID NO: 5223850 - DNA, 13 bp, Homo sapiens
agtgatcttgaga

SEQ ID NO: 5223851 - DNA, 19 bp, Homo sapiens
agtgatcttggctgtttca

SEQ ID NO: 5223852 - DNA, 13 bp, Homo sapiens
agtgatctttcaa

SEQ ID NO: 5223853 - DNA, 14 bp, Homo sapiens
agtgatctttcaat

SEQ ID NO: 5223854 - DNA, 20 bp, Homo sapiens
agtgatctttcaatatcatt

SEQ ID NO: 5223855 - DNA, 12 bp, Homo sapiens
agtgatgaaatt

SEQ ID NO: 5223856 - DNA, 22 bp, Homo sapiens
agtgatgaaattataagtagat

SEQ ID NO: 5223857 - DNA, 23 bp, Homo sapiens
agtgatgaatgtactatgtctga

SEQ ID NO: 5223858 - DNA, 16 bp, Homo sapiens
agtgatgacttgctgt

SEQ ID NO: 5223859 - DNA, 12 bp, Homo sapiens
agtgatgatttg

SEQ ID NO: 5223860 - DNA, 22 bp, Homo sapiens
agtgatgatttgggggaggctt

SEQ ID NO: 5223861 - DNA, 20 bp, Homo sapiens
agtgatgccgggcgccagga

SEQ ID NO: 5223862 - DNA, 21 bp, Homo sapiens
agtgatgccgggcgccaggac

SEQ ID NO: 5223863 - DNA, 22 bp, Homo sapiens
agtgatgccgggcgccaggaca

SEQ ID NO: 5223864 - DNA, 20 bp, Homo sapiens
agtgatgcctgcccgcaccc

SEQ ID NO: 5223865 - DNA, 20 bp, Homo sapiens
agtgatgcctggggaaggag

SEQ ID NO: 5223866 - DNA, 22 bp, Homo sapiens
agtgatggaatatcatgaatgt

SEQ ID NO: 5223867 - DNA, 14 bp, Homo sapiens
agtgatggagcaga

SEQ ID NO: 5223868 - DNA, 18 bp, Homo sapiens
agtgatggagcagagcaa

SEQ ID NO: 5223869 - DNA, 12 bp, Homo sapiens
agtgatggcatt

SEQ ID NO: 5223870 - DNA, 22 bp, Homo sapiens
agtgatggcattactctgcact

SEQ ID NO: 5223871 - DNA, 21 bp, Homo sapiens
agtgatggcgcgggaggcacc

SEQ ID NO: 5223872 - DNA, 17 bp, Homo sapiens
agtgatgggaaggtttt

SEQ ID NO: 5223873 - DNA, 12 bp, Homo sapiens
agtgatgggagt

SEQ ID NO: 5223874 - DNA, 19 bp, Homo sapiens
agtgatgggcaaggggcca

SEQ ID NO: 5223875 - DNA, 17 bp, Homo sapiens
aggtgtggagtggaggg

SEQ ID NO: 5223876 - DNA, 14 bp, Homo sapiens
aggtgtggctgtca

SEQ ID NO: 5223877 - DNA, 23 bp, Homo sapiens
aggtgtggctttaggagcagtgg

SEQ ID NO: 5223878 - DNA, 18 bp, Homo sapiens
aggtgtgggatctgggga

SEQ ID NO: 5223879 - DNA, 19 bp, Homo sapiens
aggtgtgggatggagagtg

SEQ ID NO: 5223880 - DNA, 12 bp, Homo sapiens
aggtgtgggccg

SEQ ID NO: 5223881 - DNA, 15 bp, Homo sapiens
aggtgtgggctccca

SEQ ID NO: 5223882 - DNA, 16 bp, Homo sapiens
aggtgtgggctcccac

SEQ ID NO: 5223883 - DNA, 19 bp, Homo sapiens
aggtgtgggtgtctgtttg

SEQ ID NO: 5223884 - DNA, 17 bp, Homo sapiens
aggtgtgtatgtaaagt

SEQ ID NO: 5223885 - DNA, 20 bp, Homo sapiens
aggtgtgtatgtaaagttaa

SEQ ID NO: 5223886 - DNA, 22 bp, Homo sapiens
aggtgtgtccttgaactgaggc

SEQ ID NO: 5223887 - DNA, 16 bp, Homo sapiens
aggtgtgtggtgcacg

SEQ ID NO: 5223888 - DNA, 21 bp, Homo sapiens
aggtgtgtgtgaactgggcac

SEQ ID NO: 5223889 - DNA, 16 bp, Homo sapiens
aggtgttaaaaaccat

SEQ ID NO: 5223890 - DNA, 21 bp, Homo sapiens
aggtgttaaaaaccattataa

SEQ ID NO: 5223891 - DNA, 18 bp, Homo sapiens
aggtgttaacattccaag

SEQ ID NO: 5223892 - DNA, 20 bp, Homo sapiens
aggtgttacagaggaccctt

SEQ ID NO: 5223893 - DNA, 23 bp, Homo sapiens
aggtgttacagaggacccttacg

SEQ ID NO: 5223894 - DNA, 14 bp, Homo sapiens
aggtgttagagagg

SEQ ID NO: 5223895 - DNA, 19 bp, Homo sapiens
aggtgttatgtattcctat

SEQ ID NO: 5223896 - DNA, 20 bp, Homo sapiens
aggtgttatgtattcctatg

SEQ ID NO: 5223897 - DNA, 12 bp, Homo sapiens
aggtgttatttg

SEQ ID NO: 5223898 - DNA, 16 bp, Homo sapiens
aggtgttattttcaat

SEQ ID NO: 5223899 - DNA, 20 bp, Homo sapiens
aggtgttattttcaatgaaa

SEQ ID NO: 5223900 - DNA, 22 bp, Homo sapiens
aggtgttcaagaccagcctgac

SEQ ID NO: 5223901 - DNA, 17 bp, Homo sapiens
aggtgttcccaggctgc

SEQ ID NO: 5223902 - DNA, 21 bp, Homo sapiens
aggtgttcctcctcccctctc

SEQ ID NO: 5223903 - DNA, 16 bp, Homo sapiens
aggtgttgaaaatgag

SEQ ID NO: 5223904 - DNA, 21 bp, Homo sapiens
aggtgttgccaaatatgtcct

SEQ ID NO: 5223905 - DNA, 17 bp, Homo sapiens
aggtgttggctgcacgt

SEQ ID NO: 5223906 - DNA, 23 bp, Homo sapiens
aggtgttgggtcagtggccaggt

SEQ ID NO: 5223907 - DNA, 18 bp, Homo sapiens
aggtgttggttttggggg

SEQ ID NO: 5223908 - DNA, 17 bp, Homo sapiens
aggtgttgtcagcaggc

SEQ ID NO: 5223909 - DNA, 16 bp, Homo sapiens
aggtgttgtgcatttg

SEQ ID NO: 5223910 - DNA, 17 bp, Homo sapiens
aggtgttgtgcatttgt

SEQ ID NO: 5223911 - DNA, 20 bp, Homo sapiens
aggtgtttaagtaattgcca

SEQ ID NO: 5223912 - DNA, 18 bp, Homo sapiens
aggtgtttccatttctca

SEQ ID NO: 5223913 - DNA, 23 bp, Homo sapiens
aggtgtttcttgtgtttgagaac

SEQ ID NO: 5223914 - DNA, 14 bp, Homo sapiens
aggtgtttgaaaat

SEQ ID NO: 5223915 - DNA, 22 bp, Homo sapiens
aggtgtttgaacagaggccaca

SEQ ID NO: 5223916 - DNA, 17 bp, Homo sapiens
aggtgtttgactttcaa

SEQ ID NO: 5223917 - DNA, 13 bp, Homo sapiens
aggtgtttgggat

SEQ ID NO: 5223918 - DNA, 19 bp, Homo sapiens
aggtgttttctgtgtaacc

SEQ ID NO: 5223919 - DNA, 18 bp, Homo sapiens
aggtgttttgttcaccat

SEQ ID NO: 5223920 - DNA, 19 bp, Homo sapiens
aggtgttttttatgaagtg

SEQ ID NO: 5223921 - DNA, 12 bp, Homo sapiens
aggttaaaaaaa

SEQ ID NO: 5223922 - DNA, 18 bp, Homo sapiens
aggttaaaaaaaaaagtc

SEQ ID NO: 5223923 - DNA, 23 bp, Homo sapiens
aggttaaaaaaatggcagtgatg

SEQ ID NO: 5223924 - DNA, 16 bp, Homo sapiens
aggttaaaaagaaaag

SEQ ID NO: 5223925 - DNA, 15 bp, Homo sapiens
aggttaaaatataaa

SEQ ID NO: 5223926 - DNA, 23 bp, Homo sapiens
aggttaaaatataaattaagact

SEQ ID NO: 5223927 - DNA, 19 bp, Homo sapiens
aggttaaacggtgcccatc

SEQ ID NO: 5223928 - DNA, 20 bp, Homo sapiens
aggttaaacgtagcatgtgg

SEQ ID NO: 5223929 - DNA, 18 bp, Homo sapiens
aggttaaagaagctgcat

SEQ ID NO: 5223930 - DNA, 18 bp, Homo sapiens
aggttaaagcaaaccagc

SEQ ID NO: 5223931 - DNA, 14 bp, Homo sapiens
aggttaaagctaaa

SEQ ID NO: 5223932 - DNA, 19 bp, Homo sapiens
aggttaaaggaaaagcaca

SEQ ID NO: 5223933 - DNA, 15 bp, Homo sapiens
aggttaaattattga

SEQ ID NO: 5223934 - DNA, 22 bp, Homo sapiens
aggttaagcactttaacacagt

SEQ ID NO: 5223935 - DNA, 13 bp, Homo sapiens
aggttaaggggat

SEQ ID NO: 5223936 - DNA, 19 bp, Homo sapiens
aggttaaggggatctaaaa

SEQ ID NO: 5223937 - DNA, 20 bp, Homo sapiens
aggttaataaagatgattga

SEQ ID NO: 5223938 - DNA, 16 bp, Homo sapiens
aggttaatatttaaga

SEQ ID NO: 5223939 - DNA, 15 bp, Homo sapiens
aggttaattccaatt

SEQ ID NO: 5223940 - DNA, 22 bp, Homo sapiens
aggttaattccaattatatgag

SEQ ID NO: 5223941 - DNA, 17 bp, Homo sapiens
aggttaatttttccttc

SEQ ID NO: 5223942 - DNA, 23 bp, Homo sapiens
aggttacaacagatttgtgaact

SEQ ID NO: 5223943 - DNA, 24 bp, Homo sapiens
aggttacaacagatttgtgaactc

SEQ ID NO: 5223944 - DNA, 20 bp, Homo sapiens
aggttacagattatcacatt

SEQ ID NO: 5223945 - DNA, 17 bp, Homo sapiens
aggttaccctgtaacat

SEQ ID NO: 5223946 - DNA, 14 bp, Homo sapiens
aggttactttagtt

SEQ ID NO: 5223947 - DNA, 13 bp, Homo sapiens
aggttagaagaac

SEQ ID NO: 5223948 - DNA, 22 bp, Homo sapiens
aggttagatgctattaagaagg

SEQ ID NO: 5223949 - DNA, 20 bp, Homo sapiens
aggttagcccaatggagaaa

SEQ ID NO: 5223950 - DNA, 21 bp, Homo sapiens
aggttagcctttgccctgtca

SEQ ID NO: 5223951 - DNA, 18 bp, Homo sapiens
aggttaggatttaacagt

SEQ ID NO: 5223952 - DNA, 21 bp, Homo sapiens
aggttaggcagtataaagaat

SEQ ID NO: 5223953 - DNA, 17 bp, Homo sapiens
aggttaggtcttaggaa

SEQ ID NO: 5223954 - DNA, 15 bp, Homo sapiens
aggttaggtttgtca

SEQ ID NO: 5223955 - DNA, 18 bp, Homo sapiens
aggttaggtttgtcaaca

SEQ ID NO: 5223956 - DNA, 15 bp, Homo sapiens
aggttataagaaaca

SEQ ID NO: 5223957 - DNA, 14 bp, Homo sapiens
aggttataattttt

SEQ ID NO: 5223958 - DNA, 19 bp, Homo sapiens
aggttataattttttttaa

SEQ ID NO: 5223959 - DNA, 20 bp, Homo sapiens
aggttataattttttttaaa

SEQ ID NO: 5223960 - DNA, 18 bp, Homo sapiens
aggttatacaataaccca

SEQ ID NO: 5223961 - DNA, 17 bp, Homo sapiens
aggttataggtcactcc

SEQ ID NO: 5223962 - DNA, 17 bp, Homo sapiens
aggttatatgaatatat

SEQ ID NO: 5223963 - DNA, 14 bp, Homo sapiens
aggttatcagaaag

SEQ ID NO: 5223964 - DNA, 21 bp, Homo sapiens
aggttatcagaaagatcaaat

SEQ ID NO: 5223965 - DNA, 19 bp, Homo sapiens
aggttatcgaaataacaat

SEQ ID NO: 5223966 - DNA, 20 bp, Homo sapiens
aggttatcgaaataacaatg

SEQ ID NO: 5223967 - DNA, 19 bp, Homo sapiens
aggttatctacttttactc

SEQ ID NO: 5223968 - DNA, 22 bp, Homo sapiens
aggttatctgcctggcctggct

SEQ ID NO: 5223969 - DNA, 22 bp, Homo sapiens
aggttatctttttaaaaactct

SEQ ID NO: 5223970 - DNA, 22 bp, Homo sapiens
aggttatgcaagtcgccaggca

SEQ ID NO: 5223971 - DNA, 14 bp, Homo sapiens
aggttatgcctcat

SEQ ID NO: 5223972 - DNA, 16 bp, Homo sapiens
aggttatgttcatttt

SEQ ID NO: 5223973 - DNA, 19 bp, Homo sapiens
aggttattttagtttctgt

SEQ ID NO: 5223974 - DNA, 23 bp, Homo sapiens
aggttattttctttatcattgct

SEQ ID NO: 5223975 - DNA, 17 bp, Homo sapiens
aggttcaaaagaagttg

SEQ ID NO: 5223976 - DNA, 14 bp, Homo sapiens
aggttcaaagatat

SEQ ID NO: 5223977 - DNA, 17 bp, Homo sapiens
aggttcaaagatatttt

SEQ ID NO: 5223978 - DNA, 18 bp, Homo sapiens
aggttcaagcgattctcc

SEQ ID NO: 5223979 - DNA, 17 bp, Homo sapiens
aggttcaagtgattctc

SEQ ID NO: 5223980 - DNA, 14 bp, Homo sapiens
aggttcacactcag

SEQ ID NO: 5223981 - DNA, 19 bp, Homo sapiens
aggttcacctgcagcgagt

SEQ ID NO: 5223982 - DNA, 24 bp, Homo sapiens
aggttcactgagctccccagatct

SEQ ID NO: 5223983 - DNA, 13 bp, Homo sapiens
aggttcagatttt

SEQ ID NO: 5223984 - DNA, 22 bp, Homo sapiens
aggttcagcaaggtgagagagg

SEQ ID NO: 5223985 - DNA, 13 bp, Homo sapiens
aggttcagccaag

SEQ ID NO: 5223986 - DNA, 13 bp, Homo sapiens
aggttcagcttgt

SEQ ID NO: 5223987 - DNA, 12 bp, Homo sapiens
aggttcattttt

SEQ ID NO: 5223988 - DNA, 18 bp, Homo sapiens
aggttccaactgtatata

SEQ ID NO: 5223989 - DNA, 11 bp, Homo sapiens
aggttccagaa

SEQ ID NO: 5223990 - DNA, 13 bp, Homo sapiens
aggttccagaggc

SEQ ID NO: 5223991 - DNA, 14 bp, Homo sapiens
aggttcccagcagc

SEQ ID NO: 5223992 - DNA, 19 bp, Homo sapiens
aggttccccaagggccctg

SEQ ID NO: 5223993 - DNA, 23 bp, Homo sapiens
aggttccccaagggccctggcac

SEQ ID NO: 5223994 - DNA, 15 bp, Homo sapiens
aggttccccagagag

SEQ ID NO: 5223995 - DNA, 17 bp, Homo sapiens
aggttccccagagagca

SEQ ID NO: 5223996 - DNA, 22 bp, Homo sapiens
aggttccccagagagcaggcag

SEQ ID NO: 5223997 - DNA, 21 bp, Homo sapiens
aggttccgcttggagcagagg

SEQ ID NO: 5223998 - DNA, 23 bp, Homo sapiens
aggttccgcttggagcagagggg

SEQ ID NO: 5223999 - DNA, 12 bp, Homo sapiens
aggttcctccta

SEQ ID NO: 5224000 - DNA, 15 bp, Homo sapiens
aggttcctcctaggc

SEQ ID NO: 5224001 - DNA, 12 bp, Homo sapiens
aggttcctctgc

SEQ ID NO: 5224002 - DNA, 13 bp, Homo sapiens
aggttcctctgcc

SEQ ID NO: 5224003 - DNA, 20 bp, Homo sapiens
aggttcctgaaatatccagg

SEQ ID NO: 5224004 - DNA, 15 bp, Homo sapiens
aggttcctggggccg

SEQ ID NO: 5224005 - DNA, 18 bp, Homo sapiens
aggttcctggggccgcct

SEQ ID NO: 5224006 - DNA, 22 bp, Homo sapiens
aggttcctggggccgcctgccc

SEQ ID NO: 5224007 - DNA, 14 bp, Homo sapiens
aggttcctgtcaat

SEQ ID NO: 5224008 - DNA, 22 bp, Homo sapiens
aggttcctgtttgaacccagga

SEQ ID NO: 5224009 - DNA, 23 bp, Homo sapiens
aggttcctgtttgaacccaggag

SEQ ID NO: 5224010 - DNA, 15 bp, Homo sapiens
aggttccttttaagt

SEQ ID NO: 5224011 - DNA, 18 bp, Homo sapiens
aggttcgtatagaaaaag

SEQ ID NO: 5224012 - DNA, 11 bp, Homo sapiens
aggttctaaag

SEQ ID NO: 5224013 - DNA, 12 bp, Homo sapiens
aggttctaaagt

SEQ ID NO: 5224014 - DNA, 14 bp, Homo sapiens
aggttctaaagttc

SEQ ID NO: 5224015 - DNA, 16 bp, Homo sapiens
aggttctaaagttcta

SEQ ID NO: 5224016 - DNA, 22 bp, Homo sapiens
aggttctaaggcctaggattct

SEQ ID NO: 5224017 - DNA, 16 bp, Homo sapiens
aggttctaggtcctgg

SEQ ID NO: 5224018 - DNA, 19 bp, Homo sapiens
aggttctaggtttcaaaga

SEQ ID NO: 5224019 - DNA, 11 bp, Homo sapiens
aggttctatga

SEQ ID NO: 5224020 - DNA, 14 bp, Homo sapiens
aggttctatgatat

SEQ ID NO: 5224021 - DNA, 18 bp, Homo sapiens
aggttctattttcttaaa

SEQ ID NO: 5224022 - DNA, 15 bp, Homo sapiens
aggttctcagacctc

SEQ ID NO: 5224023 - DNA, 21 bp, Homo sapiens
aggttctcagcaagtgtacag

SEQ ID NO: 5224024 - DNA, 22 bp, Homo sapiens
aggttctcagcaagtgtacagt

SEQ ID NO: 5224025 - DNA, 23 bp, Homo sapiens
aggttctcattaggttttgcttg

SEQ ID NO: 5224026 - DNA, 15 bp, Homo sapiens
aggttctcatttctc

SEQ ID NO: 5224027 - DNA, 17 bp, Homo sapiens
aggttctcatttctcag

SEQ ID NO: 5224028 - DNA, 22 bp, Homo sapiens
aggttctcattttggtttgttt

SEQ ID NO: 5224029 - DNA, 22 bp, Homo sapiens
aggttctccaacatcacagccc

SEQ ID NO: 5224030 - DNA, 14 bp, Homo sapiens
aggttctcccagcc

SEQ ID NO: 5224031 - DNA, 22 bp, Homo sapiens
aggttctctcctccccaaggag

SEQ ID NO: 5224032 - DNA, 12 bp, Homo sapiens
aggttctctcta

SEQ ID NO: 5224033 - DNA, 20 bp, Homo sapiens
aggttctctctactggtcct

SEQ ID NO: 5224034 - DNA, 18 bp, Homo sapiens
aggttctctctcactgcc

SEQ ID NO: 5224035 - DNA, 18 bp, Homo sapiens
aggttctgcactcctgga

SEQ ID NO: 5224036 - DNA, 21 bp, Homo sapiens
aggttctgcactcctggaacc

SEQ ID NO: 5224037 - DNA, 18 bp, Homo sapiens
aggttctgctttctgata

SEQ ID NO: 5224038 - DNA, 14 bp, Homo sapiens
aggttctgggcctc

SEQ ID NO: 5224039 - DNA, 17 bp, Homo sapiens
aggttctggggaggaag

SEQ ID NO: 5224040 - DNA, 20 bp, Homo sapiens
aggttctggttagctcagcc

SEQ ID NO: 5224041 - DNA, 14 bp, Homo sapiens
aggttctggttcca

SEQ ID NO: 5224042 - DNA, 19 bp, Homo sapiens
aggttctgtagagccaatt

SEQ ID NO: 5224043 - DNA, 13 bp, Homo sapiens
aggttctgtctgt

SEQ ID NO: 5224044 - DNA, 21 bp, Homo sapiens
aggttctgttaccccatcctc

SEQ ID NO: 5224045 - DNA, 15 bp, Homo sapiens
aggttctgttttgtt

SEQ ID NO: 5224046 - DNA, 14 bp, Homo sapiens
aggttcttactgct

SEQ ID NO: 5224047 - DNA, 16 bp, Homo sapiens
aggttcttactgcttg

SEQ ID NO: 5224048 - DNA, 23 bp, Homo sapiens
aggttcttcccttttacatactg

SEQ ID NO: 5224049 - DNA, 16 bp, Homo sapiens
aggttcttctggtgag

SEQ ID NO: 5224050 - DNA, 19 bp, Homo sapiens
aggttcttcttcctgaagc

SEQ ID NO: 5224051 - DNA, 13 bp, Homo sapiens
aggttcttgctgc

SEQ ID NO: 5224052 - DNA, 15 bp, Homo sapiens
agtgatgtagaaaga

SEQ ID NO: 5224053 - DNA, 18 bp, Homo sapiens
agtgatgtattttcatag

SEQ ID NO: 5224054 - DNA, 19 bp, Homo sapiens
agtgatgtgatttatgcat

SEQ ID NO: 5224055 - DNA, 13 bp, Homo sapiens
agtgatgtgggaa

SEQ ID NO: 5224056 - DNA, 20 bp, Homo sapiens
agtgatgtgggaagttacct

SEQ ID NO: 5224057 - DNA, 21 bp, Homo sapiens
agtgatgtgtttacatttact

SEQ ID NO: 5224058 - DNA, 22 bp, Homo sapiens
agtgatgtgtttacatttactg

SEQ ID NO: 5224059 - DNA, 17 bp, Homo sapiens
agtgatgttagcagacc

SEQ ID NO: 5224060 - DNA, 22 bp, Homo sapiens
agtgatgtttgccatttgctgg

SEQ ID NO: 5224061 - DNA, 17 bp, Homo sapiens
agtgatgtttttatgat

SEQ ID NO: 5224062 - DNA, 18 bp, Homo sapiens
agtgattaaggtctctct

SEQ ID NO: 5224063 - DNA, 19 bp, Homo sapiens
agtgattaaggtctctctt

SEQ ID NO: 5224064 - DNA, 13 bp, Homo sapiens
agtgattaccagg

SEQ ID NO: 5224065 - DNA, 16 bp, Homo sapiens
agtgattatctctttg

SEQ ID NO: 5224066 - DNA, 14 bp, Homo sapiens
agtgattcagcagg

SEQ ID NO: 5224067 - DNA, 15 bp, Homo sapiens
agtgattcatcttca

SEQ ID NO: 5224068 - DNA, 16 bp, Homo sapiens
agtgattcattgtttg

SEQ ID NO: 5224069 - DNA, 21 bp, Homo sapiens
agtgattctcatgcctcagcc

SEQ ID NO: 5224070 - DNA, 14 bp, Homo sapiens
agtgattctcctgc

SEQ ID NO: 5224071 - DNA, 20 bp, Homo sapiens
agtgattctcctgcctcagc

SEQ ID NO: 5224072 - DNA, 13 bp, Homo sapiens
agtgattctctct

SEQ ID NO: 5224073 - DNA, 18 bp, Homo sapiens
agtgattctctcttctct

SEQ ID NO: 5224074 - DNA, 12 bp, Homo sapiens
agtgattctgat

SEQ ID NO: 5224075 - DNA, 14 bp, Homo sapiens
agtgattctgattt

SEQ ID NO: 5224076 - DNA, 17 bp, Homo sapiens
agtgattctgatttcag

SEQ ID NO: 5224077 - DNA, 18 bp, Homo sapiens
agtgattctgatttcagt

SEQ ID NO: 5224078 - DNA, 19 bp, Homo sapiens
agtgattctgatttcagtt

SEQ ID NO: 5224079 - DNA, 21 bp, Homo sapiens
agtgattctgtttgccttttg

SEQ ID NO: 5224080 - DNA, 16 bp, Homo sapiens
agtgattgaaccagct

SEQ ID NO: 5224081 - DNA, 16 bp, Homo sapiens
agtgattgacacacag

SEQ ID NO: 5224082 - DNA, 14 bp, Homo sapiens
agtgattgacattt

SEQ ID NO: 5224083 - DNA, 16 bp, Homo sapiens
agtgattgtagtttaa

SEQ ID NO: 5224084 - DNA, 15 bp, Homo sapiens
agtgattgttggcac

SEQ ID NO: 5224085 - DNA, 14 bp, Homo sapiens
agtgatttacacag

SEQ ID NO: 5224086 - DNA, 16 bp, Homo sapiens
agtgatttccacaggt

SEQ ID NO: 5224087 - DNA, 13 bp, Homo sapiens
agtgatttctaga

SEQ ID NO: 5224088 - DNA, 13 bp, Homo sapiens
agtgatttgctat

SEQ ID NO: 5224089 - DNA, 19 bp, Homo sapiens
agtgatttgctatcatata

SEQ ID NO: 5224090 - DNA, 22 bp, Homo sapiens
agtgatttgctatcatatatta

SEQ ID NO: 5224091 - DNA, 23 bp, Homo sapiens
agtgattttatttttgcaaaata

SEQ ID NO: 5224092 - DNA, 15 bp, Homo sapiens
agtgattttcaaacc

SEQ ID NO: 5224093 - DNA, 12 bp, Homo sapiens
agtgattttcat

SEQ ID NO: 5224094 - DNA, 15 bp, Homo sapiens
agtgattttcattgt

SEQ ID NO: 5224095 - DNA, 23 bp, Homo sapiens
agtgatttttagtaacctttaaa

SEQ ID NO: 5224096 - DNA, 20 bp, Homo sapiens
agtgatttttatgccacctg

SEQ ID NO: 5224097 - DNA, 17 bp, Homo sapiens
agtgcaaaaactgtaaa

SEQ ID NO: 5224098 - DNA, 12 bp, Homo sapiens
agtgcaaaatgt

SEQ ID NO: 5224099 - DNA, 15 bp, Homo sapiens
agtgcaaacacagca

SEQ ID NO: 5224100 - DNA, 16 bp, Homo sapiens
agtgcaaacacagcat

SEQ ID NO: 5224101 - DNA, 18 bp, Homo sapiens
agtgcaaacagaagtgca

SEQ ID NO: 5224102 - DNA, 13 bp, Homo sapiens
agtgcaaaccact

SEQ ID NO: 5224103 - DNA, 18 bp, Homo sapiens
agtgcaaaccacttctcc

SEQ ID NO: 5224104 - DNA, 16 bp, Homo sapiens
agtgcaaagctgcttg

SEQ ID NO: 5224105 - DNA, 17 bp, Homo sapiens
agtgcaaagtataaaat

SEQ ID NO: 5224106 - DNA, 23 bp, Homo sapiens
agtgcaaatactccaagcttcaa

SEQ ID NO: 5224107 - DNA, 22 bp, Homo sapiens
agtgcaaattgtcacaggacag

SEQ ID NO: 5224108 - DNA, 18 bp, Homo sapiens
agtgcaaatttgatacat

SEQ ID NO: 5224109 - DNA, 15 bp, Homo sapiens
agtgcaacaaaatca

SEQ ID NO: 5224110 - DNA, 17 bp, Homo sapiens
agtgcaacactgaagct

SEQ ID NO: 5224111 - DNA, 16 bp, Homo sapiens
agtgcaacactggtct

SEQ ID NO: 5224112 - DNA, 18 bp, Homo sapiens
agtgcaacatctctgaat

SEQ ID NO: 5224113 - DNA, 16 bp, Homo sapiens
agtgcaacatttctgt

SEQ ID NO: 5224114 - DNA, 18 bp, Homo sapiens
agtgcaacatttctgtat

SEQ ID NO: 5224115 - DNA, 15 bp, Homo sapiens
agtgcaacctctgct

SEQ ID NO: 5224116 - DNA, 16 bp, Homo sapiens
agtgcaacctctgctt

SEQ ID NO: 5224117 - DNA, 19 bp, Homo sapiens
agtgcaacggcatgatttt

SEQ ID NO: 5224118 - DNA, 22 bp, Homo sapiens
agtgcaagactgaattaatgag

SEQ ID NO: 5224119 - DNA, 15 bp, Homo sapiens
agtgcaagagcctga

SEQ ID NO: 5224120 - DNA, 14 bp, Homo sapiens
agtgcaagattttt

SEQ ID NO: 5224121 - DNA, 18 bp, Homo sapiens
agtgcaagctttaacaga

SEQ ID NO: 5224122 - DNA, 20 bp, Homo sapiens
agtgcaataaatctgaccca

SEQ ID NO: 5224123 - DNA, 21 bp, Homo sapiens
agtgcaataaatctgacccag

SEQ ID NO: 5224124 - DNA, 15 bp, Homo sapiens
agtgcaatatatttt

SEQ ID NO: 5224125 - DNA, 16 bp, Homo sapiens
agtgcaatatattttg

SEQ ID NO: 5224126 - DNA, 19 bp, Homo sapiens
agtgcaatatgggcgggca

SEQ ID NO: 5224127 - DNA, 20 bp, Homo sapiens
agtgcaatatgggcgggcag

SEQ ID NO: 5224128 - DNA, 22 bp, Homo sapiens
agtgcaatccatgtatctgtat

SEQ ID NO: 5224129 - DNA, 18 bp, Homo sapiens
agtgcaatgacacagtct

SEQ ID NO: 5224130 - DNA, 16 bp, Homo sapiens
agtgcaatgccccctc

SEQ ID NO: 5224131 - DNA, 22 bp, Homo sapiens
agtgcaatgccccctcccctcc

SEQ ID NO: 5224132 - DNA, 14 bp, Homo sapiens
agtgcaatgcgtgt

SEQ ID NO: 5224133 - DNA, 17 bp, Homo sapiens
agtgcaatgcttgtaga

SEQ ID NO: 5224134 - DNA, 12 bp, Homo sapiens
agtgcaatgggt

SEQ ID NO: 5224135 - DNA, 19 bp, Homo sapiens
agtgcaattccaagaaaat

SEQ ID NO: 5224136 - DNA, 21 bp, Homo sapiens
agtgcaattccaagaaaatat

SEQ ID NO: 5224137 - DNA, 21 bp, Homo sapiens
agtgcaattgcacaaatacaa

SEQ ID NO: 5224138 - DNA, 15 bp, Homo sapiens
agtgcaatttcccct

SEQ ID NO: 5224139 - DNA, 16 bp, Homo sapiens
agtgcaatttcccctc

SEQ ID NO: 5224140 - DNA, 21 bp, Homo sapiens
agtgcaatttcccctctgtgt

SEQ ID NO: 5224141 - DNA, 16 bp, Homo sapiens
agtgcaatttcttctg

SEQ ID NO: 5224142 - DNA, 15 bp, Homo sapiens
agtgcacaaaatgaa

SEQ ID NO: 5224143 - DNA, 12 bp, Homo sapiens
agtgcacacaca

SEQ ID NO: 5224144 - DNA, 16 bp, Homo sapiens
agtgcacacagaaata

SEQ ID NO: 5224145 - DNA, 20 bp, Homo sapiens
agtgcacacctttattcaga

SEQ ID NO: 5224146 - DNA, 21 bp, Homo sapiens
agtgcacacctttattcagaa

SEQ ID NO: 5224147 - DNA, 22 bp, Homo sapiens
agtgcacacctttattcagaac

SEQ ID NO: 5224148 - DNA, 23 bp, Homo sapiens
agtgcacacctttattcagaact

SEQ ID NO: 5224149 - DNA, 13 bp, Homo sapiens
agtgcacagctgt

SEQ ID NO: 5224150 - DNA, 15 bp, Homo sapiens
agtgcacaggagcca

SEQ ID NO: 5224151 - DNA, 21 bp, Homo sapiens
agtgcacagggaagggcttgg

SEQ ID NO: 5224152 - DNA, 19 bp, Homo sapiens
agtgcacatctgacccaga

SEQ ID NO: 5224153 - DNA, 12 bp, Homo sapiens
agtgcacatgaa

SEQ ID NO: 5224154 - DNA, 13 bp, Homo sapiens
agtgcacatgaac

SEQ ID NO: 5224155 - DNA, 22 bp, Homo sapiens
agtgcacatgccccttggtcct

SEQ ID NO: 5224156 - DNA, 17 bp, Homo sapiens
agtgcacccactctgct

SEQ ID NO: 5224157 - DNA, 22 bp, Homo sapiens
agtgcacctctcatcagcccag

SEQ ID NO: 5224158 - DNA, 12 bp, Homo sapiens
agtgcacctgcc

SEQ ID NO: 5224159 - DNA, 17 bp, Homo sapiens
agtgcacctgcctcagc

SEQ ID NO: 5224160 - DNA, 22 bp, Homo sapiens
agtgcacctgtggcctctcagt

SEQ ID NO: 5224161 - DNA, 17 bp, Homo sapiens
agtgcactaatgtgtaa

SEQ ID NO: 5224162 - DNA, 16 bp, Homo sapiens
agtgcactcctggtga

SEQ ID NO: 5224163 - DNA, 18 bp, Homo sapiens
agtgcacttttttatgaa

SEQ ID NO: 5224164 - DNA, 17 bp, Homo sapiens
agtgcagaacacctggc

SEQ ID NO: 5224165 - DNA, 19 bp, Homo sapiens
agtgcagaatgctcctcca

SEQ ID NO: 5224166 - DNA, 20 bp, Homo sapiens
agtgcagaatgtaagtgggc

SEQ ID NO: 5224167 - DNA, 20 bp, Homo sapiens
agtgcagacacctaacccca

SEQ ID NO: 5224168 - DNA, 18 bp, Homo sapiens
agtgcagagccttctcag

SEQ ID NO: 5224169 - DNA, 19 bp, Homo sapiens
agtgcagagccttctcaga

SEQ ID NO: 5224170 - DNA, 18 bp, Homo sapiens
agtgcagcaaccagagca

SEQ ID NO: 5224171 - DNA, 22 bp, Homo sapiens
agtgcagcaaccagagcactgt

SEQ ID NO: 5224172 - DNA, 18 bp, Homo sapiens
agtgcagcaagcctggcc

SEQ ID NO: 5224173 - DNA, 16 bp, Homo sapiens
agtgcagcagggcagt

SEQ ID NO: 5224174 - DNA, 21 bp, Homo sapiens
agtgcagcaggttaagaattt

SEQ ID NO: 5224175 - DNA, 14 bp, Homo sapiens
agtgcagcatatac

SEQ ID NO: 5224176 - DNA, 15 bp, Homo sapiens
agtgcagcatggagg

SEQ ID NO: 5224177 - DNA, 15 bp, Homo sapiens
agtgcagccactggc

SEQ ID NO: 5224178 - DNA, 20 bp, Homo sapiens
agtgcagcccttcctcctga

SEQ ID NO: 5224179 - DNA, 16 bp, Homo sapiens
agtgcagccttctcca

SEQ ID NO: 5224180 - DNA, 18 bp, Homo sapiens
agtgcagcgggccaggca

SEQ ID NO: 5224181 - DNA, 17 bp, Homo sapiens
agtgcagctaacatgag

SEQ ID NO: 5224182 - DNA, 15 bp, Homo sapiens
agtgcagctcatgtt

SEQ ID NO: 5224183 - DNA, 14 bp, Homo sapiens
agtgcagctgattt

SEQ ID NO: 5224184 - DNA, 16 bp, Homo sapiens
agtgcagctgatttta

SEQ ID NO: 5224185 - DNA, 20 bp, Homo sapiens
agtgcagctgattttaacaa

SEQ ID NO: 5224186 - DNA, 23 bp, Homo sapiens
agtgcagcttgacattatgtttt

SEQ ID NO: 5224187 - DNA, 16 bp, Homo sapiens
agtgcagcttgcagtc

SEQ ID NO: 5224188 - DNA, 13 bp, Homo sapiens
agtgcaggcccac

SEQ ID NO: 5224189 - DNA, 15 bp, Homo sapiens
agtgcaggcccaccc

SEQ ID NO: 5224190 - DNA, 18 bp, Homo sapiens
agtgcaggcccaccctgc

SEQ ID NO: 5224191 - DNA, 19 bp, Homo sapiens
agtgcaggcccaccctgct

SEQ ID NO: 5224192 - DNA, 12 bp, Homo sapiens
agtgcaggctgg

SEQ ID NO: 5224193 - DNA, 15 bp, Homo sapiens
agtgcaggctggcca

SEQ ID NO: 5224194 - DNA, 17 bp, Homo sapiens
agtgcaggctggccagc

SEQ ID NO: 5224195 - DNA, 19 bp, Homo sapiens
agtgcaggctggccagccg

SEQ ID NO: 5224196 - DNA, 21 bp, Homo sapiens
agtgcaggctggccagccgct

SEQ ID NO: 5224197 - DNA, 13 bp, Homo sapiens
agtgcagggagga

SEQ ID NO: 5224198 - DNA, 16 bp, Homo sapiens
agtgcagggcaaaata

SEQ ID NO: 5224199 - DNA, 21 bp, Homo sapiens
agtgcaggggatggggtgggg

SEQ ID NO: 5224200 - DNA, 20 bp, Homo sapiens
agtgcaggtgcagtttcatt

SEQ ID NO: 5224201 - DNA, 16 bp, Homo sapiens
agtgcagtcctgatca

SEQ ID NO: 5224202 - DNA, 21 bp, Homo sapiens
agtgcagtggcacaatcttgg

SEQ ID NO: 5224203 - DNA, 24 bp, Homo sapiens
agtgcagtggcacgatctcggctc

SEQ ID NO: 5224204 - DNA, 20 bp, Homo sapiens
agtgcagtggcgcaatctcg

SEQ ID NO: 5224205 - DNA, 23 bp, Homo sapiens
agtgcagtggcgtgatctcagct

SEQ ID NO: 5224206 - DNA, 22 bp, Homo sapiens
agtgcagtggtgcgatcttggc

SEQ ID NO: 5224207 - DNA, 15 bp, Homo sapiens
agtgcagttatttgc

SEQ ID NO: 5224208 - DNA, 17 bp, Homo sapiens
agtgcataaataatttt

SEQ ID NO: 5224209 - DNA, 21 bp, Homo sapiens
agtgcatagaattctagcttt

SEQ ID NO: 5224210 - DNA, 21 bp, Homo sapiens
agtgcatagttgtagacaaag

SEQ ID NO: 5224211 - DNA, 19 bp, Homo sapiens
agtgcatattcctttctat

SEQ ID NO: 5224212 - DNA, 12 bp, Homo sapiens
agtgcatcatta

SEQ ID NO: 5224213 - DNA, 14 bp, Homo sapiens
agtgcatccaaagg

SEQ ID NO: 5224214 - DNA, 22 bp, Homo sapiens
agtgcatccccacgacccctgc

SEQ ID NO: 5224215 - DNA, 13 bp, Homo sapiens
agtgcatcctgat

SEQ ID NO: 5224216 - DNA, 16 bp, Homo sapiens
agtgcatccttcatca

SEQ ID NO: 5224217 - DNA, 16 bp, Homo sapiens
agtgcatctcagatgc

SEQ ID NO: 5224218 - DNA, 14 bp, Homo sapiens
agtgcatctggaga

SEQ ID NO: 5224219 - DNA, 19 bp, Homo sapiens
agtgcatctggagagaaca

SEQ ID NO: 5224220 - DNA, 14 bp, Homo sapiens
agtgcatgaacagg

SEQ ID NO: 5224221 - DNA, 15 bp, Homo sapiens
agtgcatgatggtga

SEQ ID NO: 5224222 - DNA, 11 bp, Homo sapiens
agtgcatgcat

SEQ ID NO: 5224223 - DNA, 12 bp, Homo sapiens
agtgcatgcatg

SEQ ID NO: 5224224 - DNA, 24 bp, Homo sapiens
agtgcatgcattgagctgcctcca

SEQ ID NO: 5224225 - DNA, 18 bp, Homo sapiens
agtgcatgggtcagggtg

SEQ ID NO: 5224226 - DNA, 17 bp, Homo sapiens
agtgcatggtggccaga

SEQ ID NO: 5224227 - DNA, 19 bp, Homo sapiens
agtgcatggtggccagagg

SEQ ID NO: 5224228 - DNA, 18 bp, Homo sapiens
agtgcatgtactatctta

SEQ ID NO: 5224229 - DNA, 18 bp, Homo sapiens
agtgcatgtcacatgcca

SEQ ID NO: 5224230 - DNA, 19 bp, Homo sapiens
agtgcatgtcacatgccac

SEQ ID NO: 5224231 - DNA, 14 bp, Homo sapiens
aggttcttgctttc

SEQ ID NO: 5224232 - DNA, 21 bp, Homo sapiens
aggttcttgctttctctctca

SEQ ID NO: 5224233 - DNA, 17 bp, Homo sapiens
aggttcttgttggtgca

SEQ ID NO: 5224234 - DNA, 14 bp, Homo sapiens
aggttctttctgaa

SEQ ID NO: 5224235 - DNA, 13 bp, Homo sapiens
aggttctttgtgt

SEQ ID NO: 5224236 - DNA, 13 bp, Homo sapiens
aggttgaaaaaca

SEQ ID NO: 5224237 - DNA, 12 bp, Homo sapiens
aggttgaaagac

SEQ ID NO: 5224238 - DNA, 15 bp, Homo sapiens
aggttgaactatgaa

SEQ ID NO: 5224239 - DNA, 19 bp, Homo sapiens
aggttgaactttgccaaaa

SEQ ID NO: 5224240 - DNA, 22 bp, Homo sapiens
aggttgaagacctaaccagggc

SEQ ID NO: 5224241 - DNA, 21 bp, Homo sapiens
aggttgaagcagaattgcttg

SEQ ID NO: 5224242 - DNA, 12 bp, Homo sapiens
aggttgaagcca

SEQ ID NO: 5224243 - DNA, 23 bp, Homo sapiens
aggttgacaccattctcctgcct

SEQ ID NO: 5224244 - DNA, 14 bp, Homo sapiens
aggttgactaagaa

SEQ ID NO: 5224245 - DNA, 21 bp, Homo sapiens
aggttgagaggaggacttggt

SEQ ID NO: 5224246 - DNA, 18 bp, Homo sapiens
aggttgagctatgatatg

SEQ ID NO: 5224247 - DNA, 17 bp, Homo sapiens
aggttgaggggctcctg

SEQ ID NO: 5224248 - DNA, 22 bp, Homo sapiens
aggttgataaatcattttatgt

SEQ ID NO: 5224249 - DNA, 15 bp, Homo sapiens
aggttgataactttg

SEQ ID NO: 5224250 - DNA, 19 bp, Homo sapiens
aggttgataactttgcttg

SEQ ID NO: 5224251 - DNA, 15 bp, Homo sapiens
aggttgatcagtgag

SEQ ID NO: 5224252 - DNA, 16 bp, Homo sapiens
aggttgcacactttgg

SEQ ID NO: 5224253 - DNA, 16 bp, Homo sapiens
aggttgcacagcaaga

SEQ ID NO: 5224254 - DNA, 22 bp, Homo sapiens
aggttgcagagaagcatcctcc

SEQ ID NO: 5224255 - DNA, 12 bp, Homo sapiens
aggttgcagtga

SEQ ID NO: 5224256 - DNA, 18 bp, Homo sapiens
aggttgcagtgagccaag

SEQ ID NO: 5224257 - DNA, 18 bp, Homo sapiens
aggttgcagtgagccgag

SEQ ID NO: 5224258 - DNA, 16 bp, Homo sapiens
aggttgcagtgagctg

SEQ ID NO: 5224259 - DNA, 20 bp, Homo sapiens
aggttgcagtgagctgagat

SEQ ID NO: 5224260 - DNA, 21 bp, Homo sapiens
aggttgccccttccccatctc

SEQ ID NO: 5224261 - DNA, 13 bp, Homo sapiens
aggttgccgtgag

SEQ ID NO: 5224262 - DNA, 12 bp, Homo sapiens
aggttgcctgaa

SEQ ID NO: 5224263 - DNA, 17 bp, Homo sapiens
aggttgcctgaaaaatg

SEQ ID NO: 5224264 - DNA, 19 bp, Homo sapiens
aggttgctgtacaggaaaa

SEQ ID NO: 5224265 - DNA, 16 bp, Homo sapiens
aggttgctgtttcaca

SEQ ID NO: 5224266 - DNA, 23 bp, Homo sapiens
aggttgcttcagctgatccttca

SEQ ID NO: 5224267 - DNA, 21 bp, Homo sapiens
aggttggaactatgcagtgtg

SEQ ID NO: 5224268 - DNA, 16 bp, Homo sapiens
aggttggaactgctgc

SEQ ID NO: 5224269 - DNA, 19 bp, Homo sapiens
aggttggaactgctgccat

SEQ ID NO: 5224270 - DNA, 18 bp, Homo sapiens
aggttggaagagaatcac

SEQ ID NO: 5224271 - DNA, 18 bp, Homo sapiens
aggttggaagctagctcc

SEQ ID NO: 5224272 - DNA, 20 bp, Homo sapiens
aggttggaaggggccttgct

SEQ ID NO: 5224273 - DNA, 17 bp, Homo sapiens
aggttggaccccagaga

SEQ ID NO: 5224274 - DNA, 22 bp, Homo sapiens
aggttggagtccagcctaatca

SEQ ID NO: 5224275 - DNA, 17 bp, Homo sapiens
aggttggagtgcattca

SEQ ID NO: 5224276 - DNA, 22 bp, Homo sapiens
aggttggcagtgatcctgcaag

SEQ ID NO: 5224277 - DNA, 18 bp, Homo sapiens
aggttggcggcagacaca

SEQ ID NO: 5224278 - DNA, 21 bp, Homo sapiens
aggttggcgtgccctggaggc

SEQ ID NO: 5224279 - DNA, 16 bp, Homo sapiens
aggttggctctgccag

SEQ ID NO: 5224280 - DNA, 20 bp, Homo sapiens
aggttgggaaggcacctgct

SEQ ID NO: 5224281 - DNA, 22 bp, Homo sapiens
aggttgggaaggcacctgctcc

SEQ ID NO: 5224282 - DNA, 19 bp, Homo sapiens
aggttgggagccaaatgtg

SEQ ID NO: 5224283 - DNA, 21 bp, Homo sapiens
aggttgggccatactggcctc

SEQ ID NO: 5224284 - DNA, 14 bp, Homo sapiens
aggttggtgactga

SEQ ID NO: 5224285 - DNA, 17 bp, Homo sapiens
aggttgtagtgagccca

SEQ ID NO: 5224286 - DNA, 15 bp, Homo sapiens
aggttgtatgtaaat

SEQ ID NO: 5224287 - DNA, 16 bp, Homo sapiens
aggttgtatgtaaatc

SEQ ID NO: 5224288 - DNA, 19 bp, Homo sapiens
aggttgtatgtaaatctgc

SEQ ID NO: 5224289 - DNA, 17 bp, Homo sapiens
aggttgtctccaggcca

SEQ ID NO: 5224290 - DNA, 14 bp, Homo sapiens
aggttgtgaaataa

SEQ ID NO: 5224291 - DNA, 12 bp, Homo sapiens
aggttgtgaatg

SEQ ID NO: 5224292 - DNA, 18 bp, Homo sapiens
aggttgtgcattttgtgt

SEQ ID NO: 5224293 - DNA, 22 bp, Homo sapiens
aggttgtggcctttgcgctcct

SEQ ID NO: 5224294 - DNA, 13 bp, Homo sapiens
aggttgtgggcct

SEQ ID NO: 5224295 - DNA, 19 bp, Homo sapiens
aggttgtggggaggctgca

SEQ ID NO: 5224296 - DNA, 20 bp, Homo sapiens
aggttgtggggaggctgcac

SEQ ID NO: 5224297 - DNA, 21 bp, Homo sapiens
aggttgtggggaggctgcact

SEQ ID NO: 5224298 - DNA, 14 bp, Homo sapiens
aggttgtgtcactg

SEQ ID NO: 5224299 - DNA, 23 bp, Homo sapiens
aggttgtgttgcctgctgagctg

SEQ ID NO: 5224300 - DNA, 20 bp, Homo sapiens
aggttgttaaaacagaaaag

SEQ ID NO: 5224301 - DNA, 16 bp, Homo sapiens
aggttgtttatgaggg

SEQ ID NO: 5224302 - DNA, 20 bp, Homo sapiens
aggttgtttttaaaaccact

SEQ ID NO: 5224303 - DNA, 21 bp, Homo sapiens
aggttgtttttaaaaccacta

SEQ ID NO: 5224304 - DNA, 17 bp, Homo sapiens
aggtttaaacttctctg

SEQ ID NO: 5224305 - DNA, 13 bp, Homo sapiens
aggtttaaatgaa

SEQ ID NO: 5224306 - DNA, 15 bp, Homo sapiens
aggtttaaatgaaca

SEQ ID NO: 5224307 - DNA, 19 bp, Homo sapiens
aggtttaaatgaacaagag

SEQ ID NO: 5224308 - DNA, 15 bp, Homo sapiens
aggtttaacatttgc

SEQ ID NO: 5224309 - DNA, 13 bp, Homo sapiens
aggtttaactcag

SEQ ID NO: 5224310 - DNA, 23 bp, Homo sapiens
aggtttaactcagatcactactg

SEQ ID NO: 5224311 - DNA, 14 bp, Homo sapiens
aggtttaagctgtt

SEQ ID NO: 5224312 - DNA, 19 bp, Homo sapiens
aggtttaagtagatttcat

SEQ ID NO: 5224313 - DNA, 18 bp, Homo sapiens
aggtttacaatttacaaa

SEQ ID NO: 5224314 - DNA, 14 bp, Homo sapiens
aggtttacagaatt

SEQ ID NO: 5224315 - DNA, 20 bp, Homo sapiens
aggtttacagtgaataaaag

SEQ ID NO: 5224316 - DNA, 19 bp, Homo sapiens
aggtttactagcacctgcc

SEQ ID NO: 5224317 - DNA, 22 bp, Homo sapiens
aggtttagaatcaagtctgtga

SEQ ID NO: 5224318 - DNA, 13 bp, Homo sapiens
aggtttagcgttt

SEQ ID NO: 5224319 - DNA, 21 bp, Homo sapiens
aggtttaggctggtggcccag

SEQ ID NO: 5224320 - DNA, 14 bp, Homo sapiens
aggtttataaagca

SEQ ID NO: 5224321 - DNA, 16 bp, Homo sapiens
aggtttataaagcaga

SEQ ID NO: 5224322 - DNA, 19 bp, Homo sapiens
aggtttatattgggaagct

SEQ ID NO: 5224323 - DNA, 12 bp, Homo sapiens
aggtttattgtt

SEQ ID NO: 5224324 - DNA, 17 bp, Homo sapiens
aggtttatttttctgtt

SEQ ID NO: 5224325 - DNA, 17 bp, Homo sapiens
aggtttcaaagatgctg

SEQ ID NO: 5224326 - DNA, 23 bp, Homo sapiens
aggtttcaacaaatttcattgca

SEQ ID NO: 5224327 - DNA, 20 bp, Homo sapiens
aggtttcactgtgttggcca

SEQ ID NO: 5224328 - DNA, 15 bp, Homo sapiens
aggtttcagatgagg

SEQ ID NO: 5224329 - DNA, 13 bp, Homo sapiens
aggtttcagcatt

SEQ ID NO: 5224330 - DNA, 19 bp, Homo sapiens
aggtttcagtagctccttg

SEQ ID NO: 5224331 - DNA, 18 bp, Homo sapiens
aggtttcccagtgagcct

SEQ ID NO: 5224332 - DNA, 15 bp, Homo sapiens
aggtttcctgctcca

SEQ ID NO: 5224333 - DNA, 17 bp, Homo sapiens
aggtttcgaaatgtaaa

SEQ ID NO: 5224334 - DNA, 20 bp, Homo sapiens
aggtttcgaaatgtaaatat

SEQ ID NO: 5224335 - DNA, 13 bp, Homo sapiens
aggtttcgatatt

SEQ ID NO: 5224336 - DNA, 17 bp, Homo sapiens
aggtttcgatatttatt

SEQ ID NO: 5224337 - DNA, 18 bp, Homo sapiens
aggtttcgatatttattg

SEQ ID NO: 5224338 - DNA, 15 bp, Homo sapiens
aggtttcgtggcagc

SEQ ID NO: 5224339 - DNA, 16 bp, Homo sapiens
aggtttcgttgcatgg

SEQ ID NO: 5224340 - DNA, 12 bp, Homo sapiens
aggtttctattg

SEQ ID NO: 5224341 - DNA, 14 bp, Homo sapiens
aggtttctattttc

SEQ ID NO: 5224342 - DNA, 18 bp, Homo sapiens
aggtttctccttgaagca

SEQ ID NO: 5224343 - DNA, 16 bp, Homo sapiens
aggtttctctcttccc

SEQ ID NO: 5224344 - DNA, 15 bp, Homo sapiens
aggtttctctgcctc

SEQ ID NO: 5224345 - DNA, 19 bp, Homo sapiens
aggtttctctgcctccagg

SEQ ID NO: 5224346 - DNA, 23 bp, Homo sapiens
aggtttctgaaaattaacactgc

SEQ ID NO: 5224347 - DNA, 21 bp, Homo sapiens
aggtttctgagttcctgcatg

SEQ ID NO: 5224348 - DNA, 18 bp, Homo sapiens
aggtttctggtctctagg

SEQ ID NO: 5224349 - DNA, 15 bp, Homo sapiens
aggtttcttccaccc

SEQ ID NO: 5224350 - DNA, 15 bp, Homo sapiens
aggtttcttctctgg

SEQ ID NO: 5224351 - DNA, 23 bp, Homo sapiens
aggtttcttggggtcccagggaa

SEQ ID NO: 5224352 - DNA, 20 bp, Homo sapiens
aggtttctttttttttcctt

SEQ ID NO: 5224353 - DNA, 22 bp, Homo sapiens
aggtttgaaaagctgactgttt

SEQ ID NO: 5224354 - DNA, 14 bp, Homo sapiens
aggtttgaaggaga

SEQ ID NO: 5224355 - DNA, 17 bp, Homo sapiens
aggtttgaaggagaatg

SEQ ID NO: 5224356 - DNA, 18 bp, Homo sapiens
aggtttgaaggagaatgg

SEQ ID NO: 5224357 - DNA, 19 bp, Homo sapiens
aggtttgaaggagaatggc

SEQ ID NO: 5224358 - DNA, 17 bp, Homo sapiens
aggtttgaccaggaaag

SEQ ID NO: 5224359 - DNA, 17 bp, Homo sapiens
aggtttgcaaattaaaa

SEQ ID NO: 5224360 - DNA, 19 bp, Homo sapiens
aggtttgcaaattaaaaag

SEQ ID NO: 5224361 - DNA, 17 bp, Homo sapiens
aggtttgcacccctcct

SEQ ID NO: 5224362 - DNA, 19 bp, Homo sapiens
aggtttgcggatgagggca

SEQ ID NO: 5224363 - DNA, 13 bp, Homo sapiens
aggtttgctgtgt

SEQ ID NO: 5224364 - DNA, 15 bp, Homo sapiens
aggtttgctgtgtct

SEQ ID NO: 5224365 - DNA, 18 bp, Homo sapiens
aggtttgctgtgtctcac

SEQ ID NO: 5224366 - DNA, 20 bp, Homo sapiens
aggtttgctgtgtctcacag

SEQ ID NO: 5224367 - DNA, 17 bp, Homo sapiens
aggtttgcttcctcagt

SEQ ID NO: 5224368 - DNA, 17 bp, Homo sapiens
aggtttggaaaactaac

SEQ ID NO: 5224369 - DNA, 14 bp, Homo sapiens
aggtttggaagagt

SEQ ID NO: 5224370 - DNA, 22 bp, Homo sapiens
aggtttggaaggagcagaaaac

SEQ ID NO: 5224371 - DNA, 18 bp, Homo sapiens
aggtttggctcctgccca

SEQ ID NO: 5224372 - DNA, 21 bp, Homo sapiens
aggtttgggggacgcccagcc

SEQ ID NO: 5224373 - DNA, 16 bp, Homo sapiens
aggtttggtgtgtgga

SEQ ID NO: 5224374 - DNA, 19 bp, Homo sapiens
aggtttggtttttttgtac

SEQ ID NO: 5224375 - DNA, 13 bp, Homo sapiens
aggtttgtatatt

SEQ ID NO: 5224376 - DNA, 20 bp, Homo sapiens
aggtttgtatattgtcagat

SEQ ID NO: 5224377 - DNA, 21 bp, Homo sapiens
aggtttgtatgatgtagtttt

SEQ ID NO: 5224378 - DNA, 17 bp, Homo sapiens
aggtttgtcaacacaaa

SEQ ID NO: 5224379 - DNA, 18 bp, Homo sapiens
aggtttgtcaacacaaag

SEQ ID NO: 5224380 - DNA, 17 bp, Homo sapiens
aggtttgtcatcagatg

SEQ ID NO: 5224381 - DNA, 22 bp, Homo sapiens
aggtttgtcccagtcagaaata

SEQ ID NO: 5224382 - DNA, 17 bp, Homo sapiens
aggtttgtcctggtcat

SEQ ID NO: 5224383 - DNA, 13 bp, Homo sapiens
aggtttgtttgtg

SEQ ID NO: 5224384 - DNA, 15 bp, Homo sapiens
aggtttgttttcatt

SEQ ID NO: 5224385 - DNA, 17 bp, Homo sapiens
aggtttgttttgtgaat

SEQ ID NO: 5224386 - DNA, 20 bp, Homo sapiens
aggtttgttttgtgaatttt

SEQ ID NO: 5224387 - DNA, 16 bp, Homo sapiens
aggtttgttttttcaa

SEQ ID NO: 5224388 - DNA, 18 bp, Homo sapiens
aggtttgttttttcaaga

SEQ ID NO: 5224389 - DNA, 19 bp, Homo sapiens
aggtttgttttttcaagaa

SEQ ID NO: 5224390 - DNA, 21 bp, Homo sapiens
aggttttaaaaataagtttta

SEQ ID NO: 5224391 - DNA, 20 bp, Homo sapiens
aggttttaagctaaaatgtt

SEQ ID NO: 5224392 - DNA, 22 bp, Homo sapiens
aggttttaatttagtaaaccaa

SEQ ID NO: 5224393 - DNA, 13 bp, Homo sapiens
aggttttacagat

SEQ ID NO: 5224394 - DNA, 16 bp, Homo sapiens
aggttttaggttctaa

SEQ ID NO: 5224395 - DNA, 18 bp, Homo sapiens
aggttttaggttctaaag

SEQ ID NO: 5224396 - DNA, 15 bp, Homo sapiens
aggttttattcatat

SEQ ID NO: 5224397 - DNA, 22 bp, Homo sapiens
aggttttcagagaattatctca

SEQ ID NO: 5224398 - DNA, 22 bp, Homo sapiens
aggttttccaaaagtaaagatg

SEQ ID NO: 5224399 - DNA, 22 bp, Homo sapiens
aggttttcctcttctattttgt

SEQ ID NO: 5224400 - DNA, 17 bp, Homo sapiens
aggttttctatgtgact

SEQ ID NO: 5224401 - DNA, 14 bp, Homo sapiens
aggttttctgctct

SEQ ID NO: 5224402 - DNA, 15 bp, Homo sapiens
aggttttctgtgttt

SEQ ID NO: 5224403 - DNA, 23 bp, Homo sapiens
aggttttctgtgtttagctattt

SEQ ID NO: 5224404 - DNA, 17 bp, Homo sapiens
aggttttcttttaagaa

SEQ ID NO: 5224405 - DNA, 16 bp, Homo sapiens
aggttttgaataaaaa

SEQ ID NO: 5224406 - DNA, 17 bp, Homo sapiens
aggttttgaataaaaag

SEQ ID NO: 5224407 - DNA, 23 bp, Homo sapiens
aggttttgaataaaaagtgaact

SEQ ID NO: 5224408 - DNA, 23 bp, Homo sapiens
aggttttggatcttgaatgtggt

SEQ ID NO: 5224409 - DNA, 15 bp, Homo sapiens
aggttttgtaaagat

SEQ ID NO: 5224410 - DNA, 13 bp, Homo sapiens
aggttttgtacaa

SEQ ID NO: 5224411 - DNA, 12 bp, Homo sapiens
aggttttgtatt

SEQ ID NO: 5224412 - DNA, 22 bp, Homo sapiens
aggttttgtattttttaaaaca

SEQ ID NO: 5224413 - DNA, 17 bp, Homo sapiens
aggttttgttgttttat

SEQ ID NO: 5224414 - DNA, 17 bp, Homo sapiens
aggttttgtttgctatc

SEQ ID NO: 5224415 - DNA, 19 bp, Homo sapiens
aggttttgtttgctatctt

SEQ ID NO: 5224416 - DNA, 22 bp, Homo sapiens
aggttttgtttgctatcttaat

SEQ ID NO: 5224417 - DNA, 17 bp, Homo sapiens
aggtttttatgtgcctt

SEQ ID NO: 5224418 - DNA, 23 bp, Homo sapiens
aggtttttcaattaaacggatta

SEQ ID NO: 5224419 - DNA, 17 bp, Homo sapiens
aggtttttcatctgaaa

SEQ ID NO: 5224420 - DNA, 20 bp, Homo sapiens
aggtttttccttatttgctt

SEQ ID NO: 5224421 - DNA, 15 bp, Homo sapiens
aggtttttctccccg

SEQ ID NO: 5224422 - DNA, 14 bp, Homo sapiens
aggtttttgatttt

SEQ ID NO: 5224423 - DNA, 20 bp, Homo sapiens
aggtttttggaattatgtct

SEQ ID NO: 5224424 - DNA, 19 bp, Homo sapiens
aggtttttttccttctgaa

SEQ ID NO: 5224425 - DNA, 16 bp, Homo sapiens
aggtttttttttctca

SEQ ID NO: 5224426 - DNA, 21 bp, Homo sapiens
aggttttttttttaagtgcaa

SEQ ID NO: 5224427 - DNA, 22 bp, Homo sapiens
aggttttttttttttaatttaa

SEQ ID NO: 5224428 - DNA, 19 bp, Homo sapiens
agtaaaaaacaacttcttt

SEQ ID NO: 5224429 - DNA, 16 bp, Homo sapiens
agtaaaaacaaagaaa

SEQ ID NO: 5224430 - DNA, 13 bp, Homo sapiens
agtaaaaactaga

SEQ ID NO: 5224431 - DNA, 13 bp, Homo sapiens
agtaaaaagaaca

SEQ ID NO: 5224432 - DNA, 20 bp, Homo sapiens
agtaaaaagaacaacacttg

SEQ ID NO: 5224433 - DNA, 14 bp, Homo sapiens
agtaaaaagacatt

SEQ ID NO: 5224434 - DNA, 17 bp, Homo sapiens
agtaaaaataaaatact

SEQ ID NO: 5224435 - DNA, 17 bp, Homo sapiens
agtaaaaataaatcaag

SEQ ID NO: 5224436 - DNA, 13 bp, Homo sapiens
agtaaaaatatgt

SEQ ID NO: 5224437 - DNA, 16 bp, Homo sapiens
agtaaaaatattaact

SEQ ID NO: 5224438 - DNA, 18 bp, Homo sapiens
agtaaaaatattaactga

SEQ ID NO: 5224439 - DNA, 17 bp, Homo sapiens
agtaaaaatttcttcca

SEQ ID NO: 5224440 - DNA, 19 bp, Homo sapiens
agtaaaacaaacaatacct

SEQ ID NO: 5224441 - DNA, 20 bp, Homo sapiens
agtaaaacaaacaatacctg

SEQ ID NO: 5224442 - DNA, 13 bp, Homo sapiens
agtaaaacacaga

SEQ ID NO: 5224443 - DNA, 12 bp, Homo sapiens
agtaaaacagtc

SEQ ID NO: 5224444 - DNA, 17 bp, Homo sapiens
agtaaaacataatgtat

SEQ ID NO: 5224445 - DNA, 15 bp, Homo sapiens
agtaaaaccaaaggt

SEQ ID NO: 5224446 - DNA, 16 bp, Homo sapiens
agtaaaaccacagcag

SEQ ID NO: 5224447 - DNA, 19 bp, Homo sapiens
agtaaaaccacagcagttg

SEQ ID NO: 5224448 - DNA, 18 bp, Homo sapiens
agtaaaaccttgttctat

SEQ ID NO: 5224449 - DNA, 20 bp, Homo sapiens
agtaaaaccttgttctattt

SEQ ID NO: 5224450 - DNA, 14 bp, Homo sapiens
agtaaaacttgctg

SEQ ID NO: 5224451 - DNA, 18 bp, Homo sapiens
agtaaaacttgtattgga

SEQ ID NO: 5224452 - DNA, 11 bp, Homo sapiens
agtaaaagaaa

SEQ ID NO: 5224453 - DNA, 20 bp, Homo sapiens
agtaaaagaaaccacttctg

SEQ ID NO: 5224454 - DNA, 23 bp, Homo sapiens
agtaaaagaagaaatagttctgt

SEQ ID NO: 5224455 - DNA, 13 bp, Homo sapiens
agtaaaagacatt

SEQ ID NO: 5224456 - DNA, 15 bp, Homo sapiens
agtaaaagctaatta

SEQ ID NO: 5224457 - DNA, 20 bp, Homo sapiens
agtaaaagctaattaggatt

SEQ ID NO: 5224458 - DNA, 19 bp, Homo sapiens
agtaaaagtatagatacaa

SEQ ID NO: 5224459 - DNA, 12 bp, Homo sapiens
agtaaaagtcat

SEQ ID NO: 5224460 - DNA, 15 bp, Homo sapiens
agtaaaagtcataaa

SEQ ID NO: 5224461 - DNA, 19 bp, Homo sapiens
agtaaaataaatattgtct

SEQ ID NO: 5224462 - DNA, 20 bp, Homo sapiens
agtaaaataaatattgtctt

SEQ ID NO: 5224463 - DNA, 20 bp, Homo sapiens
agtaaaatactattgcctca

SEQ ID NO: 5224464 - DNA, 13 bp, Homo sapiens
agtaaaatatgtc

SEQ ID NO: 5224465 - DNA, 14 bp, Homo sapiens
agtaaaatccaaag

SEQ ID NO: 5224466 - DNA, 23 bp, Homo sapiens
agtaaaatgaacattttgtggag

SEQ ID NO: 5224467 - DNA, 13 bp, Homo sapiens
agtaaaattacag

SEQ ID NO: 5224468 - DNA, 17 bp, Homo sapiens
agtaaaattacagaaga

SEQ ID NO: 5224469 - DNA, 22 bp, Homo sapiens
agtaaaattatcctctttgtaa

SEQ ID NO: 5224470 - DNA, 13 bp, Homo sapiens
agtaaaattatct

SEQ ID NO: 5224471 - DNA, 15 bp, Homo sapiens
agtaaaattatctgt

SEQ ID NO: 5224472 - DNA, 18 bp, Homo sapiens
agtaaaattatctgttct

SEQ ID NO: 5224473 - DNA, 20 bp, Homo sapiens
agtaaaattatctgttctat

SEQ ID NO: 5224474 - DNA, 22 bp, Homo sapiens
agtaaaattattccctgaattg

SEQ ID NO: 5224475 - DNA, 17 bp, Homo sapiens
agtaaaattgccatatt

SEQ ID NO: 5224476 - DNA, 20 bp, Homo sapiens
agtaaaattgccatattgca

SEQ ID NO: 5224477 - DNA, 22 bp, Homo sapiens
agtaaaattgccatattgcaca

SEQ ID NO: 5224478 - DNA, 15 bp, Homo sapiens
agtaaaatttatttc

SEQ ID NO: 5224479 - DNA, 17 bp, Homo sapiens
agtaaaatttatttcat

SEQ ID NO: 5224480 - DNA, 15 bp, Homo sapiens
agtaaaatttcagga

SEQ ID NO: 5224481 - DNA, 12 bp, Homo sapiens
agtaaacactgt

SEQ ID NO: 5224482 - DNA, 14 bp, Homo sapiens
agtaaacaggaaac

SEQ ID NO: 5224483 - DNA, 16 bp, Homo sapiens
agtaaacagggtacct

SEQ ID NO: 5224484 - DNA, 20 bp, Homo sapiens
agtaaacattaagtaaatgc

SEQ ID NO: 5224485 - DNA, 21 bp, Homo sapiens
agtaaacattaagtaaatgct

SEQ ID NO: 5224486 - DNA, 20 bp, Homo sapiens
agtaaaccatgtattccctt

SEQ ID NO: 5224487 - DNA, 15 bp, Homo sapiens
agtaaacctgtctga

SEQ ID NO: 5224488 - DNA, 15 bp, Homo sapiens
agtaaacggcccagg

SEQ ID NO: 5224489 - DNA, 23 bp, Homo sapiens
agtaaacggcccaggccaggtgc

SEQ ID NO: 5224490 - DNA, 19 bp, Homo sapiens
agtaaacgggaacatgccc

SEQ ID NO: 5224491 - DNA, 23 bp, Homo sapiens
agtaaacgggaacatgccccctg

SEQ ID NO: 5224492 - DNA, 20 bp, Homo sapiens
agtaaactattctataaaca

SEQ ID NO: 5224493 - DNA, 17 bp, Homo sapiens
agtaaactattcttaat

SEQ ID NO: 5224494 - DNA, 14 bp, Homo sapiens
agtaaactatttat

SEQ ID NO: 5224495 - DNA, 16 bp, Homo sapiens
agtaaactatttatct

SEQ ID NO: 5224496 - DNA, 15 bp, Homo sapiens
agtaaactgaggccc

SEQ ID NO: 5224497 - DNA, 14 bp, Homo sapiens
agtaaactgatgta

SEQ ID NO: 5224498 - DNA, 13 bp, Homo sapiens
agtaaactggtga

SEQ ID NO: 5224499 - DNA, 14 bp, Homo sapiens
agtaaactggtgag

SEQ ID NO: 5224500 - DNA, 16 bp, Homo sapiens
agtaaactgtttctca

SEQ ID NO: 5224501 - DNA, 18 bp, Homo sapiens
agtaaacttgtgtattga

SEQ ID NO: 5224502 - DNA, 13 bp, Homo sapiens
agtaaagaaatga

SEQ ID NO: 5224503 - DNA, 15 bp, Homo sapiens
agtaaagaaatgaca

SEQ ID NO: 5224504 - DNA, 13 bp, Homo sapiens
agtaaagaaattt

SEQ ID NO: 5224505 - DNA, 20 bp, Homo sapiens
agtaaagaaatttaaaagac

SEQ ID NO: 5224506 - DNA, 22 bp, Homo sapiens
agtaaagagaaactttgtgcta

SEQ ID NO: 5224507 - DNA, 16 bp, Homo sapiens
agtaaagaggcttcca

SEQ ID NO: 5224508 - DNA, 23 bp, Homo sapiens
agtaaagaggcttccaagcatta

SEQ ID NO: 5224509 - DNA, 24 bp, Homo sapiens
agtaaagagtacactcagccactg

SEQ ID NO: 5224510 - DNA, 23 bp, Homo sapiens
agtaaagccattaaatgaatatt

SEQ ID NO: 5224511 - DNA, 17 bp, Homo sapiens
agtaaagctaaaatgat

SEQ ID NO: 5224512 - DNA, 12 bp, Homo sapiens
agtaaaggagat

SEQ ID NO: 5224513 - DNA, 19 bp, Homo sapiens
agtaaaggagtaagaacct

SEQ ID NO: 5224514 - DNA, 16 bp, Homo sapiens
agtaaaggcctcatct

SEQ ID NO: 5224515 - DNA, 22 bp, Homo sapiens
agtaaaggcctcatctccttta

SEQ ID NO: 5224516 - DNA, 13 bp, Homo sapiens
agtaaaggcctcc

SEQ ID NO: 5224517 - DNA, 22 bp, Homo sapiens
agtaaaggcctcctcccccacc

SEQ ID NO: 5224518 - DNA, 15 bp, Homo sapiens
agtaaagtaaagtat

SEQ ID NO: 5224519 - DNA, 18 bp, Homo sapiens
agtaaagtcaaggagaaa

SEQ ID NO: 5224520 - DNA, 15 bp, Homo sapiens
agtaaagtggcaatt

SEQ ID NO: 5224521 - DNA, 21 bp, Homo sapiens
agtaaagtggttctctgcctt

SEQ ID NO: 5224522 - DNA, 22 bp, Homo sapiens
agtaaagtggttctctgccttt

SEQ ID NO: 5224523 - DNA, 15 bp, Homo sapiens
agtaaagtgtaacat

SEQ ID NO: 5224524 - DNA, 18 bp, Homo sapiens
agtaaagtgttctgccag

SEQ ID NO: 5224525 - DNA, 16 bp, Homo sapiens
agtaaagtttatttca

SEQ ID NO: 5224526 - DNA, 12 bp, Homo sapiens
agtaaataaact

SEQ ID NO: 5224527 - DNA, 15 bp, Homo sapiens
agtaaataaactctt

SEQ ID NO: 5224528 - DNA, 17 bp, Homo sapiens
agtaaataaactcttca

SEQ ID NO: 5224529 - DNA, 22 bp, Homo sapiens
agtaaataaactcttcaaggcc

SEQ ID NO: 5224530 - DNA, 20 bp, Homo sapiens
agtaaataaactgtttatat

SEQ ID NO: 5224531 - DNA, 14 bp, Homo sapiens
agtaaataaattgt

SEQ ID NO: 5224532 - DNA, 20 bp, Homo sapiens
agtaaataatgattcaatgt

SEQ ID NO: 5224533 - DNA, 15 bp, Homo sapiens
agtaaatacactgtg

SEQ ID NO: 5224534 - DNA, 14 bp, Homo sapiens
agtaaatacattat

SEQ ID NO: 5224535 - DNA, 18 bp, Homo sapiens
agtaaatacttgcagttg

SEQ ID NO: 5224536 - DNA, 21 bp, Homo sapiens
agtaaatatacactttacatt

SEQ ID NO: 5224537 - DNA, 15 bp, Homo sapiens
agtaaatatattata

SEQ ID NO: 5224538 - DNA, 22 bp, Homo sapiens
agtaaatatcccaaactgtgat

SEQ ID NO: 5224539 - DNA, 14 bp, Homo sapiens
agtaaatatgtgaa

SEQ ID NO: 5224540 - DNA, 16 bp, Homo sapiens
agtaaatatgtgaaga

SEQ ID NO: 5224541 - DNA, 21 bp, Homo sapiens
agtaaatattatgattttatt

SEQ ID NO: 5224542 - DNA, 18 bp, Homo sapiens
agtaaatattgaggcttt

SEQ ID NO: 5224543 - DNA, 21 bp, Homo sapiens
agtaaatattgaggctttgtg

SEQ ID NO: 5224544 - DNA, 14 bp, Homo sapiens
agtaaatatttcag

SEQ ID NO: 5224545 - DNA, 17 bp, Homo sapiens
agtaaatcccacgacat

SEQ ID NO: 5224546 - DNA, 21 bp, Homo sapiens
agtaaatcctcatttgaggaa

SEQ ID NO: 5224547 - DNA, 19 bp, Homo sapiens
agtaaatccttatttatat

SEQ ID NO: 5224548 - DNA, 14 bp, Homo sapiens
agtaaatgaaacta

SEQ ID NO: 5224549 - DNA, 11 bp, Homo sapiens
agtaaatgcta

SEQ ID NO: 5224550 - DNA, 18 bp, Homo sapiens
agtaaatgctacctctga

SEQ ID NO: 5224551 - DNA, 22 bp, Homo sapiens
agtaaatgctaggttaattcca

SEQ ID NO: 5224552 - DNA, 23 bp, Homo sapiens
agtaaatgctaggttaattccaa

SEQ ID NO: 5224553 - DNA, 22 bp, Homo sapiens
agtaaatggcttatccagctgg

SEQ ID NO: 5224554 - DNA, 17 bp, Homo sapiens
agtaaatgggagggcat

SEQ ID NO: 5224555 - DNA, 22 bp, Homo sapiens
agtaaatgtccacttaaaatac

SEQ ID NO: 5224556 - DNA, 11 bp, Homo sapiens
agtaaatgtct

SEQ ID NO: 5224557 - DNA, 13 bp, Homo sapiens
agtaaatgtcttc

SEQ ID NO: 5224558 - DNA, 14 bp, Homo sapiens
agtaaatgttaact

SEQ ID NO: 5224559 - DNA, 19 bp, Homo sapiens
agtaaattagtaatgtact

SEQ ID NO: 5224560 - DNA, 15 bp, Homo sapiens
agtaaattatagctc

SEQ ID NO: 5224561 - DNA, 16 bp, Homo sapiens
agtaaattatgatgtc

SEQ ID NO: 5224562 - DNA, 20 bp, Homo sapiens
agtaaattcctaattctatg

SEQ ID NO: 5224563 - DNA, 15 bp, Homo sapiens
agtaaattctgttga

SEQ ID NO: 5224564 - DNA, 12 bp, Homo sapiens
agtaaattggaa

SEQ ID NO: 5224565 - DNA, 13 bp, Homo sapiens
agtaaattttcaa

SEQ ID NO: 5224566 - DNA, 15 bp, Homo sapiens
agtaacaagagtgat

SEQ ID NO: 5224567 - DNA, 18 bp, Homo sapiens
agtaacaagagtgattct

SEQ ID NO: 5224568 - DNA, 16 bp, Homo sapiens
agtaacaatgcatgct

SEQ ID NO: 5224569 - DNA, 14 bp, Homo sapiens
agtaacacaaacat

SEQ ID NO: 5224570 - DNA, 22 bp, Homo sapiens
agtaacacacccctgcttggga

SEQ ID NO: 5224571 - DNA, 21 bp, Homo sapiens
agtaacacagtattatgcctg

SEQ ID NO: 5224572 - DNA, 18 bp, Homo sapiens
agtaacacagtgcagtgc

SEQ ID NO: 5224573 - DNA, 13 bp, Homo sapiens
agtaacactaata

SEQ ID NO: 5224574 - DNA, 16 bp, Homo sapiens
agtaacactaatatat

SEQ ID NO: 5224575 - DNA, 23 bp, Homo sapiens
agtaacactaatatatttaaaaa

SEQ ID NO: 5224576 - DNA, 19 bp, Homo sapiens
agtaacactagtagctgtt

SEQ ID NO: 5224577 - DNA, 20 bp, Homo sapiens
agtaacactgtgatttatct

SEQ ID NO: 5224578 - DNA, 16 bp, Homo sapiens
agtaacacttgaaaag

SEQ ID NO: 5224579 - DNA, 11 bp, Homo sapiens
agtaacacttt

SEQ ID NO: 5224580 - DNA, 12 bp, Homo sapiens
agtaacacttta

SEQ ID NO: 5224581 - DNA, 13 bp, Homo sapiens
agtaacagacaca

SEQ ID NO: 5224582 - DNA, 21 bp, Homo sapiens
agtaacagctaatctttaata

SEQ ID NO: 5224583 - DNA, 17 bp, Homo sapiens
agtaacagggccttgct

SEQ ID NO: 5224584 - DNA, 16 bp, Homo sapiens
agtaacagtatttcca

SEQ ID NO: 5224585 - DNA, 17 bp, Homo sapiens
agtaacagtatttccat

SEQ ID NO: 5224586 - DNA, 18 bp, Homo sapiens
agtaacatataaattaat

SEQ ID NO: 5224587 - DNA, 22 bp, Homo sapiens
agtaacatataaattaatacat

SEQ ID NO: 5224588 - DNA, 21 bp, Homo sapiens
agtgcatgtcacatgccacaa

SEQ ID NO: 5224589 - DNA, 18 bp, Homo sapiens
agtgcatgtgaagcatgc

SEQ ID NO: 5224590 - DNA, 13 bp, Homo sapiens
agtgcatgtgcat

SEQ ID NO: 5224591 - DNA, 17 bp, Homo sapiens
agtgcatgttaaaataa

SEQ ID NO: 5224592 - DNA, 13 bp, Homo sapiens
agtgcattagaaa

SEQ ID NO: 5224593 - DNA, 20 bp, Homo sapiens
agtgcattgtttctgtgggc

SEQ ID NO: 5224594 - DNA, 20 bp, Homo sapiens
agtgcatttagttttgtctt

SEQ ID NO: 5224595 - DNA, 16 bp, Homo sapiens
agtgcatttattgcct

SEQ ID NO: 5224596 - DNA, 22 bp, Homo sapiens
agtgcatttctgaatagaaatg

SEQ ID NO: 5224597 - DNA, 16 bp, Homo sapiens
agtgcatttctgggcc

SEQ ID NO: 5224598 - DNA, 17 bp, Homo sapiens
agtgcattttcccagat

SEQ ID NO: 5224599 - DNA, 19 bp, Homo sapiens
agtgcattttgtttctgta

SEQ ID NO: 5224600 - DNA, 20 bp, Homo sapiens
agtgcattttgtttctgtat

SEQ ID NO: 5224601 - DNA, 22 bp, Homo sapiens
agtgcattttgtttctgtatat

SEQ ID NO: 5224602 - DNA, 13 bp, Homo sapiens
agtgcatttttaa

SEQ ID NO: 5224603 - DNA, 17 bp, Homo sapiens
agtgcatttttgtaaat

SEQ ID NO: 5224604 - DNA, 19 bp, Homo sapiens
agtgccaaaaggccccttc

SEQ ID NO: 5224605 - DNA, 13 bp, Homo sapiens
agtgccaaaataa

SEQ ID NO: 5224606 - DNA, 23 bp, Homo sapiens
agtgccaaaataaagtctgtcat

SEQ ID NO: 5224607 - DNA, 14 bp, Homo sapiens
agtgccaaataatt

SEQ ID NO: 5224608 - DNA, 19 bp, Homo sapiens
agtgccaaatgctggggca

SEQ ID NO: 5224609 - DNA, 16 bp, Homo sapiens
agtgccaactgtggct

SEQ ID NO: 5224610 - DNA, 19 bp, Homo sapiens
agtgccaacttcccctcta

SEQ ID NO: 5224611 - DNA, 20 bp, Homo sapiens
agtgccaagacacagcaggg

SEQ ID NO: 5224612 - DNA, 14 bp, Homo sapiens
agtgccaagcacag

SEQ ID NO: 5224613 - DNA, 19 bp, Homo sapiens
agtgccaagtttttcagaa

SEQ ID NO: 5224614 - DNA, 22 bp, Homo sapiens
agtgccaagtttttcagaaagt

SEQ ID NO: 5224615 - DNA, 14 bp, Homo sapiens
agtgccaatgttgt

SEQ ID NO: 5224616 - DNA, 14 bp, Homo sapiens
agtgccacaaagct

SEQ ID NO: 5224617 - DNA, 15 bp, Homo sapiens
agtgccacaaagctc

SEQ ID NO: 5224618 - DNA, 11 bp, Homo sapiens
agtgccacaga

SEQ ID NO: 5224619 - DNA, 13 bp, Homo sapiens
agtgccacagcct

SEQ ID NO: 5224620 - DNA, 17 bp, Homo sapiens
agtgccacatggccgct

SEQ ID NO: 5224621 - DNA, 18 bp, Homo sapiens
agtgccacatggccgctg

SEQ ID NO: 5224622 - DNA, 23 bp, Homo sapiens
agtgccacatggccgctgcccac

SEQ ID NO: 5224623 - DNA, 20 bp, Homo sapiens
agtgccacccgcagatgaca

SEQ ID NO: 5224624 - DNA, 13 bp, Homo sapiens
agtgccacctatg

SEQ ID NO: 5224625 - DNA, 18 bp, Homo sapiens
agtgccacctatgcctgt

SEQ ID NO: 5224626 - DNA, 21 bp, Homo sapiens
agtgccacctatgcctgtggt

SEQ ID NO: 5224627 - DNA, 22 bp, Homo sapiens
agtgccacctatgcctgtggtg

SEQ ID NO: 5224628 - DNA, 21 bp, Homo sapiens
agtgccacgttactcccctgg

SEQ ID NO: 5224629 - DNA, 23 bp, Homo sapiens
agtgccacgttactcccctggct

SEQ ID NO: 5224630 - DNA, 18 bp, Homo sapiens
agtgccactgccccccga

SEQ ID NO: 5224631 - DNA, 21 bp, Homo sapiens
agtgccactgcccgagctggt

SEQ ID NO: 5224632 - DNA, 16 bp, Homo sapiens
agtgccacttaatgta

SEQ ID NO: 5224633 - DNA, 21 bp, Homo sapiens
agtgccacttaatgtatgtta

SEQ ID NO: 5224634 - DNA, 21 bp, Homo sapiens
agtgccacttgacattccttg

SEQ ID NO: 5224635 - DNA, 20 bp, Homo sapiens
agtgccagaaagagagaacc

SEQ ID NO: 5224636 - DNA, 15 bp, Homo sapiens
agtgccagaggtggg

SEQ ID NO: 5224637 - DNA, 18 bp, Homo sapiens
agtgccagaggtgggcag

SEQ ID NO: 5224638 - DNA, 22 bp, Homo sapiens
agtgccagcattccagacttca

SEQ ID NO: 5224639 - DNA, 15 bp, Homo sapiens
agtgccagcccctgc

SEQ ID NO: 5224640 - DNA, 19 bp, Homo sapiens
agtgccagctactcaggag

SEQ ID NO: 5224641 - DNA, 15 bp, Homo sapiens
agtgccagctccagt

SEQ ID NO: 5224642 - DNA, 16 bp, Homo sapiens
agtgccaggaaagagt

SEQ ID NO: 5224643 - DNA, 13 bp, Homo sapiens
agtgccaggacag

SEQ ID NO: 5224644 - DNA, 16 bp, Homo sapiens
agtgccaggacagctg

SEQ ID NO: 5224645 - DNA, 17 bp, Homo sapiens
agtgccaggacagctgg

SEQ ID NO: 5224646 - DNA, 19 bp, Homo sapiens
agtgccaggacagctggct

SEQ ID NO: 5224647 - DNA, 13 bp, Homo sapiens
agtgccaggacca

SEQ ID NO: 5224648 - DNA, 19 bp, Homo sapiens
agtgccaggaccagcctgt

SEQ ID NO: 5224649 - DNA, 23 bp, Homo sapiens
agtgccaggactccccaggccag

SEQ ID NO: 5224650 - DNA, 24 bp, Homo sapiens
agtgccaggactccccaggccagg

SEQ ID NO: 5224651 - DNA, 12 bp, Homo sapiens
agtgccaggagg

SEQ ID NO: 5224652 - DNA, 10 bp, Homo sapiens
agtgccaggc

SEQ ID NO: 5224653 - DNA, 17 bp, Homo sapiens
agtgccataccttctcc

SEQ ID NO: 5224654 - DNA, 21 bp, Homo sapiens
agtgccataccttctcccagg

SEQ ID NO: 5224655 - DNA, 23 bp, Homo sapiens
agtgccataccttctcccaggcc

SEQ ID NO: 5224656 - DNA, 16 bp, Homo sapiens
agtgccatccctgaga

SEQ ID NO: 5224657 - DNA, 16 bp, Homo sapiens
agtgccatggccagga

SEQ ID NO: 5224658 - DNA, 18 bp, Homo sapiens
agtgccatggccaggagt

SEQ ID NO: 5224659 - DNA, 14 bp, Homo sapiens
agtgccatggctgg

SEQ ID NO: 5224660 - DNA, 12 bp, Homo sapiens
agtgccattact

SEQ ID NO: 5224661 - DNA, 19 bp, Homo sapiens
agtgccattactactgtac

SEQ ID NO: 5224662 - DNA, 22 bp, Homo sapiens
agtgccattccactccactcag

SEQ ID NO: 5224663 - DNA, 10 bp, Homo sapiens
agtgcccaaa

SEQ ID NO: 5224664 - DNA, 14 bp, Homo sapiens
agtgcccacaggat

SEQ ID NO: 5224665 - DNA, 17 bp, Homo sapiens
agtgcccacatttgatg

SEQ ID NO: 5224666 - DNA, 18 bp, Homo sapiens
agtgcccaccctgggaga

SEQ ID NO: 5224667 - DNA, 20 bp, Homo sapiens
agtgcccaccgccctcctcc

SEQ ID NO: 5224668 - DNA, 21 bp, Homo sapiens
agtgcccaccgccctcctcca

SEQ ID NO: 5224669 - DNA, 11 bp, Homo sapiens
agtgcccagcc

SEQ ID NO: 5224670 - DNA, 12 bp, Homo sapiens
agtgcccagccc

SEQ ID NO: 5224671 - DNA, 22 bp, Homo sapiens
agtgcccagcccctgcccctac

SEQ ID NO: 5224672 - DNA, 20 bp, Homo sapiens
agtgcccagtgatggcatta

SEQ ID NO: 5224673 - DNA, 20 bp, Homo sapiens
agtgcccagtggagcctgcc

SEQ ID NO: 5224674 - DNA, 23 bp, Homo sapiens
agtgcccagtggagcctgccgcc

SEQ ID NO: 5224675 - DNA, 19 bp, Homo sapiens
agtgcccatggggtagaag

SEQ ID NO: 5224676 - DNA, 14 bp, Homo sapiens
agtgcccatgtgta

SEQ ID NO: 5224677 - DNA, 18 bp, Homo sapiens
agtgcccatgtgtacatt

SEQ ID NO: 5224678 - DNA, 20 bp, Homo sapiens
agtgccccaaggaggtggct

SEQ ID NO: 5224679 - DNA, 13 bp, Homo sapiens
agtgccccacctg

SEQ ID NO: 5224680 - DNA, 16 bp, Homo sapiens
agtgccccacttctgg

SEQ ID NO: 5224681 - DNA, 16 bp, Homo sapiens
agtgccccagaaatgc

SEQ ID NO: 5224682 - DNA, 21 bp, Homo sapiens
agtgccccagacagttctttt

SEQ ID NO: 5224683 - DNA, 19 bp, Homo sapiens
agtgccccagactgagctc

SEQ ID NO: 5224684 - DNA, 21 bp, Homo sapiens
agtgccccagggagtccaggg

SEQ ID NO: 5224685 - DNA, 22 bp, Homo sapiens
agtgccccagggagtccagggt

SEQ ID NO: 5224686 - DNA, 17 bp, Homo sapiens
agtgccccctcacctct

SEQ ID NO: 5224687 - DNA, 11 bp, Homo sapiens
agtgcccctgc

SEQ ID NO: 5224688 - DNA, 13 bp, Homo sapiens
agtgcccctgcag

SEQ ID NO: 5224689 - DNA, 21 bp, Homo sapiens
agtgcccctgctgcctcccca

SEQ ID NO: 5224690 - DNA, 14 bp, Homo sapiens
agtgcccctgtccc

SEQ ID NO: 5224691 - DNA, 19 bp, Homo sapiens
agtgcccctgtcccacctg

SEQ ID NO: 5224692 - DNA, 14 bp, Homo sapiens
agtgcccgccctgc

SEQ ID NO: 5224693 - DNA, 20 bp, Homo sapiens
agtgcccgccctgcccctgc

SEQ ID NO: 5224694 - DNA, 19 bp, Homo sapiens
agtgcccgcctaggagttg

SEQ ID NO: 5224695 - DNA, 21 bp, Homo sapiens
agtgccctctcccaccctctt

SEQ ID NO: 5224696 - DNA, 23 bp, Homo sapiens
agtgccctctcccaccctcttcc

SEQ ID NO: 5224697 - DNA, 19 bp, Homo sapiens
agtgccctctggacagctt

SEQ ID NO: 5224698 - DNA, 16 bp, Homo sapiens
agtgccctgagccagg

SEQ ID NO: 5224699 - DNA, 23 bp, Homo sapiens
agtgccctgagccagggtctcca

SEQ ID NO: 5224700 - DNA, 18 bp, Homo sapiens
agtgccctgcaggcacag

SEQ ID NO: 5224701 - DNA, 21 bp, Homo sapiens
agtgccctgccccagtcagcc

SEQ ID NO: 5224702 - DNA, 18 bp, Homo sapiens
agtgccctgccccctggc

SEQ ID NO: 5224703 - DNA, 19 bp, Homo sapiens
agtgccctgccccctggct

SEQ ID NO: 5224704 - DNA, 21 bp, Homo sapiens
agtgccctgccccctggctga

SEQ ID NO: 5224705 - DNA, 22 bp, Homo sapiens
agtgccctgccccctggctgac

SEQ ID NO: 5224706 - DNA, 18 bp, Homo sapiens
agtgccctgctttgcaaa

SEQ ID NO: 5224707 - DNA, 22 bp, Homo sapiens
agtgccctggggctgatctcag

SEQ ID NO: 5224708 - DNA, 20 bp, Homo sapiens
agtgcccttcctgctgcgca

SEQ ID NO: 5224709 - DNA, 22 bp, Homo sapiens
agtgccgaatgactatgtccag

SEQ ID NO: 5224710 - DNA, 14 bp, Homo sapiens
agtgccgaggacat

SEQ ID NO: 5224711 - DNA, 18 bp, Homo sapiens
agtgccgcatctcacagc

SEQ ID NO: 5224712 - DNA, 15 bp, Homo sapiens
agtgccgctcctgct

SEQ ID NO: 5224713 - DNA, 18 bp, Homo sapiens
agtgccgctcctgcttcc

SEQ ID NO: 5224714 - DNA, 19 bp, Homo sapiens
agtgccgctcctgcttccc

SEQ ID NO: 5224715 - DNA, 23 bp, Homo sapiens
agtgccgctcctgcttcccctcc

SEQ ID NO: 5224716 - DNA, 14 bp, Homo sapiens
agtgccggctgtgg

SEQ ID NO: 5224717 - DNA, 23 bp, Homo sapiens
agtgccgtagtcctttttgtaac

SEQ ID NO: 5224718 - DNA, 16 bp, Homo sapiens
agtgcctaaagtgctg

SEQ ID NO: 5224719 - DNA, 14 bp, Homo sapiens
agtgcctacaatgg

SEQ ID NO: 5224720 - DNA, 17 bp, Homo sapiens
agtgcctagactgttac

SEQ ID NO: 5224721 - DNA, 14 bp, Homo sapiens
agtgcctattgata

SEQ ID NO: 5224722 - DNA, 21 bp, Homo sapiens
agtgcctcaagaggaatgaaa

SEQ ID NO: 5224723 - DNA, 17 bp, Homo sapiens
agtgcctcagcgctgcc

SEQ ID NO: 5224724 - DNA, 20 bp, Homo sapiens
agtgcctcagcgctgcccac

SEQ ID NO: 5224725 - DNA, 23 bp, Homo sapiens
agtgcctccacatgctgcctggc

SEQ ID NO: 5224726 - DNA, 13 bp, Homo sapiens
agtgcctcgaggc

SEQ ID NO: 5224727 - DNA, 14 bp, Homo sapiens
agtgcctcggacag

SEQ ID NO: 5224728 - DNA, 17 bp, Homo sapiens
agtgcctcttccagtga

SEQ ID NO: 5224729 - DNA, 18 bp, Homo sapiens
agtgcctgacacactaac

SEQ ID NO: 5224730 - DNA, 14 bp, Homo sapiens
agtgcctgcagcat

SEQ ID NO: 5224731 - DNA, 16 bp, Homo sapiens
agtgcctgcagcatct

SEQ ID NO: 5224732 - DNA, 20 bp, Homo sapiens
agtgcctgccactctctggg

SEQ ID NO: 5224733 - DNA, 23 bp, Homo sapiens
agtgcctgccactctctgggact

SEQ ID NO: 5224734 - DNA, 20 bp, Homo sapiens
agtgcctgctgggtgccagg

SEQ ID NO: 5224735 - DNA, 21 bp, Homo sapiens
agtgcctgctgggtgccaggt

SEQ ID NO: 5224736 - DNA, 14 bp, Homo sapiens
agtgcctgctgttc

SEQ ID NO: 5224737 - DNA, 22 bp, Homo sapiens
agtgcctggatcccctctgtct

SEQ ID NO: 5224738 - DNA, 15 bp, Homo sapiens
agtgcctgggaagcc

SEQ ID NO: 5224739 - DNA, 17 bp, Homo sapiens
agtgcctgggaatgtat

SEQ ID NO: 5224740 - DNA, 19 bp, Homo sapiens
agtgcctgggctcagcctg

SEQ ID NO: 5224741 - DNA, 20 bp, Homo sapiens
agtgccttaacctagagggt

SEQ ID NO: 5224742 - DNA, 20 bp, Homo sapiens
agtgccttaatagtagggta

SEQ ID NO: 5224743 - DNA, 20 bp, Homo sapiens
agtgccttacctcctgccca

SEQ ID NO: 5224744 - DNA, 23 bp, Homo sapiens
agtgccttacctcctgcccagga

SEQ ID NO: 5224745 - DNA, 20 bp, Homo sapiens
agtgccttagcatgtgttgc

SEQ ID NO: 5224746 - DNA, 14 bp, Homo sapiens
agtgccttatggaa

SEQ ID NO: 5224747 - DNA, 18 bp, Homo sapiens
agtgccttatggaacact

SEQ ID NO: 5224748 - DNA, 20 bp, Homo sapiens
agtgccttatggaacactct

SEQ ID NO: 5224749 - DNA, 13 bp, Homo sapiens
agtgccttcaaca

SEQ ID NO: 5224750 - DNA, 18 bp, Homo sapiens
agtgccttcaacacagct

SEQ ID NO: 5224751 - DNA, 20 bp, Homo sapiens
agtgccttcaataaatggta

SEQ ID NO: 5224752 - DNA, 19 bp, Homo sapiens
agtgccttcagccaagacc

SEQ ID NO: 5224753 - DNA, 21 bp, Homo sapiens
agtgccttcagccaagaccat

SEQ ID NO: 5224754 - DNA, 13 bp, Homo sapiens
agtgccttcctct

SEQ ID NO: 5224755 - DNA, 11 bp, Homo sapiens
agtgccttctc

SEQ ID NO: 5224756 - DNA, 19 bp, Homo sapiens
agtgccttctccttcccca

SEQ ID NO: 5224757 - DNA, 20 bp, Homo sapiens
agtgccttctccttccccag

SEQ ID NO: 5224758 - DNA, 21 bp, Homo sapiens
agtgccttctccttccccagg

SEQ ID NO: 5224759 - DNA, 22 bp, Homo sapiens
agtgccttctccttccccagga

SEQ ID NO: 5224760 - DNA, 13 bp, Homo sapiens
agtgccttctctc

SEQ ID NO: 5224761 - DNA, 22 bp, Homo sapiens
agtgccttctctcagctcccag

SEQ ID NO: 5224762 - DNA, 20 bp, Homo sapiens
agtgccttctttagaccctc

SEQ ID NO: 5224763 - DNA, 16 bp, Homo sapiens
agtgccttgagctgcc

SEQ ID NO: 5224764 - DNA, 19 bp, Homo sapiens
agtgccttgagctgcctgc

SEQ ID NO: 5224765 - DNA, 15 bp, Homo sapiens
agtgccttggagcag

SEQ ID NO: 5224766 - DNA, 21 bp, Homo sapiens
agtgccttggagcagaaagcc

SEQ ID NO: 5224767 - DNA, 21 bp, Homo sapiens
agtgccttggggaatttcctc

SEQ ID NO: 5224768 - DNA, 13 bp, Homo sapiens
agtgcctttcagg

SEQ ID NO: 5224769 - DNA, 19 bp, Homo sapiens
agtgcctttcaggatctat

SEQ ID NO: 5224770 - DNA, 14 bp, Homo sapiens
agtgcctttcccca

SEQ ID NO: 5224771 - DNA, 22 bp, Homo sapiens
agtgccttttgcagaagagggt

SEQ ID NO: 5224772 - DNA, 17 bp, Homo sapiens
agtgccttttgctgcgc

SEQ ID NO: 5224773 - DNA, 14 bp, Homo sapiens
agtgccttttggaa

SEQ ID NO: 5224774 - DNA, 15 bp, Homo sapiens
agtgccttttggaac

SEQ ID NO: 5224775 - DNA, 17 bp, Homo sapiens
agtgccttttggtttca

SEQ ID NO: 5224776 - DNA, 23 bp, Homo sapiens
agtgccttttggtttcaccttcc

SEQ ID NO: 5224777 - DNA, 13 bp, Homo sapiens
agtgcgatgtgga

SEQ ID NO: 5224778 - DNA, 22 bp, Homo sapiens
agtgcgcagatctgtgcctggg

SEQ ID NO: 5224779 - DNA, 23 bp, Homo sapiens
agtgcgcagatctgtgcctggga

SEQ ID NO: 5224780 - DNA, 18 bp, Homo sapiens
agtgcggacccttcccag

SEQ ID NO: 5224781 - DNA, 23 bp, Homo sapiens
agtgcggacccttcccagccctc

SEQ ID NO: 5224782 - DNA, 22 bp, Homo sapiens
agtgcggcccctcggctgttcc

SEQ ID NO: 5224783 - DNA, 18 bp, Homo sapiens
agtgcggcgtggagactg

SEQ ID NO: 5224784 - DNA, 19 bp, Homo sapiens
agtgcgggctgaggccaga

SEQ ID NO: 5224785 - DNA, 22 bp, Homo sapiens
agtgcggttcctcatctgagag

SEQ ID NO: 5224786 - DNA, 19 bp, Homo sapiens
agtgcggtttactcactgc

SEQ ID NO: 5224787 - DNA, 14 bp, Homo sapiens
agtgcgtggatctg

SEQ ID NO: 5224788 - DNA, 18 bp, Homo sapiens
agtgcgtgtgtagagtta

SEQ ID NO: 5224789 - DNA, 22 bp, Homo sapiens
agtgcgtgtgtagagttaagaa

SEQ ID NO: 5224790 - DNA, 15 bp, Homo sapiens
agtgcgtgtgtgtat

SEQ ID NO: 5224791 - DNA, 13 bp, Homo sapiens
agtgcgttctccc

SEQ ID NO: 5224792 - DNA, 20 bp, Homo sapiens
agtgctaaaaatgggacttc

SEQ ID NO: 5224793 - DNA, 15 bp, Homo sapiens
agtgctaaactactg

SEQ ID NO: 5224794 - DNA, 16 bp, Homo sapiens
agtgctaaactactga

SEQ ID NO: 5224795 - DNA, 21 bp, Homo sapiens
agtgctaaactactgattact

SEQ ID NO: 5224796 - DNA, 18 bp, Homo sapiens
agtgctaaagttttcttc

SEQ ID NO: 5224797 - DNA, 19 bp, Homo sapiens
agtgctaaagttttcttcc

SEQ ID NO: 5224798 - DNA, 20 bp, Homo sapiens
agtgctaaagttttcttccc

SEQ ID NO: 5224799 - DNA, 17 bp, Homo sapiens
agtgctaacatgaagac

SEQ ID NO: 5224800 - DNA, 17 bp, Homo sapiens
agtgctaagcattagct

SEQ ID NO: 5224801 - DNA, 18 bp, Homo sapiens
agtgctaagctgccctga

SEQ ID NO: 5224802 - DNA, 14 bp, Homo sapiens
agtgctaaggttct

SEQ ID NO: 5224803 - DNA, 15 bp, Homo sapiens
agtgctaaggttcta

SEQ ID NO: 5224804 - DNA, 17 bp, Homo sapiens
agtgctaaggttctaag

SEQ ID NO: 5224805 - DNA, 21 bp, Homo sapiens
agtgctaaggttctaaggcct

SEQ ID NO: 5224806 - DNA, 15 bp, Homo sapiens
agtgctaattttgaa

SEQ ID NO: 5224807 - DNA, 17 bp, Homo sapiens
agtgctacagaaagcac

SEQ ID NO: 5224808 - DNA, 19 bp, Homo sapiens
agtgctacagatgtacatt

SEQ ID NO: 5224809 - DNA, 16 bp, Homo sapiens
agtgctacagggtcca

SEQ ID NO: 5224810 - DNA, 17 bp, Homo sapiens
agtgctacataaattgg

SEQ ID NO: 5224811 - DNA, 13 bp, Homo sapiens
agtgctactttgc

SEQ ID NO: 5224812 - DNA, 13 bp, Homo sapiens
agtgctagaaaat

SEQ ID NO: 5224813 - DNA, 17 bp, Homo sapiens
agtgctagatttagcac

SEQ ID NO: 5224814 - DNA, 22 bp, Homo sapiens
agtgctaggataaaccaatcat

SEQ ID NO: 5224815 - DNA, 23 bp, Homo sapiens
agtgctagtgtggtctgtaatat

SEQ ID NO: 5224816 - DNA, 19 bp, Homo sapiens
agtgctataaatgccagag

SEQ ID NO: 5224817 - DNA, 22 bp, Homo sapiens
agtgctataaatgccagagcca

SEQ ID NO: 5224818 - DNA, 13 bp, Homo sapiens
agtgctatatata

SEQ ID NO: 5224819 - DNA, 17 bp, Homo sapiens
agtgctatgcatattta

SEQ ID NO: 5224820 - DNA, 21 bp, Homo sapiens
agtgctatgcatatttataga

SEQ ID NO: 5224821 - DNA, 16 bp, Homo sapiens
agtgctatgtgtgaga

SEQ ID NO: 5224822 - DNA, 19 bp, Homo sapiens
agtgctattacgaagttca

SEQ ID NO: 5224823 - DNA, 16 bp, Homo sapiens
agtgctattctgtgtt

SEQ ID NO: 5224824 - DNA, 23 bp, Homo sapiens
agtgctattctgtgttgaacaca

SEQ ID NO: 5224825 - DNA, 14 bp, Homo sapiens
agtgctattgcaga

SEQ ID NO: 5224826 - DNA, 12 bp, Homo sapiens
agtgctatttca

SEQ ID NO: 5224827 - DNA, 14 bp, Homo sapiens
agtgctatttcagc

SEQ ID NO: 5224828 - DNA, 17 bp, Homo sapiens
agtgctcaacctacagt

SEQ ID NO: 5224829 - DNA, 23 bp, Homo sapiens
agtgctcaacctacagtggaggg

SEQ ID NO: 5224830 - DNA, 22 bp, Homo sapiens
agtgctcaaggttactgggagt

SEQ ID NO: 5224831 - DNA, 19 bp, Homo sapiens
agtgctcacacaatcagac

SEQ ID NO: 5224832 - DNA, 21 bp, Homo sapiens
agtgctcacacaatcagacca

SEQ ID NO: 5224833 - DNA, 15 bp, Homo sapiens
agtgctcaccagccc

SEQ ID NO: 5224834 - DNA, 17 bp, Homo sapiens
agtgctcacccacacca

SEQ ID NO: 5224835 - DNA, 13 bp, Homo sapiens
agtgctcagctgt

SEQ ID NO: 5224836 - DNA, 13 bp, Homo sapiens
agtgctcagggaa

SEQ ID NO: 5224837 - DNA, 14 bp, Homo sapiens
agtgctcagggaaa

SEQ ID NO: 5224838 - DNA, 15 bp, Homo sapiens
agtgctcagggaaat

SEQ ID NO: 5224839 - DNA, 21 bp, Homo sapiens
agtgctcagggaaatggcctt

SEQ ID NO: 5224840 - DNA, 22 bp, Homo sapiens
agtgctcagggaaatggccttc

SEQ ID NO: 5224841 - DNA, 15 bp, Homo sapiens
agtgctcagttccaa

SEQ ID NO: 5224842 - DNA, 16 bp, Homo sapiens
agtgctcagttccaat

SEQ ID NO: 5224843 - DNA, 16 bp, Homo sapiens
agtgctccccacacgt

SEQ ID NO: 5224844 - DNA, 23 bp, Homo sapiens
agtgctccccacacgtgctcgca

SEQ ID NO: 5224845 - DNA, 18 bp, Homo sapiens
agtgctcccctctgaaag

SEQ ID NO: 5224846 - DNA, 14 bp, Homo sapiens
agtgctccctcaca

SEQ ID NO: 5224847 - DNA, 23 bp, Homo sapiens
agtgctccctggaggcacgcacc

SEQ ID NO: 5224848 - DNA, 19 bp, Homo sapiens
agtgctcctccgtgtggac

SEQ ID NO: 5224849 - DNA, 14 bp, Homo sapiens
agtgctcctgtgca

SEQ ID NO: 5224850 - DNA, 16 bp, Homo sapiens
agtgctcctgtgcagg

SEQ ID NO: 5224851 - DNA, 20 bp, Homo sapiens
agtgctcgagtcacattctg

SEQ ID NO: 5224852 - DNA, 23 bp, Homo sapiens
agtgctcgagtcacattctgctt

SEQ ID NO: 5224853 - DNA, 15 bp, Homo sapiens
agtgctcgctgttgc

SEQ ID NO: 5224854 - DNA, 16 bp, Homo sapiens
agtgctcgctgttgct

SEQ ID NO: 5224855 - DNA, 17 bp, Homo sapiens
agtgctcgctgttgctg

SEQ ID NO: 5224856 - DNA, 19 bp, Homo sapiens
agtgctcgctgttgctgaa

SEQ ID NO: 5224857 - DNA, 12 bp, Homo sapiens
agtgctctctcc

SEQ ID NO: 5224858 - DNA, 13 bp, Homo sapiens
agtgctctctcca

SEQ ID NO: 5224859 - DNA, 17 bp, Homo sapiens
agtgctctgaccctggg

SEQ ID NO: 5224860 - DNA, 16 bp, Homo sapiens
agtgctctgatccctc

SEQ ID NO: 5224861 - DNA, 15 bp, Homo sapiens
agtgctctgcctcag

SEQ ID NO: 5224862 - DNA, 17 bp, Homo sapiens
agtgctctgcctcagac

SEQ ID NO: 5224863 - DNA, 21 bp, Homo sapiens
agtgctcttcccactccagct

SEQ ID NO: 5224864 - DNA, 17 bp, Homo sapiens
agtgctcttggctgacc

SEQ ID NO: 5224865 - DNA, 19 bp, Homo sapiens
agtgctctttgtggcagtg

SEQ ID NO: 5224866 - DNA, 22 bp, Homo sapiens
agtgctctttgtggcagtggcc

SEQ ID NO: 5224867 - DNA, 14 bp, Homo sapiens
agtgctcttttctc

SEQ ID NO: 5224868 - DNA, 17 bp, Homo sapiens
agtgctcttttctcctc

SEQ ID NO: 5224869 - DNA, 12 bp, Homo sapiens
agtgctgaagct

SEQ ID NO: 5224870 - DNA, 18 bp, Homo sapiens
agtgctgaccccaggaag

SEQ ID NO: 5224871 - DNA, 20 bp, Homo sapiens
agtgctgagattacaggtgt

SEQ ID NO: 5224872 - DNA, 19 bp, Homo sapiens
agtgctgagtctgtgaata

SEQ ID NO: 5224873 - DNA, 17 bp, Homo sapiens
agtgctgcagctccctg

SEQ ID NO: 5224874 - DNA, 13 bp, Homo sapiens
agtgctgcagctt

SEQ ID NO: 5224875 - DNA, 22 bp, Homo sapiens
agtgctgcatttaaaagataca

SEQ ID NO: 5224876 - DNA, 19 bp, Homo sapiens
agtgctgccacttaaaaag

SEQ ID NO: 5224877 - DNA, 21 bp, Homo sapiens
agtgctgccacttaaaaagac

SEQ ID NO: 5224878 - DNA, 22 bp, Homo sapiens
agtgctgccacttaaaaagact

SEQ ID NO: 5224879 - DNA, 12 bp, Homo sapiens
agtgctgccatg

SEQ ID NO: 5224880 - DNA, 14 bp, Homo sapiens
agtgctgccatgcc

SEQ ID NO: 5224881 - DNA, 19 bp, Homo sapiens
agtgctgccccttgcaagc

SEQ ID NO: 5224882 - DNA, 12 bp, Homo sapiens
agtgctgccctg

SEQ ID NO: 5224883 - DNA, 17 bp, Homo sapiens
agtgctgcctgtcccca

SEQ ID NO: 5224884 - DNA, 13 bp, Homo sapiens
agtgctgctgtgg

SEQ ID NO: 5224885 - DNA, 19 bp, Homo sapiens
agtgctgcttctcttggga

SEQ ID NO: 5224886 - DNA, 13 bp, Homo sapiens
agtgctgcttctt

SEQ ID NO: 5224887 - DNA, 15 bp, Homo sapiens
agtgctgcttcttgc

SEQ ID NO: 5224888 - DNA, 19 bp, Homo sapiens
agtgctgcttgtgcctccc

SEQ ID NO: 5224889 - DNA, 21 bp, Homo sapiens
agtgctgcttgtgcctccctt

SEQ ID NO: 5224890 - DNA, 16 bp, Homo sapiens
agtgctggaactttag

SEQ ID NO: 5224891 - DNA, 18 bp, Homo sapiens
agtgctggaatggggacc

SEQ ID NO: 5224892 - DNA, 12 bp, Homo sapiens
agtgctggactg

SEQ ID NO: 5224893 - DNA, 13 bp, Homo sapiens
agtgctggactgt

SEQ ID NO: 5224894 - DNA, 12 bp, Homo sapiens
agtgctggattt

SEQ ID NO: 5224895 - DNA, 13 bp, Homo sapiens
agtgctggcactt

SEQ ID NO: 5224896 - DNA, 20 bp, Homo sapiens
agtgctggcccacccagtcc

SEQ ID NO: 5224897 - DNA, 16 bp, Homo sapiens
agtgctggctcacagt

SEQ ID NO: 5224898 - DNA, 18 bp, Homo sapiens
agtgctggctcacagtac

SEQ ID NO: 5224899 - DNA, 16 bp, Homo sapiens
agtgctggctgctggc

SEQ ID NO: 5224900 - DNA, 15 bp, Homo sapiens
agtgctgggaccaga

SEQ ID NO: 5224901 - DNA, 16 bp, Homo sapiens
agtgctgggaccagag

SEQ ID NO: 5224902 - DNA, 18 bp, Homo sapiens
agtgctgggaccagagcc

SEQ ID NO: 5224903 - DNA, 11 bp, Homo sapiens
agtgctgggat

SEQ ID NO: 5224904 - DNA, 22 bp, Homo sapiens
agtgctgggatggaggggagtg

SEQ ID NO: 5224905 - DNA, 19 bp, Homo sapiens
agtgctgggattaaggcgt

SEQ ID NO: 5224906 - DNA, 18 bp, Homo sapiens
agtgctgggattacaggc

SEQ ID NO: 5224907 - DNA, 22 bp, Homo sapiens
agtgctgggattacaggcatga

SEQ ID NO: 5224908 - DNA, 19 bp, Homo sapiens
agtgctgggattacaggtg

SEQ ID NO: 5224909 - DNA, 20 bp, Homo sapiens
agtgctgggattacaggtgt

SEQ ID NO: 5224910 - DNA, 20 bp, Homo sapiens
agtgctgggattaccggcgt

SEQ ID NO: 5224911 - DNA, 24 bp, Homo sapiens
agtgctgggattgtgggcatgagc

SEQ ID NO: 5224912 - DNA, 18 bp, Homo sapiens
agtgctgggcaagtttac

SEQ ID NO: 5224913 - DNA, 18 bp, Homo sapiens
agtgctgggcactgctcc

SEQ ID NO: 5224914 - DNA, 15 bp, Homo sapiens
agtgctgggcccagc

SEQ ID NO: 5224915 - DNA, 15 bp, Homo sapiens
agtgctgggggaggc

SEQ ID NO: 5224916 - DNA, 12 bp, Homo sapiens
agtgctggttct

SEQ ID NO: 5224917 - DNA, 13 bp, Homo sapiens
agtgctgtaatat

SEQ ID NO: 5224918 - DNA, 18 bp, Homo sapiens
agtgctgtaatattgtaa

SEQ ID NO: 5224919 - DNA, 18 bp, Homo sapiens
agtgctgtacccttccac

SEQ ID NO: 5224920 - DNA, 22 bp, Homo sapiens
agtgctgtacccttccacctcc

SEQ ID NO: 5224921 - DNA, 14 bp, Homo sapiens
agtgctgtataaaa

SEQ ID NO: 5224922 - DNA, 22 bp, Homo sapiens
agtgctgtataaaatcagccaa

SEQ ID NO: 5224923 - DNA, 20 bp, Homo sapiens
agtgctgtctgatctgtgct

SEQ ID NO: 5224924 - DNA, 22 bp, Homo sapiens
agtgctgtctgatctgtgcttt

SEQ ID NO: 5224925 - DNA, 18 bp, Homo sapiens
agtgctgtgcaaggtatt

SEQ ID NO: 5224926 - DNA, 20 bp, Homo sapiens
agtgctgtgctgtgtttaat

SEQ ID NO: 5224927 - DNA, 18 bp, Homo sapiens
agtgctgtgttttagtct

SEQ ID NO: 5224928 - DNA, 17 bp, Homo sapiens
agtgctgttctggagct

SEQ ID NO: 5224929 - DNA, 15 bp, Homo sapiens
agtgctgttgaagat

SEQ ID NO: 5224930 - DNA, 23 bp, Homo sapiens
agtgctgttgaagatttgaggac

SEQ ID NO: 5224931 - DNA, 22 bp, Homo sapiens
agtgctgttgggatatagtcaa

SEQ ID NO: 5224932 - DNA, 12 bp, Homo sapiens
agtgctgtttag

SEQ ID NO: 5224933 - DNA, 16 bp, Homo sapiens
agtgctgtttgggcag

SEQ ID NO: 5224934 - DNA, 15 bp, Homo sapiens
agtgctgttttgtta

SEQ ID NO: 5224935 - DNA, 22 bp, Homo sapiens
agtgctgttttgttatataatt

SEQ ID NO: 5224936 - DNA, 14 bp, Homo sapiens
agtgcttaacattt

SEQ ID NO: 5224937 - DNA, 14 bp, Homo sapiens
agtgcttagaaagt

SEQ ID NO: 5224938 - DNA, 22 bp, Homo sapiens
agtgcttagaaagttattgtgt

SEQ ID NO: 5224939 - DNA, 17 bp, Homo sapiens
agtgcttataatgtgtg

SEQ ID NO: 5224940 - DNA, 19 bp, Homo sapiens
agtgcttcaagggtaatct

SEQ ID NO: 5224941 - DNA, 18 bp, Homo sapiens
agtgcttcacaaaatgca

SEQ ID NO: 5224942 - DNA, 18 bp, Homo sapiens
agtaacatgcaacaaaaa

SEQ ID NO: 5224943 - DNA, 21 bp, Homo sapiens
agtaacatgcaacaaaaatgt

SEQ ID NO: 5224944 - DNA, 18 bp, Homo sapiens
agtaacatgcatacttta

SEQ ID NO: 5224945 - DNA, 15 bp, Homo sapiens
agtaacatgccagct

SEQ ID NO: 5224946 - DNA, 18 bp, Homo sapiens
agtaacattctacttgct

SEQ ID NO: 5224947 - DNA, 19 bp, Homo sapiens
agtaacattctacttgctt

SEQ ID NO: 5224948 - DNA, 20 bp, Homo sapiens
agtaaccaaggccctgtctc

SEQ ID NO: 5224949 - DNA, 23 bp, Homo sapiens
agtaaccatcactggttgcactt

SEQ ID NO: 5224950 - DNA, 14 bp, Homo sapiens
agtaaccatttaat

SEQ ID NO: 5224951 - DNA, 14 bp, Homo sapiens
agtaaccatttcag

SEQ ID NO: 5224952 - DNA, 14 bp, Homo sapiens
agtaaccatttgca

SEQ ID NO: 5224953 - DNA, 19 bp, Homo sapiens
agtaaccattttcctttgg

SEQ ID NO: 5224954 - DNA, 15 bp, Homo sapiens
agtaacccctcctgg

SEQ ID NO: 5224955 - DNA, 21 bp, Homo sapiens
agtaaccttttgcacctgctc

SEQ ID NO: 5224956 - DNA, 17 bp, Homo sapiens
agtaacgcgtcttcctg

SEQ ID NO: 5224957 - DNA, 16 bp, Homo sapiens
agtaacgggacagtaa

SEQ ID NO: 5224958 - DNA, 22 bp, Homo sapiens
agtaacgggtcgtaatgactta

SEQ ID NO: 5224959 - DNA, 15 bp, Homo sapiens
agtaacgtgctcact

SEQ ID NO: 5224960 - DNA, 18 bp, Homo sapiens
agtaactaagcacattat

SEQ ID NO: 5224961 - DNA, 19 bp, Homo sapiens
agtaactaagcacattatg

SEQ ID NO: 5224962 - DNA, 22 bp, Homo sapiens
agtaactagtggggcttaatga

SEQ ID NO: 5224963 - DNA, 19 bp, Homo sapiens
agtaactataacaaaaaaa

SEQ ID NO: 5224964 - DNA, 21 bp, Homo sapiens
agtaactataagatacaataa

SEQ ID NO: 5224965 - DNA, 20 bp, Homo sapiens
agtaactcagtgaaggccca

SEQ ID NO: 5224966 - DNA, 12 bp, Homo sapiens
agtaactcattt

SEQ ID NO: 5224967 - DNA, 14 bp, Homo sapiens
agtaactcccactc

SEQ ID NO: 5224968 - DNA, 18 bp, Homo sapiens
agtaactgccattttttg

SEQ ID NO: 5224969 - DNA, 23 bp, Homo sapiens
agtaactgtcaggctgaaaacaa

SEQ ID NO: 5224970 - DNA, 11 bp, Homo sapiens
agtaactgttt

SEQ ID NO: 5224971 - DNA, 16 bp, Homo sapiens
agtaacttaatactct

SEQ ID NO: 5224972 - DNA, 17 bp, Homo sapiens
agtaacttacttaggtg

SEQ ID NO: 5224973 - DNA, 13 bp, Homo sapiens
agtaacttagaaa

SEQ ID NO: 5224974 - DNA, 14 bp, Homo sapiens
agtaacttattttg

SEQ ID NO: 5224975 - DNA, 17 bp, Homo sapiens
agtaacttcttatggaa

SEQ ID NO: 5224976 - DNA, 14 bp, Homo sapiens
agtaacttggcttt

SEQ ID NO: 5224977 - DNA, 17 bp, Homo sapiens
agtaacttggttataca

SEQ ID NO: 5224978 - DNA, 18 bp, Homo sapiens
agtaacttgtcaaggaat

SEQ ID NO: 5224979 - DNA, 17 bp, Homo sapiens
agtaactttatgtgtaa

SEQ ID NO: 5224980 - DNA, 22 bp, Homo sapiens
agtaactttgcgggatatttag

SEQ ID NO: 5224981 - DNA, 14 bp, Homo sapiens
agtaacttttacaa

SEQ ID NO: 5224982 - DNA, 22 bp, Homo sapiens
agtaacttttttgtgtatgtac

SEQ ID NO: 5224983 - DNA, 13 bp, Homo sapiens
agtaagaaaatat

SEQ ID NO: 5224984 - DNA, 14 bp, Homo sapiens
agtaagaaaatatt

SEQ ID NO: 5224985 - DNA, 20 bp, Homo sapiens
agtaagaaagtgaagcaaat

SEQ ID NO: 5224986 - DNA, 18 bp, Homo sapiens
agtaagaaatgggcctca

SEQ ID NO: 5224987 - DNA, 17 bp, Homo sapiens
agtaagaaatttcaggt

SEQ ID NO: 5224988 - DNA, 14 bp, Homo sapiens
agtaagaagacatg

SEQ ID NO: 5224989 - DNA, 19 bp, Homo sapiens
agtaagaagaggagcctca

SEQ ID NO: 5224990 - DNA, 21 bp, Homo sapiens
agtaagaagaggagcctcaga

SEQ ID NO: 5224991 - DNA, 23 bp, Homo sapiens
agtaagaataccacatcaaataa

SEQ ID NO: 5224992 - DNA, 14 bp, Homo sapiens
agtaagaatgcaaa

SEQ ID NO: 5224993 - DNA, 19 bp, Homo sapiens
agtaagaatgtgtgtgcag

SEQ ID NO: 5224994 - DNA, 24 bp, Homo sapiens
agtaagacattgggtctattccag

SEQ ID NO: 5224995 - DNA, 19 bp, Homo sapiens
agtaagaccggaagctcct

SEQ ID NO: 5224996 - DNA, 11 bp, Homo sapiens
agtaagagact

SEQ ID NO: 5224997 - DNA, 19 bp, Homo sapiens
agtaagagctaagttctaa

SEQ ID NO: 5224998 - DNA, 14 bp, Homo sapiens
agtaagagctggtg

SEQ ID NO: 5224999 - DNA, 19 bp, Homo sapiens
agtaagagctggtgtctga

SEQ ID NO: 5225000 - DNA, 14 bp, Homo sapiens
agtaagaggtgtta

SEQ ID NO: 5225001 - DNA, 18 bp, Homo sapiens
agtaagatattatttaaa

SEQ ID NO: 5225002 - DNA, 20 bp, Homo sapiens
agtaagatattatttaaatg

SEQ ID NO: 5225003 - DNA, 14 bp, Homo sapiens
agtaagatcactgt

SEQ ID NO: 5225004 - DNA, 20 bp, Homo sapiens
agtaagatcactgtttagat

SEQ ID NO: 5225005 - DNA, 23 bp, Homo sapiens
agtaagatggttttcaaatcatt

SEQ ID NO: 5225006 - DNA, 18 bp, Homo sapiens
agtaagatgtaaattgaa

SEQ ID NO: 5225007 - DNA, 23 bp, Homo sapiens
agtaagatttacccagaatgtca

SEQ ID NO: 5225008 - DNA, 17 bp, Homo sapiens
agtaagcacctttagaa

SEQ ID NO: 5225009 - DNA, 13 bp, Homo sapiens
agtaagcagtgtt

SEQ ID NO: 5225010 - DNA, 21 bp, Homo sapiens
agtaagcctcatcatcagagc

SEQ ID NO: 5225011 - DNA, 17 bp, Homo sapiens
agtaagcctccctcctc

SEQ ID NO: 5225012 - DNA, 22 bp, Homo sapiens
agtaagcggctcaagcccagga

SEQ ID NO: 5225013 - DNA, 20 bp, Homo sapiens
agtaagctgctctattgtag

SEQ ID NO: 5225014 - DNA, 17 bp, Homo sapiens
agtaagggaaatagaaa

SEQ ID NO: 5225015 - DNA, 19 bp, Homo sapiens
agtaagggaagcagaagga

SEQ ID NO: 5225016 - DNA, 15 bp, Homo sapiens
agtaagggtaaaaaa

SEQ ID NO: 5225017 - DNA, 19 bp, Homo sapiens
agtaagggtaaaaaagata

SEQ ID NO: 5225018 - DNA, 14 bp, Homo sapiens
agtaaggtgcagtt

SEQ ID NO: 5225019 - DNA, 19 bp, Homo sapiens
agtaaggtgcttggagttt

SEQ ID NO: 5225020 - DNA, 16 bp, Homo sapiens
agtaagtaagaaagaa

SEQ ID NO: 5225021 - DNA, 17 bp, Homo sapiens
agtaagtaccactcagg

SEQ ID NO: 5225022 - DNA, 20 bp, Homo sapiens
agtaagtagcaaccctgtga

SEQ ID NO: 5225023 - DNA, 21 bp, Homo sapiens
agtaagtagcaaccctgtgat

SEQ ID NO: 5225024 - DNA, 17 bp, Homo sapiens
agtaagtataacaaact

SEQ ID NO: 5225025 - DNA, 16 bp, Homo sapiens
agtaagtctcaaggta

SEQ ID NO: 5225026 - DNA, 23 bp, Homo sapiens
agtaagtcttgcctatattttcc

SEQ ID NO: 5225027 - DNA, 20 bp, Homo sapiens
agtaagtcttttttttttcc

SEQ ID NO: 5225028 - DNA, 22 bp, Homo sapiens
agtaagtcttttttttttccaa

SEQ ID NO: 5225029 - DNA, 16 bp, Homo sapiens
agtaagtgccttccat

SEQ ID NO: 5225030 - DNA, 14 bp, Homo sapiens
agtaagtgcgaaga

SEQ ID NO: 5225031 - DNA, 17 bp, Homo sapiens
agtaagtgcgaagactg

SEQ ID NO: 5225032 - DNA, 21 bp, Homo sapiens
agtaagtgcgaagactgagcc

SEQ ID NO: 5225033 - DNA, 15 bp, Homo sapiens
agtaagtgtacaatt

SEQ ID NO: 5225034 - DNA, 16 bp, Homo sapiens
agtaagtgtacaattg

SEQ ID NO: 5225035 - DNA, 17 bp, Homo sapiens
agtaagtgtgtcttcct

SEQ ID NO: 5225036 - DNA, 14 bp, Homo sapiens
agtaagttaataat

SEQ ID NO: 5225037 - DNA, 20 bp, Homo sapiens
agtaagttatctttgaatat

SEQ ID NO: 5225038 - DNA, 20 bp, Homo sapiens
agtaagttcatcaaacatgt

SEQ ID NO: 5225039 - DNA, 18 bp, Homo sapiens
agtaagttctgtggttcc

SEQ ID NO: 5225040 - DNA, 17 bp, Homo sapiens
agtaagtttcccctctg

SEQ ID NO: 5225041 - DNA, 23 bp, Homo sapiens
agtaagtttctcatcccatgggc

SEQ ID NO: 5225042 - DNA, 19 bp, Homo sapiens
agtaagtttttttagaaga

SEQ ID NO: 5225043 - DNA, 18 bp, Homo sapiens
agtaataaaaagccacca

SEQ ID NO: 5225044 - DNA, 23 bp, Homo sapiens
agtaataaaacccagcatgtaca

SEQ ID NO: 5225045 - DNA, 17 bp, Homo sapiens
agtaataaactgtgttt

SEQ ID NO: 5225046 - DNA, 14 bp, Homo sapiens
agtaataaagactc

SEQ ID NO: 5225047 - DNA, 13 bp, Homo sapiens
agtaataaagaga

SEQ ID NO: 5225048 - DNA, 19 bp, Homo sapiens
agtaataaagagaaatata

SEQ ID NO: 5225049 - DNA, 16 bp, Homo sapiens
agtaataaatgaatgt

SEQ ID NO: 5225050 - DNA, 12 bp, Homo sapiens
agtaataactga

SEQ ID NO: 5225051 - DNA, 14 bp, Homo sapiens
agtaataactgatg

SEQ ID NO: 5225052 - DNA, 20 bp, Homo sapiens
agtaataatgtaatactgta

SEQ ID NO: 5225053 - DNA, 24 bp, Homo sapiens
agtaataatgtaatactgtagaaa

SEQ ID NO: 5225054 - DNA, 23 bp, Homo sapiens
agtaatacctctaatagtataaa

SEQ ID NO: 5225055 - DNA, 15 bp, Homo sapiens
agtaatactttttaa

SEQ ID NO: 5225056 - DNA, 15 bp, Homo sapiens
agtaatagattgttt

SEQ ID NO: 5225057 - DNA, 16 bp, Homo sapiens
agtaatagctgaacct

SEQ ID NO: 5225058 - DNA, 18 bp, Homo sapiens
agtaataggaccagagcg

SEQ ID NO: 5225059 - DNA, 18 bp, Homo sapiens
agtaataggcattttaag

SEQ ID NO: 5225060 - DNA, 22 bp, Homo sapiens
agtaatatattctgaagcaaca

SEQ ID NO: 5225061 - DNA, 18 bp, Homo sapiens
agtaatatcaaagcattt

SEQ ID NO: 5225062 - DNA, 17 bp, Homo sapiens
agtaatatctttcagtt

SEQ ID NO: 5225063 - DNA, 15 bp, Homo sapiens
agtaatatgcacaca

SEQ ID NO: 5225064 - DNA, 19 bp, Homo sapiens
agtaatatgcacacatttt

SEQ ID NO: 5225065 - DNA, 20 bp, Homo sapiens
agtaatatgcacacattttt

SEQ ID NO: 5225066 - DNA, 13 bp, Homo sapiens
agtaatatgttta

SEQ ID NO: 5225067 - DNA, 18 bp, Homo sapiens
agtaatattacatttcat

SEQ ID NO: 5225068 - DNA, 20 bp, Homo sapiens
agtaatattacatttcattt

SEQ ID NO: 5225069 - DNA, 16 bp, Homo sapiens
agtaatatttaaagat

SEQ ID NO: 5225070 - DNA, 13 bp, Homo sapiens
agtaatatttatt

SEQ ID NO: 5225071 - DNA, 15 bp, Homo sapiens
agtaatcaataaaga

SEQ ID NO: 5225072 - DNA, 18 bp, Homo sapiens
agtaatcaataaagaaaa

SEQ ID NO: 5225073 - DNA, 15 bp, Homo sapiens
agtaatcaatacaga

SEQ ID NO: 5225074 - DNA, 13 bp, Homo sapiens
agtaatcacttaa

SEQ ID NO: 5225075 - DNA, 14 bp, Homo sapiens
agtaatcaggcagc

SEQ ID NO: 5225076 - DNA, 15 bp, Homo sapiens
agtaatcatactcaa

SEQ ID NO: 5225077 - DNA, 21 bp, Homo sapiens
agtaatcatgttttaatgtag

SEQ ID NO: 5225078 - DNA, 22 bp, Homo sapiens
agtaatcatgttttaatgtaga

SEQ ID NO: 5225079 - DNA, 15 bp, Homo sapiens
agtaatccaagcaaa

SEQ ID NO: 5225080 - DNA, 21 bp, Homo sapiens
agtaatccaagcaaatgtgaa

SEQ ID NO: 5225081 - DNA, 11 bp, Homo sapiens
agtaatcccag

SEQ ID NO: 5225082 - DNA, 15 bp, Homo sapiens
agtaatcccatttcc

SEQ ID NO: 5225083 - DNA, 19 bp, Homo sapiens
agtaatcccgccacctatc

SEQ ID NO: 5225084 - DNA, 20 bp, Homo sapiens
agtaatctgagaaacaatga

SEQ ID NO: 5225085 - DNA, 19 bp, Homo sapiens
agtaatctgatcgttcttt

SEQ ID NO: 5225086 - DNA, 23 bp, Homo sapiens
agtaatctgcattattggaatat

SEQ ID NO: 5225087 - DNA, 13 bp, Homo sapiens
agtaatctgtaca

SEQ ID NO: 5225088 - DNA, 15 bp, Homo sapiens
agtaatctgtacatt

SEQ ID NO: 5225089 - DNA, 19 bp, Homo sapiens
agtaatctgtacattttgt

SEQ ID NO: 5225090 - DNA, 15 bp, Homo sapiens
agtaatctgtataat

SEQ ID NO: 5225091 - DNA, 14 bp, Homo sapiens
agtaatctttttac

SEQ ID NO: 5225092 - DNA, 15 bp, Homo sapiens
agtaatctttttaca

SEQ ID NO: 5225093 - DNA, 21 bp, Homo sapiens
agtaatctttttacagttgca

SEQ ID NO: 5225094 - DNA, 21 bp, Homo sapiens
agtaatgaaggcatatttcca

SEQ ID NO: 5225095 - DNA, 12 bp, Homo sapiens
agtaatgaattt

SEQ ID NO: 5225096 - DNA, 22 bp, Homo sapiens
agtaatgaattttatgtgacta

SEQ ID NO: 5225097 - DNA, 21 bp, Homo sapiens
agtaatgaatttttatgatat

SEQ ID NO: 5225098 - DNA, 17 bp, Homo sapiens
agtaatgagcttaagaa

SEQ ID NO: 5225099 - DNA, 17 bp, Homo sapiens
agtaatgagtttaaaaa

SEQ ID NO: 5225100 - DNA, 17 bp, Homo sapiens
agtaatgataactggaa

SEQ ID NO: 5225101 - DNA, 20 bp, Homo sapiens
agtaatgataactggaaact

SEQ ID NO: 5225102 - DNA, 17 bp, Homo sapiens
agtaatgatactgtgtg

SEQ ID NO: 5225103 - DNA, 22 bp, Homo sapiens
agtaatgatactgtgtgttttc

SEQ ID NO: 5225104 - DNA, 16 bp, Homo sapiens
agtaatgatatttatt

SEQ ID NO: 5225105 - DNA, 14 bp, Homo sapiens
agtaatgatgaaat

SEQ ID NO: 5225106 - DNA, 22 bp, Homo sapiens
agtaatgatgaaatctttcttt

SEQ ID NO: 5225107 - DNA, 13 bp, Homo sapiens
agtaatgatttct

SEQ ID NO: 5225108 - DNA, 20 bp, Homo sapiens
agtaatgcctctgtctagca

SEQ ID NO: 5225109 - DNA, 19 bp, Homo sapiens
agtaatgggccaattaaaa

SEQ ID NO: 5225110 - DNA, 20 bp, Homo sapiens
agtaatgggccaattaaaat

SEQ ID NO: 5225111 - DNA, 21 bp, Homo sapiens
agtaatgggccaattaaaata

SEQ ID NO: 5225112 - DNA, 22 bp, Homo sapiens
agtaatgggtttcatatttctt

SEQ ID NO: 5225113 - DNA, 18 bp, Homo sapiens
agtaatggtgtagaacac

SEQ ID NO: 5225114 - DNA, 16 bp, Homo sapiens
agtaatgtagaaatgt

SEQ ID NO: 5225115 - DNA, 18 bp, Homo sapiens
agtaatgtagaaatgttt

SEQ ID NO: 5225116 - DNA, 15 bp, Homo sapiens
agtaatgtatatctg

SEQ ID NO: 5225117 - DNA, 23 bp, Homo sapiens
agtaatgtcataaagtgagaaaa

SEQ ID NO: 5225118 - DNA, 18 bp, Homo sapiens
agtaatgtggaagaaaat

SEQ ID NO: 5225119 - DNA, 14 bp, Homo sapiens
agtgcttcacattt

SEQ ID NO: 5225120 - DNA, 16 bp, Homo sapiens
agtgcttcacatttgt

SEQ ID NO: 5225121 - DNA, 23 bp, Homo sapiens
agtgcttcagagtttgtgtgtat

SEQ ID NO: 5225122 - DNA, 14 bp, Homo sapiens
agtgcttcagcctg

SEQ ID NO: 5225123 - DNA, 15 bp, Homo sapiens
agtgcttcagcctga

SEQ ID NO: 5225124 - DNA, 20 bp, Homo sapiens
agtgcttcagcctgaggctg

SEQ ID NO: 5225125 - DNA, 16 bp, Homo sapiens
agtgcttccaaggcag

SEQ ID NO: 5225126 - DNA, 12 bp, Homo sapiens
agtgcttccttt

SEQ ID NO: 5225127 - DNA, 19 bp, Homo sapiens
agtgcttctccaacactga

SEQ ID NO: 5225128 - DNA, 14 bp, Homo sapiens
agtgcttcttgtaa

SEQ ID NO: 5225129 - DNA, 16 bp, Homo sapiens
agtgcttcttgtaata

SEQ ID NO: 5225130 - DNA, 18 bp, Homo sapiens
agtgcttcttgtaatatt

SEQ ID NO: 5225131 - DNA, 14 bp, Homo sapiens
agtgcttgaggcca

SEQ ID NO: 5225132 - DNA, 23 bp, Homo sapiens
agtgcttgcagatcatctgggga

SEQ ID NO: 5225133 - DNA, 20 bp, Homo sapiens
agtgcttgcatcctatttgg

SEQ ID NO: 5225134 - DNA, 21 bp, Homo sapiens
agtgcttgcatcctatttggt

SEQ ID NO: 5225135 - DNA, 22 bp, Homo sapiens
agtgcttgccaccaccagatga

SEQ ID NO: 5225136 - DNA, 23 bp, Homo sapiens
agtgcttgctgttcccatccctg

SEQ ID NO: 5225137 - DNA, 13 bp, Homo sapiens
agtgcttgctttt

SEQ ID NO: 5225138 - DNA, 17 bp, Homo sapiens
agtgcttgcttttcatg

SEQ ID NO: 5225139 - DNA, 22 bp, Homo sapiens
agtgcttggaacatactgttca

SEQ ID NO: 5225140 - DNA, 13 bp, Homo sapiens
agtgcttggcaca

SEQ ID NO: 5225141 - DNA, 18 bp, Homo sapiens
agtgcttggcacatagtg

SEQ ID NO: 5225142 - DNA, 16 bp, Homo sapiens
agtgcttggcccagga

SEQ ID NO: 5225143 - DNA, 19 bp, Homo sapiens
agtgcttggcccaggagtt

SEQ ID NO: 5225144 - DNA, 19 bp, Homo sapiens
agtgcttggctgccccaca

SEQ ID NO: 5225145 - DNA, 22 bp, Homo sapiens
agtgcttgggggtttttgaagt

SEQ ID NO: 5225146 - DNA, 21 bp, Homo sapiens
agtgcttgtatagcttttatc

SEQ ID NO: 5225147 - DNA, 23 bp, Homo sapiens
agtgcttgtatagcttttatctg

SEQ ID NO: 5225148 - DNA, 19 bp, Homo sapiens
agtgcttgttagagagaaa

SEQ ID NO: 5225149 - DNA, 20 bp, Homo sapiens
agtgcttgttagagagaaag

SEQ ID NO: 5225150 - DNA, 21 bp, Homo sapiens
agtgcttgttagagagaaaga

SEQ ID NO: 5225151 - DNA, 19 bp, Homo sapiens
agtgctttaagaatgaaca

SEQ ID NO: 5225152 - DNA, 23 bp, Homo sapiens
agtgctttacatgctgtgctctt

SEQ ID NO: 5225153 - DNA, 23 bp, Homo sapiens
agtgctttacctaagtgttgatt

SEQ ID NO: 5225154 - DNA, 21 bp, Homo sapiens
agtgctttatactgaacgtgg

SEQ ID NO: 5225155 - DNA, 15 bp, Homo sapiens
agtgctttattttgt

SEQ ID NO: 5225156 - DNA, 23 bp, Homo sapiens
agtgctttctttccgtcaccctg

SEQ ID NO: 5225157 - DNA, 12 bp, Homo sapiens
agtgctttgccc

SEQ ID NO: 5225158 - DNA, 13 bp, Homo sapiens
agtgctttgtgat

SEQ ID NO: 5225159 - DNA, 20 bp, Homo sapiens
agtgcttttaaaaattttgt

SEQ ID NO: 5225160 - DNA, 22 bp, Homo sapiens
agtgcttttaaactggagaggc

SEQ ID NO: 5225161 - DNA, 15 bp, Homo sapiens
agtggaaaaaagaga

SEQ ID NO: 5225162 - DNA, 20 bp, Homo sapiens
agtggaaaaaagagaaaaac

SEQ ID NO: 5225163 - DNA, 12 bp, Homo sapiens
agtggaaaaaca

SEQ ID NO: 5225164 - DNA, 13 bp, Homo sapiens
agtggaaaaacac

SEQ ID NO: 5225165 - DNA, 14 bp, Homo sapiens
agtggaaaaacaca

SEQ ID NO: 5225166 - DNA, 21 bp, Homo sapiens
agtggaaaaagaaattctgtt

SEQ ID NO: 5225167 - DNA, 17 bp, Homo sapiens
agtggaaaaatcagaag

SEQ ID NO: 5225168 - DNA, 19 bp, Homo sapiens
agtggaaaaatcagaagca

SEQ ID NO: 5225169 - DNA, 13 bp, Homo sapiens
agtggaaaacaaa

SEQ ID NO: 5225170 - DNA, 14 bp, Homo sapiens
agtggaaaaggcac

SEQ ID NO: 5225171 - DNA, 18 bp, Homo sapiens
agtggaaaggatcacaga

SEQ ID NO: 5225172 - DNA, 14 bp, Homo sapiens
agtggaaagtcagg

SEQ ID NO: 5225173 - DNA, 14 bp, Homo sapiens
agtggaaagtcctg

SEQ ID NO: 5225174 - DNA, 22 bp, Homo sapiens
agtggaacacaaatgaaaatga

SEQ ID NO: 5225175 - DNA, 15 bp, Homo sapiens
agtggaacattttca

SEQ ID NO: 5225176 - DNA, 22 bp, Homo sapiens
agtggaactcaatatatagtta

SEQ ID NO: 5225177 - DNA, 13 bp, Homo sapiens
agtggaagaaaca

SEQ ID NO: 5225178 - DNA, 15 bp, Homo sapiens
agtggaagacagaga

SEQ ID NO: 5225179 - DNA, 17 bp, Homo sapiens
agtggaagacagagatg

SEQ ID NO: 5225180 - DNA, 15 bp, Homo sapiens
agtggaagagcagcc

SEQ ID NO: 5225181 - DNA, 22 bp, Homo sapiens
agtggaagagcagcctgatggc

SEQ ID NO: 5225182 - DNA, 22 bp, Homo sapiens
agtggaagatttcttgactatt

SEQ ID NO: 5225183 - DNA, 13 bp, Homo sapiens
agtggaagccact

SEQ ID NO: 5225184 - DNA, 17 bp, Homo sapiens
agtggaagccactggac

SEQ ID NO: 5225185 - DNA, 13 bp, Homo sapiens
agtggaaggaaag

SEQ ID NO: 5225186 - DNA, 21 bp, Homo sapiens
agtggaagtatgtatattaaa

SEQ ID NO: 5225187 - DNA, 16 bp, Homo sapiens
agtggaagttcttcaa

SEQ ID NO: 5225188 - DNA, 18 bp, Homo sapiens
agtggaagttcttcaaga

SEQ ID NO: 5225189 - DNA, 22 bp, Homo sapiens
agtggaatagatgtctcaaaaa

SEQ ID NO: 5225190 - DNA, 23 bp, Homo sapiens
agtggaatagtatcctccaggtt

SEQ ID NO: 5225191 - DNA, 22 bp, Homo sapiens
agtggaatagtgaatacttact

SEQ ID NO: 5225192 - DNA, 22 bp, Homo sapiens
agtggaatccagtgtggctccc

SEQ ID NO: 5225193 - DNA, 22 bp, Homo sapiens
agtggaatcctatatagaatgc

SEQ ID NO: 5225194 - DNA, 15 bp, Homo sapiens
agtggaatgcaggga

SEQ ID NO: 5225195 - DNA, 19 bp, Homo sapiens
agtggaatgcagggaagag

SEQ ID NO: 5225196 - DNA, 14 bp, Homo sapiens
agtggaatttcttg

SEQ ID NO: 5225197 - DNA, 17 bp, Homo sapiens
agtggaatttcttgttt

SEQ ID NO: 5225198 - DNA, 19 bp, Homo sapiens
agtggacaaattttgagtt

SEQ ID NO: 5225199 - DNA, 15 bp, Homo sapiens
agtggacagagggag

SEQ ID NO: 5225200 - DNA, 14 bp, Homo sapiens
agtggacagcagct

SEQ ID NO: 5225201 - DNA, 20 bp, Homo sapiens
agtggacagcagctggactg

SEQ ID NO: 5225202 - DNA, 13 bp, Homo sapiens
agtggacaggagt

SEQ ID NO: 5225203 - DNA, 21 bp, Homo sapiens
agtggacatcgtaggcagcca

SEQ ID NO: 5225204 - DNA, 23 bp, Homo sapiens
agtggacatcgtaggcagccacg

SEQ ID NO: 5225205 - DNA, 17 bp, Homo sapiens
agtggacatggtcacag

SEQ ID NO: 5225206 - DNA, 13 bp, Homo sapiens
agtggaccaggac

SEQ ID NO: 5225207 - DNA, 19 bp, Homo sapiens
agtggacccgcccgcggcc

SEQ ID NO: 5225208 - DNA, 17 bp, Homo sapiens
agtggaccctgaaatgt

SEQ ID NO: 5225209 - DNA, 21 bp, Homo sapiens
agtggaccctgaaatgtgtgt

SEQ ID NO: 5225210 - DNA, 13 bp, Homo sapiens
agtggaccctgtg

SEQ ID NO: 5225211 - DNA, 20 bp, Homo sapiens
agtggaccgaaatctgtatt

SEQ ID NO: 5225212 - DNA, 16 bp, Homo sapiens
agtggaccgccctttt

SEQ ID NO: 5225213 - DNA, 21 bp, Homo sapiens
agtggaccgcccttttcccct

SEQ ID NO: 5225214 - DNA, 20 bp, Homo sapiens
agtggaccttaggccttcct

SEQ ID NO: 5225215 - DNA, 19 bp, Homo sapiens
agtggacgttaggccaggc

SEQ ID NO: 5225216 - DNA, 17 bp, Homo sapiens
agtggactcagcagtga

SEQ ID NO: 5225217 - DNA, 13 bp, Homo sapiens
agtggactcaggg

SEQ ID NO: 5225218 - DNA, 16 bp, Homo sapiens
agtggactcagtgggt

SEQ ID NO: 5225219 - DNA, 19 bp, Homo sapiens
agtggactcgcgagagggt

SEQ ID NO: 5225220 - DNA, 16 bp, Homo sapiens
agtggactctctgaca

SEQ ID NO: 5225221 - DNA, 18 bp, Homo sapiens
agtggactctctgacaaa

SEQ ID NO: 5225222 - DNA, 22 bp, Homo sapiens
agtggactctctgacaaagtgg

SEQ ID NO: 5225223 - DNA, 15 bp, Homo sapiens
agtggactcttccct

SEQ ID NO: 5225224 - DNA, 21 bp, Homo sapiens
agtggactcttccctctcgct

SEQ ID NO: 5225225 - DNA, 22 bp, Homo sapiens
agtggactcttccctctcgctc

SEQ ID NO: 5225226 - DNA, 17 bp, Homo sapiens
agtggactggcccctgg

SEQ ID NO: 5225227 - DNA, 15 bp, Homo sapiens
agtggactgtatttc

SEQ ID NO: 5225228 - DNA, 16 bp, Homo sapiens
agtggactgtgtccct

SEQ ID NO: 5225229 - DNA, 15 bp, Homo sapiens
agtggactttccacc

SEQ ID NO: 5225230 - DNA, 22 bp, Homo sapiens
agtggactttccaccccctccc

SEQ ID NO: 5225231 - DNA, 12 bp, Homo sapiens
agtggagaaatg

SEQ ID NO: 5225232 - DNA, 21 bp, Homo sapiens
agtggagacagtcctttccca

SEQ ID NO: 5225233 - DNA, 14 bp, Homo sapiens
agtggagagggcta

SEQ ID NO: 5225234 - DNA, 13 bp, Homo sapiens
agtggagccctca

SEQ ID NO: 5225235 - DNA, 13 bp, Homo sapiens
agtggagctgaat

SEQ ID NO: 5225236 - DNA, 13 bp, Homo sapiens
agtggagctggtc

SEQ ID NO: 5225237 - DNA, 16 bp, Homo sapiens
agtggagctggtctgc

SEQ ID NO: 5225238 - DNA, 19 bp, Homo sapiens
agtggagctgtctgtctct

SEQ ID NO: 5225239 - DNA, 13 bp, Homo sapiens
agtggagcttttg

SEQ ID NO: 5225240 - DNA, 10 bp, Homo sapiens
agtggaggaa

SEQ ID NO: 5225241 - DNA, 18 bp, Homo sapiens
agtggaggaaatgttgga

SEQ ID NO: 5225242 - DNA, 12 bp, Homo sapiens
agtggaggaagc

SEQ ID NO: 5225243 - DNA, 23 bp, Homo sapiens
agtggaggaggtggcttcatgtg

SEQ ID NO: 5225244 - DNA, 13 bp, Homo sapiens
agtggaggcattg

SEQ ID NO: 5225245 - DNA, 14 bp, Homo sapiens
agtggaggctgctg

SEQ ID NO: 5225246 - DNA, 16 bp, Homo sapiens
agtggaggctgctgtg

SEQ ID NO: 5225247 - DNA, 13 bp, Homo sapiens
agtggaggctggc

SEQ ID NO: 5225248 - DNA, 21 bp, Homo sapiens
agtggaggctggcagggtccc

SEQ ID NO: 5225249 - DNA, 20 bp, Homo sapiens
agtggagggagactgaccca

SEQ ID NO: 5225250 - DNA, 17 bp, Homo sapiens
agtggaggggtcagcag

SEQ ID NO: 5225251 - DNA, 23 bp, Homo sapiens
agtggaggggtcagcaggggggt

SEQ ID NO: 5225252 - DNA, 23 bp, Homo sapiens
agtggagggttgagatgtagagt

SEQ ID NO: 5225253 - DNA, 14 bp, Homo sapiens
agtggaggtgctgc

SEQ ID NO: 5225254 - DNA, 23 bp, Homo sapiens
agtggaggtgggctgggccctct

SEQ ID NO: 5225255 - DNA, 17 bp, Homo sapiens
agtggaggtttatagtt

SEQ ID NO: 5225256 - DNA, 14 bp, Homo sapiens
agtggagtctgagt

SEQ ID NO: 5225257 - DNA, 19 bp, Homo sapiens
agtggagtctgagtctgag

SEQ ID NO: 5225258 - DNA, 20 bp, Homo sapiens
agtggagtctgccacccagg

SEQ ID NO: 5225259 - DNA, 15 bp, Homo sapiens
agtggagtgagatct

SEQ ID NO: 5225260 - DNA, 15 bp, Homo sapiens
agtggagttactgaa

SEQ ID NO: 5225261 - DNA, 20 bp, Homo sapiens
agtggagttgaaactgctat

SEQ ID NO: 5225262 - DNA, 17 bp, Homo sapiens
agtggagttgactctgg

SEQ ID NO: 5225263 - DNA, 18 bp, Homo sapiens
agtggagtttccaacaga

SEQ ID NO: 5225264 - DNA, 17 bp, Homo sapiens
agtggagttttataaat

SEQ ID NO: 5225265 - DNA, 20 bp, Homo sapiens
agtggatccagcttcactgt

SEQ ID NO: 5225266 - DNA, 13 bp, Homo sapiens
agtggatctggag

SEQ ID NO: 5225267 - DNA, 21 bp, Homo sapiens
agtggatctggagtctgaagg

SEQ ID NO: 5225268 - DNA, 22 bp, Homo sapiens
agtggatcttcagaactgccct

SEQ ID NO: 5225269 - DNA, 16 bp, Homo sapiens
agtggatgactgttga

SEQ ID NO: 5225270 - DNA, 15 bp, Homo sapiens
agtggatgctgtgct

SEQ ID NO: 5225271 - DNA, 18 bp, Homo sapiens
agtggatggacagatgga

SEQ ID NO: 5225272 - DNA, 21 bp, Homo sapiens
agtggatggaggagaaataaa

SEQ ID NO: 5225273 - DNA, 15 bp, Homo sapiens
agtggatggatggac

SEQ ID NO: 5225274 - DNA, 19 bp, Homo sapiens
agtggatggatggacagaa

SEQ ID NO: 5225275 - DNA, 14 bp, Homo sapiens
agtggatggcccag

SEQ ID NO: 5225276 - DNA, 16 bp, Homo sapiens
agtggatggcccagca

SEQ ID NO: 5225277 - DNA, 19 bp, Homo sapiens
agtggatggcccagcaggc

SEQ ID NO: 5225278 - DNA, 18 bp, Homo sapiens
agtggatgggaatttgtc

SEQ ID NO: 5225279 - DNA, 12 bp, Homo sapiens
agtggatgtata

SEQ ID NO: 5225280 - DNA, 21 bp, Homo sapiens
agtggatgtttttaatgacca

SEQ ID NO: 5225281 - DNA, 16 bp, Homo sapiens
agtggattcctcccca

SEQ ID NO: 5225282 - DNA, 17 bp, Homo sapiens
agtggattctggatggc

SEQ ID NO: 5225283 - DNA, 15 bp, Homo sapiens
agtggcaaaaaagaa

SEQ ID NO: 5225284 - DNA, 17 bp, Homo sapiens
agtggcaaaaaagaaca

SEQ ID NO: 5225285 - DNA, 18 bp, Homo sapiens
agtggcaaaaaagaacag

SEQ ID NO: 5225286 - DNA, 13 bp, Homo sapiens
agtggcaaaatat

SEQ ID NO: 5225287 - DNA, 19 bp, Homo sapiens
agtggcaaaatattatgtt

SEQ ID NO: 5225288 - DNA, 21 bp, Homo sapiens
agtggcaaaatattatgttat

SEQ ID NO: 5225289 - DNA, 23 bp, Homo sapiens
agtggcaaaatattatgttatga

SEQ ID NO: 5225290 - DNA, 22 bp, Homo sapiens
agtggcaaaggatccagatagc

SEQ ID NO: 5225291 - DNA, 23 bp, Homo sapiens
agtggcaagaccaaaatgacaat

SEQ ID NO: 5225292 - DNA, 12 bp, Homo sapiens
agtggcaagcta

SEQ ID NO: 5225293 - DNA, 12 bp, Homo sapiens
agtggcacagga

SEQ ID NO: 5225294 - DNA, 13 bp, Homo sapiens
agtggcacctgtc

SEQ ID NO: 5225295 - DNA, 22 bp, Homo sapiens
agtggcacctgtctgctccagc

SEQ ID NO: 5225296 - DNA, 20 bp, Homo sapiens
agtggcactaaaatgtttaa

SEQ ID NO: 5225297 - DNA, 23 bp, Homo sapiens
agtaatgtggaagaaaatggttt

SEQ ID NO: 5225298 - DNA, 20 bp, Homo sapiens
agtaatgttaaacaccattt

SEQ ID NO: 5225299 - DNA, 14 bp, Homo sapiens
agtaatgtttttta

SEQ ID NO: 5225300 - DNA, 16 bp, Homo sapiens
agtaatgttttttaga

SEQ ID NO: 5225301 - DNA, 23 bp, Homo sapiens
agtaattaaggtacatcattatt

SEQ ID NO: 5225302 - DNA, 15 bp, Homo sapiens
agtaattaataaaga

SEQ ID NO: 5225303 - DNA, 19 bp, Homo sapiens
agtaattaataaagaaaaa

SEQ ID NO: 5225304 - DNA, 14 bp, Homo sapiens
agtaattactttca

SEQ ID NO: 5225305 - DNA, 19 bp, Homo sapiens
agtaattaggataactaaa

SEQ ID NO: 5225306 - DNA, 20 bp, Homo sapiens
agtaattagtagaaatgcca

SEQ ID NO: 5225307 - DNA, 13 bp, Homo sapiens
agtaattatagga

SEQ ID NO: 5225308 - DNA, 14 bp, Homo sapiens
agtaattataggaa

SEQ ID NO: 5225309 - DNA, 20 bp, Homo sapiens
agtaattatcgggaacagtg

SEQ ID NO: 5225310 - DNA, 19 bp, Homo sapiens
agtaattatgcactaaata

SEQ ID NO: 5225311 - DNA, 19 bp, Homo sapiens
agtaattattatttaactc

SEQ ID NO: 5225312 - DNA, 15 bp, Homo sapiens
agtaattcaactgga

SEQ ID NO: 5225313 - DNA, 18 bp, Homo sapiens
agtaattcaactggaaat

SEQ ID NO: 5225314 - DNA, 15 bp, Homo sapiens
agtaattcaagaaaa

SEQ ID NO: 5225315 - DNA, 19 bp, Homo sapiens
agtaattcaagaaaacaac

SEQ ID NO: 5225316 - DNA, 20 bp, Homo sapiens
agtaattcaagcctctaaac

SEQ ID NO: 5225317 - DNA, 21 bp, Homo sapiens
agtaattcaagcctctaaaca

SEQ ID NO: 5225318 - DNA, 13 bp, Homo sapiens
agtaattcttctg

SEQ ID NO: 5225319 - DNA, 15 bp, Homo sapiens
agtaattcttttctg

SEQ ID NO: 5225320 - DNA, 18 bp, Homo sapiens
agtaattgacatgtgcca

SEQ ID NO: 5225321 - DNA, 22 bp, Homo sapiens
agtaattgcatttgcttttgta

SEQ ID NO: 5225322 - DNA, 18 bp, Homo sapiens
agtaattgccacagctgt

SEQ ID NO: 5225323 - DNA, 23 bp, Homo sapiens
agtaattgccagcttttatacca

SEQ ID NO: 5225324 - DNA, 12 bp, Homo sapiens
agtaattggaaa

SEQ ID NO: 5225325 - DNA, 19 bp, Homo sapiens
agtaattgggaaaaaagca

SEQ ID NO: 5225326 - DNA, 15 bp, Homo sapiens
agtaattgtgaaaaa

SEQ ID NO: 5225327 - DNA, 22 bp, Homo sapiens
agtaattgtgtttacattttat

SEQ ID NO: 5225328 - DNA, 22 bp, Homo sapiens
agtaattgttatttattcttta

SEQ ID NO: 5225329 - DNA, 13 bp, Homo sapiens
agtaatttaaatg

SEQ ID NO: 5225330 - DNA, 22 bp, Homo sapiens
agtaatttaatttgtaaaactt

SEQ ID NO: 5225331 - DNA, 19 bp, Homo sapiens
agtaatttacaaacctctc

SEQ ID NO: 5225332 - DNA, 12 bp, Homo sapiens
agtaatttagaa

SEQ ID NO: 5225333 - DNA, 10 bp, Homo sapiens
agtaatttat

SEQ ID NO: 5225334 - DNA, 11 bp, Homo sapiens
agtaatttata

SEQ ID NO: 5225335 - DNA, 15 bp, Homo sapiens
agtaatttatataga

SEQ ID NO: 5225336 - DNA, 22 bp, Homo sapiens
agtaatttcaagaatgtttcag

SEQ ID NO: 5225337 - DNA, 18 bp, Homo sapiens
agtaatttcatgcacaca

SEQ ID NO: 5225338 - DNA, 14 bp, Homo sapiens
agtaatttcattta

SEQ ID NO: 5225339 - DNA, 12 bp, Homo sapiens
agtaatttcctt

SEQ ID NO: 5225340 - DNA, 14 bp, Homo sapiens
agtaatttcttttt

SEQ ID NO: 5225341 - DNA, 14 bp, Homo sapiens
agtaatttggaaat

SEQ ID NO: 5225342 - DNA, 21 bp, Homo sapiens
agtaatttgggaaaagaagct

SEQ ID NO: 5225343 - DNA, 18 bp, Homo sapiens
agtaatttgtaaaaaaga

SEQ ID NO: 5225344 - DNA, 14 bp, Homo sapiens
agtaatttgtaaag

SEQ ID NO: 5225345 - DNA, 23 bp, Homo sapiens
agtaattttcatattaaacaaaa

SEQ ID NO: 5225346 - DNA, 14 bp, Homo sapiens
agtaattttcttct

SEQ ID NO: 5225347 - DNA, 17 bp, Homo sapiens
agtaattttcttctcat

SEQ ID NO: 5225348 - DNA, 20 bp, Homo sapiens
agtaattttcttctcattct

SEQ ID NO: 5225349 - DNA, 14 bp, Homo sapiens
agtaattttgtcac

SEQ ID NO: 5225350 - DNA, 20 bp, Homo sapiens
agtaattttgtcacattatt

SEQ ID NO: 5225351 - DNA, 21 bp, Homo sapiens
agtaattttgtcacattattt

SEQ ID NO: 5225352 - DNA, 22 bp, Homo sapiens
agtacaaaaaattagccagtca

SEQ ID NO: 5225353 - DNA, 14 bp, Homo sapiens
agtacaaaattgcc

SEQ ID NO: 5225354 - DNA, 17 bp, Homo sapiens
agtacaaacatgaaaaa

SEQ ID NO: 5225355 - DNA, 15 bp, Homo sapiens
agtacaaatgaagaa

SEQ ID NO: 5225356 - DNA, 16 bp, Homo sapiens
agtacaaatgccttaa

SEQ ID NO: 5225357 - DNA, 23 bp, Homo sapiens
agtacaaatgccttaaaatggaa

SEQ ID NO: 5225358 - DNA, 20 bp, Homo sapiens
agtacaagctcttgtttctg

SEQ ID NO: 5225359 - DNA, 21 bp, Homo sapiens
agtacaagtggtaatttttgt

SEQ ID NO: 5225360 - DNA, 22 bp, Homo sapiens
agtacaagtggtaatttttgta

SEQ ID NO: 5225361 - DNA, 14 bp, Homo sapiens
agtacaataatgta

SEQ ID NO: 5225362 - DNA, 18 bp, Homo sapiens
agtacaataatgtactca

SEQ ID NO: 5225363 - DNA, 19 bp, Homo sapiens
agtacaatagtatacattt

SEQ ID NO: 5225364 - DNA, 17 bp, Homo sapiens
agtacaatgaactgctt

SEQ ID NO: 5225365 - DNA, 17 bp, Homo sapiens
agtacaatgtgtttttc

SEQ ID NO: 5225366 - DNA, 14 bp, Homo sapiens
agtacaatgtttca

SEQ ID NO: 5225367 - DNA, 15 bp, Homo sapiens
agtacaattcttact

SEQ ID NO: 5225368 - DNA, 14 bp, Homo sapiens
agtacaattctttg

SEQ ID NO: 5225369 - DNA, 22 bp, Homo sapiens
agtacacaataagcaaaaacaa

SEQ ID NO: 5225370 - DNA, 14 bp, Homo sapiens
agtacactcagcca

SEQ ID NO: 5225371 - DNA, 14 bp, Homo sapiens
agtacactctgctg

SEQ ID NO: 5225372 - DNA, 13 bp, Homo sapiens
agtacactgagag

SEQ ID NO: 5225373 - DNA, 17 bp, Homo sapiens
agtacactgcctgcctt

SEQ ID NO: 5225374 - DNA, 18 bp, Homo sapiens
agtacactgtgtctctat

SEQ ID NO: 5225375 - DNA, 20 bp, Homo sapiens
agtacactgtttcaaacttt

SEQ ID NO: 5225376 - DNA, 23 bp, Homo sapiens
agtacactgtttcaaactttact

SEQ ID NO: 5225377 - DNA, 14 bp, Homo sapiens
agtacagaaggcaa

SEQ ID NO: 5225378 - DNA, 16 bp, Homo sapiens
agtacagaattcaaca

SEQ ID NO: 5225379 - DNA, 15 bp, Homo sapiens
agtacagaattggat

SEQ ID NO: 5225380 - DNA, 17 bp, Homo sapiens
agtacagaatttgaatt

SEQ ID NO: 5225381 - DNA, 21 bp, Homo sapiens
agtacagacgtctcaagactg

SEQ ID NO: 5225382 - DNA, 13 bp, Homo sapiens
agtacagactgca

SEQ ID NO: 5225383 - DNA, 21 bp, Homo sapiens
agtacagagaaattctgtggt

SEQ ID NO: 5225384 - DNA, 13 bp, Homo sapiens
agtacagagaagc

SEQ ID NO: 5225385 - DNA, 14 bp, Homo sapiens
agtacagatactgt

SEQ ID NO: 5225386 - DNA, 17 bp, Homo sapiens
agtacagatactgtgag

SEQ ID NO: 5225387 - DNA, 19 bp, Homo sapiens
agtacagatactgtgagct

SEQ ID NO: 5225388 - DNA, 15 bp, Homo sapiens
agtacagcctggacc

SEQ ID NO: 5225389 - DNA, 21 bp, Homo sapiens
agtacagcggctcccctctgc

SEQ ID NO: 5225390 - DNA, 12 bp, Homo sapiens
agtacagctatt

SEQ ID NO: 5225391 - DNA, 18 bp, Homo sapiens
agtacaggcagcacagag

SEQ ID NO: 5225392 - DNA, 17 bp, Homo sapiens
agtacagggcaggagct

SEQ ID NO: 5225393 - DNA, 20 bp, Homo sapiens
agtacaggtactttgtctaa

SEQ ID NO: 5225394 - DNA, 21 bp, Homo sapiens
agtacaggtcatctgctggga

SEQ ID NO: 5225395 - DNA, 19 bp, Homo sapiens
agtacagtagcttaaataa

SEQ ID NO: 5225396 - DNA, 16 bp, Homo sapiens
agtacagtattctttt

SEQ ID NO: 5225397 - DNA, 13 bp, Homo sapiens
agtacagtggtgc

SEQ ID NO: 5225398 - DNA, 22 bp, Homo sapiens
agtacagtggttctacaatcta

SEQ ID NO: 5225399 - DNA, 22 bp, Homo sapiens
agtacataaaggtggtatgtgt

SEQ ID NO: 5225400 - DNA, 18 bp, Homo sapiens
agtacatatggtagacaa

SEQ ID NO: 5225401 - DNA, 15 bp, Homo sapiens
agtacatatgtaatt

SEQ ID NO: 5225402 - DNA, 18 bp, Homo sapiens
agtacatattaggaaaat

SEQ ID NO: 5225403 - DNA, 19 bp, Homo sapiens
agtacatatttattttctt

SEQ ID NO: 5225404 - DNA, 21 bp, Homo sapiens
agtacatatttattttctttt

SEQ ID NO: 5225405 - DNA, 17 bp, Homo sapiens
agtacatcttgtgcatg

SEQ ID NO: 5225406 - DNA, 19 bp, Homo sapiens
agtacatcttgtgcatgca

SEQ ID NO: 5225407 - DNA, 21 bp, Homo sapiens
agtacatcttgtgcatgcaaa

SEQ ID NO: 5225408 - DNA, 18 bp, Homo sapiens
agtacatggagctcaggt

SEQ ID NO: 5225409 - DNA, 21 bp, Homo sapiens
agtacatggagctcaggtttc

SEQ ID NO: 5225410 - DNA, 14 bp, Homo sapiens
agtacatgttaaac

SEQ ID NO: 5225411 - DNA, 22 bp, Homo sapiens
agtacattactaaatatataaa

SEQ ID NO: 5225412 - DNA, 17 bp, Homo sapiens
agtacattctcagtttt

SEQ ID NO: 5225413 - DNA, 12 bp, Homo sapiens
agtacatttaat

SEQ ID NO: 5225414 - DNA, 13 bp, Homo sapiens
agtacatttaata

SEQ ID NO: 5225415 - DNA, 19 bp, Homo sapiens
agtacatttggagacacaa

SEQ ID NO: 5225416 - DNA, 23 bp, Homo sapiens
agtacatttttgtctttatctca

SEQ ID NO: 5225417 - DNA, 21 bp, Homo sapiens
agtacattttttgaaatgctg

SEQ ID NO: 5225418 - DNA, 21 bp, Homo sapiens
agtaccaaatccacaagccat

SEQ ID NO: 5225419 - DNA, 15 bp, Homo sapiens
agtaccaatcatttt

SEQ ID NO: 5225420 - DNA, 16 bp, Homo sapiens
agtaccaatcatttta

SEQ ID NO: 5225421 - DNA, 14 bp, Homo sapiens
agtaccaatgctgt

SEQ ID NO: 5225422 - DNA, 16 bp, Homo sapiens
agtaccaatgggaagc

SEQ ID NO: 5225423 - DNA, 19 bp, Homo sapiens
agtaccaatgggaagcagg

SEQ ID NO: 5225424 - DNA, 16 bp, Homo sapiens
agtaccacattccatg

SEQ ID NO: 5225425 - DNA, 15 bp, Homo sapiens
agtaccactcaggcc

SEQ ID NO: 5225426 - DNA, 21 bp, Homo sapiens
agtaccagcgctctaaaagca

SEQ ID NO: 5225427 - DNA, 22 bp, Homo sapiens
agtaccaggggctgggctccct

SEQ ID NO: 5225428 - DNA, 21 bp, Homo sapiens
agtaccagtgagtggccccac

SEQ ID NO: 5225429 - DNA, 19 bp, Homo sapiens
agtaccataatcttagaga

SEQ ID NO: 5225430 - DNA, 19 bp, Homo sapiens
agtaccatagtaccattta

SEQ ID NO: 5225431 - DNA, 23 bp, Homo sapiens
agtaccatttaatggggaggaca

SEQ ID NO: 5225432 - DNA, 14 bp, Homo sapiens
agtaccatttatac

SEQ ID NO: 5225433 - DNA, 21 bp, Homo sapiens
agtaccatttatacaaattag

SEQ ID NO: 5225434 - DNA, 22 bp, Homo sapiens
agtacccaaaagctcagccagc

SEQ ID NO: 5225435 - DNA, 15 bp, Homo sapiens
agtacccacctgagc

SEQ ID NO: 5225436 - DNA, 16 bp, Homo sapiens
agtacccacctgagct

SEQ ID NO: 5225437 - DNA, 23 bp, Homo sapiens
agtacccactctggagcatttct

SEQ ID NO: 5225438 - DNA, 13 bp, Homo sapiens
agtacccagccta

SEQ ID NO: 5225439 - DNA, 15 bp, Homo sapiens
agtacccgactgttt

SEQ ID NO: 5225440 - DNA, 19 bp, Homo sapiens
agtaccctccattgggcac

SEQ ID NO: 5225441 - DNA, 21 bp, Homo sapiens
agtaccctccattgggcacag

SEQ ID NO: 5225442 - DNA, 18 bp, Homo sapiens
agtaccctctcagctcca

SEQ ID NO: 5225443 - DNA, 21 bp, Homo sapiens
agtaccctgatgccttttgga

SEQ ID NO: 5225444 - DNA, 15 bp, Homo sapiens
agtaccctgcaggcc

SEQ ID NO: 5225445 - DNA, 18 bp, Homo sapiens
agtaccctgcaggccagg

SEQ ID NO: 5225446 - DNA, 21 bp, Homo sapiens
agtacctagctggctctgtga

SEQ ID NO: 5225447 - DNA, 21 bp, Homo sapiens
agtacctataaagtaaagcta

SEQ ID NO: 5225448 - DNA, 15 bp, Homo sapiens
agtacctatgacttt

SEQ ID NO: 5225449 - DNA, 15 bp, Homo sapiens
agtacctccaagcaa

SEQ ID NO: 5225450 - DNA, 12 bp, Homo sapiens
agtacctcctgt

SEQ ID NO: 5225451 - DNA, 17 bp, Homo sapiens
agtacctcgtttctaca

SEQ ID NO: 5225452 - DNA, 21 bp, Homo sapiens
agtacctctcaagctagtgtt

SEQ ID NO: 5225453 - DNA, 19 bp, Homo sapiens
agtacctctgtatagaaat

SEQ ID NO: 5225454 - DNA, 20 bp, Homo sapiens
agtacctctgtatagaaatc

SEQ ID NO: 5225455 - DNA, 15 bp, Homo sapiens
agtacctgaaaagta

SEQ ID NO: 5225456 - DNA, 15 bp, Homo sapiens
agtacctgagggtct

SEQ ID NO: 5225457 - DNA, 21 bp, Homo sapiens
agtacctgagggtctgtaggt

SEQ ID NO: 5225458 - DNA, 18 bp, Homo sapiens
agtacctgattgtatttt

SEQ ID NO: 5225459 - DNA, 13 bp, Homo sapiens
agtacctgctgcc

SEQ ID NO: 5225460 - DNA, 15 bp, Homo sapiens
agtacctgctgcccc

SEQ ID NO: 5225461 - DNA, 14 bp, Homo sapiens
agtacctggaggag

SEQ ID NO: 5225462 - DNA, 15 bp, Homo sapiens
agtacctggaggagg

SEQ ID NO: 5225463 - DNA, 20 bp, Homo sapiens
agtacctgggaaaggaccca

SEQ ID NO: 5225464 - DNA, 13 bp, Homo sapiens
agtacctgggcaa

SEQ ID NO: 5225465 - DNA, 14 bp, Homo sapiens
agtacctgtgactc

SEQ ID NO: 5225466 - DNA, 15 bp, Homo sapiens
agtacctgtgactct

SEQ ID NO: 5225467 - DNA, 14 bp, Homo sapiens
agtacctgtgtgtt

SEQ ID NO: 5225468 - DNA, 20 bp, Homo sapiens
agtaccttatcaaagtagca

SEQ ID NO: 5225469 - DNA, 13 bp, Homo sapiens
agtaccttcaaat

SEQ ID NO: 5225470 - DNA, 14 bp, Homo sapiens
agtaccttctgcca

SEQ ID NO: 5225471 - DNA, 13 bp, Homo sapiens
agtaccttgcttc

SEQ ID NO: 5225472 - DNA, 13 bp, Homo sapiens
agtaccttgtttt

SEQ ID NO: 5225473 - DNA, 19 bp, Homo sapiens
agtacctttcctacatttt

SEQ ID NO: 5225474 - DNA, 16 bp, Homo sapiens
agtacctttgctcttg

SEQ ID NO: 5225475 - DNA, 17 bp, Homo sapiens
agtacctttgctcttgc

SEQ ID NO: 5225476 - DNA, 12 bp, Homo sapiens
agtggcagagaa

SEQ ID NO: 5225477 - DNA, 17 bp, Homo sapiens
agtggcagatttcttta

SEQ ID NO: 5225478 - DNA, 15 bp, Homo sapiens
agtggcagcagcccc

SEQ ID NO: 5225479 - DNA, 16 bp, Homo sapiens
agtggcagccaagagc

SEQ ID NO: 5225480 - DNA, 12 bp, Homo sapiens
agtggcagccat

SEQ ID NO: 5225481 - DNA, 14 bp, Homo sapiens
agtggcagccgcct

SEQ ID NO: 5225482 - DNA, 11 bp, Homo sapiens
agtggcagctg

SEQ ID NO: 5225483 - DNA, 22 bp, Homo sapiens
agtggcagctgtcccctctccc

SEQ ID NO: 5225484 - DNA, 17 bp, Homo sapiens
agtggcaggaccctgtc

SEQ ID NO: 5225485 - DNA, 12 bp, Homo sapiens
agtggcagggca

SEQ ID NO: 5225486 - DNA, 13 bp, Homo sapiens
agtggcagggcac

SEQ ID NO: 5225487 - DNA, 16 bp, Homo sapiens
agtggcagggcacagg

SEQ ID NO: 5225488 - DNA, 16 bp, Homo sapiens
agtggcaggtgggctg

SEQ ID NO: 5225489 - DNA, 23 bp, Homo sapiens
agtggcaggtgggctgcctgctg

SEQ ID NO: 5225490 - DNA, 23 bp, Homo sapiens
agtggcagtcttcagtttgcaga

SEQ ID NO: 5225491 - DNA, 20 bp, Homo sapiens
agtggcatcatctcagctca

SEQ ID NO: 5225492 - DNA, 19 bp, Homo sapiens
agtggcatctgaaaacaat

SEQ ID NO: 5225493 - DNA, 23 bp, Homo sapiens
agtggcatgtgggttgtgatatt

SEQ ID NO: 5225494 - DNA, 20 bp, Homo sapiens
agtggcattggcagcaggtg

SEQ ID NO: 5225495 - DNA, 22 bp, Homo sapiens
agtggcatttctatgcaggcag

SEQ ID NO: 5225496 - DNA, 18 bp, Homo sapiens
agtggccaagatcacagt

SEQ ID NO: 5225497 - DNA, 14 bp, Homo sapiens
agtggccaagcctg

SEQ ID NO: 5225498 - DNA, 20 bp, Homo sapiens
agtggccaagcctgctgtgt

SEQ ID NO: 5225499 - DNA, 20 bp, Homo sapiens
agtggccacgttcagggagg

SEQ ID NO: 5225500 - DNA, 13 bp, Homo sapiens
agtggccactggc

SEQ ID NO: 5225501 - DNA, 21 bp, Homo sapiens
agtggccagaccagagctctg

SEQ ID NO: 5225502 - DNA, 18 bp, Homo sapiens
agtggccagccagtgcca

SEQ ID NO: 5225503 - DNA, 16 bp, Homo sapiens
agtggccagcgccagg

SEQ ID NO: 5225504 - DNA, 17 bp, Homo sapiens
agtggccagcgccaggg

SEQ ID NO: 5225505 - DNA, 19 bp, Homo sapiens
agtggccagcgccagggcc

SEQ ID NO: 5225506 - DNA, 14 bp, Homo sapiens
agtggccaggtgcc

SEQ ID NO: 5225507 - DNA, 21 bp, Homo sapiens
agtggcccaacaggggctcca

SEQ ID NO: 5225508 - DNA, 23 bp, Homo sapiens
agtggcccagggaatcagggagc

SEQ ID NO: 5225509 - DNA, 19 bp, Homo sapiens
agtggcccatggcatttta

SEQ ID NO: 5225510 - DNA, 12 bp, Homo sapiens
agtggccccacc

SEQ ID NO: 5225511 - DNA, 20 bp, Homo sapiens
agtggccccacctgtgtccc

SEQ ID NO: 5225512 - DNA, 20 bp, Homo sapiens
agtggccccatccagcatgt

SEQ ID NO: 5225513 - DNA, 22 bp, Homo sapiens
agtggccccatccagcatgtgt

SEQ ID NO: 5225514 - DNA, 16 bp, Homo sapiens
agtggcccccacagaa

SEQ ID NO: 5225515 - DNA, 17 bp, Homo sapiens
agtggcccccgggcctg

SEQ ID NO: 5225516 - DNA, 21 bp, Homo sapiens
agtggcccctcacctgggcct

SEQ ID NO: 5225517 - DNA, 23 bp, Homo sapiens
agtggcccctggcacctgggtgc

SEQ ID NO: 5225518 - DNA, 19 bp, Homo sapiens
agtggccccttaggccagt

SEQ ID NO: 5225519 - DNA, 24 bp, Homo sapiens
agtggcccgcgtgattgtggcatt

SEQ ID NO: 5225520 - DNA, 18 bp, Homo sapiens
agtggccgaaccccccac

SEQ ID NO: 5225521 - DNA, 20 bp, Homo sapiens
agtggccgaaccccccactc

SEQ ID NO: 5225522 - DNA, 22 bp, Homo sapiens
agtggccggggctgaagccaca

SEQ ID NO: 5225523 - DNA, 14 bp, Homo sapiens
agtggcctagagca

SEQ ID NO: 5225524 - DNA, 15 bp, Homo sapiens
agtggcctcaaccct

SEQ ID NO: 5225525 - DNA, 21 bp, Homo sapiens
agtggcctcaaccctccctca

SEQ ID NO: 5225526 - DNA, 22 bp, Homo sapiens
agtggcctcaaccctccctcag

SEQ ID NO: 5225527 - DNA, 20 bp, Homo sapiens
agtggcctcttggataccag

SEQ ID NO: 5225528 - DNA, 23 bp, Homo sapiens
agtggcctctttgtctaaaacaa

SEQ ID NO: 5225529 - DNA, 17 bp, Homo sapiens
agtggcctgcaggggcc

SEQ ID NO: 5225530 - DNA, 13 bp, Homo sapiens
agtggcctggcca

SEQ ID NO: 5225531 - DNA, 14 bp, Homo sapiens
agtggcctggccag

SEQ ID NO: 5225532 - DNA, 15 bp, Homo sapiens
agtggcctggccagg

SEQ ID NO: 5225533 - DNA, 23 bp, Homo sapiens
agtggcctggccgttcagcctgt

SEQ ID NO: 5225534 - DNA, 14 bp, Homo sapiens
agtggcctggctcc

SEQ ID NO: 5225535 - DNA, 17 bp, Homo sapiens
agtggcctggctccgct

SEQ ID NO: 5225536 - DNA, 23 bp, Homo sapiens
agtggcctggctccgctgtgtgg

SEQ ID NO: 5225537 - DNA, 11 bp, Homo sapiens
agtggcctggg

SEQ ID NO: 5225538 - DNA, 13 bp, Homo sapiens
agtggcctgggtc

SEQ ID NO: 5225539 - DNA, 14 bp, Homo sapiens
agtggcctgtgagc

SEQ ID NO: 5225540 - DNA, 16 bp, Homo sapiens
agtggcctgtgagcaa

SEQ ID NO: 5225541 - DNA, 21 bp, Homo sapiens
agtggcctgtgagcaagagcc

SEQ ID NO: 5225542 - DNA, 18 bp, Homo sapiens
agtggccttacccctgcc

SEQ ID NO: 5225543 - DNA, 18 bp, Homo sapiens
agtggccttccccagcat

SEQ ID NO: 5225544 - DNA, 21 bp, Homo sapiens
agtggcgaaatccctgctcac

SEQ ID NO: 5225545 - DNA, 17 bp, Homo sapiens
agtggcgagtccagaca

SEQ ID NO: 5225546 - DNA, 23 bp, Homo sapiens
agtggcgccatctcggctcactg

SEQ ID NO: 5225547 - DNA, 21 bp, Homo sapiens
agtggcggcacgtccttgggc

SEQ ID NO: 5225548 - DNA, 13 bp, Homo sapiens
agtggcgggccca

SEQ ID NO: 5225549 - DNA, 16 bp, Homo sapiens
agtggcggggcccctg

SEQ ID NO: 5225550 - DNA, 19 bp, Homo sapiens
agtggcgtgatctcagctc

SEQ ID NO: 5225551 - DNA, 22 bp, Homo sapiens
agtggctatttctttatattta

SEQ ID NO: 5225552 - DNA, 23 bp, Homo sapiens
agtggctcaatgcaacctctgcc

SEQ ID NO: 5225553 - DNA, 16 bp, Homo sapiens
agtggctcacacctgt

SEQ ID NO: 5225554 - DNA, 12 bp, Homo sapiens
agtggctcccca

SEQ ID NO: 5225555 - DNA, 15 bp, Homo sapiens
agtggctccccacct

SEQ ID NO: 5225556 - DNA, 16 bp, Homo sapiens
agtggctccccacctg

SEQ ID NO: 5225557 - DNA, 17 bp, Homo sapiens
agtggctcccctgccca

SEQ ID NO: 5225558 - DNA, 15 bp, Homo sapiens
agtggctctcagagc

SEQ ID NO: 5225559 - DNA, 20 bp, Homo sapiens
agtggctctcagagcagcag

SEQ ID NO: 5225560 - DNA, 23 bp, Homo sapiens
agtggctcttctaacctcagcca

SEQ ID NO: 5225561 - DNA, 16 bp, Homo sapiens
agtggctcttgggaca

SEQ ID NO: 5225562 - DNA, 23 bp, Homo sapiens
agtggctgaaataaaagcctctg

SEQ ID NO: 5225563 - DNA, 13 bp, Homo sapiens
agtggctgaccag

SEQ ID NO: 5225564 - DNA, 14 bp, Homo sapiens
agtggctgccacac

SEQ ID NO: 5225565 - DNA, 12 bp, Homo sapiens
agtggctgcggt

SEQ ID NO: 5225566 - DNA, 13 bp, Homo sapiens
agtggctgctctg

SEQ ID NO: 5225567 - DNA, 14 bp, Homo sapiens
agtggctgctgccc

SEQ ID NO: 5225568 - DNA, 17 bp, Homo sapiens
agtggctgctgcccagg

SEQ ID NO: 5225569 - DNA, 22 bp, Homo sapiens
agtggctgctgcccaggcccag

SEQ ID NO: 5225570 - DNA, 13 bp, Homo sapiens
agtggctggggca

SEQ ID NO: 5225571 - DNA, 12 bp, Homo sapiens
agtggctggggg

SEQ ID NO: 5225572 - DNA, 14 bp, Homo sapiens
agtggctgggtggg

SEQ ID NO: 5225573 - DNA, 18 bp, Homo sapiens
agtggctggtccagggct

SEQ ID NO: 5225574 - DNA, 14 bp, Homo sapiens
agtggctggtctgg

SEQ ID NO: 5225575 - DNA, 17 bp, Homo sapiens
agtggctggtgcccatg

SEQ ID NO: 5225576 - DNA, 19 bp, Homo sapiens
agtggctggtgcccatgaa

SEQ ID NO: 5225577 - DNA, 16 bp, Homo sapiens
agtggctgtcatcagc

SEQ ID NO: 5225578 - DNA, 12 bp, Homo sapiens
agtggctgtcca

SEQ ID NO: 5225579 - DNA, 13 bp, Homo sapiens
agtggctgtccag

SEQ ID NO: 5225580 - DNA, 18 bp, Homo sapiens
agtggctgtccagtgccc

SEQ ID NO: 5225581 - DNA, 17 bp, Homo sapiens
agtggcttaatagtaat

SEQ ID NO: 5225582 - DNA, 20 bp, Homo sapiens
agtggcttcactcctgctgt

SEQ ID NO: 5225583 - DNA, 17 bp, Homo sapiens
agtggcttcagcccctg

SEQ ID NO: 5225584 - DNA, 14 bp, Homo sapiens
agtggcttctccag

SEQ ID NO: 5225585 - DNA, 15 bp, Homo sapiens
agtggcttctttcca

SEQ ID NO: 5225586 - DNA, 14 bp, Homo sapiens
agtggcttgtcctc

SEQ ID NO: 5225587 - DNA, 20 bp, Homo sapiens
agtggcttgtgattctggga

SEQ ID NO: 5225588 - DNA, 22 bp, Homo sapiens
agtggctttctaccacacacag

SEQ ID NO: 5225589 - DNA, 16 bp, Homo sapiens
agtggcttttgcccca

SEQ ID NO: 5225590 - DNA, 18 bp, Homo sapiens
agtggctttttgtactgt

SEQ ID NO: 5225591 - DNA, 23 bp, Homo sapiens
agtggctttttgtactgtagttc

SEQ ID NO: 5225592 - DNA, 16 bp, Homo sapiens
agtgggaaaaaataga

SEQ ID NO: 5225593 - DNA, 19 bp, Homo sapiens
agtgggaaaaatgtaggag

SEQ ID NO: 5225594 - DNA, 20 bp, Homo sapiens
agtgggaacgtgactgcccc

SEQ ID NO: 5225595 - DNA, 18 bp, Homo sapiens
agtgggaactctgacaag

SEQ ID NO: 5225596 - DNA, 14 bp, Homo sapiens
agtgggaagagctg

SEQ ID NO: 5225597 - DNA, 23 bp, Homo sapiens
agtgggaagagggggctggccat

SEQ ID NO: 5225598 - DNA, 17 bp, Homo sapiens
agtgggaagcccatcct

SEQ ID NO: 5225599 - DNA, 10 bp, Homo sapiens
agtgggaagg

SEQ ID NO: 5225600 - DNA, 23 bp, Homo sapiens
agtgggaagggagcattgcagcc

SEQ ID NO: 5225601 - DNA, 17 bp, Homo sapiens
agtgggaagtgaagccc

SEQ ID NO: 5225602 - DNA, 15 bp, Homo sapiens
agtgggaagtgaatc

SEQ ID NO: 5225603 - DNA, 21 bp, Homo sapiens
agtgggacaaaccagagcaga

SEQ ID NO: 5225604 - DNA, 22 bp, Homo sapiens
agtgggacaccattctgaattt

SEQ ID NO: 5225605 - DNA, 13 bp, Homo sapiens
agtgggacagaca

SEQ ID NO: 5225606 - DNA, 20 bp, Homo sapiens
agtgggacagacagcagctg

SEQ ID NO: 5225607 - DNA, 19 bp, Homo sapiens
agtgggacagggcatggcc

SEQ ID NO: 5225608 - DNA, 14 bp, Homo sapiens
agtgggacccacag

SEQ ID NO: 5225609 - DNA, 15 bp, Homo sapiens
agtgggacccataga

SEQ ID NO: 5225610 - DNA, 18 bp, Homo sapiens
agtgggacccatagatct

SEQ ID NO: 5225611 - DNA, 14 bp, Homo sapiens
agtgggacttggag

SEQ ID NO: 5225612 - DNA, 22 bp, Homo sapiens
agtgggacttggagagcaaagg

SEQ ID NO: 5225613 - DNA, 12 bp, Homo sapiens
agtgggagaaaa

SEQ ID NO: 5225614 - DNA, 16 bp, Homo sapiens
agtgggagaagtggcc

SEQ ID NO: 5225615 - DNA, 15 bp, Homo sapiens
agtgggagaggaagc

SEQ ID NO: 5225616 - DNA, 18 bp, Homo sapiens
agtgggagaggctgggag

SEQ ID NO: 5225617 - DNA, 23 bp, Homo sapiens
agtgggagcagcttcttgggctg

SEQ ID NO: 5225618 - DNA, 14 bp, Homo sapiens
agtgggagccaggg

SEQ ID NO: 5225619 - DNA, 18 bp, Homo sapiens
agtgggagcccagcacac

SEQ ID NO: 5225620 - DNA, 15 bp, Homo sapiens
agtgggagctgagct

SEQ ID NO: 5225621 - DNA, 16 bp, Homo sapiens
agtgggagctgcctgt

SEQ ID NO: 5225622 - DNA, 18 bp, Homo sapiens
agtgggaggacagagccg

SEQ ID NO: 5225623 - DNA, 20 bp, Homo sapiens
agtgggaggagagggcagag

SEQ ID NO: 5225624 - DNA, 17 bp, Homo sapiens
agtgggaggcaaatggg

SEQ ID NO: 5225625 - DNA, 18 bp, Homo sapiens
agtgggaggcgtgccccc

SEQ ID NO: 5225626 - DNA, 16 bp, Homo sapiens
agtgggaggggcaggc

SEQ ID NO: 5225627 - DNA, 17 bp, Homo sapiens
agtgggaggggcaggct

SEQ ID NO: 5225628 - DNA, 22 bp, Homo sapiens
agtgggaggggcaggctgacat

SEQ ID NO: 5225629 - DNA, 12 bp, Homo sapiens
agtgggaggtca

SEQ ID NO: 5225630 - DNA, 20 bp, Homo sapiens
agtgggatctgtcacaccag

SEQ ID NO: 5225631 - DNA, 22 bp, Homo sapiens
agtgggatcttacccacttccc

SEQ ID NO: 5225632 - DNA, 19 bp, Homo sapiens
agtgggcagaggtggcgcc

SEQ ID NO: 5225633 - DNA, 13 bp, Homo sapiens
agtgggcaggggt

SEQ ID NO: 5225634 - DNA, 14 bp, Homo sapiens
agtgggcagtcaca

SEQ ID NO: 5225635 - DNA, 23 bp, Homo sapiens
agtgggcagtcaccacccagccc

SEQ ID NO: 5225636 - DNA, 19 bp, Homo sapiens
agtgggccaggacaggccc

SEQ ID NO: 5225637 - DNA, 14 bp, Homo sapiens
agtgggccagggct

SEQ ID NO: 5225638 - DNA, 22 bp, Homo sapiens
agtgggccagggctgccctgag

SEQ ID NO: 5225639 - DNA, 18 bp, Homo sapiens
agtgggcccacccggtgg

SEQ ID NO: 5225640 - DNA, 22 bp, Homo sapiens
agtgggccccgggctggagaaa

SEQ ID NO: 5225641 - DNA, 12 bp, Homo sapiens
agtgggccctgc

SEQ ID NO: 5225642 - DNA, 17 bp, Homo sapiens
agtgggccctggctctg

SEQ ID NO: 5225643 - DNA, 17 bp, Homo sapiens
agtgggccggccccagg

SEQ ID NO: 5225644 - DNA, 12 bp, Homo sapiens
agtgggcgcagt

SEQ ID NO: 5225645 - DNA, 16 bp, Homo sapiens
agtgggcggcttccct

SEQ ID NO: 5225646 - DNA, 18 bp, Homo sapiens
agtgggcgggccatgagg

SEQ ID NO: 5225647 - DNA, 22 bp, Homo sapiens
agtgggctatgccactaggccc

SEQ ID NO: 5225648 - DNA, 19 bp, Homo sapiens
agtgggctccctggcccag

SEQ ID NO: 5225649 - DNA, 15 bp, Homo sapiens
agtgggctcctgaca

SEQ ID NO: 5225650 - DNA, 15 bp, Homo sapiens
agtgggctctgagca

SEQ ID NO: 5225651 - DNA, 22 bp, Homo sapiens
agtgggctgacatcaagtgtaa

SEQ ID NO: 5225652 - DNA, 11 bp, Homo sapiens
agtgggctgca

SEQ ID NO: 5225653 - DNA, 12 bp, Homo sapiens
agtgggctgcac

SEQ ID NO: 5225654 - DNA, 23 bp, Homo sapiens
agtgggctgcacgctcccctcca

SEQ ID NO: 5225655 - DNA, 18 bp, Homo sapiens
agtacctttgctcttgca

SEQ ID NO: 5225656 - DNA, 19 bp, Homo sapiens
agtaccttttatatcccat

SEQ ID NO: 5225657 - DNA, 22 bp, Homo sapiens
agtacgaatcttatttttcctg

SEQ ID NO: 5225658 - DNA, 16 bp, Homo sapiens
agtacgatcaagttgt

SEQ ID NO: 5225659 - DNA, 14 bp, Homo sapiens
agtacggctgctgc

SEQ ID NO: 5225660 - DNA, 18 bp, Homo sapiens
agtacgtcccgctgctgt

SEQ ID NO: 5225661 - DNA, 17 bp, Homo sapiens
agtacgtgctttgagaa

SEQ ID NO: 5225662 - DNA, 14 bp, Homo sapiens
agtacgtgtggctt

SEQ ID NO: 5225663 - DNA, 16 bp, Homo sapiens
agtacgttaaaagcaa

SEQ ID NO: 5225664 - DNA, 15 bp, Homo sapiens
agtacgttattgttg

SEQ ID NO: 5225665 - DNA, 14 bp, Homo sapiens
agtacgttgtgcat

SEQ ID NO: 5225666 - DNA, 15 bp, Homo sapiens
agtacgttgtgcatt

SEQ ID NO: 5225667 - DNA, 17 bp, Homo sapiens
agtacgttgtgcatttg

SEQ ID NO: 5225668 - DNA, 18 bp, Homo sapiens
agtacgttgtgcatttgg

SEQ ID NO: 5225669 - DNA, 18 bp, Homo sapiens
agtacgtttttgcattat

SEQ ID NO: 5225670 - DNA, 20 bp, Homo sapiens
agtacgtttttgcattattc

SEQ ID NO: 5225671 - DNA, 19 bp, Homo sapiens
agtactaaaactagataac

SEQ ID NO: 5225672 - DNA, 22 bp, Homo sapiens
agtactaaaactagataactta

SEQ ID NO: 5225673 - DNA, 18 bp, Homo sapiens
agtactaaaggcttgccg

SEQ ID NO: 5225674 - DNA, 17 bp, Homo sapiens
agtactaaggtgacttt

SEQ ID NO: 5225675 - DNA, 22 bp, Homo sapiens
agtactaaggtgactttctgaa

SEQ ID NO: 5225676 - DNA, 24 bp, Homo sapiens
agtactaaggtgactttctgaaac

SEQ ID NO: 5225677 - DNA, 19 bp, Homo sapiens
agtactacagtcctcccat

SEQ ID NO: 5225678 - DNA, 16 bp, Homo sapiens
agtactagcaataagt

SEQ ID NO: 5225679 - DNA, 22 bp, Homo sapiens
agtactatgtattaccagcccc

SEQ ID NO: 5225680 - DNA, 22 bp, Homo sapiens
agtactattgctagtactagta

SEQ ID NO: 5225681 - DNA, 15 bp, Homo sapiens
agtactatttcttaa

SEQ ID NO: 5225682 - DNA, 19 bp, Homo sapiens
agtactattttaatttgta

SEQ ID NO: 5225683 - DNA, 23 bp, Homo sapiens
agtactattttaatttgtattga

SEQ ID NO: 5225684 - DNA, 13 bp, Homo sapiens
agtactcaatgtt

SEQ ID NO: 5225685 - DNA, 22 bp, Homo sapiens
agtactcactaaaagttctcaa

SEQ ID NO: 5225686 - DNA, 17 bp, Homo sapiens
agtactcactttttcca

SEQ ID NO: 5225687 - DNA, 16 bp, Homo sapiens
agtactcagaggctga

SEQ ID NO: 5225688 - DNA, 17 bp, Homo sapiens
agtactcagtatagcat

SEQ ID NO: 5225689 - DNA, 20 bp, Homo sapiens
agtactccacactgcacaat

SEQ ID NO: 5225690 - DNA, 13 bp, Homo sapiens
agtactcctccct

SEQ ID NO: 5225691 - DNA, 16 bp, Homo sapiens
agtactcctccctggg

SEQ ID NO: 5225692 - DNA, 19 bp, Homo sapiens
agtactccttaagaacaca

SEQ ID NO: 5225693 - DNA, 16 bp, Homo sapiens
agtactctaatataca

SEQ ID NO: 5225694 - DNA, 17 bp, Homo sapiens
agtactctctgctctag

SEQ ID NO: 5225695 - DNA, 14 bp, Homo sapiens
agtactctttaaca

SEQ ID NO: 5225696 - DNA, 23 bp, Homo sapiens
agtactctttctctcccctcctc

SEQ ID NO: 5225697 - DNA, 18 bp, Homo sapiens
agtactgaggtggtggac

SEQ ID NO: 5225698 - DNA, 14 bp, Homo sapiens
agtactgattattc

SEQ ID NO: 5225699 - DNA, 17 bp, Homo sapiens
agtactgattattcttc

SEQ ID NO: 5225700 - DNA, 22 bp, Homo sapiens
agtactgcatgatcttacacga

SEQ ID NO: 5225701 - DNA, 19 bp, Homo sapiens
agtactgcattttttactt

SEQ ID NO: 5225702 - DNA, 17 bp, Homo sapiens
agtactgctttactgtg

SEQ ID NO: 5225703 - DNA, 15 bp, Homo sapiens
agtactggaataaac

SEQ ID NO: 5225704 - DNA, 17 bp, Homo sapiens
agtactggaataaacag

SEQ ID NO: 5225705 - DNA, 14 bp, Homo sapiens
agtactggaattta

SEQ ID NO: 5225706 - DNA, 20 bp, Homo sapiens
agtactggtaagattgttat

SEQ ID NO: 5225707 - DNA, 15 bp, Homo sapiens
agtactggttacttt

SEQ ID NO: 5225708 - DNA, 20 bp, Homo sapiens
agtactggttactttcaaaa

SEQ ID NO: 5225709 - DNA, 21 bp, Homo sapiens
agtactggttactttcaaaat

SEQ ID NO: 5225710 - DNA, 23 bp, Homo sapiens
agtactgtaagaataatttatag

SEQ ID NO: 5225711 - DNA, 20 bp, Homo sapiens
agtactgtaataatacctca

SEQ ID NO: 5225712 - DNA, 19 bp, Homo sapiens
agtactgtgggcaatttag

SEQ ID NO: 5225713 - DNA, 16 bp, Homo sapiens
agtactgtgtacagaa

SEQ ID NO: 5225714 - DNA, 13 bp, Homo sapiens
agtacttaacata

SEQ ID NO: 5225715 - DNA, 13 bp, Homo sapiens
agtacttaatagt

SEQ ID NO: 5225716 - DNA, 15 bp, Homo sapiens
agtacttaatatact

SEQ ID NO: 5225717 - DNA, 18 bp, Homo sapiens
agtacttaatatactcag

SEQ ID NO: 5225718 - DNA, 18 bp, Homo sapiens
agtacttcagcaagagag

SEQ ID NO: 5225719 - DNA, 19 bp, Homo sapiens
agtacttcagcaagagaga

SEQ ID NO: 5225720 - DNA, 13 bp, Homo sapiens
agtacttccagat

SEQ ID NO: 5225721 - DNA, 13 bp, Homo sapiens
agtacttccctca

SEQ ID NO: 5225722 - DNA, 14 bp, Homo sapiens
agtacttcctctag

SEQ ID NO: 5225723 - DNA, 23 bp, Homo sapiens
agtacttcctctaggaaatgtac

SEQ ID NO: 5225724 - DNA, 19 bp, Homo sapiens
agtacttctccaccctgct

SEQ ID NO: 5225725 - DNA, 19 bp, Homo sapiens
agtacttcttctgtaatat

SEQ ID NO: 5225726 - DNA, 11 bp, Homo sapiens
agtacttgaaa

SEQ ID NO: 5225727 - DNA, 14 bp, Homo sapiens
agtacttgagaata

SEQ ID NO: 5225728 - DNA, 20 bp, Homo sapiens
agtacttgagggaccaatat

SEQ ID NO: 5225729 - DNA, 13 bp, Homo sapiens
agtacttgctcaa

SEQ ID NO: 5225730 - DNA, 17 bp, Homo sapiens
agtacttgctctctgag

SEQ ID NO: 5225731 - DNA, 23 bp, Homo sapiens
agtacttggttgggtcagattta

SEQ ID NO: 5225732 - DNA, 23 bp, Homo sapiens
agtacttgtgaaacacagctgtt

SEQ ID NO: 5225733 - DNA, 17 bp, Homo sapiens
agtactttattgtacag

SEQ ID NO: 5225734 - DNA, 23 bp, Homo sapiens
agtactttattgtacagactgtt

SEQ ID NO: 5225735 - DNA, 17 bp, Homo sapiens
agtactttctttctgtg

SEQ ID NO: 5225736 - DNA, 19 bp, Homo sapiens
agtactttgccatccttgc

SEQ ID NO: 5225737 - DNA, 17 bp, Homo sapiens
agtactttggaggcccc

SEQ ID NO: 5225738 - DNA, 22 bp, Homo sapiens
agtactttggaggcccctatgt

SEQ ID NO: 5225739 - DNA, 11 bp, Homo sapiens
agtactttgtg

SEQ ID NO: 5225740 - DNA, 13 bp, Homo sapiens
agtactttgtgca

SEQ ID NO: 5225741 - DNA, 14 bp, Homo sapiens
agtacttttaacgt

SEQ ID NO: 5225742 - DNA, 14 bp, Homo sapiens
agtacttttattaa

SEQ ID NO: 5225743 - DNA, 15 bp, Homo sapiens
agtacttttattaat

SEQ ID NO: 5225744 - DNA, 20 bp, Homo sapiens
agtacttttattaatatttg

SEQ ID NO: 5225745 - DNA, 17 bp, Homo sapiens
agtacttttctgttcat

SEQ ID NO: 5225746 - DNA, 19 bp, Homo sapiens
agtacttttggcattttac

SEQ ID NO: 5225747 - DNA, 20 bp, Homo sapiens
agtacttttgttgtatggga

SEQ ID NO: 5225748 - DNA, 21 bp, Homo sapiens
agtacttttgttgtatgggat

SEQ ID NO: 5225749 - DNA, 16 bp, Homo sapiens
agtacttttttaaata

SEQ ID NO: 5225750 - DNA, 11 bp, Homo sapiens
agtagaaaaat

SEQ ID NO: 5225751 - DNA, 20 bp, Homo sapiens
agtagaaaaattgtttccaa

SEQ ID NO: 5225752 - DNA, 22 bp, Homo sapiens
agtagaaaagcagtcccattca

SEQ ID NO: 5225753 - DNA, 17 bp, Homo sapiens
agtagaaaagtcgggga

SEQ ID NO: 5225754 - DNA, 12 bp, Homo sapiens
agtagaaaatac

SEQ ID NO: 5225755 - DNA, 19 bp, Homo sapiens
agtagaaaatacattatta

SEQ ID NO: 5225756 - DNA, 23 bp, Homo sapiens
agtagaaaatacattattagaat

SEQ ID NO: 5225757 - DNA, 12 bp, Homo sapiens
agtagaaaatgt

SEQ ID NO: 5225758 - DNA, 22 bp, Homo sapiens
agtagaaaatgtgaccctccaa

SEQ ID NO: 5225759 - DNA, 23 bp, Homo sapiens
agtagaaactacgaaaaataaaa

SEQ ID NO: 5225760 - DNA, 19 bp, Homo sapiens
agtagaaagaaaatgtctg

SEQ ID NO: 5225761 - DNA, 16 bp, Homo sapiens
agtagaaagacatctg

SEQ ID NO: 5225762 - DNA, 12 bp, Homo sapiens
agtagaaagagt

SEQ ID NO: 5225763 - DNA, 13 bp, Homo sapiens
agtagaaagagtg

SEQ ID NO: 5225764 - DNA, 13 bp, Homo sapiens
agtagaaagctaa

SEQ ID NO: 5225765 - DNA, 15 bp, Homo sapiens
agtagaaagctaaag

SEQ ID NO: 5225766 - DNA, 19 bp, Homo sapiens
agtagaaataatatgcatt

SEQ ID NO: 5225767 - DNA, 12 bp, Homo sapiens
agtagaaatcat

SEQ ID NO: 5225768 - DNA, 15 bp, Homo sapiens
agtagaactttgtat

SEQ ID NO: 5225769 - DNA, 16 bp, Homo sapiens
agtagaactttgtata

SEQ ID NO: 5225770 - DNA, 18 bp, Homo sapiens
agtagaactttgtatagt

SEQ ID NO: 5225771 - DNA, 19 bp, Homo sapiens
agtagaactttgtatagtt

SEQ ID NO: 5225772 - DNA, 19 bp, Homo sapiens
agtagaagcctgcagcggc

SEQ ID NO: 5225773 - DNA, 16 bp, Homo sapiens
agtagaaggtcggagg

SEQ ID NO: 5225774 - DNA, 17 bp, Homo sapiens
agtagaagtcttagatg

SEQ ID NO: 5225775 - DNA, 14 bp, Homo sapiens
agtagaatctcagt

SEQ ID NO: 5225776 - DNA, 15 bp, Homo sapiens
agtagaatctctttt

SEQ ID NO: 5225777 - DNA, 13 bp, Homo sapiens
agtagaatgtagt

SEQ ID NO: 5225778 - DNA, 17 bp, Homo sapiens
agtagaattatatctaa

SEQ ID NO: 5225779 - DNA, 21 bp, Homo sapiens
agtagaattatatctaattta

SEQ ID NO: 5225780 - DNA, 15 bp, Homo sapiens
agtagaattttagtc

SEQ ID NO: 5225781 - DNA, 23 bp, Homo sapiens
agtagacagcaataactcggtgt

SEQ ID NO: 5225782 - DNA, 14 bp, Homo sapiens
agtagacatttata

SEQ ID NO: 5225783 - DNA, 19 bp, Homo sapiens
agtagacattttaacaaga

SEQ ID NO: 5225784 - DNA, 22 bp, Homo sapiens
agtagacattttaacaagaaga

SEQ ID NO: 5225785 - DNA, 18 bp, Homo sapiens
agtagaccaaatcttgtt

SEQ ID NO: 5225786 - DNA, 16 bp, Homo sapiens
agtagacccctggctg

SEQ ID NO: 5225787 - DNA, 20 bp, Homo sapiens
agtagacctgattttcaaaa

SEQ ID NO: 5225788 - DNA, 20 bp, Homo sapiens
agtagaccttgttacttctg

SEQ ID NO: 5225789 - DNA, 16 bp, Homo sapiens
agtagacgaacagctg

SEQ ID NO: 5225790 - DNA, 17 bp, Homo sapiens
agtagacgaacagctga

SEQ ID NO: 5225791 - DNA, 14 bp, Homo sapiens
agtagactccaaca

SEQ ID NO: 5225792 - DNA, 15 bp, Homo sapiens
agtagagaaacattt

SEQ ID NO: 5225793 - DNA, 23 bp, Homo sapiens
agtagagaaatggattcagtata

SEQ ID NO: 5225794 - DNA, 16 bp, Homo sapiens
agtagagaagtatcca

SEQ ID NO: 5225795 - DNA, 21 bp, Homo sapiens
agtagagaagtatccaattat

SEQ ID NO: 5225796 - DNA, 22 bp, Homo sapiens
agtagagagggaacatcctaag

SEQ ID NO: 5225797 - DNA, 17 bp, Homo sapiens
agtagagcaaagactta

SEQ ID NO: 5225798 - DNA, 16 bp, Homo sapiens
agtagagccaggtgct

SEQ ID NO: 5225799 - DNA, 22 bp, Homo sapiens
agtagagcttgtaataaatact

SEQ ID NO: 5225800 - DNA, 17 bp, Homo sapiens
agtagaggggacgtgag

SEQ ID NO: 5225801 - DNA, 23 bp, Homo sapiens
agtagaggggtctcatgtctccc

SEQ ID NO: 5225802 - DNA, 14 bp, Homo sapiens
agtagaggtacact

SEQ ID NO: 5225803 - DNA, 20 bp, Homo sapiens
agtagaggtacacttgtgaa

SEQ ID NO: 5225804 - DNA, 22 bp, Homo sapiens
agtagaggtataattgtgtgat

SEQ ID NO: 5225805 - DNA, 13 bp, Homo sapiens
agtagaggtggct

SEQ ID NO: 5225806 - DNA, 15 bp, Homo sapiens
agtagaggtttaaag

SEQ ID NO: 5225807 - DNA, 19 bp, Homo sapiens
agtagagtgagttcttttt

SEQ ID NO: 5225808 - DNA, 18 bp, Homo sapiens
agtagataatttcagggt

SEQ ID NO: 5225809 - DNA, 19 bp, Homo sapiens
agtagatactaaagcaaat

SEQ ID NO: 5225810 - DNA, 17 bp, Homo sapiens
agtagatactctcagca

SEQ ID NO: 5225811 - DNA, 21 bp, Homo sapiens
agtagatattactttatcact

SEQ ID NO: 5225812 - DNA, 15 bp, Homo sapiens
agtagatcacctcct

SEQ ID NO: 5225813 - DNA, 15 bp, Homo sapiens
agtagatcatgcata

SEQ ID NO: 5225814 - DNA, 18 bp, Homo sapiens
agtagatcatgcatagag

SEQ ID NO: 5225815 - DNA, 15 bp, Homo sapiens
agtagatctgctttc

SEQ ID NO: 5225816 - DNA, 23 bp, Homo sapiens
agtagatctgctttctgttcatc

SEQ ID NO: 5225817 - DNA, 15 bp, Homo sapiens
agtagatctgtggcg

SEQ ID NO: 5225818 - DNA, 18 bp, Homo sapiens
agtagatgaacctgcagc

SEQ ID NO: 5225819 - DNA, 21 bp, Homo sapiens
agtagatgcatttgggtccag

SEQ ID NO: 5225820 - DNA, 20 bp, Homo sapiens
agtagatgcgcagccccatc

SEQ ID NO: 5225821 - DNA, 20 bp, Homo sapiens
agtagatgtggcctttgaat

SEQ ID NO: 5225822 - DNA, 17 bp, Homo sapiens
agtagattaaaaattat

SEQ ID NO: 5225823 - DNA, 18 bp, Homo sapiens
agtagattaaaaattata

SEQ ID NO: 5225824 - DNA, 23 bp, Homo sapiens
agtagattatggcctttttaagt

SEQ ID NO: 5225825 - DNA, 22 bp, Homo sapiens
agtagattcaagttgtgtctga

SEQ ID NO: 5225826 - DNA, 22 bp, Homo sapiens
agtagattctggacagtcagct

SEQ ID NO: 5225827 - DNA, 21 bp, Homo sapiens
agtagattcttacaaggccct

SEQ ID NO: 5225828 - DNA, 22 bp, Homo sapiens
agtagattgatctaaggcatgc

SEQ ID NO: 5225829 - DNA, 20 bp, Homo sapiens
agtagattgcagaaaattct

SEQ ID NO: 5225830 - DNA, 20 bp, Homo sapiens
agtagatttacagaacaaag

SEQ ID NO: 5225831 - DNA, 15 bp, Homo sapiens
agtagatttctatga

SEQ ID NO: 5225832 - DNA, 16 bp, Homo sapiens
agtgggctgcagcagc

SEQ ID NO: 5225833 - DNA, 15 bp, Homo sapiens
agtgggctgcctggg

SEQ ID NO: 5225834 - DNA, 16 bp, Homo sapiens
agtgggctgcctgggg

SEQ ID NO: 5225835 - DNA, 10 bp, Homo sapiens
agtgggctgt

SEQ ID NO: 5225836 - DNA, 16 bp, Homo sapiens
agtgggcttgattctg

SEQ ID NO: 5225837 - DNA, 14 bp, Homo sapiens
agtgggctttccag

SEQ ID NO: 5225838 - DNA, 16 bp, Homo sapiens
agtgggctttggtggc

SEQ ID NO: 5225839 - DNA, 18 bp, Homo sapiens
agtggggaacaggtccca

SEQ ID NO: 5225840 - DNA, 16 bp, Homo sapiens
agtggggaactgaggg

SEQ ID NO: 5225841 - DNA, 19 bp, Homo sapiens
agtggggaaggaggccaag

SEQ ID NO: 5225842 - DNA, 16 bp, Homo sapiens
agtggggaatgaagat

SEQ ID NO: 5225843 - DNA, 11 bp, Homo sapiens
agtggggacag

SEQ ID NO: 5225844 - DNA, 15 bp, Homo sapiens
agtggggacagagca

SEQ ID NO: 5225845 - DNA, 20 bp, Homo sapiens
agtggggaccccacccctca

SEQ ID NO: 5225846 - DNA, 23 bp, Homo sapiens
agtggggacgggggctgcttctc

SEQ ID NO: 5225847 - DNA, 22 bp, Homo sapiens
agtggggagagagcccttccca

SEQ ID NO: 5225848 - DNA, 12 bp, Homo sapiens
agtggggagagt

SEQ ID NO: 5225849 - DNA, 23 bp, Homo sapiens
agtggggagagttgtgatggagg

SEQ ID NO: 5225850 - DNA, 23 bp, Homo sapiens
agtggggaggagactcaggccca

SEQ ID NO: 5225851 - DNA, 12 bp, Homo sapiens
agtggggaggga

SEQ ID NO: 5225852 - DNA, 17 bp, Homo sapiens
agtggggaggggcctgg

SEQ ID NO: 5225853 - DNA, 23 bp, Homo sapiens
agtggggaggggcctggcctggg

SEQ ID NO: 5225854 - DNA, 20 bp, Homo sapiens
agtggggatggggcctccct

SEQ ID NO: 5225855 - DNA, 21 bp, Homo sapiens
agtggggatggggcctccctc

SEQ ID NO: 5225856 - DNA, 16 bp, Homo sapiens
agtggggcagagcctc

SEQ ID NO: 5225857 - DNA, 18 bp, Homo sapiens
agtggggcccatggcccc

SEQ ID NO: 5225858 - DNA, 15 bp, Homo sapiens
agtggggccccaaag

SEQ ID NO: 5225859 - DNA, 21 bp, Homo sapiens
agtggggccccaaagcccagc

SEQ ID NO: 5225860 - DNA, 22 bp, Homo sapiens
agtggggccccaaagcccagcc

SEQ ID NO: 5225861 - DNA, 12 bp, Homo sapiens
agtggggcctgt

SEQ ID NO: 5225862 - DNA, 18 bp, Homo sapiens
agtggggctcgccatgcc

SEQ ID NO: 5225863 - DNA, 13 bp, Homo sapiens
agtggggctctct

SEQ ID NO: 5225864 - DNA, 20 bp, Homo sapiens
agtggggctctctgagtcct

SEQ ID NO: 5225865 - DNA, 16 bp, Homo sapiens
agtggggctgcaggca

SEQ ID NO: 5225866 - DNA, 16 bp, Homo sapiens
agtggggctggaagca

SEQ ID NO: 5225867 - DNA, 18 bp, Homo sapiens
agtggggctggaagcaga

SEQ ID NO: 5225868 - DNA, 19 bp, Homo sapiens
agtggggctggggaaaggg

SEQ ID NO: 5225869 - DNA, 19 bp, Homo sapiens
agtgggggagtggccacag

SEQ ID NO: 5225870 - DNA, 18 bp, Homo sapiens
agtgggggatcacagcct

SEQ ID NO: 5225871 - DNA, 17 bp, Homo sapiens
agtgggggcagcccagg

SEQ ID NO: 5225872 - DNA, 14 bp, Homo sapiens
agtgggggccgctg

SEQ ID NO: 5225873 - DNA, 18 bp, Homo sapiens
agtgggggccgctggccc

SEQ ID NO: 5225874 - DNA, 18 bp, Homo sapiens
agtggggggaacgcccac

SEQ ID NO: 5225875 - DNA, 13 bp, Homo sapiens
agtggggggagga

SEQ ID NO: 5225876 - DNA, 18 bp, Homo sapiens
agtggggggtggacacag

SEQ ID NO: 5225877 - DNA, 12 bp, Homo sapiens
agtgggggtgga

SEQ ID NO: 5225878 - DNA, 17 bp, Homo sapiens
agtgggggtggaggacc

SEQ ID NO: 5225879 - DNA, 17 bp, Homo sapiens
agtggggtaattctgct

SEQ ID NO: 5225880 - DNA, 16 bp, Homo sapiens
agtggggtaggttggg

SEQ ID NO: 5225881 - DNA, 20 bp, Homo sapiens
agtggggtcccccctgagtg

SEQ ID NO: 5225882 - DNA, 23 bp, Homo sapiens
agtggggtctccctctcctgcct

SEQ ID NO: 5225883 - DNA, 20 bp, Homo sapiens
agtggggtgaaattttctta

SEQ ID NO: 5225884 - DNA, 14 bp, Homo sapiens
agtggggtgctggg

SEQ ID NO: 5225885 - DNA, 22 bp, Homo sapiens
agtggggttgcaaccactgcaa

SEQ ID NO: 5225886 - DNA, 15 bp, Homo sapiens
agtggggtttcctgg

SEQ ID NO: 5225887 - DNA, 21 bp, Homo sapiens
agtggggtttcgcagcctgag

SEQ ID NO: 5225888 - DNA, 21 bp, Homo sapiens
agtgggtaaatcagggacagg

SEQ ID NO: 5225889 - DNA, 22 bp, Homo sapiens
agtgggtacccccaggaccaga

SEQ ID NO: 5225890 - DNA, 18 bp, Homo sapiens
agtgggtactttctgaaa

SEQ ID NO: 5225891 - DNA, 15 bp, Homo sapiens
agtgggtatttctta

SEQ ID NO: 5225892 - DNA, 22 bp, Homo sapiens
agtgggtcatatgtttattcaa

SEQ ID NO: 5225893 - DNA, 14 bp, Homo sapiens
agtgggtctgggat

SEQ ID NO: 5225894 - DNA, 21 bp, Homo sapiens
agtgggtcttggaccagggca

SEQ ID NO: 5225895 - DNA, 19 bp, Homo sapiens
agtgggtgaataatacagt

SEQ ID NO: 5225896 - DNA, 21 bp, Homo sapiens
agtgggtggggacagaccagc

SEQ ID NO: 5225897 - DNA, 16 bp, Homo sapiens
agtgggttattctgga

SEQ ID NO: 5225898 - DNA, 18 bp, Homo sapiens
agtgggttattctggagt

SEQ ID NO: 5225899 - DNA, 22 bp, Homo sapiens
agtgggttcactagagctggga

SEQ ID NO: 5225900 - DNA, 16 bp, Homo sapiens
agtgggttctccaaac

SEQ ID NO: 5225901 - DNA, 14 bp, Homo sapiens
agtgggtttctgac

SEQ ID NO: 5225902 - DNA, 19 bp, Homo sapiens
agtggtaaatactgtgaaa

SEQ ID NO: 5225903 - DNA, 16 bp, Homo sapiens
agtggtaatcatatgt

SEQ ID NO: 5225904 - DNA, 20 bp, Homo sapiens
agtggtaatcatatgtgtct

SEQ ID NO: 5225905 - DNA, 15 bp, Homo sapiens
agtggtaccagctca

SEQ ID NO: 5225906 - DNA, 21 bp, Homo sapiens
agtggtaccagctcactccct

SEQ ID NO: 5225907 - DNA, 20 bp, Homo sapiens
agtggtactagtgtggtgtg

SEQ ID NO: 5225908 - DNA, 20 bp, Homo sapiens
agtggtagagtcctaggaca

SEQ ID NO: 5225909 - DNA, 14 bp, Homo sapiens
agtggtatagaaat

SEQ ID NO: 5225910 - DNA, 16 bp, Homo sapiens
agtggtatagaaatgc

SEQ ID NO: 5225911 - DNA, 22 bp, Homo sapiens
agtggtcaaaccgcactcaccc

SEQ ID NO: 5225912 - DNA, 16 bp, Homo sapiens
agtggtcactggtcag

SEQ ID NO: 5225913 - DNA, 17 bp, Homo sapiens
agtggtcatgctcagcc

SEQ ID NO: 5225914 - DNA, 20 bp, Homo sapiens
agtggtcatgctcagccttg

SEQ ID NO: 5225915 - DNA, 16 bp, Homo sapiens
agtggtccctgccctc

SEQ ID NO: 5225916 - DNA, 17 bp, Homo sapiens
agtggtcctcattcttg

SEQ ID NO: 5225917 - DNA, 19 bp, Homo sapiens
agtggtctcacctggaggc

SEQ ID NO: 5225918 - DNA, 16 bp, Homo sapiens
agtggtctcctctcag

SEQ ID NO: 5225919 - DNA, 22 bp, Homo sapiens
agtggtctccttcacatcagaa

SEQ ID NO: 5225920 - DNA, 19 bp, Homo sapiens
agtggtctctactgtggca

SEQ ID NO: 5225921 - DNA, 12 bp, Homo sapiens
agtggtctctgc

SEQ ID NO: 5225922 - DNA, 22 bp, Homo sapiens
agtggtctctgctggggaaggg

SEQ ID NO: 5225923 - DNA, 22 bp, Homo sapiens
agtggtctggaatggactgggt

SEQ ID NO: 5225924 - DNA, 15 bp, Homo sapiens
agtggtctttctgga

SEQ ID NO: 5225925 - DNA, 15 bp, Homo sapiens
agtggtctttgtaag

SEQ ID NO: 5225926 - DNA, 16 bp, Homo sapiens
agtggtctttgtaaga

SEQ ID NO: 5225927 - DNA, 16 bp, Homo sapiens
agtggtgaaatcttgt

SEQ ID NO: 5225928 - DNA, 20 bp, Homo sapiens
agtggtgacaaatcaagaat

SEQ ID NO: 5225929 - DNA, 17 bp, Homo sapiens
agtggtgaccaaaattt

SEQ ID NO: 5225930 - DNA, 15 bp, Homo sapiens
agtggtgagcaagca

SEQ ID NO: 5225931 - DNA, 19 bp, Homo sapiens
agtggtgagtggaagggag

SEQ ID NO: 5225932 - DNA, 15 bp, Homo sapiens
agtggtgatttgaaa

SEQ ID NO: 5225933 - DNA, 22 bp, Homo sapiens
agtggtgatttgaaaaatataa

SEQ ID NO: 5225934 - DNA, 16 bp, Homo sapiens
agtggtgctcagttgt

SEQ ID NO: 5225935 - DNA, 15 bp, Homo sapiens
agtggtggaggtggg

SEQ ID NO: 5225936 - DNA, 17 bp, Homo sapiens
agtggtggaggtgggtg

SEQ ID NO: 5225937 - DNA, 11 bp, Homo sapiens
agtggtggcag

SEQ ID NO: 5225938 - DNA, 18 bp, Homo sapiens
agtggtggcagggcctag

SEQ ID NO: 5225939 - DNA, 20 bp, Homo sapiens
agtggtggcctatttcagct

SEQ ID NO: 5225940 - DNA, 23 bp, Homo sapiens
agtggtggcctatttcagctgct

SEQ ID NO: 5225941 - DNA, 14 bp, Homo sapiens
agtggtggctctga

SEQ ID NO: 5225942 - DNA, 20 bp, Homo sapiens
agtggtggtaaccctggtgg

SEQ ID NO: 5225943 - DNA, 16 bp, Homo sapiens
agtggtggtgtctcac

SEQ ID NO: 5225944 - DNA, 17 bp, Homo sapiens
agtggtggttcctttgc

SEQ ID NO: 5225945 - DNA, 19 bp, Homo sapiens
agtggtggttttctgttct

SEQ ID NO: 5225946 - DNA, 18 bp, Homo sapiens
agtggtgtgatcccagct

SEQ ID NO: 5225947 - DNA, 15 bp, Homo sapiens
agtggtgtgatctca

SEQ ID NO: 5225948 - DNA, 17 bp, Homo sapiens
agtggtgtgtgaagttt

SEQ ID NO: 5225949 - DNA, 12 bp, Homo sapiens
agtggtgtgtgg

SEQ ID NO: 5225950 - DNA, 17 bp, Homo sapiens
agtggtgttttaaagag

SEQ ID NO: 5225951 - DNA, 17 bp, Homo sapiens
agtggtgttttttttcc

SEQ ID NO: 5225952 - DNA, 14 bp, Homo sapiens
agtggttattcatt

SEQ ID NO: 5225953 - DNA, 22 bp, Homo sapiens
agtggttattcattattcctca

SEQ ID NO: 5225954 - DNA, 13 bp, Homo sapiens
agtggttcaaatt

SEQ ID NO: 5225955 - DNA, 21 bp, Homo sapiens
agtggttcctaatcctctagg

SEQ ID NO: 5225956 - DNA, 14 bp, Homo sapiens
agtggttcctgtgg

SEQ ID NO: 5225957 - DNA, 17 bp, Homo sapiens
agtggttcgggggaaat

SEQ ID NO: 5225958 - DNA, 20 bp, Homo sapiens
agtggttctacaatctattt

SEQ ID NO: 5225959 - DNA, 21 bp, Homo sapiens
agtggttctacaatctattta

SEQ ID NO: 5225960 - DNA, 15 bp, Homo sapiens
agtggttgaatatga

SEQ ID NO: 5225961 - DNA, 15 bp, Homo sapiens
agtggttgcctgggg

SEQ ID NO: 5225962 - DNA, 21 bp, Homo sapiens
agtggttggatgtagtcacat

SEQ ID NO: 5225963 - DNA, 20 bp, Homo sapiens
agtggtttccacatgctctg

SEQ ID NO: 5225964 - DNA, 22 bp, Homo sapiens
agtggtttccacatgctctgag

SEQ ID NO: 5225965 - DNA, 22 bp, Homo sapiens
agtggtttccctgcccgaggtc

SEQ ID NO: 5225966 - DNA, 17 bp, Homo sapiens
agtggtttcggaaaaaa

SEQ ID NO: 5225967 - DNA, 22 bp, Homo sapiens
agtggtttctacttcccctggg

SEQ ID NO: 5225968 - DNA, 21 bp, Homo sapiens
agtggtttctgcgtgtgtata

SEQ ID NO: 5225969 - DNA, 17 bp, Homo sapiens
agtggtttgcaggtcag

SEQ ID NO: 5225970 - DNA, 21 bp, Homo sapiens
agtggtttgggccccattcag

SEQ ID NO: 5225971 - DNA, 14 bp, Homo sapiens
agtggttttaggat

SEQ ID NO: 5225972 - DNA, 18 bp, Homo sapiens
agtggttttatactgaag

SEQ ID NO: 5225973 - DNA, 23 bp, Homo sapiens
agtggttttatactgaaggaaaa

SEQ ID NO: 5225974 - DNA, 14 bp, Homo sapiens
agtgtaaaaatgag

SEQ ID NO: 5225975 - DNA, 11 bp, Homo sapiens
agtgtaaaata

SEQ ID NO: 5225976 - DNA, 18 bp, Homo sapiens
agtgtaaaatattttgaa

SEQ ID NO: 5225977 - DNA, 15 bp, Homo sapiens
agtgtaaaattgtta

SEQ ID NO: 5225978 - DNA, 15 bp, Homo sapiens
agtgtaaactgaaac

SEQ ID NO: 5225979 - DNA, 19 bp, Homo sapiens
agtgtaaagaataaatgaa

SEQ ID NO: 5225980 - DNA, 13 bp, Homo sapiens
agtgtaaagcatt

SEQ ID NO: 5225981 - DNA, 16 bp, Homo sapiens
agtgtaaagcattcca

SEQ ID NO: 5225982 - DNA, 17 bp, Homo sapiens
agtgtaaagcattccaa

SEQ ID NO: 5225983 - DNA, 20 bp, Homo sapiens
agtgtaaagcattccaacaa

SEQ ID NO: 5225984 - DNA, 22 bp, Homo sapiens
agtgtaaataattttaaataac

SEQ ID NO: 5225985 - DNA, 21 bp, Homo sapiens
agtgtaaatagttactccagt

SEQ ID NO: 5225986 - DNA, 15 bp, Homo sapiens
agtgtaacaagaaag

SEQ ID NO: 5225987 - DNA, 19 bp, Homo sapiens
agtgtaacaagaaaggaga

SEQ ID NO: 5225988 - DNA, 14 bp, Homo sapiens
agtgtaacagctga

SEQ ID NO: 5225989 - DNA, 16 bp, Homo sapiens
agtgtaacagctgagg

SEQ ID NO: 5225990 - DNA, 17 bp, Homo sapiens
agtgtaacagctgaggt

SEQ ID NO: 5225991 - DNA, 21 bp, Homo sapiens
agtgtaacgatgcactttgga

SEQ ID NO: 5225992 - DNA, 22 bp, Homo sapiens
agtgtaacgatgcactttggaa

SEQ ID NO: 5225993 - DNA, 16 bp, Homo sapiens
agtgtaacttgcttaa

SEQ ID NO: 5225994 - DNA, 18 bp, Homo sapiens
agtgtaacttgcttaaat

SEQ ID NO: 5225995 - DNA, 12 bp, Homo sapiens
agtgtaactttc

SEQ ID NO: 5225996 - DNA, 14 bp, Homo sapiens
agtgtaagaactgt

SEQ ID NO: 5225997 - DNA, 18 bp, Homo sapiens
agtgtaagaactgtacat

SEQ ID NO: 5225998 - DNA, 16 bp, Homo sapiens
agtgtaaggcataggg

SEQ ID NO: 5225999 - DNA, 13 bp, Homo sapiens
agtgtaataagac

SEQ ID NO: 5226000 - DNA, 20 bp, Homo sapiens
agtgtaatataattgtgtaa

SEQ ID NO: 5226001 - DNA, 12 bp, Homo sapiens
agtgtaatgtga

SEQ ID NO: 5226002 - DNA, 15 bp, Homo sapiens
agtgtaatgtgactt

SEQ ID NO: 5226003 - DNA, 17 bp, Homo sapiens
agtgtaattagcttttg

SEQ ID NO: 5226004 - DNA, 19 bp, Homo sapiens
agtgtaattttaatggctg

SEQ ID NO: 5226005 - DNA, 12 bp, Homo sapiens
agtgtacaattg

SEQ ID NO: 5226006 - DNA, 17 bp, Homo sapiens
agtgtacaattgatctt

SEQ ID NO: 5226007 - DNA, 15 bp, Homo sapiens
agtgtacacagactg

SEQ ID NO: 5226008 - DNA, 22 bp, Homo sapiens
agtgtacaccactttcccacac

SEQ ID NO: 5226009 - DNA, 14 bp, Homo sapiens
agtgtacagactct

SEQ ID NO: 5226010 - DNA, 18 bp, Homo sapiens
agtagatttctggcatat

SEQ ID NO: 5226011 - DNA, 18 bp, Homo sapiens
agtagattttctttaaaa

SEQ ID NO: 5226012 - DNA, 20 bp, Homo sapiens
agtagattttctttaaaaga

SEQ ID NO: 5226013 - DNA, 21 bp, Homo sapiens
agtagattttctttaaaagaa

SEQ ID NO: 5226014 - DNA, 15 bp, Homo sapiens
agtagcaaatgttta

SEQ ID NO: 5226015 - DNA, 18 bp, Homo sapiens
agtagcaaccctgtgata

SEQ ID NO: 5226016 - DNA, 18 bp, Homo sapiens
agtagcaaccttcatttt

SEQ ID NO: 5226017 - DNA, 23 bp, Homo sapiens
agtagcaaccttcattttacatt

SEQ ID NO: 5226018 - DNA, 16 bp, Homo sapiens
agtagcaaggaaggac

SEQ ID NO: 5226019 - DNA, 20 bp, Homo sapiens
agtagcaagttctagagaag

SEQ ID NO: 5226020 - DNA, 15 bp, Homo sapiens
agtagcaatgtgcct

SEQ ID NO: 5226021 - DNA, 21 bp, Homo sapiens
agtagcacaggctgagtgcag

SEQ ID NO: 5226022 - DNA, 20 bp, Homo sapiens
agtagcacccccagccatct

SEQ ID NO: 5226023 - DNA, 18 bp, Homo sapiens
agtagcaccctggattga

SEQ ID NO: 5226024 - DNA, 16 bp, Homo sapiens
agtagcaccttcagaa

SEQ ID NO: 5226025 - DNA, 21 bp, Homo sapiens
agtagcagaaaacagaggcca

SEQ ID NO: 5226026 - DNA, 13 bp, Homo sapiens
agtagcagaaata

SEQ ID NO: 5226027 - DNA, 12 bp, Homo sapiens
agtagcaggacc

SEQ ID NO: 5226028 - DNA, 21 bp, Homo sapiens
agtagcagggggggaaatgca

SEQ ID NO: 5226029 - DNA, 22 bp, Homo sapiens
agtagcagtgattgtcttaata

SEQ ID NO: 5226030 - DNA, 23 bp, Homo sapiens
agtagcatctcagtggtgtgtga

SEQ ID NO: 5226031 - DNA, 14 bp, Homo sapiens
agtagcatgagaga

SEQ ID NO: 5226032 - DNA, 18 bp, Homo sapiens
agtagcatggactctggg

SEQ ID NO: 5226033 - DNA, 22 bp, Homo sapiens
agtagcatttactgtgtctttg

SEQ ID NO: 5226034 - DNA, 22 bp, Homo sapiens
agtagcattttaatagtttcta

SEQ ID NO: 5226035 - DNA, 23 bp, Homo sapiens
agtagcattttaatagtttctaa

SEQ ID NO: 5226036 - DNA, 14 bp, Homo sapiens
agtagccagagttg

SEQ ID NO: 5226037 - DNA, 23 bp, Homo sapiens
agtagccagggtgtggccctgcc

SEQ ID NO: 5226038 - DNA, 19 bp, Homo sapiens
agtagccattttgtaactg

SEQ ID NO: 5226039 - DNA, 23 bp, Homo sapiens
agtagcccacaataatgaataat

SEQ ID NO: 5226040 - DNA, 22 bp, Homo sapiens
agtagccccaacccaaacctgg

SEQ ID NO: 5226041 - DNA, 21 bp, Homo sapiens
agtagcccttcagtcttaata

SEQ ID NO: 5226042 - DNA, 17 bp, Homo sapiens
agtagccgagagcctgc

SEQ ID NO: 5226043 - DNA, 18 bp, Homo sapiens
agtagcctatgaatgaaa

SEQ ID NO: 5226044 - DNA, 18 bp, Homo sapiens
agtagcctcttgtgtaac

SEQ ID NO: 5226045 - DNA, 19 bp, Homo sapiens
agtagctatgactgcagat

SEQ ID NO: 5226046 - DNA, 23 bp, Homo sapiens
agtagctccttggttttgcctct

SEQ ID NO: 5226047 - DNA, 22 bp, Homo sapiens
agtagctcgtcctcactggtct

SEQ ID NO: 5226048 - DNA, 15 bp, Homo sapiens
agtagctctcctgac

SEQ ID NO: 5226049 - DNA, 14 bp, Homo sapiens
agtagctctgcctt

SEQ ID NO: 5226050 - DNA, 18 bp, Homo sapiens
agtagctgaacctgtctg

SEQ ID NO: 5226051 - DNA, 14 bp, Homo sapiens
agtagctgagagga

SEQ ID NO: 5226052 - DNA, 18 bp, Homo sapiens
agtagctgagaggaagat

SEQ ID NO: 5226053 - DNA, 19 bp, Homo sapiens
agtagctgagaggaagatg

SEQ ID NO: 5226054 - DNA, 14 bp, Homo sapiens
agtagctgagctca

SEQ ID NO: 5226055 - DNA, 22 bp, Homo sapiens
agtagctgagctcacaaggcag

SEQ ID NO: 5226056 - DNA, 16 bp, Homo sapiens
agtagctgataaagaa

SEQ ID NO: 5226057 - DNA, 15 bp, Homo sapiens
agtagctgctaccta

SEQ ID NO: 5226058 - DNA, 18 bp, Homo sapiens
agtagctgcttcctggac

SEQ ID NO: 5226059 - DNA, 17 bp, Homo sapiens
agtagctggattacagg

SEQ ID NO: 5226060 - DNA, 23 bp, Homo sapiens
agtagctgggactacagatgtgg

SEQ ID NO: 5226061 - DNA, 17 bp, Homo sapiens
agtagctgggactgcag

SEQ ID NO: 5226062 - DNA, 21 bp, Homo sapiens
agtagctgggagtacaggcgt

SEQ ID NO: 5226063 - DNA, 21 bp, Homo sapiens
agtagctgggatgacaggcgc

SEQ ID NO: 5226064 - DNA, 22 bp, Homo sapiens
agtagctgggattttaaactag

SEQ ID NO: 5226065 - DNA, 20 bp, Homo sapiens
agtagctgggcctgtgcact

SEQ ID NO: 5226066 - DNA, 15 bp, Homo sapiens
agtagctgtcagatg

SEQ ID NO: 5226067 - DNA, 20 bp, Homo sapiens
agtagctgtcagatgtcaca

SEQ ID NO: 5226068 - DNA, 21 bp, Homo sapiens
agtagctgtcagatgtcacat

SEQ ID NO: 5226069 - DNA, 17 bp, Homo sapiens
agtagcttaaataaatt

SEQ ID NO: 5226070 - DNA, 19 bp, Homo sapiens
agtagcttaaataaattca

SEQ ID NO: 5226071 - DNA, 22 bp, Homo sapiens
agtagcttaaataaattcaaac

SEQ ID NO: 5226072 - DNA, 17 bp, Homo sapiens
agtagcttaagaaaaaa

SEQ ID NO: 5226073 - DNA, 14 bp, Homo sapiens
agtagcttatctca

SEQ ID NO: 5226074 - DNA, 13 bp, Homo sapiens
agtagcttgctcc

SEQ ID NO: 5226075 - DNA, 19 bp, Homo sapiens
agtagcttgctccctgtgt

SEQ ID NO: 5226076 - DNA, 23 bp, Homo sapiens
agtagcttgctccctgtgtccac

SEQ ID NO: 5226077 - DNA, 15 bp, Homo sapiens
agtagctttccacat

SEQ ID NO: 5226078 - DNA, 20 bp, Homo sapiens
agtagctttgcacttttcta

SEQ ID NO: 5226079 - DNA, 13 bp, Homo sapiens
agtaggaaagaat

SEQ ID NO: 5226080 - DNA, 22 bp, Homo sapiens
agtaggaagactttggaaagac

SEQ ID NO: 5226081 - DNA, 22 bp, Homo sapiens
agtaggacaaggtgcaggcagg

SEQ ID NO: 5226082 - DNA, 13 bp, Homo sapiens
agtaggaccaggc

SEQ ID NO: 5226083 - DNA, 12 bp, Homo sapiens
agtaggagagga

SEQ ID NO: 5226084 - DNA, 15 bp, Homo sapiens
agtaggagctgagct

SEQ ID NO: 5226085 - DNA, 20 bp, Homo sapiens
agtaggagtggctgaccagg

SEQ ID NO: 5226086 - DNA, 20 bp, Homo sapiens
agtaggagttttatatactg

SEQ ID NO: 5226087 - DNA, 22 bp, Homo sapiens
agtaggatatgcctgctctttg

SEQ ID NO: 5226088 - DNA, 22 bp, Homo sapiens
agtaggatttatgtattttgaa

SEQ ID NO: 5226089 - DNA, 17 bp, Homo sapiens
agtaggcatttttacca

SEQ ID NO: 5226090 - DNA, 21 bp, Homo sapiens
agtaggcggcgatttttgtat

SEQ ID NO: 5226091 - DNA, 22 bp, Homo sapiens
agtaggctccagacaggaggag

SEQ ID NO: 5226092 - DNA, 12 bp, Homo sapiens
agtaggctgccg

SEQ ID NO: 5226093 - DNA, 14 bp, Homo sapiens
agtaggctgggcct

SEQ ID NO: 5226094 - DNA, 21 bp, Homo sapiens
agtaggctgtattttctttta

SEQ ID NO: 5226095 - DNA, 17 bp, Homo sapiens
agtaggcttttaccatt

SEQ ID NO: 5226096 - DNA, 22 bp, Homo sapiens
agtaggcttttaccattagcat

SEQ ID NO: 5226097 - DNA, 22 bp, Homo sapiens
agtagggaaaatagggtccttg

SEQ ID NO: 5226098 - DNA, 23 bp, Homo sapiens
agtagggaatgggaggcttgctg

SEQ ID NO: 5226099 - DNA, 19 bp, Homo sapiens
agtagggatgcggatcctg

SEQ ID NO: 5226100 - DNA, 19 bp, Homo sapiens
agtaggggtaccactgaat

SEQ ID NO: 5226101 - DNA, 17 bp, Homo sapiens
agtaggggttgaagaaa

SEQ ID NO: 5226102 - DNA, 15 bp, Homo sapiens
agtagggtttgacat

SEQ ID NO: 5226103 - DNA, 15 bp, Homo sapiens
agtaggtcccggcca

SEQ ID NO: 5226104 - DNA, 23 bp, Homo sapiens
agtaggtcccggccagctctgga

SEQ ID NO: 5226105 - DNA, 20 bp, Homo sapiens
agtaggtcgttttaaaaaca

SEQ ID NO: 5226106 - DNA, 17 bp, Homo sapiens
agtaggtctgcacacat

SEQ ID NO: 5226107 - DNA, 18 bp, Homo sapiens
agtaggtctgggatggac

SEQ ID NO: 5226108 - DNA, 17 bp, Homo sapiens
agtaggtgatattcatt

SEQ ID NO: 5226109 - DNA, 13 bp, Homo sapiens
agtaggtgatgag

SEQ ID NO: 5226110 - DNA, 22 bp, Homo sapiens
agtaggtgggattacaggtgcc

SEQ ID NO: 5226111 - DNA, 23 bp, Homo sapiens
agtaggttgaggacaggagaggg

SEQ ID NO: 5226112 - DNA, 20 bp, Homo sapiens
agtagtaaaattagaaaaaa

SEQ ID NO: 5226113 - DNA, 18 bp, Homo sapiens
agtagtaccaaatgcttt

SEQ ID NO: 5226114 - DNA, 19 bp, Homo sapiens
agtagtaccaaatgcttta

SEQ ID NO: 5226115 - DNA, 14 bp, Homo sapiens
agtagtaccttgtt

SEQ ID NO: 5226116 - DNA, 17 bp, Homo sapiens
agtagtacttaatagta

SEQ ID NO: 5226117 - DNA, 15 bp, Homo sapiens
agtagtagtgtcttc

SEQ ID NO: 5226118 - DNA, 16 bp, Homo sapiens
agtagtataatgtatg

SEQ ID NO: 5226119 - DNA, 17 bp, Homo sapiens
agtagtcagaagcaggt

SEQ ID NO: 5226120 - DNA, 20 bp, Homo sapiens
agtagtcagaagcaggttct

SEQ ID NO: 5226121 - DNA, 13 bp, Homo sapiens
agtagtcagactg

SEQ ID NO: 5226122 - DNA, 18 bp, Homo sapiens
agtagtcagctagatcat

SEQ ID NO: 5226123 - DNA, 16 bp, Homo sapiens
agtagtccaggctgtc

SEQ ID NO: 5226124 - DNA, 13 bp, Homo sapiens
agtagtcctgtga

SEQ ID NO: 5226125 - DNA, 16 bp, Homo sapiens
agtagtccttggcata

SEQ ID NO: 5226126 - DNA, 21 bp, Homo sapiens
agtagtctctgtgaggcctta

SEQ ID NO: 5226127 - DNA, 14 bp, Homo sapiens
agtagtctgctcac

SEQ ID NO: 5226128 - DNA, 19 bp, Homo sapiens
agtagtctgtgtttaaagt

SEQ ID NO: 5226129 - DNA, 18 bp, Homo sapiens
agtagtcttatgtaaagt

SEQ ID NO: 5226130 - DNA, 17 bp, Homo sapiens
agtagtgagaagaatat

SEQ ID NO: 5226131 - DNA, 13 bp, Homo sapiens
agtagtgcattta

SEQ ID NO: 5226132 - DNA, 23 bp, Homo sapiens
agtagtgccaaaaggccccttcc

SEQ ID NO: 5226133 - DNA, 16 bp, Homo sapiens
agtagtgcctgtgatc

SEQ ID NO: 5226134 - DNA, 12 bp, Homo sapiens
agtagtgctatc

SEQ ID NO: 5226135 - DNA, 14 bp, Homo sapiens
agtagtggccactg

SEQ ID NO: 5226136 - DNA, 15 bp, Homo sapiens
agtagtggccactgg

SEQ ID NO: 5226137 - DNA, 16 bp, Homo sapiens
agtagtgggaaagata

SEQ ID NO: 5226138 - DNA, 23 bp, Homo sapiens
agtagtgtcactgcttgttatgc

SEQ ID NO: 5226139 - DNA, 20 bp, Homo sapiens
agtagtgtctggatcagtaa

SEQ ID NO: 5226140 - DNA, 13 bp, Homo sapiens
agtagtgtgagtg

SEQ ID NO: 5226141 - DNA, 22 bp, Homo sapiens
agtagtgtgagtgttagaaaaa

SEQ ID NO: 5226142 - DNA, 12 bp, Homo sapiens
agtagtgtggcc

SEQ ID NO: 5226143 - DNA, 23 bp, Homo sapiens
agtagtgttctgttcacttttcc

SEQ ID NO: 5226144 - DNA, 15 bp, Homo sapiens
agtagtgttgggtgg

SEQ ID NO: 5226145 - DNA, 23 bp, Homo sapiens
agtagtgttgggtggaggatgga

SEQ ID NO: 5226146 - DNA, 14 bp, Homo sapiens
agtagtgtttggaa

SEQ ID NO: 5226147 - DNA, 21 bp, Homo sapiens
agtagttaaaagtttttgtca

SEQ ID NO: 5226148 - DNA, 22 bp, Homo sapiens
agtagttactaaaatttacaca

SEQ ID NO: 5226149 - DNA, 18 bp, Homo sapiens
agtagttatataattgtt

SEQ ID NO: 5226150 - DNA, 23 bp, Homo sapiens
agtagttatcatgttagtaatac

SEQ ID NO: 5226151 - DNA, 19 bp, Homo sapiens
agtagttccacacaggttt

SEQ ID NO: 5226152 - DNA, 15 bp, Homo sapiens
agtagttctcaaagt

SEQ ID NO: 5226153 - DNA, 13 bp, Homo sapiens
agtagttctgtat

SEQ ID NO: 5226154 - DNA, 16 bp, Homo sapiens
agtagttctgtatttg

SEQ ID NO: 5226155 - DNA, 17 bp, Homo sapiens
agtagttctgtatttga

SEQ ID NO: 5226156 - DNA, 21 bp, Homo sapiens
agtagttctgtatttgaaagt

SEQ ID NO: 5226157 - DNA, 21 bp, Homo sapiens
agtagttgatgaccaatctct

SEQ ID NO: 5226158 - DNA, 23 bp, Homo sapiens
agtagttgatgaccaatctctgt

SEQ ID NO: 5226159 - DNA, 19 bp, Homo sapiens
agtagttgggattacaggt

SEQ ID NO: 5226160 - DNA, 17 bp, Homo sapiens
agtagttggtttgtatg

SEQ ID NO: 5226161 - DNA, 19 bp, Homo sapiens
agtagttggtttgtatgag

SEQ ID NO: 5226162 - DNA, 18 bp, Homo sapiens
agtagttgttggtctgta

SEQ ID NO: 5226163 - DNA, 21 bp, Homo sapiens
agtagtttctaagtctgttat

SEQ ID NO: 5226164 - DNA, 14 bp, Homo sapiens
agtagtttctcagg

SEQ ID NO: 5226165 - DNA, 13 bp, Homo sapiens
agtagtttgcatt

SEQ ID NO: 5226166 - DNA, 14 bp, Homo sapiens
agtagtttgcattt

SEQ ID NO: 5226167 - DNA, 14 bp, Homo sapiens
agtagtttggtttg

SEQ ID NO: 5226168 - DNA, 12 bp, Homo sapiens
agtagtttgtat

SEQ ID NO: 5226169 - DNA, 17 bp, Homo sapiens
agtagtttgtataactt

SEQ ID NO: 5226170 - DNA, 18 bp, Homo sapiens
agtagttttattttaata

SEQ ID NO: 5226171 - DNA, 13 bp, Homo sapiens
agtataaaatagt

SEQ ID NO: 5226172 - DNA, 16 bp, Homo sapiens
agtataaacaaagtta

SEQ ID NO: 5226173 - DNA, 17 bp, Homo sapiens
agtataaagaattgtgg

SEQ ID NO: 5226174 - DNA, 18 bp, Homo sapiens
agtataaagtaacccata

SEQ ID NO: 5226175 - DNA, 12 bp, Homo sapiens
agtataaagtca

SEQ ID NO: 5226176 - DNA, 14 bp, Homo sapiens
agtataaatgtaca

SEQ ID NO: 5226177 - DNA, 15 bp, Homo sapiens
agtataaatgtacat

SEQ ID NO: 5226178 - DNA, 16 bp, Homo sapiens
agtataaatgtacatc

SEQ ID NO: 5226179 - DNA, 23 bp, Homo sapiens
agtataaatttgtgtaatattac

SEQ ID NO: 5226180 - DNA, 14 bp, Homo sapiens
agtataacaaacta

SEQ ID NO: 5226181 - DNA, 17 bp, Homo sapiens
agtataacagcaaataa

SEQ ID NO: 5226182 - DNA, 14 bp, Homo sapiens
agtataacatgtcg

SEQ ID NO: 5226183 - DNA, 17 bp, Homo sapiens
agtataaccatatgata

SEQ ID NO: 5226184 - DNA, 21 bp, Homo sapiens
agtataaccatatgatactat

SEQ ID NO: 5226185 - DNA, 13 bp, Homo sapiens
agtataagaaatg

SEQ ID NO: 5226186 - DNA, 16 bp, Homo sapiens
agtgtacagattttat

SEQ ID NO: 5226187 - DNA, 18 bp, Homo sapiens
agtgtacagtatttacct

SEQ ID NO: 5226188 - DNA, 13 bp, Homo sapiens
agtgtacagtctt

SEQ ID NO: 5226189 - DNA, 22 bp, Homo sapiens
agtgtacatatgtaaaatattg

SEQ ID NO: 5226190 - DNA, 22 bp, Homo sapiens
agtgtaccaagtgcttcctaca

SEQ ID NO: 5226191 - DNA, 23 bp, Homo sapiens
agtgtaccaagtgcttcctacaa

SEQ ID NO: 5226192 - DNA, 21 bp, Homo sapiens
agtgtaccattaaaatatgca

SEQ ID NO: 5226193 - DNA, 20 bp, Homo sapiens
agtgtacccacgctgggtat

SEQ ID NO: 5226194 - DNA, 18 bp, Homo sapiens
agtgtacccatctttaat

SEQ ID NO: 5226195 - DNA, 22 bp, Homo sapiens
agtgtacccatctttaatttat

SEQ ID NO: 5226196 - DNA, 21 bp, Homo sapiens
agtgtacctcctctcagtgtt

SEQ ID NO: 5226197 - DNA, 18 bp, Homo sapiens
agtgtacctgtaaatgtc

SEQ ID NO: 5226198 - DNA, 16 bp, Homo sapiens
agtgtacgattcttaa

SEQ ID NO: 5226199 - DNA, 23 bp, Homo sapiens
agtgtactaattaacatataata

SEQ ID NO: 5226200 - DNA, 14 bp, Homo sapiens
agtgtactcccagg

SEQ ID NO: 5226201 - DNA, 15 bp, Homo sapiens
agtgtactgctttca

SEQ ID NO: 5226202 - DNA, 16 bp, Homo sapiens
agtgtactggatttaa

SEQ ID NO: 5226203 - DNA, 15 bp, Homo sapiens
agtgtactgtgcctg

SEQ ID NO: 5226204 - DNA, 22 bp, Homo sapiens
agtgtacttcataagatattct

SEQ ID NO: 5226205 - DNA, 15 bp, Homo sapiens
agtgtactttgaact

SEQ ID NO: 5226206 - DNA, 17 bp, Homo sapiens
agtgtactttgaacttc

SEQ ID NO: 5226207 - DNA, 19 bp, Homo sapiens
agtgtagaagaaaatatcc

SEQ ID NO: 5226208 - DNA, 15 bp, Homo sapiens
agtgtagaagcattc

SEQ ID NO: 5226209 - DNA, 19 bp, Homo sapiens
agtgtagaagcattccttc

SEQ ID NO: 5226210 - DNA, 20 bp, Homo sapiens
agtgtagacctgagctggga

SEQ ID NO: 5226211 - DNA, 14 bp, Homo sapiens
agtgtagattttat

SEQ ID NO: 5226212 - DNA, 16 bp, Homo sapiens
agtgtagcatcttcct

SEQ ID NO: 5226213 - DNA, 23 bp, Homo sapiens
agtgtagccaggtccccctgcag

SEQ ID NO: 5226214 - DNA, 18 bp, Homo sapiens
agtgtagcctaaagggca

SEQ ID NO: 5226215 - DNA, 19 bp, Homo sapiens
agtgtagcctaaagggcag

SEQ ID NO: 5226216 - DNA, 15 bp, Homo sapiens
agtgtagcgggagga

SEQ ID NO: 5226217 - DNA, 12 bp, Homo sapiens
agtgtagctgta

SEQ ID NO: 5226218 - DNA, 19 bp, Homo sapiens
agtgtagctgtaagggcag

SEQ ID NO: 5226219 - DNA, 20 bp, Homo sapiens
agtgtagctgtaagggcagt

SEQ ID NO: 5226220 - DNA, 14 bp, Homo sapiens
agtgtagctgtgaa

SEQ ID NO: 5226221 - DNA, 23 bp, Homo sapiens
agtgtagctgtgtggctttcctt

SEQ ID NO: 5226222 - DNA, 21 bp, Homo sapiens
agtgtaggataatataaaaag

SEQ ID NO: 5226223 - DNA, 13 bp, Homo sapiens
agtgtaggggtgg

SEQ ID NO: 5226224 - DNA, 16 bp, Homo sapiens
agtgtagtcaggtgct

SEQ ID NO: 5226225 - DNA, 17 bp, Homo sapiens
agtgtagtcaggtgctc

SEQ ID NO: 5226226 - DNA, 16 bp, Homo sapiens
agtgtagtcccggagg

SEQ ID NO: 5226227 - DNA, 17 bp, Homo sapiens
agtgtagttaatttatc

SEQ ID NO: 5226228 - DNA, 21 bp, Homo sapiens
agtgtataaatccaatatcat

SEQ ID NO: 5226229 - DNA, 16 bp, Homo sapiens
agtgtataatataaaa

SEQ ID NO: 5226230 - DNA, 23 bp, Homo sapiens
agtgtatacatgtgtgggtgctg

SEQ ID NO: 5226231 - DNA, 19 bp, Homo sapiens
agtgtataccacctgtaca

SEQ ID NO: 5226232 - DNA, 13 bp, Homo sapiens
agtgtatatatat

SEQ ID NO: 5226233 - DNA, 16 bp, Homo sapiens
agtgtatatatattta

SEQ ID NO: 5226234 - DNA, 22 bp, Homo sapiens
agtgtatatatatttatatata

SEQ ID NO: 5226235 - DNA, 14 bp, Homo sapiens
agtgtatatcagaa

SEQ ID NO: 5226236 - DNA, 20 bp, Homo sapiens
agtgtatatgattctcttga

SEQ ID NO: 5226237 - DNA, 13 bp, Homo sapiens
agtgtatatgtga

SEQ ID NO: 5226238 - DNA, 15 bp, Homo sapiens
agtgtatatgtgatt

SEQ ID NO: 5226239 - DNA, 16 bp, Homo sapiens
agtgtatatttattca

SEQ ID NO: 5226240 - DNA, 21 bp, Homo sapiens
agtgtatatttattcataatg

SEQ ID NO: 5226241 - DNA, 13 bp, Homo sapiens
agtgtatcaaaat

SEQ ID NO: 5226242 - DNA, 15 bp, Homo sapiens
agtgtatcaaaatgc

SEQ ID NO: 5226243 - DNA, 17 bp, Homo sapiens
agtgtatcaaaatgctc

SEQ ID NO: 5226244 - DNA, 18 bp, Homo sapiens
agtgtatcaaaatgctct

SEQ ID NO: 5226245 - DNA, 20 bp, Homo sapiens
agtgtatcaggtcagggact

SEQ ID NO: 5226246 - DNA, 13 bp, Homo sapiens
agtgtatctcgaa

SEQ ID NO: 5226247 - DNA, 21 bp, Homo sapiens
agtgtatctcgaagtcttcca

SEQ ID NO: 5226248 - DNA, 20 bp, Homo sapiens
agtgtatgagttgcatttgt

SEQ ID NO: 5226249 - DNA, 15 bp, Homo sapiens
agtgtatgattactg

SEQ ID NO: 5226250 - DNA, 19 bp, Homo sapiens
agtgtatgattactggcct

SEQ ID NO: 5226251 - DNA, 23 bp, Homo sapiens
agtgtatgctgtagctgaaagag

SEQ ID NO: 5226252 - DNA, 16 bp, Homo sapiens
agtgtatggaaataaa

SEQ ID NO: 5226253 - DNA, 20 bp, Homo sapiens
agtgtatggaaataaatgta

SEQ ID NO: 5226254 - DNA, 22 bp, Homo sapiens
agtgtatggaaataaatgtatc

SEQ ID NO: 5226255 - DNA, 14 bp, Homo sapiens
agtgtatggggcag

SEQ ID NO: 5226256 - DNA, 16 bp, Homo sapiens
agtgtatggggcagct

SEQ ID NO: 5226257 - DNA, 15 bp, Homo sapiens
agtgtatgtatacac

SEQ ID NO: 5226258 - DNA, 17 bp, Homo sapiens
agtgtatgtatacacac

SEQ ID NO: 5226259 - DNA, 16 bp, Homo sapiens
agtgtatgtcttgtat

SEQ ID NO: 5226260 - DNA, 14 bp, Homo sapiens
agtgtatgtgaatt

SEQ ID NO: 5226261 - DNA, 15 bp, Homo sapiens
agtgtatgtgtgtgt

SEQ ID NO: 5226262 - DNA, 13 bp, Homo sapiens
agtgtattaatct

SEQ ID NO: 5226263 - DNA, 15 bp, Homo sapiens
agtgtattatcactg

SEQ ID NO: 5226264 - DNA, 16 bp, Homo sapiens
agtgtattatttctgg

SEQ ID NO: 5226265 - DNA, 18 bp, Homo sapiens
agtgtattctatttgtgt

SEQ ID NO: 5226266 - DNA, 23 bp, Homo sapiens
agtgtatttaagaaagggaaagc

SEQ ID NO: 5226267 - DNA, 19 bp, Homo sapiens
agtgtatttaatgtttgta

SEQ ID NO: 5226268 - DNA, 14 bp, Homo sapiens
agtgtatttcagtt

SEQ ID NO: 5226269 - DNA, 18 bp, Homo sapiens
agtgtattttaaaataga

SEQ ID NO: 5226270 - DNA, 15 bp, Homo sapiens
agtgtattttaaatt

SEQ ID NO: 5226271 - DNA, 23 bp, Homo sapiens
agtgtattttaaattctcagtca

SEQ ID NO: 5226272 - DNA, 22 bp, Homo sapiens
agtgtattttataaaattaaag

SEQ ID NO: 5226273 - DNA, 16 bp, Homo sapiens
agtgtatttttgtaat

SEQ ID NO: 5226274 - DNA, 22 bp, Homo sapiens
agtgtattttttaaaattgatt

SEQ ID NO: 5226275 - DNA, 18 bp, Homo sapiens
agtgtatttttttactaa

SEQ ID NO: 5226276 - DNA, 19 bp, Homo sapiens
agtgtcaaataaacactgt

SEQ ID NO: 5226277 - DNA, 15 bp, Homo sapiens
agtgtcaaccagaca

SEQ ID NO: 5226278 - DNA, 17 bp, Homo sapiens
agtgtcaagaaggaaga

SEQ ID NO: 5226279 - DNA, 14 bp, Homo sapiens
agtgtcaagttgtg

SEQ ID NO: 5226280 - DNA, 19 bp, Homo sapiens
agtgtcaagttgtgcttgt

SEQ ID NO: 5226281 - DNA, 16 bp, Homo sapiens
agtgtcacctccttcc

SEQ ID NO: 5226282 - DNA, 17 bp, Homo sapiens
agtgtcacctccttccc

SEQ ID NO: 5226283 - DNA, 19 bp, Homo sapiens
agtgtcacctccttcccca

SEQ ID NO: 5226284 - DNA, 20 bp, Homo sapiens
agtgtcacctccttccccag

SEQ ID NO: 5226285 - DNA, 23 bp, Homo sapiens
agtgtcacctccttccccagctc

SEQ ID NO: 5226286 - DNA, 20 bp, Homo sapiens
agtgtcacctctctcagagc

SEQ ID NO: 5226287 - DNA, 16 bp, Homo sapiens
agtgtcactcaaggcg

SEQ ID NO: 5226288 - DNA, 16 bp, Homo sapiens
agtgtcactccataaa

SEQ ID NO: 5226289 - DNA, 17 bp, Homo sapiens
agtgtcacttgactctt

SEQ ID NO: 5226290 - DNA, 16 bp, Homo sapiens
agtgtcacttttttcc

SEQ ID NO: 5226291 - DNA, 21 bp, Homo sapiens
agtgtcacttttttcctgtca

SEQ ID NO: 5226292 - DNA, 22 bp, Homo sapiens
agtgtcacttttttcctgtcaa

SEQ ID NO: 5226293 - DNA, 12 bp, Homo sapiens
agtgtcagagtc

SEQ ID NO: 5226294 - DNA, 14 bp, Homo sapiens
agtgtcagagtcat

SEQ ID NO: 5226295 - DNA, 21 bp, Homo sapiens
agtgtcagctgtggggaacat

SEQ ID NO: 5226296 - DNA, 14 bp, Homo sapiens
agtgtcaggcactg

SEQ ID NO: 5226297 - DNA, 14 bp, Homo sapiens
agtgtcagggtcca

SEQ ID NO: 5226298 - DNA, 13 bp, Homo sapiens
agtgtcagtacta

SEQ ID NO: 5226299 - DNA, 14 bp, Homo sapiens
agtgtcagtactaa

SEQ ID NO: 5226300 - DNA, 15 bp, Homo sapiens
agtgtcagtactaag

SEQ ID NO: 5226301 - DNA, 14 bp, Homo sapiens
agtgtcataaagat

SEQ ID NO: 5226302 - DNA, 18 bp, Homo sapiens
agtgtcatccaccagtgt

SEQ ID NO: 5226303 - DNA, 20 bp, Homo sapiens
agtgtcatgaagtgcacagg

SEQ ID NO: 5226304 - DNA, 12 bp, Homo sapiens
agtgtcattatt

SEQ ID NO: 5226305 - DNA, 21 bp, Homo sapiens
agtgtcattattagtctccta

SEQ ID NO: 5226306 - DNA, 23 bp, Homo sapiens
agtgtcattttctgttatacaca

SEQ ID NO: 5226307 - DNA, 14 bp, Homo sapiens
agtgtccaaagcag

SEQ ID NO: 5226308 - DNA, 17 bp, Homo sapiens
agtgtccaaagcagggt

SEQ ID NO: 5226309 - DNA, 20 bp, Homo sapiens
agtgtccaaagcagggtctg

SEQ ID NO: 5226310 - DNA, 21 bp, Homo sapiens
agtgtccaaagcagggtctgg

SEQ ID NO: 5226311 - DNA, 23 bp, Homo sapiens
agtgtccagaccattgtcttcca

SEQ ID NO: 5226312 - DNA, 14 bp, Homo sapiens
agtgtccagagacc

SEQ ID NO: 5226313 - DNA, 14 bp, Homo sapiens
agtgtccagcttcc

SEQ ID NO: 5226314 - DNA, 18 bp, Homo sapiens
agtgtccagcttccaaag

SEQ ID NO: 5226315 - DNA, 21 bp, Homo sapiens
agtgtccattatctgctgttc

SEQ ID NO: 5226316 - DNA, 21 bp, Homo sapiens
agtgtccattgacatgtacag

SEQ ID NO: 5226317 - DNA, 17 bp, Homo sapiens
agtgtccattttgtgaa

SEQ ID NO: 5226318 - DNA, 18 bp, Homo sapiens
agtgtccattttgtgaag

SEQ ID NO: 5226319 - DNA, 21 bp, Homo sapiens
agtgtccattttgtgaagccc

SEQ ID NO: 5226320 - DNA, 19 bp, Homo sapiens
agtgtcccagggccctgga

SEQ ID NO: 5226321 - DNA, 23 bp, Homo sapiens
agtgtccccagcctacctctcca

SEQ ID NO: 5226322 - DNA, 15 bp, Homo sapiens
agtgtccccaggggc

SEQ ID NO: 5226323 - DNA, 21 bp, Homo sapiens
agtgtccccatgggctcccac

SEQ ID NO: 5226324 - DNA, 18 bp, Homo sapiens
agtgtcccccacccccac

SEQ ID NO: 5226325 - DNA, 18 bp, Homo sapiens
agtgtccccccttgaagc

SEQ ID NO: 5226326 - DNA, 14 bp, Homo sapiens
agtgtcccctccac

SEQ ID NO: 5226327 - DNA, 16 bp, Homo sapiens
agtgtcccctgcccca

SEQ ID NO: 5226328 - DNA, 16 bp, Homo sapiens
agtgtccgagaactaa

SEQ ID NO: 5226329 - DNA, 14 bp, Homo sapiens
agtgtcctcagggg

SEQ ID NO: 5226330 - DNA, 14 bp, Homo sapiens
agtgtcctcatcta

SEQ ID NO: 5226331 - DNA, 15 bp, Homo sapiens
agtgtcctgagctca

SEQ ID NO: 5226332 - DNA, 17 bp, Homo sapiens
agtgtcctgagctcagc

SEQ ID NO: 5226333 - DNA, 20 bp, Homo sapiens
agtgtcctgagctcagcgtg

SEQ ID NO: 5226334 - DNA, 13 bp, Homo sapiens
agtgtcctgccca

SEQ ID NO: 5226335 - DNA, 20 bp, Homo sapiens
agtgtcctgctacctttgtc

SEQ ID NO: 5226336 - DNA, 13 bp, Homo sapiens
agtgtcctggacc

SEQ ID NO: 5226337 - DNA, 20 bp, Homo sapiens
agtgtcctggaccctggcct

SEQ ID NO: 5226338 - DNA, 13 bp, Homo sapiens
agtgtcctgtctg

SEQ ID NO: 5226339 - DNA, 16 bp, Homo sapiens
agtgtcctgtctgctg

SEQ ID NO: 5226340 - DNA, 21 bp, Homo sapiens
agtgtcctgtgctttctgcat

SEQ ID NO: 5226341 - DNA, 16 bp, Homo sapiens
agtgtccttagtgtat

SEQ ID NO: 5226342 - DNA, 18 bp, Homo sapiens
agtgtccttgctctagag

SEQ ID NO: 5226343 - DNA, 13 bp, Homo sapiens
agtgtcctttcca

SEQ ID NO: 5226344 - DNA, 15 bp, Homo sapiens
agtgtcgagtccagt

SEQ ID NO: 5226345 - DNA, 16 bp, Homo sapiens
agtgtcgccgtccctc

SEQ ID NO: 5226346 - DNA, 21 bp, Homo sapiens
agtgtcgccgtccctctgcct

SEQ ID NO: 5226347 - DNA, 18 bp, Homo sapiens
agtgtcgtgtctgctgtt

SEQ ID NO: 5226348 - DNA, 20 bp, Homo sapiens
agtgtctaggcactgagcag

SEQ ID NO: 5226349 - DNA, 19 bp, Homo sapiens
agtgtctataaaagaaaca

SEQ ID NO: 5226350 - DNA, 15 bp, Homo sapiens
agtgtctatggagca

SEQ ID NO: 5226351 - DNA, 13 bp, Homo sapiens
agtgtctccacct

SEQ ID NO: 5226352 - DNA, 15 bp, Homo sapiens
agtgtctcctctctg

SEQ ID NO: 5226353 - DNA, 22 bp, Homo sapiens
agtgtctcggagggattcccct

SEQ ID NO: 5226354 - DNA, 20 bp, Homo sapiens
agtgtctctgcctggagcag

SEQ ID NO: 5226355 - DNA, 20 bp, Homo sapiens
agtgtctcttgactggctca

SEQ ID NO: 5226356 - DNA, 17 bp, Homo sapiens
agtgtctgcagtcctgg

SEQ ID NO: 5226357 - DNA, 21 bp, Homo sapiens
agtgtctgctgctgcctccct

SEQ ID NO: 5226358 - DNA, 17 bp, Homo sapiens
agtgtctggaattgtgg

SEQ ID NO: 5226359 - DNA, 13 bp, Homo sapiens
agtgtctggagcg

SEQ ID NO: 5226360 - DNA, 18 bp, Homo sapiens
agtgtctggatcagtaaa

SEQ ID NO: 5226361 - DNA, 20 bp, Homo sapiens
agtgtctggatcagtaaaat

SEQ ID NO: 5226362 - DNA, 16 bp, Homo sapiens
agtgtctggcacacag

SEQ ID NO: 5226363 - DNA, 14 bp, Homo sapiens
agtgtctggcccag

SEQ ID NO: 5226364 - DNA, 18 bp, Homo sapiens
agtataagatttttgaaa

SEQ ID NO: 5226365 - DNA, 21 bp, Homo sapiens
agtataatattaaggcttact

SEQ ID NO: 5226366 - DNA, 20 bp, Homo sapiens
agtataatctcctctgctca

SEQ ID NO: 5226367 - DNA, 13 bp, Homo sapiens
agtataattaaca

SEQ ID NO: 5226368 - DNA, 23 bp, Homo sapiens
agtataattaacatgttaaacca

SEQ ID NO: 5226369 - DNA, 14 bp, Homo sapiens
agtataatttgaca

SEQ ID NO: 5226370 - DNA, 14 bp, Homo sapiens
agtataattttggt

SEQ ID NO: 5226371 - DNA, 18 bp, Homo sapiens
agtataattttttgtaat

SEQ ID NO: 5226372 - DNA, 15 bp, Homo sapiens
agtatacaaacattt

SEQ ID NO: 5226373 - DNA, 18 bp, Homo sapiens
agtatacaagataagctt

SEQ ID NO: 5226374 - DNA, 16 bp, Homo sapiens
agtatacaagtgtttc

SEQ ID NO: 5226375 - DNA, 21 bp, Homo sapiens
agtatacacatcataaacaaa

SEQ ID NO: 5226376 - DNA, 21 bp, Homo sapiens
agtatacagttcaataaactt

SEQ ID NO: 5226377 - DNA, 12 bp, Homo sapiens
agtatacattgt

SEQ ID NO: 5226378 - DNA, 19 bp, Homo sapiens
agtatacattttataatga

SEQ ID NO: 5226379 - DNA, 15 bp, Homo sapiens
agtataccagagaag

SEQ ID NO: 5226380 - DNA, 15 bp, Homo sapiens
agtatacctcatttt

SEQ ID NO: 5226381 - DNA, 19 bp, Homo sapiens
agtatacctcatttttcat

SEQ ID NO: 5226382 - DNA, 15 bp, Homo sapiens
agtatacctggcttt

SEQ ID NO: 5226383 - DNA, 23 bp, Homo sapiens
agtatacctgtggtttggtttta

SEQ ID NO: 5226384 - DNA, 20 bp, Homo sapiens
agtatacgtataaatatcag

SEQ ID NO: 5226385 - DNA, 19 bp, Homo sapiens
agtatacgtttttaaatag

SEQ ID NO: 5226386 - DNA, 23 bp, Homo sapiens
agtatactagggagccatttgag

SEQ ID NO: 5226387 - DNA, 14 bp, Homo sapiens
agtatactgtgtgg

SEQ ID NO: 5226388 - DNA, 22 bp, Homo sapiens
agtatacttttcccctgttaaa

SEQ ID NO: 5226389 - DNA, 23 bp, Homo sapiens
agtatacttttcccctgttaaac

SEQ ID NO: 5226390 - DNA, 17 bp, Homo sapiens
agtatacttttgtttca

SEQ ID NO: 5226391 - DNA, 15 bp, Homo sapiens
agtatagaaaatctt

SEQ ID NO: 5226392 - DNA, 12 bp, Homo sapiens
agtatagatggt

SEQ ID NO: 5226393 - DNA, 16 bp, Homo sapiens
agtataggataaatta

SEQ ID NO: 5226394 - DNA, 14 bp, Homo sapiens
agtataggatggat

SEQ ID NO: 5226395 - DNA, 15 bp, Homo sapiens
agtatagtagaaaga

SEQ ID NO: 5226396 - DNA, 15 bp, Homo sapiens
agtatataaatacta

SEQ ID NO: 5226397 - DNA, 14 bp, Homo sapiens
agtatataagcttt

SEQ ID NO: 5226398 - DNA, 17 bp, Homo sapiens
agtatataagctttttt

SEQ ID NO: 5226399 - DNA, 13 bp, Homo sapiens
agtatataataac

SEQ ID NO: 5226400 - DNA, 14 bp, Homo sapiens
agtatataataact

SEQ ID NO: 5226401 - DNA, 15 bp, Homo sapiens
agtatataataactt

SEQ ID NO: 5226402 - DNA, 19 bp, Homo sapiens
agtatataatggtttcaaa

SEQ ID NO: 5226403 - DNA, 11 bp, Homo sapiens
agtatatactg

SEQ ID NO: 5226404 - DNA, 15 bp, Homo sapiens
agtatatacttttaa

SEQ ID NO: 5226405 - DNA, 16 bp, Homo sapiens
agtatatacttttaaa

SEQ ID NO: 5226406 - DNA, 17 bp, Homo sapiens
agtatatacttttaaat

SEQ ID NO: 5226407 - DNA, 21 bp, Homo sapiens
agtatatacttttaaattatg

SEQ ID NO: 5226408 - DNA, 19 bp, Homo sapiens
agtatatagccttaagtct

SEQ ID NO: 5226409 - DNA, 21 bp, Homo sapiens
agtatatattctacacatata

SEQ ID NO: 5226410 - DNA, 20 bp, Homo sapiens
agtatatcccaagtgcactt

SEQ ID NO: 5226411 - DNA, 18 bp, Homo sapiens
agtatatctaatggctgt

SEQ ID NO: 5226412 - DNA, 13 bp, Homo sapiens
agtatatctggac

SEQ ID NO: 5226413 - DNA, 18 bp, Homo sapiens
agtatatctggacaagcc

SEQ ID NO: 5226414 - DNA, 22 bp, Homo sapiens
agtatatctggacaagccaact

SEQ ID NO: 5226415 - DNA, 15 bp, Homo sapiens
agtatatgaaatatt

SEQ ID NO: 5226416 - DNA, 20 bp, Homo sapiens
agtatatgaaatattttgaa

SEQ ID NO: 5226417 - DNA, 17 bp, Homo sapiens
agtatatggcatatgaa

SEQ ID NO: 5226418 - DNA, 13 bp, Homo sapiens
agtatatgtaaca

SEQ ID NO: 5226419 - DNA, 17 bp, Homo sapiens
agtatatgtaacagttt

SEQ ID NO: 5226420 - DNA, 21 bp, Homo sapiens
agtatatgtaacagtttaaaa

SEQ ID NO: 5226421 - DNA, 15 bp, Homo sapiens
agtatatgtcattta

SEQ ID NO: 5226422 - DNA, 17 bp, Homo sapiens
agtatatgtcatttact

SEQ ID NO: 5226423 - DNA, 14 bp, Homo sapiens
agtatattaaaaat

SEQ ID NO: 5226424 - DNA, 19 bp, Homo sapiens
agtatattaaaaatggtaa

SEQ ID NO: 5226425 - DNA, 19 bp, Homo sapiens
agtatattagtttgattta

SEQ ID NO: 5226426 - DNA, 19 bp, Homo sapiens
agtatattatatggcagga

SEQ ID NO: 5226427 - DNA, 15 bp, Homo sapiens
agtatattattatta

SEQ ID NO: 5226428 - DNA, 14 bp, Homo sapiens
agtatattcaaaaa

SEQ ID NO: 5226429 - DNA, 15 bp, Homo sapiens
agtatattcaaaaat

SEQ ID NO: 5226430 - DNA, 22 bp, Homo sapiens
agtatattcctctgctgaacaa

SEQ ID NO: 5226431 - DNA, 21 bp, Homo sapiens
agtatattcttattggaaatg

SEQ ID NO: 5226432 - DNA, 16 bp, Homo sapiens
agtatattcttgtaaa

SEQ ID NO: 5226433 - DNA, 20 bp, Homo sapiens
agtatattcttgtaaataca

SEQ ID NO: 5226434 - DNA, 14 bp, Homo sapiens
agtatattgaaaag

SEQ ID NO: 5226435 - DNA, 15 bp, Homo sapiens
agtatattgaaaaga

SEQ ID NO: 5226436 - DNA, 18 bp, Homo sapiens
agtatattgttgaagaga

SEQ ID NO: 5226437 - DNA, 15 bp, Homo sapiens
agtatatttaaactc

SEQ ID NO: 5226438 - DNA, 23 bp, Homo sapiens
agtatatttaagaagccaagggg

SEQ ID NO: 5226439 - DNA, 13 bp, Homo sapiens
agtatatttaatt

SEQ ID NO: 5226440 - DNA, 23 bp, Homo sapiens
agtatatttaattttgacataag

SEQ ID NO: 5226441 - DNA, 20 bp, Homo sapiens
agtatatttatataattatg

SEQ ID NO: 5226442 - DNA, 20 bp, Homo sapiens
agtatatttccattcagaca

SEQ ID NO: 5226443 - DNA, 22 bp, Homo sapiens
agtatatttcttcgttcttttt

SEQ ID NO: 5226444 - DNA, 18 bp, Homo sapiens
agtatatttgtaaaagct

SEQ ID NO: 5226445 - DNA, 18 bp, Homo sapiens
agtatattttctgtattt

SEQ ID NO: 5226446 - DNA, 13 bp, Homo sapiens
agtatattttctt

SEQ ID NO: 5226447 - DNA, 17 bp, Homo sapiens
agtatcaaagaaaaaca

SEQ ID NO: 5226448 - DNA, 17 bp, Homo sapiens
agtatcaaaggcagaaa

SEQ ID NO: 5226449 - DNA, 19 bp, Homo sapiens
agtatcaaatattagatgt

SEQ ID NO: 5226450 - DNA, 21 bp, Homo sapiens
agtatcaaatattagatgtga

SEQ ID NO: 5226451 - DNA, 23 bp, Homo sapiens
agtatcaaatattagatgtgatt

SEQ ID NO: 5226452 - DNA, 22 bp, Homo sapiens
agtatcaacttcccagtgatct

SEQ ID NO: 5226453 - DNA, 16 bp, Homo sapiens
agtatcaaggctgcct

SEQ ID NO: 5226454 - DNA, 19 bp, Homo sapiens
agtatcaaggctgcctgga

SEQ ID NO: 5226455 - DNA, 16 bp, Homo sapiens
agtatcaagtatagaa

SEQ ID NO: 5226456 - DNA, 18 bp, Homo sapiens
agtatcaagtgttctaaa

SEQ ID NO: 5226457 - DNA, 19 bp, Homo sapiens
agtatcaatccttgttcag

SEQ ID NO: 5226458 - DNA, 13 bp, Homo sapiens
agtatcactgtct

SEQ ID NO: 5226459 - DNA, 17 bp, Homo sapiens
agtatcactgtctttcc

SEQ ID NO: 5226460 - DNA, 13 bp, Homo sapiens
agtatcagaacaa

SEQ ID NO: 5226461 - DNA, 14 bp, Homo sapiens
agtatcagaattga

SEQ ID NO: 5226462 - DNA, 18 bp, Homo sapiens
agtatcagagatgtccat

SEQ ID NO: 5226463 - DNA, 16 bp, Homo sapiens
agtatcagctacaatt

SEQ ID NO: 5226464 - DNA, 22 bp, Homo sapiens
agtatcagtcatgacagatgaa

SEQ ID NO: 5226465 - DNA, 20 bp, Homo sapiens
agtatcagtgttttaaattc

SEQ ID NO: 5226466 - DNA, 22 bp, Homo sapiens
agtatcagtgttttaaattctg

SEQ ID NO: 5226467 - DNA, 12 bp, Homo sapiens
agtatcatgcat

SEQ ID NO: 5226468 - DNA, 19 bp, Homo sapiens
agtatcatggaaatattat

SEQ ID NO: 5226469 - DNA, 20 bp, Homo sapiens
agtatccaattatgtgacaa

SEQ ID NO: 5226470 - DNA, 22 bp, Homo sapiens
agtatccacagaaaatgtaaac

SEQ ID NO: 5226471 - DNA, 14 bp, Homo sapiens
agtatccactttgc

SEQ ID NO: 5226472 - DNA, 11 bp, Homo sapiens
agtatccaggc

SEQ ID NO: 5226473 - DNA, 13 bp, Homo sapiens
agtatcctccagg

SEQ ID NO: 5226474 - DNA, 20 bp, Homo sapiens
agtatcctccaggtttttca

SEQ ID NO: 5226475 - DNA, 16 bp, Homo sapiens
agtatcctgaaacagt

SEQ ID NO: 5226476 - DNA, 20 bp, Homo sapiens
agtatcctgagagcccagaa

SEQ ID NO: 5226477 - DNA, 14 bp, Homo sapiens
agtatccttcattg

SEQ ID NO: 5226478 - DNA, 13 bp, Homo sapiens
agtatccttcctt

SEQ ID NO: 5226479 - DNA, 14 bp, Homo sapiens
agtatctaaaagtg

SEQ ID NO: 5226480 - DNA, 20 bp, Homo sapiens
agtatctaaatttggaactt

SEQ ID NO: 5226481 - DNA, 21 bp, Homo sapiens
agtatctaaatttggaactta

SEQ ID NO: 5226482 - DNA, 14 bp, Homo sapiens
agtatctaactctt

SEQ ID NO: 5226483 - DNA, 18 bp, Homo sapiens
agtatctacctggaaaca

SEQ ID NO: 5226484 - DNA, 19 bp, Homo sapiens
agtatctatatatgtgtat

SEQ ID NO: 5226485 - DNA, 23 bp, Homo sapiens
agtatctatatatgtgtatgtac

SEQ ID NO: 5226486 - DNA, 16 bp, Homo sapiens
agtatctcaacaacat

SEQ ID NO: 5226487 - DNA, 10 bp, Homo sapiens
agtatctcat

SEQ ID NO: 5226488 - DNA, 22 bp, Homo sapiens
agtatctcatcaacaaagaaat

SEQ ID NO: 5226489 - DNA, 23 bp, Homo sapiens
agtatctcggacctttcagctgt

SEQ ID NO: 5226490 - DNA, 20 bp, Homo sapiens
agtatctctactttcctgat

SEQ ID NO: 5226491 - DNA, 23 bp, Homo sapiens
agtatctctactttcctgatgtt

SEQ ID NO: 5226492 - DNA, 13 bp, Homo sapiens
agtatctctggcc

SEQ ID NO: 5226493 - DNA, 16 bp, Homo sapiens
agtatctcttcagtct

SEQ ID NO: 5226494 - DNA, 18 bp, Homo sapiens
agtatctcttcagtctct

SEQ ID NO: 5226495 - DNA, 13 bp, Homo sapiens
agtatctggctgg

SEQ ID NO: 5226496 - DNA, 14 bp, Homo sapiens
agtatctgggaact

SEQ ID NO: 5226497 - DNA, 18 bp, Homo sapiens
agtatctgggattattct

SEQ ID NO: 5226498 - DNA, 19 bp, Homo sapiens
agtatctgggattattctt

SEQ ID NO: 5226499 - DNA, 20 bp, Homo sapiens
agtatctgggattattcttt

SEQ ID NO: 5226500 - DNA, 14 bp, Homo sapiens
agtatctgtacctg

SEQ ID NO: 5226501 - DNA, 12 bp, Homo sapiens
agtatctgtata

SEQ ID NO: 5226502 - DNA, 14 bp, Homo sapiens
agtatctgtgaact

SEQ ID NO: 5226503 - DNA, 15 bp, Homo sapiens
agtatcttaaaattg

SEQ ID NO: 5226504 - DNA, 15 bp, Homo sapiens
agtatcttagagttt

SEQ ID NO: 5226505 - DNA, 12 bp, Homo sapiens
agtatcttcaaa

SEQ ID NO: 5226506 - DNA, 17 bp, Homo sapiens
agtatcttcaaaaatac

SEQ ID NO: 5226507 - DNA, 11 bp, Homo sapiens
agtatcttgaa

SEQ ID NO: 5226508 - DNA, 22 bp, Homo sapiens
agtatcttgaaatcctggaaaa

SEQ ID NO: 5226509 - DNA, 12 bp, Homo sapiens
agtatcttgaag

SEQ ID NO: 5226510 - DNA, 15 bp, Homo sapiens
agtatcttgaagact

SEQ ID NO: 5226511 - DNA, 17 bp, Homo sapiens
agtatctttaaatataa

SEQ ID NO: 5226512 - DNA, 13 bp, Homo sapiens
agtatgaaaataa

SEQ ID NO: 5226513 - DNA, 19 bp, Homo sapiens
agtatgaaaatggaaattt

SEQ ID NO: 5226514 - DNA, 16 bp, Homo sapiens
agtatgaaagctgggg

SEQ ID NO: 5226515 - DNA, 16 bp, Homo sapiens
agtatgaaattatata

SEQ ID NO: 5226516 - DNA, 23 bp, Homo sapiens
agtatgaaccacatggaacttaa

SEQ ID NO: 5226517 - DNA, 15 bp, Homo sapiens
agtatgaacttgaga

SEQ ID NO: 5226518 - DNA, 22 bp, Homo sapiens
agtatgaacttgagatctgtat

SEQ ID NO: 5226519 - DNA, 13 bp, Homo sapiens
agtatgaatatta

SEQ ID NO: 5226520 - DNA, 15 bp, Homo sapiens
agtatgaatctatgc

SEQ ID NO: 5226521 - DNA, 17 bp, Homo sapiens
agtatgaatctatgcca

SEQ ID NO: 5226522 - DNA, 14 bp, Homo sapiens
agtatgaatgatgt

SEQ ID NO: 5226523 - DNA, 20 bp, Homo sapiens
agtatgacgctgatacataa

SEQ ID NO: 5226524 - DNA, 20 bp, Homo sapiens
agtatgagaaatacagtgct

SEQ ID NO: 5226525 - DNA, 16 bp, Homo sapiens
agtatgaggcatttgt

SEQ ID NO: 5226526 - DNA, 20 bp, Homo sapiens
agtatgaggcatttgtttga

SEQ ID NO: 5226527 - DNA, 23 bp, Homo sapiens
agtatgaggcatttgtttgaact

SEQ ID NO: 5226528 - DNA, 18 bp, Homo sapiens
agtatgagtcttctgtaa

SEQ ID NO: 5226529 - DNA, 22 bp, Homo sapiens
agtatgagtgcaagcaaagcag

SEQ ID NO: 5226530 - DNA, 21 bp, Homo sapiens
agtatgagtgttgtgcctact

SEQ ID NO: 5226531 - DNA, 13 bp, Homo sapiens
agtatgagttatc

SEQ ID NO: 5226532 - DNA, 21 bp, Homo sapiens
agtatgatgaaaataattttc

SEQ ID NO: 5226533 - DNA, 23 bp, Homo sapiens
agtatgatgaaaataattttcca

SEQ ID NO: 5226534 - DNA, 22 bp, Homo sapiens
agtatgatggaacagtgaaagt

SEQ ID NO: 5226535 - DNA, 23 bp, Homo sapiens
agtatgatttgttcctttctgga

SEQ ID NO: 5226536 - DNA, 19 bp, Homo sapiens
agtatgatttttacaataa

SEQ ID NO: 5226537 - DNA, 13 bp, Homo sapiens
agtatgcaaaata

SEQ ID NO: 5226538 - DNA, 18 bp, Homo sapiens
agtatgcaagaagaatat

SEQ ID NO: 5226539 - DNA, 18 bp, Homo sapiens
agtatgcactaatcaata

SEQ ID NO: 5226540 - DNA, 16 bp, Homo sapiens
agtatgcatgcagtct

SEQ ID NO: 5226541 - DNA, 22 bp, Homo sapiens
agtatgccaaaaatatatgcta

SEQ ID NO: 5226542 - DNA, 13 bp, Homo sapiens
agtatgccttaag

SEQ ID NO: 5226543 - DNA, 21 bp, Homo sapiens
agtgtctggcccagccatggc

SEQ ID NO: 5226544 - DNA, 22 bp, Homo sapiens
agtgtctggcccagccatggct

SEQ ID NO: 5226545 - DNA, 23 bp, Homo sapiens
agtgtctggcccagccatggctg

SEQ ID NO: 5226546 - DNA, 23 bp, Homo sapiens
agtgtctggcccgcaatactgta

SEQ ID NO: 5226547 - DNA, 12 bp, Homo sapiens
agtgtctggctg

SEQ ID NO: 5226548 - DNA, 14 bp, Homo sapiens
agtgtctggctgca

SEQ ID NO: 5226549 - DNA, 13 bp, Homo sapiens
agtgtctggcttt

SEQ ID NO: 5226550 - DNA, 15 bp, Homo sapiens
agtgtctggcttttt

SEQ ID NO: 5226551 - DNA, 20 bp, Homo sapiens
agtgtctgggtttggcccaa

SEQ ID NO: 5226552 - DNA, 22 bp, Homo sapiens
agtgtctgtatcggagacagtg

SEQ ID NO: 5226553 - DNA, 13 bp, Homo sapiens
agtgtctgtattt

SEQ ID NO: 5226554 - DNA, 13 bp, Homo sapiens
agtgtctgtccat

SEQ ID NO: 5226555 - DNA, 18 bp, Homo sapiens
agtgtctgtccatctgtc

SEQ ID NO: 5226556 - DNA, 15 bp, Homo sapiens
agtgtctgtgccatg

SEQ ID NO: 5226557 - DNA, 14 bp, Homo sapiens
agtgtctgtgtgtg

SEQ ID NO: 5226558 - DNA, 15 bp, Homo sapiens
agtgtctgtgtgtgt

SEQ ID NO: 5226559 - DNA, 15 bp, Homo sapiens
agtgtcttaattaaa

SEQ ID NO: 5226560 - DNA, 13 bp, Homo sapiens
agtgtcttccata

SEQ ID NO: 5226561 - DNA, 14 bp, Homo sapiens
agtgtcttcctgtg

SEQ ID NO: 5226562 - DNA, 18 bp, Homo sapiens
agtgtcttctgttcccaa

SEQ ID NO: 5226563 - DNA, 13 bp, Homo sapiens
agtgtctttccac

SEQ ID NO: 5226564 - DNA, 14 bp, Homo sapiens
agtgtctttcggaa

SEQ ID NO: 5226565 - DNA, 19 bp, Homo sapiens
agtgtctttctagccataa

SEQ ID NO: 5226566 - DNA, 15 bp, Homo sapiens
agtgtctttctttgg

SEQ ID NO: 5226567 - DNA, 15 bp, Homo sapiens
agtgtcttttgacat

SEQ ID NO: 5226568 - DNA, 16 bp, Homo sapiens
agtgtcttttttggcc

SEQ ID NO: 5226569 - DNA, 23 bp, Homo sapiens
agtgtcttttttttcttcacctc

SEQ ID NO: 5226570 - DNA, 15 bp, Homo sapiens
agtgtgaaatagaca

SEQ ID NO: 5226571 - DNA, 14 bp, Homo sapiens
agtgtgaaatatat

SEQ ID NO: 5226572 - DNA, 22 bp, Homo sapiens
agtgtgaagacactgtgcaggc

SEQ ID NO: 5226573 - DNA, 20 bp, Homo sapiens
agtgtgaagacccaaaacag

SEQ ID NO: 5226574 - DNA, 14 bp, Homo sapiens
agtgtgaagatctt

SEQ ID NO: 5226575 - DNA, 10 bp, Homo sapiens
agtgtgaagc

SEQ ID NO: 5226576 - DNA, 13 bp, Homo sapiens
agtgtgaagcctg

SEQ ID NO: 5226577 - DNA, 20 bp, Homo sapiens
agtgtgaagcttccttggct

SEQ ID NO: 5226578 - DNA, 17 bp, Homo sapiens
agtgtgaagtatatatt

SEQ ID NO: 5226579 - DNA, 22 bp, Homo sapiens
agtgtgaagtatatattcccct

SEQ ID NO: 5226580 - DNA, 13 bp, Homo sapiens
agtgtgaagttag

SEQ ID NO: 5226581 - DNA, 18 bp, Homo sapiens
agtgtgaagttagaattc

SEQ ID NO: 5226582 - DNA, 22 bp, Homo sapiens
agtgtgaagttagaattccttc

SEQ ID NO: 5226583 - DNA, 17 bp, Homo sapiens
agtgtgaatagcctggc

SEQ ID NO: 5226584 - DNA, 14 bp, Homo sapiens
agtgtgaatattaa

SEQ ID NO: 5226585 - DNA, 17 bp, Homo sapiens
agtgtgacagggccagt

SEQ ID NO: 5226586 - DNA, 19 bp, Homo sapiens
agtgtgaccaaaagttaca

SEQ ID NO: 5226587 - DNA, 16 bp, Homo sapiens
agtgtgaccagttttg

SEQ ID NO: 5226588 - DNA, 17 bp, Homo sapiens
agtgtgaccagttttga

SEQ ID NO: 5226589 - DNA, 18 bp, Homo sapiens
agtgtgacctcctgtgac

SEQ ID NO: 5226590 - DNA, 21 bp, Homo sapiens
agtgtgactccttatctcttt

SEQ ID NO: 5226591 - DNA, 12 bp, Homo sapiens
agtgtgacttct

SEQ ID NO: 5226592 - DNA, 14 bp, Homo sapiens
agtgtgacttctta

SEQ ID NO: 5226593 - DNA, 17 bp, Homo sapiens
agtgtgagaacttccaa

SEQ ID NO: 5226594 - DNA, 16 bp, Homo sapiens
agtgtgagagagactg

SEQ ID NO: 5226595 - DNA, 22 bp, Homo sapiens
agtgtgagcatcttgccagcct

SEQ ID NO: 5226596 - DNA, 16 bp, Homo sapiens
agtgtgagctcttccc

SEQ ID NO: 5226597 - DNA, 17 bp, Homo sapiens
agtgtgagctcttccct

SEQ ID NO: 5226598 - DNA, 19 bp, Homo sapiens
agtgtgaggacctccctgt

SEQ ID NO: 5226599 - DNA, 23 bp, Homo sapiens
agtgtgaggagagggtggcatca

SEQ ID NO: 5226600 - DNA, 14 bp, Homo sapiens
agtgtgagggcagc

SEQ ID NO: 5226601 - DNA, 17 bp, Homo sapiens
agtgtgagggtgcaggg

SEQ ID NO: 5226602 - DNA, 18 bp, Homo sapiens
agtgtgagggtgcaggga

SEQ ID NO: 5226603 - DNA, 17 bp, Homo sapiens
agtgtgagtaagagctg

SEQ ID NO: 5226604 - DNA, 17 bp, Homo sapiens
agtgtgagtggcagcca

SEQ ID NO: 5226605 - DNA, 20 bp, Homo sapiens
agtgtgagtggcagccatgc

SEQ ID NO: 5226606 - DNA, 22 bp, Homo sapiens
agtgtgatgtatgtgtaataaa

SEQ ID NO: 5226607 - DNA, 23 bp, Homo sapiens
agtgtgatgtatgtgtaataaat

SEQ ID NO: 5226608 - DNA, 19 bp, Homo sapiens
agtgtgattgggaataaat

SEQ ID NO: 5226609 - DNA, 21 bp, Homo sapiens
agtgtgattgggaataaatat

SEQ ID NO: 5226610 - DNA, 22 bp, Homo sapiens
agtgtgattgggaataaatatg

SEQ ID NO: 5226611 - DNA, 19 bp, Homo sapiens
agtgtgatttgaattctgt

SEQ ID NO: 5226612 - DNA, 22 bp, Homo sapiens
agtgtgatttttttcacattta

SEQ ID NO: 5226613 - DNA, 13 bp, Homo sapiens
agtgtgcaaagaa

SEQ ID NO: 5226614 - DNA, 19 bp, Homo sapiens
agtgtgcaagcaaagaacc

SEQ ID NO: 5226615 - DNA, 22 bp, Homo sapiens
agtgtgcactaaggggcccggc

SEQ ID NO: 5226616 - DNA, 22 bp, Homo sapiens
agtgtgcagtataattttctaa

SEQ ID NO: 5226617 - DNA, 17 bp, Homo sapiens
agtgtgcagtatctgtg

SEQ ID NO: 5226618 - DNA, 16 bp, Homo sapiens
agtgtgcagtggtgca

SEQ ID NO: 5226619 - DNA, 19 bp, Homo sapiens
agtgtgcatattgtacact

SEQ ID NO: 5226620 - DNA, 18 bp, Homo sapiens
agtgtgcatggaggccct

SEQ ID NO: 5226621 - DNA, 22 bp, Homo sapiens
agtgtgccaccctctgcagggc

SEQ ID NO: 5226622 - DNA, 17 bp, Homo sapiens
agtgtgcccttctctta

SEQ ID NO: 5226623 - DNA, 14 bp, Homo sapiens
agtgtgcctctctc

SEQ ID NO: 5226624 - DNA, 23 bp, Homo sapiens
agtgtgcggatgataactactga

SEQ ID NO: 5226625 - DNA, 16 bp, Homo sapiens
agtgtgctaaaaatga

SEQ ID NO: 5226626 - DNA, 22 bp, Homo sapiens
agtgtgctaacctcactgcctc

SEQ ID NO: 5226627 - DNA, 18 bp, Homo sapiens
agtgtgctcggacacagt

SEQ ID NO: 5226628 - DNA, 18 bp, Homo sapiens
agtgtgctgactttttaa

SEQ ID NO: 5226629 - DNA, 20 bp, Homo sapiens
agtgtgctgctgttctgtgt

SEQ ID NO: 5226630 - DNA, 21 bp, Homo sapiens
agtgtgctgctgttctgtgta

SEQ ID NO: 5226631 - DNA, 12 bp, Homo sapiens
agtgtgctggag

SEQ ID NO: 5226632 - DNA, 19 bp, Homo sapiens
agtgtgctgtatggcccag

SEQ ID NO: 5226633 - DNA, 21 bp, Homo sapiens
agtgtgctgtatggcccaggc

SEQ ID NO: 5226634 - DNA, 22 bp, Homo sapiens
agtgtgctgtatggcccaggca

SEQ ID NO: 5226635 - DNA, 22 bp, Homo sapiens
agtgtgcttctgttatcaaaca

SEQ ID NO: 5226636 - DNA, 12 bp, Homo sapiens
agtgtgctttat

SEQ ID NO: 5226637 - DNA, 17 bp, Homo sapiens
agtgtgctttataaaaa

SEQ ID NO: 5226638 - DNA, 17 bp, Homo sapiens
agtgtggaaattaagaa

SEQ ID NO: 5226639 - DNA, 14 bp, Homo sapiens
agtgtggactctgg

SEQ ID NO: 5226640 - DNA, 17 bp, Homo sapiens
agtgtggacttggcagg

SEQ ID NO: 5226641 - DNA, 15 bp, Homo sapiens
agtgtggaggccact

SEQ ID NO: 5226642 - DNA, 19 bp, Homo sapiens
agtgtggaggggagatata

SEQ ID NO: 5226643 - DNA, 22 bp, Homo sapiens
agtgtggagtgggtaatccagg

SEQ ID NO: 5226644 - DNA, 16 bp, Homo sapiens
agtgtggatgtaaatt

SEQ ID NO: 5226645 - DNA, 21 bp, Homo sapiens
agtgtggatgtaaattttata

SEQ ID NO: 5226646 - DNA, 15 bp, Homo sapiens
agtgtggcaaaataa

SEQ ID NO: 5226647 - DNA, 17 bp, Homo sapiens
agtgtggcagtttggca

SEQ ID NO: 5226648 - DNA, 18 bp, Homo sapiens
agtgtggcctcttctgag

SEQ ID NO: 5226649 - DNA, 11 bp, Homo sapiens
agtgtggcctg

SEQ ID NO: 5226650 - DNA, 14 bp, Homo sapiens
agtgtggcctggat

SEQ ID NO: 5226651 - DNA, 19 bp, Homo sapiens
agtgtggcctgtgccagca

SEQ ID NO: 5226652 - DNA, 22 bp, Homo sapiens
agtgtggcctgtgccagcacca

SEQ ID NO: 5226653 - DNA, 12 bp, Homo sapiens
agtgtggctccc

SEQ ID NO: 5226654 - DNA, 16 bp, Homo sapiens
agtgtggctcccctct

SEQ ID NO: 5226655 - DNA, 21 bp, Homo sapiens
agtgtggctcccctctattta

SEQ ID NO: 5226656 - DNA, 14 bp, Homo sapiens
agtgtggctggtgt

SEQ ID NO: 5226657 - DNA, 16 bp, Homo sapiens
agtgtggctggtgtcc

SEQ ID NO: 5226658 - DNA, 15 bp, Homo sapiens
agtgtgggacaggct

SEQ ID NO: 5226659 - DNA, 16 bp, Homo sapiens
agtgtgggactccagg

SEQ ID NO: 5226660 - DNA, 22 bp, Homo sapiens
agtgtgggactccaggccagct

SEQ ID NO: 5226661 - DNA, 18 bp, Homo sapiens
agtgtgggagtgcagaga

SEQ ID NO: 5226662 - DNA, 16 bp, Homo sapiens
agtgtgggcgctctcc

SEQ ID NO: 5226663 - DNA, 19 bp, Homo sapiens
agtgtgggcgctctcccta

SEQ ID NO: 5226664 - DNA, 15 bp, Homo sapiens
agtgtgggctgccct

SEQ ID NO: 5226665 - DNA, 16 bp, Homo sapiens
agtgtgggcttgacca

SEQ ID NO: 5226666 - DNA, 18 bp, Homo sapiens
agtgtggggagggcaggt

SEQ ID NO: 5226667 - DNA, 16 bp, Homo sapiens
agtgtgggtctgtgtg

SEQ ID NO: 5226668 - DNA, 22 bp, Homo sapiens
agtgtgggtgatcagaaggctg

SEQ ID NO: 5226669 - DNA, 15 bp, Homo sapiens
agtgtggtctgtaat

SEQ ID NO: 5226670 - DNA, 16 bp, Homo sapiens
agtgtggtgtcttgcg

SEQ ID NO: 5226671 - DNA, 9 bp, Homo sapiens
agtgtgtaa

SEQ ID NO: 5226672 - DNA, 14 bp, Homo sapiens
agtgtgtaaaatta

SEQ ID NO: 5226673 - DNA, 21 bp, Homo sapiens
agtgtgtaaaattaatgtaat

SEQ ID NO: 5226674 - DNA, 12 bp, Homo sapiens
agtgtgtaaaca

SEQ ID NO: 5226675 - DNA, 12 bp, Homo sapiens
agtgtgtaatga

SEQ ID NO: 5226676 - DNA, 19 bp, Homo sapiens
agtgtgtaattatgtaaat

SEQ ID NO: 5226677 - DNA, 12 bp, Homo sapiens
agtgtgtacttc

SEQ ID NO: 5226678 - DNA, 21 bp, Homo sapiens
agtgtgtagaaacacagccta

SEQ ID NO: 5226679 - DNA, 17 bp, Homo sapiens
agtgtgtataaaacatt

SEQ ID NO: 5226680 - DNA, 16 bp, Homo sapiens
agtgtgtattgttccc

SEQ ID NO: 5226681 - DNA, 19 bp, Homo sapiens
agtgtgtatttaactctgt

SEQ ID NO: 5226682 - DNA, 20 bp, Homo sapiens
agtgtgtcaagattgcaaag

SEQ ID NO: 5226683 - DNA, 19 bp, Homo sapiens
agtgtgtcacactgagctg

SEQ ID NO: 5226684 - DNA, 18 bp, Homo sapiens
agtgtgtcagtttttcct

SEQ ID NO: 5226685 - DNA, 18 bp, Homo sapiens
agtgtgtccaagtgtgtg

SEQ ID NO: 5226686 - DNA, 21 bp, Homo sapiens
agtgtgtccaagtgtgtgtgc

SEQ ID NO: 5226687 - DNA, 15 bp, Homo sapiens
agtgtgtccatcata

SEQ ID NO: 5226688 - DNA, 14 bp, Homo sapiens
agtgtgtccatcct

SEQ ID NO: 5226689 - DNA, 21 bp, Homo sapiens
agtgtgtccttggggcacagt

SEQ ID NO: 5226690 - DNA, 15 bp, Homo sapiens
agtgtgtctcctgca

SEQ ID NO: 5226691 - DNA, 12 bp, Homo sapiens
agtgtgtctgct

SEQ ID NO: 5226692 - DNA, 14 bp, Homo sapiens
agtgtgtctgctga

SEQ ID NO: 5226693 - DNA, 16 bp, Homo sapiens
agtgtgtctgctgagt

SEQ ID NO: 5226694 - DNA, 12 bp, Homo sapiens
agtgtgtctggg

SEQ ID NO: 5226695 - DNA, 14 bp, Homo sapiens
agtgtgtctgggat

SEQ ID NO: 5226696 - DNA, 13 bp, Homo sapiens
agtgtgtcttcct

SEQ ID NO: 5226697 - DNA, 22 bp, Homo sapiens
agtgtgtgaaaattcaggtgct

SEQ ID NO: 5226698 - DNA, 14 bp, Homo sapiens
agtgtgtgagtgtg

SEQ ID NO: 5226699 - DNA, 17 bp, Homo sapiens
agtgtgtgcatgtgtgc

SEQ ID NO: 5226700 - DNA, 18 bp, Homo sapiens
agtgtgtgcatgtgtgtg

SEQ ID NO: 5226701 - DNA, 21 bp, Homo sapiens
agtgtgtgctcagcagcccca

SEQ ID NO: 5226702 - DNA, 14 bp, Homo sapiens
agtgtgtggctggg

SEQ ID NO: 5226703 - DNA, 16 bp, Homo sapiens
agtgtgtggctgggcg

SEQ ID NO: 5226704 - DNA, 13 bp, Homo sapiens
agtgtgtggggga

SEQ ID NO: 5226705 - DNA, 16 bp, Homo sapiens
agtgtgtgggggagat

SEQ ID NO: 5226706 - DNA, 20 bp, Homo sapiens
agtgtgtggtcaacatttct

SEQ ID NO: 5226707 - DNA, 16 bp, Homo sapiens
agtgtgtggtgttagg

SEQ ID NO: 5226708 - DNA, 17 bp, Homo sapiens
agtgtgtgtatactgta

SEQ ID NO: 5226709 - DNA, 19 bp, Homo sapiens
agtgtgtgtatactgtaat

SEQ ID NO: 5226710 - DNA, 14 bp, Homo sapiens
agtgtgtgtgcaga

SEQ ID NO: 5226711 - DNA, 13 bp, Homo sapiens
agtgtgtgtgcat

SEQ ID NO: 5226712 - DNA, 18 bp, Homo sapiens
agtgtgtgtgcatgtgtg

SEQ ID NO: 5226713 - DNA, 13 bp, Homo sapiens
agtgtgtgtgtct

SEQ ID NO: 5226714 - DNA, 18 bp, Homo sapiens
agtgtgtgtgtgcatgtg

SEQ ID NO: 5226715 - DNA, 19 bp, Homo sapiens
agtgtgtgtgtgtgtctgt

SEQ ID NO: 5226716 - DNA, 24 bp, Homo sapiens
agtgtgtgttgcaaatcactctgc

SEQ ID NO: 5226717 - DNA, 21 bp, Homo sapiens
agtgtgtgtttgtgtgtttca

SEQ ID NO: 5226718 - DNA, 19 bp, Homo sapiens
agtgtgtgtttttcataaa

SEQ ID NO: 5226719 - DNA, 12 bp, Homo sapiens
agtgtgttctga

SEQ ID NO: 5226720 - DNA, 14 bp, Homo sapiens
agtgtgttctgatg

SEQ ID NO: 5226721 - DNA, 17 bp, Homo sapiens
agtgtgttctgattaga

SEQ ID NO: 5226722 - DNA, 22 bp, Homo sapiens
agtgtgttgttgctttaggctc

SEQ ID NO: 5226723 - DNA, 17 bp, Homo sapiens
agtatgccttaagcaga

SEQ ID NO: 5226724 - DNA, 15 bp, Homo sapiens
agtatgctatgctat

SEQ ID NO: 5226725 - DNA, 14 bp, Homo sapiens
agtatgctctgagt

SEQ ID NO: 5226726 - DNA, 15 bp, Homo sapiens
agtatgctctgagta

SEQ ID NO: 5226727 - DNA, 19 bp, Homo sapiens
agtatgctgttttaataat

SEQ ID NO: 5226728 - DNA, 23 bp, Homo sapiens
agtatgcttgaaaagataaatta

SEQ ID NO: 5226729 - DNA, 19 bp, Homo sapiens
agtatgcttgggccctgca

SEQ ID NO: 5226730 - DNA, 21 bp, Homo sapiens
agtatggaagggaggggtcct

SEQ ID NO: 5226731 - DNA, 19 bp, Homo sapiens
agtatggaatattcatttt

SEQ ID NO: 5226732 - DNA, 14 bp, Homo sapiens
agtatggaattttc

SEQ ID NO: 5226733 - DNA, 14 bp, Homo sapiens
agtatggagctcag

SEQ ID NO: 5226734 - DNA, 15 bp, Homo sapiens
agtatggcctgtgtc

SEQ ID NO: 5226735 - DNA, 17 bp, Homo sapiens
agtatgggactggcctc

SEQ ID NO: 5226736 - DNA, 18 bp, Homo sapiens
agtatgggggttgtaaat

SEQ ID NO: 5226737 - DNA, 21 bp, Homo sapiens
agtatggtgctaatgtgtctg

SEQ ID NO: 5226738 - DNA, 15 bp, Homo sapiens
agtatggtggctggg

SEQ ID NO: 5226739 - DNA, 14 bp, Homo sapiens
agtatggtgtgttc

SEQ ID NO: 5226740 - DNA, 14 bp, Homo sapiens
agtatggttcaaga

SEQ ID NO: 5226741 - DNA, 21 bp, Homo sapiens
agtatggttcaagattgttga

SEQ ID NO: 5226742 - DNA, 15 bp, Homo sapiens
agtatgtaaagtatg

SEQ ID NO: 5226743 - DNA, 21 bp, Homo sapiens
agtatgtaaagtatgtaaaca

SEQ ID NO: 5226744 - DNA, 14 bp, Homo sapiens
agtatgtaatcttt

SEQ ID NO: 5226745 - DNA, 18 bp, Homo sapiens
agtatgtatattaaaaaa

SEQ ID NO: 5226746 - DNA, 20 bp, Homo sapiens
agtatgtatattaaaaaaga

SEQ ID NO: 5226747 - DNA, 22 bp, Homo sapiens
agtatgtatattaaaaaagaga

SEQ ID NO: 5226748 - DNA, 13 bp, Homo sapiens
agtatgtatgtgt

SEQ ID NO: 5226749 - DNA, 13 bp, Homo sapiens
agtatgtattatt

SEQ ID NO: 5226750 - DNA, 15 bp, Homo sapiens
agtatgtcactctgg

SEQ ID NO: 5226751 - DNA, 15 bp, Homo sapiens
agtatgtcagttata

SEQ ID NO: 5226752 - DNA, 18 bp, Homo sapiens
agtatgtctgtttttgta

SEQ ID NO: 5226753 - DNA, 14 bp, Homo sapiens
agtatgtgactttt

SEQ ID NO: 5226754 - DNA, 22 bp, Homo sapiens
agtatgtgacttttctgattaa

SEQ ID NO: 5226755 - DNA, 23 bp, Homo sapiens
agtatgtgagtagtcttatgtaa

SEQ ID NO: 5226756 - DNA, 12 bp, Homo sapiens
agtatgtgcagt

SEQ ID NO: 5226757 - DNA, 16 bp, Homo sapiens
agtatgtgggggcttc

SEQ ID NO: 5226758 - DNA, 17 bp, Homo sapiens
agtatgtgggggcttca

SEQ ID NO: 5226759 - DNA, 15 bp, Homo sapiens
agtatgtgtgctctt

SEQ ID NO: 5226760 - DNA, 19 bp, Homo sapiens
agtatgttaagctctttat

SEQ ID NO: 5226761 - DNA, 18 bp, Homo sapiens
agtatgttagtgcaaatt

SEQ ID NO: 5226762 - DNA, 14 bp, Homo sapiens
agtatgttcaaagt

SEQ ID NO: 5226763 - DNA, 22 bp, Homo sapiens
agtatgttccaaaccctcctgg

SEQ ID NO: 5226764 - DNA, 11 bp, Homo sapiens
agtatgttgta

SEQ ID NO: 5226765 - DNA, 23 bp, Homo sapiens
agtatgttgtacatactgccgaa

SEQ ID NO: 5226766 - DNA, 18 bp, Homo sapiens
agtatgttgtcaaagaga

SEQ ID NO: 5226767 - DNA, 21 bp, Homo sapiens
agtatgttgtcataacattta

SEQ ID NO: 5226768 - DNA, 15 bp, Homo sapiens
agtatgttttaacaa

SEQ ID NO: 5226769 - DNA, 18 bp, Homo sapiens
agtatgttttaacaaaaa

SEQ ID NO: 5226770 - DNA, 17 bp, Homo sapiens
agtatgttttacactgt

SEQ ID NO: 5226771 - DNA, 21 bp, Homo sapiens
agtatgttttacactgtacca

SEQ ID NO: 5226772 - DNA, 20 bp, Homo sapiens
agtatgttttagcatgtgtt

SEQ ID NO: 5226773 - DNA, 17 bp, Homo sapiens
agtatgtttttacatta

SEQ ID NO: 5226774 - DNA, 18 bp, Homo sapiens
agtatgtttttacattat

SEQ ID NO: 5226775 - DNA, 20 bp, Homo sapiens
agtattaaaagttgcatttg

SEQ ID NO: 5226776 - DNA, 15 bp, Homo sapiens
agtattaaaatctac

SEQ ID NO: 5226777 - DNA, 13 bp, Homo sapiens
agtattaaaatgc

SEQ ID NO: 5226778 - DNA, 15 bp, Homo sapiens
agtattaaaatttgg

SEQ ID NO: 5226779 - DNA, 13 bp, Homo sapiens
agtattaaactgt

SEQ ID NO: 5226780 - DNA, 20 bp, Homo sapiens
agtattaaactgtaaatcat

SEQ ID NO: 5226781 - DNA, 15 bp, Homo sapiens
agtattaaagggggg

SEQ ID NO: 5226782 - DNA, 20 bp, Homo sapiens
agtattaaaggggggagggg

SEQ ID NO: 5226783 - DNA, 13 bp, Homo sapiens
agtattaaatatt

SEQ ID NO: 5226784 - DNA, 18 bp, Homo sapiens
agtattaaatatttaaca

SEQ ID NO: 5226785 - DNA, 13 bp, Homo sapiens
agtattaactatt

SEQ ID NO: 5226786 - DNA, 14 bp, Homo sapiens
agtattaactctgt

SEQ ID NO: 5226787 - DNA, 20 bp, Homo sapiens
agtattaactctgtaaaagt

SEQ ID NO: 5226788 - DNA, 14 bp, Homo sapiens
agtattaagcagtt

SEQ ID NO: 5226789 - DNA, 19 bp, Homo sapiens
agtattaagggtaggatgt

SEQ ID NO: 5226790 - DNA, 13 bp, Homo sapiens
agtattaagtgaa

SEQ ID NO: 5226791 - DNA, 16 bp, Homo sapiens
agtattaagtgaaatt

SEQ ID NO: 5226792 - DNA, 15 bp, Homo sapiens
agtattaataaagaa

SEQ ID NO: 5226793 - DNA, 21 bp, Homo sapiens
agtattaatatctgaggatga

SEQ ID NO: 5226794 - DNA, 13 bp, Homo sapiens
agtattacacatt

SEQ ID NO: 5226795 - DNA, 22 bp, Homo sapiens
agtattacatgatttaaagact

SEQ ID NO: 5226796 - DNA, 17 bp, Homo sapiens
agtattaccaccctttc

SEQ ID NO: 5226797 - DNA, 14 bp, Homo sapiens
agtattactgctgc

SEQ ID NO: 5226798 - DNA, 15 bp, Homo sapiens
agtattactgctgct

SEQ ID NO: 5226799 - DNA, 18 bp, Homo sapiens
agtattagaataccacag

SEQ ID NO: 5226800 - DNA, 21 bp, Homo sapiens
agtattagaataccacaggaa

SEQ ID NO: 5226801 - DNA, 13 bp, Homo sapiens
agtattataaaca

SEQ ID NO: 5226802 - DNA, 20 bp, Homo sapiens
agtattataggccaaactgg

SEQ ID NO: 5226803 - DNA, 20 bp, Homo sapiens
agtattatataaactgtgcc

SEQ ID NO: 5226804 - DNA, 14 bp, Homo sapiens
agtattatatgtac

SEQ ID NO: 5226805 - DNA, 15 bp, Homo sapiens
agtattatcattgct

SEQ ID NO: 5226806 - DNA, 14 bp, Homo sapiens
agtattatctgtaa

SEQ ID NO: 5226807 - DNA, 16 bp, Homo sapiens
agtattatctgtaaaa

SEQ ID NO: 5226808 - DNA, 21 bp, Homo sapiens
agtattatgccccagttcaga

SEQ ID NO: 5226809 - DNA, 23 bp, Homo sapiens
agtattatgccccagttcagaaa

SEQ ID NO: 5226810 - DNA, 22 bp, Homo sapiens
agtattatgcctgagttataaa

SEQ ID NO: 5226811 - DNA, 14 bp, Homo sapiens
agtattatgtttct

SEQ ID NO: 5226812 - DNA, 15 bp, Homo sapiens
agtattatttagtaa

SEQ ID NO: 5226813 - DNA, 17 bp, Homo sapiens
agtattatttagtaaaa

SEQ ID NO: 5226814 - DNA, 18 bp, Homo sapiens
agtattatttagtaaaat

SEQ ID NO: 5226815 - DNA, 19 bp, Homo sapiens
agtattcagaaattaaaat

SEQ ID NO: 5226816 - DNA, 16 bp, Homo sapiens
agtattcagagtctct

SEQ ID NO: 5226817 - DNA, 18 bp, Homo sapiens
agtattcagagtctctga

SEQ ID NO: 5226818 - DNA, 14 bp, Homo sapiens
agtattcaggcact

SEQ ID NO: 5226819 - DNA, 16 bp, Homo sapiens
agtattcagttccaat

SEQ ID NO: 5226820 - DNA, 19 bp, Homo sapiens
agtattccattgtgtgagt

SEQ ID NO: 5226821 - DNA, 20 bp, Homo sapiens
agtattccatttttactaaa

SEQ ID NO: 5226822 - DNA, 20 bp, Homo sapiens
agtattcctagcaaatttct

SEQ ID NO: 5226823 - DNA, 23 bp, Homo sapiens
agtattcgctgtgttcatggtct

SEQ ID NO: 5226824 - DNA, 21 bp, Homo sapiens
agtattcgtgaataagttgat

SEQ ID NO: 5226825 - DNA, 17 bp, Homo sapiens
agtattctaataagcta

SEQ ID NO: 5226826 - DNA, 22 bp, Homo sapiens
agtattctcagagcatgtgtca

SEQ ID NO: 5226827 - DNA, 16 bp, Homo sapiens
agtattctcattcttc

SEQ ID NO: 5226828 - DNA, 12 bp, Homo sapiens
agtattctgaca

SEQ ID NO: 5226829 - DNA, 19 bp, Homo sapiens
agtattctgacatgtaaga

SEQ ID NO: 5226830 - DNA, 12 bp, Homo sapiens
agtattctgcct

SEQ ID NO: 5226831 - DNA, 23 bp, Homo sapiens
agtattctgcctttgcagaaaca

SEQ ID NO: 5226832 - DNA, 16 bp, Homo sapiens
agtattcttttcaatt

SEQ ID NO: 5226833 - DNA, 14 bp, Homo sapiens
agtattctttttct

SEQ ID NO: 5226834 - DNA, 15 bp, Homo sapiens
agtattgaaaacttc

SEQ ID NO: 5226835 - DNA, 15 bp, Homo sapiens
agtattgaaagccaa

SEQ ID NO: 5226836 - DNA, 15 bp, Homo sapiens
agtattgacaaaatg

SEQ ID NO: 5226837 - DNA, 14 bp, Homo sapiens
agtattgacactga

SEQ ID NO: 5226838 - DNA, 18 bp, Homo sapiens
agtattgacttctttttg

SEQ ID NO: 5226839 - DNA, 20 bp, Homo sapiens
agtattgagacactgtcaag

SEQ ID NO: 5226840 - DNA, 19 bp, Homo sapiens
agtattgagctttgcattt

SEQ ID NO: 5226841 - DNA, 15 bp, Homo sapiens
agtattgattcaaat

SEQ ID NO: 5226842 - DNA, 22 bp, Homo sapiens
agtattgcagtctaaaacttca

SEQ ID NO: 5226843 - DNA, 18 bp, Homo sapiens
agtattgccaaacattaa

SEQ ID NO: 5226844 - DNA, 17 bp, Homo sapiens
agtattgcgaatgtgca

SEQ ID NO: 5226845 - DNA, 20 bp, Homo sapiens
agtattgctatttatattca

SEQ ID NO: 5226846 - DNA, 13 bp, Homo sapiens
agtattggagcac

SEQ ID NO: 5226847 - DNA, 18 bp, Homo sapiens
agtattggagcacatgtt

SEQ ID NO: 5226848 - DNA, 23 bp, Homo sapiens
agtattgggacgtagagcacagc

SEQ ID NO: 5226849 - DNA, 13 bp, Homo sapiens
agtattggttact

SEQ ID NO: 5226850 - DNA, 19 bp, Homo sapiens
agtattggttactggtgat

SEQ ID NO: 5226851 - DNA, 12 bp, Homo sapiens
agtattgtaaat

SEQ ID NO: 5226852 - DNA, 13 bp, Homo sapiens
agtattgtaaatt

SEQ ID NO: 5226853 - DNA, 14 bp, Homo sapiens
agtattgtaaatta

SEQ ID NO: 5226854 - DNA, 16 bp, Homo sapiens
agtattgtaatgagtg

SEQ ID NO: 5226855 - DNA, 13 bp, Homo sapiens
agtattgtagaaa

SEQ ID NO: 5226856 - DNA, 22 bp, Homo sapiens
agtattgtccatatcagacctc

SEQ ID NO: 5226857 - DNA, 15 bp, Homo sapiens
agtattgtggggctc

SEQ ID NO: 5226858 - DNA, 19 bp, Homo sapiens
agtattgttctatttttgt

SEQ ID NO: 5226859 - DNA, 22 bp, Homo sapiens
agtattgttcttgtaaaactgt

SEQ ID NO: 5226860 - DNA, 12 bp, Homo sapiens
agtattgttgtc

SEQ ID NO: 5226861 - DNA, 15 bp, Homo sapiens
agtattgtttacatt

SEQ ID NO: 5226862 - DNA, 15 bp, Homo sapiens
agtattgtttcctga

SEQ ID NO: 5226863 - DNA, 17 bp, Homo sapiens
agtatttaaagaaactg

SEQ ID NO: 5226864 - DNA, 17 bp, Homo sapiens
agtatttaactaattat

SEQ ID NO: 5226865 - DNA, 18 bp, Homo sapiens
agtatttaagcctaaaga

SEQ ID NO: 5226866 - DNA, 20 bp, Homo sapiens
agtatttaagcctaaagatt

SEQ ID NO: 5226867 - DNA, 21 bp, Homo sapiens
agtatttaagcctaaagattt

SEQ ID NO: 5226868 - DNA, 19 bp, Homo sapiens
agtatttaagctttaaatg

SEQ ID NO: 5226869 - DNA, 11 bp, Homo sapiens
agtatttaatt

SEQ ID NO: 5226870 - DNA, 13 bp, Homo sapiens
agtatttaattag

SEQ ID NO: 5226871 - DNA, 17 bp, Homo sapiens
agtatttaattagtgct

SEQ ID NO: 5226872 - DNA, 15 bp, Homo sapiens
agtatttacagatgt

SEQ ID NO: 5226873 - DNA, 22 bp, Homo sapiens
agtatttactctgctccaaagt

SEQ ID NO: 5226874 - DNA, 15 bp, Homo sapiens
agtatttactgactg

SEQ ID NO: 5226875 - DNA, 19 bp, Homo sapiens
agtatttactttttaaaaa

SEQ ID NO: 5226876 - DNA, 19 bp, Homo sapiens
agtatttagaagccaacta

SEQ ID NO: 5226877 - DNA, 18 bp, Homo sapiens
agtatttataaaaatata

SEQ ID NO: 5226878 - DNA, 12 bp, Homo sapiens
agtatttatata

SEQ ID NO: 5226879 - DNA, 23 bp, Homo sapiens
agtatttatatatttataactca

SEQ ID NO: 5226880 - DNA, 14 bp, Homo sapiens
agtatttatattta

SEQ ID NO: 5226881 - DNA, 15 bp, Homo sapiens
agtatttatatttaa

SEQ ID NO: 5226882 - DNA, 17 bp, Homo sapiens
agtatttatctcctgtc

SEQ ID NO: 5226883 - DNA, 15 bp, Homo sapiens
agtatttattcccat

SEQ ID NO: 5226884 - DNA, 13 bp, Homo sapiens
agtatttattggt

SEQ ID NO: 5226885 - DNA, 12 bp, Homo sapiens
agtatttattgt

SEQ ID NO: 5226886 - DNA, 15 bp, Homo sapiens
agtatttattgtcag

SEQ ID NO: 5226887 - DNA, 20 bp, Homo sapiens
agtatttattgttcccacaa

SEQ ID NO: 5226888 - DNA, 13 bp, Homo sapiens
agtatttatttat

SEQ ID NO: 5226889 - DNA, 17 bp, Homo sapiens
agtatttatttatgtac

SEQ ID NO: 5226890 - DNA, 18 bp, Homo sapiens
agtatttatttatgtact

SEQ ID NO: 5226891 - DNA, 14 bp, Homo sapiens
agtatttattttgt

SEQ ID NO: 5226892 - DNA, 21 bp, Homo sapiens
agtatttattttgtaattatg

SEQ ID NO: 5226893 - DNA, 18 bp, Homo sapiens
agtatttcaactgctgta

SEQ ID NO: 5226894 - DNA, 23 bp, Homo sapiens
agtatttcaactgctgtaaaatt

SEQ ID NO: 5226895 - DNA, 19 bp, Homo sapiens
agtatttcagatgctttag

SEQ ID NO: 5226896 - DNA, 14 bp, Homo sapiens
agtatttcagtgta

SEQ ID NO: 5226897 - DNA, 13 bp, Homo sapiens
agtatttcatgta

SEQ ID NO: 5226898 - DNA, 16 bp, Homo sapiens
agtatttcatgtaata

SEQ ID NO: 5226899 - DNA, 15 bp, Homo sapiens
agtatttcattgcct

SEQ ID NO: 5226900 - DNA, 13 bp, Homo sapiens
agtatttcccagc

SEQ ID NO: 5226901 - DNA, 13 bp, Homo sapiens
agtatttcccttc

SEQ ID NO: 5226902 - DNA, 14 bp, Homo sapiens
agtatttcccttcc

SEQ ID NO: 5226903 - DNA, 19 bp, Homo sapiens
agtatttcccttccaaaga

SEQ ID NO: 5226904 - DNA, 15 bp, Homo sapiens
agtgtgtttagaagg

SEQ ID NO: 5226905 - DNA, 20 bp, Homo sapiens
agtgtgtttccttcagtgca

SEQ ID NO: 5226906 - DNA, 17 bp, Homo sapiens
agtgtgtttgtgagtat

SEQ ID NO: 5226907 - DNA, 20 bp, Homo sapiens
agtgtgtttgtgagtatgtg

SEQ ID NO: 5226908 - DNA, 20 bp, Homo sapiens
agtgtgttttggtatgcact

SEQ ID NO: 5226909 - DNA, 18 bp, Homo sapiens
agtgtgtttttgcactgt

SEQ ID NO: 5226910 - DNA, 19 bp, Homo sapiens
agtgtgtttttgcactgtc

SEQ ID NO: 5226911 - DNA, 20 bp, Homo sapiens
agtgtgtttttgcactgtct

SEQ ID NO: 5226912 - DNA, 23 bp, Homo sapiens
agtgttaaaagaaaataaattac

SEQ ID NO: 5226913 - DNA, 17 bp, Homo sapiens
agtgttaaagtggtctg

SEQ ID NO: 5226914 - DNA, 14 bp, Homo sapiens
agtgttaaattcat

SEQ ID NO: 5226915 - DNA, 12 bp, Homo sapiens
agtgttaagata

SEQ ID NO: 5226916 - DNA, 20 bp, Homo sapiens
agtgttaagtttttaatctg

SEQ ID NO: 5226917 - DNA, 14 bp, Homo sapiens
agtgttaataaaat

SEQ ID NO: 5226918 - DNA, 15 bp, Homo sapiens
agtgttaataaatgg

SEQ ID NO: 5226919 - DNA, 18 bp, Homo sapiens
agtgttaatacatcacat

SEQ ID NO: 5226920 - DNA, 15 bp, Homo sapiens
agtgttaatactgag

SEQ ID NO: 5226921 - DNA, 16 bp, Homo sapiens
agtgttaatactgaga

SEQ ID NO: 5226922 - DNA, 20 bp, Homo sapiens
agtgttacctaacaatgttt

SEQ ID NO: 5226923 - DNA, 22 bp, Homo sapiens
agtgttactgcctataatctta

SEQ ID NO: 5226924 - DNA, 16 bp, Homo sapiens
agtgttagaaaaaact

SEQ ID NO: 5226925 - DNA, 14 bp, Homo sapiens
agtgttagagaaat

SEQ ID NO: 5226926 - DNA, 15 bp, Homo sapiens
agtgttagagaaatc

SEQ ID NO: 5226927 - DNA, 17 bp, Homo sapiens
agtgttagagaaatcct

SEQ ID NO: 5226928 - DNA, 23 bp, Homo sapiens
agtgttagccttttttccccaga

SEQ ID NO: 5226929 - DNA, 19 bp, Homo sapiens
agtgttaggcctggcacag

SEQ ID NO: 5226930 - DNA, 23 bp, Homo sapiens
agtgttagggaagggcctgccac

SEQ ID NO: 5226931 - DNA, 18 bp, Homo sapiens
agtgttagggattccttc

SEQ ID NO: 5226932 - DNA, 19 bp, Homo sapiens
agtgttagtgctggtcaga

SEQ ID NO: 5226933 - DNA, 21 bp, Homo sapiens
agtgttagtgctggtcagaga

SEQ ID NO: 5226934 - DNA, 14 bp, Homo sapiens
agtgttagtgggaa

SEQ ID NO: 5226935 - DNA, 15 bp, Homo sapiens
agtgttagttataaa

SEQ ID NO: 5226936 - DNA, 15 bp, Homo sapiens
agtgttataaaatct

SEQ ID NO: 5226937 - DNA, 15 bp, Homo sapiens
agtgttatatgaaca

SEQ ID NO: 5226938 - DNA, 16 bp, Homo sapiens
agtgttatatgaacat

SEQ ID NO: 5226939 - DNA, 20 bp, Homo sapiens
agtgttatatgaacatacaa

SEQ ID NO: 5226940 - DNA, 15 bp, Homo sapiens
agtgttatcaggcgt

SEQ ID NO: 5226941 - DNA, 15 bp, Homo sapiens
agtgttatcccaaga

SEQ ID NO: 5226942 - DNA, 20 bp, Homo sapiens
agtgttattgagagagatgt

SEQ ID NO: 5226943 - DNA, 15 bp, Homo sapiens
agtgttattgcatgc

SEQ ID NO: 5226944 - DNA, 17 bp, Homo sapiens
agtgttattttcattca

SEQ ID NO: 5226945 - DNA, 16 bp, Homo sapiens
agtgttcaaaatacta

SEQ ID NO: 5226946 - DNA, 21 bp, Homo sapiens
agtgttcaaactactgtacat

SEQ ID NO: 5226947 - DNA, 16 bp, Homo sapiens
agtgttcaaataaact

SEQ ID NO: 5226948 - DNA, 17 bp, Homo sapiens
agtgttcacaaactgtg

SEQ ID NO: 5226949 - DNA, 15 bp, Homo sapiens
agtgttcacaacctg

SEQ ID NO: 5226950 - DNA, 14 bp, Homo sapiens
agtgttcactgctc

SEQ ID NO: 5226951 - DNA, 16 bp, Homo sapiens
agtgttcagcatagag

SEQ ID NO: 5226952 - DNA, 13 bp, Homo sapiens
agtgttcagtgtt

SEQ ID NO: 5226953 - DNA, 14 bp, Homo sapiens
agtgttcagtgttg

SEQ ID NO: 5226954 - DNA, 16 bp, Homo sapiens
agtgttcagtgttgac

SEQ ID NO: 5226955 - DNA, 17 bp, Homo sapiens
agtgttcagtgttgaca

SEQ ID NO: 5226956 - DNA, 18 bp, Homo sapiens
agtgttcagtgttgacat

SEQ ID NO: 5226957 - DNA, 22 bp, Homo sapiens
agtgttcagtgttgacatagcc

SEQ ID NO: 5226958 - DNA, 23 bp, Homo sapiens
agtgttcagtgttgacatagcct

SEQ ID NO: 5226959 - DNA, 21 bp, Homo sapiens
agtgttcataaataaagtttg

SEQ ID NO: 5226960 - DNA, 17 bp, Homo sapiens
agtgttccagctgcctg

SEQ ID NO: 5226961 - DNA, 19 bp, Homo sapiens
agtgttcccaaagtgaact

SEQ ID NO: 5226962 - DNA, 16 bp, Homo sapiens
agtgttccccttccac

SEQ ID NO: 5226963 - DNA, 22 bp, Homo sapiens
agtgttccctatccaatcaatc

SEQ ID NO: 5226964 - DNA, 23 bp, Homo sapiens
agtgttccctatccaatcaatct

SEQ ID NO: 5226965 - DNA, 18 bp, Homo sapiens
agtgttccctttcctact

SEQ ID NO: 5226966 - DNA, 15 bp, Homo sapiens
agtgttcctgagaca

SEQ ID NO: 5226967 - DNA, 17 bp, Homo sapiens
agtgttcctgtctcaat

SEQ ID NO: 5226968 - DNA, 12 bp, Homo sapiens
agtgttcctgtg

SEQ ID NO: 5226969 - DNA, 20 bp, Homo sapiens
agtgttcctttttaaatgtg

SEQ ID NO: 5226970 - DNA, 22 bp, Homo sapiens
agtgttcctttttaaatgtgaa

SEQ ID NO: 5226971 - DNA, 23 bp, Homo sapiens
agtgttcctttttaaatgtgaat

SEQ ID NO: 5226972 - DNA, 15 bp, Homo sapiens
agtgttcgcttggct

SEQ ID NO: 5226973 - DNA, 19 bp, Homo sapiens
agtgttctaaaatgaaata

SEQ ID NO: 5226974 - DNA, 20 bp, Homo sapiens
agtgttctcatgaagcagga

SEQ ID NO: 5226975 - DNA, 19 bp, Homo sapiens
agtgttctctctgaatgct

SEQ ID NO: 5226976 - DNA, 12 bp, Homo sapiens
agtgttctgagc

SEQ ID NO: 5226977 - DNA, 14 bp, Homo sapiens
agtgttctgagccc

SEQ ID NO: 5226978 - DNA, 14 bp, Homo sapiens
agtgttctgctcct

SEQ ID NO: 5226979 - DNA, 19 bp, Homo sapiens
agtgttctgtctgactttc

SEQ ID NO: 5226980 - DNA, 13 bp, Homo sapiens
agtgttctgtgaa

SEQ ID NO: 5226981 - DNA, 20 bp, Homo sapiens
agtgttctgtgaatagcagt

SEQ ID NO: 5226982 - DNA, 22 bp, Homo sapiens
agtgttctgtgggcttggcctt

SEQ ID NO: 5226983 - DNA, 23 bp, Homo sapiens
agtgttctgtgggcttggccttg

SEQ ID NO: 5226984 - DNA, 15 bp, Homo sapiens
agtgttctgttacaa

SEQ ID NO: 5226985 - DNA, 23 bp, Homo sapiens
agtgttctgttacaaaatgtaac

SEQ ID NO: 5226986 - DNA, 13 bp, Homo sapiens
agtgttcttaggt

SEQ ID NO: 5226987 - DNA, 16 bp, Homo sapiens
agtgttcttcagtgta

SEQ ID NO: 5226988 - DNA, 20 bp, Homo sapiens
agtgttcttgggggtggggc

SEQ ID NO: 5226989 - DNA, 16 bp, Homo sapiens
agtgttctttctcttt

SEQ ID NO: 5226990 - DNA, 23 bp, Homo sapiens
agtgttgaaaaatatctttgcat

SEQ ID NO: 5226991 - DNA, 17 bp, Homo sapiens
agtgttgaaaatgtatt

SEQ ID NO: 5226992 - DNA, 19 bp, Homo sapiens
agtgttgaaattggaaagg

SEQ ID NO: 5226993 - DNA, 12 bp, Homo sapiens
agtgttgacata

SEQ ID NO: 5226994 - DNA, 13 bp, Homo sapiens
agtgttgacatag

SEQ ID NO: 5226995 - DNA, 14 bp, Homo sapiens
agtgttgacatagc

SEQ ID NO: 5226996 - DNA, 22 bp, Homo sapiens
agtgttgacatagcctttgtgc

SEQ ID NO: 5226997 - DNA, 20 bp, Homo sapiens
agtgttgaggaggggagcaa

SEQ ID NO: 5226998 - DNA, 14 bp, Homo sapiens
agtgttgcctaagt

SEQ ID NO: 5226999 - DNA, 17 bp, Homo sapiens
agtgttgcctaagtatt

SEQ ID NO: 5227000 - DNA, 21 bp, Homo sapiens
agtgttgcctcttgcaatgcc

SEQ ID NO: 5227001 - DNA, 16 bp, Homo sapiens
agtgttgctcagctcc

SEQ ID NO: 5227002 - DNA, 17 bp, Homo sapiens
agtgttggaaaaaattt

SEQ ID NO: 5227003 - DNA, 17 bp, Homo sapiens
agtgttggagaagaact

SEQ ID NO: 5227004 - DNA, 23 bp, Homo sapiens
agtgttggagaagaactgaaatc

SEQ ID NO: 5227005 - DNA, 15 bp, Homo sapiens
agtgttggctgtgtg

SEQ ID NO: 5227006 - DNA, 19 bp, Homo sapiens
agtgttgggattacaggtg

SEQ ID NO: 5227007 - DNA, 17 bp, Homo sapiens
agtgttggggctggggg

SEQ ID NO: 5227008 - DNA, 16 bp, Homo sapiens
agtgttggggttgaca

SEQ ID NO: 5227009 - DNA, 19 bp, Homo sapiens
agtgttggggttgacattt

SEQ ID NO: 5227010 - DNA, 16 bp, Homo sapiens
agtgttgggtggagga

SEQ ID NO: 5227011 - DNA, 21 bp, Homo sapiens
agtgttgggtggaggatggac

SEQ ID NO: 5227012 - DNA, 13 bp, Homo sapiens
agtgttgtggaga

SEQ ID NO: 5227013 - DNA, 16 bp, Homo sapiens
agtgttgtggatttaa

SEQ ID NO: 5227014 - DNA, 20 bp, Homo sapiens
agtgttgtggatttaacaga

SEQ ID NO: 5227015 - DNA, 17 bp, Homo sapiens
agtgttgtgttaaaagg

SEQ ID NO: 5227016 - DNA, 16 bp, Homo sapiens
agtgttgtgttacaat

SEQ ID NO: 5227017 - DNA, 22 bp, Homo sapiens
agtgttgtgttacaataagtgt

SEQ ID NO: 5227018 - DNA, 20 bp, Homo sapiens
agtgttgtgttcctggctga

SEQ ID NO: 5227019 - DNA, 17 bp, Homo sapiens
agtgttgttgctgacca

SEQ ID NO: 5227020 - DNA, 20 bp, Homo sapiens
agtgttgttgctgaccagct

SEQ ID NO: 5227021 - DNA, 18 bp, Homo sapiens
agtgttgtttgtaaataa

SEQ ID NO: 5227022 - DNA, 16 bp, Homo sapiens
agtgtttaaatgctgt

SEQ ID NO: 5227023 - DNA, 13 bp, Homo sapiens
agtgtttaactgg

SEQ ID NO: 5227024 - DNA, 13 bp, Homo sapiens
agtgtttaagtca

SEQ ID NO: 5227025 - DNA, 17 bp, Homo sapiens
agtgtttactttaaatc

SEQ ID NO: 5227026 - DNA, 13 bp, Homo sapiens
agtgtttagaaat

SEQ ID NO: 5227027 - DNA, 22 bp, Homo sapiens
agtgtttagcattaaaaataaa

SEQ ID NO: 5227028 - DNA, 14 bp, Homo sapiens
agtgtttatgacaa

SEQ ID NO: 5227029 - DNA, 15 bp, Homo sapiens
agtgtttatttttca

SEQ ID NO: 5227030 - DNA, 17 bp, Homo sapiens
agtgtttatttttcata

SEQ ID NO: 5227031 - DNA, 20 bp, Homo sapiens
agtgtttcaaaaaattatat

SEQ ID NO: 5227032 - DNA, 11 bp, Homo sapiens
agtgtttcaat

SEQ ID NO: 5227033 - DNA, 16 bp, Homo sapiens
agtgtttcccataatt

SEQ ID NO: 5227034 - DNA, 17 bp, Homo sapiens
agtgtttccctctgtgt

SEQ ID NO: 5227035 - DNA, 22 bp, Homo sapiens
agtgtttcctgagtagcagtga

SEQ ID NO: 5227036 - DNA, 13 bp, Homo sapiens
agtgtttcctttt

SEQ ID NO: 5227037 - DNA, 21 bp, Homo sapiens
agtgtttctagctaaataaat

SEQ ID NO: 5227038 - DNA, 19 bp, Homo sapiens
agtgtttctagtaacagta

SEQ ID NO: 5227039 - DNA, 18 bp, Homo sapiens
agtgtttctcaaaagagg

SEQ ID NO: 5227040 - DNA, 22 bp, Homo sapiens
agtgtttctcaaaagaggttac

SEQ ID NO: 5227041 - DNA, 17 bp, Homo sapiens
agtgtttctgaatgttt

SEQ ID NO: 5227042 - DNA, 20 bp, Homo sapiens
agtgtttctgcagaggcagc

SEQ ID NO: 5227043 - DNA, 11 bp, Homo sapiens
agtgtttctgt

SEQ ID NO: 5227044 - DNA, 14 bp, Homo sapiens
agtgtttctgtgaa

SEQ ID NO: 5227045 - DNA, 13 bp, Homo sapiens
agtgtttctgtgc

SEQ ID NO: 5227046 - DNA, 13 bp, Homo sapiens
agtgtttctgttc

SEQ ID NO: 5227047 - DNA, 18 bp, Homo sapiens
agtgtttcttcacttctt

SEQ ID NO: 5227048 - DNA, 23 bp, Homo sapiens
agtgtttcttctggcttagtctg

SEQ ID NO: 5227049 - DNA, 23 bp, Homo sapiens
agtgtttgaaaactgacatcaga

SEQ ID NO: 5227050 - DNA, 22 bp, Homo sapiens
agtgtttgatttttattttata

SEQ ID NO: 5227051 - DNA, 14 bp, Homo sapiens
agtgtttgtatttg

SEQ ID NO: 5227052 - DNA, 22 bp, Homo sapiens
agtgtttgttggatccgtttga

SEQ ID NO: 5227053 - DNA, 19 bp, Homo sapiens
agtgttttaaattctgaga

SEQ ID NO: 5227054 - DNA, 17 bp, Homo sapiens
agtgttttaagaaatgt

SEQ ID NO: 5227055 - DNA, 21 bp, Homo sapiens
agtgttttaagaaatgtagtt

SEQ ID NO: 5227056 - DNA, 14 bp, Homo sapiens
agtgttttacaatg

SEQ ID NO: 5227057 - DNA, 18 bp, Homo sapiens
agtgttttcaattttaaa

SEQ ID NO: 5227058 - DNA, 17 bp, Homo sapiens
agtgttttcagaagaaa

SEQ ID NO: 5227059 - DNA, 18 bp, Homo sapiens
agtgttttcagaagaaat

SEQ ID NO: 5227060 - DNA, 19 bp, Homo sapiens
agtgttttctcagaacagc

SEQ ID NO: 5227061 - DNA, 22 bp, Homo sapiens
agtgttttctcagaacagctga

SEQ ID NO: 5227062 - DNA, 15 bp, Homo sapiens
agtgttttctgggat

SEQ ID NO: 5227063 - DNA, 11 bp, Homo sapiens
agtgttttctt

SEQ ID NO: 5227064 - DNA, 19 bp, Homo sapiens
agtgttttcttgtgttgtt

SEQ ID NO: 5227065 - DNA, 17 bp, Homo sapiens
agtgttttgcacatcat

SEQ ID NO: 5227066 - DNA, 16 bp, Homo sapiens
agtgttttgcatacat

SEQ ID NO: 5227067 - DNA, 19 bp, Homo sapiens
agtgttttggactccatct

SEQ ID NO: 5227068 - DNA, 23 bp, Homo sapiens
agtgttttggactccatctctca

SEQ ID NO: 5227069 - DNA, 22 bp, Homo sapiens
agtgttttgtaccagtgaattt

SEQ ID NO: 5227070 - DNA, 17 bp, Homo sapiens
agtgtttttacctctgt

SEQ ID NO: 5227071 - DNA, 22 bp, Homo sapiens
agtgtttttctttaatcaaaag

SEQ ID NO: 5227072 - DNA, 18 bp, Homo sapiens
agtgtttttgtaaagtgt

SEQ ID NO: 5227073 - DNA, 15 bp, Homo sapiens
agtgtttttgtgaat

SEQ ID NO: 5227074 - DNA, 24 bp, Homo sapiens
agtgttttttcactttagctatgt

SEQ ID NO: 5227075 - DNA, 21 bp, Homo sapiens
agttaaaaaaaaaacagcctg

SEQ ID NO: 5227076 - DNA, 13 bp, Homo sapiens
agttaaaaaaaat

SEQ ID NO: 5227077 - DNA, 18 bp, Homo sapiens
agttaaaaattaaatatt

SEQ ID NO: 5227078 - DNA, 14 bp, Homo sapiens
agttaaaacacata

SEQ ID NO: 5227079 - DNA, 20 bp, Homo sapiens
agttaaaactcatcacataa

SEQ ID NO: 5227080 - DNA, 19 bp, Homo sapiens
agttaaaactggatggaaa

SEQ ID NO: 5227081 - DNA, 21 bp, Homo sapiens
agttaaaagaatgtaaaatat

SEQ ID NO: 5227082 - DNA, 14 bp, Homo sapiens
agtatttccttcca

SEQ ID NO: 5227083 - DNA, 16 bp, Homo sapiens
agtatttccttccact

SEQ ID NO: 5227084 - DNA, 18 bp, Homo sapiens
agtatttccttccactgt

SEQ ID NO: 5227085 - DNA, 23 bp, Homo sapiens
agtatttctacattacagccata

SEQ ID NO: 5227086 - DNA, 13 bp, Homo sapiens
agtatttctatga

SEQ ID NO: 5227087 - DNA, 17 bp, Homo sapiens
agtatttctatgaaata

SEQ ID NO: 5227088 - DNA, 18 bp, Homo sapiens
agtatttctatgaaatat

SEQ ID NO: 5227089 - DNA, 18 bp, Homo sapiens
agtatttctcctttgcaa

SEQ ID NO: 5227090 - DNA, 20 bp, Homo sapiens
agtatttctcctttgcaata

SEQ ID NO: 5227091 - DNA, 21 bp, Homo sapiens
agtatttctgttcctttttgt

SEQ ID NO: 5227092 - DNA, 22 bp, Homo sapiens
agtatttctgttcctttttgta

SEQ ID NO: 5227093 - DNA, 23 bp, Homo sapiens
agtatttctgttcctttttgtaa

SEQ ID NO: 5227094 - DNA, 13 bp, Homo sapiens
agtatttctttgt

SEQ ID NO: 5227095 - DNA, 22 bp, Homo sapiens
agtatttctttgttatacattt

SEQ ID NO: 5227096 - DNA, 18 bp, Homo sapiens
agtatttgaaaacagaaa

SEQ ID NO: 5227097 - DNA, 21 bp, Homo sapiens
agtatttgaaaacagaaattg

SEQ ID NO: 5227098 - DNA, 23 bp, Homo sapiens
agtatttgaaactgaatgtttat

SEQ ID NO: 5227099 - DNA, 15 bp, Homo sapiens
agtatttgaattaaa

SEQ ID NO: 5227100 - DNA, 17 bp, Homo sapiens
agtatttgaattaaaac

SEQ ID NO: 5227101 - DNA, 21 bp, Homo sapiens
agtatttgaattaaaacttct

SEQ ID NO: 5227102 - DNA, 16 bp, Homo sapiens
agtatttgatgtacat

SEQ ID NO: 5227103 - DNA, 17 bp, Homo sapiens
agtatttgatgtacatt

SEQ ID NO: 5227104 - DNA, 19 bp, Homo sapiens
agtatttgatgtacattac

SEQ ID NO: 5227105 - DNA, 19 bp, Homo sapiens
agtatttgattcaaaatat

SEQ ID NO: 5227106 - DNA, 20 bp, Homo sapiens
agtatttgattcaaaatatt

SEQ ID NO: 5227107 - DNA, 21 bp, Homo sapiens
agtatttgctgtttgtccagt

SEQ ID NO: 5227108 - DNA, 14 bp, Homo sapiens
agtatttggaagca

SEQ ID NO: 5227109 - DNA, 15 bp, Homo sapiens
agtatttgtatcctg

SEQ ID NO: 5227110 - DNA, 21 bp, Homo sapiens
agtatttgtcgtgtgtagaaa

SEQ ID NO: 5227111 - DNA, 18 bp, Homo sapiens
agtatttgttaatttaga

SEQ ID NO: 5227112 - DNA, 19 bp, Homo sapiens
agtattttaagaagacata

SEQ ID NO: 5227113 - DNA, 22 bp, Homo sapiens
agtattttaagaagttgctgca

SEQ ID NO: 5227114 - DNA, 14 bp, Homo sapiens
agtattttaatcct

SEQ ID NO: 5227115 - DNA, 16 bp, Homo sapiens
agtattttaatcctgt

SEQ ID NO: 5227116 - DNA, 17 bp, Homo sapiens
agtattttaatcctgta

SEQ ID NO: 5227117 - DNA, 12 bp, Homo sapiens
agtattttagtg

SEQ ID NO: 5227118 - DNA, 18 bp, Homo sapiens
agtattttagtgaacttg

SEQ ID NO: 5227119 - DNA, 21 bp, Homo sapiens
agtattttagtggaccctgaa

SEQ ID NO: 5227120 - DNA, 14 bp, Homo sapiens
agtattttatttgt

SEQ ID NO: 5227121 - DNA, 19 bp, Homo sapiens
agtattttccctgctaggg

SEQ ID NO: 5227122 - DNA, 14 bp, Homo sapiens
agtattttcctgta

SEQ ID NO: 5227123 - DNA, 16 bp, Homo sapiens
agtattttcctgtaaa

SEQ ID NO: 5227124 - DNA, 22 bp, Homo sapiens
agtattttctccacttcatttt

SEQ ID NO: 5227125 - DNA, 18 bp, Homo sapiens
agtattttgaagtttaca

SEQ ID NO: 5227126 - DNA, 17 bp, Homo sapiens
agtattttggttcttag

SEQ ID NO: 5227127 - DNA, 23 bp, Homo sapiens
agtattttggttcttagttctca

SEQ ID NO: 5227128 - DNA, 13 bp, Homo sapiens
agtatttttaaca

SEQ ID NO: 5227129 - DNA, 14 bp, Homo sapiens
agtatttttaacac

SEQ ID NO: 5227130 - DNA, 13 bp, Homo sapiens
agtatttttataa

SEQ ID NO: 5227131 - DNA, 19 bp, Homo sapiens
agtatttttataatgactg

SEQ ID NO: 5227132 - DNA, 23 bp, Homo sapiens
agtatttttataatgactggtct

SEQ ID NO: 5227133 - DNA, 20 bp, Homo sapiens
agtatttttataattttatc

SEQ ID NO: 5227134 - DNA, 22 bp, Homo sapiens
agtatttttataattttatctg

SEQ ID NO: 5227135 - DNA, 19 bp, Homo sapiens
agtatttttatacaaacct

SEQ ID NO: 5227136 - DNA, 14 bp, Homo sapiens
agtatttttatcca

SEQ ID NO: 5227137 - DNA, 14 bp, Homo sapiens
agtatttttcagat

SEQ ID NO: 5227138 - DNA, 15 bp, Homo sapiens
agtatttttcagata

SEQ ID NO: 5227139 - DNA, 23 bp, Homo sapiens
agtatttttctgtgaccatcaat

SEQ ID NO: 5227140 - DNA, 16 bp, Homo sapiens
agtatttttgaaagaa

SEQ ID NO: 5227141 - DNA, 22 bp, Homo sapiens
agtatttttgaaagaattctat

SEQ ID NO: 5227142 - DNA, 23 bp, Homo sapiens
agtatttttgaaagaattctatt

SEQ ID NO: 5227143 - DNA, 18 bp, Homo sapiens
agtatttttgacagaata

SEQ ID NO: 5227144 - DNA, 22 bp, Homo sapiens
agtatttttgattaacaatgta

SEQ ID NO: 5227145 - DNA, 13 bp, Homo sapiens
agtatttttgccg

SEQ ID NO: 5227146 - DNA, 16 bp, Homo sapiens
agtatttttgctgctt

SEQ ID NO: 5227147 - DNA, 19 bp, Homo sapiens
agtatttttgctgcttctg

SEQ ID NO: 5227148 - DNA, 11 bp, Homo sapiens
agtatttttgg

SEQ ID NO: 5227149 - DNA, 15 bp, Homo sapiens
agtatttttgtctct

SEQ ID NO: 5227150 - DNA, 15 bp, Homo sapiens
agtattttttacatt

SEQ ID NO: 5227151 - DNA, 18 bp, Homo sapiens
agtattttttacatttta

SEQ ID NO: 5227152 - DNA, 14 bp, Homo sapiens
agtattttttcaag

SEQ ID NO: 5227153 - DNA, 19 bp, Homo sapiens
agtattttttcaagttgta

SEQ ID NO: 5227154 - DNA, 21 bp, Homo sapiens
agtattttttcagtattatat

SEQ ID NO: 5227155 - DNA, 20 bp, Homo sapiens
agtatttttttatcttggga

SEQ ID NO: 5227156 - DNA, 16 bp, Homo sapiens
agtatttttttcttac

SEQ ID NO: 5227157 - DNA, 23 bp, Homo sapiens
agtattttttttgcttttatgac

SEQ ID NO: 5227158 - DNA, 16 bp, Homo sapiens
agtatttttttttaat

SEQ ID NO: 5227159 - DNA, 14 bp, Homo sapiens
agtcaaaaaattat

SEQ ID NO: 5227160 - DNA, 21 bp, Homo sapiens
agtcaaaaaattatttgctat

SEQ ID NO: 5227161 - DNA, 12 bp, Homo sapiens
agtcaaaacaaa

SEQ ID NO: 5227162 - DNA, 19 bp, Homo sapiens
agtcaaaacacttgtaatt

SEQ ID NO: 5227163 - DNA, 18 bp, Homo sapiens
agtcaaaactatttttgt

SEQ ID NO: 5227164 - DNA, 20 bp, Homo sapiens
agtcaaaactatttttgtaa

SEQ ID NO: 5227165 - DNA, 21 bp, Homo sapiens
agtcaaaactatttttgtaaa

SEQ ID NO: 5227166 - DNA, 22 bp, Homo sapiens
agtcaaaagatccttcatttta

SEQ ID NO: 5227167 - DNA, 18 bp, Homo sapiens
agtcaaaaggtgcctgtg

SEQ ID NO: 5227168 - DNA, 13 bp, Homo sapiens
agtcaaaatttca

SEQ ID NO: 5227169 - DNA, 21 bp, Homo sapiens
agtcaaacaaaaaagaaaagt

SEQ ID NO: 5227170 - DNA, 23 bp, Homo sapiens
agtcaaacaaaaaagaaaagtag

SEQ ID NO: 5227171 - DNA, 21 bp, Homo sapiens
agtcaaacaagttgtgccttt

SEQ ID NO: 5227172 - DNA, 19 bp, Homo sapiens
agtcaaacacttgtgactt

SEQ ID NO: 5227173 - DNA, 22 bp, Homo sapiens
agtcaaacacttgtgacttttg

SEQ ID NO: 5227174 - DNA, 13 bp, Homo sapiens
agtcaaaccataa

SEQ ID NO: 5227175 - DNA, 17 bp, Homo sapiens
agtcaaaccataaactt

SEQ ID NO: 5227176 - DNA, 18 bp, Homo sapiens
agtcaaaccataaacttc

SEQ ID NO: 5227177 - DNA, 20 bp, Homo sapiens
agtcaaaccataaacttcat

SEQ ID NO: 5227178 - DNA, 14 bp, Homo sapiens
agtcaaataaatgt

SEQ ID NO: 5227179 - DNA, 21 bp, Homo sapiens
agtcaaataaatgtttccccc

SEQ ID NO: 5227180 - DNA, 14 bp, Homo sapiens
agtcaaataactcc

SEQ ID NO: 5227181 - DNA, 13 bp, Homo sapiens
agtcaaatccagt

SEQ ID NO: 5227182 - DNA, 16 bp, Homo sapiens
agtcaaatccagtggt

SEQ ID NO: 5227183 - DNA, 17 bp, Homo sapiens
agtcaaatccagtggtg

SEQ ID NO: 5227184 - DNA, 22 bp, Homo sapiens
agtcaaatccagtggtgggtaa

SEQ ID NO: 5227185 - DNA, 17 bp, Homo sapiens
agtcaaatctgggctca

SEQ ID NO: 5227186 - DNA, 14 bp, Homo sapiens
agtcaaatgcattt

SEQ ID NO: 5227187 - DNA, 18 bp, Homo sapiens
agtcaaattaataatctt

SEQ ID NO: 5227188 - DNA, 19 bp, Homo sapiens
agtcaaattgtgtgaaagg

SEQ ID NO: 5227189 - DNA, 23 bp, Homo sapiens
agtcaaattgtgtgaaaggtact

SEQ ID NO: 5227190 - DNA, 22 bp, Homo sapiens
agtcaaatttgaaaataattgt

SEQ ID NO: 5227191 - DNA, 12 bp, Homo sapiens
agtcaacaaact

SEQ ID NO: 5227192 - DNA, 16 bp, Homo sapiens
agtcaacaaactattt

SEQ ID NO: 5227193 - DNA, 16 bp, Homo sapiens
agtcaacaggtcactt

SEQ ID NO: 5227194 - DNA, 14 bp, Homo sapiens
agtcaacagtaaac

SEQ ID NO: 5227195 - DNA, 21 bp, Homo sapiens
agtcaacagtaaaccactgaa

SEQ ID NO: 5227196 - DNA, 19 bp, Homo sapiens
agtcaacagtaccctggtt

SEQ ID NO: 5227197 - DNA, 14 bp, Homo sapiens
agtcaacagtgaaa

SEQ ID NO: 5227198 - DNA, 21 bp, Homo sapiens
agtcaacagttcaaagaagtc

SEQ ID NO: 5227199 - DNA, 20 bp, Homo sapiens
agtcaacggggggctcctgc

SEQ ID NO: 5227200 - DNA, 22 bp, Homo sapiens
agtcaacggggggctcctgccc

SEQ ID NO: 5227201 - DNA, 13 bp, Homo sapiens
agtcaactgctgt

SEQ ID NO: 5227202 - DNA, 17 bp, Homo sapiens
agtcaactggctggcca

SEQ ID NO: 5227203 - DNA, 14 bp, Homo sapiens
agtcaactggggaa

SEQ ID NO: 5227204 - DNA, 15 bp, Homo sapiens
agtcaactggggaaa

SEQ ID NO: 5227205 - DNA, 16 bp, Homo sapiens
agtcaactggggaaaa

SEQ ID NO: 5227206 - DNA, 18 bp, Homo sapiens
agtcaactggggaaaagg

SEQ ID NO: 5227207 - DNA, 19 bp, Homo sapiens
agtcaactggggaaaagga

SEQ ID NO: 5227208 - DNA, 14 bp, Homo sapiens
agtcaagaaaaata

SEQ ID NO: 5227209 - DNA, 16 bp, Homo sapiens
agtcaagaaaaatata

SEQ ID NO: 5227210 - DNA, 22 bp, Homo sapiens
agtcaagaagcaattatttaaa

SEQ ID NO: 5227211 - DNA, 19 bp, Homo sapiens
agtcaagacgaacatgtag

SEQ ID NO: 5227212 - DNA, 22 bp, Homo sapiens
agtcaagattcccggctggact

SEQ ID NO: 5227213 - DNA, 19 bp, Homo sapiens
agtcaagcacatgtaataa

SEQ ID NO: 5227214 - DNA, 14 bp, Homo sapiens
agtcaagctcctcc

SEQ ID NO: 5227215 - DNA, 15 bp, Homo sapiens
agtcaagctcctcct

SEQ ID NO: 5227216 - DNA, 18 bp, Homo sapiens
agtcaagctcctcctccc

SEQ ID NO: 5227217 - DNA, 14 bp, Homo sapiens
agtcaaggcctgct

SEQ ID NO: 5227218 - DNA, 16 bp, Homo sapiens
agtcaaggcttagacc

SEQ ID NO: 5227219 - DNA, 16 bp, Homo sapiens
agtcaagtgtgcctgc

SEQ ID NO: 5227220 - DNA, 18 bp, Homo sapiens
agtcaagttccctcctgc

SEQ ID NO: 5227221 - DNA, 20 bp, Homo sapiens
agtcaagttccgtctcctct

SEQ ID NO: 5227222 - DNA, 18 bp, Homo sapiens
agtcaataaaagagctgt

SEQ ID NO: 5227223 - DNA, 12 bp, Homo sapiens
agtcaatacata

SEQ ID NO: 5227224 - DNA, 14 bp, Homo sapiens
agtcaataggccta

SEQ ID NO: 5227225 - DNA, 15 bp, Homo sapiens
agtcaatcaaacagg

SEQ ID NO: 5227226 - DNA, 14 bp, Homo sapiens
agtcaatcatttct

SEQ ID NO: 5227227 - DNA, 17 bp, Homo sapiens
agtcaatggatccacaa

SEQ ID NO: 5227228 - DNA, 15 bp, Homo sapiens
agtcaatgtgcagtg

SEQ ID NO: 5227229 - DNA, 15 bp, Homo sapiens
agtcaattacatgtt

SEQ ID NO: 5227230 - DNA, 16 bp, Homo sapiens
agtcaattagtacagt

SEQ ID NO: 5227231 - DNA, 15 bp, Homo sapiens
agtcaattcagtgat

SEQ ID NO: 5227232 - DNA, 19 bp, Homo sapiens
agtcaattccacccctcct

SEQ ID NO: 5227233 - DNA, 21 bp, Homo sapiens
agtcaattctgatgttactga

SEQ ID NO: 5227234 - DNA, 17 bp, Homo sapiens
agtcaattgtttaatgt

SEQ ID NO: 5227235 - DNA, 16 bp, Homo sapiens
agtcaatttgctgaaa

SEQ ID NO: 5227236 - DNA, 12 bp, Homo sapiens
agtcacaaaata

SEQ ID NO: 5227237 - DNA, 14 bp, Homo sapiens
agtcacaaaataaa

SEQ ID NO: 5227238 - DNA, 23 bp, Homo sapiens
agtcacaaaataaagctgtgaca

SEQ ID NO: 5227239 - DNA, 18 bp, Homo sapiens
agtcacaaagaacatgta

SEQ ID NO: 5227240 - DNA, 12 bp, Homo sapiens
agtcacaaagag

SEQ ID NO: 5227241 - DNA, 16 bp, Homo sapiens
agtcacaacaaaagga

SEQ ID NO: 5227242 - DNA, 20 bp, Homo sapiens
agtcacaacaaaaggaagac

SEQ ID NO: 5227243 - DNA, 23 bp, Homo sapiens
agtcacaatgttctttatataca

SEQ ID NO: 5227244 - DNA, 15 bp, Homo sapiens
agtcacaatttgcaa

SEQ ID NO: 5227245 - DNA, 13 bp, Homo sapiens
agtcacacagaca

SEQ ID NO: 5227246 - DNA, 18 bp, Homo sapiens
agtcacacagacacacaa

SEQ ID NO: 5227247 - DNA, 13 bp, Homo sapiens
agtcacacagcta

SEQ ID NO: 5227248 - DNA, 11 bp, Homo sapiens
agtcacacagt

SEQ ID NO: 5227249 - DNA, 22 bp, Homo sapiens
agtcacacagtattacttctgc

SEQ ID NO: 5227250 - DNA, 23 bp, Homo sapiens
agtcacacagtattacttctgct

SEQ ID NO: 5227251 - DNA, 17 bp, Homo sapiens
agtcacacagtgttgga

SEQ ID NO: 5227252 - DNA, 18 bp, Homo sapiens
agtcacacattacaaagt

SEQ ID NO: 5227253 - DNA, 23 bp, Homo sapiens
agtcacacattatagaaattact

SEQ ID NO: 5227254 - DNA, 21 bp, Homo sapiens
agtcacaccagggcaactctt

SEQ ID NO: 5227255 - DNA, 16 bp, Homo sapiens
agtcacacccactccc

SEQ ID NO: 5227256 - DNA, 16 bp, Homo sapiens
agtcacactgctggga

SEQ ID NO: 5227257 - DNA, 13 bp, Homo sapiens
agtcacactgtaa

SEQ ID NO: 5227258 - DNA, 22 bp, Homo sapiens
agtcacagagataattctagct

SEQ ID NO: 5227259 - DNA, 21 bp, Homo sapiens
agtcacagatgaggcccccgc

SEQ ID NO: 5227260 - DNA, 21 bp, Homo sapiens
agttaaaagactgcagctgct

SEQ ID NO: 5227261 - DNA, 18 bp, Homo sapiens
agttaaaagtaaaattgt

SEQ ID NO: 5227262 - DNA, 22 bp, Homo sapiens
agttaaaagtaaaattgtttca

SEQ ID NO: 5227263 - DNA, 22 bp, Homo sapiens
agttaaaagtgttgattacata

SEQ ID NO: 5227264 - DNA, 10 bp, Homo sapiens
agttaaaatc

SEQ ID NO: 5227265 - DNA, 17 bp, Homo sapiens
agttaaaatcacatttt

SEQ ID NO: 5227266 - DNA, 19 bp, Homo sapiens
agttaaaatgtgtttttca

SEQ ID NO: 5227267 - DNA, 21 bp, Homo sapiens
agttaaaatgtgtttttcagt

SEQ ID NO: 5227268 - DNA, 12 bp, Homo sapiens
agttaaacacac

SEQ ID NO: 5227269 - DNA, 14 bp, Homo sapiens
agttaaactatttt

SEQ ID NO: 5227270 - DNA, 12 bp, Homo sapiens
agttaaactgag

SEQ ID NO: 5227271 - DNA, 19 bp, Homo sapiens
agttaaagagacaaatagt

SEQ ID NO: 5227272 - DNA, 12 bp, Homo sapiens
agttaaagccac

SEQ ID NO: 5227273 - DNA, 12 bp, Homo sapiens
agttaaaggcag

SEQ ID NO: 5227274 - DNA, 19 bp, Homo sapiens
agttaaaggcagtccagag

SEQ ID NO: 5227275 - DNA, 17 bp, Homo sapiens
agttaaaggctgactac

SEQ ID NO: 5227276 - DNA, 18 bp, Homo sapiens
agttaaagggcagaaggg

SEQ ID NO: 5227277 - DNA, 17 bp, Homo sapiens
agttaaaggttactgtt

SEQ ID NO: 5227278 - DNA, 16 bp, Homo sapiens
agttaaagtgaataac

SEQ ID NO: 5227279 - DNA, 23 bp, Homo sapiens
agttaaagtgaggccactgaaga

SEQ ID NO: 5227280 - DNA, 11 bp, Homo sapiens
agttaaataaa

SEQ ID NO: 5227281 - DNA, 14 bp, Homo sapiens
agttaaataaaaca

SEQ ID NO: 5227282 - DNA, 17 bp, Homo sapiens
agttaaataaaacattg

SEQ ID NO: 5227283 - DNA, 12 bp, Homo sapiens
agttaaataaat

SEQ ID NO: 5227284 - DNA, 21 bp, Homo sapiens
agttaaatagagtatatgcac

SEQ ID NO: 5227285 - DNA, 18 bp, Homo sapiens
agttaaatatgatttgca

SEQ ID NO: 5227286 - DNA, 19 bp, Homo sapiens
agttaaatctcctgtggag

SEQ ID NO: 5227287 - DNA, 18 bp, Homo sapiens
agttaaatgtatcacatt

SEQ ID NO: 5227288 - DNA, 12 bp, Homo sapiens
agttaaatgtgt

SEQ ID NO: 5227289 - DNA, 14 bp, Homo sapiens
agttaaatgtgtgt

SEQ ID NO: 5227290 - DNA, 17 bp, Homo sapiens
agttaaatgtgtgtaaa

SEQ ID NO: 5227291 - DNA, 13 bp, Homo sapiens
agttaaattgatg

SEQ ID NO: 5227292 - DNA, 14 bp, Homo sapiens
agttaaatttctgg

SEQ ID NO: 5227293 - DNA, 16 bp, Homo sapiens
agttaacaaggaatgc

SEQ ID NO: 5227294 - DNA, 17 bp, Homo sapiens
agttaacaaggaatgcc

SEQ ID NO: 5227295 - DNA, 13 bp, Homo sapiens
agttaacaatgat

SEQ ID NO: 5227296 - DNA, 17 bp, Homo sapiens
agttaacacatcaaata

SEQ ID NO: 5227297 - DNA, 20 bp, Homo sapiens
agttaacacctttaaagtgt

SEQ ID NO: 5227298 - DNA, 12 bp, Homo sapiens
agttaacagaga

SEQ ID NO: 5227299 - DNA, 14 bp, Homo sapiens
agttaacaggacag

SEQ ID NO: 5227300 - DNA, 15 bp, Homo sapiens
agttaacaggatatt

SEQ ID NO: 5227301 - DNA, 16 bp, Homo sapiens
agttaacaggatatta

SEQ ID NO: 5227302 - DNA, 19 bp, Homo sapiens
agttaacaggcaaacattt

SEQ ID NO: 5227303 - DNA, 13 bp, Homo sapiens
agttaacatctga

SEQ ID NO: 5227304 - DNA, 21 bp, Homo sapiens
agttaacattaacatctatta

SEQ ID NO: 5227305 - DNA, 21 bp, Homo sapiens
agttaacattcagtactttat

SEQ ID NO: 5227306 - DNA, 18 bp, Homo sapiens
agttaacccggagctaag

SEQ ID NO: 5227307 - DNA, 13 bp, Homo sapiens
agttaacgggtga

SEQ ID NO: 5227308 - DNA, 22 bp, Homo sapiens
agttaacgtattagttgccaat

SEQ ID NO: 5227309 - DNA, 17 bp, Homo sapiens
agttaactattgcattt

SEQ ID NO: 5227310 - DNA, 18 bp, Homo sapiens
agttaactgtgaaatacc

SEQ ID NO: 5227311 - DNA, 21 bp, Homo sapiens
agttaacttagtgtttagcat

SEQ ID NO: 5227312 - DNA, 14 bp, Homo sapiens
agttaactttcaga

SEQ ID NO: 5227313 - DNA, 18 bp, Homo sapiens
agttaagaagctgttgta

SEQ ID NO: 5227314 - DNA, 16 bp, Homo sapiens
agttaagaattgaaga

SEQ ID NO: 5227315 - DNA, 19 bp, Homo sapiens
agttaagacaacaggcatt

SEQ ID NO: 5227316 - DNA, 13 bp, Homo sapiens
agttaagagaaac

SEQ ID NO: 5227317 - DNA, 14 bp, Homo sapiens
agttaagagaaact

SEQ ID NO: 5227318 - DNA, 15 bp, Homo sapiens
agttaagagaaactt

SEQ ID NO: 5227319 - DNA, 19 bp, Homo sapiens
agttaagagaaactttata

SEQ ID NO: 5227320 - DNA, 24 bp, Homo sapiens
agttaagcacaaccatgttcttga

SEQ ID NO: 5227321 - DNA, 16 bp, Homo sapiens
agttaagcagcctttc

SEQ ID NO: 5227322 - DNA, 16 bp, Homo sapiens
agttaagccccctcct

SEQ ID NO: 5227323 - DNA, 13 bp, Homo sapiens
agttaagcctttg

SEQ ID NO: 5227324 - DNA, 21 bp, Homo sapiens
agttaaggagaatcatgtttc

SEQ ID NO: 5227325 - DNA, 22 bp, Homo sapiens
agttaaggagaatcatgtttct

SEQ ID NO: 5227326 - DNA, 13 bp, Homo sapiens
agttaaggcaaat

SEQ ID NO: 5227327 - DNA, 15 bp, Homo sapiens
agttaaggcaaatca

SEQ ID NO: 5227328 - DNA, 21 bp, Homo sapiens
agttaaggtgtgcaaagatct

SEQ ID NO: 5227329 - DNA, 20 bp, Homo sapiens
agttaaggtgtgcagtgttt

SEQ ID NO: 5227330 - DNA, 15 bp, Homo sapiens
agttaagtatttaca

SEQ ID NO: 5227331 - DNA, 18 bp, Homo sapiens
agttaagtcgctgaacaa

SEQ ID NO: 5227332 - DNA, 12 bp, Homo sapiens
agttaagtgaag

SEQ ID NO: 5227333 - DNA, 18 bp, Homo sapiens
agttaagtgaagcctacc

SEQ ID NO: 5227334 - DNA, 15 bp, Homo sapiens
agttaagtgaatgtc

SEQ ID NO: 5227335 - DNA, 19 bp, Homo sapiens
agttaataacagctccttt

SEQ ID NO: 5227336 - DNA, 20 bp, Homo sapiens
agttaataagcaaaatcctg

SEQ ID NO: 5227337 - DNA, 21 bp, Homo sapiens
agttaataagttgatgttttc

SEQ ID NO: 5227338 - DNA, 18 bp, Homo sapiens
agttaatactccagagac

SEQ ID NO: 5227339 - DNA, 19 bp, Homo sapiens
agttaatactccagagaca

SEQ ID NO: 5227340 - DNA, 20 bp, Homo sapiens
agttaataggagtatttttg

SEQ ID NO: 5227341 - DNA, 13 bp, Homo sapiens
agttaatataaat

SEQ ID NO: 5227342 - DNA, 15 bp, Homo sapiens
agttaatattgtgaa

SEQ ID NO: 5227343 - DNA, 14 bp, Homo sapiens
agttaatattttgt

SEQ ID NO: 5227344 - DNA, 15 bp, Homo sapiens
agttaatcttgcttt

SEQ ID NO: 5227345 - DNA, 12 bp, Homo sapiens
agttaatgaaat

SEQ ID NO: 5227346 - DNA, 21 bp, Homo sapiens
agttaatgaaggtgtgctaca

SEQ ID NO: 5227347 - DNA, 16 bp, Homo sapiens
agttaatgagccatca

SEQ ID NO: 5227348 - DNA, 20 bp, Homo sapiens
agttaatgatggttgatggg

SEQ ID NO: 5227349 - DNA, 20 bp, Homo sapiens
agttaatggggtagaggagg

SEQ ID NO: 5227350 - DNA, 17 bp, Homo sapiens
agttaatgtactttcat

SEQ ID NO: 5227351 - DNA, 21 bp, Homo sapiens
agttaatgtactttcattccc

SEQ ID NO: 5227352 - DNA, 19 bp, Homo sapiens
agttaatgtatataaaaat

SEQ ID NO: 5227353 - DNA, 16 bp, Homo sapiens
agttaatgtgccaaaa

SEQ ID NO: 5227354 - DNA, 16 bp, Homo sapiens
agttaattcttaaaac

SEQ ID NO: 5227355 - DNA, 17 bp, Homo sapiens
agttaattcttaaaact

SEQ ID NO: 5227356 - DNA, 18 bp, Homo sapiens
agttaattcttaaaacta

SEQ ID NO: 5227357 - DNA, 21 bp, Homo sapiens
agttaattcttaaaactataa

SEQ ID NO: 5227358 - DNA, 23 bp, Homo sapiens
agttaattcttaaaactataaca

SEQ ID NO: 5227359 - DNA, 11 bp, Homo sapiens
agttaattttt

SEQ ID NO: 5227360 - DNA, 15 bp, Homo sapiens
agttaatttttccaa

SEQ ID NO: 5227361 - DNA, 17 bp, Homo sapiens
agttaatttttccaact

SEQ ID NO: 5227362 - DNA, 14 bp, Homo sapiens
agttacaaaaatag

SEQ ID NO: 5227363 - DNA, 19 bp, Homo sapiens
agttacaaagtaatttctt

SEQ ID NO: 5227364 - DNA, 16 bp, Homo sapiens
agttacaacattaatt

SEQ ID NO: 5227365 - DNA, 20 bp, Homo sapiens
agttacaataaagtttacaa

SEQ ID NO: 5227366 - DNA, 15 bp, Homo sapiens
agttacaattacatc

SEQ ID NO: 5227367 - DNA, 19 bp, Homo sapiens
agttacaattacatctcta

SEQ ID NO: 5227368 - DNA, 19 bp, Homo sapiens
agttacacaattaattgtc

SEQ ID NO: 5227369 - DNA, 18 bp, Homo sapiens
agttacacatgatcataa

SEQ ID NO: 5227370 - DNA, 18 bp, Homo sapiens
agttacactaaaaggtga

SEQ ID NO: 5227371 - DNA, 20 bp, Homo sapiens
agttacactggatgaaaatg

SEQ ID NO: 5227372 - DNA, 13 bp, Homo sapiens
agttacagaaagt

SEQ ID NO: 5227373 - DNA, 15 bp, Homo sapiens
agttacagaaagtgg

SEQ ID NO: 5227374 - DNA, 19 bp, Homo sapiens
agttacagaaatgattact

SEQ ID NO: 5227375 - DNA, 13 bp, Homo sapiens
agttacagaattc

SEQ ID NO: 5227376 - DNA, 16 bp, Homo sapiens
agttacagcagataca

SEQ ID NO: 5227377 - DNA, 20 bp, Homo sapiens
agttacagcctgttagtaac

SEQ ID NO: 5227378 - DNA, 23 bp, Homo sapiens
agttacagcgagaggcagagaaa

SEQ ID NO: 5227379 - DNA, 14 bp, Homo sapiens
agttacagtggcag

SEQ ID NO: 5227380 - DNA, 15 bp, Homo sapiens
agttacagtggcagt

SEQ ID NO: 5227381 - DNA, 18 bp, Homo sapiens
agttacagtggcagtatt

SEQ ID NO: 5227382 - DNA, 19 bp, Homo sapiens
agttacagtggcagtattg

SEQ ID NO: 5227383 - DNA, 19 bp, Homo sapiens
agttacatacatttaaaaa

SEQ ID NO: 5227384 - DNA, 22 bp, Homo sapiens
agttacatacatttaaaaaaca

SEQ ID NO: 5227385 - DNA, 12 bp, Homo sapiens
agttacatgcat

SEQ ID NO: 5227386 - DNA, 16 bp, Homo sapiens
agttacatgcataaaa

SEQ ID NO: 5227387 - DNA, 20 bp, Homo sapiens
agttacatggtaattatgtg

SEQ ID NO: 5227388 - DNA, 20 bp, Homo sapiens
agttacattaatgcccagcc

SEQ ID NO: 5227389 - DNA, 16 bp, Homo sapiens
agttaccagtgcctta

SEQ ID NO: 5227390 - DNA, 19 bp, Homo sapiens
agttaccattaaaccatct

SEQ ID NO: 5227391 - DNA, 18 bp, Homo sapiens
agttaccattatttaatt

SEQ ID NO: 5227392 - DNA, 22 bp, Homo sapiens
agttaccattatttaatttgta

SEQ ID NO: 5227393 - DNA, 23 bp, Homo sapiens
agttacccaaaatctgattagaa

SEQ ID NO: 5227394 - DNA, 17 bp, Homo sapiens
agttacccaaattaaga

SEQ ID NO: 5227395 - DNA, 20 bp, Homo sapiens
agttaccctgatctggaccc

SEQ ID NO: 5227396 - DNA, 21 bp, Homo sapiens
agttaccgagacatgaatact

SEQ ID NO: 5227397 - DNA, 20 bp, Homo sapiens
agttacctggaatcaaataa

SEQ ID NO: 5227398 - DNA, 22 bp, Homo sapiens
agttaccttaaagctgaattta

SEQ ID NO: 5227399 - DNA, 15 bp, Homo sapiens
agttacctttgctgt

SEQ ID NO: 5227400 - DNA, 19 bp, Homo sapiens
agttacgagttttccctca

SEQ ID NO: 5227401 - DNA, 18 bp, Homo sapiens
agttacgttgcatccaca

SEQ ID NO: 5227402 - DNA, 14 bp, Homo sapiens
agttactaaaattt

SEQ ID NO: 5227403 - DNA, 15 bp, Homo sapiens
agttactaaaattta

SEQ ID NO: 5227404 - DNA, 18 bp, Homo sapiens
agttactaagaagaaaat

SEQ ID NO: 5227405 - DNA, 21 bp, Homo sapiens
agttactacctcctctcctga

SEQ ID NO: 5227406 - DNA, 14 bp, Homo sapiens
agttactactgatt

SEQ ID NO: 5227407 - DNA, 18 bp, Homo sapiens
agttactaggtaacttca

SEQ ID NO: 5227408 - DNA, 22 bp, Homo sapiens
agttactaggtaacttcatatt

SEQ ID NO: 5227409 - DNA, 13 bp, Homo sapiens
agttactcagccc

SEQ ID NO: 5227410 - DNA, 19 bp, Homo sapiens
agttactcagccctgggcc

SEQ ID NO: 5227411 - DNA, 17 bp, Homo sapiens
agttactccagtgccaa

SEQ ID NO: 5227412 - DNA, 21 bp, Homo sapiens
agttactcccttctcgtgttt

SEQ ID NO: 5227413 - DNA, 15 bp, Homo sapiens
agttactctgaaggg

SEQ ID NO: 5227414 - DNA, 16 bp, Homo sapiens
agttactgaacagtaa

SEQ ID NO: 5227415 - DNA, 18 bp, Homo sapiens
agttactgattcactgca

SEQ ID NO: 5227416 - DNA, 17 bp, Homo sapiens
agttactgcaacttaac

SEQ ID NO: 5227417 - DNA, 17 bp, Homo sapiens
agttactgggtatttga

SEQ ID NO: 5227418 - DNA, 14 bp, Homo sapiens
agttactggtttca

SEQ ID NO: 5227419 - DNA, 12 bp, Homo sapiens
agttactgtaaa

SEQ ID NO: 5227420 - DNA, 15 bp, Homo sapiens
agttactgtaaaatg

SEQ ID NO: 5227421 - DNA, 16 bp, Homo sapiens
agttactgtaaaatgc

SEQ ID NO: 5227422 - DNA, 13 bp, Homo sapiens
agttactgtaaat

SEQ ID NO: 5227423 - DNA, 13 bp, Homo sapiens
agttactgtgcat

SEQ ID NO: 5227424 - DNA, 16 bp, Homo sapiens
agttactgtgtaaact

SEQ ID NO: 5227425 - DNA, 16 bp, Homo sapiens
agttactgtgtaatta

SEQ ID NO: 5227426 - DNA, 13 bp, Homo sapiens
agttactgttcat

SEQ ID NO: 5227427 - DNA, 20 bp, Homo sapiens
agttacttaagattcagttt

SEQ ID NO: 5227428 - DNA, 21 bp, Homo sapiens
agttacttaagattcagtttt

SEQ ID NO: 5227429 - DNA, 15 bp, Homo sapiens
agttacttaatgacc

SEQ ID NO: 5227430 - DNA, 15 bp, Homo sapiens
agttacttacctgca

SEQ ID NO: 5227431 - DNA, 15 bp, Homo sapiens
agttacttcctatca

SEQ ID NO: 5227432 - DNA, 16 bp, Homo sapiens
agttacttccttcctg

SEQ ID NO: 5227433 - DNA, 12 bp, Homo sapiens
agttacttgaaa

SEQ ID NO: 5227434 - DNA, 15 bp, Homo sapiens
agttacttgtgttca

SEQ ID NO: 5227435 - DNA, 14 bp, Homo sapiens
agttactttagatg

SEQ ID NO: 5227436 - DNA, 22 bp, Homo sapiens
agttactttccaattctccttt

SEQ ID NO: 5227437 - DNA, 19 bp, Homo sapiens
agttactttgtcagaggca

SEQ ID NO: 5227438 - DNA, 17 bp, Homo sapiens
agttacttttccttgca

SEQ ID NO: 5227439 - DNA, 20 bp, Homo sapiens
agttacttttccttgcatac

SEQ ID NO: 5227440 - DNA, 14 bp, Homo sapiens
agtcacagattctt

SEQ ID NO: 5227441 - DNA, 16 bp, Homo sapiens
agtcacagccatttca

SEQ ID NO: 5227442 - DNA, 13 bp, Homo sapiens
agtcacagctgca

SEQ ID NO: 5227443 - DNA, 15 bp, Homo sapiens
agtcacagctgcagc

SEQ ID NO: 5227444 - DNA, 17 bp, Homo sapiens
agtcacagctgcagctg

SEQ ID NO: 5227445 - DNA, 21 bp, Homo sapiens
agtcacagctgcagctgggcc

SEQ ID NO: 5227446 - DNA, 22 bp, Homo sapiens
agtcacagctgcagctgggccc

SEQ ID NO: 5227447 - DNA, 23 bp, Homo sapiens
agtcacagctgcagctgggcccc

SEQ ID NO: 5227448 - DNA, 18 bp, Homo sapiens
agtcacagctttcccagg

SEQ ID NO: 5227449 - DNA, 19 bp, Homo sapiens
agtcacagctttcccaggt

SEQ ID NO: 5227450 - DNA, 23 bp, Homo sapiens
agtcacaggaagaaagcagaaag

SEQ ID NO: 5227451 - DNA, 16 bp, Homo sapiens
agtcacaggcccagga

SEQ ID NO: 5227452 - DNA, 17 bp, Homo sapiens
agtcacaggcccaggaa

SEQ ID NO: 5227453 - DNA, 13 bp, Homo sapiens
agtcacagggcag

SEQ ID NO: 5227454 - DNA, 14 bp, Homo sapiens
agtcacatcacagg

SEQ ID NO: 5227455 - DNA, 17 bp, Homo sapiens
agtcacatcagtgagga

SEQ ID NO: 5227456 - DNA, 20 bp, Homo sapiens
agtcacatcagtgaggaggg

SEQ ID NO: 5227457 - DNA, 20 bp, Homo sapiens
agtcacattccaagcctcat

SEQ ID NO: 5227458 - DNA, 19 bp, Homo sapiens
agtcacattcctgaacagg

SEQ ID NO: 5227459 - DNA, 14 bp, Homo sapiens
agtcaccaagccca

SEQ ID NO: 5227460 - DNA, 15 bp, Homo sapiens
agtcaccaagcccag

SEQ ID NO: 5227461 - DNA, 18 bp, Homo sapiens
agtcaccacccagccctt

SEQ ID NO: 5227462 - DNA, 14 bp, Homo sapiens
agtcaccagagact

SEQ ID NO: 5227463 - DNA, 11 bp, Homo sapiens
agtcaccatgc

SEQ ID NO: 5227464 - DNA, 18 bp, Homo sapiens
agtcaccattctgcattt

SEQ ID NO: 5227465 - DNA, 23 bp, Homo sapiens
agtcaccattctgcatttagctg

SEQ ID NO: 5227466 - DNA, 18 bp, Homo sapiens
agtcacccaaacacttct

SEQ ID NO: 5227467 - DNA, 15 bp, Homo sapiens
agtcacccccccagg

SEQ ID NO: 5227468 - DNA, 17 bp, Homo sapiens
agtcacccccccaggcc

SEQ ID NO: 5227469 - DNA, 23 bp, Homo sapiens
agtcacccccccaggcctccaga

SEQ ID NO: 5227470 - DNA, 19 bp, Homo sapiens
agtcaccccggccacctgc

SEQ ID NO: 5227471 - DNA, 19 bp, Homo sapiens
agtcaccctacctgtgcct

SEQ ID NO: 5227472 - DNA, 15 bp, Homo sapiens
agtcaccctagccct

SEQ ID NO: 5227473 - DNA, 18 bp, Homo sapiens
agtcacctacaggactgg

SEQ ID NO: 5227474 - DNA, 15 bp, Homo sapiens
agtcacctccccaca

SEQ ID NO: 5227475 - DNA, 17 bp, Homo sapiens
agtcacctcctccactc

SEQ ID NO: 5227476 - DNA, 15 bp, Homo sapiens
agtcacctcctgctc

SEQ ID NO: 5227477 - DNA, 14 bp, Homo sapiens
agtcacctgcaagc

SEQ ID NO: 5227478 - DNA, 20 bp, Homo sapiens
agtcacctgcaagccccagg

SEQ ID NO: 5227479 - DNA, 16 bp, Homo sapiens
agtcacctgctccaga

SEQ ID NO: 5227480 - DNA, 14 bp, Homo sapiens
agtcaccttccagg

SEQ ID NO: 5227481 - DNA, 21 bp, Homo sapiens
agtcaccttcccttgccactt

SEQ ID NO: 5227482 - DNA, 13 bp, Homo sapiens
agtcaccttttaa

SEQ ID NO: 5227483 - DNA, 16 bp, Homo sapiens
agtcaccttttaaatc

SEQ ID NO: 5227484 - DNA, 13 bp, Homo sapiens
agtcaccttttct

SEQ ID NO: 5227485 - DNA, 19 bp, Homo sapiens
agtcaccttttctgtggct

SEQ ID NO: 5227486 - DNA, 15 bp, Homo sapiens
agtcacgcctgaaac

SEQ ID NO: 5227487 - DNA, 19 bp, Homo sapiens
agtcacggggaggtgctgg

SEQ ID NO: 5227488 - DNA, 18 bp, Homo sapiens
agtcacgtgaggcccctg

SEQ ID NO: 5227489 - DNA, 22 bp, Homo sapiens
agtcacgtgaggcccctgtgca

SEQ ID NO: 5227490 - DNA, 21 bp, Homo sapiens
agtcacgtggaggagcagtgc

SEQ ID NO: 5227491 - DNA, 13 bp, Homo sapiens
agtcactaagact

SEQ ID NO: 5227492 - DNA, 16 bp, Homo sapiens
agtcactaatatagta

SEQ ID NO: 5227493 - DNA, 18 bp, Homo sapiens
agtcactaccttcatgca

SEQ ID NO: 5227494 - DNA, 15 bp, Homo sapiens
agtcactagaagtcc

SEQ ID NO: 5227495 - DNA, 20 bp, Homo sapiens
agtcactagaagtcctgctg

SEQ ID NO: 5227496 - DNA, 21 bp, Homo sapiens
agtcactatgggatgagaaaa

SEQ ID NO: 5227497 - DNA, 17 bp, Homo sapiens
agtcactcaattgtttt

SEQ ID NO: 5227498 - DNA, 21 bp, Homo sapiens
agtcactccgttttgcaaaag

SEQ ID NO: 5227499 - DNA, 21 bp, Homo sapiens
agtcactcctctctagggcag

SEQ ID NO: 5227500 - DNA, 20 bp, Homo sapiens
agtcactcgataataaagta

SEQ ID NO: 5227501 - DNA, 17 bp, Homo sapiens
agtcactctagtcaatg

SEQ ID NO: 5227502 - DNA, 20 bp, Homo sapiens
agtcactctagtcaatgaca

SEQ ID NO: 5227503 - DNA, 22 bp, Homo sapiens
agtcactctagtcaatgacatg

SEQ ID NO: 5227504 - DNA, 14 bp, Homo sapiens
agtcactgaacaaa

SEQ ID NO: 5227505 - DNA, 18 bp, Homo sapiens
agtcactgagacagcccg

SEQ ID NO: 5227506 - DNA, 23 bp, Homo sapiens
agtcactgatgtacaattaaaaa

SEQ ID NO: 5227507 - DNA, 18 bp, Homo sapiens
agtcactgcaaaaccagg

SEQ ID NO: 5227508 - DNA, 20 bp, Homo sapiens
agtcactgcacgttttcatc

SEQ ID NO: 5227509 - DNA, 17 bp, Homo sapiens
agtcactgccactttgc

SEQ ID NO: 5227510 - DNA, 19 bp, Homo sapiens
agtcactgccactttgcac

SEQ ID NO: 5227511 - DNA, 14 bp, Homo sapiens
agtcactgcctgga

SEQ ID NO: 5227512 - DNA, 18 bp, Homo sapiens
agtcactgctgcaaggtg

SEQ ID NO: 5227513 - DNA, 13 bp, Homo sapiens
agtcactggaaag

SEQ ID NO: 5227514 - DNA, 19 bp, Homo sapiens
agtcactgttcgtcactca

SEQ ID NO: 5227515 - DNA, 13 bp, Homo sapiens
agtcacttaaaat

SEQ ID NO: 5227516 - DNA, 23 bp, Homo sapiens
agtcacttaactataaggtgcct

SEQ ID NO: 5227517 - DNA, 16 bp, Homo sapiens
agtcacttatttcata

SEQ ID NO: 5227518 - DNA, 20 bp, Homo sapiens
agtcacttgatgtgccattt

SEQ ID NO: 5227519 - DNA, 21 bp, Homo sapiens
agtcacttgatgtgccatttt

SEQ ID NO: 5227520 - DNA, 23 bp, Homo sapiens
agtcacttgatgtgccattttaa

SEQ ID NO: 5227521 - DNA, 12 bp, Homo sapiens
agtcacttgtaa

SEQ ID NO: 5227522 - DNA, 22 bp, Homo sapiens
agtcactttgcttaagatgcta

SEQ ID NO: 5227523 - DNA, 15 bp, Homo sapiens
agtcagaaaacttta

SEQ ID NO: 5227524 - DNA, 17 bp, Homo sapiens
agtcagaaaactttaaa

SEQ ID NO: 5227525 - DNA, 22 bp, Homo sapiens
agtcagaaaattggcagtggca

SEQ ID NO: 5227526 - DNA, 24 bp, Homo sapiens
agtcagaaaattggcagtggcaga

SEQ ID NO: 5227527 - DNA, 12 bp, Homo sapiens
agtcagaaatga

SEQ ID NO: 5227528 - DNA, 19 bp, Homo sapiens
agtcagaaatgattcaggg

SEQ ID NO: 5227529 - DNA, 14 bp, Homo sapiens
agtcagaacagcag

SEQ ID NO: 5227530 - DNA, 14 bp, Homo sapiens
agtcagaagttctg

SEQ ID NO: 5227531 - DNA, 18 bp, Homo sapiens
agtcagaatatttttgaa

SEQ ID NO: 5227532 - DNA, 19 bp, Homo sapiens
agtcagaatttttaactgt

SEQ ID NO: 5227533 - DNA, 20 bp, Homo sapiens
agtcagaatttttaactgta

SEQ ID NO: 5227534 - DNA, 15 bp, Homo sapiens
agtcagacatttctt

SEQ ID NO: 5227535 - DNA, 21 bp, Homo sapiens
agtcagacatttctttggaaa

SEQ ID NO: 5227536 - DNA, 18 bp, Homo sapiens
agtcagaccctaggaagc

SEQ ID NO: 5227537 - DNA, 18 bp, Homo sapiens
agtcagacgccaggcacc

SEQ ID NO: 5227538 - DNA, 12 bp, Homo sapiens
agtcagactgat

SEQ ID NO: 5227539 - DNA, 17 bp, Homo sapiens
agtcagactgatagaca

SEQ ID NO: 5227540 - DNA, 22 bp, Homo sapiens
agtcagactgatagacaccata

SEQ ID NO: 5227541 - DNA, 17 bp, Homo sapiens
agtcagagaaaacactt

SEQ ID NO: 5227542 - DNA, 13 bp, Homo sapiens
agtcagagacaga

SEQ ID NO: 5227543 - DNA, 17 bp, Homo sapiens
agtcagagacagatacc

SEQ ID NO: 5227544 - DNA, 11 bp, Homo sapiens
agtcagagccc

SEQ ID NO: 5227545 - DNA, 23 bp, Homo sapiens
agtcagagcccctacagcattgt

SEQ ID NO: 5227546 - DNA, 12 bp, Homo sapiens
agtcagagccct

SEQ ID NO: 5227547 - DNA, 15 bp, Homo sapiens
agtcagaggagaaga

SEQ ID NO: 5227548 - DNA, 21 bp, Homo sapiens
agtcagatacgcaacctcctt

SEQ ID NO: 5227549 - DNA, 20 bp, Homo sapiens
agtcagatctgcctaaggac

SEQ ID NO: 5227550 - DNA, 23 bp, Homo sapiens
agtcagatgagcaaggacattgc

SEQ ID NO: 5227551 - DNA, 14 bp, Homo sapiens
agtcagatgcccag

SEQ ID NO: 5227552 - DNA, 14 bp, Homo sapiens
agtcagatggatgt

SEQ ID NO: 5227553 - DNA, 18 bp, Homo sapiens
agtcagatgggtctgata

SEQ ID NO: 5227554 - DNA, 21 bp, Homo sapiens
agtcagatgtttgagcagtgg

SEQ ID NO: 5227555 - DNA, 16 bp, Homo sapiens
agtcagattcttgcat

SEQ ID NO: 5227556 - DNA, 13 bp, Homo sapiens
agtcagcaccttg

SEQ ID NO: 5227557 - DNA, 16 bp, Homo sapiens
agtcagcagtcatgca

SEQ ID NO: 5227558 - DNA, 15 bp, Homo sapiens
agtcagcagtcctag

SEQ ID NO: 5227559 - DNA, 19 bp, Homo sapiens
agtcagcatgcttcccaga

SEQ ID NO: 5227560 - DNA, 19 bp, Homo sapiens
agtcagccacactgggcct

SEQ ID NO: 5227561 - DNA, 21 bp, Homo sapiens
agtcagccacactgggcctgg

SEQ ID NO: 5227562 - DNA, 15 bp, Homo sapiens
agtcagccagtggct

SEQ ID NO: 5227563 - DNA, 21 bp, Homo sapiens
agtcagccgacaactatttcg

SEQ ID NO: 5227564 - DNA, 15 bp, Homo sapiens
agtcagcctctctcc

SEQ ID NO: 5227565 - DNA, 16 bp, Homo sapiens
agtcagcctggctggg

SEQ ID NO: 5227566 - DNA, 18 bp, Homo sapiens
agtcagcctggctgggct

SEQ ID NO: 5227567 - DNA, 15 bp, Homo sapiens
agtcagcggagagga

SEQ ID NO: 5227568 - DNA, 18 bp, Homo sapiens
agtcagcggagaggaccc

SEQ ID NO: 5227569 - DNA, 21 bp, Homo sapiens
agtcagctactctagttctgt

SEQ ID NO: 5227570 - DNA, 22 bp, Homo sapiens
agtcagctccgagtggctcccg

SEQ ID NO: 5227571 - DNA, 17 bp, Homo sapiens
agtcagctctctgccct

SEQ ID NO: 5227572 - DNA, 18 bp, Homo sapiens
agtcagctctctgccctg

SEQ ID NO: 5227573 - DNA, 17 bp, Homo sapiens
agtcagctcttcatctg

SEQ ID NO: 5227574 - DNA, 22 bp, Homo sapiens
agtcagctcttcatctgcccaa

SEQ ID NO: 5227575 - DNA, 19 bp, Homo sapiens
agtcagctgaccccctccc

SEQ ID NO: 5227576 - DNA, 22 bp, Homo sapiens
agtcagctgaccccctcccccc

SEQ ID NO: 5227577 - DNA, 15 bp, Homo sapiens
agtcaggacctggct

SEQ ID NO: 5227578 - DNA, 16 bp, Homo sapiens
agtcaggacctggctt

SEQ ID NO: 5227579 - DNA, 17 bp, Homo sapiens
agtcaggacctggcttg

SEQ ID NO: 5227580 - DNA, 22 bp, Homo sapiens
agtcaggagttttactgcctgt

SEQ ID NO: 5227581 - DNA, 11 bp, Homo sapiens
agtcaggcagg

SEQ ID NO: 5227582 - DNA, 17 bp, Homo sapiens
agtcaggcccaggcact

SEQ ID NO: 5227583 - DNA, 18 bp, Homo sapiens
agtcaggcctgggcagga

SEQ ID NO: 5227584 - DNA, 23 bp, Homo sapiens
agtcaggcctgggcaggaccctg

SEQ ID NO: 5227585 - DNA, 23 bp, Homo sapiens
agtcaggctgttggcgtgtccca

SEQ ID NO: 5227586 - DNA, 19 bp, Homo sapiens
agtcaggcttctcttgcta

SEQ ID NO: 5227587 - DNA, 19 bp, Homo sapiens
agtcagggacccctgccct

SEQ ID NO: 5227588 - DNA, 17 bp, Homo sapiens
agtcagggacctgctgc

SEQ ID NO: 5227589 - DNA, 18 bp, Homo sapiens
agtcagggacctgctgct

SEQ ID NO: 5227590 - DNA, 24 bp, Homo sapiens
agtcagggcggggctggccagctg

SEQ ID NO: 5227591 - DNA, 20 bp, Homo sapiens
agtcaggggagaagctgaag

SEQ ID NO: 5227592 - DNA, 19 bp, Homo sapiens
agtcaggggctctgtgtta

SEQ ID NO: 5227593 - DNA, 14 bp, Homo sapiens
agtcaggtaatata

SEQ ID NO: 5227594 - DNA, 15 bp, Homo sapiens
agtcaggtaatatac

SEQ ID NO: 5227595 - DNA, 19 bp, Homo sapiens
agtcaggtgtcatcatcag

SEQ ID NO: 5227596 - DNA, 13 bp, Homo sapiens
agtcagtaaacat

SEQ ID NO: 5227597 - DNA, 19 bp, Homo sapiens
agtcagtacacccaatttt

SEQ ID NO: 5227598 - DNA, 17 bp, Homo sapiens
agtcagtacgatcaagt

SEQ ID NO: 5227599 - DNA, 15 bp, Homo sapiens
agtcagtaggagagg

SEQ ID NO: 5227600 - DNA, 13 bp, Homo sapiens
agtcagtattgtt

SEQ ID NO: 5227601 - DNA, 17 bp, Homo sapiens
agtcagtattgttttgg

SEQ ID NO: 5227602 - DNA, 18 bp, Homo sapiens
agtcagtcatgtcactga

SEQ ID NO: 5227603 - DNA, 15 bp, Homo sapiens
agtcagtcattcaga

SEQ ID NO: 5227604 - DNA, 22 bp, Homo sapiens
agtcagtcgcctttcagcaggc

SEQ ID NO: 5227605 - DNA, 19 bp, Homo sapiens
agtcagtctgcacttaaat

SEQ ID NO: 5227606 - DNA, 24 bp, Homo sapiens
agtcagtgcactaaccccagctgc

SEQ ID NO: 5227607 - DNA, 16 bp, Homo sapiens
agtcagtgccaggtcc

SEQ ID NO: 5227608 - DNA, 20 bp, Homo sapiens
agtcagtgcccatgtgtatg

SEQ ID NO: 5227609 - DNA, 23 bp, Homo sapiens
agtcagtgctctcagctggcagt

SEQ ID NO: 5227610 - DNA, 20 bp, Homo sapiens
agtcagtggagagatgtttg

SEQ ID NO: 5227611 - DNA, 19 bp, Homo sapiens
agtcagtggagcctgggtg

SEQ ID NO: 5227612 - DNA, 21 bp, Homo sapiens
agtcagtgtactctgagtcct

SEQ ID NO: 5227613 - DNA, 13 bp, Homo sapiens
agtcagtgtcaat

SEQ ID NO: 5227614 - DNA, 15 bp, Homo sapiens
agtcagtgtctggct

SEQ ID NO: 5227615 - DNA, 14 bp, Homo sapiens
agtcagtgttgaat

SEQ ID NO: 5227616 - DNA, 16 bp, Homo sapiens
agtcagtgttgagatg

SEQ ID NO: 5227617 - DNA, 19 bp, Homo sapiens
agttagaaatctccagtgt

SEQ ID NO: 5227618 - DNA, 15 bp, Homo sapiens
agttagaacatttgc

SEQ ID NO: 5227619 - DNA, 15 bp, Homo sapiens
agttagaaccacagc

SEQ ID NO: 5227620 - DNA, 20 bp, Homo sapiens
agttagaaccacagcagaca

SEQ ID NO: 5227621 - DNA, 20 bp, Homo sapiens
agttagaaggaggttctaat

SEQ ID NO: 5227622 - DNA, 15 bp, Homo sapiens
agttagaataataaa

SEQ ID NO: 5227623 - DNA, 17 bp, Homo sapiens
agttagaatctattttc

SEQ ID NO: 5227624 - DNA, 15 bp, Homo sapiens
agttagaattccttc

SEQ ID NO: 5227625 - DNA, 19 bp, Homo sapiens
agttagaattccttcaggg

SEQ ID NO: 5227626 - DNA, 21 bp, Homo sapiens
agttagaattccttcagggtg

SEQ ID NO: 5227627 - DNA, 15 bp, Homo sapiens
agttagaattggaaa

SEQ ID NO: 5227628 - DNA, 16 bp, Homo sapiens
agttagagaatatatt

SEQ ID NO: 5227629 - DNA, 18 bp, Homo sapiens
agttagagatgcctccct

SEQ ID NO: 5227630 - DNA, 22 bp, Homo sapiens
agttagattattgaaatattat

SEQ ID NO: 5227631 - DNA, 16 bp, Homo sapiens
agttagcaaactttgt

SEQ ID NO: 5227632 - DNA, 18 bp, Homo sapiens
agttagcaactagggcta

SEQ ID NO: 5227633 - DNA, 14 bp, Homo sapiens
agttagcacagagg

SEQ ID NO: 5227634 - DNA, 17 bp, Homo sapiens
agttagcaggaaatagt

SEQ ID NO: 5227635 - DNA, 18 bp, Homo sapiens
agttagcatccaggctgg

SEQ ID NO: 5227636 - DNA, 19 bp, Homo sapiens
agttagcatccaggctggc

SEQ ID NO: 5227637 - DNA, 22 bp, Homo sapiens
agttagcatttaccaacatgta

SEQ ID NO: 5227638 - DNA, 23 bp, Homo sapiens
agttagccaaacaacaacaaaaa

SEQ ID NO: 5227639 - DNA, 11 bp, Homo sapiens
agttagccaat

SEQ ID NO: 5227640 - DNA, 20 bp, Homo sapiens
agttagccactgctggtgtt

SEQ ID NO: 5227641 - DNA, 23 bp, Homo sapiens
agttagccccagaaaatgaaatc

SEQ ID NO: 5227642 - DNA, 18 bp, Homo sapiens
agttagctattgggagca

SEQ ID NO: 5227643 - DNA, 16 bp, Homo sapiens
agttagctcaggaggc

SEQ ID NO: 5227644 - DNA, 15 bp, Homo sapiens
agttagctttaactt

SEQ ID NO: 5227645 - DNA, 20 bp, Homo sapiens
agttagctttaacttaaata

SEQ ID NO: 5227646 - DNA, 13 bp, Homo sapiens
agttagctttatt

SEQ ID NO: 5227647 - DNA, 20 bp, Homo sapiens
agttaggaaataaaaccttt

SEQ ID NO: 5227648 - DNA, 22 bp, Homo sapiens
agttaggaaataaaacctttca

SEQ ID NO: 5227649 - DNA, 16 bp, Homo sapiens
agttaggaatgagaag

SEQ ID NO: 5227650 - DNA, 16 bp, Homo sapiens
agttaggatagcattt

SEQ ID NO: 5227651 - DNA, 16 bp, Homo sapiens
agttaggatgctcagt

SEQ ID NO: 5227652 - DNA, 18 bp, Homo sapiens
agttaggctattcacaac

SEQ ID NO: 5227653 - DNA, 15 bp, Homo sapiens
agttagggagagaga

SEQ ID NO: 5227654 - DNA, 23 bp, Homo sapiens
agttagggagagagaagcaggca

SEQ ID NO: 5227655 - DNA, 18 bp, Homo sapiens
agttagggttttgcaata

SEQ ID NO: 5227656 - DNA, 15 bp, Homo sapiens
agttaggttataaga

SEQ ID NO: 5227657 - DNA, 19 bp, Homo sapiens
agttaggttataagaaaca

SEQ ID NO: 5227658 - DNA, 14 bp, Homo sapiens
agttagtagcatgt

SEQ ID NO: 5227659 - DNA, 17 bp, Homo sapiens
agttagtattaaaatct

SEQ ID NO: 5227660 - DNA, 13 bp, Homo sapiens
agttagtcgccct

SEQ ID NO: 5227661 - DNA, 17 bp, Homo sapiens
agttagtctactcttaa

SEQ ID NO: 5227662 - DNA, 22 bp, Homo sapiens
agttagtctactcttaagccat

SEQ ID NO: 5227663 - DNA, 23 bp, Homo sapiens
agttagtctactcttaagccatc

SEQ ID NO: 5227664 - DNA, 17 bp, Homo sapiens
agttagtggattactgc

SEQ ID NO: 5227665 - DNA, 21 bp, Homo sapiens
agttagtgtgttgtctgtgca

SEQ ID NO: 5227666 - DNA, 21 bp, Homo sapiens
agttagttcaatcctgattca

SEQ ID NO: 5227667 - DNA, 17 bp, Homo sapiens
agttagttccactgaga

SEQ ID NO: 5227668 - DNA, 23 bp, Homo sapiens
agttagttctctcgtaactggtt

SEQ ID NO: 5227669 - DNA, 15 bp, Homo sapiens
agttagtttctcata

SEQ ID NO: 5227670 - DNA, 22 bp, Homo sapiens
agttagtttgtatatattatta

SEQ ID NO: 5227671 - DNA, 23 bp, Homo sapiens
agttagttttggttatttctaaa

SEQ ID NO: 5227672 - DNA, 17 bp, Homo sapiens
agttagtttttaggtca

SEQ ID NO: 5227673 - DNA, 14 bp, Homo sapiens
agttataaaactat

SEQ ID NO: 5227674 - DNA, 13 bp, Homo sapiens
agttataaagaaa

SEQ ID NO: 5227675 - DNA, 17 bp, Homo sapiens
agttataaagaaagatt

SEQ ID NO: 5227676 - DNA, 12 bp, Homo sapiens
agttataaatca

SEQ ID NO: 5227677 - DNA, 13 bp, Homo sapiens
agttataacagat

SEQ ID NO: 5227678 - DNA, 17 bp, Homo sapiens
agttataacagatgtga

SEQ ID NO: 5227679 - DNA, 20 bp, Homo sapiens
agttataacagatgtgaaaa

SEQ ID NO: 5227680 - DNA, 13 bp, Homo sapiens
agttataagaaaa

SEQ ID NO: 5227681 - DNA, 16 bp, Homo sapiens
agttataataactgaa

SEQ ID NO: 5227682 - DNA, 15 bp, Homo sapiens
agttataatttcaat

SEQ ID NO: 5227683 - DNA, 19 bp, Homo sapiens
agttatacagttataaaat

SEQ ID NO: 5227684 - DNA, 15 bp, Homo sapiens
agttatacatcttca

SEQ ID NO: 5227685 - DNA, 19 bp, Homo sapiens
agttatacatcttcattaa

SEQ ID NO: 5227686 - DNA, 15 bp, Homo sapiens
agttataccagcaaa

SEQ ID NO: 5227687 - DNA, 16 bp, Homo sapiens
agttataccagcaaaa

SEQ ID NO: 5227688 - DNA, 20 bp, Homo sapiens
agttatacttatttgtatat

SEQ ID NO: 5227689 - DNA, 15 bp, Homo sapiens
agttatagtgaatac

SEQ ID NO: 5227690 - DNA, 20 bp, Homo sapiens
agttatagtgaatactgcta

SEQ ID NO: 5227691 - DNA, 15 bp, Homo sapiens
agttatagtttcaga

SEQ ID NO: 5227692 - DNA, 17 bp, Homo sapiens
agttatataaagagaaa

SEQ ID NO: 5227693 - DNA, 20 bp, Homo sapiens
agttatataaagagaaaatt

SEQ ID NO: 5227694 - DNA, 21 bp, Homo sapiens
agttatataaaggcaaggaaa

SEQ ID NO: 5227695 - DNA, 13 bp, Homo sapiens
agttatatagata

SEQ ID NO: 5227696 - DNA, 21 bp, Homo sapiens
agttatataggttttgtttgc

SEQ ID NO: 5227697 - DNA, 22 bp, Homo sapiens
agttatataggttttgtttgct

SEQ ID NO: 5227698 - DNA, 18 bp, Homo sapiens
agttatatattccttact

SEQ ID NO: 5227699 - DNA, 19 bp, Homo sapiens
agttatattctttaaattt

SEQ ID NO: 5227700 - DNA, 17 bp, Homo sapiens
agttatattgaatatat

SEQ ID NO: 5227701 - DNA, 19 bp, Homo sapiens
agttatattgaatatatca

SEQ ID NO: 5227702 - DNA, 19 bp, Homo sapiens
agttatatttcagatgtaa

SEQ ID NO: 5227703 - DNA, 22 bp, Homo sapiens
agttatatttcagatgtaatgt

SEQ ID NO: 5227704 - DNA, 16 bp, Homo sapiens
agttatattttgcagt

SEQ ID NO: 5227705 - DNA, 17 bp, Homo sapiens
agttatattttgctgtt

SEQ ID NO: 5227706 - DNA, 18 bp, Homo sapiens
agttatcaaaagaagaaa

SEQ ID NO: 5227707 - DNA, 18 bp, Homo sapiens
agttatcaactttagcta

SEQ ID NO: 5227708 - DNA, 15 bp, Homo sapiens
agttatcatgaattt

SEQ ID NO: 5227709 - DNA, 12 bp, Homo sapiens
agttatcatgtt

SEQ ID NO: 5227710 - DNA, 17 bp, Homo sapiens
agttatcatgttagtaa

SEQ ID NO: 5227711 - DNA, 18 bp, Homo sapiens
agttatcatgttagtaat

SEQ ID NO: 5227712 - DNA, 23 bp, Homo sapiens
agttatcctgcaagggacaggaa

SEQ ID NO: 5227713 - DNA, 17 bp, Homo sapiens
agttatctaaaagaaat

SEQ ID NO: 5227714 - DNA, 21 bp, Homo sapiens
agttatctaagaatacagctt

SEQ ID NO: 5227715 - DNA, 18 bp, Homo sapiens
agttatctgttcttttga

SEQ ID NO: 5227716 - DNA, 14 bp, Homo sapiens
agttatctgtttgt

SEQ ID NO: 5227717 - DNA, 13 bp, Homo sapiens
agttatcttaaat

SEQ ID NO: 5227718 - DNA, 14 bp, Homo sapiens
agttatcttaaata

SEQ ID NO: 5227719 - DNA, 16 bp, Homo sapiens
agttatcttaaatatg

SEQ ID NO: 5227720 - DNA, 17 bp, Homo sapiens
agttatcttaaatatga

SEQ ID NO: 5227721 - DNA, 14 bp, Homo sapiens
agttatcttagctg

SEQ ID NO: 5227722 - DNA, 21 bp, Homo sapiens
agttatcttctttattattcc

SEQ ID NO: 5227723 - DNA, 18 bp, Homo sapiens
agttatctttgaatatgt

SEQ ID NO: 5227724 - DNA, 17 bp, Homo sapiens
agttatgaaaagataac

SEQ ID NO: 5227725 - DNA, 21 bp, Homo sapiens
agttatgacagccatttgtaa

SEQ ID NO: 5227726 - DNA, 12 bp, Homo sapiens
agttatgatgta

SEQ ID NO: 5227727 - DNA, 14 bp, Homo sapiens
agttatgcatcccc

SEQ ID NO: 5227728 - DNA, 23 bp, Homo sapiens
agttatgccgtataggatgtcag

SEQ ID NO: 5227729 - DNA, 19 bp, Homo sapiens
agttatggctataggtgct

SEQ ID NO: 5227730 - DNA, 17 bp, Homo sapiens
agttatggtgatgactt

SEQ ID NO: 5227731 - DNA, 15 bp, Homo sapiens
agttatggtgccgaa

SEQ ID NO: 5227732 - DNA, 19 bp, Homo sapiens
agttatggtttcctcattt

SEQ ID NO: 5227733 - DNA, 23 bp, Homo sapiens
agttatggtttcctcattttact

SEQ ID NO: 5227734 - DNA, 13 bp, Homo sapiens
agttatgtaaata

SEQ ID NO: 5227735 - DNA, 14 bp, Homo sapiens
agttatgtaaataa

SEQ ID NO: 5227736 - DNA, 18 bp, Homo sapiens
agttatgtatttaaagtt

SEQ ID NO: 5227737 - DNA, 13 bp, Homo sapiens
agttatgtgaatg

SEQ ID NO: 5227738 - DNA, 23 bp, Homo sapiens
agttatgtgggtggcttctagtt

SEQ ID NO: 5227739 - DNA, 22 bp, Homo sapiens
agttatgtgtatgtgagtattc

SEQ ID NO: 5227740 - DNA, 20 bp, Homo sapiens
agttatgtgttaaatttagt

SEQ ID NO: 5227741 - DNA, 14 bp, Homo sapiens
agttatgttaaaat

SEQ ID NO: 5227742 - DNA, 16 bp, Homo sapiens
agttatgttttacatg

SEQ ID NO: 5227743 - DNA, 19 bp, Homo sapiens
agttatgttttacatgccc

SEQ ID NO: 5227744 - DNA, 15 bp, Homo sapiens
agttattaaaatcat

SEQ ID NO: 5227745 - DNA, 13 bp, Homo sapiens
agttattaaaatt

SEQ ID NO: 5227746 - DNA, 16 bp, Homo sapiens
agttattaaaattgtt

SEQ ID NO: 5227747 - DNA, 13 bp, Homo sapiens
agttattaaatgt

SEQ ID NO: 5227748 - DNA, 16 bp, Homo sapiens
agttattaaatgtttc

SEQ ID NO: 5227749 - DNA, 21 bp, Homo sapiens
agttattaaatgtttcaaaat

SEQ ID NO: 5227750 - DNA, 23 bp, Homo sapiens
agttattaactgtattttctttc

SEQ ID NO: 5227751 - DNA, 15 bp, Homo sapiens
agttattaattaaag

SEQ ID NO: 5227752 - DNA, 17 bp, Homo sapiens
agttattaattaaagaa

SEQ ID NO: 5227753 - DNA, 20 bp, Homo sapiens
agttattacatgtaatttga

SEQ ID NO: 5227754 - DNA, 18 bp, Homo sapiens
agttattacctctccagt

SEQ ID NO: 5227755 - DNA, 20 bp, Homo sapiens
agttattacctttacatatt

SEQ ID NO: 5227756 - DNA, 23 bp, Homo sapiens
agttattagaacttagttttgtt

SEQ ID NO: 5227757 - DNA, 17 bp, Homo sapiens
agttattagtgccaagt

SEQ ID NO: 5227758 - DNA, 21 bp, Homo sapiens
agttattatagttattcaaat

SEQ ID NO: 5227759 - DNA, 20 bp, Homo sapiens
agttattatatttacaaatg

SEQ ID NO: 5227760 - DNA, 19 bp, Homo sapiens
agttattatctatggaaat

SEQ ID NO: 5227761 - DNA, 16 bp, Homo sapiens
agttattcaaatgaag

SEQ ID NO: 5227762 - DNA, 17 bp, Homo sapiens
agttattcaaatgaagg

SEQ ID NO: 5227763 - DNA, 17 bp, Homo sapiens
agttattcaaatttgta

SEQ ID NO: 5227764 - DNA, 15 bp, Homo sapiens
agttattcataaaga

SEQ ID NO: 5227765 - DNA, 21 bp, Homo sapiens
agttattcccttacctgaagg

SEQ ID NO: 5227766 - DNA, 13 bp, Homo sapiens
agttattctatca

SEQ ID NO: 5227767 - DNA, 20 bp, Homo sapiens
agttattcttgtcattttga

SEQ ID NO: 5227768 - DNA, 17 bp, Homo sapiens
agttattgaagcagagt

SEQ ID NO: 5227769 - DNA, 19 bp, Homo sapiens
agttattgaagcagagtgg

SEQ ID NO: 5227770 - DNA, 17 bp, Homo sapiens
agttattgacaaactct

SEQ ID NO: 5227771 - DNA, 18 bp, Homo sapiens
agttattgacaaactctc

SEQ ID NO: 5227772 - DNA, 19 bp, Homo sapiens
agttattgagattgtcctc

SEQ ID NO: 5227773 - DNA, 17 bp, Homo sapiens
agttattgataagttca

SEQ ID NO: 5227774 - DNA, 19 bp, Homo sapiens
agttattgcagtttatcat

SEQ ID NO: 5227775 - DNA, 19 bp, Homo sapiens
agttattggtggaatcttt

SEQ ID NO: 5227776 - DNA, 18 bp, Homo sapiens
agttattgtacagctgtt

SEQ ID NO: 5227777 - DNA, 22 bp, Homo sapiens
agttattgttaattatgtacaa

SEQ ID NO: 5227778 - DNA, 19 bp, Homo sapiens
agttattgttttatgttct

SEQ ID NO: 5227779 - DNA, 11 bp, Homo sapiens
agttatttacc

SEQ ID NO: 5227780 - DNA, 20 bp, Homo sapiens
agttatttaccagaagttta

SEQ ID NO: 5227781 - DNA, 14 bp, Homo sapiens
agttatttactttt

SEQ ID NO: 5227782 - DNA, 16 bp, Homo sapiens
agttatttagaaatat

SEQ ID NO: 5227783 - DNA, 20 bp, Homo sapiens
agttatttagaaatatcctt

SEQ ID NO: 5227784 - DNA, 21 bp, Homo sapiens
agttatttcatcttttattca

SEQ ID NO: 5227785 - DNA, 18 bp, Homo sapiens
agttatttgtataaatta

SEQ ID NO: 5227786 - DNA, 15 bp, Homo sapiens
agttattttaggaga

SEQ ID NO: 5227787 - DNA, 11 bp, Homo sapiens
agttattttat

SEQ ID NO: 5227788 - DNA, 14 bp, Homo sapiens
agttattttatagg

SEQ ID NO: 5227789 - DNA, 15 bp, Homo sapiens
agttattttataggg

SEQ ID NO: 5227790 - DNA, 13 bp, Homo sapiens
agttattttatga

SEQ ID NO: 5227791 - DNA, 21 bp, Homo sapiens
agttattttatgacatgaaaa

SEQ ID NO: 5227792 - DNA, 12 bp, Homo sapiens
agttattttcag

SEQ ID NO: 5227793 - DNA, 14 bp, Homo sapiens
agttattttccagg

SEQ ID NO: 5227794 - DNA, 18 bp, Homo sapiens
agttattttcttgtttaa

SEQ ID NO: 5227795 - DNA, 14 bp, Homo sapiens
agtcagtgtttctt

SEQ ID NO: 5227796 - DNA, 14 bp, Homo sapiens
agtcagttaacgtc

SEQ ID NO: 5227797 - DNA, 18 bp, Homo sapiens
agtcataaaatagtatgt

SEQ ID NO: 5227798 - DNA, 15 bp, Homo sapiens
agtcataaacagcat

SEQ ID NO: 5227799 - DNA, 15 bp, Homo sapiens
agtcataaatactgt

SEQ ID NO: 5227800 - DNA, 15 bp, Homo sapiens
agtcataagctccag

SEQ ID NO: 5227801 - DNA, 12 bp, Homo sapiens
agtcataataaa

SEQ ID NO: 5227802 - DNA, 17 bp, Homo sapiens
agtcataccaactttag

SEQ ID NO: 5227803 - DNA, 15 bp, Homo sapiens
agtcatacctgctcc

SEQ ID NO: 5227804 - DNA, 22 bp, Homo sapiens
agtcatacgtctttagatgcta

SEQ ID NO: 5227805 - DNA, 14 bp, Homo sapiens
agtcatagaaatag

SEQ ID NO: 5227806 - DNA, 23 bp, Homo sapiens
agtcatatcttaatatatttcta

SEQ ID NO: 5227807 - DNA, 13 bp, Homo sapiens
agtcatatttttg

SEQ ID NO: 5227808 - DNA, 14 bp, Homo sapiens
agtcatcaaaaaga

SEQ ID NO: 5227809 - DNA, 15 bp, Homo sapiens
agtcatcaaaaagag

SEQ ID NO: 5227810 - DNA, 15 bp, Homo sapiens
agtcatcaaagcaga

SEQ ID NO: 5227811 - DNA, 14 bp, Homo sapiens
agtcatcaacaaaa

SEQ ID NO: 5227812 - DNA, 18 bp, Homo sapiens
agtcatcaacaaaaggga

SEQ ID NO: 5227813 - DNA, 16 bp, Homo sapiens
agtcatcaatgcaata

SEQ ID NO: 5227814 - DNA, 13 bp, Homo sapiens
agtcatcaggtgt

SEQ ID NO: 5227815 - DNA, 16 bp, Homo sapiens
agtcatcatcagggcc

SEQ ID NO: 5227816 - DNA, 17 bp, Homo sapiens
agtcatcatcagggcct

SEQ ID NO: 5227817 - DNA, 21 bp, Homo sapiens
agtcatcatcagggcctgggg

SEQ ID NO: 5227818 - DNA, 13 bp, Homo sapiens
agtcatcatctct

SEQ ID NO: 5227819 - DNA, 19 bp, Homo sapiens
agtcatcatctcttgataa

SEQ ID NO: 5227820 - DNA, 23 bp, Homo sapiens
agtcatcattacttgggaaattt

SEQ ID NO: 5227821 - DNA, 23 bp, Homo sapiens
agtcatccaacaagaagaaatat

SEQ ID NO: 5227822 - DNA, 15 bp, Homo sapiens
agtcatccagtgaaa

SEQ ID NO: 5227823 - DNA, 15 bp, Homo sapiens
agtcatcccctctca

SEQ ID NO: 5227824 - DNA, 18 bp, Homo sapiens
agtcatcccctctcagga

SEQ ID NO: 5227825 - DNA, 22 bp, Homo sapiens
agtcatcccctctcaggagagt

SEQ ID NO: 5227826 - DNA, 13 bp, Homo sapiens
agtcatcctgccc

SEQ ID NO: 5227827 - DNA, 19 bp, Homo sapiens
agtcatctacttaataaat

SEQ ID NO: 5227828 - DNA, 16 bp, Homo sapiens
agtcatctactttttt

SEQ ID NO: 5227829 - DNA, 22 bp, Homo sapiens
agtcatctatagttgatatgtt

SEQ ID NO: 5227830 - DNA, 13 bp, Homo sapiens
agtcatctcaaac

SEQ ID NO: 5227831 - DNA, 16 bp, Homo sapiens
agtcatctcaaacact

SEQ ID NO: 5227832 - DNA, 19 bp, Homo sapiens
agtcatctccaaaaacagt

SEQ ID NO: 5227833 - DNA, 20 bp, Homo sapiens
agtcatctccaaaaacagta

SEQ ID NO: 5227834 - DNA, 17 bp, Homo sapiens
agtcatctccatcagct

SEQ ID NO: 5227835 - DNA, 21 bp, Homo sapiens
agtcatctgtaagagcttgct

SEQ ID NO: 5227836 - DNA, 11 bp, Homo sapiens
agtcatcttgc

SEQ ID NO: 5227837 - DNA, 14 bp, Homo sapiens
agtcatcttgcaca

SEQ ID NO: 5227838 - DNA, 14 bp, Homo sapiens
agtcatgaacacat

SEQ ID NO: 5227839 - DNA, 19 bp, Homo sapiens
agtcatgaacacatcagct

SEQ ID NO: 5227840 - DNA, 13 bp, Homo sapiens
agtcatgaagccc

SEQ ID NO: 5227841 - DNA, 21 bp, Homo sapiens
agtcatgaagcccaagtgaaa

SEQ ID NO: 5227842 - DNA, 16 bp, Homo sapiens
agtcatgacagatgaa

SEQ ID NO: 5227843 - DNA, 13 bp, Homo sapiens
agtcatgacattt

SEQ ID NO: 5227844 - DNA, 14 bp, Homo sapiens
agtcatgagctgag

SEQ ID NO: 5227845 - DNA, 22 bp, Homo sapiens
agtcatgaggaaagacacagat

SEQ ID NO: 5227846 - DNA, 21 bp, Homo sapiens
agtcatgatctccctgccgcc

SEQ ID NO: 5227847 - DNA, 20 bp, Homo sapiens
agtcatgatgtttttaaaat

SEQ ID NO: 5227848 - DNA, 21 bp, Homo sapiens
agtcatgatgtttttaaaatc

SEQ ID NO: 5227849 - DNA, 22 bp, Homo sapiens
agtcatgcaaaccgttaggaaa

SEQ ID NO: 5227850 - DNA, 16 bp, Homo sapiens
agtcatgcataaatat

SEQ ID NO: 5227851 - DNA, 17 bp, Homo sapiens
agtcatgcataaatatg

SEQ ID NO: 5227852 - DNA, 20 bp, Homo sapiens
agtcatgcataaatatgcag

SEQ ID NO: 5227853 - DNA, 18 bp, Homo sapiens
agtcatgctcccctgtgc

SEQ ID NO: 5227854 - DNA, 21 bp, Homo sapiens
agtcatgctgaatactcctcc

SEQ ID NO: 5227855 - DNA, 19 bp, Homo sapiens
agtcatggaatcttgctgc

SEQ ID NO: 5227856 - DNA, 19 bp, Homo sapiens
agtcatggataactacatt

SEQ ID NO: 5227857 - DNA, 15 bp, Homo sapiens
agtcatggctgtccc

SEQ ID NO: 5227858 - DNA, 23 bp, Homo sapiens
agtcatggctgtcccctgcaagt

SEQ ID NO: 5227859 - DNA, 17 bp, Homo sapiens
agtcatgggaacgcagc

SEQ ID NO: 5227860 - DNA, 20 bp, Homo sapiens
agtcatggggtccctgctgc

SEQ ID NO: 5227861 - DNA, 21 bp, Homo sapiens
agtcatggggtccctgctgca

SEQ ID NO: 5227862 - DNA, 15 bp, Homo sapiens
agtcatgggtcacac

SEQ ID NO: 5227863 - DNA, 10 bp, Homo sapiens
agtcatggta

SEQ ID NO: 5227864 - DNA, 18 bp, Homo sapiens
agtcatggtactacccca

SEQ ID NO: 5227865 - DNA, 17 bp, Homo sapiens
agtcatggtcaggggtg

SEQ ID NO: 5227866 - DNA, 16 bp, Homo sapiens
agtcatggtcctggct

SEQ ID NO: 5227867 - DNA, 18 bp, Homo sapiens
agtcatggtcctggctgg

SEQ ID NO: 5227868 - DNA, 15 bp, Homo sapiens
agtcatggtgttgcg

SEQ ID NO: 5227869 - DNA, 17 bp, Homo sapiens
agtcatggtgttgcgta

SEQ ID NO: 5227870 - DNA, 14 bp, Homo sapiens
agtcatgtatgcaa

SEQ ID NO: 5227871 - DNA, 16 bp, Homo sapiens
agtcatgtatgcaagt

SEQ ID NO: 5227872 - DNA, 17 bp, Homo sapiens
agtcatgtatgtttctc

SEQ ID NO: 5227873 - DNA, 12 bp, Homo sapiens
agtcatgtgacc

SEQ ID NO: 5227874 - DNA, 15 bp, Homo sapiens
agtcatgtgagcctc

SEQ ID NO: 5227875 - DNA, 13 bp, Homo sapiens
agtcatgtgcatt

SEQ ID NO: 5227876 - DNA, 13 bp, Homo sapiens
agtcatgtgcctc

SEQ ID NO: 5227877 - DNA, 19 bp, Homo sapiens
agtcatgtttatctgctta

SEQ ID NO: 5227878 - DNA, 17 bp, Homo sapiens
agtcatgtttctgcagt

SEQ ID NO: 5227879 - DNA, 16 bp, Homo sapiens
agtcattaaaaacata

SEQ ID NO: 5227880 - DNA, 14 bp, Homo sapiens
agtcattaaagaca

SEQ ID NO: 5227881 - DNA, 17 bp, Homo sapiens
agtcattaaattactat

SEQ ID NO: 5227882 - DNA, 14 bp, Homo sapiens
agtcattagactcc

SEQ ID NO: 5227883 - DNA, 15 bp, Homo sapiens
agtcattagactcct

SEQ ID NO: 5227884 - DNA, 23 bp, Homo sapiens
agtcattattattactttttaaa

SEQ ID NO: 5227885 - DNA, 20 bp, Homo sapiens
agtcattcagatatgattca

SEQ ID NO: 5227886 - DNA, 23 bp, Homo sapiens
agtcattcagatatgattcaaat

SEQ ID NO: 5227887 - DNA, 13 bp, Homo sapiens
agtcattcagcag

SEQ ID NO: 5227888 - DNA, 22 bp, Homo sapiens
agtcattcagcagcaaattttc

SEQ ID NO: 5227889 - DNA, 22 bp, Homo sapiens
agtcattcaggtgacctcctgc

SEQ ID NO: 5227890 - DNA, 13 bp, Homo sapiens
agtcattcatatt

SEQ ID NO: 5227891 - DNA, 18 bp, Homo sapiens
agtcattcatatttgtct

SEQ ID NO: 5227892 - DNA, 23 bp, Homo sapiens
agtcattccaagaactataaact

SEQ ID NO: 5227893 - DNA, 20 bp, Homo sapiens
agtcattccttctttttaaa

SEQ ID NO: 5227894 - DNA, 16 bp, Homo sapiens
agtcattctaggatgt

SEQ ID NO: 5227895 - DNA, 20 bp, Homo sapiens
agtcattctcattgaattat

SEQ ID NO: 5227896 - DNA, 17 bp, Homo sapiens
agtcattctgcctgccc

SEQ ID NO: 5227897 - DNA, 18 bp, Homo sapiens
agtcattctgcctgccct

SEQ ID NO: 5227898 - DNA, 20 bp, Homo sapiens
agtcattctgcctgccctga

SEQ ID NO: 5227899 - DNA, 13 bp, Homo sapiens
agtcattctttaa

SEQ ID NO: 5227900 - DNA, 15 bp, Homo sapiens
agtcattgatagaac

SEQ ID NO: 5227901 - DNA, 13 bp, Homo sapiens
agtcattgctgta

SEQ ID NO: 5227902 - DNA, 14 bp, Homo sapiens
agtcattggcttta

SEQ ID NO: 5227903 - DNA, 21 bp, Homo sapiens
agtcattggctttatcctctt

SEQ ID NO: 5227904 - DNA, 16 bp, Homo sapiens
agtcattgtaatcttt

SEQ ID NO: 5227905 - DNA, 18 bp, Homo sapiens
agtcattgtatgttatta

SEQ ID NO: 5227906 - DNA, 13 bp, Homo sapiens
agtcatttaataa

SEQ ID NO: 5227907 - DNA, 13 bp, Homo sapiens
agtcatttactaa

SEQ ID NO: 5227908 - DNA, 18 bp, Homo sapiens
agtcatttactaaacata

SEQ ID NO: 5227909 - DNA, 19 bp, Homo sapiens
agtcatttactaaacatat

SEQ ID NO: 5227910 - DNA, 18 bp, Homo sapiens
agtcatttgagtctctta

SEQ ID NO: 5227911 - DNA, 15 bp, Homo sapiens
agtcatttgtgaatt

SEQ ID NO: 5227912 - DNA, 15 bp, Homo sapiens
agtcatttgtggtta

SEQ ID NO: 5227913 - DNA, 21 bp, Homo sapiens
agtcatttgttaatatttctt

SEQ ID NO: 5227914 - DNA, 22 bp, Homo sapiens
agtcatttgttaatatttcttc

SEQ ID NO: 5227915 - DNA, 16 bp, Homo sapiens
agtcattttattttgt

SEQ ID NO: 5227916 - DNA, 19 bp, Homo sapiens
agtcattttcacttttaaa

SEQ ID NO: 5227917 - DNA, 12 bp, Homo sapiens
agtcattttggg

SEQ ID NO: 5227918 - DNA, 16 bp, Homo sapiens
agtcattttgtgttga

SEQ ID NO: 5227919 - DNA, 21 bp, Homo sapiens
agtcattttgtgttgaagagc

SEQ ID NO: 5227920 - DNA, 21 bp, Homo sapiens
agtcatttttacaatgtaatt

SEQ ID NO: 5227921 - DNA, 14 bp, Homo sapiens
agtcatttttagca

SEQ ID NO: 5227922 - DNA, 16 bp, Homo sapiens
agtccaaaccttctac

SEQ ID NO: 5227923 - DNA, 23 bp, Homo sapiens
agtccaaaccttctaccctgggt

SEQ ID NO: 5227924 - DNA, 19 bp, Homo sapiens
agtccaaatgtttacaggg

SEQ ID NO: 5227925 - DNA, 18 bp, Homo sapiens
agtccaaattgtctgtct

SEQ ID NO: 5227926 - DNA, 16 bp, Homo sapiens
agtccaaccagaaaca

SEQ ID NO: 5227927 - DNA, 12 bp, Homo sapiens
agtccaacctgc

SEQ ID NO: 5227928 - DNA, 19 bp, Homo sapiens
agtccaacgtggggcagca

SEQ ID NO: 5227929 - DNA, 17 bp, Homo sapiens
agtccaactacagccaa

SEQ ID NO: 5227930 - DNA, 15 bp, Homo sapiens
agtccaactactaaa

SEQ ID NO: 5227931 - DNA, 20 bp, Homo sapiens
agtccaactcacttccagtg

SEQ ID NO: 5227932 - DNA, 16 bp, Homo sapiens
agtccaagaccagact

SEQ ID NO: 5227933 - DNA, 19 bp, Homo sapiens
agtccaagagggtccttta

SEQ ID NO: 5227934 - DNA, 18 bp, Homo sapiens
agtccaagcaacagcctt

SEQ ID NO: 5227935 - DNA, 20 bp, Homo sapiens
agtccaagccgtaggaccca

SEQ ID NO: 5227936 - DNA, 13 bp, Homo sapiens
agtccaaggttta

SEQ ID NO: 5227937 - DNA, 19 bp, Homo sapiens
agtccaatcacccccagga

SEQ ID NO: 5227938 - DNA, 23 bp, Homo sapiens
agtccaatcacccccaggacctc

SEQ ID NO: 5227939 - DNA, 16 bp, Homo sapiens
agtccaatgaagataa

SEQ ID NO: 5227940 - DNA, 21 bp, Homo sapiens
agtccaatgaagataaatgct

SEQ ID NO: 5227941 - DNA, 14 bp, Homo sapiens
agtccaatgtggca

SEQ ID NO: 5227942 - DNA, 15 bp, Homo sapiens
agtccaattttaatt

SEQ ID NO: 5227943 - DNA, 14 bp, Homo sapiens
agtccacaaaataa

SEQ ID NO: 5227944 - DNA, 18 bp, Homo sapiens
agtccacaggacgcacag

SEQ ID NO: 5227945 - DNA, 24 bp, Homo sapiens
agtccacaggacgcacagcccagg

SEQ ID NO: 5227946 - DNA, 20 bp, Homo sapiens
agtccacaggggccaccacc

SEQ ID NO: 5227947 - DNA, 20 bp, Homo sapiens
agtccaccccaattaactga

SEQ ID NO: 5227948 - DNA, 17 bp, Homo sapiens
agtccaccctttggaga

SEQ ID NO: 5227949 - DNA, 22 bp, Homo sapiens
agtccacgcccaccagccttgc

SEQ ID NO: 5227950 - DNA, 19 bp, Homo sapiens
agtccacggacccccagag

SEQ ID NO: 5227951 - DNA, 23 bp, Homo sapiens
agtccactcctgacccctctcct

SEQ ID NO: 5227952 - DNA, 15 bp, Homo sapiens
agtccactgcctcca

SEQ ID NO: 5227953 - DNA, 22 bp, Homo sapiens
agtccactgcctccatgatgca

SEQ ID NO: 5227954 - DNA, 23 bp, Homo sapiens
agtccactgcctccatgatgcaa

SEQ ID NO: 5227955 - DNA, 21 bp, Homo sapiens
agtccactgttgagccccagt

SEQ ID NO: 5227956 - DNA, 19 bp, Homo sapiens
agtccacttatgtagacaa

SEQ ID NO: 5227957 - DNA, 13 bp, Homo sapiens
agtccactttcct

SEQ ID NO: 5227958 - DNA, 16 bp, Homo sapiens
agtccactttcctctc

SEQ ID NO: 5227959 - DNA, 18 bp, Homo sapiens
agtccactttcctctctc

SEQ ID NO: 5227960 - DNA, 19 bp, Homo sapiens
agtccagaataagtgctgt

SEQ ID NO: 5227961 - DNA, 16 bp, Homo sapiens
agtccagacaccatca

SEQ ID NO: 5227962 - DNA, 18 bp, Homo sapiens
agtccagacaccatcacc

SEQ ID NO: 5227963 - DNA, 18 bp, Homo sapiens
agtccagacccaagtcaa

SEQ ID NO: 5227964 - DNA, 17 bp, Homo sapiens
agtccagaccccccagc

SEQ ID NO: 5227965 - DNA, 15 bp, Homo sapiens
agtccagacctgggc

SEQ ID NO: 5227966 - DNA, 21 bp, Homo sapiens
agtccagacctgggccctggt

SEQ ID NO: 5227967 - DNA, 22 bp, Homo sapiens
agtccagatgccttcctgtctt

SEQ ID NO: 5227968 - DNA, 12 bp, Homo sapiens
agtccagattgt

SEQ ID NO: 5227969 - DNA, 18 bp, Homo sapiens
agtccagatttacactgg

SEQ ID NO: 5227970 - DNA, 15 bp, Homo sapiens
agtccagccagctcc

SEQ ID NO: 5227971 - DNA, 17 bp, Homo sapiens
agtccagccagctcctg

SEQ ID NO: 5227972 - DNA, 16 bp, Homo sapiens
agtccagcccctcctc

SEQ ID NO: 5227973 - DNA, 17 bp, Homo sapiens
agtccagcccctcctcc

SEQ ID NO: 5227974 - DNA, 15 bp, Homo sapiens
agttattttggatat

SEQ ID NO: 5227975 - DNA, 15 bp, Homo sapiens
agttatttttattat

SEQ ID NO: 5227976 - DNA, 16 bp, Homo sapiens
agttatttttctcttt

SEQ ID NO: 5227977 - DNA, 22 bp, Homo sapiens
agttatttttctttttaagaga

SEQ ID NO: 5227978 - DNA, 18 bp, Homo sapiens
agttatttttgtacatgt

SEQ ID NO: 5227979 - DNA, 13 bp, Homo sapiens
agttcaaaattct

SEQ ID NO: 5227980 - DNA, 13 bp, Homo sapiens
agttcaaacaaga

SEQ ID NO: 5227981 - DNA, 13 bp, Homo sapiens
agttcaaagaagt

SEQ ID NO: 5227982 - DNA, 23 bp, Homo sapiens
agttcaaagaagtcatggcccaa

SEQ ID NO: 5227983 - DNA, 18 bp, Homo sapiens
agttcaaagagtctgtct

SEQ ID NO: 5227984 - DNA, 14 bp, Homo sapiens
agttcaaagtgtat

SEQ ID NO: 5227985 - DNA, 15 bp, Homo sapiens
agttcaaagtgtata

SEQ ID NO: 5227986 - DNA, 18 bp, Homo sapiens
agttcaaagtgtatattt

SEQ ID NO: 5227987 - DNA, 17 bp, Homo sapiens
agttcaaatcctcacca

SEQ ID NO: 5227988 - DNA, 14 bp, Homo sapiens
agttcaaattttgc

SEQ ID NO: 5227989 - DNA, 13 bp, Homo sapiens
agttcaacatgtt

SEQ ID NO: 5227990 - DNA, 13 bp, Homo sapiens
agttcaagaaatg

SEQ ID NO: 5227991 - DNA, 14 bp, Homo sapiens
agttcaagaagata

SEQ ID NO: 5227992 - DNA, 19 bp, Homo sapiens
agttcaagaccagcctggc

SEQ ID NO: 5227993 - DNA, 20 bp, Homo sapiens
agttcaagaccagcctggcc

SEQ ID NO: 5227994 - DNA, 18 bp, Homo sapiens
agttcaagaccagcctgt

SEQ ID NO: 5227995 - DNA, 23 bp, Homo sapiens
agttcaagactgaaatggcttct

SEQ ID NO: 5227996 - DNA, 20 bp, Homo sapiens
agttcaagatcaaaaaggct

SEQ ID NO: 5227997 - DNA, 21 bp, Homo sapiens
agttcaagcgattcttgtgcc

SEQ ID NO: 5227998 - DNA, 22 bp, Homo sapiens
agttcaagctaaatattgttta

SEQ ID NO: 5227999 - DNA, 18 bp, Homo sapiens
agttcaagtgatctttca

SEQ ID NO: 5228000 - DNA, 13 bp, Homo sapiens
agttcaataacaa

SEQ ID NO: 5228001 - DNA, 13 bp, Homo sapiens
agttcaatacagt

SEQ ID NO: 5228002 - DNA, 16 bp, Homo sapiens
agttcaatcaaacttt

SEQ ID NO: 5228003 - DNA, 13 bp, Homo sapiens
agttcaatcctac

SEQ ID NO: 5228004 - DNA, 12 bp, Homo sapiens
agttcaatgatc

SEQ ID NO: 5228005 - DNA, 16 bp, Homo sapiens
agttcaatgatctagg

SEQ ID NO: 5228006 - DNA, 21 bp, Homo sapiens
agttcaatgatctaggtttaa

SEQ ID NO: 5228007 - DNA, 22 bp, Homo sapiens
agttcaatgatctaggtttaac

SEQ ID NO: 5228008 - DNA, 14 bp, Homo sapiens
agttcaatggctgc

SEQ ID NO: 5228009 - DNA, 17 bp, Homo sapiens
agttcaatggctgctga

SEQ ID NO: 5228010 - DNA, 16 bp, Homo sapiens
agttcaattctcattt

SEQ ID NO: 5228011 - DNA, 19 bp, Homo sapiens
agttcacaaaaaaatgttc

SEQ ID NO: 5228012 - DNA, 23 bp, Homo sapiens
agttcacaccctgcaaggcccac

SEQ ID NO: 5228013 - DNA, 15 bp, Homo sapiens
agttcacagcttcac

SEQ ID NO: 5228014 - DNA, 18 bp, Homo sapiens
agttcacaggaggccagt

SEQ ID NO: 5228015 - DNA, 23 bp, Homo sapiens
agttcacagggtattaatatgct

SEQ ID NO: 5228016 - DNA, 17 bp, Homo sapiens
agttcacagtgtttctt

SEQ ID NO: 5228017 - DNA, 16 bp, Homo sapiens
agttcacatgtgccct

SEQ ID NO: 5228018 - DNA, 21 bp, Homo sapiens
agttcacatgtgccctgcctt

SEQ ID NO: 5228019 - DNA, 14 bp, Homo sapiens
agttcaccagccct

SEQ ID NO: 5228020 - DNA, 16 bp, Homo sapiens
agttcaccagccctga

SEQ ID NO: 5228021 - DNA, 22 bp, Homo sapiens
agttcacctatttcaaaaattt

SEQ ID NO: 5228022 - DNA, 16 bp, Homo sapiens
agttcaccttggaagg

SEQ ID NO: 5228023 - DNA, 16 bp, Homo sapiens
agttcactataaatgg

SEQ ID NO: 5228024 - DNA, 21 bp, Homo sapiens
agttcactataaatggtgttt

SEQ ID NO: 5228025 - DNA, 11 bp, Homo sapiens
agttcactttt

SEQ ID NO: 5228026 - DNA, 21 bp, Homo sapiens
agttcagaaatttaaaagcag

SEQ ID NO: 5228027 - DNA, 20 bp, Homo sapiens
agttcagaatggcagtcctg

SEQ ID NO: 5228028 - DNA, 23 bp, Homo sapiens
agttcagacttagtttttataaa

SEQ ID NO: 5228029 - DNA, 17 bp, Homo sapiens
agttcagagttttctgg

SEQ ID NO: 5228030 - DNA, 18 bp, Homo sapiens
agttcagatagagatatt

SEQ ID NO: 5228031 - DNA, 22 bp, Homo sapiens
agttcagatcttaatataaatt

SEQ ID NO: 5228032 - DNA, 21 bp, Homo sapiens
agttcagcacttgtctcattt

SEQ ID NO: 5228033 - DNA, 12 bp, Homo sapiens
agttcagccatt

SEQ ID NO: 5228034 - DNA, 21 bp, Homo sapiens
agttcagcgctgtcaggattg

SEQ ID NO: 5228035 - DNA, 16 bp, Homo sapiens
agttcagctgcttctc

SEQ ID NO: 5228036 - DNA, 16 bp, Homo sapiens
agttcaggaacccttc

SEQ ID NO: 5228037 - DNA, 20 bp, Homo sapiens
agttcaggaacccttctcca

SEQ ID NO: 5228038 - DNA, 20 bp, Homo sapiens
agttcaggagtcccaaggaa

SEQ ID NO: 5228039 - DNA, 20 bp, Homo sapiens
agttcaggatttggtttttc

SEQ ID NO: 5228040 - DNA, 16 bp, Homo sapiens
agttcagggaccgtcc

SEQ ID NO: 5228041 - DNA, 18 bp, Homo sapiens
agttcagggaggggctga

SEQ ID NO: 5228042 - DNA, 19 bp, Homo sapiens
agttcagtacctggaggag

SEQ ID NO: 5228043 - DNA, 17 bp, Homo sapiens
agttcagtagaattacc

SEQ ID NO: 5228044 - DNA, 19 bp, Homo sapiens
agttcagtagatttccttt

SEQ ID NO: 5228045 - DNA, 17 bp, Homo sapiens
agttcagtctgtaggga

SEQ ID NO: 5228046 - DNA, 23 bp, Homo sapiens
agttcagtggcagggctcaggat

SEQ ID NO: 5228047 - DNA, 16 bp, Homo sapiens
agttcagttcctcttt

SEQ ID NO: 5228048 - DNA, 23 bp, Homo sapiens
agttcagttcctctttgcatgga

SEQ ID NO: 5228049 - DNA, 15 bp, Homo sapiens
agttcataaatttgt

SEQ ID NO: 5228050 - DNA, 21 bp, Homo sapiens
agttcataaatttgttgtcat

SEQ ID NO: 5228051 - DNA, 15 bp, Homo sapiens
agttcataattcacc

SEQ ID NO: 5228052 - DNA, 11 bp, Homo sapiens
agttcatacat

SEQ ID NO: 5228053 - DNA, 15 bp, Homo sapiens
agttcatacattgta

SEQ ID NO: 5228054 - DNA, 20 bp, Homo sapiens
agttcatacctaagtactgt

SEQ ID NO: 5228055 - DNA, 14 bp, Homo sapiens
agttcatactgaat

SEQ ID NO: 5228056 - DNA, 15 bp, Homo sapiens
agttcatactgaatg

SEQ ID NO: 5228057 - DNA, 17 bp, Homo sapiens
agttcatagaaatacat

SEQ ID NO: 5228058 - DNA, 18 bp, Homo sapiens
agttcatataatttaaag

SEQ ID NO: 5228059 - DNA, 19 bp, Homo sapiens
agttcatataatttaaaga

SEQ ID NO: 5228060 - DNA, 20 bp, Homo sapiens
agttcatataatttaaagaa

SEQ ID NO: 5228061 - DNA, 16 bp, Homo sapiens
agttcatatgcagaac

SEQ ID NO: 5228062 - DNA, 17 bp, Homo sapiens
agttcatccattctatt

SEQ ID NO: 5228063 - DNA, 12 bp, Homo sapiens
agttcatcccaa

SEQ ID NO: 5228064 - DNA, 19 bp, Homo sapiens
agttcatcccagccccaat

SEQ ID NO: 5228065 - DNA, 15 bp, Homo sapiens
agttcatcccttctc

SEQ ID NO: 5228066 - DNA, 22 bp, Homo sapiens
agttcatcccttctcttccagg

SEQ ID NO: 5228067 - DNA, 18 bp, Homo sapiens
agttcatcgattttctat

SEQ ID NO: 5228068 - DNA, 15 bp, Homo sapiens
agttcatctctgctg

SEQ ID NO: 5228069 - DNA, 16 bp, Homo sapiens
agttcatctctgctga

SEQ ID NO: 5228070 - DNA, 15 bp, Homo sapiens
agttcatcttgaatt

SEQ ID NO: 5228071 - DNA, 22 bp, Homo sapiens
agttcatgcagctgtggcagag

SEQ ID NO: 5228072 - DNA, 13 bp, Homo sapiens
agttcatgtaaat

SEQ ID NO: 5228073 - DNA, 16 bp, Homo sapiens
agttcatgtaaataat

SEQ ID NO: 5228074 - DNA, 16 bp, Homo sapiens
agttcatgtctgctat

SEQ ID NO: 5228075 - DNA, 17 bp, Homo sapiens
agttcatgtttgcttca

SEQ ID NO: 5228076 - DNA, 23 bp, Homo sapiens
agttcattagaaatattttaaaa

SEQ ID NO: 5228077 - DNA, 16 bp, Homo sapiens
agttcattcagggccg

SEQ ID NO: 5228078 - DNA, 12 bp, Homo sapiens
agttcattcctg

SEQ ID NO: 5228079 - DNA, 20 bp, Homo sapiens
agttcattcgctttgtctgt

SEQ ID NO: 5228080 - DNA, 23 bp, Homo sapiens
agttcattctaccaagctgtcac

SEQ ID NO: 5228081 - DNA, 15 bp, Homo sapiens
agttcattgcaatta

SEQ ID NO: 5228082 - DNA, 14 bp, Homo sapiens
agttcatttcctga

SEQ ID NO: 5228083 - DNA, 17 bp, Homo sapiens
agttccaaatgtttata

SEQ ID NO: 5228084 - DNA, 20 bp, Homo sapiens
agttccacaattttgtctct

SEQ ID NO: 5228085 - DNA, 23 bp, Homo sapiens
agttccacaattttgtctctagt

SEQ ID NO: 5228086 - DNA, 19 bp, Homo sapiens
agttccacttaacacatga

SEQ ID NO: 5228087 - DNA, 19 bp, Homo sapiens
agttccacttagagaacaa

SEQ ID NO: 5228088 - DNA, 15 bp, Homo sapiens
agttccagaaagtaa

SEQ ID NO: 5228089 - DNA, 16 bp, Homo sapiens
agttccagaaagtaaa

SEQ ID NO: 5228090 - DNA, 21 bp, Homo sapiens
agttccagaaggatccaagac

SEQ ID NO: 5228091 - DNA, 14 bp, Homo sapiens
agttccagcagttt

SEQ ID NO: 5228092 - DNA, 16 bp, Homo sapiens
agttccagcagtttca

SEQ ID NO: 5228093 - DNA, 16 bp, Homo sapiens
agttccagtttctcct

SEQ ID NO: 5228094 - DNA, 18 bp, Homo sapiens
agttccagtttctccttg

SEQ ID NO: 5228095 - DNA, 14 bp, Homo sapiens
agttccataccaag

SEQ ID NO: 5228096 - DNA, 23 bp, Homo sapiens
agttccatatagacaccaaggag

SEQ ID NO: 5228097 - DNA, 13 bp, Homo sapiens
agttccatgaaga

SEQ ID NO: 5228098 - DNA, 17 bp, Homo sapiens
agttccattatgaaaat

SEQ ID NO: 5228099 - DNA, 20 bp, Homo sapiens
agttccattatgaaaatctt

SEQ ID NO: 5228100 - DNA, 15 bp, Homo sapiens
agttccattctatga

SEQ ID NO: 5228101 - DNA, 17 bp, Homo sapiens
agttcccaaaagattgc

SEQ ID NO: 5228102 - DNA, 17 bp, Homo sapiens
agttcccaaagggaggg

SEQ ID NO: 5228103 - DNA, 19 bp, Homo sapiens
agttcccacattaaagaag

SEQ ID NO: 5228104 - DNA, 22 bp, Homo sapiens
agttcccacattaaagaagacc

SEQ ID NO: 5228105 - DNA, 15 bp, Homo sapiens
agttcccagaatcaa

SEQ ID NO: 5228106 - DNA, 16 bp, Homo sapiens
agttcccagaatcaaa

SEQ ID NO: 5228107 - DNA, 22 bp, Homo sapiens
agttcccattattatttctgtt

SEQ ID NO: 5228108 - DNA, 14 bp, Homo sapiens
agttccccatgcag

SEQ ID NO: 5228109 - DNA, 22 bp, Homo sapiens
agttcccccaaccatcttcact

SEQ ID NO: 5228110 - DNA, 23 bp, Homo sapiens
agttcccccaaccatcttcactg

SEQ ID NO: 5228111 - DNA, 15 bp, Homo sapiens
agttcccccaacctc

SEQ ID NO: 5228112 - DNA, 15 bp, Homo sapiens
agttcccccagtacc

SEQ ID NO: 5228113 - DNA, 19 bp, Homo sapiens
agttccccgctgacccttg

SEQ ID NO: 5228114 - DNA, 14 bp, Homo sapiens
agttcccctatgtg

SEQ ID NO: 5228115 - DNA, 18 bp, Homo sapiens
agttcccctatgtggaag

SEQ ID NO: 5228116 - DNA, 23 bp, Homo sapiens
agttcccgctctgcattgcctga

SEQ ID NO: 5228117 - DNA, 22 bp, Homo sapiens
agttcccggagcacagccctgg

SEQ ID NO: 5228118 - DNA, 20 bp, Homo sapiens
agttcccgggagctgggccc

SEQ ID NO: 5228119 - DNA, 17 bp, Homo sapiens
agttccctacttcctgt

SEQ ID NO: 5228120 - DNA, 17 bp, Homo sapiens
agttccctcagccctca

SEQ ID NO: 5228121 - DNA, 19 bp, Homo sapiens
agttccctcagtgtgaagc

SEQ ID NO: 5228122 - DNA, 11 bp, Homo sapiens
agttccctcct

SEQ ID NO: 5228123 - DNA, 18 bp, Homo sapiens
agttccctcctgcccagg

SEQ ID NO: 5228124 - DNA, 19 bp, Homo sapiens
agttccctcctgcccagga

SEQ ID NO: 5228125 - DNA, 22 bp, Homo sapiens
agttccctcctgcccaggactg

SEQ ID NO: 5228126 - DNA, 18 bp, Homo sapiens
agttccctctgcctggga

SEQ ID NO: 5228127 - DNA, 17 bp, Homo sapiens
agttccctctgctcagc

SEQ ID NO: 5228128 - DNA, 21 bp, Homo sapiens
agttccctgaaaacccagaga

SEQ ID NO: 5228129 - DNA, 15 bp, Homo sapiens
agttccctgaaacac

SEQ ID NO: 5228130 - DNA, 23 bp, Homo sapiens
agttccctggagaaaaaaattgc

SEQ ID NO: 5228131 - DNA, 18 bp, Homo sapiens
agttcccttgattcaaat

SEQ ID NO: 5228132 - DNA, 20 bp, Homo sapiens
agttcccttgattcaaataa

SEQ ID NO: 5228133 - DNA, 15 bp, Homo sapiens
agttcccttggcctc

SEQ ID NO: 5228134 - DNA, 17 bp, Homo sapiens
agttcccttggcctcag

SEQ ID NO: 5228135 - DNA, 20 bp, Homo sapiens
agttccctttatttcacata

SEQ ID NO: 5228136 - DNA, 16 bp, Homo sapiens
agttccgatttcccag

SEQ ID NO: 5228137 - DNA, 17 bp, Homo sapiens
agttccggcctgggcac

SEQ ID NO: 5228138 - DNA, 15 bp, Homo sapiens
agttccggggagaaa

SEQ ID NO: 5228139 - DNA, 22 bp, Homo sapiens
agttccggggagaaacccagag

SEQ ID NO: 5228140 - DNA, 14 bp, Homo sapiens
agttccgtctcctc

SEQ ID NO: 5228141 - DNA, 18 bp, Homo sapiens
agttcctaacaggatgaa

SEQ ID NO: 5228142 - DNA, 20 bp, Homo sapiens
agttcctaagaagcttctaa

SEQ ID NO: 5228143 - DNA, 15 bp, Homo sapiens
agttcctaatggatt

SEQ ID NO: 5228144 - DNA, 22 bp, Homo sapiens
agttcctaccgtactccctgca

SEQ ID NO: 5228145 - DNA, 18 bp, Homo sapiens
agttcctagcaagttgac

SEQ ID NO: 5228146 - DNA, 18 bp, Homo sapiens
agttcctcctaaggaaat

SEQ ID NO: 5228147 - DNA, 12 bp, Homo sapiens
agttcctcgccc

SEQ ID NO: 5228148 - DNA, 16 bp, Homo sapiens
agttcctcgccctggg

SEQ ID NO: 5228149 - DNA, 17 bp, Homo sapiens
agttcctctaacatttg

SEQ ID NO: 5228150 - DNA, 18 bp, Homo sapiens
agttcctctagtgccctc

SEQ ID NO: 5228151 - DNA, 14 bp, Homo sapiens
agttcctctgcagt

SEQ ID NO: 5228152 - DNA, 20 bp, Homo sapiens
agtccagcccctcctccctc

SEQ ID NO: 5228153 - DNA, 13 bp, Homo sapiens
agtccagcctgga

SEQ ID NO: 5228154 - DNA, 15 bp, Homo sapiens
agtccagccttccag

SEQ ID NO: 5228155 - DNA, 13 bp, Homo sapiens
agtccagctcccc

SEQ ID NO: 5228156 - DNA, 20 bp, Homo sapiens
agtccagctccttaaactga

SEQ ID NO: 5228157 - DNA, 18 bp, Homo sapiens
agtccagctttccttctg

SEQ ID NO: 5228158 - DNA, 13 bp, Homo sapiens
agtccaggaacaa

SEQ ID NO: 5228159 - DNA, 18 bp, Homo sapiens
agtccaggactgggtctg

SEQ ID NO: 5228160 - DNA, 22 bp, Homo sapiens
agtccaggactgggtctgacct

SEQ ID NO: 5228161 - DNA, 23 bp, Homo sapiens
agtccaggagccccagccagccc

SEQ ID NO: 5228162 - DNA, 13 bp, Homo sapiens
agtccaggcacag

SEQ ID NO: 5228163 - DNA, 14 bp, Homo sapiens
agtccaggcacagg

SEQ ID NO: 5228164 - DNA, 16 bp, Homo sapiens
agtccaggcacaggat

SEQ ID NO: 5228165 - DNA, 19 bp, Homo sapiens
agtccaggccatggaggca

SEQ ID NO: 5228166 - DNA, 13 bp, Homo sapiens
agtccaggcccca

SEQ ID NO: 5228167 - DNA, 23 bp, Homo sapiens
agtccaggccccaaaaccacagc

SEQ ID NO: 5228168 - DNA, 21 bp, Homo sapiens
agtccaggcccccagcccctc

SEQ ID NO: 5228169 - DNA, 18 bp, Homo sapiens
agtccaggcctctctctg

SEQ ID NO: 5228170 - DNA, 21 bp, Homo sapiens
agtccaggcctctctctgctc

SEQ ID NO: 5228171 - DNA, 19 bp, Homo sapiens
agtccagggtttctctgca

SEQ ID NO: 5228172 - DNA, 16 bp, Homo sapiens
agtccaggtcctggtg

SEQ ID NO: 5228173 - DNA, 17 bp, Homo sapiens
agtccaggtcctggtgg

SEQ ID NO: 5228174 - DNA, 20 bp, Homo sapiens
agtccagtcaagttccctcc

SEQ ID NO: 5228175 - DNA, 23 bp, Homo sapiens
agtccagtcaagttccctcctgc

SEQ ID NO: 5228176 - DNA, 22 bp, Homo sapiens
agtccagtcctttgttgctgtt

SEQ ID NO: 5228177 - DNA, 16 bp, Homo sapiens
agtccagtgagaaatt

SEQ ID NO: 5228178 - DNA, 17 bp, Homo sapiens
agtccagtgctctgcct

SEQ ID NO: 5228179 - DNA, 20 bp, Homo sapiens
agtccagtgctctgcctcag

SEQ ID NO: 5228180 - DNA, 20 bp, Homo sapiens
agtccagttttgtgtgcttt

SEQ ID NO: 5228181 - DNA, 15 bp, Homo sapiens
agtccatagctgagc

SEQ ID NO: 5228182 - DNA, 15 bp, Homo sapiens
agtccatcagatgtt

SEQ ID NO: 5228183 - DNA, 14 bp, Homo sapiens
agtccatcagcctc

SEQ ID NO: 5228184 - DNA, 15 bp, Homo sapiens
agtccatgaaaatac

SEQ ID NO: 5228185 - DNA, 14 bp, Homo sapiens
agtccatgctccag

SEQ ID NO: 5228186 - DNA, 18 bp, Homo sapiens
agtccatgctccagggtc

SEQ ID NO: 5228187 - DNA, 22 bp, Homo sapiens
agtccatgtcctatgcctcaca

SEQ ID NO: 5228188 - DNA, 20 bp, Homo sapiens
agtccatgtgataattgtaa

SEQ ID NO: 5228189 - DNA, 13 bp, Homo sapiens
agtccatgttatt

SEQ ID NO: 5228190 - DNA, 14 bp, Homo sapiens
agtccattcatctt

SEQ ID NO: 5228191 - DNA, 15 bp, Homo sapiens
agtccattctcccag

SEQ ID NO: 5228192 - DNA, 17 bp, Homo sapiens
agtccatttatatatga

SEQ ID NO: 5228193 - DNA, 18 bp, Homo sapiens
agtccatttatatatgaa

SEQ ID NO: 5228194 - DNA, 10 bp, Homo sapiens
agtccatttc

SEQ ID NO: 5228195 - DNA, 18 bp, Homo sapiens
agtccatttcccacatct

SEQ ID NO: 5228196 - DNA, 19 bp, Homo sapiens
agtccatttcccacatctt

SEQ ID NO: 5228197 - DNA, 20 bp, Homo sapiens
agtccatttcccacatcttt

SEQ ID NO: 5228198 - DNA, 17 bp, Homo sapiens
agtccatttttgagtaa

SEQ ID NO: 5228199 - DNA, 21 bp, Homo sapiens
agtccatttttgagtaaaact

SEQ ID NO: 5228200 - DNA, 20 bp, Homo sapiens
agtccattttttaaaaatgt

SEQ ID NO: 5228201 - DNA, 11 bp, Homo sapiens
agtcccaaagc

SEQ ID NO: 5228202 - DNA, 19 bp, Homo sapiens
agtcccaagcggtgtctct

SEQ ID NO: 5228203 - DNA, 16 bp, Homo sapiens
agtcccaagctaggct

SEQ ID NO: 5228204 - DNA, 17 bp, Homo sapiens
agtcccaaggaaagccc

SEQ ID NO: 5228205 - DNA, 20 bp, Homo sapiens
agtcccaaggaaagccccag

SEQ ID NO: 5228206 - DNA, 21 bp, Homo sapiens
agtcccaaggaaagccccagc

SEQ ID NO: 5228207 - DNA, 13 bp, Homo sapiens
agtcccacactgt

SEQ ID NO: 5228208 - DNA, 16 bp, Homo sapiens
agtcccacactgtgca

SEQ ID NO: 5228209 - DNA, 18 bp, Homo sapiens
agtcccacactgtgcaga

SEQ ID NO: 5228210 - DNA, 17 bp, Homo sapiens
agtcccacactgtggcc

SEQ ID NO: 5228211 - DNA, 21 bp, Homo sapiens
agtcccacagccccttgcttc

SEQ ID NO: 5228212 - DNA, 12 bp, Homo sapiens
agtcccacccgg

SEQ ID NO: 5228213 - DNA, 21 bp, Homo sapiens
agtcccacccggacaggtggg

SEQ ID NO: 5228214 - DNA, 13 bp, Homo sapiens
agtcccacggctc

SEQ ID NO: 5228215 - DNA, 19 bp, Homo sapiens
agtcccacggctctgtgcc

SEQ ID NO: 5228216 - DNA, 14 bp, Homo sapiens
agtcccactccaag

SEQ ID NO: 5228217 - DNA, 23 bp, Homo sapiens
agtcccactgcacccccctgtgc

SEQ ID NO: 5228218 - DNA, 20 bp, Homo sapiens
agtcccactgcctcaggttc

SEQ ID NO: 5228219 - DNA, 13 bp, Homo sapiens
agtcccactgtgc

SEQ ID NO: 5228220 - DNA, 19 bp, Homo sapiens
agtcccagaaccacactgt

SEQ ID NO: 5228221 - DNA, 21 bp, Homo sapiens
agtcccagaagatgaaaaaaa

SEQ ID NO: 5228222 - DNA, 17 bp, Homo sapiens
agtcccagagctcatcc

SEQ ID NO: 5228223 - DNA, 18 bp, Homo sapiens
agtcccagagctcatccc

SEQ ID NO: 5228224 - DNA, 13 bp, Homo sapiens
agtcccagcactt

SEQ ID NO: 5228225 - DNA, 14 bp, Homo sapiens
agtcccagcacttt

SEQ ID NO: 5228226 - DNA, 12 bp, Homo sapiens
agtcccagcagc

SEQ ID NO: 5228227 - DNA, 17 bp, Homo sapiens
agtcccagcagccagcc

SEQ ID NO: 5228228 - DNA, 16 bp, Homo sapiens
agtcccagcctctggg

SEQ ID NO: 5228229 - DNA, 17 bp, Homo sapiens
agtcccagcctctgggg

SEQ ID NO: 5228230 - DNA, 21 bp, Homo sapiens
agtcccagctacttgggagcc

SEQ ID NO: 5228231 - DNA, 23 bp, Homo sapiens
agtcccaggggcagccacaccac

SEQ ID NO: 5228232 - DNA, 17 bp, Homo sapiens
agtcccagtccttgaga

SEQ ID NO: 5228233 - DNA, 15 bp, Homo sapiens
agtcccagttcccat

SEQ ID NO: 5228234 - DNA, 18 bp, Homo sapiens
agtcccatttttctcttg

SEQ ID NO: 5228235 - DNA, 21 bp, Homo sapiens
agtccccaaggcctctctctg

SEQ ID NO: 5228236 - DNA, 22 bp, Homo sapiens
agtccccacagataactgaaaa

SEQ ID NO: 5228237 - DNA, 16 bp, Homo sapiens
agtccccacccctgcc

SEQ ID NO: 5228238 - DNA, 17 bp, Homo sapiens
agtccccacccctgccc

SEQ ID NO: 5228239 - DNA, 20 bp, Homo sapiens
agtccccacccctgccccca

SEQ ID NO: 5228240 - DNA, 13 bp, Homo sapiens
agtccccagaact

SEQ ID NO: 5228241 - DNA, 12 bp, Homo sapiens
agtccccagact

SEQ ID NO: 5228242 - DNA, 13 bp, Homo sapiens
agtccccagactc

SEQ ID NO: 5228243 - DNA, 13 bp, Homo sapiens
agtccccagagaa

SEQ ID NO: 5228244 - DNA, 11 bp, Homo sapiens
agtccccagcc

SEQ ID NO: 5228245 - DNA, 13 bp, Homo sapiens
agtccccagccct

SEQ ID NO: 5228246 - DNA, 14 bp, Homo sapiens
agtccccagccctg

SEQ ID NO: 5228247 - DNA, 18 bp, Homo sapiens
agtccccagccctgggct

SEQ ID NO: 5228248 - DNA, 18 bp, Homo sapiens
agtccccagcccttctgc

SEQ ID NO: 5228249 - DNA, 19 bp, Homo sapiens
agtccccatcagcaccatg

SEQ ID NO: 5228250 - DNA, 18 bp, Homo sapiens
agtccccattgaggcttg

SEQ ID NO: 5228251 - DNA, 22 bp, Homo sapiens
agtcccccaacagatgcttttc

SEQ ID NO: 5228252 - DNA, 19 bp, Homo sapiens
agtcccccaccacactgaa

SEQ ID NO: 5228253 - DNA, 16 bp, Homo sapiens
agtcccccacccacct

SEQ ID NO: 5228254 - DNA, 18 bp, Homo sapiens
agtcccccacccacctcc

SEQ ID NO: 5228255 - DNA, 21 bp, Homo sapiens
agtcccccacccacctcctgc

SEQ ID NO: 5228256 - DNA, 16 bp, Homo sapiens
agtccccccacccctc

SEQ ID NO: 5228257 - DNA, 22 bp, Homo sapiens
agtccccccacccctccccacc

SEQ ID NO: 5228258 - DNA, 13 bp, Homo sapiens
agtccccccgacc

SEQ ID NO: 5228259 - DNA, 20 bp, Homo sapiens
agtcccccctcccacctcca

SEQ ID NO: 5228260 - DNA, 21 bp, Homo sapiens
agtcccccctcccacctccag

SEQ ID NO: 5228261 - DNA, 22 bp, Homo sapiens
agtccccctcctcagccagcct

SEQ ID NO: 5228262 - DNA, 23 bp, Homo sapiens
agtccccctcctcagccagcctc

SEQ ID NO: 5228263 - DNA, 19 bp, Homo sapiens
agtccccgagggcgaaggc

SEQ ID NO: 5228264 - DNA, 22 bp, Homo sapiens
agtccccgggcatctttgggga

SEQ ID NO: 5228265 - DNA, 15 bp, Homo sapiens
agtccccgtgccccg

SEQ ID NO: 5228266 - DNA, 18 bp, Homo sapiens
agtccccgtgccccgcct

SEQ ID NO: 5228267 - DNA, 20 bp, Homo sapiens
agtccccgtgccccgcctcc

SEQ ID NO: 5228268 - DNA, 15 bp, Homo sapiens
agtcccctactccct

SEQ ID NO: 5228269 - DNA, 21 bp, Homo sapiens
agtcccctccccggccctacc

SEQ ID NO: 5228270 - DNA, 13 bp, Homo sapiens
agtcccctctctc

SEQ ID NO: 5228271 - DNA, 14 bp, Homo sapiens
agtcccctctctct

SEQ ID NO: 5228272 - DNA, 17 bp, Homo sapiens
agtcccctctctctggg

SEQ ID NO: 5228273 - DNA, 23 bp, Homo sapiens
agtcccctgttgattatcttcag

SEQ ID NO: 5228274 - DNA, 14 bp, Homo sapiens
agtcccctgtttgt

SEQ ID NO: 5228275 - DNA, 23 bp, Homo sapiens
agtcccctgtttgtttctgaaag

SEQ ID NO: 5228276 - DNA, 23 bp, Homo sapiens
agtccccttctgtgtttctggag

SEQ ID NO: 5228277 - DNA, 12 bp, Homo sapiens
agtcccctttct

SEQ ID NO: 5228278 - DNA, 15 bp, Homo sapiens
agtcccgaggcagca

SEQ ID NO: 5228279 - DNA, 13 bp, Homo sapiens
agtcccggcttcc

SEQ ID NO: 5228280 - DNA, 20 bp, Homo sapiens
agtcccgtgccctgtttcca

SEQ ID NO: 5228281 - DNA, 18 bp, Homo sapiens
agtccctaggagggaagg

SEQ ID NO: 5228282 - DNA, 23 bp, Homo sapiens
agtccctaggagggaaggagctg

SEQ ID NO: 5228283 - DNA, 20 bp, Homo sapiens
agtccctataataaaggctg

SEQ ID NO: 5228284 - DNA, 15 bp, Homo sapiens
agtccctatagtata

SEQ ID NO: 5228285 - DNA, 21 bp, Homo sapiens
agtccctcaagccaccagatg

SEQ ID NO: 5228286 - DNA, 12 bp, Homo sapiens
agtccctcacct

SEQ ID NO: 5228287 - DNA, 23 bp, Homo sapiens
agtccctcccatctctaccccaa

SEQ ID NO: 5228288 - DNA, 19 bp, Homo sapiens
agtccctccctcctggctc

SEQ ID NO: 5228289 - DNA, 20 bp, Homo sapiens
agtccctccctcctggctca

SEQ ID NO: 5228290 - DNA, 21 bp, Homo sapiens
agtccctccctcctggctcac

SEQ ID NO: 5228291 - DNA, 22 bp, Homo sapiens
agtccctccctcctggctcaca

SEQ ID NO: 5228292 - DNA, 18 bp, Homo sapiens
agtccctccctgcctgag

SEQ ID NO: 5228293 - DNA, 13 bp, Homo sapiens
agtccctcctccc

SEQ ID NO: 5228294 - DNA, 18 bp, Homo sapiens
agtccctcctcccccacg

SEQ ID NO: 5228295 - DNA, 19 bp, Homo sapiens
agtccctcctcccccacgc

SEQ ID NO: 5228296 - DNA, 12 bp, Homo sapiens
agtccctcctgt

SEQ ID NO: 5228297 - DNA, 20 bp, Homo sapiens
agtccctcgccgtccctccc

SEQ ID NO: 5228298 - DNA, 18 bp, Homo sapiens
agtccctctggaaagaaa

SEQ ID NO: 5228299 - DNA, 23 bp, Homo sapiens
agtccctgaggcaggtccccaga

SEQ ID NO: 5228300 - DNA, 19 bp, Homo sapiens
agtccctgcacagtgactt

SEQ ID NO: 5228301 - DNA, 21 bp, Homo sapiens
agtccctgcacagtgacttct

SEQ ID NO: 5228302 - DNA, 16 bp, Homo sapiens
agtccctgccaatgga

SEQ ID NO: 5228303 - DNA, 22 bp, Homo sapiens
agtccctgcctggaccagcctc

SEQ ID NO: 5228304 - DNA, 23 bp, Homo sapiens
agtccctgcctggaccagcctct

SEQ ID NO: 5228305 - DNA, 13 bp, Homo sapiens
agtccctgctggg

SEQ ID NO: 5228306 - DNA, 17 bp, Homo sapiens
agtccctggagctgtcc

SEQ ID NO: 5228307 - DNA, 21 bp, Homo sapiens
agtccctgggagcaagttgca

SEQ ID NO: 5228308 - DNA, 20 bp, Homo sapiens
agtccctgggggaagccctg

SEQ ID NO: 5228309 - DNA, 21 bp, Homo sapiens
agtccctgggggaagccctgg

SEQ ID NO: 5228310 - DNA, 21 bp, Homo sapiens
agtccctgtgaagactgggtg

SEQ ID NO: 5228311 - DNA, 16 bp, Homo sapiens
agtccctgtgttctgc

SEQ ID NO: 5228312 - DNA, 12 bp, Homo sapiens
agtccctgttct

SEQ ID NO: 5228313 - DNA, 20 bp, Homo sapiens
agtccctgttctcagctccg

SEQ ID NO: 5228314 - DNA, 18 bp, Homo sapiens
agtccctgttttctgagc

SEQ ID NO: 5228315 - DNA, 22 bp, Homo sapiens
agtcccttagaagatctgcttc

SEQ ID NO: 5228316 - DNA, 17 bp, Homo sapiens
agtcccttcagactggc

SEQ ID NO: 5228317 - DNA, 15 bp, Homo sapiens
agtcccttccacacc

SEQ ID NO: 5228318 - DNA, 13 bp, Homo sapiens
agtcccttcccct

SEQ ID NO: 5228319 - DNA, 22 bp, Homo sapiens
agtcccttcccctccctggctc

SEQ ID NO: 5228320 - DNA, 19 bp, Homo sapiens
agtcccttcctattctcct

SEQ ID NO: 5228321 - DNA, 23 bp, Homo sapiens
agtcccttcctattctcctgcca

SEQ ID NO: 5228322 - DNA, 14 bp, Homo sapiens
agtcccttctctct

SEQ ID NO: 5228323 - DNA, 20 bp, Homo sapiens
agtcccttctctctttctaa

SEQ ID NO: 5228324 - DNA, 21 bp, Homo sapiens
agtccctttggacaaatgcat

SEQ ID NO: 5228325 - DNA, 21 bp, Homo sapiens
agtcccttttcattctcctcc

SEQ ID NO: 5228326 - DNA, 16 bp, Homo sapiens
agtccgaaaagcaaac

SEQ ID NO: 5228327 - DNA, 23 bp, Homo sapiens
agtccgcaagttcagggaagcag

SEQ ID NO: 5228328 - DNA, 15 bp, Homo sapiens
agtccgcagaagccc

SEQ ID NO: 5228329 - DNA, 15 bp, Homo sapiens
agttcctctgcagtt

SEQ ID NO: 5228330 - DNA, 21 bp, Homo sapiens
agttcctctttgcatggaatt

SEQ ID NO: 5228331 - DNA, 18 bp, Homo sapiens
agttcctgaacctgatgc

SEQ ID NO: 5228332 - DNA, 14 bp, Homo sapiens
agttcctgcactcc

SEQ ID NO: 5228333 - DNA, 13 bp, Homo sapiens
agttcctgctaaa

SEQ ID NO: 5228334 - DNA, 11 bp, Homo sapiens
agttcctgctc

SEQ ID NO: 5228335 - DNA, 14 bp, Homo sapiens
agttcctgctctct

SEQ ID NO: 5228336 - DNA, 17 bp, Homo sapiens
agttcctgctctctgct

SEQ ID NO: 5228337 - DNA, 18 bp, Homo sapiens
agttcctgctgcctgggt

SEQ ID NO: 5228338 - DNA, 21 bp, Homo sapiens
agttcctgtcccttctcttaa

SEQ ID NO: 5228339 - DNA, 23 bp, Homo sapiens
agttcctgtcccttctcttaatt

SEQ ID NO: 5228340 - DNA, 19 bp, Homo sapiens
agttccttactgtttacag

SEQ ID NO: 5228341 - DNA, 19 bp, Homo sapiens
agttccttaggagatgtca

SEQ ID NO: 5228342 - DNA, 21 bp, Homo sapiens
agttccttaggttttctttgg

SEQ ID NO: 5228343 - DNA, 17 bp, Homo sapiens
agttccttataagaatt

SEQ ID NO: 5228344 - DNA, 19 bp, Homo sapiens
agttccttatccctctctt

SEQ ID NO: 5228345 - DNA, 14 bp, Homo sapiens
agttccttatgtat

SEQ ID NO: 5228346 - DNA, 13 bp, Homo sapiens
agttccttctgta

SEQ ID NO: 5228347 - DNA, 14 bp, Homo sapiens
agttccttgcctta

SEQ ID NO: 5228348 - DNA, 16 bp, Homo sapiens
agttccttgccttaat

SEQ ID NO: 5228349 - DNA, 16 bp, Homo sapiens
agttcctttgtgtgta

SEQ ID NO: 5228350 - DNA, 19 bp, Homo sapiens
agttcgaacatgtttcact

SEQ ID NO: 5228351 - DNA, 13 bp, Homo sapiens
agttcgagaccaa

SEQ ID NO: 5228352 - DNA, 14 bp, Homo sapiens
agttcgagaccagc

SEQ ID NO: 5228353 - DNA, 17 bp, Homo sapiens
agttcgagaccagcctc

SEQ ID NO: 5228354 - DNA, 19 bp, Homo sapiens
agttcgagagcagcctggc

SEQ ID NO: 5228355 - DNA, 17 bp, Homo sapiens
agttcgcagccaccctg

SEQ ID NO: 5228356 - DNA, 17 bp, Homo sapiens
agttcgcctggagccct

SEQ ID NO: 5228357 - DNA, 18 bp, Homo sapiens
agttcgcctggagccctc

SEQ ID NO: 5228358 - DNA, 19 bp, Homo sapiens
agttcgcctggagccctcc

SEQ ID NO: 5228359 - DNA, 20 bp, Homo sapiens
agttcggtgagctacaaatg

SEQ ID NO: 5228360 - DNA, 21 bp, Homo sapiens
agttcgtaccgcttccttaga

SEQ ID NO: 5228361 - DNA, 13 bp, Homo sapiens
agttctaaaattg

SEQ ID NO: 5228362 - DNA, 16 bp, Homo sapiens
agttctaacacatttc

SEQ ID NO: 5228363 - DNA, 14 bp, Homo sapiens
agttctaagattct

SEQ ID NO: 5228364 - DNA, 15 bp, Homo sapiens
agttctaagattcta

SEQ ID NO: 5228365 - DNA, 17 bp, Homo sapiens
agttctaagattctaat

SEQ ID NO: 5228366 - DNA, 18 bp, Homo sapiens
agttctaagattctaatg

SEQ ID NO: 5228367 - DNA, 16 bp, Homo sapiens
agttctaagattctga

SEQ ID NO: 5228368 - DNA, 16 bp, Homo sapiens
agttctaataatttct

SEQ ID NO: 5228369 - DNA, 18 bp, Homo sapiens
agttctaataatttctaa

SEQ ID NO: 5228370 - DNA, 23 bp, Homo sapiens
agttctacaagcatatttgagaa

SEQ ID NO: 5228371 - DNA, 13 bp, Homo sapiens
agttctacagaaa

SEQ ID NO: 5228372 - DNA, 22 bp, Homo sapiens
agttctacctcaggcagctcaa

SEQ ID NO: 5228373 - DNA, 23 bp, Homo sapiens
agttctacttcatgtaatccaaa

SEQ ID NO: 5228374 - DNA, 14 bp, Homo sapiens
agttctagaaaaac

SEQ ID NO: 5228375 - DNA, 19 bp, Homo sapiens
agttctagaaccacttcct

SEQ ID NO: 5228376 - DNA, 20 bp, Homo sapiens
agttctagaaccacttcctg

SEQ ID NO: 5228377 - DNA, 11 bp, Homo sapiens
agttctagaag

SEQ ID NO: 5228378 - DNA, 21 bp, Homo sapiens
agttctagaagccacagtgcc

SEQ ID NO: 5228379 - DNA, 14 bp, Homo sapiens
agttctagaattct

SEQ ID NO: 5228380 - DNA, 22 bp, Homo sapiens
agttctagacatggaggttcta

SEQ ID NO: 5228381 - DNA, 14 bp, Homo sapiens
agttctagagaaga

SEQ ID NO: 5228382 - DNA, 20 bp, Homo sapiens
agttctagagaagaggctgg

SEQ ID NO: 5228383 - DNA, 10 bp, Homo sapiens
agttctagat

SEQ ID NO: 5228384 - DNA, 14 bp, Homo sapiens
agttctaggaaaat

SEQ ID NO: 5228385 - DNA, 15 bp, Homo sapiens
agttctaggaaaata

SEQ ID NO: 5228386 - DNA, 21 bp, Homo sapiens
agttctaggcatacttttcaa

SEQ ID NO: 5228387 - DNA, 22 bp, Homo sapiens
agttctaggcctttcctctgca

SEQ ID NO: 5228388 - DNA, 21 bp, Homo sapiens
agttctaggggagaagagccc

SEQ ID NO: 5228389 - DNA, 23 bp, Homo sapiens
agttctagtgcagctgaaattga

SEQ ID NO: 5228390 - DNA, 17 bp, Homo sapiens
agttctagttgattgcg

SEQ ID NO: 5228391 - DNA, 15 bp, Homo sapiens
agttctagtttgcat

SEQ ID NO: 5228392 - DNA, 16 bp, Homo sapiens
agttctagtttgcatt

SEQ ID NO: 5228393 - DNA, 18 bp, Homo sapiens
agttctatactgtaaagc

SEQ ID NO: 5228394 - DNA, 18 bp, Homo sapiens
agttctatccccaagctg

SEQ ID NO: 5228395 - DNA, 20 bp, Homo sapiens
agttctatccttttgcctgc

SEQ ID NO: 5228396 - DNA, 23 bp, Homo sapiens
agttctatgaagagtattaatgt

SEQ ID NO: 5228397 - DNA, 19 bp, Homo sapiens
agttctattatctgggttt

SEQ ID NO: 5228398 - DNA, 23 bp, Homo sapiens
agttctatttatttgtgagactg

SEQ ID NO: 5228399 - DNA, 23 bp, Homo sapiens
agttctatttctatctgcaaata

SEQ ID NO: 5228400 - DNA, 14 bp, Homo sapiens
agttctatttgcta

SEQ ID NO: 5228401 - DNA, 16 bp, Homo sapiens
agttctcaaatgtgtg

SEQ ID NO: 5228402 - DNA, 17 bp, Homo sapiens
agttctcaaatgtgtgt

SEQ ID NO: 5228403 - DNA, 18 bp, Homo sapiens
agttctcaaatgtgtgtg

SEQ ID NO: 5228404 - DNA, 15 bp, Homo sapiens
agttctcaatgtaga

SEQ ID NO: 5228405 - DNA, 18 bp, Homo sapiens
agttctcactatgtttct

SEQ ID NO: 5228406 - DNA, 20 bp, Homo sapiens
agttctcactatgtttctca

SEQ ID NO: 5228407 - DNA, 13 bp, Homo sapiens
agttctcactcct

SEQ ID NO: 5228408 - DNA, 12 bp, Homo sapiens
agttctcactgt

SEQ ID NO: 5228409 - DNA, 20 bp, Homo sapiens
agttctcagaactgttggct

SEQ ID NO: 5228410 - DNA, 14 bp, Homo sapiens
agttctcagggctc

SEQ ID NO: 5228411 - DNA, 14 bp, Homo sapiens
agttctcatccaca

SEQ ID NO: 5228412 - DNA, 15 bp, Homo sapiens
agttctcatcttgta

SEQ ID NO: 5228413 - DNA, 16 bp, Homo sapiens
agttctccagcttcag

SEQ ID NO: 5228414 - DNA, 18 bp, Homo sapiens
agttctccagcttcagct

SEQ ID NO: 5228415 - DNA, 21 bp, Homo sapiens
agttctccagcttcagctcaa

SEQ ID NO: 5228416 - DNA, 21 bp, Homo sapiens
agttctccgtaacagtgtaaa

SEQ ID NO: 5228417 - DNA, 23 bp, Homo sapiens
agttctccgtaacagtgtaaagt

SEQ ID NO: 5228418 - DNA, 22 bp, Homo sapiens
agttctcctggaggcaggggct

SEQ ID NO: 5228419 - DNA, 18 bp, Homo sapiens
agttctctcatcggaggc

SEQ ID NO: 5228420 - DNA, 16 bp, Homo sapiens
agttctctccttcttc

SEQ ID NO: 5228421 - DNA, 11 bp, Homo sapiens
agttctctgat

SEQ ID NO: 5228422 - DNA, 15 bp, Homo sapiens
agttctctgatgcag

SEQ ID NO: 5228423 - DNA, 17 bp, Homo sapiens
agttctctgatgcagaa

SEQ ID NO: 5228424 - DNA, 18 bp, Homo sapiens
agttctctgatgcagaaa

SEQ ID NO: 5228425 - DNA, 19 bp, Homo sapiens
agttctctgatgcagaaat

SEQ ID NO: 5228426 - DNA, 12 bp, Homo sapiens
agttctctgcca

SEQ ID NO: 5228427 - DNA, 15 bp, Homo sapiens
agttctctgtaatta

SEQ ID NO: 5228428 - DNA, 21 bp, Homo sapiens
agttctctgtaattacaacta

SEQ ID NO: 5228429 - DNA, 16 bp, Homo sapiens
agttctcttatctttg

SEQ ID NO: 5228430 - DNA, 12 bp, Homo sapiens
agttctcttccg

SEQ ID NO: 5228431 - DNA, 14 bp, Homo sapiens
agttctcttctcct

SEQ ID NO: 5228432 - DNA, 17 bp, Homo sapiens
agttctcttctcctgtg

SEQ ID NO: 5228433 - DNA, 14 bp, Homo sapiens
agttctcttgcttt

SEQ ID NO: 5228434 - DNA, 17 bp, Homo sapiens
agttctctttggaaata

SEQ ID NO: 5228435 - DNA, 12 bp, Homo sapiens
agttctgaaaac

SEQ ID NO: 5228436 - DNA, 13 bp, Homo sapiens
agttctgaaagct

SEQ ID NO: 5228437 - DNA, 19 bp, Homo sapiens
agttctgaactggaacatg

SEQ ID NO: 5228438 - DNA, 12 bp, Homo sapiens
agttctgaaggt

SEQ ID NO: 5228439 - DNA, 18 bp, Homo sapiens
agttctgacactgtgtgt

SEQ ID NO: 5228440 - DNA, 15 bp, Homo sapiens
agttctgacagtgtt

SEQ ID NO: 5228441 - DNA, 18 bp, Homo sapiens
agttctgactttgaattt

SEQ ID NO: 5228442 - DNA, 15 bp, Homo sapiens
agttctgagtcctga

SEQ ID NO: 5228443 - DNA, 14 bp, Homo sapiens
agttctgagtgttt

SEQ ID NO: 5228444 - DNA, 15 bp, Homo sapiens
agttctgagtgtttt

SEQ ID NO: 5228445 - DNA, 22 bp, Homo sapiens
agttctgagtgtttttactaca

SEQ ID NO: 5228446 - DNA, 17 bp, Homo sapiens
agttctgcaataacagt

SEQ ID NO: 5228447 - DNA, 18 bp, Homo sapiens
agttctgcactcttgtac

SEQ ID NO: 5228448 - DNA, 16 bp, Homo sapiens
agttctgcagataaac

SEQ ID NO: 5228449 - DNA, 21 bp, Homo sapiens
agttctgcagataaacagtag

SEQ ID NO: 5228450 - DNA, 12 bp, Homo sapiens
agttctgcaggt

SEQ ID NO: 5228451 - DNA, 18 bp, Homo sapiens
agttctgcaggttgaagc

SEQ ID NO: 5228452 - DNA, 20 bp, Homo sapiens
agttctgccacctctgacgc

SEQ ID NO: 5228453 - DNA, 12 bp, Homo sapiens
agttctgccagg

SEQ ID NO: 5228454 - DNA, 14 bp, Homo sapiens
agttctgccaggag

SEQ ID NO: 5228455 - DNA, 15 bp, Homo sapiens
agttctgccaggcaa

SEQ ID NO: 5228456 - DNA, 16 bp, Homo sapiens
agttctgccaggcaac

SEQ ID NO: 5228457 - DNA, 15 bp, Homo sapiens
agttctgctcattct

SEQ ID NO: 5228458 - DNA, 21 bp, Homo sapiens
agttctgctcattctaatgat

SEQ ID NO: 5228459 - DNA, 15 bp, Homo sapiens
agttctgctccagac

SEQ ID NO: 5228460 - DNA, 18 bp, Homo sapiens
agttctgctccagacagg

SEQ ID NO: 5228461 - DNA, 16 bp, Homo sapiens
agttctgctcctctcc

SEQ ID NO: 5228462 - DNA, 15 bp, Homo sapiens
agttctgctgaatgc

SEQ ID NO: 5228463 - DNA, 10 bp, Homo sapiens
agttctggaa

SEQ ID NO: 5228464 - DNA, 19 bp, Homo sapiens
agttctggaaaagaactgt

SEQ ID NO: 5228465 - DNA, 19 bp, Homo sapiens
agttctggaaaccacgtgg

SEQ ID NO: 5228466 - DNA, 22 bp, Homo sapiens
agttctggatggtgtgccttcc

SEQ ID NO: 5228467 - DNA, 23 bp, Homo sapiens
agttctggatggtgtgccttcca

SEQ ID NO: 5228468 - DNA, 12 bp, Homo sapiens
agttctgggtgc

SEQ ID NO: 5228469 - DNA, 14 bp, Homo sapiens
agttctgggtttct

SEQ ID NO: 5228470 - DNA, 16 bp, Homo sapiens
agttctggtgttccta

SEQ ID NO: 5228471 - DNA, 14 bp, Homo sapiens
agttctggttccta

SEQ ID NO: 5228472 - DNA, 15 bp, Homo sapiens
agttctgtaatgtag

SEQ ID NO: 5228473 - DNA, 12 bp, Homo sapiens
agttctgtagaa

SEQ ID NO: 5228474 - DNA, 21 bp, Homo sapiens
agttctgtagagccttctgat

SEQ ID NO: 5228475 - DNA, 13 bp, Homo sapiens
agttctgtatttg

SEQ ID NO: 5228476 - DNA, 20 bp, Homo sapiens
agttctgtatttgaaagtgc

SEQ ID NO: 5228477 - DNA, 11 bp, Homo sapiens
agttctgtgac

SEQ ID NO: 5228478 - DNA, 15 bp, Homo sapiens
agttctgtgcctccc

SEQ ID NO: 5228479 - DNA, 19 bp, Homo sapiens
agttctgtgcctcccccca

SEQ ID NO: 5228480 - DNA, 20 bp, Homo sapiens
agttctgtgcctccccccag

SEQ ID NO: 5228481 - DNA, 22 bp, Homo sapiens
agttctgtgcctccccccagac

SEQ ID NO: 5228482 - DNA, 15 bp, Homo sapiens
agttctgtgtacatt

SEQ ID NO: 5228483 - DNA, 15 bp, Homo sapiens
agttctgtgtacttt

SEQ ID NO: 5228484 - DNA, 21 bp, Homo sapiens
agttctgtgtatttaattgta

SEQ ID NO: 5228485 - DNA, 17 bp, Homo sapiens
agttctgtgtcctcgca

SEQ ID NO: 5228486 - DNA, 19 bp, Homo sapiens
agttctgtgtggtgcattc

SEQ ID NO: 5228487 - DNA, 15 bp, Homo sapiens
agttctgtgtttaat

SEQ ID NO: 5228488 - DNA, 19 bp, Homo sapiens
agttctgtgtttaatttct

SEQ ID NO: 5228489 - DNA, 21 bp, Homo sapiens
agttctgttaaatatttttgt

SEQ ID NO: 5228490 - DNA, 21 bp, Homo sapiens
agttctgttatatcccctgct

SEQ ID NO: 5228491 - DNA, 22 bp, Homo sapiens
agttctgttatatcccctgcta

SEQ ID NO: 5228492 - DNA, 19 bp, Homo sapiens
agttctgttgacctgtgca

SEQ ID NO: 5228493 - DNA, 22 bp, Homo sapiens
agttctgttgtgtttgtcaaaa

SEQ ID NO: 5228494 - DNA, 18 bp, Homo sapiens
agttctgttgttttgtgt

SEQ ID NO: 5228495 - DNA, 21 bp, Homo sapiens
agttctgtttggtgtgtccca

SEQ ID NO: 5228496 - DNA, 14 bp, Homo sapiens
agttcttaacccag

SEQ ID NO: 5228497 - DNA, 18 bp, Homo sapiens
agttcttaacccagtgtc

SEQ ID NO: 5228498 - DNA, 20 bp, Homo sapiens
agttcttaagacttctctgt

SEQ ID NO: 5228499 - DNA, 22 bp, Homo sapiens
agttcttaaggattgtgatatt

SEQ ID NO: 5228500 - DNA, 23 bp, Homo sapiens
agttcttactgcttaattcaaat

SEQ ID NO: 5228501 - DNA, 22 bp, Homo sapiens
agttcttagagcacttttaaca

SEQ ID NO: 5228502 - DNA, 14 bp, Homo sapiens
agttcttagatatc

SEQ ID NO: 5228503 - DNA, 16 bp, Homo sapiens
agttcttagccctcta

SEQ ID NO: 5228504 - DNA, 23 bp, Homo sapiens
agttcttagtcccacagggaaat

SEQ ID NO: 5228505 - DNA, 20 bp, Homo sapiens
agttcttagttgctgtatgt

SEQ ID NO: 5228506 - DNA, 21 bp, Homo sapiens
agttcttagttgctgtatgtc

SEQ ID NO: 5228507 - DNA, 18 bp, Homo sapiens
agttcttatctctagctc

SEQ ID NO: 5228508 - DNA, 20 bp, Homo sapiens
agtccgcagttgtagcagaa

SEQ ID NO: 5228509 - DNA, 23 bp, Homo sapiens
agtccgcagttgtagcagaaacc

SEQ ID NO: 5228510 - DNA, 18 bp, Homo sapiens
agtccgccaaacactcca

SEQ ID NO: 5228511 - DNA, 16 bp, Homo sapiens
agtccgccgctgcaca

SEQ ID NO: 5228512 - DNA, 18 bp, Homo sapiens
agtccgcctggccggctc

SEQ ID NO: 5228513 - DNA, 22 bp, Homo sapiens
agtccggacccacctcaccccg

SEQ ID NO: 5228514 - DNA, 15 bp, Homo sapiens
agtccggaggcagca

SEQ ID NO: 5228515 - DNA, 15 bp, Homo sapiens
agtccggatttctaa

SEQ ID NO: 5228516 - DNA, 16 bp, Homo sapiens
agtccggatttctaac

SEQ ID NO: 5228517 - DNA, 18 bp, Homo sapiens
agtccggatttctaacag

SEQ ID NO: 5228518 - DNA, 22 bp, Homo sapiens
agtccggatttctaacagtcct

SEQ ID NO: 5228519 - DNA, 14 bp, Homo sapiens
agtccggtgccttc

SEQ ID NO: 5228520 - DNA, 15 bp, Homo sapiens
agtccggtgccttcc

SEQ ID NO: 5228521 - DNA, 21 bp, Homo sapiens
agtccggtgccttccaccctg

SEQ ID NO: 5228522 - DNA, 21 bp, Homo sapiens
agtccgtgctgacagctgctc

SEQ ID NO: 5228523 - DNA, 13 bp, Homo sapiens
agtccgtgggacg

SEQ ID NO: 5228524 - DNA, 15 bp, Homo sapiens
agtccgtgggctggc

SEQ ID NO: 5228525 - DNA, 22 bp, Homo sapiens
agtccgtgtggatccaatgtta

SEQ ID NO: 5228526 - DNA, 21 bp, Homo sapiens
agtcctaagaagtggggcaga

SEQ ID NO: 5228527 - DNA, 16 bp, Homo sapiens
agtcctaatttgaaca

SEQ ID NO: 5228528 - DNA, 16 bp, Homo sapiens
agtcctagaatgtttc

SEQ ID NO: 5228529 - DNA, 14 bp, Homo sapiens
agtcctagagctcc

SEQ ID NO: 5228530 - DNA, 18 bp, Homo sapiens
agtcctagagctcctgtc

SEQ ID NO: 5228531 - DNA, 19 bp, Homo sapiens
agtcctagagctcctgtcc

SEQ ID NO: 5228532 - DNA, 17 bp, Homo sapiens
agtcctagccactcagg

SEQ ID NO: 5228533 - DNA, 13 bp, Homo sapiens
agtcctagcccct

SEQ ID NO: 5228534 - DNA, 12 bp, Homo sapiens
agtcctagctgc

SEQ ID NO: 5228535 - DNA, 14 bp, Homo sapiens
agtcctagctgcac

SEQ ID NO: 5228536 - DNA, 16 bp, Homo sapiens
agtcctagctgcacag

SEQ ID NO: 5228537 - DNA, 16 bp, Homo sapiens
agtcctagtgaacctc

SEQ ID NO: 5228538 - DNA, 16 bp, Homo sapiens
agtcctagttttccta

SEQ ID NO: 5228539 - DNA, 23 bp, Homo sapiens
agtcctagttttcctacttataa

SEQ ID NO: 5228540 - DNA, 17 bp, Homo sapiens
agtcctatcgactttat

SEQ ID NO: 5228541 - DNA, 13 bp, Homo sapiens
agtcctatctcat

SEQ ID NO: 5228542 - DNA, 22 bp, Homo sapiens
agtcctatctgggcttcctgga

SEQ ID NO: 5228543 - DNA, 16 bp, Homo sapiens
agtcctatggaaaaaa

SEQ ID NO: 5228544 - DNA, 19 bp, Homo sapiens
agtcctatgtacagagctt

SEQ ID NO: 5228545 - DNA, 18 bp, Homo sapiens
agtcctattcaaattcct

SEQ ID NO: 5228546 - DNA, 19 bp, Homo sapiens
agtcctattcaaattccta

SEQ ID NO: 5228547 - DNA, 14 bp, Homo sapiens
agtcctatttcagt

SEQ ID NO: 5228548 - DNA, 21 bp, Homo sapiens
agtcctcacacacggaggcca

SEQ ID NO: 5228549 - DNA, 22 bp, Homo sapiens
agtcctcacacacggaggccag

SEQ ID NO: 5228550 - DNA, 15 bp, Homo sapiens
agtcctcacagccta

SEQ ID NO: 5228551 - DNA, 20 bp, Homo sapiens
agtcctcacagcctctccct

SEQ ID NO: 5228552 - DNA, 17 bp, Homo sapiens
agtcctcacatgcccgc

SEQ ID NO: 5228553 - DNA, 15 bp, Homo sapiens
agtcctcactcccag

SEQ ID NO: 5228554 - DNA, 16 bp, Homo sapiens
agtcctcactcccagt

SEQ ID NO: 5228555 - DNA, 18 bp, Homo sapiens
agtcctcactcccagtcc

SEQ ID NO: 5228556 - DNA, 16 bp, Homo sapiens
agtcctcactgtcctg

SEQ ID NO: 5228557 - DNA, 18 bp, Homo sapiens
agtcctcactgtcctgtt

SEQ ID NO: 5228558 - DNA, 23 bp, Homo sapiens
agtcctcacttctagatctcagc

SEQ ID NO: 5228559 - DNA, 21 bp, Homo sapiens
agtcctcaggtacagcgggct

SEQ ID NO: 5228560 - DNA, 18 bp, Homo sapiens
agtcctcataaaaagcaa

SEQ ID NO: 5228561 - DNA, 22 bp, Homo sapiens
agtcctccagaactcttcctcc

SEQ ID NO: 5228562 - DNA, 14 bp, Homo sapiens
agtcctccagcctc

SEQ ID NO: 5228563 - DNA, 13 bp, Homo sapiens
agtcctcccaagc

SEQ ID NO: 5228564 - DNA, 14 bp, Homo sapiens
agtcctcccaagct

SEQ ID NO: 5228565 - DNA, 17 bp, Homo sapiens
agtcctcccaagctgtg

SEQ ID NO: 5228566 - DNA, 20 bp, Homo sapiens
agtcctcccaagctgtgctg

SEQ ID NO: 5228567 - DNA, 14 bp, Homo sapiens
agtcctcccatctc

SEQ ID NO: 5228568 - DNA, 19 bp, Homo sapiens
agtcctcccctcacagcct

SEQ ID NO: 5228569 - DNA, 20 bp, Homo sapiens
agtcctcccctcacagcctc

SEQ ID NO: 5228570 - DNA, 23 bp, Homo sapiens
agtcctcccctcacagcctctga

SEQ ID NO: 5228571 - DNA, 24 bp, Homo sapiens
agtcctccctcctgcaggctggct

SEQ ID NO: 5228572 - DNA, 13 bp, Homo sapiens
agtcctccctgct

SEQ ID NO: 5228573 - DNA, 15 bp, Homo sapiens
agtcctccctgctca

SEQ ID NO: 5228574 - DNA, 16 bp, Homo sapiens
agtcctccctgctcag

SEQ ID NO: 5228575 - DNA, 21 bp, Homo sapiens
agtcctccctgctcagctggc

SEQ ID NO: 5228576 - DNA, 23 bp, Homo sapiens
agtcctccggttgcatactggac

SEQ ID NO: 5228577 - DNA, 13 bp, Homo sapiens
agtcctcctggga

SEQ ID NO: 5228578 - DNA, 17 bp, Homo sapiens
agtcctccttcccagct

SEQ ID NO: 5228579 - DNA, 18 bp, Homo sapiens
agtcctccttcccagctc

SEQ ID NO: 5228580 - DNA, 16 bp, Homo sapiens
agtcctcctttgcttg

SEQ ID NO: 5228581 - DNA, 18 bp, Homo sapiens
agtcctcgccccccgccc

SEQ ID NO: 5228582 - DNA, 16 bp, Homo sapiens
agtcctcggcagctcc

SEQ ID NO: 5228583 - DNA, 15 bp, Homo sapiens
agtcctcgtagccat

SEQ ID NO: 5228584 - DNA, 23 bp, Homo sapiens
agtcctctactttgctccgtgga

SEQ ID NO: 5228585 - DNA, 14 bp, Homo sapiens
agtcctctgcctcc

SEQ ID NO: 5228586 - DNA, 16 bp, Homo sapiens
agtcctctgctccagc

SEQ ID NO: 5228587 - DNA, 19 bp, Homo sapiens
agtcctctgctccagcaac

SEQ ID NO: 5228588 - DNA, 20 bp, Homo sapiens
agtcctctgggtaggaatca

SEQ ID NO: 5228589 - DNA, 22 bp, Homo sapiens
agtcctcttttctgagaggact

SEQ ID NO: 5228590 - DNA, 22 bp, Homo sapiens
agtcctgaagaggcgggccagc

SEQ ID NO: 5228591 - DNA, 14 bp, Homo sapiens
agtcctgaaggaca

SEQ ID NO: 5228592 - DNA, 13 bp, Homo sapiens
agtcctgactggg

SEQ ID NO: 5228593 - DNA, 20 bp, Homo sapiens
agtcctgactgggctgggtt

SEQ ID NO: 5228594 - DNA, 21 bp, Homo sapiens
agtcctgactgggctgggttt

SEQ ID NO: 5228595 - DNA, 15 bp, Homo sapiens
agtcctgaggagagg

SEQ ID NO: 5228596 - DNA, 21 bp, Homo sapiens
agtcctgagtgggtgttgcac

SEQ ID NO: 5228597 - DNA, 18 bp, Homo sapiens
agtcctgcagaggattta

SEQ ID NO: 5228598 - DNA, 23 bp, Homo sapiens
agtcctgcaggagtgctggcatt

SEQ ID NO: 5228599 - DNA, 20 bp, Homo sapiens
agtcctgccaccaccctgtc

SEQ ID NO: 5228600 - DNA, 21 bp, Homo sapiens
agtcctgccaccaccctgtct

SEQ ID NO: 5228601 - DNA, 20 bp, Homo sapiens
agtcctgccccccaccccac

SEQ ID NO: 5228602 - DNA, 11 bp, Homo sapiens
agtcctgcctg

SEQ ID NO: 5228603 - DNA, 12 bp, Homo sapiens
agtcctgcctga

SEQ ID NO: 5228604 - DNA, 13 bp, Homo sapiens
agtcctgcctggc

SEQ ID NO: 5228605 - DNA, 14 bp, Homo sapiens
agtcctgcctggcc

SEQ ID NO: 5228606 - DNA, 15 bp, Homo sapiens
agtcctgcctggcca

SEQ ID NO: 5228607 - DNA, 20 bp, Homo sapiens
agtcctgcctggccaggcag

SEQ ID NO: 5228608 - DNA, 11 bp, Homo sapiens
agtcctgcctt

SEQ ID NO: 5228609 - DNA, 15 bp, Homo sapiens
agtcctgctccagaa

SEQ ID NO: 5228610 - DNA, 23 bp, Homo sapiens
agtcctgctccagaatttggaaa

SEQ ID NO: 5228611 - DNA, 14 bp, Homo sapiens
agtcctgctctcta

SEQ ID NO: 5228612 - DNA, 20 bp, Homo sapiens
agtcctgctctctacccagc

SEQ ID NO: 5228613 - DNA, 12 bp, Homo sapiens
agtcctgctgcc

SEQ ID NO: 5228614 - DNA, 14 bp, Homo sapiens
agtcctgctgcctg

SEQ ID NO: 5228615 - DNA, 22 bp, Homo sapiens
agtcctgctggatcttgcctaa

SEQ ID NO: 5228616 - DNA, 15 bp, Homo sapiens
agtcctgctggcctg

SEQ ID NO: 5228617 - DNA, 19 bp, Homo sapiens
agtcctgctggcctgctct

SEQ ID NO: 5228618 - DNA, 14 bp, Homo sapiens
agtcctggaagcca

SEQ ID NO: 5228619 - DNA, 22 bp, Homo sapiens
agtcctggaagccagctttccc

SEQ ID NO: 5228620 - DNA, 18 bp, Homo sapiens
agtcctggaggcaggggg

SEQ ID NO: 5228621 - DNA, 15 bp, Homo sapiens
agtcctggcagctgg

SEQ ID NO: 5228622 - DNA, 19 bp, Homo sapiens
agtcctggcagctggacca

SEQ ID NO: 5228623 - DNA, 22 bp, Homo sapiens
agtcctggccattttcttgcct

SEQ ID NO: 5228624 - DNA, 23 bp, Homo sapiens
agtcctggccattttcttgcctg

SEQ ID NO: 5228625 - DNA, 21 bp, Homo sapiens
agtcctggcccttgatgccca

SEQ ID NO: 5228626 - DNA, 22 bp, Homo sapiens
agtcctggcccttgatgcccag

SEQ ID NO: 5228627 - DNA, 14 bp, Homo sapiens
agtcctggcctggc

SEQ ID NO: 5228628 - DNA, 18 bp, Homo sapiens
agtcctggcctggcttct

SEQ ID NO: 5228629 - DNA, 18 bp, Homo sapiens
agtcctggctacatccca

SEQ ID NO: 5228630 - DNA, 19 bp, Homo sapiens
agtcctggctacatcccag

SEQ ID NO: 5228631 - DNA, 14 bp, Homo sapiens
agtcctgggaggat

SEQ ID NO: 5228632 - DNA, 13 bp, Homo sapiens
agtcctgggaggt

SEQ ID NO: 5228633 - DNA, 10 bp, Homo sapiens
agtcctgggt

SEQ ID NO: 5228634 - DNA, 13 bp, Homo sapiens
agtcctggtcctg

SEQ ID NO: 5228635 - DNA, 14 bp, Homo sapiens
agtcctggtcctgg

SEQ ID NO: 5228636 - DNA, 15 bp, Homo sapiens
agtcctggtcctggc

SEQ ID NO: 5228637 - DNA, 12 bp, Homo sapiens
agtcctggtctg

SEQ ID NO: 5228638 - DNA, 16 bp, Homo sapiens
agtcctggtctgctca

SEQ ID NO: 5228639 - DNA, 17 bp, Homo sapiens
agtcctggtctgctcag

SEQ ID NO: 5228640 - DNA, 18 bp, Homo sapiens
agtcctggtctgctcagg

SEQ ID NO: 5228641 - DNA, 15 bp, Homo sapiens
agtcctggtggggct

SEQ ID NO: 5228642 - DNA, 23 bp, Homo sapiens
agtcctggttgtctgaacccagg

SEQ ID NO: 5228643 - DNA, 19 bp, Homo sapiens
agtcctggtttcctcagcc

SEQ ID NO: 5228644 - DNA, 12 bp, Homo sapiens
agtcctgtaatg

SEQ ID NO: 5228645 - DNA, 10 bp, Homo sapiens
agtcctgtat

SEQ ID NO: 5228646 - DNA, 22 bp, Homo sapiens
agtcctgtcagttcagaaaaaa

SEQ ID NO: 5228647 - DNA, 17 bp, Homo sapiens
agtcctgtctctgcctg

SEQ ID NO: 5228648 - DNA, 13 bp, Homo sapiens
agtcctgtgaatt

SEQ ID NO: 5228649 - DNA, 14 bp, Homo sapiens
agtcctgtgaattt

SEQ ID NO: 5228650 - DNA, 17 bp, Homo sapiens
agtcctgttctcagagc

SEQ ID NO: 5228651 - DNA, 15 bp, Homo sapiens
agtcctgttgaagac

SEQ ID NO: 5228652 - DNA, 19 bp, Homo sapiens
agtcctgttgaagacttcc

SEQ ID NO: 5228653 - DNA, 20 bp, Homo sapiens
agtcctgttgaagacttcct

SEQ ID NO: 5228654 - DNA, 23 bp, Homo sapiens
agtcctgttgaagacttcctctc

SEQ ID NO: 5228655 - DNA, 21 bp, Homo sapiens
agtccttaaaaatcacactgt

SEQ ID NO: 5228656 - DNA, 24 bp, Homo sapiens
agtccttaaaatgtaagattatag

SEQ ID NO: 5228657 - DNA, 22 bp, Homo sapiens
agtccttaagacggaagtaaat

SEQ ID NO: 5228658 - DNA, 15 bp, Homo sapiens
agtccttaagcagag

SEQ ID NO: 5228659 - DNA, 14 bp, Homo sapiens
agtccttacctcgg

SEQ ID NO: 5228660 - DNA, 20 bp, Homo sapiens
agtccttactgtctcactcg

SEQ ID NO: 5228661 - DNA, 14 bp, Homo sapiens
agtccttagcctgg

SEQ ID NO: 5228662 - DNA, 18 bp, Homo sapiens
agtccttagcctgggcct

SEQ ID NO: 5228663 - DNA, 22 bp, Homo sapiens
agtccttagcctgggcctcctc

SEQ ID NO: 5228664 - DNA, 19 bp, Homo sapiens
agtccttaggctactgtaa

SEQ ID NO: 5228665 - DNA, 19 bp, Homo sapiens
agtccttattatcccagct

SEQ ID NO: 5228666 - DNA, 18 bp, Homo sapiens
agtccttcagtttagaac

SEQ ID NO: 5228667 - DNA, 11 bp, Homo sapiens
agtccttccac

SEQ ID NO: 5228668 - DNA, 14 bp, Homo sapiens
agtccttcctggca

SEQ ID NO: 5228669 - DNA, 12 bp, Homo sapiens
agtccttgcttg

SEQ ID NO: 5228670 - DNA, 13 bp, Homo sapiens
agtccttgcttgg

SEQ ID NO: 5228671 - DNA, 14 bp, Homo sapiens
agtccttggcctgc

SEQ ID NO: 5228672 - DNA, 18 bp, Homo sapiens
agtccttggtctgctggt

SEQ ID NO: 5228673 - DNA, 14 bp, Homo sapiens
agtccttgtcttgt

SEQ ID NO: 5228674 - DNA, 22 bp, Homo sapiens
agtccttgtcttgtaattgtgg

SEQ ID NO: 5228675 - DNA, 16 bp, Homo sapiens
agtcctttaaattttg

SEQ ID NO: 5228676 - DNA, 22 bp, Homo sapiens
agtcctttcccaccattcctgc

SEQ ID NO: 5228677 - DNA, 16 bp, Homo sapiens
agtcctttctgccttg

SEQ ID NO: 5228678 - DNA, 19 bp, Homo sapiens
agtcctttctgccttggcc

SEQ ID NO: 5228679 - DNA, 17 bp, Homo sapiens
agtcctttgagctcctg

SEQ ID NO: 5228680 - DNA, 20 bp, Homo sapiens
agtcctttgatagaagataa

SEQ ID NO: 5228681 - DNA, 12 bp, Homo sapiens
agtcctttgtct

SEQ ID NO: 5228682 - DNA, 13 bp, Homo sapiens
agtcctttgtgaa

SEQ ID NO: 5228683 - DNA, 23 bp, Homo sapiens
agtccttttagcacatcactgag

SEQ ID NO: 5228684 - DNA, 12 bp, Homo sapiens
agtccttttctt

SEQ ID NO: 5228685 - DNA, 15 bp, Homo sapiens
agtccttttgtaaag

SEQ ID NO: 5228686 - DNA, 19 bp, Homo sapiens
agtcctttttgtaactacc

SEQ ID NO: 5228687 - DNA, 20 bp, Homo sapiens
agttcttatgaggaggggag

SEQ ID NO: 5228688 - DNA, 21 bp, Homo sapiens
agttcttatgaggaggggagg

SEQ ID NO: 5228689 - DNA, 12 bp, Homo sapiens
agttcttcctgc

SEQ ID NO: 5228690 - DNA, 22 bp, Homo sapiens
agttcttcctgcaaccactctg

SEQ ID NO: 5228691 - DNA, 15 bp, Homo sapiens
agttcttcgactgtt

SEQ ID NO: 5228692 - DNA, 18 bp, Homo sapiens
agttcttcgggaagagag

SEQ ID NO: 5228693 - DNA, 19 bp, Homo sapiens
agttcttcgggaagagagg

SEQ ID NO: 5228694 - DNA, 22 bp, Homo sapiens
agttcttcgggaagagaggagt

SEQ ID NO: 5228695 - DNA, 19 bp, Homo sapiens
agttcttctcaaaaaataa

SEQ ID NO: 5228696 - DNA, 13 bp, Homo sapiens
agttcttctcccg

SEQ ID NO: 5228697 - DNA, 15 bp, Homo sapiens
agttcttgaattgtt

SEQ ID NO: 5228698 - DNA, 19 bp, Homo sapiens
agttcttgaattgttatga

SEQ ID NO: 5228699 - DNA, 22 bp, Homo sapiens
agttcttgagtagatctgcttc

SEQ ID NO: 5228700 - DNA, 14 bp, Homo sapiens
agttcttgcaataa

SEQ ID NO: 5228701 - DNA, 19 bp, Homo sapiens
agttcttggtgactgtccc

SEQ ID NO: 5228702 - DNA, 20 bp, Homo sapiens
agttcttgtgcatgtttact

SEQ ID NO: 5228703 - DNA, 15 bp, Homo sapiens
agttctttaaactgt

SEQ ID NO: 5228704 - DNA, 20 bp, Homo sapiens
agttctttaggtgcctcctg

SEQ ID NO: 5228705 - DNA, 15 bp, Homo sapiens
agttctttcctcccc

SEQ ID NO: 5228706 - DNA, 21 bp, Homo sapiens
agttctttcctccccctgcaa

SEQ ID NO: 5228707 - DNA, 22 bp, Homo sapiens
agttctttcctccccctgcaac

SEQ ID NO: 5228708 - DNA, 15 bp, Homo sapiens
agttctttcctcttt

SEQ ID NO: 5228709 - DNA, 19 bp, Homo sapiens
agttctttcctctttctgc

SEQ ID NO: 5228710 - DNA, 16 bp, Homo sapiens
agttctttgattctgt

SEQ ID NO: 5228711 - DNA, 18 bp, Homo sapiens
agttctttgattctgtaa

SEQ ID NO: 5228712 - DNA, 17 bp, Homo sapiens
agttctttgatttgtac

SEQ ID NO: 5228713 - DNA, 18 bp, Homo sapiens
agttctttgatttgtacc

SEQ ID NO: 5228714 - DNA, 21 bp, Homo sapiens
agttctttgatttgtaccatt

SEQ ID NO: 5228715 - DNA, 22 bp, Homo sapiens
agttctttgatttgtaccattc

SEQ ID NO: 5228716 - DNA, 15 bp, Homo sapiens
agttctttgctgccc

SEQ ID NO: 5228717 - DNA, 21 bp, Homo sapiens
agttctttgctgcccctgtct

SEQ ID NO: 5228718 - DNA, 22 bp, Homo sapiens
agttctttggattctaaataca

SEQ ID NO: 5228719 - DNA, 14 bp, Homo sapiens
agttctttggctct

SEQ ID NO: 5228720 - DNA, 21 bp, Homo sapiens
agttctttgggccagacatgc

SEQ ID NO: 5228721 - DNA, 17 bp, Homo sapiens
agttctttgttcctgct

SEQ ID NO: 5228722 - DNA, 21 bp, Homo sapiens
agttctttgttcctgctttct

SEQ ID NO: 5228723 - DNA, 12 bp, Homo sapiens
agttctttttca

SEQ ID NO: 5228724 - DNA, 19 bp, Homo sapiens
agttctttttgaagtattt

SEQ ID NO: 5228725 - DNA, 14 bp, Homo sapiens
agttctttttgcca

SEQ ID NO: 5228726 - DNA, 20 bp, Homo sapiens
agttctttttgtacacttaa

SEQ ID NO: 5228727 - DNA, 16 bp, Homo sapiens
agttcttttttgtaca

SEQ ID NO: 5228728 - DNA, 22 bp, Homo sapiens
agttcttttttgtacagtattt

SEQ ID NO: 5228729 - DNA, 20 bp, Homo sapiens
agttgaaaaaagaagtttgg

SEQ ID NO: 5228730 - DNA, 19 bp, Homo sapiens
agttgaaaagactccaaag

SEQ ID NO: 5228731 - DNA, 22 bp, Homo sapiens
agttgaaaagactccaaagaaa

SEQ ID NO: 5228732 - DNA, 15 bp, Homo sapiens
agttgaaaagccaaa

SEQ ID NO: 5228733 - DNA, 22 bp, Homo sapiens
agttgaaaagccaaaggtcaaa

SEQ ID NO: 5228734 - DNA, 16 bp, Homo sapiens
agttgaaaataaagtg

SEQ ID NO: 5228735 - DNA, 18 bp, Homo sapiens
agttgaaaataaagtgta

SEQ ID NO: 5228736 - DNA, 12 bp, Homo sapiens
agttgaaaatac

SEQ ID NO: 5228737 - DNA, 18 bp, Homo sapiens
agttgaaaatgcaactct

SEQ ID NO: 5228738 - DNA, 20 bp, Homo sapiens
agttgaaaatggatttttaa

SEQ ID NO: 5228739 - DNA, 19 bp, Homo sapiens
agttgaaatgttctgtcaa

SEQ ID NO: 5228740 - DNA, 20 bp, Homo sapiens
agttgaacactagtctgtgt

SEQ ID NO: 5228741 - DNA, 13 bp, Homo sapiens
agttgaacagagg

SEQ ID NO: 5228742 - DNA, 19 bp, Homo sapiens
agttgaaccattatacttt

SEQ ID NO: 5228743 - DNA, 21 bp, Homo sapiens
agttgaacctgatgagcaaga

SEQ ID NO: 5228744 - DNA, 16 bp, Homo sapiens
agttgaaccttacagt

SEQ ID NO: 5228745 - DNA, 14 bp, Homo sapiens
agttgaagacagag

SEQ ID NO: 5228746 - DNA, 20 bp, Homo sapiens
agttgaaggttaaaggaaaa

SEQ ID NO: 5228747 - DNA, 15 bp, Homo sapiens
agttgaagtcatgct

SEQ ID NO: 5228748 - DNA, 17 bp, Homo sapiens
agttgaagtcatgctcc

SEQ ID NO: 5228749 - DNA, 17 bp, Homo sapiens
agttgaagttagtggaa

SEQ ID NO: 5228750 - DNA, 19 bp, Homo sapiens
agttgaagttagtggaaat

SEQ ID NO: 5228751 - DNA, 15 bp, Homo sapiens
agttgaagtttagga

SEQ ID NO: 5228752 - DNA, 13 bp, Homo sapiens
agttgaataaaca

SEQ ID NO: 5228753 - DNA, 22 bp, Homo sapiens
agttgaataaacataaaagcta

SEQ ID NO: 5228754 - DNA, 18 bp, Homo sapiens
agttgaatacttgaacca

SEQ ID NO: 5228755 - DNA, 17 bp, Homo sapiens
agttgaatataagaaaa

SEQ ID NO: 5228756 - DNA, 22 bp, Homo sapiens
agttgaatataagaaaatgctt

SEQ ID NO: 5228757 - DNA, 13 bp, Homo sapiens
agttgaatattat

SEQ ID NO: 5228758 - DNA, 19 bp, Homo sapiens
agttgaatgacaacagaag

SEQ ID NO: 5228759 - DNA, 15 bp, Homo sapiens
agttgaatgataata

SEQ ID NO: 5228760 - DNA, 15 bp, Homo sapiens
agttgaattccaagt

SEQ ID NO: 5228761 - DNA, 19 bp, Homo sapiens
agttgaattccaagtgtat

SEQ ID NO: 5228762 - DNA, 23 bp, Homo sapiens
agttgaattgaggggattaatat

SEQ ID NO: 5228763 - DNA, 18 bp, Homo sapiens
agttgaatttcagtcctt

SEQ ID NO: 5228764 - DNA, 22 bp, Homo sapiens
agttgaattttttctaaaaaga

SEQ ID NO: 5228765 - DNA, 22 bp, Homo sapiens
agttgacaaaaagctcttacac

SEQ ID NO: 5228766 - DNA, 19 bp, Homo sapiens
agttgacaacctagaatgt

SEQ ID NO: 5228767 - DNA, 17 bp, Homo sapiens
agttgacagaatggtgc

SEQ ID NO: 5228768 - DNA, 13 bp, Homo sapiens
agttgacagtatt

SEQ ID NO: 5228769 - DNA, 14 bp, Homo sapiens
agttgacagtgaaa

SEQ ID NO: 5228770 - DNA, 17 bp, Homo sapiens
agttgacatgagattta

SEQ ID NO: 5228771 - DNA, 17 bp, Homo sapiens
agttgacatgggtgggg

SEQ ID NO: 5228772 - DNA, 20 bp, Homo sapiens
agttgaccaactatattgcg

SEQ ID NO: 5228773 - DNA, 17 bp, Homo sapiens
agttgacctttatttat

SEQ ID NO: 5228774 - DNA, 16 bp, Homo sapiens
agttgactaatgaggc

SEQ ID NO: 5228775 - DNA, 17 bp, Homo sapiens
agttgactgactgagca

SEQ ID NO: 5228776 - DNA, 16 bp, Homo sapiens
agttgacttactgttt

SEQ ID NO: 5228777 - DNA, 20 bp, Homo sapiens
agttgacttactgtttctta

SEQ ID NO: 5228778 - DNA, 18 bp, Homo sapiens
agttgacttatagtacat

SEQ ID NO: 5228779 - DNA, 18 bp, Homo sapiens
agttgacttcaaatgtgt

SEQ ID NO: 5228780 - DNA, 20 bp, Homo sapiens
agttgacttcaaatgtgtaa

SEQ ID NO: 5228781 - DNA, 21 bp, Homo sapiens
agttgacttcaaatgtgtaac

SEQ ID NO: 5228782 - DNA, 15 bp, Homo sapiens
agttgacttctgaca

SEQ ID NO: 5228783 - DNA, 22 bp, Homo sapiens
agttgacttgacagaacactgt

SEQ ID NO: 5228784 - DNA, 17 bp, Homo sapiens
agttgactttctccctg

SEQ ID NO: 5228785 - DNA, 14 bp, Homo sapiens
agttgagaaggtgc

SEQ ID NO: 5228786 - DNA, 18 bp, Homo sapiens
agttgagaaggtgcctgc

SEQ ID NO: 5228787 - DNA, 14 bp, Homo sapiens
agttgagacaagaa

SEQ ID NO: 5228788 - DNA, 17 bp, Homo sapiens
agttgagacaagaaaat

SEQ ID NO: 5228789 - DNA, 23 bp, Homo sapiens
agttgagagacagtaacacaatt

SEQ ID NO: 5228790 - DNA, 18 bp, Homo sapiens
agttgagatagttttcat

SEQ ID NO: 5228791 - DNA, 22 bp, Homo sapiens
agttgagattcaaacccaggct

SEQ ID NO: 5228792 - DNA, 17 bp, Homo sapiens
agttgagattgtactgt

SEQ ID NO: 5228793 - DNA, 20 bp, Homo sapiens
agttgagatttttaagaact

SEQ ID NO: 5228794 - DNA, 21 bp, Homo sapiens
agttgagatttttaagaactt

SEQ ID NO: 5228795 - DNA, 13 bp, Homo sapiens
agttgagcacagg

SEQ ID NO: 5228796 - DNA, 16 bp, Homo sapiens
agttgagccagcagac

SEQ ID NO: 5228797 - DNA, 20 bp, Homo sapiens
agttgagccagcagacattg

SEQ ID NO: 5228798 - DNA, 16 bp, Homo sapiens
agttgagccccaagtc

SEQ ID NO: 5228799 - DNA, 17 bp, Homo sapiens
agttgagctatgactta

SEQ ID NO: 5228800 - DNA, 18 bp, Homo sapiens
agttgagctatgacttaa

SEQ ID NO: 5228801 - DNA, 16 bp, Homo sapiens
agttgaggaactgtac

SEQ ID NO: 5228802 - DNA, 18 bp, Homo sapiens
agttgaggaactgtacag

SEQ ID NO: 5228803 - DNA, 13 bp, Homo sapiens
agttgaggccact

SEQ ID NO: 5228804 - DNA, 21 bp, Homo sapiens
agttgagggaaacccccagcc

SEQ ID NO: 5228805 - DNA, 16 bp, Homo sapiens
agttgaggggagagga

SEQ ID NO: 5228806 - DNA, 19 bp, Homo sapiens
agttgaggggagcatgctt

SEQ ID NO: 5228807 - DNA, 19 bp, Homo sapiens
agttgaggtggggtagtgc

SEQ ID NO: 5228808 - DNA, 22 bp, Homo sapiens
agttgagtgggtatttcttatt

SEQ ID NO: 5228809 - DNA, 19 bp, Homo sapiens
agttgataacccctcttag

SEQ ID NO: 5228810 - DNA, 16 bp, Homo sapiens
agttgatactacagtt

SEQ ID NO: 5228811 - DNA, 19 bp, Homo sapiens
agttgatagcacagaccct

SEQ ID NO: 5228812 - DNA, 22 bp, Homo sapiens
agttgatataaaactctgggtc

SEQ ID NO: 5228813 - DNA, 23 bp, Homo sapiens
agttgatataaaactctgggtct

SEQ ID NO: 5228814 - DNA, 21 bp, Homo sapiens
agttgatatgttttatttcat

SEQ ID NO: 5228815 - DNA, 22 bp, Homo sapiens
agttgatatgttttatttcatt

SEQ ID NO: 5228816 - DNA, 13 bp, Homo sapiens
agttgatattcaa

SEQ ID NO: 5228817 - DNA, 14 bp, Homo sapiens
agttgatcatgcag

SEQ ID NO: 5228818 - DNA, 21 bp, Homo sapiens
agttgatctgaaattcctctg

SEQ ID NO: 5228819 - DNA, 18 bp, Homo sapiens
agttgatctggaacccag

SEQ ID NO: 5228820 - DNA, 23 bp, Homo sapiens
agttgatctggaacccagactca

SEQ ID NO: 5228821 - DNA, 23 bp, Homo sapiens
agttgatgaccaatctctgtgac

SEQ ID NO: 5228822 - DNA, 16 bp, Homo sapiens
agttgatgactttctg

SEQ ID NO: 5228823 - DNA, 14 bp, Homo sapiens
agttgatgtatcca

SEQ ID NO: 5228824 - DNA, 16 bp, Homo sapiens
agttgatgtatggtat

SEQ ID NO: 5228825 - DNA, 22 bp, Homo sapiens
agttgatgtgggaagaagtaaa

SEQ ID NO: 5228826 - DNA, 15 bp, Homo sapiens
agttgatgtgtcttt

SEQ ID NO: 5228827 - DNA, 13 bp, Homo sapiens
agttgattcagct

SEQ ID NO: 5228828 - DNA, 23 bp, Homo sapiens
agttgattccttgagtttcatat

SEQ ID NO: 5228829 - DNA, 20 bp, Homo sapiens
agttgattctgaatctgaaa

SEQ ID NO: 5228830 - DNA, 23 bp, Homo sapiens
agttgattctgtcccccacgtgg

SEQ ID NO: 5228831 - DNA, 19 bp, Homo sapiens
agttgattgcgagaatttt

SEQ ID NO: 5228832 - DNA, 18 bp, Homo sapiens
agttgatttaaactctta

SEQ ID NO: 5228833 - DNA, 23 bp, Homo sapiens
agttgattttacaattgaaatga

SEQ ID NO: 5228834 - DNA, 19 bp, Homo sapiens
agttgattttgaacttttt

SEQ ID NO: 5228835 - DNA, 13 bp, Homo sapiens
agttgatttttct

SEQ ID NO: 5228836 - DNA, 18 bp, Homo sapiens
agttgcaataaaatagta

SEQ ID NO: 5228837 - DNA, 21 bp, Homo sapiens
agttgcaataaactcagtcaa

SEQ ID NO: 5228838 - DNA, 14 bp, Homo sapiens
agttgcaataatac

SEQ ID NO: 5228839 - DNA, 22 bp, Homo sapiens
agttgcaataatacttctcaaa

SEQ ID NO: 5228840 - DNA, 19 bp, Homo sapiens
agttgcaatcgtaatgtac

SEQ ID NO: 5228841 - DNA, 11 bp, Homo sapiens
agttgcacagc

SEQ ID NO: 5228842 - DNA, 14 bp, Homo sapiens
agttgcacagcatc

SEQ ID NO: 5228843 - DNA, 11 bp, Homo sapiens
agttgcacatg

SEQ ID NO: 5228844 - DNA, 19 bp, Homo sapiens
agttgcacatgattgtata

SEQ ID NO: 5228845 - DNA, 19 bp, Homo sapiens
agttgcaccattctttctt

SEQ ID NO: 5228846 - DNA, 16 bp, Homo sapiens
agttgcactaactgct

SEQ ID NO: 5228847 - DNA, 13 bp, Homo sapiens
agttgcactacat

SEQ ID NO: 5228848 - DNA, 11 bp, Homo sapiens
agttgcagaaa

SEQ ID NO: 5228849 - DNA, 15 bp, Homo sapiens
agttgcagaaaatga

SEQ ID NO: 5228850 - DNA, 17 bp, Homo sapiens
agttgcagaaaatgaac

SEQ ID NO: 5228851 - DNA, 17 bp, Homo sapiens
agttgcagactcagttt

SEQ ID NO: 5228852 - DNA, 22 bp, Homo sapiens
agttgcagactcagtttgtcag

SEQ ID NO: 5228853 - DNA, 15 bp, Homo sapiens
agttgcagatgtatt

SEQ ID NO: 5228854 - DNA, 15 bp, Homo sapiens
agttgcagcccaagg

SEQ ID NO: 5228855 - DNA, 19 bp, Homo sapiens
agttgcagcccaaggacag

SEQ ID NO: 5228856 - DNA, 20 bp, Homo sapiens
agttgcagcccaaggacagt

SEQ ID NO: 5228857 - DNA, 15 bp, Homo sapiens
agttgcagctgtttt

SEQ ID NO: 5228858 - DNA, 21 bp, Homo sapiens
agttgcagctgttttgttgac

SEQ ID NO: 5228859 - DNA, 22 bp, Homo sapiens
agttgcagctgttttgttgaca

SEQ ID NO: 5228860 - DNA, 23 bp, Homo sapiens
agttgcaggtaattttttgtctg

SEQ ID NO: 5228861 - DNA, 13 bp, Homo sapiens
agttgcagtctca

SEQ ID NO: 5228862 - DNA, 13 bp, Homo sapiens
agttgcagtgagc

SEQ ID NO: 5228863 - DNA, 21 bp, Homo sapiens
agtcctttttttccatcttta

SEQ ID NO: 5228864 - DNA, 14 bp, Homo sapiens
agtcgaaggatgct

SEQ ID NO: 5228865 - DNA, 15 bp, Homo sapiens
agtcgaaggatgctc

SEQ ID NO: 5228866 - DNA, 21 bp, Homo sapiens
agtcgaaggatgctctttccc

SEQ ID NO: 5228867 - DNA, 21 bp, Homo sapiens
agtcgaccgcacttatggtaa

SEQ ID NO: 5228868 - DNA, 16 bp, Homo sapiens
agtcgagattgcactg

SEQ ID NO: 5228869 - DNA, 16 bp, Homo sapiens
agtcgagcactctaat

SEQ ID NO: 5228870 - DNA, 14 bp, Homo sapiens
agtcgagccctgca

SEQ ID NO: 5228871 - DNA, 13 bp, Homo sapiens
agtcgaggctggt

SEQ ID NO: 5228872 - DNA, 13 bp, Homo sapiens
agtcgatattccc

SEQ ID NO: 5228873 - DNA, 15 bp, Homo sapiens
agtcgatgaactatt

SEQ ID NO: 5228874 - DNA, 18 bp, Homo sapiens
agtcgattaacctgcatg

SEQ ID NO: 5228875 - DNA, 17 bp, Homo sapiens
agtcgcagaccagagct

SEQ ID NO: 5228876 - DNA, 16 bp, Homo sapiens
agtcgcccctcagagc

SEQ ID NO: 5228877 - DNA, 18 bp, Homo sapiens
agtcgcccctcagagcat

SEQ ID NO: 5228878 - DNA, 17 bp, Homo sapiens
agtcgccctctgtgcct

SEQ ID NO: 5228879 - DNA, 14 bp, Homo sapiens
agtcgcgctgcctg

SEQ ID NO: 5228880 - DNA, 19 bp, Homo sapiens
agtcgctctcatgaagccc

SEQ ID NO: 5228881 - DNA, 19 bp, Homo sapiens
agtcgctgaacaattacct

SEQ ID NO: 5228882 - DNA, 15 bp, Homo sapiens
agtcgctgaggaaaa

SEQ ID NO: 5228883 - DNA, 22 bp, Homo sapiens
agtcgctggcatgtttcactcc

SEQ ID NO: 5228884 - DNA, 17 bp, Homo sapiens
agtcgcttgccaaagca

SEQ ID NO: 5228885 - DNA, 18 bp, Homo sapiens
agtcgcttgccaaagcag

SEQ ID NO: 5228886 - DNA, 21 bp, Homo sapiens
agtcgcttttgccttttcaaa

SEQ ID NO: 5228887 - DNA, 22 bp, Homo sapiens
agtcggaaaagcgtctttaaga

SEQ ID NO: 5228888 - DNA, 15 bp, Homo sapiens
agtcggagtggacac

SEQ ID NO: 5228889 - DNA, 17 bp, Homo sapiens
agtcggagtggacaccg

SEQ ID NO: 5228890 - DNA, 16 bp, Homo sapiens
agtcggatctagccat

SEQ ID NO: 5228891 - DNA, 18 bp, Homo sapiens
agtcggatctagccatgg

SEQ ID NO: 5228892 - DNA, 14 bp, Homo sapiens
agtcggcatgccag

SEQ ID NO: 5228893 - DNA, 15 bp, Homo sapiens
agtcggcatgccagg

SEQ ID NO: 5228894 - DNA, 19 bp, Homo sapiens
agtcgggatgtcagcagac

SEQ ID NO: 5228895 - DNA, 16 bp, Homo sapiens
agtcgggcatgagtct

SEQ ID NO: 5228896 - DNA, 17 bp, Homo sapiens
agtcgggcatgagtctg

SEQ ID NO: 5228897 - DNA, 14 bp, Homo sapiens
agtcggggcaggcc

SEQ ID NO: 5228898 - DNA, 18 bp, Homo sapiens
agtcggggcaggccaggg

SEQ ID NO: 5228899 - DNA, 16 bp, Homo sapiens
agtcgggggctggcct

SEQ ID NO: 5228900 - DNA, 20 bp, Homo sapiens
agtcgggggctggcctagga

SEQ ID NO: 5228901 - DNA, 15 bp, Homo sapiens
agtcggtctgctttg

SEQ ID NO: 5228902 - DNA, 17 bp, Homo sapiens
agtcggtgaccccatca

SEQ ID NO: 5228903 - DNA, 13 bp, Homo sapiens
agtcgtaagggtt

SEQ ID NO: 5228904 - DNA, 18 bp, Homo sapiens
agtcgtcagcctccctga

SEQ ID NO: 5228905 - DNA, 22 bp, Homo sapiens
agtcgtcatcacttttcagtga

SEQ ID NO: 5228906 - DNA, 17 bp, Homo sapiens
agtcgtccttactcctg

SEQ ID NO: 5228907 - DNA, 18 bp, Homo sapiens
agtcgtcgcacagtctct

SEQ ID NO: 5228908 - DNA, 13 bp, Homo sapiens
agtcgtgatgtgg

SEQ ID NO: 5228909 - DNA, 14 bp, Homo sapiens
agtcgtgatgtgga

SEQ ID NO: 5228910 - DNA, 21 bp, Homo sapiens
agtcgtggctttggcagtgtt

SEQ ID NO: 5228911 - DNA, 19 bp, Homo sapiens
agtcgtggggtgtgctggg

SEQ ID NO: 5228912 - DNA, 17 bp, Homo sapiens
agtcgttttagtgtctg

SEQ ID NO: 5228913 - DNA, 17 bp, Homo sapiens
agtctaaaaagacctgg

SEQ ID NO: 5228914 - DNA, 20 bp, Homo sapiens
agtctaaacaatgaattctt

SEQ ID NO: 5228915 - DNA, 19 bp, Homo sapiens
agtctaaaccaagattatg

SEQ ID NO: 5228916 - DNA, 23 bp, Homo sapiens
agtctaaagatggagtttctaag

SEQ ID NO: 5228917 - DNA, 13 bp, Homo sapiens
agtctaaagttta

SEQ ID NO: 5228918 - DNA, 15 bp, Homo sapiens
agtctaaagttttat

SEQ ID NO: 5228919 - DNA, 23 bp, Homo sapiens
agtctaacaactgcccagtttcc

SEQ ID NO: 5228920 - DNA, 23 bp, Homo sapiens
agtctaacatattcaatgcaagt

SEQ ID NO: 5228921 - DNA, 12 bp, Homo sapiens
agtctaaccaaa

SEQ ID NO: 5228922 - DNA, 13 bp, Homo sapiens
agtctaaccaaat

SEQ ID NO: 5228923 - DNA, 14 bp, Homo sapiens
agtctaaccaaatg

SEQ ID NO: 5228924 - DNA, 20 bp, Homo sapiens
agtctaacttttttttactt

SEQ ID NO: 5228925 - DNA, 18 bp, Homo sapiens
agtctaagtaagtgtctg

SEQ ID NO: 5228926 - DNA, 17 bp, Homo sapiens
agtctaatttttattca

SEQ ID NO: 5228927 - DNA, 23 bp, Homo sapiens
agtctacagtactgacagaaagc

SEQ ID NO: 5228928 - DNA, 21 bp, Homo sapiens
agtctaccaacctgttcaagt

SEQ ID NO: 5228929 - DNA, 14 bp, Homo sapiens
agtctacccagaga

SEQ ID NO: 5228930 - DNA, 16 bp, Homo sapiens
agtctaccctgtcctt

SEQ ID NO: 5228931 - DNA, 22 bp, Homo sapiens
agtctacctgccttgcctgtta

SEQ ID NO: 5228932 - DNA, 13 bp, Homo sapiens
agtctacctgctg

SEQ ID NO: 5228933 - DNA, 14 bp, Homo sapiens
agtctacctgctgg

SEQ ID NO: 5228934 - DNA, 23 bp, Homo sapiens
agtctacctgctggacagcctcc

SEQ ID NO: 5228935 - DNA, 15 bp, Homo sapiens
agtctacgttctcca

SEQ ID NO: 5228936 - DNA, 18 bp, Homo sapiens
agtctactcttaagccat

SEQ ID NO: 5228937 - DNA, 20 bp, Homo sapiens
agtctactcttaagccatct

SEQ ID NO: 5228938 - DNA, 14 bp, Homo sapiens
agtctacttctgtg

SEQ ID NO: 5228939 - DNA, 16 bp, Homo sapiens
agtctagaaaataatg

SEQ ID NO: 5228940 - DNA, 14 bp, Homo sapiens
agtctagattcaaa

SEQ ID NO: 5228941 - DNA, 16 bp, Homo sapiens
agtctagattctctgg

SEQ ID NO: 5228942 - DNA, 19 bp, Homo sapiens
agtctagcacagttccttg

SEQ ID NO: 5228943 - DNA, 16 bp, Homo sapiens
agtctagcattctgca

SEQ ID NO: 5228944 - DNA, 23 bp, Homo sapiens
agtctagcgtagtgcagcagggc

SEQ ID NO: 5228945 - DNA, 20 bp, Homo sapiens
agtctaggagctgggaggaa

SEQ ID NO: 5228946 - DNA, 19 bp, Homo sapiens
agtctagtacttattacat

SEQ ID NO: 5228947 - DNA, 15 bp, Homo sapiens
agtctagtcagtgta

SEQ ID NO: 5228948 - DNA, 15 bp, Homo sapiens
agtctagtgaagatg

SEQ ID NO: 5228949 - DNA, 19 bp, Homo sapiens
agtctagttattggatcag

SEQ ID NO: 5228950 - DNA, 17 bp, Homo sapiens
agtctagttcctgatga

SEQ ID NO: 5228951 - DNA, 14 bp, Homo sapiens
agtctatagaaatg

SEQ ID NO: 5228952 - DNA, 17 bp, Homo sapiens
agtctatagatgcctct

SEQ ID NO: 5228953 - DNA, 21 bp, Homo sapiens
agtctatatggttctccaaga

SEQ ID NO: 5228954 - DNA, 19 bp, Homo sapiens
agtctatcaacattgaata

SEQ ID NO: 5228955 - DNA, 14 bp, Homo sapiens
agtctatccacaga

SEQ ID NO: 5228956 - DNA, 15 bp, Homo sapiens
agtctatccacagag

SEQ ID NO: 5228957 - DNA, 16 bp, Homo sapiens
agtctatccacagaga

SEQ ID NO: 5228958 - DNA, 17 bp, Homo sapiens
agtctatgctgtgtgca

SEQ ID NO: 5228959 - DNA, 13 bp, Homo sapiens
agtctatgcttaa

SEQ ID NO: 5228960 - DNA, 19 bp, Homo sapiens
agtctatgttttaaaataa

SEQ ID NO: 5228961 - DNA, 15 bp, Homo sapiens
agtctattgtttgtt

SEQ ID NO: 5228962 - DNA, 20 bp, Homo sapiens
agtctatttacggaactcaa

SEQ ID NO: 5228963 - DNA, 21 bp, Homo sapiens
agtctatttccactgaacaaa

SEQ ID NO: 5228964 - DNA, 22 bp, Homo sapiens
agtctatttccactgaacaaaa

SEQ ID NO: 5228965 - DNA, 18 bp, Homo sapiens
agtctatttccattcttt

SEQ ID NO: 5228966 - DNA, 17 bp, Homo sapiens
agtctattttattatga

SEQ ID NO: 5228967 - DNA, 11 bp, Homo sapiens
agtctattttt

SEQ ID NO: 5228968 - DNA, 14 bp, Homo sapiens
agtctatttttaat

SEQ ID NO: 5228969 - DNA, 20 bp, Homo sapiens
agtctatttttgtacaaaag

SEQ ID NO: 5228970 - DNA, 21 bp, Homo sapiens
agtctatttttttaactgaaa

SEQ ID NO: 5228971 - DNA, 15 bp, Homo sapiens
agtctcaaataataa

SEQ ID NO: 5228972 - DNA, 17 bp, Homo sapiens
agtctcaacatgtgttt

SEQ ID NO: 5228973 - DNA, 21 bp, Homo sapiens
agtctcaacatgtgtttctga

SEQ ID NO: 5228974 - DNA, 22 bp, Homo sapiens
agtctcaacatgtgtttctgac

SEQ ID NO: 5228975 - DNA, 23 bp, Homo sapiens
agtctcaacatgtgtttctgaca

SEQ ID NO: 5228976 - DNA, 20 bp, Homo sapiens
agtctcaagcactaaaaagt

SEQ ID NO: 5228977 - DNA, 16 bp, Homo sapiens
agtctcaagggtggca

SEQ ID NO: 5228978 - DNA, 18 bp, Homo sapiens
agtctcaagggtggcagg

SEQ ID NO: 5228979 - DNA, 19 bp, Homo sapiens
agtctcaagggtggcaggt

SEQ ID NO: 5228980 - DNA, 17 bp, Homo sapiens
agtctcaataaactgaa

SEQ ID NO: 5228981 - DNA, 16 bp, Homo sapiens
agtctcaatgaaatag

SEQ ID NO: 5228982 - DNA, 16 bp, Homo sapiens
agtctcaatgttccat

SEQ ID NO: 5228983 - DNA, 21 bp, Homo sapiens
agtctcaattctgaaggggaa

SEQ ID NO: 5228984 - DNA, 16 bp, Homo sapiens
agtctcaattttgtat

SEQ ID NO: 5228985 - DNA, 21 bp, Homo sapiens
agtctcaattttgtatttaat

SEQ ID NO: 5228986 - DNA, 20 bp, Homo sapiens
agtctcacactgtttttcat

SEQ ID NO: 5228987 - DNA, 22 bp, Homo sapiens
agtctcacagagaagctcctgc

SEQ ID NO: 5228988 - DNA, 24 bp, Homo sapiens
agtctcacatgattccagccatca

SEQ ID NO: 5228989 - DNA, 20 bp, Homo sapiens
agtctcaccatttccccagg

SEQ ID NO: 5228990 - DNA, 13 bp, Homo sapiens
agtctcacccact

SEQ ID NO: 5228991 - DNA, 17 bp, Homo sapiens
agtctcacctgccggct

SEQ ID NO: 5228992 - DNA, 17 bp, Homo sapiens
agtctcactagcacatg

SEQ ID NO: 5228993 - DNA, 23 bp, Homo sapiens
agtctcactctcgtcgcccaggc

SEQ ID NO: 5228994 - DNA, 16 bp, Homo sapiens
agtctcactcttgtca

SEQ ID NO: 5228995 - DNA, 19 bp, Homo sapiens
agtctcactgttgcccagg

SEQ ID NO: 5228996 - DNA, 21 bp, Homo sapiens
agtctcactgttgcccaggct

SEQ ID NO: 5228997 - DNA, 19 bp, Homo sapiens
agtctcactttgtcgccca

SEQ ID NO: 5228998 - DNA, 19 bp, Homo sapiens
agtctcagaaactcccctg

SEQ ID NO: 5228999 - DNA, 18 bp, Homo sapiens
agtctcagaaagccttcc

SEQ ID NO: 5229000 - DNA, 19 bp, Homo sapiens
agtctcagaatgtcatttt

SEQ ID NO: 5229001 - DNA, 16 bp, Homo sapiens
agtctcagagcacaga

SEQ ID NO: 5229002 - DNA, 11 bp, Homo sapiens
agtctcagcta

SEQ ID NO: 5229003 - DNA, 18 bp, Homo sapiens
agtctcagctaagctcac

SEQ ID NO: 5229004 - DNA, 13 bp, Homo sapiens
agtctcagctgct

SEQ ID NO: 5229005 - DNA, 16 bp, Homo sapiens
agtctcagctgctgaa

SEQ ID NO: 5229006 - DNA, 13 bp, Homo sapiens
agtctcaggagga

SEQ ID NO: 5229007 - DNA, 23 bp, Homo sapiens
agtctcaggccctgaaggttcct

SEQ ID NO: 5229008 - DNA, 13 bp, Homo sapiens
agtctcagtccag

SEQ ID NO: 5229009 - DNA, 22 bp, Homo sapiens
agtctcagtccagatgccttcc

SEQ ID NO: 5229010 - DNA, 19 bp, Homo sapiens
agtctcagtggcttcatct

SEQ ID NO: 5229011 - DNA, 20 bp, Homo sapiens
agtctcagtttgtgtgtctt

SEQ ID NO: 5229012 - DNA, 20 bp, Homo sapiens
agtctcataggttaaaaaaa

SEQ ID NO: 5229013 - DNA, 16 bp, Homo sapiens
agtctcatatcaggga

SEQ ID NO: 5229014 - DNA, 15 bp, Homo sapiens
agtctcatcctccca

SEQ ID NO: 5229015 - DNA, 13 bp, Homo sapiens
agtctcatctcct

SEQ ID NO: 5229016 - DNA, 17 bp, Homo sapiens
agtctcatctcctgacc

SEQ ID NO: 5229017 - DNA, 21 bp, Homo sapiens
agtctcatgccttgagatctg

SEQ ID NO: 5229018 - DNA, 15 bp, Homo sapiens
agtctcatgggaagc

SEQ ID NO: 5229019 - DNA, 21 bp, Homo sapiens
agtctcattcgcctttgtctt

SEQ ID NO: 5229020 - DNA, 16 bp, Homo sapiens
agtctcattgtcacct

SEQ ID NO: 5229021 - DNA, 17 bp, Homo sapiens
agtctcatttgggctag

SEQ ID NO: 5229022 - DNA, 21 bp, Homo sapiens
agtctcattttcatcttcttc

SEQ ID NO: 5229023 - DNA, 14 bp, Homo sapiens
agtctccaatccca

SEQ ID NO: 5229024 - DNA, 14 bp, Homo sapiens
agtctccaccagga

SEQ ID NO: 5229025 - DNA, 21 bp, Homo sapiens
agtctccactttctcaatgct

SEQ ID NO: 5229026 - DNA, 17 bp, Homo sapiens
agtctccagaagaaaat

SEQ ID NO: 5229027 - DNA, 21 bp, Homo sapiens
agtctccagagagaaatcagg

SEQ ID NO: 5229028 - DNA, 14 bp, Homo sapiens
agtctccagataga

SEQ ID NO: 5229029 - DNA, 11 bp, Homo sapiens
agtctccaggg

SEQ ID NO: 5229030 - DNA, 23 bp, Homo sapiens
agtctccagggacccttgcctgc

SEQ ID NO: 5229031 - DNA, 19 bp, Homo sapiens
agtctccagtggttgctgt

SEQ ID NO: 5229032 - DNA, 22 bp, Homo sapiens
agtctccagtggttgctgttga

SEQ ID NO: 5229033 - DNA, 13 bp, Homo sapiens
agtctcccaaggc

SEQ ID NO: 5229034 - DNA, 14 bp, Homo sapiens
agtctcccaaggct

SEQ ID NO: 5229035 - DNA, 19 bp, Homo sapiens
agtctcccaggccccctgc

SEQ ID NO: 5229036 - DNA, 13 bp, Homo sapiens
agtctcccaggga

SEQ ID NO: 5229037 - DNA, 14 bp, Homo sapiens
agtctcccagggag

SEQ ID NO: 5229038 - DNA, 13 bp, Homo sapiens
agtctcccattct

SEQ ID NO: 5229039 - DNA, 15 bp, Homo sapiens
agtctcccattctca

SEQ ID NO: 5229040 - DNA, 13 bp, Homo sapiens
agtctccccagat

SEQ ID NO: 5229041 - DNA, 13 bp, Homo sapiens
agtctccccttcc

SEQ ID NO: 5229042 - DNA, 14 bp, Homo sapiens
agttgcagtgagca

SEQ ID NO: 5229043 - DNA, 15 bp, Homo sapiens
agttgcagtgagcag

SEQ ID NO: 5229044 - DNA, 16 bp, Homo sapiens
agttgcagtgagcagg

SEQ ID NO: 5229045 - DNA, 14 bp, Homo sapiens
agttgcagttttta

SEQ ID NO: 5229046 - DNA, 17 bp, Homo sapiens
agttgcatagcagtata

SEQ ID NO: 5229047 - DNA, 18 bp, Homo sapiens
agttgcatagcagtatat

SEQ ID NO: 5229048 - DNA, 17 bp, Homo sapiens
agttgcatgaccacata

SEQ ID NO: 5229049 - DNA, 22 bp, Homo sapiens
agttgcatgctagcatgggtat

SEQ ID NO: 5229050 - DNA, 15 bp, Homo sapiens
agttgcatgtagtaa

SEQ ID NO: 5229051 - DNA, 19 bp, Homo sapiens
agttgcatgtagtaacact

SEQ ID NO: 5229052 - DNA, 16 bp, Homo sapiens
agttgcattagtaact

SEQ ID NO: 5229053 - DNA, 18 bp, Homo sapiens
agttgcatttagaaatca

SEQ ID NO: 5229054 - DNA, 18 bp, Homo sapiens
agttgcatttagcttctt

SEQ ID NO: 5229055 - DNA, 22 bp, Homo sapiens
agttgcatttagcttctttccc

SEQ ID NO: 5229056 - DNA, 16 bp, Homo sapiens
agttgcatttgtaaaa

SEQ ID NO: 5229057 - DNA, 14 bp, Homo sapiens
agttgccaacagtt

SEQ ID NO: 5229058 - DNA, 18 bp, Homo sapiens
agttgccaagacaaatca

SEQ ID NO: 5229059 - DNA, 19 bp, Homo sapiens
agttgccaagacaaatcaa

SEQ ID NO: 5229060 - DNA, 13 bp, Homo sapiens
agttgccaatatg

SEQ ID NO: 5229061 - DNA, 14 bp, Homo sapiens
agttgccaatatgc

SEQ ID NO: 5229062 - DNA, 18 bp, Homo sapiens
agttgccaatatgccagc

SEQ ID NO: 5229063 - DNA, 20 bp, Homo sapiens
agttgccaccacctctgtgg

SEQ ID NO: 5229064 - DNA, 23 bp, Homo sapiens
agttgccagtcaccccggccacc

SEQ ID NO: 5229065 - DNA, 20 bp, Homo sapiens
agttgccatgggaaacaaat

SEQ ID NO: 5229066 - DNA, 20 bp, Homo sapiens
agttgccatgtagacccctt

SEQ ID NO: 5229067 - DNA, 18 bp, Homo sapiens
agttgccattttgtaaac

SEQ ID NO: 5229068 - DNA, 12 bp, Homo sapiens
agttgcccagag

SEQ ID NO: 5229069 - DNA, 18 bp, Homo sapiens
agttgccccgtctctgtt

SEQ ID NO: 5229070 - DNA, 19 bp, Homo sapiens
agttgccccgtctctgttc

SEQ ID NO: 5229071 - DNA, 22 bp, Homo sapiens
agttgccgcatattatatcaga

SEQ ID NO: 5229072 - DNA, 23 bp, Homo sapiens
agttgcctaaatccatttggaaa

SEQ ID NO: 5229073 - DNA, 14 bp, Homo sapiens
agttgcctccaggg

SEQ ID NO: 5229074 - DNA, 21 bp, Homo sapiens
agttgcctgactcctgggtgg

SEQ ID NO: 5229075 - DNA, 20 bp, Homo sapiens
agttgcgacggagagaaaaa

SEQ ID NO: 5229076 - DNA, 22 bp, Homo sapiens
agttgcgacggagagaaaaaag

SEQ ID NO: 5229077 - DNA, 20 bp, Homo sapiens
agttgcgtggactctgcaca

SEQ ID NO: 5229078 - DNA, 15 bp, Homo sapiens
agttgcgtgtctgtt

SEQ ID NO: 5229079 - DNA, 21 bp, Homo sapiens
agttgctaagtgtgcttagtt

SEQ ID NO: 5229080 - DNA, 14 bp, Homo sapiens
agttgctagcaaac

SEQ ID NO: 5229081 - DNA, 13 bp, Homo sapiens
agttgctattttt

SEQ ID NO: 5229082 - DNA, 15 bp, Homo sapiens
agttgctatttttgt

SEQ ID NO: 5229083 - DNA, 14 bp, Homo sapiens
agttgctcacatgt

SEQ ID NO: 5229084 - DNA, 21 bp, Homo sapiens
agttgctccgcctctgctggc

SEQ ID NO: 5229085 - DNA, 20 bp, Homo sapiens
agttgctcctacccctgtcc

SEQ ID NO: 5229086 - DNA, 20 bp, Homo sapiens
agttgctctgacctcctctg

SEQ ID NO: 5229087 - DNA, 15 bp, Homo sapiens
agttgctgagaaatg

SEQ ID NO: 5229088 - DNA, 16 bp, Homo sapiens
agttgctgagaaatgg

SEQ ID NO: 5229089 - DNA, 16 bp, Homo sapiens
agttgctgatccctgc

SEQ ID NO: 5229090 - DNA, 17 bp, Homo sapiens
agttgctgcaaacctga

SEQ ID NO: 5229091 - DNA, 18 bp, Homo sapiens
agttgctgcttctcccag

SEQ ID NO: 5229092 - DNA, 17 bp, Homo sapiens
agttgctgggagctgaa

SEQ ID NO: 5229093 - DNA, 18 bp, Homo sapiens
agttgctgggattacagg

SEQ ID NO: 5229094 - DNA, 20 bp, Homo sapiens
agttgctggttttgaatatt

SEQ ID NO: 5229095 - DNA, 18 bp, Homo sapiens
agttgctgtaagcacctg

SEQ ID NO: 5229096 - DNA, 13 bp, Homo sapiens
agttgctgtcaca

SEQ ID NO: 5229097 - DNA, 15 bp, Homo sapiens
agttgctgtcacaaa

SEQ ID NO: 5229098 - DNA, 14 bp, Homo sapiens
agttgctgtcataa

SEQ ID NO: 5229099 - DNA, 16 bp, Homo sapiens
agttgctgtccccttc

SEQ ID NO: 5229100 - DNA, 19 bp, Homo sapiens
agttgctgtgaactttcat

SEQ ID NO: 5229101 - DNA, 15 bp, Homo sapiens
agttgctgtgcccca

SEQ ID NO: 5229102 - DNA, 13 bp, Homo sapiens
agttgctgtggac

SEQ ID NO: 5229103 - DNA, 16 bp, Homo sapiens
agttgctgtgtgtctg

SEQ ID NO: 5229104 - DNA, 20 bp, Homo sapiens
agttgctgtgtgtctgtcct

SEQ ID NO: 5229105 - DNA, 13 bp, Homo sapiens
agttgctgtttat

SEQ ID NO: 5229106 - DNA, 20 bp, Homo sapiens
agttgcttaattttgatttt

SEQ ID NO: 5229107 - DNA, 13 bp, Homo sapiens
agttgcttacaaa

SEQ ID NO: 5229108 - DNA, 14 bp, Homo sapiens
agttgcttgtaaaa

SEQ ID NO: 5229109 - DNA, 19 bp, Homo sapiens
agttgcttgtcttctggta

SEQ ID NO: 5229110 - DNA, 22 bp, Homo sapiens
agttgctttaaagtacctgtag

SEQ ID NO: 5229111 - DNA, 19 bp, Homo sapiens
agttgctttgccagagcag

SEQ ID NO: 5229112 - DNA, 16 bp, Homo sapiens
agttgctttgcccaag

SEQ ID NO: 5229113 - DNA, 24 bp, Homo sapiens
agttgctttggattctctaagatg

SEQ ID NO: 5229114 - DNA, 13 bp, Homo sapiens
agttgcttttcag

SEQ ID NO: 5229115 - DNA, 16 bp, Homo sapiens
agttggaaaattccca

SEQ ID NO: 5229116 - DNA, 23 bp, Homo sapiens
agttggaaacactaaatgttaaa

SEQ ID NO: 5229117 - DNA, 22 bp, Homo sapiens
agttggaaatcagttgtgaata

SEQ ID NO: 5229118 - DNA, 19 bp, Homo sapiens
agttggaactttctgttcc

SEQ ID NO: 5229119 - DNA, 10 bp, Homo sapiens
agttggaagg

SEQ ID NO: 5229120 - DNA, 15 bp, Homo sapiens
agttggaaggatctg

SEQ ID NO: 5229121 - DNA, 20 bp, Homo sapiens
agttggaagggaccccagat

SEQ ID NO: 5229122 - DNA, 21 bp, Homo sapiens
agttggaatgactgaaagaag

SEQ ID NO: 5229123 - DNA, 20 bp, Homo sapiens
agttggacagcaaaaccatt

SEQ ID NO: 5229124 - DNA, 17 bp, Homo sapiens
agttggacagtttaaag

SEQ ID NO: 5229125 - DNA, 18 bp, Homo sapiens
agttggaccagaggaagc

SEQ ID NO: 5229126 - DNA, 14 bp, Homo sapiens
agttggactctcag

SEQ ID NO: 5229127 - DNA, 17 bp, Homo sapiens
agttggactctcaggga

SEQ ID NO: 5229128 - DNA, 16 bp, Homo sapiens
agttggacttgagaaa

SEQ ID NO: 5229129 - DNA, 15 bp, Homo sapiens
agttggacttgtttt

SEQ ID NO: 5229130 - DNA, 22 bp, Homo sapiens
agttggagggaaagccagcctg

SEQ ID NO: 5229131 - DNA, 23 bp, Homo sapiens
agttggagggaaagccagcctgg

SEQ ID NO: 5229132 - DNA, 18 bp, Homo sapiens
agttggagtttgtgtctg

SEQ ID NO: 5229133 - DNA, 14 bp, Homo sapiens
agttggcagacagc

SEQ ID NO: 5229134 - DNA, 20 bp, Homo sapiens
agttggcagagaaggcctct

SEQ ID NO: 5229135 - DNA, 19 bp, Homo sapiens
agttggcaggagctcctgg

SEQ ID NO: 5229136 - DNA, 20 bp, Homo sapiens
agttggcaggagctcctgga

SEQ ID NO: 5229137 - DNA, 23 bp, Homo sapiens
agttggcaggagctcctggaagc

SEQ ID NO: 5229138 - DNA, 17 bp, Homo sapiens
agttggcatcacctgcg

SEQ ID NO: 5229139 - DNA, 23 bp, Homo sapiens
agttggccagattgtggggtgca

SEQ ID NO: 5229140 - DNA, 20 bp, Homo sapiens
agttggcctcagcagaaggc

SEQ ID NO: 5229141 - DNA, 16 bp, Homo sapiens
agttggcctctgcccc

SEQ ID NO: 5229142 - DNA, 19 bp, Homo sapiens
agttggcctgtgcttggag

SEQ ID NO: 5229143 - DNA, 20 bp, Homo sapiens
agttggcgttgtgggcaggc

SEQ ID NO: 5229144 - DNA, 21 bp, Homo sapiens
agttggctcacatcatgtaat

SEQ ID NO: 5229145 - DNA, 14 bp, Homo sapiens
agttggctgtgttc

SEQ ID NO: 5229146 - DNA, 22 bp, Homo sapiens
agttggctgtgttcgggggagc

SEQ ID NO: 5229147 - DNA, 15 bp, Homo sapiens
agttggcttacctgg

SEQ ID NO: 5229148 - DNA, 22 bp, Homo sapiens
agttggcttctgtttctagttg

SEQ ID NO: 5229149 - DNA, 23 bp, Homo sapiens
agttggctttgcccacccctcac

SEQ ID NO: 5229150 - DNA, 24 bp, Homo sapiens
agttggctttgcccacccctcact

SEQ ID NO: 5229151 - DNA, 23 bp, Homo sapiens
agttgggaacttcagatggacct

SEQ ID NO: 5229152 - DNA, 18 bp, Homo sapiens
agttgggaagtctcagcc

SEQ ID NO: 5229153 - DNA, 20 bp, Homo sapiens
agttgggaagtctcagcctg

SEQ ID NO: 5229154 - DNA, 18 bp, Homo sapiens
agttgggactacaggcgt

SEQ ID NO: 5229155 - DNA, 15 bp, Homo sapiens
agttgggactcagga

SEQ ID NO: 5229156 - DNA, 19 bp, Homo sapiens
agttgggactcaggatatt

SEQ ID NO: 5229157 - DNA, 21 bp, Homo sapiens
agttgggatgccaatttcctc

SEQ ID NO: 5229158 - DNA, 22 bp, Homo sapiens
agttgggatgccaatttcctct

SEQ ID NO: 5229159 - DNA, 23 bp, Homo sapiens
agttgggatgccaatttcctctc

SEQ ID NO: 5229160 - DNA, 20 bp, Homo sapiens
agttgggcaaaacccaggac

SEQ ID NO: 5229161 - DNA, 20 bp, Homo sapiens
agttgggcctaaataaatga

SEQ ID NO: 5229162 - DNA, 19 bp, Homo sapiens
agttgggcttcctcatagt

SEQ ID NO: 5229163 - DNA, 15 bp, Homo sapiens
agttgggcttgctat

SEQ ID NO: 5229164 - DNA, 17 bp, Homo sapiens
agttggggcactgggcg

SEQ ID NO: 5229165 - DNA, 17 bp, Homo sapiens
agttggggcccagtcct

SEQ ID NO: 5229166 - DNA, 17 bp, Homo sapiens
agttggggccctcttgc

SEQ ID NO: 5229167 - DNA, 23 bp, Homo sapiens
agttggggccctcttgccagcct

SEQ ID NO: 5229168 - DNA, 20 bp, Homo sapiens
agttggggctgccatagggt

SEQ ID NO: 5229169 - DNA, 18 bp, Homo sapiens
agttgggggtcagtgctg

SEQ ID NO: 5229170 - DNA, 21 bp, Homo sapiens
agttggggtctggcagcctcc

SEQ ID NO: 5229171 - DNA, 17 bp, Homo sapiens
agttgggtctgaaagga

SEQ ID NO: 5229172 - DNA, 17 bp, Homo sapiens
agttgggtggatgcctg

SEQ ID NO: 5229173 - DNA, 21 bp, Homo sapiens
agttgggtggatgcctggtgg

SEQ ID NO: 5229174 - DNA, 17 bp, Homo sapiens
agttgggtgtattgtgc

SEQ ID NO: 5229175 - DNA, 16 bp, Homo sapiens
agttgggtgtctcctt

SEQ ID NO: 5229176 - DNA, 22 bp, Homo sapiens
agttggtaagcttccaggaaaa

SEQ ID NO: 5229177 - DNA, 17 bp, Homo sapiens
agttggtacacaactag

SEQ ID NO: 5229178 - DNA, 16 bp, Homo sapiens
agttggtccacagcat

SEQ ID NO: 5229179 - DNA, 17 bp, Homo sapiens
agttggtcccccttcca

SEQ ID NO: 5229180 - DNA, 18 bp, Homo sapiens
agttggtcccccttccat

SEQ ID NO: 5229181 - DNA, 20 bp, Homo sapiens
agttggtcttactttgttaa

SEQ ID NO: 5229182 - DNA, 21 bp, Homo sapiens
agttggtcttatagaaagcac

SEQ ID NO: 5229183 - DNA, 16 bp, Homo sapiens
agttggtgaacagaga

SEQ ID NO: 5229184 - DNA, 18 bp, Homo sapiens
agttggtgaacagagaga

SEQ ID NO: 5229185 - DNA, 19 bp, Homo sapiens
agttggtgaacagagagaa

SEQ ID NO: 5229186 - DNA, 17 bp, Homo sapiens
agttggtgactgggaaa

SEQ ID NO: 5229187 - DNA, 18 bp, Homo sapiens
agttggtgactgggaaag

SEQ ID NO: 5229188 - DNA, 14 bp, Homo sapiens
agttggtggggcca

SEQ ID NO: 5229189 - DNA, 19 bp, Homo sapiens
agttggtggggccaggcca

SEQ ID NO: 5229190 - DNA, 13 bp, Homo sapiens
agttggtgtcttt

SEQ ID NO: 5229191 - DNA, 17 bp, Homo sapiens
agttggtgttcataatt

SEQ ID NO: 5229192 - DNA, 16 bp, Homo sapiens
agttggtgttgacata

SEQ ID NO: 5229193 - DNA, 16 bp, Homo sapiens
agttggttgaattttt

SEQ ID NO: 5229194 - DNA, 14 bp, Homo sapiens
agttggtttgtatg

SEQ ID NO: 5229195 - DNA, 17 bp, Homo sapiens
agttggtttgtatgaga

SEQ ID NO: 5229196 - DNA, 16 bp, Homo sapiens
agttggtttgtgtgat

SEQ ID NO: 5229197 - DNA, 13 bp, Homo sapiens
agttgtaaacgtc

SEQ ID NO: 5229198 - DNA, 15 bp, Homo sapiens
agttgtaaacgtctt

SEQ ID NO: 5229199 - DNA, 22 bp, Homo sapiens
agttgtaaatatataaatatat

SEQ ID NO: 5229200 - DNA, 19 bp, Homo sapiens
agttgtaacttatattgaa

SEQ ID NO: 5229201 - DNA, 20 bp, Homo sapiens
agttgtaatagagaatattt

SEQ ID NO: 5229202 - DNA, 15 bp, Homo sapiens
agttgtacaaatgta

SEQ ID NO: 5229203 - DNA, 21 bp, Homo sapiens
agttgtacaaatgtattttga

SEQ ID NO: 5229204 - DNA, 15 bp, Homo sapiens
agttgtacatgaaat

SEQ ID NO: 5229205 - DNA, 19 bp, Homo sapiens
agttgtaccactgctaata

SEQ ID NO: 5229206 - DNA, 22 bp, Homo sapiens
agttgtaccactgctaataaat

SEQ ID NO: 5229207 - DNA, 18 bp, Homo sapiens
agttgtaccgcaatgtga

SEQ ID NO: 5229208 - DNA, 13 bp, Homo sapiens
agttgtacctttt

SEQ ID NO: 5229209 - DNA, 19 bp, Homo sapiens
agttgtaccttttaatatg

SEQ ID NO: 5229210 - DNA, 14 bp, Homo sapiens
agttgtacttctgc

SEQ ID NO: 5229211 - DNA, 13 bp, Homo sapiens
agttgtagaatgt

SEQ ID NO: 5229212 - DNA, 20 bp, Homo sapiens
agttgtagaatgtattgtac

SEQ ID NO: 5229213 - DNA, 16 bp, Homo sapiens
agttgtagacaaagta

SEQ ID NO: 5229214 - DNA, 22 bp, Homo sapiens
agttgtagcaaagatttcaaaa

SEQ ID NO: 5229215 - DNA, 17 bp, Homo sapiens
agttgtagcagaaacca

SEQ ID NO: 5229216 - DNA, 20 bp, Homo sapiens
agttgtagcaggtttcacta

SEQ ID NO: 5229217 - DNA, 20 bp, Homo sapiens
agttgtataaaagttgtact

SEQ ID NO: 5229218 - DNA, 17 bp, Homo sapiens
agtctccccttcctggc

SEQ ID NO: 5229219 - DNA, 18 bp, Homo sapiens
agtctccctcccttgggg

SEQ ID NO: 5229220 - DNA, 16 bp, Homo sapiens
agtctccctccgactc

SEQ ID NO: 5229221 - DNA, 20 bp, Homo sapiens
agtctccctccgactccaga

SEQ ID NO: 5229222 - DNA, 21 bp, Homo sapiens
agtctccctccgactccagat

SEQ ID NO: 5229223 - DNA, 15 bp, Homo sapiens
agtctccctgatgga

SEQ ID NO: 5229224 - DNA, 19 bp, Homo sapiens
agtctccctgcacagcctc

SEQ ID NO: 5229225 - DNA, 17 bp, Homo sapiens
agtctcccttctcccat

SEQ ID NO: 5229226 - DNA, 17 bp, Homo sapiens
agtctccctttcccttc

SEQ ID NO: 5229227 - DNA, 16 bp, Homo sapiens
agtctccggcctctcc

SEQ ID NO: 5229228 - DNA, 18 bp, Homo sapiens
agtctcctaggggcttgg

SEQ ID NO: 5229229 - DNA, 21 bp, Homo sapiens
agtctcctaggggcttggtcc

SEQ ID NO: 5229230 - DNA, 14 bp, Homo sapiens
agtctcctcactct

SEQ ID NO: 5229231 - DNA, 20 bp, Homo sapiens
agtctcctcactctgtccct

SEQ ID NO: 5229232 - DNA, 21 bp, Homo sapiens
agtctcctcactctgtccctg

SEQ ID NO: 5229233 - DNA, 23 bp, Homo sapiens
agtctcctcactctgtccctgtc

SEQ ID NO: 5229234 - DNA, 13 bp, Homo sapiens
agtctcctcactg

SEQ ID NO: 5229235 - DNA, 15 bp, Homo sapiens
agtctcctcactgcc

SEQ ID NO: 5229236 - DNA, 16 bp, Homo sapiens
agtctcctcactgcca

SEQ ID NO: 5229237 - DNA, 19 bp, Homo sapiens
agtctcctcactgccacta

SEQ ID NO: 5229238 - DNA, 23 bp, Homo sapiens
agtctcctcactgccactaaaat

SEQ ID NO: 5229239 - DNA, 11 bp, Homo sapiens
agtctcctctc

SEQ ID NO: 5229240 - DNA, 13 bp, Homo sapiens
agtctcctcttta

SEQ ID NO: 5229241 - DNA, 14 bp, Homo sapiens
agtctcctctttaa

SEQ ID NO: 5229242 - DNA, 18 bp, Homo sapiens
agtctcctctttaaaaca

SEQ ID NO: 5229243 - DNA, 14 bp, Homo sapiens
agtctcctgacatt

SEQ ID NO: 5229244 - DNA, 18 bp, Homo sapiens
agtctcctggatttaaat

SEQ ID NO: 5229245 - DNA, 16 bp, Homo sapiens
agtctcctgtatcatt

SEQ ID NO: 5229246 - DNA, 11 bp, Homo sapiens
agtctccttct

SEQ ID NO: 5229247 - DNA, 12 bp, Homo sapiens
agtctccttctc

SEQ ID NO: 5229248 - DNA, 14 bp, Homo sapiens
agtctccttctctt

SEQ ID NO: 5229249 - DNA, 16 bp, Homo sapiens
agtctccttctcttct

SEQ ID NO: 5229250 - DNA, 14 bp, Homo sapiens
agtctcgaatgtaa

SEQ ID NO: 5229251 - DNA, 17 bp, Homo sapiens
agtctcgaatgtaattg

SEQ ID NO: 5229252 - DNA, 23 bp, Homo sapiens
agtctcgaatgtaattggaatct

SEQ ID NO: 5229253 - DNA, 13 bp, Homo sapiens
agtctcgctctgt

SEQ ID NO: 5229254 - DNA, 20 bp, Homo sapiens
agtctcgctctgtcacccag

SEQ ID NO: 5229255 - DNA, 21 bp, Homo sapiens
agtctcgctctgttgcccagg

SEQ ID NO: 5229256 - DNA, 23 bp, Homo sapiens
agtctcgctctgttgcccaggct

SEQ ID NO: 5229257 - DNA, 14 bp, Homo sapiens
agtctctaattcta

SEQ ID NO: 5229258 - DNA, 20 bp, Homo sapiens
agtctctacccctttctgtt

SEQ ID NO: 5229259 - DNA, 16 bp, Homo sapiens
agtctctaggttctga

SEQ ID NO: 5229260 - DNA, 15 bp, Homo sapiens
agtctctataccaat

SEQ ID NO: 5229261 - DNA, 17 bp, Homo sapiens
agtctctataccaataa

SEQ ID NO: 5229262 - DNA, 19 bp, Homo sapiens
agtctctataccaataaag

SEQ ID NO: 5229263 - DNA, 20 bp, Homo sapiens
agtctctataccaataaagt

SEQ ID NO: 5229264 - DNA, 21 bp, Homo sapiens
agtctctataccaataaagtg

SEQ ID NO: 5229265 - DNA, 22 bp, Homo sapiens
agtctctataccaataaagtga

SEQ ID NO: 5229266 - DNA, 16 bp, Homo sapiens
agtctctatattatgt

SEQ ID NO: 5229267 - DNA, 15 bp, Homo sapiens
agtctctatcattaa

SEQ ID NO: 5229268 - DNA, 17 bp, Homo sapiens
agtctctatcattaaag

SEQ ID NO: 5229269 - DNA, 18 bp, Homo sapiens
agtctctatcattaaagt

SEQ ID NO: 5229270 - DNA, 20 bp, Homo sapiens
agtctctatcattaaagttc

SEQ ID NO: 5229271 - DNA, 21 bp, Homo sapiens
agtctctatcattaaagttct

SEQ ID NO: 5229272 - DNA, 22 bp, Homo sapiens
agtctctatttaaattcttttt

SEQ ID NO: 5229273 - DNA, 20 bp, Homo sapiens
agtctctcaaagaccccatg

SEQ ID NO: 5229274 - DNA, 17 bp, Homo sapiens
agtctctcatttctttc

SEQ ID NO: 5229275 - DNA, 13 bp, Homo sapiens
agtctctccagcc

SEQ ID NO: 5229276 - DNA, 15 bp, Homo sapiens
agtctctccagcctc

SEQ ID NO: 5229277 - DNA, 18 bp, Homo sapiens
agtctctccagcctcaca

SEQ ID NO: 5229278 - DNA, 20 bp, Homo sapiens
agtctctccagcctcacaga

SEQ ID NO: 5229279 - DNA, 15 bp, Homo sapiens
agtctctctctccct

SEQ ID NO: 5229280 - DNA, 21 bp, Homo sapiens
agtctctctgtgaatacaatt

SEQ ID NO: 5229281 - DNA, 22 bp, Homo sapiens
agtctctctgtgaatacaatta

SEQ ID NO: 5229282 - DNA, 21 bp, Homo sapiens
agtctctcttctctccagctg

SEQ ID NO: 5229283 - DNA, 19 bp, Homo sapiens
agtctctgactcttgcctt

SEQ ID NO: 5229284 - DNA, 23 bp, Homo sapiens
agtctctgaggggctaccaggaa

SEQ ID NO: 5229285 - DNA, 21 bp, Homo sapiens
agtctctgattagttgacagt

SEQ ID NO: 5229286 - DNA, 14 bp, Homo sapiens
agtctctgccaccc

SEQ ID NO: 5229287 - DNA, 18 bp, Homo sapiens
agtctctgccacccactc

SEQ ID NO: 5229288 - DNA, 22 bp, Homo sapiens
agtctctgccacccactcagga

SEQ ID NO: 5229289 - DNA, 23 bp, Homo sapiens
agtctctgccagttacttgggct

SEQ ID NO: 5229290 - DNA, 20 bp, Homo sapiens
agtctctggaaaagctgggg

SEQ ID NO: 5229291 - DNA, 17 bp, Homo sapiens
agtctctggctcagctg

SEQ ID NO: 5229292 - DNA, 19 bp, Homo sapiens
agtctctggctcagctgtg

SEQ ID NO: 5229293 - DNA, 11 bp, Homo sapiens
agtctctggga

SEQ ID NO: 5229294 - DNA, 13 bp, Homo sapiens
agtctctgggaga

SEQ ID NO: 5229295 - DNA, 21 bp, Homo sapiens
agtctctgggagactttccct

SEQ ID NO: 5229296 - DNA, 16 bp, Homo sapiens
agtctctggggcaggc

SEQ ID NO: 5229297 - DNA, 18 bp, Homo sapiens
agtctctggggcaggctg

SEQ ID NO: 5229298 - DNA, 12 bp, Homo sapiens
agtctctgtgag

SEQ ID NO: 5229299 - DNA, 14 bp, Homo sapiens
agtctctttcttcc

SEQ ID NO: 5229300 - DNA, 15 bp, Homo sapiens
agtctcttttcttta

SEQ ID NO: 5229301 - DNA, 16 bp, Homo sapiens
agtctcttttttacaa

SEQ ID NO: 5229302 - DNA, 19 bp, Homo sapiens
agtctcttttttattctgt

SEQ ID NO: 5229303 - DNA, 21 bp, Homo sapiens
agtctctttttttggcccagg

SEQ ID NO: 5229304 - DNA, 23 bp, Homo sapiens
agtctctttttttggcccaggcc

SEQ ID NO: 5229305 - DNA, 15 bp, Homo sapiens
agtctgaacagctgt

SEQ ID NO: 5229306 - DNA, 18 bp, Homo sapiens
agtctgaacagctgtaat

SEQ ID NO: 5229307 - DNA, 21 bp, Homo sapiens
agtctgaaccaatagaaagca

SEQ ID NO: 5229308 - DNA, 12 bp, Homo sapiens
agtctgaaggct

SEQ ID NO: 5229309 - DNA, 13 bp, Homo sapiens
agtctgaaggctg

SEQ ID NO: 5229310 - DNA, 15 bp, Homo sapiens
agtctgaaggctggg

SEQ ID NO: 5229311 - DNA, 13 bp, Homo sapiens
agtctgaatattt

SEQ ID NO: 5229312 - DNA, 16 bp, Homo sapiens
agtctgaatctcccaa

SEQ ID NO: 5229313 - DNA, 14 bp, Homo sapiens
agtctgagaaatag

SEQ ID NO: 5229314 - DNA, 19 bp, Homo sapiens
agtctgagaggttagaatg

SEQ ID NO: 5229315 - DNA, 20 bp, Homo sapiens
agtctgagaggttagaatga

SEQ ID NO: 5229316 - DNA, 11 bp, Homo sapiens
agtctgagccc

SEQ ID NO: 5229317 - DNA, 14 bp, Homo sapiens
agtctgagcccatt

SEQ ID NO: 5229318 - DNA, 12 bp, Homo sapiens
agtctgagcccc

SEQ ID NO: 5229319 - DNA, 18 bp, Homo sapiens
agtctgaggactgtcctc

SEQ ID NO: 5229320 - DNA, 22 bp, Homo sapiens
agtctgaggccccaggccctag

SEQ ID NO: 5229321 - DNA, 18 bp, Homo sapiens
agtctgaggtcctgagca

SEQ ID NO: 5229322 - DNA, 22 bp, Homo sapiens
agtctgaggtcctgagcactgc

SEQ ID NO: 5229323 - DNA, 15 bp, Homo sapiens
agtctgagtaagaaa

SEQ ID NO: 5229324 - DNA, 21 bp, Homo sapiens
agtctgagtcatcaaaaagag

SEQ ID NO: 5229325 - DNA, 16 bp, Homo sapiens
agtctgagtcctgtct

SEQ ID NO: 5229326 - DNA, 20 bp, Homo sapiens
agtctgagtcctgtctctgc

SEQ ID NO: 5229327 - DNA, 14 bp, Homo sapiens
agtctgagtctgag

SEQ ID NO: 5229328 - DNA, 16 bp, Homo sapiens
agtctgatattcacct

SEQ ID NO: 5229329 - DNA, 18 bp, Homo sapiens
agtctgatcgtgacgctg

SEQ ID NO: 5229330 - DNA, 21 bp, Homo sapiens
agtctgattataccatgtgtg

SEQ ID NO: 5229331 - DNA, 20 bp, Homo sapiens
agtctgattcccaagctctg

SEQ ID NO: 5229332 - DNA, 22 bp, Homo sapiens
agtctgattcccaagctctgct

SEQ ID NO: 5229333 - DNA, 11 bp, Homo sapiens
agtctgattta

SEQ ID NO: 5229334 - DNA, 14 bp, Homo sapiens
agtctgattttaat

SEQ ID NO: 5229335 - DNA, 15 bp, Homo sapiens
agtctgattttaatg

SEQ ID NO: 5229336 - DNA, 16 bp, Homo sapiens
agtctgatttttaaga

SEQ ID NO: 5229337 - DNA, 11 bp, Homo sapiens
agtctgcagtg

SEQ ID NO: 5229338 - DNA, 22 bp, Homo sapiens
agtctgcataaacttcatcttc

SEQ ID NO: 5229339 - DNA, 14 bp, Homo sapiens
agtctgcatatatt

SEQ ID NO: 5229340 - DNA, 20 bp, Homo sapiens
agtctgcccacgcagaggac

SEQ ID NO: 5229341 - DNA, 17 bp, Homo sapiens
agtctgccgattttgta

SEQ ID NO: 5229342 - DNA, 22 bp, Homo sapiens
agtctgcgcccttgtgccctgc

SEQ ID NO: 5229343 - DNA, 23 bp, Homo sapiens
agtctgcgtctctgctttaaagt

SEQ ID NO: 5229344 - DNA, 20 bp, Homo sapiens
agtctgctcctcttgttcct

SEQ ID NO: 5229345 - DNA, 14 bp, Homo sapiens
agtctgctctcagc

SEQ ID NO: 5229346 - DNA, 15 bp, Homo sapiens
agtctgctctcagct

SEQ ID NO: 5229347 - DNA, 16 bp, Homo sapiens
agtctgctctcagctt

SEQ ID NO: 5229348 - DNA, 13 bp, Homo sapiens
agtctgctctgct

SEQ ID NO: 5229349 - DNA, 16 bp, Homo sapiens
agtctgctctgctgct

SEQ ID NO: 5229350 - DNA, 15 bp, Homo sapiens
agtctgctgccctcc

SEQ ID NO: 5229351 - DNA, 17 bp, Homo sapiens
agtctgcttagaaataa

SEQ ID NO: 5229352 - DNA, 19 bp, Homo sapiens
agtctgcttatccttccac

SEQ ID NO: 5229353 - DNA, 14 bp, Homo sapiens
agtctgcttctgca

SEQ ID NO: 5229354 - DNA, 13 bp, Homo sapiens
agtctgctttcac

SEQ ID NO: 5229355 - DNA, 13 bp, Homo sapiens
agtctgctttctc

SEQ ID NO: 5229356 - DNA, 20 bp, Homo sapiens
agtctggaaagtgatgtcag

SEQ ID NO: 5229357 - DNA, 14 bp, Homo sapiens
agtctggaacactt

SEQ ID NO: 5229358 - DNA, 11 bp, Homo sapiens
agtctggacct

SEQ ID NO: 5229359 - DNA, 23 bp, Homo sapiens
agtctggactttgcttcccctcc

SEQ ID NO: 5229360 - DNA, 13 bp, Homo sapiens
agtctggaggggc

SEQ ID NO: 5229361 - DNA, 16 bp, Homo sapiens
agtctggaggtcccag

SEQ ID NO: 5229362 - DNA, 17 bp, Homo sapiens
agtctggaggtcccaga

SEQ ID NO: 5229363 - DNA, 14 bp, Homo sapiens
agtctggagtgaac

SEQ ID NO: 5229364 - DNA, 23 bp, Homo sapiens
agtctggagtgggataggagcag

SEQ ID NO: 5229365 - DNA, 20 bp, Homo sapiens
agtctggataacttccacag

SEQ ID NO: 5229366 - DNA, 21 bp, Homo sapiens
agtctggataacttccacagg

SEQ ID NO: 5229367 - DNA, 15 bp, Homo sapiens
agtctggatctggga

SEQ ID NO: 5229368 - DNA, 20 bp, Homo sapiens
agtctggcaaacatgtgcaa

SEQ ID NO: 5229369 - DNA, 21 bp, Homo sapiens
agtctggcaccatgttggcct

SEQ ID NO: 5229370 - DNA, 22 bp, Homo sapiens
agtctggcaccatgttggcctc

SEQ ID NO: 5229371 - DNA, 15 bp, Homo sapiens
agtctggccaacatc

SEQ ID NO: 5229372 - DNA, 14 bp, Homo sapiens
agtctggccatttt

SEQ ID NO: 5229373 - DNA, 15 bp, Homo sapiens
agtctggcctgccag

SEQ ID NO: 5229374 - DNA, 19 bp, Homo sapiens
agtctggcctgccaggctc

SEQ ID NO: 5229375 - DNA, 13 bp, Homo sapiens
agtctggctttac

SEQ ID NO: 5229376 - DNA, 22 bp, Homo sapiens
agtctggctttacctttttgta

SEQ ID NO: 5229377 - DNA, 18 bp, Homo sapiens
agtctgggaaattctata

SEQ ID NO: 5229378 - DNA, 18 bp, Homo sapiens
agtctgggatattcttta

SEQ ID NO: 5229379 - DNA, 23 bp, Homo sapiens
agtctgggcaatgaaaccaaagc

SEQ ID NO: 5229380 - DNA, 14 bp, Homo sapiens
agtctgggcctctg

SEQ ID NO: 5229381 - DNA, 15 bp, Homo sapiens
agtctgggcctctga

SEQ ID NO: 5229382 - DNA, 14 bp, Homo sapiens
agtctgggctgccg

SEQ ID NO: 5229383 - DNA, 16 bp, Homo sapiens
agtctggggacctggc

SEQ ID NO: 5229384 - DNA, 19 bp, Homo sapiens
agtctggggacctggcact

SEQ ID NO: 5229385 - DNA, 16 bp, Homo sapiens
agtctggggtgggagg

SEQ ID NO: 5229386 - DNA, 20 bp, Homo sapiens
agtctggggtgggagggagg

SEQ ID NO: 5229387 - DNA, 12 bp, Homo sapiens
agtctgggtcag

SEQ ID NO: 5229388 - DNA, 17 bp, Homo sapiens
agtctgggtcagaccca

SEQ ID NO: 5229389 - DNA, 23 bp, Homo sapiens
agtctgggtcagacccatctctc

SEQ ID NO: 5229390 - DNA, 17 bp, Homo sapiens
agtctgggtccaggcct

SEQ ID NO: 5229391 - DNA, 19 bp, Homo sapiens
agtctgggtccatcctggt

SEQ ID NO: 5229392 - DNA, 22 bp, Homo sapiens
agtctggtcagagccacagggt

SEQ ID NO: 5229393 - DNA, 14 bp, Homo sapiens
agtctggtggagga

SEQ ID NO: 5229394 - DNA, 16 bp, Homo sapiens
agtctggtggaggagc

SEQ ID NO: 5229395 - DNA, 17 bp, Homo sapiens
agtctggtgggaggacg

SEQ ID NO: 5229396 - DNA, 14 bp, Homo sapiens
agtctggtgttctg

SEQ ID NO: 5229397 - DNA, 21 bp, Homo sapiens
agttgtataaactgtattttg

SEQ ID NO: 5229398 - DNA, 21 bp, Homo sapiens
agttgtatataaaattagatt

SEQ ID NO: 5229399 - DNA, 18 bp, Homo sapiens
agttgtatcagtaccatt

SEQ ID NO: 5229400 - DNA, 16 bp, Homo sapiens
agttgtatctcttttg

SEQ ID NO: 5229401 - DNA, 18 bp, Homo sapiens
agttgtatgatctgtgcc

SEQ ID NO: 5229402 - DNA, 15 bp, Homo sapiens
agttgtatgtttgct

SEQ ID NO: 5229403 - DNA, 18 bp, Homo sapiens
agttgtatgtttgctgat

SEQ ID NO: 5229404 - DNA, 19 bp, Homo sapiens
agttgtatttaacagaaat

SEQ ID NO: 5229405 - DNA, 17 bp, Homo sapiens
agttgtatttcaaatat

SEQ ID NO: 5229406 - DNA, 14 bp, Homo sapiens
agttgtatttgaag

SEQ ID NO: 5229407 - DNA, 18 bp, Homo sapiens
agttgtattttaataaag

SEQ ID NO: 5229408 - DNA, 20 bp, Homo sapiens
agttgtattttaataaagat

SEQ ID NO: 5229409 - DNA, 19 bp, Homo sapiens
agttgtcacagaaattatg

SEQ ID NO: 5229410 - DNA, 23 bp, Homo sapiens
agttgtcactgcttttggcctgg

SEQ ID NO: 5229411 - DNA, 15 bp, Homo sapiens
agttgtcagaatatg

SEQ ID NO: 5229412 - DNA, 19 bp, Homo sapiens
agttgtcccgattgtaact

SEQ ID NO: 5229413 - DNA, 16 bp, Homo sapiens
agttgtcctatggaca

SEQ ID NO: 5229414 - DNA, 21 bp, Homo sapiens
agttgtcctatggacaactta

SEQ ID NO: 5229415 - DNA, 22 bp, Homo sapiens
agttgtcctgatgtttttctgt

SEQ ID NO: 5229416 - DNA, 18 bp, Homo sapiens
agttgtcctgatttctta

SEQ ID NO: 5229417 - DNA, 20 bp, Homo sapiens
agttgtcctgatttcttatt

SEQ ID NO: 5229418 - DNA, 17 bp, Homo sapiens
agttgtcctttctgatc

SEQ ID NO: 5229419 - DNA, 21 bp, Homo sapiens
agttgtcgtttttagctttgt

SEQ ID NO: 5229420 - DNA, 21 bp, Homo sapiens
agttgtctattctgagccttg

SEQ ID NO: 5229421 - DNA, 12 bp, Homo sapiens
agttgtctctga

SEQ ID NO: 5229422 - DNA, 22 bp, Homo sapiens
agttgtctctgatgcagcttat

SEQ ID NO: 5229423 - DNA, 17 bp, Homo sapiens
agttgtctgagctgctg

SEQ ID NO: 5229424 - DNA, 13 bp, Homo sapiens
agttgtctggctt

SEQ ID NO: 5229425 - DNA, 23 bp, Homo sapiens
agttgtctggctttttgcacgtg

SEQ ID NO: 5229426 - DNA, 12 bp, Homo sapiens
agttgtctgtcc

SEQ ID NO: 5229427 - DNA, 19 bp, Homo sapiens
agttgtctgtccaggccct

SEQ ID NO: 5229428 - DNA, 20 bp, Homo sapiens
agttgtctgtccaggccctt

SEQ ID NO: 5229429 - DNA, 15 bp, Homo sapiens
agttgtctgtcctgg

SEQ ID NO: 5229430 - DNA, 13 bp, Homo sapiens
agttgtcttacac

SEQ ID NO: 5229431 - DNA, 13 bp, Homo sapiens
agttgtcttatgt

SEQ ID NO: 5229432 - DNA, 21 bp, Homo sapiens
agttgtcttatgtgaaaaatt

SEQ ID NO: 5229433 - DNA, 18 bp, Homo sapiens
agttgtcttttaaactac

SEQ ID NO: 5229434 - DNA, 20 bp, Homo sapiens
agttgtgaagaggggccaga

SEQ ID NO: 5229435 - DNA, 18 bp, Homo sapiens
agttgtgaccttagtgtt

SEQ ID NO: 5229436 - DNA, 14 bp, Homo sapiens
agttgtgagccctc

SEQ ID NO: 5229437 - DNA, 22 bp, Homo sapiens
agttgtgagtttaccttgtata

SEQ ID NO: 5229438 - DNA, 18 bp, Homo sapiens
agttgtgatataaaggac

SEQ ID NO: 5229439 - DNA, 20 bp, Homo sapiens
agttgtgatctgttgtaata

SEQ ID NO: 5229440 - DNA, 20 bp, Homo sapiens
agttgtgcaacggccagggt

SEQ ID NO: 5229441 - DNA, 20 bp, Homo sapiens
agttgtgcagcttttggtca

SEQ ID NO: 5229442 - DNA, 23 bp, Homo sapiens
agttgtgcctcatttatttattg

SEQ ID NO: 5229443 - DNA, 15 bp, Homo sapiens
agttgtgccttttat

SEQ ID NO: 5229444 - DNA, 19 bp, Homo sapiens
agttgtgccttttatagct

SEQ ID NO: 5229445 - DNA, 23 bp, Homo sapiens
agttgtgccttttatagctatta

SEQ ID NO: 5229446 - DNA, 14 bp, Homo sapiens
agttgtgcttgttt

SEQ ID NO: 5229447 - DNA, 20 bp, Homo sapiens
agttgtggaaagataataaa

SEQ ID NO: 5229448 - DNA, 18 bp, Homo sapiens
agttgtggaaagcctctg

SEQ ID NO: 5229449 - DNA, 21 bp, Homo sapiens
agttgtggaaagcctctgctg

SEQ ID NO: 5229450 - DNA, 20 bp, Homo sapiens
agttgtggagagtgcaacag

SEQ ID NO: 5229451 - DNA, 13 bp, Homo sapiens
agttgtggatatc

SEQ ID NO: 5229452 - DNA, 18 bp, Homo sapiens
agttgtggatatcagggt

SEQ ID NO: 5229453 - DNA, 17 bp, Homo sapiens
agttgtggatttcagtt

SEQ ID NO: 5229454 - DNA, 12 bp, Homo sapiens
agttgtggcctc

SEQ ID NO: 5229455 - DNA, 19 bp, Homo sapiens
agttgtggtgctgacaaag

SEQ ID NO: 5229456 - DNA, 15 bp, Homo sapiens
agttgtggtgtgagt

SEQ ID NO: 5229457 - DNA, 21 bp, Homo sapiens
agttgtgtctaggctggaaga

SEQ ID NO: 5229458 - DNA, 15 bp, Homo sapiens
agttgtgtggcccag

SEQ ID NO: 5229459 - DNA, 14 bp, Homo sapiens
agttgtgttgttct

SEQ ID NO: 5229460 - DNA, 16 bp, Homo sapiens
agttgtgtttgaagca

SEQ ID NO: 5229461 - DNA, 20 bp, Homo sapiens
agttgtgtttgttgctggct

SEQ ID NO: 5229462 - DNA, 15 bp, Homo sapiens
agttgttacattttt

SEQ ID NO: 5229463 - DNA, 16 bp, Homo sapiens
agttgttacattttta

SEQ ID NO: 5229464 - DNA, 15 bp, Homo sapiens
agttgttaccaaata

SEQ ID NO: 5229465 - DNA, 23 bp, Homo sapiens
agttgttactgaagttatctgtg

SEQ ID NO: 5229466 - DNA, 15 bp, Homo sapiens
agttgttagattaag

SEQ ID NO: 5229467 - DNA, 16 bp, Homo sapiens
agttgttagtgatttg

SEQ ID NO: 5229468 - DNA, 20 bp, Homo sapiens
agttgttagtgatttgctat

SEQ ID NO: 5229469 - DNA, 22 bp, Homo sapiens
agttgttatgccatgatttttg

SEQ ID NO: 5229470 - DNA, 13 bp, Homo sapiens
agttgttattaca

SEQ ID NO: 5229471 - DNA, 19 bp, Homo sapiens
agttgttattacatccttg

SEQ ID NO: 5229472 - DNA, 20 bp, Homo sapiens
agttgttcaactattttatt

SEQ ID NO: 5229473 - DNA, 15 bp, Homo sapiens
agttgttcacatata

SEQ ID NO: 5229474 - DNA, 21 bp, Homo sapiens
agttgttcgccgcgtggaatg

SEQ ID NO: 5229475 - DNA, 18 bp, Homo sapiens
agttgttgaatgactgac

SEQ ID NO: 5229476 - DNA, 19 bp, Homo sapiens
agttgttgaatgactgacc

SEQ ID NO: 5229477 - DNA, 21 bp, Homo sapiens
agttgttgaatgactgaccca

SEQ ID NO: 5229478 - DNA, 13 bp, Homo sapiens
agttgttgactgt

SEQ ID NO: 5229479 - DNA, 23 bp, Homo sapiens
agttgttgctatacatgttggaa

SEQ ID NO: 5229480 - DNA, 15 bp, Homo sapiens
agttgttggcctccg

SEQ ID NO: 5229481 - DNA, 16 bp, Homo sapiens
agttgttgtaacctgc

SEQ ID NO: 5229482 - DNA, 18 bp, Homo sapiens
agttgttgtgggttctat

SEQ ID NO: 5229483 - DNA, 22 bp, Homo sapiens
agttgttgtgggttctatgttt

SEQ ID NO: 5229484 - DNA, 22 bp, Homo sapiens
agttgttgtttgccaagctaat

SEQ ID NO: 5229485 - DNA, 15 bp, Homo sapiens
agttgtttaactgtg

SEQ ID NO: 5229486 - DNA, 16 bp, Homo sapiens
agttgtttaataagta

SEQ ID NO: 5229487 - DNA, 21 bp, Homo sapiens
agttgtttaataagtatatct

SEQ ID NO: 5229488 - DNA, 14 bp, Homo sapiens
agttgtttataaaa

SEQ ID NO: 5229489 - DNA, 22 bp, Homo sapiens
agttgtttatgtatcagctctc

SEQ ID NO: 5229490 - DNA, 18 bp, Homo sapiens
agttgtttattccaaaga

SEQ ID NO: 5229491 - DNA, 21 bp, Homo sapiens
agttgtttcagataaatttca

SEQ ID NO: 5229492 - DNA, 15 bp, Homo sapiens
agttgtttcattgac

SEQ ID NO: 5229493 - DNA, 20 bp, Homo sapiens
agttgtttctaagagcagag

SEQ ID NO: 5229494 - DNA, 23 bp, Homo sapiens
agttgtttgaggcaaattaactg

SEQ ID NO: 5229495 - DNA, 11 bp, Homo sapiens
agttgtttgat

SEQ ID NO: 5229496 - DNA, 14 bp, Homo sapiens
agttgtttgcttct

SEQ ID NO: 5229497 - DNA, 21 bp, Homo sapiens
agttgttttggtgcctgcctc

SEQ ID NO: 5229498 - DNA, 15 bp, Homo sapiens
agttgttttgtcttg

SEQ ID NO: 5229499 - DNA, 17 bp, Homo sapiens
agttgtttttgtatatt

SEQ ID NO: 5229500 - DNA, 20 bp, Homo sapiens
agttgtttttgtatattggt

SEQ ID NO: 5229501 - DNA, 18 bp, Homo sapiens
agttgttttttgtgtttc

SEQ ID NO: 5229502 - DNA, 21 bp, Homo sapiens
agttgttttttgtgtttccat

SEQ ID NO: 5229503 - DNA, 19 bp, Homo sapiens
agttgtttttttttgtttt

SEQ ID NO: 5229504 - DNA, 12 bp, Homo sapiens
agtttaaaaaaa

SEQ ID NO: 5229505 - DNA, 15 bp, Homo sapiens
agtttaaaaaaattg

SEQ ID NO: 5229506 - DNA, 22 bp, Homo sapiens
agtttaaaaagatgaaaaagaa

SEQ ID NO: 5229507 - DNA, 12 bp, Homo sapiens
agtttaaaaata

SEQ ID NO: 5229508 - DNA, 18 bp, Homo sapiens
agtttaaaaatcaacttt

SEQ ID NO: 5229509 - DNA, 23 bp, Homo sapiens
agtttaaaaatcagaaagacatt

SEQ ID NO: 5229510 - DNA, 22 bp, Homo sapiens
agtttaaaaatctgccacctgc

SEQ ID NO: 5229511 - DNA, 13 bp, Homo sapiens
agtttaaaacagt

SEQ ID NO: 5229512 - DNA, 14 bp, Homo sapiens
agtttaaaagcatg

SEQ ID NO: 5229513 - DNA, 17 bp, Homo sapiens
agtttaaaagcatgaaa

SEQ ID NO: 5229514 - DNA, 22 bp, Homo sapiens
agtttaaaagttcttagttata

SEQ ID NO: 5229515 - DNA, 18 bp, Homo sapiens
agtttaaaatcttgcatg

SEQ ID NO: 5229516 - DNA, 19 bp, Homo sapiens
agtttaaaatgaagcaatt

SEQ ID NO: 5229517 - DNA, 22 bp, Homo sapiens
agtttaaaatgaagcaatttat

SEQ ID NO: 5229518 - DNA, 14 bp, Homo sapiens
agtttaaaatgtat

SEQ ID NO: 5229519 - DNA, 14 bp, Homo sapiens
agtttaaaattatt

SEQ ID NO: 5229520 - DNA, 22 bp, Homo sapiens
agtttaaagagaaaagggaaaa

SEQ ID NO: 5229521 - DNA, 18 bp, Homo sapiens
agtttaaagcatctgtaa

SEQ ID NO: 5229522 - DNA, 14 bp, Homo sapiens
agtttaaagttgca

SEQ ID NO: 5229523 - DNA, 18 bp, Homo sapiens
agtttaaatattaagcat

SEQ ID NO: 5229524 - DNA, 20 bp, Homo sapiens
agtttaaatattaagcatga

SEQ ID NO: 5229525 - DNA, 19 bp, Homo sapiens
agtttaacaaatgactgta

SEQ ID NO: 5229526 - DNA, 12 bp, Homo sapiens
agtttaacacaa

SEQ ID NO: 5229527 - DNA, 15 bp, Homo sapiens
agtttaacagatatt

SEQ ID NO: 5229528 - DNA, 23 bp, Homo sapiens
agtttaaccaaaaagaccagact

SEQ ID NO: 5229529 - DNA, 17 bp, Homo sapiens
agtttaactttaaaact

SEQ ID NO: 5229530 - DNA, 23 bp, Homo sapiens
agtttaagccgcagacctggagc

SEQ ID NO: 5229531 - DNA, 14 bp, Homo sapiens
agtttaaggaatat

SEQ ID NO: 5229532 - DNA, 18 bp, Homo sapiens
agtttaagggggacttaa

SEQ ID NO: 5229533 - DNA, 18 bp, Homo sapiens
agtttaaggtacactgtt

SEQ ID NO: 5229534 - DNA, 22 bp, Homo sapiens
agtttaagtaagtaagtttcat

SEQ ID NO: 5229535 - DNA, 15 bp, Homo sapiens
agtttaagtctctga

SEQ ID NO: 5229536 - DNA, 23 bp, Homo sapiens
agtttaagtgtgcagccatagtt

SEQ ID NO: 5229537 - DNA, 17 bp, Homo sapiens
agtttaatacaggaaat

SEQ ID NO: 5229538 - DNA, 15 bp, Homo sapiens
agtttaatattaaag

SEQ ID NO: 5229539 - DNA, 18 bp, Homo sapiens
agtttaatattaaagcca

SEQ ID NO: 5229540 - DNA, 20 bp, Homo sapiens
agtttaatgcaagagaacat

SEQ ID NO: 5229541 - DNA, 21 bp, Homo sapiens
agtttaatgcaagagaacatt

SEQ ID NO: 5229542 - DNA, 22 bp, Homo sapiens
agtttaatggtgccttcatttg

SEQ ID NO: 5229543 - DNA, 13 bp, Homo sapiens
agtttaatgtctc

SEQ ID NO: 5229544 - DNA, 14 bp, Homo sapiens
agtttaatgtctcc

SEQ ID NO: 5229545 - DNA, 20 bp, Homo sapiens
agtttaattatctgcattta

SEQ ID NO: 5229546 - DNA, 23 bp, Homo sapiens
agtttaattgaaagaatgtaaag

SEQ ID NO: 5229547 - DNA, 14 bp, Homo sapiens
agtttaattgactt

SEQ ID NO: 5229548 - DNA, 21 bp, Homo sapiens
agtttaattttgatatattca

SEQ ID NO: 5229549 - DNA, 19 bp, Homo sapiens
agtttacaagtgtatatca

SEQ ID NO: 5229550 - DNA, 14 bp, Homo sapiens
agtttacaatatta

SEQ ID NO: 5229551 - DNA, 21 bp, Homo sapiens
agtttacacttcatatagcat

SEQ ID NO: 5229552 - DNA, 18 bp, Homo sapiens
agtttacagaaaaatctt

SEQ ID NO: 5229553 - DNA, 12 bp, Homo sapiens
agtttacagtat

SEQ ID NO: 5229554 - DNA, 16 bp, Homo sapiens
agtttacagtatttct

SEQ ID NO: 5229555 - DNA, 14 bp, Homo sapiens
agtttacagtttgt

SEQ ID NO: 5229556 - DNA, 14 bp, Homo sapiens
agtttacattctaa

SEQ ID NO: 5229557 - DNA, 15 bp, Homo sapiens
agtttacattgtaaa

SEQ ID NO: 5229558 - DNA, 17 bp, Homo sapiens
agtttacattgtaaata

SEQ ID NO: 5229559 - DNA, 17 bp, Homo sapiens
agtttacattgtcctgt

SEQ ID NO: 5229560 - DNA, 13 bp, Homo sapiens
agtttacattttt

SEQ ID NO: 5229561 - DNA, 21 bp, Homo sapiens
agtttacatttttatttatga

SEQ ID NO: 5229562 - DNA, 22 bp, Homo sapiens
agtttacatttttatttatgaa

SEQ ID NO: 5229563 - DNA, 13 bp, Homo sapiens
agtttaccatttg

SEQ ID NO: 5229564 - DNA, 17 bp, Homo sapiens
agtttaccatttgtaat

SEQ ID NO: 5229565 - DNA, 20 bp, Homo sapiens
agtttaccccttggctttgt

SEQ ID NO: 5229566 - DNA, 20 bp, Homo sapiens
agtttacctctttaaaaaca

SEQ ID NO: 5229567 - DNA, 15 bp, Homo sapiens
agtttactattttac

SEQ ID NO: 5229568 - DNA, 15 bp, Homo sapiens
agtttactccttctg

SEQ ID NO: 5229569 - DNA, 15 bp, Homo sapiens
agtttactggataaa

SEQ ID NO: 5229570 - DNA, 13 bp, Homo sapiens
agtttacttcatg

SEQ ID NO: 5229571 - DNA, 16 bp, Homo sapiens
agtttagaaattacaa

SEQ ID NO: 5229572 - DNA, 12 bp, Homo sapiens
agtttagaacag

SEQ ID NO: 5229573 - DNA, 13 bp, Homo sapiens
agtttagaacaga

SEQ ID NO: 5229574 - DNA, 19 bp, Homo sapiens
agtctgtacctcaaatgaa

SEQ ID NO: 5229575 - DNA, 20 bp, Homo sapiens
agtctgtacctcaaatgaat

SEQ ID NO: 5229576 - DNA, 17 bp, Homo sapiens
agtctgtactaaacagt

SEQ ID NO: 5229577 - DNA, 12 bp, Homo sapiens
agtctgtacttc

SEQ ID NO: 5229578 - DNA, 22 bp, Homo sapiens
agtctgtacttcagttctcatc

SEQ ID NO: 5229579 - DNA, 17 bp, Homo sapiens
agtctgtaggagcaagg

SEQ ID NO: 5229580 - DNA, 22 bp, Homo sapiens
agtctgtagggagtgaagccac

SEQ ID NO: 5229581 - DNA, 21 bp, Homo sapiens
agtctgtcacccaggctggag

SEQ ID NO: 5229582 - DNA, 22 bp, Homo sapiens
agtctgtcacccaggctggagt

SEQ ID NO: 5229583 - DNA, 15 bp, Homo sapiens
agtctgtcataatat

SEQ ID NO: 5229584 - DNA, 21 bp, Homo sapiens
agtctgtcataatatttgaac

SEQ ID NO: 5229585 - DNA, 22 bp, Homo sapiens
agtctgtcataatatttgaaca

SEQ ID NO: 5229586 - DNA, 13 bp, Homo sapiens
agtctgtcatcca

SEQ ID NO: 5229587 - DNA, 15 bp, Homo sapiens
agtctgtccaggctc

SEQ ID NO: 5229588 - DNA, 11 bp, Homo sapiens
agtctgtcctt

SEQ ID NO: 5229589 - DNA, 14 bp, Homo sapiens
agtctgtctactgt

SEQ ID NO: 5229590 - DNA, 17 bp, Homo sapiens
agtctgtctactgtggt

SEQ ID NO: 5229591 - DNA, 20 bp, Homo sapiens
agtctgtctactgtggtgat

SEQ ID NO: 5229592 - DNA, 14 bp, Homo sapiens
agtctgtctcaaaa

SEQ ID NO: 5229593 - DNA, 12 bp, Homo sapiens
agtctgtctcag

SEQ ID NO: 5229594 - DNA, 14 bp, Homo sapiens
agtctgtctcagga

SEQ ID NO: 5229595 - DNA, 14 bp, Homo sapiens
agtctgtctctgtc

SEQ ID NO: 5229596 - DNA, 16 bp, Homo sapiens
agtctgtctgcactgc

SEQ ID NO: 5229597 - DNA, 15 bp, Homo sapiens
agtctgtcttctgta

SEQ ID NO: 5229598 - DNA, 16 bp, Homo sapiens
agtctgtcttctgtat

SEQ ID NO: 5229599 - DNA, 20 bp, Homo sapiens
agtctgtcttctgtatataa

SEQ ID NO: 5229600 - DNA, 16 bp, Homo sapiens
agtctgtctttcctga

SEQ ID NO: 5229601 - DNA, 18 bp, Homo sapiens
agtctgtgagattcattc

SEQ ID NO: 5229602 - DNA, 21 bp, Homo sapiens
agtctgtgagattcattcatg

SEQ ID NO: 5229603 - DNA, 20 bp, Homo sapiens
agtctgtgccacgtgtttgt

SEQ ID NO: 5229604 - DNA, 21 bp, Homo sapiens
agtctgtgcctggagctcctg

SEQ ID NO: 5229605 - DNA, 22 bp, Homo sapiens
agtctgtggagcgtccttgtcc

SEQ ID NO: 5229606 - DNA, 14 bp, Homo sapiens
agtctgtggatcag

SEQ ID NO: 5229607 - DNA, 17 bp, Homo sapiens
agtctgtggatcagaga

SEQ ID NO: 5229608 - DNA, 22 bp, Homo sapiens
agtctgtggctttttgttcaga

SEQ ID NO: 5229609 - DNA, 17 bp, Homo sapiens
agtctgtgtaactttaa

SEQ ID NO: 5229610 - DNA, 21 bp, Homo sapiens
agtctgtgtaactttaaacat

SEQ ID NO: 5229611 - DNA, 14 bp, Homo sapiens
agtctgtgtgactg

SEQ ID NO: 5229612 - DNA, 18 bp, Homo sapiens
agtctgtgtgatgaactt

SEQ ID NO: 5229613 - DNA, 17 bp, Homo sapiens
agtctgtgtgcacaatg

SEQ ID NO: 5229614 - DNA, 20 bp, Homo sapiens
agtctgtgtggcaaattaaa

SEQ ID NO: 5229615 - DNA, 19 bp, Homo sapiens
agtctgtgtgtagccagga

SEQ ID NO: 5229616 - DNA, 23 bp, Homo sapiens
agtctgtgtttacagacagaaga

SEQ ID NO: 5229617 - DNA, 20 bp, Homo sapiens
agtctgtgtttgaccttcac

SEQ ID NO: 5229618 - DNA, 16 bp, Homo sapiens
agtctgttgattaaag

SEQ ID NO: 5229619 - DNA, 13 bp, Homo sapiens
agtctgttgtgtg

SEQ ID NO: 5229620 - DNA, 16 bp, Homo sapiens
agtctgtttcccaagc

SEQ ID NO: 5229621 - DNA, 15 bp, Homo sapiens
agtctgttttgtaaa

SEQ ID NO: 5229622 - DNA, 20 bp, Homo sapiens
agtcttaacaaaccaacatc

SEQ ID NO: 5229623 - DNA, 17 bp, Homo sapiens
agtcttaacatttctaa

SEQ ID NO: 5229624 - DNA, 22 bp, Homo sapiens
agtcttaataaaataaactaga

SEQ ID NO: 5229625 - DNA, 22 bp, Homo sapiens
agtcttaatgttgaatgctgct

SEQ ID NO: 5229626 - DNA, 18 bp, Homo sapiens
agtcttaatttatttctt

SEQ ID NO: 5229627 - DNA, 15 bp, Homo sapiens
agtcttacaatcaaa

SEQ ID NO: 5229628 - DNA, 19 bp, Homo sapiens
agtcttacaatcaaatctc

SEQ ID NO: 5229629 - DNA, 16 bp, Homo sapiens
agtcttacaggaagcc

SEQ ID NO: 5229630 - DNA, 16 bp, Homo sapiens
agtcttactacagaaa

SEQ ID NO: 5229631 - DNA, 19 bp, Homo sapiens
agtcttactgttttgtgcg

SEQ ID NO: 5229632 - DNA, 24 bp, Homo sapiens
agtcttagacttgaaatactactt

SEQ ID NO: 5229633 - DNA, 21 bp, Homo sapiens
agtcttagatcatagttttat

SEQ ID NO: 5229634 - DNA, 14 bp, Homo sapiens
agtcttagatgtat

SEQ ID NO: 5229635 - DNA, 23 bp, Homo sapiens
agtcttagatgtatatatttcct

SEQ ID NO: 5229636 - DNA, 22 bp, Homo sapiens
agtcttagggatttattttcaa

SEQ ID NO: 5229637 - DNA, 15 bp, Homo sapiens
agtcttaggtttcca

SEQ ID NO: 5229638 - DNA, 17 bp, Homo sapiens
agtcttagtaatagcat

SEQ ID NO: 5229639 - DNA, 21 bp, Homo sapiens
agtcttatctgagctgagcca

SEQ ID NO: 5229640 - DNA, 22 bp, Homo sapiens
agtcttatctgagctgagccag

SEQ ID NO: 5229641 - DNA, 23 bp, Homo sapiens
agtcttatctgagctgagccagg

SEQ ID NO: 5229642 - DNA, 16 bp, Homo sapiens
agtcttatgcttccag

SEQ ID NO: 5229643 - DNA, 17 bp, Homo sapiens
agtcttatgcttccaga

SEQ ID NO: 5229644 - DNA, 18 bp, Homo sapiens
agtcttatgcttccagaa

SEQ ID NO: 5229645 - DNA, 15 bp, Homo sapiens
agtcttatgtaaagt

SEQ ID NO: 5229646 - DNA, 22 bp, Homo sapiens
agtcttcaacataacccacttg

SEQ ID NO: 5229647 - DNA, 19 bp, Homo sapiens
agtcttcacttgcactggg

SEQ ID NO: 5229648 - DNA, 18 bp, Homo sapiens
agtcttcagacccagaga

SEQ ID NO: 5229649 - DNA, 14 bp, Homo sapiens
agtcttcatgaaat

SEQ ID NO: 5229650 - DNA, 16 bp, Homo sapiens
agtcttcatgaaatgc

SEQ ID NO: 5229651 - DNA, 14 bp, Homo sapiens
agtcttccaaacca

SEQ ID NO: 5229652 - DNA, 20 bp, Homo sapiens
agtcttccacaaagaaaatt

SEQ ID NO: 5229653 - DNA, 17 bp, Homo sapiens
agtcttccacctggaag

SEQ ID NO: 5229654 - DNA, 15 bp, Homo sapiens
agtcttccagaaagc

SEQ ID NO: 5229655 - DNA, 22 bp, Homo sapiens
agtcttccagagcctaagaaaa

SEQ ID NO: 5229656 - DNA, 17 bp, Homo sapiens
agtcttccatcagcagt

SEQ ID NO: 5229657 - DNA, 20 bp, Homo sapiens
agtcttccatcagcagtgat

SEQ ID NO: 5229658 - DNA, 16 bp, Homo sapiens
agtcttccatttgcaa

SEQ ID NO: 5229659 - DNA, 17 bp, Homo sapiens
agtcttccctagggctg

SEQ ID NO: 5229660 - DNA, 14 bp, Homo sapiens
agtcttccctcaga

SEQ ID NO: 5229661 - DNA, 18 bp, Homo sapiens
agtcttcccttacctcaa

SEQ ID NO: 5229662 - DNA, 10 bp, Homo sapiens
agtcttccta

SEQ ID NO: 5229663 - DNA, 23 bp, Homo sapiens
agtcttcctcttagcctctggat

SEQ ID NO: 5229664 - DNA, 19 bp, Homo sapiens
agtcttcctgacactttaa

SEQ ID NO: 5229665 - DNA, 15 bp, Homo sapiens
agtcttcctgtagtg

SEQ ID NO: 5229666 - DNA, 17 bp, Homo sapiens
agtcttccttgtggaat

SEQ ID NO: 5229667 - DNA, 20 bp, Homo sapiens
agtcttccttgtggaatgct

SEQ ID NO: 5229668 - DNA, 20 bp, Homo sapiens
agtcttctcatagcattaac

SEQ ID NO: 5229669 - DNA, 11 bp, Homo sapiens
agtcttctccc

SEQ ID NO: 5229670 - DNA, 20 bp, Homo sapiens
agtcttctcccaactcagcc

SEQ ID NO: 5229671 - DNA, 13 bp, Homo sapiens
agtcttctccctg

SEQ ID NO: 5229672 - DNA, 14 bp, Homo sapiens
agtcttctccctgt

SEQ ID NO: 5229673 - DNA, 18 bp, Homo sapiens
agtcttctctctggctca

SEQ ID NO: 5229674 - DNA, 20 bp, Homo sapiens
agtcttctctctggctcagg

SEQ ID NO: 5229675 - DNA, 13 bp, Homo sapiens
agtcttctgactg

SEQ ID NO: 5229676 - DNA, 18 bp, Homo sapiens
agtcttctgactgtcacc

SEQ ID NO: 5229677 - DNA, 21 bp, Homo sapiens
agtcttctgagcgagtgctct

SEQ ID NO: 5229678 - DNA, 18 bp, Homo sapiens
agtcttctgggctgcggg

SEQ ID NO: 5229679 - DNA, 23 bp, Homo sapiens
agtcttgaaatgaaagggaaact

SEQ ID NO: 5229680 - DNA, 12 bp, Homo sapiens
agtcttgaagtt

SEQ ID NO: 5229681 - DNA, 16 bp, Homo sapiens
agtcttgacctctcca

SEQ ID NO: 5229682 - DNA, 18 bp, Homo sapiens
agtcttgacctctccagc

SEQ ID NO: 5229683 - DNA, 21 bp, Homo sapiens
agtcttgagcaatgtttttct

SEQ ID NO: 5229684 - DNA, 23 bp, Homo sapiens
agtcttgagtgggccccctctct

SEQ ID NO: 5229685 - DNA, 12 bp, Homo sapiens
agtcttgcctag

SEQ ID NO: 5229686 - DNA, 21 bp, Homo sapiens
agtcttgcctatattttcctg

SEQ ID NO: 5229687 - DNA, 12 bp, Homo sapiens
agtcttgctgtg

SEQ ID NO: 5229688 - DNA, 14 bp, Homo sapiens
agtcttgctgtgct

SEQ ID NO: 5229689 - DNA, 16 bp, Homo sapiens
agtcttgctgtggtct

SEQ ID NO: 5229690 - DNA, 23 bp, Homo sapiens
agtcttgctgtggtctctttgtg

SEQ ID NO: 5229691 - DNA, 16 bp, Homo sapiens
agtcttggaatacttg

SEQ ID NO: 5229692 - DNA, 20 bp, Homo sapiens
agtcttggcctgcctcccag

SEQ ID NO: 5229693 - DNA, 13 bp, Homo sapiens
agtcttgggcctg

SEQ ID NO: 5229694 - DNA, 23 bp, Homo sapiens
agtcttggtttctctctacagtg

SEQ ID NO: 5229695 - DNA, 16 bp, Homo sapiens
agtcttgtacacttaa

SEQ ID NO: 5229696 - DNA, 11 bp, Homo sapiens
agtcttgtata

SEQ ID NO: 5229697 - DNA, 22 bp, Homo sapiens
agtcttgtattaagttgttaat

SEQ ID NO: 5229698 - DNA, 15 bp, Homo sapiens
agtcttgtcagaatt

SEQ ID NO: 5229699 - DNA, 20 bp, Homo sapiens
agtcttgtcccaattaaaat

SEQ ID NO: 5229700 - DNA, 20 bp, Homo sapiens
agtcttgtctcagattttat

SEQ ID NO: 5229701 - DNA, 17 bp, Homo sapiens
agtcttgtcttagctct

SEQ ID NO: 5229702 - DNA, 18 bp, Homo sapiens
agtcttgtcttagctctg

SEQ ID NO: 5229703 - DNA, 15 bp, Homo sapiens
agtcttgtgaacttt

SEQ ID NO: 5229704 - DNA, 20 bp, Homo sapiens
agtcttgtgactagtgctga

SEQ ID NO: 5229705 - DNA, 23 bp, Homo sapiens
agtcttgtgactagtgctgaagc

SEQ ID NO: 5229706 - DNA, 12 bp, Homo sapiens
agtcttgtgctt

SEQ ID NO: 5229707 - DNA, 20 bp, Homo sapiens
agtcttgtgcttttcctatt

SEQ ID NO: 5229708 - DNA, 14 bp, Homo sapiens
agtcttgttaatta

SEQ ID NO: 5229709 - DNA, 17 bp, Homo sapiens
agtctttaaaggcccag

SEQ ID NO: 5229710 - DNA, 17 bp, Homo sapiens
agtctttatttttttcc

SEQ ID NO: 5229711 - DNA, 22 bp, Homo sapiens
agtctttatttttttcccatga

SEQ ID NO: 5229712 - DNA, 16 bp, Homo sapiens
agtctttcacatttaa

SEQ ID NO: 5229713 - DNA, 18 bp, Homo sapiens
agtctttcacatttaaat

SEQ ID NO: 5229714 - DNA, 13 bp, Homo sapiens
agtctttcagatg

SEQ ID NO: 5229715 - DNA, 22 bp, Homo sapiens
agtctttcattcggtgtgaact

SEQ ID NO: 5229716 - DNA, 13 bp, Homo sapiens
agtctttccccca

SEQ ID NO: 5229717 - DNA, 16 bp, Homo sapiens
agtctttcccccagga

SEQ ID NO: 5229718 - DNA, 15 bp, Homo sapiens
agtctttctcactgc

SEQ ID NO: 5229719 - DNA, 17 bp, Homo sapiens
agtctttctcactgcct

SEQ ID NO: 5229720 - DNA, 15 bp, Homo sapiens
agtctttctcctctt

SEQ ID NO: 5229721 - DNA, 21 bp, Homo sapiens
agtctttctcctctttgagac

SEQ ID NO: 5229722 - DNA, 14 bp, Homo sapiens
agtctttctctttc

SEQ ID NO: 5229723 - DNA, 14 bp, Homo sapiens
agtctttcttgaaa

SEQ ID NO: 5229724 - DNA, 19 bp, Homo sapiens
agtctttgagactaaattc

SEQ ID NO: 5229725 - DNA, 9 bp, Homo sapiens
agtctttgc

SEQ ID NO: 5229726 - DNA, 22 bp, Homo sapiens
agtctttgccagtcattcagca

SEQ ID NO: 5229727 - DNA, 14 bp, Homo sapiens
agtctttgccttct

SEQ ID NO: 5229728 - DNA, 15 bp, Homo sapiens
agtctttgccttctc

SEQ ID NO: 5229729 - DNA, 20 bp, Homo sapiens
agtctttgctcagtgtccag

SEQ ID NO: 5229730 - DNA, 20 bp, Homo sapiens
agtctttgggggattcaaat

SEQ ID NO: 5229731 - DNA, 15 bp, Homo sapiens
agtctttggttctaa

SEQ ID NO: 5229732 - DNA, 23 bp, Homo sapiens
agtctttgtaagtaaactgccct

SEQ ID NO: 5229733 - DNA, 14 bp, Homo sapiens
agtctttgtacaga

SEQ ID NO: 5229734 - DNA, 15 bp, Homo sapiens
agtctttgtgtgtta

SEQ ID NO: 5229735 - DNA, 17 bp, Homo sapiens
agtctttgtgtgttata

SEQ ID NO: 5229736 - DNA, 13 bp, Homo sapiens
agtctttgttgca

SEQ ID NO: 5229737 - DNA, 19 bp, Homo sapiens
agtcttttaaaaagtattg

SEQ ID NO: 5229738 - DNA, 12 bp, Homo sapiens
agtcttttactc

SEQ ID NO: 5229739 - DNA, 21 bp, Homo sapiens
agtcttttccacatggcagat

SEQ ID NO: 5229740 - DNA, 15 bp, Homo sapiens
agtcttttccatgaa

SEQ ID NO: 5229741 - DNA, 18 bp, Homo sapiens
agtcttttctctgaaaag

SEQ ID NO: 5229742 - DNA, 18 bp, Homo sapiens
agtcttttctgttattgt

SEQ ID NO: 5229743 - DNA, 15 bp, Homo sapiens
agtcttttgcatgtc

SEQ ID NO: 5229744 - DNA, 22 bp, Homo sapiens
agtcttttgcatgtcgcacaat

SEQ ID NO: 5229745 - DNA, 16 bp, Homo sapiens
agtcttttgctgtgct

SEQ ID NO: 5229746 - DNA, 13 bp, Homo sapiens
agtcttttgcttt

SEQ ID NO: 5229747 - DNA, 14 bp, Homo sapiens
agtcttttgctttt

SEQ ID NO: 5229748 - DNA, 22 bp, Homo sapiens
agtcttttgcttttgcccattt

SEQ ID NO: 5229749 - DNA, 19 bp, Homo sapiens
agtcttttgcttttggcaa

SEQ ID NO: 5229750 - DNA, 15 bp, Homo sapiens
agtcttttgtaatat

SEQ ID NO: 5229751 - DNA, 23 bp, Homo sapiens
agtctttttagtgttttgcaagg

SEQ ID NO: 5229752 - DNA, 19 bp, Homo sapiens
agtttagaacctacaaaag

SEQ ID NO: 5229753 - DNA, 12 bp, Homo sapiens
agtttagaactt

SEQ ID NO: 5229754 - DNA, 21 bp, Homo sapiens
agtttagaagcgctcatctgg

SEQ ID NO: 5229755 - DNA, 18 bp, Homo sapiens
agtttagaatggaggaag

SEQ ID NO: 5229756 - DNA, 23 bp, Homo sapiens
agtttagaatggaggaagaacaa

SEQ ID NO: 5229757 - DNA, 21 bp, Homo sapiens
agtttagcccttccctgcctt

SEQ ID NO: 5229758 - DNA, 14 bp, Homo sapiens
agtttagctctgag

SEQ ID NO: 5229759 - DNA, 16 bp, Homo sapiens
agtttaggataaaata

SEQ ID NO: 5229760 - DNA, 13 bp, Homo sapiens
agtttaggcagct

SEQ ID NO: 5229761 - DNA, 13 bp, Homo sapiens
agtttaggccttg

SEQ ID NO: 5229762 - DNA, 21 bp, Homo sapiens
agtttagggaacaatttggca

SEQ ID NO: 5229763 - DNA, 24 bp, Homo sapiens
agtttagggaacaatttggcaatt

SEQ ID NO: 5229764 - DNA, 13 bp, Homo sapiens
agtttagggtggg

SEQ ID NO: 5229765 - DNA, 22 bp, Homo sapiens
agtttagtgtggttttctgttt

SEQ ID NO: 5229766 - DNA, 13 bp, Homo sapiens
agtttataaaagt

SEQ ID NO: 5229767 - DNA, 16 bp, Homo sapiens
agtttataagcccaaa

SEQ ID NO: 5229768 - DNA, 23 bp, Homo sapiens
agtttataagcccaaatggctct

SEQ ID NO: 5229769 - DNA, 12 bp, Homo sapiens
agtttatacaga

SEQ ID NO: 5229770 - DNA, 20 bp, Homo sapiens
agtttatacagtgtacatgt

SEQ ID NO: 5229771 - DNA, 21 bp, Homo sapiens
agtttatatactgctatttac

SEQ ID NO: 5229772 - DNA, 15 bp, Homo sapiens
agtttatattctgaa

SEQ ID NO: 5229773 - DNA, 22 bp, Homo sapiens
agtttatattctgaaaggaaat

SEQ ID NO: 5229774 - DNA, 15 bp, Homo sapiens
agtttatatttaact

SEQ ID NO: 5229775 - DNA, 19 bp, Homo sapiens
agtttatcagtaaataact

SEQ ID NO: 5229776 - DNA, 15 bp, Homo sapiens
agtttatcatgaagc

SEQ ID NO: 5229777 - DNA, 16 bp, Homo sapiens
agtttatcatgaagcc

SEQ ID NO: 5229778 - DNA, 16 bp, Homo sapiens
agtttatcattcaagt

SEQ ID NO: 5229779 - DNA, 13 bp, Homo sapiens
agtttatccaaat

SEQ ID NO: 5229780 - DNA, 19 bp, Homo sapiens
agtttatctatcggaagaa

SEQ ID NO: 5229781 - DNA, 22 bp, Homo sapiens
agtttatctatcggaagaacat

SEQ ID NO: 5229782 - DNA, 19 bp, Homo sapiens
agtttatgcagtgctgctt

SEQ ID NO: 5229783 - DNA, 19 bp, Homo sapiens
agtttatggatatgctgct

SEQ ID NO: 5229784 - DNA, 19 bp, Homo sapiens
agtttatggcaaagatttt

SEQ ID NO: 5229785 - DNA, 15 bp, Homo sapiens
agtttatgtctaaag

SEQ ID NO: 5229786 - DNA, 21 bp, Homo sapiens
agtttatgtctaaagagcttt

SEQ ID NO: 5229787 - DNA, 12 bp, Homo sapiens
agtttatgtttt

SEQ ID NO: 5229788 - DNA, 16 bp, Homo sapiens
agtttatgttttggtc

SEQ ID NO: 5229789 - DNA, 14 bp, Homo sapiens
agtttattaaatct

SEQ ID NO: 5229790 - DNA, 15 bp, Homo sapiens
agtttattaaatctg

SEQ ID NO: 5229791 - DNA, 16 bp, Homo sapiens
agtttattacaatgta

SEQ ID NO: 5229792 - DNA, 17 bp, Homo sapiens
agtttattacaatgtat

SEQ ID NO: 5229793 - DNA, 21 bp, Homo sapiens
agtttattacaatgtatcttt

SEQ ID NO: 5229794 - DNA, 20 bp, Homo sapiens
agtttattatagtctgtact

SEQ ID NO: 5229795 - DNA, 15 bp, Homo sapiens
agtttattattttca

SEQ ID NO: 5229796 - DNA, 22 bp, Homo sapiens
agtttattccagagctgccagt

SEQ ID NO: 5229797 - DNA, 13 bp, Homo sapiens
agtttattctaat

SEQ ID NO: 5229798 - DNA, 14 bp, Homo sapiens
agtttattctgatt

SEQ ID NO: 5229799 - DNA, 14 bp, Homo sapiens
agtttattctgtgg

SEQ ID NO: 5229800 - DNA, 16 bp, Homo sapiens
agtttattctgtggtt

SEQ ID NO: 5229801 - DNA, 17 bp, Homo sapiens
agtttattctgtggttc

SEQ ID NO: 5229802 - DNA, 22 bp, Homo sapiens
agtttattgccctcaaaatctt

SEQ ID NO: 5229803 - DNA, 20 bp, Homo sapiens
agtttattgtaatatatggg

SEQ ID NO: 5229804 - DNA, 22 bp, Homo sapiens
agtttattgtttgatgttttta

SEQ ID NO: 5229805 - DNA, 13 bp, Homo sapiens
agtttatttcatg

SEQ ID NO: 5229806 - DNA, 21 bp, Homo sapiens
agtttatttccactattttca

SEQ ID NO: 5229807 - DNA, 22 bp, Homo sapiens
agtttatttccactattttcaa

SEQ ID NO: 5229808 - DNA, 18 bp, Homo sapiens
agtttatttgttgagagt

SEQ ID NO: 5229809 - DNA, 23 bp, Homo sapiens
agtttattttaaaacaataggat

SEQ ID NO: 5229810 - DNA, 17 bp, Homo sapiens
agtttattttgttacac

SEQ ID NO: 5229811 - DNA, 12 bp, Homo sapiens
agtttatttttg

SEQ ID NO: 5229812 - DNA, 13 bp, Homo sapiens
agtttatttttgt

SEQ ID NO: 5229813 - DNA, 17 bp, Homo sapiens
agtttattttttctaca

SEQ ID NO: 5229814 - DNA, 18 bp, Homo sapiens
agtttattttttctacac

SEQ ID NO: 5229815 - DNA, 18 bp, Homo sapiens
agtttcaaaaatctgaag

SEQ ID NO: 5229816 - DNA, 22 bp, Homo sapiens
agtttcaaaaatctgaagattg

SEQ ID NO: 5229817 - DNA, 16 bp, Homo sapiens
agtttcaaagtgtctc

SEQ ID NO: 5229818 - DNA, 19 bp, Homo sapiens
agtttcaaagtgtctcatt

SEQ ID NO: 5229819 - DNA, 15 bp, Homo sapiens
agtttcaaccatgaa

SEQ ID NO: 5229820 - DNA, 18 bp, Homo sapiens
agtttcaagttttaaagt

SEQ ID NO: 5229821 - DNA, 22 bp, Homo sapiens
agtttcaagttttaaagttcat

SEQ ID NO: 5229822 - DNA, 16 bp, Homo sapiens
agtttcaataaagttt

SEQ ID NO: 5229823 - DNA, 17 bp, Homo sapiens
agtttcaataaagtttg

SEQ ID NO: 5229824 - DNA, 21 bp, Homo sapiens
agtttcaatgtagtctgtagc

SEQ ID NO: 5229825 - DNA, 16 bp, Homo sapiens
agtttcaatgtgattc

SEQ ID NO: 5229826 - DNA, 16 bp, Homo sapiens
agtttcaattcagtgc

SEQ ID NO: 5229827 - DNA, 17 bp, Homo sapiens
agtttcaattcagtgct

SEQ ID NO: 5229828 - DNA, 15 bp, Homo sapiens
agtttcaattgagta

SEQ ID NO: 5229829 - DNA, 19 bp, Homo sapiens
agtttcacaagtgagccct

SEQ ID NO: 5229830 - DNA, 20 bp, Homo sapiens
agtttcacagactcttacca

SEQ ID NO: 5229831 - DNA, 20 bp, Homo sapiens
agtttcacataagttatttg

SEQ ID NO: 5229832 - DNA, 20 bp, Homo sapiens
agtttcacatatttgtagct

SEQ ID NO: 5229833 - DNA, 18 bp, Homo sapiens
agtttcaccactcctctc

SEQ ID NO: 5229834 - DNA, 22 bp, Homo sapiens
agtttcaccactcctctccctt

SEQ ID NO: 5229835 - DNA, 18 bp, Homo sapiens
agtttcaccatctttgag

SEQ ID NO: 5229836 - DNA, 15 bp, Homo sapiens
agtttcactccctct

SEQ ID NO: 5229837 - DNA, 15 bp, Homo sapiens
agtttcactgactta

SEQ ID NO: 5229838 - DNA, 17 bp, Homo sapiens
agtttcactgccatata

SEQ ID NO: 5229839 - DNA, 20 bp, Homo sapiens
agtttcactgtactgcatgt

SEQ ID NO: 5229840 - DNA, 23 bp, Homo sapiens
agtttcactgtactgcatgtgac

SEQ ID NO: 5229841 - DNA, 12 bp, Homo sapiens
agtttcagaagc

SEQ ID NO: 5229842 - DNA, 16 bp, Homo sapiens
agtttcagaagcaggc

SEQ ID NO: 5229843 - DNA, 13 bp, Homo sapiens
agtttcagaagta

SEQ ID NO: 5229844 - DNA, 12 bp, Homo sapiens
agtttcagagaa

SEQ ID NO: 5229845 - DNA, 17 bp, Homo sapiens
agtttcagagatggaca

SEQ ID NO: 5229846 - DNA, 17 bp, Homo sapiens
agtttcagatatatatc

SEQ ID NO: 5229847 - DNA, 20 bp, Homo sapiens
agtttcagatttgccattca

SEQ ID NO: 5229848 - DNA, 16 bp, Homo sapiens
agtttcagctggaaac

SEQ ID NO: 5229849 - DNA, 23 bp, Homo sapiens
agtttcagctggaaacttctgta

SEQ ID NO: 5229850 - DNA, 17 bp, Homo sapiens
agtttcagcttaaaata

SEQ ID NO: 5229851 - DNA, 24 bp, Homo sapiens
agtttcaggcaaggcagctcccag

SEQ ID NO: 5229852 - DNA, 15 bp, Homo sapiens
agtttcaggtgacat

SEQ ID NO: 5229853 - DNA, 18 bp, Homo sapiens
agtttcaggtgtttagtt

SEQ ID NO: 5229854 - DNA, 20 bp, Homo sapiens
agtttcagtagattgcagaa

SEQ ID NO: 5229855 - DNA, 16 bp, Homo sapiens
agtttcagtttctgtt

SEQ ID NO: 5229856 - DNA, 18 bp, Homo sapiens
agtttcagtttgttggaa

SEQ ID NO: 5229857 - DNA, 16 bp, Homo sapiens
agtttcataattgtgt

SEQ ID NO: 5229858 - DNA, 18 bp, Homo sapiens
agtttcatagctaagaaa

SEQ ID NO: 5229859 - DNA, 16 bp, Homo sapiens
agtttcatcaggacca

SEQ ID NO: 5229860 - DNA, 19 bp, Homo sapiens
agtttcatctggttgtgac

SEQ ID NO: 5229861 - DNA, 21 bp, Homo sapiens
agtttcatgaaatgattggaa

SEQ ID NO: 5229862 - DNA, 19 bp, Homo sapiens
agtttcatgtatgtatata

SEQ ID NO: 5229863 - DNA, 18 bp, Homo sapiens
agtttcatgttggtttat

SEQ ID NO: 5229864 - DNA, 15 bp, Homo sapiens
agtttcattattctc

SEQ ID NO: 5229865 - DNA, 20 bp, Homo sapiens
agtttcattctcctgcctgt

SEQ ID NO: 5229866 - DNA, 23 bp, Homo sapiens
agtttcatttacaatttcaaaag

SEQ ID NO: 5229867 - DNA, 14 bp, Homo sapiens
agtttcatttttca

SEQ ID NO: 5229868 - DNA, 17 bp, Homo sapiens
agtttccaagcaaatgt

SEQ ID NO: 5229869 - DNA, 18 bp, Homo sapiens
agtttccaattccactgt

SEQ ID NO: 5229870 - DNA, 17 bp, Homo sapiens
agtttccatagcaacag

SEQ ID NO: 5229871 - DNA, 21 bp, Homo sapiens
agtttccatttggattttaaa

SEQ ID NO: 5229872 - DNA, 22 bp, Homo sapiens
agtttcccaaaaaccccagtgt

SEQ ID NO: 5229873 - DNA, 10 bp, Homo sapiens
agtttcccca

SEQ ID NO: 5229874 - DNA, 23 bp, Homo sapiens
agtttccccatttgtttgtgctt

SEQ ID NO: 5229875 - DNA, 16 bp, Homo sapiens
agtttcccctctggct

SEQ ID NO: 5229876 - DNA, 17 bp, Homo sapiens
agtttcccctctggctt

SEQ ID NO: 5229877 - DNA, 13 bp, Homo sapiens
agtttccctctgt

SEQ ID NO: 5229878 - DNA, 20 bp, Homo sapiens
agtttccctctgtatacaag

SEQ ID NO: 5229879 - DNA, 20 bp, Homo sapiens
agtttcccttcctccatcct

SEQ ID NO: 5229880 - DNA, 21 bp, Homo sapiens
agtttccgaatctctttccct

SEQ ID NO: 5229881 - DNA, 20 bp, Homo sapiens
agtttccgtgcgtggcactc

SEQ ID NO: 5229882 - DNA, 23 bp, Homo sapiens
agtttccgtttccaggtgtttat

SEQ ID NO: 5229883 - DNA, 17 bp, Homo sapiens
agtttcctaaaagttca

SEQ ID NO: 5229884 - DNA, 16 bp, Homo sapiens
agtttcctaatcagaa

SEQ ID NO: 5229885 - DNA, 17 bp, Homo sapiens
agtttcctagaacgcaa

SEQ ID NO: 5229886 - DNA, 23 bp, Homo sapiens
agtttcctcagaacccacagtga

SEQ ID NO: 5229887 - DNA, 18 bp, Homo sapiens
agtttcctcaggctgctg

SEQ ID NO: 5229888 - DNA, 11 bp, Homo sapiens
agtttcctgga

SEQ ID NO: 5229889 - DNA, 18 bp, Homo sapiens
agtttccttattttcata

SEQ ID NO: 5229890 - DNA, 18 bp, Homo sapiens
agtttccttggctggtgc

SEQ ID NO: 5229891 - DNA, 13 bp, Homo sapiens
agtttccttttaa

SEQ ID NO: 5229892 - DNA, 19 bp, Homo sapiens
agtttccttttctgtctct

SEQ ID NO: 5229893 - DNA, 20 bp, Homo sapiens
agtttcgacttatttcttaa

SEQ ID NO: 5229894 - DNA, 20 bp, Homo sapiens
agtttcgaggggtcctcacc

SEQ ID NO: 5229895 - DNA, 20 bp, Homo sapiens
agtttctaaaattgagttct

SEQ ID NO: 5229896 - DNA, 19 bp, Homo sapiens
agtttctaaaccatgaaaa

SEQ ID NO: 5229897 - DNA, 16 bp, Homo sapiens
agtttctaaactggag

SEQ ID NO: 5229898 - DNA, 17 bp, Homo sapiens
agtttctaaactggaga

SEQ ID NO: 5229899 - DNA, 19 bp, Homo sapiens
agtttctaaactggagact

SEQ ID NO: 5229900 - DNA, 14 bp, Homo sapiens
agtttctaagaatt

SEQ ID NO: 5229901 - DNA, 14 bp, Homo sapiens
agtttctaagattc

SEQ ID NO: 5229902 - DNA, 18 bp, Homo sapiens
agtttctaagtctgttat

SEQ ID NO: 5229903 - DNA, 22 bp, Homo sapiens
agtttctacattcagattatat

SEQ ID NO: 5229904 - DNA, 15 bp, Homo sapiens
agtttctagaggcct

SEQ ID NO: 5229905 - DNA, 16 bp, Homo sapiens
agtttctagaggcctc

SEQ ID NO: 5229906 - DNA, 17 bp, Homo sapiens
agtttctagaggcctca

SEQ ID NO: 5229907 - DNA, 16 bp, Homo sapiens
agtttctagctagaaa

SEQ ID NO: 5229908 - DNA, 19 bp, Homo sapiens
agtttctatggattcactt

SEQ ID NO: 5229909 - DNA, 17 bp, Homo sapiens
agtttctattgtaaatt

SEQ ID NO: 5229910 - DNA, 15 bp, Homo sapiens
agtttctatttagtt

SEQ ID NO: 5229911 - DNA, 20 bp, Homo sapiens
agtttctcaaaacccttaaa

SEQ ID NO: 5229912 - DNA, 13 bp, Homo sapiens
agtttctcaagtt

SEQ ID NO: 5229913 - DNA, 19 bp, Homo sapiens
agtttctcaagtttaaagt

SEQ ID NO: 5229914 - DNA, 23 bp, Homo sapiens
agtttctcagatccttgtttcaa

SEQ ID NO: 5229915 - DNA, 12 bp, Homo sapiens
agtttctcagct

SEQ ID NO: 5229916 - DNA, 14 bp, Homo sapiens
agtttctcagctcc

SEQ ID NO: 5229917 - DNA, 16 bp, Homo sapiens
agtttctcagctccca

SEQ ID NO: 5229918 - DNA, 22 bp, Homo sapiens
agtttctcatgacggcttttgt

SEQ ID NO: 5229919 - DNA, 13 bp, Homo sapiens
agtttctccaagc

SEQ ID NO: 5229920 - DNA, 21 bp, Homo sapiens
agtttctcctttattgctcct

SEQ ID NO: 5229921 - DNA, 18 bp, Homo sapiens
agtttctctaaagtcact

SEQ ID NO: 5229922 - DNA, 11 bp, Homo sapiens
agtttctctgt

SEQ ID NO: 5229923 - DNA, 12 bp, Homo sapiens
agtttctctgtt

SEQ ID NO: 5229924 - DNA, 18 bp, Homo sapiens
agtttctgaatattttaa

SEQ ID NO: 5229925 - DNA, 19 bp, Homo sapiens
agtttctgacaattaacat

SEQ ID NO: 5229926 - DNA, 19 bp, Homo sapiens
agtttctgccgcagccctg

SEQ ID NO: 5229927 - DNA, 13 bp, Homo sapiens
agtttctgcctgg

SEQ ID NO: 5229928 - DNA, 14 bp, Homo sapiens
agtttctgcctggg

SEQ ID NO: 5229929 - DNA, 15 bp, Homo sapiens
agtttctgcctgggc

SEQ ID NO: 5229930 - DNA, 23 bp, Homo sapiens
agtttctggattagcttttccta

SEQ ID NO: 5229931 - DNA, 17 bp, Homo sapiens
agtttctggctgaaaat

SEQ ID NO: 5229932 - DNA, 17 bp, Homo sapiens
agtttctgggacctcag

SEQ ID NO: 5229933 - DNA, 22 bp, Homo sapiens
agtttctggtaagactgctggt

SEQ ID NO: 5229934 - DNA, 13 bp, Homo sapiens
agtttctgtaatt

SEQ ID NO: 5229935 - DNA, 11 bp, Homo sapiens
agtttctgttg

SEQ ID NO: 5229936 - DNA, 16 bp, Homo sapiens
agtttctgtttcaaag

SEQ ID NO: 5229937 - DNA, 19 bp, Homo sapiens
agtttctgtttgattcttt

SEQ ID NO: 5229938 - DNA, 15 bp, Homo sapiens
agtttcttagctttt

SEQ ID NO: 5229939 - DNA, 16 bp, Homo sapiens
agtttcttcaatctga

SEQ ID NO: 5229940 - DNA, 14 bp, Homo sapiens
agtttcttcatgca

SEQ ID NO: 5229941 - DNA, 17 bp, Homo sapiens
agtttcttcatgcatta

SEQ ID NO: 5229942 - DNA, 13 bp, Homo sapiens
agtttcttcctgc

SEQ ID NO: 5229943 - DNA, 13 bp, Homo sapiens
agtttcttctcat

SEQ ID NO: 5229944 - DNA, 15 bp, Homo sapiens
agtttcttcttacac

SEQ ID NO: 5229945 - DNA, 18 bp, Homo sapiens
agtttcttgcaagctcca

SEQ ID NO: 5229946 - DNA, 13 bp, Homo sapiens
agtttcttgcttg

SEQ ID NO: 5229947 - DNA, 18 bp, Homo sapiens
agtttcttgcttggaagc

SEQ ID NO: 5229948 - DNA, 16 bp, Homo sapiens
agtttcttggtctcag

SEQ ID NO: 5229949 - DNA, 18 bp, Homo sapiens
agtttcttggtctcagct

SEQ ID NO: 5229950 - DNA, 18 bp, Homo sapiens
agtttcttgtaagccatc

SEQ ID NO: 5229951 - DNA, 20 bp, Homo sapiens
agtttcttgtgtagatttga

SEQ ID NO: 5229952 - DNA, 22 bp, Homo sapiens
agtttcttgtgtagatttgaaa

SEQ ID NO: 5229953 - DNA, 14 bp, Homo sapiens
agtttctttacatt

SEQ ID NO: 5229954 - DNA, 14 bp, Homo sapiens
agtttctttcagat

SEQ ID NO: 5229955 - DNA, 19 bp, Homo sapiens
agtttctttcagatcattt

SEQ ID NO: 5229956 - DNA, 19 bp, Homo sapiens
agtttctttcctgccttct

SEQ ID NO: 5229957 - DNA, 21 bp, Homo sapiens
agtttctttcctgccttcttc

SEQ ID NO: 5229958 - DNA, 18 bp, Homo sapiens
agtttcttttgtgttcct

SEQ ID NO: 5229959 - DNA, 17 bp, Homo sapiens
agtttgaaagttgtaca

SEQ ID NO: 5229960 - DNA, 18 bp, Homo sapiens
agtttgaaagttgtacat

SEQ ID NO: 5229961 - DNA, 12 bp, Homo sapiens
agtttgaaattc

SEQ ID NO: 5229962 - DNA, 15 bp, Homo sapiens
agtttgaacttcata

SEQ ID NO: 5229963 - DNA, 20 bp, Homo sapiens
agtttgaagaccaatcaaat

SEQ ID NO: 5229964 - DNA, 15 bp, Homo sapiens
agtttgaagaccgcc

SEQ ID NO: 5229965 - DNA, 16 bp, Homo sapiens
agtttgaagcctgtgc

SEQ ID NO: 5229966 - DNA, 16 bp, Homo sapiens
agtttgaaggaaacag

SEQ ID NO: 5229967 - DNA, 21 bp, Homo sapiens
agtttgaaggaggtgagggat

SEQ ID NO: 5229968 - DNA, 13 bp, Homo sapiens
agtttgacactgc

SEQ ID NO: 5229969 - DNA, 14 bp, Homo sapiens
agtttgacttgtat

SEQ ID NO: 5229970 - DNA, 16 bp, Homo sapiens
agtttgacttgtataa

SEQ ID NO: 5229971 - DNA, 23 bp, Homo sapiens
agtttgactttttggaattcagc

SEQ ID NO: 5229972 - DNA, 17 bp, Homo sapiens
agtttgagacaagccct

SEQ ID NO: 5229973 - DNA, 21 bp, Homo sapiens
agtttgagacaagccctggca

SEQ ID NO: 5229974 - DNA, 23 bp, Homo sapiens
agtttgagacaagccctggcaac

SEQ ID NO: 5229975 - DNA, 13 bp, Homo sapiens
agtttgagaccag

SEQ ID NO: 5229976 - DNA, 19 bp, Homo sapiens
agtttgagaccagcctggc

SEQ ID NO: 5229977 - DNA, 18 bp, Homo sapiens
agtttgagaccaggctgg

SEQ ID NO: 5229978 - DNA, 18 bp, Homo sapiens
agtttgagatcagcctgg

SEQ ID NO: 5229979 - DNA, 18 bp, Homo sapiens
agtttgaggaaatttgca

SEQ ID NO: 5229980 - DNA, 20 bp, Homo sapiens
agtttgaggaaatttgcagc

SEQ ID NO: 5229981 - DNA, 17 bp, Homo sapiens
agtttgaggattagttt

SEQ ID NO: 5229982 - DNA, 18 bp, Homo sapiens
agtttgaggattagttta

SEQ ID NO: 5229983 - DNA, 11 bp, Homo sapiens
agtttgaggcc

SEQ ID NO: 5229984 - DNA, 19 bp, Homo sapiens
agtttgaggctgcaatgag

SEQ ID NO: 5229985 - DNA, 18 bp, Homo sapiens
agtttgatacaggaatta

SEQ ID NO: 5229986 - DNA, 14 bp, Homo sapiens
agtttgatcttcct

SEQ ID NO: 5229987 - DNA, 20 bp, Homo sapiens
agtttgatgtcattaatgtg

SEQ ID NO: 5229988 - DNA, 14 bp, Homo sapiens
agtttgattaaatt

SEQ ID NO: 5229989 - DNA, 16 bp, Homo sapiens
agtttgattaaattct

SEQ ID NO: 5229990 - DNA, 18 bp, Homo sapiens
agtttgattaaattcttg

SEQ ID NO: 5229991 - DNA, 20 bp, Homo sapiens
agtttgattaaattcttgca

SEQ ID NO: 5229992 - DNA, 22 bp, Homo sapiens
agtttgattaaattcttgcaaa

SEQ ID NO: 5229993 - DNA, 14 bp, Homo sapiens
agtttgattattca

SEQ ID NO: 5229994 - DNA, 21 bp, Homo sapiens
agtttgattgaggagctgcac

SEQ ID NO: 5229995 - DNA, 16 bp, Homo sapiens
agtttgatttaatatc

SEQ ID NO: 5229996 - DNA, 16 bp, Homo sapiens
agtttgcaaacctgca

SEQ ID NO: 5229997 - DNA, 20 bp, Homo sapiens
agtttgcaaacctgcagttt

SEQ ID NO: 5229998 - DNA, 18 bp, Homo sapiens
agtttgcactcaaatctt

SEQ ID NO: 5229999 - DNA, 14 bp, Homo sapiens
agtttgcagaaaag

SEQ ID NO: 5230000 - DNA, 21 bp, Homo sapiens
agtttgcagaaaagcacctgc

SEQ ID NO: 5230001 - DNA, 23 bp, Homo sapiens
agtttgcatacttcctggatttt

SEQ ID NO: 5230002 - DNA, 16 bp, Homo sapiens
agtttgcatgattctt

SEQ ID NO: 5230003 - DNA, 15 bp, Homo sapiens
agtttgcattcctga

SEQ ID NO: 5230004 - DNA, 19 bp, Homo sapiens
agtttgccacccctgtcca

SEQ ID NO: 5230005 - DNA, 13 bp, Homo sapiens
agtttgcccagag

SEQ ID NO: 5230006 - DNA, 12 bp, Homo sapiens
agtttgccctgg

SEQ ID NO: 5230007 - DNA, 22 bp, Homo sapiens
agtttgcctctgcacgtgcaca

SEQ ID NO: 5230008 - DNA, 16 bp, Homo sapiens
agtttgcctgctgtat

SEQ ID NO: 5230009 - DNA, 18 bp, Homo sapiens
agtttgcctgctgtattt

SEQ ID NO: 5230010 - DNA, 20 bp, Homo sapiens
agtttgctaaaagaagagag

SEQ ID NO: 5230011 - DNA, 23 bp, Homo sapiens
agtttgctaaattgagaggggct

SEQ ID NO: 5230012 - DNA, 14 bp, Homo sapiens
agtttgctattaga

SEQ ID NO: 5230013 - DNA, 11 bp, Homo sapiens
agtttgctgta

SEQ ID NO: 5230014 - DNA, 21 bp, Homo sapiens
agtttgctgtatacaaacagg

SEQ ID NO: 5230015 - DNA, 21 bp, Homo sapiens
agtttgctgtccttcttagaa

SEQ ID NO: 5230016 - DNA, 21 bp, Homo sapiens
agtttgctgttttaaattgca

SEQ ID NO: 5230017 - DNA, 23 bp, Homo sapiens
agtttgctgttttaaattgcatt

SEQ ID NO: 5230018 - DNA, 14 bp, Homo sapiens
agtttgcttagaaa

SEQ ID NO: 5230019 - DNA, 18 bp, Homo sapiens
agtttgcttgatatattt

SEQ ID NO: 5230020 - DNA, 14 bp, Homo sapiens
agtttggaaataaa

SEQ ID NO: 5230021 - DNA, 19 bp, Homo sapiens
agtttggaaataaaaatgt

SEQ ID NO: 5230022 - DNA, 20 bp, Homo sapiens
agtttggaaataaaaatgtt

SEQ ID NO: 5230023 - DNA, 12 bp, Homo sapiens
agtttggccaga

SEQ ID NO: 5230024 - DNA, 15 bp, Homo sapiens
agtttggccctggag

SEQ ID NO: 5230025 - DNA, 16 bp, Homo sapiens
agtttggccctggagc

SEQ ID NO: 5230026 - DNA, 19 bp, Homo sapiens
agtttgggatccctgtctt

SEQ ID NO: 5230027 - DNA, 16 bp, Homo sapiens
agtttgggccactgca

SEQ ID NO: 5230028 - DNA, 15 bp, Homo sapiens
agtttgggcttcagc

SEQ ID NO: 5230029 - DNA, 22 bp, Homo sapiens
agtttggggactcaggaccaga

SEQ ID NO: 5230030 - DNA, 20 bp, Homo sapiens
agtttggggcaagtcatgta

SEQ ID NO: 5230031 - DNA, 13 bp, Homo sapiens
agtttgggtaaaa

SEQ ID NO: 5230032 - DNA, 18 bp, Homo sapiens
agtttgggtaaaatactt

SEQ ID NO: 5230033 - DNA, 15 bp, Homo sapiens
agtttggtatgaaac

SEQ ID NO: 5230034 - DNA, 16 bp, Homo sapiens
agtttggtctggactg

SEQ ID NO: 5230035 - DNA, 16 bp, Homo sapiens
agtttggtgttttata

SEQ ID NO: 5230036 - DNA, 21 bp, Homo sapiens
agtttggttaatcagtgttga

SEQ ID NO: 5230037 - DNA, 15 bp, Homo sapiens
agtttggttttgaca

SEQ ID NO: 5230038 - DNA, 14 bp, Homo sapiens
agtttgtaaatgac

SEQ ID NO: 5230039 - DNA, 15 bp, Homo sapiens
agtttgtaaatgtta

SEQ ID NO: 5230040 - DNA, 22 bp, Homo sapiens
agtttgtagcatttttctaata

SEQ ID NO: 5230041 - DNA, 15 bp, Homo sapiens
agtttgtagccaggt

SEQ ID NO: 5230042 - DNA, 16 bp, Homo sapiens
agtttgtagccaggta

SEQ ID NO: 5230043 - DNA, 17 bp, Homo sapiens
agtttgtaggtaaaatg

SEQ ID NO: 5230044 - DNA, 18 bp, Homo sapiens
agtttgtagtaaaagtgg

SEQ ID NO: 5230045 - DNA, 19 bp, Homo sapiens
agtttgtattaaacttgaa

SEQ ID NO: 5230046 - DNA, 13 bp, Homo sapiens
agtttgtattttg

SEQ ID NO: 5230047 - DNA, 18 bp, Homo sapiens
agtttgtcacatgaaaca

SEQ ID NO: 5230048 - DNA, 17 bp, Homo sapiens
agtttgtcgctcatgtg

SEQ ID NO: 5230049 - DNA, 13 bp, Homo sapiens
agtttgtctattt

SEQ ID NO: 5230050 - DNA, 14 bp, Homo sapiens
agtttgtctatttt

SEQ ID NO: 5230051 - DNA, 15 bp, Homo sapiens
agtttgtctatttta

SEQ ID NO: 5230052 - DNA, 19 bp, Homo sapiens
agtttgtctattttaaaat

SEQ ID NO: 5230053 - DNA, 22 bp, Homo sapiens
agtttgtgaagtgattgacatt

SEQ ID NO: 5230054 - DNA, 13 bp, Homo sapiens
agtttgtgagaaa

SEQ ID NO: 5230055 - DNA, 19 bp, Homo sapiens
agtttgtgattttacattt

SEQ ID NO: 5230056 - DNA, 21 bp, Homo sapiens
agtttgtgattttacatttat

SEQ ID NO: 5230057 - DNA, 16 bp, Homo sapiens
agtttgtgcaagacac

SEQ ID NO: 5230058 - DNA, 16 bp, Homo sapiens
agtttgtgctctactg

SEQ ID NO: 5230059 - DNA, 14 bp, Homo sapiens
agtttgtggtaact

SEQ ID NO: 5230060 - DNA, 18 bp, Homo sapiens
agtttgtggtaacttgag

SEQ ID NO: 5230061 - DNA, 17 bp, Homo sapiens
agtttgtggtaatttgt

SEQ ID NO: 5230062 - DNA, 12 bp, Homo sapiens
agtttgtgtaaa

SEQ ID NO: 5230063 - DNA, 20 bp, Homo sapiens
agtttgtgtgtatttgtatt

SEQ ID NO: 5230064 - DNA, 13 bp, Homo sapiens
agtttgtgtgtct

SEQ ID NO: 5230065 - DNA, 14 bp, Homo sapiens
agtttgtgtgtctt

SEQ ID NO: 5230066 - DNA, 16 bp, Homo sapiens
agtttgtgtgtcttaa

SEQ ID NO: 5230067 - DNA, 22 bp, Homo sapiens
agtttgtgtgtcttaattatta

SEQ ID NO: 5230068 - DNA, 15 bp, Homo sapiens
agtttgtgttagaaa

SEQ ID NO: 5230069 - DNA, 17 bp, Homo sapiens
agtttgtgttagaaaag

SEQ ID NO: 5230070 - DNA, 22 bp, Homo sapiens
agtttgtgttagaaaagtttcg

SEQ ID NO: 5230071 - DNA, 23 bp, Homo sapiens
agtttgtgttgttgttgctgctg

SEQ ID NO: 5230072 - DNA, 12 bp, Homo sapiens
agtttgttaaag

SEQ ID NO: 5230073 - DNA, 19 bp, Homo sapiens
agtttgttaaagcctgttc

SEQ ID NO: 5230074 - DNA, 18 bp, Homo sapiens
agtttgttacctacctta

SEQ ID NO: 5230075 - DNA, 15 bp, Homo sapiens
agtttgttactttaa

SEQ ID NO: 5230076 - DNA, 14 bp, Homo sapiens
agtttgttactttg

SEQ ID NO: 5230077 - DNA, 15 bp, Homo sapiens
agtttgttactttga

SEQ ID NO: 5230078 - DNA, 22 bp, Homo sapiens
agtttgttagtatgaggcattt

SEQ ID NO: 5230079 - DNA, 23 bp, Homo sapiens
agtttgttatagatttagctatt

SEQ ID NO: 5230080 - DNA, 13 bp, Homo sapiens
agtttgttcagtg

SEQ ID NO: 5230081 - DNA, 13 bp, Homo sapiens
agtttgttctgca

SEQ ID NO: 5230082 - DNA, 20 bp, Homo sapiens
agtttgttctgttctggggg

SEQ ID NO: 5230083 - DNA, 22 bp, Homo sapiens
agtttgtttaaacacttatctt

SEQ ID NO: 5230084 - DNA, 14 bp, Homo sapiens
agtttgtttacaca

SEQ ID NO: 5230085 - DNA, 13 bp, Homo sapiens
agtttgtttcctg

SEQ ID NO: 5230086 - DNA, 20 bp, Homo sapiens
agtttgtttcttgtgtgttt

SEQ ID NO: 5230087 - DNA, 22 bp, Homo sapiens
agtttgtttcttgtgtgttttt

SEQ ID NO: 5230088 - DNA, 17 bp, Homo sapiens
agtttgtttctttgaat

SEQ ID NO: 5230089 - DNA, 12 bp, Homo sapiens
agtttgttttac

SEQ ID NO: 5230090 - DNA, 13 bp, Homo sapiens
agtttgttttaca

SEQ ID NO: 5230091 - DNA, 20 bp, Homo sapiens
agtttgttttacaaattttt

SEQ ID NO: 5230092 - DNA, 20 bp, Homo sapiens
agtttgttttctttttctgt

SEQ ID NO: 5230093 - DNA, 14 bp, Homo sapiens
agttttaaaaatga

SEQ ID NO: 5230094 - DNA, 18 bp, Homo sapiens
agttttaaaaatgaagat

SEQ ID NO: 5230095 - DNA, 19 bp, Homo sapiens
agttttaaaaatgaagatc

SEQ ID NO: 5230096 - DNA, 15 bp, Homo sapiens
agttttaaaaggctc

SEQ ID NO: 5230097 - DNA, 21 bp, Homo sapiens
agttttaaacccaaaatatat

SEQ ID NO: 5230098 - DNA, 16 bp, Homo sapiens
agttttaaagaaattt

SEQ ID NO: 5230099 - DNA, 13 bp, Homo sapiens
agttttaaataaa

SEQ ID NO: 5230100 - DNA, 12 bp, Homo sapiens
agttttaaatat

SEQ ID NO: 5230101 - DNA, 15 bp, Homo sapiens
agttttaaatatgaa

SEQ ID NO: 5230102 - DNA, 21 bp, Homo sapiens
agttttaaatatgaacaaaga

SEQ ID NO: 5230103 - DNA, 14 bp, Homo sapiens
agttttaaatatta

SEQ ID NO: 5230104 - DNA, 13 bp, Homo sapiens
agttttaaattat

SEQ ID NO: 5230105 - DNA, 19 bp, Homo sapiens
agttttaacacttctagat

SEQ ID NO: 5230106 - DNA, 22 bp, Homo sapiens
agttttaacctcaggttccaaa

SEQ ID NO: 5230107 - DNA, 14 bp, Homo sapiens
agttttaactttaa

SEQ ID NO: 5230108 - DNA, 20 bp, Homo sapiens
agttttaactttaatacagc

SEQ ID NO: 5230109 - DNA, 13 bp, Homo sapiens
agttttaataaga

SEQ ID NO: 5230110 - DNA, 19 bp, Homo sapiens
agtctttttataggtttta

SEQ ID NO: 5230111 - DNA, 14 bp, Homo sapiens
agtctttttttcct

SEQ ID NO: 5230112 - DNA, 19 bp, Homo sapiens
agtcttttttttttccaaa

SEQ ID NO: 5230113 - DNA, 20 bp, Homo sapiens
agtcttttttttttccaaat

SEQ ID NO: 5230114 - DNA, 14 bp, Homo sapiens
agtgaaaaaaagaa

SEQ ID NO: 5230115 - DNA, 15 bp, Homo sapiens
agtgaaaaaaagaaa

SEQ ID NO: 5230116 - DNA, 20 bp, Homo sapiens
agtgaaaaagacttcaaatg

SEQ ID NO: 5230117 - DNA, 23 bp, Homo sapiens
agtgaaaaaggaggaagagaaaa

SEQ ID NO: 5230118 - DNA, 22 bp, Homo sapiens
agtgaaaaatatgttgagtgtt

SEQ ID NO: 5230119 - DNA, 22 bp, Homo sapiens
agtgaaaaatcttaagtaccaa

SEQ ID NO: 5230120 - DNA, 12 bp, Homo sapiens
agtgaaaacaag

SEQ ID NO: 5230121 - DNA, 19 bp, Homo sapiens
agtgaaaacaagtgctggc

SEQ ID NO: 5230122 - DNA, 19 bp, Homo sapiens
agtgaaaacctctttcgga

SEQ ID NO: 5230123 - DNA, 16 bp, Homo sapiens
agtgaaaactttgtag

SEQ ID NO: 5230124 - DNA, 12 bp, Homo sapiens
agtgaaaatact

SEQ ID NO: 5230125 - DNA, 14 bp, Homo sapiens
agtgaaaataggta

SEQ ID NO: 5230126 - DNA, 22 bp, Homo sapiens
agtgaaaatcttggagaccctg

SEQ ID NO: 5230127 - DNA, 16 bp, Homo sapiens
agtgaaaattctgttg

SEQ ID NO: 5230128 - DNA, 18 bp, Homo sapiens
agtgaaaattctgttggt

SEQ ID NO: 5230129 - DNA, 11 bp, Homo sapiens
agtgaaaattg

SEQ ID NO: 5230130 - DNA, 21 bp, Homo sapiens
agtgaaaatttttttgatgtg

SEQ ID NO: 5230131 - DNA, 23 bp, Homo sapiens
agtgaaacacttgcttgccaact

SEQ ID NO: 5230132 - DNA, 16 bp, Homo sapiens
agtgaaacagagaaag

SEQ ID NO: 5230133 - DNA, 19 bp, Homo sapiens
agtgaaacagagaaagaaa

SEQ ID NO: 5230134 - DNA, 20 bp, Homo sapiens
agtgaaacagagaaagaaaa

SEQ ID NO: 5230135 - DNA, 15 bp, Homo sapiens
agtgaaaccatgact

SEQ ID NO: 5230136 - DNA, 20 bp, Homo sapiens
agtgaaacctttagggcagc

SEQ ID NO: 5230137 - DNA, 15 bp, Homo sapiens
agtgaaactcccacc

SEQ ID NO: 5230138 - DNA, 20 bp, Homo sapiens
agtgaaactcgttaatttgt

SEQ ID NO: 5230139 - DNA, 14 bp, Homo sapiens
agtgaaactgcatt

SEQ ID NO: 5230140 - DNA, 13 bp, Homo sapiens
agtgaaactgctt

SEQ ID NO: 5230141 - DNA, 21 bp, Homo sapiens
agtgaaactgcttgtttccta

SEQ ID NO: 5230142 - DNA, 17 bp, Homo sapiens
agtgaaagaaaataaca

SEQ ID NO: 5230143 - DNA, 21 bp, Homo sapiens
agtgaaagacatttcaaatct

SEQ ID NO: 5230144 - DNA, 16 bp, Homo sapiens
agtgaaagctagagat

SEQ ID NO: 5230145 - DNA, 20 bp, Homo sapiens
agtgaaaggaagataaacgt

SEQ ID NO: 5230146 - DNA, 18 bp, Homo sapiens
agtgaaagggctatggca

SEQ ID NO: 5230147 - DNA, 17 bp, Homo sapiens
agtgaaaggtcacacta

SEQ ID NO: 5230148 - DNA, 16 bp, Homo sapiens
agtgaaagttgccatt

SEQ ID NO: 5230149 - DNA, 21 bp, Homo sapiens
agtgaaataaattctgattct

SEQ ID NO: 5230150 - DNA, 20 bp, Homo sapiens
agtgaaataatattgatttc

SEQ ID NO: 5230151 - DNA, 22 bp, Homo sapiens
agtgaaataattaaaaaccact

SEQ ID NO: 5230152 - DNA, 13 bp, Homo sapiens
agtgaaatattac

SEQ ID NO: 5230153 - DNA, 16 bp, Homo sapiens
agtgaaatattgtaaa

SEQ ID NO: 5230154 - DNA, 15 bp, Homo sapiens
agtgaaatgagcagc

SEQ ID NO: 5230155 - DNA, 22 bp, Homo sapiens
agtgaaatggctggggccgctg

SEQ ID NO: 5230156 - DNA, 12 bp, Homo sapiens
agtgaaatgtga

SEQ ID NO: 5230157 - DNA, 15 bp, Homo sapiens
agtgaaatgtgaagg

SEQ ID NO: 5230158 - DNA, 17 bp, Homo sapiens
agtgaaattagtatttt

SEQ ID NO: 5230159 - DNA, 21 bp, Homo sapiens
agtgaaattagtattttgagc

SEQ ID NO: 5230160 - DNA, 14 bp, Homo sapiens
agtgaaatttctag

SEQ ID NO: 5230161 - DNA, 17 bp, Homo sapiens
agtgaaatttctagcct

SEQ ID NO: 5230162 - DNA, 17 bp, Homo sapiens
agtgaaattttaaatgc

SEQ ID NO: 5230163 - DNA, 23 bp, Homo sapiens
agtgaacaaatttacagagacag

SEQ ID NO: 5230164 - DNA, 15 bp, Homo sapiens
agtgaacaactattt

SEQ ID NO: 5230165 - DNA, 19 bp, Homo sapiens
agtgaacaactatttataa

SEQ ID NO: 5230166 - DNA, 17 bp, Homo sapiens
agtgaacacagcagacc

SEQ ID NO: 5230167 - DNA, 15 bp, Homo sapiens
agtgaacagcttcac

SEQ ID NO: 5230168 - DNA, 14 bp, Homo sapiens
agtgaacataactg

SEQ ID NO: 5230169 - DNA, 15 bp, Homo sapiens
agtgaacataactgt

SEQ ID NO: 5230170 - DNA, 19 bp, Homo sapiens
agtgaacatactaattcta

SEQ ID NO: 5230171 - DNA, 15 bp, Homo sapiens
agtgaacattacatt

SEQ ID NO: 5230172 - DNA, 22 bp, Homo sapiens
agtgaacattacattgccattt

SEQ ID NO: 5230173 - DNA, 22 bp, Homo sapiens
agtgaacattattaaatcagaa

SEQ ID NO: 5230174 - DNA, 21 bp, Homo sapiens
agtgaacattcccagcccagc

SEQ ID NO: 5230175 - DNA, 12 bp, Homo sapiens
agtgaacatttc

SEQ ID NO: 5230176 - DNA, 13 bp, Homo sapiens
agtgaacatttct

SEQ ID NO: 5230177 - DNA, 18 bp, Homo sapiens
agtgaacatttgggtaaa

SEQ ID NO: 5230178 - DNA, 22 bp, Homo sapiens
agtgaaccaaaaatagaaatta

SEQ ID NO: 5230179 - DNA, 22 bp, Homo sapiens
agtgaaccaaagagactggagc

SEQ ID NO: 5230180 - DNA, 23 bp, Homo sapiens
agtgaaccaaagagactggagca

SEQ ID NO: 5230181 - DNA, 16 bp, Homo sapiens
agtgaaccacaggttt

SEQ ID NO: 5230182 - DNA, 21 bp, Homo sapiens
agtgaaccatcattataaacg

SEQ ID NO: 5230183 - DNA, 18 bp, Homo sapiens
agtgaactaagttattgt

SEQ ID NO: 5230184 - DNA, 19 bp, Homo sapiens
agtgaactaagttattgtt

SEQ ID NO: 5230185 - DNA, 20 bp, Homo sapiens
agtgaactacgcttgctcat

SEQ ID NO: 5230186 - DNA, 21 bp, Homo sapiens
agtgaactcctgccaggcaca

SEQ ID NO: 5230187 - DNA, 16 bp, Homo sapiens
agtgaacttgggaggg

SEQ ID NO: 5230188 - DNA, 15 bp, Homo sapiens
agtgaacttttgtaa

SEQ ID NO: 5230189 - DNA, 16 bp, Homo sapiens
agtgaacttttgtaat

SEQ ID NO: 5230190 - DNA, 18 bp, Homo sapiens
agtgaacttttgtaattt

SEQ ID NO: 5230191 - DNA, 15 bp, Homo sapiens
agtgaagaaaacttg

SEQ ID NO: 5230192 - DNA, 22 bp, Homo sapiens
agtgaagaaaagtgaatgctca

SEQ ID NO: 5230193 - DNA, 23 bp, Homo sapiens
agtgaagaaaagtgaatgctcaa

SEQ ID NO: 5230194 - DNA, 18 bp, Homo sapiens
agtgaagaagccatcaat

SEQ ID NO: 5230195 - DNA, 15 bp, Homo sapiens
agtgaagaatacatc

SEQ ID NO: 5230196 - DNA, 14 bp, Homo sapiens
agtgaagaatactt

SEQ ID NO: 5230197 - DNA, 13 bp, Homo sapiens
agtgaagaatcta

SEQ ID NO: 5230198 - DNA, 13 bp, Homo sapiens
agtgaagaattta

SEQ ID NO: 5230199 - DNA, 19 bp, Homo sapiens
agtgaagaatttatctctt

SEQ ID NO: 5230200 - DNA, 15 bp, Homo sapiens
agtgaagacagaagt

SEQ ID NO: 5230201 - DNA, 14 bp, Homo sapiens
agtgaagaccagag

SEQ ID NO: 5230202 - DNA, 19 bp, Homo sapiens
agtgaagacgtcaggggca

SEQ ID NO: 5230203 - DNA, 21 bp, Homo sapiens
agtgaagactagaaaattaga

SEQ ID NO: 5230204 - DNA, 17 bp, Homo sapiens
agtgaagactccagaaa

SEQ ID NO: 5230205 - DNA, 17 bp, Homo sapiens
agtgaagacttcttggg

SEQ ID NO: 5230206 - DNA, 21 bp, Homo sapiens
agtgaagaggggcagcccttg

SEQ ID NO: 5230207 - DNA, 21 bp, Homo sapiens
agtgaagagtagaacccaggt

SEQ ID NO: 5230208 - DNA, 12 bp, Homo sapiens
agtgaagatgtg

SEQ ID NO: 5230209 - DNA, 14 bp, Homo sapiens
agtgaagatgtgta

SEQ ID NO: 5230210 - DNA, 16 bp, Homo sapiens
agtgaagatgtttact

SEQ ID NO: 5230211 - DNA, 16 bp, Homo sapiens
agtgaagcaaaaacta

SEQ ID NO: 5230212 - DNA, 12 bp, Homo sapiens
agtgaagcagca

SEQ ID NO: 5230213 - DNA, 16 bp, Homo sapiens
agtgaagcagcactgt

SEQ ID NO: 5230214 - DNA, 15 bp, Homo sapiens
agtgaagcatggcat

SEQ ID NO: 5230215 - DNA, 16 bp, Homo sapiens
agtgaagcatttaaaa

SEQ ID NO: 5230216 - DNA, 14 bp, Homo sapiens
agtgaagccacaga

SEQ ID NO: 5230217 - DNA, 14 bp, Homo sapiens
agtgaaggaaataa

SEQ ID NO: 5230218 - DNA, 15 bp, Homo sapiens
agtgaaggaaataaa

SEQ ID NO: 5230219 - DNA, 15 bp, Homo sapiens
agtgaaggaaatgaa

SEQ ID NO: 5230220 - DNA, 21 bp, Homo sapiens
agtgaaggagaaaggagccgg

SEQ ID NO: 5230221 - DNA, 23 bp, Homo sapiens
agtgaagggaagagacagcccag

SEQ ID NO: 5230222 - DNA, 22 bp, Homo sapiens
agtgaaggttcccaaggacatg

SEQ ID NO: 5230223 - DNA, 19 bp, Homo sapiens
agtgaagtagcctcttgtg

SEQ ID NO: 5230224 - DNA, 22 bp, Homo sapiens
agtgaagtagcctcttgtgtaa

SEQ ID NO: 5230225 - DNA, 23 bp, Homo sapiens
agtgaagtatgcactaatcaata

SEQ ID NO: 5230226 - DNA, 21 bp, Homo sapiens
agtgaagtcatgacctccagg

SEQ ID NO: 5230227 - DNA, 15 bp, Homo sapiens
agtgaagtccagtga

SEQ ID NO: 5230228 - DNA, 22 bp, Homo sapiens
agtgaagtccttcagtgagccc

SEQ ID NO: 5230229 - DNA, 19 bp, Homo sapiens
agtgaagtctagaatcata

SEQ ID NO: 5230230 - DNA, 17 bp, Homo sapiens
agtgaagtgagaagttc

SEQ ID NO: 5230231 - DNA, 22 bp, Homo sapiens
agtgaagtgcctttttcctaga

SEQ ID NO: 5230232 - DNA, 23 bp, Homo sapiens
agtgaagtgttaatacatcacat

SEQ ID NO: 5230233 - DNA, 18 bp, Homo sapiens
agtgaagtgttctgctga

SEQ ID NO: 5230234 - DNA, 14 bp, Homo sapiens
agtgaagttgctgc

SEQ ID NO: 5230235 - DNA, 23 bp, Homo sapiens
agtgaagttgctgcttctcccag

SEQ ID NO: 5230236 - DNA, 13 bp, Homo sapiens
agtgaataaactt

SEQ ID NO: 5230237 - DNA, 23 bp, Homo sapiens
agtgaataaatattttaggaaac

SEQ ID NO: 5230238 - DNA, 17 bp, Homo sapiens
agtgaataacctgagga

SEQ ID NO: 5230239 - DNA, 18 bp, Homo sapiens
agtgaataactgcaaagt

SEQ ID NO: 5230240 - DNA, 15 bp, Homo sapiens
agtgaatacattaac

SEQ ID NO: 5230241 - DNA, 22 bp, Homo sapiens
agtgaatacattaacggtgcta

SEQ ID NO: 5230242 - DNA, 17 bp, Homo sapiens
agtgaatacattttgca

SEQ ID NO: 5230243 - DNA, 20 bp, Homo sapiens
agtgaatactgctacagcaa

SEQ ID NO: 5230244 - DNA, 15 bp, Homo sapiens
agtgaatatgcctgt

SEQ ID NO: 5230245 - DNA, 12 bp, Homo sapiens
agtgaatattca

SEQ ID NO: 5230246 - DNA, 14 bp, Homo sapiens
agtgaatattgctt

SEQ ID NO: 5230247 - DNA, 18 bp, Homo sapiens
agtgaatatttttgtatt

SEQ ID NO: 5230248 - DNA, 13 bp, Homo sapiens
agtgaatcttatg

SEQ ID NO: 5230249 - DNA, 15 bp, Homo sapiens
agtgaatctttctcc

SEQ ID NO: 5230250 - DNA, 15 bp, Homo sapiens
agtgaatgaaagatt

SEQ ID NO: 5230251 - DNA, 17 bp, Homo sapiens
agtgaatgagtaaataa

SEQ ID NO: 5230252 - DNA, 20 bp, Homo sapiens
agtgaatgagtaaataaact

SEQ ID NO: 5230253 - DNA, 18 bp, Homo sapiens
agtgaatgctcaagtttt

SEQ ID NO: 5230254 - DNA, 14 bp, Homo sapiens
agtgaatgctggga

SEQ ID NO: 5230255 - DNA, 13 bp, Homo sapiens
agtgaatgggaaa

SEQ ID NO: 5230256 - DNA, 18 bp, Homo sapiens
agtgaatgggaaagggtg

SEQ ID NO: 5230257 - DNA, 19 bp, Homo sapiens
agtgaatggtgccattttc

SEQ ID NO: 5230258 - DNA, 19 bp, Homo sapiens
agtgaattagttttaaaat

SEQ ID NO: 5230259 - DNA, 14 bp, Homo sapiens
agtgaattccctca

SEQ ID NO: 5230260 - DNA, 20 bp, Homo sapiens
agtgaattcttgaaggaaaa

SEQ ID NO: 5230261 - DNA, 12 bp, Homo sapiens
agtgaattgaag

SEQ ID NO: 5230262 - DNA, 12 bp, Homo sapiens
agtgaatttcag

SEQ ID NO: 5230263 - DNA, 17 bp, Homo sapiens
agtgaatttcagtataa

SEQ ID NO: 5230264 - DNA, 19 bp, Homo sapiens
agtgaatttgaatgaaaaa

SEQ ID NO: 5230265 - DNA, 16 bp, Homo sapiens
agtgaatttgcactgt

SEQ ID NO: 5230266 - DNA, 19 bp, Homo sapiens
agtgaatttgtccattgta

SEQ ID NO: 5230267 - DNA, 16 bp, Homo sapiens
agtgaattttaaaatg

SEQ ID NO: 5230268 - DNA, 17 bp, Homo sapiens
agtgaatttttctctaa

SEQ ID NO: 5230269 - DNA, 16 bp, Homo sapiens
agtgaatttttgcaat

SEQ ID NO: 5230270 - DNA, 18 bp, Homo sapiens
agtgaatttttgcaataa

SEQ ID NO: 5230271 - DNA, 24 bp, Homo sapiens
agtgaatttttgcaataatgcagt

SEQ ID NO: 5230272 - DNA, 15 bp, Homo sapiens
agtgacaaaaataaa

SEQ ID NO: 5230273 - DNA, 14 bp, Homo sapiens
agtgacaaaagctc

SEQ ID NO: 5230274 - DNA, 19 bp, Homo sapiens
agtgacaaaatgggaggag

SEQ ID NO: 5230275 - DNA, 13 bp, Homo sapiens
agtgacaaaccat

SEQ ID NO: 5230276 - DNA, 18 bp, Homo sapiens
agtgacaaagactcctct

SEQ ID NO: 5230277 - DNA, 21 bp, Homo sapiens
agtgacaaagactcctctggg

SEQ ID NO: 5230278 - DNA, 17 bp, Homo sapiens
agtgacaaagcaattta

SEQ ID NO: 5230279 - DNA, 20 bp, Homo sapiens
agtgacaaagccagaggaga

SEQ ID NO: 5230280 - DNA, 18 bp, Homo sapiens
agtgacaaagcctctgaa

SEQ ID NO: 5230281 - DNA, 23 bp, Homo sapiens
agtgacaaagcctctgaaagatg

SEQ ID NO: 5230282 - DNA, 24 bp, Homo sapiens
agtgacaaataaattaggaccaag

SEQ ID NO: 5230283 - DNA, 16 bp, Homo sapiens
agtgacaaggccccag

SEQ ID NO: 5230284 - DNA, 17 bp, Homo sapiens
agtgacaagtggagggg

SEQ ID NO: 5230285 - DNA, 17 bp, Homo sapiens
agtgacacaagcacttt

SEQ ID NO: 5230286 - DNA, 13 bp, Homo sapiens
agtgacacaatct

SEQ ID NO: 5230287 - DNA, 13 bp, Homo sapiens
agtgacacacact

SEQ ID NO: 5230288 - DNA, 14 bp, Homo sapiens
agttttaataagaa

SEQ ID NO: 5230289 - DNA, 21 bp, Homo sapiens
agttttaataagaacagatca

SEQ ID NO: 5230290 - DNA, 21 bp, Homo sapiens
agttttacagattgcctcctt

SEQ ID NO: 5230291 - DNA, 16 bp, Homo sapiens
agttttaccagatgat

SEQ ID NO: 5230292 - DNA, 19 bp, Homo sapiens
agttttaccctatatctat

SEQ ID NO: 5230293 - DNA, 20 bp, Homo sapiens
agttttactctgctgcaaaa

SEQ ID NO: 5230294 - DNA, 22 bp, Homo sapiens
agttttactcttaaatcatttg

SEQ ID NO: 5230295 - DNA, 11 bp, Homo sapiens
agttttactgc

SEQ ID NO: 5230296 - DNA, 15 bp, Homo sapiens
agttttactgcattt

SEQ ID NO: 5230297 - DNA, 21 bp, Homo sapiens
agttttagaataaggaggagg

SEQ ID NO: 5230298 - DNA, 19 bp, Homo sapiens
agttttagggtacatgtgc

SEQ ID NO: 5230299 - DNA, 17 bp, Homo sapiens
agttttagtctttagaa

SEQ ID NO: 5230300 - DNA, 15 bp, Homo sapiens
agttttagtttcaaa

SEQ ID NO: 5230301 - DNA, 14 bp, Homo sapiens
agttttataaaact

SEQ ID NO: 5230302 - DNA, 12 bp, Homo sapiens
agttttataaat

SEQ ID NO: 5230303 - DNA, 16 bp, Homo sapiens
agttttatacataaac

SEQ ID NO: 5230304 - DNA, 18 bp, Homo sapiens
agttttatacataaacag

SEQ ID NO: 5230305 - DNA, 20 bp, Homo sapiens
agttttatatattatatgga

SEQ ID NO: 5230306 - DNA, 16 bp, Homo sapiens
agttttatatgcttct

SEQ ID NO: 5230307 - DNA, 19 bp, Homo sapiens
agttttatcacatgtatgt

SEQ ID NO: 5230308 - DNA, 20 bp, Homo sapiens
agttttatcacatgtatgtt

SEQ ID NO: 5230309 - DNA, 12 bp, Homo sapiens
agttttatcatt

SEQ ID NO: 5230310 - DNA, 15 bp, Homo sapiens
agttttatcattttc

SEQ ID NO: 5230311 - DNA, 20 bp, Homo sapiens
agttttatccataatgatgg

SEQ ID NO: 5230312 - DNA, 14 bp, Homo sapiens
agttttatgctctt

SEQ ID NO: 5230313 - DNA, 23 bp, Homo sapiens
agttttatgctcttttttactca

SEQ ID NO: 5230314 - DNA, 16 bp, Homo sapiens
agttttattgaaaatg

SEQ ID NO: 5230315 - DNA, 15 bp, Homo sapiens
agttttatttaactt

SEQ ID NO: 5230316 - DNA, 20 bp, Homo sapiens
agttttatttatatttattg

SEQ ID NO: 5230317 - DNA, 23 bp, Homo sapiens
agttttatttatatttattgact

SEQ ID NO: 5230318 - DNA, 13 bp, Homo sapiens
agttttatttgta

SEQ ID NO: 5230319 - DNA, 14 bp, Homo sapiens
agttttatttgtat

SEQ ID NO: 5230320 - DNA, 17 bp, Homo sapiens
agttttattttaaatta

SEQ ID NO: 5230321 - DNA, 16 bp, Homo sapiens
agttttattttatgtt

SEQ ID NO: 5230322 - DNA, 19 bp, Homo sapiens
agttttattttatgtttag

SEQ ID NO: 5230323 - DNA, 18 bp, Homo sapiens
agttttattttctaaatt

SEQ ID NO: 5230324 - DNA, 22 bp, Homo sapiens
agttttatttttaagaaaaatt

SEQ ID NO: 5230325 - DNA, 13 bp, Homo sapiens
agttttatttttg

SEQ ID NO: 5230326 - DNA, 15 bp, Homo sapiens
agttttatttttgcc

SEQ ID NO: 5230327 - DNA, 19 bp, Homo sapiens
agttttcagaaaaagaaat

SEQ ID NO: 5230328 - DNA, 18 bp, Homo sapiens
agttttcagaacctcttc

SEQ ID NO: 5230329 - DNA, 20 bp, Homo sapiens
agttttcagaacctcttccc

SEQ ID NO: 5230330 - DNA, 21 bp, Homo sapiens
agttttcagaacctcttcccc

SEQ ID NO: 5230331 - DNA, 16 bp, Homo sapiens
agttttcagccttggg

SEQ ID NO: 5230332 - DNA, 18 bp, Homo sapiens
agttttcatagtatccat

SEQ ID NO: 5230333 - DNA, 12 bp, Homo sapiens
agttttcatttt

SEQ ID NO: 5230334 - DNA, 19 bp, Homo sapiens
agttttccaaactgtgtca

SEQ ID NO: 5230335 - DNA, 10 bp, Homo sapiens
agttttccag

SEQ ID NO: 5230336 - DNA, 18 bp, Homo sapiens
agttttccagtattgaaa

SEQ ID NO: 5230337 - DNA, 12 bp, Homo sapiens
agttttccatga

SEQ ID NO: 5230338 - DNA, 13 bp, Homo sapiens
agttttccatgaa

SEQ ID NO: 5230339 - DNA, 16 bp, Homo sapiens
agttttccatgaaaac

SEQ ID NO: 5230340 - DNA, 21 bp, Homo sapiens
agttttccatgaaaacgtttt

SEQ ID NO: 5230341 - DNA, 13 bp, Homo sapiens
agttttcccctgg

SEQ ID NO: 5230342 - DNA, 15 bp, Homo sapiens
agttttcccctggcc

SEQ ID NO: 5230343 - DNA, 16 bp, Homo sapiens
agttttccctgaagtt

SEQ ID NO: 5230344 - DNA, 14 bp, Homo sapiens
agttttccctgcac

SEQ ID NO: 5230345 - DNA, 20 bp, Homo sapiens
agttttccctgcactgtgtc

SEQ ID NO: 5230346 - DNA, 12 bp, Homo sapiens
agttttccctgg

SEQ ID NO: 5230347 - DNA, 16 bp, Homo sapiens
agttttcctaaatgta

SEQ ID NO: 5230348 - DNA, 17 bp, Homo sapiens
agttttcctaaatgtat

SEQ ID NO: 5230349 - DNA, 14 bp, Homo sapiens
agttttccttctca

SEQ ID NO: 5230350 - DNA, 13 bp, Homo sapiens
agttttccttctg

SEQ ID NO: 5230351 - DNA, 20 bp, Homo sapiens
agttttccttgctatttcaa

SEQ ID NO: 5230352 - DNA, 21 bp, Homo sapiens
agttttccttgggagaactaa

SEQ ID NO: 5230353 - DNA, 12 bp, Homo sapiens
agttttcctttg

SEQ ID NO: 5230354 - DNA, 15 bp, Homo sapiens
agttttcgataaagg

SEQ ID NO: 5230355 - DNA, 17 bp, Homo sapiens
agttttcggaaacactg

SEQ ID NO: 5230356 - DNA, 22 bp, Homo sapiens
agttttcggaaacactgactta

SEQ ID NO: 5230357 - DNA, 18 bp, Homo sapiens
agttttctagcaattttc

SEQ ID NO: 5230358 - DNA, 22 bp, Homo sapiens
agttttctccttgatatcattc

SEQ ID NO: 5230359 - DNA, 12 bp, Homo sapiens
agttttctctta

SEQ ID NO: 5230360 - DNA, 17 bp, Homo sapiens
agttttctgagaaagac

SEQ ID NO: 5230361 - DNA, 13 bp, Homo sapiens
agttttctggctg

SEQ ID NO: 5230362 - DNA, 16 bp, Homo sapiens
agttttcttcctttga

SEQ ID NO: 5230363 - DNA, 23 bp, Homo sapiens
agttttcttcctttgaaagactg

SEQ ID NO: 5230364 - DNA, 15 bp, Homo sapiens
agttttcttgttgct

SEQ ID NO: 5230365 - DNA, 18 bp, Homo sapiens
agttttcttgttgctttg

SEQ ID NO: 5230366 - DNA, 21 bp, Homo sapiens
agttttcttgttgctttgttg

SEQ ID NO: 5230367 - DNA, 13 bp, Homo sapiens
agttttcttgttt

SEQ ID NO: 5230368 - DNA, 13 bp, Homo sapiens
agttttctttagt

SEQ ID NO: 5230369 - DNA, 22 bp, Homo sapiens
agttttctttgcttatgttgaa

SEQ ID NO: 5230370 - DNA, 13 bp, Homo sapiens
agttttctttgta

SEQ ID NO: 5230371 - DNA, 15 bp, Homo sapiens
agttttgaaaagcta

SEQ ID NO: 5230372 - DNA, 15 bp, Homo sapiens
agttttgaaagaaaa

SEQ ID NO: 5230373 - DNA, 17 bp, Homo sapiens
agttttgaaagaaaaat

SEQ ID NO: 5230374 - DNA, 14 bp, Homo sapiens
agttttgaaatgaa

SEQ ID NO: 5230375 - DNA, 17 bp, Homo sapiens
agttttgaagattctat

SEQ ID NO: 5230376 - DNA, 14 bp, Homo sapiens
agttttgacaagct

SEQ ID NO: 5230377 - DNA, 18 bp, Homo sapiens
agttttgacaagctggct

SEQ ID NO: 5230378 - DNA, 18 bp, Homo sapiens
agttttgacatcagccag

SEQ ID NO: 5230379 - DNA, 18 bp, Homo sapiens
agttttgagaacgtaaag

SEQ ID NO: 5230380 - DNA, 18 bp, Homo sapiens
agttttgagtaattcaag

SEQ ID NO: 5230381 - DNA, 18 bp, Homo sapiens
agttttgagtagatatta

SEQ ID NO: 5230382 - DNA, 20 bp, Homo sapiens
agttttgagtagatattact

SEQ ID NO: 5230383 - DNA, 21 bp, Homo sapiens
agttttgagtagatattactt

SEQ ID NO: 5230384 - DNA, 17 bp, Homo sapiens
agttttgagtgtactgt

SEQ ID NO: 5230385 - DNA, 14 bp, Homo sapiens
agttttgagtgtat

SEQ ID NO: 5230386 - DNA, 16 bp, Homo sapiens
agttttgagtgtatac

SEQ ID NO: 5230387 - DNA, 17 bp, Homo sapiens
agttttgataaagtaat

SEQ ID NO: 5230388 - DNA, 17 bp, Homo sapiens
agttttgatataatctt

SEQ ID NO: 5230389 - DNA, 21 bp, Homo sapiens
agttttgatataatcttggct

SEQ ID NO: 5230390 - DNA, 13 bp, Homo sapiens
agttttgatgaaa

SEQ ID NO: 5230391 - DNA, 20 bp, Homo sapiens
agttttgatgactggcattt

SEQ ID NO: 5230392 - DNA, 14 bp, Homo sapiens
agttttgattttgg

SEQ ID NO: 5230393 - DNA, 20 bp, Homo sapiens
agttttgattttggaaagat

SEQ ID NO: 5230394 - DNA, 17 bp, Homo sapiens
agttttgcatagttcta

SEQ ID NO: 5230395 - DNA, 16 bp, Homo sapiens
agttttgcatttatgg

SEQ ID NO: 5230396 - DNA, 15 bp, Homo sapiens
agttttgctccttct

SEQ ID NO: 5230397 - DNA, 14 bp, Homo sapiens
agttttgctgtctc

SEQ ID NO: 5230398 - DNA, 19 bp, Homo sapiens
agttttgctttgttgaata

SEQ ID NO: 5230399 - DNA, 20 bp, Homo sapiens
agttttgctttgttgaataa

SEQ ID NO: 5230400 - DNA, 21 bp, Homo sapiens
agttttggaatctaagctgtt

SEQ ID NO: 5230401 - DNA, 17 bp, Homo sapiens
agttttggatgcagtgc

SEQ ID NO: 5230402 - DNA, 19 bp, Homo sapiens
agttttggatgcagtgctc

SEQ ID NO: 5230403 - DNA, 17 bp, Homo sapiens
agttttggccaccacat

SEQ ID NO: 5230404 - DNA, 20 bp, Homo sapiens
agttttgggaagttaaaggg

SEQ ID NO: 5230405 - DNA, 17 bp, Homo sapiens
agttttgggaggggatg

SEQ ID NO: 5230406 - DNA, 22 bp, Homo sapiens
agttttgggaggggatggcaga

SEQ ID NO: 5230407 - DNA, 20 bp, Homo sapiens
agttttggggggcggggctg

SEQ ID NO: 5230408 - DNA, 15 bp, Homo sapiens
agttttggttgcttt

SEQ ID NO: 5230409 - DNA, 21 bp, Homo sapiens
agttttggttgctttaatatc

SEQ ID NO: 5230410 - DNA, 22 bp, Homo sapiens
agttttggttgctttaatatca

SEQ ID NO: 5230411 - DNA, 14 bp, Homo sapiens
agttttggttttta

SEQ ID NO: 5230412 - DNA, 21 bp, Homo sapiens
agttttgtaaaaactgaagaa

SEQ ID NO: 5230413 - DNA, 22 bp, Homo sapiens
agttttgtaaaagaaatcatgt

SEQ ID NO: 5230414 - DNA, 12 bp, Homo sapiens
agttttgtaaat

SEQ ID NO: 5230415 - DNA, 16 bp, Homo sapiens
agttttgtaagtaaca

SEQ ID NO: 5230416 - DNA, 22 bp, Homo sapiens
agttttgtacaaagttttcctt

SEQ ID NO: 5230417 - DNA, 11 bp, Homo sapiens
agttttgtata

SEQ ID NO: 5230418 - DNA, 17 bp, Homo sapiens
agttttgtataacttaa

SEQ ID NO: 5230419 - DNA, 16 bp, Homo sapiens
agttttgtcagaaaag

SEQ ID NO: 5230420 - DNA, 20 bp, Homo sapiens
agttttgtctaattatcaat

SEQ ID NO: 5230421 - DNA, 15 bp, Homo sapiens
agttttgtctgtctc

SEQ ID NO: 5230422 - DNA, 17 bp, Homo sapiens
agttttgtctgtctccc

SEQ ID NO: 5230423 - DNA, 12 bp, Homo sapiens
agttttgtcttg

SEQ ID NO: 5230424 - DNA, 14 bp, Homo sapiens
agttttgtcttgaa

SEQ ID NO: 5230425 - DNA, 15 bp, Homo sapiens
agttttgtgaaattt

SEQ ID NO: 5230426 - DNA, 16 bp, Homo sapiens
agttttgtgaaatttt

SEQ ID NO: 5230427 - DNA, 21 bp, Homo sapiens
agttttgtgaaatttttcata

SEQ ID NO: 5230428 - DNA, 21 bp, Homo sapiens
agttttgtgaaggtgatttat

SEQ ID NO: 5230429 - DNA, 23 bp, Homo sapiens
agttttgtggactgagcgaggaa

SEQ ID NO: 5230430 - DNA, 18 bp, Homo sapiens
agttttgtgtacagtatg

SEQ ID NO: 5230431 - DNA, 16 bp, Homo sapiens
agttttgtgtgtatat

SEQ ID NO: 5230432 - DNA, 23 bp, Homo sapiens
agttttgtgtgtatatatttaaa

SEQ ID NO: 5230433 - DNA, 12 bp, Homo sapiens
agttttgtgttt

SEQ ID NO: 5230434 - DNA, 16 bp, Homo sapiens
agttttgtgtttgttg

SEQ ID NO: 5230435 - DNA, 21 bp, Homo sapiens
agttttgtgtttgttgtagat

SEQ ID NO: 5230436 - DNA, 16 bp, Homo sapiens
agttttgttcatgaaa

SEQ ID NO: 5230437 - DNA, 19 bp, Homo sapiens
agttttgttccagaggagc

SEQ ID NO: 5230438 - DNA, 11 bp, Homo sapiens
agttttgttct

SEQ ID NO: 5230439 - DNA, 13 bp, Homo sapiens
agttttgttgtac

SEQ ID NO: 5230440 - DNA, 18 bp, Homo sapiens
agttttgttgtacttaaa

SEQ ID NO: 5230441 - DNA, 18 bp, Homo sapiens
agttttgtttggaccaaa

SEQ ID NO: 5230442 - DNA, 18 bp, Homo sapiens
agttttgttttaaaatta

SEQ ID NO: 5230443 - DNA, 21 bp, Homo sapiens
agttttgttttccctttaaag

SEQ ID NO: 5230444 - DNA, 21 bp, Homo sapiens
agtttttaaaaaggcctttgg

SEQ ID NO: 5230445 - DNA, 22 bp, Homo sapiens
agtttttaaaaaggcctttggg

SEQ ID NO: 5230446 - DNA, 18 bp, Homo sapiens
agtttttaaaaatgtcat

SEQ ID NO: 5230447 - DNA, 23 bp, Homo sapiens
agtttttaaaatatattgctgca

SEQ ID NO: 5230448 - DNA, 19 bp, Homo sapiens
agtttttaaaattggcctt

SEQ ID NO: 5230449 - DNA, 21 bp, Homo sapiens
agtttttaaaatttatttgca

SEQ ID NO: 5230450 - DNA, 15 bp, Homo sapiens
agtttttaaagcctt

SEQ ID NO: 5230451 - DNA, 16 bp, Homo sapiens
agtttttaaagccttc

SEQ ID NO: 5230452 - DNA, 19 bp, Homo sapiens
agtttttaatcgtacattt

SEQ ID NO: 5230453 - DNA, 21 bp, Homo sapiens
agtttttaattaaaaacttta

SEQ ID NO: 5230454 - DNA, 12 bp, Homo sapiens
agtttttacaaa

SEQ ID NO: 5230455 - DNA, 18 bp, Homo sapiens
agtttttacagctgtgtt

SEQ ID NO: 5230456 - DNA, 13 bp, Homo sapiens
agtttttacagtg

SEQ ID NO: 5230457 - DNA, 14 bp, Homo sapiens
agtttttacagtgt

SEQ ID NO: 5230458 - DNA, 22 bp, Homo sapiens
agtttttacctaccacagtgtc

SEQ ID NO: 5230459 - DNA, 23 bp, Homo sapiens
agtttttaccttgttttctctat

SEQ ID NO: 5230460 - DNA, 15 bp, Homo sapiens
agtttttactgaaca

SEQ ID NO: 5230461 - DNA, 18 bp, Homo sapiens
agtttttagtaatctgta

SEQ ID NO: 5230462 - DNA, 14 bp, Homo sapiens
agtttttagtttgt

SEQ ID NO: 5230463 - DNA, 20 bp, Homo sapiens
agtttttatacctgtacaca

SEQ ID NO: 5230464 - DNA, 16 bp, Homo sapiens
agtttttatatttgtt

SEQ ID NO: 5230465 - DNA, 18 bp, Homo sapiens
agtttttatgagaaactt

SEQ ID NO: 5230466 - DNA, 20 bp, Homo sapiens
agtttttatgcctttctctc

SEQ ID NO: 5230467 - DNA, 13 bp, Homo sapiens
agtgacacagaca

SEQ ID NO: 5230468 - DNA, 21 bp, Homo sapiens
agtgacaccaataaatgtttg

SEQ ID NO: 5230469 - DNA, 21 bp, Homo sapiens
agtgacacctcagtcatattt

SEQ ID NO: 5230470 - DNA, 15 bp, Homo sapiens
agtgacactggacca

SEQ ID NO: 5230471 - DNA, 18 bp, Homo sapiens
agtgacagaaggcccgag

SEQ ID NO: 5230472 - DNA, 20 bp, Homo sapiens
agtgacagactggattaaaa

SEQ ID NO: 5230473 - DNA, 20 bp, Homo sapiens
agtgacagagacccagatct

SEQ ID NO: 5230474 - DNA, 21 bp, Homo sapiens
agtgacagagcgagactccat

SEQ ID NO: 5230475 - DNA, 20 bp, Homo sapiens
agtgacagctaggatgtgca

SEQ ID NO: 5230476 - DNA, 22 bp, Homo sapiens
agtgacaggcaccagatgggat

SEQ ID NO: 5230477 - DNA, 20 bp, Homo sapiens
agtgacagggaagctacagg

SEQ ID NO: 5230478 - DNA, 22 bp, Homo sapiens
agtgacagggaagctacaggtt

SEQ ID NO: 5230479 - DNA, 20 bp, Homo sapiens
agtgacagtggattgcattt

SEQ ID NO: 5230480 - DNA, 17 bp, Homo sapiens
agtgacatcggttcagg

SEQ ID NO: 5230481 - DNA, 21 bp, Homo sapiens
agtgacatcggttcaggagga

SEQ ID NO: 5230482 - DNA, 12 bp, Homo sapiens
agtgacatgaag

SEQ ID NO: 5230483 - DNA, 15 bp, Homo sapiens
agtgacatgaagcat

SEQ ID NO: 5230484 - DNA, 13 bp, Homo sapiens
agtgacatgcagt

SEQ ID NO: 5230485 - DNA, 14 bp, Homo sapiens
agtgacatgcagtt

SEQ ID NO: 5230486 - DNA, 21 bp, Homo sapiens
agtgacatgggtgtgccaggc

SEQ ID NO: 5230487 - DNA, 17 bp, Homo sapiens
agtgacatttaatgcca

SEQ ID NO: 5230488 - DNA, 11 bp, Homo sapiens
agtgaccaagg

SEQ ID NO: 5230489 - DNA, 14 bp, Homo sapiens
agtgaccaaggagg

SEQ ID NO: 5230490 - DNA, 22 bp, Homo sapiens
agtgaccaatcgggagtagcaa

SEQ ID NO: 5230491 - DNA, 15 bp, Homo sapiens
agtgaccacttattc

SEQ ID NO: 5230492 - DNA, 19 bp, Homo sapiens
agtgaccacttattctgta

SEQ ID NO: 5230493 - DNA, 21 bp, Homo sapiens
agtgaccaggctcacaactgt

SEQ ID NO: 5230494 - DNA, 18 bp, Homo sapiens
agtgaccattgcatgccg

SEQ ID NO: 5230495 - DNA, 11 bp, Homo sapiens
agtgacccagc

SEQ ID NO: 5230496 - DNA, 13 bp, Homo sapiens
agtgaccccagaa

SEQ ID NO: 5230497 - DNA, 14 bp, Homo sapiens
agtgaccccagaaa

SEQ ID NO: 5230498 - DNA, 19 bp, Homo sapiens
agtgaccccagctccaggc

SEQ ID NO: 5230499 - DNA, 20 bp, Homo sapiens
agtgaccccagctccaggca

SEQ ID NO: 5230500 - DNA, 17 bp, Homo sapiens
agtgaccccagggcctg

SEQ ID NO: 5230501 - DNA, 16 bp, Homo sapiens
agtgacccggaggcca

SEQ ID NO: 5230502 - DNA, 19 bp, Homo sapiens
agtgacccggaggccacat

SEQ ID NO: 5230503 - DNA, 18 bp, Homo sapiens
agtgaccctggagctagg

SEQ ID NO: 5230504 - DNA, 13 bp, Homo sapiens
agtgacccttccc

SEQ ID NO: 5230505 - DNA, 18 bp, Homo sapiens
agtgaccgattatgcttt

SEQ ID NO: 5230506 - DNA, 19 bp, Homo sapiens
agtgaccgattatgctttc

SEQ ID NO: 5230507 - DNA, 20 bp, Homo sapiens
agtgaccgggcactggcact

SEQ ID NO: 5230508 - DNA, 22 bp, Homo sapiens
agtgaccgggggctgctgggcg

SEQ ID NO: 5230509 - DNA, 17 bp, Homo sapiens
agtgacctcactggcct

SEQ ID NO: 5230510 - DNA, 21 bp, Homo sapiens
agtgacctcactggcctgcca

SEQ ID NO: 5230511 - DNA, 20 bp, Homo sapiens
agtgacctccttctgcaaag

SEQ ID NO: 5230512 - DNA, 19 bp, Homo sapiens
agtgacctcggacagagcc

SEQ ID NO: 5230513 - DNA, 21 bp, Homo sapiens
agtgacctcggacagagcccc

SEQ ID NO: 5230514 - DNA, 20 bp, Homo sapiens
agtgacctgaccggcacctg

SEQ ID NO: 5230515 - DNA, 14 bp, Homo sapiens
agtgacctgaggaa

SEQ ID NO: 5230516 - DNA, 19 bp, Homo sapiens
agtgacctgccctacatat

SEQ ID NO: 5230517 - DNA, 21 bp, Homo sapiens
agtgacctgccctacatatct

SEQ ID NO: 5230518 - DNA, 20 bp, Homo sapiens
agtgaccttttcttcatttt

SEQ ID NO: 5230519 - DNA, 23 bp, Homo sapiens
agtgacggttcctacacaggaca

SEQ ID NO: 5230520 - DNA, 18 bp, Homo sapiens
agtgacgtggttcatccc

SEQ ID NO: 5230521 - DNA, 18 bp, Homo sapiens
agtgactagtacaaatta

SEQ ID NO: 5230522 - DNA, 13 bp, Homo sapiens
agtgactccaggg

SEQ ID NO: 5230523 - DNA, 14 bp, Homo sapiens
agtgactccctggg

SEQ ID NO: 5230524 - DNA, 15 bp, Homo sapiens
agtgactccctggga

SEQ ID NO: 5230525 - DNA, 17 bp, Homo sapiens
agtgactccctgggagc

SEQ ID NO: 5230526 - DNA, 15 bp, Homo sapiens
agtgactcgggctcc

SEQ ID NO: 5230527 - DNA, 17 bp, Homo sapiens
agtgactcgggctcctg

SEQ ID NO: 5230528 - DNA, 20 bp, Homo sapiens
agtgactcggtgtaaaacca

SEQ ID NO: 5230529 - DNA, 18 bp, Homo sapiens
agtgactctatatagctg

SEQ ID NO: 5230530 - DNA, 21 bp, Homo sapiens
agtgactctcctgcctcagcc

SEQ ID NO: 5230531 - DNA, 16 bp, Homo sapiens
agtgactgaaaatggc

SEQ ID NO: 5230532 - DNA, 17 bp, Homo sapiens
agtgactgaaaccattt

SEQ ID NO: 5230533 - DNA, 19 bp, Homo sapiens
agtgactgaacgatccttc

SEQ ID NO: 5230534 - DNA, 18 bp, Homo sapiens
agtgactgaattctgcct

SEQ ID NO: 5230535 - DNA, 22 bp, Homo sapiens
agtgactgacggctgtgtattt

SEQ ID NO: 5230536 - DNA, 21 bp, Homo sapiens
agtgactgatggctaatgtac

SEQ ID NO: 5230537 - DNA, 15 bp, Homo sapiens
agtgactgctgcgct

SEQ ID NO: 5230538 - DNA, 15 bp, Homo sapiens
agtgactgggccctg

SEQ ID NO: 5230539 - DNA, 19 bp, Homo sapiens
agtgactgggccctgtcca

SEQ ID NO: 5230540 - DNA, 16 bp, Homo sapiens
agtgactgtaattaat

SEQ ID NO: 5230541 - DNA, 18 bp, Homo sapiens
agtgactgtatctgtgta

SEQ ID NO: 5230542 - DNA, 20 bp, Homo sapiens
agtgactgtatctgtgtaga

SEQ ID NO: 5230543 - DNA, 19 bp, Homo sapiens
agtgactgtcgtgtttaca

SEQ ID NO: 5230544 - DNA, 17 bp, Homo sapiens
agtgactgttcaagagc

SEQ ID NO: 5230545 - DNA, 19 bp, Homo sapiens
agtgactgttcaagagcac

SEQ ID NO: 5230546 - DNA, 14 bp, Homo sapiens
agtgactgttgtac

SEQ ID NO: 5230547 - DNA, 18 bp, Homo sapiens
agtgacttaggaggctga

SEQ ID NO: 5230548 - DNA, 18 bp, Homo sapiens
agtgacttattttgtctt

SEQ ID NO: 5230549 - DNA, 21 bp, Homo sapiens
agtgacttcctggggatgtca

SEQ ID NO: 5230550 - DNA, 13 bp, Homo sapiens
agtgacttctgag

SEQ ID NO: 5230551 - DNA, 17 bp, Homo sapiens
agtgacttctggagaaa

SEQ ID NO: 5230552 - DNA, 14 bp, Homo sapiens
agtgacttctggct

SEQ ID NO: 5230553 - DNA, 18 bp, Homo sapiens
agtgacttcttccctaaa

SEQ ID NO: 5230554 - DNA, 21 bp, Homo sapiens
agtgacttgaatgtacaaaga

SEQ ID NO: 5230555 - DNA, 23 bp, Homo sapiens
agtgacttgcaatccaggctgtt

SEQ ID NO: 5230556 - DNA, 18 bp, Homo sapiens
agtgacttgtgtcccatg

SEQ ID NO: 5230557 - DNA, 17 bp, Homo sapiens
agtgacttgttctgagt

SEQ ID NO: 5230558 - DNA, 17 bp, Homo sapiens
agtgactttacaggagg

SEQ ID NO: 5230559 - DNA, 13 bp, Homo sapiens
agtgactttgtat

SEQ ID NO: 5230560 - DNA, 20 bp, Homo sapiens
agtgacttttcaagtattta

SEQ ID NO: 5230561 - DNA, 20 bp, Homo sapiens
agtgactttttctgagcttt

SEQ ID NO: 5230562 - DNA, 19 bp, Homo sapiens
agtgagaaaaagctcctgt

SEQ ID NO: 5230563 - DNA, 22 bp, Homo sapiens
agtgagaaaaagctcctgtcct

SEQ ID NO: 5230564 - DNA, 20 bp, Homo sapiens
agtgagaaaagttcaatact

SEQ ID NO: 5230565 - DNA, 16 bp, Homo sapiens
agtgagaaaatgaaca

SEQ ID NO: 5230566 - DNA, 19 bp, Homo sapiens
agtgagaactctctccctg

SEQ ID NO: 5230567 - DNA, 17 bp, Homo sapiens
agtgagaagggcctgct

SEQ ID NO: 5230568 - DNA, 19 bp, Homo sapiens
agtgagaatctggctcctg

SEQ ID NO: 5230569 - DNA, 19 bp, Homo sapiens
agtgagacaaaattttagt

SEQ ID NO: 5230570 - DNA, 12 bp, Homo sapiens
agtgagacacag

SEQ ID NO: 5230571 - DNA, 15 bp, Homo sapiens
agtgagacacagagt

SEQ ID NO: 5230572 - DNA, 13 bp, Homo sapiens
agtgagacagaag

SEQ ID NO: 5230573 - DNA, 14 bp, Homo sapiens
agtgagacaggctg

SEQ ID NO: 5230574 - DNA, 15 bp, Homo sapiens
agtgagacaggctgg

SEQ ID NO: 5230575 - DNA, 14 bp, Homo sapiens
agtgagacatcagg

SEQ ID NO: 5230576 - DNA, 19 bp, Homo sapiens
agtgagaccatgtttcaaa

SEQ ID NO: 5230577 - DNA, 17 bp, Homo sapiens
agtgagaccctgtctct

SEQ ID NO: 5230578 - DNA, 20 bp, Homo sapiens
agtgagaccttccttttact

SEQ ID NO: 5230579 - DNA, 22 bp, Homo sapiens
agtgagactctgtctcaaaaaa

SEQ ID NO: 5230580 - DNA, 12 bp, Homo sapiens
agtgagactgac

SEQ ID NO: 5230581 - DNA, 18 bp, Homo sapiens
agtgagactgacacctca

SEQ ID NO: 5230582 - DNA, 18 bp, Homo sapiens
agtgagactgactgcaag

SEQ ID NO: 5230583 - DNA, 20 bp, Homo sapiens
agtgagactgggaacttgat

SEQ ID NO: 5230584 - DNA, 19 bp, Homo sapiens
agtgagagacctctgccta

SEQ ID NO: 5230585 - DNA, 20 bp, Homo sapiens
agtgagagaggaggcctgga

SEQ ID NO: 5230586 - DNA, 14 bp, Homo sapiens
agtgagagcacaaa

SEQ ID NO: 5230587 - DNA, 18 bp, Homo sapiens
agtgagagcacaaagata

SEQ ID NO: 5230588 - DNA, 16 bp, Homo sapiens
agtgagagcagggctg

SEQ ID NO: 5230589 - DNA, 19 bp, Homo sapiens
agtgagagcagggctgggc

SEQ ID NO: 5230590 - DNA, 17 bp, Homo sapiens
agtgagagccagcagca

SEQ ID NO: 5230591 - DNA, 16 bp, Homo sapiens
agtgagagcctttgcc

SEQ ID NO: 5230592 - DNA, 19 bp, Homo sapiens
agtgagagcctttgccttt

SEQ ID NO: 5230593 - DNA, 12 bp, Homo sapiens
agtgagaggccc

SEQ ID NO: 5230594 - DNA, 14 bp, Homo sapiens
agtgagaggccccc

SEQ ID NO: 5230595 - DNA, 18 bp, Homo sapiens
agtgagaggcccccaccc

SEQ ID NO: 5230596 - DNA, 19 bp, Homo sapiens
agtgagaggggagggaggg

SEQ ID NO: 5230597 - DNA, 20 bp, Homo sapiens
agtgagaggggagggctcct

SEQ ID NO: 5230598 - DNA, 15 bp, Homo sapiens
agtgagagtgaggcc

SEQ ID NO: 5230599 - DNA, 16 bp, Homo sapiens
agtgagatagcattgt

SEQ ID NO: 5230600 - DNA, 22 bp, Homo sapiens
agtgagatataggataaaataa

SEQ ID NO: 5230601 - DNA, 22 bp, Homo sapiens
agtgagatgagggatgggcctg

SEQ ID NO: 5230602 - DNA, 12 bp, Homo sapiens
agtgagatgcat

SEQ ID NO: 5230603 - DNA, 16 bp, Homo sapiens
agtgagatgcattctt

SEQ ID NO: 5230604 - DNA, 14 bp, Homo sapiens
agtgagatgggaag

SEQ ID NO: 5230605 - DNA, 15 bp, Homo sapiens
agtgagatgggaagg

SEQ ID NO: 5230606 - DNA, 18 bp, Homo sapiens
agtgagatggtatgaaat

SEQ ID NO: 5230607 - DNA, 18 bp, Homo sapiens
agtgagatgtagaaagtt

SEQ ID NO: 5230608 - DNA, 14 bp, Homo sapiens
agtgagatgtttgg

SEQ ID NO: 5230609 - DNA, 22 bp, Homo sapiens
agtgagatttaagttcctgctg

SEQ ID NO: 5230610 - DNA, 23 bp, Homo sapiens
agtgagatttaagttcctgctgc

SEQ ID NO: 5230611 - DNA, 19 bp, Homo sapiens
agtgagatttgtatttata

SEQ ID NO: 5230612 - DNA, 17 bp, Homo sapiens
agtgagcaagggggccc

SEQ ID NO: 5230613 - DNA, 16 bp, Homo sapiens
agtgagcactgaaaca

SEQ ID NO: 5230614 - DNA, 12 bp, Homo sapiens
agtgagcagaac

SEQ ID NO: 5230615 - DNA, 13 bp, Homo sapiens
agtgagcagaaca

SEQ ID NO: 5230616 - DNA, 18 bp, Homo sapiens
agtgagcagaacaggtag

SEQ ID NO: 5230617 - DNA, 22 bp, Homo sapiens
agtgagcagagatgtactgcaa

SEQ ID NO: 5230618 - DNA, 17 bp, Homo sapiens
agtgagcagatgggaca

SEQ ID NO: 5230619 - DNA, 19 bp, Homo sapiens
agtgagcagctactgtaac

SEQ ID NO: 5230620 - DNA, 23 bp, Homo sapiens
agtgagcagctactgtaactttt

SEQ ID NO: 5230621 - DNA, 13 bp, Homo sapiens
agtgagcagggtg

SEQ ID NO: 5230622 - DNA, 15 bp, Homo sapiens
agtgagcagggtggg

SEQ ID NO: 5230623 - DNA, 19 bp, Homo sapiens
agtgagcagggtggggtct

SEQ ID NO: 5230624 - DNA, 18 bp, Homo sapiens
agtgagcagtcgcctgcc

SEQ ID NO: 5230625 - DNA, 13 bp, Homo sapiens
agtgagcagtgtt

SEQ ID NO: 5230626 - DNA, 13 bp, Homo sapiens
agtgagcatatct

SEQ ID NO: 5230627 - DNA, 18 bp, Homo sapiens
agtgagccaaatgtaaaa

SEQ ID NO: 5230628 - DNA, 13 bp, Homo sapiens
agtgagccacaga

SEQ ID NO: 5230629 - DNA, 15 bp, Homo sapiens
agtgagccacagacc

SEQ ID NO: 5230630 - DNA, 19 bp, Homo sapiens
agtgagccacagaccacct

SEQ ID NO: 5230631 - DNA, 19 bp, Homo sapiens
agtgagccagaaattgatt

SEQ ID NO: 5230632 - DNA, 12 bp, Homo sapiens
agtgagccagca

SEQ ID NO: 5230633 - DNA, 15 bp, Homo sapiens
agtgagccctgctct

SEQ ID NO: 5230634 - DNA, 20 bp, Homo sapiens
agtgagccgagattgcacca

SEQ ID NO: 5230635 - DNA, 21 bp, Homo sapiens
agtgagccgagattgcaccac

SEQ ID NO: 5230636 - DNA, 19 bp, Homo sapiens
agtgagccgcatcttctcc

SEQ ID NO: 5230637 - DNA, 20 bp, Homo sapiens
agtgagccgcatcttctcca

SEQ ID NO: 5230638 - DNA, 18 bp, Homo sapiens
agtgagcctcctgtgcct

SEQ ID NO: 5230639 - DNA, 21 bp, Homo sapiens
agtgagcctcctgtgcctggc

SEQ ID NO: 5230640 - DNA, 13 bp, Homo sapiens
agtgagcctctgc

SEQ ID NO: 5230641 - DNA, 18 bp, Homo sapiens
agtgagcctctgcgcctc

SEQ ID NO: 5230642 - DNA, 15 bp, Homo sapiens
agtgagcctggctct

SEQ ID NO: 5230643 - DNA, 22 bp, Homo sapiens
agtgagcggtgctgtcctcagg

SEQ ID NO: 5230644 - DNA, 20 bp, Homo sapiens
agtgagcgtgtagcgtcctg

SEQ ID NO: 5230645 - DNA, 23 bp, Homo sapiens
agtttttatggttccaatgaaat

SEQ ID NO: 5230646 - DNA, 21 bp, Homo sapiens
agtttttattcaaagcagctg

SEQ ID NO: 5230647 - DNA, 18 bp, Homo sapiens
agtttttatttagcatgg

SEQ ID NO: 5230648 - DNA, 20 bp, Homo sapiens
agtttttattttaaacattt

SEQ ID NO: 5230649 - DNA, 21 bp, Homo sapiens
agtttttattttaaacatttt

SEQ ID NO: 5230650 - DNA, 13 bp, Homo sapiens
agtttttcacttt

SEQ ID NO: 5230651 - DNA, 12 bp, Homo sapiens
agtttttcagaa

SEQ ID NO: 5230652 - DNA, 15 bp, Homo sapiens
agtttttcagaaagt

SEQ ID NO: 5230653 - DNA, 16 bp, Homo sapiens
agtttttcatactgta

SEQ ID NO: 5230654 - DNA, 18 bp, Homo sapiens
agtttttcatactgtaca

SEQ ID NO: 5230655 - DNA, 18 bp, Homo sapiens
agtttttcattaaataaa

SEQ ID NO: 5230656 - DNA, 13 bp, Homo sapiens
agtttttcatttg

SEQ ID NO: 5230657 - DNA, 14 bp, Homo sapiens
agtttttcatttgt

SEQ ID NO: 5230658 - DNA, 15 bp, Homo sapiens
agtttttcattttaa

SEQ ID NO: 5230659 - DNA, 23 bp, Homo sapiens
agtttttccaaaacctcagttaa

SEQ ID NO: 5230660 - DNA, 12 bp, Homo sapiens
agtttttccccc

SEQ ID NO: 5230661 - DNA, 13 bp, Homo sapiens
agtttttcctgga

SEQ ID NO: 5230662 - DNA, 14 bp, Homo sapiens
agtttttctctcaa

SEQ ID NO: 5230663 - DNA, 12 bp, Homo sapiens
agtttttctgaa

SEQ ID NO: 5230664 - DNA, 14 bp, Homo sapiens
agtttttctgaaag

SEQ ID NO: 5230665 - DNA, 13 bp, Homo sapiens
agtttttctgtcc

SEQ ID NO: 5230666 - DNA, 23 bp, Homo sapiens
agtttttctttaatatgattcta

SEQ ID NO: 5230667 - DNA, 22 bp, Homo sapiens
agtttttgaaaattatgcaaaa

SEQ ID NO: 5230668 - DNA, 13 bp, Homo sapiens
agtttttgaaaga

SEQ ID NO: 5230669 - DNA, 21 bp, Homo sapiens
agtttttgatcaagaatgcaa

SEQ ID NO: 5230670 - DNA, 21 bp, Homo sapiens
agtttttggataaagaatact

SEQ ID NO: 5230671 - DNA, 12 bp, Homo sapiens
agtttttgtact

SEQ ID NO: 5230672 - DNA, 14 bp, Homo sapiens
agtttttgtatctt

SEQ ID NO: 5230673 - DNA, 15 bp, Homo sapiens
agtttttgtatcttg

SEQ ID NO: 5230674 - DNA, 23 bp, Homo sapiens
agtttttgtatcttggggcaaga

SEQ ID NO: 5230675 - DNA, 12 bp, Homo sapiens
agtttttgttct

SEQ ID NO: 5230676 - DNA, 21 bp, Homo sapiens
agttttttacttttgtttatt

SEQ ID NO: 5230677 - DNA, 12 bp, Homo sapiens
agttttttcatc

SEQ ID NO: 5230678 - DNA, 13 bp, Homo sapiens
agttttttcatct

SEQ ID NO: 5230679 - DNA, 22 bp, Homo sapiens
agttttttgaaaatgggctcaa

SEQ ID NO: 5230680 - DNA, 21 bp, Homo sapiens
agttttttgaaattatgtgac

SEQ ID NO: 5230681 - DNA, 23 bp, Homo sapiens
agttttttgaaattatgtgacat

SEQ ID NO: 5230682 - DNA, 14 bp, Homo sapiens
agttttttgcttct

SEQ ID NO: 5230683 - DNA, 17 bp, Homo sapiens
agtttttttccttaaaa

SEQ ID NO: 5230684 - DNA, 15 bp, Homo sapiens
agtttttttgttcat

SEQ ID NO: 5230685 - DNA, 19 bp, Homo sapiens
agtttttttgttcatactt

SEQ ID NO: 5230686 - DNA, 14 bp, Homo sapiens
agttttttttgtaa

SEQ ID NO: 5230687 - DNA, 15 bp, Homo sapiens
agttttttttgtttg

SEQ ID NO: 5230688 - DNA, 21 bp, Homo sapiens
agttttttttgtttgcctctt

SEQ ID NO: 5230689 - DNA, 20 bp, Homo sapiens
agtttttttttataattcag

SEQ ID NO: 5230690 - DNA, 23 bp, Homo sapiens
agtttttttttatacactgtaat

SEQ ID NO: 5230691 - DNA, 18 bp, Homo sapiens
agttttttttttcttgtc

SEQ ID NO: 5230692 - DNA, 19 bp, Homo sapiens
agttttttttttcttgtct

SEQ ID NO: 5230693 - DNA, 22 bp, Homo sapiens
agttttttttttcttgtctata

SEQ ID NO: 5230694 - DNA, 16 bp, Homo sapiens
agtttttttttttcca

SEQ ID NO: 5230695 - DNA, 13 bp, Homo sapiens
ataaaaaaaaata

SEQ ID NO: 5230696 - DNA, 13 bp, Homo sapiens
ataaaaaaaagaa

SEQ ID NO: 5230697 - DNA, 19 bp, Homo sapiens
ataaaaaaaagaaatgaaa

SEQ ID NO: 5230698 - DNA, 19 bp, Homo sapiens
ataaaaaaaagttgtttat

SEQ ID NO: 5230699 - DNA, 17 bp, Homo sapiens
ataaaaaaacaatcatt

SEQ ID NO: 5230700 - DNA, 12 bp, Homo sapiens
ataaaaaaagaa

SEQ ID NO: 5230701 - DNA, 12 bp, Homo sapiens
ataaaaaaatac

SEQ ID NO: 5230702 - DNA, 19 bp, Homo sapiens
ataaaaaaatatatacaga

SEQ ID NO: 5230703 - DNA, 17 bp, Homo sapiens
ataaaaaacagaaaccg

SEQ ID NO: 5230704 - DNA, 15 bp, Homo sapiens
ataaaaaacatttat

SEQ ID NO: 5230705 - DNA, 17 bp, Homo sapiens
ataaaaaagaaaacatt

SEQ ID NO: 5230706 - DNA, 23 bp, Homo sapiens
ataaaaaagaaaacattccagat

SEQ ID NO: 5230707 - DNA, 15 bp, Homo sapiens
ataaaaaagattcta

SEQ ID NO: 5230708 - DNA, 17 bp, Homo sapiens
ataaaaaataacaactg

SEQ ID NO: 5230709 - DNA, 20 bp, Homo sapiens
ataaaaaataataatacaag

SEQ ID NO: 5230710 - DNA, 13 bp, Homo sapiens
ataaaaaatagac

SEQ ID NO: 5230711 - DNA, 13 bp, Homo sapiens
ataaaaaatatat

SEQ ID NO: 5230712 - DNA, 17 bp, Homo sapiens
ataaaaaatatgtattt

SEQ ID NO: 5230713 - DNA, 19 bp, Homo sapiens
ataaaaaatattcttgtca

SEQ ID NO: 5230714 - DNA, 13 bp, Homo sapiens
ataaaaaatattg

SEQ ID NO: 5230715 - DNA, 13 bp, Homo sapiens
ataaaaaatcatg

SEQ ID NO: 5230716 - DNA, 14 bp, Homo sapiens
ataaaaaatctgaa

SEQ ID NO: 5230717 - DNA, 20 bp, Homo sapiens
ataaaaaatctttagggaat

SEQ ID NO: 5230718 - DNA, 14 bp, Homo sapiens
ataaaaaatgacaa

SEQ ID NO: 5230719 - DNA, 13 bp, Homo sapiens
ataaaaaatggtt

SEQ ID NO: 5230720 - DNA, 15 bp, Homo sapiens
ataaaaaatgtaaca

SEQ ID NO: 5230721 - DNA, 22 bp, Homo sapiens
ataaaaaattaacttagttttt

SEQ ID NO: 5230722 - DNA, 13 bp, Homo sapiens
ataaaaaattatg

SEQ ID NO: 5230723 - DNA, 13 bp, Homo sapiens
ataaaaaatttta

SEQ ID NO: 5230724 - DNA, 19 bp, Homo sapiens
ataaaaaattttgtaattt

SEQ ID NO: 5230725 - DNA, 17 bp, Homo sapiens
ataaaaacaagtcattt

SEQ ID NO: 5230726 - DNA, 19 bp, Homo sapiens
ataaaaacacaccttaaaa

SEQ ID NO: 5230727 - DNA, 12 bp, Homo sapiens
ataaaaacactt

SEQ ID NO: 5230728 - DNA, 19 bp, Homo sapiens
ataaaaacattgaaatatt

SEQ ID NO: 5230729 - DNA, 20 bp, Homo sapiens
ataaaaacattgaaatatta

SEQ ID NO: 5230730 - DNA, 19 bp, Homo sapiens
ataaaaacattttgaagtg

SEQ ID NO: 5230731 - DNA, 18 bp, Homo sapiens
ataaaaaccaaactctgt

SEQ ID NO: 5230732 - DNA, 22 bp, Homo sapiens
ataaaaaccacccacaaagaaa

SEQ ID NO: 5230733 - DNA, 13 bp, Homo sapiens
ataaaaaccataa

SEQ ID NO: 5230734 - DNA, 17 bp, Homo sapiens
ataaaaaccttccaaac

SEQ ID NO: 5230735 - DNA, 18 bp, Homo sapiens
ataaaaactaaattgtaa

SEQ ID NO: 5230736 - DNA, 16 bp, Homo sapiens
ataaaaactactgaat

SEQ ID NO: 5230737 - DNA, 20 bp, Homo sapiens
ataaaaactactgaataaat

SEQ ID NO: 5230738 - DNA, 20 bp, Homo sapiens
ataaaaacttgaaaatatat

SEQ ID NO: 5230739 - DNA, 21 bp, Homo sapiens
ataaaaagaaaaaaatggaaa

SEQ ID NO: 5230740 - DNA, 23 bp, Homo sapiens
ataaaaagactattaagagcaat

SEQ ID NO: 5230741 - DNA, 14 bp, Homo sapiens
ataaaaagatcact

SEQ ID NO: 5230742 - DNA, 22 bp, Homo sapiens
ataaaaagatcactttctcagt

SEQ ID NO: 5230743 - DNA, 13 bp, Homo sapiens
ataaaaagcagaa

SEQ ID NO: 5230744 - DNA, 15 bp, Homo sapiens
ataaaaagcgctgca

SEQ ID NO: 5230745 - DNA, 12 bp, Homo sapiens
ataaaaagctga

SEQ ID NO: 5230746 - DNA, 21 bp, Homo sapiens
ataaaaagcttccatgattct

SEQ ID NO: 5230747 - DNA, 15 bp, Homo sapiens
ataaaaaggaaatta

SEQ ID NO: 5230748 - DNA, 16 bp, Homo sapiens
ataaaaaggaaattag

SEQ ID NO: 5230749 - DNA, 18 bp, Homo sapiens
ataaaaaggaaattagtc

SEQ ID NO: 5230750 - DNA, 14 bp, Homo sapiens
ataaaaaggacatc

SEQ ID NO: 5230751 - DNA, 19 bp, Homo sapiens
ataaaaaggacatcagcaa

SEQ ID NO: 5230752 - DNA, 16 bp, Homo sapiens
ataaaaagtgaacttt

SEQ ID NO: 5230753 - DNA, 20 bp, Homo sapiens
ataaaaagtgaacttttgta

SEQ ID NO: 5230754 - DNA, 17 bp, Homo sapiens
ataaaaagtgacacagc

SEQ ID NO: 5230755 - DNA, 16 bp, Homo sapiens
ataaaaagtgcttttg

SEQ ID NO: 5230756 - DNA, 20 bp, Homo sapiens
ataaaaagtggaatttcttg

SEQ ID NO: 5230757 - DNA, 10 bp, Homo sapiens
ataaaaagtt

SEQ ID NO: 5230758 - DNA, 13 bp, Homo sapiens
ataaaaagtttca

SEQ ID NO: 5230759 - DNA, 14 bp, Homo sapiens
ataaaaataaaaaa

SEQ ID NO: 5230760 - DNA, 15 bp, Homo sapiens
ataaaaataaataga

SEQ ID NO: 5230761 - DNA, 13 bp, Homo sapiens
ataaaaataaatt

SEQ ID NO: 5230762 - DNA, 22 bp, Homo sapiens
ataaaaataaatttggttctaa

SEQ ID NO: 5230763 - DNA, 13 bp, Homo sapiens
ataaaaatatatt

SEQ ID NO: 5230764 - DNA, 15 bp, Homo sapiens
ataaaaatatgtaat

SEQ ID NO: 5230765 - DNA, 16 bp, Homo sapiens
ataaaaatatgtacaa

SEQ ID NO: 5230766 - DNA, 23 bp, Homo sapiens
ataaaaatattgtgttgtgaatg

SEQ ID NO: 5230767 - DNA, 16 bp, Homo sapiens
ataaaaatcaggagcc

SEQ ID NO: 5230768 - DNA, 12 bp, Homo sapiens
ataaaaatcata

SEQ ID NO: 5230769 - DNA, 18 bp, Homo sapiens
ataaaaatcatatagacc

SEQ ID NO: 5230770 - DNA, 12 bp, Homo sapiens
ataaaaatgaaa

SEQ ID NO: 5230771 - DNA, 12 bp, Homo sapiens
ataaaaatgaca

SEQ ID NO: 5230772 - DNA, 13 bp, Homo sapiens
ataaaaatggcat

SEQ ID NO: 5230773 - DNA, 12 bp, Homo sapiens
ataaaaatgttt

SEQ ID NO: 5230774 - DNA, 17 bp, Homo sapiens
ataaaaattacatatat

SEQ ID NO: 5230775 - DNA, 17 bp, Homo sapiens
ataaaaattatgaaata

SEQ ID NO: 5230776 - DNA, 18 bp, Homo sapiens
ataaaaattctagattac

SEQ ID NO: 5230777 - DNA, 14 bp, Homo sapiens
ataaaaattgaaaa

SEQ ID NO: 5230778 - DNA, 22 bp, Homo sapiens
ataaaacaaaaccaagccttgg

SEQ ID NO: 5230779 - DNA, 13 bp, Homo sapiens
ataaaacaaaggg

SEQ ID NO: 5230780 - DNA, 15 bp, Homo sapiens
ataaaacaactctga

SEQ ID NO: 5230781 - DNA, 11 bp, Homo sapiens
ataaaacaagc

SEQ ID NO: 5230782 - DNA, 12 bp, Homo sapiens
ataaaacagaat

SEQ ID NO: 5230783 - DNA, 19 bp, Homo sapiens
ataaaacagagtaatcttg

SEQ ID NO: 5230784 - DNA, 21 bp, Homo sapiens
ataaaacagagtaatcttgtt

SEQ ID NO: 5230785 - DNA, 16 bp, Homo sapiens
ataaaacaggtcaata

SEQ ID NO: 5230786 - DNA, 18 bp, Homo sapiens
ataaaacaggtcaataca

SEQ ID NO: 5230787 - DNA, 16 bp, Homo sapiens
ataaaacagtatctct

SEQ ID NO: 5230788 - DNA, 17 bp, Homo sapiens
ataaaacagtatctctt

SEQ ID NO: 5230789 - DNA, 21 bp, Homo sapiens
ataaaacagtcatggcctgag

SEQ ID NO: 5230790 - DNA, 11 bp, Homo sapiens
ataaaacagtg

SEQ ID NO: 5230791 - DNA, 21 bp, Homo sapiens
ataaaacagtgtttccagtga

SEQ ID NO: 5230792 - DNA, 15 bp, Homo sapiens
ataaaacatagcaaa

SEQ ID NO: 5230793 - DNA, 19 bp, Homo sapiens
ataaaacatcataaatctt

SEQ ID NO: 5230794 - DNA, 16 bp, Homo sapiens
ataaaacatctttcca

SEQ ID NO: 5230795 - DNA, 20 bp, Homo sapiens
ataaaacatctttgaaatta

SEQ ID NO: 5230796 - DNA, 14 bp, Homo sapiens
ataaaacattaaga

SEQ ID NO: 5230797 - DNA, 22 bp, Homo sapiens
ataaaacattatgctccagaaa

SEQ ID NO: 5230798 - DNA, 23 bp, Homo sapiens
ataaaacattttaaatggacaga

SEQ ID NO: 5230799 - DNA, 18 bp, Homo sapiens
ataaaaccagaaagagga

SEQ ID NO: 5230800 - DNA, 11 bp, Homo sapiens
ataaaaccatg

SEQ ID NO: 5230801 - DNA, 18 bp, Homo sapiens
ataaaacccaatactttt

SEQ ID NO: 5230802 - DNA, 12 bp, Homo sapiens
ataaaaccctta

SEQ ID NO: 5230803 - DNA, 19 bp, Homo sapiens
ataaaacctcagctagctc

SEQ ID NO: 5230804 - DNA, 22 bp, Homo sapiens
ataaaacctgatatatacacat

SEQ ID NO: 5230805 - DNA, 16 bp, Homo sapiens
ataaaactaaatatat

SEQ ID NO: 5230806 - DNA, 17 bp, Homo sapiens
ataaaactaaatatatg

SEQ ID NO: 5230807 - DNA, 18 bp, Homo sapiens
ataaaactaaatatatgt

SEQ ID NO: 5230808 - DNA, 21 bp, Homo sapiens
ataaaactatttaaaattggc

SEQ ID NO: 5230809 - DNA, 20 bp, Homo sapiens
ataaaactatttattgtgct

SEQ ID NO: 5230810 - DNA, 19 bp, Homo sapiens
ataaaactcagttaaaatg

SEQ ID NO: 5230811 - DNA, 23 bp, Homo sapiens
ataaaactgagactgtatatgtt

SEQ ID NO: 5230812 - DNA, 19 bp, Homo sapiens
ataaaactgatgtgaaact

SEQ ID NO: 5230813 - DNA, 14 bp, Homo sapiens
ataaaactgctagt

SEQ ID NO: 5230814 - DNA, 12 bp, Homo sapiens
ataaaactgtgt

SEQ ID NO: 5230815 - DNA, 14 bp, Homo sapiens
ataaaactgtttca

SEQ ID NO: 5230816 - DNA, 15 bp, Homo sapiens
ataaaactgtttcaa

SEQ ID NO: 5230817 - DNA, 17 bp, Homo sapiens
ataaaactgtttgactt

SEQ ID NO: 5230818 - DNA, 19 bp, Homo sapiens
ataaaactgtttgacttct

SEQ ID NO: 5230819 - DNA, 17 bp, Homo sapiens
ataaaacttaaaaacaa

SEQ ID NO: 5230820 - DNA, 19 bp, Homo sapiens
ataaaacttgataaatgga

SEQ ID NO: 5230821 - DNA, 13 bp, Homo sapiens
ataaaactttaaa

SEQ ID NO: 5230822 - DNA, 14 bp, Homo sapiens
ataaaactttaaaa

SEQ ID NO: 5230823 - DNA, 19 bp, Homo sapiens
ataaaactttatgtactgc

SEQ ID NO: 5230824 - DNA, 15 bp, Homo sapiens
ataaaactttccaaa

SEQ ID NO: 5230825 - DNA, 17 bp, Homo sapiens
ataaaactttgctgcca

SEQ ID NO: 5230826 - DNA, 17 bp, Homo sapiens
ataaaactttttaaaat

SEQ ID NO: 5230827 - DNA, 16 bp, Homo sapiens
agtgagctacagagcc

SEQ ID NO: 5230828 - DNA, 16 bp, Homo sapiens
agtgagctaccaggaa

SEQ ID NO: 5230829 - DNA, 17 bp, Homo sapiens
agtgagctaccaggaag

SEQ ID NO: 5230830 - DNA, 17 bp, Homo sapiens
agtgagctgtaggtgtg

SEQ ID NO: 5230831 - DNA, 24 bp, Homo sapiens
agtgagcttgtaattgcaccactg

SEQ ID NO: 5230832 - DNA, 16 bp, Homo sapiens
agtgagctttgctgct

SEQ ID NO: 5230833 - DNA, 21 bp, Homo sapiens
agtgaggaaccctgatctctc

SEQ ID NO: 5230834 - DNA, 19 bp, Homo sapiens
agtgaggaagccaggtcca

SEQ ID NO: 5230835 - DNA, 22 bp, Homo sapiens
agtgaggaaggcaggaagagag

SEQ ID NO: 5230836 - DNA, 17 bp, Homo sapiens
agtgaggaatggcagtg

SEQ ID NO: 5230837 - DNA, 18 bp, Homo sapiens
agtgaggagggatgtggg

SEQ ID NO: 5230838 - DNA, 18 bp, Homo sapiens
agtgaggagggtggagga

SEQ ID NO: 5230839 - DNA, 18 bp, Homo sapiens
agtgaggatgctgcagtg

SEQ ID NO: 5230840 - DNA, 13 bp, Homo sapiens
agtgaggcagccg

SEQ ID NO: 5230841 - DNA, 16 bp, Homo sapiens
agtgaggccactgaag

SEQ ID NO: 5230842 - DNA, 17 bp, Homo sapiens
agtgaggcccaaggagc

SEQ ID NO: 5230843 - DNA, 17 bp, Homo sapiens
agtgaggcggattgaga

SEQ ID NO: 5230844 - DNA, 15 bp, Homo sapiens
agtgaggctctgccc

SEQ ID NO: 5230845 - DNA, 16 bp, Homo sapiens
agtgaggctctgccct

SEQ ID NO: 5230846 - DNA, 21 bp, Homo sapiens
agtgaggctctgcccttggtt

SEQ ID NO: 5230847 - DNA, 14 bp, Homo sapiens
agtgaggcttccag

SEQ ID NO: 5230848 - DNA, 16 bp, Homo sapiens
agtgagggagacagga

SEQ ID NO: 5230849 - DNA, 18 bp, Homo sapiens
agtgagggcctcagagcc

SEQ ID NO: 5230850 - DNA, 21 bp, Homo sapiens
agtgagggcctcagagcctga

SEQ ID NO: 5230851 - DNA, 15 bp, Homo sapiens
agtgagggctgggca

SEQ ID NO: 5230852 - DNA, 20 bp, Homo sapiens
agtgagggcttgtcattacc

SEQ ID NO: 5230853 - DNA, 17 bp, Homo sapiens
agtgaggggagatgctg

SEQ ID NO: 5230854 - DNA, 24 bp, Homo sapiens
agtgaggggtaaaagctgatctgg

SEQ ID NO: 5230855 - DNA, 16 bp, Homo sapiens
agtgagggtcagagag

SEQ ID NO: 5230856 - DNA, 22 bp, Homo sapiens
agtgagggtttctgagctgctc

SEQ ID NO: 5230857 - DNA, 22 bp, Homo sapiens
agtgaggtagtgccaatgacag

SEQ ID NO: 5230858 - DNA, 22 bp, Homo sapiens
agtgaggtgtgtcacaatgaga

SEQ ID NO: 5230859 - DNA, 19 bp, Homo sapiens
agtgaggtgttgcagccca

SEQ ID NO: 5230860 - DNA, 18 bp, Homo sapiens
agtgagtacctgcaaaaa

SEQ ID NO: 5230861 - DNA, 23 bp, Homo sapiens
agtgagtacctgcaaaaatgagt

SEQ ID NO: 5230862 - DNA, 20 bp, Homo sapiens
agtgagtattggaagacttg

SEQ ID NO: 5230863 - DNA, 14 bp, Homo sapiens
agtgagtcacctgc

SEQ ID NO: 5230864 - DNA, 18 bp, Homo sapiens
agtgagtcacctgctcca

SEQ ID NO: 5230865 - DNA, 19 bp, Homo sapiens
agtgagtcagcaccttggc

SEQ ID NO: 5230866 - DNA, 17 bp, Homo sapiens
agtgagtctctctgggc

SEQ ID NO: 5230867 - DNA, 16 bp, Homo sapiens
agtgagtctcttcaga

SEQ ID NO: 5230868 - DNA, 15 bp, Homo sapiens
agtgagtctgtcagc

SEQ ID NO: 5230869 - DNA, 13 bp, Homo sapiens
agtgagtgagcct

SEQ ID NO: 5230870 - DNA, 12 bp, Homo sapiens
agtgagtggcat

SEQ ID NO: 5230871 - DNA, 17 bp, Homo sapiens
agtgagtgtaggggtgg

SEQ ID NO: 5230872 - DNA, 13 bp, Homo sapiens
agtgagtgtatgt

SEQ ID NO: 5230873 - DNA, 15 bp, Homo sapiens
agtgagtgtatgtgt

SEQ ID NO: 5230874 - DNA, 22 bp, Homo sapiens
agtgagtgtgctgactttttaa

SEQ ID NO: 5230875 - DNA, 23 bp, Homo sapiens
agtgagtgtgctgactttttaac

SEQ ID NO: 5230876 - DNA, 19 bp, Homo sapiens
agtgagtgtgctgctgtaa

SEQ ID NO: 5230877 - DNA, 23 bp, Homo sapiens
agtgagtgtgtgtgcttgaatgt

SEQ ID NO: 5230878 - DNA, 16 bp, Homo sapiens
agtgagtgtttctatg

SEQ ID NO: 5230879 - DNA, 22 bp, Homo sapiens
agtgagttcagcctttaagata

SEQ ID NO: 5230880 - DNA, 13 bp, Homo sapiens
agtgagttctttt

SEQ ID NO: 5230881 - DNA, 20 bp, Homo sapiens
agtgagttgttgccctgggt

SEQ ID NO: 5230882 - DNA, 16 bp, Homo sapiens
agtgagtttgtaaata

SEQ ID NO: 5230883 - DNA, 23 bp, Homo sapiens
agtgagttttactcttaaatcat

SEQ ID NO: 5230884 - DNA, 15 bp, Homo sapiens
agtgagttttttagt

SEQ ID NO: 5230885 - DNA, 12 bp, Homo sapiens
agtgataaatct

SEQ ID NO: 5230886 - DNA, 22 bp, Homo sapiens
agtgataaatctagaaaattga

SEQ ID NO: 5230887 - DNA, 20 bp, Homo sapiens
agtgataacactggagtggt

SEQ ID NO: 5230888 - DNA, 18 bp, Homo sapiens
agtgataactcctaagag

SEQ ID NO: 5230889 - DNA, 15 bp, Homo sapiens
agtgataagagcagt

SEQ ID NO: 5230890 - DNA, 22 bp, Homo sapiens
agtgataatgttcattttgaaa

SEQ ID NO: 5230891 - DNA, 23 bp, Homo sapiens
agtgataattttatttataaact

SEQ ID NO: 5230892 - DNA, 17 bp, Homo sapiens
agtgatacaacttcaag

SEQ ID NO: 5230893 - DNA, 21 bp, Homo sapiens
agtgatacactgtatctaaaa

SEQ ID NO: 5230894 - DNA, 19 bp, Homo sapiens
agtgatacggatttagcta

SEQ ID NO: 5230895 - DNA, 14 bp, Homo sapiens
agtgataggcccaa

SEQ ID NO: 5230896 - DNA, 21 bp, Homo sapiens
agtgatagtcttttgcttttg

SEQ ID NO: 5230897 - DNA, 20 bp, Homo sapiens
agtgatataaaagctgcata

SEQ ID NO: 5230898 - DNA, 14 bp, Homo sapiens
agtgatataaatca

SEQ ID NO: 5230899 - DNA, 14 bp, Homo sapiens
agtgatatatgtat

SEQ ID NO: 5230900 - DNA, 16 bp, Homo sapiens
agtgatatatgtattt

SEQ ID NO: 5230901 - DNA, 22 bp, Homo sapiens
agtgatatatgtatttattgtc

SEQ ID NO: 5230902 - DNA, 17 bp, Homo sapiens
agtgatatcataaaagt

SEQ ID NO: 5230903 - DNA, 21 bp, Homo sapiens
agtgatatctttctcattacc

SEQ ID NO: 5230904 - DNA, 19 bp, Homo sapiens
agtgatatgatccagagca

SEQ ID NO: 5230905 - DNA, 15 bp, Homo sapiens
agtgatatggagcaa

SEQ ID NO: 5230906 - DNA, 17 bp, Homo sapiens
agtgatatggagcaaga

SEQ ID NO: 5230907 - DNA, 23 bp, Homo sapiens
agtgatatggtactaaggagaat

SEQ ID NO: 5230908 - DNA, 12 bp, Homo sapiens
agtgatattctt

SEQ ID NO: 5230909 - DNA, 19 bp, Homo sapiens
agtgatattctttgttaat

SEQ ID NO: 5230910 - DNA, 15 bp, Homo sapiens
agtgatattggaact

SEQ ID NO: 5230911 - DNA, 16 bp, Homo sapiens
agtgatcaataaaatg

SEQ ID NO: 5230912 - DNA, 20 bp, Homo sapiens
agtgatcaataaaatgtgat

SEQ ID NO: 5230913 - DNA, 14 bp, Homo sapiens
agtgatcacagcag

SEQ ID NO: 5230914 - DNA, 17 bp, Homo sapiens
agtgatcaccagcgtga

SEQ ID NO: 5230915 - DNA, 12 bp, Homo sapiens
agtgatcactgg

SEQ ID NO: 5230916 - DNA, 15 bp, Homo sapiens
agtgatcagcaatga

SEQ ID NO: 5230917 - DNA, 18 bp, Homo sapiens
agtgatcagcaatgaaga

SEQ ID NO: 5230918 - DNA, 23 bp, Homo sapiens
agtgatcagttgctctctgttca

SEQ ID NO: 5230919 - DNA, 19 bp, Homo sapiens
agtgatcctcccacctcag

SEQ ID NO: 5230920 - DNA, 21 bp, Homo sapiens
agtgatcctcccgccccagcc

SEQ ID NO: 5230921 - DNA, 15 bp, Homo sapiens
agtgatcctcctgtc

SEQ ID NO: 5230922 - DNA, 14 bp, Homo sapiens
agtgatcctgcaag

SEQ ID NO: 5230923 - DNA, 19 bp, Homo sapiens
agtgatccttccacctcag

SEQ ID NO: 5230924 - DNA, 23 bp, Homo sapiens
agtgatccttccacctcagtctc

SEQ ID NO: 5230925 - DNA, 16 bp, Homo sapiens
agtgatctatgtttgt

SEQ ID NO: 5230926 - DNA, 22 bp, Homo sapiens
agtgatctatgtttgtgtgatt

SEQ ID NO: 5230927 - DNA, 14 bp, Homo sapiens
agtgatctcaaatc

SEQ ID NO: 5230928 - DNA, 21 bp, Homo sapiens
agtgatctcactaaaaatata

SEQ ID NO: 5230929 - DNA, 17 bp, Homo sapiens
agtgatctcagggcaga

SEQ ID NO: 5230930 - DNA, 20 bp, Homo sapiens
agtgatctgtcccctctccc

SEQ ID NO: 5230931 - DNA, 12 bp, Homo sapiens
agtgatcttggc

SEQ ID NO: 5230932 - DNA, 22 bp, Homo sapiens
agtgatgaaaatttgcctttgc

SEQ ID NO: 5230933 - DNA, 13 bp, Homo sapiens
agtgatgaatgta

SEQ ID NO: 5230934 - DNA, 14 bp, Homo sapiens
agtgatgaatgtac

SEQ ID NO: 5230935 - DNA, 20 bp, Homo sapiens
agtgatgagctgaaaagtga

SEQ ID NO: 5230936 - DNA, 12 bp, Homo sapiens
agtgatgatgtt

SEQ ID NO: 5230937 - DNA, 16 bp, Homo sapiens
agtgatgattgtaagt

SEQ ID NO: 5230938 - DNA, 18 bp, Homo sapiens
agtgatgattgtaagtcc

SEQ ID NO: 5230939 - DNA, 17 bp, Homo sapiens
agtgatgccatgaagac

SEQ ID NO: 5230940 - DNA, 14 bp, Homo sapiens
agtgatgcctgccc

SEQ ID NO: 5230941 - DNA, 22 bp, Homo sapiens
agtgatgcctgcccgcaccctg

SEQ ID NO: 5230942 - DNA, 16 bp, Homo sapiens
agtgatggagttcctt

SEQ ID NO: 5230943 - DNA, 13 bp, Homo sapiens
agtgatggcatta

SEQ ID NO: 5230944 - DNA, 19 bp, Homo sapiens
agtgatggcgcgggaggca

SEQ ID NO: 5230945 - DNA, 23 bp, Homo sapiens
agtgatggcgcgggaggcaccag

SEQ ID NO: 5230946 - DNA, 20 bp, Homo sapiens
agtgatgggaaggtttttaa

SEQ ID NO: 5230947 - DNA, 20 bp, Homo sapiens
agtgatgggagaattggtat

SEQ ID NO: 5230948 - DNA, 20 bp, Homo sapiens
agtgatgggcaaggggccag

SEQ ID NO: 5230949 - DNA, 13 bp, Homo sapiens
agtgatggtcaga

SEQ ID NO: 5230950 - DNA, 19 bp, Homo sapiens
agtgatggtctcacagagc

SEQ ID NO: 5230951 - DNA, 20 bp, Homo sapiens
agtgatggtgtccttccctg

SEQ ID NO: 5230952 - DNA, 20 bp, Homo sapiens
agtgatgtatgttatttgat

SEQ ID NO: 5230953 - DNA, 19 bp, Homo sapiens
agtgatgtcactagggcag

SEQ ID NO: 5230954 - DNA, 20 bp, Homo sapiens
agtgatgtccttaaaatgtg

SEQ ID NO: 5230955 - DNA, 21 bp, Homo sapiens
agtgatgtccttaaaatgtgg

SEQ ID NO: 5230956 - DNA, 14 bp, Homo sapiens
agtgatgtgattta

SEQ ID NO: 5230957 - DNA, 16 bp, Homo sapiens
agtgatgtgatttatg

SEQ ID NO: 5230958 - DNA, 19 bp, Homo sapiens
agtgatgtgctggagctgg

SEQ ID NO: 5230959 - DNA, 21 bp, Homo sapiens
agtgatgtgggaagttacctt

SEQ ID NO: 5230960 - DNA, 15 bp, Homo sapiens
agtgatgtgtttaca

SEQ ID NO: 5230961 - DNA, 17 bp, Homo sapiens
agtgatgtgtttacatt

SEQ ID NO: 5230962 - DNA, 15 bp, Homo sapiens
agtgatgttagcaga

SEQ ID NO: 5230963 - DNA, 14 bp, Homo sapiens
agtgatgttgaaat

SEQ ID NO: 5230964 - DNA, 20 bp, Homo sapiens
agtgatgttgtttgggagag

SEQ ID NO: 5230965 - DNA, 21 bp, Homo sapiens
agtgatgttgtttgggagagt

SEQ ID NO: 5230966 - DNA, 17 bp, Homo sapiens
agtgattaagaaaacat

SEQ ID NO: 5230967 - DNA, 21 bp, Homo sapiens
agtgattaaggtctctctttg

SEQ ID NO: 5230968 - DNA, 22 bp, Homo sapiens
agtgattaaggtctctctttgg

SEQ ID NO: 5230969 - DNA, 15 bp, Homo sapiens
agtgattaccaggga

SEQ ID NO: 5230970 - DNA, 18 bp, Homo sapiens
agtgattaccagggactg

SEQ ID NO: 5230971 - DNA, 15 bp, Homo sapiens
agtgattatttttcc

SEQ ID NO: 5230972 - DNA, 16 bp, Homo sapiens
agtgattatttttcca

SEQ ID NO: 5230973 - DNA, 15 bp, Homo sapiens
agtgattcactgtgc

SEQ ID NO: 5230974 - DNA, 17 bp, Homo sapiens
agtgattcactgtgctt

SEQ ID NO: 5230975 - DNA, 22 bp, Homo sapiens
agtgattcactgtgcttcgagc

SEQ ID NO: 5230976 - DNA, 17 bp, Homo sapiens
agtgattcccaactcct

SEQ ID NO: 5230977 - DNA, 23 bp, Homo sapiens
agtgattcgcttttggtatttgt

SEQ ID NO: 5230978 - DNA, 16 bp, Homo sapiens
agtgattctgatttca

SEQ ID NO: 5230979 - DNA, 20 bp, Homo sapiens
agtgattctgatttcagttt

SEQ ID NO: 5230980 - DNA, 21 bp, Homo sapiens
agtgattctgtccctccaaag

SEQ ID NO: 5230981 - DNA, 18 bp, Homo sapiens
agtgattgaaccagctca

SEQ ID NO: 5230982 - DNA, 14 bp, Homo sapiens
agtgattgcagctt

SEQ ID NO: 5230983 - DNA, 15 bp, Homo sapiens
agtgattgtcttaat

SEQ ID NO: 5230984 - DNA, 17 bp, Homo sapiens
agtgattgtcttaatat

SEQ ID NO: 5230985 - DNA, 13 bp, Homo sapiens
agtgattgtgaag

SEQ ID NO: 5230986 - DNA, 16 bp, Homo sapiens
agtgatttgctatcat

SEQ ID NO: 5230987 - DNA, 15 bp, Homo sapiens
agtgatttgtaatat

SEQ ID NO: 5230988 - DNA, 16 bp, Homo sapiens
agtgatttttatgcca

SEQ ID NO: 5230989 - DNA, 20 bp, Homo sapiens
agtgatttttggtcttctgt

SEQ ID NO: 5230990 - DNA, 16 bp, Homo sapiens
agtgcaaaaactgtaa

SEQ ID NO: 5230991 - DNA, 19 bp, Homo sapiens
agtgcaaaactgtgtcaca

SEQ ID NO: 5230992 - DNA, 12 bp, Homo sapiens
agtgcaaaaggc

SEQ ID NO: 5230993 - DNA, 17 bp, Homo sapiens
agtgcaaaatgtcttgt

SEQ ID NO: 5230994 - DNA, 22 bp, Homo sapiens
agtgcaaaatgtcttgtgtatt

SEQ ID NO: 5230995 - DNA, 19 bp, Homo sapiens
agtgcaaacagaagtgcat

SEQ ID NO: 5230996 - DNA, 22 bp, Homo sapiens
agtgcaaacagaagtgcatcct

SEQ ID NO: 5230997 - DNA, 18 bp, Homo sapiens
agtgcaaacttcagagtt

SEQ ID NO: 5230998 - DNA, 21 bp, Homo sapiens
agtgcaaagatttgctttaat

SEQ ID NO: 5230999 - DNA, 11 bp, Homo sapiens
agtgcaaagct

SEQ ID NO: 5231000 - DNA, 17 bp, Homo sapiens
agtgcaaagtgccctca

SEQ ID NO: 5231001 - DNA, 17 bp, Homo sapiens
agtgcaaatcatagctg

SEQ ID NO: 5231002 - DNA, 19 bp, Homo sapiens
agtgcaaattgtatcttat

SEQ ID NO: 5231003 - DNA, 14 bp, Homo sapiens
agtgcaaattgtca

SEQ ID NO: 5231004 - DNA, 15 bp, Homo sapiens
ataaaagaaaaaata

SEQ ID NO: 5231005 - DNA, 17 bp, Homo sapiens
ataaaagaaatgcacaa

SEQ ID NO: 5231006 - DNA, 19 bp, Homo sapiens
ataaaagaatatttagaaa

SEQ ID NO: 5231007 - DNA, 15 bp, Homo sapiens
ataaaagacagtgaa

SEQ ID NO: 5231008 - DNA, 15 bp, Homo sapiens
ataaaagagctttat

SEQ ID NO: 5231009 - DNA, 14 bp, Homo sapiens
ataaaagatacatt

SEQ ID NO: 5231010 - DNA, 18 bp, Homo sapiens
ataaaagatacatttgta

SEQ ID NO: 5231011 - DNA, 20 bp, Homo sapiens
ataaaagatgaaagagcagt

SEQ ID NO: 5231012 - DNA, 21 bp, Homo sapiens
ataaaagatggggtctgtaaa

SEQ ID NO: 5231013 - DNA, 15 bp, Homo sapiens
ataaaagattcacct

SEQ ID NO: 5231014 - DNA, 11 bp, Homo sapiens
ataaaagcaaa

SEQ ID NO: 5231015 - DNA, 16 bp, Homo sapiens
ataaaagcaaaagaga

SEQ ID NO: 5231016 - DNA, 18 bp, Homo sapiens
ataaaagcaaaagagaaa

SEQ ID NO: 5231017 - DNA, 23 bp, Homo sapiens
ataaaagcaaaagagaaatacat

SEQ ID NO: 5231018 - DNA, 20 bp, Homo sapiens
ataaaagcaattccaacctt

SEQ ID NO: 5231019 - DNA, 21 bp, Homo sapiens
ataaaagcaattctgactgtc

SEQ ID NO: 5231020 - DNA, 16 bp, Homo sapiens
ataaaagcacactgct

SEQ ID NO: 5231021 - DNA, 20 bp, Homo sapiens
ataaaagcagcatctgctaa

SEQ ID NO: 5231022 - DNA, 15 bp, Homo sapiens
ataaaagcataaatg

SEQ ID NO: 5231023 - DNA, 18 bp, Homo sapiens
ataaaagcataaatgcaa

SEQ ID NO: 5231024 - DNA, 11 bp, Homo sapiens
ataaaagccca

SEQ ID NO: 5231025 - DNA, 19 bp, Homo sapiens
ataaaagcctgtttaagag

SEQ ID NO: 5231026 - DNA, 20 bp, Homo sapiens
ataaaagcctgtttaagaga

SEQ ID NO: 5231027 - DNA, 13 bp, Homo sapiens
ataaaagctataa

SEQ ID NO: 5231028 - DNA, 14 bp, Homo sapiens
ataaaagctataaa

SEQ ID NO: 5231029 - DNA, 15 bp, Homo sapiens
ataaaagctattact

SEQ ID NO: 5231030 - DNA, 22 bp, Homo sapiens
ataaaagctctagataaaactt

SEQ ID NO: 5231031 - DNA, 22 bp, Homo sapiens
ataaaagctgaagttactttat

SEQ ID NO: 5231032 - DNA, 16 bp, Homo sapiens
ataaaaggaaaaccag

SEQ ID NO: 5231033 - DNA, 19 bp, Homo sapiens
ataaaaggaagccaaagag

SEQ ID NO: 5231034 - DNA, 16 bp, Homo sapiens
ataaaaggatgttaca

SEQ ID NO: 5231035 - DNA, 17 bp, Homo sapiens
ataaaaggatgttacaa

SEQ ID NO: 5231036 - DNA, 19 bp, Homo sapiens
ataaaaggcaaatgtgtac

SEQ ID NO: 5231037 - DNA, 20 bp, Homo sapiens
ataaaaggcaaatgtgtaca

SEQ ID NO: 5231038 - DNA, 17 bp, Homo sapiens
ataaaaggcattcatct

SEQ ID NO: 5231039 - DNA, 18 bp, Homo sapiens
ataaaagggcaaatctgc

SEQ ID NO: 5231040 - DNA, 19 bp, Homo sapiens
ataaaagggtcaaacctgt

SEQ ID NO: 5231041 - DNA, 21 bp, Homo sapiens
ataaaaggtggagtttctctg

SEQ ID NO: 5231042 - DNA, 16 bp, Homo sapiens
ataaaaggttgccaaa

SEQ ID NO: 5231043 - DNA, 18 bp, Homo sapiens
ataaaaggttgccaaatt

SEQ ID NO: 5231044 - DNA, 20 bp, Homo sapiens
ataaaaggttgccaaattgc

SEQ ID NO: 5231045 - DNA, 23 bp, Homo sapiens
ataaaaggtttctttttttttcc

SEQ ID NO: 5231046 - DNA, 15 bp, Homo sapiens
ataaaagtacatgtt

SEQ ID NO: 5231047 - DNA, 17 bp, Homo sapiens
ataaaagtgatcaataa

SEQ ID NO: 5231048 - DNA, 18 bp, Homo sapiens
ataaaagtgatcaataaa

SEQ ID NO: 5231049 - DNA, 18 bp, Homo sapiens
ataaaagtgattgttggc

SEQ ID NO: 5231050 - DNA, 22 bp, Homo sapiens
ataaaagtgccttagcatgtgt

SEQ ID NO: 5231051 - DNA, 15 bp, Homo sapiens
ataaaagtgctgccg

SEQ ID NO: 5231052 - DNA, 23 bp, Homo sapiens
ataaaagttcctctcccttccct

SEQ ID NO: 5231053 - DNA, 15 bp, Homo sapiens
ataaaagttgcgttt

SEQ ID NO: 5231054 - DNA, 15 bp, Homo sapiens
ataaaagtttgcatg

SEQ ID NO: 5231055 - DNA, 18 bp, Homo sapiens
ataaaagttttttaataa

SEQ ID NO: 5231056 - DNA, 13 bp, Homo sapiens
ataaaataaactt

SEQ ID NO: 5231057 - DNA, 15 bp, Homo sapiens
ataaaataaagcaaa

SEQ ID NO: 5231058 - DNA, 14 bp, Homo sapiens
ataaaataaagtat

SEQ ID NO: 5231059 - DNA, 13 bp, Homo sapiens
ataaaataaataa

SEQ ID NO: 5231060 - DNA, 15 bp, Homo sapiens
ataaaataaatatac

SEQ ID NO: 5231061 - DNA, 19 bp, Homo sapiens
ataaaataaatatactaat

SEQ ID NO: 5231062 - DNA, 19 bp, Homo sapiens
ataaaataactaaaatgta

SEQ ID NO: 5231063 - DNA, 18 bp, Homo sapiens
ataaaataagtaacatat

SEQ ID NO: 5231064 - DNA, 22 bp, Homo sapiens
ataaaataagtcctaaagtgaa

SEQ ID NO: 5231065 - DNA, 17 bp, Homo sapiens
ataaaataattctaaag

SEQ ID NO: 5231066 - DNA, 16 bp, Homo sapiens
ataaaataattttatt

SEQ ID NO: 5231067 - DNA, 15 bp, Homo sapiens
ataaaataattttta

SEQ ID NO: 5231068 - DNA, 22 bp, Homo sapiens
ataaaataatttttatatttga

SEQ ID NO: 5231069 - DNA, 13 bp, Homo sapiens
ataaaatacacgt

SEQ ID NO: 5231070 - DNA, 12 bp, Homo sapiens
ataaaatacata

SEQ ID NO: 5231071 - DNA, 16 bp, Homo sapiens
ataaaatactattttt

SEQ ID NO: 5231072 - DNA, 23 bp, Homo sapiens
ataaaatactgcttttgcaaaca

SEQ ID NO: 5231073 - DNA, 13 bp, Homo sapiens
ataaaatactttt

SEQ ID NO: 5231074 - DNA, 15 bp, Homo sapiens
ataaaatagaataat

SEQ ID NO: 5231075 - DNA, 21 bp, Homo sapiens
ataaaataggcttagagagga

SEQ ID NO: 5231076 - DNA, 18 bp, Homo sapiens
ataaaatagtatgaaaat

SEQ ID NO: 5231077 - DNA, 22 bp, Homo sapiens
ataaaatagtatgttaatatgt

SEQ ID NO: 5231078 - DNA, 15 bp, Homo sapiens
ataaaatataattgt

SEQ ID NO: 5231079 - DNA, 13 bp, Homo sapiens
ataaaatatcaat

SEQ ID NO: 5231080 - DNA, 12 bp, Homo sapiens
ataaaatatcat

SEQ ID NO: 5231081 - DNA, 15 bp, Homo sapiens
ataaaatatcataaa

SEQ ID NO: 5231082 - DNA, 15 bp, Homo sapiens
ataaaatatcattca

SEQ ID NO: 5231083 - DNA, 16 bp, Homo sapiens
ataaaatatcattcag

SEQ ID NO: 5231084 - DNA, 19 bp, Homo sapiens
ataaaatatctatattcta

SEQ ID NO: 5231085 - DNA, 14 bp, Homo sapiens
ataaaatattcact

SEQ ID NO: 5231086 - DNA, 15 bp, Homo sapiens
ataaaatattcactc

SEQ ID NO: 5231087 - DNA, 23 bp, Homo sapiens
ataaaatattcactctccattag

SEQ ID NO: 5231088 - DNA, 12 bp, Homo sapiens
ataaaatatttt

SEQ ID NO: 5231089 - DNA, 14 bp, Homo sapiens
ataaaatattttaa

SEQ ID NO: 5231090 - DNA, 15 bp, Homo sapiens
ataaaatattttctg

SEQ ID NO: 5231091 - DNA, 20 bp, Homo sapiens
ataaaatattttctgtgtgt

SEQ ID NO: 5231092 - DNA, 22 bp, Homo sapiens
ataaaatattttctgtgtgttc

SEQ ID NO: 5231093 - DNA, 22 bp, Homo sapiens
ataaaatattttgttaactttt

SEQ ID NO: 5231094 - DNA, 16 bp, Homo sapiens
ataaaatcaattttta

SEQ ID NO: 5231095 - DNA, 15 bp, Homo sapiens
ataaaatcaccctga

SEQ ID NO: 5231096 - DNA, 19 bp, Homo sapiens
ataaaatcataagtatttg

SEQ ID NO: 5231097 - DNA, 20 bp, Homo sapiens
ataaaatcccattgtattta

SEQ ID NO: 5231098 - DNA, 18 bp, Homo sapiens
ataaaatctactccaaat

SEQ ID NO: 5231099 - DNA, 12 bp, Homo sapiens
ataaaatctgaa

SEQ ID NO: 5231100 - DNA, 21 bp, Homo sapiens
ataaaatctgaattttgcaat

SEQ ID NO: 5231101 - DNA, 17 bp, Homo sapiens
ataaaatctgatatgta

SEQ ID NO: 5231102 - DNA, 18 bp, Homo sapiens
ataaaatctttccatctc

SEQ ID NO: 5231103 - DNA, 13 bp, Homo sapiens
ataaaatgaaaat

SEQ ID NO: 5231104 - DNA, 15 bp, Homo sapiens
ataaaatgaaagatt

SEQ ID NO: 5231105 - DNA, 16 bp, Homo sapiens
ataaaatgactactta

SEQ ID NO: 5231106 - DNA, 15 bp, Homo sapiens
ataaaatgaggcagt

SEQ ID NO: 5231107 - DNA, 16 bp, Homo sapiens
ataaaatgagttacct

SEQ ID NO: 5231108 - DNA, 13 bp, Homo sapiens
ataaaatgcaaat

SEQ ID NO: 5231109 - DNA, 16 bp, Homo sapiens
ataaaatgcaaatgaa

SEQ ID NO: 5231110 - DNA, 19 bp, Homo sapiens
ataaaatgcaaatgaatca

SEQ ID NO: 5231111 - DNA, 20 bp, Homo sapiens
ataaaatgcaaatgaatcat

SEQ ID NO: 5231112 - DNA, 21 bp, Homo sapiens
ataaaatgcaaatgaatcatt

SEQ ID NO: 5231113 - DNA, 17 bp, Homo sapiens
ataaaatgcatactgtt

SEQ ID NO: 5231114 - DNA, 17 bp, Homo sapiens
ataaaatgctaggttct

SEQ ID NO: 5231115 - DNA, 19 bp, Homo sapiens
ataaaatgctaggttctac

SEQ ID NO: 5231116 - DNA, 14 bp, Homo sapiens
ataaaatgctttaa

SEQ ID NO: 5231117 - DNA, 22 bp, Homo sapiens
ataaaatggtgttttcatgtaa

SEQ ID NO: 5231118 - DNA, 17 bp, Homo sapiens
ataaaatggttcatatt

SEQ ID NO: 5231119 - DNA, 18 bp, Homo sapiens
ataaaatgtaacactgat

SEQ ID NO: 5231120 - DNA, 17 bp, Homo sapiens
ataaaatgtaattactt

SEQ ID NO: 5231121 - DNA, 19 bp, Homo sapiens
ataaaatgtattcaagcaa

SEQ ID NO: 5231122 - DNA, 20 bp, Homo sapiens
ataaaatgtcttcaaggctt

SEQ ID NO: 5231123 - DNA, 14 bp, Homo sapiens
ataaaatgtgtaca

SEQ ID NO: 5231124 - DNA, 16 bp, Homo sapiens
ataaaatgtgtacagt

SEQ ID NO: 5231125 - DNA, 20 bp, Homo sapiens
ataaaatgtgtacagtgaat

SEQ ID NO: 5231126 - DNA, 15 bp, Homo sapiens
ataaaatgtgttgaa

SEQ ID NO: 5231127 - DNA, 14 bp, Homo sapiens
ataaaatgttcctt

SEQ ID NO: 5231128 - DNA, 12 bp, Homo sapiens
ataaaatgttga

SEQ ID NO: 5231129 - DNA, 17 bp, Homo sapiens
ataaaatgttgaaaagt

SEQ ID NO: 5231130 - DNA, 16 bp, Homo sapiens
ataaaatgtttacatt

SEQ ID NO: 5231131 - DNA, 20 bp, Homo sapiens
ataaaatgtttatttttgct

SEQ ID NO: 5231132 - DNA, 18 bp, Homo sapiens
ataaaatgtttcattatg

SEQ ID NO: 5231133 - DNA, 15 bp, Homo sapiens
ataaaattaaaagtt

SEQ ID NO: 5231134 - DNA, 19 bp, Homo sapiens
ataaaattaaaatttaaca

SEQ ID NO: 5231135 - DNA, 22 bp, Homo sapiens
ataaaattaaaatttaacatct

SEQ ID NO: 5231136 - DNA, 16 bp, Homo sapiens
ataaaattaagaatgt

SEQ ID NO: 5231137 - DNA, 16 bp, Homo sapiens
ataaaattagaaagca

SEQ ID NO: 5231138 - DNA, 13 bp, Homo sapiens
ataaaattagatt

SEQ ID NO: 5231139 - DNA, 12 bp, Homo sapiens
ataaaattatag

SEQ ID NO: 5231140 - DNA, 14 bp, Homo sapiens
ataaaattatagat

SEQ ID NO: 5231141 - DNA, 21 bp, Homo sapiens
ataaaattatagatgggaatg

SEQ ID NO: 5231142 - DNA, 15 bp, Homo sapiens
ataaaattatttgca

SEQ ID NO: 5231143 - DNA, 18 bp, Homo sapiens
ataaaattattttggatt

SEQ ID NO: 5231144 - DNA, 17 bp, Homo sapiens
ataaaattcagaattct

SEQ ID NO: 5231145 - DNA, 12 bp, Homo sapiens
ataaaattcatt

SEQ ID NO: 5231146 - DNA, 17 bp, Homo sapiens
ataaaattcctatctca

SEQ ID NO: 5231147 - DNA, 13 bp, Homo sapiens
ataaaattcgctt

SEQ ID NO: 5231148 - DNA, 13 bp, Homo sapiens
ataaaattctaga

SEQ ID NO: 5231149 - DNA, 22 bp, Homo sapiens
ataaaattctattacagtatgt

SEQ ID NO: 5231150 - DNA, 14 bp, Homo sapiens
ataaaattctgtaa

SEQ ID NO: 5231151 - DNA, 15 bp, Homo sapiens
ataaaattgaaaaca

SEQ ID NO: 5231152 - DNA, 12 bp, Homo sapiens
ataaaattgaag

SEQ ID NO: 5231153 - DNA, 22 bp, Homo sapiens
ataaaattgcagtttcatgtat

SEQ ID NO: 5231154 - DNA, 18 bp, Homo sapiens
ataaaattggattacagt

SEQ ID NO: 5231155 - DNA, 11 bp, Homo sapiens
ataaaattgta

SEQ ID NO: 5231156 - DNA, 21 bp, Homo sapiens
ataaaattgtaaaattgtata

SEQ ID NO: 5231157 - DNA, 18 bp, Homo sapiens
ataaaattgttatttcaa

SEQ ID NO: 5231158 - DNA, 12 bp, Homo sapiens
ataaaatttaaa

SEQ ID NO: 5231159 - DNA, 18 bp, Homo sapiens
ataaaatttaaaaactta

SEQ ID NO: 5231160 - DNA, 13 bp, Homo sapiens
ataaaatttaatt

SEQ ID NO: 5231161 - DNA, 14 bp, Homo sapiens
ataaaatttacatt

SEQ ID NO: 5231162 - DNA, 18 bp, Homo sapiens
ataaaatttacatttaat

SEQ ID NO: 5231163 - DNA, 16 bp, Homo sapiens
ataaaatttgttgcat

SEQ ID NO: 5231164 - DNA, 13 bp, Homo sapiens
ataaaattttaaa

SEQ ID NO: 5231165 - DNA, 14 bp, Homo sapiens
ataaaattttgctt

SEQ ID NO: 5231166 - DNA, 11 bp, Homo sapiens
ataaaattttt

SEQ ID NO: 5231167 - DNA, 15 bp, Homo sapiens
ataaaattttttaaa

SEQ ID NO: 5231168 - DNA, 19 bp, Homo sapiens
ataaaattttttttcatgt

SEQ ID NO: 5231169 - DNA, 23 bp, Homo sapiens
ataaaattttttttcatgtttta

SEQ ID NO: 5231170 - DNA, 20 bp, Homo sapiens
ataaacaaacaaacaaaaat

SEQ ID NO: 5231171 - DNA, 15 bp, Homo sapiens
ataaacaaagacatt

SEQ ID NO: 5231172 - DNA, 15 bp, Homo sapiens
ataaacaaagttact

SEQ ID NO: 5231173 - DNA, 20 bp, Homo sapiens
ataaacaaatgaattgtatt

SEQ ID NO: 5231174 - DNA, 16 bp, Homo sapiens
ataaacaacagctgaa

SEQ ID NO: 5231175 - DNA, 17 bp, Homo sapiens
ataaacaagaaaaataa

SEQ ID NO: 5231176 - DNA, 20 bp, Homo sapiens
ataaacaagaaaaataaaga

SEQ ID NO: 5231177 - DNA, 22 bp, Homo sapiens
ataaacaagaccacgtttctaa

SEQ ID NO: 5231178 - DNA, 19 bp, Homo sapiens
ataaacaataaaaacaact

SEQ ID NO: 5231179 - DNA, 18 bp, Homo sapiens
ataaacaatgatgccctg

SEQ ID NO: 5231180 - DNA, 23 bp, Homo sapiens
ataaacacagctgctttcttctt

SEQ ID NO: 5231181 - DNA, 19 bp, Homo sapiens
ataaacaccaacccaggaa

SEQ ID NO: 5231182 - DNA, 20 bp, Homo sapiens
ataaacactccacagtgttt

SEQ ID NO: 5231183 - DNA, 22 bp, Homo sapiens
ataaacactccacagtgtttat

SEQ ID NO: 5231184 - DNA, 16 bp, Homo sapiens
agtgcaacaaaatcaa

SEQ ID NO: 5231185 - DNA, 11 bp, Homo sapiens
agtgcaacaag

SEQ ID NO: 5231186 - DNA, 13 bp, Homo sapiens
agtgcaacactgg

SEQ ID NO: 5231187 - DNA, 21 bp, Homo sapiens
agtgcaacactggtctgctgt

SEQ ID NO: 5231188 - DNA, 20 bp, Homo sapiens
agtgcaacagcactggctct

SEQ ID NO: 5231189 - DNA, 15 bp, Homo sapiens
agtgcaacagtagca

SEQ ID NO: 5231190 - DNA, 17 bp, Homo sapiens
agtgcaacatttctgta

SEQ ID NO: 5231191 - DNA, 22 bp, Homo sapiens
agtgcaacatttctgtatactg

SEQ ID NO: 5231192 - DNA, 24 bp, Homo sapiens
agtgcaaccacacacctcaccaga

SEQ ID NO: 5231193 - DNA, 14 bp, Homo sapiens
agtgcaacctctgc

SEQ ID NO: 5231194 - DNA, 23 bp, Homo sapiens
agtgcaagaagtctggccatttt

SEQ ID NO: 5231195 - DNA, 17 bp, Homo sapiens
agtgcaagagactttgt

SEQ ID NO: 5231196 - DNA, 16 bp, Homo sapiens
agtgcaagagcctgag

SEQ ID NO: 5231197 - DNA, 18 bp, Homo sapiens
agtgcaagcagatgacaa

SEQ ID NO: 5231198 - DNA, 13 bp, Homo sapiens
agtgcaaggaatg

SEQ ID NO: 5231199 - DNA, 14 bp, Homo sapiens
agtgcaaggaccta

SEQ ID NO: 5231200 - DNA, 16 bp, Homo sapiens
agtgcaagttcatgtg

SEQ ID NO: 5231201 - DNA, 17 bp, Homo sapiens
agtgcaagttcatgtgt

SEQ ID NO: 5231202 - DNA, 14 bp, Homo sapiens
agtgcaatatattt

SEQ ID NO: 5231203 - DNA, 17 bp, Homo sapiens
agtgcaatgccccctcc

SEQ ID NO: 5231204 - DNA, 18 bp, Homo sapiens
agtgcaatgccccctccc

SEQ ID NO: 5231205 - DNA, 19 bp, Homo sapiens
agtgcaatgcgtgttgtac

SEQ ID NO: 5231206 - DNA, 22 bp, Homo sapiens
agtgcaatggtataaatttcaa

SEQ ID NO: 5231207 - DNA, 22 bp, Homo sapiens
agtgcaattaacatatgtcacg

SEQ ID NO: 5231208 - DNA, 20 bp, Homo sapiens
agtgcaattccaagaaaata

SEQ ID NO: 5231209 - DNA, 18 bp, Homo sapiens
agtgcaattgcacaaata

SEQ ID NO: 5231210 - DNA, 15 bp, Homo sapiens
agtgcaatttcttct

SEQ ID NO: 5231211 - DNA, 20 bp, Homo sapiens
agtgcaatttcttctgtagc

SEQ ID NO: 5231212 - DNA, 14 bp, Homo sapiens
agtgcacaaaatga

SEQ ID NO: 5231213 - DNA, 20 bp, Homo sapiens
agtgcacacagaaatatata

SEQ ID NO: 5231214 - DNA, 11 bp, Homo sapiens
agtgcacacct

SEQ ID NO: 5231215 - DNA, 13 bp, Homo sapiens
agtgcacacttgt

SEQ ID NO: 5231216 - DNA, 14 bp, Homo sapiens
agtgcacaggagcc

SEQ ID NO: 5231217 - DNA, 15 bp, Homo sapiens
agtgcacagggaagg

SEQ ID NO: 5231218 - DNA, 20 bp, Homo sapiens
agtgcacatttggaattgac

SEQ ID NO: 5231219 - DNA, 23 bp, Homo sapiens
agtgcacatttggaattgacgga

SEQ ID NO: 5231220 - DNA, 21 bp, Homo sapiens
agtgcaccaggtcactctgac

SEQ ID NO: 5231221 - DNA, 13 bp, Homo sapiens
agtgcacccactc

SEQ ID NO: 5231222 - DNA, 21 bp, Homo sapiens
agtgcacctgcctccaccagc

SEQ ID NO: 5231223 - DNA, 20 bp, Homo sapiens
agtgcactaaccccagctgc

SEQ ID NO: 5231224 - DNA, 15 bp, Homo sapiens
agtgcactcagagct

SEQ ID NO: 5231225 - DNA, 15 bp, Homo sapiens
agtgcactccaagaa

SEQ ID NO: 5231226 - DNA, 19 bp, Homo sapiens
agtgcactccggcctgggt

SEQ ID NO: 5231227 - DNA, 20 bp, Homo sapiens
agtgcactccggcctgggtg

SEQ ID NO: 5231228 - DNA, 23 bp, Homo sapiens
agtgcactccggcctgggtgaca

SEQ ID NO: 5231229 - DNA, 15 bp, Homo sapiens
agtgcactcctggtg

SEQ ID NO: 5231230 - DNA, 14 bp, Homo sapiens
agtgcactgactgt

SEQ ID NO: 5231231 - DNA, 13 bp, Homo sapiens
agtgcactggcag

SEQ ID NO: 5231232 - DNA, 18 bp, Homo sapiens
agtgcacttgctggaaga

SEQ ID NO: 5231233 - DNA, 21 bp, Homo sapiens
agtgcacttttttatgaagaa

SEQ ID NO: 5231234 - DNA, 13 bp, Homo sapiens
agtgcagaaatga

SEQ ID NO: 5231235 - DNA, 16 bp, Homo sapiens
agtgcagaacacctgg

SEQ ID NO: 5231236 - DNA, 13 bp, Homo sapiens
agtgcagaatgta

SEQ ID NO: 5231237 - DNA, 22 bp, Homo sapiens
agtgcagacacctaaccccagg

SEQ ID NO: 5231238 - DNA, 13 bp, Homo sapiens
agtgcagacaggc

SEQ ID NO: 5231239 - DNA, 22 bp, Homo sapiens
agtgcagagaaagaaagggaaa

SEQ ID NO: 5231240 - DNA, 20 bp, Homo sapiens
agtgcagagatcctacttct

SEQ ID NO: 5231241 - DNA, 21 bp, Homo sapiens
agtgcagagccttctcagaag

SEQ ID NO: 5231242 - DNA, 21 bp, Homo sapiens
agtgcagagcttgtggaaagc

SEQ ID NO: 5231243 - DNA, 18 bp, Homo sapiens
agtgcagaggcggctctg

SEQ ID NO: 5231244 - DNA, 19 bp, Homo sapiens
agtgcagatgagtgtgtgt

SEQ ID NO: 5231245 - DNA, 15 bp, Homo sapiens
agtgcagcaaccaga

SEQ ID NO: 5231246 - DNA, 21 bp, Homo sapiens
agtgcagcaaccagagcactg

SEQ ID NO: 5231247 - DNA, 16 bp, Homo sapiens
agtgcagcaagcctgg

SEQ ID NO: 5231248 - DNA, 14 bp, Homo sapiens
agtgcagcagagga

SEQ ID NO: 5231249 - DNA, 23 bp, Homo sapiens
agtgcagcagaggacagtctgga

SEQ ID NO: 5231250 - DNA, 15 bp, Homo sapiens
agtgcagcagggcag

SEQ ID NO: 5231251 - DNA, 17 bp, Homo sapiens
agtgcagcatggaggaa

SEQ ID NO: 5231252 - DNA, 22 bp, Homo sapiens
agtgcagccaaaggggagccag

SEQ ID NO: 5231253 - DNA, 14 bp, Homo sapiens
agtgcagccactgg

SEQ ID NO: 5231254 - DNA, 19 bp, Homo sapiens
agtgcagccccctcctgac

SEQ ID NO: 5231255 - DNA, 15 bp, Homo sapiens
agtgcagcccctctc

SEQ ID NO: 5231256 - DNA, 24 bp, Homo sapiens
agtgcagcccgtgtggccccttca

SEQ ID NO: 5231257 - DNA, 18 bp, Homo sapiens
agtgcagccgtttgagaa

SEQ ID NO: 5231258 - DNA, 19 bp, Homo sapiens
agtgcagcgggccaggcag

SEQ ID NO: 5231259 - DNA, 17 bp, Homo sapiens
agtgcagctcaggagac

SEQ ID NO: 5231260 - DNA, 17 bp, Homo sapiens
agtgcagctcatgtttt

SEQ ID NO: 5231261 - DNA, 21 bp, Homo sapiens
agtgcagctcatgtttttaac

SEQ ID NO: 5231262 - DNA, 16 bp, Homo sapiens
agtgcagctgaaattg

SEQ ID NO: 5231263 - DNA, 18 bp, Homo sapiens
agtgcagctgattttaac

SEQ ID NO: 5231264 - DNA, 22 bp, Homo sapiens
agtgcaggaaaaggctgcagct

SEQ ID NO: 5231265 - DNA, 12 bp, Homo sapiens
agtgcaggccca

SEQ ID NO: 5231266 - DNA, 17 bp, Homo sapiens
agtgcaggcccaccctg

SEQ ID NO: 5231267 - DNA, 11 bp, Homo sapiens
agtgcaggctg

SEQ ID NO: 5231268 - DNA, 13 bp, Homo sapiens
agtgcaggctggc

SEQ ID NO: 5231269 - DNA, 14 bp, Homo sapiens
agtgcaggctggcc

SEQ ID NO: 5231270 - DNA, 19 bp, Homo sapiens
agtgcaggtgcagtttcat

SEQ ID NO: 5231271 - DNA, 15 bp, Homo sapiens
agtgcagtatagaat

SEQ ID NO: 5231272 - DNA, 20 bp, Homo sapiens
agtgcagtcaccctgtggca

SEQ ID NO: 5231273 - DNA, 22 bp, Homo sapiens
agtgcagtcagcagatgctgtt

SEQ ID NO: 5231274 - DNA, 10 bp, Homo sapiens
agtgcagtga

SEQ ID NO: 5231275 - DNA, 14 bp, Homo sapiens
agtgcagtgacaca

SEQ ID NO: 5231276 - DNA, 23 bp, Homo sapiens
agtgcagtggcatcatctcagct

SEQ ID NO: 5231277 - DNA, 12 bp, Homo sapiens
agtgcagtggct

SEQ ID NO: 5231278 - DNA, 18 bp, Homo sapiens
agtgcagtggctcaatgc

SEQ ID NO: 5231279 - DNA, 20 bp, Homo sapiens
agtgcagttgaggtctgcgt

SEQ ID NO: 5231280 - DNA, 17 bp, Homo sapiens
agtgcagttgtgatttc

SEQ ID NO: 5231281 - DNA, 22 bp, Homo sapiens
agtgcataaaggttctggggct

SEQ ID NO: 5231282 - DNA, 22 bp, Homo sapiens
agtgcatagttgtagacaaagt

SEQ ID NO: 5231283 - DNA, 16 bp, Homo sapiens
agtgcatattcctttc

SEQ ID NO: 5231284 - DNA, 16 bp, Homo sapiens
agtgcatatttatcca

SEQ ID NO: 5231285 - DNA, 17 bp, Homo sapiens
agtgcatcacatctgca

SEQ ID NO: 5231286 - DNA, 13 bp, Homo sapiens
agtgcatctactt

SEQ ID NO: 5231287 - DNA, 14 bp, Homo sapiens
agtgcatctcagcc

SEQ ID NO: 5231288 - DNA, 15 bp, Homo sapiens
agtgcatctcagccc

SEQ ID NO: 5231289 - DNA, 16 bp, Homo sapiens
agtgcatctcagccca

SEQ ID NO: 5231290 - DNA, 21 bp, Homo sapiens
agtgcatctggagagaacagg

SEQ ID NO: 5231291 - DNA, 21 bp, Homo sapiens
agtgcatgaaaaaccattttt

SEQ ID NO: 5231292 - DNA, 21 bp, Homo sapiens
agtgcatgaacagggtccctg

SEQ ID NO: 5231293 - DNA, 12 bp, Homo sapiens
agtgcatgatgg

SEQ ID NO: 5231294 - DNA, 16 bp, Homo sapiens
agtgcatgatggtgag

SEQ ID NO: 5231295 - DNA, 14 bp, Homo sapiens
agtgcatgcatgtt

SEQ ID NO: 5231296 - DNA, 19 bp, Homo sapiens
agtgcatgcattgagctgc

SEQ ID NO: 5231297 - DNA, 14 bp, Homo sapiens
agtgcatgccagga

SEQ ID NO: 5231298 - DNA, 15 bp, Homo sapiens
agtgcatgctctctg

SEQ ID NO: 5231299 - DNA, 22 bp, Homo sapiens
agtgcatgctctctgcagccag

SEQ ID NO: 5231300 - DNA, 14 bp, Homo sapiens
agtgcatggccaca

SEQ ID NO: 5231301 - DNA, 16 bp, Homo sapiens
agtgcatggccacagc

SEQ ID NO: 5231302 - DNA, 17 bp, Homo sapiens
agtgcatggccacagcc

SEQ ID NO: 5231303 - DNA, 18 bp, Homo sapiens
agtgcatggccacagcca

SEQ ID NO: 5231304 - DNA, 19 bp, Homo sapiens
agtgcatggccacagccac

SEQ ID NO: 5231305 - DNA, 16 bp, Homo sapiens
agtgcatgggtcaggg

SEQ ID NO: 5231306 - DNA, 22 bp, Homo sapiens
agtgcatgggtcagggtgtgag

SEQ ID NO: 5231307 - DNA, 17 bp, Homo sapiens
agtgcatgtcacatgac

SEQ ID NO: 5231308 - DNA, 20 bp, Homo sapiens
agtgcatgtgaagcatgctt

SEQ ID NO: 5231309 - DNA, 22 bp, Homo sapiens
agtgcatgtgaagcatgctttg

SEQ ID NO: 5231310 - DNA, 22 bp, Homo sapiens
agtgcattcaaccttaccaaaa

SEQ ID NO: 5231311 - DNA, 20 bp, Homo sapiens
agtgcattcattcatcctct

SEQ ID NO: 5231312 - DNA, 16 bp, Homo sapiens
agtgcattgtttctgt

SEQ ID NO: 5231313 - DNA, 17 bp, Homo sapiens
agtgcatttctgggcct

SEQ ID NO: 5231314 - DNA, 17 bp, Homo sapiens
agtgcattttgtttctg

SEQ ID NO: 5231315 - DNA, 18 bp, Homo sapiens
agtgcatttttaaacttg

SEQ ID NO: 5231316 - DNA, 21 bp, Homo sapiens
agtgcatttttaaacttgaaa

SEQ ID NO: 5231317 - DNA, 17 bp, Homo sapiens
agtgcatttttatctgt

SEQ ID NO: 5231318 - DNA, 21 bp, Homo sapiens
agtgcatttttatctgtgagt

SEQ ID NO: 5231319 - DNA, 14 bp, Homo sapiens
agtgcatttttgta

SEQ ID NO: 5231320 - DNA, 20 bp, Homo sapiens
agtgcatttttgtaaatgtg

SEQ ID NO: 5231321 - DNA, 14 bp, Homo sapiens
agtgccaaaaacaa

SEQ ID NO: 5231322 - DNA, 18 bp, Homo sapiens
agtgccaaaataaagtct

SEQ ID NO: 5231323 - DNA, 14 bp, Homo sapiens
agtgccaaacttgg

SEQ ID NO: 5231324 - DNA, 13 bp, Homo sapiens
agtgccaaagaaa

SEQ ID NO: 5231325 - DNA, 21 bp, Homo sapiens
agtgccaaagaagcagaccat

SEQ ID NO: 5231326 - DNA, 14 bp, Homo sapiens
agtgccaaatgctc

SEQ ID NO: 5231327 - DNA, 18 bp, Homo sapiens
agtgccaaatgctggggc

SEQ ID NO: 5231328 - DNA, 20 bp, Homo sapiens
agtgccaaatgctggggcag

SEQ ID NO: 5231329 - DNA, 16 bp, Homo sapiens
agtgccaactcctcac

SEQ ID NO: 5231330 - DNA, 18 bp, Homo sapiens
agtgccaacttcccctct

SEQ ID NO: 5231331 - DNA, 19 bp, Homo sapiens
agtgccaagcacagtgcct

SEQ ID NO: 5231332 - DNA, 12 bp, Homo sapiens
agtgccaaggac

SEQ ID NO: 5231333 - DNA, 19 bp, Homo sapiens
agtgccaaggttgtcctgg

SEQ ID NO: 5231334 - DNA, 23 bp, Homo sapiens
agtgccaatgttgtgtgttgcac

SEQ ID NO: 5231335 - DNA, 16 bp, Homo sapiens
agtgccacaaagctca

SEQ ID NO: 5231336 - DNA, 22 bp, Homo sapiens
agtgccacaaagctcaatagga

SEQ ID NO: 5231337 - DNA, 10 bp, Homo sapiens
agtgccacag

SEQ ID NO: 5231338 - DNA, 13 bp, Homo sapiens
agtgccacagaga

SEQ ID NO: 5231339 - DNA, 15 bp, Homo sapiens
agtgccacagcctgc

SEQ ID NO: 5231340 - DNA, 16 bp, Homo sapiens
agtgccacagcctgct

SEQ ID NO: 5231341 - DNA, 19 bp, Homo sapiens
agtgccacagcctgctggc

SEQ ID NO: 5231342 - DNA, 20 bp, Homo sapiens
agtgccacagcctgctggca

SEQ ID NO: 5231343 - DNA, 23 bp, Homo sapiens
agtgccacagcctgctggcaggg

SEQ ID NO: 5231344 - DNA, 21 bp, Homo sapiens
agtgccacatgacagcagtgt

SEQ ID NO: 5231345 - DNA, 21 bp, Homo sapiens
agtgccaccaagctcacacct

SEQ ID NO: 5231346 - DNA, 22 bp, Homo sapiens
agtgccaccaagctcacacctg

SEQ ID NO: 5231347 - DNA, 23 bp, Homo sapiens
agtgccaccaagctcacacctgt

SEQ ID NO: 5231348 - DNA, 20 bp, Homo sapiens
agtgccacccacctttgcca

SEQ ID NO: 5231349 - DNA, 22 bp, Homo sapiens
agtgccacccatgcagctgctc

SEQ ID NO: 5231350 - DNA, 17 bp, Homo sapiens
agtgccacctatgcctg

SEQ ID NO: 5231351 - DNA, 19 bp, Homo sapiens
agtgccacctatgcctgtg

SEQ ID NO: 5231352 - DNA, 20 bp, Homo sapiens
agtgccacctatgcctgtgg

SEQ ID NO: 5231353 - DNA, 17 bp, Homo sapiens
agtgccacgtcatgagc

SEQ ID NO: 5231354 - DNA, 18 bp, Homo sapiens
agtgccacgtggccgctg

SEQ ID NO: 5231355 - DNA, 23 bp, Homo sapiens
agtgccacgtggccgctgcccac

SEQ ID NO: 5231356 - DNA, 19 bp, Homo sapiens
agtgccactcattcctgta

SEQ ID NO: 5231357 - DNA, 17 bp, Homo sapiens
agtgccactgttgtttt

SEQ ID NO: 5231358 - DNA, 17 bp, Homo sapiens
agtgccacttaatgtat

SEQ ID NO: 5231359 - DNA, 17 bp, Homo sapiens
agtgccacttgacattc

SEQ ID NO: 5231360 - DNA, 19 bp, Homo sapiens
agtgccacttgacattcct

SEQ ID NO: 5231361 - DNA, 23 bp, Homo sapiens
agtgccagatgttgtctgaacta

SEQ ID NO: 5231362 - DNA, 21 bp, Homo sapiens
ataaacactgcctatatatgt

SEQ ID NO: 5231363 - DNA, 19 bp, Homo sapiens
ataaacactggctctggga

SEQ ID NO: 5231364 - DNA, 17 bp, Homo sapiens
ataaacactggtgccaa

SEQ ID NO: 5231365 - DNA, 20 bp, Homo sapiens
ataaacactggtgccaacca

SEQ ID NO: 5231366 - DNA, 14 bp, Homo sapiens
ataaacactgtgta

SEQ ID NO: 5231367 - DNA, 20 bp, Homo sapiens
ataaacactgttttatagaa

SEQ ID NO: 5231368 - DNA, 18 bp, Homo sapiens
ataaacacttctccttaa

SEQ ID NO: 5231369 - DNA, 21 bp, Homo sapiens
ataaacagaaatgctctgatt

SEQ ID NO: 5231370 - DNA, 17 bp, Homo sapiens
ataaacagacaaaaaca

SEQ ID NO: 5231371 - DNA, 15 bp, Homo sapiens
ataaacagatgaata

SEQ ID NO: 5231372 - DNA, 17 bp, Homo sapiens
ataaacagatgaataaa

SEQ ID NO: 5231373 - DNA, 12 bp, Homo sapiens
ataaacagcagg

SEQ ID NO: 5231374 - DNA, 13 bp, Homo sapiens
ataaacagctatt

SEQ ID NO: 5231375 - DNA, 19 bp, Homo sapiens
ataaacaggtcaatgaatg

SEQ ID NO: 5231376 - DNA, 19 bp, Homo sapiens
ataaacagtctaaagaaga

SEQ ID NO: 5231377 - DNA, 15 bp, Homo sapiens
ataaacagtgagcat

SEQ ID NO: 5231378 - DNA, 19 bp, Homo sapiens
ataaacagtgagcatatct

SEQ ID NO: 5231379 - DNA, 22 bp, Homo sapiens
ataaacagtggaatataaggaa

SEQ ID NO: 5231380 - DNA, 17 bp, Homo sapiens
ataaacagttgttactt

SEQ ID NO: 5231381 - DNA, 20 bp, Homo sapiens
ataaacatacgtgtgcatgt

SEQ ID NO: 5231382 - DNA, 18 bp, Homo sapiens
ataaacatatgcaaacag

SEQ ID NO: 5231383 - DNA, 22 bp, Homo sapiens
ataaacatatttttatacttta

SEQ ID NO: 5231384 - DNA, 12 bp, Homo sapiens
ataaacatgaag

SEQ ID NO: 5231385 - DNA, 16 bp, Homo sapiens
ataaacatgagcgctg

SEQ ID NO: 5231386 - DNA, 20 bp, Homo sapiens
ataaacatgtcacaatacag

SEQ ID NO: 5231387 - DNA, 12 bp, Homo sapiens
ataaacattaaa

SEQ ID NO: 5231388 - DNA, 13 bp, Homo sapiens
ataaacattaaac

SEQ ID NO: 5231389 - DNA, 17 bp, Homo sapiens
ataaacattaaacactg

SEQ ID NO: 5231390 - DNA, 21 bp, Homo sapiens
ataaacattaattttgtgcat

SEQ ID NO: 5231391 - DNA, 23 bp, Homo sapiens
ataaacattaattttgtgcattc

SEQ ID NO: 5231392 - DNA, 12 bp, Homo sapiens
ataaacattttt

SEQ ID NO: 5231393 - DNA, 18 bp, Homo sapiens
ataaacattttttaagaa

SEQ ID NO: 5231394 - DNA, 16 bp, Homo sapiens
ataaaccaaaaacatt

SEQ ID NO: 5231395 - DNA, 18 bp, Homo sapiens
ataaaccaaaaacatttg

SEQ ID NO: 5231396 - DNA, 17 bp, Homo sapiens
ataaaccaaacccagcc

SEQ ID NO: 5231397 - DNA, 18 bp, Homo sapiens
ataaaccaaacccagcca

SEQ ID NO: 5231398 - DNA, 15 bp, Homo sapiens
ataaaccaaaggaca

SEQ ID NO: 5231399 - DNA, 19 bp, Homo sapiens
ataaaccaaatatgttaaa

SEQ ID NO: 5231400 - DNA, 18 bp, Homo sapiens
ataaaccaagacaagacc

SEQ ID NO: 5231401 - DNA, 18 bp, Homo sapiens
ataaaccacaagcatctc

SEQ ID NO: 5231402 - DNA, 22 bp, Homo sapiens
ataaaccattggacagatttca

SEQ ID NO: 5231403 - DNA, 17 bp, Homo sapiens
ataaacccatctgtaat

SEQ ID NO: 5231404 - DNA, 23 bp, Homo sapiens
ataaaccctccttggtgcctctg

SEQ ID NO: 5231405 - DNA, 20 bp, Homo sapiens
ataaaccgtggtctcatgta

SEQ ID NO: 5231406 - DNA, 20 bp, Homo sapiens
ataaaccgtttttaacacat

SEQ ID NO: 5231407 - DNA, 22 bp, Homo sapiens
ataaacctaaaaaagatatatt

SEQ ID NO: 5231408 - DNA, 16 bp, Homo sapiens
ataaacctcaaaatgt

SEQ ID NO: 5231409 - DNA, 14 bp, Homo sapiens
ataaacctgaggca

SEQ ID NO: 5231410 - DNA, 16 bp, Homo sapiens
ataaacctgaggcagg

SEQ ID NO: 5231411 - DNA, 17 bp, Homo sapiens
ataaacctggagatgat

SEQ ID NO: 5231412 - DNA, 20 bp, Homo sapiens
ataaacctgtctaagcaata

SEQ ID NO: 5231413 - DNA, 14 bp, Homo sapiens
ataaacctgttctt

SEQ ID NO: 5231414 - DNA, 14 bp, Homo sapiens
ataaaccttcagaa

SEQ ID NO: 5231415 - DNA, 14 bp, Homo sapiens
ataaaccttgaaca

SEQ ID NO: 5231416 - DNA, 19 bp, Homo sapiens
ataaaccttgtcaataaaa

SEQ ID NO: 5231417 - DNA, 14 bp, Homo sapiens
ataaacgaaacaca

SEQ ID NO: 5231418 - DNA, 16 bp, Homo sapiens
ataaacgaaacattta

SEQ ID NO: 5231419 - DNA, 15 bp, Homo sapiens
ataaacgaccaaact

SEQ ID NO: 5231420 - DNA, 18 bp, Homo sapiens
ataaacgatatatgtaaa

SEQ ID NO: 5231421 - DNA, 18 bp, Homo sapiens
ataaacgatttaattctc

SEQ ID NO: 5231422 - DNA, 15 bp, Homo sapiens
ataaacgcaagctga

SEQ ID NO: 5231423 - DNA, 19 bp, Homo sapiens
ataaacggttcctggtgac

SEQ ID NO: 5231424 - DNA, 17 bp, Homo sapiens
ataaacgtggatgttac

SEQ ID NO: 5231425 - DNA, 15 bp, Homo sapiens
ataaacgtttgaaat

SEQ ID NO: 5231426 - DNA, 14 bp, Homo sapiens
ataaactaagagaa

SEQ ID NO: 5231427 - DNA, 16 bp, Homo sapiens
ataaactactctttga

SEQ ID NO: 5231428 - DNA, 13 bp, Homo sapiens
ataaactactgta

SEQ ID NO: 5231429 - DNA, 16 bp, Homo sapiens
ataaactagaataata

SEQ ID NO: 5231430 - DNA, 15 bp, Homo sapiens
ataaactagagaagg

SEQ ID NO: 5231431 - DNA, 16 bp, Homo sapiens
ataaactagagaaggg

SEQ ID NO: 5231432 - DNA, 19 bp, Homo sapiens
ataaactagattacattca

SEQ ID NO: 5231433 - DNA, 14 bp, Homo sapiens
ataaactaggtaaa

SEQ ID NO: 5231434 - DNA, 21 bp, Homo sapiens
ataaactagtctgttggcaat

SEQ ID NO: 5231435 - DNA, 16 bp, Homo sapiens
ataaactagtttccag

SEQ ID NO: 5231436 - DNA, 18 bp, Homo sapiens
ataaactagtttccagtg

SEQ ID NO: 5231437 - DNA, 19 bp, Homo sapiens
ataaactagtttccagtgg

SEQ ID NO: 5231438 - DNA, 19 bp, Homo sapiens
ataaactataaacttaagg

SEQ ID NO: 5231439 - DNA, 16 bp, Homo sapiens
ataaactatattctgt

SEQ ID NO: 5231440 - DNA, 14 bp, Homo sapiens
ataaactatcagtt

SEQ ID NO: 5231441 - DNA, 19 bp, Homo sapiens
ataaactatttatatcaca

SEQ ID NO: 5231442 - DNA, 23 bp, Homo sapiens
ataaactatttatatcacacaat

SEQ ID NO: 5231443 - DNA, 21 bp, Homo sapiens
ataaactcaaaactcttgaaa

SEQ ID NO: 5231444 - DNA, 19 bp, Homo sapiens
ataaactcagtcaaatgta

SEQ ID NO: 5231445 - DNA, 14 bp, Homo sapiens
ataaactcatttat

SEQ ID NO: 5231446 - DNA, 21 bp, Homo sapiens
ataaactcctactaaatccct

SEQ ID NO: 5231447 - DNA, 23 bp, Homo sapiens
ataaactcctactaaatccctcc

SEQ ID NO: 5231448 - DNA, 20 bp, Homo sapiens
ataaactccttaacttcagg

SEQ ID NO: 5231449 - DNA, 17 bp, Homo sapiens
ataaactcttaagagaa

SEQ ID NO: 5231450 - DNA, 15 bp, Homo sapiens
ataaactcttcaagg

SEQ ID NO: 5231451 - DNA, 13 bp, Homo sapiens
ataaactctttta

SEQ ID NO: 5231452 - DNA, 12 bp, Homo sapiens
ataaactgaaat

SEQ ID NO: 5231453 - DNA, 21 bp, Homo sapiens
ataaactgaatattttggaaa

SEQ ID NO: 5231454 - DNA, 23 bp, Homo sapiens
ataaactgaatattttggaaact

SEQ ID NO: 5231455 - DNA, 20 bp, Homo sapiens
ataaactgactttatcctca

SEQ ID NO: 5231456 - DNA, 13 bp, Homo sapiens
ataaactgagcct

SEQ ID NO: 5231457 - DNA, 15 bp, Homo sapiens
ataaactgctgtcaa

SEQ ID NO: 5231458 - DNA, 18 bp, Homo sapiens
ataaactggtatgaataa

SEQ ID NO: 5231459 - DNA, 17 bp, Homo sapiens
ataaactgtacaaatga

SEQ ID NO: 5231460 - DNA, 14 bp, Homo sapiens
ataaactgtattaa

SEQ ID NO: 5231461 - DNA, 22 bp, Homo sapiens
ataaactgtattaaatcttaaa

SEQ ID NO: 5231462 - DNA, 16 bp, Homo sapiens
ataaactgtattttga

SEQ ID NO: 5231463 - DNA, 13 bp, Homo sapiens
ataaactgtcact

SEQ ID NO: 5231464 - DNA, 14 bp, Homo sapiens
ataaactgtgagat

SEQ ID NO: 5231465 - DNA, 16 bp, Homo sapiens
ataaactgtgagataa

SEQ ID NO: 5231466 - DNA, 13 bp, Homo sapiens
ataaactgtttat

SEQ ID NO: 5231467 - DNA, 24 bp, Homo sapiens
ataaacttaaagctactgtagaaa

SEQ ID NO: 5231468 - DNA, 19 bp, Homo sapiens
ataaacttaagggcaagga

SEQ ID NO: 5231469 - DNA, 17 bp, Homo sapiens
ataaacttagaggaaaa

SEQ ID NO: 5231470 - DNA, 15 bp, Homo sapiens
ataaacttatttgct

SEQ ID NO: 5231471 - DNA, 13 bp, Homo sapiens
ataaacttcagca

SEQ ID NO: 5231472 - DNA, 15 bp, Homo sapiens
ataaacttcagcacc

SEQ ID NO: 5231473 - DNA, 12 bp, Homo sapiens
ataaacttcatc

SEQ ID NO: 5231474 - DNA, 14 bp, Homo sapiens
ataaacttcatctt

SEQ ID NO: 5231475 - DNA, 18 bp, Homo sapiens
ataaacttcatcttcaac

SEQ ID NO: 5231476 - DNA, 16 bp, Homo sapiens
ataaacttcctttttt

SEQ ID NO: 5231477 - DNA, 20 bp, Homo sapiens
ataaacttcttaacatgctt

SEQ ID NO: 5231478 - DNA, 17 bp, Homo sapiens
ataaacttggattctct

SEQ ID NO: 5231479 - DNA, 16 bp, Homo sapiens
ataaacttgtacttac

SEQ ID NO: 5231480 - DNA, 20 bp, Homo sapiens
ataaacttgtaggactttta

SEQ ID NO: 5231481 - DNA, 12 bp, Homo sapiens
ataaacttgtgc

SEQ ID NO: 5231482 - DNA, 13 bp, Homo sapiens
ataaacttgtgta

SEQ ID NO: 5231483 - DNA, 16 bp, Homo sapiens
ataaactttacatatt

SEQ ID NO: 5231484 - DNA, 24 bp, Homo sapiens
ataaactttaccttttttatacat

SEQ ID NO: 5231485 - DNA, 16 bp, Homo sapiens
ataaactttcagaact

SEQ ID NO: 5231486 - DNA, 18 bp, Homo sapiens
ataaactttgaataaaag

SEQ ID NO: 5231487 - DNA, 21 bp, Homo sapiens
ataaactttgaataaaagaat

SEQ ID NO: 5231488 - DNA, 16 bp, Homo sapiens
ataaactttttttcaa

SEQ ID NO: 5231489 - DNA, 19 bp, Homo sapiens
ataaactttttttcaatgt

SEQ ID NO: 5231490 - DNA, 12 bp, Homo sapiens
ataaagaaaaat

SEQ ID NO: 5231491 - DNA, 20 bp, Homo sapiens
ataaagaaaagacattttaa

SEQ ID NO: 5231492 - DNA, 16 bp, Homo sapiens
ataaagaaaagatgca

SEQ ID NO: 5231493 - DNA, 15 bp, Homo sapiens
ataaagaaaattctc

SEQ ID NO: 5231494 - DNA, 16 bp, Homo sapiens
ataaagaaaattctct

SEQ ID NO: 5231495 - DNA, 18 bp, Homo sapiens
ataaagaaaattctctca

SEQ ID NO: 5231496 - DNA, 15 bp, Homo sapiens
ataaagaaacctttt

SEQ ID NO: 5231497 - DNA, 17 bp, Homo sapiens
ataaagaaacttttgaa

SEQ ID NO: 5231498 - DNA, 19 bp, Homo sapiens
ataaagaaacttttgaaaa

SEQ ID NO: 5231499 - DNA, 22 bp, Homo sapiens
ataaagaaagattgtaaactaa

SEQ ID NO: 5231500 - DNA, 14 bp, Homo sapiens
ataaagaaataata

SEQ ID NO: 5231501 - DNA, 17 bp, Homo sapiens
ataaagaaatagaacaa

SEQ ID NO: 5231502 - DNA, 14 bp, Homo sapiens
ataaagaaatattt

SEQ ID NO: 5231503 - DNA, 15 bp, Homo sapiens
ataaagaaatattta

SEQ ID NO: 5231504 - DNA, 16 bp, Homo sapiens
ataaagaaattcaaga

SEQ ID NO: 5231505 - DNA, 17 bp, Homo sapiens
ataaagaaattgcaata

SEQ ID NO: 5231506 - DNA, 15 bp, Homo sapiens
ataaagaacaaggta

SEQ ID NO: 5231507 - DNA, 21 bp, Homo sapiens
ataaagaacaaggtagttttt

SEQ ID NO: 5231508 - DNA, 23 bp, Homo sapiens
ataaagaactccttattttgtat

SEQ ID NO: 5231509 - DNA, 18 bp, Homo sapiens
ataaagaagaaaataacc

SEQ ID NO: 5231510 - DNA, 23 bp, Homo sapiens
ataaagaagcaataaagaagagt

SEQ ID NO: 5231511 - DNA, 19 bp, Homo sapiens
ataaagaatacttgaactt

SEQ ID NO: 5231512 - DNA, 20 bp, Homo sapiens
ataaagaatacttgaacttg

SEQ ID NO: 5231513 - DNA, 15 bp, Homo sapiens
ataaagaataggact

SEQ ID NO: 5231514 - DNA, 13 bp, Homo sapiens
ataaagaatgaaa

SEQ ID NO: 5231515 - DNA, 16 bp, Homo sapiens
ataaagaatgaaagta

SEQ ID NO: 5231516 - DNA, 18 bp, Homo sapiens
ataaagaattaatgactt

SEQ ID NO: 5231517 - DNA, 14 bp, Homo sapiens
ataaagacaaccat

SEQ ID NO: 5231518 - DNA, 19 bp, Homo sapiens
ataaagacaaccatattta

SEQ ID NO: 5231519 - DNA, 22 bp, Homo sapiens
ataaagacaaccatatttagca

SEQ ID NO: 5231520 - DNA, 20 bp, Homo sapiens
ataaagacaatcactgccaa

SEQ ID NO: 5231521 - DNA, 12 bp, Homo sapiens
ataaagacagag

SEQ ID NO: 5231522 - DNA, 13 bp, Homo sapiens
ataaagacagctg

SEQ ID NO: 5231523 - DNA, 18 bp, Homo sapiens
ataaagacagctgacaga

SEQ ID NO: 5231524 - DNA, 11 bp, Homo sapiens
ataaagacagg

SEQ ID NO: 5231525 - DNA, 21 bp, Homo sapiens
ataaagaccgtacaaactcag

SEQ ID NO: 5231526 - DNA, 22 bp, Homo sapiens
ataaagactcctaatagctttt

SEQ ID NO: 5231527 - DNA, 16 bp, Homo sapiens
ataaagacttcatgtt

SEQ ID NO: 5231528 - DNA, 12 bp, Homo sapiens
ataaagactttt

SEQ ID NO: 5231529 - DNA, 14 bp, Homo sapiens
ataaagacttttat

SEQ ID NO: 5231530 - DNA, 11 bp, Homo sapiens
ataaagagaaa

SEQ ID NO: 5231531 - DNA, 12 bp, Homo sapiens
ataaagagaaaa

SEQ ID NO: 5231532 - DNA, 18 bp, Homo sapiens
ataaagagaaaattgaat

SEQ ID NO: 5231533 - DNA, 20 bp, Homo sapiens
ataaagagaaaattgaattt

SEQ ID NO: 5231534 - DNA, 23 bp, Homo sapiens
ataaagaggagtgttattgcatg

SEQ ID NO: 5231535 - DNA, 16 bp, Homo sapiens
ataaagaggcatcttt

SEQ ID NO: 5231536 - DNA, 17 bp, Homo sapiens
ataaagagggtaacaat

SEQ ID NO: 5231537 - DNA, 13 bp, Homo sapiens
ataaagagttaga

SEQ ID NO: 5231538 - DNA, 13 bp, Homo sapiens
ataaagataaaat

SEQ ID NO: 5231539 - DNA, 20 bp, Homo sapiens
ataaagataaatgcaaccat

SEQ ID NO: 5231540 - DNA, 22 bp, Homo sapiens
ataaagataacccttattccat

SEQ ID NO: 5231541 - DNA, 17 bp, Homo sapiens
ataaagatacaaaatgt

SEQ ID NO: 5231542 - DNA, 23 bp, Homo sapiens
agtgccagcattccagacttcaa

SEQ ID NO: 5231543 - DNA, 14 bp, Homo sapiens
agtgccagcccctg

SEQ ID NO: 5231544 - DNA, 17 bp, Homo sapiens
agtgccagcccctgctg

SEQ ID NO: 5231545 - DNA, 16 bp, Homo sapiens
agtgccagctccagtg

SEQ ID NO: 5231546 - DNA, 15 bp, Homo sapiens
agtgccagctccctc

SEQ ID NO: 5231547 - DNA, 20 bp, Homo sapiens
agtgccagctggtgaatcca

SEQ ID NO: 5231548 - DNA, 21 bp, Homo sapiens
agtgccagcttctttgcagct

SEQ ID NO: 5231549 - DNA, 11 bp, Homo sapiens
agtgccaggac

SEQ ID NO: 5231550 - DNA, 15 bp, Homo sapiens
agtgccaggacagct

SEQ ID NO: 5231551 - DNA, 20 bp, Homo sapiens
agtgccaggacagctggctg

SEQ ID NO: 5231552 - DNA, 22 bp, Homo sapiens
agtgccaggacagctggctgct

SEQ ID NO: 5231553 - DNA, 23 bp, Homo sapiens
agtgccaggacagctggctgctg

SEQ ID NO: 5231554 - DNA, 14 bp, Homo sapiens
agtgccaggaccag

SEQ ID NO: 5231555 - DNA, 18 bp, Homo sapiens
agtgccaggaccagcctg

SEQ ID NO: 5231556 - DNA, 16 bp, Homo sapiens
agtgccaggagggcac

SEQ ID NO: 5231557 - DNA, 18 bp, Homo sapiens
agtgccaggagggcacag

SEQ ID NO: 5231558 - DNA, 23 bp, Homo sapiens
agtgccaggctgcggtgggcagc

SEQ ID NO: 5231559 - DNA, 12 bp, Homo sapiens
agtgccagggtg

SEQ ID NO: 5231560 - DNA, 19 bp, Homo sapiens
agtgccagggtgggctggg

SEQ ID NO: 5231561 - DNA, 21 bp, Homo sapiens
agtgccagggtgggctgggga

SEQ ID NO: 5231562 - DNA, 16 bp, Homo sapiens
agtgccaggtggctca

SEQ ID NO: 5231563 - DNA, 17 bp, Homo sapiens
agtgccaggtggctcag

SEQ ID NO: 5231564 - DNA, 16 bp, Homo sapiens
agtgccagtcagcagt

SEQ ID NO: 5231565 - DNA, 20 bp, Homo sapiens
agtgccatacatgttattgt

SEQ ID NO: 5231566 - DNA, 16 bp, Homo sapiens
agtgccataccttctc

SEQ ID NO: 5231567 - DNA, 18 bp, Homo sapiens
agtgccataccttctccc

SEQ ID NO: 5231568 - DNA, 12 bp, Homo sapiens
agtgccatgctt

SEQ ID NO: 5231569 - DNA, 13 bp, Homo sapiens
agtgccatgcttt

SEQ ID NO: 5231570 - DNA, 13 bp, Homo sapiens
agtgccatggctg

SEQ ID NO: 5231571 - DNA, 18 bp, Homo sapiens
agtgccattactactgta

SEQ ID NO: 5231572 - DNA, 16 bp, Homo sapiens
agtgccattatttcta

SEQ ID NO: 5231573 - DNA, 16 bp, Homo sapiens
agtgccattccactcc

SEQ ID NO: 5231574 - DNA, 21 bp, Homo sapiens
agtgccattccactccactca

SEQ ID NO: 5231575 - DNA, 14 bp, Homo sapiens
agtgccattgtctt

SEQ ID NO: 5231576 - DNA, 16 bp, Homo sapiens
agtgccattgtcttta

SEQ ID NO: 5231577 - DNA, 17 bp, Homo sapiens
agtgcccaaagtgggga

SEQ ID NO: 5231578 - DNA, 18 bp, Homo sapiens
agtgcccaaagtggggag

SEQ ID NO: 5231579 - DNA, 15 bp, Homo sapiens
agtgcccaactgtta

SEQ ID NO: 5231580 - DNA, 16 bp, Homo sapiens
agtgcccaccaacatc

SEQ ID NO: 5231581 - DNA, 16 bp, Homo sapiens
agtgcccaccctggga

SEQ ID NO: 5231582 - DNA, 15 bp, Homo sapiens
agtgcccaccgccct

SEQ ID NO: 5231583 - DNA, 22 bp, Homo sapiens
agtgcccaccgccctcctccac

SEQ ID NO: 5231584 - DNA, 13 bp, Homo sapiens
agtgcccagcccc

SEQ ID NO: 5231585 - DNA, 23 bp, Homo sapiens
agtgcccagtgatggcattactc

SEQ ID NO: 5231586 - DNA, 14 bp, Homo sapiens
agtgcccatggggt

SEQ ID NO: 5231587 - DNA, 22 bp, Homo sapiens
agtgcccatggggtagaagtag

SEQ ID NO: 5231588 - DNA, 14 bp, Homo sapiens
agtgcccatggtgg

SEQ ID NO: 5231589 - DNA, 15 bp, Homo sapiens
agtgcccatggtggc

SEQ ID NO: 5231590 - DNA, 13 bp, Homo sapiens
agtgcccattcct

SEQ ID NO: 5231591 - DNA, 17 bp, Homo sapiens
agtgcccattcctcacc

SEQ ID NO: 5231592 - DNA, 13 bp, Homo sapiens
agtgccccaagga

SEQ ID NO: 5231593 - DNA, 19 bp, Homo sapiens
agtgccccaaggaggtggc

SEQ ID NO: 5231594 - DNA, 22 bp, Homo sapiens
agtgccccacctcccgccctca

SEQ ID NO: 5231595 - DNA, 14 bp, Homo sapiens
agtgccccacctgc

SEQ ID NO: 5231596 - DNA, 20 bp, Homo sapiens
agtgccccacttctggccac

SEQ ID NO: 5231597 - DNA, 12 bp, Homo sapiens
agtgccccagac

SEQ ID NO: 5231598 - DNA, 13 bp, Homo sapiens
agtgccccagact

SEQ ID NO: 5231599 - DNA, 16 bp, Homo sapiens
agtgccccagactgag

SEQ ID NO: 5231600 - DNA, 21 bp, Homo sapiens
agtgccccagactgagctctc

SEQ ID NO: 5231601 - DNA, 22 bp, Homo sapiens
agtgccccagatgtacatgtgt

SEQ ID NO: 5231602 - DNA, 20 bp, Homo sapiens
agtgccccagggagtccagg

SEQ ID NO: 5231603 - DNA, 17 bp, Homo sapiens
agtgccccagtggtgcg

SEQ ID NO: 5231604 - DNA, 20 bp, Homo sapiens
agtgccccattcttttgtaa

SEQ ID NO: 5231605 - DNA, 16 bp, Homo sapiens
agtgcccccactgacc

SEQ ID NO: 5231606 - DNA, 18 bp, Homo sapiens
agtgccccctcacctctc

SEQ ID NO: 5231607 - DNA, 21 bp, Homo sapiens
agtgccccgtctacagctccc

SEQ ID NO: 5231608 - DNA, 21 bp, Homo sapiens
agtgcccctcccatggcccag

SEQ ID NO: 5231609 - DNA, 14 bp, Homo sapiens
agtgcccctgcagg

SEQ ID NO: 5231610 - DNA, 18 bp, Homo sapiens
agtgcccctgcaggggag

SEQ ID NO: 5231611 - DNA, 12 bp, Homo sapiens
agtgcccctgct

SEQ ID NO: 5231612 - DNA, 19 bp, Homo sapiens
agtgcccctgctgcctccc

SEQ ID NO: 5231613 - DNA, 20 bp, Homo sapiens
agtgcccctgctgcctcccc

SEQ ID NO: 5231614 - DNA, 22 bp, Homo sapiens
agtgcccctgctgcctccccaa

SEQ ID NO: 5231615 - DNA, 20 bp, Homo sapiens
agtgcccctgtcccacctgg

SEQ ID NO: 5231616 - DNA, 21 bp, Homo sapiens
agtgcccctgtcccacctggc

SEQ ID NO: 5231617 - DNA, 22 bp, Homo sapiens
agtgcccctgtcccacctggct

SEQ ID NO: 5231618 - DNA, 23 bp, Homo sapiens
agtgcccctgtcccacctggctc

SEQ ID NO: 5231619 - DNA, 21 bp, Homo sapiens
agtgccccttaaatttctgcc

SEQ ID NO: 5231620 - DNA, 17 bp, Homo sapiens
agtgcccgccctgcccc

SEQ ID NO: 5231621 - DNA, 20 bp, Homo sapiens
agtgcccgcctaggagttga

SEQ ID NO: 5231622 - DNA, 21 bp, Homo sapiens
agtgcccggtgcagggcctgg

SEQ ID NO: 5231623 - DNA, 22 bp, Homo sapiens
agtgcccggtgcagggcctggc

SEQ ID NO: 5231624 - DNA, 23 bp, Homo sapiens
agtgcccggtgcagggcctggca

SEQ ID NO: 5231625 - DNA, 21 bp, Homo sapiens
agtgcccgttttaccaataaa

SEQ ID NO: 5231626 - DNA, 17 bp, Homo sapiens
agtgccctccacagccg

SEQ ID NO: 5231627 - DNA, 21 bp, Homo sapiens
agtgccctccacagccgcagc

SEQ ID NO: 5231628 - DNA, 15 bp, Homo sapiens
agtgccctctcccac

SEQ ID NO: 5231629 - DNA, 18 bp, Homo sapiens
agtgccctctcccaccct

SEQ ID NO: 5231630 - DNA, 21 bp, Homo sapiens
agtgccctctggacagcttga

SEQ ID NO: 5231631 - DNA, 17 bp, Homo sapiens
agtgccctgcaggcaca

SEQ ID NO: 5231632 - DNA, 22 bp, Homo sapiens
agtgccctgcaggcacagagga

SEQ ID NO: 5231633 - DNA, 14 bp, Homo sapiens
agtgccctgccccc

SEQ ID NO: 5231634 - DNA, 16 bp, Homo sapiens
agtgccctgccccctg

SEQ ID NO: 5231635 - DNA, 14 bp, Homo sapiens
agtgccctgctttg

SEQ ID NO: 5231636 - DNA, 19 bp, Homo sapiens
agtgccctgctttgcaaac

SEQ ID NO: 5231637 - DNA, 15 bp, Homo sapiens
agtgccctggggcat

SEQ ID NO: 5231638 - DNA, 21 bp, Homo sapiens
agtgcccttaaggatcacccc

SEQ ID NO: 5231639 - DNA, 19 bp, Homo sapiens
agtgcccttggtgcgaggg

SEQ ID NO: 5231640 - DNA, 21 bp, Homo sapiens
agtgcccttttgtatcttaag

SEQ ID NO: 5231641 - DNA, 13 bp, Homo sapiens
agtgccgaggaca

SEQ ID NO: 5231642 - DNA, 17 bp, Homo sapiens
agtgccgcaaattgtac

SEQ ID NO: 5231643 - DNA, 19 bp, Homo sapiens
agtgccgcatctcacagct

SEQ ID NO: 5231644 - DNA, 23 bp, Homo sapiens
agtgccgcatctcacagctatgc

SEQ ID NO: 5231645 - DNA, 13 bp, Homo sapiens
agtgccgctcctg

SEQ ID NO: 5231646 - DNA, 14 bp, Homo sapiens
agtgccgctcctgc

SEQ ID NO: 5231647 - DNA, 13 bp, Homo sapiens
agtgccggctgtg

SEQ ID NO: 5231648 - DNA, 19 bp, Homo sapiens
agtgcctaaaataagaata

SEQ ID NO: 5231649 - DNA, 22 bp, Homo sapiens
agtgcctacaatgggaaaactt

SEQ ID NO: 5231650 - DNA, 19 bp, Homo sapiens
agtgcctactggggggctt

SEQ ID NO: 5231651 - DNA, 14 bp, Homo sapiens
agtgcctagactgt

SEQ ID NO: 5231652 - DNA, 13 bp, Homo sapiens
agtgcctcacctc

SEQ ID NO: 5231653 - DNA, 21 bp, Homo sapiens
agtgcctcacctcgaaaggag

SEQ ID NO: 5231654 - DNA, 15 bp, Homo sapiens
agtgcctcaccttcc

SEQ ID NO: 5231655 - DNA, 11 bp, Homo sapiens
agtgcctcagc

SEQ ID NO: 5231656 - DNA, 13 bp, Homo sapiens
agtgcctcagtgc

SEQ ID NO: 5231657 - DNA, 14 bp, Homo sapiens
agtgcctccacatg

SEQ ID NO: 5231658 - DNA, 22 bp, Homo sapiens
agtgcctccccttcttgtgtcc

SEQ ID NO: 5231659 - DNA, 14 bp, Homo sapiens
agtgcctcctggcc

SEQ ID NO: 5231660 - DNA, 15 bp, Homo sapiens
agtgcctcctgggac

SEQ ID NO: 5231661 - DNA, 19 bp, Homo sapiens
agtgcctcctgggaccatg

SEQ ID NO: 5231662 - DNA, 22 bp, Homo sapiens
agtgcctctccctgctgctcct

SEQ ID NO: 5231663 - DNA, 12 bp, Homo sapiens
agtgcctctggt

SEQ ID NO: 5231664 - DNA, 14 bp, Homo sapiens
agtgcctctggtct

SEQ ID NO: 5231665 - DNA, 14 bp, Homo sapiens
agtgcctcttccag

SEQ ID NO: 5231666 - DNA, 21 bp, Homo sapiens
agtgcctcttccagtgaacat

SEQ ID NO: 5231667 - DNA, 13 bp, Homo sapiens
agtgcctcttgtt

SEQ ID NO: 5231668 - DNA, 15 bp, Homo sapiens
agtgcctctttgaag

SEQ ID NO: 5231669 - DNA, 14 bp, Homo sapiens
agtgcctgaacatg

SEQ ID NO: 5231670 - DNA, 18 bp, Homo sapiens
agtgcctgagctggggaa

SEQ ID NO: 5231671 - DNA, 23 bp, Homo sapiens
agtgcctgcattcccaggaaaat

SEQ ID NO: 5231672 - DNA, 13 bp, Homo sapiens
agtgcctgccact

SEQ ID NO: 5231673 - DNA, 17 bp, Homo sapiens
agtgcctgccactctct

SEQ ID NO: 5231674 - DNA, 18 bp, Homo sapiens
agtgcctgccactctctg

SEQ ID NO: 5231675 - DNA, 17 bp, Homo sapiens
agtgcctgctctgctgt

SEQ ID NO: 5231676 - DNA, 13 bp, Homo sapiens
agtgcctgctggg

SEQ ID NO: 5231677 - DNA, 17 bp, Homo sapiens
agtgcctgctgggtgcc

SEQ ID NO: 5231678 - DNA, 19 bp, Homo sapiens
agtgcctgctgggtgccag

SEQ ID NO: 5231679 - DNA, 23 bp, Homo sapiens
agtgcctgctgggtgccaggtgc

SEQ ID NO: 5231680 - DNA, 14 bp, Homo sapiens
agtgcctgctgtat

SEQ ID NO: 5231681 - DNA, 23 bp, Homo sapiens
agtgcctggatcccctctgtcta

SEQ ID NO: 5231682 - DNA, 17 bp, Homo sapiens
agtgcctggcaaggcct

SEQ ID NO: 5231683 - DNA, 10 bp, Homo sapiens
agtgcctggg

SEQ ID NO: 5231684 - DNA, 22 bp, Homo sapiens
agtgcctgggaatgtattattc

SEQ ID NO: 5231685 - DNA, 19 bp, Homo sapiens
agtgcctgtgagcatgggg

SEQ ID NO: 5231686 - DNA, 22 bp, Homo sapiens
agtgcctgtgagcatggggcca

SEQ ID NO: 5231687 - DNA, 23 bp, Homo sapiens
agtgcctgtgagcatggggccag

SEQ ID NO: 5231688 - DNA, 22 bp, Homo sapiens
agtgcctgtttgggataatgat

SEQ ID NO: 5231689 - DNA, 18 bp, Homo sapiens
agtgccttacacaatggt

SEQ ID NO: 5231690 - DNA, 22 bp, Homo sapiens
agtgccttacctcctgcccagg

SEQ ID NO: 5231691 - DNA, 14 bp, Homo sapiens
agtgccttagcatg

SEQ ID NO: 5231692 - DNA, 20 bp, Homo sapiens
agtgccttatcaaataatat

SEQ ID NO: 5231693 - DNA, 21 bp, Homo sapiens
agtgccttatcaaataatatt

SEQ ID NO: 5231694 - DNA, 21 bp, Homo sapiens
agtgccttatggaacactctg

SEQ ID NO: 5231695 - DNA, 20 bp, Homo sapiens
agtgccttatttcctttcca

SEQ ID NO: 5231696 - DNA, 21 bp, Homo sapiens
agtgccttcaacacagcttgt

SEQ ID NO: 5231697 - DNA, 18 bp, Homo sapiens
agtgccttcaataaatgg

SEQ ID NO: 5231698 - DNA, 15 bp, Homo sapiens
agtgccttccataat

SEQ ID NO: 5231699 - DNA, 24 bp, Homo sapiens
agtgccttccgtgggtcatcccag

SEQ ID NO: 5231700 - DNA, 16 bp, Homo sapiens
agtgccttctaaaggt

SEQ ID NO: 5231701 - DNA, 15 bp, Homo sapiens
agtgccttctccttc

SEQ ID NO: 5231702 - DNA, 23 bp, Homo sapiens
agtgccttctccttccccaggat

SEQ ID NO: 5231703 - DNA, 17 bp, Homo sapiens
agtgccttctctcagct

SEQ ID NO: 5231704 - DNA, 23 bp, Homo sapiens
agtgccttctctcagctcccagg

SEQ ID NO: 5231705 - DNA, 14 bp, Homo sapiens
agtgccttctgagc

SEQ ID NO: 5231706 - DNA, 14 bp, Homo sapiens
agtgccttctgggc

SEQ ID NO: 5231707 - DNA, 18 bp, Homo sapiens
agtgccttctgtggggac

SEQ ID NO: 5231708 - DNA, 15 bp, Homo sapiens
agtgccttgagctgc

SEQ ID NO: 5231709 - DNA, 22 bp, Homo sapiens
agtgccttggagcagaaagcca

SEQ ID NO: 5231710 - DNA, 18 bp, Homo sapiens
agtgcctttatctcagcc

SEQ ID NO: 5231711 - DNA, 19 bp, Homo sapiens
agtgcctttatctcagcca

SEQ ID NO: 5231712 - DNA, 20 bp, Homo sapiens
agtgcctttatctcagccat

SEQ ID NO: 5231713 - DNA, 17 bp, Homo sapiens
agtgcctttcaggatct

SEQ ID NO: 5231714 - DNA, 21 bp, Homo sapiens
agtgcctttcaggatctattt

SEQ ID NO: 5231715 - DNA, 17 bp, Homo sapiens
agtgcctttgcagctca

SEQ ID NO: 5231716 - DNA, 18 bp, Homo sapiens
agtgccttttgctgcgca

SEQ ID NO: 5231717 - DNA, 21 bp, Homo sapiens
agtgccttttgctgcgcacca

SEQ ID NO: 5231718 - DNA, 18 bp, Homo sapiens
agtgcctttttcctagaa

SEQ ID NO: 5231719 - DNA, 19 bp, Homo sapiens
ataaagatcatgtaaaagt

SEQ ID NO: 5231720 - DNA, 17 bp, Homo sapiens
ataaagatcatttataa

SEQ ID NO: 5231721 - DNA, 21 bp, Homo sapiens
ataaagatgagtgagcatgcc

SEQ ID NO: 5231722 - DNA, 11 bp, Homo sapiens
ataaagatgat

SEQ ID NO: 5231723 - DNA, 13 bp, Homo sapiens
ataaagatgattg

SEQ ID NO: 5231724 - DNA, 16 bp, Homo sapiens
ataaagatgattgaat

SEQ ID NO: 5231725 - DNA, 17 bp, Homo sapiens
ataaagatggctattat

SEQ ID NO: 5231726 - DNA, 16 bp, Homo sapiens
ataaagatgttaaatg

SEQ ID NO: 5231727 - DNA, 13 bp, Homo sapiens
ataaagattaaca

SEQ ID NO: 5231728 - DNA, 20 bp, Homo sapiens
ataaagattatataaagacc

SEQ ID NO: 5231729 - DNA, 16 bp, Homo sapiens
ataaagattctcacat

SEQ ID NO: 5231730 - DNA, 13 bp, Homo sapiens
ataaagattgtac

SEQ ID NO: 5231731 - DNA, 13 bp, Homo sapiens
ataaagatttttt

SEQ ID NO: 5231732 - DNA, 12 bp, Homo sapiens
ataaagcaaata

SEQ ID NO: 5231733 - DNA, 16 bp, Homo sapiens
ataaagcaaattactc

SEQ ID NO: 5231734 - DNA, 15 bp, Homo sapiens
ataaagcaagctcaa

SEQ ID NO: 5231735 - DNA, 10 bp, Homo sapiens
ataaagcaat

SEQ ID NO: 5231736 - DNA, 14 bp, Homo sapiens
ataaagcaataaga

SEQ ID NO: 5231737 - DNA, 13 bp, Homo sapiens
ataaagcaatgaa

SEQ ID NO: 5231738 - DNA, 12 bp, Homo sapiens
ataaagcaattt

SEQ ID NO: 5231739 - DNA, 14 bp, Homo sapiens
ataaagcaattttc

SEQ ID NO: 5231740 - DNA, 21 bp, Homo sapiens
ataaagcaattttccttgaag

SEQ ID NO: 5231741 - DNA, 19 bp, Homo sapiens
ataaagcacagatttgcat

SEQ ID NO: 5231742 - DNA, 14 bp, Homo sapiens
ataaagcacagctg

SEQ ID NO: 5231743 - DNA, 20 bp, Homo sapiens
ataaagcaccagcagtgttt

SEQ ID NO: 5231744 - DNA, 14 bp, Homo sapiens
ataaagcagagcca

SEQ ID NO: 5231745 - DNA, 21 bp, Homo sapiens
ataaagcagagccaaggccac

SEQ ID NO: 5231746 - DNA, 12 bp, Homo sapiens
ataaagcagagt

SEQ ID NO: 5231747 - DNA, 22 bp, Homo sapiens
ataaagcagcctcattctgagg

SEQ ID NO: 5231748 - DNA, 14 bp, Homo sapiens
ataaagcagcgttt

SEQ ID NO: 5231749 - DNA, 18 bp, Homo sapiens
ataaagcagcgtttctat

SEQ ID NO: 5231750 - DNA, 15 bp, Homo sapiens
ataaagcaggcagaa

SEQ ID NO: 5231751 - DNA, 12 bp, Homo sapiens
ataaagcatgtg

SEQ ID NO: 5231752 - DNA, 12 bp, Homo sapiens
ataaagcattta

SEQ ID NO: 5231753 - DNA, 18 bp, Homo sapiens
ataaagcatttataaatt

SEQ ID NO: 5231754 - DNA, 12 bp, Homo sapiens
ataaagccacat

SEQ ID NO: 5231755 - DNA, 14 bp, Homo sapiens
ataaagcctatttt

SEQ ID NO: 5231756 - DNA, 17 bp, Homo sapiens
ataaagcctcaaatctt

SEQ ID NO: 5231757 - DNA, 21 bp, Homo sapiens
ataaagcctcaaggttttagg

SEQ ID NO: 5231758 - DNA, 20 bp, Homo sapiens
ataaagccttggatgtatat

SEQ ID NO: 5231759 - DNA, 13 bp, Homo sapiens
ataaagcctttaa

SEQ ID NO: 5231760 - DNA, 18 bp, Homo sapiens
ataaagcctttgtatctt

SEQ ID NO: 5231761 - DNA, 17 bp, Homo sapiens
ataaagccttttaaatc

SEQ ID NO: 5231762 - DNA, 22 bp, Homo sapiens
ataaagcgaaaaactcaaccaa

SEQ ID NO: 5231763 - DNA, 18 bp, Homo sapiens
ataaagcgaatggaccat

SEQ ID NO: 5231764 - DNA, 17 bp, Homo sapiens
ataaagcgatatacaga

SEQ ID NO: 5231765 - DNA, 19 bp, Homo sapiens
ataaagcgatatacagatg

SEQ ID NO: 5231766 - DNA, 22 bp, Homo sapiens
ataaagcgatatacagatgaaa

SEQ ID NO: 5231767 - DNA, 23 bp, Homo sapiens
ataaagctacaatattctctctt

SEQ ID NO: 5231768 - DNA, 12 bp, Homo sapiens
ataaagctactg

SEQ ID NO: 5231769 - DNA, 16 bp, Homo sapiens
ataaagctactgaatt

SEQ ID NO: 5231770 - DNA, 17 bp, Homo sapiens
ataaagctactgaattt

SEQ ID NO: 5231771 - DNA, 16 bp, Homo sapiens
ataaagctcccttgaa

SEQ ID NO: 5231772 - DNA, 15 bp, Homo sapiens
ataaagctcctctgc

SEQ ID NO: 5231773 - DNA, 17 bp, Homo sapiens
ataaagctcctctgctc

SEQ ID NO: 5231774 - DNA, 14 bp, Homo sapiens
ataaagctgtgaca

SEQ ID NO: 5231775 - DNA, 13 bp, Homo sapiens
ataaagctgtgag

SEQ ID NO: 5231776 - DNA, 18 bp, Homo sapiens
ataaagctgtgtggcagt

SEQ ID NO: 5231777 - DNA, 12 bp, Homo sapiens
ataaagctgttc

SEQ ID NO: 5231778 - DNA, 13 bp, Homo sapiens
ataaagcttaata

SEQ ID NO: 5231779 - DNA, 17 bp, Homo sapiens
ataaagcttaggtcaaa

SEQ ID NO: 5231780 - DNA, 21 bp, Homo sapiens
ataaagcttctctctgagctg

SEQ ID NO: 5231781 - DNA, 13 bp, Homo sapiens
ataaagcttgttg

SEQ ID NO: 5231782 - DNA, 10 bp, Homo sapiens
ataaagcttt

SEQ ID NO: 5231783 - DNA, 11 bp, Homo sapiens
ataaagcttta

SEQ ID NO: 5231784 - DNA, 12 bp, Homo sapiens
ataaagctttat

SEQ ID NO: 5231785 - DNA, 15 bp, Homo sapiens
ataaagctttataaa

SEQ ID NO: 5231786 - DNA, 16 bp, Homo sapiens
ataaagcttttgcata

SEQ ID NO: 5231787 - DNA, 18 bp, Homo sapiens
ataaagcttttgcataga

SEQ ID NO: 5231788 - DNA, 17 bp, Homo sapiens
ataaaggaaaacaaaaa

SEQ ID NO: 5231789 - DNA, 18 bp, Homo sapiens
ataaaggaaaacaaaaaa

SEQ ID NO: 5231790 - DNA, 19 bp, Homo sapiens
ataaaggaaaacaaaaaac

SEQ ID NO: 5231791 - DNA, 15 bp, Homo sapiens
ataaaggaaaagaca

SEQ ID NO: 5231792 - DNA, 16 bp, Homo sapiens
ataaaggaaaagacac

SEQ ID NO: 5231793 - DNA, 18 bp, Homo sapiens
ataaaggaaaagacacat

SEQ ID NO: 5231794 - DNA, 17 bp, Homo sapiens
ataaaggaaaatgactt

SEQ ID NO: 5231795 - DNA, 20 bp, Homo sapiens
ataaaggaccctgtttctgt

SEQ ID NO: 5231796 - DNA, 15 bp, Homo sapiens
ataaaggagaggtta

SEQ ID NO: 5231797 - DNA, 15 bp, Homo sapiens
ataaaggaggaatca

SEQ ID NO: 5231798 - DNA, 20 bp, Homo sapiens
ataaaggataactctgtatt

SEQ ID NO: 5231799 - DNA, 23 bp, Homo sapiens
ataaaggataactctgtattaca

SEQ ID NO: 5231800 - DNA, 21 bp, Homo sapiens
ataaaggatatagcaacatct

SEQ ID NO: 5231801 - DNA, 15 bp, Homo sapiens
ataaaggatatttca

SEQ ID NO: 5231802 - DNA, 21 bp, Homo sapiens
ataaaggatgtgattgtggaa

SEQ ID NO: 5231803 - DNA, 15 bp, Homo sapiens
ataaaggcaaggaaa

SEQ ID NO: 5231804 - DNA, 16 bp, Homo sapiens
ataaaggcagctgcct

SEQ ID NO: 5231805 - DNA, 21 bp, Homo sapiens
ataaaggcagctgcctctgct

SEQ ID NO: 5231806 - DNA, 16 bp, Homo sapiens
ataaaggcagttttct

SEQ ID NO: 5231807 - DNA, 18 bp, Homo sapiens
ataaaggcagttttctaa

SEQ ID NO: 5231808 - DNA, 17 bp, Homo sapiens
ataaaggccacaggaga

SEQ ID NO: 5231809 - DNA, 22 bp, Homo sapiens
ataaaggccacaggagacatta

SEQ ID NO: 5231810 - DNA, 12 bp, Homo sapiens
ataaaggcctgc

SEQ ID NO: 5231811 - DNA, 15 bp, Homo sapiens
ataaaggcgctaatt

SEQ ID NO: 5231812 - DNA, 14 bp, Homo sapiens
ataaagggaacaaa

SEQ ID NO: 5231813 - DNA, 13 bp, Homo sapiens
ataaagggaagaa

SEQ ID NO: 5231814 - DNA, 15 bp, Homo sapiens
ataaagggatttgac

SEQ ID NO: 5231815 - DNA, 19 bp, Homo sapiens
ataaagggcccacacctgg

SEQ ID NO: 5231816 - DNA, 22 bp, Homo sapiens
ataaagggcccacacctggtgg

SEQ ID NO: 5231817 - DNA, 17 bp, Homo sapiens
ataaagggggagggaaa

SEQ ID NO: 5231818 - DNA, 12 bp, Homo sapiens
ataaagggtcag

SEQ ID NO: 5231819 - DNA, 15 bp, Homo sapiens
ataaagggtcaggcc

SEQ ID NO: 5231820 - DNA, 14 bp, Homo sapiens
ataaaggtatttag

SEQ ID NO: 5231821 - DNA, 14 bp, Homo sapiens
ataaaggtcatatt

SEQ ID NO: 5231822 - DNA, 20 bp, Homo sapiens
ataaaggtggtatgtgtgtg

SEQ ID NO: 5231823 - DNA, 13 bp, Homo sapiens
ataaaggttatga

SEQ ID NO: 5231824 - DNA, 18 bp, Homo sapiens
ataaaggttatgaaacat

SEQ ID NO: 5231825 - DNA, 22 bp, Homo sapiens
ataaaggttatgaaacatatca

SEQ ID NO: 5231826 - DNA, 15 bp, Homo sapiens
ataaaggttcatgca

SEQ ID NO: 5231827 - DNA, 17 bp, Homo sapiens
ataaaggttcatgcaaa

SEQ ID NO: 5231828 - DNA, 15 bp, Homo sapiens
ataaaggttctatga

SEQ ID NO: 5231829 - DNA, 21 bp, Homo sapiens
ataaaggtttcgttgcatggt

SEQ ID NO: 5231830 - DNA, 17 bp, Homo sapiens
ataaaggttttggttgc

SEQ ID NO: 5231831 - DNA, 17 bp, Homo sapiens
ataaagtaaaaaagtta

SEQ ID NO: 5231832 - DNA, 14 bp, Homo sapiens
ataaagtaaagcta

SEQ ID NO: 5231833 - DNA, 16 bp, Homo sapiens
ataaagtaaatacatg

SEQ ID NO: 5231834 - DNA, 14 bp, Homo sapiens
ataaagtaacagta

SEQ ID NO: 5231835 - DNA, 18 bp, Homo sapiens
ataaagtaataactgtta

SEQ ID NO: 5231836 - DNA, 14 bp, Homo sapiens
ataaagtaattcat

SEQ ID NO: 5231837 - DNA, 12 bp, Homo sapiens
ataaagtacaaa

SEQ ID NO: 5231838 - DNA, 13 bp, Homo sapiens
ataaagtacaaat

SEQ ID NO: 5231839 - DNA, 17 bp, Homo sapiens
ataaagtacaaatgaag

SEQ ID NO: 5231840 - DNA, 20 bp, Homo sapiens
ataaagtacaaatgaagaaa

SEQ ID NO: 5231841 - DNA, 14 bp, Homo sapiens
ataaagtagaaatg

SEQ ID NO: 5231842 - DNA, 17 bp, Homo sapiens
ataaagtagtcctgtga

SEQ ID NO: 5231843 - DNA, 19 bp, Homo sapiens
ataaagtagtttgatctaa

SEQ ID NO: 5231844 - DNA, 11 bp, Homo sapiens
ataaagtatag

SEQ ID NO: 5231845 - DNA, 15 bp, Homo sapiens
ataaagtatcatgca

SEQ ID NO: 5231846 - DNA, 19 bp, Homo sapiens
ataaagtatgaatatttca

SEQ ID NO: 5231847 - DNA, 20 bp, Homo sapiens
ataaagtatgaatatttcat

SEQ ID NO: 5231848 - DNA, 23 bp, Homo sapiens
ataaagtatgaatatttcatttt

SEQ ID NO: 5231849 - DNA, 15 bp, Homo sapiens
ataaagtatgccttc

SEQ ID NO: 5231850 - DNA, 16 bp, Homo sapiens
ataaagtattccacct

SEQ ID NO: 5231851 - DNA, 15 bp, Homo sapiens
ataaagtattctttt

SEQ ID NO: 5231852 - DNA, 21 bp, Homo sapiens
ataaagtatttaattagtgct

SEQ ID NO: 5231853 - DNA, 14 bp, Homo sapiens
ataaagtattttct

SEQ ID NO: 5231854 - DNA, 21 bp, Homo sapiens
ataaagtcattattaggaagt

SEQ ID NO: 5231855 - DNA, 17 bp, Homo sapiens
ataaagtcctgaacctt

SEQ ID NO: 5231856 - DNA, 13 bp, Homo sapiens
ataaagtctgagt

SEQ ID NO: 5231857 - DNA, 17 bp, Homo sapiens
ataaagtctgagtgggc

SEQ ID NO: 5231858 - DNA, 15 bp, Homo sapiens
ataaagtctgtcatg

SEQ ID NO: 5231859 - DNA, 16 bp, Homo sapiens
ataaagtctgtcatgc

SEQ ID NO: 5231860 - DNA, 18 bp, Homo sapiens
ataaagtgaccctgctct

SEQ ID NO: 5231861 - DNA, 15 bp, Homo sapiens
ataaagtgactgaaa

SEQ ID NO: 5231862 - DNA, 17 bp, Homo sapiens
ataaagtgatctgtgtt

SEQ ID NO: 5231863 - DNA, 23 bp, Homo sapiens
ataaagtgcaattgcacaaatac

SEQ ID NO: 5231864 - DNA, 19 bp, Homo sapiens
ataaagtgcctcggacagt

SEQ ID NO: 5231865 - DNA, 17 bp, Homo sapiens
ataaagtgccttctggg

SEQ ID NO: 5231866 - DNA, 18 bp, Homo sapiens
ataaagtgcttgtgtaat

SEQ ID NO: 5231867 - DNA, 22 bp, Homo sapiens
ataaagtggaagtatgtatatt

SEQ ID NO: 5231868 - DNA, 13 bp, Homo sapiens
ataaagtgtgtgt

SEQ ID NO: 5231869 - DNA, 22 bp, Homo sapiens
ataaagtgttacgttttattgg

SEQ ID NO: 5231870 - DNA, 13 bp, Homo sapiens
ataaagttacagt

SEQ ID NO: 5231871 - DNA, 15 bp, Homo sapiens
ataaagttacagttt

SEQ ID NO: 5231872 - DNA, 16 bp, Homo sapiens
ataaagttacctacat

SEQ ID NO: 5231873 - DNA, 12 bp, Homo sapiens
ataaagttagaa

SEQ ID NO: 5231874 - DNA, 15 bp, Homo sapiens
ataaagttagtgtgt

SEQ ID NO: 5231875 - DNA, 17 bp, Homo sapiens
ataaagttattaatagc

SEQ ID NO: 5231876 - DNA, 13 bp, Homo sapiens
ataaagttcctgt

SEQ ID NO: 5231877 - DNA, 13 bp, Homo sapiens
ataaagttcctta

SEQ ID NO: 5231878 - DNA, 15 bp, Homo sapiens
ataaagttctgtact

SEQ ID NO: 5231879 - DNA, 14 bp, Homo sapiens
ataaagttgagaga

SEQ ID NO: 5231880 - DNA, 17 bp, Homo sapiens
ataaagttgataaagat

SEQ ID NO: 5231881 - DNA, 18 bp, Homo sapiens
ataaagttggtgacagat

SEQ ID NO: 5231882 - DNA, 23 bp, Homo sapiens
ataaagttggttcacttcaaagc

SEQ ID NO: 5231883 - DNA, 12 bp, Homo sapiens
ataaagttgtat

SEQ ID NO: 5231884 - DNA, 16 bp, Homo sapiens
ataaagttgtattgca

SEQ ID NO: 5231885 - DNA, 14 bp, Homo sapiens
ataaagttgttgca

SEQ ID NO: 5231886 - DNA, 18 bp, Homo sapiens
ataaagttgttttatctt

SEQ ID NO: 5231887 - DNA, 19 bp, Homo sapiens
ataaagtttatcagatatt

SEQ ID NO: 5231888 - DNA, 15 bp, Homo sapiens
ataaagtttgatctt

SEQ ID NO: 5231889 - DNA, 12 bp, Homo sapiens
ataaagtttgct

SEQ ID NO: 5231890 - DNA, 19 bp, Homo sapiens
ataaagtttgcttagaaaa

SEQ ID NO: 5231891 - DNA, 14 bp, Homo sapiens
ataaagttttatat

SEQ ID NO: 5231892 - DNA, 21 bp, Homo sapiens
ataaagttttatatattatat

SEQ ID NO: 5231893 - DNA, 19 bp, Homo sapiens
ataaataaaaagcgctgca

SEQ ID NO: 5231894 - DNA, 15 bp, Homo sapiens
ataaataaaaatgca

SEQ ID NO: 5231895 - DNA, 16 bp, Homo sapiens
ataaataaaaatgcat

SEQ ID NO: 5231896 - DNA, 17 bp, Homo sapiens
ataaataaaaatgcatt

SEQ ID NO: 5231897 - DNA, 15 bp, Homo sapiens
ataaataaaaatgga

SEQ ID NO: 5231898 - DNA, 15 bp, Homo sapiens
ataaataaaaattca

SEQ ID NO: 5231899 - DNA, 13 bp, Homo sapiens
ataaataaaacat

SEQ ID NO: 5231900 - DNA, 13 bp, Homo sapiens
ataaataaaactg

SEQ ID NO: 5231901 - DNA, 19 bp, Homo sapiens
ataaataaaactgaatctc

SEQ ID NO: 5231902 - DNA, 21 bp, Homo sapiens
ataaataaaagatagcaatat

SEQ ID NO: 5231903 - DNA, 17 bp, Homo sapiens
agtgcctttttccttat

SEQ ID NO: 5231904 - DNA, 15 bp, Homo sapiens
agtgcgaccaccact

SEQ ID NO: 5231905 - DNA, 17 bp, Homo sapiens
agtgcgattctggataa

SEQ ID NO: 5231906 - DNA, 21 bp, Homo sapiens
agtgcgcagatctgtgcctgg

SEQ ID NO: 5231907 - DNA, 14 bp, Homo sapiens
agtgcgcctcacca

SEQ ID NO: 5231908 - DNA, 18 bp, Homo sapiens
agtgcgctcttggtccct

SEQ ID NO: 5231909 - DNA, 21 bp, Homo sapiens
agtgcgctcttggtccctggt

SEQ ID NO: 5231910 - DNA, 22 bp, Homo sapiens
agtgcggacccttcccagccct

SEQ ID NO: 5231911 - DNA, 15 bp, Homo sapiens
agtgcggcgtggaga

SEQ ID NO: 5231912 - DNA, 21 bp, Homo sapiens
agtgcgggctgaggccagagt

SEQ ID NO: 5231913 - DNA, 16 bp, Homo sapiens
agtgcgggtccggcag

SEQ ID NO: 5231914 - DNA, 14 bp, Homo sapiens
agtgcggttcctca

SEQ ID NO: 5231915 - DNA, 15 bp, Homo sapiens
agtgcggttcctcat

SEQ ID NO: 5231916 - DNA, 18 bp, Homo sapiens
agtgcggttcctcatctg

SEQ ID NO: 5231917 - DNA, 15 bp, Homo sapiens
agtgcgtccacgagc

SEQ ID NO: 5231918 - DNA, 17 bp, Homo sapiens
agtgcgtctgaggggac

SEQ ID NO: 5231919 - DNA, 17 bp, Homo sapiens
agtgcgtgaatgtatgt

SEQ ID NO: 5231920 - DNA, 14 bp, Homo sapiens
agtgcgtgctcagt

SEQ ID NO: 5231921 - DNA, 21 bp, Homo sapiens
agtgcgtggtataatctccat

SEQ ID NO: 5231922 - DNA, 19 bp, Homo sapiens
agtgcgtgtgaaacagcgt

SEQ ID NO: 5231923 - DNA, 13 bp, Homo sapiens
agtgcgtgtgtag

SEQ ID NO: 5231924 - DNA, 18 bp, Homo sapiens
agtgctaaacctatctgt

SEQ ID NO: 5231925 - DNA, 19 bp, Homo sapiens
agtgctaacatgaagacct

SEQ ID NO: 5231926 - DNA, 22 bp, Homo sapiens
agtgctaacatgaagacctttt

SEQ ID NO: 5231927 - DNA, 23 bp, Homo sapiens
agtgctaacatgaagaccttttt

SEQ ID NO: 5231928 - DNA, 19 bp, Homo sapiens
agtgctaagagcctctgga

SEQ ID NO: 5231929 - DNA, 20 bp, Homo sapiens
agtgctaagattacaggcgt

SEQ ID NO: 5231930 - DNA, 19 bp, Homo sapiens
agtgctaagcattagcttt

SEQ ID NO: 5231931 - DNA, 15 bp, Homo sapiens
agtgctaagtgtgaa

SEQ ID NO: 5231932 - DNA, 16 bp, Homo sapiens
agtgctaagtgtgaac

SEQ ID NO: 5231933 - DNA, 18 bp, Homo sapiens
agtgctaattttgaaaaa

SEQ ID NO: 5231934 - DNA, 18 bp, Homo sapiens
agtgctacagaaagcaca

SEQ ID NO: 5231935 - DNA, 23 bp, Homo sapiens
agtgctacagaaagcacaaagaa

SEQ ID NO: 5231936 - DNA, 14 bp, Homo sapiens
agtgctacattttg

SEQ ID NO: 5231937 - DNA, 17 bp, Homo sapiens
agtgctacttgagagtg

SEQ ID NO: 5231938 - DNA, 17 bp, Homo sapiens
agtgctagccactggaa

SEQ ID NO: 5231939 - DNA, 17 bp, Homo sapiens
agtgctaggataaacca

SEQ ID NO: 5231940 - DNA, 20 bp, Homo sapiens
agtgctaggattacaggcat

SEQ ID NO: 5231941 - DNA, 23 bp, Homo sapiens
agtgctagtgagctgggcatggt

SEQ ID NO: 5231942 - DNA, 18 bp, Homo sapiens
agtgctataaatgccaga

SEQ ID NO: 5231943 - DNA, 20 bp, Homo sapiens
agtgctataaatgccagagc

SEQ ID NO: 5231944 - DNA, 21 bp, Homo sapiens
agtgctataaatgccagagcc

SEQ ID NO: 5231945 - DNA, 23 bp, Homo sapiens
agtgctataaatgccagagccaa

SEQ ID NO: 5231946 - DNA, 14 bp, Homo sapiens
agtgctatatatat

SEQ ID NO: 5231947 - DNA, 16 bp, Homo sapiens
agtgctatatatataa

SEQ ID NO: 5231948 - DNA, 19 bp, Homo sapiens
agtgctatctcatgacaac

SEQ ID NO: 5231949 - DNA, 15 bp, Homo sapiens
agtgctatgaagaca

SEQ ID NO: 5231950 - DNA, 22 bp, Homo sapiens
agtgctatgcatatttatagag

SEQ ID NO: 5231951 - DNA, 13 bp, Homo sapiens
agtgctatgtgtg

SEQ ID NO: 5231952 - DNA, 23 bp, Homo sapiens
agtgctattacgaagttcaagat

SEQ ID NO: 5231953 - DNA, 19 bp, Homo sapiens
agtgctcaagcagcaaaat

SEQ ID NO: 5231954 - DNA, 22 bp, Homo sapiens
agtgctcaccagccctgcagcc

SEQ ID NO: 5231955 - DNA, 12 bp, Homo sapiens
agtgctcagctg

SEQ ID NO: 5231956 - DNA, 15 bp, Homo sapiens
agtgctcagctgtgg

SEQ ID NO: 5231957 - DNA, 16 bp, Homo sapiens
agtgctcagctgtggc

SEQ ID NO: 5231958 - DNA, 17 bp, Homo sapiens
agtgctcagctgtggct

SEQ ID NO: 5231959 - DNA, 22 bp, Homo sapiens
agtgctcagctgtggctggagg

SEQ ID NO: 5231960 - DNA, 23 bp, Homo sapiens
agtgctcagctgtggctggagga

SEQ ID NO: 5231961 - DNA, 15 bp, Homo sapiens
agtgctcattcatca

SEQ ID NO: 5231962 - DNA, 17 bp, Homo sapiens
agtgctcatttcaggat

SEQ ID NO: 5231963 - DNA, 13 bp, Homo sapiens
agtgctccccaca

SEQ ID NO: 5231964 - DNA, 14 bp, Homo sapiens
agtgctcccctctg

SEQ ID NO: 5231965 - DNA, 16 bp, Homo sapiens
agtgctccctggaggc

SEQ ID NO: 5231966 - DNA, 15 bp, Homo sapiens
agtgctcctgtgcag

SEQ ID NO: 5231967 - DNA, 21 bp, Homo sapiens
agtgctcgagtcacattctgc

SEQ ID NO: 5231968 - DNA, 22 bp, Homo sapiens
agtgctcgagtcacattctgct

SEQ ID NO: 5231969 - DNA, 14 bp, Homo sapiens
agtgctcgctgttg

SEQ ID NO: 5231970 - DNA, 20 bp, Homo sapiens
agtgctcgctgttgctgaat

SEQ ID NO: 5231971 - DNA, 12 bp, Homo sapiens
agtgctcgcttt

SEQ ID NO: 5231972 - DNA, 15 bp, Homo sapiens
agtgctcggcagtca

SEQ ID NO: 5231973 - DNA, 16 bp, Homo sapiens
agtgctcggcagtcat

SEQ ID NO: 5231974 - DNA, 18 bp, Homo sapiens
agtgctctaggctgcccc

SEQ ID NO: 5231975 - DNA, 14 bp, Homo sapiens
agtgctctcagctg

SEQ ID NO: 5231976 - DNA, 18 bp, Homo sapiens
agtgctctcagctggcag

SEQ ID NO: 5231977 - DNA, 22 bp, Homo sapiens
agtgctctgaccctgggctttc

SEQ ID NO: 5231978 - DNA, 11 bp, Homo sapiens
agtgctctgat

SEQ ID NO: 5231979 - DNA, 13 bp, Homo sapiens
agtgctctgcctc

SEQ ID NO: 5231980 - DNA, 16 bp, Homo sapiens
agtgctctgcctcaga

SEQ ID NO: 5231981 - DNA, 23 bp, Homo sapiens
agtgctcttggctgacccctctg

SEQ ID NO: 5231982 - DNA, 18 bp, Homo sapiens
agtgctctttgtggcagt

SEQ ID NO: 5231983 - DNA, 14 bp, Homo sapiens
agtgctgaacagtg

SEQ ID NO: 5231984 - DNA, 15 bp, Homo sapiens
agtgctgaacagtgg

SEQ ID NO: 5231985 - DNA, 16 bp, Homo sapiens
agtgctgaacagtgga

SEQ ID NO: 5231986 - DNA, 22 bp, Homo sapiens
agtgctgaagcttattaatgct

SEQ ID NO: 5231987 - DNA, 15 bp, Homo sapiens
agtgctgaatttccc

SEQ ID NO: 5231988 - DNA, 18 bp, Homo sapiens
agtgctgagaaggacacc

SEQ ID NO: 5231989 - DNA, 20 bp, Homo sapiens
agtgctgagattacagacgt

SEQ ID NO: 5231990 - DNA, 20 bp, Homo sapiens
agtgctgagattacaggcat

SEQ ID NO: 5231991 - DNA, 19 bp, Homo sapiens
agtgctgaggccagggctg

SEQ ID NO: 5231992 - DNA, 18 bp, Homo sapiens
agtgctgaggggcactct

SEQ ID NO: 5231993 - DNA, 16 bp, Homo sapiens
agtgctgattcaaacc

SEQ ID NO: 5231994 - DNA, 12 bp, Homo sapiens
agtgctgcagct

SEQ ID NO: 5231995 - DNA, 18 bp, Homo sapiens
agtgctgcagctccctgg

SEQ ID NO: 5231996 - DNA, 22 bp, Homo sapiens
agtgctgcagctccctggcttc

SEQ ID NO: 5231997 - DNA, 23 bp, Homo sapiens
agtgctgcagctccctggcttct

SEQ ID NO: 5231998 - DNA, 16 bp, Homo sapiens
agtgctgcagctttgg

SEQ ID NO: 5231999 - DNA, 13 bp, Homo sapiens
agtgctgcattta

SEQ ID NO: 5232000 - DNA, 17 bp, Homo sapiens
agtgctgcatttaaaag

SEQ ID NO: 5232001 - DNA, 20 bp, Homo sapiens
agtgctgcatttaaaagata

SEQ ID NO: 5232002 - DNA, 15 bp, Homo sapiens
agtgctgccatgcca

SEQ ID NO: 5232003 - DNA, 16 bp, Homo sapiens
agtgctgccatgccac

SEQ ID NO: 5232004 - DNA, 24 bp, Homo sapiens
agtgctgccatgccactgccaggc

SEQ ID NO: 5232005 - DNA, 16 bp, Homo sapiens
agtgctgcccatgagc

SEQ ID NO: 5232006 - DNA, 24 bp, Homo sapiens
agtgctgccccttgcaagccataa

SEQ ID NO: 5232007 - DNA, 17 bp, Homo sapiens
agtgctgccctctccca

SEQ ID NO: 5232008 - DNA, 21 bp, Homo sapiens
agtgctgcctgtccccatgct

SEQ ID NO: 5232009 - DNA, 18 bp, Homo sapiens
agtgctgctctaggccca

SEQ ID NO: 5232010 - DNA, 12 bp, Homo sapiens
agtgctgctgtg

SEQ ID NO: 5232011 - DNA, 15 bp, Homo sapiens
agtgctgctgtggag

SEQ ID NO: 5232012 - DNA, 15 bp, Homo sapiens
agtgctgcttctctt

SEQ ID NO: 5232013 - DNA, 16 bp, Homo sapiens
agtgctgcttgtgcct

SEQ ID NO: 5232014 - DNA, 17 bp, Homo sapiens
agtgctggaactttagt

SEQ ID NO: 5232015 - DNA, 21 bp, Homo sapiens
agtgctggaatggggacctgg

SEQ ID NO: 5232016 - DNA, 14 bp, Homo sapiens
agtgctggagaaat

SEQ ID NO: 5232017 - DNA, 19 bp, Homo sapiens
agtgctggagtctcctgag

SEQ ID NO: 5232018 - DNA, 17 bp, Homo sapiens
agtgctggatttgatga

SEQ ID NO: 5232019 - DNA, 12 bp, Homo sapiens
agtgctggcact

SEQ ID NO: 5232020 - DNA, 16 bp, Homo sapiens
agtgctggccacacag

SEQ ID NO: 5232021 - DNA, 19 bp, Homo sapiens
agtgctggccacacagcag

SEQ ID NO: 5232022 - DNA, 20 bp, Homo sapiens
agtgctggccacacagcagc

SEQ ID NO: 5232023 - DNA, 17 bp, Homo sapiens
agtgctggctcacagta

SEQ ID NO: 5232024 - DNA, 20 bp, Homo sapiens
agtgctggctcacagtacag

SEQ ID NO: 5232025 - DNA, 12 bp, Homo sapiens
agtgctggctcc

SEQ ID NO: 5232026 - DNA, 13 bp, Homo sapiens
agtgctggctcca

SEQ ID NO: 5232027 - DNA, 19 bp, Homo sapiens
agtgctggctccacgccct

SEQ ID NO: 5232028 - DNA, 12 bp, Homo sapiens
agtgctggctgc

SEQ ID NO: 5232029 - DNA, 21 bp, Homo sapiens
agtgctgggaattacaggcgt

SEQ ID NO: 5232030 - DNA, 17 bp, Homo sapiens
agtgctgggatgacagg

SEQ ID NO: 5232031 - DNA, 20 bp, Homo sapiens
agtgctgggatgacaggcat

SEQ ID NO: 5232032 - DNA, 21 bp, Homo sapiens
agtgctgggatgacaggtgtg

SEQ ID NO: 5232033 - DNA, 21 bp, Homo sapiens
agtgctgggatggaggggagt

SEQ ID NO: 5232034 - DNA, 12 bp, Homo sapiens
agtgctgggatt

SEQ ID NO: 5232035 - DNA, 20 bp, Homo sapiens
agtgctgggattacaagcgt

SEQ ID NO: 5232036 - DNA, 14 bp, Homo sapiens
agtgctgggcactg

SEQ ID NO: 5232037 - DNA, 12 bp, Homo sapiens
agtgctgggccc

SEQ ID NO: 5232038 - DNA, 13 bp, Homo sapiens
agtgctgggccca

SEQ ID NO: 5232039 - DNA, 16 bp, Homo sapiens
agtgctgggcccagcc

SEQ ID NO: 5232040 - DNA, 21 bp, Homo sapiens
agtgctgggggaggccatcca

SEQ ID NO: 5232041 - DNA, 19 bp, Homo sapiens
agtgctggtcagagagacc

SEQ ID NO: 5232042 - DNA, 19 bp, Homo sapiens
agtgctggttctccaacag

SEQ ID NO: 5232043 - DNA, 12 bp, Homo sapiens
agtgctgtaaaa

SEQ ID NO: 5232044 - DNA, 16 bp, Homo sapiens
agtgctgtacccttcc

SEQ ID NO: 5232045 - DNA, 17 bp, Homo sapiens
agtgctgtacccttcca

SEQ ID NO: 5232046 - DNA, 12 bp, Homo sapiens
agtgctgtataa

SEQ ID NO: 5232047 - DNA, 19 bp, Homo sapiens
agtgctgtataaaatcagc

SEQ ID NO: 5232048 - DNA, 19 bp, Homo sapiens
agtgctgtctgatctgtgc

SEQ ID NO: 5232049 - DNA, 21 bp, Homo sapiens
agtgctgtctgatctgtgctt

SEQ ID NO: 5232050 - DNA, 17 bp, Homo sapiens
agtgctgtgctgtgcta

SEQ ID NO: 5232051 - DNA, 17 bp, Homo sapiens
agtgctgtggcctgggc

SEQ ID NO: 5232052 - DNA, 21 bp, Homo sapiens
agtgctgtgttttagtctctt

SEQ ID NO: 5232053 - DNA, 14 bp, Homo sapiens
agtgctgttctgga

SEQ ID NO: 5232054 - DNA, 15 bp, Homo sapiens
agtgctgttggtggc

SEQ ID NO: 5232055 - DNA, 20 bp, Homo sapiens
agtgctgtttattaatctta

SEQ ID NO: 5232056 - DNA, 22 bp, Homo sapiens
agtgctgtttattaatcttagt

SEQ ID NO: 5232057 - DNA, 23 bp, Homo sapiens
agtgctgttttattactgtttct

SEQ ID NO: 5232058 - DNA, 17 bp, Homo sapiens
agtgcttaaaaatcatt

SEQ ID NO: 5232059 - DNA, 18 bp, Homo sapiens
agtgcttaacattttccc

SEQ ID NO: 5232060 - DNA, 17 bp, Homo sapiens
agtgcttaacgttttct

SEQ ID NO: 5232061 - DNA, 16 bp, Homo sapiens
agtgcttacattttaa

SEQ ID NO: 5232062 - DNA, 18 bp, Homo sapiens
agtgcttacattttaata

SEQ ID NO: 5232063 - DNA, 21 bp, Homo sapiens
agtgcttagaggttctgcctc

SEQ ID NO: 5232064 - DNA, 22 bp, Homo sapiens
agtgcttagaggttctgcctct

SEQ ID NO: 5232065 - DNA, 15 bp, Homo sapiens
agtgcttagcaaaaa

SEQ ID NO: 5232066 - DNA, 22 bp, Homo sapiens
agtgcttattctctcatcacag

SEQ ID NO: 5232067 - DNA, 23 bp, Homo sapiens
agtgcttcacaggttttatgtgt

SEQ ID NO: 5232068 - DNA, 13 bp, Homo sapiens
agtgcttcacatt

SEQ ID NO: 5232069 - DNA, 21 bp, Homo sapiens
agtgcttcagagtttgtgtgt

SEQ ID NO: 5232070 - DNA, 18 bp, Homo sapiens
agtgcttcagcctgaggc

SEQ ID NO: 5232071 - DNA, 19 bp, Homo sapiens
agtgcttcagcctgaggct

SEQ ID NO: 5232072 - DNA, 14 bp, Homo sapiens
agtgcttcctacaa

SEQ ID NO: 5232073 - DNA, 17 bp, Homo sapiens
agtgcttcctacaaaga

SEQ ID NO: 5232074 - DNA, 21 bp, Homo sapiens
agtgcttctacacatttcatc

SEQ ID NO: 5232075 - DNA, 23 bp, Homo sapiens
agtgcttctacacatttcatcta

SEQ ID NO: 5232076 - DNA, 22 bp, Homo sapiens
agtgcttctctgtgcaggagcc

SEQ ID NO: 5232077 - DNA, 21 bp, Homo sapiens
agtgcttcttaaagagttctt

SEQ ID NO: 5232078 - DNA, 22 bp, Homo sapiens
agtgcttcttgtaatatttctt

SEQ ID NO: 5232079 - DNA, 19 bp, Homo sapiens
agtgcttgatatgtaagta

SEQ ID NO: 5232080 - DNA, 14 bp, Homo sapiens
ataaataaaagcct

SEQ ID NO: 5232081 - DNA, 15 bp, Homo sapiens
ataaataaaagcctc

SEQ ID NO: 5232082 - DNA, 14 bp, Homo sapiens
ataaataaaagtac

SEQ ID NO: 5232083 - DNA, 20 bp, Homo sapiens
ataaataaaatggatagaaa

SEQ ID NO: 5232084 - DNA, 18 bp, Homo sapiens
ataaataaactttgggaa

SEQ ID NO: 5232085 - DNA, 14 bp, Homo sapiens
ataaataaagaaga

SEQ ID NO: 5232086 - DNA, 15 bp, Homo sapiens
ataaataaagaagaa

SEQ ID NO: 5232087 - DNA, 13 bp, Homo sapiens
ataaataaagttt

SEQ ID NO: 5232088 - DNA, 13 bp, Homo sapiens
ataaataaatgcc

SEQ ID NO: 5232089 - DNA, 12 bp, Homo sapiens
ataaataaatgt

SEQ ID NO: 5232090 - DNA, 14 bp, Homo sapiens
ataaataaattcca

SEQ ID NO: 5232091 - DNA, 17 bp, Homo sapiens
ataaataacacttgtca

SEQ ID NO: 5232092 - DNA, 14 bp, Homo sapiens
ataaataacttttt

SEQ ID NO: 5232093 - DNA, 15 bp, Homo sapiens
ataaataatattata

SEQ ID NO: 5232094 - DNA, 21 bp, Homo sapiens
ataaataatattatattgtat

SEQ ID NO: 5232095 - DNA, 13 bp, Homo sapiens
ataaataatctca

SEQ ID NO: 5232096 - DNA, 11 bp, Homo sapiens
ataaataattt

SEQ ID NO: 5232097 - DNA, 22 bp, Homo sapiens
ataaataattttgttttaatct

SEQ ID NO: 5232098 - DNA, 14 bp, Homo sapiens
ataaatacaaatct

SEQ ID NO: 5232099 - DNA, 17 bp, Homo sapiens
ataaatacaaatctgta

SEQ ID NO: 5232100 - DNA, 23 bp, Homo sapiens
ataaatacaaatctgtataaatg

SEQ ID NO: 5232101 - DNA, 12 bp, Homo sapiens
ataaatacaata

SEQ ID NO: 5232102 - DNA, 12 bp, Homo sapiens
ataaatacatac

SEQ ID NO: 5232103 - DNA, 22 bp, Homo sapiens
ataaatacatacggtcaggttt

SEQ ID NO: 5232104 - DNA, 16 bp, Homo sapiens
ataaataccaaagata

SEQ ID NO: 5232105 - DNA, 23 bp, Homo sapiens
ataaatacctcttagctgagtgg

SEQ ID NO: 5232106 - DNA, 17 bp, Homo sapiens
ataaatactaaatatga

SEQ ID NO: 5232107 - DNA, 14 bp, Homo sapiens
ataaatactgacaa

SEQ ID NO: 5232108 - DNA, 19 bp, Homo sapiens
ataaatactgtcaaacaat

SEQ ID NO: 5232109 - DNA, 15 bp, Homo sapiens
ataaatagaaaagta

SEQ ID NO: 5232110 - DNA, 14 bp, Homo sapiens
ataaatagaatgta

SEQ ID NO: 5232111 - DNA, 16 bp, Homo sapiens
ataaatagaatgtaaa

SEQ ID NO: 5232112 - DNA, 20 bp, Homo sapiens
ataaatagaatgtaaatgtc

SEQ ID NO: 5232113 - DNA, 13 bp, Homo sapiens
ataaatagattta

SEQ ID NO: 5232114 - DNA, 17 bp, Homo sapiens
ataaatagatttagtct

SEQ ID NO: 5232115 - DNA, 22 bp, Homo sapiens
ataaatagatttgattatttcc

SEQ ID NO: 5232116 - DNA, 19 bp, Homo sapiens
ataaatagctaaatggcaa

SEQ ID NO: 5232117 - DNA, 15 bp, Homo sapiens
ataaatagctatatc

SEQ ID NO: 5232118 - DNA, 17 bp, Homo sapiens
ataaataggtttatatt

SEQ ID NO: 5232119 - DNA, 15 bp, Homo sapiens
ataaatagtttatga

SEQ ID NO: 5232120 - DNA, 16 bp, Homo sapiens
ataaatataaatatat

SEQ ID NO: 5232121 - DNA, 15 bp, Homo sapiens
ataaatataagcctt

SEQ ID NO: 5232122 - DNA, 14 bp, Homo sapiens
ataaatataattgg

SEQ ID NO: 5232123 - DNA, 15 bp, Homo sapiens
ataaatataattggg

SEQ ID NO: 5232124 - DNA, 21 bp, Homo sapiens
ataaatataatttataagcat

SEQ ID NO: 5232125 - DNA, 22 bp, Homo sapiens
ataaatatactaataaaaaggt

SEQ ID NO: 5232126 - DNA, 23 bp, Homo sapiens
ataaatatataaaaagaaaagat

SEQ ID NO: 5232127 - DNA, 15 bp, Homo sapiens
ataaatatatacatt

SEQ ID NO: 5232128 - DNA, 21 bp, Homo sapiens
ataaatatatataaacctaaa

SEQ ID NO: 5232129 - DNA, 17 bp, Homo sapiens
ataaatatatataaaga

SEQ ID NO: 5232130 - DNA, 21 bp, Homo sapiens
ataaatatatataaagaatat

SEQ ID NO: 5232131 - DNA, 21 bp, Homo sapiens
ataaatatatatatatataaa

SEQ ID NO: 5232132 - DNA, 22 bp, Homo sapiens
ataaatatatatatatataaaa

SEQ ID NO: 5232133 - DNA, 18 bp, Homo sapiens
ataaatatatatttttca

SEQ ID NO: 5232134 - DNA, 22 bp, Homo sapiens
ataaatatatatttttcaacca

SEQ ID NO: 5232135 - DNA, 13 bp, Homo sapiens
ataaatatatgta

SEQ ID NO: 5232136 - DNA, 14 bp, Homo sapiens
ataaatatattatt

SEQ ID NO: 5232137 - DNA, 22 bp, Homo sapiens
ataaatatattattacttgtaa

SEQ ID NO: 5232138 - DNA, 17 bp, Homo sapiens
ataaatatatttaactt

SEQ ID NO: 5232139 - DNA, 20 bp, Homo sapiens
ataaatatattttctttcta

SEQ ID NO: 5232140 - DNA, 18 bp, Homo sapiens
ataaatatcacagtatta

SEQ ID NO: 5232141 - DNA, 14 bp, Homo sapiens
ataaatatcagtat

SEQ ID NO: 5232142 - DNA, 13 bp, Homo sapiens
ataaatatcatta

SEQ ID NO: 5232143 - DNA, 16 bp, Homo sapiens
ataaatatcattatag

SEQ ID NO: 5232144 - DNA, 22 bp, Homo sapiens
ataaatatctatttatctgtct

SEQ ID NO: 5232145 - DNA, 24 bp, Homo sapiens
ataaatatctatttatctgtctga

SEQ ID NO: 5232146 - DNA, 11 bp, Homo sapiens
ataaatatgtg

SEQ ID NO: 5232147 - DNA, 13 bp, Homo sapiens
ataaatatgtgat

SEQ ID NO: 5232148 - DNA, 22 bp, Homo sapiens
ataaatatgtgattatcattta

SEQ ID NO: 5232149 - DNA, 23 bp, Homo sapiens
ataaatatgtgattatcatttat

SEQ ID NO: 5232150 - DNA, 23 bp, Homo sapiens
ataaatattggttgggatgactt

SEQ ID NO: 5232151 - DNA, 18 bp, Homo sapiens
ataaatattgtattttag

SEQ ID NO: 5232152 - DNA, 15 bp, Homo sapiens
ataaatattgtcctg

SEQ ID NO: 5232153 - DNA, 19 bp, Homo sapiens
ataaatatttattaaatga

SEQ ID NO: 5232154 - DNA, 21 bp, Homo sapiens
ataaatatttggtaattctgt

SEQ ID NO: 5232155 - DNA, 14 bp, Homo sapiens
ataaatattttaca

SEQ ID NO: 5232156 - DNA, 23 bp, Homo sapiens
ataaatattttaggaaactctcc

SEQ ID NO: 5232157 - DNA, 18 bp, Homo sapiens
ataaatatttttggggca

SEQ ID NO: 5232158 - DNA, 20 bp, Homo sapiens
ataaatatttttggggcatc

SEQ ID NO: 5232159 - DNA, 19 bp, Homo sapiens
ataaatcaagaatcattga

SEQ ID NO: 5232160 - DNA, 15 bp, Homo sapiens
ataaatcaatgtcac

SEQ ID NO: 5232161 - DNA, 17 bp, Homo sapiens
ataaatcaattcatgtt

SEQ ID NO: 5232162 - DNA, 19 bp, Homo sapiens
ataaatcaattcattgtgt

SEQ ID NO: 5232163 - DNA, 14 bp, Homo sapiens
ataaatcacacatt

SEQ ID NO: 5232164 - DNA, 23 bp, Homo sapiens
ataaatcacagaaaatttaactt

SEQ ID NO: 5232165 - DNA, 16 bp, Homo sapiens
ataaatcacagatgca

SEQ ID NO: 5232166 - DNA, 19 bp, Homo sapiens
ataaatcacagatttccaa

SEQ ID NO: 5232167 - DNA, 14 bp, Homo sapiens
ataaatcagtattt

SEQ ID NO: 5232168 - DNA, 17 bp, Homo sapiens
ataaatcagtgaactgt

SEQ ID NO: 5232169 - DNA, 16 bp, Homo sapiens
ataaatcataaagtca

SEQ ID NO: 5232170 - DNA, 11 bp, Homo sapiens
ataaatcatgg

SEQ ID NO: 5232171 - DNA, 14 bp, Homo sapiens
ataaatcatttcag

SEQ ID NO: 5232172 - DNA, 16 bp, Homo sapiens
ataaatcatttcagta

SEQ ID NO: 5232173 - DNA, 16 bp, Homo sapiens
ataaatcattttatgt

SEQ ID NO: 5232174 - DNA, 18 bp, Homo sapiens
ataaatcattttatgtca

SEQ ID NO: 5232175 - DNA, 24 bp, Homo sapiens
ataaatccaatagtctgccacaag

SEQ ID NO: 5232176 - DNA, 14 bp, Homo sapiens
ataaatccagtgac

SEQ ID NO: 5232177 - DNA, 15 bp, Homo sapiens
ataaatccagtgacc

SEQ ID NO: 5232178 - DNA, 23 bp, Homo sapiens
ataaatccagtgacctctctctc

SEQ ID NO: 5232179 - DNA, 12 bp, Homo sapiens
ataaatctaaat

SEQ ID NO: 5232180 - DNA, 13 bp, Homo sapiens
ataaatctaaata

SEQ ID NO: 5232181 - DNA, 23 bp, Homo sapiens
ataaatctaaatgattatcttga

SEQ ID NO: 5232182 - DNA, 15 bp, Homo sapiens
ataaatctaggatgt

SEQ ID NO: 5232183 - DNA, 14 bp, Homo sapiens
ataaatctcttctt

SEQ ID NO: 5232184 - DNA, 20 bp, Homo sapiens
ataaatctgagcctaaatct

SEQ ID NO: 5232185 - DNA, 17 bp, Homo sapiens
ataaatctgtctgattc

SEQ ID NO: 5232186 - DNA, 19 bp, Homo sapiens
ataaatctgtctgattcta

SEQ ID NO: 5232187 - DNA, 15 bp, Homo sapiens
ataaatctgtgaact

SEQ ID NO: 5232188 - DNA, 16 bp, Homo sapiens
ataaatctgtgaactt

SEQ ID NO: 5232189 - DNA, 19 bp, Homo sapiens
ataaatctgtgaacttgaa

SEQ ID NO: 5232190 - DNA, 22 bp, Homo sapiens
ataaatctgttagcattattgc

SEQ ID NO: 5232191 - DNA, 21 bp, Homo sapiens
ataaatcttacccttcaatgt

SEQ ID NO: 5232192 - DNA, 22 bp, Homo sapiens
ataaatcttacccttcaatgtt

SEQ ID NO: 5232193 - DNA, 13 bp, Homo sapiens
ataaatgaaataa

SEQ ID NO: 5232194 - DNA, 14 bp, Homo sapiens
ataaatgaagatta

SEQ ID NO: 5232195 - DNA, 11 bp, Homo sapiens
ataaatgaagc

SEQ ID NO: 5232196 - DNA, 21 bp, Homo sapiens
ataaatgaagtattatctgta

SEQ ID NO: 5232197 - DNA, 16 bp, Homo sapiens
ataaatgaagtttata

SEQ ID NO: 5232198 - DNA, 21 bp, Homo sapiens
ataaatgaagtttatacagta

SEQ ID NO: 5232199 - DNA, 22 bp, Homo sapiens
ataaatgaagtttatacagtac

SEQ ID NO: 5232200 - DNA, 17 bp, Homo sapiens
ataaatgaataaatcca

SEQ ID NO: 5232201 - DNA, 15 bp, Homo sapiens
ataaatgaatcttac

SEQ ID NO: 5232202 - DNA, 11 bp, Homo sapiens
ataaatgaatg

SEQ ID NO: 5232203 - DNA, 12 bp, Homo sapiens
ataaatgaatga

SEQ ID NO: 5232204 - DNA, 15 bp, Homo sapiens
ataaatgaatgaata

SEQ ID NO: 5232205 - DNA, 20 bp, Homo sapiens
ataaatgacaaagtgttgaa

SEQ ID NO: 5232206 - DNA, 16 bp, Homo sapiens
ataaatgacacccaga

SEQ ID NO: 5232207 - DNA, 13 bp, Homo sapiens
ataaatgagaaaa

SEQ ID NO: 5232208 - DNA, 18 bp, Homo sapiens
ataaatgatgattgaact

SEQ ID NO: 5232209 - DNA, 19 bp, Homo sapiens
ataaatgattatattcaca

SEQ ID NO: 5232210 - DNA, 18 bp, Homo sapiens
ataaatgattcaaaaagt

SEQ ID NO: 5232211 - DNA, 16 bp, Homo sapiens
ataaatgattcttagt

SEQ ID NO: 5232212 - DNA, 12 bp, Homo sapiens
ataaatgcaaat

SEQ ID NO: 5232213 - DNA, 23 bp, Homo sapiens
ataaatgcaaatggctaccgttt

SEQ ID NO: 5232214 - DNA, 17 bp, Homo sapiens
ataaatgcaatatgtat

SEQ ID NO: 5232215 - DNA, 22 bp, Homo sapiens
ataaatgcaatatgtattaata

SEQ ID NO: 5232216 - DNA, 17 bp, Homo sapiens
ataaatgcacatttcag

SEQ ID NO: 5232217 - DNA, 16 bp, Homo sapiens
ataaatgcactgtaat

SEQ ID NO: 5232218 - DNA, 14 bp, Homo sapiens
ataaatgcagccca

SEQ ID NO: 5232219 - DNA, 16 bp, Homo sapiens
ataaatgcatgatttt

SEQ ID NO: 5232220 - DNA, 22 bp, Homo sapiens
ataaatgcatgattttatacat

SEQ ID NO: 5232221 - DNA, 14 bp, Homo sapiens
ataaatgccagagc

SEQ ID NO: 5232222 - DNA, 21 bp, Homo sapiens
ataaatgccagagccaacctg

SEQ ID NO: 5232223 - DNA, 18 bp, Homo sapiens
ataaatgccatcaataaa

SEQ ID NO: 5232224 - DNA, 13 bp, Homo sapiens
ataaatgccttta

SEQ ID NO: 5232225 - DNA, 21 bp, Homo sapiens
ataaatgctattttttatttt

SEQ ID NO: 5232226 - DNA, 23 bp, Homo sapiens
ataaatgctattttttattttac

SEQ ID NO: 5232227 - DNA, 16 bp, Homo sapiens
ataaatgctttaaata

SEQ ID NO: 5232228 - DNA, 20 bp, Homo sapiens
ataaatgctttaaatagttt

SEQ ID NO: 5232229 - DNA, 13 bp, Homo sapiens
ataaatggaaatc

SEQ ID NO: 5232230 - DNA, 14 bp, Homo sapiens
ataaatggaaatca

SEQ ID NO: 5232231 - DNA, 15 bp, Homo sapiens
ataaatggacttgct

SEQ ID NO: 5232232 - DNA, 17 bp, Homo sapiens
ataaatggacttgcttc

SEQ ID NO: 5232233 - DNA, 12 bp, Homo sapiens
ataaatggaggt

SEQ ID NO: 5232234 - DNA, 18 bp, Homo sapiens
ataaatggccagtgctgc

SEQ ID NO: 5232235 - DNA, 19 bp, Homo sapiens
ataaatggccagtgctgct

SEQ ID NO: 5232236 - DNA, 24 bp, Homo sapiens
ataaatggccagtgctgcttcttg

SEQ ID NO: 5232237 - DNA, 18 bp, Homo sapiens
ataaatgggtaacactga

SEQ ID NO: 5232238 - DNA, 17 bp, Homo sapiens
ataaatggtgtcataac

SEQ ID NO: 5232239 - DNA, 22 bp, Homo sapiens
ataaatggtgtcataactagag

SEQ ID NO: 5232240 - DNA, 18 bp, Homo sapiens
ataaatggttaagacaaa

SEQ ID NO: 5232241 - DNA, 20 bp, Homo sapiens
ataaatggtttggtgctttt

SEQ ID NO: 5232242 - DNA, 17 bp, Homo sapiens
ataaatgtaaaaatgaa

SEQ ID NO: 5232243 - DNA, 21 bp, Homo sapiens
ataaatgtaaaaatgaaggaa

SEQ ID NO: 5232244 - DNA, 13 bp, Homo sapiens
ataaatgtacatc

SEQ ID NO: 5232245 - DNA, 20 bp, Homo sapiens
ataaatgtacccctctcagt

SEQ ID NO: 5232246 - DNA, 20 bp, Homo sapiens
ataaatgtactacatttgca

SEQ ID NO: 5232247 - DNA, 21 bp, Homo sapiens
ataaatgtactacatttgcat

SEQ ID NO: 5232248 - DNA, 17 bp, Homo sapiens
ataaatgtatatacaca

SEQ ID NO: 5232249 - DNA, 21 bp, Homo sapiens
ataaatgtatatacacatata

SEQ ID NO: 5232250 - DNA, 13 bp, Homo sapiens
ataaatgtatctg

SEQ ID NO: 5232251 - DNA, 16 bp, Homo sapiens
ataaatgtatctgaat

SEQ ID NO: 5232252 - DNA, 20 bp, Homo sapiens
ataaatgtcacaataaaaca

SEQ ID NO: 5232253 - DNA, 15 bp, Homo sapiens
ataaatgtcactgcc

SEQ ID NO: 5232254 - DNA, 23 bp, Homo sapiens
ataaatgtcactttttgaggcaa

SEQ ID NO: 5232255 - DNA, 17 bp, Homo sapiens
ataaatgtcattaaaat

SEQ ID NO: 5232256 - DNA, 13 bp, Homo sapiens
ataaatgtcctaa

SEQ ID NO: 5232257 - DNA, 15 bp, Homo sapiens
ataaatgtctgttga

SEQ ID NO: 5232258 - DNA, 20 bp, Homo sapiens
ataaatgtcttttttttaat

SEQ ID NO: 5232259 - DNA, 16 bp, Homo sapiens
agtgcttgcatcctat

SEQ ID NO: 5232260 - DNA, 17 bp, Homo sapiens
agtgcttgcatcctatt

SEQ ID NO: 5232261 - DNA, 16 bp, Homo sapiens
agtgcttgccacagag

SEQ ID NO: 5232262 - DNA, 17 bp, Homo sapiens
agtgcttgccacagagc

SEQ ID NO: 5232263 - DNA, 19 bp, Homo sapiens
agtgcttgccacagagcgg

SEQ ID NO: 5232264 - DNA, 22 bp, Homo sapiens
agtgcttgcttttcatgcaaac

SEQ ID NO: 5232265 - DNA, 15 bp, Homo sapiens
agtgcttggctgccc

SEQ ID NO: 5232266 - DNA, 14 bp, Homo sapiens
agtgcttgggctcc

SEQ ID NO: 5232267 - DNA, 16 bp, Homo sapiens
agtgcttgggctccac

SEQ ID NO: 5232268 - DNA, 23 bp, Homo sapiens
agtgcttgggtggtgggtgctgg

SEQ ID NO: 5232269 - DNA, 13 bp, Homo sapiens
agtgcttggttga

SEQ ID NO: 5232270 - DNA, 13 bp, Homo sapiens
agtgcttgtgtaa

SEQ ID NO: 5232271 - DNA, 14 bp, Homo sapiens
agtgcttgtgtaat

SEQ ID NO: 5232272 - DNA, 19 bp, Homo sapiens
agtgcttgtgtaatttatg

SEQ ID NO: 5232273 - DNA, 18 bp, Homo sapiens
agtgctttaagaatgaac

SEQ ID NO: 5232274 - DNA, 18 bp, Homo sapiens
agtgctttacctttaaaa

SEQ ID NO: 5232275 - DNA, 16 bp, Homo sapiens
agtgctttatggctct

SEQ ID NO: 5232276 - DNA, 22 bp, Homo sapiens
agtgctttccttttttaaaaat

SEQ ID NO: 5232277 - DNA, 16 bp, Homo sapiens
agtgctttgcatgtat

SEQ ID NO: 5232278 - DNA, 14 bp, Homo sapiens
agtgctttgccctt

SEQ ID NO: 5232279 - DNA, 20 bp, Homo sapiens
agtgctttgctggagtcctg

SEQ ID NO: 5232280 - DNA, 23 bp, Homo sapiens
agtgctttgctggagtcctgttc

SEQ ID NO: 5232281 - DNA, 13 bp, Homo sapiens
agtgctttgtaat

SEQ ID NO: 5232282 - DNA, 18 bp, Homo sapiens
agtgcttttaaaaatttt

SEQ ID NO: 5232283 - DNA, 13 bp, Homo sapiens
ataataaagaata

SEQ ID NO: 5232284 - DNA, 14 bp, Homo sapiens
ataataaagaatag

SEQ ID NO: 5232285 - DNA, 17 bp, Homo sapiens
ataataaagatgtgaaa

SEQ ID NO: 5232286 - DNA, 16 bp, Homo sapiens
ataataaagctactga

SEQ ID NO: 5232287 - DNA, 18 bp, Homo sapiens
ataataaaggactgtaat

SEQ ID NO: 5232288 - DNA, 13 bp, Homo sapiens
ataataaaggctg

SEQ ID NO: 5232289 - DNA, 14 bp, Homo sapiens
ataataaaggtcac

SEQ ID NO: 5232290 - DNA, 19 bp, Homo sapiens
ataataaaggttctatgat

SEQ ID NO: 5232291 - DNA, 15 bp, Homo sapiens
ataataaagtaattg

SEQ ID NO: 5232292 - DNA, 16 bp, Homo sapiens
ataataaagtacttga

SEQ ID NO: 5232293 - DNA, 12 bp, Homo sapiens
ataataaagtat

SEQ ID NO: 5232294 - DNA, 13 bp, Homo sapiens
ataataaagtatt

SEQ ID NO: 5232295 - DNA, 17 bp, Homo sapiens
ataataaagtattttct

SEQ ID NO: 5232296 - DNA, 17 bp, Homo sapiens
ataataaagttgtttta

SEQ ID NO: 5232297 - DNA, 14 bp, Homo sapiens
ataataaatcacac

SEQ ID NO: 5232298 - DNA, 15 bp, Homo sapiens
ataataaatgaggaa

SEQ ID NO: 5232299 - DNA, 13 bp, Homo sapiens
ataataaattcat

SEQ ID NO: 5232300 - DNA, 12 bp, Homo sapiens
ataataaattga

SEQ ID NO: 5232301 - DNA, 15 bp, Homo sapiens
ataataaattgcatg

SEQ ID NO: 5232302 - DNA, 14 bp, Homo sapiens
ataataaattttct

SEQ ID NO: 5232303 - DNA, 15 bp, Homo sapiens
ataataaattttcta

SEQ ID NO: 5232304 - DNA, 13 bp, Homo sapiens
ataataacaacaa

SEQ ID NO: 5232305 - DNA, 22 bp, Homo sapiens
ataataacaacaacttaatgtg

SEQ ID NO: 5232306 - DNA, 18 bp, Homo sapiens
ataataacagcaccccat

SEQ ID NO: 5232307 - DNA, 14 bp, Homo sapiens
ataataacatatat

SEQ ID NO: 5232308 - DNA, 17 bp, Homo sapiens
ataataactagatctcc

SEQ ID NO: 5232309 - DNA, 21 bp, Homo sapiens
ataataactagatctcctgta

SEQ ID NO: 5232310 - DNA, 13 bp, Homo sapiens
ataataactgaac

SEQ ID NO: 5232311 - DNA, 15 bp, Homo sapiens
ataataactgaactg

SEQ ID NO: 5232312 - DNA, 16 bp, Homo sapiens
ataataactgaactgt

SEQ ID NO: 5232313 - DNA, 14 bp, Homo sapiens
ataataactttatt

SEQ ID NO: 5232314 - DNA, 18 bp, Homo sapiens
ataataagacttttctct

SEQ ID NO: 5232315 - DNA, 23 bp, Homo sapiens
ataataagagccctgagcccaga

SEQ ID NO: 5232316 - DNA, 16 bp, Homo sapiens
ataataagcaaaaaga

SEQ ID NO: 5232317 - DNA, 16 bp, Homo sapiens
ataataaggaaaagtt

SEQ ID NO: 5232318 - DNA, 20 bp, Homo sapiens
ataataagttttgatataat

SEQ ID NO: 5232319 - DNA, 22 bp, Homo sapiens
ataataagttttgatataatct

SEQ ID NO: 5232320 - DNA, 10 bp, Homo sapiens
ataataataa

SEQ ID NO: 5232321 - DNA, 12 bp, Homo sapiens
ataataataata

SEQ ID NO: 5232322 - DNA, 14 bp, Homo sapiens
ataataataataat

SEQ ID NO: 5232323 - DNA, 12 bp, Homo sapiens
ataataatacaa

SEQ ID NO: 5232324 - DNA, 15 bp, Homo sapiens
ataataatattgttt

SEQ ID NO: 5232325 - DNA, 15 bp, Homo sapiens
ataataatgaatgtc

SEQ ID NO: 5232326 - DNA, 14 bp, Homo sapiens
ataataatgggaga

SEQ ID NO: 5232327 - DNA, 19 bp, Homo sapiens
ataataattgaaaagattt

SEQ ID NO: 5232328 - DNA, 15 bp, Homo sapiens
ataataattgaagaa

SEQ ID NO: 5232329 - DNA, 14 bp, Homo sapiens
ataataatttgcac

SEQ ID NO: 5232330 - DNA, 14 bp, Homo sapiens
ataataattttcct

SEQ ID NO: 5232331 - DNA, 18 bp, Homo sapiens
ataatacaccactacatt

SEQ ID NO: 5232332 - DNA, 21 bp, Homo sapiens
ataatacaccactacattctg

SEQ ID NO: 5232333 - DNA, 23 bp, Homo sapiens
ataatacaccactacattctgtt

SEQ ID NO: 5232334 - DNA, 22 bp, Homo sapiens
ataatacactaattcctttcta

SEQ ID NO: 5232335 - DNA, 18 bp, Homo sapiens
ataatacagatttgtaac

SEQ ID NO: 5232336 - DNA, 17 bp, Homo sapiens
ataatacagcgctctct

SEQ ID NO: 5232337 - DNA, 13 bp, Homo sapiens
ataatacattccg

SEQ ID NO: 5232338 - DNA, 15 bp, Homo sapiens
ataataccttagaag

SEQ ID NO: 5232339 - DNA, 14 bp, Homo sapiens
ataatactaaagtg

SEQ ID NO: 5232340 - DNA, 16 bp, Homo sapiens
ataatactaatttatt

SEQ ID NO: 5232341 - DNA, 20 bp, Homo sapiens
ataatactaatttattgccg

SEQ ID NO: 5232342 - DNA, 22 bp, Homo sapiens
ataatactatatttatactgta

SEQ ID NO: 5232343 - DNA, 17 bp, Homo sapiens
ataatactctgttgtac

SEQ ID NO: 5232344 - DNA, 14 bp, Homo sapiens
ataatactgaacca

SEQ ID NO: 5232345 - DNA, 22 bp, Homo sapiens
ataatactgctgagatacatac

SEQ ID NO: 5232346 - DNA, 15 bp, Homo sapiens
ataatacttcataca

SEQ ID NO: 5232347 - DNA, 13 bp, Homo sapiens
ataatacttgcaa

SEQ ID NO: 5232348 - DNA, 15 bp, Homo sapiens
ataatacttgcaact

SEQ ID NO: 5232349 - DNA, 14 bp, Homo sapiens
ataatactttgtat

SEQ ID NO: 5232350 - DNA, 15 bp, Homo sapiens
ataatactttgtata

SEQ ID NO: 5232351 - DNA, 18 bp, Homo sapiens
ataatactttgtatacaa

SEQ ID NO: 5232352 - DNA, 21 bp, Homo sapiens
ataatactttgtatacaagta

SEQ ID NO: 5232353 - DNA, 12 bp, Homo sapiens
ataatagaaatg

SEQ ID NO: 5232354 - DNA, 15 bp, Homo sapiens
ataatagaatttcct

SEQ ID NO: 5232355 - DNA, 22 bp, Homo sapiens
ataatagacatacagagatata

SEQ ID NO: 5232356 - DNA, 21 bp, Homo sapiens
ataatagactcgctagtcagt

SEQ ID NO: 5232357 - DNA, 22 bp, Homo sapiens
ataatagagtagcctaaaatta

SEQ ID NO: 5232358 - DNA, 20 bp, Homo sapiens
ataatagatgtgaaaatgct

SEQ ID NO: 5232359 - DNA, 13 bp, Homo sapiens
ataatagattctc

SEQ ID NO: 5232360 - DNA, 19 bp, Homo sapiens
ataatagcacatgatttgg

SEQ ID NO: 5232361 - DNA, 17 bp, Homo sapiens
ataatagcatttttgta

SEQ ID NO: 5232362 - DNA, 17 bp, Homo sapiens
ataatagctcacagcac

SEQ ID NO: 5232363 - DNA, 12 bp, Homo sapiens
ataataggaatt

SEQ ID NO: 5232364 - DNA, 20 bp, Homo sapiens
ataataggatataaaacaca

SEQ ID NO: 5232365 - DNA, 15 bp, Homo sapiens
ataataggccacaga

SEQ ID NO: 5232366 - DNA, 12 bp, Homo sapiens
ataatagggaaa

SEQ ID NO: 5232367 - DNA, 14 bp, Homo sapiens
ataatagggaaaat

SEQ ID NO: 5232368 - DNA, 16 bp, Homo sapiens
ataatagggttttcag

SEQ ID NO: 5232369 - DNA, 18 bp, Homo sapiens
ataataggtagcctgctg

SEQ ID NO: 5232370 - DNA, 17 bp, Homo sapiens
ataataggtagtttgga

SEQ ID NO: 5232371 - DNA, 13 bp, Homo sapiens
ataataggtcata

SEQ ID NO: 5232372 - DNA, 17 bp, Homo sapiens
ataataggtcatatgtt

SEQ ID NO: 5232373 - DNA, 21 bp, Homo sapiens
ataataggtgggggaaaatga

SEQ ID NO: 5232374 - DNA, 23 bp, Homo sapiens
ataataggtgggggaaaatgaat

SEQ ID NO: 5232375 - DNA, 16 bp, Homo sapiens
ataatagttaatgaag

SEQ ID NO: 5232376 - DNA, 21 bp, Homo sapiens
ataatagttattatttaattg

SEQ ID NO: 5232377 - DNA, 17 bp, Homo sapiens
ataatataaaaagcaga

SEQ ID NO: 5232378 - DNA, 19 bp, Homo sapiens
ataatataaatgaatgaaa

SEQ ID NO: 5232379 - DNA, 16 bp, Homo sapiens
ataatataacaacact

SEQ ID NO: 5232380 - DNA, 23 bp, Homo sapiens
ataatatactaaaccaactctaa

SEQ ID NO: 5232381 - DNA, 13 bp, Homo sapiens
ataatatacttgt

SEQ ID NO: 5232382 - DNA, 20 bp, Homo sapiens
ataatatacttgtggactaa

SEQ ID NO: 5232383 - DNA, 15 bp, Homo sapiens
ataatatagaaagaa

SEQ ID NO: 5232384 - DNA, 19 bp, Homo sapiens
ataatatataaaagaaata

SEQ ID NO: 5232385 - DNA, 21 bp, Homo sapiens
ataatatataaaagaaatata

SEQ ID NO: 5232386 - DNA, 22 bp, Homo sapiens
ataatatataaaagaaatatat

SEQ ID NO: 5232387 - DNA, 15 bp, Homo sapiens
ataatatataaacaa

SEQ ID NO: 5232388 - DNA, 21 bp, Homo sapiens
ataatatatatatatatcagt

SEQ ID NO: 5232389 - DNA, 14 bp, Homo sapiens
ataatatatttctt

SEQ ID NO: 5232390 - DNA, 14 bp, Homo sapiens
ataatatatttgtg

SEQ ID NO: 5232391 - DNA, 13 bp, Homo sapiens
ataatatattttc

SEQ ID NO: 5232392 - DNA, 14 bp, Homo sapiens
ataatatattttca

SEQ ID NO: 5232393 - DNA, 15 bp, Homo sapiens
ataatatattttctg

SEQ ID NO: 5232394 - DNA, 19 bp, Homo sapiens
ataatatccactgcaatac

SEQ ID NO: 5232395 - DNA, 21 bp, Homo sapiens
ataatatccaggtcaacagaa

SEQ ID NO: 5232396 - DNA, 23 bp, Homo sapiens
ataatatccaggtcaacagaatg

SEQ ID NO: 5232397 - DNA, 17 bp, Homo sapiens
ataatatcctgaataac

SEQ ID NO: 5232398 - DNA, 14 bp, Homo sapiens
ataatatctaaagt

SEQ ID NO: 5232399 - DNA, 17 bp, Homo sapiens
ataatatctaaagttat

SEQ ID NO: 5232400 - DNA, 18 bp, Homo sapiens
ataatatctaaagttata

SEQ ID NO: 5232401 - DNA, 20 bp, Homo sapiens
ataatatctaaagttatatt

SEQ ID NO: 5232402 - DNA, 13 bp, Homo sapiens
ataatatctgtga

SEQ ID NO: 5232403 - DNA, 15 bp, Homo sapiens
ataatatctgtgagg

SEQ ID NO: 5232404 - DNA, 24 bp, Homo sapiens
ataatatctgtgaggtgctgatga

SEQ ID NO: 5232405 - DNA, 17 bp, Homo sapiens
ataatatcttgaagaat

SEQ ID NO: 5232406 - DNA, 22 bp, Homo sapiens
ataatatcttgaagaatattgt

SEQ ID NO: 5232407 - DNA, 18 bp, Homo sapiens
ataatatctttgtgataa

SEQ ID NO: 5232408 - DNA, 22 bp, Homo sapiens
ataatatctttgtgataattta

SEQ ID NO: 5232409 - DNA, 13 bp, Homo sapiens
ataatatgaagcc

SEQ ID NO: 5232410 - DNA, 16 bp, Homo sapiens
ataatatgaagccttt

SEQ ID NO: 5232411 - DNA, 16 bp, Homo sapiens
ataatatgatgcaaac

SEQ ID NO: 5232412 - DNA, 15 bp, Homo sapiens
ataatatgcatatat

SEQ ID NO: 5232413 - DNA, 14 bp, Homo sapiens
ataatatgtacaaa

SEQ ID NO: 5232414 - DNA, 15 bp, Homo sapiens
ataatatgtacaaat

SEQ ID NO: 5232415 - DNA, 16 bp, Homo sapiens
ataatatgtacaaata

SEQ ID NO: 5232416 - DNA, 18 bp, Homo sapiens
ataatatgtacaaataat

SEQ ID NO: 5232417 - DNA, 14 bp, Homo sapiens
ataatatgtcacct

SEQ ID NO: 5232418 - DNA, 20 bp, Homo sapiens
ataatatgtgatgattaata

SEQ ID NO: 5232419 - DNA, 23 bp, Homo sapiens
ataatatgtgccttaagttttag

SEQ ID NO: 5232420 - DNA, 15 bp, Homo sapiens
ataatatgtttagtt

SEQ ID NO: 5232421 - DNA, 22 bp, Homo sapiens
ataatatgtttagttttacatt

SEQ ID NO: 5232422 - DNA, 16 bp, Homo sapiens
ataatattaataagaa

SEQ ID NO: 5232423 - DNA, 16 bp, Homo sapiens
ataatattaatttatt

SEQ ID NO: 5232424 - DNA, 14 bp, Homo sapiens
ataatattagtgat

SEQ ID NO: 5232425 - DNA, 18 bp, Homo sapiens
ataatattagtgattctg

SEQ ID NO: 5232426 - DNA, 12 bp, Homo sapiens
ataatattcagc

SEQ ID NO: 5232427 - DNA, 16 bp, Homo sapiens
ataatattcattggtt

SEQ ID NO: 5232428 - DNA, 12 bp, Homo sapiens
ataatattgaaa

SEQ ID NO: 5232429 - DNA, 21 bp, Homo sapiens
ataatattgccttgatgtttc

SEQ ID NO: 5232430 - DNA, 19 bp, Homo sapiens
ataatattgtgtcatagaa

SEQ ID NO: 5232431 - DNA, 22 bp, Homo sapiens
ataatattgtttggtaaatgtt

SEQ ID NO: 5232432 - DNA, 18 bp, Homo sapiens
ataatatttaaaatagtt

SEQ ID NO: 5232433 - DNA, 20 bp, Homo sapiens
ataatatttaggcatgagct

SEQ ID NO: 5232434 - DNA, 14 bp, Homo sapiens
ataatatttcaagt

SEQ ID NO: 5232435 - DNA, 19 bp, Homo sapiens
ataatattttacatacact

SEQ ID NO: 5232436 - DNA, 17 bp, Homo sapiens
ataatattttagaaaat

SEQ ID NO: 5232437 - DNA, 12 bp, Homo sapiens
ataatattttct

SEQ ID NO: 5232438 - DNA, 18 bp, Homo sapiens
ataatatttttaatatat

SEQ ID NO: 5232439 - DNA, 20 bp, Homo sapiens
ataatatttttaattaaata

SEQ ID NO: 5232440 - DNA, 15 bp, Homo sapiens
ataatatttttgtat

SEQ ID NO: 5232441 - DNA, 18 bp, Homo sapiens
ataatcaaagctacctgt

SEQ ID NO: 5232442 - DNA, 16 bp, Homo sapiens
ataatcaaagctcata

SEQ ID NO: 5232443 - DNA, 14 bp, Homo sapiens
ataatcaaatgatt

SEQ ID NO: 5232444 - DNA, 16 bp, Homo sapiens
ataatcaaatgatttc

SEQ ID NO: 5232445 - DNA, 17 bp, Homo sapiens
ataatcaaatgatttca

SEQ ID NO: 5232446 - DNA, 16 bp, Homo sapiens
ataatcaagacaagtg

SEQ ID NO: 5232447 - DNA, 13 bp, Homo sapiens
agtgtgaaccccc

SEQ ID NO: 5232448 - DNA, 22 bp, Homo sapiens
agtgtgaactggaccctgttgc

SEQ ID NO: 5232449 - DNA, 20 bp, Homo sapiens
agtgtgaagacactgtgcag

SEQ ID NO: 5232450 - DNA, 16 bp, Homo sapiens
agtgtgaagtacaata

SEQ ID NO: 5232451 - DNA, 17 bp, Homo sapiens
agtgtgaagtacaataa

SEQ ID NO: 5232452 - DNA, 12 bp, Homo sapiens
agtgtgaagtta

SEQ ID NO: 5232453 - DNA, 15 bp, Homo sapiens
agtgtgaagttagaa

SEQ ID NO: 5232454 - DNA, 20 bp, Homo sapiens
agtgtgaagttagaattcct

SEQ ID NO: 5232455 - DNA, 20 bp, Homo sapiens
agtgtgaatatatggtctgt

SEQ ID NO: 5232456 - DNA, 23 bp, Homo sapiens
agtgtgacaaggattgctactgt

SEQ ID NO: 5232457 - DNA, 14 bp, Homo sapiens
agtgtgacagggcc

SEQ ID NO: 5232458 - DNA, 14 bp, Homo sapiens
agtgtgaccaggca

SEQ ID NO: 5232459 - DNA, 21 bp, Homo sapiens
agtgtgacgggggttggggtg

SEQ ID NO: 5232460 - DNA, 18 bp, Homo sapiens
agtgtgactagatatcaa

SEQ ID NO: 5232461 - DNA, 20 bp, Homo sapiens
agtgtgactgatctctcgtg

SEQ ID NO: 5232462 - DNA, 23 bp, Homo sapiens
agtgtgagaccccaaagactctg

SEQ ID NO: 5232463 - DNA, 21 bp, Homo sapiens
agtgtgagccaccgcgcctgg

SEQ ID NO: 5232464 - DNA, 18 bp, Homo sapiens
agtgtgagcgccttggta

SEQ ID NO: 5232465 - DNA, 13 bp, Homo sapiens
agtgtgagctctt

SEQ ID NO: 5232466 - DNA, 13 bp, Homo sapiens
agtgtgagggcag

SEQ ID NO: 5232467 - DNA, 12 bp, Homo sapiens
agtgtgagtaag

SEQ ID NO: 5232468 - DNA, 16 bp, Homo sapiens
agtgtgagtaagagct

SEQ ID NO: 5232469 - DNA, 19 bp, Homo sapiens
agtgtgagtaagagctggt

SEQ ID NO: 5232470 - DNA, 17 bp, Homo sapiens
agtgtgagtcagaatgt

SEQ ID NO: 5232471 - DNA, 14 bp, Homo sapiens
agtgtgagtggcag

SEQ ID NO: 5232472 - DNA, 15 bp, Homo sapiens
agtgtgagtgtgaga

SEQ ID NO: 5232473 - DNA, 18 bp, Homo sapiens
agtgtgattgggaataaa

SEQ ID NO: 5232474 - DNA, 12 bp, Homo sapiens
agtgtgcaaaat

SEQ ID NO: 5232475 - DNA, 13 bp, Homo sapiens
agtgtgcacagat

SEQ ID NO: 5232476 - DNA, 17 bp, Homo sapiens
agtgtgcagacagccat

SEQ ID NO: 5232477 - DNA, 14 bp, Homo sapiens
agtgtgcagactga

SEQ ID NO: 5232478 - DNA, 16 bp, Homo sapiens
agtgtgcagactgatg

SEQ ID NO: 5232479 - DNA, 21 bp, Homo sapiens
agtgtgcagttctagtttgca

SEQ ID NO: 5232480 - DNA, 15 bp, Homo sapiens
agtgtgcatattgta

SEQ ID NO: 5232481 - DNA, 16 bp, Homo sapiens
agtgtgcatattgtac

SEQ ID NO: 5232482 - DNA, 17 bp, Homo sapiens
agtgtgcatattgtaca

SEQ ID NO: 5232483 - DNA, 19 bp, Homo sapiens
agtgtgcatggaggccctc

SEQ ID NO: 5232484 - DNA, 15 bp, Homo sapiens
agtgtgccacatgga

SEQ ID NO: 5232485 - DNA, 14 bp, Homo sapiens
agtgtgccaccctc

SEQ ID NO: 5232486 - DNA, 15 bp, Homo sapiens
agtgtgccaccctct

SEQ ID NO: 5232487 - DNA, 17 bp, Homo sapiens
agtgtgccaccctctgc

SEQ ID NO: 5232488 - DNA, 20 bp, Homo sapiens
agtgtgcccaaaagccatgt

SEQ ID NO: 5232489 - DNA, 19 bp, Homo sapiens
agtgtgccccccatcctgg

SEQ ID NO: 5232490 - DNA, 20 bp, Homo sapiens
agtgtgccccccatcctggc

SEQ ID NO: 5232491 - DNA, 22 bp, Homo sapiens
agtgtgccccccatcctggccc

SEQ ID NO: 5232492 - DNA, 23 bp, Homo sapiens
agtgtgccccccatcctggccca

SEQ ID NO: 5232493 - DNA, 20 bp, Homo sapiens
agtgtgcctgctatccagcc

SEQ ID NO: 5232494 - DNA, 14 bp, Homo sapiens
agtgtgcgcccggc

SEQ ID NO: 5232495 - DNA, 14 bp, Homo sapiens
agtgtgcggagctg

SEQ ID NO: 5232496 - DNA, 17 bp, Homo sapiens
agtgtgcggctgtgtgt

SEQ ID NO: 5232497 - DNA, 15 bp, Homo sapiens
agtgtgcgtgtgtgc

SEQ ID NO: 5232498 - DNA, 18 bp, Homo sapiens
agtgtgctaacctcactg

SEQ ID NO: 5232499 - DNA, 23 bp, Homo sapiens
agtgtgctctccccggcaggcct

SEQ ID NO: 5232500 - DNA, 22 bp, Homo sapiens
agtgtgctctttttttaaaagg

SEQ ID NO: 5232501 - DNA, 13 bp, Homo sapiens
agtgtgctgctat

SEQ ID NO: 5232502 - DNA, 15 bp, Homo sapiens
agtgtgctgctgttc

SEQ ID NO: 5232503 - DNA, 15 bp, Homo sapiens
agtgtgctgggcaga

SEQ ID NO: 5232504 - DNA, 18 bp, Homo sapiens
agtgtgcttgtcatctgc

SEQ ID NO: 5232505 - DNA, 18 bp, Homo sapiens
agtgtgctttatgctgaa

SEQ ID NO: 5232506 - DNA, 21 bp, Homo sapiens
agtgtgctttatgctgaaaca

SEQ ID NO: 5232507 - DNA, 13 bp, Homo sapiens
agtgtggaaagca

SEQ ID NO: 5232508 - DNA, 18 bp, Homo sapiens
agtgtggactctggactg

SEQ ID NO: 5232509 - DNA, 14 bp, Homo sapiens
agtgtggagaagga

SEQ ID NO: 5232510 - DNA, 21 bp, Homo sapiens
agtgtggagaggggtgcaccc

SEQ ID NO: 5232511 - DNA, 12 bp, Homo sapiens
agtgtggagtgg

SEQ ID NO: 5232512 - DNA, 18 bp, Homo sapiens
agtgtggatgttcagaat

SEQ ID NO: 5232513 - DNA, 13 bp, Homo sapiens
agtgtggccaggc

SEQ ID NO: 5232514 - DNA, 13 bp, Homo sapiens
agtgtggcctctt

SEQ ID NO: 5232515 - DNA, 13 bp, Homo sapiens
agtgtggcctgga

SEQ ID NO: 5232516 - DNA, 20 bp, Homo sapiens
agtgtggcctgtgccagcac

SEQ ID NO: 5232517 - DNA, 15 bp, Homo sapiens
agtgtggcgggaagg

SEQ ID NO: 5232518 - DNA, 17 bp, Homo sapiens
agtgtggctcccctcta

SEQ ID NO: 5232519 - DNA, 20 bp, Homo sapiens
agtgtggctgaggaggcctc

SEQ ID NO: 5232520 - DNA, 13 bp, Homo sapiens
agtgtggctggtg

SEQ ID NO: 5232521 - DNA, 15 bp, Homo sapiens
agtgtggctggtgtc

SEQ ID NO: 5232522 - DNA, 17 bp, Homo sapiens
agtgtgggaagggagag

SEQ ID NO: 5232523 - DNA, 14 bp, Homo sapiens
agtgtgggaatgcg

SEQ ID NO: 5232524 - DNA, 16 bp, Homo sapiens
agtgtgggacaggctc

SEQ ID NO: 5232525 - DNA, 19 bp, Homo sapiens
agtgtgggacaggctcttc

SEQ ID NO: 5232526 - DNA, 20 bp, Homo sapiens
agtgtgggagtgcagagaaa

SEQ ID NO: 5232527 - DNA, 20 bp, Homo sapiens
agtgtgggcgctctccctac

SEQ ID NO: 5232528 - DNA, 16 bp, Homo sapiens
agtgtgggctgccctt

SEQ ID NO: 5232529 - DNA, 15 bp, Homo sapiens
agtgtggggggtcct

SEQ ID NO: 5232530 - DNA, 23 bp, Homo sapiens
agtgtggggtgtgtgcagggctg

SEQ ID NO: 5232531 - DNA, 19 bp, Homo sapiens
agtgtgggtctgtgtgtgt

SEQ ID NO: 5232532 - DNA, 23 bp, Homo sapiens
agtgtgggtctgtgtgtgtgtat

SEQ ID NO: 5232533 - DNA, 19 bp, Homo sapiens
agtgtgggtgatcagaagg

SEQ ID NO: 5232534 - DNA, 21 bp, Homo sapiens
agtgtggtagggacttaaaaa

SEQ ID NO: 5232535 - DNA, 17 bp, Homo sapiens
agtgtggtcccaacagg

SEQ ID NO: 5232536 - DNA, 17 bp, Homo sapiens
agtgtggtgggaggggt

SEQ ID NO: 5232537 - DNA, 16 bp, Homo sapiens
agtgtggtggttattt

SEQ ID NO: 5232538 - DNA, 17 bp, Homo sapiens
agtgtggtgtttcctgg

SEQ ID NO: 5232539 - DNA, 22 bp, Homo sapiens
agtgtggttatgaactttatag

SEQ ID NO: 5232540 - DNA, 22 bp, Homo sapiens
agtgtggtttctttttgaatct

SEQ ID NO: 5232541 - DNA, 12 bp, Homo sapiens
agtgtggttttc

SEQ ID NO: 5232542 - DNA, 17 bp, Homo sapiens
agtgtggttttctgttt

SEQ ID NO: 5232543 - DNA, 16 bp, Homo sapiens
agtgtgtaaaattaat

SEQ ID NO: 5232544 - DNA, 17 bp, Homo sapiens
agtgtgtaaaattaatg

SEQ ID NO: 5232545 - DNA, 22 bp, Homo sapiens
agtgtgtaaaattaatgtaata

SEQ ID NO: 5232546 - DNA, 11 bp, Homo sapiens
agtgtgtaaag

SEQ ID NO: 5232547 - DNA, 22 bp, Homo sapiens
agtgtgtaaataatttgcactg

SEQ ID NO: 5232548 - DNA, 21 bp, Homo sapiens
agtgtgtaaggtatatgtttt

SEQ ID NO: 5232549 - DNA, 13 bp, Homo sapiens
agtgtgtaattat

SEQ ID NO: 5232550 - DNA, 17 bp, Homo sapiens
agtgtgtacttcttcat

SEQ ID NO: 5232551 - DNA, 23 bp, Homo sapiens
agtgtgtatatattttgtgtgaa

SEQ ID NO: 5232552 - DNA, 19 bp, Homo sapiens
agtgtgtatgtgcgtgtgt

SEQ ID NO: 5232553 - DNA, 20 bp, Homo sapiens
agtgtgtatgtgcgtgtgtg

SEQ ID NO: 5232554 - DNA, 11 bp, Homo sapiens
agtgtgtatta

SEQ ID NO: 5232555 - DNA, 15 bp, Homo sapiens
agtgtgtattgttcc

SEQ ID NO: 5232556 - DNA, 19 bp, Homo sapiens
agtgtgtattgttcccagt

SEQ ID NO: 5232557 - DNA, 21 bp, Homo sapiens
agtgtgtattgttcccagtga

SEQ ID NO: 5232558 - DNA, 13 bp, Homo sapiens
agtgtgtcagagc

SEQ ID NO: 5232559 - DNA, 15 bp, Homo sapiens
agtgtgtcagagccc

SEQ ID NO: 5232560 - DNA, 20 bp, Homo sapiens
agtgtgtcagagcccagggg

SEQ ID NO: 5232561 - DNA, 21 bp, Homo sapiens
agtgtgtcagagcccagggga

SEQ ID NO: 5232562 - DNA, 13 bp, Homo sapiens
agtgtgtcagttt

SEQ ID NO: 5232563 - DNA, 17 bp, Homo sapiens
agtgtgtccttggggca

SEQ ID NO: 5232564 - DNA, 11 bp, Homo sapiens
agtgtgtctgc

SEQ ID NO: 5232565 - DNA, 13 bp, Homo sapiens
agtgtgtctgctg

SEQ ID NO: 5232566 - DNA, 16 bp, Homo sapiens
agtgtgtctttataaa

SEQ ID NO: 5232567 - DNA, 20 bp, Homo sapiens
agtgtgtgaaaattcaggtg

SEQ ID NO: 5232568 - DNA, 14 bp, Homo sapiens
agtgtgtgacttac

SEQ ID NO: 5232569 - DNA, 21 bp, Homo sapiens
agtgtgtgattttttgcattc

SEQ ID NO: 5232570 - DNA, 18 bp, Homo sapiens
agtgtgtgcacatgtgtg

SEQ ID NO: 5232571 - DNA, 19 bp, Homo sapiens
agtgtgtgcacatgtgtgc

SEQ ID NO: 5232572 - DNA, 22 bp, Homo sapiens
agtgtgtgcacatgtgtgcgtg

SEQ ID NO: 5232573 - DNA, 19 bp, Homo sapiens
agtgtgtgcataatagcta

SEQ ID NO: 5232574 - DNA, 23 bp, Homo sapiens
agtgtgtgcatgtgtgtgctcag

SEQ ID NO: 5232575 - DNA, 13 bp, Homo sapiens
agtgtgtgccaag

SEQ ID NO: 5232576 - DNA, 15 bp, Homo sapiens
agtgtgtgccaagag

SEQ ID NO: 5232577 - DNA, 14 bp, Homo sapiens
agtgtgtggccccg

SEQ ID NO: 5232578 - DNA, 17 bp, Homo sapiens
agtgtgtggccccgccc

SEQ ID NO: 5232579 - DNA, 21 bp, Homo sapiens
agtgtgtggctttcagagcct

SEQ ID NO: 5232580 - DNA, 17 bp, Homo sapiens
agtgtgtgggcagggtt

SEQ ID NO: 5232581 - DNA, 17 bp, Homo sapiens
agtgtgtgtgcaatgtt

SEQ ID NO: 5232582 - DNA, 18 bp, Homo sapiens
agtgtgtgtgcaatgttc

SEQ ID NO: 5232583 - DNA, 16 bp, Homo sapiens
agtgtgtgtgcatgga

SEQ ID NO: 5232584 - DNA, 16 bp, Homo sapiens
agtgtgtgtgcatgtg

SEQ ID NO: 5232585 - DNA, 12 bp, Homo sapiens
agtgtgtgtgcg

SEQ ID NO: 5232586 - DNA, 20 bp, Homo sapiens
agtgtgtgtggcagcaggca

SEQ ID NO: 5232587 - DNA, 21 bp, Homo sapiens
agtgtgtgtgggtgaaatgga

SEQ ID NO: 5232588 - DNA, 18 bp, Homo sapiens
agtgtgtgtgttctgtag

SEQ ID NO: 5232589 - DNA, 18 bp, Homo sapiens
agtgtgtgtttaacattc

SEQ ID NO: 5232590 - DNA, 16 bp, Homo sapiens
agtgtgttataaaata

SEQ ID NO: 5232591 - DNA, 18 bp, Homo sapiens
agtgtgttataaaataat

SEQ ID NO: 5232592 - DNA, 16 bp, Homo sapiens
agtgtgttctgatgag

SEQ ID NO: 5232593 - DNA, 12 bp, Homo sapiens
agtgtgttgact

SEQ ID NO: 5232594 - DNA, 18 bp, Homo sapiens
agtgtgtttaaataaaca

SEQ ID NO: 5232595 - DNA, 15 bp, Homo sapiens
agtgtgttttcataa

SEQ ID NO: 5232596 - DNA, 18 bp, Homo sapiens
agtgtgttttcataacaa

SEQ ID NO: 5232597 - DNA, 21 bp, Homo sapiens
agtgtgtttttgcactgtctg

SEQ ID NO: 5232598 - DNA, 21 bp, Homo sapiens
agtgttaaaaaatttttgaaa

SEQ ID NO: 5232599 - DNA, 13 bp, Homo sapiens
agtgttaaagtgg

SEQ ID NO: 5232600 - DNA, 15 bp, Homo sapiens
agtgttaaatgtgat

SEQ ID NO: 5232601 - DNA, 15 bp, Homo sapiens
agtgttaagataatt

SEQ ID NO: 5232602 - DNA, 16 bp, Homo sapiens
agtgttaatacatcac

SEQ ID NO: 5232603 - DNA, 17 bp, Homo sapiens
agtgttaatacatcaca

SEQ ID NO: 5232604 - DNA, 19 bp, Homo sapiens
agtgttaatacatcacatc

SEQ ID NO: 5232605 - DNA, 21 bp, Homo sapiens
agtgttaatacatcacatctt

SEQ ID NO: 5232606 - DNA, 19 bp, Homo sapiens
agtgttaatactagttgtg

SEQ ID NO: 5232607 - DNA, 18 bp, Homo sapiens
agtgttaatactgagaaa

SEQ ID NO: 5232608 - DNA, 20 bp, Homo sapiens
agtgttaatcaatttaaacc

SEQ ID NO: 5232609 - DNA, 22 bp, Homo sapiens
agtgttacaatcagtgtgaatg

SEQ ID NO: 5232610 - DNA, 21 bp, Homo sapiens
agtgttacctaacaatgtttt

SEQ ID NO: 5232611 - DNA, 17 bp, Homo sapiens
agtgttacctgtgtgct

SEQ ID NO: 5232612 - DNA, 14 bp, Homo sapiens
agtgttacttgcag

SEQ ID NO: 5232613 - DNA, 17 bp, Homo sapiens
agtgttactttttgtaa

SEQ ID NO: 5232614 - DNA, 17 bp, Homo sapiens
agtgttaggcctggcac

SEQ ID NO: 5232615 - DNA, 20 bp, Homo sapiens
agtgttaggcctggcacagt

SEQ ID NO: 5232616 - DNA, 17 bp, Homo sapiens
agtgttagtgctggtca

SEQ ID NO: 5232617 - DNA, 16 bp, Homo sapiens
agtgttagtgggaaga

SEQ ID NO: 5232618 - DNA, 23 bp, Homo sapiens
agtgttatcatattggtgctgag

SEQ ID NO: 5232619 - DNA, 19 bp, Homo sapiens
agtgttatgcggtctaggg

SEQ ID NO: 5232620 - DNA, 15 bp, Homo sapiens
agtgttatgtatttc

SEQ ID NO: 5232621 - DNA, 22 bp, Homo sapiens
agtgttattagtgtatgctttg

SEQ ID NO: 5232622 - DNA, 17 bp, Homo sapiens
agtgttatttatttctt

SEQ ID NO: 5232623 - DNA, 22 bp, Homo sapiens
agtgttattttctttgaaattg

SEQ ID NO: 5232624 - DNA, 17 bp, Homo sapiens
agtgttcaaaatactac

SEQ ID NO: 5232625 - DNA, 17 bp, Homo sapiens
agtgttcaaattctgat

SEQ ID NO: 5232626 - DNA, 18 bp, Homo sapiens
ataatcaagacaagtgtt

SEQ ID NO: 5232627 - DNA, 16 bp, Homo sapiens
ataatcaagagcctta

SEQ ID NO: 5232628 - DNA, 17 bp, Homo sapiens
ataatcaagagccttaa

SEQ ID NO: 5232629 - DNA, 22 bp, Homo sapiens
ataatcaagagccttaaaacat

SEQ ID NO: 5232630 - DNA, 13 bp, Homo sapiens
ataatcaagattt

SEQ ID NO: 5232631 - DNA, 14 bp, Homo sapiens
ataatcaagatttt

SEQ ID NO: 5232632 - DNA, 17 bp, Homo sapiens
ataatcaagtgcatttc

SEQ ID NO: 5232633 - DNA, 22 bp, Homo sapiens
ataatcactctaattaattgta

SEQ ID NO: 5232634 - DNA, 19 bp, Homo sapiens
ataatcagacaagcttgaa

SEQ ID NO: 5232635 - DNA, 15 bp, Homo sapiens
ataatcagatgctgg

SEQ ID NO: 5232636 - DNA, 15 bp, Homo sapiens
ataatcaggaaaaat

SEQ ID NO: 5232637 - DNA, 15 bp, Homo sapiens
ataatcagtaaatag

SEQ ID NO: 5232638 - DNA, 17 bp, Homo sapiens
ataatcagtgactgaaa

SEQ ID NO: 5232639 - DNA, 23 bp, Homo sapiens
ataatcagtgactgaaaccattt

SEQ ID NO: 5232640 - DNA, 21 bp, Homo sapiens
ataatcatccttttttaaaaa

SEQ ID NO: 5232641 - DNA, 14 bp, Homo sapiens
ataatcatgctcat

SEQ ID NO: 5232642 - DNA, 22 bp, Homo sapiens
ataatcatggctcttagaaact

SEQ ID NO: 5232643 - DNA, 12 bp, Homo sapiens
ataatcattgct

SEQ ID NO: 5232644 - DNA, 13 bp, Homo sapiens
ataatcattgctt

SEQ ID NO: 5232645 - DNA, 20 bp, Homo sapiens
ataatccacccccaggtgca

SEQ ID NO: 5232646 - DNA, 18 bp, Homo sapiens
ataatccattccaaaata

SEQ ID NO: 5232647 - DNA, 15 bp, Homo sapiens
ataatcccagcactt

SEQ ID NO: 5232648 - DNA, 16 bp, Homo sapiens
ataatcccagcacttt

SEQ ID NO: 5232649 - DNA, 21 bp, Homo sapiens
ataatccctggatgatatttt

SEQ ID NO: 5232650 - DNA, 18 bp, Homo sapiens
ataatcctaaacatatga

SEQ ID NO: 5232651 - DNA, 17 bp, Homo sapiens
ataatcctagagtctta

SEQ ID NO: 5232652 - DNA, 15 bp, Homo sapiens
ataatccttctgcaa

SEQ ID NO: 5232653 - DNA, 12 bp, Homo sapiens
ataatctacatc

SEQ ID NO: 5232654 - DNA, 12 bp, Homo sapiens
ataatctagaac

SEQ ID NO: 5232655 - DNA, 14 bp, Homo sapiens
ataatctagtttac

SEQ ID NO: 5232656 - DNA, 14 bp, Homo sapiens
ataatctatttaca

SEQ ID NO: 5232657 - DNA, 15 bp, Homo sapiens
ataatctatttacat

SEQ ID NO: 5232658 - DNA, 13 bp, Homo sapiens
ataatctcaaagg

SEQ ID NO: 5232659 - DNA, 18 bp, Homo sapiens
ataatctccaactttatt

SEQ ID NO: 5232660 - DNA, 14 bp, Homo sapiens
ataatctctgattc

SEQ ID NO: 5232661 - DNA, 19 bp, Homo sapiens
ataatctctgattccctga

SEQ ID NO: 5232662 - DNA, 16 bp, Homo sapiens
ataatctctggaaatt

SEQ ID NO: 5232663 - DNA, 16 bp, Homo sapiens
ataatctgaaatgaca

SEQ ID NO: 5232664 - DNA, 22 bp, Homo sapiens
ataatctgaaatgacaggatat

SEQ ID NO: 5232665 - DNA, 20 bp, Homo sapiens
ataatctgatgggcctggct

SEQ ID NO: 5232666 - DNA, 20 bp, Homo sapiens
ataatctggactcctctgtc

SEQ ID NO: 5232667 - DNA, 20 bp, Homo sapiens
ataatctggtgttcttgcta

SEQ ID NO: 5232668 - DNA, 22 bp, Homo sapiens
ataatctggtgttcttgctaac

SEQ ID NO: 5232669 - DNA, 13 bp, Homo sapiens
ataatctgtcaaa

SEQ ID NO: 5232670 - DNA, 19 bp, Homo sapiens
ataatctgtgagtgaaagt

SEQ ID NO: 5232671 - DNA, 14 bp, Homo sapiens
ataatcttagagac

SEQ ID NO: 5232672 - DNA, 17 bp, Homo sapiens
ataatcttataattgtt

SEQ ID NO: 5232673 - DNA, 23 bp, Homo sapiens
ataatcttattagggagaaaatt

SEQ ID NO: 5232674 - DNA, 15 bp, Homo sapiens
ataatcttcaggtga

SEQ ID NO: 5232675 - DNA, 22 bp, Homo sapiens
ataatcttggcttcttaaaaac

SEQ ID NO: 5232676 - DNA, 12 bp, Homo sapiens
ataatctttcta

SEQ ID NO: 5232677 - DNA, 14 bp, Homo sapiens
ataatctttctata

SEQ ID NO: 5232678 - DNA, 17 bp, Homo sapiens
ataatgaaaatattttt

SEQ ID NO: 5232679 - DNA, 16 bp, Homo sapiens
ataatgaaatctgttt

SEQ ID NO: 5232680 - DNA, 16 bp, Homo sapiens
ataatgaacaaaatta

SEQ ID NO: 5232681 - DNA, 14 bp, Homo sapiens
ataatgaacaattg

SEQ ID NO: 5232682 - DNA, 17 bp, Homo sapiens
ataatgaacagaacata

SEQ ID NO: 5232683 - DNA, 18 bp, Homo sapiens
ataatgaacagaatttat

SEQ ID NO: 5232684 - DNA, 20 bp, Homo sapiens
ataatgaacagcagaaagac

SEQ ID NO: 5232685 - DNA, 19 bp, Homo sapiens
ataatgaaccgtttacagt

SEQ ID NO: 5232686 - DNA, 18 bp, Homo sapiens
ataatgaagaatggccat

SEQ ID NO: 5232687 - DNA, 14 bp, Homo sapiens
ataatgaagacata

SEQ ID NO: 5232688 - DNA, 14 bp, Homo sapiens
ataatgaagatctt

SEQ ID NO: 5232689 - DNA, 14 bp, Homo sapiens
ataatgaagattaa

SEQ ID NO: 5232690 - DNA, 16 bp, Homo sapiens
ataatgaataaactga

SEQ ID NO: 5232691 - DNA, 18 bp, Homo sapiens
ataatgaataaactgaat

SEQ ID NO: 5232692 - DNA, 12 bp, Homo sapiens
ataatgaataat

SEQ ID NO: 5232693 - DNA, 15 bp, Homo sapiens
ataatgaatgaaaca

SEQ ID NO: 5232694 - DNA, 12 bp, Homo sapiens
ataatgaatgag

SEQ ID NO: 5232695 - DNA, 23 bp, Homo sapiens
ataatgactgccctgtttctgtt

SEQ ID NO: 5232696 - DNA, 14 bp, Homo sapiens
ataatgagagcaaa

SEQ ID NO: 5232697 - DNA, 20 bp, Homo sapiens
ataatgagagcaaatgcaaa

SEQ ID NO: 5232698 - DNA, 15 bp, Homo sapiens
ataatgagctattaa

SEQ ID NO: 5232699 - DNA, 19 bp, Homo sapiens
ataatgaggcaactcagca

SEQ ID NO: 5232700 - DNA, 22 bp, Homo sapiens
ataatgagtaatgcagacattt

SEQ ID NO: 5232701 - DNA, 15 bp, Homo sapiens
ataatgataaaataa

SEQ ID NO: 5232702 - DNA, 15 bp, Homo sapiens
ataatgatactgaat

SEQ ID NO: 5232703 - DNA, 17 bp, Homo sapiens
ataatgatctaagaagc

SEQ ID NO: 5232704 - DNA, 16 bp, Homo sapiens
ataatgatgatgatga

SEQ ID NO: 5232705 - DNA, 22 bp, Homo sapiens
ataatgatggatttaacagcat

SEQ ID NO: 5232706 - DNA, 20 bp, Homo sapiens
ataatgattaggagagctgt

SEQ ID NO: 5232707 - DNA, 14 bp, Homo sapiens
ataatgattcataa

SEQ ID NO: 5232708 - DNA, 13 bp, Homo sapiens
ataatgatttcct

SEQ ID NO: 5232709 - DNA, 16 bp, Homo sapiens
ataatgatttcctctg

SEQ ID NO: 5232710 - DNA, 15 bp, Homo sapiens
ataatgcaaatgtca

SEQ ID NO: 5232711 - DNA, 16 bp, Homo sapiens
ataatgcaacaatgtg

SEQ ID NO: 5232712 - DNA, 17 bp, Homo sapiens
ataatgcaatcaaaaat

SEQ ID NO: 5232713 - DNA, 16 bp, Homo sapiens
ataatgcactgagtat

SEQ ID NO: 5232714 - DNA, 21 bp, Homo sapiens
ataatgcactggggtaccaca

SEQ ID NO: 5232715 - DNA, 22 bp, Homo sapiens
ataatgcactggggtaccacat

SEQ ID NO: 5232716 - DNA, 14 bp, Homo sapiens
ataatgcagtatgg

SEQ ID NO: 5232717 - DNA, 22 bp, Homo sapiens
ataatgcagttgtggtgtgcca

SEQ ID NO: 5232718 - DNA, 19 bp, Homo sapiens
ataatgcatatttttgcac

SEQ ID NO: 5232719 - DNA, 20 bp, Homo sapiens
ataatgccaagggtaaacaa

SEQ ID NO: 5232720 - DNA, 20 bp, Homo sapiens
ataatgccaatgaacatctc

SEQ ID NO: 5232721 - DNA, 12 bp, Homo sapiens
ataatgccactg

SEQ ID NO: 5232722 - DNA, 15 bp, Homo sapiens
ataatgccagaatat

SEQ ID NO: 5232723 - DNA, 16 bp, Homo sapiens
ataatgcccttaatgt

SEQ ID NO: 5232724 - DNA, 18 bp, Homo sapiens
ataatgccggtgagaata

SEQ ID NO: 5232725 - DNA, 17 bp, Homo sapiens
ataatgcctaccttgtg

SEQ ID NO: 5232726 - DNA, 21 bp, Homo sapiens
ataatgctaatttaaagagac

SEQ ID NO: 5232727 - DNA, 20 bp, Homo sapiens
ataatgctacaattttaaga

SEQ ID NO: 5232728 - DNA, 15 bp, Homo sapiens
ataatgctactgtct

SEQ ID NO: 5232729 - DNA, 17 bp, Homo sapiens
ataatgcttaacataaa

SEQ ID NO: 5232730 - DNA, 15 bp, Homo sapiens
ataatgcttcagata

SEQ ID NO: 5232731 - DNA, 15 bp, Homo sapiens
ataatgctttggaaa

SEQ ID NO: 5232732 - DNA, 18 bp, Homo sapiens
ataatgcttttactaagc

SEQ ID NO: 5232733 - DNA, 21 bp, Homo sapiens
ataatgcttttctaattaata

SEQ ID NO: 5232734 - DNA, 23 bp, Homo sapiens
ataatggaaaaaaaaaaaagagg

SEQ ID NO: 5232735 - DNA, 14 bp, Homo sapiens
ataatggaaacatt

SEQ ID NO: 5232736 - DNA, 21 bp, Homo sapiens
ataatggaaacattacagttc

SEQ ID NO: 5232737 - DNA, 18 bp, Homo sapiens
ataatggaactctttttt

SEQ ID NO: 5232738 - DNA, 17 bp, Homo sapiens
ataatggaatctatatt

SEQ ID NO: 5232739 - DNA, 17 bp, Homo sapiens
ataatggcctcttaaaa

SEQ ID NO: 5232740 - DNA, 19 bp, Homo sapiens
ataatggcctggtaggtct

SEQ ID NO: 5232741 - DNA, 18 bp, Homo sapiens
ataatgggaaaggttgaa

SEQ ID NO: 5232742 - DNA, 23 bp, Homo sapiens
ataatgggattagaaacaaacaa

SEQ ID NO: 5232743 - DNA, 21 bp, Homo sapiens
ataatgggattttcttttctt

SEQ ID NO: 5232744 - DNA, 17 bp, Homo sapiens
ataatgggccactgaaa

SEQ ID NO: 5232745 - DNA, 21 bp, Homo sapiens
ataatgggccactgaaatctg

SEQ ID NO: 5232746 - DNA, 18 bp, Homo sapiens
ataatggggcagacacaa

SEQ ID NO: 5232747 - DNA, 17 bp, Homo sapiens
ataatgggtttctttca

SEQ ID NO: 5232748 - DNA, 15 bp, Homo sapiens
ataatggtaaatctt

SEQ ID NO: 5232749 - DNA, 15 bp, Homo sapiens
ataatggtaatagaa

SEQ ID NO: 5232750 - DNA, 12 bp, Homo sapiens
ataatggtaatt

SEQ ID NO: 5232751 - DNA, 13 bp, Homo sapiens
ataatggtaattt

SEQ ID NO: 5232752 - DNA, 23 bp, Homo sapiens
ataatggtaatttagtgtatatg

SEQ ID NO: 5232753 - DNA, 17 bp, Homo sapiens
ataatggtaccagataa

SEQ ID NO: 5232754 - DNA, 20 bp, Homo sapiens
ataatggtactcccaaactg

SEQ ID NO: 5232755 - DNA, 23 bp, Homo sapiens
ataatggtactcccaaactgaca

SEQ ID NO: 5232756 - DNA, 13 bp, Homo sapiens
ataatggtcagag

SEQ ID NO: 5232757 - DNA, 17 bp, Homo sapiens
ataatggtcccatccag

SEQ ID NO: 5232758 - DNA, 17 bp, Homo sapiens
ataatggtgaatgttca

SEQ ID NO: 5232759 - DNA, 19 bp, Homo sapiens
ataatggttactcatttta

SEQ ID NO: 5232760 - DNA, 15 bp, Homo sapiens
ataatggttgtgaaa

SEQ ID NO: 5232761 - DNA, 23 bp, Homo sapiens
ataatggttgtgaaatgtaacat

SEQ ID NO: 5232762 - DNA, 19 bp, Homo sapiens
ataatggtttactgctgtc

SEQ ID NO: 5232763 - DNA, 20 bp, Homo sapiens
ataatggtttactgctgtca

SEQ ID NO: 5232764 - DNA, 19 bp, Homo sapiens
ataatgtaaacaatatcag

SEQ ID NO: 5232765 - DNA, 14 bp, Homo sapiens
ataatgtaacatga

SEQ ID NO: 5232766 - DNA, 14 bp, Homo sapiens
ataatgtaactgaa

SEQ ID NO: 5232767 - DNA, 15 bp, Homo sapiens
ataatgtaatactgt

SEQ ID NO: 5232768 - DNA, 17 bp, Homo sapiens
ataatgtaatactgtag

SEQ ID NO: 5232769 - DNA, 20 bp, Homo sapiens
ataatgtaatactgtagaaa

SEQ ID NO: 5232770 - DNA, 14 bp, Homo sapiens
ataatgtactcaca

SEQ ID NO: 5232771 - DNA, 19 bp, Homo sapiens
ataatgtagtatgatgtaa

SEQ ID NO: 5232772 - DNA, 22 bp, Homo sapiens
ataatgtataaagaacaaggta

SEQ ID NO: 5232773 - DNA, 16 bp, Homo sapiens
ataatgtatataaagt

SEQ ID NO: 5232774 - DNA, 15 bp, Homo sapiens
ataatgtatgtacag

SEQ ID NO: 5232775 - DNA, 18 bp, Homo sapiens
ataatgtattcatatttg

SEQ ID NO: 5232776 - DNA, 19 bp, Homo sapiens
ataatgtattcatatttgt

SEQ ID NO: 5232777 - DNA, 16 bp, Homo sapiens
ataatgtcaaaatcat

SEQ ID NO: 5232778 - DNA, 14 bp, Homo sapiens
ataatgtcaaatga

SEQ ID NO: 5232779 - DNA, 16 bp, Homo sapiens
ataatgtcaaatgaaa

SEQ ID NO: 5232780 - DNA, 14 bp, Homo sapiens
ataatgtccccact

SEQ ID NO: 5232781 - DNA, 16 bp, Homo sapiens
ataatgtccccactcc

SEQ ID NO: 5232782 - DNA, 17 bp, Homo sapiens
ataatgtccccactccc

SEQ ID NO: 5232783 - DNA, 18 bp, Homo sapiens
ataatgtcctttccctgg

SEQ ID NO: 5232784 - DNA, 15 bp, Homo sapiens
ataatgtctagattt

SEQ ID NO: 5232785 - DNA, 20 bp, Homo sapiens
ataatgtctagattttgaaa

SEQ ID NO: 5232786 - DNA, 23 bp, Homo sapiens
ataatgtctagattttgaaaaat

SEQ ID NO: 5232787 - DNA, 15 bp, Homo sapiens
ataatgtctctgtga

SEQ ID NO: 5232788 - DNA, 19 bp, Homo sapiens
ataatgtcttgttaatatt

SEQ ID NO: 5232789 - DNA, 13 bp, Homo sapiens
ataatgtgaaaat

SEQ ID NO: 5232790 - DNA, 19 bp, Homo sapiens
ataatgtgaaactggatta

SEQ ID NO: 5232791 - DNA, 16 bp, Homo sapiens
ataatgtgaagtgtta

SEQ ID NO: 5232792 - DNA, 12 bp, Homo sapiens
ataatgtgattt

SEQ ID NO: 5232793 - DNA, 20 bp, Homo sapiens
ataatgtgcaaattttgcat

SEQ ID NO: 5232794 - DNA, 12 bp, Homo sapiens
ataatgtgcctg

SEQ ID NO: 5232795 - DNA, 22 bp, Homo sapiens
ataatgtgcctggctctgattc

SEQ ID NO: 5232796 - DNA, 23 bp, Homo sapiens
ataatgtggatttcctattttaa

SEQ ID NO: 5232797 - DNA, 17 bp, Homo sapiens
ataatgtgggaagaaac

SEQ ID NO: 5232798 - DNA, 14 bp, Homo sapiens
ataatgtgtctgtg

SEQ ID NO: 5232799 - DNA, 15 bp, Homo sapiens
ataatgtgtctgtgt

SEQ ID NO: 5232800 - DNA, 20 bp, Homo sapiens
ataatgtgtgctttattgaa

SEQ ID NO: 5232801 - DNA, 12 bp, Homo sapiens
ataatgtgtgta

SEQ ID NO: 5232802 - DNA, 15 bp, Homo sapiens
ataatgtgtgtatgt

SEQ ID NO: 5232803 - DNA, 12 bp, Homo sapiens
ataatgttaaat

SEQ ID NO: 5232804 - DNA, 16 bp, Homo sapiens
ataatgttaaatttgt

SEQ ID NO: 5232805 - DNA, 18 bp, Homo sapiens
ataatgttaaatttgtaa

SEQ ID NO: 5232806 - DNA, 15 bp, Homo sapiens
agtgttcacaaactg

SEQ ID NO: 5232807 - DNA, 18 bp, Homo sapiens
agtgttcacaaactgtga

SEQ ID NO: 5232808 - DNA, 23 bp, Homo sapiens
agtgttcacatggctctcatgta

SEQ ID NO: 5232809 - DNA, 15 bp, Homo sapiens
agtgttcagaattca

SEQ ID NO: 5232810 - DNA, 19 bp, Homo sapiens
agtgttcagtgttgacata

SEQ ID NO: 5232811 - DNA, 16 bp, Homo sapiens
agtgttcattgcacaa

SEQ ID NO: 5232812 - DNA, 21 bp, Homo sapiens
agtgttcccaaagtgaactct

SEQ ID NO: 5232813 - DNA, 21 bp, Homo sapiens
agtgttccccttccactgagg

SEQ ID NO: 5232814 - DNA, 17 bp, Homo sapiens
agtgttcccgtgcctgg

SEQ ID NO: 5232815 - DNA, 18 bp, Homo sapiens
agtgttcccgtgcctggg

SEQ ID NO: 5232816 - DNA, 19 bp, Homo sapiens
agtgttcccgtgcctggga

SEQ ID NO: 5232817 - DNA, 15 bp, Homo sapiens
agtgttccctatcca

SEQ ID NO: 5232818 - DNA, 23 bp, Homo sapiens
agtgttccgaagatgctgtagta

SEQ ID NO: 5232819 - DNA, 15 bp, Homo sapiens
agtgttcctgaagct

SEQ ID NO: 5232820 - DNA, 15 bp, Homo sapiens
agtgttcctgtctca

SEQ ID NO: 5232821 - DNA, 16 bp, Homo sapiens
agtgttcctgtctcaa

SEQ ID NO: 5232822 - DNA, 17 bp, Homo sapiens
agtgttccttgtgcccg

SEQ ID NO: 5232823 - DNA, 19 bp, Homo sapiens
agtgttcctttttaaatgt

SEQ ID NO: 5232824 - DNA, 21 bp, Homo sapiens
agtgttcctttttaaatgtga

SEQ ID NO: 5232825 - DNA, 16 bp, Homo sapiens
agtgttctaaaatgaa

SEQ ID NO: 5232826 - DNA, 21 bp, Homo sapiens
agtgttctagattatgtcttt

SEQ ID NO: 5232827 - DNA, 15 bp, Homo sapiens
agtgttctctctgaa

SEQ ID NO: 5232828 - DNA, 15 bp, Homo sapiens
agtgttctgcatgga

SEQ ID NO: 5232829 - DNA, 23 bp, Homo sapiens
agtgttctgcatggattcagcat

SEQ ID NO: 5232830 - DNA, 18 bp, Homo sapiens
agtgttctgccagatctt

SEQ ID NO: 5232831 - DNA, 22 bp, Homo sapiens
agtgttctgctcctgcttttct

SEQ ID NO: 5232832 - DNA, 12 bp, Homo sapiens
agtgttctgtat

SEQ ID NO: 5232833 - DNA, 13 bp, Homo sapiens
agtgttctgtcta

SEQ ID NO: 5232834 - DNA, 16 bp, Homo sapiens
agtgttctgtgaatag

SEQ ID NO: 5232835 - DNA, 12 bp, Homo sapiens
agtgttctgtgc

SEQ ID NO: 5232836 - DNA, 17 bp, Homo sapiens
agtgttctgtgggcttg

SEQ ID NO: 5232837 - DNA, 17 bp, Homo sapiens
agtgttctgttacaaaa

SEQ ID NO: 5232838 - DNA, 18 bp, Homo sapiens
agtgttctgttacaaaat

SEQ ID NO: 5232839 - DNA, 17 bp, Homo sapiens
agtgttctgttcacttt

SEQ ID NO: 5232840 - DNA, 21 bp, Homo sapiens
agtgttcttaggtttactgtg

SEQ ID NO: 5232841 - DNA, 15 bp, Homo sapiens
agtgttcttcagtgt

SEQ ID NO: 5232842 - DNA, 17 bp, Homo sapiens
agtgttgaaaatgttca

SEQ ID NO: 5232843 - DNA, 23 bp, Homo sapiens
agtgttgaaattggaaaggactt

SEQ ID NO: 5232844 - DNA, 21 bp, Homo sapiens
agtgttgaagaagagtttgca

SEQ ID NO: 5232845 - DNA, 19 bp, Homo sapiens
agtgttgaattttattgaa

SEQ ID NO: 5232846 - DNA, 16 bp, Homo sapiens
agtgttgacatagcct

SEQ ID NO: 5232847 - DNA, 17 bp, Homo sapiens
agtgttgagacccaggc

SEQ ID NO: 5232848 - DNA, 20 bp, Homo sapiens
agtgttgagcatctgtcccc

SEQ ID NO: 5232849 - DNA, 17 bp, Homo sapiens
agtgttgagccttttcc

SEQ ID NO: 5232850 - DNA, 14 bp, Homo sapiens
agtgttgaggaggg

SEQ ID NO: 5232851 - DNA, 17 bp, Homo sapiens
agtgttgaggaggggag

SEQ ID NO: 5232852 - DNA, 18 bp, Homo sapiens
agtgttgaggaggggagc

SEQ ID NO: 5232853 - DNA, 18 bp, Homo sapiens
agtgttgcatatgagcct

SEQ ID NO: 5232854 - DNA, 16 bp, Homo sapiens
agtgttgcatggatgt

SEQ ID NO: 5232855 - DNA, 13 bp, Homo sapiens
agtgttgcctaag

SEQ ID NO: 5232856 - DNA, 15 bp, Homo sapiens
agtgttgcctcctcc

SEQ ID NO: 5232857 - DNA, 17 bp, Homo sapiens
agtgttgcctcctccca

SEQ ID NO: 5232858 - DNA, 19 bp, Homo sapiens
agtgttgcctcttgcaatg

SEQ ID NO: 5232859 - DNA, 18 bp, Homo sapiens
agtgttgcgtttttcctt

SEQ ID NO: 5232860 - DNA, 19 bp, Homo sapiens
agtgttgcgtttttccttg

SEQ ID NO: 5232861 - DNA, 17 bp, Homo sapiens
agtgttgctcagctcct

SEQ ID NO: 5232862 - DNA, 15 bp, Homo sapiens
agtgttgctgtggct

SEQ ID NO: 5232863 - DNA, 16 bp, Homo sapiens
agtgttggagaagaac

SEQ ID NO: 5232864 - DNA, 14 bp, Homo sapiens
agtgttggctgtgt

SEQ ID NO: 5232865 - DNA, 15 bp, Homo sapiens
agtgttggggctggg

SEQ ID NO: 5232866 - DNA, 13 bp, Homo sapiens
agtgttgtacaat

SEQ ID NO: 5232867 - DNA, 19 bp, Homo sapiens
agtgttgtaccatatgtag

SEQ ID NO: 5232868 - DNA, 22 bp, Homo sapiens
agtgttgtaccatatgtagcat

SEQ ID NO: 5232869 - DNA, 20 bp, Homo sapiens
agtgttgtgccccttcactc

SEQ ID NO: 5232870 - DNA, 15 bp, Homo sapiens
agtgttgtggagaaa

SEQ ID NO: 5232871 - DNA, 17 bp, Homo sapiens
agtgttgtgggcttcct

SEQ ID NO: 5232872 - DNA, 15 bp, Homo sapiens
agtgttgtgttcctg

SEQ ID NO: 5232873 - DNA, 17 bp, Homo sapiens
agtgttgttcattatac

SEQ ID NO: 5232874 - DNA, 14 bp, Homo sapiens
agtgtttaaaactt

SEQ ID NO: 5232875 - DNA, 14 bp, Homo sapiens
agtgtttaaatgct

SEQ ID NO: 5232876 - DNA, 17 bp, Homo sapiens
agtgtttaacttgtcaa

SEQ ID NO: 5232877 - DNA, 16 bp, Homo sapiens
agtgtttaattgtata

SEQ ID NO: 5232878 - DNA, 22 bp, Homo sapiens
agtgtttaattgtataaaacag

SEQ ID NO: 5232879 - DNA, 16 bp, Homo sapiens
agtgtttagaagagcc

SEQ ID NO: 5232880 - DNA, 20 bp, Homo sapiens
agtgtttatcctttcatata

SEQ ID NO: 5232881 - DNA, 16 bp, Homo sapiens
agtgtttatgtaatag

SEQ ID NO: 5232882 - DNA, 19 bp, Homo sapiens
agtgtttatttttcatatt

SEQ ID NO: 5232883 - DNA, 22 bp, Homo sapiens
agtgtttatttttcatattgtg

SEQ ID NO: 5232884 - DNA, 22 bp, Homo sapiens
agtgtttcaaaggtatgtagtt

SEQ ID NO: 5232885 - DNA, 19 bp, Homo sapiens
agtgtttcagattttttaa

SEQ ID NO: 5232886 - DNA, 20 bp, Homo sapiens
agtgtttcagattttttaaa

SEQ ID NO: 5232887 - DNA, 14 bp, Homo sapiens
agtgtttcatgggt

SEQ ID NO: 5232888 - DNA, 23 bp, Homo sapiens
agtgtttccagtgacacaactca

SEQ ID NO: 5232889 - DNA, 19 bp, Homo sapiens
agtgtttcgacagctgatt

SEQ ID NO: 5232890 - DNA, 21 bp, Homo sapiens
agtgtttcgcgggtaactggg

SEQ ID NO: 5232891 - DNA, 19 bp, Homo sapiens
agtgtttcgttaagcagta

SEQ ID NO: 5232892 - DNA, 21 bp, Homo sapiens
agtgtttctaataaacttgga

SEQ ID NO: 5232893 - DNA, 13 bp, Homo sapiens
agtgtttctatga

SEQ ID NO: 5232894 - DNA, 14 bp, Homo sapiens
agtgtttctcaaaa

SEQ ID NO: 5232895 - DNA, 15 bp, Homo sapiens
agtgtttctgaatgt

SEQ ID NO: 5232896 - DNA, 16 bp, Homo sapiens
agtgtttctgcagagg

SEQ ID NO: 5232897 - DNA, 18 bp, Homo sapiens
agtgtttctgcagaggca

SEQ ID NO: 5232898 - DNA, 17 bp, Homo sapiens
agtgtttctgtgcatgg

SEQ ID NO: 5232899 - DNA, 14 bp, Homo sapiens
agtgtttctgttct

SEQ ID NO: 5232900 - DNA, 14 bp, Homo sapiens
agtgtttcttttaa

SEQ ID NO: 5232901 - DNA, 12 bp, Homo sapiens
agtgtttgaaaa

SEQ ID NO: 5232902 - DNA, 14 bp, Homo sapiens
agtgtttgaaaaag

SEQ ID NO: 5232903 - DNA, 15 bp, Homo sapiens
agtgtttgccctttg

SEQ ID NO: 5232904 - DNA, 12 bp, Homo sapiens
agtgtttgctgc

SEQ ID NO: 5232905 - DNA, 16 bp, Homo sapiens
agtgtttggacagctg

SEQ ID NO: 5232906 - DNA, 20 bp, Homo sapiens
agtgtttggtgctcatttaa

SEQ ID NO: 5232907 - DNA, 18 bp, Homo sapiens
agtgtttggtgtattatc

SEQ ID NO: 5232908 - DNA, 20 bp, Homo sapiens
agtgtttgtgagctttttgt

SEQ ID NO: 5232909 - DNA, 13 bp, Homo sapiens
agtgtttgtggga

SEQ ID NO: 5232910 - DNA, 15 bp, Homo sapiens
agtgttttaaattct

SEQ ID NO: 5232911 - DNA, 19 bp, Homo sapiens
agtgttttaagaaatgtag

SEQ ID NO: 5232912 - DNA, 20 bp, Homo sapiens
agtgttttaagataaattat

SEQ ID NO: 5232913 - DNA, 19 bp, Homo sapiens
agtgttttacaatgatttg

SEQ ID NO: 5232914 - DNA, 13 bp, Homo sapiens
agtgttttactct

SEQ ID NO: 5232915 - DNA, 16 bp, Homo sapiens
agtgttttagatgtta

SEQ ID NO: 5232916 - DNA, 18 bp, Homo sapiens
agtgttttagatgttact

SEQ ID NO: 5232917 - DNA, 23 bp, Homo sapiens
agtgttttagtctagttattgga

SEQ ID NO: 5232918 - DNA, 16 bp, Homo sapiens
agtgttttattttcaa

SEQ ID NO: 5232919 - DNA, 17 bp, Homo sapiens
agtgttttcacctcata

SEQ ID NO: 5232920 - DNA, 14 bp, Homo sapiens
agtgttttcagagc

SEQ ID NO: 5232921 - DNA, 23 bp, Homo sapiens
agtgttttcattctggtccttag

SEQ ID NO: 5232922 - DNA, 16 bp, Homo sapiens
agtgttttctcagaac

SEQ ID NO: 5232923 - DNA, 13 bp, Homo sapiens
agtgttttctggg

SEQ ID NO: 5232924 - DNA, 16 bp, Homo sapiens
agtgttttctttgagg

SEQ ID NO: 5232925 - DNA, 15 bp, Homo sapiens
agtgttttggactcc

SEQ ID NO: 5232926 - DNA, 18 bp, Homo sapiens
agtgttttggactccatc

SEQ ID NO: 5232927 - DNA, 21 bp, Homo sapiens
agtgttttggagaaaaaaatc

SEQ ID NO: 5232928 - DNA, 22 bp, Homo sapiens
agtgttttggtggaaaaaacat

SEQ ID NO: 5232929 - DNA, 23 bp, Homo sapiens
agtgttttgtaccagtgaatttt

SEQ ID NO: 5232930 - DNA, 19 bp, Homo sapiens
agtgttttgttttttaatt

SEQ ID NO: 5232931 - DNA, 21 bp, Homo sapiens
agtgtttttcatggaaaagcc

SEQ ID NO: 5232932 - DNA, 22 bp, Homo sapiens
agtgtttttcctgtgtattaaa

SEQ ID NO: 5232933 - DNA, 15 bp, Homo sapiens
agttaaaaaaaataa

SEQ ID NO: 5232934 - DNA, 18 bp, Homo sapiens
agttaaaaaaaataataa

SEQ ID NO: 5232935 - DNA, 19 bp, Homo sapiens
agttaaaaattaaatattt

SEQ ID NO: 5232936 - DNA, 21 bp, Homo sapiens
agttaaaaattaaatatttat

SEQ ID NO: 5232937 - DNA, 17 bp, Homo sapiens
agttaaaacaaaggaac

SEQ ID NO: 5232938 - DNA, 18 bp, Homo sapiens
agttaaaacaaaggaact

SEQ ID NO: 5232939 - DNA, 17 bp, Homo sapiens
agttaaaacaatgaagt

SEQ ID NO: 5232940 - DNA, 22 bp, Homo sapiens
agttaaaacagctattttagta

SEQ ID NO: 5232941 - DNA, 21 bp, Homo sapiens
agttaaaactggatggaaata

SEQ ID NO: 5232942 - DNA, 18 bp, Homo sapiens
agttaaaagcacaaagga

SEQ ID NO: 5232943 - DNA, 13 bp, Homo sapiens
agttaaaagttag

SEQ ID NO: 5232944 - DNA, 19 bp, Homo sapiens
agttaaaatatatatagtt

SEQ ID NO: 5232945 - DNA, 10 bp, Homo sapiens
agttaaaatg

SEQ ID NO: 5232946 - DNA, 19 bp, Homo sapiens
agttaaaatgtttactgta

SEQ ID NO: 5232947 - DNA, 20 bp, Homo sapiens
agttaaaatgtttactgtaa

SEQ ID NO: 5232948 - DNA, 14 bp, Homo sapiens
agttaaacataaat

SEQ ID NO: 5232949 - DNA, 15 bp, Homo sapiens
agttaaactaaaaaa

SEQ ID NO: 5232950 - DNA, 16 bp, Homo sapiens
agttaaactaaaaaaa

SEQ ID NO: 5232951 - DNA, 19 bp, Homo sapiens
agttaaactaccacttttt

SEQ ID NO: 5232952 - DNA, 14 bp, Homo sapiens
agttaaactgagag

SEQ ID NO: 5232953 - DNA, 14 bp, Homo sapiens
agttaaactgatta

SEQ ID NO: 5232954 - DNA, 20 bp, Homo sapiens
agttaaactgtattttatgt

SEQ ID NO: 5232955 - DNA, 15 bp, Homo sapiens
agttaaactgtgaag

SEQ ID NO: 5232956 - DNA, 16 bp, Homo sapiens
agttaaagaaaggaaa

SEQ ID NO: 5232957 - DNA, 13 bp, Homo sapiens
agttaaagcagtg

SEQ ID NO: 5232958 - DNA, 13 bp, Homo sapiens
agttaaaggcagt

SEQ ID NO: 5232959 - DNA, 20 bp, Homo sapiens
agttaaaggcagtccagagc

SEQ ID NO: 5232960 - DNA, 21 bp, Homo sapiens
agttaaaggcagtccagagct

SEQ ID NO: 5232961 - DNA, 17 bp, Homo sapiens
agttaaagggaagaaaa

SEQ ID NO: 5232962 - DNA, 23 bp, Homo sapiens
agttaaagggaagaaaacactgt

SEQ ID NO: 5232963 - DNA, 12 bp, Homo sapiens
agttaaagtcaa

SEQ ID NO: 5232964 - DNA, 23 bp, Homo sapiens
agttaaatagagtatatgcactt

SEQ ID NO: 5232965 - DNA, 12 bp, Homo sapiens
agttaaatatga

SEQ ID NO: 5232966 - DNA, 13 bp, Homo sapiens
agttaaatatgat

SEQ ID NO: 5232967 - DNA, 14 bp, Homo sapiens
agttaaatatgatt

SEQ ID NO: 5232968 - DNA, 22 bp, Homo sapiens
agttaaatatgatttgcatttt

SEQ ID NO: 5232969 - DNA, 13 bp, Homo sapiens
agttaaatatgta

SEQ ID NO: 5232970 - DNA, 14 bp, Homo sapiens
agttaaatctcaaa

SEQ ID NO: 5232971 - DNA, 12 bp, Homo sapiens
agttaaatgtat

SEQ ID NO: 5232972 - DNA, 23 bp, Homo sapiens
agttaaatgtgtgtaaaaaagtg

SEQ ID NO: 5232973 - DNA, 18 bp, Homo sapiens
agttaaatgttacctctg

SEQ ID NO: 5232974 - DNA, 17 bp, Homo sapiens
agttaacaatgatatat

SEQ ID NO: 5232975 - DNA, 16 bp, Homo sapiens
agttaacacactaccg

SEQ ID NO: 5232976 - DNA, 19 bp, Homo sapiens
agttaacaggatattagac

SEQ ID NO: 5232977 - DNA, 21 bp, Homo sapiens
agttaacatcatgaatttatt

SEQ ID NO: 5232978 - DNA, 21 bp, Homo sapiens
agttaaccaatcgcaaagcaa

SEQ ID NO: 5232979 - DNA, 17 bp, Homo sapiens
agttaacgggtgaataa

SEQ ID NO: 5232980 - DNA, 22 bp, Homo sapiens
agttaacgtcacccaaaagcac

SEQ ID NO: 5232981 - DNA, 15 bp, Homo sapiens
agttaactattgcat

SEQ ID NO: 5232982 - DNA, 16 bp, Homo sapiens
agttaactattttatt

SEQ ID NO: 5232983 - DNA, 13 bp, Homo sapiens
agttaactgttcc

SEQ ID NO: 5232984 - DNA, 17 bp, Homo sapiens
agttaactgttcccctt

SEQ ID NO: 5232985 - DNA, 12 bp, Homo sapiens
ataatgttaaca

SEQ ID NO: 5232986 - DNA, 17 bp, Homo sapiens
ataatgttcattttgaa

SEQ ID NO: 5232987 - DNA, 23 bp, Homo sapiens
ataatgttctccactgacacaaa

SEQ ID NO: 5232988 - DNA, 11 bp, Homo sapiens
ataatgttctt

SEQ ID NO: 5232989 - DNA, 16 bp, Homo sapiens
ataatgttctttaatg

SEQ ID NO: 5232990 - DNA, 21 bp, Homo sapiens
ataatgttctttaatgttgtc

SEQ ID NO: 5232991 - DNA, 13 bp, Homo sapiens
ataatgttgcctt

SEQ ID NO: 5232992 - DNA, 20 bp, Homo sapiens
ataatgttgccttggaaaca

SEQ ID NO: 5232993 - DNA, 21 bp, Homo sapiens
ataatgttgccttggaaacat

SEQ ID NO: 5232994 - DNA, 13 bp, Homo sapiens
ataatgtttaaat

SEQ ID NO: 5232995 - DNA, 18 bp, Homo sapiens
ataatgtttaaatagcat

SEQ ID NO: 5232996 - DNA, 22 bp, Homo sapiens
ataatgtttaaatcatgtatgt

SEQ ID NO: 5232997 - DNA, 18 bp, Homo sapiens
ataatgtttcaaacatat

SEQ ID NO: 5232998 - DNA, 23 bp, Homo sapiens
ataatgtttcaaacatatataac

SEQ ID NO: 5232999 - DNA, 23 bp, Homo sapiens
ataatgtttccctcaagaacaaa

SEQ ID NO: 5233000 - DNA, 14 bp, Homo sapiens
ataatgtttttcct

SEQ ID NO: 5233001 - DNA, 19 bp, Homo sapiens
ataatgtttttcctttctt

SEQ ID NO: 5233002 - DNA, 15 bp, Homo sapiens
ataattaaaaaccac

SEQ ID NO: 5233003 - DNA, 13 bp, Homo sapiens
ataattaaaacaa

SEQ ID NO: 5233004 - DNA, 21 bp, Homo sapiens
ataattaaaacaaaatccttg

SEQ ID NO: 5233005 - DNA, 20 bp, Homo sapiens
ataattaaaatttatcttaa

SEQ ID NO: 5233006 - DNA, 17 bp, Homo sapiens
ataattaaagaaaattg

SEQ ID NO: 5233007 - DNA, 13 bp, Homo sapiens
ataattaaagatg

SEQ ID NO: 5233008 - DNA, 18 bp, Homo sapiens
ataattaaagatgccata

SEQ ID NO: 5233009 - DNA, 19 bp, Homo sapiens
ataattaaagatgccatag

SEQ ID NO: 5233010 - DNA, 22 bp, Homo sapiens
ataattaaagcttaaactgaat

SEQ ID NO: 5233011 - DNA, 16 bp, Homo sapiens
ataattaaagtgtcca

SEQ ID NO: 5233012 - DNA, 15 bp, Homo sapiens
ataattaaataaatg

SEQ ID NO: 5233013 - DNA, 14 bp, Homo sapiens
ataattaaatatat

SEQ ID NO: 5233014 - DNA, 16 bp, Homo sapiens
ataattaaatctcttt

SEQ ID NO: 5233015 - DNA, 14 bp, Homo sapiens
ataattaaatgaaa

SEQ ID NO: 5233016 - DNA, 16 bp, Homo sapiens
ataattaaatgaaata

SEQ ID NO: 5233017 - DNA, 18 bp, Homo sapiens
ataattaaatgaaatact

SEQ ID NO: 5233018 - DNA, 18 bp, Homo sapiens
ataattaaattttaatgt

SEQ ID NO: 5233019 - DNA, 18 bp, Homo sapiens
ataattaacacttaaggt

SEQ ID NO: 5233020 - DNA, 15 bp, Homo sapiens
ataattaacatgtta

SEQ ID NO: 5233021 - DNA, 21 bp, Homo sapiens
ataattaaccaaccttgttta

SEQ ID NO: 5233022 - DNA, 21 bp, Homo sapiens
ataattaaccaaggtagaatg

SEQ ID NO: 5233023 - DNA, 16 bp, Homo sapiens
ataattaacttaactg

SEQ ID NO: 5233024 - DNA, 14 bp, Homo sapiens
ataattaattgtca

SEQ ID NO: 5233025 - DNA, 16 bp, Homo sapiens
ataattaattgtcatt

SEQ ID NO: 5233026 - DNA, 22 bp, Homo sapiens
ataattacagtgcctaaaataa

SEQ ID NO: 5233027 - DNA, 14 bp, Homo sapiens
ataattacatcttt

SEQ ID NO: 5233028 - DNA, 14 bp, Homo sapiens
ataattacattcct

SEQ ID NO: 5233029 - DNA, 15 bp, Homo sapiens
ataattacattccta

SEQ ID NO: 5233030 - DNA, 22 bp, Homo sapiens
ataattacattggcacaatgta

SEQ ID NO: 5233031 - DNA, 17 bp, Homo sapiens
ataattacgtttaaagt

SEQ ID NO: 5233032 - DNA, 16 bp, Homo sapiens
ataattacttaatgtg

SEQ ID NO: 5233033 - DNA, 15 bp, Homo sapiens
ataattagaacaata

SEQ ID NO: 5233034 - DNA, 17 bp, Homo sapiens
ataattagaacaatagc

SEQ ID NO: 5233035 - DNA, 21 bp, Homo sapiens
ataattagatccattaattta

SEQ ID NO: 5233036 - DNA, 15 bp, Homo sapiens
ataattagctatatt

SEQ ID NO: 5233037 - DNA, 18 bp, Homo sapiens
ataattaggatctatgca

SEQ ID NO: 5233038 - DNA, 20 bp, Homo sapiens
ataattaggatctatgcaat

SEQ ID NO: 5233039 - DNA, 21 bp, Homo sapiens
ataattatatgctatttctat

SEQ ID NO: 5233040 - DNA, 13 bp, Homo sapiens
ataattatatgtt

SEQ ID NO: 5233041 - DNA, 20 bp, Homo sapiens
ataattatcggaagcagtgc

SEQ ID NO: 5233042 - DNA, 12 bp, Homo sapiens
ataattatgaaa

SEQ ID NO: 5233043 - DNA, 15 bp, Homo sapiens
ataattatgaaaact

SEQ ID NO: 5233044 - DNA, 14 bp, Homo sapiens
ataattatgacagt

SEQ ID NO: 5233045 - DNA, 16 bp, Homo sapiens
ataattatgacagtta

SEQ ID NO: 5233046 - DNA, 12 bp, Homo sapiens
ataattatgctt

SEQ ID NO: 5233047 - DNA, 13 bp, Homo sapiens
ataattatgggaa

SEQ ID NO: 5233048 - DNA, 14 bp, Homo sapiens
ataattatgggaac

SEQ ID NO: 5233049 - DNA, 22 bp, Homo sapiens
ataattatgggaacaagtgtac

SEQ ID NO: 5233050 - DNA, 18 bp, Homo sapiens
ataattatgttattgaaa

SEQ ID NO: 5233051 - DNA, 13 bp, Homo sapiens
ataattatttaca

SEQ ID NO: 5233052 - DNA, 16 bp, Homo sapiens
ataattatttatttaa

SEQ ID NO: 5233053 - DNA, 18 bp, Homo sapiens
ataattatttatttaata

SEQ ID NO: 5233054 - DNA, 21 bp, Homo sapiens
ataattatttcagattcctca

SEQ ID NO: 5233055 - DNA, 22 bp, Homo sapiens
ataattatttttatctgaagct

SEQ ID NO: 5233056 - DNA, 16 bp, Homo sapiens
ataattcacacattaa

SEQ ID NO: 5233057 - DNA, 23 bp, Homo sapiens
ataattcacattgtattcagagt

SEQ ID NO: 5233058 - DNA, 20 bp, Homo sapiens
ataattcaccaaaagttcat

SEQ ID NO: 5233059 - DNA, 17 bp, Homo sapiens
ataattcagaaggatct

SEQ ID NO: 5233060 - DNA, 20 bp, Homo sapiens
ataattcaggaagcagcttt

SEQ ID NO: 5233061 - DNA, 20 bp, Homo sapiens
ataattcagtatgttttaca

SEQ ID NO: 5233062 - DNA, 21 bp, Homo sapiens
ataattcagtatgttttacac

SEQ ID NO: 5233063 - DNA, 23 bp, Homo sapiens
ataattcagtatgttttacactg

SEQ ID NO: 5233064 - DNA, 19 bp, Homo sapiens
ataattcattaaaaacatt

SEQ ID NO: 5233065 - DNA, 21 bp, Homo sapiens
ataattcattaaaaacatttt

SEQ ID NO: 5233066 - DNA, 14 bp, Homo sapiens
ataattcatttaag

SEQ ID NO: 5233067 - DNA, 13 bp, Homo sapiens
ataattcatttgt

SEQ ID NO: 5233068 - DNA, 19 bp, Homo sapiens
ataattccctatcttttag

SEQ ID NO: 5233069 - DNA, 15 bp, Homo sapiens
ataattccttggtga

SEQ ID NO: 5233070 - DNA, 18 bp, Homo sapiens
ataattctatactgttga

SEQ ID NO: 5233071 - DNA, 14 bp, Homo sapiens
ataattctgaaaca

SEQ ID NO: 5233072 - DNA, 17 bp, Homo sapiens
ataattctgaagttata

SEQ ID NO: 5233073 - DNA, 19 bp, Homo sapiens
ataattctgggaagcaaaa

SEQ ID NO: 5233074 - DNA, 11 bp, Homo sapiens
ataattctgta

SEQ ID NO: 5233075 - DNA, 12 bp, Homo sapiens
ataattctgtaa

SEQ ID NO: 5233076 - DNA, 13 bp, Homo sapiens
ataattcttattt

SEQ ID NO: 5233077 - DNA, 19 bp, Homo sapiens
ataattcttattttgtgga

SEQ ID NO: 5233078 - DNA, 13 bp, Homo sapiens
ataattcttcctt

SEQ ID NO: 5233079 - DNA, 19 bp, Homo sapiens
ataattctttcaatacaga

SEQ ID NO: 5233080 - DNA, 17 bp, Homo sapiens
ataattctttctttttc

SEQ ID NO: 5233081 - DNA, 13 bp, Homo sapiens
ataattcttttct

SEQ ID NO: 5233082 - DNA, 23 bp, Homo sapiens
ataattgaaaagattttaacaag

SEQ ID NO: 5233083 - DNA, 12 bp, Homo sapiens
ataattgaaact

SEQ ID NO: 5233084 - DNA, 13 bp, Homo sapiens
ataattgaagaat

SEQ ID NO: 5233085 - DNA, 16 bp, Homo sapiens
ataattgagactgaaa

SEQ ID NO: 5233086 - DNA, 22 bp, Homo sapiens
ataattgagactgaaagaaact

SEQ ID NO: 5233087 - DNA, 19 bp, Homo sapiens
ataattgagttttcagtgg

SEQ ID NO: 5233088 - DNA, 13 bp, Homo sapiens
ataattgattaaa

SEQ ID NO: 5233089 - DNA, 15 bp, Homo sapiens
ataattgattaaaat

SEQ ID NO: 5233090 - DNA, 16 bp, Homo sapiens
ataattgattaaaatc

SEQ ID NO: 5233091 - DNA, 18 bp, Homo sapiens
ataattgattaaaatctc

SEQ ID NO: 5233092 - DNA, 17 bp, Homo sapiens
ataattgcaagggaaga

SEQ ID NO: 5233093 - DNA, 14 bp, Homo sapiens
ataattgcatgaaa

SEQ ID NO: 5233094 - DNA, 13 bp, Homo sapiens
ataattgcattca

SEQ ID NO: 5233095 - DNA, 17 bp, Homo sapiens
ataattggatttcctaa

SEQ ID NO: 5233096 - DNA, 22 bp, Homo sapiens
ataattggttattaaactgaat

SEQ ID NO: 5233097 - DNA, 15 bp, Homo sapiens
ataattgtacaaaat

SEQ ID NO: 5233098 - DNA, 21 bp, Homo sapiens
ataattgtacaaaattaagca

SEQ ID NO: 5233099 - DNA, 15 bp, Homo sapiens
ataattgtatatatg

SEQ ID NO: 5233100 - DNA, 21 bp, Homo sapiens
ataattgtatcgtatagctgt

SEQ ID NO: 5233101 - DNA, 20 bp, Homo sapiens
ataattgtatctacattaaa

SEQ ID NO: 5233102 - DNA, 19 bp, Homo sapiens
ataattgtcatgactttca

SEQ ID NO: 5233103 - DNA, 22 bp, Homo sapiens
ataattgtcatgactttcagat

SEQ ID NO: 5233104 - DNA, 21 bp, Homo sapiens
ataattgtgaccaatacattt

SEQ ID NO: 5233105 - DNA, 23 bp, Homo sapiens
ataattgtgaccaatacatttgt

SEQ ID NO: 5233106 - DNA, 13 bp, Homo sapiens
ataattgtggatt

SEQ ID NO: 5233107 - DNA, 15 bp, Homo sapiens
ataattgtggattat

SEQ ID NO: 5233108 - DNA, 12 bp, Homo sapiens
ataattgtgtac

SEQ ID NO: 5233109 - DNA, 13 bp, Homo sapiens
ataattgtgtaca

SEQ ID NO: 5233110 - DNA, 13 bp, Homo sapiens
ataattgtgtatt

SEQ ID NO: 5233111 - DNA, 14 bp, Homo sapiens
ataattgtgtgata

SEQ ID NO: 5233112 - DNA, 19 bp, Homo sapiens
ataattgttgaaattttgc

SEQ ID NO: 5233113 - DNA, 21 bp, Homo sapiens
ataattgttgaaattttgcaa

SEQ ID NO: 5233114 - DNA, 21 bp, Homo sapiens
ataattgttgttctgttaact

SEQ ID NO: 5233115 - DNA, 22 bp, Homo sapiens
ataattgttgttctgttaactg

SEQ ID NO: 5233116 - DNA, 14 bp, Homo sapiens
ataattgtttttta

SEQ ID NO: 5233117 - DNA, 17 bp, Homo sapiens
ataatttaaaataaata

SEQ ID NO: 5233118 - DNA, 18 bp, Homo sapiens
ataatttaaagaaacact

SEQ ID NO: 5233119 - DNA, 21 bp, Homo sapiens
ataatttaaagaaacactaaa

SEQ ID NO: 5233120 - DNA, 15 bp, Homo sapiens
ataatttaacagaag

SEQ ID NO: 5233121 - DNA, 13 bp, Homo sapiens
ataatttaacagt

SEQ ID NO: 5233122 - DNA, 22 bp, Homo sapiens
ataatttaactaatttaaacca

SEQ ID NO: 5233123 - DNA, 23 bp, Homo sapiens
ataatttaactaatttaaaccag

SEQ ID NO: 5233124 - DNA, 21 bp, Homo sapiens
ataatttaagccaataaataa

SEQ ID NO: 5233125 - DNA, 18 bp, Homo sapiens
ataatttacaggttctta

SEQ ID NO: 5233126 - DNA, 21 bp, Homo sapiens
ataatttagtggatggaatat

SEQ ID NO: 5233127 - DNA, 20 bp, Homo sapiens
ataatttagttgtttctaga

SEQ ID NO: 5233128 - DNA, 14 bp, Homo sapiens
ataatttataagca

SEQ ID NO: 5233129 - DNA, 21 bp, Homo sapiens
ataatttataagcattgccat

SEQ ID NO: 5233130 - DNA, 19 bp, Homo sapiens
ataatttatacaggtcata

SEQ ID NO: 5233131 - DNA, 19 bp, Homo sapiens
ataatttatggtattgtat

SEQ ID NO: 5233132 - DNA, 16 bp, Homo sapiens
ataatttattattaag

SEQ ID NO: 5233133 - DNA, 22 bp, Homo sapiens
ataatttattgtaccaaagctg

SEQ ID NO: 5233134 - DNA, 20 bp, Homo sapiens
ataatttcagggaaattaat

SEQ ID NO: 5233135 - DNA, 20 bp, Homo sapiens
ataatttcagttattttgct

SEQ ID NO: 5233136 - DNA, 12 bp, Homo sapiens
ataatttccaaa

SEQ ID NO: 5233137 - DNA, 23 bp, Homo sapiens
ataatttccatttacttaagact

SEQ ID NO: 5233138 - DNA, 18 bp, Homo sapiens
ataatttcccaattagga

SEQ ID NO: 5233139 - DNA, 17 bp, Homo sapiens
ataatttcctcactgcc

SEQ ID NO: 5233140 - DNA, 23 bp, Homo sapiens
ataatttccttcaggcagctgaa

SEQ ID NO: 5233141 - DNA, 15 bp, Homo sapiens
ataatttcgagattt

SEQ ID NO: 5233142 - DNA, 15 bp, Homo sapiens
ataatttctcctcat

SEQ ID NO: 5233143 - DNA, 19 bp, Homo sapiens
ataatttctcctcatttaa

SEQ ID NO: 5233144 - DNA, 17 bp, Homo sapiens
ataatttgaactttgga

SEQ ID NO: 5233145 - DNA, 18 bp, Homo sapiens
ataatttgaactttggaa

SEQ ID NO: 5233146 - DNA, 20 bp, Homo sapiens
ataatttgaatgtatttgat

SEQ ID NO: 5233147 - DNA, 17 bp, Homo sapiens
ataatttgaattttatg

SEQ ID NO: 5233148 - DNA, 18 bp, Homo sapiens
ataatttgacaaagaaaa

SEQ ID NO: 5233149 - DNA, 16 bp, Homo sapiens
ataatttgaggtgaaa

SEQ ID NO: 5233150 - DNA, 20 bp, Homo sapiens
ataatttgaggtgaaattca

SEQ ID NO: 5233151 - DNA, 20 bp, Homo sapiens
ataatttgcaatttcaggaa

SEQ ID NO: 5233152 - DNA, 13 bp, Homo sapiens
ataatttgcataa

SEQ ID NO: 5233153 - DNA, 23 bp, Homo sapiens
ataatttgccagacagagatcag

SEQ ID NO: 5233154 - DNA, 12 bp, Homo sapiens
ataatttgtaaa

SEQ ID NO: 5233155 - DNA, 14 bp, Homo sapiens
ataatttgtaaatg

SEQ ID NO: 5233156 - DNA, 14 bp, Homo sapiens
ataatttgtacaat

SEQ ID NO: 5233157 - DNA, 18 bp, Homo sapiens
ataatttgtacaatggtt

SEQ ID NO: 5233158 - DNA, 19 bp, Homo sapiens
ataatttgtacaatggttt

SEQ ID NO: 5233159 - DNA, 20 bp, Homo sapiens
ataatttgtacaatggttta

SEQ ID NO: 5233160 - DNA, 22 bp, Homo sapiens
ataatttgtacatatgtaaaat

SEQ ID NO: 5233161 - DNA, 22 bp, Homo sapiens
ataatttgtgtctgtgtttaat

SEQ ID NO: 5233162 - DNA, 14 bp, Homo sapiens
ataatttgttgtac

SEQ ID NO: 5233163 - DNA, 16 bp, Homo sapiens
ataatttgtttaaaat

SEQ ID NO: 5233164 - DNA, 19 bp, Homo sapiens
agttaactgttccccttgg

SEQ ID NO: 5233165 - DNA, 22 bp, Homo sapiens
agttaacttagtgtttagcatt

SEQ ID NO: 5233166 - DNA, 17 bp, Homo sapiens
agttaacttgaagaaac

SEQ ID NO: 5233167 - DNA, 12 bp, Homo sapiens
agttaacttgga

SEQ ID NO: 5233168 - DNA, 17 bp, Homo sapiens
agttaagaaaaaaataa

SEQ ID NO: 5233169 - DNA, 16 bp, Homo sapiens
agttaagaagccctgc

SEQ ID NO: 5233170 - DNA, 15 bp, Homo sapiens
agttaagaagctgtt

SEQ ID NO: 5233171 - DNA, 21 bp, Homo sapiens
agttaagaagctgttgtacat

SEQ ID NO: 5233172 - DNA, 15 bp, Homo sapiens
agttaagaattgagc

SEQ ID NO: 5233173 - DNA, 13 bp, Homo sapiens
agttaagacctgg

SEQ ID NO: 5233174 - DNA, 16 bp, Homo sapiens
agttaagagaaacttt

SEQ ID NO: 5233175 - DNA, 21 bp, Homo sapiens
agttaagatatccctaatgtt

SEQ ID NO: 5233176 - DNA, 15 bp, Homo sapiens
agttaagatgtttct

SEQ ID NO: 5233177 - DNA, 20 bp, Homo sapiens
agttaagcaaatttcatttc

SEQ ID NO: 5233178 - DNA, 22 bp, Homo sapiens
agttaagcacaaccatgttctt

SEQ ID NO: 5233179 - DNA, 15 bp, Homo sapiens
agttaagcagccttt

SEQ ID NO: 5233180 - DNA, 19 bp, Homo sapiens
agttaagcagcctttctgt

SEQ ID NO: 5233181 - DNA, 21 bp, Homo sapiens
agttaagcagcctttctgtgg

SEQ ID NO: 5233182 - DNA, 12 bp, Homo sapiens
agttaaggaaat

SEQ ID NO: 5233183 - DNA, 19 bp, Homo sapiens
agttaaggaaatgttgagg

SEQ ID NO: 5233184 - DNA, 19 bp, Homo sapiens
agttaaggaccgtggccct

SEQ ID NO: 5233185 - DNA, 16 bp, Homo sapiens
agttaaggtgggcccg

SEQ ID NO: 5233186 - DNA, 19 bp, Homo sapiens
agttaaggtgggcccggcc

SEQ ID NO: 5233187 - DNA, 19 bp, Homo sapiens
agttaagtatttacagatg

SEQ ID NO: 5233188 - DNA, 22 bp, Homo sapiens
agttaagtctatctggtattaa

SEQ ID NO: 5233189 - DNA, 15 bp, Homo sapiens
agttaataacagctc

SEQ ID NO: 5233190 - DNA, 11 bp, Homo sapiens
agttaataatg

SEQ ID NO: 5233191 - DNA, 17 bp, Homo sapiens
agttaatacttaacatt

SEQ ID NO: 5233192 - DNA, 21 bp, Homo sapiens
agttaataggagtatttttgg

SEQ ID NO: 5233193 - DNA, 20 bp, Homo sapiens
agttaatatatcccagaaat

SEQ ID NO: 5233194 - DNA, 23 bp, Homo sapiens
agttaatattggaagtgaaatta

SEQ ID NO: 5233195 - DNA, 22 bp, Homo sapiens
agttaatatttttaaaagtata

SEQ ID NO: 5233196 - DNA, 16 bp, Homo sapiens
agttaatcaactgaaa

SEQ ID NO: 5233197 - DNA, 19 bp, Homo sapiens
agttaatcatcaagagaat

SEQ ID NO: 5233198 - DNA, 18 bp, Homo sapiens
agttaatcttgctttctt

SEQ ID NO: 5233199 - DNA, 23 bp, Homo sapiens
agttaatgaaataaaatttgaaa

SEQ ID NO: 5233200 - DNA, 18 bp, Homo sapiens
agttaatgatggcagagg

SEQ ID NO: 5233201 - DNA, 16 bp, Homo sapiens
agttaatgcttaagag

SEQ ID NO: 5233202 - DNA, 21 bp, Homo sapiens
agttaatggggtagaggaggg

SEQ ID NO: 5233203 - DNA, 17 bp, Homo sapiens
agttaatgtatataaaa

SEQ ID NO: 5233204 - DNA, 20 bp, Homo sapiens
agttaatgtatataaaaatg

SEQ ID NO: 5233205 - DNA, 15 bp, Homo sapiens
agttaatgtgccaaa

SEQ ID NO: 5233206 - DNA, 20 bp, Homo sapiens
agttaattacatcctcatgc

SEQ ID NO: 5233207 - DNA, 19 bp, Homo sapiens
agttaattagcattctggc

SEQ ID NO: 5233208 - DNA, 21 bp, Homo sapiens
agttaattatgtgcatattaa

SEQ ID NO: 5233209 - DNA, 19 bp, Homo sapiens
agttaattccctgctaaat

SEQ ID NO: 5233210 - DNA, 15 bp, Homo sapiens
agttaattcttaaaa

SEQ ID NO: 5233211 - DNA, 21 bp, Homo sapiens
agttaattggatgttcactgc

SEQ ID NO: 5233212 - DNA, 15 bp, Homo sapiens
agttaattgttttat

SEQ ID NO: 5233213 - DNA, 22 bp, Homo sapiens
agttacaaattataatgtattc

SEQ ID NO: 5233214 - DNA, 20 bp, Homo sapiens
agttacaacattaattttat

SEQ ID NO: 5233215 - DNA, 18 bp, Homo sapiens
agttacaataaagtttac

SEQ ID NO: 5233216 - DNA, 17 bp, Homo sapiens
agttacaattacatctc

SEQ ID NO: 5233217 - DNA, 21 bp, Homo sapiens
agttacaattgttacagtact

SEQ ID NO: 5233218 - DNA, 16 bp, Homo sapiens
agttacacatttttca

SEQ ID NO: 5233219 - DNA, 22 bp, Homo sapiens
agttacacctccactcagcact

SEQ ID NO: 5233220 - DNA, 22 bp, Homo sapiens
agttacacggggttacactgtt

SEQ ID NO: 5233221 - DNA, 14 bp, Homo sapiens
agttacagaattcc

SEQ ID NO: 5233222 - DNA, 18 bp, Homo sapiens
agttacagacaaagcgtg

SEQ ID NO: 5233223 - DNA, 18 bp, Homo sapiens
agttacagatgcacccca

SEQ ID NO: 5233224 - DNA, 22 bp, Homo sapiens
agttacagcctgttagtaacat

SEQ ID NO: 5233225 - DNA, 17 bp, Homo sapiens
agttacagcgagaggca

SEQ ID NO: 5233226 - DNA, 22 bp, Homo sapiens
agttacagcgagaggcagagaa

SEQ ID NO: 5233227 - DNA, 16 bp, Homo sapiens
agttacagctgtgatt

SEQ ID NO: 5233228 - DNA, 24 bp, Homo sapiens
agttacaggggattttattaatta

SEQ ID NO: 5233229 - DNA, 23 bp, Homo sapiens
agttacagtaaatacactgtgaa

SEQ ID NO: 5233230 - DNA, 13 bp, Homo sapiens
agttacagttctg

SEQ ID NO: 5233231 - DNA, 14 bp, Homo sapiens
agttacagttctgt

SEQ ID NO: 5233232 - DNA, 15 bp, Homo sapiens
agttacagttctgtg

SEQ ID NO: 5233233 - DNA, 16 bp, Homo sapiens
agttacagtttgcaca

SEQ ID NO: 5233234 - DNA, 22 bp, Homo sapiens
agttacataattcactctgagt

SEQ ID NO: 5233235 - DNA, 14 bp, Homo sapiens
agttacatacattt

SEQ ID NO: 5233236 - DNA, 15 bp, Homo sapiens
agttacatacattta

SEQ ID NO: 5233237 - DNA, 15 bp, Homo sapiens
agttacatgcataaa

SEQ ID NO: 5233238 - DNA, 19 bp, Homo sapiens
agttacattaaaataaacc

SEQ ID NO: 5233239 - DNA, 12 bp, Homo sapiens
agttacatttat

SEQ ID NO: 5233240 - DNA, 22 bp, Homo sapiens
agttaccaaacattacaaaaaa

SEQ ID NO: 5233241 - DNA, 23 bp, Homo sapiens
agttaccactggtgtatgaaatg

SEQ ID NO: 5233242 - DNA, 18 bp, Homo sapiens
agttacccaaattaagag

SEQ ID NO: 5233243 - DNA, 14 bp, Homo sapiens
agttacccacccta

SEQ ID NO: 5233244 - DNA, 16 bp, Homo sapiens
agttaccttatagtta

SEQ ID NO: 5233245 - DNA, 17 bp, Homo sapiens
agttaccttatagttac

SEQ ID NO: 5233246 - DNA, 22 bp, Homo sapiens
agttaccttatagttactgtgt

SEQ ID NO: 5233247 - DNA, 14 bp, Homo sapiens
agttaccttcaaag

SEQ ID NO: 5233248 - DNA, 13 bp, Homo sapiens
agttacctttgct

SEQ ID NO: 5233249 - DNA, 20 bp, Homo sapiens
agttacctttgctgtcactt

SEQ ID NO: 5233250 - DNA, 21 bp, Homo sapiens
agttacgtataatgctttctg

SEQ ID NO: 5233251 - DNA, 22 bp, Homo sapiens
agttacgtataatgctttctga

SEQ ID NO: 5233252 - DNA, 23 bp, Homo sapiens
agttactaagaagaaaattgctg

SEQ ID NO: 5233253 - DNA, 20 bp, Homo sapiens
agttactaatatatctgtaa

SEQ ID NO: 5233254 - DNA, 16 bp, Homo sapiens
agttactaggtaactt

SEQ ID NO: 5233255 - DNA, 19 bp, Homo sapiens
agttactaggtaacttcat

SEQ ID NO: 5233256 - DNA, 15 bp, Homo sapiens
agttactatcctggc

SEQ ID NO: 5233257 - DNA, 17 bp, Homo sapiens
agttactatcctggctt

SEQ ID NO: 5233258 - DNA, 13 bp, Homo sapiens
agttactcaagca

SEQ ID NO: 5233259 - DNA, 16 bp, Homo sapiens
agttactcaagcagtt

SEQ ID NO: 5233260 - DNA, 14 bp, Homo sapiens
agttactcagccct

SEQ ID NO: 5233261 - DNA, 15 bp, Homo sapiens
agttactcagccctg

SEQ ID NO: 5233262 - DNA, 16 bp, Homo sapiens
agttactcagccctgg

SEQ ID NO: 5233263 - DNA, 21 bp, Homo sapiens
agttactccagtgccaacaat

SEQ ID NO: 5233264 - DNA, 19 bp, Homo sapiens
agttactccctacactgat

SEQ ID NO: 5233265 - DNA, 20 bp, Homo sapiens
agttactccctacactgatg

SEQ ID NO: 5233266 - DNA, 16 bp, Homo sapiens
agttactctgaagggc

SEQ ID NO: 5233267 - DNA, 19 bp, Homo sapiens
agttactcttcagttttag

SEQ ID NO: 5233268 - DNA, 21 bp, Homo sapiens
agttactgccggtttgaaaat

SEQ ID NO: 5233269 - DNA, 14 bp, Homo sapiens
agttactgtgtaat

SEQ ID NO: 5233270 - DNA, 15 bp, Homo sapiens
agttactgtgtaatt

SEQ ID NO: 5233271 - DNA, 19 bp, Homo sapiens
agttactgtgtaattagtg

SEQ ID NO: 5233272 - DNA, 14 bp, Homo sapiens
agttactgttcatg

SEQ ID NO: 5233273 - DNA, 16 bp, Homo sapiens
agttacttaagattca

SEQ ID NO: 5233274 - DNA, 19 bp, Homo sapiens
agttacttaagattcagtt

SEQ ID NO: 5233275 - DNA, 22 bp, Homo sapiens
agttacttaattgccagcaaat

SEQ ID NO: 5233276 - DNA, 15 bp, Homo sapiens
agttacttacacacc

SEQ ID NO: 5233277 - DNA, 16 bp, Homo sapiens
agttacttacacacct

SEQ ID NO: 5233278 - DNA, 15 bp, Homo sapiens
agttacttccttcct

SEQ ID NO: 5233279 - DNA, 15 bp, Homo sapiens
agttacttgaaataa

SEQ ID NO: 5233280 - DNA, 16 bp, Homo sapiens
agttacttgaaataag

SEQ ID NO: 5233281 - DNA, 15 bp, Homo sapiens
agttacttgaatttc

SEQ ID NO: 5233282 - DNA, 13 bp, Homo sapiens
agttacttgataa

SEQ ID NO: 5233283 - DNA, 16 bp, Homo sapiens
agttacttgctataaa

SEQ ID NO: 5233284 - DNA, 18 bp, Homo sapiens
agttacttgctataaata

SEQ ID NO: 5233285 - DNA, 22 bp, Homo sapiens
agttacttgctataaatagatt

SEQ ID NO: 5233286 - DNA, 15 bp, Homo sapiens
agttacttgtctgag

SEQ ID NO: 5233287 - DNA, 19 bp, Homo sapiens
agttacttgtctgaggcct

SEQ ID NO: 5233288 - DNA, 12 bp, Homo sapiens
agttacttgtga

SEQ ID NO: 5233289 - DNA, 16 bp, Homo sapiens
agttacttgtgttcat

SEQ ID NO: 5233290 - DNA, 13 bp, Homo sapiens
agttactttagat

SEQ ID NO: 5233291 - DNA, 20 bp, Homo sapiens
agttactttatgtttgtctt

SEQ ID NO: 5233292 - DNA, 16 bp, Homo sapiens
agttactttcttaatg

SEQ ID NO: 5233293 - DNA, 19 bp, Homo sapiens
agttactttggaacactac

SEQ ID NO: 5233294 - DNA, 12 bp, Homo sapiens
agttactttgta

SEQ ID NO: 5233295 - DNA, 13 bp, Homo sapiens
agttactttgtaa

SEQ ID NO: 5233296 - DNA, 14 bp, Homo sapiens
agttacttttcctt

SEQ ID NO: 5233297 - DNA, 23 bp, Homo sapiens
agttagaaaattcagctcctttc

SEQ ID NO: 5233298 - DNA, 16 bp, Homo sapiens
agttagaaatctccag

SEQ ID NO: 5233299 - DNA, 16 bp, Homo sapiens
agttagaaccacagca

SEQ ID NO: 5233300 - DNA, 18 bp, Homo sapiens
agttagaataataaatat

SEQ ID NO: 5233301 - DNA, 19 bp, Homo sapiens
agttagaataataaatatt

SEQ ID NO: 5233302 - DNA, 14 bp, Homo sapiens
agttagaattcctt

SEQ ID NO: 5233303 - DNA, 13 bp, Homo sapiens
agttagactgttg

SEQ ID NO: 5233304 - DNA, 19 bp, Homo sapiens
agttagagaatatattttt

SEQ ID NO: 5233305 - DNA, 14 bp, Homo sapiens
agttagagaatctg

SEQ ID NO: 5233306 - DNA, 19 bp, Homo sapiens
agttagagactcgcctggg

SEQ ID NO: 5233307 - DNA, 22 bp, Homo sapiens
agttagagcccattaatcttga

SEQ ID NO: 5233308 - DNA, 19 bp, Homo sapiens
agttagaggccagcctggc

SEQ ID NO: 5233309 - DNA, 21 bp, Homo sapiens
agttagataaaaataaaatgt

SEQ ID NO: 5233310 - DNA, 15 bp, Homo sapiens
agttagatctttgta

SEQ ID NO: 5233311 - DNA, 22 bp, Homo sapiens
agttagcaaactttgtatgtca

SEQ ID NO: 5233312 - DNA, 20 bp, Homo sapiens
agttagcactgaactgcttt

SEQ ID NO: 5233313 - DNA, 19 bp, Homo sapiens
agttagcagggatgttcct

SEQ ID NO: 5233314 - DNA, 20 bp, Homo sapiens
agttagcatgcgcgctgtgg

SEQ ID NO: 5233315 - DNA, 23 bp, Homo sapiens
agttagcatgcgcgctgtgggca

SEQ ID NO: 5233316 - DNA, 19 bp, Homo sapiens
agttagcattgtttctaga

SEQ ID NO: 5233317 - DNA, 18 bp, Homo sapiens
agttagcatttaccaaca

SEQ ID NO: 5233318 - DNA, 15 bp, Homo sapiens
agttagccactgctg

SEQ ID NO: 5233319 - DNA, 16 bp, Homo sapiens
agttagccactgctgg

SEQ ID NO: 5233320 - DNA, 18 bp, Homo sapiens
agttagccactgctggtg

SEQ ID NO: 5233321 - DNA, 17 bp, Homo sapiens
agttagccccagaaaat

SEQ ID NO: 5233322 - DNA, 21 bp, Homo sapiens
agttagcccggccaaggacac

SEQ ID NO: 5233323 - DNA, 23 bp, Homo sapiens
agttagcccggccaaggacactg

SEQ ID NO: 5233324 - DNA, 20 bp, Homo sapiens
agttagcctggatagccttg

SEQ ID NO: 5233325 - DNA, 23 bp, Homo sapiens
agttagcctttatctaccaactt

SEQ ID NO: 5233326 - DNA, 19 bp, Homo sapiens
agttagctcaggaggcttg

SEQ ID NO: 5233327 - DNA, 22 bp, Homo sapiens
agttagctcaggaggcttggaa

SEQ ID NO: 5233328 - DNA, 15 bp, Homo sapiens
agttagctccataaa

SEQ ID NO: 5233329 - DNA, 23 bp, Homo sapiens
agttagctccataaagtacaaat

SEQ ID NO: 5233330 - DNA, 21 bp, Homo sapiens
agttagctttaacttaaatag

SEQ ID NO: 5233331 - DNA, 22 bp, Homo sapiens
agttagctttaacttaaatagt

SEQ ID NO: 5233332 - DNA, 13 bp, Homo sapiens
agttaggaaataa

SEQ ID NO: 5233333 - DNA, 14 bp, Homo sapiens
agttaggaaataaa

SEQ ID NO: 5233334 - DNA, 15 bp, Homo sapiens
agttaggaaataaaa

SEQ ID NO: 5233335 - DNA, 18 bp, Homo sapiens
agttaggaaataaaacct

SEQ ID NO: 5233336 - DNA, 15 bp, Homo sapiens
agttaggaatgagaa

SEQ ID NO: 5233337 - DNA, 18 bp, Homo sapiens
agttaggatagcattttt

SEQ ID NO: 5233338 - DNA, 21 bp, Homo sapiens
agttaggattcagatcgaaat

SEQ ID NO: 5233339 - DNA, 17 bp, Homo sapiens
agttaggcttccatgat

SEQ ID NO: 5233340 - DNA, 20 bp, Homo sapiens
agttagggagagagaagcag

SEQ ID NO: 5233341 - DNA, 13 bp, Homo sapiens
ataatttgtttcc

SEQ ID NO: 5233342 - DNA, 14 bp, Homo sapiens
ataatttgtttcca

SEQ ID NO: 5233343 - DNA, 17 bp, Homo sapiens
ataattttaaaaatggt

SEQ ID NO: 5233344 - DNA, 14 bp, Homo sapiens
ataattttaaagta

SEQ ID NO: 5233345 - DNA, 14 bp, Homo sapiens
ataattttaaattc

SEQ ID NO: 5233346 - DNA, 12 bp, Homo sapiens
ataattttacaa

SEQ ID NO: 5233347 - DNA, 16 bp, Homo sapiens
ataattttacaattta

SEQ ID NO: 5233348 - DNA, 14 bp, Homo sapiens
ataattttagtaat

SEQ ID NO: 5233349 - DNA, 21 bp, Homo sapiens
ataattttagtgtcatttcca

SEQ ID NO: 5233350 - DNA, 16 bp, Homo sapiens
ataattttatctgtat

SEQ ID NO: 5233351 - DNA, 13 bp, Homo sapiens
ataattttatgaa

SEQ ID NO: 5233352 - DNA, 19 bp, Homo sapiens
ataattttatgaatgtctt

SEQ ID NO: 5233353 - DNA, 15 bp, Homo sapiens
ataattttattacat

SEQ ID NO: 5233354 - DNA, 18 bp, Homo sapiens
ataattttcaaaagaaaa

SEQ ID NO: 5233355 - DNA, 20 bp, Homo sapiens
ataattttcaagagaagaaa

SEQ ID NO: 5233356 - DNA, 21 bp, Homo sapiens
ataattttcaagagaagaaaa

SEQ ID NO: 5233357 - DNA, 22 bp, Homo sapiens
ataattttccagtataaaacaa

SEQ ID NO: 5233358 - DNA, 11 bp, Homo sapiens
ataattttcct

SEQ ID NO: 5233359 - DNA, 14 bp, Homo sapiens
ataattttcctcaa

SEQ ID NO: 5233360 - DNA, 16 bp, Homo sapiens
ataattttcctgtgac

SEQ ID NO: 5233361 - DNA, 19 bp, Homo sapiens
ataattttcctttttcatg

SEQ ID NO: 5233362 - DNA, 14 bp, Homo sapiens
ataattttctaaga

SEQ ID NO: 5233363 - DNA, 15 bp, Homo sapiens
ataattttctaagtc

SEQ ID NO: 5233364 - DNA, 17 bp, Homo sapiens
ataattttcttcatgca

SEQ ID NO: 5233365 - DNA, 13 bp, Homo sapiens
ataattttgaaat

SEQ ID NO: 5233366 - DNA, 17 bp, Homo sapiens
ataattttgaaatgatt

SEQ ID NO: 5233367 - DNA, 23 bp, Homo sapiens
ataattttgaaatgattcatctt

SEQ ID NO: 5233368 - DNA, 20 bp, Homo sapiens
ataattttgaccataaatta

SEQ ID NO: 5233369 - DNA, 23 bp, Homo sapiens
ataattttgaccataaattaatt

SEQ ID NO: 5233370 - DNA, 18 bp, Homo sapiens
ataattttgcaaatctgt

SEQ ID NO: 5233371 - DNA, 15 bp, Homo sapiens
ataattttgcatact

SEQ ID NO: 5233372 - DNA, 13 bp, Homo sapiens
ataattttgctgg

SEQ ID NO: 5233373 - DNA, 22 bp, Homo sapiens
ataattttgctggaattcctaa

SEQ ID NO: 5233374 - DNA, 16 bp, Homo sapiens
ataattttggtaattt

SEQ ID NO: 5233375 - DNA, 20 bp, Homo sapiens
ataattttggtccaaattct

SEQ ID NO: 5233376 - DNA, 16 bp, Homo sapiens
ataattttggttgtaa

SEQ ID NO: 5233377 - DNA, 12 bp, Homo sapiens
ataattttgtaa

SEQ ID NO: 5233378 - DNA, 23 bp, Homo sapiens
ataattttgtaatgtatcaaata

SEQ ID NO: 5233379 - DNA, 20 bp, Homo sapiens
ataatttttaaaagaggaaa

SEQ ID NO: 5233380 - DNA, 15 bp, Homo sapiens
ataatttttaaagta

SEQ ID NO: 5233381 - DNA, 19 bp, Homo sapiens
ataatttttaaagtatata

SEQ ID NO: 5233382 - DNA, 13 bp, Homo sapiens
ataatttttaact

SEQ ID NO: 5233383 - DNA, 15 bp, Homo sapiens
ataatttttacctaa

SEQ ID NO: 5233384 - DNA, 14 bp, Homo sapiens
ataatttttatatg

SEQ ID NO: 5233385 - DNA, 23 bp, Homo sapiens
ataatttttatatttaattatta

SEQ ID NO: 5233386 - DNA, 16 bp, Homo sapiens
ataatttttatatttg

SEQ ID NO: 5233387 - DNA, 19 bp, Homo sapiens
ataatttttatatttgaaa

SEQ ID NO: 5233388 - DNA, 21 bp, Homo sapiens
ataatttttatatttgaaata

SEQ ID NO: 5233389 - DNA, 16 bp, Homo sapiens
ataattttttaattat

SEQ ID NO: 5233390 - DNA, 23 bp, Homo sapiens
ataattttttagttaaaatctat

SEQ ID NO: 5233391 - DNA, 13 bp, Homo sapiens
ataattttttgca

SEQ ID NO: 5233392 - DNA, 13 bp, Homo sapiens
ataattttttgta

SEQ ID NO: 5233393 - DNA, 22 bp, Homo sapiens
ataattttttttaaaatagaaa

SEQ ID NO: 5233394 - DNA, 16 bp, Homo sapiens
ataattttttttaaag

SEQ ID NO: 5233395 - DNA, 18 bp, Homo sapiens
ataattttttttttctca

SEQ ID NO: 5233396 - DNA, 14 bp, Homo sapiens
atacaaaaaaatta

SEQ ID NO: 5233397 - DNA, 18 bp, Homo sapiens
atacaaaaatactcagat

SEQ ID NO: 5233398 - DNA, 13 bp, Homo sapiens
atacaaaaatgaa

SEQ ID NO: 5233399 - DNA, 15 bp, Homo sapiens
atacaaaaatgaata

SEQ ID NO: 5233400 - DNA, 20 bp, Homo sapiens
atacaaaaccttgtgtaaga

SEQ ID NO: 5233401 - DNA, 12 bp, Homo sapiens
atacaaaagcat

SEQ ID NO: 5233402 - DNA, 15 bp, Homo sapiens
atacaaaagcatgtg

SEQ ID NO: 5233403 - DNA, 13 bp, Homo sapiens
atacaaaaggctc

SEQ ID NO: 5233404 - DNA, 16 bp, Homo sapiens
atacaaaataaaactg

SEQ ID NO: 5233405 - DNA, 18 bp, Homo sapiens
atacaaaataaaattatg

SEQ ID NO: 5233406 - DNA, 17 bp, Homo sapiens
atacaaaatatttaagt

SEQ ID NO: 5233407 - DNA, 18 bp, Homo sapiens
atacaaaatatttaagtg

SEQ ID NO: 5233408 - DNA, 16 bp, Homo sapiens
atacaaacaagcacag

SEQ ID NO: 5233409 - DNA, 16 bp, Homo sapiens
atacaaacaatggaaa

SEQ ID NO: 5233410 - DNA, 22 bp, Homo sapiens
atacaaacaatggaaactgaat

SEQ ID NO: 5233411 - DNA, 11 bp, Homo sapiens
atacaaacagg

SEQ ID NO: 5233412 - DNA, 16 bp, Homo sapiens
atacaaacatgtggca

SEQ ID NO: 5233413 - DNA, 15 bp, Homo sapiens
atacaaagaaacttt

SEQ ID NO: 5233414 - DNA, 17 bp, Homo sapiens
atacaaagaaacttttt

SEQ ID NO: 5233415 - DNA, 14 bp, Homo sapiens
atacaaagctgtca

SEQ ID NO: 5233416 - DNA, 12 bp, Homo sapiens
atacaaagtaaa

SEQ ID NO: 5233417 - DNA, 16 bp, Homo sapiens
atacaaagtaaataca

SEQ ID NO: 5233418 - DNA, 16 bp, Homo sapiens
atacaaatagattttt

SEQ ID NO: 5233419 - DNA, 13 bp, Homo sapiens
atacaaatatatg

SEQ ID NO: 5233420 - DNA, 14 bp, Homo sapiens
atacaaatatattg

SEQ ID NO: 5233421 - DNA, 23 bp, Homo sapiens
atacaaatatatttaattgtgtc

SEQ ID NO: 5233422 - DNA, 20 bp, Homo sapiens
atacaaatctcactgtatta

SEQ ID NO: 5233423 - DNA, 17 bp, Homo sapiens
atacaaatctgtataaa

SEQ ID NO: 5233424 - DNA, 20 bp, Homo sapiens
atacaaatctgtataaatgt

SEQ ID NO: 5233425 - DNA, 22 bp, Homo sapiens
atacaaatctgtataaatgtct

SEQ ID NO: 5233426 - DNA, 15 bp, Homo sapiens
atacaaatgcatctt

SEQ ID NO: 5233427 - DNA, 17 bp, Homo sapiens
atacaaatgcatctttg

SEQ ID NO: 5233428 - DNA, 18 bp, Homo sapiens
atacaaatgcatctttga

SEQ ID NO: 5233429 - DNA, 19 bp, Homo sapiens
atacaaatgtttataactc

SEQ ID NO: 5233430 - DNA, 14 bp, Homo sapiens
atacaaatgtttta

SEQ ID NO: 5233431 - DNA, 18 bp, Homo sapiens
atacaaattaattttact

SEQ ID NO: 5233432 - DNA, 14 bp, Homo sapiens
atacaaattagaaa

SEQ ID NO: 5233433 - DNA, 17 bp, Homo sapiens
atacaaattagaaaatg

SEQ ID NO: 5233434 - DNA, 21 bp, Homo sapiens
atacaaatttaacttttaaag

SEQ ID NO: 5233435 - DNA, 23 bp, Homo sapiens
atacaaatttggccttaagaact

SEQ ID NO: 5233436 - DNA, 23 bp, Homo sapiens
atacaacaaaggcaagttaagag

SEQ ID NO: 5233437 - DNA, 14 bp, Homo sapiens
atacaacaagaaca

SEQ ID NO: 5233438 - DNA, 15 bp, Homo sapiens
atacaacaagaacaa

SEQ ID NO: 5233439 - DNA, 16 bp, Homo sapiens
atacaacacaaagaga

SEQ ID NO: 5233440 - DNA, 19 bp, Homo sapiens
atacaacaggattttcaag

SEQ ID NO: 5233441 - DNA, 20 bp, Homo sapiens
atacaacaggattttcaagt

SEQ ID NO: 5233442 - DNA, 12 bp, Homo sapiens
atacaacagtgc

SEQ ID NO: 5233443 - DNA, 15 bp, Homo sapiens
atacaacagtgctaa

SEQ ID NO: 5233444 - DNA, 16 bp, Homo sapiens
atacaacagtgctaaa

SEQ ID NO: 5233445 - DNA, 18 bp, Homo sapiens
atacaacagtgctaaaaa

SEQ ID NO: 5233446 - DNA, 20 bp, Homo sapiens
atacaacatgtagctgagtt

SEQ ID NO: 5233447 - DNA, 17 bp, Homo sapiens
atacaacctaacttatg

SEQ ID NO: 5233448 - DNA, 19 bp, Homo sapiens
atacaacctaacttatgga

SEQ ID NO: 5233449 - DNA, 23 bp, Homo sapiens
atacaacctaacttatggactgt

SEQ ID NO: 5233450 - DNA, 17 bp, Homo sapiens
atacaacctatgtaatt

SEQ ID NO: 5233451 - DNA, 21 bp, Homo sapiens
atacaacctatgtaattttta

SEQ ID NO: 5233452 - DNA, 15 bp, Homo sapiens
atacaacctccctct

SEQ ID NO: 5233453 - DNA, 15 bp, Homo sapiens
atacaacctgagcct

SEQ ID NO: 5233454 - DNA, 16 bp, Homo sapiens
atacaacctgagcctt

SEQ ID NO: 5233455 - DNA, 14 bp, Homo sapiens
atacaacctgcttg

SEQ ID NO: 5233456 - DNA, 18 bp, Homo sapiens
atacaacctgcttgggtg

SEQ ID NO: 5233457 - DNA, 19 bp, Homo sapiens
atacaacttgatactttta

SEQ ID NO: 5233458 - DNA, 12 bp, Homo sapiens
atacaactttac

SEQ ID NO: 5233459 - DNA, 12 bp, Homo sapiens
atacaagaaaaa

SEQ ID NO: 5233460 - DNA, 19 bp, Homo sapiens
atacaagaaaaagtagaaa

SEQ ID NO: 5233461 - DNA, 14 bp, Homo sapiens
atacaagaaaatgt

SEQ ID NO: 5233462 - DNA, 15 bp, Homo sapiens
atacaagaaaatgta

SEQ ID NO: 5233463 - DNA, 18 bp, Homo sapiens
atacaagataagcttcca

SEQ ID NO: 5233464 - DNA, 18 bp, Homo sapiens
atacaagatattatgtat

SEQ ID NO: 5233465 - DNA, 21 bp, Homo sapiens
atacaagccatttactttgca

SEQ ID NO: 5233466 - DNA, 18 bp, Homo sapiens
atacaaggagggcctctg

SEQ ID NO: 5233467 - DNA, 22 bp, Homo sapiens
atacaaggatcagattcttgct

SEQ ID NO: 5233468 - DNA, 12 bp, Homo sapiens
atacaaggcaag

SEQ ID NO: 5233469 - DNA, 12 bp, Homo sapiens
atacaaggtata

SEQ ID NO: 5233470 - DNA, 15 bp, Homo sapiens
atacaagtgtttcta

SEQ ID NO: 5233471 - DNA, 19 bp, Homo sapiens
atacaagtgtttctagtaa

SEQ ID NO: 5233472 - DNA, 19 bp, Homo sapiens
atacaagttcttggtccct

SEQ ID NO: 5233473 - DNA, 17 bp, Homo sapiens
atacaagtttcagacag

SEQ ID NO: 5233474 - DNA, 13 bp, Homo sapiens
atacaagtttcat

SEQ ID NO: 5233475 - DNA, 14 bp, Homo sapiens
atacaagtttcatc

SEQ ID NO: 5233476 - DNA, 15 bp, Homo sapiens
atacaagtttgaaca

SEQ ID NO: 5233477 - DNA, 15 bp, Homo sapiens
atacaataaaagagc

SEQ ID NO: 5233478 - DNA, 17 bp, Homo sapiens
atacaataaaagagctt

SEQ ID NO: 5233479 - DNA, 18 bp, Homo sapiens
atacaataaaagagcttt

SEQ ID NO: 5233480 - DNA, 20 bp, Homo sapiens
atacaataaaagagctttat

SEQ ID NO: 5233481 - DNA, 20 bp, Homo sapiens
atacaataaactattggaaa

SEQ ID NO: 5233482 - DNA, 21 bp, Homo sapiens
atacaataacccagttacttt

SEQ ID NO: 5233483 - DNA, 11 bp, Homo sapiens
atacaataatg

SEQ ID NO: 5233484 - DNA, 15 bp, Homo sapiens
atacaatacatagga

SEQ ID NO: 5233485 - DNA, 13 bp, Homo sapiens
atacaatatataa

SEQ ID NO: 5233486 - DNA, 19 bp, Homo sapiens
atacaatatataaaaatat

SEQ ID NO: 5233487 - DNA, 17 bp, Homo sapiens
atacaatatatattttg

SEQ ID NO: 5233488 - DNA, 14 bp, Homo sapiens
atacaatattaatt

SEQ ID NO: 5233489 - DNA, 12 bp, Homo sapiens
atacaatcagct

SEQ ID NO: 5233490 - DNA, 14 bp, Homo sapiens
atacaatcagctgc

SEQ ID NO: 5233491 - DNA, 21 bp, Homo sapiens
atacaatcagctgctttgtta

SEQ ID NO: 5233492 - DNA, 19 bp, Homo sapiens
atacaatccgagctacaaa

SEQ ID NO: 5233493 - DNA, 23 bp, Homo sapiens
atacaatccgagctacaaagcat

SEQ ID NO: 5233494 - DNA, 16 bp, Homo sapiens
atacaatgaccacata

SEQ ID NO: 5233495 - DNA, 21 bp, Homo sapiens
atacaatgactagtcacctgg

SEQ ID NO: 5233496 - DNA, 21 bp, Homo sapiens
atacaatgatgctatttgcaa

SEQ ID NO: 5233497 - DNA, 22 bp, Homo sapiens
atacaatgatgctatttgcaat

SEQ ID NO: 5233498 - DNA, 13 bp, Homo sapiens
atacaatgcactt

SEQ ID NO: 5233499 - DNA, 14 bp, Homo sapiens
atacaatgggaaaa

SEQ ID NO: 5233500 - DNA, 23 bp, Homo sapiens
atacaatggtcatttccagacaa

SEQ ID NO: 5233501 - DNA, 17 bp, Homo sapiens
atacaatggtttctgaa

SEQ ID NO: 5233502 - DNA, 21 bp, Homo sapiens
atacaatgtacaattatgtct

SEQ ID NO: 5233503 - DNA, 14 bp, Homo sapiens
atacaatgtatgta

SEQ ID NO: 5233504 - DNA, 20 bp, Homo sapiens
atacaatgtatttatttaaa

SEQ ID NO: 5233505 - DNA, 11 bp, Homo sapiens
atacaattaaa

SEQ ID NO: 5233506 - DNA, 14 bp, Homo sapiens
atacaattaaaggt

SEQ ID NO: 5233507 - DNA, 15 bp, Homo sapiens
atacaattaaaggtc

SEQ ID NO: 5233508 - DNA, 23 bp, Homo sapiens
atacaattaaaggtcctgccctc

SEQ ID NO: 5233509 - DNA, 21 bp, Homo sapiens
atacaattattgtatattgat

SEQ ID NO: 5233510 - DNA, 19 bp, Homo sapiens
atacaattggacgcatttt

SEQ ID NO: 5233511 - DNA, 13 bp, Homo sapiens
atacaatttactt

SEQ ID NO: 5233512 - DNA, 14 bp, Homo sapiens
atacaatttacttt

SEQ ID NO: 5233513 - DNA, 23 bp, Homo sapiens
atacaatttgttcttgtatttta

SEQ ID NO: 5233514 - DNA, 14 bp, Homo sapiens
atacaattttgttt

SEQ ID NO: 5233515 - DNA, 18 bp, Homo sapiens
atacaattttgtttctgt

SEQ ID NO: 5233516 - DNA, 19 bp, Homo sapiens
atacaattttgtttctgta

SEQ ID NO: 5233517 - DNA, 20 bp, Homo sapiens
atacaattttgtttctgtac

SEQ ID NO: 5233518 - DNA, 18 bp, Homo sapiens
atacaatttttatttctt

SEQ ID NO: 5233519 - DNA, 17 bp, Homo sapiens
atacaattttttttatt

SEQ ID NO: 5233520 - DNA, 15 bp, Homo sapiens
atacacaacacacac

SEQ ID NO: 5233521 - DNA, 13 bp, Homo sapiens
atacacaacattt

SEQ ID NO: 5233522 - DNA, 21 bp, Homo sapiens
agttagggcatttttcttgga

SEQ ID NO: 5233523 - DNA, 16 bp, Homo sapiens
agttagggtctatgta

SEQ ID NO: 5233524 - DNA, 16 bp, Homo sapiens
agttagggttttgcaa

SEQ ID NO: 5233525 - DNA, 14 bp, Homo sapiens
agttaggtgtgcca

SEQ ID NO: 5233526 - DNA, 16 bp, Homo sapiens
agttaggttataagaa

SEQ ID NO: 5233527 - DNA, 18 bp, Homo sapiens
agttaggttataagaaac

SEQ ID NO: 5233528 - DNA, 19 bp, Homo sapiens
agttaggtttaacataaag

SEQ ID NO: 5233529 - DNA, 23 bp, Homo sapiens
agttaggtttaacataaaggtta

SEQ ID NO: 5233530 - DNA, 16 bp, Homo sapiens
agttagtaatggtgct

SEQ ID NO: 5233531 - DNA, 15 bp, Homo sapiens
agttagtagcatgtt

SEQ ID NO: 5233532 - DNA, 14 bp, Homo sapiens
agttagtggaaatc

SEQ ID NO: 5233533 - DNA, 20 bp, Homo sapiens
agttagtggattactgccat

SEQ ID NO: 5233534 - DNA, 11 bp, Homo sapiens
agttagttcag

SEQ ID NO: 5233535 - DNA, 18 bp, Homo sapiens
agttagttcagtagctta

SEQ ID NO: 5233536 - DNA, 15 bp, Homo sapiens
agttagttccactga

SEQ ID NO: 5233537 - DNA, 19 bp, Homo sapiens
agttagttccactgagacc

SEQ ID NO: 5233538 - DNA, 21 bp, Homo sapiens
agttagttgtgaaagaaagct

SEQ ID NO: 5233539 - DNA, 17 bp, Homo sapiens
agttagtttctttggga

SEQ ID NO: 5233540 - DNA, 14 bp, Homo sapiens
agttataaaaatac

SEQ ID NO: 5233541 - DNA, 15 bp, Homo sapiens
agttataaaaataca

SEQ ID NO: 5233542 - DNA, 16 bp, Homo sapiens
agttataaaaatacaa

SEQ ID NO: 5233543 - DNA, 18 bp, Homo sapiens
agttataaaattaaaagt

SEQ ID NO: 5233544 - DNA, 20 bp, Homo sapiens
agttataaaattaaaagttt

SEQ ID NO: 5233545 - DNA, 15 bp, Homo sapiens
agttataaagaaaga

SEQ ID NO: 5233546 - DNA, 18 bp, Homo sapiens
agttataaagaaagattg

SEQ ID NO: 5233547 - DNA, 14 bp, Homo sapiens
agttataaatattt

SEQ ID NO: 5233548 - DNA, 14 bp, Homo sapiens
agttataacagatg

SEQ ID NO: 5233549 - DNA, 16 bp, Homo sapiens
agttataacagatgtg

SEQ ID NO: 5233550 - DNA, 12 bp, Homo sapiens
agttataagaaa

SEQ ID NO: 5233551 - DNA, 14 bp, Homo sapiens
agttataagaagaa

SEQ ID NO: 5233552 - DNA, 15 bp, Homo sapiens
agttataataactga

SEQ ID NO: 5233553 - DNA, 17 bp, Homo sapiens
agttataataactgaac

SEQ ID NO: 5233554 - DNA, 20 bp, Homo sapiens
agttatacagttataaaatt

SEQ ID NO: 5233555 - DNA, 21 bp, Homo sapiens
agttatacagttataaaatta

SEQ ID NO: 5233556 - DNA, 18 bp, Homo sapiens
agttatagaggtaaaatt

SEQ ID NO: 5233557 - DNA, 15 bp, Homo sapiens
agttatagatgtcta

SEQ ID NO: 5233558 - DNA, 17 bp, Homo sapiens
agttatagatgtctagg

SEQ ID NO: 5233559 - DNA, 19 bp, Homo sapiens
agttatagatgtctaggta

SEQ ID NO: 5233560 - DNA, 17 bp, Homo sapiens
agttatagtgtttaact

SEQ ID NO: 5233561 - DNA, 18 bp, Homo sapiens
agttatagtgtttaactg

SEQ ID NO: 5233562 - DNA, 20 bp, Homo sapiens
agttatagtgtttaactggc

SEQ ID NO: 5233563 - DNA, 18 bp, Homo sapiens
agttatagtttcagatat

SEQ ID NO: 5233564 - DNA, 16 bp, Homo sapiens
agttatagtttgcttt

SEQ ID NO: 5233565 - DNA, 20 bp, Homo sapiens
agttatataattcactcaag

SEQ ID NO: 5233566 - DNA, 14 bp, Homo sapiens
agttatatagataa

SEQ ID NO: 5233567 - DNA, 23 bp, Homo sapiens
agttatataggttttgtttgcta

SEQ ID NO: 5233568 - DNA, 14 bp, Homo sapiens
agttatatattcct

SEQ ID NO: 5233569 - DNA, 12 bp, Homo sapiens
agttatatcttg

SEQ ID NO: 5233570 - DNA, 14 bp, Homo sapiens
agttatatgatatt

SEQ ID NO: 5233571 - DNA, 17 bp, Homo sapiens
agttatatgatattctt

SEQ ID NO: 5233572 - DNA, 13 bp, Homo sapiens
agttatatgtaca

SEQ ID NO: 5233573 - DNA, 17 bp, Homo sapiens
agttatatgtacagttt

SEQ ID NO: 5233574 - DNA, 22 bp, Homo sapiens
agttatattagtgaagatggtt

SEQ ID NO: 5233575 - DNA, 16 bp, Homo sapiens
agttatattcacagtt

SEQ ID NO: 5233576 - DNA, 23 bp, Homo sapiens
agttatattggaattataaatat

SEQ ID NO: 5233577 - DNA, 19 bp, Homo sapiens
agttatatttactttaaaa

SEQ ID NO: 5233578 - DNA, 14 bp, Homo sapiens
agttatattttcta

SEQ ID NO: 5233579 - DNA, 15 bp, Homo sapiens
agttatattttctat

SEQ ID NO: 5233580 - DNA, 17 bp, Homo sapiens
agttatcaaaaagtatt

SEQ ID NO: 5233581 - DNA, 21 bp, Homo sapiens
agttatcaaaaagtattatca

SEQ ID NO: 5233582 - DNA, 13 bp, Homo sapiens
agttatcacactt

SEQ ID NO: 5233583 - DNA, 20 bp, Homo sapiens
agttatcagctctatgtcaa

SEQ ID NO: 5233584 - DNA, 17 bp, Homo sapiens
agttatcatcctattgt

SEQ ID NO: 5233585 - DNA, 18 bp, Homo sapiens
agttatcatgcatgttat

SEQ ID NO: 5233586 - DNA, 13 bp, Homo sapiens
agttatcatgtta

SEQ ID NO: 5233587 - DNA, 19 bp, Homo sapiens
agttatcatgttagtaata

SEQ ID NO: 5233588 - DNA, 17 bp, Homo sapiens
agttatcctgcaaggga

SEQ ID NO: 5233589 - DNA, 22 bp, Homo sapiens
agttatcctttgtgagcctatg

SEQ ID NO: 5233590 - DNA, 16 bp, Homo sapiens
agttatctaaaagaaa

SEQ ID NO: 5233591 - DNA, 14 bp, Homo sapiens
agttatctaagaat

SEQ ID NO: 5233592 - DNA, 14 bp, Homo sapiens
agttatctgatttt

SEQ ID NO: 5233593 - DNA, 17 bp, Homo sapiens
agttatctgtttcctgt

SEQ ID NO: 5233594 - DNA, 19 bp, Homo sapiens
agttatcttaaatatgaat

SEQ ID NO: 5233595 - DNA, 20 bp, Homo sapiens
agttatcttaaatatgaatt

SEQ ID NO: 5233596 - DNA, 15 bp, Homo sapiens
agttatcttctttat

SEQ ID NO: 5233597 - DNA, 22 bp, Homo sapiens
agttatcttctttattattcct

SEQ ID NO: 5233598 - DNA, 16 bp, Homo sapiens
agttatctttccctct

SEQ ID NO: 5233599 - DNA, 14 bp, Homo sapiens
agttatcttttaat

SEQ ID NO: 5233600 - DNA, 14 bp, Homo sapiens
agttatgaaatatt

SEQ ID NO: 5233601 - DNA, 23 bp, Homo sapiens
agttatgaacacttaaattatga

SEQ ID NO: 5233602 - DNA, 21 bp, Homo sapiens
agttatgagggtcagggcagt

SEQ ID NO: 5233603 - DNA, 14 bp, Homo sapiens
agttatgatgtaat

SEQ ID NO: 5233604 - DNA, 15 bp, Homo sapiens
agttatgcatcccca

SEQ ID NO: 5233605 - DNA, 19 bp, Homo sapiens
agttatgccgctagataca

SEQ ID NO: 5233606 - DNA, 21 bp, Homo sapiens
agttatggcctatacactatt

SEQ ID NO: 5233607 - DNA, 17 bp, Homo sapiens
agttatgtaaataattc

SEQ ID NO: 5233608 - DNA, 13 bp, Homo sapiens
agttatgtattta

SEQ ID NO: 5233609 - DNA, 12 bp, Homo sapiens
agttatgtcttt

SEQ ID NO: 5233610 - DNA, 14 bp, Homo sapiens
agttatgtgtatgt

SEQ ID NO: 5233611 - DNA, 19 bp, Homo sapiens
agttatgtgtatgtgagta

SEQ ID NO: 5233612 - DNA, 24 bp, Homo sapiens
agttatgtgttaaatttagtgcaa

SEQ ID NO: 5233613 - DNA, 14 bp, Homo sapiens
agttattaaaattg

SEQ ID NO: 5233614 - DNA, 17 bp, Homo sapiens
agttattaaaattgttg

SEQ ID NO: 5233615 - DNA, 12 bp, Homo sapiens
agttattaaata

SEQ ID NO: 5233616 - DNA, 14 bp, Homo sapiens
agttattaaatgtt

SEQ ID NO: 5233617 - DNA, 19 bp, Homo sapiens
agttattaactgtattttc

SEQ ID NO: 5233618 - DNA, 19 bp, Homo sapiens
agttattaagttctttaaa

SEQ ID NO: 5233619 - DNA, 12 bp, Homo sapiens
agttattaatag

SEQ ID NO: 5233620 - DNA, 22 bp, Homo sapiens
agttattaatttttaaggatgt

SEQ ID NO: 5233621 - DNA, 20 bp, Homo sapiens
agttattatctatggaaatg

SEQ ID NO: 5233622 - DNA, 21 bp, Homo sapiens
agttattatgtagctgaaaca

SEQ ID NO: 5233623 - DNA, 14 bp, Homo sapiens
agttattatttaat

SEQ ID NO: 5233624 - DNA, 18 bp, Homo sapiens
agttattccacaaacaca

SEQ ID NO: 5233625 - DNA, 22 bp, Homo sapiens
agttattccacaaacacattat

SEQ ID NO: 5233626 - DNA, 20 bp, Homo sapiens
agttattcttggtactgttg

SEQ ID NO: 5233627 - DNA, 23 bp, Homo sapiens
agttattcttggtactgttgctt

SEQ ID NO: 5233628 - DNA, 14 bp, Homo sapiens
agttattgaagcag

SEQ ID NO: 5233629 - DNA, 23 bp, Homo sapiens
agttattgaagcagagtggcagt

SEQ ID NO: 5233630 - DNA, 19 bp, Homo sapiens
agttattgaatcttaattt

SEQ ID NO: 5233631 - DNA, 21 bp, Homo sapiens
agttattgaatcttaattttt

SEQ ID NO: 5233632 - DNA, 21 bp, Homo sapiens
agttattgataagttcataca

SEQ ID NO: 5233633 - DNA, 16 bp, Homo sapiens
agttattgcagtttat

SEQ ID NO: 5233634 - DNA, 18 bp, Homo sapiens
agttattgcagtttatca

SEQ ID NO: 5233635 - DNA, 21 bp, Homo sapiens
agttattgctgcataaatttg

SEQ ID NO: 5233636 - DNA, 22 bp, Homo sapiens
agttattgctgcataaatttgt

SEQ ID NO: 5233637 - DNA, 20 bp, Homo sapiens
agttattgctggtgcaaaga

SEQ ID NO: 5233638 - DNA, 20 bp, Homo sapiens
agttattggatcagtgaaaa

SEQ ID NO: 5233639 - DNA, 22 bp, Homo sapiens
agttattggcatggttgttgca

SEQ ID NO: 5233640 - DNA, 24 bp, Homo sapiens
agttattggcatggttgttgcata

SEQ ID NO: 5233641 - DNA, 12 bp, Homo sapiens
agttattggtgg

SEQ ID NO: 5233642 - DNA, 22 bp, Homo sapiens
agttattgtacagctgtttaag

SEQ ID NO: 5233643 - DNA, 22 bp, Homo sapiens
agttattgtccctggcttcctt

SEQ ID NO: 5233644 - DNA, 23 bp, Homo sapiens
agttattgttttatgttctagtg

SEQ ID NO: 5233645 - DNA, 12 bp, Homo sapiens
agttatttaaat

SEQ ID NO: 5233646 - DNA, 16 bp, Homo sapiens
agttatttacttgaaa

SEQ ID NO: 5233647 - DNA, 13 bp, Homo sapiens
agttatttatgct

SEQ ID NO: 5233648 - DNA, 15 bp, Homo sapiens
agttatttatttcca

SEQ ID NO: 5233649 - DNA, 17 bp, Homo sapiens
agttatttatttccaaa

SEQ ID NO: 5233650 - DNA, 16 bp, Homo sapiens
agttatttcatctttt

SEQ ID NO: 5233651 - DNA, 14 bp, Homo sapiens
agttatttccaagt

SEQ ID NO: 5233652 - DNA, 22 bp, Homo sapiens
agttatttctgcctataaattt

SEQ ID NO: 5233653 - DNA, 14 bp, Homo sapiens
agttatttctgttt

SEQ ID NO: 5233654 - DNA, 11 bp, Homo sapiens
agttattttaa

SEQ ID NO: 5233655 - DNA, 22 bp, Homo sapiens
agttattttaatacctttaaat

SEQ ID NO: 5233656 - DNA, 19 bp, Homo sapiens
agttattttaattatcttt

SEQ ID NO: 5233657 - DNA, 15 bp, Homo sapiens
agttattttacaaat

SEQ ID NO: 5233658 - DNA, 12 bp, Homo sapiens
agttattttagg

SEQ ID NO: 5233659 - DNA, 13 bp, Homo sapiens
agttattttagga

SEQ ID NO: 5233660 - DNA, 21 bp, Homo sapiens
agttattttataatcaatgaa

SEQ ID NO: 5233661 - DNA, 24 bp, Homo sapiens
agttattttatgacatgaaaagtt

SEQ ID NO: 5233662 - DNA, 14 bp, Homo sapiens
agttattttctaca

SEQ ID NO: 5233663 - DNA, 17 bp, Homo sapiens
agttattttcttgttta

SEQ ID NO: 5233664 - DNA, 17 bp, Homo sapiens
agttattttggatatat

SEQ ID NO: 5233665 - DNA, 14 bp, Homo sapiens
agttattttgtcac

SEQ ID NO: 5233666 - DNA, 16 bp, Homo sapiens
agttattttgtgtcct

SEQ ID NO: 5233667 - DNA, 21 bp, Homo sapiens
agttatttttatttatttaaa

SEQ ID NO: 5233668 - DNA, 15 bp, Homo sapiens
agttatttttgtaca

SEQ ID NO: 5233669 - DNA, 16 bp, Homo sapiens
agttatttttgtacat

SEQ ID NO: 5233670 - DNA, 18 bp, Homo sapiens
agttcaaacataaggaaa

SEQ ID NO: 5233671 - DNA, 14 bp, Homo sapiens
agttcaaactcaca

SEQ ID NO: 5233672 - DNA, 15 bp, Homo sapiens
agttcaaagtcatga

SEQ ID NO: 5233673 - DNA, 22 bp, Homo sapiens
agttcaaagtcatgatgttttt

SEQ ID NO: 5233674 - DNA, 21 bp, Homo sapiens
agttcaaagtgtatatttatt

SEQ ID NO: 5233675 - DNA, 22 bp, Homo sapiens
agttcaaagtgtatatttattc

SEQ ID NO: 5233676 - DNA, 21 bp, Homo sapiens
agttcaaatgatgaagaccaa

SEQ ID NO: 5233677 - DNA, 14 bp, Homo sapiens
agttcaacaacaaa

SEQ ID NO: 5233678 - DNA, 15 bp, Homo sapiens
agttcaacaacaaaa

SEQ ID NO: 5233679 - DNA, 21 bp, Homo sapiens
agttcaacctggtggcaccag

SEQ ID NO: 5233680 - DNA, 19 bp, Homo sapiens
agttcaagaaataagtttt

SEQ ID NO: 5233681 - DNA, 17 bp, Homo sapiens
agttcaagaaatgaaga

SEQ ID NO: 5233682 - DNA, 18 bp, Homo sapiens
agttcaagaccagcctgg

SEQ ID NO: 5233683 - DNA, 22 bp, Homo sapiens
agttcaagcctgtgggagtaga

SEQ ID NO: 5233684 - DNA, 11 bp, Homo sapiens
agttcaagtga

SEQ ID NO: 5233685 - DNA, 21 bp, Homo sapiens
agttcaataaatgtctgttga

SEQ ID NO: 5233686 - DNA, 20 bp, Homo sapiens
agttcaatactcttgaaatg

SEQ ID NO: 5233687 - DNA, 19 bp, Homo sapiens
agttcaatcaaactttcag

SEQ ID NO: 5233688 - DNA, 18 bp, Homo sapiens
agttcaatcctgattcat

SEQ ID NO: 5233689 - DNA, 22 bp, Homo sapiens
agttcaatctcccgctgctgct

SEQ ID NO: 5233690 - DNA, 11 bp, Homo sapiens
agttcaatgat

SEQ ID NO: 5233691 - DNA, 14 bp, Homo sapiens
agttcaatgatcta

SEQ ID NO: 5233692 - DNA, 22 bp, Homo sapiens
agttcaatgttcagttttcctt

SEQ ID NO: 5233693 - DNA, 16 bp, Homo sapiens
agttcaattgtgaaaa

SEQ ID NO: 5233694 - DNA, 20 bp, Homo sapiens
agttcaattgtgaaaatgaa

SEQ ID NO: 5233695 - DNA, 17 bp, Homo sapiens
agttcaattgtgtctgt

SEQ ID NO: 5233696 - DNA, 18 bp, Homo sapiens
agttcacaaaaaaatgtt

SEQ ID NO: 5233697 - DNA, 22 bp, Homo sapiens
agttcacaaaaaaatgttcatt

SEQ ID NO: 5233698 - DNA, 14 bp, Homo sapiens
agttcacaccctgc

SEQ ID NO: 5233699 - DNA, 15 bp, Homo sapiens
agttcacaccctgca

SEQ ID NO: 5233700 - DNA, 17 bp, Homo sapiens
agttcacaccctgcaag

SEQ ID NO: 5233701 - DNA, 18 bp, Homo sapiens
atacacaactttgcaaat

SEQ ID NO: 5233702 - DNA, 18 bp, Homo sapiens
atacacaagagggactgt

SEQ ID NO: 5233703 - DNA, 19 bp, Homo sapiens
atacacaagcaatgcaaga

SEQ ID NO: 5233704 - DNA, 15 bp, Homo sapiens
atacacaagtaaaca

SEQ ID NO: 5233705 - DNA, 15 bp, Homo sapiens
atacacaatcctcca

SEQ ID NO: 5233706 - DNA, 17 bp, Homo sapiens
atacacacacaaagaga

SEQ ID NO: 5233707 - DNA, 12 bp, Homo sapiens
atacacacacac

SEQ ID NO: 5233708 - DNA, 15 bp, Homo sapiens
atacacacacacaca

SEQ ID NO: 5233709 - DNA, 18 bp, Homo sapiens
atacacacacacacacag

SEQ ID NO: 5233710 - DNA, 21 bp, Homo sapiens
atacacacacacacacagcca

SEQ ID NO: 5233711 - DNA, 23 bp, Homo sapiens
atacacacacacacacagccaca

SEQ ID NO: 5233712 - DNA, 13 bp, Homo sapiens
atacacacagtta

SEQ ID NO: 5233713 - DNA, 16 bp, Homo sapiens
atacacacatatacat

SEQ ID NO: 5233714 - DNA, 18 bp, Homo sapiens
atacacacatatacatat

SEQ ID NO: 5233715 - DNA, 21 bp, Homo sapiens
atacacacatatacatatata

SEQ ID NO: 5233716 - DNA, 14 bp, Homo sapiens
atacacacgctgcc

SEQ ID NO: 5233717 - DNA, 18 bp, Homo sapiens
atacacacggctccccca

SEQ ID NO: 5233718 - DNA, 13 bp, Homo sapiens
atacacagaggag

SEQ ID NO: 5233719 - DNA, 14 bp, Homo sapiens
atacacagggaggg

SEQ ID NO: 5233720 - DNA, 12 bp, Homo sapiens
atacacagtatt

SEQ ID NO: 5233721 - DNA, 23 bp, Homo sapiens
atacacataattaaagtgtccat

SEQ ID NO: 5233722 - DNA, 23 bp, Homo sapiens
atacacatagttctgtaataaaa

SEQ ID NO: 5233723 - DNA, 18 bp, Homo sapiens
atacacatataaaaacaa

SEQ ID NO: 5233724 - DNA, 21 bp, Homo sapiens
atacacatatacctataatgt

SEQ ID NO: 5233725 - DNA, 23 bp, Homo sapiens
atacacatatatatattttacat

SEQ ID NO: 5233726 - DNA, 14 bp, Homo sapiens
atacacatgaaaac

SEQ ID NO: 5233727 - DNA, 13 bp, Homo sapiens
atacacatggaaa

SEQ ID NO: 5233728 - DNA, 17 bp, Homo sapiens
atacacatggaaaaaaa

SEQ ID NO: 5233729 - DNA, 14 bp, Homo sapiens
atacacattagaaa

SEQ ID NO: 5233730 - DNA, 15 bp, Homo sapiens
atacacatttcacat

SEQ ID NO: 5233731 - DNA, 19 bp, Homo sapiens
atacacattttgtaaatct

SEQ ID NO: 5233732 - DNA, 23 bp, Homo sapiens
atacacattttgtaaatctgtac

SEQ ID NO: 5233733 - DNA, 13 bp, Homo sapiens
atacaccaaacat

SEQ ID NO: 5233734 - DNA, 16 bp, Homo sapiens
atacaccaaacatttc

SEQ ID NO: 5233735 - DNA, 11 bp, Homo sapiens
atacaccaagt

SEQ ID NO: 5233736 - DNA, 15 bp, Homo sapiens
atacaccactacatt

SEQ ID NO: 5233737 - DNA, 21 bp, Homo sapiens
atacaccactacattctgtta

SEQ ID NO: 5233738 - DNA, 22 bp, Homo sapiens
atacaccagaagacaaacaata

SEQ ID NO: 5233739 - DNA, 19 bp, Homo sapiens
atacacccagttctgaata

SEQ ID NO: 5233740 - DNA, 22 bp, Homo sapiens
atacaccccctcttctgagcac

SEQ ID NO: 5233741 - DNA, 23 bp, Homo sapiens
atacaccccctcttctgagcaca

SEQ ID NO: 5233742 - DNA, 19 bp, Homo sapiens
atacacgaatagacatcaa

SEQ ID NO: 5233743 - DNA, 16 bp, Homo sapiens
atacacgggacagttg

SEQ ID NO: 5233744 - DNA, 19 bp, Homo sapiens
atacacgggacagttgctg

SEQ ID NO: 5233745 - DNA, 16 bp, Homo sapiens
atacacgtgtatatga

SEQ ID NO: 5233746 - DNA, 19 bp, Homo sapiens
atacactaaccaaatctct

SEQ ID NO: 5233747 - DNA, 22 bp, Homo sapiens
atacactaatgagtatttggta

SEQ ID NO: 5233748 - DNA, 15 bp, Homo sapiens
atacactacaaatgt

SEQ ID NO: 5233749 - DNA, 19 bp, Homo sapiens
atacactacaaatgttaaa

SEQ ID NO: 5233750 - DNA, 21 bp, Homo sapiens
atacactatgaagatgtttca

SEQ ID NO: 5233751 - DNA, 22 bp, Homo sapiens
atacactatttgtgagcaaagg

SEQ ID NO: 5233752 - DNA, 20 bp, Homo sapiens
atacactcaaacaatcatga

SEQ ID NO: 5233753 - DNA, 13 bp, Homo sapiens
atacactctctag

SEQ ID NO: 5233754 - DNA, 17 bp, Homo sapiens
atacactgaaaggaaaa

SEQ ID NO: 5233755 - DNA, 21 bp, Homo sapiens
atacactgaaaggaaaaatgt

SEQ ID NO: 5233756 - DNA, 20 bp, Homo sapiens
atacactgaattgaatctac

SEQ ID NO: 5233757 - DNA, 12 bp, Homo sapiens
atacactgagat

SEQ ID NO: 5233758 - DNA, 13 bp, Homo sapiens
atacactgtaagc

SEQ ID NO: 5233759 - DNA, 16 bp, Homo sapiens
atacactgtaagcttt

SEQ ID NO: 5233760 - DNA, 17 bp, Homo sapiens
atacactgtaagctttg

SEQ ID NO: 5233761 - DNA, 23 bp, Homo sapiens
atacactgtagtttttgaaaatt

SEQ ID NO: 5233762 - DNA, 16 bp, Homo sapiens
atacactgtatctaaa

SEQ ID NO: 5233763 - DNA, 20 bp, Homo sapiens
atacactgtatgttatagaa

SEQ ID NO: 5233764 - DNA, 20 bp, Homo sapiens
atacacttcttttgaacatc

SEQ ID NO: 5233765 - DNA, 22 bp, Homo sapiens
atacacttggggagatttgcca

SEQ ID NO: 5233766 - DNA, 21 bp, Homo sapiens
atacactttgttgcaagatgt

SEQ ID NO: 5233767 - DNA, 23 bp, Homo sapiens
atacactttgttgcaagatgtga

SEQ ID NO: 5233768 - DNA, 17 bp, Homo sapiens
atacacttttttccaaa

SEQ ID NO: 5233769 - DNA, 16 bp, Homo sapiens
atacagaaatgcaaaa

SEQ ID NO: 5233770 - DNA, 14 bp, Homo sapiens
atacagaactcaca

SEQ ID NO: 5233771 - DNA, 21 bp, Homo sapiens
atacagaactcacagtaccta

SEQ ID NO: 5233772 - DNA, 20 bp, Homo sapiens
atacagaactgaattaagtt

SEQ ID NO: 5233773 - DNA, 19 bp, Homo sapiens
atacagaagcccatgtctt

SEQ ID NO: 5233774 - DNA, 14 bp, Homo sapiens
atacagaatgaatc

SEQ ID NO: 5233775 - DNA, 16 bp, Homo sapiens
atacagaattgactgc

SEQ ID NO: 5233776 - DNA, 21 bp, Homo sapiens
atacagaattgactgcagttg

SEQ ID NO: 5233777 - DNA, 21 bp, Homo sapiens
atacagaattgtgtctgcagg

SEQ ID NO: 5233778 - DNA, 22 bp, Homo sapiens
atacagaattgtgtctgcagga

SEQ ID NO: 5233779 - DNA, 17 bp, Homo sapiens
atacagaatttatagaa

SEQ ID NO: 5233780 - DNA, 12 bp, Homo sapiens
atacagacacta

SEQ ID NO: 5233781 - DNA, 15 bp, Homo sapiens
atacagacactaagt

SEQ ID NO: 5233782 - DNA, 23 bp, Homo sapiens
atacagacactaagttatagtat

SEQ ID NO: 5233783 - DNA, 18 bp, Homo sapiens
atacagaccgaactgttg

SEQ ID NO: 5233784 - DNA, 22 bp, Homo sapiens
atacagagatatacaaatatat

SEQ ID NO: 5233785 - DNA, 12 bp, Homo sapiens
atacagagccac

SEQ ID NO: 5233786 - DNA, 13 bp, Homo sapiens
atacagagccacg

SEQ ID NO: 5233787 - DNA, 22 bp, Homo sapiens
atacagagcctgttttaaaaaa

SEQ ID NO: 5233788 - DNA, 18 bp, Homo sapiens
atacagagctctctgagg

SEQ ID NO: 5233789 - DNA, 12 bp, Homo sapiens
atacagaggaga

SEQ ID NO: 5233790 - DNA, 13 bp, Homo sapiens
atacagaggagat

SEQ ID NO: 5233791 - DNA, 16 bp, Homo sapiens
atacagaggcaactgc

SEQ ID NO: 5233792 - DNA, 17 bp, Homo sapiens
atacagaggcaactgca

SEQ ID NO: 5233793 - DNA, 18 bp, Homo sapiens
atacagaggtaactatca

SEQ ID NO: 5233794 - DNA, 14 bp, Homo sapiens
atacagagtatatt

SEQ ID NO: 5233795 - DNA, 14 bp, Homo sapiens
atacagataacatt

SEQ ID NO: 5233796 - DNA, 13 bp, Homo sapiens
atacagatatatt

SEQ ID NO: 5233797 - DNA, 19 bp, Homo sapiens
atacagatcaggcagtgtt

SEQ ID NO: 5233798 - DNA, 19 bp, Homo sapiens
atacagatccgcatgtgtc

SEQ ID NO: 5233799 - DNA, 22 bp, Homo sapiens
atacagatctcagggctcggga

SEQ ID NO: 5233800 - DNA, 20 bp, Homo sapiens
atacagatctgtttattctg

SEQ ID NO: 5233801 - DNA, 20 bp, Homo sapiens
atacagatgaaaatttgaga

SEQ ID NO: 5233802 - DNA, 17 bp, Homo sapiens
atacagatgacaatggg

SEQ ID NO: 5233803 - DNA, 17 bp, Homo sapiens
atacagatgcaagcaag

SEQ ID NO: 5233804 - DNA, 17 bp, Homo sapiens
atacagattttgatagc

SEQ ID NO: 5233805 - DNA, 22 bp, Homo sapiens
atacagattttgatagcaaagc

SEQ ID NO: 5233806 - DNA, 15 bp, Homo sapiens
atacagcaaaggaaa

SEQ ID NO: 5233807 - DNA, 22 bp, Homo sapiens
atacagcactacttacttagag

SEQ ID NO: 5233808 - DNA, 22 bp, Homo sapiens
atacagcagagctaggtggaaa

SEQ ID NO: 5233809 - DNA, 23 bp, Homo sapiens
atacagcatgagattgtacattt

SEQ ID NO: 5233810 - DNA, 21 bp, Homo sapiens
atacagccccaaaccagggtg

SEQ ID NO: 5233811 - DNA, 22 bp, Homo sapiens
atacagccccaaaccagggtgc

SEQ ID NO: 5233812 - DNA, 17 bp, Homo sapiens
atacagcgctctctctg

SEQ ID NO: 5233813 - DNA, 19 bp, Homo sapiens
atacagctattaaaatgta

SEQ ID NO: 5233814 - DNA, 13 bp, Homo sapiens
atacagctcagaa

SEQ ID NO: 5233815 - DNA, 16 bp, Homo sapiens
atacagctggctatct

SEQ ID NO: 5233816 - DNA, 20 bp, Homo sapiens
atacagctggctatctacta

SEQ ID NO: 5233817 - DNA, 20 bp, Homo sapiens
atacagctgtattgtctgaa

SEQ ID NO: 5233818 - DNA, 12 bp, Homo sapiens
atacagctttct

SEQ ID NO: 5233819 - DNA, 19 bp, Homo sapiens
atacaggaaaagctgctga

SEQ ID NO: 5233820 - DNA, 23 bp, Homo sapiens
atacaggaaaagctgctgacagt

SEQ ID NO: 5233821 - DNA, 17 bp, Homo sapiens
atacaggaatgaagcct

SEQ ID NO: 5233822 - DNA, 20 bp, Homo sapiens
atacaggactggttccttcc

SEQ ID NO: 5233823 - DNA, 18 bp, Homo sapiens
atacaggacttttaaatg

SEQ ID NO: 5233824 - DNA, 15 bp, Homo sapiens
atacaggagacccaa

SEQ ID NO: 5233825 - DNA, 21 bp, Homo sapiens
atacaggagacccaacaatga

SEQ ID NO: 5233826 - DNA, 18 bp, Homo sapiens
atacaggagagaagctgg

SEQ ID NO: 5233827 - DNA, 17 bp, Homo sapiens
atacaggagattctctt

SEQ ID NO: 5233828 - DNA, 20 bp, Homo sapiens
atacagggagccggcggcct

SEQ ID NO: 5233829 - DNA, 19 bp, Homo sapiens
atacaggggaatattttat

SEQ ID NO: 5233830 - DNA, 21 bp, Homo sapiens
atacaggggaggggcgcaccc

SEQ ID NO: 5233831 - DNA, 22 bp, Homo sapiens
atacagggtgctccttgtcaat

SEQ ID NO: 5233832 - DNA, 21 bp, Homo sapiens
atacaggtcatattaatatat

SEQ ID NO: 5233833 - DNA, 14 bp, Homo sapiens
atacaggtgacagt

SEQ ID NO: 5233834 - DNA, 12 bp, Homo sapiens
atacaggtgctc

SEQ ID NO: 5233835 - DNA, 18 bp, Homo sapiens
atacagtaaagtttaaaa

SEQ ID NO: 5233836 - DNA, 21 bp, Homo sapiens
atacagtaaagtttaaaaaat

SEQ ID NO: 5233837 - DNA, 17 bp, Homo sapiens
atacagtaactttatgt

SEQ ID NO: 5233838 - DNA, 19 bp, Homo sapiens
atacagtaagctgctctat

SEQ ID NO: 5233839 - DNA, 12 bp, Homo sapiens
atacagtacaca

SEQ ID NO: 5233840 - DNA, 19 bp, Homo sapiens
atacagtagtgagaagaat

SEQ ID NO: 5233841 - DNA, 18 bp, Homo sapiens
atacagtattatttagta

SEQ ID NO: 5233842 - DNA, 23 bp, Homo sapiens
atacagtattatttagtaaaatt

SEQ ID NO: 5233843 - DNA, 24 bp, Homo sapiens
atacagtcattatttaaagcacat

SEQ ID NO: 5233844 - DNA, 16 bp, Homo sapiens
atacagtctctatttg

SEQ ID NO: 5233845 - DNA, 14 bp, Homo sapiens
atacagtgaagcaa

SEQ ID NO: 5233846 - DNA, 23 bp, Homo sapiens
atacagtgcagagccttctcaga

SEQ ID NO: 5233847 - DNA, 14 bp, Homo sapiens
atacagtgcccacc

SEQ ID NO: 5233848 - DNA, 13 bp, Homo sapiens
atacagtgccttg

SEQ ID NO: 5233849 - DNA, 13 bp, Homo sapiens
atacagtgtacat

SEQ ID NO: 5233850 - DNA, 16 bp, Homo sapiens
atacagtgtacatgta

SEQ ID NO: 5233851 - DNA, 18 bp, Homo sapiens
atacagttactcagaatt

SEQ ID NO: 5233852 - DNA, 17 bp, Homo sapiens
atacagttacttaatga

SEQ ID NO: 5233853 - DNA, 17 bp, Homo sapiens
atacagttataaaatta

SEQ ID NO: 5233854 - DNA, 18 bp, Homo sapiens
atacagttataaaattaa

SEQ ID NO: 5233855 - DNA, 21 bp, Homo sapiens
atacagttcggtgagctacaa

SEQ ID NO: 5233856 - DNA, 15 bp, Homo sapiens
atacagttgtataaa

SEQ ID NO: 5233857 - DNA, 18 bp, Homo sapiens
atacagtttataaagcca

SEQ ID NO: 5233858 - DNA, 17 bp, Homo sapiens
atacagtttgacttttt

SEQ ID NO: 5233859 - DNA, 20 bp, Homo sapiens
atacagtttgactttttgga

SEQ ID NO: 5233860 - DNA, 15 bp, Homo sapiens
atacagttttaaaga

SEQ ID NO: 5233861 - DNA, 17 bp, Homo sapiens
atacagttttaaagaat

SEQ ID NO: 5233862 - DNA, 20 bp, Homo sapiens
atacagttttatgctctttt

SEQ ID NO: 5233863 - DNA, 21 bp, Homo sapiens
atacagttttatgctcttttt

SEQ ID NO: 5233864 - DNA, 14 bp, Homo sapiens
atacagttttcatt

SEQ ID NO: 5233865 - DNA, 21 bp, Homo sapiens
atacataaaagaatgtacaga

SEQ ID NO: 5233866 - DNA, 20 bp, Homo sapiens
atacataaacaagaccacgt

SEQ ID NO: 5233867 - DNA, 12 bp, Homo sapiens
atacataaagtt

SEQ ID NO: 5233868 - DNA, 14 bp, Homo sapiens
atacataaagttct

SEQ ID NO: 5233869 - DNA, 23 bp, Homo sapiens
atacataaagttctctgtaatta

SEQ ID NO: 5233870 - DNA, 18 bp, Homo sapiens
atacataaatagtagaaa

SEQ ID NO: 5233871 - DNA, 17 bp, Homo sapiens
atacataaatgcccagc

SEQ ID NO: 5233872 - DNA, 22 bp, Homo sapiens
atacataactaaatttgatact

SEQ ID NO: 5233873 - DNA, 14 bp, Homo sapiens
atacataactagtt

SEQ ID NO: 5233874 - DNA, 14 bp, Homo sapiens
atacataactgaag

SEQ ID NO: 5233875 - DNA, 13 bp, Homo sapiens
atacataacttca

SEQ ID NO: 5233876 - DNA, 17 bp, Homo sapiens
atacataacttcagtgc

SEQ ID NO: 5233877 - DNA, 17 bp, Homo sapiens
atacataacttgatata

SEQ ID NO: 5233878 - DNA, 22 bp, Homo sapiens
agttcacaccctgcaaggccca

SEQ ID NO: 5233879 - DNA, 14 bp, Homo sapiens
agttcacaggaggc

SEQ ID NO: 5233880 - DNA, 18 bp, Homo sapiens
agttcacatgtgccctgc

SEQ ID NO: 5233881 - DNA, 19 bp, Homo sapiens
agttcacatgtgccctgcc

SEQ ID NO: 5233882 - DNA, 19 bp, Homo sapiens
agttcaccagccctgagcc

SEQ ID NO: 5233883 - DNA, 19 bp, Homo sapiens
agttcaccccttatcctga

SEQ ID NO: 5233884 - DNA, 15 bp, Homo sapiens
agttcaccttggaag

SEQ ID NO: 5233885 - DNA, 22 bp, Homo sapiens
agttcacgtaagatacaagttt

SEQ ID NO: 5233886 - DNA, 22 bp, Homo sapiens
agttcactgttgtacacagtct

SEQ ID NO: 5233887 - DNA, 17 bp, Homo sapiens
agttcacttactcttac

SEQ ID NO: 5233888 - DNA, 22 bp, Homo sapiens
agttcacttcatcttctcagct

SEQ ID NO: 5233889 - DNA, 22 bp, Homo sapiens
agttcacttctttgcagagcct

SEQ ID NO: 5233890 - DNA, 20 bp, Homo sapiens
agttcagaaatttaaaagca

SEQ ID NO: 5233891 - DNA, 17 bp, Homo sapiens
agttcagaaggtgtgtc

SEQ ID NO: 5233892 - DNA, 15 bp, Homo sapiens
agttcagacttagtt

SEQ ID NO: 5233893 - DNA, 18 bp, Homo sapiens
agttcagagccaagcctt

SEQ ID NO: 5233894 - DNA, 19 bp, Homo sapiens
agttcagagctgccctctc

SEQ ID NO: 5233895 - DNA, 16 bp, Homo sapiens
agttcagaggaagcac

SEQ ID NO: 5233896 - DNA, 12 bp, Homo sapiens
agttcagagttt

SEQ ID NO: 5233897 - DNA, 15 bp, Homo sapiens
agttcagagttttct

SEQ ID NO: 5233898 - DNA, 15 bp, Homo sapiens
agttcagcaccaccc

SEQ ID NO: 5233899 - DNA, 17 bp, Homo sapiens
agttcagcaccacccta

SEQ ID NO: 5233900 - DNA, 18 bp, Homo sapiens
agttcagcaccaccctag

SEQ ID NO: 5233901 - DNA, 14 bp, Homo sapiens
agttcagcacttgt

SEQ ID NO: 5233902 - DNA, 15 bp, Homo sapiens
agttcagccaccctg

SEQ ID NO: 5233903 - DNA, 12 bp, Homo sapiens
agttcagccaga

SEQ ID NO: 5233904 - DNA, 19 bp, Homo sapiens
agttcagcggttgaggaga

SEQ ID NO: 5233905 - DNA, 16 bp, Homo sapiens
agttcaggaatttttg

SEQ ID NO: 5233906 - DNA, 17 bp, Homo sapiens
agttcaggaatttttgt

SEQ ID NO: 5233907 - DNA, 16 bp, Homo sapiens
agttcaggagtcccaa

SEQ ID NO: 5233908 - DNA, 21 bp, Homo sapiens
agttcaggagtcccaaggaaa

SEQ ID NO: 5233909 - DNA, 16 bp, Homo sapiens
agttcagggaagcagg

SEQ ID NO: 5233910 - DNA, 18 bp, Homo sapiens
agttcagggaagcaggca

SEQ ID NO: 5233911 - DNA, 20 bp, Homo sapiens
agttcagggaagcaggcaga

SEQ ID NO: 5233912 - DNA, 19 bp, Homo sapiens
agttcaggtaacaggcaga

SEQ ID NO: 5233913 - DNA, 20 bp, Homo sapiens
agttcagtaagaccggaagc

SEQ ID NO: 5233914 - DNA, 20 bp, Homo sapiens
agttcagtacctggaggagg

SEQ ID NO: 5233915 - DNA, 22 bp, Homo sapiens
agttcagtgataactctgagca

SEQ ID NO: 5233916 - DNA, 11 bp, Homo sapiens
agttcagtggc

SEQ ID NO: 5233917 - DNA, 19 bp, Homo sapiens
agttcagtggcactcaaca

SEQ ID NO: 5233918 - DNA, 13 bp, Homo sapiens
agttcagtggcag

SEQ ID NO: 5233919 - DNA, 18 bp, Homo sapiens
agttcagtggcagggctc

SEQ ID NO: 5233920 - DNA, 19 bp, Homo sapiens
agttcagtggcagggctca

SEQ ID NO: 5233921 - DNA, 14 bp, Homo sapiens
agttcagtgttgca

SEQ ID NO: 5233922 - DNA, 20 bp, Homo sapiens
agttcagttcctctttgcat

SEQ ID NO: 5233923 - DNA, 18 bp, Homo sapiens
agttcataacagtgccat

SEQ ID NO: 5233924 - DNA, 10 bp, Homo sapiens
agttcataca

SEQ ID NO: 5233925 - DNA, 21 bp, Homo sapiens
agttcatacaacatgcatgtt

SEQ ID NO: 5233926 - DNA, 13 bp, Homo sapiens
agttcatactgat

SEQ ID NO: 5233927 - DNA, 14 bp, Homo sapiens
agttcatagaaata

SEQ ID NO: 5233928 - DNA, 19 bp, Homo sapiens
agttcatagaaatacatca

SEQ ID NO: 5233929 - DNA, 20 bp, Homo sapiens
agttcatagggtctcttcag

SEQ ID NO: 5233930 - DNA, 20 bp, Homo sapiens
agttcatatctggagcctga

SEQ ID NO: 5233931 - DNA, 19 bp, Homo sapiens
agttcatcaaatcatcatt

SEQ ID NO: 5233932 - DNA, 20 bp, Homo sapiens
agttcatcagagttatggtg

SEQ ID NO: 5233933 - DNA, 13 bp, Homo sapiens
agttcatcccttc

SEQ ID NO: 5233934 - DNA, 17 bp, Homo sapiens
agttcatccgcactgta

SEQ ID NO: 5233935 - DNA, 18 bp, Homo sapiens
agttcatcctgcatggga

SEQ ID NO: 5233936 - DNA, 20 bp, Homo sapiens
agttcatctctgctgaacat

SEQ ID NO: 5233937 - DNA, 13 bp, Homo sapiens
agttcatcttgaa

SEQ ID NO: 5233938 - DNA, 14 bp, Homo sapiens
agttcatcttgcag

SEQ ID NO: 5233939 - DNA, 21 bp, Homo sapiens
agttcatggcttttctctttg

SEQ ID NO: 5233940 - DNA, 14 bp, Homo sapiens
agttcatgtaaata

SEQ ID NO: 5233941 - DNA, 18 bp, Homo sapiens
agttcatgtctgaaacag

SEQ ID NO: 5233942 - DNA, 21 bp, Homo sapiens
agttcatgtctgaaacagaga

SEQ ID NO: 5233943 - DNA, 17 bp, Homo sapiens
agttcatgtctgctatc

SEQ ID NO: 5233944 - DNA, 22 bp, Homo sapiens
agttcatgtgtggaaatgggac

SEQ ID NO: 5233945 - DNA, 22 bp, Homo sapiens
agttcatgttgctcagaagaga

SEQ ID NO: 5233946 - DNA, 19 bp, Homo sapiens
agttcattacctccctatc

SEQ ID NO: 5233947 - DNA, 15 bp, Homo sapiens
agttcattagaaata

SEQ ID NO: 5233948 - DNA, 14 bp, Homo sapiens
agttcattcatatt

SEQ ID NO: 5233949 - DNA, 15 bp, Homo sapiens
agttcattctaccaa

SEQ ID NO: 5233950 - DNA, 18 bp, Homo sapiens
agttcattctaccaagct

SEQ ID NO: 5233951 - DNA, 19 bp, Homo sapiens
agttcattctaccaagctg

SEQ ID NO: 5233952 - DNA, 18 bp, Homo sapiens
agttcattgacctcatca

SEQ ID NO: 5233953 - DNA, 21 bp, Homo sapiens
agttcattgtaaatgaacata

SEQ ID NO: 5233954 - DNA, 22 bp, Homo sapiens
agttcattgtaaatgaacataa

SEQ ID NO: 5233955 - DNA, 19 bp, Homo sapiens
agttcatttttatcccttc

SEQ ID NO: 5233956 - DNA, 18 bp, Homo sapiens
agttccaaaatgccaaat

SEQ ID NO: 5233957 - DNA, 11 bp, Homo sapiens
agttccaacat

SEQ ID NO: 5233958 - DNA, 20 bp, Homo sapiens
agttccaagagtctaaagat

SEQ ID NO: 5233959 - DNA, 14 bp, Homo sapiens
agttccaatgtgcc

SEQ ID NO: 5233960 - DNA, 15 bp, Homo sapiens
agttccaatgtgccc

SEQ ID NO: 5233961 - DNA, 16 bp, Homo sapiens
agttccacaattttgt

SEQ ID NO: 5233962 - DNA, 13 bp, Homo sapiens
agttccacagcag

SEQ ID NO: 5233963 - DNA, 21 bp, Homo sapiens
agttccaccatcaagccacca

SEQ ID NO: 5233964 - DNA, 13 bp, Homo sapiens
agttccactgaga

SEQ ID NO: 5233965 - DNA, 15 bp, Homo sapiens
agttccactgagctc

SEQ ID NO: 5233966 - DNA, 23 bp, Homo sapiens
agttccacttccaggtctgcctg

SEQ ID NO: 5233967 - DNA, 18 bp, Homo sapiens
agttccagaagtgtgact

SEQ ID NO: 5233968 - DNA, 16 bp, Homo sapiens
agttccagctggtctt

SEQ ID NO: 5233969 - DNA, 13 bp, Homo sapiens
agttccagctttt

SEQ ID NO: 5233970 - DNA, 17 bp, Homo sapiens
agttccaggactcaggg

SEQ ID NO: 5233971 - DNA, 20 bp, Homo sapiens
agttccagtcctaactttct

SEQ ID NO: 5233972 - DNA, 15 bp, Homo sapiens
agttccagtgctgca

SEQ ID NO: 5233973 - DNA, 17 bp, Homo sapiens
agttccagtttctcctt

SEQ ID NO: 5233974 - DNA, 19 bp, Homo sapiens
agttccagttttgttttga

SEQ ID NO: 5233975 - DNA, 23 bp, Homo sapiens
agttccatcaggtcccccccagg

SEQ ID NO: 5233976 - DNA, 22 bp, Homo sapiens
agttccatgaagaccacatcca

SEQ ID NO: 5233977 - DNA, 18 bp, Homo sapiens
agttccattatgaaaatc

SEQ ID NO: 5233978 - DNA, 13 bp, Homo sapiens
agttccattcttg

SEQ ID NO: 5233979 - DNA, 15 bp, Homo sapiens
agttccattcttggt

SEQ ID NO: 5233980 - DNA, 17 bp, Homo sapiens
agttcccacattaaaga

SEQ ID NO: 5233981 - DNA, 18 bp, Homo sapiens
agttcccaccatctgatt

SEQ ID NO: 5233982 - DNA, 13 bp, Homo sapiens
agttcccagaatc

SEQ ID NO: 5233983 - DNA, 14 bp, Homo sapiens
agttcccagagtgg

SEQ ID NO: 5233984 - DNA, 14 bp, Homo sapiens
agttcccagctccc

SEQ ID NO: 5233985 - DNA, 16 bp, Homo sapiens
agttcccagctccccc

SEQ ID NO: 5233986 - DNA, 17 bp, Homo sapiens
agttcccagctcccccc

SEQ ID NO: 5233987 - DNA, 21 bp, Homo sapiens
agttcccagctccccccgccc

SEQ ID NO: 5233988 - DNA, 23 bp, Homo sapiens
agttcccagctccccccgcccac

SEQ ID NO: 5233989 - DNA, 19 bp, Homo sapiens
agttcccagttggagctcc

SEQ ID NO: 5233990 - DNA, 20 bp, Homo sapiens
agttcccagttggagctcca

SEQ ID NO: 5233991 - DNA, 20 bp, Homo sapiens
agttcccatctcctttctct

SEQ ID NO: 5233992 - DNA, 19 bp, Homo sapiens
agttcccatggtgtatgtg

SEQ ID NO: 5233993 - DNA, 21 bp, Homo sapiens
agttcccatggtgtatgtggt

SEQ ID NO: 5233994 - DNA, 19 bp, Homo sapiens
agttcccatttccttgtct

SEQ ID NO: 5233995 - DNA, 20 bp, Homo sapiens
agttccccatccctgtcatt

SEQ ID NO: 5233996 - DNA, 18 bp, Homo sapiens
agttcccccaacctcaga

SEQ ID NO: 5233997 - DNA, 15 bp, Homo sapiens
agttccccgctgacc

SEQ ID NO: 5233998 - DNA, 23 bp, Homo sapiens
agttcccctggaagcagtgccca

SEQ ID NO: 5233999 - DNA, 14 bp, Homo sapiens
agttcccctggagc

SEQ ID NO: 5234000 - DNA, 18 bp, Homo sapiens
agttcccctgtttattca

SEQ ID NO: 5234001 - DNA, 15 bp, Homo sapiens
agttcccgctctgca

SEQ ID NO: 5234002 - DNA, 21 bp, Homo sapiens
agttcccggagcacagccctg

SEQ ID NO: 5234003 - DNA, 22 bp, Homo sapiens
agttcccgggagctgggccctg

SEQ ID NO: 5234004 - DNA, 15 bp, Homo sapiens
agttccctacttcct

SEQ ID NO: 5234005 - DNA, 16 bp, Homo sapiens
agttccctcagccctc

SEQ ID NO: 5234006 - DNA, 16 bp, Homo sapiens
agttccctcctgcagc

SEQ ID NO: 5234007 - DNA, 15 bp, Homo sapiens
agttccctcctgccc

SEQ ID NO: 5234008 - DNA, 15 bp, Homo sapiens
agttccctctgcctg

SEQ ID NO: 5234009 - DNA, 16 bp, Homo sapiens
agttccctctgcctgg

SEQ ID NO: 5234010 - DNA, 14 bp, Homo sapiens
agttccctctgctc

SEQ ID NO: 5234011 - DNA, 17 bp, Homo sapiens
agttccctgaaacacga

SEQ ID NO: 5234012 - DNA, 17 bp, Homo sapiens
agttcccttgaaacttt

SEQ ID NO: 5234013 - DNA, 19 bp, Homo sapiens
agttcccttgattcaaata

SEQ ID NO: 5234014 - DNA, 18 bp, Homo sapiens
agttcccttggcctcaga

SEQ ID NO: 5234015 - DNA, 16 bp, Homo sapiens
agttcccttggtggca

SEQ ID NO: 5234016 - DNA, 17 bp, Homo sapiens
agttccgcctcccgggt

SEQ ID NO: 5234017 - DNA, 14 bp, Homo sapiens
agttccggcctggg

SEQ ID NO: 5234018 - DNA, 16 bp, Homo sapiens
agttccggcctgggca

SEQ ID NO: 5234019 - DNA, 13 bp, Homo sapiens
agttccgtctcct

SEQ ID NO: 5234020 - DNA, 15 bp, Homo sapiens
agttccgtctcctct

SEQ ID NO: 5234021 - DNA, 22 bp, Homo sapiens
agttcctaagaagcttctaata

SEQ ID NO: 5234022 - DNA, 13 bp, Homo sapiens
agttcctatcttt

SEQ ID NO: 5234023 - DNA, 17 bp, Homo sapiens
agttcctatgacacagt

SEQ ID NO: 5234024 - DNA, 18 bp, Homo sapiens
agttcctcctacttacaa

SEQ ID NO: 5234025 - DNA, 13 bp, Homo sapiens
agttcctcgccct

SEQ ID NO: 5234026 - DNA, 21 bp, Homo sapiens
agttcctctaacttggctcac

SEQ ID NO: 5234027 - DNA, 18 bp, Homo sapiens
agttcctctcccttccct

SEQ ID NO: 5234028 - DNA, 13 bp, Homo sapiens
agttcctctgggt

SEQ ID NO: 5234029 - DNA, 15 bp, Homo sapiens
agttcctctttgcat

SEQ ID NO: 5234030 - DNA, 14 bp, Homo sapiens
agttcctcttttgt

SEQ ID NO: 5234031 - DNA, 22 bp, Homo sapiens
agttcctcttttgtgctgcttc

SEQ ID NO: 5234032 - DNA, 16 bp, Homo sapiens
agttcctgagaccagc

SEQ ID NO: 5234033 - DNA, 20 bp, Homo sapiens
agttcctgagaccagccaac

SEQ ID NO: 5234034 - DNA, 16 bp, Homo sapiens
agttcctgcactccag

SEQ ID NO: 5234035 - DNA, 18 bp, Homo sapiens
agttcctgcactccagaa

SEQ ID NO: 5234036 - DNA, 13 bp, Homo sapiens
agttcctgctccg

SEQ ID NO: 5234037 - DNA, 14 bp, Homo sapiens
agttcctgctccgt

SEQ ID NO: 5234038 - DNA, 20 bp, Homo sapiens
agttcctgctccgtggactg

SEQ ID NO: 5234039 - DNA, 23 bp, Homo sapiens
agttcctgctctctgctcatggg

SEQ ID NO: 5234040 - DNA, 13 bp, Homo sapiens
agttcctgctgcc

SEQ ID NO: 5234041 - DNA, 17 bp, Homo sapiens
agttcctgctgcctggg

SEQ ID NO: 5234042 - DNA, 21 bp, Homo sapiens
agttcctggaattagttggca

SEQ ID NO: 5234043 - DNA, 18 bp, Homo sapiens
agttcctgtaacaggtgt

SEQ ID NO: 5234044 - DNA, 17 bp, Homo sapiens
agttcctgtgcacagcc

SEQ ID NO: 5234045 - DNA, 14 bp, Homo sapiens
agttcctgtgcctc

SEQ ID NO: 5234046 - DNA, 18 bp, Homo sapiens
agttcctgtggccaggag

SEQ ID NO: 5234047 - DNA, 15 bp, Homo sapiens
agttcctgtggctcc

SEQ ID NO: 5234048 - DNA, 17 bp, Homo sapiens
agttcctgtggctccct

SEQ ID NO: 5234049 - DNA, 19 bp, Homo sapiens
agttcctgttcaccttatg

SEQ ID NO: 5234050 - DNA, 18 bp, Homo sapiens
agttccttaggttttctt

SEQ ID NO: 5234051 - DNA, 18 bp, Homo sapiens
agttccttataagaatta

SEQ ID NO: 5234052 - DNA, 21 bp, Homo sapiens
agttccttatccctctcttcc

SEQ ID NO: 5234053 - DNA, 20 bp, Homo sapiens
agttccttcagcttccattt

SEQ ID NO: 5234054 - DNA, 14 bp, Homo sapiens
agttccttctatac

SEQ ID NO: 5234055 - DNA, 14 bp, Homo sapiens
agttccttctgtag

SEQ ID NO: 5234056 - DNA, 14 bp, Homo sapiens
agttcctttagaaa

SEQ ID NO: 5234057 - DNA, 21 bp, Homo sapiens
atacataatatatgacttcct

SEQ ID NO: 5234058 - DNA, 15 bp, Homo sapiens
atacataatggtact

SEQ ID NO: 5234059 - DNA, 21 bp, Homo sapiens
atacataatggtactcccaaa

SEQ ID NO: 5234060 - DNA, 21 bp, Homo sapiens
atacataatgtttttcctttc

SEQ ID NO: 5234061 - DNA, 15 bp, Homo sapiens
atacatacaaatata

SEQ ID NO: 5234062 - DNA, 13 bp, Homo sapiens
atacatacacata

SEQ ID NO: 5234063 - DNA, 12 bp, Homo sapiens
atacatacagaa

SEQ ID NO: 5234064 - DNA, 14 bp, Homo sapiens
atacatacatacat

SEQ ID NO: 5234065 - DNA, 15 bp, Homo sapiens
atacatacatacata

SEQ ID NO: 5234066 - DNA, 20 bp, Homo sapiens
atacatacatgtatctggtt

SEQ ID NO: 5234067 - DNA, 19 bp, Homo sapiens
atacatactatagattctt

SEQ ID NO: 5234068 - DNA, 20 bp, Homo sapiens
atacatacttacatgtgtgt

SEQ ID NO: 5234069 - DNA, 19 bp, Homo sapiens
atacatagagagagacagt

SEQ ID NO: 5234070 - DNA, 13 bp, Homo sapiens
atacatagtaaat

SEQ ID NO: 5234071 - DNA, 16 bp, Homo sapiens
atacatagtcacaaaa

SEQ ID NO: 5234072 - DNA, 17 bp, Homo sapiens
atacatagtctttgttt

SEQ ID NO: 5234073 - DNA, 15 bp, Homo sapiens
atacatagtgaaaat

SEQ ID NO: 5234074 - DNA, 19 bp, Homo sapiens
atacatataaagattaaca

SEQ ID NO: 5234075 - DNA, 14 bp, Homo sapiens
atacatatacacaa

SEQ ID NO: 5234076 - DNA, 13 bp, Homo sapiens
atacatatatata

SEQ ID NO: 5234077 - DNA, 16 bp, Homo sapiens
atacatatatatatac

SEQ ID NO: 5234078 - DNA, 22 bp, Homo sapiens
atacatatatatatacacatac

SEQ ID NO: 5234079 - DNA, 23 bp, Homo sapiens
atacatatatatatttgtaacat

SEQ ID NO: 5234080 - DNA, 16 bp, Homo sapiens
atacatatatatctga

SEQ ID NO: 5234081 - DNA, 14 bp, Homo sapiens
atacatatatctac

SEQ ID NO: 5234082 - DNA, 22 bp, Homo sapiens
atacatatatctacacatacag

SEQ ID NO: 5234083 - DNA, 23 bp, Homo sapiens
atacatatatctacacatacaga

SEQ ID NO: 5234084 - DNA, 23 bp, Homo sapiens
atacatatatgtatatatatgca

SEQ ID NO: 5234085 - DNA, 17 bp, Homo sapiens
atacatatcagaaaagt

SEQ ID NO: 5234086 - DNA, 21 bp, Homo sapiens
atacatatcagaaaagtagaa

SEQ ID NO: 5234087 - DNA, 21 bp, Homo sapiens
atacatatcgctgacttcatg

SEQ ID NO: 5234088 - DNA, 20 bp, Homo sapiens
atacatatctttattaatca

SEQ ID NO: 5234089 - DNA, 21 bp, Homo sapiens
atacatatctttattaatcac

SEQ ID NO: 5234090 - DNA, 22 bp, Homo sapiens
atacatatgagtgtggaagccg

SEQ ID NO: 5234091 - DNA, 18 bp, Homo sapiens
atacatatggatgttact

SEQ ID NO: 5234092 - DNA, 22 bp, Homo sapiens
atacatatgtagactatataca

SEQ ID NO: 5234093 - DNA, 12 bp, Homo sapiens
atacatatgtat

SEQ ID NO: 5234094 - DNA, 13 bp, Homo sapiens
atacatatgtatg

SEQ ID NO: 5234095 - DNA, 18 bp, Homo sapiens
atacatatgtatgtgtga

SEQ ID NO: 5234096 - DNA, 17 bp, Homo sapiens
atacatattataaataa

SEQ ID NO: 5234097 - DNA, 22 bp, Homo sapiens
atacatattataaataaatgcc

SEQ ID NO: 5234098 - DNA, 23 bp, Homo sapiens
atacatattataaataaatgcca

SEQ ID NO: 5234099 - DNA, 19 bp, Homo sapiens
atacatattcaaagtatat

SEQ ID NO: 5234100 - DNA, 19 bp, Homo sapiens
atacatatttttgtagcac

SEQ ID NO: 5234101 - DNA, 15 bp, Homo sapiens
atacatcaacaagaa

SEQ ID NO: 5234102 - DNA, 13 bp, Homo sapiens
atacatcaaggag

SEQ ID NO: 5234103 - DNA, 17 bp, Homo sapiens
atacatcaatatgtata

SEQ ID NO: 5234104 - DNA, 13 bp, Homo sapiens
atacatcacatct

SEQ ID NO: 5234105 - DNA, 18 bp, Homo sapiens
atacatcacgttaaagta

SEQ ID NO: 5234106 - DNA, 12 bp, Homo sapiens
atacatcactgc

SEQ ID NO: 5234107 - DNA, 18 bp, Homo sapiens
atacatcactgcttgatg

SEQ ID NO: 5234108 - DNA, 19 bp, Homo sapiens
atacatcactgcttgatga

SEQ ID NO: 5234109 - DNA, 16 bp, Homo sapiens
atacatcactgtatac

SEQ ID NO: 5234110 - DNA, 20 bp, Homo sapiens
atacatcatacttaacttta

SEQ ID NO: 5234111 - DNA, 23 bp, Homo sapiens
atacatcctgctttccctcccca

SEQ ID NO: 5234112 - DNA, 16 bp, Homo sapiens
atacatcctgggtaat

SEQ ID NO: 5234113 - DNA, 19 bp, Homo sapiens
atacatcctttttctgcta

SEQ ID NO: 5234114 - DNA, 23 bp, Homo sapiens
atacatctaagtcagtttcacat

SEQ ID NO: 5234115 - DNA, 20 bp, Homo sapiens
atacatctccagtacattcc

SEQ ID NO: 5234116 - DNA, 15 bp, Homo sapiens
atacatctctcccca

SEQ ID NO: 5234117 - DNA, 15 bp, Homo sapiens
atacatctgctgtgt

SEQ ID NO: 5234118 - DNA, 17 bp, Homo sapiens
atacatctgctgtgtgg

SEQ ID NO: 5234119 - DNA, 14 bp, Homo sapiens
atacatctttatca

SEQ ID NO: 5234120 - DNA, 22 bp, Homo sapiens
atacatctttatcattaaacat

SEQ ID NO: 5234121 - DNA, 15 bp, Homo sapiens
atacatctttcccta

SEQ ID NO: 5234122 - DNA, 22 bp, Homo sapiens
atacatgaaaatttgtttgaca

SEQ ID NO: 5234123 - DNA, 18 bp, Homo sapiens
atacatgaagcttcatgc

SEQ ID NO: 5234124 - DNA, 12 bp, Homo sapiens
atacatgaataa

SEQ ID NO: 5234125 - DNA, 16 bp, Homo sapiens
atacatgaataaaaat

SEQ ID NO: 5234126 - DNA, 23 bp, Homo sapiens
atacatgaataaaaataaagttt

SEQ ID NO: 5234127 - DNA, 13 bp, Homo sapiens
atacatgaatcat

SEQ ID NO: 5234128 - DNA, 13 bp, Homo sapiens
atacatgagaaag

SEQ ID NO: 5234129 - DNA, 15 bp, Homo sapiens
atacatgatacattt

SEQ ID NO: 5234130 - DNA, 17 bp, Homo sapiens
atacatgatacattttt

SEQ ID NO: 5234131 - DNA, 13 bp, Homo sapiens
atacatgattgaa

SEQ ID NO: 5234132 - DNA, 14 bp, Homo sapiens
atacatgcacagtc

SEQ ID NO: 5234133 - DNA, 15 bp, Homo sapiens
atacatgcacagtca

SEQ ID NO: 5234134 - DNA, 16 bp, Homo sapiens
atacatgcacagtcat

SEQ ID NO: 5234135 - DNA, 15 bp, Homo sapiens
atacatgcatataat

SEQ ID NO: 5234136 - DNA, 21 bp, Homo sapiens
atacatgcatataatgaataa

SEQ ID NO: 5234137 - DNA, 16 bp, Homo sapiens
atacatgcgtgtacct

SEQ ID NO: 5234138 - DNA, 19 bp, Homo sapiens
atacatgctgcgcatgttt

SEQ ID NO: 5234139 - DNA, 12 bp, Homo sapiens
atacatggggaa

SEQ ID NO: 5234140 - DNA, 20 bp, Homo sapiens
atacatgggtgaattatgtt

SEQ ID NO: 5234141 - DNA, 16 bp, Homo sapiens
atacatgtgatacatt

SEQ ID NO: 5234142 - DNA, 19 bp, Homo sapiens
atacatgtgatacattttt

SEQ ID NO: 5234143 - DNA, 21 bp, Homo sapiens
atacatgtgccgaatgtgcag

SEQ ID NO: 5234144 - DNA, 13 bp, Homo sapiens
atacatgtgtaca

SEQ ID NO: 5234145 - DNA, 17 bp, Homo sapiens
atacatgtgtacatata

SEQ ID NO: 5234146 - DNA, 18 bp, Homo sapiens
atacatgtgtacatatat

SEQ ID NO: 5234147 - DNA, 19 bp, Homo sapiens
atacatgtgtacatatatg

SEQ ID NO: 5234148 - DNA, 21 bp, Homo sapiens
atacatgtgtacatatatgta

SEQ ID NO: 5234149 - DNA, 14 bp, Homo sapiens
atacatgtgtatat

SEQ ID NO: 5234150 - DNA, 21 bp, Homo sapiens
atacatgtgtatattcctttt

SEQ ID NO: 5234151 - DNA, 12 bp, Homo sapiens
atacatgtgtgg

SEQ ID NO: 5234152 - DNA, 14 bp, Homo sapiens
atacatgtgtgtat

SEQ ID NO: 5234153 - DNA, 22 bp, Homo sapiens
atacatgtgtgtatatatgtgt

SEQ ID NO: 5234154 - DNA, 20 bp, Homo sapiens
atacatgttgtatttatgga

SEQ ID NO: 5234155 - DNA, 14 bp, Homo sapiens
atacatgtttatgt

SEQ ID NO: 5234156 - DNA, 19 bp, Homo sapiens
atacatgtttatgtaaaca

SEQ ID NO: 5234157 - DNA, 18 bp, Homo sapiens
atacatgtttgcagtgtt

SEQ ID NO: 5234158 - DNA, 21 bp, Homo sapiens
atacatgtttgcagtgttaag

SEQ ID NO: 5234159 - DNA, 13 bp, Homo sapiens
atacattaaaata

SEQ ID NO: 5234160 - DNA, 16 bp, Homo sapiens
atacattaaaataact

SEQ ID NO: 5234161 - DNA, 17 bp, Homo sapiens
atacattaaaataacta

SEQ ID NO: 5234162 - DNA, 13 bp, Homo sapiens
atacattaaagca

SEQ ID NO: 5234163 - DNA, 14 bp, Homo sapiens
atacattaaagcag

SEQ ID NO: 5234164 - DNA, 20 bp, Homo sapiens
atacattagacacacatata

SEQ ID NO: 5234165 - DNA, 17 bp, Homo sapiens
atacattaggaagctga

SEQ ID NO: 5234166 - DNA, 14 bp, Homo sapiens
atacattagtaaat

SEQ ID NO: 5234167 - DNA, 17 bp, Homo sapiens
atacattagtaaatgtc

SEQ ID NO: 5234168 - DNA, 22 bp, Homo sapiens
atacattagtaaatgtctttgt

SEQ ID NO: 5234169 - DNA, 17 bp, Homo sapiens
atacattataacaacta

SEQ ID NO: 5234170 - DNA, 22 bp, Homo sapiens
atacattatatttctattttat

SEQ ID NO: 5234171 - DNA, 17 bp, Homo sapiens
atacattattagaatat

SEQ ID NO: 5234172 - DNA, 23 bp, Homo sapiens
atacattattgaaaagcaaatct

SEQ ID NO: 5234173 - DNA, 16 bp, Homo sapiens
atacattatttctgta

SEQ ID NO: 5234174 - DNA, 18 bp, Homo sapiens
atacattatttctgtata

SEQ ID NO: 5234175 - DNA, 19 bp, Homo sapiens
atacattatttctgtatat

SEQ ID NO: 5234176 - DNA, 20 bp, Homo sapiens
atacattatttctgtatata

SEQ ID NO: 5234177 - DNA, 21 bp, Homo sapiens
atacattatttctgtatatag

SEQ ID NO: 5234178 - DNA, 16 bp, Homo sapiens
atacattcaaatttgt

SEQ ID NO: 5234179 - DNA, 20 bp, Homo sapiens
atacattcaaatttgtctgg

SEQ ID NO: 5234180 - DNA, 14 bp, Homo sapiens
atacattcagacgt

SEQ ID NO: 5234181 - DNA, 16 bp, Homo sapiens
atacattcataaggaa

SEQ ID NO: 5234182 - DNA, 16 bp, Homo sapiens
atacattcatactgta

SEQ ID NO: 5234183 - DNA, 19 bp, Homo sapiens
atacattccatcacagcca

SEQ ID NO: 5234184 - DNA, 23 bp, Homo sapiens
atacattccatcacagccagccc

SEQ ID NO: 5234185 - DNA, 15 bp, Homo sapiens
atacattccattgtt

SEQ ID NO: 5234186 - DNA, 17 bp, Homo sapiens
atacattccctatcaaa

SEQ ID NO: 5234187 - DNA, 14 bp, Homo sapiens
atacattcctgaga

SEQ ID NO: 5234188 - DNA, 17 bp, Homo sapiens
atacattcctgagattc

SEQ ID NO: 5234189 - DNA, 21 bp, Homo sapiens
atacattgaacacatttcctt

SEQ ID NO: 5234190 - DNA, 12 bp, Homo sapiens
atacattgaatt

SEQ ID NO: 5234191 - DNA, 22 bp, Homo sapiens
atacattggaggctttattttg

SEQ ID NO: 5234192 - DNA, 21 bp, Homo sapiens
atacattggttttgaaatgtt

SEQ ID NO: 5234193 - DNA, 22 bp, Homo sapiens
atacattgtacgaagagtattt

SEQ ID NO: 5234194 - DNA, 17 bp, Homo sapiens
atacattgtataggcca

SEQ ID NO: 5234195 - DNA, 21 bp, Homo sapiens
atacattgtataggccatctg

SEQ ID NO: 5234196 - DNA, 20 bp, Homo sapiens
atacattgtatatatgtgta

SEQ ID NO: 5234197 - DNA, 17 bp, Homo sapiens
atacattgtgtgaaaaa

SEQ ID NO: 5234198 - DNA, 20 bp, Homo sapiens
atacattgtgttttcctaaa

SEQ ID NO: 5234199 - DNA, 16 bp, Homo sapiens
atacatttaataaaac

SEQ ID NO: 5234200 - DNA, 21 bp, Homo sapiens
atacatttataatgtttgcta

SEQ ID NO: 5234201 - DNA, 21 bp, Homo sapiens
atacatttctcctttgataaa

SEQ ID NO: 5234202 - DNA, 12 bp, Homo sapiens
atacatttgtaa

SEQ ID NO: 5234203 - DNA, 16 bp, Homo sapiens
atacattttacatatg

SEQ ID NO: 5234204 - DNA, 12 bp, Homo sapiens
atacattttata

SEQ ID NO: 5234205 - DNA, 13 bp, Homo sapiens
atacattttataa

SEQ ID NO: 5234206 - DNA, 18 bp, Homo sapiens
atacattttataatgatg

SEQ ID NO: 5234207 - DNA, 22 bp, Homo sapiens
atacattttataatgatgaact

SEQ ID NO: 5234208 - DNA, 16 bp, Homo sapiens
atacattttatatctg

SEQ ID NO: 5234209 - DNA, 17 bp, Homo sapiens
atacattttctaaataa

SEQ ID NO: 5234210 - DNA, 18 bp, Homo sapiens
atacattttctaaataaa

SEQ ID NO: 5234211 - DNA, 24 bp, Homo sapiens
atacattttctaaataaaaatatg

SEQ ID NO: 5234212 - DNA, 16 bp, Homo sapiens
atacattttctaagaa

SEQ ID NO: 5234213 - DNA, 16 bp, Homo sapiens
atacattttctggtgg

SEQ ID NO: 5234214 - DNA, 16 bp, Homo sapiens
atacattttgtaccaa

SEQ ID NO: 5234215 - DNA, 18 bp, Homo sapiens
atacattttgttatagaa

SEQ ID NO: 5234216 - DNA, 22 bp, Homo sapiens
atacattttgttatagaatact

SEQ ID NO: 5234217 - DNA, 16 bp, Homo sapiens
atacattttttaagct

SEQ ID NO: 5234218 - DNA, 15 bp, Homo sapiens
ataccaaagataatg

SEQ ID NO: 5234219 - DNA, 17 bp, Homo sapiens
ataccaaagcacatttt

SEQ ID NO: 5234220 - DNA, 16 bp, Homo sapiens
ataccaaatattttag

SEQ ID NO: 5234221 - DNA, 17 bp, Homo sapiens
ataccaactatttcaat

SEQ ID NO: 5234222 - DNA, 14 bp, Homo sapiens
ataccaactgaagt

SEQ ID NO: 5234223 - DNA, 19 bp, Homo sapiens
ataccaagagtatgagaaa

SEQ ID NO: 5234224 - DNA, 23 bp, Homo sapiens
ataccaagcccctagtcttagag

SEQ ID NO: 5234225 - DNA, 21 bp, Homo sapiens
ataccaattacccataaacag

SEQ ID NO: 5234226 - DNA, 22 bp, Homo sapiens
ataccaattacccataaacagc

SEQ ID NO: 5234227 - DNA, 15 bp, Homo sapiens
ataccaattatggaa

SEQ ID NO: 5234228 - DNA, 18 bp, Homo sapiens
ataccacaaaccctgctg

SEQ ID NO: 5234229 - DNA, 15 bp, Homo sapiens
ataccacaagacatt

SEQ ID NO: 5234230 - DNA, 15 bp, Homo sapiens
ataccacagtctttc

SEQ ID NO: 5234231 - DNA, 16 bp, Homo sapiens
ataccacccaatgctg

SEQ ID NO: 5234232 - DNA, 15 bp, Homo sapiens
ataccacctgtacat

SEQ ID NO: 5234233 - DNA, 19 bp, Homo sapiens
ataccactctgtaattgca

SEQ ID NO: 5234234 - DNA, 17 bp, Homo sapiens
ataccactctttacctt

SEQ ID NO: 5234235 - DNA, 13 bp, Homo sapiens
agttcctttcaaa

SEQ ID NO: 5234236 - DNA, 14 bp, Homo sapiens
agttcctttccctc

SEQ ID NO: 5234237 - DNA, 19 bp, Homo sapiens
agttcctttccttttcttt

SEQ ID NO: 5234238 - DNA, 19 bp, Homo sapiens
agttcctttgatctcgctg

SEQ ID NO: 5234239 - DNA, 16 bp, Homo sapiens
agttcgagaccagcct

SEQ ID NO: 5234240 - DNA, 18 bp, Homo sapiens
agttcgagaccagcctgg

SEQ ID NO: 5234241 - DNA, 19 bp, Homo sapiens
agttcgagaccagcctggc

SEQ ID NO: 5234242 - DNA, 21 bp, Homo sapiens
agttcgagaccagcctggcca

SEQ ID NO: 5234243 - DNA, 14 bp, Homo sapiens
agttcgcagccacc

SEQ ID NO: 5234244 - DNA, 19 bp, Homo sapiens
agttcggtgagctacaaat

SEQ ID NO: 5234245 - DNA, 19 bp, Homo sapiens
agttcgtaccgcttcctta

SEQ ID NO: 5234246 - DNA, 21 bp, Homo sapiens
agttcgttggtagagccctca

SEQ ID NO: 5234247 - DNA, 23 bp, Homo sapiens
agttcgttggtagagccctcaga

SEQ ID NO: 5234248 - DNA, 22 bp, Homo sapiens
agttctaaaaaaaatgcatatt

SEQ ID NO: 5234249 - DNA, 13 bp, Homo sapiens
agttctaaaaaga

SEQ ID NO: 5234250 - DNA, 15 bp, Homo sapiens
agttctaaattttgt

SEQ ID NO: 5234251 - DNA, 19 bp, Homo sapiens
agttctaacagtgaagttt

SEQ ID NO: 5234252 - DNA, 18 bp, Homo sapiens
agttctaagactcaaatg

SEQ ID NO: 5234253 - DNA, 13 bp, Homo sapiens
agttctaagattc

SEQ ID NO: 5234254 - DNA, 16 bp, Homo sapiens
agttctaagattctaa

SEQ ID NO: 5234255 - DNA, 15 bp, Homo sapiens
agttctaagattctg

SEQ ID NO: 5234256 - DNA, 21 bp, Homo sapiens
agttctaataatttctaatgt

SEQ ID NO: 5234257 - DNA, 15 bp, Homo sapiens
agttctacaagcata

SEQ ID NO: 5234258 - DNA, 17 bp, Homo sapiens
agttctacaagcatatt

SEQ ID NO: 5234259 - DNA, 21 bp, Homo sapiens
agttctacaagcatatttgag

SEQ ID NO: 5234260 - DNA, 17 bp, Homo sapiens
agttctactcaggctgg

SEQ ID NO: 5234261 - DNA, 10 bp, Homo sapiens
agttctagac

SEQ ID NO: 5234262 - DNA, 21 bp, Homo sapiens
agttctagacatggaggttct

SEQ ID NO: 5234263 - DNA, 23 bp, Homo sapiens
agttctagacatggaggttctaa

SEQ ID NO: 5234264 - DNA, 16 bp, Homo sapiens
agttctagagaagagg

SEQ ID NO: 5234265 - DNA, 17 bp, Homo sapiens
agttctagagaagaggc

SEQ ID NO: 5234266 - DNA, 18 bp, Homo sapiens
agttctagcatagtaaac

SEQ ID NO: 5234267 - DNA, 23 bp, Homo sapiens
agttctagtccttggtctgctgg

SEQ ID NO: 5234268 - DNA, 18 bp, Homo sapiens
agttctagtgcagctgaa

SEQ ID NO: 5234269 - DNA, 22 bp, Homo sapiens
agttctagtgcagctgaaattg

SEQ ID NO: 5234270 - DNA, 18 bp, Homo sapiens
agttctagttgattgcga

SEQ ID NO: 5234271 - DNA, 19 bp, Homo sapiens
agttctatccccaagctgg

SEQ ID NO: 5234272 - DNA, 21 bp, Homo sapiens
agttctatccttttgcctgca

SEQ ID NO: 5234273 - DNA, 22 bp, Homo sapiens
agttctatgaagagtattaatg

SEQ ID NO: 5234274 - DNA, 18 bp, Homo sapiens
agttctatggagactttg

SEQ ID NO: 5234275 - DNA, 16 bp, Homo sapiens
agttctattatctggg

SEQ ID NO: 5234276 - DNA, 14 bp, Homo sapiens
agttctatttaaaa

SEQ ID NO: 5234277 - DNA, 16 bp, Homo sapiens
agttctatttaaaatg

SEQ ID NO: 5234278 - DNA, 17 bp, Homo sapiens
agttctatttaaaatgg

SEQ ID NO: 5234279 - DNA, 16 bp, Homo sapiens
agttctatttctatct

SEQ ID NO: 5234280 - DNA, 20 bp, Homo sapiens
agttctatttctatctgcaa

SEQ ID NO: 5234281 - DNA, 18 bp, Homo sapiens
agttctattttactgtct

SEQ ID NO: 5234282 - DNA, 19 bp, Homo sapiens
agttctcactatgtttctc

SEQ ID NO: 5234283 - DNA, 17 bp, Homo sapiens
agttctcactcctagga

SEQ ID NO: 5234284 - DNA, 13 bp, Homo sapiens
agttctcactggg

SEQ ID NO: 5234285 - DNA, 14 bp, Homo sapiens
agttctcagaataa

SEQ ID NO: 5234286 - DNA, 15 bp, Homo sapiens
agttctcagaataac

SEQ ID NO: 5234287 - DNA, 12 bp, Homo sapiens
agttctcagctt

SEQ ID NO: 5234288 - DNA, 15 bp, Homo sapiens
agttctcagggctcc

SEQ ID NO: 5234289 - DNA, 19 bp, Homo sapiens
agttctcagggctcctgcc

SEQ ID NO: 5234290 - DNA, 15 bp, Homo sapiens
agttctcataaacag

SEQ ID NO: 5234291 - DNA, 12 bp, Homo sapiens
agttctcatcca

SEQ ID NO: 5234292 - DNA, 13 bp, Homo sapiens
agttctcatccac

SEQ ID NO: 5234293 - DNA, 18 bp, Homo sapiens
agttctcatccacagagg

SEQ ID NO: 5234294 - DNA, 23 bp, Homo sapiens
agttctcatccacagaggccagg

SEQ ID NO: 5234295 - DNA, 17 bp, Homo sapiens
agttctccagcttcagc

SEQ ID NO: 5234296 - DNA, 22 bp, Homo sapiens
agttctccctgtacagtgttac

SEQ ID NO: 5234297 - DNA, 17 bp, Homo sapiens
agttctcccttcaactg

SEQ ID NO: 5234298 - DNA, 19 bp, Homo sapiens
agttctccgtaacagtgta

SEQ ID NO: 5234299 - DNA, 19 bp, Homo sapiens
agttctcctatcttctcca

SEQ ID NO: 5234300 - DNA, 14 bp, Homo sapiens
agttctccttccct

SEQ ID NO: 5234301 - DNA, 18 bp, Homo sapiens
agttctccttttgaactt

SEQ ID NO: 5234302 - DNA, 21 bp, Homo sapiens
agttctctactccctcttgtc

SEQ ID NO: 5234303 - DNA, 23 bp, Homo sapiens
agttctctcatcggaggcccatg

SEQ ID NO: 5234304 - DNA, 22 bp, Homo sapiens
agttctctcccttcctctctcc

SEQ ID NO: 5234305 - DNA, 12 bp, Homo sapiens
agttctctcctt

SEQ ID NO: 5234306 - DNA, 22 bp, Homo sapiens
agttctctgggaagtggtcagc

SEQ ID NO: 5234307 - DNA, 20 bp, Homo sapiens
agttctctgtaattacaact

SEQ ID NO: 5234308 - DNA, 16 bp, Homo sapiens
agttctctgtggaagc

SEQ ID NO: 5234309 - DNA, 17 bp, Homo sapiens
agttctcttatctttga

SEQ ID NO: 5234310 - DNA, 11 bp, Homo sapiens
agttctcttcc

SEQ ID NO: 5234311 - DNA, 16 bp, Homo sapiens
agttctcttctcctgt

SEQ ID NO: 5234312 - DNA, 15 bp, Homo sapiens
agttctcttgctttc

SEQ ID NO: 5234313 - DNA, 15 bp, Homo sapiens
agttctcttgtcctg

SEQ ID NO: 5234314 - DNA, 15 bp, Homo sapiens
agttctctttggaaa

SEQ ID NO: 5234315 - DNA, 16 bp, Homo sapiens
agttctctttggaaat

SEQ ID NO: 5234316 - DNA, 19 bp, Homo sapiens
agttctgaaaactgtttat

SEQ ID NO: 5234317 - DNA, 22 bp, Homo sapiens
agttctgaaaactgtttatggt

SEQ ID NO: 5234318 - DNA, 13 bp, Homo sapiens
agttctgaaattt

SEQ ID NO: 5234319 - DNA, 14 bp, Homo sapiens
agttctgaaattta

SEQ ID NO: 5234320 - DNA, 15 bp, Homo sapiens
agttctgaagaagat

SEQ ID NO: 5234321 - DNA, 16 bp, Homo sapiens
agttctgaagaagatg

SEQ ID NO: 5234322 - DNA, 15 bp, Homo sapiens
agttctgacattcat

SEQ ID NO: 5234323 - DNA, 19 bp, Homo sapiens
agttctgacgctgacaata

SEQ ID NO: 5234324 - DNA, 15 bp, Homo sapiens
agttctgactttgaa

SEQ ID NO: 5234325 - DNA, 20 bp, Homo sapiens
agttctgactttgaatttat

SEQ ID NO: 5234326 - DNA, 12 bp, Homo sapiens
agttctgatgag

SEQ ID NO: 5234327 - DNA, 22 bp, Homo sapiens
agttctgattcatttgaataaa

SEQ ID NO: 5234328 - DNA, 19 bp, Homo sapiens
agttctgcacatacagatg

SEQ ID NO: 5234329 - DNA, 16 bp, Homo sapiens
agttctgcactccaga

SEQ ID NO: 5234330 - DNA, 13 bp, Homo sapiens
agttctgccagga

SEQ ID NO: 5234331 - DNA, 12 bp, Homo sapiens
agttctgctcca

SEQ ID NO: 5234332 - DNA, 14 bp, Homo sapiens
agttctgctccaga

SEQ ID NO: 5234333 - DNA, 19 bp, Homo sapiens
agttctgctccagacaggg

SEQ ID NO: 5234334 - DNA, 17 bp, Homo sapiens
agttctgctcctctcca

SEQ ID NO: 5234335 - DNA, 19 bp, Homo sapiens
agttctgctcctctccagg

SEQ ID NO: 5234336 - DNA, 20 bp, Homo sapiens
agttctgctcctctccaggc

SEQ ID NO: 5234337 - DNA, 21 bp, Homo sapiens
agttctgctcctctccaggca

SEQ ID NO: 5234338 - DNA, 12 bp, Homo sapiens
agttctgctcta

SEQ ID NO: 5234339 - DNA, 16 bp, Homo sapiens
agttctgctctggttg

SEQ ID NO: 5234340 - DNA, 13 bp, Homo sapiens
agttctgctgccc

SEQ ID NO: 5234341 - DNA, 13 bp, Homo sapiens
agttctgctgtct

SEQ ID NO: 5234342 - DNA, 15 bp, Homo sapiens
agttctgctgtctcc

SEQ ID NO: 5234343 - DNA, 17 bp, Homo sapiens
agttctgctgtctccct

SEQ ID NO: 5234344 - DNA, 19 bp, Homo sapiens
agttctgctttctgcctct

SEQ ID NO: 5234345 - DNA, 15 bp, Homo sapiens
agttctggaggagga

SEQ ID NO: 5234346 - DNA, 18 bp, Homo sapiens
agttctggaggaggaggt

SEQ ID NO: 5234347 - DNA, 14 bp, Homo sapiens
agttctggatgtaa

SEQ ID NO: 5234348 - DNA, 16 bp, Homo sapiens
agttctggatgtctgg

SEQ ID NO: 5234349 - DNA, 18 bp, Homo sapiens
agttctggatgtctggct

SEQ ID NO: 5234350 - DNA, 20 bp, Homo sapiens
agttctggatgtctggctca

SEQ ID NO: 5234351 - DNA, 16 bp, Homo sapiens
agttctggcaagagca

SEQ ID NO: 5234352 - DNA, 18 bp, Homo sapiens
agttctggcaagagcaga

SEQ ID NO: 5234353 - DNA, 20 bp, Homo sapiens
agttctggcaagagcagata

SEQ ID NO: 5234354 - DNA, 22 bp, Homo sapiens
agttctggcaagagcagatact

SEQ ID NO: 5234355 - DNA, 17 bp, Homo sapiens
agttctgggtgctccct

SEQ ID NO: 5234356 - DNA, 15 bp, Homo sapiens
agttctggtccacaa

SEQ ID NO: 5234357 - DNA, 18 bp, Homo sapiens
agttctggtccacaaacc

SEQ ID NO: 5234358 - DNA, 14 bp, Homo sapiens
agttctgtaaaata

SEQ ID NO: 5234359 - DNA, 14 bp, Homo sapiens
agttctgtaataaa

SEQ ID NO: 5234360 - DNA, 11 bp, Homo sapiens
agttctgtata

SEQ ID NO: 5234361 - DNA, 20 bp, Homo sapiens
agttctgtatataaatatat

SEQ ID NO: 5234362 - DNA, 14 bp, Homo sapiens
agttctgtatttga

SEQ ID NO: 5234363 - DNA, 21 bp, Homo sapiens
agttctgtgactaggaaaaaa

SEQ ID NO: 5234364 - DNA, 21 bp, Homo sapiens
agttctgtgcctccccccaga

SEQ ID NO: 5234365 - DNA, 23 bp, Homo sapiens
agttctgtgcctccccccagacc

SEQ ID NO: 5234366 - DNA, 14 bp, Homo sapiens
agttctgtggttcc

SEQ ID NO: 5234367 - DNA, 16 bp, Homo sapiens
agttctgtggtttcat

SEQ ID NO: 5234368 - DNA, 22 bp, Homo sapiens
agttctgtggtttcatgttagt

SEQ ID NO: 5234369 - DNA, 23 bp, Homo sapiens
agttctgtggtttcatgttagtt

SEQ ID NO: 5234370 - DNA, 11 bp, Homo sapiens
agttctgtgta

SEQ ID NO: 5234371 - DNA, 17 bp, Homo sapiens
agttctgtgtagagaat

SEQ ID NO: 5234372 - DNA, 19 bp, Homo sapiens
agttctgtgtagagaatgt

SEQ ID NO: 5234373 - DNA, 13 bp, Homo sapiens
agttctgtgtatt

SEQ ID NO: 5234374 - DNA, 23 bp, Homo sapiens
agttctgtgtcctcgcactgccc

SEQ ID NO: 5234375 - DNA, 20 bp, Homo sapiens
agttctgtgtggtgcattcc

SEQ ID NO: 5234376 - DNA, 23 bp, Homo sapiens
agttctgtgtggtgcattcctga

SEQ ID NO: 5234377 - DNA, 18 bp, Homo sapiens
agttctgtgtgtctggtg

SEQ ID NO: 5234378 - DNA, 18 bp, Homo sapiens
agttctgtgtttaatttc

SEQ ID NO: 5234379 - DNA, 22 bp, Homo sapiens
agttctgtgtttaatttcttca

SEQ ID NO: 5234380 - DNA, 19 bp, Homo sapiens
agttctgttaaatattttt

SEQ ID NO: 5234381 - DNA, 20 bp, Homo sapiens
agttctgttatatcccctgc

SEQ ID NO: 5234382 - DNA, 20 bp, Homo sapiens
agttctgttggtctacagaa

SEQ ID NO: 5234383 - DNA, 21 bp, Homo sapiens
agttctgttggtctacagaaa

SEQ ID NO: 5234384 - DNA, 20 bp, Homo sapiens
agttctgttgttttgtgtat

SEQ ID NO: 5234385 - DNA, 15 bp, Homo sapiens
agttcttaaaacact

SEQ ID NO: 5234386 - DNA, 13 bp, Homo sapiens
agttcttaaaatt

SEQ ID NO: 5234387 - DNA, 15 bp, Homo sapiens
agttcttaaaattag

SEQ ID NO: 5234388 - DNA, 17 bp, Homo sapiens
agttcttaaaattagtg

SEQ ID NO: 5234389 - DNA, 23 bp, Homo sapiens
agttcttaaagtttaaagttgca

SEQ ID NO: 5234390 - DNA, 15 bp, Homo sapiens
agttcttaactgctg

SEQ ID NO: 5234391 - DNA, 19 bp, Homo sapiens
agttcttaagcatttgcgt

SEQ ID NO: 5234392 - DNA, 18 bp, Homo sapiens
agttcttaatacaggaga

SEQ ID NO: 5234393 - DNA, 23 bp, Homo sapiens
agttcttacaataaaccctcctt

SEQ ID NO: 5234394 - DNA, 18 bp, Homo sapiens
agttcttagatatctttt

SEQ ID NO: 5234395 - DNA, 21 bp, Homo sapiens
agttcttagattcaggggaag

SEQ ID NO: 5234396 - DNA, 23 bp, Homo sapiens
agttcttagattcaggggaaggg

SEQ ID NO: 5234397 - DNA, 22 bp, Homo sapiens
agttcttattttagtatacgta

SEQ ID NO: 5234398 - DNA, 23 bp, Homo sapiens
agttcttcaaagatagggaggga

SEQ ID NO: 5234399 - DNA, 14 bp, Homo sapiens
agttcttcaagagg

SEQ ID NO: 5234400 - DNA, 17 bp, Homo sapiens
agttcttcaagaggaaa

SEQ ID NO: 5234401 - DNA, 20 bp, Homo sapiens
agttcttcatttggaggaat

SEQ ID NO: 5234402 - DNA, 13 bp, Homo sapiens
agttcttcctgca

SEQ ID NO: 5234403 - DNA, 17 bp, Homo sapiens
agttcttcgactgttgt

SEQ ID NO: 5234404 - DNA, 20 bp, Homo sapiens
agttcttctttctttcttaa

SEQ ID NO: 5234405 - DNA, 12 bp, Homo sapiens
agttcttgaatt

SEQ ID NO: 5234406 - DNA, 13 bp, Homo sapiens
agttcttgaattg

SEQ ID NO: 5234407 - DNA, 14 bp, Homo sapiens
agttcttgaattgt

SEQ ID NO: 5234408 - DNA, 17 bp, Homo sapiens
agttcttgaattgttat

SEQ ID NO: 5234409 - DNA, 13 bp, Homo sapiens
agttcttggacca

SEQ ID NO: 5234410 - DNA, 21 bp, Homo sapiens
agttcttggaccagtttgcag

SEQ ID NO: 5234411 - DNA, 12 bp, Homo sapiens
agttcttggcct

SEQ ID NO: 5234412 - DNA, 20 bp, Homo sapiens
agttcttggtgactgtccca

SEQ ID NO: 5234413 - DNA, 21 bp, Homo sapiens
agttcttggtgactgtcccac

SEQ ID NO: 5234414 - DNA, 12 bp, Homo sapiens
ataccacttacc

SEQ ID NO: 5234415 - DNA, 14 bp, Homo sapiens
ataccacttacctc

SEQ ID NO: 5234416 - DNA, 20 bp, Homo sapiens
ataccactttgacacgcttc

SEQ ID NO: 5234417 - DNA, 21 bp, Homo sapiens
ataccactttgacacgcttca

SEQ ID NO: 5234418 - DNA, 22 bp, Homo sapiens
ataccacttttcattgcaaagt

SEQ ID NO: 5234419 - DNA, 17 bp, Homo sapiens
ataccacttttgttctt

SEQ ID NO: 5234420 - DNA, 17 bp, Homo sapiens
ataccagaaagctctac

SEQ ID NO: 5234421 - DNA, 17 bp, Homo sapiens
ataccagacctcttcta

SEQ ID NO: 5234422 - DNA, 15 bp, Homo sapiens
ataccagactgcagg

SEQ ID NO: 5234423 - DNA, 13 bp, Homo sapiens
ataccagagaagg

SEQ ID NO: 5234424 - DNA, 19 bp, Homo sapiens
ataccagagccttcaagtg

SEQ ID NO: 5234425 - DNA, 21 bp, Homo sapiens
ataccagagccttcaagtgcc

SEQ ID NO: 5234426 - DNA, 22 bp, Homo sapiens
ataccagagccttcaagtgcca

SEQ ID NO: 5234427 - DNA, 18 bp, Homo sapiens
ataccagagtctggagct

SEQ ID NO: 5234428 - DNA, 12 bp, Homo sapiens
ataccagcaaaa

SEQ ID NO: 5234429 - DNA, 17 bp, Homo sapiens
ataccagcaaaagtgca

SEQ ID NO: 5234430 - DNA, 24 bp, Homo sapiens
ataccagcagcaactgaaaatgaa

SEQ ID NO: 5234431 - DNA, 19 bp, Homo sapiens
ataccagccagtaaatggg

SEQ ID NO: 5234432 - DNA, 22 bp, Homo sapiens
ataccagcccctgtatggcact

SEQ ID NO: 5234433 - DNA, 23 bp, Homo sapiens
ataccagctactccggaggctga

SEQ ID NO: 5234434 - DNA, 17 bp, Homo sapiens
ataccagctgagtctga

SEQ ID NO: 5234435 - DNA, 17 bp, Homo sapiens
ataccagcttaatagct

SEQ ID NO: 5234436 - DNA, 22 bp, Homo sapiens
ataccaggcaacctcccatccc

SEQ ID NO: 5234437 - DNA, 14 bp, Homo sapiens
ataccaggcagtgt

SEQ ID NO: 5234438 - DNA, 17 bp, Homo sapiens
ataccaggccgccccag

SEQ ID NO: 5234439 - DNA, 16 bp, Homo sapiens
ataccaggttgaaaga

SEQ ID NO: 5234440 - DNA, 22 bp, Homo sapiens
ataccagtactcagtatagcat

SEQ ID NO: 5234441 - DNA, 19 bp, Homo sapiens
ataccagtcacctcctgct

SEQ ID NO: 5234442 - DNA, 17 bp, Homo sapiens
ataccagtgaaccaaag

SEQ ID NO: 5234443 - DNA, 15 bp, Homo sapiens
ataccagttcttgca

SEQ ID NO: 5234444 - DNA, 17 bp, Homo sapiens
ataccatactcatttct

SEQ ID NO: 5234445 - DNA, 16 bp, Homo sapiens
ataccataggaagaca

SEQ ID NO: 5234446 - DNA, 20 bp, Homo sapiens
ataccataggaagacataaa

SEQ ID NO: 5234447 - DNA, 16 bp, Homo sapiens
ataccatatgaatgaa

SEQ ID NO: 5234448 - DNA, 16 bp, Homo sapiens
ataccatcactgagtg

SEQ ID NO: 5234449 - DNA, 21 bp, Homo sapiens
ataccatccatccctggtgaa

SEQ ID NO: 5234450 - DNA, 15 bp, Homo sapiens
ataccatcctgccca

SEQ ID NO: 5234451 - DNA, 15 bp, Homo sapiens
ataccatgacatgaa

SEQ ID NO: 5234452 - DNA, 19 bp, Homo sapiens
ataccatgatgctgagccc

SEQ ID NO: 5234453 - DNA, 17 bp, Homo sapiens
ataccattaaaactgct

SEQ ID NO: 5234454 - DNA, 20 bp, Homo sapiens
ataccattattatcaagtag

SEQ ID NO: 5234455 - DNA, 14 bp, Homo sapiens
ataccattattatg

SEQ ID NO: 5234456 - DNA, 22 bp, Homo sapiens
ataccattctattctccagaca

SEQ ID NO: 5234457 - DNA, 14 bp, Homo sapiens
ataccattgaaatc

SEQ ID NO: 5234458 - DNA, 22 bp, Homo sapiens
ataccatttagtaagaatacca

SEQ ID NO: 5234459 - DNA, 15 bp, Homo sapiens
ataccatttccgtaa

SEQ ID NO: 5234460 - DNA, 17 bp, Homo sapiens
ataccatttcctcagct

SEQ ID NO: 5234461 - DNA, 14 bp, Homo sapiens
atacccaaaggaat

SEQ ID NO: 5234462 - DNA, 21 bp, Homo sapiens
atacccaaaggaatagaaatc

SEQ ID NO: 5234463 - DNA, 22 bp, Homo sapiens
atacccaaattttaatattcca

SEQ ID NO: 5234464 - DNA, 22 bp, Homo sapiens
atacccaacagtttatttttat

SEQ ID NO: 5234465 - DNA, 23 bp, Homo sapiens
atacccacacattccagggctgg

SEQ ID NO: 5234466 - DNA, 14 bp, Homo sapiens
atacccacccccac

SEQ ID NO: 5234467 - DNA, 16 bp, Homo sapiens
atacccacccccaccc

SEQ ID NO: 5234468 - DNA, 18 bp, Homo sapiens
atacccagagagaaaaag

SEQ ID NO: 5234469 - DNA, 23 bp, Homo sapiens
atacccagcagagggataaccca

SEQ ID NO: 5234470 - DNA, 13 bp, Homo sapiens
atacccagtggaa

SEQ ID NO: 5234471 - DNA, 15 bp, Homo sapiens
atacccatgaactta

SEQ ID NO: 5234472 - DNA, 22 bp, Homo sapiens
atacccattcttcagtgcctag

SEQ ID NO: 5234473 - DNA, 17 bp, Homo sapiens
ataccccaaagtccagg

SEQ ID NO: 5234474 - DNA, 19 bp, Homo sapiens
ataccccaaagtccaggct

SEQ ID NO: 5234475 - DNA, 15 bp, Homo sapiens
ataccccaaattgtg

SEQ ID NO: 5234476 - DNA, 17 bp, Homo sapiens
ataccccaagactccca

SEQ ID NO: 5234477 - DNA, 12 bp, Homo sapiens
ataccccactgg

SEQ ID NO: 5234478 - DNA, 15 bp, Homo sapiens
ataccccagaaatta

SEQ ID NO: 5234479 - DNA, 16 bp, Homo sapiens
ataccccatcattcat

SEQ ID NO: 5234480 - DNA, 20 bp, Homo sapiens
ataccccattaaatctgaca

SEQ ID NO: 5234481 - DNA, 23 bp, Homo sapiens
ataccccattaccagcatttact

SEQ ID NO: 5234482 - DNA, 13 bp, Homo sapiens
atacccccagaga

SEQ ID NO: 5234483 - DNA, 15 bp, Homo sapiens
atacccccaggaaac

SEQ ID NO: 5234484 - DNA, 16 bp, Homo sapiens
atacccccaggaaact

SEQ ID NO: 5234485 - DNA, 20 bp, Homo sapiens
ataccccctgcaaagcccag

SEQ ID NO: 5234486 - DNA, 15 bp, Homo sapiens
ataccccctgcccca

SEQ ID NO: 5234487 - DNA, 18 bp, Homo sapiens
ataccccttacaaatgaa

SEQ ID NO: 5234488 - DNA, 15 bp, Homo sapiens
ataccccttattgct

SEQ ID NO: 5234489 - DNA, 17 bp, Homo sapiens
ataccccttattgctgc

SEQ ID NO: 5234490 - DNA, 23 bp, Homo sapiens
ataccccttattgctgccaaaac

SEQ ID NO: 5234491 - DNA, 15 bp, Homo sapiens
ataccctaccctatg

SEQ ID NO: 5234492 - DNA, 19 bp, Homo sapiens
ataccctactgtggggaga

SEQ ID NO: 5234493 - DNA, 22 bp, Homo sapiens
ataccctactgtggggagagat

SEQ ID NO: 5234494 - DNA, 11 bp, Homo sapiens
ataccctagaa

SEQ ID NO: 5234495 - DNA, 16 bp, Homo sapiens
ataccctaggtctcca

SEQ ID NO: 5234496 - DNA, 14 bp, Homo sapiens
ataccctctgagac

SEQ ID NO: 5234497 - DNA, 22 bp, Homo sapiens
ataccgaccatcgtccagccct

SEQ ID NO: 5234498 - DNA, 18 bp, Homo sapiens
ataccgagacccaccatc

SEQ ID NO: 5234499 - DNA, 18 bp, Homo sapiens
ataccgcctcgtgccagc

SEQ ID NO: 5234500 - DNA, 22 bp, Homo sapiens
ataccgcctcgtgccagcagcc

SEQ ID NO: 5234501 - DNA, 14 bp, Homo sapiens
ataccgctcagtat

SEQ ID NO: 5234502 - DNA, 15 bp, Homo sapiens
ataccggaattactt

SEQ ID NO: 5234503 - DNA, 17 bp, Homo sapiens
ataccggacttgtcaca

SEQ ID NO: 5234504 - DNA, 17 bp, Homo sapiens
ataccggagctccagtt

SEQ ID NO: 5234505 - DNA, 15 bp, Homo sapiens
atacctaattgtgga

SEQ ID NO: 5234506 - DNA, 13 bp, Homo sapiens
atacctataatgt

SEQ ID NO: 5234507 - DNA, 16 bp, Homo sapiens
atacctataatgtgtg

SEQ ID NO: 5234508 - DNA, 17 bp, Homo sapiens
atacctataatgtgtgt

SEQ ID NO: 5234509 - DNA, 18 bp, Homo sapiens
atacctataatgtgtgta

SEQ ID NO: 5234510 - DNA, 19 bp, Homo sapiens
atacctataatgtgtgtat

SEQ ID NO: 5234511 - DNA, 19 bp, Homo sapiens
atacctatcacttacattt

SEQ ID NO: 5234512 - DNA, 14 bp, Homo sapiens
atacctatgtgaaa

SEQ ID NO: 5234513 - DNA, 14 bp, Homo sapiens
atacctattaaagg

SEQ ID NO: 5234514 - DNA, 13 bp, Homo sapiens
atacctatttcat

SEQ ID NO: 5234515 - DNA, 16 bp, Homo sapiens
atacctcaaactatct

SEQ ID NO: 5234516 - DNA, 15 bp, Homo sapiens
atacctcaacctatg

SEQ ID NO: 5234517 - DNA, 18 bp, Homo sapiens
atacctcaacctatggta

SEQ ID NO: 5234518 - DNA, 14 bp, Homo sapiens
atacctcaattttt

SEQ ID NO: 5234519 - DNA, 15 bp, Homo sapiens
atacctcaccctgct

SEQ ID NO: 5234520 - DNA, 12 bp, Homo sapiens
atacctcacttt

SEQ ID NO: 5234521 - DNA, 17 bp, Homo sapiens
atacctcaggaaagaat

SEQ ID NO: 5234522 - DNA, 19 bp, Homo sapiens
atacctcatcatccacccg

SEQ ID NO: 5234523 - DNA, 12 bp, Homo sapiens
atacctcatttt

SEQ ID NO: 5234524 - DNA, 14 bp, Homo sapiens
atacctctaactgt

SEQ ID NO: 5234525 - DNA, 19 bp, Homo sapiens
atacctctaactgtgcaaa

SEQ ID NO: 5234526 - DNA, 17 bp, Homo sapiens
atacctctaataaacac

SEQ ID NO: 5234527 - DNA, 14 bp, Homo sapiens
atacctctaatagt

SEQ ID NO: 5234528 - DNA, 12 bp, Homo sapiens
atacctctgtgt

SEQ ID NO: 5234529 - DNA, 14 bp, Homo sapiens
atacctctgtgtgc

SEQ ID NO: 5234530 - DNA, 16 bp, Homo sapiens
atacctctgtgtgctc

SEQ ID NO: 5234531 - DNA, 15 bp, Homo sapiens
atacctcttagctga

SEQ ID NO: 5234532 - DNA, 20 bp, Homo sapiens
atacctcttagctgagtgga

SEQ ID NO: 5234533 - DNA, 21 bp, Homo sapiens
atacctgagcctcaaccttct

SEQ ID NO: 5234534 - DNA, 22 bp, Homo sapiens
atacctgcacgttcataaccaa

SEQ ID NO: 5234535 - DNA, 14 bp, Homo sapiens
atacctgcccctgc

SEQ ID NO: 5234536 - DNA, 13 bp, Homo sapiens
atacctggcctca

SEQ ID NO: 5234537 - DNA, 18 bp, Homo sapiens
atacctggttgagtgtgt

SEQ ID NO: 5234538 - DNA, 15 bp, Homo sapiens
atacctgtacacaca

SEQ ID NO: 5234539 - DNA, 21 bp, Homo sapiens
atacctgtacacacacagaca

SEQ ID NO: 5234540 - DNA, 16 bp, Homo sapiens
atacctgtccccctga

SEQ ID NO: 5234541 - DNA, 18 bp, Homo sapiens
atacctgtccccctgaca

SEQ ID NO: 5234542 - DNA, 15 bp, Homo sapiens
atacctgtgaggact

SEQ ID NO: 5234543 - DNA, 17 bp, Homo sapiens
atacctgtgaggactgg

SEQ ID NO: 5234544 - DNA, 16 bp, Homo sapiens
atacctgtgcctcggc

SEQ ID NO: 5234545 - DNA, 16 bp, Homo sapiens
ataccttaaaatttga

SEQ ID NO: 5234546 - DNA, 18 bp, Homo sapiens
ataccttagactgaaaaa

SEQ ID NO: 5234547 - DNA, 15 bp, Homo sapiens
ataccttagctccct

SEQ ID NO: 5234548 - DNA, 13 bp, Homo sapiens
ataccttatttat

SEQ ID NO: 5234549 - DNA, 21 bp, Homo sapiens
ataccttatttatttttgtgt

SEQ ID NO: 5234550 - DNA, 17 bp, Homo sapiens
ataccttccatctcaac

SEQ ID NO: 5234551 - DNA, 15 bp, Homo sapiens
ataccttctatgtat

SEQ ID NO: 5234552 - DNA, 14 bp, Homo sapiens
ataccttctcccag

SEQ ID NO: 5234553 - DNA, 15 bp, Homo sapiens
ataccttctcccagg

SEQ ID NO: 5234554 - DNA, 23 bp, Homo sapiens
ataccttctcccaggcctctgcc

SEQ ID NO: 5234555 - DNA, 13 bp, Homo sapiens
ataccttcttatt

SEQ ID NO: 5234556 - DNA, 17 bp, Homo sapiens
ataccttgaaaggcagg

SEQ ID NO: 5234557 - DNA, 22 bp, Homo sapiens
atacctttaaatatcattcttt

SEQ ID NO: 5234558 - DNA, 18 bp, Homo sapiens
atacctttcacagctttt

SEQ ID NO: 5234559 - DNA, 15 bp, Homo sapiens
atacctttccttttt

SEQ ID NO: 5234560 - DNA, 22 bp, Homo sapiens
atacctttcctttttggggagt

SEQ ID NO: 5234561 - DNA, 23 bp, Homo sapiens
atacctttctaagggaaaaagtt

SEQ ID NO: 5234562 - DNA, 12 bp, Homo sapiens
atacctttgaaa

SEQ ID NO: 5234563 - DNA, 20 bp, Homo sapiens
atacctttggaaaaatcttg

SEQ ID NO: 5234564 - DNA, 22 bp, Homo sapiens
atacctttgtagttactcaagc

SEQ ID NO: 5234565 - DNA, 19 bp, Homo sapiens
ataccttttctcacaaaaa

SEQ ID NO: 5234566 - DNA, 19 bp, Homo sapiens
atacctttttcttaaaaaa

SEQ ID NO: 5234567 - DNA, 19 bp, Homo sapiens
atacgaaataattgttgtt

SEQ ID NO: 5234568 - DNA, 20 bp, Homo sapiens
atacgaacccaatctgcaca

SEQ ID NO: 5234569 - DNA, 17 bp, Homo sapiens
atacgactttattttct

SEQ ID NO: 5234570 - DNA, 23 bp, Homo sapiens
atacgcaacataattaaattttg

SEQ ID NO: 5234571 - DNA, 17 bp, Homo sapiens
atacgcaattgtatata

SEQ ID NO: 5234572 - DNA, 18 bp, Homo sapiens
atacgcaattgtatatat

SEQ ID NO: 5234573 - DNA, 19 bp, Homo sapiens
atacgcaattgtatatata

SEQ ID NO: 5234574 - DNA, 21 bp, Homo sapiens
atacgcaattgtatatatatg

SEQ ID NO: 5234575 - DNA, 22 bp, Homo sapiens
atacgcaattgtatatatatgt

SEQ ID NO: 5234576 - DNA, 17 bp, Homo sapiens
atacgcactacatgtgg

SEQ ID NO: 5234577 - DNA, 18 bp, Homo sapiens
atacgcattaagggcctg

SEQ ID NO: 5234578 - DNA, 21 bp, Homo sapiens
atacgcattaagggcctgctg

SEQ ID NO: 5234579 - DNA, 22 bp, Homo sapiens
atacgcattaagggcctgctgg

SEQ ID NO: 5234580 - DNA, 20 bp, Homo sapiens
atacgccagaactgctttat

SEQ ID NO: 5234581 - DNA, 21 bp, Homo sapiens
atacgcctttaaaggttttta

SEQ ID NO: 5234582 - DNA, 23 bp, Homo sapiens
atacgctaataagtgacaaataa

SEQ ID NO: 5234583 - DNA, 24 bp, Homo sapiens
atacgcttttctttgttataccat

SEQ ID NO: 5234584 - DNA, 22 bp, Homo sapiens
atacggaagtaaacctgaacaa

SEQ ID NO: 5234585 - DNA, 18 bp, Homo sapiens
atacgggagtgacccagc

SEQ ID NO: 5234586 - DNA, 19 bp, Homo sapiens
atacgggggttgggctaga

SEQ ID NO: 5234587 - DNA, 17 bp, Homo sapiens
atacggggtcttgctct

SEQ ID NO: 5234588 - DNA, 15 bp, Homo sapiens
atacgtacacatttt

SEQ ID NO: 5234589 - DNA, 16 bp, Homo sapiens
atacgtacacatttta

SEQ ID NO: 5234590 - DNA, 13 bp, Homo sapiens
atacgtacataca

SEQ ID NO: 5234591 - DNA, 19 bp, Homo sapiens
atacgtagttgtgcttttg

SEQ ID NO: 5234592 - DNA, 16 bp, Homo sapiens
agttcttgtgcatgtt

SEQ ID NO: 5234593 - DNA, 13 bp, Homo sapiens
agttcttgtgcca

SEQ ID NO: 5234594 - DNA, 14 bp, Homo sapiens
agttcttgtggaag

SEQ ID NO: 5234595 - DNA, 15 bp, Homo sapiens
agttcttgtggaaga

SEQ ID NO: 5234596 - DNA, 14 bp, Homo sapiens
agttctttactggt

SEQ ID NO: 5234597 - DNA, 15 bp, Homo sapiens
agttctttactggtg

SEQ ID NO: 5234598 - DNA, 16 bp, Homo sapiens
agttctttaggtgcct

SEQ ID NO: 5234599 - DNA, 23 bp, Homo sapiens
agttctttaggtgcctcctgtct

SEQ ID NO: 5234600 - DNA, 18 bp, Homo sapiens
agttctttcctccccctg

SEQ ID NO: 5234601 - DNA, 20 bp, Homo sapiens
agttctttcctccccctgca

SEQ ID NO: 5234602 - DNA, 14 bp, Homo sapiens
agttctttcctctt

SEQ ID NO: 5234603 - DNA, 23 bp, Homo sapiens
agttctttcctctttctgctctg

SEQ ID NO: 5234604 - DNA, 20 bp, Homo sapiens
agttctttgatttgtaccat

SEQ ID NO: 5234605 - DNA, 15 bp, Homo sapiens
agttctttgcaagct

SEQ ID NO: 5234606 - DNA, 17 bp, Homo sapiens
agttctttgctgcccct

SEQ ID NO: 5234607 - DNA, 17 bp, Homo sapiens
agttctttggctctatt

SEQ ID NO: 5234608 - DNA, 17 bp, Homo sapiens
agttctttggctgaaag

SEQ ID NO: 5234609 - DNA, 15 bp, Homo sapiens
agttctttgggccag

SEQ ID NO: 5234610 - DNA, 19 bp, Homo sapiens
agttctttgttcatagccc

SEQ ID NO: 5234611 - DNA, 21 bp, Homo sapiens
agttctttgttcatagcccag

SEQ ID NO: 5234612 - DNA, 20 bp, Homo sapiens
agttctttgttcctgctttc

SEQ ID NO: 5234613 - DNA, 12 bp, Homo sapiens
agttcttttcta

SEQ ID NO: 5234614 - DNA, 18 bp, Homo sapiens
agttctttttcactctgt

SEQ ID NO: 5234615 - DNA, 23 bp, Homo sapiens
agttctttttgccagttttccct

SEQ ID NO: 5234616 - DNA, 17 bp, Homo sapiens
agttctttttgtacact

SEQ ID NO: 5234617 - DNA, 19 bp, Homo sapiens
agttcttttttgtacagta

SEQ ID NO: 5234618 - DNA, 18 bp, Homo sapiens
agttgaaaaaagaagttt

SEQ ID NO: 5234619 - DNA, 17 bp, Homo sapiens
agttgaaaaacagctga

SEQ ID NO: 5234620 - DNA, 17 bp, Homo sapiens
agttgaaaagtaaaaaa

SEQ ID NO: 5234621 - DNA, 20 bp, Homo sapiens
agttgaaaagtaaaaaatat

SEQ ID NO: 5234622 - DNA, 17 bp, Homo sapiens
agttgaaaatacattct

SEQ ID NO: 5234623 - DNA, 22 bp, Homo sapiens
agttgaaaatcttataatttaa

SEQ ID NO: 5234624 - DNA, 23 bp, Homo sapiens
agttgaaaatcttataatttaaa

SEQ ID NO: 5234625 - DNA, 19 bp, Homo sapiens
agttgaaaattcatagtaa

SEQ ID NO: 5234626 - DNA, 12 bp, Homo sapiens
agttgaaagtaa

SEQ ID NO: 5234627 - DNA, 14 bp, Homo sapiens
agttgaaagtaaaa

SEQ ID NO: 5234628 - DNA, 13 bp, Homo sapiens
agttgaaatgttc

SEQ ID NO: 5234629 - DNA, 19 bp, Homo sapiens
agttgaacaagatttccct

SEQ ID NO: 5234630 - DNA, 21 bp, Homo sapiens
agttgaacactagtctgtgta

SEQ ID NO: 5234631 - DNA, 16 bp, Homo sapiens
agttgaacagagctag

SEQ ID NO: 5234632 - DNA, 21 bp, Homo sapiens
agttgaacagagctagaggcc

SEQ ID NO: 5234633 - DNA, 17 bp, Homo sapiens
agttgaaccattatact

SEQ ID NO: 5234634 - DNA, 17 bp, Homo sapiens
agttgaacctatttctc

SEQ ID NO: 5234635 - DNA, 19 bp, Homo sapiens
agttgaacctatttctctt

SEQ ID NO: 5234636 - DNA, 21 bp, Homo sapiens
agttgaactatgactggagta

SEQ ID NO: 5234637 - DNA, 13 bp, Homo sapiens
agttgaactgata

SEQ ID NO: 5234638 - DNA, 23 bp, Homo sapiens
agttgaactgatagttactgttg

SEQ ID NO: 5234639 - DNA, 19 bp, Homo sapiens
agttgaagaaaaaatggca

SEQ ID NO: 5234640 - DNA, 20 bp, Homo sapiens
agttgaaggctagaagtgtg

SEQ ID NO: 5234641 - DNA, 22 bp, Homo sapiens
agttgaagttagtggaaatctg

SEQ ID NO: 5234642 - DNA, 13 bp, Homo sapiens
agttgaataaaaa

SEQ ID NO: 5234643 - DNA, 14 bp, Homo sapiens
agttgaataaacat

SEQ ID NO: 5234644 - DNA, 15 bp, Homo sapiens
agttgaatacttgaa

SEQ ID NO: 5234645 - DNA, 17 bp, Homo sapiens
agttgaatacttgaacc

SEQ ID NO: 5234646 - DNA, 16 bp, Homo sapiens
agttgaatataagaaa

SEQ ID NO: 5234647 - DNA, 12 bp, Homo sapiens
agttgaatattg

SEQ ID NO: 5234648 - DNA, 14 bp, Homo sapiens
agttgaatctattg

SEQ ID NO: 5234649 - DNA, 21 bp, Homo sapiens
agttgaatgacaacagaagct

SEQ ID NO: 5234650 - DNA, 20 bp, Homo sapiens
agttgaatggcctgccttga

SEQ ID NO: 5234651 - DNA, 10 bp, Homo sapiens
agttgaattt

SEQ ID NO: 5234652 - DNA, 19 bp, Homo sapiens
agttgaatttattggcttt

SEQ ID NO: 5234653 - DNA, 23 bp, Homo sapiens
agttgaattttttttaacattcc

SEQ ID NO: 5234654 - DNA, 20 bp, Homo sapiens
agttgacaattctgcatgta

SEQ ID NO: 5234655 - DNA, 17 bp, Homo sapiens
agttgacacctgagaaa

SEQ ID NO: 5234656 - DNA, 15 bp, Homo sapiens
agttgaccaatgaaa

SEQ ID NO: 5234657 - DNA, 15 bp, Homo sapiens
agttgacccctcctg

SEQ ID NO: 5234658 - DNA, 15 bp, Homo sapiens
agttgaccctatttt

SEQ ID NO: 5234659 - DNA, 19 bp, Homo sapiens
agttgaccgttttcatcct

SEQ ID NO: 5234660 - DNA, 23 bp, Homo sapiens
agttgaccgttttcatcctggcc

SEQ ID NO: 5234661 - DNA, 11 bp, Homo sapiens
agttgaccttt

SEQ ID NO: 5234662 - DNA, 20 bp, Homo sapiens
agttgacctttatttattaa

SEQ ID NO: 5234663 - DNA, 23 bp, Homo sapiens
agttgacctttatttattaaact

SEQ ID NO: 5234664 - DNA, 18 bp, Homo sapiens
agttgacggggcagtcag

SEQ ID NO: 5234665 - DNA, 16 bp, Homo sapiens
agttgactcacaggcc

SEQ ID NO: 5234666 - DNA, 23 bp, Homo sapiens
agttgactcacaggccctggaga

SEQ ID NO: 5234667 - DNA, 18 bp, Homo sapiens
agttgactggctttcctc

SEQ ID NO: 5234668 - DNA, 12 bp, Homo sapiens
agttgacttact

SEQ ID NO: 5234669 - DNA, 21 bp, Homo sapiens
agttgacttatagtacatgat

SEQ ID NO: 5234670 - DNA, 17 bp, Homo sapiens
agttgagaaaaatttat

SEQ ID NO: 5234671 - DNA, 20 bp, Homo sapiens
agttgagaaacagttccatt

SEQ ID NO: 5234672 - DNA, 16 bp, Homo sapiens
agttgagaaggtgcct

SEQ ID NO: 5234673 - DNA, 20 bp, Homo sapiens
agttgagactcggccgcagc

SEQ ID NO: 5234674 - DNA, 21 bp, Homo sapiens
agttgagattcaaacccaggc

SEQ ID NO: 5234675 - DNA, 16 bp, Homo sapiens
agttgagattgtactg

SEQ ID NO: 5234676 - DNA, 18 bp, Homo sapiens
agttgagattgtactgtt

SEQ ID NO: 5234677 - DNA, 22 bp, Homo sapiens
agttgagatttttaagaacttc

SEQ ID NO: 5234678 - DNA, 23 bp, Homo sapiens
agttgagcacaggcaacattaca

SEQ ID NO: 5234679 - DNA, 21 bp, Homo sapiens
agttgagccagcagacattgt

SEQ ID NO: 5234680 - DNA, 11 bp, Homo sapiens
agttgagcccc

SEQ ID NO: 5234681 - DNA, 20 bp, Homo sapiens
agttgagcgtgcgcactgca

SEQ ID NO: 5234682 - DNA, 13 bp, Homo sapiens
agttgagctatga

SEQ ID NO: 5234683 - DNA, 15 bp, Homo sapiens
agttgaggacttctt

SEQ ID NO: 5234684 - DNA, 15 bp, Homo sapiens
agttgaggagtttcc

SEQ ID NO: 5234685 - DNA, 16 bp, Homo sapiens
agttgaggagtttcct

SEQ ID NO: 5234686 - DNA, 11 bp, Homo sapiens
agttgaggcca

SEQ ID NO: 5234687 - DNA, 22 bp, Homo sapiens
agttgaggcttagctatgtttc

SEQ ID NO: 5234688 - DNA, 15 bp, Homo sapiens
agttgaggggagagg

SEQ ID NO: 5234689 - DNA, 19 bp, Homo sapiens
agttgaggggagaggaaat

SEQ ID NO: 5234690 - DNA, 18 bp, Homo sapiens
agttgaggggcttccctc

SEQ ID NO: 5234691 - DNA, 22 bp, Homo sapiens
agttgaggggcttccctctgct

SEQ ID NO: 5234692 - DNA, 19 bp, Homo sapiens
agttgaggtctttctcctc

SEQ ID NO: 5234693 - DNA, 20 bp, Homo sapiens
agttgagtacagtgaggagg

SEQ ID NO: 5234694 - DNA, 20 bp, Homo sapiens
agttgagtcgtcatcacttt

SEQ ID NO: 5234695 - DNA, 22 bp, Homo sapiens
agttgagtctcctctctgagac

SEQ ID NO: 5234696 - DNA, 17 bp, Homo sapiens
agttgagtcttcacatt

SEQ ID NO: 5234697 - DNA, 14 bp, Homo sapiens
agttgagtgaaatt

SEQ ID NO: 5234698 - DNA, 17 bp, Homo sapiens
agttgagtgatagagct

SEQ ID NO: 5234699 - DNA, 21 bp, Homo sapiens
agttgagttattccacaaaca

SEQ ID NO: 5234700 - DNA, 23 bp, Homo sapiens
agttgataaagattttttaataa

SEQ ID NO: 5234701 - DNA, 14 bp, Homo sapiens
agttgatagcacag

SEQ ID NO: 5234702 - DNA, 15 bp, Homo sapiens
agttgatagcacaga

SEQ ID NO: 5234703 - DNA, 22 bp, Homo sapiens
agttgatagcacagaccctgcc

SEQ ID NO: 5234704 - DNA, 19 bp, Homo sapiens
agttgataggagacttgta

SEQ ID NO: 5234705 - DNA, 17 bp, Homo sapiens
agttgatatagaacagt

SEQ ID NO: 5234706 - DNA, 19 bp, Homo sapiens
agttgatatagaacagtgc

SEQ ID NO: 5234707 - DNA, 21 bp, Homo sapiens
agttgatatgccttttcccaa

SEQ ID NO: 5234708 - DNA, 21 bp, Homo sapiens
agttgatattctaaaatataa

SEQ ID NO: 5234709 - DNA, 15 bp, Homo sapiens
agttgatcataatta

SEQ ID NO: 5234710 - DNA, 17 bp, Homo sapiens
agttgatcataattaaa

SEQ ID NO: 5234711 - DNA, 15 bp, Homo sapiens
agttgatcatgcagg

SEQ ID NO: 5234712 - DNA, 15 bp, Homo sapiens
agttgatctggaacc

SEQ ID NO: 5234713 - DNA, 17 bp, Homo sapiens
agttgatctggaaccca

SEQ ID NO: 5234714 - DNA, 20 bp, Homo sapiens
agttgatctggaacccagac

SEQ ID NO: 5234715 - DNA, 21 bp, Homo sapiens
agttgatctggaacccagact

SEQ ID NO: 5234716 - DNA, 14 bp, Homo sapiens
agttgatgaccaat

SEQ ID NO: 5234717 - DNA, 20 bp, Homo sapiens
agttgatgaccaatctctgt

SEQ ID NO: 5234718 - DNA, 13 bp, Homo sapiens
agttgatgctaca

SEQ ID NO: 5234719 - DNA, 14 bp, Homo sapiens
agttgatggagccc

SEQ ID NO: 5234720 - DNA, 17 bp, Homo sapiens
agttgatggagccccag

SEQ ID NO: 5234721 - DNA, 18 bp, Homo sapiens
agttgatggagccccagg

SEQ ID NO: 5234722 - DNA, 18 bp, Homo sapiens
agttgatgggggccagga

SEQ ID NO: 5234723 - DNA, 21 bp, Homo sapiens
agttgatgggggtgtgatttg

SEQ ID NO: 5234724 - DNA, 15 bp, Homo sapiens
agttgatgttgcatt

SEQ ID NO: 5234725 - DNA, 16 bp, Homo sapiens
agttgatgttgcattt

SEQ ID NO: 5234726 - DNA, 14 bp, Homo sapiens
agttgatgttttct

SEQ ID NO: 5234727 - DNA, 15 bp, Homo sapiens
agttgatgttttcta

SEQ ID NO: 5234728 - DNA, 19 bp, Homo sapiens
agttgattcagccctcaga

SEQ ID NO: 5234729 - DNA, 18 bp, Homo sapiens
agttgattcagctctgca

SEQ ID NO: 5234730 - DNA, 21 bp, Homo sapiens
agttgattccttgagtttcat

SEQ ID NO: 5234731 - DNA, 22 bp, Homo sapiens
agttgattctgtcccccacgtg

SEQ ID NO: 5234732 - DNA, 18 bp, Homo sapiens
agttgattgcgagaattt

SEQ ID NO: 5234733 - DNA, 18 bp, Homo sapiens
agttgatttagtgttttt

SEQ ID NO: 5234734 - DNA, 23 bp, Homo sapiens
agttgatttttttttttttttcc

SEQ ID NO: 5234735 - DNA, 15 bp, Homo sapiens
agttgcaaagcattt

SEQ ID NO: 5234736 - DNA, 11 bp, Homo sapiens
agttgcaagac

SEQ ID NO: 5234737 - DNA, 14 bp, Homo sapiens
agttgcaagatctt

SEQ ID NO: 5234738 - DNA, 20 bp, Homo sapiens
agttgcaaggcaaatgttta

SEQ ID NO: 5234739 - DNA, 17 bp, Homo sapiens
agttgcaataaaatagt

SEQ ID NO: 5234740 - DNA, 13 bp, Homo sapiens
agttgcaataata

SEQ ID NO: 5234741 - DNA, 17 bp, Homo sapiens
agttgcaataatacttc

SEQ ID NO: 5234742 - DNA, 20 bp, Homo sapiens
agttgcaattgaattaaatt

SEQ ID NO: 5234743 - DNA, 12 bp, Homo sapiens
agttgcacagca

SEQ ID NO: 5234744 - DNA, 13 bp, Homo sapiens
agttgcacagcat

SEQ ID NO: 5234745 - DNA, 16 bp, Homo sapiens
agttgcacatgattgt

SEQ ID NO: 5234746 - DNA, 19 bp, Homo sapiens
agttgcacccttccctgtg

SEQ ID NO: 5234747 - DNA, 15 bp, Homo sapiens
agttgcacggctgct

SEQ ID NO: 5234748 - DNA, 20 bp, Homo sapiens
agttgcacggctgctgaggc

SEQ ID NO: 5234749 - DNA, 16 bp, Homo sapiens
agttgcagaaaatgaa

SEQ ID NO: 5234750 - DNA, 16 bp, Homo sapiens
agttgcagattcattt

SEQ ID NO: 5234751 - DNA, 14 bp, Homo sapiens
agttgcagcccaag

SEQ ID NO: 5234752 - DNA, 14 bp, Homo sapiens
agttgcagctgttt

SEQ ID NO: 5234753 - DNA, 20 bp, Homo sapiens
agttgcaggtgccaatgact

SEQ ID NO: 5234754 - DNA, 22 bp, Homo sapiens
agttgcaggtgccaatgactaa

SEQ ID NO: 5234755 - DNA, 16 bp, Homo sapiens
agttgcagtattggac

SEQ ID NO: 5234756 - DNA, 17 bp, Homo sapiens
agttgcagtcactctag

SEQ ID NO: 5234757 - DNA, 11 bp, Homo sapiens
agttgcagttt

SEQ ID NO: 5234758 - DNA, 14 bp, Homo sapiens
agttgcataagcat

SEQ ID NO: 5234759 - DNA, 16 bp, Homo sapiens
agttgcatatatggac

SEQ ID NO: 5234760 - DNA, 21 bp, Homo sapiens
agttgcatggcatcacctcca

SEQ ID NO: 5234761 - DNA, 13 bp, Homo sapiens
agttgcatgtagt

SEQ ID NO: 5234762 - DNA, 17 bp, Homo sapiens
agttgcatgtagtaaca

SEQ ID NO: 5234763 - DNA, 18 bp, Homo sapiens
agttgcatgtagtaacac

SEQ ID NO: 5234764 - DNA, 21 bp, Homo sapiens
agttgcatgtagtaacactaa

SEQ ID NO: 5234765 - DNA, 20 bp, Homo sapiens
agttgcattggtttgagaaa

SEQ ID NO: 5234766 - DNA, 19 bp, Homo sapiens
agttgcatttagaaatcaa

SEQ ID NO: 5234767 - DNA, 14 bp, Homo sapiens
agttgcatttgtaa

SEQ ID NO: 5234768 - DNA, 23 bp, Homo sapiens
agttgcattttaaccctatttta

SEQ ID NO: 5234769 - DNA, 13 bp, Homo sapiens
agttgccaagaca

SEQ ID NO: 5234770 - DNA, 21 bp, Homo sapiens
atacgtagttgtgcttttgtt

SEQ ID NO: 5234771 - DNA, 21 bp, Homo sapiens
atacgtatgcatttttttagt

SEQ ID NO: 5234772 - DNA, 17 bp, Homo sapiens
atacgtgccagatataa

SEQ ID NO: 5234773 - DNA, 18 bp, Homo sapiens
atacgtgggcattcaaat

SEQ ID NO: 5234774 - DNA, 14 bp, Homo sapiens
atacgtgtgtgaag

SEQ ID NO: 5234775 - DNA, 17 bp, Homo sapiens
atacgtgttaggaggct

SEQ ID NO: 5234776 - DNA, 15 bp, Homo sapiens
atacgtgttctatag

SEQ ID NO: 5234777 - DNA, 16 bp, Homo sapiens
atacgtgttctataga

SEQ ID NO: 5234778 - DNA, 18 bp, Homo sapiens
atacgtgttttgaattgc

SEQ ID NO: 5234779 - DNA, 22 bp, Homo sapiens
atacgtgttttgaattgcaaac

SEQ ID NO: 5234780 - DNA, 17 bp, Homo sapiens
atacgttgatagtttac

SEQ ID NO: 5234781 - DNA, 13 bp, Homo sapiens
atacgtttgataa

SEQ ID NO: 5234782 - DNA, 19 bp, Homo sapiens
atacgtttgtgcagaatct

SEQ ID NO: 5234783 - DNA, 16 bp, Homo sapiens
atacgttttggtgttg

SEQ ID NO: 5234784 - DNA, 22 bp, Homo sapiens
atacgttttggtgttgcttttc

SEQ ID NO: 5234785 - DNA, 16 bp, Homo sapiens
atacgttttgtgtata

SEQ ID NO: 5234786 - DNA, 19 bp, Homo sapiens
atactaaaaagaagtgctg

SEQ ID NO: 5234787 - DNA, 13 bp, Homo sapiens
atactaaaaatca

SEQ ID NO: 5234788 - DNA, 12 bp, Homo sapiens
atactaaaatat

SEQ ID NO: 5234789 - DNA, 16 bp, Homo sapiens
atactaaaatatgtct

SEQ ID NO: 5234790 - DNA, 13 bp, Homo sapiens
atactaaagcaaa

SEQ ID NO: 5234791 - DNA, 15 bp, Homo sapiens
atactaaccatttct

SEQ ID NO: 5234792 - DNA, 17 bp, Homo sapiens
atactaactgctgattt

SEQ ID NO: 5234793 - DNA, 23 bp, Homo sapiens
atactaagaataacaagaagccc

SEQ ID NO: 5234794 - DNA, 10 bp, Homo sapiens
atactaagag

SEQ ID NO: 5234795 - DNA, 17 bp, Homo sapiens
atactaagcattgaatg

SEQ ID NO: 5234796 - DNA, 11 bp, Homo sapiens
atactaataaa

SEQ ID NO: 5234797 - DNA, 12 bp, Homo sapiens
atactaataaaa

SEQ ID NO: 5234798 - DNA, 16 bp, Homo sapiens
atactaataaaaaggt

SEQ ID NO: 5234799 - DNA, 18 bp, Homo sapiens
atactaataaaaaggttt

SEQ ID NO: 5234800 - DNA, 19 bp, Homo sapiens
atactaataaaaaggttta

SEQ ID NO: 5234801 - DNA, 19 bp, Homo sapiens
atactaataaaatacatac

SEQ ID NO: 5234802 - DNA, 22 bp, Homo sapiens
atactaataaactaataattgc

SEQ ID NO: 5234803 - DNA, 14 bp, Homo sapiens
atactaataaatat

SEQ ID NO: 5234804 - DNA, 15 bp, Homo sapiens
atactaataaatata

SEQ ID NO: 5234805 - DNA, 18 bp, Homo sapiens
atactaataaatataatt

SEQ ID NO: 5234806 - DNA, 22 bp, Homo sapiens
atactaatagagtacttaatat

SEQ ID NO: 5234807 - DNA, 21 bp, Homo sapiens
atactaatagcctaaaagatt

SEQ ID NO: 5234808 - DNA, 14 bp, Homo sapiens
atactaatgatgag

SEQ ID NO: 5234809 - DNA, 12 bp, Homo sapiens
atactaatttat

SEQ ID NO: 5234810 - DNA, 17 bp, Homo sapiens
atactaatttattgccg

SEQ ID NO: 5234811 - DNA, 22 bp, Homo sapiens
atactaatttttgcttaacatt

SEQ ID NO: 5234812 - DNA, 17 bp, Homo sapiens
atactacaacttttgtt

SEQ ID NO: 5234813 - DNA, 13 bp, Homo sapiens
atactacagtttg

SEQ ID NO: 5234814 - DNA, 14 bp, Homo sapiens
atactacatcttta

SEQ ID NO: 5234815 - DNA, 14 bp, Homo sapiens
atactaccagggtc

SEQ ID NO: 5234816 - DNA, 23 bp, Homo sapiens
atactaccctgggctctggtctg

SEQ ID NO: 5234817 - DNA, 16 bp, Homo sapiens
atactacctataggaa

SEQ ID NO: 5234818 - DNA, 15 bp, Homo sapiens
atactacctctgaat

SEQ ID NO: 5234819 - DNA, 15 bp, Homo sapiens
atactaccttgaaaa

SEQ ID NO: 5234820 - DNA, 14 bp, Homo sapiens
atactactgaaaca

SEQ ID NO: 5234821 - DNA, 19 bp, Homo sapiens
atactactgaaacagattt

SEQ ID NO: 5234822 - DNA, 13 bp, Homo sapiens
atactactgtaaa

SEQ ID NO: 5234823 - DNA, 14 bp, Homo sapiens
atactactgtaaat

SEQ ID NO: 5234824 - DNA, 16 bp, Homo sapiens
atactactgtaaatgt

SEQ ID NO: 5234825 - DNA, 22 bp, Homo sapiens
atactagatttgggagaagggc

SEQ ID NO: 5234826 - DNA, 16 bp, Homo sapiens
atactagccagagctc

SEQ ID NO: 5234827 - DNA, 22 bp, Homo sapiens
atactagccagagctcctcctt

SEQ ID NO: 5234828 - DNA, 16 bp, Homo sapiens
atactagggagccatt

SEQ ID NO: 5234829 - DNA, 22 bp, Homo sapiens
atactaggttaacatttgtaat

SEQ ID NO: 5234830 - DNA, 23 bp, Homo sapiens
atactagtgggatcaacaatgat

SEQ ID NO: 5234831 - DNA, 15 bp, Homo sapiens
atactatacaacaat

SEQ ID NO: 5234832 - DNA, 16 bp, Homo sapiens
atactatacaacaatg

SEQ ID NO: 5234833 - DNA, 13 bp, Homo sapiens
atactatagattc

SEQ ID NO: 5234834 - DNA, 17 bp, Homo sapiens
atactatattaaattct

SEQ ID NO: 5234835 - DNA, 13 bp, Homo sapiens
atactatattaac

SEQ ID NO: 5234836 - DNA, 17 bp, Homo sapiens
atactatccatgtaata

SEQ ID NO: 5234837 - DNA, 16 bp, Homo sapiens
atactatgaaatatgt

SEQ ID NO: 5234838 - DNA, 19 bp, Homo sapiens
atactatgcagtatctctt

SEQ ID NO: 5234839 - DNA, 17 bp, Homo sapiens
atactatgtaagggctt

SEQ ID NO: 5234840 - DNA, 18 bp, Homo sapiens
atactatgtaagggcttt

SEQ ID NO: 5234841 - DNA, 13 bp, Homo sapiens
atactatgtggga

SEQ ID NO: 5234842 - DNA, 19 bp, Homo sapiens
atactattaaacatgctgt

SEQ ID NO: 5234843 - DNA, 12 bp, Homo sapiens
atactattaaag

SEQ ID NO: 5234844 - DNA, 14 bp, Homo sapiens
atactattaccacc

SEQ ID NO: 5234845 - DNA, 14 bp, Homo sapiens
atactattcaatgc

SEQ ID NO: 5234846 - DNA, 12 bp, Homo sapiens
atactattctca

SEQ ID NO: 5234847 - DNA, 16 bp, Homo sapiens
atactatttaagatgt

SEQ ID NO: 5234848 - DNA, 19 bp, Homo sapiens
atactatttaagatgtgaa

SEQ ID NO: 5234849 - DNA, 20 bp, Homo sapiens
atactatttaagatgtgaaa

SEQ ID NO: 5234850 - DNA, 23 bp, Homo sapiens
atactatttagtttttgtaattt

SEQ ID NO: 5234851 - DNA, 18 bp, Homo sapiens
atactatttttactgcca

SEQ ID NO: 5234852 - DNA, 19 bp, Homo sapiens
atactatttttactgccac

SEQ ID NO: 5234853 - DNA, 22 bp, Homo sapiens
atactcaaagtggaaaggatca

SEQ ID NO: 5234854 - DNA, 19 bp, Homo sapiens
atactcaaatgagtaacat

SEQ ID NO: 5234855 - DNA, 14 bp, Homo sapiens
atactcaaatggtg

SEQ ID NO: 5234856 - DNA, 15 bp, Homo sapiens
atactcaagctgtct

SEQ ID NO: 5234857 - DNA, 13 bp, Homo sapiens
atactcaatcaag

SEQ ID NO: 5234858 - DNA, 12 bp, Homo sapiens
atactcacattt

SEQ ID NO: 5234859 - DNA, 16 bp, Homo sapiens
atactcaccaaaatat

SEQ ID NO: 5234860 - DNA, 17 bp, Homo sapiens
atactcacctcctccca

SEQ ID NO: 5234861 - DNA, 13 bp, Homo sapiens
atactcagagggg

SEQ ID NO: 5234862 - DNA, 21 bp, Homo sapiens
atactcagggattccttctaa

SEQ ID NO: 5234863 - DNA, 20 bp, Homo sapiens
atactcataatgtgaagtgt

SEQ ID NO: 5234864 - DNA, 15 bp, Homo sapiens
atactcatcagagca

SEQ ID NO: 5234865 - DNA, 18 bp, Homo sapiens
atactcatccttgtataa

SEQ ID NO: 5234866 - DNA, 14 bp, Homo sapiens
atactcatgaatga

SEQ ID NO: 5234867 - DNA, 15 bp, Homo sapiens
atactcatgaatgaa

SEQ ID NO: 5234868 - DNA, 19 bp, Homo sapiens
atactcatgaccattagaa

SEQ ID NO: 5234869 - DNA, 18 bp, Homo sapiens
atactcatgcattctttt

SEQ ID NO: 5234870 - DNA, 16 bp, Homo sapiens
atactcatttctaaaa

SEQ ID NO: 5234871 - DNA, 19 bp, Homo sapiens
atactcatttctaaaagaa

SEQ ID NO: 5234872 - DNA, 23 bp, Homo sapiens
atactcatttctaaaagaatatt

SEQ ID NO: 5234873 - DNA, 13 bp, Homo sapiens
atactcatttgga

SEQ ID NO: 5234874 - DNA, 20 bp, Homo sapiens
atactccaagcttcaagtga

SEQ ID NO: 5234875 - DNA, 17 bp, Homo sapiens
atactccaaggtggcat

SEQ ID NO: 5234876 - DNA, 20 bp, Homo sapiens
atactccactcccagcagct

SEQ ID NO: 5234877 - DNA, 22 bp, Homo sapiens
atactccagcacctgtggctga

SEQ ID NO: 5234878 - DNA, 21 bp, Homo sapiens
atactccagtgtacatagtgt

SEQ ID NO: 5234879 - DNA, 23 bp, Homo sapiens
atactccagtgtacatagtgtaa

SEQ ID NO: 5234880 - DNA, 16 bp, Homo sapiens
atactccatacataac

SEQ ID NO: 5234881 - DNA, 17 bp, Homo sapiens
atactccattattttat

SEQ ID NO: 5234882 - DNA, 22 bp, Homo sapiens
atactccctttaaagagagttt

SEQ ID NO: 5234883 - DNA, 21 bp, Homo sapiens
atactccgtgaggctgctgcc

SEQ ID NO: 5234884 - DNA, 17 bp, Homo sapiens
atactcctatgctttag

SEQ ID NO: 5234885 - DNA, 17 bp, Homo sapiens
atactcctccaaggtta

SEQ ID NO: 5234886 - DNA, 15 bp, Homo sapiens
atactcctcctttta

SEQ ID NO: 5234887 - DNA, 13 bp, Homo sapiens
atactcctgggct

SEQ ID NO: 5234888 - DNA, 14 bp, Homo sapiens
atactcctgtcacc

SEQ ID NO: 5234889 - DNA, 16 bp, Homo sapiens
atactcctgtcaccta

SEQ ID NO: 5234890 - DNA, 22 bp, Homo sapiens
atactccttaaaaatgtatgtt

SEQ ID NO: 5234891 - DNA, 15 bp, Homo sapiens
atactccttgcttcc

SEQ ID NO: 5234892 - DNA, 23 bp, Homo sapiens
atactcgtttttataaactacaa

SEQ ID NO: 5234893 - DNA, 23 bp, Homo sapiens
atactctagatgaagttttacat

SEQ ID NO: 5234894 - DNA, 15 bp, Homo sapiens
atactctagattttg

SEQ ID NO: 5234895 - DNA, 14 bp, Homo sapiens
atactctccaggat

SEQ ID NO: 5234896 - DNA, 22 bp, Homo sapiens
atactctccctgacatttctaa

SEQ ID NO: 5234897 - DNA, 13 bp, Homo sapiens
atactctctgcct

SEQ ID NO: 5234898 - DNA, 19 bp, Homo sapiens
atactctgaggctgtatgt

SEQ ID NO: 5234899 - DNA, 12 bp, Homo sapiens
atactctgtcag

SEQ ID NO: 5234900 - DNA, 13 bp, Homo sapiens
atactctgtcaga

SEQ ID NO: 5234901 - DNA, 20 bp, Homo sapiens
atactctgtgtaatctctga

SEQ ID NO: 5234902 - DNA, 23 bp, Homo sapiens
atactctgtgtaatctctgatta

SEQ ID NO: 5234903 - DNA, 18 bp, Homo sapiens
atactctgttgcctcctc

SEQ ID NO: 5234904 - DNA, 21 bp, Homo sapiens
atactctgttgcctcctctct

SEQ ID NO: 5234905 - DNA, 23 bp, Homo sapiens
atactctgttgcctcctctctcc

SEQ ID NO: 5234906 - DNA, 14 bp, Homo sapiens
atactcttatatct

SEQ ID NO: 5234907 - DNA, 13 bp, Homo sapiens
atactcttgaaag

SEQ ID NO: 5234908 - DNA, 14 bp, Homo sapiens
atactcttgaaatg

SEQ ID NO: 5234909 - DNA, 13 bp, Homo sapiens
atactctttcaat

SEQ ID NO: 5234910 - DNA, 22 bp, Homo sapiens
atactctttctgtatatacttt

SEQ ID NO: 5234911 - DNA, 19 bp, Homo sapiens
atactgaaaaaaaaagctt

SEQ ID NO: 5234912 - DNA, 17 bp, Homo sapiens
atactgaaaatccaata

SEQ ID NO: 5234913 - DNA, 17 bp, Homo sapiens
atactgaaatgctttag

SEQ ID NO: 5234914 - DNA, 20 bp, Homo sapiens
atactgaaattattttctcc

SEQ ID NO: 5234915 - DNA, 23 bp, Homo sapiens
atactgaacatctgagtcctgga

SEQ ID NO: 5234916 - DNA, 11 bp, Homo sapiens
atactgaagat

SEQ ID NO: 5234917 - DNA, 12 bp, Homo sapiens
atactgaaggaa

SEQ ID NO: 5234918 - DNA, 20 bp, Homo sapiens
atactgaaggaaaaacacaa

SEQ ID NO: 5234919 - DNA, 17 bp, Homo sapiens
atactgaaggtctgaca

SEQ ID NO: 5234920 - DNA, 15 bp, Homo sapiens
atactgaatataaaa

SEQ ID NO: 5234921 - DNA, 15 bp, Homo sapiens
atactgaatgcataa

SEQ ID NO: 5234922 - DNA, 16 bp, Homo sapiens
atactgaatttctttg

SEQ ID NO: 5234923 - DNA, 19 bp, Homo sapiens
atactgaatttctttgatt

SEQ ID NO: 5234924 - DNA, 18 bp, Homo sapiens
atactgacaatgtatttt

SEQ ID NO: 5234925 - DNA, 15 bp, Homo sapiens
atactgacagaagtt

SEQ ID NO: 5234926 - DNA, 18 bp, Homo sapiens
atactgactcaacatgga

SEQ ID NO: 5234927 - DNA, 20 bp, Homo sapiens
atactgactttttaaatttt

SEQ ID NO: 5234928 - DNA, 17 bp, Homo sapiens
atactgagaaaacctgt

SEQ ID NO: 5234929 - DNA, 18 bp, Homo sapiens
atactgagaatatacaat

SEQ ID NO: 5234930 - DNA, 19 bp, Homo sapiens
atactgagatagcttagtg

SEQ ID NO: 5234931 - DNA, 22 bp, Homo sapiens
atactgagatgctgggctgtct

SEQ ID NO: 5234932 - DNA, 18 bp, Homo sapiens
atactgagccatttatac

SEQ ID NO: 5234933 - DNA, 12 bp, Homo sapiens
atactgagcctg

SEQ ID NO: 5234934 - DNA, 15 bp, Homo sapiens
atactgagctgctaa

SEQ ID NO: 5234935 - DNA, 23 bp, Homo sapiens
atactgagctgctaaaataaacc

SEQ ID NO: 5234936 - DNA, 17 bp, Homo sapiens
atactgatgagacaaca

SEQ ID NO: 5234937 - DNA, 22 bp, Homo sapiens
atactgatgagacaacacacac

SEQ ID NO: 5234938 - DNA, 14 bp, Homo sapiens
atactgatggaatt

SEQ ID NO: 5234939 - DNA, 13 bp, Homo sapiens
atactgattatga

SEQ ID NO: 5234940 - DNA, 15 bp, Homo sapiens
atactgattatgaaa

SEQ ID NO: 5234941 - DNA, 17 bp, Homo sapiens
atactgattatgtcttt

SEQ ID NO: 5234942 - DNA, 20 bp, Homo sapiens
atactgattatgtcttttat

SEQ ID NO: 5234943 - DNA, 17 bp, Homo sapiens
atactgattgggaggtg

SEQ ID NO: 5234944 - DNA, 22 bp, Homo sapiens
atactgattgggaggtgcgtgt

SEQ ID NO: 5234945 - DNA, 13 bp, Homo sapiens
atactgattttca

SEQ ID NO: 5234946 - DNA, 22 bp, Homo sapiens
atactgattttcaaaaaaatgt

SEQ ID NO: 5234947 - DNA, 15 bp, Homo sapiens
atactgattttgaaa

SEQ ID NO: 5234948 - DNA, 23 bp, Homo sapiens
atactgcaattaaagtgatactg

SEQ ID NO: 5234949 - DNA, 20 bp, Homo sapiens
atactgcacttacaatccca

SEQ ID NO: 5234950 - DNA, 21 bp, Homo sapiens
agttgccaatatgccagcttg

SEQ ID NO: 5234951 - DNA, 20 bp, Homo sapiens
agttgccagtcaccccggcc

SEQ ID NO: 5234952 - DNA, 21 bp, Homo sapiens
agttgccattattctatgtag

SEQ ID NO: 5234953 - DNA, 14 bp, Homo sapiens
agttgcccagagca

SEQ ID NO: 5234954 - DNA, 15 bp, Homo sapiens
agttgcccagagcac

SEQ ID NO: 5234955 - DNA, 19 bp, Homo sapiens
agttgcccccattcccagc

SEQ ID NO: 5234956 - DNA, 23 bp, Homo sapiens
agttgcccccattcccagcctga

SEQ ID NO: 5234957 - DNA, 17 bp, Homo sapiens
agttgccccgtctctgt

SEQ ID NO: 5234958 - DNA, 22 bp, Homo sapiens
agttgcccgaaactaagccagg

SEQ ID NO: 5234959 - DNA, 23 bp, Homo sapiens
agttgcccgaaactaagccaggc

SEQ ID NO: 5234960 - DNA, 18 bp, Homo sapiens
agttgccctagcccagac

SEQ ID NO: 5234961 - DNA, 19 bp, Homo sapiens
agttgccctagcccagact

SEQ ID NO: 5234962 - DNA, 15 bp, Homo sapiens
agttgccctccaggc

SEQ ID NO: 5234963 - DNA, 18 bp, Homo sapiens
agttgccgtctaggattg

SEQ ID NO: 5234964 - DNA, 11 bp, Homo sapiens
agttgcctaaa

SEQ ID NO: 5234965 - DNA, 21 bp, Homo sapiens
agttgcctaagcattgcctgg

SEQ ID NO: 5234966 - DNA, 14 bp, Homo sapiens
agttgcctttattt

SEQ ID NO: 5234967 - DNA, 21 bp, Homo sapiens
agttgcctttatttgctgtta

SEQ ID NO: 5234968 - DNA, 21 bp, Homo sapiens
agttgcgacggagagaaaaaa

SEQ ID NO: 5234969 - DNA, 13 bp, Homo sapiens
agttgctaaacac

SEQ ID NO: 5234970 - DNA, 21 bp, Homo sapiens
agttgctaactgggaagaaca

SEQ ID NO: 5234971 - DNA, 22 bp, Homo sapiens
agttgctaagtgtgcttagttt

SEQ ID NO: 5234972 - DNA, 20 bp, Homo sapiens
agttgctactcttcagaata

SEQ ID NO: 5234973 - DNA, 19 bp, Homo sapiens
agttgctagcaacaactta

SEQ ID NO: 5234974 - DNA, 15 bp, Homo sapiens
agttgctatttgaac

SEQ ID NO: 5234975 - DNA, 15 bp, Homo sapiens
agttgctcaaaaaga

SEQ ID NO: 5234976 - DNA, 17 bp, Homo sapiens
agttgctcaaagagcct

SEQ ID NO: 5234977 - DNA, 17 bp, Homo sapiens
agttgctcacatgtctt

SEQ ID NO: 5234978 - DNA, 18 bp, Homo sapiens
agttgctcacatgtcttt

SEQ ID NO: 5234979 - DNA, 21 bp, Homo sapiens
agttgctcaccgactcacctg

SEQ ID NO: 5234980 - DNA, 21 bp, Homo sapiens
agttgctcgcttttcctgccc

SEQ ID NO: 5234981 - DNA, 21 bp, Homo sapiens
agttgctctatgctttccaaa

SEQ ID NO: 5234982 - DNA, 16 bp, Homo sapiens
agttgctctctgttca

SEQ ID NO: 5234983 - DNA, 23 bp, Homo sapiens
agttgctctgacctcctctgggc

SEQ ID NO: 5234984 - DNA, 12 bp, Homo sapiens
agttgctctgta

SEQ ID NO: 5234985 - DNA, 15 bp, Homo sapiens
agttgctcttctaca

SEQ ID NO: 5234986 - DNA, 12 bp, Homo sapiens
agttgctgagag

SEQ ID NO: 5234987 - DNA, 23 bp, Homo sapiens
agttgctgatccctgctctctga

SEQ ID NO: 5234988 - DNA, 21 bp, Homo sapiens
agttgctgcttctcccaggca

SEQ ID NO: 5234989 - DNA, 15 bp, Homo sapiens
agttgctggcatgtc

SEQ ID NO: 5234990 - DNA, 22 bp, Homo sapiens
agttgctggcatgtcttcattg

SEQ ID NO: 5234991 - DNA, 17 bp, Homo sapiens
agttgctggtaaaatga

SEQ ID NO: 5234992 - DNA, 12 bp, Homo sapiens
agttgctgtcac

SEQ ID NO: 5234993 - DNA, 23 bp, Homo sapiens
agttgctgtcagtcttgacctct

SEQ ID NO: 5234994 - DNA, 20 bp, Homo sapiens
agttgctgtccccttccagg

SEQ ID NO: 5234995 - DNA, 21 bp, Homo sapiens
agttgctgtgaactttcatgt

SEQ ID NO: 5234996 - DNA, 14 bp, Homo sapiens
agttgctgttaatc

SEQ ID NO: 5234997 - DNA, 22 bp, Homo sapiens
agttgctgttaatctgatgtat

SEQ ID NO: 5234998 - DNA, 17 bp, Homo sapiens
agttgcttaattttgat

SEQ ID NO: 5234999 - DNA, 18 bp, Homo sapiens
agttgcttcttcagctga

SEQ ID NO: 5235000 - DNA, 16 bp, Homo sapiens
agttgctttgccagag

SEQ ID NO: 5235001 - DNA, 21 bp, Homo sapiens
agttgctttgccagagcagga

SEQ ID NO: 5235002 - DNA, 17 bp, Homo sapiens
agttgctttgttacaat

SEQ ID NO: 5235003 - DNA, 22 bp, Homo sapiens
agttgctttgttacaataaaac

SEQ ID NO: 5235004 - DNA, 14 bp, Homo sapiens
agttggaaaggaaa

SEQ ID NO: 5235005 - DNA, 16 bp, Homo sapiens
agttggaaagttggaa

SEQ ID NO: 5235006 - DNA, 14 bp, Homo sapiens
agttggaaatattc

SEQ ID NO: 5235007 - DNA, 14 bp, Homo sapiens
agttggaaatattt

SEQ ID NO: 5235008 - DNA, 12 bp, Homo sapiens
agttggaaggat

SEQ ID NO: 5235009 - DNA, 14 bp, Homo sapiens
agttggaagggacc

SEQ ID NO: 5235010 - DNA, 17 bp, Homo sapiens
agttggacacactgtaa

SEQ ID NO: 5235011 - DNA, 13 bp, Homo sapiens
agttggacagtaa

SEQ ID NO: 5235012 - DNA, 23 bp, Homo sapiens
agttggacccattgccagtgagt

SEQ ID NO: 5235013 - DNA, 15 bp, Homo sapiens
agttggactgtggcc

SEQ ID NO: 5235014 - DNA, 19 bp, Homo sapiens
agttggactgtggcctcag

SEQ ID NO: 5235015 - DNA, 19 bp, Homo sapiens
agttggacttgagaaagat

SEQ ID NO: 5235016 - DNA, 15 bp, Homo sapiens
agttggagcaggggt

SEQ ID NO: 5235017 - DNA, 17 bp, Homo sapiens
agttggagctagaaaat

SEQ ID NO: 5235018 - DNA, 12 bp, Homo sapiens
agttggaggaga

SEQ ID NO: 5235019 - DNA, 20 bp, Homo sapiens
agttggagggaaagccagcc

SEQ ID NO: 5235020 - DNA, 21 bp, Homo sapiens
agttggagggaaagccagcct

SEQ ID NO: 5235021 - DNA, 18 bp, Homo sapiens
agttggagtactatattt

SEQ ID NO: 5235022 - DNA, 21 bp, Homo sapiens
agttggagttcattcatatta

SEQ ID NO: 5235023 - DNA, 23 bp, Homo sapiens
agttggagttcattcatattaca

SEQ ID NO: 5235024 - DNA, 15 bp, Homo sapiens
agttggcacttctgc

SEQ ID NO: 5235025 - DNA, 14 bp, Homo sapiens
agttggcagaaagg

SEQ ID NO: 5235026 - DNA, 13 bp, Homo sapiens
agttggcagacag

SEQ ID NO: 5235027 - DNA, 17 bp, Homo sapiens
agttggcagagaaaatg

SEQ ID NO: 5235028 - DNA, 20 bp, Homo sapiens
agttggcagagaaaatgctg

SEQ ID NO: 5235029 - DNA, 18 bp, Homo sapiens
agttggcaggagctcctg

SEQ ID NO: 5235030 - DNA, 20 bp, Homo sapiens
agttggccagattgtggggt

SEQ ID NO: 5235031 - DNA, 21 bp, Homo sapiens
agttggccagattgtggggtg

SEQ ID NO: 5235032 - DNA, 23 bp, Homo sapiens
agttggccatatttacctcagcc

SEQ ID NO: 5235033 - DNA, 20 bp, Homo sapiens
agttggccatgatgtctttt

SEQ ID NO: 5235034 - DNA, 16 bp, Homo sapiens
agttggccctttaata

SEQ ID NO: 5235035 - DNA, 14 bp, Homo sapiens
agttggcctcagca

SEQ ID NO: 5235036 - DNA, 15 bp, Homo sapiens
agttggcctcagcag

SEQ ID NO: 5235037 - DNA, 13 bp, Homo sapiens
agttggcctctgc

SEQ ID NO: 5235038 - DNA, 15 bp, Homo sapiens
agttggcctctgccc

SEQ ID NO: 5235039 - DNA, 22 bp, Homo sapiens
agttggcctgtgcttggaggcc

SEQ ID NO: 5235040 - DNA, 23 bp, Homo sapiens
agttggcctgtgcttggaggcct

SEQ ID NO: 5235041 - DNA, 19 bp, Homo sapiens
agttggcgttgtgggcagg

SEQ ID NO: 5235042 - DNA, 18 bp, Homo sapiens
agttggctagaagaaagt

SEQ ID NO: 5235043 - DNA, 18 bp, Homo sapiens
agttggctaggggagcag

SEQ ID NO: 5235044 - DNA, 18 bp, Homo sapiens
agttggctggatgaaatt

SEQ ID NO: 5235045 - DNA, 18 bp, Homo sapiens
agttggcttacctggccc

SEQ ID NO: 5235046 - DNA, 19 bp, Homo sapiens
agttggctttgcccacccc

SEQ ID NO: 5235047 - DNA, 19 bp, Homo sapiens
agttgggaagtctcagcct

SEQ ID NO: 5235048 - DNA, 23 bp, Homo sapiens
agttgggaagtctcagcctgggc

SEQ ID NO: 5235049 - DNA, 13 bp, Homo sapiens
agttgggagcact

SEQ ID NO: 5235050 - DNA, 16 bp, Homo sapiens
agttgggagcactgga

SEQ ID NO: 5235051 - DNA, 17 bp, Homo sapiens
agttgggattacaggtg

SEQ ID NO: 5235052 - DNA, 19 bp, Homo sapiens
agttgggattacaggtgac

SEQ ID NO: 5235053 - DNA, 16 bp, Homo sapiens
agttgggcagccagga

SEQ ID NO: 5235054 - DNA, 14 bp, Homo sapiens
agttgggcccccat

SEQ ID NO: 5235055 - DNA, 15 bp, Homo sapiens
agttgggcccctgag

SEQ ID NO: 5235056 - DNA, 16 bp, Homo sapiens
agttgggcccctgagg

SEQ ID NO: 5235057 - DNA, 20 bp, Homo sapiens
agttgggctcgcactgccca

SEQ ID NO: 5235058 - DNA, 13 bp, Homo sapiens
agttgggcttcct

SEQ ID NO: 5235059 - DNA, 15 bp, Homo sapiens
agttggggaaggcaa

SEQ ID NO: 5235060 - DNA, 18 bp, Homo sapiens
agttggggaaggcaagat

SEQ ID NO: 5235061 - DNA, 17 bp, Homo sapiens
agttggggacagaactc

SEQ ID NO: 5235062 - DNA, 14 bp, Homo sapiens
agttgggggcaggt

SEQ ID NO: 5235063 - DNA, 14 bp, Homo sapiens
agttgggggccagc

SEQ ID NO: 5235064 - DNA, 17 bp, Homo sapiens
agttgggggccagcaca

SEQ ID NO: 5235065 - DNA, 19 bp, Homo sapiens
agttgggggctaggggagg

SEQ ID NO: 5235066 - DNA, 17 bp, Homo sapiens
agttgggggtattttct

SEQ ID NO: 5235067 - DNA, 18 bp, Homo sapiens
agttgggggtattttcta

SEQ ID NO: 5235068 - DNA, 20 bp, Homo sapiens
agttgggggtcgggtggggg

SEQ ID NO: 5235069 - DNA, 17 bp, Homo sapiens
agttggggtctggcagc

SEQ ID NO: 5235070 - DNA, 19 bp, Homo sapiens
agttgggtagatgggtggg

SEQ ID NO: 5235071 - DNA, 16 bp, Homo sapiens
agttgggtgtattgtg

SEQ ID NO: 5235072 - DNA, 20 bp, Homo sapiens
agttgggtgtattgtgcgct

SEQ ID NO: 5235073 - DNA, 15 bp, Homo sapiens
agttgggtgtctcct

SEQ ID NO: 5235074 - DNA, 11 bp, Homo sapiens
agttgggtgtt

SEQ ID NO: 5235075 - DNA, 15 bp, Homo sapiens
agttgggttttttaa

SEQ ID NO: 5235076 - DNA, 13 bp, Homo sapiens
agttggtaacttt

SEQ ID NO: 5235077 - DNA, 17 bp, Homo sapiens
agttggtaagcttccag

SEQ ID NO: 5235078 - DNA, 14 bp, Homo sapiens
agttggtattaata

SEQ ID NO: 5235079 - DNA, 13 bp, Homo sapiens
agttggtccccct

SEQ ID NO: 5235080 - DNA, 18 bp, Homo sapiens
agttggtcttactttgtg

SEQ ID NO: 5235081 - DNA, 19 bp, Homo sapiens
agttggtcttactttgtta

SEQ ID NO: 5235082 - DNA, 21 bp, Homo sapiens
agttggtcttactttgttaat

SEQ ID NO: 5235083 - DNA, 19 bp, Homo sapiens
agttggtcttatagaaagc

SEQ ID NO: 5235084 - DNA, 20 bp, Homo sapiens
agttggtcttatagaaagca

SEQ ID NO: 5235085 - DNA, 14 bp, Homo sapiens
agttggtctttcca

SEQ ID NO: 5235086 - DNA, 17 bp, Homo sapiens
agttggtgaacagagag

SEQ ID NO: 5235087 - DNA, 20 bp, Homo sapiens
agttggtgaacagagagaac

SEQ ID NO: 5235088 - DNA, 23 bp, Homo sapiens
agttggtgagaaacctgtatctt

SEQ ID NO: 5235089 - DNA, 14 bp, Homo sapiens
agttggtgctgctc

SEQ ID NO: 5235090 - DNA, 17 bp, Homo sapiens
agttggtgtaatcattt

SEQ ID NO: 5235091 - DNA, 13 bp, Homo sapiens
agttggtgtgttt

SEQ ID NO: 5235092 - DNA, 15 bp, Homo sapiens
agttggttgaatttt

SEQ ID NO: 5235093 - DNA, 16 bp, Homo sapiens
agttggttgtgtcttt

SEQ ID NO: 5235094 - DNA, 16 bp, Homo sapiens
agttggtttgtatgag

SEQ ID NO: 5235095 - DNA, 19 bp, Homo sapiens
agttggtttgtatgagatg

SEQ ID NO: 5235096 - DNA, 21 bp, Homo sapiens
agttggttttgtaaaattcca

SEQ ID NO: 5235097 - DNA, 18 bp, Homo sapiens
agttgtaaaaatgaaagt

SEQ ID NO: 5235098 - DNA, 22 bp, Homo sapiens
agttgtaaaaatgaaagtgact

SEQ ID NO: 5235099 - DNA, 16 bp, Homo sapiens
agttgtaaaatagaaa

SEQ ID NO: 5235100 - DNA, 21 bp, Homo sapiens
agttgtaaaatagaaaaagtg

SEQ ID NO: 5235101 - DNA, 15 bp, Homo sapiens
agttgtaaaatgtca

SEQ ID NO: 5235102 - DNA, 21 bp, Homo sapiens
agttgtaaaattgttagtaaa

SEQ ID NO: 5235103 - DNA, 13 bp, Homo sapiens
agttgtaaagata

SEQ ID NO: 5235104 - DNA, 22 bp, Homo sapiens
agttgtaaagatattgtatctc

SEQ ID NO: 5235105 - DNA, 18 bp, Homo sapiens
agttgtaaagtatgtatt

SEQ ID NO: 5235106 - DNA, 18 bp, Homo sapiens
agttgtaaataatttatt

SEQ ID NO: 5235107 - DNA, 14 bp, Homo sapiens
agttgtaaatatat

SEQ ID NO: 5235108 - DNA, 16 bp, Homo sapiens
agttgtaaatatataa

SEQ ID NO: 5235109 - DNA, 21 bp, Homo sapiens
agttgtaacattctatttcaa

SEQ ID NO: 5235110 - DNA, 16 bp, Homo sapiens
agttgtaacttatatt

SEQ ID NO: 5235111 - DNA, 16 bp, Homo sapiens
agttgtaagaaaagct

SEQ ID NO: 5235112 - DNA, 16 bp, Homo sapiens
agttgtaataaatcta

SEQ ID NO: 5235113 - DNA, 14 bp, Homo sapiens
agttgtaatgtgta

SEQ ID NO: 5235114 - DNA, 18 bp, Homo sapiens
agttgtacaaatgtattt

SEQ ID NO: 5235115 - DNA, 19 bp, Homo sapiens
agttgtacaaatgtatttt

SEQ ID NO: 5235116 - DNA, 14 bp, Homo sapiens
agttgtacatgata

SEQ ID NO: 5235117 - DNA, 14 bp, Homo sapiens
agttgtaccaaaac

SEQ ID NO: 5235118 - DNA, 15 bp, Homo sapiens
agttgtacctccatt

SEQ ID NO: 5235119 - DNA, 16 bp, Homo sapiens
agttgtacgtaatgta

SEQ ID NO: 5235120 - DNA, 17 bp, Homo sapiens
agttgtacgtaatgtat

SEQ ID NO: 5235121 - DNA, 13 bp, Homo sapiens
agttgtactgcat

SEQ ID NO: 5235122 - DNA, 14 bp, Homo sapiens
agttgtactgcttt

SEQ ID NO: 5235123 - DNA, 20 bp, Homo sapiens
agttgtactttaaaaattta

SEQ ID NO: 5235124 - DNA, 18 bp, Homo sapiens
agttgtagaagaaaattt

SEQ ID NO: 5235125 - DNA, 19 bp, Homo sapiens
agttgtagaagaaaattta

SEQ ID NO: 5235126 - DNA, 20 bp, Homo sapiens
agttgtagaagaaaatttaa

SEQ ID NO: 5235127 - DNA, 21 bp, Homo sapiens
agttgtagaatgtattgtacc

SEQ ID NO: 5235128 - DNA, 14 bp, Homo sapiens
atactgcagggcca

SEQ ID NO: 5235129 - DNA, 19 bp, Homo sapiens
atactgcagggccaggact

SEQ ID NO: 5235130 - DNA, 21 bp, Homo sapiens
atactgccaaaacatttatga

SEQ ID NO: 5235131 - DNA, 23 bp, Homo sapiens
atactgccaaaacatttatgaca

SEQ ID NO: 5235132 - DNA, 17 bp, Homo sapiens
atactgccactaacctt

SEQ ID NO: 5235133 - DNA, 18 bp, Homo sapiens
atactgccagatgctgat

SEQ ID NO: 5235134 - DNA, 19 bp, Homo sapiens
atactgccagatgctgatg

SEQ ID NO: 5235135 - DNA, 23 bp, Homo sapiens
atactgcccaaggataggtattt

SEQ ID NO: 5235136 - DNA, 22 bp, Homo sapiens
atactgcccggggcagctgcca

SEQ ID NO: 5235137 - DNA, 20 bp, Homo sapiens
atactgccgctgcccccacc

SEQ ID NO: 5235138 - DNA, 22 bp, Homo sapiens
atactgccggtcacccaggctc

SEQ ID NO: 5235139 - DNA, 14 bp, Homo sapiens
atactgcctactgt

SEQ ID NO: 5235140 - DNA, 18 bp, Homo sapiens
atactgccttgtttaatg

SEQ ID NO: 5235141 - DNA, 20 bp, Homo sapiens
atactgccttgtttaatggt

SEQ ID NO: 5235142 - DNA, 19 bp, Homo sapiens
atactgcgactttctgcct

SEQ ID NO: 5235143 - DNA, 20 bp, Homo sapiens
atactgcgactttctgcctg

SEQ ID NO: 5235144 - DNA, 22 bp, Homo sapiens
atactgcgactttctgcctgga

SEQ ID NO: 5235145 - DNA, 23 bp, Homo sapiens
atactgcggaccaagggactcca

SEQ ID NO: 5235146 - DNA, 21 bp, Homo sapiens
atactgcgggcaccagaatgc

SEQ ID NO: 5235147 - DNA, 21 bp, Homo sapiens
atactgcgtccaccctgagct

SEQ ID NO: 5235148 - DNA, 15 bp, Homo sapiens
atactgctacagcaa

SEQ ID NO: 5235149 - DNA, 11 bp, Homo sapiens
atactgctctg

SEQ ID NO: 5235150 - DNA, 12 bp, Homo sapiens
atactgctctga

SEQ ID NO: 5235151 - DNA, 13 bp, Homo sapiens
atactgctctgaa

SEQ ID NO: 5235152 - DNA, 19 bp, Homo sapiens
atactgctgagatacatac

SEQ ID NO: 5235153 - DNA, 22 bp, Homo sapiens
atactgctgagatacatacaga

SEQ ID NO: 5235154 - DNA, 19 bp, Homo sapiens
atactgctgcttgtcaaat

SEQ ID NO: 5235155 - DNA, 18 bp, Homo sapiens
atactgcttattttatga

SEQ ID NO: 5235156 - DNA, 23 bp, Homo sapiens
atactgcttgaccgtactctcac

SEQ ID NO: 5235157 - DNA, 14 bp, Homo sapiens
atactgcttgctta

SEQ ID NO: 5235158 - DNA, 21 bp, Homo sapiens
atactgcttgcttacaatctt

SEQ ID NO: 5235159 - DNA, 13 bp, Homo sapiens
atactgcttgtca

SEQ ID NO: 5235160 - DNA, 16 bp, Homo sapiens
atactggaagttttgc

SEQ ID NO: 5235161 - DNA, 17 bp, Homo sapiens
atactggaagttttgca

SEQ ID NO: 5235162 - DNA, 20 bp, Homo sapiens
atactggaataatttgtaaa

SEQ ID NO: 5235163 - DNA, 22 bp, Homo sapiens
atactggaataatttgtaaatg

SEQ ID NO: 5235164 - DNA, 19 bp, Homo sapiens
atactggactcaggaactt

SEQ ID NO: 5235165 - DNA, 19 bp, Homo sapiens
atactggactcttcaaaaa

SEQ ID NO: 5235166 - DNA, 21 bp, Homo sapiens
atactggactcttcaaaaact

SEQ ID NO: 5235167 - DNA, 15 bp, Homo sapiens
atactggaggaacac

SEQ ID NO: 5235168 - DNA, 15 bp, Homo sapiens
atactggcctctgtg

SEQ ID NO: 5235169 - DNA, 14 bp, Homo sapiens
atactggctggtga

SEQ ID NO: 5235170 - DNA, 23 bp, Homo sapiens
atactggcttcaccatcaatcct

SEQ ID NO: 5235171 - DNA, 18 bp, Homo sapiens
atactggggggcaggcct

SEQ ID NO: 5235172 - DNA, 23 bp, Homo sapiens
atactggggggcaggcctcccaa

SEQ ID NO: 5235173 - DNA, 18 bp, Homo sapiens
atactgggtacaagagcc

SEQ ID NO: 5235174 - DNA, 17 bp, Homo sapiens
atactgggtctgcgatg

SEQ ID NO: 5235175 - DNA, 16 bp, Homo sapiens
atactgggttcttgtt

SEQ ID NO: 5235176 - DNA, 23 bp, Homo sapiens
atactgggttcttgttttatata

SEQ ID NO: 5235177 - DNA, 14 bp, Homo sapiens
atactgggtttcaa

SEQ ID NO: 5235178 - DNA, 20 bp, Homo sapiens
atactggtaccttcccccag

SEQ ID NO: 5235179 - DNA, 21 bp, Homo sapiens
atactggtgcagtcattatga

SEQ ID NO: 5235180 - DNA, 17 bp, Homo sapiens
atactggttatcctgtg

SEQ ID NO: 5235181 - DNA, 20 bp, Homo sapiens
atactgtaaaagttataata

SEQ ID NO: 5235182 - DNA, 21 bp, Homo sapiens
atactgtaaaagttataataa

SEQ ID NO: 5235183 - DNA, 13 bp, Homo sapiens
atactgtaaagaa

SEQ ID NO: 5235184 - DNA, 14 bp, Homo sapiens
atactgtaaagaaa

SEQ ID NO: 5235185 - DNA, 19 bp, Homo sapiens
atactgtaaagaaagagag

SEQ ID NO: 5235186 - DNA, 16 bp, Homo sapiens
atactgtaatcgtgct

SEQ ID NO: 5235187 - DNA, 20 bp, Homo sapiens
atactgtaatcgtgctattt

SEQ ID NO: 5235188 - DNA, 13 bp, Homo sapiens
atactgtacaata

SEQ ID NO: 5235189 - DNA, 20 bp, Homo sapiens
atactgtacaataaaaacat

SEQ ID NO: 5235190 - DNA, 13 bp, Homo sapiens
atactgtacacat

SEQ ID NO: 5235191 - DNA, 19 bp, Homo sapiens
atactgtacacatttctta

SEQ ID NO: 5235192 - DNA, 21 bp, Homo sapiens
atactgtacacatttcttaaa

SEQ ID NO: 5235193 - DNA, 14 bp, Homo sapiens
atactgtacagggg

SEQ ID NO: 5235194 - DNA, 15 bp, Homo sapiens
atactgtacatagat

SEQ ID NO: 5235195 - DNA, 14 bp, Homo sapiens
atactgtacatgct

SEQ ID NO: 5235196 - DNA, 16 bp, Homo sapiens
atactgtactgatact

SEQ ID NO: 5235197 - DNA, 17 bp, Homo sapiens
atactgtacttaataaa

SEQ ID NO: 5235198 - DNA, 20 bp, Homo sapiens
atactgtagacactctgaca

SEQ ID NO: 5235199 - DNA, 13 bp, Homo sapiens
atactgtagtttc

SEQ ID NO: 5235200 - DNA, 17 bp, Homo sapiens
atactgtatatgattat

SEQ ID NO: 5235201 - DNA, 14 bp, Homo sapiens
atactgtatatgtc

SEQ ID NO: 5235202 - DNA, 18 bp, Homo sapiens
atactgtatcagatgtga

SEQ ID NO: 5235203 - DNA, 22 bp, Homo sapiens
atactgtattaagagtgaaaat

SEQ ID NO: 5235204 - DNA, 15 bp, Homo sapiens
atactgtatttctaa

SEQ ID NO: 5235205 - DNA, 16 bp, Homo sapiens
atactgtatttctaag

SEQ ID NO: 5235206 - DNA, 22 bp, Homo sapiens
atactgtatttttactattgaa

SEQ ID NO: 5235207 - DNA, 13 bp, Homo sapiens
atactgtcaagcc

SEQ ID NO: 5235208 - DNA, 17 bp, Homo sapiens
atactgtcaagccctat

SEQ ID NO: 5235209 - DNA, 16 bp, Homo sapiens
atactgtctaagaata

SEQ ID NO: 5235210 - DNA, 14 bp, Homo sapiens
atactgtctctgga

SEQ ID NO: 5235211 - DNA, 16 bp, Homo sapiens
atactgtcttatctgc

SEQ ID NO: 5235212 - DNA, 16 bp, Homo sapiens
atactgtcttgtctca

SEQ ID NO: 5235213 - DNA, 18 bp, Homo sapiens
atactgtctttgtgctga

SEQ ID NO: 5235214 - DNA, 14 bp, Homo sapiens
atactgtgaaatac

SEQ ID NO: 5235215 - DNA, 17 bp, Homo sapiens
atactgtgcagaataat

SEQ ID NO: 5235216 - DNA, 19 bp, Homo sapiens
atactgtgcagaataatgg

SEQ ID NO: 5235217 - DNA, 20 bp, Homo sapiens
atactgtgcagaataatgga

SEQ ID NO: 5235218 - DNA, 16 bp, Homo sapiens
atactgtgctggagcc

SEQ ID NO: 5235219 - DNA, 20 bp, Homo sapiens
atactgtggcctgcaggagg

SEQ ID NO: 5235220 - DNA, 17 bp, Homo sapiens
atactgtgtatgtttta

SEQ ID NO: 5235221 - DNA, 22 bp, Homo sapiens
atactgtgtgcttgttttataa

SEQ ID NO: 5235222 - DNA, 14 bp, Homo sapiens
atactgtgtgggat

SEQ ID NO: 5235223 - DNA, 15 bp, Homo sapiens
atactgtgtgggata

SEQ ID NO: 5235224 - DNA, 14 bp, Homo sapiens
atactgtgtgtttt

SEQ ID NO: 5235225 - DNA, 21 bp, Homo sapiens
atactgtgttccctcatatgc

SEQ ID NO: 5235226 - DNA, 14 bp, Homo sapiens
atactgttatccat

SEQ ID NO: 5235227 - DNA, 15 bp, Homo sapiens
atactgttattcttt

SEQ ID NO: 5235228 - DNA, 15 bp, Homo sapiens
atactgttgatacaa

SEQ ID NO: 5235229 - DNA, 16 bp, Homo sapiens
atactgttgatacaaa

SEQ ID NO: 5235230 - DNA, 19 bp, Homo sapiens
atactgttgatacaaacca

SEQ ID NO: 5235231 - DNA, 15 bp, Homo sapiens
atactgttgcacgtg

SEQ ID NO: 5235232 - DNA, 19 bp, Homo sapiens
atactgttgcacgtgtgtt

SEQ ID NO: 5235233 - DNA, 18 bp, Homo sapiens
atactgttgcccttttcc

SEQ ID NO: 5235234 - DNA, 13 bp, Homo sapiens
atactgtttcttg

SEQ ID NO: 5235235 - DNA, 16 bp, Homo sapiens
atactgtttgtaatat

SEQ ID NO: 5235236 - DNA, 18 bp, Homo sapiens
atactgtttgtaatatac

SEQ ID NO: 5235237 - DNA, 17 bp, Homo sapiens
atactgttttatctcca

SEQ ID NO: 5235238 - DNA, 17 bp, Homo sapiens
atactgttttggaatgt

SEQ ID NO: 5235239 - DNA, 21 bp, Homo sapiens
atactgtttttcgtcattcca

SEQ ID NO: 5235240 - DNA, 22 bp, Homo sapiens
atacttaaaaaatcctgcccaa

SEQ ID NO: 5235241 - DNA, 16 bp, Homo sapiens
atacttaaaaattaat

SEQ ID NO: 5235242 - DNA, 16 bp, Homo sapiens
atacttaaaaatttat

SEQ ID NO: 5235243 - DNA, 21 bp, Homo sapiens
atacttaaaatatccactgga

SEQ ID NO: 5235244 - DNA, 18 bp, Homo sapiens
atacttaaaggaacacgt

SEQ ID NO: 5235245 - DNA, 16 bp, Homo sapiens
atacttaaatatttgt

SEQ ID NO: 5235246 - DNA, 14 bp, Homo sapiens
atacttaacaaata

SEQ ID NO: 5235247 - DNA, 23 bp, Homo sapiens
atacttaacacgtgaatattttg

SEQ ID NO: 5235248 - DNA, 13 bp, Homo sapiens
atacttaacattt

SEQ ID NO: 5235249 - DNA, 13 bp, Homo sapiens
atacttaacttta

SEQ ID NO: 5235250 - DNA, 21 bp, Homo sapiens
atacttaactttactaagtaa

SEQ ID NO: 5235251 - DNA, 11 bp, Homo sapiens
atacttaagaa

SEQ ID NO: 5235252 - DNA, 14 bp, Homo sapiens
atacttaagcaaaa

SEQ ID NO: 5235253 - DNA, 15 bp, Homo sapiens
atacttaatctaaga

SEQ ID NO: 5235254 - DNA, 20 bp, Homo sapiens
atacttaatctaagaaacaa

SEQ ID NO: 5235255 - DNA, 14 bp, Homo sapiens
atacttacagactg

SEQ ID NO: 5235256 - DNA, 23 bp, Homo sapiens
atacttacattctctaataagaa

SEQ ID NO: 5235257 - DNA, 15 bp, Homo sapiens
atacttacatttcag

SEQ ID NO: 5235258 - DNA, 23 bp, Homo sapiens
atacttacatttccatttattgt

SEQ ID NO: 5235259 - DNA, 20 bp, Homo sapiens
atacttacctagtgaaactt

SEQ ID NO: 5235260 - DNA, 16 bp, Homo sapiens
atacttagagaaccta

SEQ ID NO: 5235261 - DNA, 19 bp, Homo sapiens
atacttagcaaaaagtggg

SEQ ID NO: 5235262 - DNA, 23 bp, Homo sapiens
atacttagcaaaaagtggggcag

SEQ ID NO: 5235263 - DNA, 14 bp, Homo sapiens
atacttagtggtat

SEQ ID NO: 5235264 - DNA, 20 bp, Homo sapiens
atacttagtggtatgtctct

SEQ ID NO: 5235265 - DNA, 17 bp, Homo sapiens
atacttatatttcccta

SEQ ID NO: 5235266 - DNA, 23 bp, Homo sapiens
atacttatattttcgtatgaaaa

SEQ ID NO: 5235267 - DNA, 17 bp, Homo sapiens
atacttatgcaaaacct

SEQ ID NO: 5235268 - DNA, 21 bp, Homo sapiens
atacttattaaaaaatttgta

SEQ ID NO: 5235269 - DNA, 22 bp, Homo sapiens
atacttattaagagcaaacttt

SEQ ID NO: 5235270 - DNA, 23 bp, Homo sapiens
atacttattaagagcaaacttta

SEQ ID NO: 5235271 - DNA, 13 bp, Homo sapiens
atacttatttaaa

SEQ ID NO: 5235272 - DNA, 21 bp, Homo sapiens
atacttatttaaatagatgac

SEQ ID NO: 5235273 - DNA, 17 bp, Homo sapiens
atacttcaaaaataatg

SEQ ID NO: 5235274 - DNA, 19 bp, Homo sapiens
atacttcaaaaataatgtg

SEQ ID NO: 5235275 - DNA, 17 bp, Homo sapiens
atacttcaaaactgttt

SEQ ID NO: 5235276 - DNA, 14 bp, Homo sapiens
atacttcaaaagta

SEQ ID NO: 5235277 - DNA, 14 bp, Homo sapiens
atacttcaaatcat

SEQ ID NO: 5235278 - DNA, 12 bp, Homo sapiens
atacttcaaatg

SEQ ID NO: 5235279 - DNA, 20 bp, Homo sapiens
atacttcacctttcctctcc

SEQ ID NO: 5235280 - DNA, 17 bp, Homo sapiens
atacttcagctttgtgt

SEQ ID NO: 5235281 - DNA, 20 bp, Homo sapiens
atacttcagctttgtgtatc

SEQ ID NO: 5235282 - DNA, 21 bp, Homo sapiens
atacttcattaatttcaatca

SEQ ID NO: 5235283 - DNA, 12 bp, Homo sapiens
atacttcattag

SEQ ID NO: 5235284 - DNA, 20 bp, Homo sapiens
atacttccagcgaaatggta

SEQ ID NO: 5235285 - DNA, 13 bp, Homo sapiens
atacttcctggga

SEQ ID NO: 5235286 - DNA, 14 bp, Homo sapiens
atacttcctgggat

SEQ ID NO: 5235287 - DNA, 18 bp, Homo sapiens
atacttccttataaaaat

SEQ ID NO: 5235288 - DNA, 23 bp, Homo sapiens
atacttccttataaaaattctag

SEQ ID NO: 5235289 - DNA, 21 bp, Homo sapiens
atacttctaaatcagaaatag

SEQ ID NO: 5235290 - DNA, 21 bp, Homo sapiens
atacttctcaaacctgtttaa

SEQ ID NO: 5235291 - DNA, 16 bp, Homo sapiens
atacttctcatttttt

SEQ ID NO: 5235292 - DNA, 15 bp, Homo sapiens
atacttctctcagat

SEQ ID NO: 5235293 - DNA, 14 bp, Homo sapiens
atacttctcttttt

SEQ ID NO: 5235294 - DNA, 20 bp, Homo sapiens
atacttcttgtgtgtatgca

SEQ ID NO: 5235295 - DNA, 16 bp, Homo sapiens
atacttctttttcatt

SEQ ID NO: 5235296 - DNA, 17 bp, Homo sapiens
atacttctttttcatta

SEQ ID NO: 5235297 - DNA, 19 bp, Homo sapiens
atacttgaaaacttctcat

SEQ ID NO: 5235298 - DNA, 21 bp, Homo sapiens
atacttgaaaacttctcattt

SEQ ID NO: 5235299 - DNA, 12 bp, Homo sapiens
atacttgaacaa

SEQ ID NO: 5235300 - DNA, 17 bp, Homo sapiens
atacttgaacaaaaggg

SEQ ID NO: 5235301 - DNA, 12 bp, Homo sapiens
atacttgaacca

SEQ ID NO: 5235302 - DNA, 16 bp, Homo sapiens
atacttgaaccataaa

SEQ ID NO: 5235303 - DNA, 12 bp, Homo sapiens
atacttgaactt

SEQ ID NO: 5235304 - DNA, 16 bp, Homo sapiens
atacttgaagggccag

SEQ ID NO: 5235305 - DNA, 19 bp, Homo sapiens
atacttgaagggccagagc

SEQ ID NO: 5235306 - DNA, 18 bp, Homo sapiens
agttgtagacaaagtaca

SEQ ID NO: 5235307 - DNA, 23 bp, Homo sapiens
agttgtagacaaagtacattctg

SEQ ID NO: 5235308 - DNA, 14 bp, Homo sapiens
agttgtagactatg

SEQ ID NO: 5235309 - DNA, 22 bp, Homo sapiens
agttgtagactatggaatgtca

SEQ ID NO: 5235310 - DNA, 16 bp, Homo sapiens
agttgtagcagattgt

SEQ ID NO: 5235311 - DNA, 18 bp, Homo sapiens
agttgtagcagattgttt

SEQ ID NO: 5235312 - DNA, 13 bp, Homo sapiens
agttgtagtgtta

SEQ ID NO: 5235313 - DNA, 15 bp, Homo sapiens
agttgtataaaaaca

SEQ ID NO: 5235314 - DNA, 17 bp, Homo sapiens
agttgtataaaagttgt

SEQ ID NO: 5235315 - DNA, 19 bp, Homo sapiens
agttgtataaaagttgtac

SEQ ID NO: 5235316 - DNA, 19 bp, Homo sapiens
agttgtatataaaattaga

SEQ ID NO: 5235317 - DNA, 20 bp, Homo sapiens
agttgtatcagcacgtgtgg

SEQ ID NO: 5235318 - DNA, 15 bp, Homo sapiens
agttgtatgatctgt

SEQ ID NO: 5235319 - DNA, 17 bp, Homo sapiens
agttgtatgatctgtgc

SEQ ID NO: 5235320 - DNA, 18 bp, Homo sapiens
agttgtattcttctgtat

SEQ ID NO: 5235321 - DNA, 19 bp, Homo sapiens
agttgtattcttctgtatt

SEQ ID NO: 5235322 - DNA, 22 bp, Homo sapiens
agttgtatttaacagaaattgt

SEQ ID NO: 5235323 - DNA, 23 bp, Homo sapiens
agttgtatttaacagaaattgta

SEQ ID NO: 5235324 - DNA, 14 bp, Homo sapiens
agttgtatttcaaa

SEQ ID NO: 5235325 - DNA, 12 bp, Homo sapiens
agttgtattttg

SEQ ID NO: 5235326 - DNA, 22 bp, Homo sapiens
agttgtattttgacaaaaatgt

SEQ ID NO: 5235327 - DNA, 18 bp, Homo sapiens
agttgtattttgtacatt

SEQ ID NO: 5235328 - DNA, 19 bp, Homo sapiens
agttgtattttgtacattt

SEQ ID NO: 5235329 - DNA, 21 bp, Homo sapiens
agttgtattttgtacattttg

SEQ ID NO: 5235330 - DNA, 16 bp, Homo sapiens
agttgtcaataaatgg

SEQ ID NO: 5235331 - DNA, 16 bp, Homo sapiens
agttgtcacatcagat

SEQ ID NO: 5235332 - DNA, 21 bp, Homo sapiens
agttgtcactgcttttggcct

SEQ ID NO: 5235333 - DNA, 20 bp, Homo sapiens
agttgtccacaaatcttcag

SEQ ID NO: 5235334 - DNA, 23 bp, Homo sapiens
agttgtccacaaatcttcagtat

SEQ ID NO: 5235335 - DNA, 16 bp, Homo sapiens
agttgtcctgatgttt

SEQ ID NO: 5235336 - DNA, 17 bp, Homo sapiens
agttgtcctgatttctt

SEQ ID NO: 5235337 - DNA, 19 bp, Homo sapiens
agttgtcctttctgatcct

SEQ ID NO: 5235338 - DNA, 18 bp, Homo sapiens
agttgtcgtttttagctt

SEQ ID NO: 5235339 - DNA, 21 bp, Homo sapiens
agttgtctaaaggatgagatt

SEQ ID NO: 5235340 - DNA, 20 bp, Homo sapiens
agttgtctattctgagcctt

SEQ ID NO: 5235341 - DNA, 13 bp, Homo sapiens
agttgtctccttc

SEQ ID NO: 5235342 - DNA, 14 bp, Homo sapiens
agttgtctctgttg

SEQ ID NO: 5235343 - DNA, 21 bp, Homo sapiens
agttgtctgaattgagaaaag

SEQ ID NO: 5235344 - DNA, 11 bp, Homo sapiens
agttgtctgtc

SEQ ID NO: 5235345 - DNA, 13 bp, Homo sapiens
agttgtctgtcct

SEQ ID NO: 5235346 - DNA, 14 bp, Homo sapiens
agttgtctgtcctg

SEQ ID NO: 5235347 - DNA, 19 bp, Homo sapiens
agttgtctgtcctggtcag

SEQ ID NO: 5235348 - DNA, 17 bp, Homo sapiens
agttgtctgtctgaatg

SEQ ID NO: 5235349 - DNA, 12 bp, Homo sapiens
agttgtctgtgc

SEQ ID NO: 5235350 - DNA, 15 bp, Homo sapiens
agttgtctttctttg

SEQ ID NO: 5235351 - DNA, 18 bp, Homo sapiens
agttgtctttctttgctg

SEQ ID NO: 5235352 - DNA, 20 bp, Homo sapiens
agttgtctttctttgctgct

SEQ ID NO: 5235353 - DNA, 21 bp, Homo sapiens
agttgtgaccttagtgtttct

SEQ ID NO: 5235354 - DNA, 15 bp, Homo sapiens
agttgtgatacagag

SEQ ID NO: 5235355 - DNA, 19 bp, Homo sapiens
agttgtgatacagagtata

SEQ ID NO: 5235356 - DNA, 18 bp, Homo sapiens
agttgtgatctgttgtaa

SEQ ID NO: 5235357 - DNA, 21 bp, Homo sapiens
agttgtgatggaggggagagg

SEQ ID NO: 5235358 - DNA, 22 bp, Homo sapiens
agttgtgatggaggggagaggg

SEQ ID NO: 5235359 - DNA, 14 bp, Homo sapiens
agttgtgcagcttt

SEQ ID NO: 5235360 - DNA, 21 bp, Homo sapiens
agttgtgcagcttttggtcat

SEQ ID NO: 5235361 - DNA, 18 bp, Homo sapiens
agttgtgcatgtatgtat

SEQ ID NO: 5235362 - DNA, 19 bp, Homo sapiens
agttgtgcatgtatgtata

SEQ ID NO: 5235363 - DNA, 15 bp, Homo sapiens
agttgtgcctcattt

SEQ ID NO: 5235364 - DNA, 21 bp, Homo sapiens
agttgtgccttttatagctat

SEQ ID NO: 5235365 - DNA, 12 bp, Homo sapiens
agttgtgctaaa

SEQ ID NO: 5235366 - DNA, 17 bp, Homo sapiens
agttgtggaaagataat

SEQ ID NO: 5235367 - DNA, 19 bp, Homo sapiens
agttgtggaaagcctctgc

SEQ ID NO: 5235368 - DNA, 12 bp, Homo sapiens
agttgtggagga

SEQ ID NO: 5235369 - DNA, 19 bp, Homo sapiens
agttgtgtactctggcctc

SEQ ID NO: 5235370 - DNA, 17 bp, Homo sapiens
agttgtgtcataaatta

SEQ ID NO: 5235371 - DNA, 16 bp, Homo sapiens
agttgtgtctaggctg

SEQ ID NO: 5235372 - DNA, 21 bp, Homo sapiens
agttgtgtgaataccccaaga

SEQ ID NO: 5235373 - DNA, 15 bp, Homo sapiens
agttgtgttgttctt

SEQ ID NO: 5235374 - DNA, 14 bp, Homo sapiens
agttgtgtttcaac

SEQ ID NO: 5235375 - DNA, 14 bp, Homo sapiens
agttgttaaaacat

SEQ ID NO: 5235376 - DNA, 15 bp, Homo sapiens
agttgttaaaacatt

SEQ ID NO: 5235377 - DNA, 19 bp, Homo sapiens
agttgttaaaacatttaat

SEQ ID NO: 5235378 - DNA, 16 bp, Homo sapiens
agttgttaataaaagt

SEQ ID NO: 5235379 - DNA, 23 bp, Homo sapiens
agttgttaataaaagtacatgtt

SEQ ID NO: 5235380 - DNA, 22 bp, Homo sapiens
agttgttacatttttaagtgct

SEQ ID NO: 5235381 - DNA, 17 bp, Homo sapiens
agttgttagtgtgtctt

SEQ ID NO: 5235382 - DNA, 22 bp, Homo sapiens
agttgttagtgtgtcttagtgt

SEQ ID NO: 5235383 - DNA, 14 bp, Homo sapiens
agttgttatttatt

SEQ ID NO: 5235384 - DNA, 17 bp, Homo sapiens
agttgttatttattgaa

SEQ ID NO: 5235385 - DNA, 15 bp, Homo sapiens
agttgttcaactatt

SEQ ID NO: 5235386 - DNA, 17 bp, Homo sapiens
agttgttcaactatttt

SEQ ID NO: 5235387 - DNA, 20 bp, Homo sapiens
agttgttcaataataaatat

SEQ ID NO: 5235388 - DNA, 18 bp, Homo sapiens
agttgttcattgatggga

SEQ ID NO: 5235389 - DNA, 19 bp, Homo sapiens
agttgttccttaagtcaga

SEQ ID NO: 5235390 - DNA, 21 bp, Homo sapiens
agttgttcgggccaaggacct

SEQ ID NO: 5235391 - DNA, 17 bp, Homo sapiens
agttgttctcaggggtg

SEQ ID NO: 5235392 - DNA, 13 bp, Homo sapiens
agttgttctgaaa

SEQ ID NO: 5235393 - DNA, 17 bp, Homo sapiens
agttgttctgaaatgtc

SEQ ID NO: 5235394 - DNA, 18 bp, Homo sapiens
agttgttgactgtgatta

SEQ ID NO: 5235395 - DNA, 15 bp, Homo sapiens
agttgttgccctggg

SEQ ID NO: 5235396 - DNA, 18 bp, Homo sapiens
agttgttggtctgtagca

SEQ ID NO: 5235397 - DNA, 21 bp, Homo sapiens
agttgttggtttatactgtat

SEQ ID NO: 5235398 - DNA, 22 bp, Homo sapiens
agttgttggtttatactgtata

SEQ ID NO: 5235399 - DNA, 22 bp, Homo sapiens
agttgttggtttattttaatgg

SEQ ID NO: 5235400 - DNA, 19 bp, Homo sapiens
agttgttgtgggttctatg

SEQ ID NO: 5235401 - DNA, 12 bp, Homo sapiens
agttgtttagat

SEQ ID NO: 5235402 - DNA, 16 bp, Homo sapiens
agttgtttcattgact

SEQ ID NO: 5235403 - DNA, 19 bp, Homo sapiens
agttgtttcattgactatc

SEQ ID NO: 5235404 - DNA, 13 bp, Homo sapiens
agttgtttctcta

SEQ ID NO: 5235405 - DNA, 16 bp, Homo sapiens
agttgtttctgaccca

SEQ ID NO: 5235406 - DNA, 20 bp, Homo sapiens
agttgtttctgacccactga

SEQ ID NO: 5235407 - DNA, 20 bp, Homo sapiens
agttgtttgattcagacagc

SEQ ID NO: 5235408 - DNA, 13 bp, Homo sapiens
agttgtttgcatg

SEQ ID NO: 5235409 - DNA, 15 bp, Homo sapiens
agttgtttgtgcctt

SEQ ID NO: 5235410 - DNA, 16 bp, Homo sapiens
agttgtttgtttttgc

SEQ ID NO: 5235411 - DNA, 16 bp, Homo sapiens
agttgttttacagctg

SEQ ID NO: 5235412 - DNA, 16 bp, Homo sapiens
agttgttttatctttt

SEQ ID NO: 5235413 - DNA, 18 bp, Homo sapiens
agttgttttatcttttaa

SEQ ID NO: 5235414 - DNA, 20 bp, Homo sapiens
agttgttttccatcatttgg

SEQ ID NO: 5235415 - DNA, 23 bp, Homo sapiens
agttgttttgggtggtaaagtgt

SEQ ID NO: 5235416 - DNA, 22 bp, Homo sapiens
agttgttttggtgcctgcctct

SEQ ID NO: 5235417 - DNA, 12 bp, Homo sapiens
agtttaaaaaat

SEQ ID NO: 5235418 - DNA, 14 bp, Homo sapiens
agtttaaaaaatac

SEQ ID NO: 5235419 - DNA, 15 bp, Homo sapiens
agtttaaaaaataca

SEQ ID NO: 5235420 - DNA, 14 bp, Homo sapiens
agtttaaaaaatca

SEQ ID NO: 5235421 - DNA, 20 bp, Homo sapiens
agtttaaaaatcaacttttt

SEQ ID NO: 5235422 - DNA, 17 bp, Homo sapiens
agtttaaaaatctgcca

SEQ ID NO: 5235423 - DNA, 19 bp, Homo sapiens
agtttaaaaatctgccacc

SEQ ID NO: 5235424 - DNA, 15 bp, Homo sapiens
agtttaaaacacatt

SEQ ID NO: 5235425 - DNA, 22 bp, Homo sapiens
agtttaaaacatcagaaactga

SEQ ID NO: 5235426 - DNA, 21 bp, Homo sapiens
agtttaaaagcatgaaacatt

SEQ ID NO: 5235427 - DNA, 13 bp, Homo sapiens
agtttaaaagcca

SEQ ID NO: 5235428 - DNA, 20 bp, Homo sapiens
agtttaaaatcttgcatggc

SEQ ID NO: 5235429 - DNA, 15 bp, Homo sapiens
agtttaaaatgtata

SEQ ID NO: 5235430 - DNA, 15 bp, Homo sapiens
agtttaaacaaaaaa

SEQ ID NO: 5235431 - DNA, 19 bp, Homo sapiens
agtttaaacaaaaaaccca

SEQ ID NO: 5235432 - DNA, 19 bp, Homo sapiens
agtttaaagcatctgtaaa

SEQ ID NO: 5235433 - DNA, 21 bp, Homo sapiens
agtttaaagctcgaaaacaat

SEQ ID NO: 5235434 - DNA, 13 bp, Homo sapiens
agtttaaagttgc

SEQ ID NO: 5235435 - DNA, 19 bp, Homo sapiens
agtttaaataccagtactt

SEQ ID NO: 5235436 - DNA, 20 bp, Homo sapiens
agtttaaataccagtacttg

SEQ ID NO: 5235437 - DNA, 20 bp, Homo sapiens
agtttaaatctttgttaaaa

SEQ ID NO: 5235438 - DNA, 19 bp, Homo sapiens
agtttaaatgtattttaca

SEQ ID NO: 5235439 - DNA, 16 bp, Homo sapiens
agtttaacaataataa

SEQ ID NO: 5235440 - DNA, 22 bp, Homo sapiens
agtttaacacaagtcctgtgaa

SEQ ID NO: 5235441 - DNA, 17 bp, Homo sapiens
agtttaacagatattta

SEQ ID NO: 5235442 - DNA, 20 bp, Homo sapiens
agtttaacagatatttaaat

SEQ ID NO: 5235443 - DNA, 22 bp, Homo sapiens
agtttaacagatatttaaattt

SEQ ID NO: 5235444 - DNA, 14 bp, Homo sapiens
agtttaaccatatg

SEQ ID NO: 5235445 - DNA, 17 bp, Homo sapiens
agtttaagaccagcctg

SEQ ID NO: 5235446 - DNA, 13 bp, Homo sapiens
agtttaagagttt

SEQ ID NO: 5235447 - DNA, 16 bp, Homo sapiens
agtttaagatgacact

SEQ ID NO: 5235448 - DNA, 18 bp, Homo sapiens
agtttaaggaacttctga

SEQ ID NO: 5235449 - DNA, 21 bp, Homo sapiens
agtttaagtaagtaagtttca

SEQ ID NO: 5235450 - DNA, 22 bp, Homo sapiens
agtttaagtctcctttactgaa

SEQ ID NO: 5235451 - DNA, 15 bp, Homo sapiens
agtttaatacaggaa

SEQ ID NO: 5235452 - DNA, 23 bp, Homo sapiens
agtttaatacaggaaattgactt

SEQ ID NO: 5235453 - DNA, 17 bp, Homo sapiens
agtttaatactttttac

SEQ ID NO: 5235454 - DNA, 19 bp, Homo sapiens
agtttaatattaaagccat

SEQ ID NO: 5235455 - DNA, 22 bp, Homo sapiens
agtttaatgcaagagaacattt

SEQ ID NO: 5235456 - DNA, 15 bp, Homo sapiens
agtttaatgtctcct

SEQ ID NO: 5235457 - DNA, 20 bp, Homo sapiens
agtttaattaactatgtgat

SEQ ID NO: 5235458 - DNA, 20 bp, Homo sapiens
agtttaattagatttctgaa

SEQ ID NO: 5235459 - DNA, 14 bp, Homo sapiens
agtttaattctgtt

SEQ ID NO: 5235460 - DNA, 17 bp, Homo sapiens
agtttaatttttgcttg

SEQ ID NO: 5235461 - DNA, 15 bp, Homo sapiens
agtttacaacttgat

SEQ ID NO: 5235462 - DNA, 22 bp, Homo sapiens
agtttacaacttgattttttca

SEQ ID NO: 5235463 - DNA, 16 bp, Homo sapiens
agtttacaagcgagaa

SEQ ID NO: 5235464 - DNA, 15 bp, Homo sapiens
agtttacaagtcaga

SEQ ID NO: 5235465 - DNA, 17 bp, Homo sapiens
agtttacaagtgtatat

SEQ ID NO: 5235466 - DNA, 10 bp, Homo sapiens
agtttacaat

SEQ ID NO: 5235467 - DNA, 13 bp, Homo sapiens
agtttacaatatt

SEQ ID NO: 5235468 - DNA, 12 bp, Homo sapiens
agtttacacact

SEQ ID NO: 5235469 - DNA, 15 bp, Homo sapiens
agtttacagatgttt

SEQ ID NO: 5235470 - DNA, 14 bp, Homo sapiens
agtttacagtaaat

SEQ ID NO: 5235471 - DNA, 15 bp, Homo sapiens
agtttacagtttgtg

SEQ ID NO: 5235472 - DNA, 16 bp, Homo sapiens
agtttacagtttgtgt

SEQ ID NO: 5235473 - DNA, 13 bp, Homo sapiens
agtttacattgta

SEQ ID NO: 5235474 - DNA, 14 bp, Homo sapiens
agtttacattgtcc

SEQ ID NO: 5235475 - DNA, 19 bp, Homo sapiens
agtttacatttttatttat

SEQ ID NO: 5235476 - DNA, 20 bp, Homo sapiens
agtttaccagttgcctttta

SEQ ID NO: 5235477 - DNA, 17 bp, Homo sapiens
agtttacccatgaagat

SEQ ID NO: 5235478 - DNA, 21 bp, Homo sapiens
agtttacccatgaagattggt

SEQ ID NO: 5235479 - DNA, 22 bp, Homo sapiens
agtttacctcatccatgcactt

SEQ ID NO: 5235480 - DNA, 20 bp, Homo sapiens
agtttactagcttttcaaac

SEQ ID NO: 5235481 - DNA, 16 bp, Homo sapiens
agtttactattttact

SEQ ID NO: 5235482 - DNA, 17 bp, Homo sapiens
agtttactccttctgtt

SEQ ID NO: 5235483 - DNA, 17 bp, Homo sapiens
agtttactggataaatt

SEQ ID NO: 5235484 - DNA, 16 bp, Homo sapiens
atacttgaattttttg

SEQ ID NO: 5235485 - DNA, 15 bp, Homo sapiens
atacttgacctctgt

SEQ ID NO: 5235486 - DNA, 21 bp, Homo sapiens
atacttgagaccaacttttca

SEQ ID NO: 5235487 - DNA, 20 bp, Homo sapiens
atacttgagattttcctcca

SEQ ID NO: 5235488 - DNA, 13 bp, Homo sapiens
atacttgatgcac

SEQ ID NO: 5235489 - DNA, 13 bp, Homo sapiens
atacttgcaacta

SEQ ID NO: 5235490 - DNA, 21 bp, Homo sapiens
atacttgcaactaaggacaaa

SEQ ID NO: 5235491 - DNA, 22 bp, Homo sapiens
atacttgcaagataattttcag

SEQ ID NO: 5235492 - DNA, 23 bp, Homo sapiens
atacttgcagctcccattctatg

SEQ ID NO: 5235493 - DNA, 12 bp, Homo sapiens
atacttgcagtt

SEQ ID NO: 5235494 - DNA, 13 bp, Homo sapiens
atacttgcagttg

SEQ ID NO: 5235495 - DNA, 17 bp, Homo sapiens
atacttgccttctgata

SEQ ID NO: 5235496 - DNA, 20 bp, Homo sapiens
atacttgctccttgaataag

SEQ ID NO: 5235497 - DNA, 23 bp, Homo sapiens
atacttgggtaagtcccccaggg

SEQ ID NO: 5235498 - DNA, 13 bp, Homo sapiens
atacttgtaatta

SEQ ID NO: 5235499 - DNA, 14 bp, Homo sapiens
atacttgtaattat

SEQ ID NO: 5235500 - DNA, 15 bp, Homo sapiens
atacttgtattccct

SEQ ID NO: 5235501 - DNA, 17 bp, Homo sapiens
atacttgtcttgttcac

SEQ ID NO: 5235502 - DNA, 13 bp, Homo sapiens
atacttgtggact

SEQ ID NO: 5235503 - DNA, 21 bp, Homo sapiens
atacttgtggactaaaagata

SEQ ID NO: 5235504 - DNA, 13 bp, Homo sapiens
atacttgttctgt

SEQ ID NO: 5235505 - DNA, 15 bp, Homo sapiens
atacttgttctgtat

SEQ ID NO: 5235506 - DNA, 16 bp, Homo sapiens
atacttgttctgtatt

SEQ ID NO: 5235507 - DNA, 18 bp, Homo sapiens
atacttgttgtttaatgt

SEQ ID NO: 5235508 - DNA, 17 bp, Homo sapiens
atacttgtttcagcttc

SEQ ID NO: 5235509 - DNA, 22 bp, Homo sapiens
atacttgtttcagcttctctgc

SEQ ID NO: 5235510 - DNA, 14 bp, Homo sapiens
atactttaaaggaa

SEQ ID NO: 5235511 - DNA, 16 bp, Homo sapiens
atactttaaaggaaaa

SEQ ID NO: 5235512 - DNA, 13 bp, Homo sapiens
atactttaaataa

SEQ ID NO: 5235513 - DNA, 17 bp, Homo sapiens
atactttaaataattta

SEQ ID NO: 5235514 - DNA, 19 bp, Homo sapiens
atactttaaataatttaac

SEQ ID NO: 5235515 - DNA, 16 bp, Homo sapiens
atactttaatttttat

SEQ ID NO: 5235516 - DNA, 12 bp, Homo sapiens
atactttacagg

SEQ ID NO: 5235517 - DNA, 14 bp, Homo sapiens
atactttatatctg

SEQ ID NO: 5235518 - DNA, 21 bp, Homo sapiens
atactttatatctgtaatgat

SEQ ID NO: 5235519 - DNA, 17 bp, Homo sapiens
atactttatcaaagatt

SEQ ID NO: 5235520 - DNA, 15 bp, Homo sapiens
atactttatcaatgt

SEQ ID NO: 5235521 - DNA, 21 bp, Homo sapiens
atactttatcaatgtgtcttt

SEQ ID NO: 5235522 - DNA, 15 bp, Homo sapiens
atactttatgagcag

SEQ ID NO: 5235523 - DNA, 12 bp, Homo sapiens
atactttccaac

SEQ ID NO: 5235524 - DNA, 13 bp, Homo sapiens
atactttccatgt

SEQ ID NO: 5235525 - DNA, 16 bp, Homo sapiens
atactttccatgtttt

SEQ ID NO: 5235526 - DNA, 18 bp, Homo sapiens
atactttcgaaatttcat

SEQ ID NO: 5235527 - DNA, 15 bp, Homo sapiens
atactttctctctag

SEQ ID NO: 5235528 - DNA, 17 bp, Homo sapiens
atactttcttttattaa

SEQ ID NO: 5235529 - DNA, 17 bp, Homo sapiens
atactttgaatgtgttt

SEQ ID NO: 5235530 - DNA, 22 bp, Homo sapiens
atactttgaatgtgtttcacag

SEQ ID NO: 5235531 - DNA, 19 bp, Homo sapiens
atactttgacaaggaaaat

SEQ ID NO: 5235532 - DNA, 18 bp, Homo sapiens
atactttgcaatccaaat

SEQ ID NO: 5235533 - DNA, 15 bp, Homo sapiens
atactttgccactgc

SEQ ID NO: 5235534 - DNA, 16 bp, Homo sapiens
atactttgctgttgaa

SEQ ID NO: 5235535 - DNA, 10 bp, Homo sapiens
atactttgga

SEQ ID NO: 5235536 - DNA, 22 bp, Homo sapiens
atactttggatgacttgttcat

SEQ ID NO: 5235537 - DNA, 14 bp, Homo sapiens
atactttgtaaata

SEQ ID NO: 5235538 - DNA, 14 bp, Homo sapiens
atactttgtattgt

SEQ ID NO: 5235539 - DNA, 18 bp, Homo sapiens
atactttgtcctaagaga

SEQ ID NO: 5235540 - DNA, 22 bp, Homo sapiens
atactttgtcctaagagattta

SEQ ID NO: 5235541 - DNA, 13 bp, Homo sapiens
atactttgtctga

SEQ ID NO: 5235542 - DNA, 15 bp, Homo sapiens
atactttgtgtcttt

SEQ ID NO: 5235543 - DNA, 15 bp, Homo sapiens
atactttgttctgtt

SEQ ID NO: 5235544 - DNA, 18 bp, Homo sapiens
atactttgtttattgtaa

SEQ ID NO: 5235545 - DNA, 21 bp, Homo sapiens
atacttttaaagttttgtcag

SEQ ID NO: 5235546 - DNA, 16 bp, Homo sapiens
atacttttaatcaagt

SEQ ID NO: 5235547 - DNA, 21 bp, Homo sapiens
atacttttaatcaagtagaac

SEQ ID NO: 5235548 - DNA, 21 bp, Homo sapiens
atacttttacaagtaacaaaa

SEQ ID NO: 5235549 - DNA, 16 bp, Homo sapiens
atacttttactctgcc

SEQ ID NO: 5235550 - DNA, 13 bp, Homo sapiens
atacttttcaaag

SEQ ID NO: 5235551 - DNA, 19 bp, Homo sapiens
atacttttccttaccttta

SEQ ID NO: 5235552 - DNA, 22 bp, Homo sapiens
atacttttgagtatggctatct

SEQ ID NO: 5235553 - DNA, 20 bp, Homo sapiens
atacttttgcatttttcctt

SEQ ID NO: 5235554 - DNA, 16 bp, Homo sapiens
atacttttgcttggtt

SEQ ID NO: 5235555 - DNA, 17 bp, Homo sapiens
atacttttgtaatctat

SEQ ID NO: 5235556 - DNA, 20 bp, Homo sapiens
atacttttgtgtattctgtg

SEQ ID NO: 5235557 - DNA, 15 bp, Homo sapiens
atactttttaaaaaa

SEQ ID NO: 5235558 - DNA, 20 bp, Homo sapiens
atactttttaaaaaactatt

SEQ ID NO: 5235559 - DNA, 20 bp, Homo sapiens
atactttttacccaaatatg

SEQ ID NO: 5235560 - DNA, 21 bp, Homo sapiens
atactttttacccaaatatgt

SEQ ID NO: 5235561 - DNA, 14 bp, Homo sapiens
atactttttatcac

SEQ ID NO: 5235562 - DNA, 17 bp, Homo sapiens
atactttttcagttgtt

SEQ ID NO: 5235563 - DNA, 14 bp, Homo sapiens
atactttttcatga

SEQ ID NO: 5235564 - DNA, 21 bp, Homo sapiens
atactttttccccaaaggcat

SEQ ID NO: 5235565 - DNA, 13 bp, Homo sapiens
atactttttctaa

SEQ ID NO: 5235566 - DNA, 21 bp, Homo sapiens
atactttttcttttgtaagtg

SEQ ID NO: 5235567 - DNA, 23 bp, Homo sapiens
atactttttgaggggttcttctg

SEQ ID NO: 5235568 - DNA, 13 bp, Homo sapiens
atacttttttcta

SEQ ID NO: 5235569 - DNA, 14 bp, Homo sapiens
atacttttttgaaa

SEQ ID NO: 5235570 - DNA, 17 bp, Homo sapiens
atacttttttgaaatca

SEQ ID NO: 5235571 - DNA, 14 bp, Homo sapiens
atactttttttcac

SEQ ID NO: 5235572 - DNA, 16 bp, Homo sapiens
atagaaaaaaagaaaa

SEQ ID NO: 5235573 - DNA, 13 bp, Homo sapiens
atagaaaaacaaa

SEQ ID NO: 5235574 - DNA, 13 bp, Homo sapiens
atagaaaaaggat

SEQ ID NO: 5235575 - DNA, 19 bp, Homo sapiens
atagaaaaatgatgtcttt

SEQ ID NO: 5235576 - DNA, 12 bp, Homo sapiens
atagaaaaatgt

SEQ ID NO: 5235577 - DNA, 23 bp, Homo sapiens
atagaaaaattcagcaaaccatt

SEQ ID NO: 5235578 - DNA, 21 bp, Homo sapiens
atagaaaacaggaaaaaaact

SEQ ID NO: 5235579 - DNA, 13 bp, Homo sapiens
atagaaaactaat

SEQ ID NO: 5235580 - DNA, 21 bp, Homo sapiens
atagaaaagtagacaatcatt

SEQ ID NO: 5235581 - DNA, 19 bp, Homo sapiens
atagaaaatgcattattta

SEQ ID NO: 5235582 - DNA, 21 bp, Homo sapiens
atagaaaatggaaaatataca

SEQ ID NO: 5235583 - DNA, 15 bp, Homo sapiens
atagaaaattaaaat

SEQ ID NO: 5235584 - DNA, 16 bp, Homo sapiens
atagaaaattaaaata

SEQ ID NO: 5235585 - DNA, 21 bp, Homo sapiens
atagaaaattaaaataacttt

SEQ ID NO: 5235586 - DNA, 18 bp, Homo sapiens
atagaaaattatttgtat

SEQ ID NO: 5235587 - DNA, 19 bp, Homo sapiens
atagaaaattatttgtatg

SEQ ID NO: 5235588 - DNA, 20 bp, Homo sapiens
atagaaaattcttgagaagt

SEQ ID NO: 5235589 - DNA, 17 bp, Homo sapiens
atagaaacaatactgtt

SEQ ID NO: 5235590 - DNA, 20 bp, Homo sapiens
atagaaacactttctcactt

SEQ ID NO: 5235591 - DNA, 13 bp, Homo sapiens
atagaaacagact

SEQ ID NO: 5235592 - DNA, 14 bp, Homo sapiens
atagaaacatacac

SEQ ID NO: 5235593 - DNA, 22 bp, Homo sapiens
atagaaactaaactaaaatagt

SEQ ID NO: 5235594 - DNA, 21 bp, Homo sapiens
atagaaactcaccatgtaaaa

SEQ ID NO: 5235595 - DNA, 18 bp, Homo sapiens
atagaaacttcatggttt

SEQ ID NO: 5235596 - DNA, 13 bp, Homo sapiens
atagaaagaaact

SEQ ID NO: 5235597 - DNA, 23 bp, Homo sapiens
atagaaagaaactaaacagaaaa

SEQ ID NO: 5235598 - DNA, 13 bp, Homo sapiens
atagaaagaaatt

SEQ ID NO: 5235599 - DNA, 22 bp, Homo sapiens
atagaaagaataaaatgtttct

SEQ ID NO: 5235600 - DNA, 10 bp, Homo sapiens
atagaaagac

SEQ ID NO: 5235601 - DNA, 18 bp, Homo sapiens
atagaaagctggactgac

SEQ ID NO: 5235602 - DNA, 20 bp, Homo sapiens
atagaaagctggactgacca

SEQ ID NO: 5235603 - DNA, 21 bp, Homo sapiens
atagaaagtataatttcagtg

SEQ ID NO: 5235604 - DNA, 16 bp, Homo sapiens
atagaaagtgccagaa

SEQ ID NO: 5235605 - DNA, 15 bp, Homo sapiens
atagaaagtgttctg

SEQ ID NO: 5235606 - DNA, 17 bp, Homo sapiens
atagaaagtgttctgtt

SEQ ID NO: 5235607 - DNA, 18 bp, Homo sapiens
atagaaagttgcaaggca

SEQ ID NO: 5235608 - DNA, 15 bp, Homo sapiens
atagaaatacctcat

SEQ ID NO: 5235609 - DNA, 16 bp, Homo sapiens
atagaaatagaacact

SEQ ID NO: 5235610 - DNA, 21 bp, Homo sapiens
atagaaatatagggttttttt

SEQ ID NO: 5235611 - DNA, 16 bp, Homo sapiens
atagaaatgccaagca

SEQ ID NO: 5235612 - DNA, 20 bp, Homo sapiens
atagaaatggaaattttgct

SEQ ID NO: 5235613 - DNA, 15 bp, Homo sapiens
atagaaatgtatttt

SEQ ID NO: 5235614 - DNA, 16 bp, Homo sapiens
atagaaatgtattttg

SEQ ID NO: 5235615 - DNA, 22 bp, Homo sapiens
atagaaatgtattttgaaaaca

SEQ ID NO: 5235616 - DNA, 12 bp, Homo sapiens
atagaaatgtct

SEQ ID NO: 5235617 - DNA, 22 bp, Homo sapiens
atagaaatgtctcaaggcagtt

SEQ ID NO: 5235618 - DNA, 12 bp, Homo sapiens
atagaaattctg

SEQ ID NO: 5235619 - DNA, 15 bp, Homo sapiens
atagaaatttccaga

SEQ ID NO: 5235620 - DNA, 17 bp, Homo sapiens
atagaaattttgtaaga

SEQ ID NO: 5235621 - DNA, 18 bp, Homo sapiens
atagaaattttgtaagaa

SEQ ID NO: 5235622 - DNA, 22 bp, Homo sapiens
atagaacaagatgcactcgctg

SEQ ID NO: 5235623 - DNA, 15 bp, Homo sapiens
atagaacacaaggga

SEQ ID NO: 5235624 - DNA, 21 bp, Homo sapiens
atagaacacagaacaggaact

SEQ ID NO: 5235625 - DNA, 20 bp, Homo sapiens
atagaacactgcctctgagt

SEQ ID NO: 5235626 - DNA, 13 bp, Homo sapiens
atagaacagaact

SEQ ID NO: 5235627 - DNA, 17 bp, Homo sapiens
atagaacatattttcct

SEQ ID NO: 5235628 - DNA, 18 bp, Homo sapiens
atagaactactttgaaaa

SEQ ID NO: 5235629 - DNA, 14 bp, Homo sapiens
atagaactgaatga

SEQ ID NO: 5235630 - DNA, 14 bp, Homo sapiens
atagaactgggtaa

SEQ ID NO: 5235631 - DNA, 20 bp, Homo sapiens
atagaactgggtaaatgcaa

SEQ ID NO: 5235632 - DNA, 14 bp, Homo sapiens
atagaagaagagga

SEQ ID NO: 5235633 - DNA, 15 bp, Homo sapiens
atagaagaagaggaa

SEQ ID NO: 5235634 - DNA, 21 bp, Homo sapiens
atagaagaaggactgaagaaa

SEQ ID NO: 5235635 - DNA, 20 bp, Homo sapiens
atagaagaatacaaacatat

SEQ ID NO: 5235636 - DNA, 16 bp, Homo sapiens
atagaagaatgcatgc

SEQ ID NO: 5235637 - DNA, 17 bp, Homo sapiens
atagaagaatgcatgct

SEQ ID NO: 5235638 - DNA, 18 bp, Homo sapiens
atagaagaatgcatgctt

SEQ ID NO: 5235639 - DNA, 13 bp, Homo sapiens
atagaagctgtag

SEQ ID NO: 5235640 - DNA, 14 bp, Homo sapiens
atagaagctgtagt

SEQ ID NO: 5235641 - DNA, 19 bp, Homo sapiens
atagaagcttcagcaggag

SEQ ID NO: 5235642 - DNA, 21 bp, Homo sapiens
atagaaggaagtgtgtttgcc

SEQ ID NO: 5235643 - DNA, 15 bp, Homo sapiens
atagaaggaggagag

SEQ ID NO: 5235644 - DNA, 13 bp, Homo sapiens
atagaaggcaggt

SEQ ID NO: 5235645 - DNA, 15 bp, Homo sapiens
atagaaggctgtctt

SEQ ID NO: 5235646 - DNA, 17 bp, Homo sapiens
atagaagtctggaaaaa

SEQ ID NO: 5235647 - DNA, 15 bp, Homo sapiens
atagaagtcttcatg

SEQ ID NO: 5235648 - DNA, 17 bp, Homo sapiens
atagaagtcttcatgaa

SEQ ID NO: 5235649 - DNA, 19 bp, Homo sapiens
atagaagtggtgttttttt

SEQ ID NO: 5235650 - DNA, 22 bp, Homo sapiens
atagaagttaaaggttactgtt

SEQ ID NO: 5235651 - DNA, 13 bp, Homo sapiens
atagaagttttat

SEQ ID NO: 5235652 - DNA, 12 bp, Homo sapiens
atagaataaaag

SEQ ID NO: 5235653 - DNA, 18 bp, Homo sapiens
atagaataaaatataatt

SEQ ID NO: 5235654 - DNA, 14 bp, Homo sapiens
atagaataaaattt

SEQ ID NO: 5235655 - DNA, 22 bp, Homo sapiens
atagaataaaatttttaatctt

SEQ ID NO: 5235656 - DNA, 16 bp, Homo sapiens
atagaataatctatta

SEQ ID NO: 5235657 - DNA, 19 bp, Homo sapiens
atagaataattcttttctg

SEQ ID NO: 5235658 - DNA, 15 bp, Homo sapiens
atagaatacattgat

SEQ ID NO: 5235659 - DNA, 13 bp, Homo sapiens
atagaatacctcc

SEQ ID NO: 5235660 - DNA, 13 bp, Homo sapiens
atagaatactttt

SEQ ID NO: 5235661 - DNA, 18 bp, Homo sapiens
atagaatagcacagccag

SEQ ID NO: 5235662 - DNA, 16 bp, Homo sapiens
atagaataggcaaact

SEQ ID NO: 5235663 - DNA, 19 bp, Homo sapiens
atagaatataattatcgga

SEQ ID NO: 5235664 - DNA, 14 bp, Homo sapiens
agtttacttataaa

SEQ ID NO: 5235665 - DNA, 22 bp, Homo sapiens
agtttacttcactttcatctga

SEQ ID NO: 5235666 - DNA, 18 bp, Homo sapiens
agtttacttcctaaattt

SEQ ID NO: 5235667 - DNA, 13 bp, Homo sapiens
agtttacttgctc

SEQ ID NO: 5235668 - DNA, 15 bp, Homo sapiens
agtttactttgccaa

SEQ ID NO: 5235669 - DNA, 23 bp, Homo sapiens
agtttactttttttctgatgttt

SEQ ID NO: 5235670 - DNA, 20 bp, Homo sapiens
agtttagaaattacaagttt

SEQ ID NO: 5235671 - DNA, 16 bp, Homo sapiens
agtttagaacaggttt

SEQ ID NO: 5235672 - DNA, 17 bp, Homo sapiens
agtttagagaaatacat

SEQ ID NO: 5235673 - DNA, 14 bp, Homo sapiens
agtttagatttcaa

SEQ ID NO: 5235674 - DNA, 21 bp, Homo sapiens
agtttagatttcaagaaaaaa

SEQ ID NO: 5235675 - DNA, 18 bp, Homo sapiens
agtttagcagttaaaagt

SEQ ID NO: 5235676 - DNA, 16 bp, Homo sapiens
agtttagcccatctct

SEQ ID NO: 5235677 - DNA, 18 bp, Homo sapiens
agtttagccctgaacatt

SEQ ID NO: 5235678 - DNA, 18 bp, Homo sapiens
agtttagcccttccctgc

SEQ ID NO: 5235679 - DNA, 14 bp, Homo sapiens
agtttaggaaaatg

SEQ ID NO: 5235680 - DNA, 16 bp, Homo sapiens
agtttaggaaaatgag

SEQ ID NO: 5235681 - DNA, 19 bp, Homo sapiens
agtttaggagctcagttga

SEQ ID NO: 5235682 - DNA, 16 bp, Homo sapiens
agtttaggccttggct

SEQ ID NO: 5235683 - DNA, 21 bp, Homo sapiens
agtttagggattgggtcgtgg

SEQ ID NO: 5235684 - DNA, 14 bp, Homo sapiens
agtttagggtgggg

SEQ ID NO: 5235685 - DNA, 17 bp, Homo sapiens
agtttagtgcatctttg

SEQ ID NO: 5235686 - DNA, 13 bp, Homo sapiens
agtttataaaaga

SEQ ID NO: 5235687 - DNA, 15 bp, Homo sapiens
agtttataaagccaa

SEQ ID NO: 5235688 - DNA, 14 bp, Homo sapiens
agtttataatgcag

SEQ ID NO: 5235689 - DNA, 15 bp, Homo sapiens
agtttatacagaact

SEQ ID NO: 5235690 - DNA, 19 bp, Homo sapiens
agtttatacagtgtacatg

SEQ ID NO: 5235691 - DNA, 14 bp, Homo sapiens
agtttatacagttt

SEQ ID NO: 5235692 - DNA, 16 bp, Homo sapiens
agtttatattactctc

SEQ ID NO: 5235693 - DNA, 17 bp, Homo sapiens
agtttatcatgaagcct

SEQ ID NO: 5235694 - DNA, 14 bp, Homo sapiens
agtttatcattcaa

SEQ ID NO: 5235695 - DNA, 22 bp, Homo sapiens
agtttatcctgacatattcaag

SEQ ID NO: 5235696 - DNA, 16 bp, Homo sapiens
agtttatcctgtctga

SEQ ID NO: 5235697 - DNA, 23 bp, Homo sapiens
agtttatcgaccagtttgaatct

SEQ ID NO: 5235698 - DNA, 22 bp, Homo sapiens
agtttatcttaagcatgtcaat

SEQ ID NO: 5235699 - DNA, 15 bp, Homo sapiens
agtttatgaaacaga

SEQ ID NO: 5235700 - DNA, 16 bp, Homo sapiens
agtttatgatgcaaat

SEQ ID NO: 5235701 - DNA, 16 bp, Homo sapiens
agtttatgtctaaaga

SEQ ID NO: 5235702 - DNA, 17 bp, Homo sapiens
agtttatgtctcagttt

SEQ ID NO: 5235703 - DNA, 16 bp, Homo sapiens
agtttattataatggt

SEQ ID NO: 5235704 - DNA, 17 bp, Homo sapiens
agtttattatagtctgt

SEQ ID NO: 5235705 - DNA, 14 bp, Homo sapiens
agtttattattgta

SEQ ID NO: 5235706 - DNA, 18 bp, Homo sapiens
agtttattattttcaaag

SEQ ID NO: 5235707 - DNA, 21 bp, Homo sapiens
agtttattccagagctgccag

SEQ ID NO: 5235708 - DNA, 15 bp, Homo sapiens
agtttattctcattt

SEQ ID NO: 5235709 - DNA, 23 bp, Homo sapiens
agtttattctgtggttctataat

SEQ ID NO: 5235710 - DNA, 22 bp, Homo sapiens
agtttattgacaataatttcag

SEQ ID NO: 5235711 - DNA, 15 bp, Homo sapiens
agtttattggaagtg

SEQ ID NO: 5235712 - DNA, 14 bp, Homo sapiens
agtttattgtaaaa

SEQ ID NO: 5235713 - DNA, 17 bp, Homo sapiens
agtttatttctgtgaaa

SEQ ID NO: 5235714 - DNA, 13 bp, Homo sapiens
agtttatttgaga

SEQ ID NO: 5235715 - DNA, 17 bp, Homo sapiens
agtttatttgagaaaat

SEQ ID NO: 5235716 - DNA, 20 bp, Homo sapiens
agtttatttgagaaaatata

SEQ ID NO: 5235717 - DNA, 21 bp, Homo sapiens
agtttatttgagaaaatataa

SEQ ID NO: 5235718 - DNA, 16 bp, Homo sapiens
agtttatttgttgaga

SEQ ID NO: 5235719 - DNA, 16 bp, Homo sapiens
agtttattttctgtgt

SEQ ID NO: 5235720 - DNA, 18 bp, Homo sapiens
agtttattttctgtgtaa

SEQ ID NO: 5235721 - DNA, 14 bp, Homo sapiens
agtttatttttcca

SEQ ID NO: 5235722 - DNA, 20 bp, Homo sapiens
agtttatttttttgatggct

SEQ ID NO: 5235723 - DNA, 14 bp, Homo sapiens
agtttcaaaaatct

SEQ ID NO: 5235724 - DNA, 23 bp, Homo sapiens
agtttcaaaaatctgaagattgt

SEQ ID NO: 5235725 - DNA, 19 bp, Homo sapiens
agtttcaaaatgttaacaa

SEQ ID NO: 5235726 - DNA, 19 bp, Homo sapiens
agtttcaaacttactattt

SEQ ID NO: 5235727 - DNA, 21 bp, Homo sapiens
agtttcaaacttactattttg

SEQ ID NO: 5235728 - DNA, 17 bp, Homo sapiens
agtttcaaagtgtctca

SEQ ID NO: 5235729 - DNA, 20 bp, Homo sapiens
agtttcaagttttaaagttc

SEQ ID NO: 5235730 - DNA, 19 bp, Homo sapiens
agtttcaatgtagtctgta

SEQ ID NO: 5235731 - DNA, 15 bp, Homo sapiens
agtttcaatgtgatt

SEQ ID NO: 5235732 - DNA, 16 bp, Homo sapiens
agtttcaattgagtaa

SEQ ID NO: 5235733 - DNA, 20 bp, Homo sapiens
agtttcacaaatccttcaaa

SEQ ID NO: 5235734 - DNA, 18 bp, Homo sapiens
agtttcacaacagatttc

SEQ ID NO: 5235735 - DNA, 19 bp, Homo sapiens
agtttcacaacagatttct

SEQ ID NO: 5235736 - DNA, 20 bp, Homo sapiens
agtttcacaagtgagccctc

SEQ ID NO: 5235737 - DNA, 17 bp, Homo sapiens
agtttcacagaaaataa

SEQ ID NO: 5235738 - DNA, 20 bp, Homo sapiens
agtttcacagcacttacaat

SEQ ID NO: 5235739 - DNA, 22 bp, Homo sapiens
agtttcacagcacttacaattt

SEQ ID NO: 5235740 - DNA, 17 bp, Homo sapiens
agtttcacaggtcaata

SEQ ID NO: 5235741 - DNA, 19 bp, Homo sapiens
agtttcacatatttgtagc

SEQ ID NO: 5235742 - DNA, 14 bp, Homo sapiens
agtttcaccactcc

SEQ ID NO: 5235743 - DNA, 15 bp, Homo sapiens
agtttcaccactcct

SEQ ID NO: 5235744 - DNA, 20 bp, Homo sapiens
agtttcaccatctttgaggt

SEQ ID NO: 5235745 - DNA, 13 bp, Homo sapiens
agtttcaccattt

SEQ ID NO: 5235746 - DNA, 19 bp, Homo sapiens
agtttcacgtaaatattca

SEQ ID NO: 5235747 - DNA, 14 bp, Homo sapiens
agtttcactccctc

SEQ ID NO: 5235748 - DNA, 17 bp, Homo sapiens
agtttcactgtactgca

SEQ ID NO: 5235749 - DNA, 12 bp, Homo sapiens
agtttcagaaat

SEQ ID NO: 5235750 - DNA, 14 bp, Homo sapiens
agtttcagaaattc

SEQ ID NO: 5235751 - DNA, 19 bp, Homo sapiens
agtttcagaaattctcaaa

SEQ ID NO: 5235752 - DNA, 14 bp, Homo sapiens
agtttcagaagcag

SEQ ID NO: 5235753 - DNA, 18 bp, Homo sapiens
agtttcagaagcaggcag

SEQ ID NO: 5235754 - DNA, 15 bp, Homo sapiens
agtttcagaagtact

SEQ ID NO: 5235755 - DNA, 12 bp, Homo sapiens
agtttcagaata

SEQ ID NO: 5235756 - DNA, 16 bp, Homo sapiens
agtttcagaataaaat

SEQ ID NO: 5235757 - DNA, 13 bp, Homo sapiens
agtttcagacagg

SEQ ID NO: 5235758 - DNA, 15 bp, Homo sapiens
agtttcagacagggt

SEQ ID NO: 5235759 - DNA, 22 bp, Homo sapiens
agtttcagagaccttaatttat

SEQ ID NO: 5235760 - DNA, 16 bp, Homo sapiens
agtttcagagagtcaa

SEQ ID NO: 5235761 - DNA, 21 bp, Homo sapiens
agtttcagagagtcaatgtca

SEQ ID NO: 5235762 - DNA, 16 bp, Homo sapiens
agtttcagagatggac

SEQ ID NO: 5235763 - DNA, 18 bp, Homo sapiens
agtttcagagatggacag

SEQ ID NO: 5235764 - DNA, 17 bp, Homo sapiens
agtttcagataaatcat

SEQ ID NO: 5235765 - DNA, 14 bp, Homo sapiens
agtttcagatatat

SEQ ID NO: 5235766 - DNA, 17 bp, Homo sapiens
agtttcagctgaccaga

SEQ ID NO: 5235767 - DNA, 15 bp, Homo sapiens
agtttcagcttaaaa

SEQ ID NO: 5235768 - DNA, 22 bp, Homo sapiens
agtttcagcttaaaataaacag

SEQ ID NO: 5235769 - DNA, 11 bp, Homo sapiens
agtttcaggtg

SEQ ID NO: 5235770 - DNA, 16 bp, Homo sapiens
agtttcaggtgacatg

SEQ ID NO: 5235771 - DNA, 22 bp, Homo sapiens
agtttcaggtgacatgtgaaac

SEQ ID NO: 5235772 - DNA, 19 bp, Homo sapiens
agtttcagtaaataatgaa

SEQ ID NO: 5235773 - DNA, 21 bp, Homo sapiens
agtttcagtaatagctgaacc

SEQ ID NO: 5235774 - DNA, 22 bp, Homo sapiens
agtttcagttgtccttaaattt

SEQ ID NO: 5235775 - DNA, 16 bp, Homo sapiens
agtttcatataaagta

SEQ ID NO: 5235776 - DNA, 16 bp, Homo sapiens
agtttcatatattatt

SEQ ID NO: 5235777 - DNA, 15 bp, Homo sapiens
agtttcatcagccct

SEQ ID NO: 5235778 - DNA, 21 bp, Homo sapiens
agtttcatgtacaagatgaag

SEQ ID NO: 5235779 - DNA, 18 bp, Homo sapiens
agtttcatgtatgtatat

SEQ ID NO: 5235780 - DNA, 21 bp, Homo sapiens
agtttcattaactccttcccc

SEQ ID NO: 5235781 - DNA, 19 bp, Homo sapiens
agtttcattatagcacgaa

SEQ ID NO: 5235782 - DNA, 22 bp, Homo sapiens
agtttcatttacaatttcaaaa

SEQ ID NO: 5235783 - DNA, 21 bp, Homo sapiens
agtttcatttatgatacaaaa

SEQ ID NO: 5235784 - DNA, 16 bp, Homo sapiens
agtttccaaaaccaga

SEQ ID NO: 5235785 - DNA, 15 bp, Homo sapiens
agtttccaagaaatt

SEQ ID NO: 5235786 - DNA, 18 bp, Homo sapiens
agtttccaagcaaatgtt

SEQ ID NO: 5235787 - DNA, 20 bp, Homo sapiens
agtttccaagcaaatgttac

SEQ ID NO: 5235788 - DNA, 13 bp, Homo sapiens
agtttccatttgg

SEQ ID NO: 5235789 - DNA, 16 bp, Homo sapiens
agtttccatttggatt

SEQ ID NO: 5235790 - DNA, 17 bp, Homo sapiens
agtttccatttggattt

SEQ ID NO: 5235791 - DNA, 23 bp, Homo sapiens
agtttccatttggattttaaaca

SEQ ID NO: 5235792 - DNA, 20 bp, Homo sapiens
agtttcccaaattccctgga

SEQ ID NO: 5235793 - DNA, 22 bp, Homo sapiens
agtttccccaccagtgaatgaa

SEQ ID NO: 5235794 - DNA, 23 bp, Homo sapiens
agtttccccaccagtgaatgaaa

SEQ ID NO: 5235795 - DNA, 20 bp, Homo sapiens
agtttcccctctggcttgac

SEQ ID NO: 5235796 - DNA, 15 bp, Homo sapiens
agtttccctggtgcc

SEQ ID NO: 5235797 - DNA, 13 bp, Homo sapiens
agtttcccttcta

SEQ ID NO: 5235798 - DNA, 17 bp, Homo sapiens
agtttccgtgcgtggca

SEQ ID NO: 5235799 - DNA, 15 bp, Homo sapiens
agtttcctaaaagtt

SEQ ID NO: 5235800 - DNA, 16 bp, Homo sapiens
agtttcctcagaaccc

SEQ ID NO: 5235801 - DNA, 13 bp, Homo sapiens
agtttcctcaggc

SEQ ID NO: 5235802 - DNA, 13 bp, Homo sapiens
agtttcctcagtg

SEQ ID NO: 5235803 - DNA, 12 bp, Homo sapiens
agtttcctgaaa

SEQ ID NO: 5235804 - DNA, 19 bp, Homo sapiens
agtttcctgccttcagagt

SEQ ID NO: 5235805 - DNA, 22 bp, Homo sapiens
agtttcctgccttcagagtatc

SEQ ID NO: 5235806 - DNA, 12 bp, Homo sapiens
agtttcctggaa

SEQ ID NO: 5235807 - DNA, 23 bp, Homo sapiens
agtttccttttctgtctctctct

SEQ ID NO: 5235808 - DNA, 12 bp, Homo sapiens
agtttccttttt

SEQ ID NO: 5235809 - DNA, 16 bp, Homo sapiens
agtttcctttttaata

SEQ ID NO: 5235810 - DNA, 18 bp, Homo sapiens
agtttcctttttaatatg

SEQ ID NO: 5235811 - DNA, 17 bp, Homo sapiens
agtttcgacttatttct

SEQ ID NO: 5235812 - DNA, 19 bp, Homo sapiens
agtttcgctccatcgccca

SEQ ID NO: 5235813 - DNA, 15 bp, Homo sapiens
agtttcgttttcaaa

SEQ ID NO: 5235814 - DNA, 18 bp, Homo sapiens
agtttctaaactggagac

SEQ ID NO: 5235815 - DNA, 13 bp, Homo sapiens
agtttctaagaat

SEQ ID NO: 5235816 - DNA, 16 bp, Homo sapiens
agtttctaagaattta

SEQ ID NO: 5235817 - DNA, 16 bp, Homo sapiens
agtttctaagattcta

SEQ ID NO: 5235818 - DNA, 18 bp, Homo sapiens
agtttctaagattctaaa

SEQ ID NO: 5235819 - DNA, 14 bp, Homo sapiens
agtttctacattca

SEQ ID NO: 5235820 - DNA, 19 bp, Homo sapiens
agtttctagaattttatat

SEQ ID NO: 5235821 - DNA, 20 bp, Homo sapiens
agtttctagctctcacagac

SEQ ID NO: 5235822 - DNA, 21 bp, Homo sapiens
agtttctatggattcacttct

SEQ ID NO: 5235823 - DNA, 20 bp, Homo sapiens
agtttctatttagttattta

SEQ ID NO: 5235824 - DNA, 21 bp, Homo sapiens
agtttctcaagtttaaagtca

SEQ ID NO: 5235825 - DNA, 22 bp, Homo sapiens
agtttctcagggtcactgtcct

SEQ ID NO: 5235826 - DNA, 21 bp, Homo sapiens
agtttctccaagcaggacatg

SEQ ID NO: 5235827 - DNA, 21 bp, Homo sapiens
agtttctccaagtacttttgt

SEQ ID NO: 5235828 - DNA, 20 bp, Homo sapiens
agtttctcctttattgctcc

SEQ ID NO: 5235829 - DNA, 20 bp, Homo sapiens
agtttctctcttgttgtcca

SEQ ID NO: 5235830 - DNA, 23 bp, Homo sapiens
agtttctctgcagaaactactga

SEQ ID NO: 5235831 - DNA, 14 bp, Homo sapiens
agtttctcttttca

SEQ ID NO: 5235832 - DNA, 19 bp, Homo sapiens
agtttctgacgaaggtcct

SEQ ID NO: 5235833 - DNA, 12 bp, Homo sapiens
agtttctgcttg

SEQ ID NO: 5235834 - DNA, 23 bp, Homo sapiens
agtttctggagcaagagagagct

SEQ ID NO: 5235835 - DNA, 20 bp, Homo sapiens
agtttctggctgaaaatggt

SEQ ID NO: 5235836 - DNA, 23 bp, Homo sapiens
agtttctgtcgttaaaaacagat

SEQ ID NO: 5235837 - DNA, 23 bp, Homo sapiens
agtttctgttctccctgggaagc

SEQ ID NO: 5235838 - DNA, 18 bp, Homo sapiens
agtttctgttctgtggaa

SEQ ID NO: 5235839 - DNA, 22 bp, Homo sapiens
agtttctgttctgtggaaagtg

SEQ ID NO: 5235840 - DNA, 12 bp, Homo sapiens
agtttctgttga

SEQ ID NO: 5235841 - DNA, 17 bp, Homo sapiens
agtttctgtttgattct

SEQ ID NO: 5235842 - DNA, 13 bp, Homo sapiens
atagaatatataa

SEQ ID NO: 5235843 - DNA, 22 bp, Homo sapiens
atagaatatttattacctctga

SEQ ID NO: 5235844 - DNA, 16 bp, Homo sapiens
atagaatcaatcagta

SEQ ID NO: 5235845 - DNA, 17 bp, Homo sapiens
atagaatctactttaat

SEQ ID NO: 5235846 - DNA, 13 bp, Homo sapiens
atagaatgacagt

SEQ ID NO: 5235847 - DNA, 18 bp, Homo sapiens
atagaatgatagaacttt

SEQ ID NO: 5235848 - DNA, 14 bp, Homo sapiens
atagaatgatgttt

SEQ ID NO: 5235849 - DNA, 15 bp, Homo sapiens
atagaatgctgaact

SEQ ID NO: 5235850 - DNA, 17 bp, Homo sapiens
atagaattatattttct

SEQ ID NO: 5235851 - DNA, 13 bp, Homo sapiens
atagaattgacat

SEQ ID NO: 5235852 - DNA, 15 bp, Homo sapiens
atagaatttcctaat

SEQ ID NO: 5235853 - DNA, 14 bp, Homo sapiens
atagaatttcctgt

SEQ ID NO: 5235854 - DNA, 15 bp, Homo sapiens
atagaatttcctgta

SEQ ID NO: 5235855 - DNA, 19 bp, Homo sapiens
atagaatttcctgtaatat

SEQ ID NO: 5235856 - DNA, 21 bp, Homo sapiens
atagaatttggcccagagagg

SEQ ID NO: 5235857 - DNA, 17 bp, Homo sapiens
atagaatttttaatgtt

SEQ ID NO: 5235858 - DNA, 19 bp, Homo sapiens
atagaatttttaatgtttt

SEQ ID NO: 5235859 - DNA, 16 bp, Homo sapiens
atagacaaaaagtata

SEQ ID NO: 5235860 - DNA, 17 bp, Homo sapiens
atagacaaaagaataag

SEQ ID NO: 5235861 - DNA, 17 bp, Homo sapiens
atagacaacgatgaatt

SEQ ID NO: 5235862 - DNA, 13 bp, Homo sapiens
atagacaagtttt

SEQ ID NO: 5235863 - DNA, 20 bp, Homo sapiens
atagacaattcctccagaga

SEQ ID NO: 5235864 - DNA, 21 bp, Homo sapiens
atagacaattcctccagagac

SEQ ID NO: 5235865 - DNA, 23 bp, Homo sapiens
atagacaattcctccagagacac

SEQ ID NO: 5235866 - DNA, 21 bp, Homo sapiens
atagacaattgaggtaagttt

SEQ ID NO: 5235867 - DNA, 16 bp, Homo sapiens
atagacaatttattat

SEQ ID NO: 5235868 - DNA, 18 bp, Homo sapiens
atagacacacatacataa

SEQ ID NO: 5235869 - DNA, 12 bp, Homo sapiens
atagacaccata

SEQ ID NO: 5235870 - DNA, 12 bp, Homo sapiens
atagacacgcac

SEQ ID NO: 5235871 - DNA, 22 bp, Homo sapiens
atagacactccccgaagtcttt

SEQ ID NO: 5235872 - DNA, 13 bp, Homo sapiens
atagacagaagaa

SEQ ID NO: 5235873 - DNA, 16 bp, Homo sapiens
atagacagaagaaaca

SEQ ID NO: 5235874 - DNA, 19 bp, Homo sapiens
atagacagaagaaacaagg

SEQ ID NO: 5235875 - DNA, 24 bp, Homo sapiens
atagacagaggtttcattttcatc

SEQ ID NO: 5235876 - DNA, 23 bp, Homo sapiens
atagacagatgtggacatgcacc

SEQ ID NO: 5235877 - DNA, 15 bp, Homo sapiens
atagacagcatgaga

SEQ ID NO: 5235878 - DNA, 15 bp, Homo sapiens
atagacagctttgac

SEQ ID NO: 5235879 - DNA, 24 bp, Homo sapiens
atagacagtaaaatactattctca

SEQ ID NO: 5235880 - DNA, 18 bp, Homo sapiens
atagacagtgctgccctg

SEQ ID NO: 5235881 - DNA, 12 bp, Homo sapiens
atagacataaat

SEQ ID NO: 5235882 - DNA, 14 bp, Homo sapiens
atagacataaattg

SEQ ID NO: 5235883 - DNA, 20 bp, Homo sapiens
atagacataaattgtaattt

SEQ ID NO: 5235884 - DNA, 12 bp, Homo sapiens
atagacatcttt

SEQ ID NO: 5235885 - DNA, 12 bp, Homo sapiens
atagacatgaaa

SEQ ID NO: 5235886 - DNA, 15 bp, Homo sapiens
atagacattctcaca

SEQ ID NO: 5235887 - DNA, 18 bp, Homo sapiens
atagacatttcaaaatta

SEQ ID NO: 5235888 - DNA, 16 bp, Homo sapiens
atagacatttgtaaat

SEQ ID NO: 5235889 - DNA, 19 bp, Homo sapiens
atagacatttttttgttcc

SEQ ID NO: 5235890 - DNA, 22 bp, Homo sapiens
atagaccactgggtttggcaaa

SEQ ID NO: 5235891 - DNA, 17 bp, Homo sapiens
atagacctatgataaat

SEQ ID NO: 5235892 - DNA, 15 bp, Homo sapiens
atagacctgacaatt

SEQ ID NO: 5235893 - DNA, 18 bp, Homo sapiens
atagacgggttgaaagac

SEQ ID NO: 5235894 - DNA, 22 bp, Homo sapiens
atagacgggttgaaagacatca

SEQ ID NO: 5235895 - DNA, 23 bp, Homo sapiens
atagacgggttgaaagacatcaa

SEQ ID NO: 5235896 - DNA, 20 bp, Homo sapiens
atagacgtttggactgattt

SEQ ID NO: 5235897 - DNA, 15 bp, Homo sapiens
atagactaaatgaaa

SEQ ID NO: 5235898 - DNA, 16 bp, Homo sapiens
atagactaacttcagt

SEQ ID NO: 5235899 - DNA, 16 bp, Homo sapiens
atagactcctttgcta

SEQ ID NO: 5235900 - DNA, 20 bp, Homo sapiens
atagactgaggtataaagac

SEQ ID NO: 5235901 - DNA, 17 bp, Homo sapiens
atagactggaaaaaatg

SEQ ID NO: 5235902 - DNA, 18 bp, Homo sapiens
atagactggaaaaaatga

SEQ ID NO: 5235903 - DNA, 19 bp, Homo sapiens
atagactgtaacttccaaa

SEQ ID NO: 5235904 - DNA, 16 bp, Homo sapiens
atagacttactaataa

SEQ ID NO: 5235905 - DNA, 18 bp, Homo sapiens
atagacttactaataaaa

SEQ ID NO: 5235906 - DNA, 15 bp, Homo sapiens
atagacttatatgca

SEQ ID NO: 5235907 - DNA, 21 bp, Homo sapiens
atagacttatatgcaggctgt

SEQ ID NO: 5235908 - DNA, 19 bp, Homo sapiens
atagacttcgaaaacagat

SEQ ID NO: 5235909 - DNA, 23 bp, Homo sapiens
atagacttcgaaaacagatgaga

SEQ ID NO: 5235910 - DNA, 14 bp, Homo sapiens
atagacttctctta

SEQ ID NO: 5235911 - DNA, 16 bp, Homo sapiens
atagacttctcttaca

SEQ ID NO: 5235912 - DNA, 15 bp, Homo sapiens
atagacttgggatgg

SEQ ID NO: 5235913 - DNA, 19 bp, Homo sapiens
atagactttatgcaataaa

SEQ ID NO: 5235914 - DNA, 14 bp, Homo sapiens
atagagaacaaagt

SEQ ID NO: 5235915 - DNA, 14 bp, Homo sapiens
atagagaatgttcc

SEQ ID NO: 5235916 - DNA, 14 bp, Homo sapiens
atagagaatttaag

SEQ ID NO: 5235917 - DNA, 20 bp, Homo sapiens
atagagaccaggagggagag

SEQ ID NO: 5235918 - DNA, 23 bp, Homo sapiens
atagagactgtagattgcttctg

SEQ ID NO: 5235919 - DNA, 11 bp, Homo sapiens
atagagagaga

SEQ ID NO: 5235920 - DNA, 14 bp, Homo sapiens
atagagagagacca

SEQ ID NO: 5235921 - DNA, 14 bp, Homo sapiens
atagagaggcctgc

SEQ ID NO: 5235922 - DNA, 18 bp, Homo sapiens
atagagagggagaagaag

SEQ ID NO: 5235923 - DNA, 21 bp, Homo sapiens
atagagatatttaaaagacaa

SEQ ID NO: 5235924 - DNA, 16 bp, Homo sapiens
atagagattgtacatt

SEQ ID NO: 5235925 - DNA, 12 bp, Homo sapiens
atagagcaatta

SEQ ID NO: 5235926 - DNA, 21 bp, Homo sapiens
atagagcagcctgctgctctc

SEQ ID NO: 5235927 - DNA, 23 bp, Homo sapiens
atagagcatatttgccaataaag

SEQ ID NO: 5235928 - DNA, 15 bp, Homo sapiens
atagagccctggcca

SEQ ID NO: 5235929 - DNA, 13 bp, Homo sapiens
atagagcctgagg

SEQ ID NO: 5235930 - DNA, 15 bp, Homo sapiens
atagagcctgaggga

SEQ ID NO: 5235931 - DNA, 20 bp, Homo sapiens
atagagctccatttcccctc

SEQ ID NO: 5235932 - DNA, 12 bp, Homo sapiens
atagagctgcca

SEQ ID NO: 5235933 - DNA, 13 bp, Homo sapiens
atagagctgccac

SEQ ID NO: 5235934 - DNA, 14 bp, Homo sapiens
atagagctgccact

SEQ ID NO: 5235935 - DNA, 16 bp, Homo sapiens
atagagctgccactgg

SEQ ID NO: 5235936 - DNA, 13 bp, Homo sapiens
atagagctgtatt

SEQ ID NO: 5235937 - DNA, 14 bp, Homo sapiens
atagagctttttaa

SEQ ID NO: 5235938 - DNA, 17 bp, Homo sapiens
atagagctttttaatag

SEQ ID NO: 5235939 - DNA, 22 bp, Homo sapiens
atagagctttttaatagcacta

SEQ ID NO: 5235940 - DNA, 17 bp, Homo sapiens
atagaggagaggaaaag

SEQ ID NO: 5235941 - DNA, 13 bp, Homo sapiens
atagaggcccagg

SEQ ID NO: 5235942 - DNA, 14 bp, Homo sapiens
atagaggcccaggc

SEQ ID NO: 5235943 - DNA, 18 bp, Homo sapiens
atagaggcccaggcacca

SEQ ID NO: 5235944 - DNA, 20 bp, Homo sapiens
atagaggctagcttctgctt

SEQ ID NO: 5235945 - DNA, 20 bp, Homo sapiens
atagaggtaaaatttgcaca

SEQ ID NO: 5235946 - DNA, 18 bp, Homo sapiens
atagaggtgatgctgcta

SEQ ID NO: 5235947 - DNA, 11 bp, Homo sapiens
atagaggttct

SEQ ID NO: 5235948 - DNA, 17 bp, Homo sapiens
atagagtacactgcctg

SEQ ID NO: 5235949 - DNA, 13 bp, Homo sapiens
atagagtccagat

SEQ ID NO: 5235950 - DNA, 13 bp, Homo sapiens
atagagtgatttt

SEQ ID NO: 5235951 - DNA, 12 bp, Homo sapiens
atagagtgcagt

SEQ ID NO: 5235952 - DNA, 14 bp, Homo sapiens
atagagtgtactta

SEQ ID NO: 5235953 - DNA, 21 bp, Homo sapiens
atagagtgtacttaactattc

SEQ ID NO: 5235954 - DNA, 14 bp, Homo sapiens
atagagtgttatca

SEQ ID NO: 5235955 - DNA, 13 bp, Homo sapiens
atagagtgttttt

SEQ ID NO: 5235956 - DNA, 16 bp, Homo sapiens
atagagtttaacacaa

SEQ ID NO: 5235957 - DNA, 14 bp, Homo sapiens
atagagtttaacag

SEQ ID NO: 5235958 - DNA, 12 bp, Homo sapiens
atagagttttcc

SEQ ID NO: 5235959 - DNA, 23 bp, Homo sapiens
atagataaagtgcctataaagga

SEQ ID NO: 5235960 - DNA, 15 bp, Homo sapiens
atagataattatcca

SEQ ID NO: 5235961 - DNA, 13 bp, Homo sapiens
atagatacaaatg

SEQ ID NO: 5235962 - DNA, 17 bp, Homo sapiens
atagataccattttgaa

SEQ ID NO: 5235963 - DNA, 20 bp, Homo sapiens
atagataccattttgaaata

SEQ ID NO: 5235964 - DNA, 13 bp, Homo sapiens
atagatacttttg

SEQ ID NO: 5235965 - DNA, 20 bp, Homo sapiens
atagatataatgaacaaaat

SEQ ID NO: 5235966 - DNA, 16 bp, Homo sapiens
atagatatcctctccc

SEQ ID NO: 5235967 - DNA, 16 bp, Homo sapiens
atagatatctatattt

SEQ ID NO: 5235968 - DNA, 20 bp, Homo sapiens
atagatatgtatatatacat

SEQ ID NO: 5235969 - DNA, 17 bp, Homo sapiens
atagatattttcacaat

SEQ ID NO: 5235970 - DNA, 19 bp, Homo sapiens
atagatcaaagtcaaaaat

SEQ ID NO: 5235971 - DNA, 16 bp, Homo sapiens
atagatcaataaatgt

SEQ ID NO: 5235972 - DNA, 19 bp, Homo sapiens
atagatcacataacagaat

SEQ ID NO: 5235973 - DNA, 17 bp, Homo sapiens
atagatcacggcatgtt

SEQ ID NO: 5235974 - DNA, 15 bp, Homo sapiens
atagatcagccatta

SEQ ID NO: 5235975 - DNA, 18 bp, Homo sapiens
atagatcagccattaaaa

SEQ ID NO: 5235976 - DNA, 21 bp, Homo sapiens
atagatcccacgttgatgtct

SEQ ID NO: 5235977 - DNA, 16 bp, Homo sapiens
atagatcccccagact

SEQ ID NO: 5235978 - DNA, 17 bp, Homo sapiens
atagatcctaggtgctg

SEQ ID NO: 5235979 - DNA, 19 bp, Homo sapiens
atagatcctaggtgctgga

SEQ ID NO: 5235980 - DNA, 23 bp, Homo sapiens
atagatcctggttaccactcttt

SEQ ID NO: 5235981 - DNA, 12 bp, Homo sapiens
atagatcttctg

SEQ ID NO: 5235982 - DNA, 13 bp, Homo sapiens
atagatcttctga

SEQ ID NO: 5235983 - DNA, 21 bp, Homo sapiens
atagatcttctgaaatgaaac

SEQ ID NO: 5235984 - DNA, 18 bp, Homo sapiens
atagatgacccccaggta

SEQ ID NO: 5235985 - DNA, 13 bp, Homo sapiens
atagatgcctggg

SEQ ID NO: 5235986 - DNA, 15 bp, Homo sapiens
atagatgcctgggcc

SEQ ID NO: 5235987 - DNA, 16 bp, Homo sapiens
atagatgcctgggcct

SEQ ID NO: 5235988 - DNA, 16 bp, Homo sapiens
atagatgctggcccag

SEQ ID NO: 5235989 - DNA, 20 bp, Homo sapiens
atagatgctggcccagggcc

SEQ ID NO: 5235990 - DNA, 20 bp, Homo sapiens
atagatggacagtttgtttc

SEQ ID NO: 5235991 - DNA, 22 bp, Homo sapiens
atagatggacagtttgtttcct

SEQ ID NO: 5235992 - DNA, 13 bp, Homo sapiens
atagatgggaatg

SEQ ID NO: 5235993 - DNA, 22 bp, Homo sapiens
atagatgggggaaagcaaagca

SEQ ID NO: 5235994 - DNA, 23 bp, Homo sapiens
atagatgggtctggctgagctga

SEQ ID NO: 5235995 - DNA, 15 bp, Homo sapiens
atagatggtagaaac

SEQ ID NO: 5235996 - DNA, 21 bp, Homo sapiens
atagatggtagaaactttgga

SEQ ID NO: 5235997 - DNA, 17 bp, Homo sapiens
atagatgtaatctgatt

SEQ ID NO: 5235998 - DNA, 17 bp, Homo sapiens
atagatgtaatttttca

SEQ ID NO: 5235999 - DNA, 22 bp, Homo sapiens
atagatgtagataaactcagaa

SEQ ID NO: 5236000 - DNA, 14 bp, Homo sapiens
atagatgtatcatt

SEQ ID NO: 5236001 - DNA, 20 bp, Homo sapiens
atagatgtcagcaattaggc

SEQ ID NO: 5236002 - DNA, 22 bp, Homo sapiens
atagatgtccctttcttggcca

SEQ ID NO: 5236003 - DNA, 18 bp, Homo sapiens
atagatgtctgtgtatac

SEQ ID NO: 5236004 - DNA, 20 bp, Homo sapiens
atagatgtctgtgtatacat

SEQ ID NO: 5236005 - DNA, 21 bp, Homo sapiens
atagatgtctgtgtatacata

SEQ ID NO: 5236006 - DNA, 22 bp, Homo sapiens
atagatgtctgtgtatacatat

SEQ ID NO: 5236007 - DNA, 16 bp, Homo sapiens
atagatgtcttcatca

SEQ ID NO: 5236008 - DNA, 14 bp, Homo sapiens
atagatgtctttta

SEQ ID NO: 5236009 - DNA, 21 bp, Homo sapiens
atagatgtcttttatagtgga

SEQ ID NO: 5236010 - DNA, 14 bp, Homo sapiens
atagatgtcttttc

SEQ ID NO: 5236011 - DNA, 12 bp, Homo sapiens
atagatgtgaaa

SEQ ID NO: 5236012 - DNA, 11 bp, Homo sapiens
atagatgtgtg

SEQ ID NO: 5236013 - DNA, 14 bp, Homo sapiens
atagatgtgtggac

SEQ ID NO: 5236014 - DNA, 20 bp, Homo sapiens
atagatgttgctaacagcaa

SEQ ID NO: 5236015 - DNA, 23 bp, Homo sapiens
atagatgttgtagaataagttat

SEQ ID NO: 5236016 - DNA, 12 bp, Homo sapiens
atagatgtttga

SEQ ID NO: 5236017 - DNA, 16 bp, Homo sapiens
atagatgttttaactt

SEQ ID NO: 5236018 - DNA, 21 bp, Homo sapiens
atagattagaaaaattcctaa

SEQ ID NO: 5236019 - DNA, 21 bp, Homo sapiens
atagattagagagtgttgaaa

SEQ ID NO: 5236020 - DNA, 15 bp, Homo sapiens
atagattagattata

SEQ ID NO: 5236021 - DNA, 15 bp, Homo sapiens
atagattataacttg

SEQ ID NO: 5236022 - DNA, 14 bp, Homo sapiens
agtttcttaactta

SEQ ID NO: 5236023 - DNA, 17 bp, Homo sapiens
agtttcttacacactgt

SEQ ID NO: 5236024 - DNA, 22 bp, Homo sapiens
agtttcttactgttttgtatca

SEQ ID NO: 5236025 - DNA, 14 bp, Homo sapiens
agtttcttagcttt

SEQ ID NO: 5236026 - DNA, 14 bp, Homo sapiens
agtttcttctaaag

SEQ ID NO: 5236027 - DNA, 15 bp, Homo sapiens
agtttcttctaaaga

SEQ ID NO: 5236028 - DNA, 20 bp, Homo sapiens
agtttcttcttacacttctt

SEQ ID NO: 5236029 - DNA, 21 bp, Homo sapiens
agtttcttgcttggaagccag

SEQ ID NO: 5236030 - DNA, 23 bp, Homo sapiens
agtttcttgcttggaagccaggt

SEQ ID NO: 5236031 - DNA, 17 bp, Homo sapiens
agtttcttggccactga

SEQ ID NO: 5236032 - DNA, 16 bp, Homo sapiens
agtttcttgtaagcca

SEQ ID NO: 5236033 - DNA, 19 bp, Homo sapiens
agtttcttgtgtagatttg

SEQ ID NO: 5236034 - DNA, 16 bp, Homo sapiens
agtttctttattttgt

SEQ ID NO: 5236035 - DNA, 22 bp, Homo sapiens
agtttctttgagggttccatgg

SEQ ID NO: 5236036 - DNA, 17 bp, Homo sapiens
agtttgaaaagcaatat

SEQ ID NO: 5236037 - DNA, 12 bp, Homo sapiens
agtttgaaagtt

SEQ ID NO: 5236038 - DNA, 19 bp, Homo sapiens
agtttgaaagttgtacatg

SEQ ID NO: 5236039 - DNA, 22 bp, Homo sapiens
agtttgaaatatattatttcct

SEQ ID NO: 5236040 - DNA, 18 bp, Homo sapiens
agtttgaaattctgaatt

SEQ ID NO: 5236041 - DNA, 20 bp, Homo sapiens
agtttgaaattctgaatttg

SEQ ID NO: 5236042 - DNA, 22 bp, Homo sapiens
agtttgaaattctgaatttgca

SEQ ID NO: 5236043 - DNA, 23 bp, Homo sapiens
agtttgaaattctgaatttgcaa

SEQ ID NO: 5236044 - DNA, 22 bp, Homo sapiens
agtttgaacctttttttttgaa

SEQ ID NO: 5236045 - DNA, 19 bp, Homo sapiens
agtttgaagaccaatcaaa

SEQ ID NO: 5236046 - DNA, 23 bp, Homo sapiens
agtttgaagaccaatcaaatata

SEQ ID NO: 5236047 - DNA, 20 bp, Homo sapiens
agtttgaagcacaactccct

SEQ ID NO: 5236048 - DNA, 22 bp, Homo sapiens
agtttgaatctatttatcttca

SEQ ID NO: 5236049 - DNA, 16 bp, Homo sapiens
agtttgaatgttaaat

SEQ ID NO: 5236050 - DNA, 21 bp, Homo sapiens
agtttgaattcctaaaattat

SEQ ID NO: 5236051 - DNA, 22 bp, Homo sapiens
agtttgacaccttagagaagct

SEQ ID NO: 5236052 - DNA, 18 bp, Homo sapiens
agtttgacagtttttgac

SEQ ID NO: 5236053 - DNA, 22 bp, Homo sapiens
agtttgacctttgtcttctata

SEQ ID NO: 5236054 - DNA, 19 bp, Homo sapiens
agtttgagacaagccctgg

SEQ ID NO: 5236055 - DNA, 20 bp, Homo sapiens
agtttgagacaagccctggc

SEQ ID NO: 5236056 - DNA, 12 bp, Homo sapiens
agtttgagacca

SEQ ID NO: 5236057 - DNA, 16 bp, Homo sapiens
agtttgagaccagcct

SEQ ID NO: 5236058 - DNA, 20 bp, Homo sapiens
agtttgagatcagcctgggc

SEQ ID NO: 5236059 - DNA, 15 bp, Homo sapiens
agtttgagctgcctt

SEQ ID NO: 5236060 - DNA, 16 bp, Homo sapiens
agtttgagctgccttc

SEQ ID NO: 5236061 - DNA, 20 bp, Homo sapiens
agtttgaggctgcagtgagc

SEQ ID NO: 5236062 - DNA, 16 bp, Homo sapiens
agtttgataaatagtg

SEQ ID NO: 5236063 - DNA, 17 bp, Homo sapiens
agtttgatattaaagga

SEQ ID NO: 5236064 - DNA, 17 bp, Homo sapiens
agtttgatcaaatctaa

SEQ ID NO: 5236065 - DNA, 20 bp, Homo sapiens
agtttgatcacactatttta

SEQ ID NO: 5236066 - DNA, 16 bp, Homo sapiens
agtttgatcttcctct

SEQ ID NO: 5236067 - DNA, 22 bp, Homo sapiens
agtttgatcttcctctgctaaa

SEQ ID NO: 5236068 - DNA, 23 bp, Homo sapiens
agtttgatcttcctctgctaaat

SEQ ID NO: 5236069 - DNA, 16 bp, Homo sapiens
agtttgatgaggccct

SEQ ID NO: 5236070 - DNA, 18 bp, Homo sapiens
agtttgatgaggccctcc

SEQ ID NO: 5236071 - DNA, 17 bp, Homo sapiens
agtttgattaaattctt

SEQ ID NO: 5236072 - DNA, 16 bp, Homo sapiens
agtttgattattatgt

SEQ ID NO: 5236073 - DNA, 17 bp, Homo sapiens
agtttgattattatgtt

SEQ ID NO: 5236074 - DNA, 19 bp, Homo sapiens
agtttgatttaatatctga

SEQ ID NO: 5236075 - DNA, 13 bp, Homo sapiens
agtttgatttttg

SEQ ID NO: 5236076 - DNA, 17 bp, Homo sapiens
agtttgcaaaaaatgtt

SEQ ID NO: 5236077 - DNA, 24 bp, Homo sapiens
agtttgcacaagttcatctcattt

SEQ ID NO: 5236078 - DNA, 16 bp, Homo sapiens
agtttgcacctgtccc

SEQ ID NO: 5236079 - DNA, 20 bp, Homo sapiens
agtttgcactgtatgctgga

SEQ ID NO: 5236080 - DNA, 13 bp, Homo sapiens
agtttgcagaaaa

SEQ ID NO: 5236081 - DNA, 23 bp, Homo sapiens
agtttgcagaaaagcacctgccg

SEQ ID NO: 5236082 - DNA, 13 bp, Homo sapiens
agtttgcagagga

SEQ ID NO: 5236083 - DNA, 13 bp, Homo sapiens
agtttgcagagta

SEQ ID NO: 5236084 - DNA, 15 bp, Homo sapiens
agtttgcatatcagt

SEQ ID NO: 5236085 - DNA, 16 bp, Homo sapiens
agtttgcatttcagaa

SEQ ID NO: 5236086 - DNA, 23 bp, Homo sapiens
agtttgcatttcagaaagccttt

SEQ ID NO: 5236087 - DNA, 14 bp, Homo sapiens
agtttgcccagagt

SEQ ID NO: 5236088 - DNA, 16 bp, Homo sapiens
agtttgcccagagttg

SEQ ID NO: 5236089 - DNA, 20 bp, Homo sapiens
agtttgccccgttctgtttg

SEQ ID NO: 5236090 - DNA, 21 bp, Homo sapiens
agtttgccctggtttcactgg

SEQ ID NO: 5236091 - DNA, 19 bp, Homo sapiens
agtttgcctccctgcactt

SEQ ID NO: 5236092 - DNA, 14 bp, Homo sapiens
agtttgcctctgca

SEQ ID NO: 5236093 - DNA, 15 bp, Homo sapiens
agtttgcctgcagtt

SEQ ID NO: 5236094 - DNA, 17 bp, Homo sapiens
agtttgctaaaagaaga

SEQ ID NO: 5236095 - DNA, 22 bp, Homo sapiens
agtttgctaaattgagaggggc

SEQ ID NO: 5236096 - DNA, 17 bp, Homo sapiens
agtttgctctaccaaat

SEQ ID NO: 5236097 - DNA, 23 bp, Homo sapiens
agtttgctctaccaaatagtgat

SEQ ID NO: 5236098 - DNA, 20 bp, Homo sapiens
agtttgctgaaagatatgta

SEQ ID NO: 5236099 - DNA, 23 bp, Homo sapiens
agtttgctgaaagatatgtatat

SEQ ID NO: 5236100 - DNA, 18 bp, Homo sapiens
agtttgctgtactagaga

SEQ ID NO: 5236101 - DNA, 12 bp, Homo sapiens
agtttgctgtgc

SEQ ID NO: 5236102 - DNA, 14 bp, Homo sapiens
agtttgctgtgctt

SEQ ID NO: 5236103 - DNA, 20 bp, Homo sapiens
agtttgctgtgctttggaac

SEQ ID NO: 5236104 - DNA, 18 bp, Homo sapiens
agtttgctgttttaaatt

SEQ ID NO: 5236105 - DNA, 13 bp, Homo sapiens
agtttgcttagaa

SEQ ID NO: 5236106 - DNA, 16 bp, Homo sapiens
agtttgcttctgtaag

SEQ ID NO: 5236107 - DNA, 19 bp, Homo sapiens
agtttgctttgtttaagca

SEQ ID NO: 5236108 - DNA, 13 bp, Homo sapiens
agtttggagacaa

SEQ ID NO: 5236109 - DNA, 17 bp, Homo sapiens
agtttggagatttttca

SEQ ID NO: 5236110 - DNA, 14 bp, Homo sapiens
agtttggatatgta

SEQ ID NO: 5236111 - DNA, 16 bp, Homo sapiens
agtttggatatgtaaa

SEQ ID NO: 5236112 - DNA, 20 bp, Homo sapiens
agtttggatatttttgtact

SEQ ID NO: 5236113 - DNA, 21 bp, Homo sapiens
agtttggatatttttgtactt

SEQ ID NO: 5236114 - DNA, 22 bp, Homo sapiens
agtttggatatttttgtacttg

SEQ ID NO: 5236115 - DNA, 21 bp, Homo sapiens
agtttggatgttgtaaataaa

SEQ ID NO: 5236116 - DNA, 18 bp, Homo sapiens
agtttggcaaactctcca

SEQ ID NO: 5236117 - DNA, 16 bp, Homo sapiens
agtttggcaatagttt

SEQ ID NO: 5236118 - DNA, 17 bp, Homo sapiens
agtttggcaatagtttg

SEQ ID NO: 5236119 - DNA, 14 bp, Homo sapiens
agtttggcaggcag

SEQ ID NO: 5236120 - DNA, 13 bp, Homo sapiens
agtttggccagaa

SEQ ID NO: 5236121 - DNA, 14 bp, Homo sapiens
agtttggccagaag

SEQ ID NO: 5236122 - DNA, 12 bp, Homo sapiens
agtttggccctg

SEQ ID NO: 5236123 - DNA, 17 bp, Homo sapiens
agtttggccctggagcc

SEQ ID NO: 5236124 - DNA, 19 bp, Homo sapiens
agtttggctataagtgctc

SEQ ID NO: 5236125 - DNA, 23 bp, Homo sapiens
agtttggctgctgtcataacatc

SEQ ID NO: 5236126 - DNA, 18 bp, Homo sapiens
agtttggctgtaatttaa

SEQ ID NO: 5236127 - DNA, 20 bp, Homo sapiens
agtttgggatccctgtcttt

SEQ ID NO: 5236128 - DNA, 16 bp, Homo sapiens
agtttgggctggagct

SEQ ID NO: 5236129 - DNA, 20 bp, Homo sapiens
agtttgggctggagctcctc

SEQ ID NO: 5236130 - DNA, 22 bp, Homo sapiens
agtttggggcaagtcatgtaaa

SEQ ID NO: 5236131 - DNA, 14 bp, Homo sapiens
agtttggggcaggg

SEQ ID NO: 5236132 - DNA, 23 bp, Homo sapiens
agtttgggggcagattctgaatt

SEQ ID NO: 5236133 - DNA, 20 bp, Homo sapiens
agtttgggggttttgctgtt

SEQ ID NO: 5236134 - DNA, 11 bp, Homo sapiens
agtttggggtg

SEQ ID NO: 5236135 - DNA, 21 bp, Homo sapiens
agtttgggtgtattttcttta

SEQ ID NO: 5236136 - DNA, 16 bp, Homo sapiens
agtttggtgtgtcctc

SEQ ID NO: 5236137 - DNA, 20 bp, Homo sapiens
agtttggttcttcaaatctt

SEQ ID NO: 5236138 - DNA, 19 bp, Homo sapiens
agtttggtttttgaataga

SEQ ID NO: 5236139 - DNA, 13 bp, Homo sapiens
agtttgtaaaaat

SEQ ID NO: 5236140 - DNA, 13 bp, Homo sapiens
agtttgtaaagtc

SEQ ID NO: 5236141 - DNA, 17 bp, Homo sapiens
agtttgtaaatattcta

SEQ ID NO: 5236142 - DNA, 21 bp, Homo sapiens
agtttgtaaatgactttcata

SEQ ID NO: 5236143 - DNA, 14 bp, Homo sapiens
agtttgtaaatgtt

SEQ ID NO: 5236144 - DNA, 22 bp, Homo sapiens
agtttgtaaatgttatttctgc

SEQ ID NO: 5236145 - DNA, 23 bp, Homo sapiens
agtttgtaaatgttatttctgca

SEQ ID NO: 5236146 - DNA, 17 bp, Homo sapiens
agtttgtagaactttat

SEQ ID NO: 5236147 - DNA, 12 bp, Homo sapiens
agtttgtagcca

SEQ ID NO: 5236148 - DNA, 19 bp, Homo sapiens
agtttgtaggtaaaatgta

SEQ ID NO: 5236149 - DNA, 20 bp, Homo sapiens
agtttgtaggtaaaatgtat

SEQ ID NO: 5236150 - DNA, 17 bp, Homo sapiens
agtttgtagtaaatatt

SEQ ID NO: 5236151 - DNA, 17 bp, Homo sapiens
agtttgtagttgtttta

SEQ ID NO: 5236152 - DNA, 15 bp, Homo sapiens
agtttgtagtttttg

SEQ ID NO: 5236153 - DNA, 14 bp, Homo sapiens
agtttgtataactt

SEQ ID NO: 5236154 - DNA, 22 bp, Homo sapiens
agtttgtatgccaagtgagaag

SEQ ID NO: 5236155 - DNA, 14 bp, Homo sapiens
agtttgtattttgc

SEQ ID NO: 5236156 - DNA, 15 bp, Homo sapiens
agtttgtattttgca

SEQ ID NO: 5236157 - DNA, 16 bp, Homo sapiens
agtttgtccatttgta

SEQ ID NO: 5236158 - DNA, 16 bp, Homo sapiens
agtttgtctattttaa

SEQ ID NO: 5236159 - DNA, 21 bp, Homo sapiens
agtttgtgaagtgattgacat

SEQ ID NO: 5236160 - DNA, 14 bp, Homo sapiens
agtttgtgagaaac

SEQ ID NO: 5236161 - DNA, 21 bp, Homo sapiens
agtttgtgtatatattataaa

SEQ ID NO: 5236162 - DNA, 21 bp, Homo sapiens
agtttgtgtctgttgcttgta

SEQ ID NO: 5236163 - DNA, 17 bp, Homo sapiens
agtttgtgtgtatttgt

SEQ ID NO: 5236164 - DNA, 22 bp, Homo sapiens
agtttgtgtgtatttgtattaa

SEQ ID NO: 5236165 - DNA, 14 bp, Homo sapiens
agtttgtgtgttgt

SEQ ID NO: 5236166 - DNA, 16 bp, Homo sapiens
agtttgtgtgttgtct

SEQ ID NO: 5236167 - DNA, 20 bp, Homo sapiens
agtttgtgtgttgtcttgaa

SEQ ID NO: 5236168 - DNA, 21 bp, Homo sapiens
agtttgtgtgttgtgtccatt

SEQ ID NO: 5236169 - DNA, 14 bp, Homo sapiens
agtttgtgttttaa

SEQ ID NO: 5236170 - DNA, 17 bp, Homo sapiens
agtttgtgttttaaaaa

SEQ ID NO: 5236171 - DNA, 19 bp, Homo sapiens
agtttgttatgtgtctgga

SEQ ID NO: 5236172 - DNA, 22 bp, Homo sapiens
agtttgttatgtgtctggaaga

SEQ ID NO: 5236173 - DNA, 21 bp, Homo sapiens
agtttgttatgtgtgtatgtt

SEQ ID NO: 5236174 - DNA, 21 bp, Homo sapiens
agtttgttctccgggtgtggc

SEQ ID NO: 5236175 - DNA, 15 bp, Homo sapiens
agtttgttgaaacac

SEQ ID NO: 5236176 - DNA, 17 bp, Homo sapiens
agtttgttgctgtcaag

SEQ ID NO: 5236177 - DNA, 20 bp, Homo sapiens
agtttgtttaatgtgaactt

SEQ ID NO: 5236178 - DNA, 13 bp, Homo sapiens
agtttgtttactt

SEQ ID NO: 5236179 - DNA, 18 bp, Homo sapiens
agtttgtttcctgtctga

SEQ ID NO: 5236180 - DNA, 20 bp, Homo sapiens
agtttgtttctttgaatttt

SEQ ID NO: 5236181 - DNA, 23 bp, Homo sapiens
agtttgtttctttgaattttcat

SEQ ID NO: 5236182 - DNA, 12 bp, Homo sapiens
agtttgttttag

SEQ ID NO: 5236183 - DNA, 12 bp, Homo sapiens
agtttgttttct

SEQ ID NO: 5236184 - DNA, 13 bp, Homo sapiens
agtttgttttctt

SEQ ID NO: 5236185 - DNA, 18 bp, Homo sapiens
agtttgttttctttttct

SEQ ID NO: 5236186 - DNA, 22 bp, Homo sapiens
agttttaaaaagccagtttggg

SEQ ID NO: 5236187 - DNA, 13 bp, Homo sapiens
agttttaaaactc

SEQ ID NO: 5236188 - DNA, 23 bp, Homo sapiens
agttttaaactcatttttgccat

SEQ ID NO: 5236189 - DNA, 14 bp, Homo sapiens
agttttaaagaagt

SEQ ID NO: 5236190 - DNA, 11 bp, Homo sapiens
agttttaaata

SEQ ID NO: 5236191 - DNA, 16 bp, Homo sapiens
agttttaaatatgaac

SEQ ID NO: 5236192 - DNA, 18 bp, Homo sapiens
agttttaaatatgaacaa

SEQ ID NO: 5236193 - DNA, 13 bp, Homo sapiens
agttttaactgtg

SEQ ID NO: 5236194 - DNA, 18 bp, Homo sapiens
agttttaactgtggatat

SEQ ID NO: 5236195 - DNA, 20 bp, Homo sapiens
agttttaattcaacatcaaa

SEQ ID NO: 5236196 - DNA, 13 bp, Homo sapiens
agttttacaaagg

SEQ ID NO: 5236197 - DNA, 13 bp, Homo sapiens
agttttacagatt

SEQ ID NO: 5236198 - DNA, 15 bp, Homo sapiens
agttttacagtgttt

SEQ ID NO: 5236199 - DNA, 23 bp, Homo sapiens
atagattcacctgtaaaacttta

SEQ ID NO: 5236200 - DNA, 15 bp, Homo sapiens
atagattcagagaaa

SEQ ID NO: 5236201 - DNA, 16 bp, Homo sapiens
atagattcagagaaat

SEQ ID NO: 5236202 - DNA, 16 bp, Homo sapiens
atagattctaaagatt

SEQ ID NO: 5236203 - DNA, 13 bp, Homo sapiens
atagattgattta

SEQ ID NO: 5236204 - DNA, 14 bp, Homo sapiens
atagattgcaaata

SEQ ID NO: 5236205 - DNA, 21 bp, Homo sapiens
atagattgcaaatattggtta

SEQ ID NO: 5236206 - DNA, 17 bp, Homo sapiens
atagattgctcaaatca

SEQ ID NO: 5236207 - DNA, 19 bp, Homo sapiens
atagattgtaatacacata

SEQ ID NO: 5236208 - DNA, 21 bp, Homo sapiens
atagattgtaatacacatatc

SEQ ID NO: 5236209 - DNA, 14 bp, Homo sapiens
atagattgtccttt

SEQ ID NO: 5236210 - DNA, 16 bp, Homo sapiens
atagattgtcttaatg

SEQ ID NO: 5236211 - DNA, 15 bp, Homo sapiens
atagattgtgaataa

SEQ ID NO: 5236212 - DNA, 14 bp, Homo sapiens
atagattgttttgc

SEQ ID NO: 5236213 - DNA, 20 bp, Homo sapiens
atagatttagttttgtaact

SEQ ID NO: 5236214 - DNA, 21 bp, Homo sapiens
atagatttagttttgtaactt

SEQ ID NO: 5236215 - DNA, 15 bp, Homo sapiens
atagatttattttac

SEQ ID NO: 5236216 - DNA, 16 bp, Homo sapiens
atagatttattttaca

SEQ ID NO: 5236217 - DNA, 19 bp, Homo sapiens
atagatttattttacattt

SEQ ID NO: 5236218 - DNA, 21 bp, Homo sapiens
atagatttctgattttatgta

SEQ ID NO: 5236219 - DNA, 13 bp, Homo sapiens
atagatttgaaga

SEQ ID NO: 5236220 - DNA, 14 bp, Homo sapiens
atagatttgacctc

SEQ ID NO: 5236221 - DNA, 15 bp, Homo sapiens
atagatttgacctcc

SEQ ID NO: 5236222 - DNA, 14 bp, Homo sapiens
atagatttgattat

SEQ ID NO: 5236223 - DNA, 18 bp, Homo sapiens
atagatttgtattttaaa

SEQ ID NO: 5236224 - DNA, 17 bp, Homo sapiens
atagattttctctggaa

SEQ ID NO: 5236225 - DNA, 21 bp, Homo sapiens
atagattttctctggaaataa

SEQ ID NO: 5236226 - DNA, 16 bp, Homo sapiens
atagcaaaaatgtttt

SEQ ID NO: 5236227 - DNA, 16 bp, Homo sapiens
atagcaaacttggaat

SEQ ID NO: 5236228 - DNA, 15 bp, Homo sapiens
atagcaaagaattga

SEQ ID NO: 5236229 - DNA, 19 bp, Homo sapiens
atagcaaagatatatattc

SEQ ID NO: 5236230 - DNA, 22 bp, Homo sapiens
atagcaaagcgacgttagtcgt

SEQ ID NO: 5236231 - DNA, 14 bp, Homo sapiens
atagcaaagtagta

SEQ ID NO: 5236232 - DNA, 17 bp, Homo sapiens
atagcaaagttatctta

SEQ ID NO: 5236233 - DNA, 19 bp, Homo sapiens
atagcaaagttatcttaaa

SEQ ID NO: 5236234 - DNA, 20 bp, Homo sapiens
atagcaaagttatcttaaat

SEQ ID NO: 5236235 - DNA, 14 bp, Homo sapiens
atagcaaatgacat

SEQ ID NO: 5236236 - DNA, 19 bp, Homo sapiens
atagcaacaacaattggta

SEQ ID NO: 5236237 - DNA, 16 bp, Homo sapiens
atagcaacactctata

SEQ ID NO: 5236238 - DNA, 15 bp, Homo sapiens
atagcaacaggaaaa

SEQ ID NO: 5236239 - DNA, 18 bp, Homo sapiens
atagcaacctatttgact

SEQ ID NO: 5236240 - DNA, 16 bp, Homo sapiens
atagcaactaatgttt

SEQ ID NO: 5236241 - DNA, 16 bp, Homo sapiens
atagcaagacattata

SEQ ID NO: 5236242 - DNA, 21 bp, Homo sapiens
atagcaagatattgatcaaat

SEQ ID NO: 5236243 - DNA, 17 bp, Homo sapiens
atagcaagattgcttaa

SEQ ID NO: 5236244 - DNA, 15 bp, Homo sapiens
atagcaaggccaggg

SEQ ID NO: 5236245 - DNA, 22 bp, Homo sapiens
atagcaagtcccatcagcctat

SEQ ID NO: 5236246 - DNA, 20 bp, Homo sapiens
atagcaagtgctatttcagc

SEQ ID NO: 5236247 - DNA, 11 bp, Homo sapiens
atagcaataac

SEQ ID NO: 5236248 - DNA, 16 bp, Homo sapiens
atagcaataactgaaa

SEQ ID NO: 5236249 - DNA, 21 bp, Homo sapiens
atagcaataactgaaaatgaa

SEQ ID NO: 5236250 - DNA, 22 bp, Homo sapiens
atagcaatccatgttagttttt

SEQ ID NO: 5236251 - DNA, 17 bp, Homo sapiens
atagcaattagcagaag

SEQ ID NO: 5236252 - DNA, 15 bp, Homo sapiens
atagcacaagataaa

SEQ ID NO: 5236253 - DNA, 14 bp, Homo sapiens
atagcacagaccct

SEQ ID NO: 5236254 - DNA, 16 bp, Homo sapiens
atagcacatgatttgg

SEQ ID NO: 5236255 - DNA, 18 bp, Homo sapiens
atagcacatgattttctt

SEQ ID NO: 5236256 - DNA, 15 bp, Homo sapiens
atagcacatgtttta

SEQ ID NO: 5236257 - DNA, 21 bp, Homo sapiens
atagcacccgtggtgcatggt

SEQ ID NO: 5236258 - DNA, 21 bp, Homo sapiens
atagcaccctgccctcatggg

SEQ ID NO: 5236259 - DNA, 15 bp, Homo sapiens
atagcacctttcaac

SEQ ID NO: 5236260 - DNA, 19 bp, Homo sapiens
atagcactaaccaatgcct

SEQ ID NO: 5236261 - DNA, 20 bp, Homo sapiens
atagcactaaccaatgcctt

SEQ ID NO: 5236262 - DNA, 13 bp, Homo sapiens
atagcactttgaa

SEQ ID NO: 5236263 - DNA, 20 bp, Homo sapiens
atagcactttgaaatacctc

SEQ ID NO: 5236264 - DNA, 18 bp, Homo sapiens
atagcagacattgttaca

SEQ ID NO: 5236265 - DNA, 21 bp, Homo sapiens
atagcagactttcccaaatgt

SEQ ID NO: 5236266 - DNA, 19 bp, Homo sapiens
atagcagagagccaaatct

SEQ ID NO: 5236267 - DNA, 21 bp, Homo sapiens
atagcagaggggccaggccca

SEQ ID NO: 5236268 - DNA, 19 bp, Homo sapiens
atagcagaggtttaaatgt

SEQ ID NO: 5236269 - DNA, 20 bp, Homo sapiens
atagcagcaaaaatataaaa

SEQ ID NO: 5236270 - DNA, 13 bp, Homo sapiens
atagcagcctttc

SEQ ID NO: 5236271 - DNA, 22 bp, Homo sapiens
atagcaggtgtaataagactat

SEQ ID NO: 5236272 - DNA, 16 bp, Homo sapiens
atagcagtagtctttt

SEQ ID NO: 5236273 - DNA, 22 bp, Homo sapiens
atagcagtatatgttaatttgt

SEQ ID NO: 5236274 - DNA, 19 bp, Homo sapiens
atagcagtggcaaaatatt

SEQ ID NO: 5236275 - DNA, 21 bp, Homo sapiens
atagcagtggcaaaatattat

SEQ ID NO: 5236276 - DNA, 16 bp, Homo sapiens
atagcagttataacag

SEQ ID NO: 5236277 - DNA, 20 bp, Homo sapiens
atagcataaaatgaaatgct

SEQ ID NO: 5236278 - DNA, 22 bp, Homo sapiens
atagcataatatgaagcctttg

SEQ ID NO: 5236279 - DNA, 19 bp, Homo sapiens
atagcatacaccaaacatt

SEQ ID NO: 5236280 - DNA, 21 bp, Homo sapiens
atagcatacaccaaacatttc

SEQ ID NO: 5236281 - DNA, 17 bp, Homo sapiens
atagcatactgtgtatg

SEQ ID NO: 5236282 - DNA, 15 bp, Homo sapiens
atagcataggctggg

SEQ ID NO: 5236283 - DNA, 21 bp, Homo sapiens
atagcatatattcatacctgt

SEQ ID NO: 5236284 - DNA, 13 bp, Homo sapiens
atagcatcactta

SEQ ID NO: 5236285 - DNA, 15 bp, Homo sapiens
atagcatcacttaaa

SEQ ID NO: 5236286 - DNA, 14 bp, Homo sapiens
atagcatctttcat

SEQ ID NO: 5236287 - DNA, 17 bp, Homo sapiens
atagcatctttcatatg

SEQ ID NO: 5236288 - DNA, 15 bp, Homo sapiens
atagcatgaaataaa

SEQ ID NO: 5236289 - DNA, 20 bp, Homo sapiens
atagcatgacaggctgttca

SEQ ID NO: 5236290 - DNA, 18 bp, Homo sapiens
atagcatgcttcctttct

SEQ ID NO: 5236291 - DNA, 22 bp, Homo sapiens
atagcatggggcccctggccca

SEQ ID NO: 5236292 - DNA, 10 bp, Homo sapiens
atagcatgta

SEQ ID NO: 5236293 - DNA, 20 bp, Homo sapiens
atagcatgtaatattaaatt

SEQ ID NO: 5236294 - DNA, 13 bp, Homo sapiens
atagcatgtaatg

SEQ ID NO: 5236295 - DNA, 14 bp, Homo sapiens
atagcatgtattgt

SEQ ID NO: 5236296 - DNA, 22 bp, Homo sapiens
atagcatgtattgtgtcttttg

SEQ ID NO: 5236297 - DNA, 12 bp, Homo sapiens
atagcatgtcaa

SEQ ID NO: 5236298 - DNA, 14 bp, Homo sapiens
atagcattaataaa

SEQ ID NO: 5236299 - DNA, 22 bp, Homo sapiens
atagcattatcttatcatttat

SEQ ID NO: 5236300 - DNA, 16 bp, Homo sapiens
atagcattgaacattt

SEQ ID NO: 5236301 - DNA, 23 bp, Homo sapiens
atagcattgaacatttcttatga

SEQ ID NO: 5236302 - DNA, 19 bp, Homo sapiens
atagcattgataatcttca

SEQ ID NO: 5236303 - DNA, 12 bp, Homo sapiens
atagcattgctt

SEQ ID NO: 5236304 - DNA, 19 bp, Homo sapiens
atagcattggggacatggg

SEQ ID NO: 5236305 - DNA, 15 bp, Homo sapiens
atagcattgtaaaag

SEQ ID NO: 5236306 - DNA, 15 bp, Homo sapiens
atagcattgtgaact

SEQ ID NO: 5236307 - DNA, 14 bp, Homo sapiens
atagcattgttctt

SEQ ID NO: 5236308 - DNA, 16 bp, Homo sapiens
atagcattgttcttct

SEQ ID NO: 5236309 - DNA, 18 bp, Homo sapiens
atagcattgtttttgtca

SEQ ID NO: 5236310 - DNA, 17 bp, Homo sapiens
atagcatttctagaaca

SEQ ID NO: 5236311 - DNA, 18 bp, Homo sapiens
atagcatttttgatttat

SEQ ID NO: 5236312 - DNA, 15 bp, Homo sapiens
atagcatttttgtaa

SEQ ID NO: 5236313 - DNA, 15 bp, Homo sapiens
atagccaaaaatagc

SEQ ID NO: 5236314 - DNA, 18 bp, Homo sapiens
atagccaaaaatagctaa

SEQ ID NO: 5236315 - DNA, 15 bp, Homo sapiens
atagccaaagctgtt

SEQ ID NO: 5236316 - DNA, 22 bp, Homo sapiens
atagccaactgctaatgcaaat

SEQ ID NO: 5236317 - DNA, 23 bp, Homo sapiens
atagccaactgctaatgcaaatt

SEQ ID NO: 5236318 - DNA, 21 bp, Homo sapiens
atagccacatttggaatactt

SEQ ID NO: 5236319 - DNA, 23 bp, Homo sapiens
atagccacatttggaatactttt

SEQ ID NO: 5236320 - DNA, 15 bp, Homo sapiens
atagccactaacctt

SEQ ID NO: 5236321 - DNA, 21 bp, Homo sapiens
atagccactaaccttgcctgg

SEQ ID NO: 5236322 - DNA, 22 bp, Homo sapiens
atagccactaaccttgcctggt

SEQ ID NO: 5236323 - DNA, 21 bp, Homo sapiens
atagccacttaccttcaataa

SEQ ID NO: 5236324 - DNA, 11 bp, Homo sapiens
atagccagaga

SEQ ID NO: 5236325 - DNA, 20 bp, Homo sapiens
atagccaggagcgcatctca

SEQ ID NO: 5236326 - DNA, 21 bp, Homo sapiens
atagccaggagcgcatctcaa

SEQ ID NO: 5236327 - DNA, 21 bp, Homo sapiens
atagccatttccatggctctg

SEQ ID NO: 5236328 - DNA, 14 bp, Homo sapiens
atagccatttgccc

SEQ ID NO: 5236329 - DNA, 22 bp, Homo sapiens
atagcccaaagccaagaaagaa

SEQ ID NO: 5236330 - DNA, 21 bp, Homo sapiens
atagcccaggatatattttat

SEQ ID NO: 5236331 - DNA, 18 bp, Homo sapiens
atagccccaggcccgccc

SEQ ID NO: 5236332 - DNA, 15 bp, Homo sapiens
atagcccccactgcc

SEQ ID NO: 5236333 - DNA, 18 bp, Homo sapiens
atagcccccactgcctgg

SEQ ID NO: 5236334 - DNA, 19 bp, Homo sapiens
atagccctccccctcaacc

SEQ ID NO: 5236335 - DNA, 19 bp, Homo sapiens
atagccctgcaaaaattca

SEQ ID NO: 5236336 - DNA, 22 bp, Homo sapiens
atagccctgccctcccaagtcc

SEQ ID NO: 5236337 - DNA, 15 bp, Homo sapiens
atagccctgtcctgg

SEQ ID NO: 5236338 - DNA, 22 bp, Homo sapiens
atagccctgtgaagttcttaaa

SEQ ID NO: 5236339 - DNA, 17 bp, Homo sapiens
atagccctgttgacctg

SEQ ID NO: 5236340 - DNA, 23 bp, Homo sapiens
atagcctaaaagattttgtgaaa

SEQ ID NO: 5236341 - DNA, 23 bp, Homo sapiens
atagcctagggtgagggtgacag

SEQ ID NO: 5236342 - DNA, 17 bp, Homo sapiens
atagcctaggtgacaga

SEQ ID NO: 5236343 - DNA, 19 bp, Homo sapiens
atagcctatatttacagtg

SEQ ID NO: 5236344 - DNA, 19 bp, Homo sapiens
atagcctatggcagaaaaa

SEQ ID NO: 5236345 - DNA, 13 bp, Homo sapiens
atagcctcagcca

SEQ ID NO: 5236346 - DNA, 23 bp, Homo sapiens
atagcctctgtctggcaatgcca

SEQ ID NO: 5236347 - DNA, 15 bp, Homo sapiens
atagcctgaatttga

SEQ ID NO: 5236348 - DNA, 20 bp, Homo sapiens
atagcctgcctcagtggcag

SEQ ID NO: 5236349 - DNA, 22 bp, Homo sapiens
atagcctgcctcagtggcagca

SEQ ID NO: 5236350 - DNA, 18 bp, Homo sapiens
atagcctgcctcttctct

SEQ ID NO: 5236351 - DNA, 20 bp, Homo sapiens
atagcctgcctgatccctga

SEQ ID NO: 5236352 - DNA, 20 bp, Homo sapiens
atagcctggccaccagccat

SEQ ID NO: 5236353 - DNA, 21 bp, Homo sapiens
atagcctgtatggtttctact

SEQ ID NO: 5236354 - DNA, 13 bp, Homo sapiens
atagcctgtggcc

SEQ ID NO: 5236355 - DNA, 15 bp, Homo sapiens
atagccttgaaaaca

SEQ ID NO: 5236356 - DNA, 22 bp, Homo sapiens
atagcctttaaatcatttttat

SEQ ID NO: 5236357 - DNA, 12 bp, Homo sapiens
atagcctttgta

SEQ ID NO: 5236358 - DNA, 13 bp, Homo sapiens
atagcctttgtag

SEQ ID NO: 5236359 - DNA, 14 bp, Homo sapiens
atagcctttgtagg

SEQ ID NO: 5236360 - DNA, 17 bp, Homo sapiens
atagcgcctgtataagt

SEQ ID NO: 5236361 - DNA, 13 bp, Homo sapiens
atagcgctggctc

SEQ ID NO: 5236362 - DNA, 14 bp, Homo sapiens
atagcgctggctca

SEQ ID NO: 5236363 - DNA, 18 bp, Homo sapiens
atagcgctggctcaggaa

SEQ ID NO: 5236364 - DNA, 19 bp, Homo sapiens
atagcgctggctcaggaag

SEQ ID NO: 5236365 - DNA, 21 bp, Homo sapiens
atagcgctgtttttgttgtgt

SEQ ID NO: 5236366 - DNA, 15 bp, Homo sapiens
atagcggccctggag

SEQ ID NO: 5236367 - DNA, 14 bp, Homo sapiens
atagcgtcctgccc

SEQ ID NO: 5236368 - DNA, 17 bp, Homo sapiens
atagcgtcctgccctgc

SEQ ID NO: 5236369 - DNA, 12 bp, Homo sapiens
atagcgtgtgta

SEQ ID NO: 5236370 - DNA, 13 bp, Homo sapiens
atagcgttcttgt

SEQ ID NO: 5236371 - DNA, 18 bp, Homo sapiens
atagcgttcttgtaattt

SEQ ID NO: 5236372 - DNA, 21 bp, Homo sapiens
atagcgttggaattaaaacaa

SEQ ID NO: 5236373 - DNA, 23 bp, Homo sapiens
atagctaacattttaaataaaag

SEQ ID NO: 5236374 - DNA, 14 bp, Homo sapiens
atagctaactgtaa

SEQ ID NO: 5236375 - DNA, 17 bp, Homo sapiens
atagctaactgtaaatc

SEQ ID NO: 5236376 - DNA, 21 bp, Homo sapiens
atagctaagaaataaaactgt

SEQ ID NO: 5236377 - DNA, 16 bp, Homo sapiens
agttttactcctcagt

SEQ ID NO: 5236378 - DNA, 15 bp, Homo sapiens
agttttactcttaaa

SEQ ID NO: 5236379 - DNA, 18 bp, Homo sapiens
agttttactcttaaatca

SEQ ID NO: 5236380 - DNA, 19 bp, Homo sapiens
agttttactcttaaatcat

SEQ ID NO: 5236381 - DNA, 23 bp, Homo sapiens
agttttactcttaaatcatttgg

SEQ ID NO: 5236382 - DNA, 23 bp, Homo sapiens
agttttactcttgttgcccaggc

SEQ ID NO: 5236383 - DNA, 19 bp, Homo sapiens
agttttactgcattttcac

SEQ ID NO: 5236384 - DNA, 15 bp, Homo sapiens
agttttactgtgatt

SEQ ID NO: 5236385 - DNA, 20 bp, Homo sapiens
agttttacttttaaactgtg

SEQ ID NO: 5236386 - DNA, 18 bp, Homo sapiens
agttttagaataaggagg

SEQ ID NO: 5236387 - DNA, 14 bp, Homo sapiens
agttttagacctca

SEQ ID NO: 5236388 - DNA, 18 bp, Homo sapiens
agttttagattattttat

SEQ ID NO: 5236389 - DNA, 18 bp, Homo sapiens
agttttagctgtagatca

SEQ ID NO: 5236390 - DNA, 17 bp, Homo sapiens
agttttagttaaaactc

SEQ ID NO: 5236391 - DNA, 15 bp, Homo sapiens
agttttagttgcaga

SEQ ID NO: 5236392 - DNA, 21 bp, Homo sapiens
agttttagttgcagaaacatt

SEQ ID NO: 5236393 - DNA, 15 bp, Homo sapiens
agttttataaaactc

SEQ ID NO: 5236394 - DNA, 24 bp, Homo sapiens
agttttataatccttaaatcttaa

SEQ ID NO: 5236395 - DNA, 22 bp, Homo sapiens
agttttatacataaacagtttt

SEQ ID NO: 5236396 - DNA, 17 bp, Homo sapiens
agttttatacccttttt

SEQ ID NO: 5236397 - DNA, 20 bp, Homo sapiens
agttttataccctttttcat

SEQ ID NO: 5236398 - DNA, 19 bp, Homo sapiens
agttttatagcctggactg

SEQ ID NO: 5236399 - DNA, 12 bp, Homo sapiens
agttttatatat

SEQ ID NO: 5236400 - DNA, 17 bp, Homo sapiens
agttttatatgctttat

SEQ ID NO: 5236401 - DNA, 13 bp, Homo sapiens
agttttatcacat

SEQ ID NO: 5236402 - DNA, 17 bp, Homo sapiens
agttttatcacatgtat

SEQ ID NO: 5236403 - DNA, 21 bp, Homo sapiens
agttttatcacatgtatgttt

SEQ ID NO: 5236404 - DNA, 20 bp, Homo sapiens
agttttatcattttcaaaat

SEQ ID NO: 5236405 - DNA, 15 bp, Homo sapiens
agttttatccataat

SEQ ID NO: 5236406 - DNA, 16 bp, Homo sapiens
agttttatccataatg

SEQ ID NO: 5236407 - DNA, 20 bp, Homo sapiens
agttttatggcatgatttat

SEQ ID NO: 5236408 - DNA, 14 bp, Homo sapiens
agttttatgtttct

SEQ ID NO: 5236409 - DNA, 21 bp, Homo sapiens
agttttattgagaattttaaa

SEQ ID NO: 5236410 - DNA, 19 bp, Homo sapiens
agttttattgatgtgaaat

SEQ ID NO: 5236411 - DNA, 15 bp, Homo sapiens
agttttatttatatt

SEQ ID NO: 5236412 - DNA, 17 bp, Homo sapiens
agttttatttatattta

SEQ ID NO: 5236413 - DNA, 18 bp, Homo sapiens
agttttatttatatttat

SEQ ID NO: 5236414 - DNA, 19 bp, Homo sapiens
agttttatttatatttatt

SEQ ID NO: 5236415 - DNA, 15 bp, Homo sapiens
agttttatttgtatt

SEQ ID NO: 5236416 - DNA, 14 bp, Homo sapiens
agttttattttaaa

SEQ ID NO: 5236417 - DNA, 14 bp, Homo sapiens
agttttattttaat

SEQ ID NO: 5236418 - DNA, 14 bp, Homo sapiens
agttttattttcca

SEQ ID NO: 5236419 - DNA, 20 bp, Homo sapiens
agttttattttctaaagtac

SEQ ID NO: 5236420 - DNA, 21 bp, Homo sapiens
agttttattttctaaagtact

SEQ ID NO: 5236421 - DNA, 19 bp, Homo sapiens
agttttattttctaaattc

SEQ ID NO: 5236422 - DNA, 16 bp, Homo sapiens
agttttatttttaaga

SEQ ID NO: 5236423 - DNA, 22 bp, Homo sapiens
agttttcaaactgctgcatact

SEQ ID NO: 5236424 - DNA, 17 bp, Homo sapiens
agttttcaagcattgct

SEQ ID NO: 5236425 - DNA, 22 bp, Homo sapiens
agttttcaagtcaaattaataa

SEQ ID NO: 5236426 - DNA, 17 bp, Homo sapiens
agttttcacctcgaatt

SEQ ID NO: 5236427 - DNA, 22 bp, Homo sapiens
agttttcactcttattgcccac

SEQ ID NO: 5236428 - DNA, 18 bp, Homo sapiens
agttttcagaaaaagaaa

SEQ ID NO: 5236429 - DNA, 22 bp, Homo sapiens
agttttcagaacctcttcccca

SEQ ID NO: 5236430 - DNA, 12 bp, Homo sapiens
agttttcagatt

SEQ ID NO: 5236431 - DNA, 11 bp, Homo sapiens
agttttcagtt

SEQ ID NO: 5236432 - DNA, 14 bp, Homo sapiens
agttttcatgtgct

SEQ ID NO: 5236433 - DNA, 13 bp, Homo sapiens
agttttcattgat

SEQ ID NO: 5236434 - DNA, 15 bp, Homo sapiens
agttttccagtattg

SEQ ID NO: 5236435 - DNA, 22 bp, Homo sapiens
agttttccatggcaggaaggct

SEQ ID NO: 5236436 - DNA, 16 bp, Homo sapiens
agttttcccctggcct

SEQ ID NO: 5236437 - DNA, 18 bp, Homo sapiens
agttttcccctggcctca

SEQ ID NO: 5236438 - DNA, 11 bp, Homo sapiens
agttttcccta

SEQ ID NO: 5236439 - DNA, 21 bp, Homo sapiens
agttttccctgcactgtgtca

SEQ ID NO: 5236440 - DNA, 18 bp, Homo sapiens
agttttcccttgaggaaa

SEQ ID NO: 5236441 - DNA, 20 bp, Homo sapiens
agttttccgaagtctctgat

SEQ ID NO: 5236442 - DNA, 18 bp, Homo sapiens
agttttccggtagagttg

SEQ ID NO: 5236443 - DNA, 18 bp, Homo sapiens
agttttcctatgctttga

SEQ ID NO: 5236444 - DNA, 22 bp, Homo sapiens
agttttcctctatacatctctc

SEQ ID NO: 5236445 - DNA, 11 bp, Homo sapiens
agttttcctga

SEQ ID NO: 5236446 - DNA, 22 bp, Homo sapiens
agttttccttctcatctgtgat

SEQ ID NO: 5236447 - DNA, 16 bp, Homo sapiens
agttttccttctgtta

SEQ ID NO: 5236448 - DNA, 21 bp, Homo sapiens
agttttccttctgttaaaatg

SEQ ID NO: 5236449 - DNA, 13 bp, Homo sapiens
agttttccttgct

SEQ ID NO: 5236450 - DNA, 19 bp, Homo sapiens
agttttccttgctatttca

SEQ ID NO: 5236451 - DNA, 16 bp, Homo sapiens
agttttctaaatgttt

SEQ ID NO: 5236452 - DNA, 12 bp, Homo sapiens
agttttctagac

SEQ ID NO: 5236453 - DNA, 19 bp, Homo sapiens
agttttctagcaattttct

SEQ ID NO: 5236454 - DNA, 17 bp, Homo sapiens
agttttctccttttact

SEQ ID NO: 5236455 - DNA, 23 bp, Homo sapiens
agttttctgtgagaataaagcat

SEQ ID NO: 5236456 - DNA, 20 bp, Homo sapiens
agttttcttatatatatatt

SEQ ID NO: 5236457 - DNA, 14 bp, Homo sapiens
agttttcttctgtg

SEQ ID NO: 5236458 - DNA, 23 bp, Homo sapiens
agttttcttggtggcagaatgaa

SEQ ID NO: 5236459 - DNA, 17 bp, Homo sapiens
agttttctttgtaaagg

SEQ ID NO: 5236460 - DNA, 16 bp, Homo sapiens
agttttcttttactat

SEQ ID NO: 5236461 - DNA, 12 bp, Homo sapiens
agttttcttttt

SEQ ID NO: 5236462 - DNA, 18 bp, Homo sapiens
agttttcttttttaaatt

SEQ ID NO: 5236463 - DNA, 14 bp, Homo sapiens
agttttgaaagaaa

SEQ ID NO: 5236464 - DNA, 18 bp, Homo sapiens
agttttgaaatgaaaatc

SEQ ID NO: 5236465 - DNA, 18 bp, Homo sapiens
agttttgaagattctatg

SEQ ID NO: 5236466 - DNA, 13 bp, Homo sapiens
agttttgaatgtt

SEQ ID NO: 5236467 - DNA, 19 bp, Homo sapiens
agttttgacaagctggctt

SEQ ID NO: 5236468 - DNA, 20 bp, Homo sapiens
agttttgacggtttatgctg

SEQ ID NO: 5236469 - DNA, 17 bp, Homo sapiens
agttttgagtaattcaa

SEQ ID NO: 5236470 - DNA, 18 bp, Homo sapiens
agttttgagtgtactgtg

SEQ ID NO: 5236471 - DNA, 15 bp, Homo sapiens
agttttgatacttgt

SEQ ID NO: 5236472 - DNA, 18 bp, Homo sapiens
agttttgatataatcttg

SEQ ID NO: 5236473 - DNA, 15 bp, Homo sapiens
agttttgatgaaatt

SEQ ID NO: 5236474 - DNA, 21 bp, Homo sapiens
agttttgatgaaattcttgaa

SEQ ID NO: 5236475 - DNA, 21 bp, Homo sapiens
agttttgatgactggcatttt

SEQ ID NO: 5236476 - DNA, 19 bp, Homo sapiens
agttttgatgctgtatttg

SEQ ID NO: 5236477 - DNA, 20 bp, Homo sapiens
agttttgattaatgtttctt

SEQ ID NO: 5236478 - DNA, 24 bp, Homo sapiens
agttttgattaatgtttcttaaat

SEQ ID NO: 5236479 - DNA, 15 bp, Homo sapiens
agttttgctgtctct

SEQ ID NO: 5236480 - DNA, 13 bp, Homo sapiens
agttttgctttgt

SEQ ID NO: 5236481 - DNA, 22 bp, Homo sapiens
agttttgctttgttgaataata

SEQ ID NO: 5236482 - DNA, 21 bp, Homo sapiens
agttttgcttttagtttttct

SEQ ID NO: 5236483 - DNA, 15 bp, Homo sapiens
agttttggaggctga

SEQ ID NO: 5236484 - DNA, 15 bp, Homo sapiens
agttttggatgcagt

SEQ ID NO: 5236485 - DNA, 14 bp, Homo sapiens
agttttgggagggg

SEQ ID NO: 5236486 - DNA, 21 bp, Homo sapiens
agttttgggaggggatggcag

SEQ ID NO: 5236487 - DNA, 23 bp, Homo sapiens
agttttgggaggggatggcagac

SEQ ID NO: 5236488 - DNA, 17 bp, Homo sapiens
agttttggttatttcta

SEQ ID NO: 5236489 - DNA, 22 bp, Homo sapiens
agttttgtaaaaactgaagaat

SEQ ID NO: 5236490 - DNA, 15 bp, Homo sapiens
agttttgtaaatgta

SEQ ID NO: 5236491 - DNA, 15 bp, Homo sapiens
agttttgtaaatttc

SEQ ID NO: 5236492 - DNA, 13 bp, Homo sapiens
agttttgtaactt

SEQ ID NO: 5236493 - DNA, 19 bp, Homo sapiens
agttttgtaacttagcttt

SEQ ID NO: 5236494 - DNA, 21 bp, Homo sapiens
agttttgtacaaagttttcct

SEQ ID NO: 5236495 - DNA, 14 bp, Homo sapiens
agttttgtattcat

SEQ ID NO: 5236496 - DNA, 13 bp, Homo sapiens
agttttgtcttga

SEQ ID NO: 5236497 - DNA, 18 bp, Homo sapiens
agttttgtgatgcatttt

SEQ ID NO: 5236498 - DNA, 19 bp, Homo sapiens
agttttgtgtttgttgtag

SEQ ID NO: 5236499 - DNA, 15 bp, Homo sapiens
agttttgttccaaca

SEQ ID NO: 5236500 - DNA, 16 bp, Homo sapiens
agttttgttctgtata

SEQ ID NO: 5236501 - DNA, 19 bp, Homo sapiens
agttttgttcttttataga

SEQ ID NO: 5236502 - DNA, 15 bp, Homo sapiens
agttttgtttatgca

SEQ ID NO: 5236503 - DNA, 16 bp, Homo sapiens
agttttgtttcctcat

SEQ ID NO: 5236504 - DNA, 12 bp, Homo sapiens
agttttgtttgg

SEQ ID NO: 5236505 - DNA, 14 bp, Homo sapiens
agttttgtttggac

SEQ ID NO: 5236506 - DNA, 16 bp, Homo sapiens
agttttgtttggacca

SEQ ID NO: 5236507 - DNA, 20 bp, Homo sapiens
agttttgtttggtttacttt

SEQ ID NO: 5236508 - DNA, 23 bp, Homo sapiens
agttttgtttggtttactttcaa

SEQ ID NO: 5236509 - DNA, 22 bp, Homo sapiens
agtttttaaaaacctgtatctg

SEQ ID NO: 5236510 - DNA, 15 bp, Homo sapiens
agtttttaaaaaggc

SEQ ID NO: 5236511 - DNA, 21 bp, Homo sapiens
agtttttaaaatatattgctg

SEQ ID NO: 5236512 - DNA, 17 bp, Homo sapiens
agtttttaaaatatctt

SEQ ID NO: 5236513 - DNA, 21 bp, Homo sapiens
agtttttaacaatctaacaat

SEQ ID NO: 5236514 - DNA, 13 bp, Homo sapiens
agtttttaagagt

SEQ ID NO: 5236515 - DNA, 19 bp, Homo sapiens
agtttttaaggttatttat

SEQ ID NO: 5236516 - DNA, 19 bp, Homo sapiens
agtttttaatatttattga

SEQ ID NO: 5236517 - DNA, 14 bp, Homo sapiens
agtttttaattcat

SEQ ID NO: 5236518 - DNA, 16 bp, Homo sapiens
agtttttaatttgatg

SEQ ID NO: 5236519 - DNA, 19 bp, Homo sapiens
agtttttacaaaactgctt

SEQ ID NO: 5236520 - DNA, 16 bp, Homo sapiens
agtttttacagtgtat

SEQ ID NO: 5236521 - DNA, 17 bp, Homo sapiens
agtttttatatgttgta

SEQ ID NO: 5236522 - DNA, 20 bp, Homo sapiens
agtttttatcagccttgctt

SEQ ID NO: 5236523 - DNA, 17 bp, Homo sapiens
agtttttatggggctga

SEQ ID NO: 5236524 - DNA, 20 bp, Homo sapiens
agtttttatggttccaatga

SEQ ID NO: 5236525 - DNA, 19 bp, Homo sapiens
agtttttattaaacccctt

SEQ ID NO: 5236526 - DNA, 16 bp, Homo sapiens
agtttttattaatcta

SEQ ID NO: 5236527 - DNA, 20 bp, Homo sapiens
agtttttattgcttgttgga

SEQ ID NO: 5236528 - DNA, 14 bp, Homo sapiens
agtttttcagaaag

SEQ ID NO: 5236529 - DNA, 20 bp, Homo sapiens
agtttttcataagatatttt

SEQ ID NO: 5236530 - DNA, 12 bp, Homo sapiens
agtttttcatac

SEQ ID NO: 5236531 - DNA, 22 bp, Homo sapiens
agtttttcattaaataaatttg

SEQ ID NO: 5236532 - DNA, 23 bp, Homo sapiens
agtttttcatttgttttgctttt

SEQ ID NO: 5236533 - DNA, 14 bp, Homo sapiens
agtttttcctccca

SEQ ID NO: 5236534 - DNA, 15 bp, Homo sapiens
agtttttcctgtgca

SEQ ID NO: 5236535 - DNA, 11 bp, Homo sapiens
agtttttctga

SEQ ID NO: 5236536 - DNA, 12 bp, Homo sapiens
agtttttctgtc

SEQ ID NO: 5236537 - DNA, 22 bp, Homo sapiens
agtttttctgttttgtttggca

SEQ ID NO: 5236538 - DNA, 12 bp, Homo sapiens
agtttttcttaa

SEQ ID NO: 5236539 - DNA, 14 bp, Homo sapiens
agtttttctttaat

SEQ ID NO: 5236540 - DNA, 19 bp, Homo sapiens
agtttttctttaatatgat

SEQ ID NO: 5236541 - DNA, 13 bp, Homo sapiens
agtttttgaaaat

SEQ ID NO: 5236542 - DNA, 19 bp, Homo sapiens
agtttttgaaaattatgca

SEQ ID NO: 5236543 - DNA, 14 bp, Homo sapiens
agtttttgaaatac

SEQ ID NO: 5236544 - DNA, 14 bp, Homo sapiens
agtttttgacattt

SEQ ID NO: 5236545 - DNA, 16 bp, Homo sapiens
agtttttgatagcttt

SEQ ID NO: 5236546 - DNA, 19 bp, Homo sapiens
agtttttgccattataatt

SEQ ID NO: 5236547 - DNA, 15 bp, Homo sapiens
agtttttgctgaagg

SEQ ID NO: 5236548 - DNA, 22 bp, Homo sapiens
agtttttggagtgttatgtatt

SEQ ID NO: 5236549 - DNA, 23 bp, Homo sapiens
agtttttggagtgttatgtattt

SEQ ID NO: 5236550 - DNA, 23 bp, Homo sapiens
agtttttggtaatgatgattcaa

SEQ ID NO: 5236551 - DNA, 18 bp, Homo sapiens
agtttttgtactgtaaag

SEQ ID NO: 5236552 - DNA, 13 bp, Homo sapiens
agtttttgtatct

SEQ ID NO: 5236553 - DNA, 12 bp, Homo sapiens
agtttttgtttg

SEQ ID NO: 5236554 - DNA, 17 bp, Homo sapiens
agtttttgtttgtttct

SEQ ID NO: 5236555 - DNA, 21 bp, Homo sapiens
agtttttgtttgtttcttctt

SEQ ID NO: 5236556 - DNA, 23 bp, Homo sapiens
atagctaataataaatgcataga

SEQ ID NO: 5236557 - DNA, 23 bp, Homo sapiens
atagctacaatttgtttttgcat

SEQ ID NO: 5236558 - DNA, 16 bp, Homo sapiens
atagctacatgttctt

SEQ ID NO: 5236559 - DNA, 21 bp, Homo sapiens
atagctacatgttctttgtac

SEQ ID NO: 5236560 - DNA, 14 bp, Homo sapiens
atagctacccaaaa

SEQ ID NO: 5236561 - DNA, 21 bp, Homo sapiens
atagctacccaaaagagaaaa

SEQ ID NO: 5236562 - DNA, 17 bp, Homo sapiens
atagctactaattttaa

SEQ ID NO: 5236563 - DNA, 16 bp, Homo sapiens
atagctactatatgca

SEQ ID NO: 5236564 - DNA, 18 bp, Homo sapiens
atagctactgtagaaagg

SEQ ID NO: 5236565 - DNA, 15 bp, Homo sapiens
atagctagactggtg

SEQ ID NO: 5236566 - DNA, 16 bp, Homo sapiens
atagctagactggtga

SEQ ID NO: 5236567 - DNA, 16 bp, Homo sapiens
atagctagagcttttc

SEQ ID NO: 5236568 - DNA, 19 bp, Homo sapiens
atagctagctatttctatg

SEQ ID NO: 5236569 - DNA, 22 bp, Homo sapiens
atagctagctatttctatgtat

SEQ ID NO: 5236570 - DNA, 22 bp, Homo sapiens
atagctaggtgacatatacata

SEQ ID NO: 5236571 - DNA, 17 bp, Homo sapiens
atagctataaatagtga

SEQ ID NO: 5236572 - DNA, 19 bp, Homo sapiens
atagctatatccatgtact

SEQ ID NO: 5236573 - DNA, 23 bp, Homo sapiens
atagctatatccatgtactgtag

SEQ ID NO: 5236574 - DNA, 18 bp, Homo sapiens
atagctattactgtctgg

SEQ ID NO: 5236575 - DNA, 21 bp, Homo sapiens
atagctattttccttgctttt

SEQ ID NO: 5236576 - DNA, 18 bp, Homo sapiens
atagctatttttatggaa

SEQ ID NO: 5236577 - DNA, 17 bp, Homo sapiens
atagctatttttttcct

SEQ ID NO: 5236578 - DNA, 14 bp, Homo sapiens
atagctcaataaaa

SEQ ID NO: 5236579 - DNA, 19 bp, Homo sapiens
atagctcactgcagcctca

SEQ ID NO: 5236580 - DNA, 19 bp, Homo sapiens
atagctcaggtgtccctgc

SEQ ID NO: 5236581 - DNA, 20 bp, Homo sapiens
atagctcaggtgtccctgca

SEQ ID NO: 5236582 - DNA, 21 bp, Homo sapiens
atagctcaggtgtccctgcac

SEQ ID NO: 5236583 - DNA, 12 bp, Homo sapiens
atagctcataag

SEQ ID NO: 5236584 - DNA, 15 bp, Homo sapiens
atagctcatgtgcat

SEQ ID NO: 5236585 - DNA, 20 bp, Homo sapiens
atagctccaagctgttaaag

SEQ ID NO: 5236586 - DNA, 17 bp, Homo sapiens
atagctcccaaaagaat

SEQ ID NO: 5236587 - DNA, 23 bp, Homo sapiens
atagctcctcaaagcctcaaaac

SEQ ID NO: 5236588 - DNA, 19 bp, Homo sapiens
atagctccttcatgctttt

SEQ ID NO: 5236589 - DNA, 20 bp, Homo sapiens
atagctccttcccaggaccc

SEQ ID NO: 5236590 - DNA, 20 bp, Homo sapiens
atagctccttggagcaggca

SEQ ID NO: 5236591 - DNA, 19 bp, Homo sapiens
atagctcgagcaaaattca

SEQ ID NO: 5236592 - DNA, 21 bp, Homo sapiens
atagctcgagccggtccaatt

SEQ ID NO: 5236593 - DNA, 17 bp, Homo sapiens
atagctctaatgtttgc

SEQ ID NO: 5236594 - DNA, 17 bp, Homo sapiens
atagctctattttaaag

SEQ ID NO: 5236595 - DNA, 16 bp, Homo sapiens
atagctcttcacttcc

SEQ ID NO: 5236596 - DNA, 17 bp, Homo sapiens
atagctcttcacttcct

SEQ ID NO: 5236597 - DNA, 19 bp, Homo sapiens
atagctcttcctccccagg

SEQ ID NO: 5236598 - DNA, 16 bp, Homo sapiens
atagctcttctattta

SEQ ID NO: 5236599 - DNA, 14 bp, Homo sapiens
atagctgaaaaggg

SEQ ID NO: 5236600 - DNA, 17 bp, Homo sapiens
atagctgaaaagggcac

SEQ ID NO: 5236601 - DNA, 17 bp, Homo sapiens
atagctgaaattccagt

SEQ ID NO: 5236602 - DNA, 17 bp, Homo sapiens
atagctgatagaagaag

SEQ ID NO: 5236603 - DNA, 22 bp, Homo sapiens
atagctgatagaagaaggactg

SEQ ID NO: 5236604 - DNA, 14 bp, Homo sapiens
atagctgatcagtt

SEQ ID NO: 5236605 - DNA, 18 bp, Homo sapiens
atagctgcatgtggcttt

SEQ ID NO: 5236606 - DNA, 19 bp, Homo sapiens
atagctgcccatttcgtga

SEQ ID NO: 5236607 - DNA, 17 bp, Homo sapiens
atagctgcttccagtgt

SEQ ID NO: 5236608 - DNA, 18 bp, Homo sapiens
atagctggaaaaaacaaa

SEQ ID NO: 5236609 - DNA, 17 bp, Homo sapiens
atagctgggactacagg

SEQ ID NO: 5236610 - DNA, 22 bp, Homo sapiens
atagctggtcttatttgtaaag

SEQ ID NO: 5236611 - DNA, 18 bp, Homo sapiens
atagctgtacaaatataa

SEQ ID NO: 5236612 - DNA, 21 bp, Homo sapiens
atagctgtagttttccctgca

SEQ ID NO: 5236613 - DNA, 20 bp, Homo sapiens
atagctgtatatttgaaact

SEQ ID NO: 5236614 - DNA, 17 bp, Homo sapiens
atagctgtattgaatca

SEQ ID NO: 5236615 - DNA, 23 bp, Homo sapiens
atagctgtgtgaacgtgtatgta

SEQ ID NO: 5236616 - DNA, 16 bp, Homo sapiens
atagctgtttcaaatg

SEQ ID NO: 5236617 - DNA, 22 bp, Homo sapiens
atagctgttttgtgtatattgg

SEQ ID NO: 5236618 - DNA, 16 bp, Homo sapiens
atagcttaactaattt

SEQ ID NO: 5236619 - DNA, 23 bp, Homo sapiens
atagcttaactaatttgaatgtg

SEQ ID NO: 5236620 - DNA, 16 bp, Homo sapiens
atagcttacctgaaca

SEQ ID NO: 5236621 - DNA, 23 bp, Homo sapiens
atagcttacctgaacaggaatcc

SEQ ID NO: 5236622 - DNA, 21 bp, Homo sapiens
atagcttattatagaattgca

SEQ ID NO: 5236623 - DNA, 20 bp, Homo sapiens
atagcttcatcttgagcctg

SEQ ID NO: 5236624 - DNA, 16 bp, Homo sapiens
atagcttctgtgtgtg

SEQ ID NO: 5236625 - DNA, 17 bp, Homo sapiens
atagcttctgtgtgtga

SEQ ID NO: 5236626 - DNA, 14 bp, Homo sapiens
atagcttgaaacat

SEQ ID NO: 5236627 - DNA, 19 bp, Homo sapiens
atagcttgcgcattctcat

SEQ ID NO: 5236628 - DNA, 23 bp, Homo sapiens
atagcttgcgcattctcatggag

SEQ ID NO: 5236629 - DNA, 20 bp, Homo sapiens
atagcttgtacacatataca

SEQ ID NO: 5236630 - DNA, 23 bp, Homo sapiens
atagcttgtacacatatacatat

SEQ ID NO: 5236631 - DNA, 20 bp, Homo sapiens
atagcttgtatagtgtaaaa

SEQ ID NO: 5236632 - DNA, 23 bp, Homo sapiens
atagctttaacattttgtttcca

SEQ ID NO: 5236633 - DNA, 17 bp, Homo sapiens
atagctttacagatgta

SEQ ID NO: 5236634 - DNA, 21 bp, Homo sapiens
atagctttactgtttctcaag

SEQ ID NO: 5236635 - DNA, 14 bp, Homo sapiens
atagctttagtgaa

SEQ ID NO: 5236636 - DNA, 19 bp, Homo sapiens
atagctttataaagcagtt

SEQ ID NO: 5236637 - DNA, 21 bp, Homo sapiens
atagctttggaggagccatct

SEQ ID NO: 5236638 - DNA, 23 bp, Homo sapiens
atagctttgtatttttgtcattg

SEQ ID NO: 5236639 - DNA, 15 bp, Homo sapiens
atagcttttatctgc

SEQ ID NO: 5236640 - DNA, 15 bp, Homo sapiens
atagcttttattgta

SEQ ID NO: 5236641 - DNA, 18 bp, Homo sapiens
atagcttttattgtataa

SEQ ID NO: 5236642 - DNA, 17 bp, Homo sapiens
atagcttttgtgtctta

SEQ ID NO: 5236643 - DNA, 16 bp, Homo sapiens
ataggaaaaactgatt

SEQ ID NO: 5236644 - DNA, 12 bp, Homo sapiens
ataggaaaagaa

SEQ ID NO: 5236645 - DNA, 12 bp, Homo sapiens
ataggaaaagat

SEQ ID NO: 5236646 - DNA, 19 bp, Homo sapiens
ataggaaaagtacatttaa

SEQ ID NO: 5236647 - DNA, 14 bp, Homo sapiens
ataggaaaatacat

SEQ ID NO: 5236648 - DNA, 19 bp, Homo sapiens
ataggaaagcatatgcagc

SEQ ID NO: 5236649 - DNA, 21 bp, Homo sapiens
ataggaaagtatttttttaag

SEQ ID NO: 5236650 - DNA, 14 bp, Homo sapiens
ataggaaataaaat

SEQ ID NO: 5236651 - DNA, 16 bp, Homo sapiens
ataggaaataaatcta

SEQ ID NO: 5236652 - DNA, 17 bp, Homo sapiens
ataggaaataaatctaa

SEQ ID NO: 5236653 - DNA, 11 bp, Homo sapiens
ataggaacagc

SEQ ID NO: 5236654 - DNA, 15 bp, Homo sapiens
ataggaacagcccag

SEQ ID NO: 5236655 - DNA, 16 bp, Homo sapiens
ataggaacatatgaaa

SEQ ID NO: 5236656 - DNA, 21 bp, Homo sapiens
ataggaacatatgaaaataca

SEQ ID NO: 5236657 - DNA, 16 bp, Homo sapiens
ataggaagacataaaa

SEQ ID NO: 5236658 - DNA, 17 bp, Homo sapiens
ataggaagacgcagagc

SEQ ID NO: 5236659 - DNA, 18 bp, Homo sapiens
ataggaagatatgccact

SEQ ID NO: 5236660 - DNA, 19 bp, Homo sapiens
ataggaagattaaaaccac

SEQ ID NO: 5236661 - DNA, 19 bp, Homo sapiens
ataggaaggtcatttccat

SEQ ID NO: 5236662 - DNA, 21 bp, Homo sapiens
ataggaagttagcctttatct

SEQ ID NO: 5236663 - DNA, 23 bp, Homo sapiens
ataggaagttcttttttgtacag

SEQ ID NO: 5236664 - DNA, 20 bp, Homo sapiens
ataggaatcattcagaaatg

SEQ ID NO: 5236665 - DNA, 18 bp, Homo sapiens
ataggaatgtagaagtct

SEQ ID NO: 5236666 - DNA, 18 bp, Homo sapiens
ataggaatgtgaaagcac

SEQ ID NO: 5236667 - DNA, 12 bp, Homo sapiens
ataggaatttgt

SEQ ID NO: 5236668 - DNA, 15 bp, Homo sapiens
ataggacagagggat

SEQ ID NO: 5236669 - DNA, 15 bp, Homo sapiens
ataggacctgcatcc

SEQ ID NO: 5236670 - DNA, 17 bp, Homo sapiens
ataggaccttgggccaa

SEQ ID NO: 5236671 - DNA, 14 bp, Homo sapiens
ataggacctttcca

SEQ ID NO: 5236672 - DNA, 13 bp, Homo sapiens
ataggacgtattt

SEQ ID NO: 5236673 - DNA, 17 bp, Homo sapiens
ataggactaccgcaggc

SEQ ID NO: 5236674 - DNA, 20 bp, Homo sapiens
ataggactccatttctttct

SEQ ID NO: 5236675 - DNA, 13 bp, Homo sapiens
ataggactctttg

SEQ ID NO: 5236676 - DNA, 22 bp, Homo sapiens
ataggactgtggcaaacaaaac

SEQ ID NO: 5236677 - DNA, 13 bp, Homo sapiens
ataggacttgttt

SEQ ID NO: 5236678 - DNA, 13 bp, Homo sapiens
ataggagaggaaa

SEQ ID NO: 5236679 - DNA, 14 bp, Homo sapiens
ataggagaggatga

SEQ ID NO: 5236680 - DNA, 19 bp, Homo sapiens
ataggagaggatgagagcc

SEQ ID NO: 5236681 - DNA, 21 bp, Homo sapiens
ataggagaggatgagagccca

SEQ ID NO: 5236682 - DNA, 24 bp, Homo sapiens
ataggagaggatgagagcccagag

SEQ ID NO: 5236683 - DNA, 13 bp, Homo sapiens
ataggagcctgct

SEQ ID NO: 5236684 - DNA, 18 bp, Homo sapiens
ataggagcttccagatgg

SEQ ID NO: 5236685 - DNA, 17 bp, Homo sapiens
ataggagggaaaccttt

SEQ ID NO: 5236686 - DNA, 20 bp, Homo sapiens
ataggaggggaaaaaacaaa

SEQ ID NO: 5236687 - DNA, 23 bp, Homo sapiens
ataggaggggtctggacatgtgg

SEQ ID NO: 5236688 - DNA, 19 bp, Homo sapiens
ataggagggtgcccctggg

SEQ ID NO: 5236689 - DNA, 19 bp, Homo sapiens
ataggagtgagtgtatgtg

SEQ ID NO: 5236690 - DNA, 22 bp, Homo sapiens
ataggagtgagtgtatgtgtgt

SEQ ID NO: 5236691 - DNA, 21 bp, Homo sapiens
ataggagtggtgatttgaaaa

SEQ ID NO: 5236692 - DNA, 16 bp, Homo sapiens
ataggagttctcctgg

SEQ ID NO: 5236693 - DNA, 21 bp, Homo sapiens
ataggatagacactggacatg

SEQ ID NO: 5236694 - DNA, 22 bp, Homo sapiens
ataggatataaaacacatcaag

SEQ ID NO: 5236695 - DNA, 19 bp, Homo sapiens
ataggatgggcttctgtgc

SEQ ID NO: 5236696 - DNA, 20 bp, Homo sapiens
ataggatgtactgttgaaaa

SEQ ID NO: 5236697 - DNA, 19 bp, Homo sapiens
ataggattgcttcaattaa

SEQ ID NO: 5236698 - DNA, 23 bp, Homo sapiens
ataggattgcttcaattaaaatt

SEQ ID NO: 5236699 - DNA, 17 bp, Homo sapiens
ataggattgggaaagaa

SEQ ID NO: 5236700 - DNA, 16 bp, Homo sapiens
ataggatttatttaaa

SEQ ID NO: 5236701 - DNA, 23 bp, Homo sapiens
ataggatttatttaaaatagcaa

SEQ ID NO: 5236702 - DNA, 20 bp, Homo sapiens
ataggatttgcactgcttta

SEQ ID NO: 5236703 - DNA, 17 bp, Homo sapiens
ataggcaaagttttcca

SEQ ID NO: 5236704 - DNA, 14 bp, Homo sapiens
ataggcaaattaat

SEQ ID NO: 5236705 - DNA, 16 bp, Homo sapiens
ataggcaaggatgaaa

SEQ ID NO: 5236706 - DNA, 17 bp, Homo sapiens
ataggcaaggatgaaag

SEQ ID NO: 5236707 - DNA, 21 bp, Homo sapiens
ataggcaaggatgaaagacaa

SEQ ID NO: 5236708 - DNA, 17 bp, Homo sapiens
ataggcagatctttaaa

SEQ ID NO: 5236709 - DNA, 22 bp, Homo sapiens
ataggcagatctttaaatacag

SEQ ID NO: 5236710 - DNA, 23 bp, Homo sapiens
ataggcaggaacatacagacaca

SEQ ID NO: 5236711 - DNA, 20 bp, Homo sapiens
ataggcaggaagcccaattg

SEQ ID NO: 5236712 - DNA, 14 bp, Homo sapiens
ataggcagggggcc

SEQ ID NO: 5236713 - DNA, 16 bp, Homo sapiens
ataggcagggggccct

SEQ ID NO: 5236714 - DNA, 22 bp, Homo sapiens
ataggcatcatttcacaaggtc

SEQ ID NO: 5236715 - DNA, 22 bp, Homo sapiens
ataggcatgagccactgtgctt

SEQ ID NO: 5236716 - DNA, 14 bp, Homo sapiens
ataggcattaaatg

SEQ ID NO: 5236717 - DNA, 14 bp, Homo sapiens
ataggcattttaag

SEQ ID NO: 5236718 - DNA, 22 bp, Homo sapiens
ataggccacagaaggtgaactt

SEQ ID NO: 5236719 - DNA, 12 bp, Homo sapiens
ataggccagccg

SEQ ID NO: 5236720 - DNA, 23 bp, Homo sapiens
ataggccagggcatgtgtatgtg

SEQ ID NO: 5236721 - DNA, 18 bp, Homo sapiens
ataggccatctgtaaata

SEQ ID NO: 5236722 - DNA, 19 bp, Homo sapiens
ataggccatgttaattaaa

SEQ ID NO: 5236723 - DNA, 14 bp, Homo sapiens
ataggcccacacac

SEQ ID NO: 5236724 - DNA, 18 bp, Homo sapiens
ataggcccacacacaggt

SEQ ID NO: 5236725 - DNA, 14 bp, Homo sapiens
ataggcccctgggg

SEQ ID NO: 5236726 - DNA, 16 bp, Homo sapiens
ataggcccctggggct

SEQ ID NO: 5236727 - DNA, 21 bp, Homo sapiens
ataggccctggatgtgcccac

SEQ ID NO: 5236728 - DNA, 22 bp, Homo sapiens
ataggccctggatgtgcccaca

SEQ ID NO: 5236729 - DNA, 21 bp, Homo sapiens
ataggcctagtacaatcttgg

SEQ ID NO: 5236730 - DNA, 14 bp, Homo sapiens
ataggcctgggtgc

SEQ ID NO: 5236731 - DNA, 15 bp, Homo sapiens
agttttttaaacaaa

SEQ ID NO: 5236732 - DNA, 23 bp, Homo sapiens
agttttttaattaagcagaaaca

SEQ ID NO: 5236733 - DNA, 15 bp, Homo sapiens
agttttttactttgg

SEQ ID NO: 5236734 - DNA, 18 bp, Homo sapiens
agttttttatatatgaat

SEQ ID NO: 5236735 - DNA, 13 bp, Homo sapiens
agttttttcacct

SEQ ID NO: 5236736 - DNA, 22 bp, Homo sapiens
agttttttcacctccatgtcat

SEQ ID NO: 5236737 - DNA, 14 bp, Homo sapiens
agttttttcatctt

SEQ ID NO: 5236738 - DNA, 23 bp, Homo sapiens
agttttttcatcttcagttgtct

SEQ ID NO: 5236739 - DNA, 17 bp, Homo sapiens
agttttttctcttgggc

SEQ ID NO: 5236740 - DNA, 19 bp, Homo sapiens
agttttttgccactgcaaa

SEQ ID NO: 5236741 - DNA, 23 bp, Homo sapiens
agttttttggggggataggaaga

SEQ ID NO: 5236742 - DNA, 16 bp, Homo sapiens
agtttttttatttctt

SEQ ID NO: 5236743 - DNA, 17 bp, Homo sapiens
agtttttttatttcttt

SEQ ID NO: 5236744 - DNA, 14 bp, Homo sapiens
agtttttttctgtt

SEQ ID NO: 5236745 - DNA, 15 bp, Homo sapiens
agtttttttctttgt

SEQ ID NO: 5236746 - DNA, 14 bp, Homo sapiens
agtttttttgttca

SEQ ID NO: 5236747 - DNA, 15 bp, Homo sapiens
agttttttttataca

SEQ ID NO: 5236748 - DNA, 16 bp, Homo sapiens
agttttttttctgggt

SEQ ID NO: 5236749 - DNA, 16 bp, Homo sapiens
agttttttttgtaaac

SEQ ID NO: 5236750 - DNA, 18 bp, Homo sapiens
agttttttttgtttgcct

SEQ ID NO: 5236751 - DNA, 15 bp, Homo sapiens
agtttttttttaatc

SEQ ID NO: 5236752 - DNA, 14 bp, Homo sapiens
agttttttttttct

SEQ ID NO: 5236753 - DNA, 19 bp, Homo sapiens
agttttttttttgtttgtt

SEQ ID NO: 5236754 - DNA, 18 bp, Homo sapiens
ataaaaaaaagaaaaaag

SEQ ID NO: 5236755 - DNA, 21 bp, Homo sapiens
ataaaaaaaagttgtttataa

SEQ ID NO: 5236756 - DNA, 14 bp, Homo sapiens
ataaaaaaaatagt

SEQ ID NO: 5236757 - DNA, 15 bp, Homo sapiens
ataaaaaaaatagtt

SEQ ID NO: 5236758 - DNA, 20 bp, Homo sapiens
ataaaaaaaatgaaatgttt

SEQ ID NO: 5236759 - DNA, 16 bp, Homo sapiens
ataaaaaaagaaaaaa

SEQ ID NO: 5236760 - DNA, 16 bp, Homo sapiens
ataaaaaaagaaagca

SEQ ID NO: 5236761 - DNA, 13 bp, Homo sapiens
ataaaaaaataca

SEQ ID NO: 5236762 - DNA, 21 bp, Homo sapiens
ataaaaaaattgtaaatgttt

SEQ ID NO: 5236763 - DNA, 13 bp, Homo sapiens
ataaaaaacaaat

SEQ ID NO: 5236764 - DNA, 15 bp, Homo sapiens
ataaaaaacaaatat

SEQ ID NO: 5236765 - DNA, 18 bp, Homo sapiens
ataaaaaagaaaacattc

SEQ ID NO: 5236766 - DNA, 16 bp, Homo sapiens
ataaaaaagatcccaa

SEQ ID NO: 5236767 - DNA, 12 bp, Homo sapiens
ataaaaaagatt

SEQ ID NO: 5236768 - DNA, 17 bp, Homo sapiens
ataaaaaagattctact

SEQ ID NO: 5236769 - DNA, 16 bp, Homo sapiens
ataaaaaagtctctat

SEQ ID NO: 5236770 - DNA, 18 bp, Homo sapiens
ataaaaaagtgtcctata

SEQ ID NO: 5236771 - DNA, 11 bp, Homo sapiens
ataaaaaataa

SEQ ID NO: 5236772 - DNA, 13 bp, Homo sapiens
ataaaaaataagt

SEQ ID NO: 5236773 - DNA, 21 bp, Homo sapiens
ataaaaaataatctatttcta

SEQ ID NO: 5236774 - DNA, 17 bp, Homo sapiens
ataaaaaatagacatgt

SEQ ID NO: 5236775 - DNA, 15 bp, Homo sapiens
ataaaaaatatatgt

SEQ ID NO: 5236776 - DNA, 21 bp, Homo sapiens
ataaaaaatatatttttatat

SEQ ID NO: 5236777 - DNA, 13 bp, Homo sapiens
ataaaaaatatgt

SEQ ID NO: 5236778 - DNA, 14 bp, Homo sapiens
ataaaaaatatgta

SEQ ID NO: 5236779 - DNA, 20 bp, Homo sapiens
ataaaaaatatgtatttacc

SEQ ID NO: 5236780 - DNA, 16 bp, Homo sapiens
ataaaaaatcatgcca

SEQ ID NO: 5236781 - DNA, 19 bp, Homo sapiens
ataaaaaatcctcaacact

SEQ ID NO: 5236782 - DNA, 15 bp, Homo sapiens
ataaaaaatctgaag

SEQ ID NO: 5236783 - DNA, 13 bp, Homo sapiens
ataaaaaatgaaa

SEQ ID NO: 5236784 - DNA, 18 bp, Homo sapiens
ataaaaaatggtgcctga

SEQ ID NO: 5236785 - DNA, 13 bp, Homo sapiens
ataaaaaatgtaa

SEQ ID NO: 5236786 - DNA, 17 bp, Homo sapiens
ataaaaaatgtaacatc

SEQ ID NO: 5236787 - DNA, 12 bp, Homo sapiens
ataaaaaattaa

SEQ ID NO: 5236788 - DNA, 23 bp, Homo sapiens
ataaaaaattaacttagttttta

SEQ ID NO: 5236789 - DNA, 14 bp, Homo sapiens
ataaaaaattatgg

SEQ ID NO: 5236790 - DNA, 18 bp, Homo sapiens
ataaaaaatttattatgt

SEQ ID NO: 5236791 - DNA, 13 bp, Homo sapiens
ataaaaaattttg

SEQ ID NO: 5236792 - DNA, 15 bp, Homo sapiens
ataaaaaattttgta

SEQ ID NO: 5236793 - DNA, 12 bp, Homo sapiens
ataaaaacaaat

SEQ ID NO: 5236794 - DNA, 17 bp, Homo sapiens
ataaaaacaacaaatac

SEQ ID NO: 5236795 - DNA, 18 bp, Homo sapiens
ataaaaacaactttcact

SEQ ID NO: 5236796 - DNA, 18 bp, Homo sapiens
ataaaaacaatatatgta

SEQ ID NO: 5236797 - DNA, 16 bp, Homo sapiens
ataaaaacaatatatt

SEQ ID NO: 5236798 - DNA, 16 bp, Homo sapiens
ataaaaacaatccttt

SEQ ID NO: 5236799 - DNA, 15 bp, Homo sapiens
ataaaaacagattct

SEQ ID NO: 5236800 - DNA, 17 bp, Homo sapiens
ataaaaacagattctga

SEQ ID NO: 5236801 - DNA, 16 bp, Homo sapiens
ataaaaacataaaata

SEQ ID NO: 5236802 - DNA, 17 bp, Homo sapiens
ataaaaaccaagaagat

SEQ ID NO: 5236803 - DNA, 11 bp, Homo sapiens
ataaaaaccat

SEQ ID NO: 5236804 - DNA, 18 bp, Homo sapiens
ataaaaacccacaaaaat

SEQ ID NO: 5236805 - DNA, 13 bp, Homo sapiens
ataaaaaccctgt

SEQ ID NO: 5236806 - DNA, 16 bp, Homo sapiens
ataaaaactaaattgt

SEQ ID NO: 5236807 - DNA, 16 bp, Homo sapiens
ataaaaactaatttca

SEQ ID NO: 5236808 - DNA, 17 bp, Homo sapiens
ataaaaactaatttcat

SEQ ID NO: 5236809 - DNA, 18 bp, Homo sapiens
ataaaaactaatttcata

SEQ ID NO: 5236810 - DNA, 14 bp, Homo sapiens
ataaaaactgattt

SEQ ID NO: 5236811 - DNA, 21 bp, Homo sapiens
ataaaaacttattttatcctt

SEQ ID NO: 5236812 - DNA, 11 bp, Homo sapiens
ataaaaagaaa

SEQ ID NO: 5236813 - DNA, 13 bp, Homo sapiens
ataaaaagaaaaa

SEQ ID NO: 5236814 - DNA, 16 bp, Homo sapiens
ataaaaagaaagctaa

SEQ ID NO: 5236815 - DNA, 13 bp, Homo sapiens
ataaaaagaatga

SEQ ID NO: 5236816 - DNA, 20 bp, Homo sapiens
ataaaaagacattcttccaa

SEQ ID NO: 5236817 - DNA, 16 bp, Homo sapiens
ataaaaagagatgaaa

SEQ ID NO: 5236818 - DNA, 12 bp, Homo sapiens
ataaaaagcaaa

SEQ ID NO: 5236819 - DNA, 13 bp, Homo sapiens
ataaaaagcaaaa

SEQ ID NO: 5236820 - DNA, 16 bp, Homo sapiens
ataaaaagcatgagac

SEQ ID NO: 5236821 - DNA, 23 bp, Homo sapiens
ataaaaagcatttggtgcctatt

SEQ ID NO: 5236822 - DNA, 14 bp, Homo sapiens
ataaaaagcctctt

SEQ ID NO: 5236823 - DNA, 17 bp, Homo sapiens
ataaaaagcttccatga

SEQ ID NO: 5236824 - DNA, 11 bp, Homo sapiens
ataaaaaggaa

SEQ ID NO: 5236825 - DNA, 13 bp, Homo sapiens
ataaaaaggaagg

SEQ ID NO: 5236826 - DNA, 11 bp, Homo sapiens
ataaaaaggac

SEQ ID NO: 5236827 - DNA, 11 bp, Homo sapiens
ataaaaaggca

SEQ ID NO: 5236828 - DNA, 12 bp, Homo sapiens
ataaaaaggcac

SEQ ID NO: 5236829 - DNA, 12 bp, Homo sapiens
ataaaaaggtgt

SEQ ID NO: 5236830 - DNA, 12 bp, Homo sapiens
ataaaaaggttt

SEQ ID NO: 5236831 - DNA, 15 bp, Homo sapiens
ataaaaagtaactga

SEQ ID NO: 5236832 - DNA, 17 bp, Homo sapiens
ataaaaagtaatgactt

SEQ ID NO: 5236833 - DNA, 15 bp, Homo sapiens
ataaaaagtgaactt

SEQ ID NO: 5236834 - DNA, 17 bp, Homo sapiens
ataaaaagtgaactttt

SEQ ID NO: 5236835 - DNA, 21 bp, Homo sapiens
ataaaaagtgaacttttgtaa

SEQ ID NO: 5236836 - DNA, 19 bp, Homo sapiens
ataaaaagtgacacagcag

SEQ ID NO: 5236837 - DNA, 11 bp, Homo sapiens
ataaaaagtta

SEQ ID NO: 5236838 - DNA, 13 bp, Homo sapiens
ataaaaagttaaa

SEQ ID NO: 5236839 - DNA, 13 bp, Homo sapiens
ataaaaataatag

SEQ ID NO: 5236840 - DNA, 13 bp, Homo sapiens
ataaaaataatta

SEQ ID NO: 5236841 - DNA, 16 bp, Homo sapiens
ataaaaataattaaaa

SEQ ID NO: 5236842 - DNA, 20 bp, Homo sapiens
ataaaaatacacatgaaaac

SEQ ID NO: 5236843 - DNA, 15 bp, Homo sapiens
ataaaaataccttaa

SEQ ID NO: 5236844 - DNA, 19 bp, Homo sapiens
ataaaaataccttaaatct

SEQ ID NO: 5236845 - DNA, 23 bp, Homo sapiens
ataaaaatactacaatagtttta

SEQ ID NO: 5236846 - DNA, 14 bp, Homo sapiens
ataaaaatactgac

SEQ ID NO: 5236847 - DNA, 14 bp, Homo sapiens
ataaaaatataaat

SEQ ID NO: 5236848 - DNA, 19 bp, Homo sapiens
ataaaaatataaattgtac

SEQ ID NO: 5236849 - DNA, 12 bp, Homo sapiens
ataaaaatatat

SEQ ID NO: 5236850 - DNA, 14 bp, Homo sapiens
ataaaaatatatat

SEQ ID NO: 5236851 - DNA, 17 bp, Homo sapiens
ataaaaatcaaacaacc

SEQ ID NO: 5236852 - DNA, 21 bp, Homo sapiens
ataaaaatcaggagcctgcta

SEQ ID NO: 5236853 - DNA, 21 bp, Homo sapiens
ataaaaatcatatagaccaat

SEQ ID NO: 5236854 - DNA, 12 bp, Homo sapiens
ataaaaatgaat

SEQ ID NO: 5236855 - DNA, 13 bp, Homo sapiens
ataaaaatgaatt

SEQ ID NO: 5236856 - DNA, 13 bp, Homo sapiens
ataaaaatgacag

SEQ ID NO: 5236857 - DNA, 16 bp, Homo sapiens
ataaaaatgatctaaa

SEQ ID NO: 5236858 - DNA, 17 bp, Homo sapiens
ataaaaatgatctaaac

SEQ ID NO: 5236859 - DNA, 14 bp, Homo sapiens
ataaaaatggaatt

SEQ ID NO: 5236860 - DNA, 12 bp, Homo sapiens
ataaaaatggat

SEQ ID NO: 5236861 - DNA, 21 bp, Homo sapiens
ataaaaatggcaaatgcactg

SEQ ID NO: 5236862 - DNA, 22 bp, Homo sapiens
ataaaaatgtctcagcaacagt

SEQ ID NO: 5236863 - DNA, 16 bp, Homo sapiens
ataaaaattaaatgga

SEQ ID NO: 5236864 - DNA, 20 bp, Homo sapiens
ataaaaattatcaaaaagct

SEQ ID NO: 5236865 - DNA, 16 bp, Homo sapiens
ataaaaattctagatt

SEQ ID NO: 5236866 - DNA, 14 bp, Homo sapiens
ataaaaattctgaa

SEQ ID NO: 5236867 - DNA, 15 bp, Homo sapiens
ataaaaattctgaat

SEQ ID NO: 5236868 - DNA, 13 bp, Homo sapiens
ataaaaattgaat

SEQ ID NO: 5236869 - DNA, 17 bp, Homo sapiens
ataaaaattgaattcgt

SEQ ID NO: 5236870 - DNA, 15 bp, Homo sapiens
ataaaaatttattat

SEQ ID NO: 5236871 - DNA, 13 bp, Homo sapiens
ataaaacaagaat

SEQ ID NO: 5236872 - DNA, 16 bp, Homo sapiens
ataaaacaagaatact

SEQ ID NO: 5236873 - DNA, 17 bp, Homo sapiens
ataaaacaagccttaat

SEQ ID NO: 5236874 - DNA, 15 bp, Homo sapiens
ataaaacaataaatg

SEQ ID NO: 5236875 - DNA, 16 bp, Homo sapiens
ataaaacaataaatga

SEQ ID NO: 5236876 - DNA, 17 bp, Homo sapiens
ataaaacaataaatgaa

SEQ ID NO: 5236877 - DNA, 20 bp, Homo sapiens
ataaaacaatgtaattacat

SEQ ID NO: 5236878 - DNA, 14 bp, Homo sapiens
ataaaacacacctc

SEQ ID NO: 5236879 - DNA, 20 bp, Homo sapiens
ataaaacagcattagatagt

SEQ ID NO: 5236880 - DNA, 12 bp, Homo sapiens
ataaaacagtat

SEQ ID NO: 5236881 - DNA, 13 bp, Homo sapiens
ataaaacagtcat

SEQ ID NO: 5236882 - DNA, 14 bp, Homo sapiens
ataaaacatcacta

SEQ ID NO: 5236883 - DNA, 22 bp, Homo sapiens
ataaaacattaagaaaatcata

SEQ ID NO: 5236884 - DNA, 13 bp, Homo sapiens
ataaaacattaat

SEQ ID NO: 5236885 - DNA, 19 bp, Homo sapiens
ataaaacattagaagaaaa

SEQ ID NO: 5236886 - DNA, 12 bp, Homo sapiens
ataaaacattcc

SEQ ID NO: 5236887 - DNA, 11 bp, Homo sapiens
ataaaacattt

SEQ ID NO: 5236888 - DNA, 18 bp, Homo sapiens
ataaaacattttaaatgg

SEQ ID NO: 5236889 - DNA, 20 bp, Homo sapiens
ataaaacattttcacacaat

SEQ ID NO: 5236890 - DNA, 16 bp, Homo sapiens
ataaaaccaagcctct

SEQ ID NO: 5236891 - DNA, 15 bp, Homo sapiens
ataaaaccagaaaga

SEQ ID NO: 5236892 - DNA, 17 bp, Homo sapiens
ataaaacctgggtgtca

SEQ ID NO: 5236893 - DNA, 13 bp, Homo sapiens
ataaaacctttca

SEQ ID NO: 5236894 - DNA, 14 bp, Homo sapiens
ataaaacctttcaa

SEQ ID NO: 5236895 - DNA, 20 bp, Homo sapiens
ataaaacctttcaaatttca

SEQ ID NO: 5236896 - DNA, 21 bp, Homo sapiens
ataaaacctttcaaatttcac

SEQ ID NO: 5236897 - DNA, 18 bp, Homo sapiens
ataaaacgttatctcatt

SEQ ID NO: 5236898 - DNA, 15 bp, Homo sapiens
ataaaactaaatata

SEQ ID NO: 5236899 - DNA, 14 bp, Homo sapiens
ataaaactaaatgt

SEQ ID NO: 5236900 - DNA, 20 bp, Homo sapiens
ataaaactaaggcttttatt

SEQ ID NO: 5236901 - DNA, 22 bp, Homo sapiens
ataaaactagggggtgtatatt

SEQ ID NO: 5236902 - DNA, 14 bp, Homo sapiens
ataaaactatgtgt

SEQ ID NO: 5236903 - DNA, 11 bp, Homo sapiens
ataaaactatt

SEQ ID NO: 5236904 - DNA, 23 bp, Homo sapiens
ataaaactatttaaaattggcac

SEQ ID NO: 5236905 - DNA, 17 bp, Homo sapiens
ataaaactcagttaaaa

SEQ ID NO: 5236906 - DNA, 18 bp, Homo sapiens
ataaaactctagcagttg

SEQ ID NO: 5236907 - DNA, 11 bp, Homo sapiens
ataaaactctg

SEQ ID NO: 5236908 - DNA, 11 bp, Homo sapiens
ataaaactgaa

SEQ ID NO: 5236909 - DNA, 17 bp, Homo sapiens
ataaaactgatgtgaaa

SEQ ID NO: 5236910 - DNA, 18 bp, Homo sapiens
ataaaactgatgtgaaac

SEQ ID NO: 5236911 - DNA, 15 bp, Homo sapiens
ataaaactgcgagga

SEQ ID NO: 5236912 - DNA, 22 bp, Homo sapiens
ataaaactgcgaggacatcaaa

SEQ ID NO: 5236913 - DNA, 15 bp, Homo sapiens
ataaaactgctttgt

SEQ ID NO: 5236914 - DNA, 14 bp, Homo sapiens
ataaaactgtgact

SEQ ID NO: 5236915 - DNA, 13 bp, Homo sapiens
ataaaactgtgca

SEQ ID NO: 5236916 - DNA, 15 bp, Homo sapiens
ataggcctgtccctt

SEQ ID NO: 5236917 - DNA, 20 bp, Homo sapiens
ataggcctgtcccttgcctc

SEQ ID NO: 5236918 - DNA, 15 bp, Homo sapiens
ataggccttcttgtg

SEQ ID NO: 5236919 - DNA, 19 bp, Homo sapiens
ataggcggggcttgccttc

SEQ ID NO: 5236920 - DNA, 20 bp, Homo sapiens
ataggcggggcttgccttct

SEQ ID NO: 5236921 - DNA, 16 bp, Homo sapiens
ataggctatgccatgt

SEQ ID NO: 5236922 - DNA, 19 bp, Homo sapiens
ataggctatgtaatgtaaa

SEQ ID NO: 5236923 - DNA, 15 bp, Homo sapiens
ataggctccttcctg

SEQ ID NO: 5236924 - DNA, 13 bp, Homo sapiens
ataggctctgcac

SEQ ID NO: 5236925 - DNA, 15 bp, Homo sapiens
ataggctctgcacag

SEQ ID NO: 5236926 - DNA, 21 bp, Homo sapiens
ataggctcttaagcagcatgg

SEQ ID NO: 5236927 - DNA, 13 bp, Homo sapiens
ataggctggagaa

SEQ ID NO: 5236928 - DNA, 19 bp, Homo sapiens
ataggctggtggccttggg

SEQ ID NO: 5236929 - DNA, 14 bp, Homo sapiens
ataggcttagagag

SEQ ID NO: 5236930 - DNA, 18 bp, Homo sapiens
ataggcttagagaggaaa

SEQ ID NO: 5236931 - DNA, 17 bp, Homo sapiens
ataggcttctattacct

SEQ ID NO: 5236932 - DNA, 17 bp, Homo sapiens
ataggcttgtgtaattt

SEQ ID NO: 5236933 - DNA, 23 bp, Homo sapiens
ataggcttgtgtaatttcctgct

SEQ ID NO: 5236934 - DNA, 17 bp, Homo sapiens
ataggctttttaggaac

SEQ ID NO: 5236935 - DNA, 17 bp, Homo sapiens
atagggaatatatctct

SEQ ID NO: 5236936 - DNA, 17 bp, Homo sapiens
atagggaattttcattt

SEQ ID NO: 5236937 - DNA, 23 bp, Homo sapiens
atagggatgaactttttcctggc

SEQ ID NO: 5236938 - DNA, 21 bp, Homo sapiens
atagggcaattaattccttca

SEQ ID NO: 5236939 - DNA, 21 bp, Homo sapiens
atagggctgggcaaggaaaaa

SEQ ID NO: 5236940 - DNA, 15 bp, Homo sapiens
ataggggagccaagg

SEQ ID NO: 5236941 - DNA, 18 bp, Homo sapiens
ataggggatatttaaggt

SEQ ID NO: 5236942 - DNA, 21 bp, Homo sapiens
ataggggatttttttgatgtg

SEQ ID NO: 5236943 - DNA, 13 bp, Homo sapiens
atagggggctgca

SEQ ID NO: 5236944 - DNA, 21 bp, Homo sapiens
atagggtagaatgattaatca

SEQ ID NO: 5236945 - DNA, 15 bp, Homo sapiens
atagggtatttgacc

SEQ ID NO: 5236946 - DNA, 20 bp, Homo sapiens
atagggtccttgaaacagaa

SEQ ID NO: 5236947 - DNA, 22 bp, Homo sapiens
atagggtctgcagcctgctggg

SEQ ID NO: 5236948 - DNA, 23 bp, Homo sapiens
atagggtgctctgaggtcaataa

SEQ ID NO: 5236949 - DNA, 16 bp, Homo sapiens
atagggtggacagaag

SEQ ID NO: 5236950 - DNA, 14 bp, Homo sapiens
atagggtggcacat

SEQ ID NO: 5236951 - DNA, 14 bp, Homo sapiens
atagggtgtggctc

SEQ ID NO: 5236952 - DNA, 17 bp, Homo sapiens
atagggtttggaagaaa

SEQ ID NO: 5236953 - DNA, 15 bp, Homo sapiens
atagggttttcagat

SEQ ID NO: 5236954 - DNA, 23 bp, Homo sapiens
ataggtaaatttttaggcaaaga

SEQ ID NO: 5236955 - DNA, 17 bp, Homo sapiens
ataggtaagctgtgcct

SEQ ID NO: 5236956 - DNA, 23 bp, Homo sapiens
ataggtacaatctttcaccaagt

SEQ ID NO: 5236957 - DNA, 20 bp, Homo sapiens
ataggtagagtcattcatat

SEQ ID NO: 5236958 - DNA, 19 bp, Homo sapiens
ataggtagggggctttcac

SEQ ID NO: 5236959 - DNA, 17 bp, Homo sapiens
ataggtagtttggatat

SEQ ID NO: 5236960 - DNA, 22 bp, Homo sapiens
ataggtagtttggatatttttg

SEQ ID NO: 5236961 - DNA, 21 bp, Homo sapiens
ataggtataagtggtgtgtgt

SEQ ID NO: 5236962 - DNA, 16 bp, Homo sapiens
ataggtcactcctggg

SEQ ID NO: 5236963 - DNA, 15 bp, Homo sapiens
ataggtcataaagca

SEQ ID NO: 5236964 - DNA, 17 bp, Homo sapiens
ataggtcataaagcatt

SEQ ID NO: 5236965 - DNA, 19 bp, Homo sapiens
ataggtcatatgttgtgtt

SEQ ID NO: 5236966 - DNA, 20 bp, Homo sapiens
ataggtcattttctattcac

SEQ ID NO: 5236967 - DNA, 20 bp, Homo sapiens
ataggtcctgtgttaaacac

SEQ ID NO: 5236968 - DNA, 16 bp, Homo sapiens
ataggtcctttagaaa

SEQ ID NO: 5236969 - DNA, 17 bp, Homo sapiens
ataggtcctttagaaac

SEQ ID NO: 5236970 - DNA, 22 bp, Homo sapiens
ataggtctaaataggatcctgg

SEQ ID NO: 5236971 - DNA, 17 bp, Homo sapiens
ataggtctcttctccca

SEQ ID NO: 5236972 - DNA, 18 bp, Homo sapiens
ataggtctcttctcccag

SEQ ID NO: 5236973 - DNA, 19 bp, Homo sapiens
ataggtctcttctcccaga

SEQ ID NO: 5236974 - DNA, 22 bp, Homo sapiens
ataggtctctttgctttctggt

SEQ ID NO: 5236975 - DNA, 13 bp, Homo sapiens
ataggtctgaaat

SEQ ID NO: 5236976 - DNA, 20 bp, Homo sapiens
ataggtgatccatgtaactg

SEQ ID NO: 5236977 - DNA, 23 bp, Homo sapiens
ataggtgatccatgtaactgcct

SEQ ID NO: 5236978 - DNA, 16 bp, Homo sapiens
ataggtgcaaaaataa

SEQ ID NO: 5236979 - DNA, 18 bp, Homo sapiens
ataggtgcaaaaataaaa

SEQ ID NO: 5236980 - DNA, 19 bp, Homo sapiens
ataggtgcaaacaaacaag

SEQ ID NO: 5236981 - DNA, 14 bp, Homo sapiens
ataggtgctacaaa

SEQ ID NO: 5236982 - DNA, 13 bp, Homo sapiens
ataggtggcctct

SEQ ID NO: 5236983 - DNA, 22 bp, Homo sapiens
ataggtgtccagcattgctgga

SEQ ID NO: 5236984 - DNA, 21 bp, Homo sapiens
ataggttaaaaaaaaaagtca

SEQ ID NO: 5236985 - DNA, 22 bp, Homo sapiens
ataggttaataaagatgattga

SEQ ID NO: 5236986 - DNA, 21 bp, Homo sapiens
ataggttacataaaaggaagg

SEQ ID NO: 5236987 - DNA, 17 bp, Homo sapiens
ataggttactacctata

SEQ ID NO: 5236988 - DNA, 21 bp, Homo sapiens
ataggttactttggactgagt

SEQ ID NO: 5236989 - DNA, 22 bp, Homo sapiens
ataggttgagcaatttccccct

SEQ ID NO: 5236990 - DNA, 22 bp, Homo sapiens
ataggtttatattattgattca

SEQ ID NO: 5236991 - DNA, 14 bp, Homo sapiens
ataggtttggacaa

SEQ ID NO: 5236992 - DNA, 24 bp, Homo sapiens
ataggtttggacaaaatggaatac

SEQ ID NO: 5236993 - DNA, 22 bp, Homo sapiens
ataggttttaaacgacttttgt

SEQ ID NO: 5236994 - DNA, 14 bp, Homo sapiens
ataggttttaaatc

SEQ ID NO: 5236995 - DNA, 15 bp, Homo sapiens
ataggttttaaatct

SEQ ID NO: 5236996 - DNA, 16 bp, Homo sapiens
ataggttttgtttgct

SEQ ID NO: 5236997 - DNA, 21 bp, Homo sapiens
ataggttttgtttgctatctt

SEQ ID NO: 5236998 - DNA, 22 bp, Homo sapiens
ataggttttgtttgctatctta

SEQ ID NO: 5236999 - DNA, 18 bp, Homo sapiens
atagtaaaagataacaag

SEQ ID NO: 5237000 - DNA, 18 bp, Homo sapiens
atagtaaactaaagtatg

SEQ ID NO: 5237001 - DNA, 16 bp, Homo sapiens
atagtaaatgtgtttc

SEQ ID NO: 5237002 - DNA, 19 bp, Homo sapiens
atagtaaccattttccttt

SEQ ID NO: 5237003 - DNA, 21 bp, Homo sapiens
atagtaactataagatacaat

SEQ ID NO: 5237004 - DNA, 16 bp, Homo sapiens
atagtaactgacatga

SEQ ID NO: 5237005 - DNA, 19 bp, Homo sapiens
atagtaagacccccatctc

SEQ ID NO: 5237006 - DNA, 13 bp, Homo sapiens
atagtaagattga

SEQ ID NO: 5237007 - DNA, 13 bp, Homo sapiens
atagtaagtgctt

SEQ ID NO: 5237008 - DNA, 19 bp, Homo sapiens
atagtaataagatggctgt

SEQ ID NO: 5237009 - DNA, 20 bp, Homo sapiens
atagtaataagatggctgtg

SEQ ID NO: 5237010 - DNA, 22 bp, Homo sapiens
atagtaataagatggctgtggc

SEQ ID NO: 5237011 - DNA, 16 bp, Homo sapiens
atagtaatcattgact

SEQ ID NO: 5237012 - DNA, 17 bp, Homo sapiens
atagtaatcattgacta

SEQ ID NO: 5237013 - DNA, 18 bp, Homo sapiens
atagtaatggttctagaa

SEQ ID NO: 5237014 - DNA, 14 bp, Homo sapiens
atagtaccatttat

SEQ ID NO: 5237015 - DNA, 18 bp, Homo sapiens
atagtaccttcaatactt

SEQ ID NO: 5237016 - DNA, 14 bp, Homo sapiens
atagtacctttgct

SEQ ID NO: 5237017 - DNA, 18 bp, Homo sapiens
atagtacctttgctcttg

SEQ ID NO: 5237018 - DNA, 22 bp, Homo sapiens
atagtactagagatattttgta

SEQ ID NO: 5237019 - DNA, 17 bp, Homo sapiens
atagtagaaagacatct

SEQ ID NO: 5237020 - DNA, 22 bp, Homo sapiens
atagtagagtgatatggagcaa

SEQ ID NO: 5237021 - DNA, 20 bp, Homo sapiens
atagtagatttttaacaaaa

SEQ ID NO: 5237022 - DNA, 23 bp, Homo sapiens
atagtagcagagtcattgttaca

SEQ ID NO: 5237023 - DNA, 23 bp, Homo sapiens
atagtagccaaagttaaatgtat

SEQ ID NO: 5237024 - DNA, 22 bp, Homo sapiens
atagtaggcactaaatacatgt

SEQ ID NO: 5237025 - DNA, 22 bp, Homo sapiens
atagtaggggttgaagaaaaca

SEQ ID NO: 5237026 - DNA, 20 bp, Homo sapiens
atagtagtaaaattagaaaa

SEQ ID NO: 5237027 - DNA, 19 bp, Homo sapiens
atagtagtcaattagtaca

SEQ ID NO: 5237028 - DNA, 20 bp, Homo sapiens
atagtagtcaattagtacag

SEQ ID NO: 5237029 - DNA, 22 bp, Homo sapiens
atagtagttagcttaagtagtt

SEQ ID NO: 5237030 - DNA, 14 bp, Homo sapiens
atagtataacttta

SEQ ID NO: 5237031 - DNA, 17 bp, Homo sapiens
atagtatagaatgaact

SEQ ID NO: 5237032 - DNA, 15 bp, Homo sapiens
atagtatatctggac

SEQ ID NO: 5237033 - DNA, 16 bp, Homo sapiens
atagtatatctggaca

SEQ ID NO: 5237034 - DNA, 19 bp, Homo sapiens
atagtatcctccaggtttt

SEQ ID NO: 5237035 - DNA, 19 bp, Homo sapiens
atagtatgagggttgaaga

SEQ ID NO: 5237036 - DNA, 19 bp, Homo sapiens
atagtatgagtaatgctta

SEQ ID NO: 5237037 - DNA, 22 bp, Homo sapiens
atagtatgggaaaaaaactgaa

SEQ ID NO: 5237038 - DNA, 16 bp, Homo sapiens
atagtatgtaatttct

SEQ ID NO: 5237039 - DNA, 17 bp, Homo sapiens
atagtatgttaatatgt

SEQ ID NO: 5237040 - DNA, 18 bp, Homo sapiens
atagtattaagtgaaatt

SEQ ID NO: 5237041 - DNA, 14 bp, Homo sapiens
atagtattgaaagt

SEQ ID NO: 5237042 - DNA, 21 bp, Homo sapiens
atagtattggaaaataaaaat

SEQ ID NO: 5237043 - DNA, 22 bp, Homo sapiens
atagtattggaaaataaaaatg

SEQ ID NO: 5237044 - DNA, 14 bp, Homo sapiens
atagtatttaattg

SEQ ID NO: 5237045 - DNA, 22 bp, Homo sapiens
atagtatttataatataaatca

SEQ ID NO: 5237046 - DNA, 18 bp, Homo sapiens
atagtatttgaaaacaga

SEQ ID NO: 5237047 - DNA, 19 bp, Homo sapiens
atagtatttgaaaacagaa

SEQ ID NO: 5237048 - DNA, 22 bp, Homo sapiens
atagtatttgaaaacagaaatt

SEQ ID NO: 5237049 - DNA, 20 bp, Homo sapiens
atagtatttgagagttctaa

SEQ ID NO: 5237050 - DNA, 12 bp, Homo sapiens
atagtatttgat

SEQ ID NO: 5237051 - DNA, 20 bp, Homo sapiens
atagtatttgattcaaaata

SEQ ID NO: 5237052 - DNA, 21 bp, Homo sapiens
atagtatttgattcaaaatat

SEQ ID NO: 5237053 - DNA, 18 bp, Homo sapiens
atagtatttttatattta

SEQ ID NO: 5237054 - DNA, 20 bp, Homo sapiens
atagtcaaaccataaacttc

SEQ ID NO: 5237055 - DNA, 14 bp, Homo sapiens
atagtcaaagagag

SEQ ID NO: 5237056 - DNA, 20 bp, Homo sapiens
atagtcaaagagagttttta

SEQ ID NO: 5237057 - DNA, 13 bp, Homo sapiens
atagtcacctgct

SEQ ID NO: 5237058 - DNA, 14 bp, Homo sapiens
atagtcacctgctg

SEQ ID NO: 5237059 - DNA, 15 bp, Homo sapiens
atagtcaccttttaa

SEQ ID NO: 5237060 - DNA, 17 bp, Homo sapiens
atagtcagagtgtccct

SEQ ID NO: 5237061 - DNA, 21 bp, Homo sapiens
atagtcagctgtaccaagccc

SEQ ID NO: 5237062 - DNA, 12 bp, Homo sapiens
atagtcatctcc

SEQ ID NO: 5237063 - DNA, 21 bp, Homo sapiens
atagtcatggggtccctgctg

SEQ ID NO: 5237064 - DNA, 22 bp, Homo sapiens
atagtcatgtaagctgaaaata

SEQ ID NO: 5237065 - DNA, 20 bp, Homo sapiens
atagtcatgtttctgcagta

SEQ ID NO: 5237066 - DNA, 22 bp, Homo sapiens
atagtcattaaaaacatagaaa

SEQ ID NO: 5237067 - DNA, 17 bp, Homo sapiens
atagtccaatttttact

SEQ ID NO: 5237068 - DNA, 20 bp, Homo sapiens
atagtccaatttttactcag

SEQ ID NO: 5237069 - DNA, 20 bp, Homo sapiens
atagtccagacacttaactc

SEQ ID NO: 5237070 - DNA, 17 bp, Homo sapiens
atagtccagctttgttc

SEQ ID NO: 5237071 - DNA, 22 bp, Homo sapiens
atagtcctcagggctcagtctt

SEQ ID NO: 5237072 - DNA, 14 bp, Homo sapiens
atagtcctgaagtt

SEQ ID NO: 5237073 - DNA, 17 bp, Homo sapiens
atagtcgtgaatcttgt

SEQ ID NO: 5237074 - DNA, 20 bp, Homo sapiens
atagtctacagttgtcctga

SEQ ID NO: 5237075 - DNA, 20 bp, Homo sapiens
atagtctagatggctcctct

SEQ ID NO: 5237076 - DNA, 15 bp, Homo sapiens
atagtctagtgtagt

SEQ ID NO: 5237077 - DNA, 21 bp, Homo sapiens
atagtctctttaaaaggaaag

SEQ ID NO: 5237078 - DNA, 13 bp, Homo sapiens
atagtctggaaag

SEQ ID NO: 5237079 - DNA, 22 bp, Homo sapiens
atagtctgttccttttctctcc

SEQ ID NO: 5237080 - DNA, 16 bp, Homo sapiens
atagtcttgaaatgaa

SEQ ID NO: 5237081 - DNA, 16 bp, Homo sapiens
atagtgaaaaatgtca

SEQ ID NO: 5237082 - DNA, 19 bp, Homo sapiens
atagtgaaaattttattga

SEQ ID NO: 5237083 - DNA, 16 bp, Homo sapiens
atagtgaaacagcttt

SEQ ID NO: 5237084 - DNA, 14 bp, Homo sapiens
atagtgaacacagc

SEQ ID NO: 5237085 - DNA, 20 bp, Homo sapiens
atagtgaagcaatttgaaat

SEQ ID NO: 5237086 - DNA, 13 bp, Homo sapiens
atagtgaagtgtt

SEQ ID NO: 5237087 - DNA, 17 bp, Homo sapiens
atagtgaagtgttaata

SEQ ID NO: 5237088 - DNA, 15 bp, Homo sapiens
atagtgaatacttac

SEQ ID NO: 5237089 - DNA, 13 bp, Homo sapiens
atagtgacatgca

SEQ ID NO: 5237090 - DNA, 17 bp, Homo sapiens
atagtgacttttcaagt

SEQ ID NO: 5237091 - DNA, 13 bp, Homo sapiens
ataaaactgtgta

SEQ ID NO: 5237092 - DNA, 14 bp, Homo sapiens
ataaaactgtgtaa

SEQ ID NO: 5237093 - DNA, 16 bp, Homo sapiens
ataaaactgtgtaaac

SEQ ID NO: 5237094 - DNA, 17 bp, Homo sapiens
ataaaactgtgtaaacc

SEQ ID NO: 5237095 - DNA, 18 bp, Homo sapiens
ataaaacttaaaaacaag

SEQ ID NO: 5237096 - DNA, 20 bp, Homo sapiens
ataaaactttggcaacatct

SEQ ID NO: 5237097 - DNA, 11 bp, Homo sapiens
ataaaactttt

SEQ ID NO: 5237098 - DNA, 13 bp, Homo sapiens
ataaaagaaaatt

SEQ ID NO: 5237099 - DNA, 13 bp, Homo sapiens
ataaaagaaacac

SEQ ID NO: 5237100 - DNA, 14 bp, Homo sapiens
ataaaagaaatata

SEQ ID NO: 5237101 - DNA, 18 bp, Homo sapiens
ataaaagaaatgcacaat

SEQ ID NO: 5237102 - DNA, 21 bp, Homo sapiens
ataaaagaaatgcacaatgtc

SEQ ID NO: 5237103 - DNA, 12 bp, Homo sapiens
ataaaagaacat

SEQ ID NO: 5237104 - DNA, 14 bp, Homo sapiens
ataaaagaatgtac

SEQ ID NO: 5237105 - DNA, 14 bp, Homo sapiens
ataaaagacacaga

SEQ ID NO: 5237106 - DNA, 16 bp, Homo sapiens
ataaaagagctgtctg

SEQ ID NO: 5237107 - DNA, 17 bp, Homo sapiens
ataaaagagctgtctga

SEQ ID NO: 5237108 - DNA, 12 bp, Homo sapiens
ataaaagagctt

SEQ ID NO: 5237109 - DNA, 14 bp, Homo sapiens
ataaaagatcacct

SEQ ID NO: 5237110 - DNA, 22 bp, Homo sapiens
ataaaagatggggtctgtaaaa

SEQ ID NO: 5237111 - DNA, 14 bp, Homo sapiens
ataaaagcaaaaga

SEQ ID NO: 5237112 - DNA, 12 bp, Homo sapiens
ataaaagcaatt

SEQ ID NO: 5237113 - DNA, 15 bp, Homo sapiens
ataaaagcattgtct

SEQ ID NO: 5237114 - DNA, 15 bp, Homo sapiens
ataaaagcccaggag

SEQ ID NO: 5237115 - DNA, 16 bp, Homo sapiens
ataaaagcccaggagc

SEQ ID NO: 5237116 - DNA, 14 bp, Homo sapiens
ataaaagccttggg

SEQ ID NO: 5237117 - DNA, 17 bp, Homo sapiens
ataaaagctattacttg

SEQ ID NO: 5237118 - DNA, 15 bp, Homo sapiens
ataaaaggaagccaa

SEQ ID NO: 5237119 - DNA, 17 bp, Homo sapiens
ataaaaggaagccaaag

SEQ ID NO: 5237120 - DNA, 20 bp, Homo sapiens
ataaaaggaagccaaagagt

SEQ ID NO: 5237121 - DNA, 12 bp, Homo sapiens
ataaaaggaagt

SEQ ID NO: 5237122 - DNA, 16 bp, Homo sapiens
ataaaaggactctgga

SEQ ID NO: 5237123 - DNA, 16 bp, Homo sapiens
ataaaaggagaataag

SEQ ID NO: 5237124 - DNA, 19 bp, Homo sapiens
ataaaaggataggaaaaga

SEQ ID NO: 5237125 - DNA, 20 bp, Homo sapiens
ataaaagggggtccgtggaa

SEQ ID NO: 5237126 - DNA, 20 bp, Homo sapiens
ataaaagggtcaaacctgta

SEQ ID NO: 5237127 - DNA, 16 bp, Homo sapiens
ataaaaggtctatgct

SEQ ID NO: 5237128 - DNA, 20 bp, Homo sapiens
ataaaaggtgacccttctgt

SEQ ID NO: 5237129 - DNA, 21 bp, Homo sapiens
ataaaagtacatgttaaactt

SEQ ID NO: 5237130 - DNA, 18 bp, Homo sapiens
ataaaagtactgaagacc

SEQ ID NO: 5237131 - DNA, 19 bp, Homo sapiens
ataaaagtgaatgaaagat

SEQ ID NO: 5237132 - DNA, 19 bp, Homo sapiens
ataaaagtgatattcctat

SEQ ID NO: 5237133 - DNA, 22 bp, Homo sapiens
ataaaagtgatcaataaaatgt

SEQ ID NO: 5237134 - DNA, 14 bp, Homo sapiens
ataaaagtgattgt

SEQ ID NO: 5237135 - DNA, 21 bp, Homo sapiens
ataaaagtgattgttggcaca

SEQ ID NO: 5237136 - DNA, 20 bp, Homo sapiens
ataaaagtgccttagcatgt

SEQ ID NO: 5237137 - DNA, 21 bp, Homo sapiens
ataaaagtgccttagcatgtg

SEQ ID NO: 5237138 - DNA, 22 bp, Homo sapiens
ataaaagttattacctttacat

SEQ ID NO: 5237139 - DNA, 14 bp, Homo sapiens
ataaaagttgtact

SEQ ID NO: 5237140 - DNA, 14 bp, Homo sapiens
ataaaataaaataa

SEQ ID NO: 5237141 - DNA, 14 bp, Homo sapiens
ataaaataaacttc

SEQ ID NO: 5237142 - DNA, 15 bp, Homo sapiens
ataaaataaacttct

SEQ ID NO: 5237143 - DNA, 16 bp, Homo sapiens
ataaaataaacttctt

SEQ ID NO: 5237144 - DNA, 12 bp, Homo sapiens
ataaaataaata

SEQ ID NO: 5237145 - DNA, 15 bp, Homo sapiens
ataaaataaataatt

SEQ ID NO: 5237146 - DNA, 13 bp, Homo sapiens
ataaaataaatat

SEQ ID NO: 5237147 - DNA, 15 bp, Homo sapiens
ataaaataaatatat

SEQ ID NO: 5237148 - DNA, 13 bp, Homo sapiens
ataaaataaatta

SEQ ID NO: 5237149 - DNA, 15 bp, Homo sapiens
ataaaataaattatg

SEQ ID NO: 5237150 - DNA, 12 bp, Homo sapiens
ataaaataagaa

SEQ ID NO: 5237151 - DNA, 15 bp, Homo sapiens
ataaaataagaaggg

SEQ ID NO: 5237152 - DNA, 11 bp, Homo sapiens
ataaaataagt

SEQ ID NO: 5237153 - DNA, 12 bp, Homo sapiens
ataaaataagtc

SEQ ID NO: 5237154 - DNA, 21 bp, Homo sapiens
ataaaataagtggattttgta

SEQ ID NO: 5237155 - DNA, 16 bp, Homo sapiens
ataaaataatgctttg

SEQ ID NO: 5237156 - DNA, 23 bp, Homo sapiens
ataaaataatgggattttctttt

SEQ ID NO: 5237157 - DNA, 15 bp, Homo sapiens
ataaaataattctaa

SEQ ID NO: 5237158 - DNA, 21 bp, Homo sapiens
ataaaataatttttatatttg

SEQ ID NO: 5237159 - DNA, 19 bp, Homo sapiens
ataaaatacacgtgtatat

SEQ ID NO: 5237160 - DNA, 16 bp, Homo sapiens
ataaaatactaaacta

SEQ ID NO: 5237161 - DNA, 22 bp, Homo sapiens
ataaaatactctagcctgggcc

SEQ ID NO: 5237162 - DNA, 19 bp, Homo sapiens
ataaaatagaataattctt

SEQ ID NO: 5237163 - DNA, 19 bp, Homo sapiens
ataaaatatacaaacatgt

SEQ ID NO: 5237164 - DNA, 14 bp, Homo sapiens
ataaaatatattta

SEQ ID NO: 5237165 - DNA, 16 bp, Homo sapiens
ataaaatatatttatg

SEQ ID NO: 5237166 - DNA, 17 bp, Homo sapiens
ataaaatatcataaagc

SEQ ID NO: 5237167 - DNA, 13 bp, Homo sapiens
ataaaatatcatt

SEQ ID NO: 5237168 - DNA, 17 bp, Homo sapiens
ataaaatatcattcagc

SEQ ID NO: 5237169 - DNA, 14 bp, Homo sapiens
ataaaatatcctca

SEQ ID NO: 5237170 - DNA, 11 bp, Homo sapiens
ataaaatattt

SEQ ID NO: 5237171 - DNA, 19 bp, Homo sapiens
ataaaatattttcatacag

SEQ ID NO: 5237172 - DNA, 18 bp, Homo sapiens
ataaaatattttctgtgt

SEQ ID NO: 5237173 - DNA, 23 bp, Homo sapiens
ataaaatattttctgtgtgttcc

SEQ ID NO: 5237174 - DNA, 16 bp, Homo sapiens
ataaaatcaaaacaag

SEQ ID NO: 5237175 - DNA, 21 bp, Homo sapiens
ataaaatcaaaacaagtgaaa

SEQ ID NO: 5237176 - DNA, 15 bp, Homo sapiens
ataaaatcagccaat

SEQ ID NO: 5237177 - DNA, 22 bp, Homo sapiens
ataaaatcagccaattatgtta

SEQ ID NO: 5237178 - DNA, 16 bp, Homo sapiens
ataaaatcataagtat

SEQ ID NO: 5237179 - DNA, 20 bp, Homo sapiens
ataaaatcatgtacatttct

SEQ ID NO: 5237180 - DNA, 16 bp, Homo sapiens
ataaaatccaaaatga

SEQ ID NO: 5237181 - DNA, 17 bp, Homo sapiens
ataaaatccaaaatgaa

SEQ ID NO: 5237182 - DNA, 18 bp, Homo sapiens
ataaaatccaatattgta

SEQ ID NO: 5237183 - DNA, 19 bp, Homo sapiens
ataaaatccaatattgtaa

SEQ ID NO: 5237184 - DNA, 15 bp, Homo sapiens
ataaaatccaatgct

SEQ ID NO: 5237185 - DNA, 19 bp, Homo sapiens
ataaaatccatacatttgt

SEQ ID NO: 5237186 - DNA, 14 bp, Homo sapiens
ataaaatcctgtgc

SEQ ID NO: 5237187 - DNA, 18 bp, Homo sapiens
ataaaatctgaattttgc

SEQ ID NO: 5237188 - DNA, 18 bp, Homo sapiens
ataaaatctgctgcacct

SEQ ID NO: 5237189 - DNA, 14 bp, Homo sapiens
ataaaatcttcaac

SEQ ID NO: 5237190 - DNA, 15 bp, Homo sapiens
ataaaatcttcaact

SEQ ID NO: 5237191 - DNA, 16 bp, Homo sapiens
ataaaatgaaaattgt

SEQ ID NO: 5237192 - DNA, 17 bp, Homo sapiens
ataaaatgaaatgtctt

SEQ ID NO: 5237193 - DNA, 23 bp, Homo sapiens
ataaaatgaacatctcttgaaac

SEQ ID NO: 5237194 - DNA, 12 bp, Homo sapiens
ataaaatgaata

SEQ ID NO: 5237195 - DNA, 13 bp, Homo sapiens
ataaaatgaccag

SEQ ID NO: 5237196 - DNA, 15 bp, Homo sapiens
ataaaatgaccagta

SEQ ID NO: 5237197 - DNA, 12 bp, Homo sapiens
ataaaatgaggg

SEQ ID NO: 5237198 - DNA, 19 bp, Homo sapiens
ataaaatgatatattaaac

SEQ ID NO: 5237199 - DNA, 22 bp, Homo sapiens
ataaaatgatatattaaacctt

SEQ ID NO: 5237200 - DNA, 17 bp, Homo sapiens
ataaaatgatcctgcca

SEQ ID NO: 5237201 - DNA, 15 bp, Homo sapiens
ataaaatgatgttat

SEQ ID NO: 5237202 - DNA, 18 bp, Homo sapiens
ataaaatgatttgtggaa

SEQ ID NO: 5237203 - DNA, 18 bp, Homo sapiens
ataaaatgcaaatgaatc

SEQ ID NO: 5237204 - DNA, 23 bp, Homo sapiens
ataaaatgcaaatgaatcattgt

SEQ ID NO: 5237205 - DNA, 18 bp, Homo sapiens
ataaaatgcatactgttg

SEQ ID NO: 5237206 - DNA, 19 bp, Homo sapiens
ataaaatgcatactgttga

SEQ ID NO: 5237207 - DNA, 18 bp, Homo sapiens
ataaaatgcccatttcga

SEQ ID NO: 5237208 - DNA, 12 bp, Homo sapiens
ataaaatgcctc

SEQ ID NO: 5237209 - DNA, 16 bp, Homo sapiens
ataaaatgctcctaga

SEQ ID NO: 5237210 - DNA, 23 bp, Homo sapiens
ataaaatgctcctagaagtctta

SEQ ID NO: 5237211 - DNA, 17 bp, Homo sapiens
ataaaatggacacaaat

SEQ ID NO: 5237212 - DNA, 14 bp, Homo sapiens
ataaaatggcaaca

SEQ ID NO: 5237213 - DNA, 16 bp, Homo sapiens
ataaaatggcaacaaa

SEQ ID NO: 5237214 - DNA, 16 bp, Homo sapiens
ataaaatggctgtaat

SEQ ID NO: 5237215 - DNA, 21 bp, Homo sapiens
ataaaatggtgttttcatgta

SEQ ID NO: 5237216 - DNA, 12 bp, Homo sapiens
ataaaatgtaaa

SEQ ID NO: 5237217 - DNA, 18 bp, Homo sapiens
ataaaatgtaaactgttt

SEQ ID NO: 5237218 - DNA, 14 bp, Homo sapiens
ataaaatgtataaa

SEQ ID NO: 5237219 - DNA, 16 bp, Homo sapiens
ataaaatgtattcaag

SEQ ID NO: 5237220 - DNA, 21 bp, Homo sapiens
ataaaatgtccagtaagatca

SEQ ID NO: 5237221 - DNA, 23 bp, Homo sapiens
ataaaatgtccagtaagatcact

SEQ ID NO: 5237222 - DNA, 13 bp, Homo sapiens
ataaaatgtgatt

SEQ ID NO: 5237223 - DNA, 20 bp, Homo sapiens
ataaaatgtgatttttctga

SEQ ID NO: 5237224 - DNA, 18 bp, Homo sapiens
ataaaatgtgtacagtga

SEQ ID NO: 5237225 - DNA, 19 bp, Homo sapiens
ataaaatgtgtacagtgaa

SEQ ID NO: 5237226 - DNA, 13 bp, Homo sapiens
ataaaatgttgaa

SEQ ID NO: 5237227 - DNA, 16 bp, Homo sapiens
ataaaatgttgaaaag

SEQ ID NO: 5237228 - DNA, 19 bp, Homo sapiens
ataaaatgttgaaaagtca

SEQ ID NO: 5237229 - DNA, 17 bp, Homo sapiens
ataaaatgtttacattt

SEQ ID NO: 5237230 - DNA, 20 bp, Homo sapiens
ataaaatgtttacattttct

SEQ ID NO: 5237231 - DNA, 14 bp, Homo sapiens
ataaaatgtttcat

SEQ ID NO: 5237232 - DNA, 23 bp, Homo sapiens
ataaaattaaaatttaacatctg

SEQ ID NO: 5237233 - DNA, 17 bp, Homo sapiens
ataaaattaaagaaaat

SEQ ID NO: 5237234 - DNA, 18 bp, Homo sapiens
ataaaattaaagaaaata

SEQ ID NO: 5237235 - DNA, 21 bp, Homo sapiens
ataaaattaaagaaaataaaa

SEQ ID NO: 5237236 - DNA, 16 bp, Homo sapiens
ataaaattaaagctga

SEQ ID NO: 5237237 - DNA, 16 bp, Homo sapiens
ataaaattaaatgcct

SEQ ID NO: 5237238 - DNA, 16 bp, Homo sapiens
ataaaattaatgaaga

SEQ ID NO: 5237239 - DNA, 13 bp, Homo sapiens
ataaaattataga

SEQ ID NO: 5237240 - DNA, 19 bp, Homo sapiens
ataaaattatagctctaat

SEQ ID NO: 5237241 - DNA, 15 bp, Homo sapiens
ataaaattatgaaaa

SEQ ID NO: 5237242 - DNA, 13 bp, Homo sapiens
ataaaattatgcc

SEQ ID NO: 5237243 - DNA, 19 bp, Homo sapiens
ataaaattatggtgaaatt

SEQ ID NO: 5237244 - DNA, 13 bp, Homo sapiens
ataaaattattcc

SEQ ID NO: 5237245 - DNA, 13 bp, Homo sapiens
ataaaattatttt

SEQ ID NO: 5237246 - DNA, 17 bp, Homo sapiens
ataaaattatttttatt

SEQ ID NO: 5237247 - DNA, 17 bp, Homo sapiens
ataaaattccctaaagc

SEQ ID NO: 5237248 - DNA, 18 bp, Homo sapiens
ataaaattccctaaagcc

SEQ ID NO: 5237249 - DNA, 17 bp, Homo sapiens
ataaaattcgctttcta

SEQ ID NO: 5237250 - DNA, 14 bp, Homo sapiens
ataaaattgaaaac

SEQ ID NO: 5237251 - DNA, 18 bp, Homo sapiens
ataaaattgaaaacacta

SEQ ID NO: 5237252 - DNA, 17 bp, Homo sapiens
ataaaattggattacag

SEQ ID NO: 5237253 - DNA, 20 bp, Homo sapiens
ataaaattggattacagtat

SEQ ID NO: 5237254 - DNA, 12 bp, Homo sapiens
ataaaattgtga

SEQ ID NO: 5237255 - DNA, 13 bp, Homo sapiens
ataaaattgtgat

SEQ ID NO: 5237256 - DNA, 19 bp, Homo sapiens
ataaaattgtgatgttttg

SEQ ID NO: 5237257 - DNA, 17 bp, Homo sapiens
ataaaatttaaaaactt

SEQ ID NO: 5237258 - DNA, 15 bp, Homo sapiens
ataaaatttacattt

SEQ ID NO: 5237259 - DNA, 13 bp, Homo sapiens
ataaaatttacct

SEQ ID NO: 5237260 - DNA, 20 bp, Homo sapiens
ataaaatttccttcaggttt

SEQ ID NO: 5237261 - DNA, 21 bp, Homo sapiens
ataaaatttccttcaggtttt

SEQ ID NO: 5237262 - DNA, 14 bp, Homo sapiens
ataaaatttctact

SEQ ID NO: 5237263 - DNA, 13 bp, Homo sapiens
ataaaatttctgg

SEQ ID NO: 5237264 - DNA, 13 bp, Homo sapiens
ataaaatttgttg

SEQ ID NO: 5237265 - DNA, 14 bp, Homo sapiens
ataaaattttctag

SEQ ID NO: 5237266 - DNA, 18 bp, Homo sapiens
ataaaattttttactttt

SEQ ID NO: 5237267 - DNA, 17 bp, Homo sapiens
ataaaattttttttcat

SEQ ID NO: 5237268 - DNA, 13 bp, Homo sapiens
ataaacaaacaaa

SEQ ID NO: 5237269 - DNA, 17 bp, Homo sapiens
ataaacaaagacattga

SEQ ID NO: 5237270 - DNA, 22 bp, Homo sapiens
ataaacaacagaaacttctcag

SEQ ID NO: 5237271 - DNA, 19 bp, Homo sapiens
ataaacaagaaaaataaag

SEQ ID NO: 5237272 - DNA, 21 bp, Homo sapiens
ataaacaagaaaaataaagaa

SEQ ID NO: 5237273 - DNA, 23 bp, Homo sapiens
atagtgacttttcaagtatttaa

SEQ ID NO: 5237274 - DNA, 21 bp, Homo sapiens
atagtgagacactgtctctac

SEQ ID NO: 5237275 - DNA, 16 bp, Homo sapiens
atagtgagaccctgtc

SEQ ID NO: 5237276 - DNA, 14 bp, Homo sapiens
atagtgagagagga

SEQ ID NO: 5237277 - DNA, 21 bp, Homo sapiens
atagtgatggggctcagatgg

SEQ ID NO: 5237278 - DNA, 18 bp, Homo sapiens
atagtgcaacatctctga

SEQ ID NO: 5237279 - DNA, 19 bp, Homo sapiens
atagtgcaacatctctgaa

SEQ ID NO: 5237280 - DNA, 15 bp, Homo sapiens
atagtgcaactatga

SEQ ID NO: 5237281 - DNA, 20 bp, Homo sapiens
atagtgcaactatgaatgta

SEQ ID NO: 5237282 - DNA, 10 bp, Homo sapiens
atagtgcaag

SEQ ID NO: 5237283 - DNA, 12 bp, Homo sapiens
atagtgcaatat

SEQ ID NO: 5237284 - DNA, 15 bp, Homo sapiens
atagtgcacaaaatg

SEQ ID NO: 5237285 - DNA, 16 bp, Homo sapiens
atagtgcacacttgta

SEQ ID NO: 5237286 - DNA, 22 bp, Homo sapiens
atagtgccaggaaactaatttc

SEQ ID NO: 5237287 - DNA, 16 bp, Homo sapiens
atagtgccaggtggct

SEQ ID NO: 5237288 - DNA, 17 bp, Homo sapiens
atagtgcctaaaattgt

SEQ ID NO: 5237289 - DNA, 23 bp, Homo sapiens
atagtgcctaaagtgctgcagcc

SEQ ID NO: 5237290 - DNA, 21 bp, Homo sapiens
atagtgcctcagcgctgccca

SEQ ID NO: 5237291 - DNA, 18 bp, Homo sapiens
atagtgccttgattttaa

SEQ ID NO: 5237292 - DNA, 23 bp, Homo sapiens
atagtgccttgattttaattcag

SEQ ID NO: 5237293 - DNA, 12 bp, Homo sapiens
atagtgcctttt

SEQ ID NO: 5237294 - DNA, 22 bp, Homo sapiens
atagtgctaagaaagcaagcca

SEQ ID NO: 5237295 - DNA, 22 bp, Homo sapiens
atagtgctatatatataaatat

SEQ ID NO: 5237296 - DNA, 20 bp, Homo sapiens
atagtgctcgctttctatgt

SEQ ID NO: 5237297 - DNA, 23 bp, Homo sapiens
atagtgctcgctttctatgtagt

SEQ ID NO: 5237298 - DNA, 16 bp, Homo sapiens
atagtgctgtttaagc

SEQ ID NO: 5237299 - DNA, 20 bp, Homo sapiens
atagtgcttcacaaaatgca

SEQ ID NO: 5237300 - DNA, 18 bp, Homo sapiens
atagtgcttcttgtaata

SEQ ID NO: 5237301 - DNA, 17 bp, Homo sapiens
atagtggaaatcgctta

SEQ ID NO: 5237302 - DNA, 23 bp, Homo sapiens
atagtggaaatcgcttatatgtc

SEQ ID NO: 5237303 - DNA, 20 bp, Homo sapiens
atagtggaacattttcatat

SEQ ID NO: 5237304 - DNA, 22 bp, Homo sapiens
atagtggacattgttggcagca

SEQ ID NO: 5237305 - DNA, 13 bp, Homo sapiens
atagtggatggac

SEQ ID NO: 5237306 - DNA, 16 bp, Homo sapiens
atagtggatggacaga

SEQ ID NO: 5237307 - DNA, 21 bp, Homo sapiens
atagtggccagaccagagctc

SEQ ID NO: 5237308 - DNA, 17 bp, Homo sapiens
atagtggggcctgggag

SEQ ID NO: 5237309 - DNA, 16 bp, Homo sapiens
atagtgggtacatcaa

SEQ ID NO: 5237310 - DNA, 17 bp, Homo sapiens
atagtgggtacatcaag

SEQ ID NO: 5237311 - DNA, 16 bp, Homo sapiens
atagtggtattttaac

SEQ ID NO: 5237312 - DNA, 19 bp, Homo sapiens
atagtggtattttaacata

SEQ ID NO: 5237313 - DNA, 21 bp, Homo sapiens
atagtggtgttttaaagagaa

SEQ ID NO: 5237314 - DNA, 15 bp, Homo sapiens
atagtgtaaactgaa

SEQ ID NO: 5237315 - DNA, 19 bp, Homo sapiens
atagtgtaaactgaaacat

SEQ ID NO: 5237316 - DNA, 18 bp, Homo sapiens
atagtgtaacttgcttaa

SEQ ID NO: 5237317 - DNA, 23 bp, Homo sapiens
atagtgtaacttgcttaaatttc

SEQ ID NO: 5237318 - DNA, 12 bp, Homo sapiens
atagtgtaagaa

SEQ ID NO: 5237319 - DNA, 17 bp, Homo sapiens
atagtgtaagaactgta

SEQ ID NO: 5237320 - DNA, 19 bp, Homo sapiens
atagtgtaagaactgtaca

SEQ ID NO: 5237321 - DNA, 19 bp, Homo sapiens
atagtgtaataatgttatt

SEQ ID NO: 5237322 - DNA, 19 bp, Homo sapiens
atagtgtagctgaggaggc

SEQ ID NO: 5237323 - DNA, 15 bp, Homo sapiens
atagtgtaggcttta

SEQ ID NO: 5237324 - DNA, 22 bp, Homo sapiens
atagtgtcatagacttgggaaa

SEQ ID NO: 5237325 - DNA, 19 bp, Homo sapiens
atagtgtcatataaactca

SEQ ID NO: 5237326 - DNA, 21 bp, Homo sapiens
atagtgtcatataaactcatt

SEQ ID NO: 5237327 - DNA, 13 bp, Homo sapiens
atagtgtccaggc

SEQ ID NO: 5237328 - DNA, 16 bp, Homo sapiens
atagtgtcctatgcaa

SEQ ID NO: 5237329 - DNA, 14 bp, Homo sapiens
atagtgtgaagatc

SEQ ID NO: 5237330 - DNA, 13 bp, Homo sapiens
atagtgtgaggga

SEQ ID NO: 5237331 - DNA, 20 bp, Homo sapiens
atagtgtgctcggacacagt

SEQ ID NO: 5237332 - DNA, 12 bp, Homo sapiens
atagtgttaatc

SEQ ID NO: 5237333 - DNA, 15 bp, Homo sapiens
atagtgttaatcaat

SEQ ID NO: 5237334 - DNA, 21 bp, Homo sapiens
atagtgttaatcaatttaaac

SEQ ID NO: 5237335 - DNA, 14 bp, Homo sapiens
atagtgttcacaaa

SEQ ID NO: 5237336 - DNA, 16 bp, Homo sapiens
atagtgttctgctcct

SEQ ID NO: 5237337 - DNA, 19 bp, Homo sapiens
atagtgttgatcagatctt

SEQ ID NO: 5237338 - DNA, 13 bp, Homo sapiens
atagtgttgtgtt

SEQ ID NO: 5237339 - DNA, 22 bp, Homo sapiens
atagtgttgtgttacaataagt

SEQ ID NO: 5237340 - DNA, 14 bp, Homo sapiens
atagtgtttaactg

SEQ ID NO: 5237341 - DNA, 15 bp, Homo sapiens
atagtgtttaactgg

SEQ ID NO: 5237342 - DNA, 18 bp, Homo sapiens
atagtgtttcgttaagca

SEQ ID NO: 5237343 - DNA, 21 bp, Homo sapiens
atagtgtttcgttaagcagta

SEQ ID NO: 5237344 - DNA, 23 bp, Homo sapiens
atagtgtttcgttaagcagtaca

SEQ ID NO: 5237345 - DNA, 18 bp, Homo sapiens
atagtgttttattataaa

SEQ ID NO: 5237346 - DNA, 21 bp, Homo sapiens
atagttaaaaattaaatattt

SEQ ID NO: 5237347 - DNA, 23 bp, Homo sapiens
atagttaaaagactgcagctgct

SEQ ID NO: 5237348 - DNA, 15 bp, Homo sapiens
atagttaaaatgctg

SEQ ID NO: 5237349 - DNA, 17 bp, Homo sapiens
atagttaacacactacc

SEQ ID NO: 5237350 - DNA, 16 bp, Homo sapiens
atagttaatattttgt

SEQ ID NO: 5237351 - DNA, 13 bp, Homo sapiens
atagttacaacat

SEQ ID NO: 5237352 - DNA, 15 bp, Homo sapiens
atagttacaagcatt

SEQ ID NO: 5237353 - DNA, 16 bp, Homo sapiens
atagttacaagcattg

SEQ ID NO: 5237354 - DNA, 17 bp, Homo sapiens
atagttactgtaaaatg

SEQ ID NO: 5237355 - DNA, 13 bp, Homo sapiens
atagttactgtgt

SEQ ID NO: 5237356 - DNA, 13 bp, Homo sapiens
atagttagaactg

SEQ ID NO: 5237357 - DNA, 15 bp, Homo sapiens
atagttagattccaa

SEQ ID NO: 5237358 - DNA, 16 bp, Homo sapiens
atagttagctaataaa

SEQ ID NO: 5237359 - DNA, 16 bp, Homo sapiens
atagttagctttattg

SEQ ID NO: 5237360 - DNA, 23 bp, Homo sapiens
atagttaggatagcatttttgat

SEQ ID NO: 5237361 - DNA, 23 bp, Homo sapiens
atagttatatagataaagagata

SEQ ID NO: 5237362 - DNA, 14 bp, Homo sapiens
atagttatgtaaat

SEQ ID NO: 5237363 - DNA, 16 bp, Homo sapiens
atagttatgtaaataa

SEQ ID NO: 5237364 - DNA, 15 bp, Homo sapiens
atagttattaaatgt

SEQ ID NO: 5237365 - DNA, 19 bp, Homo sapiens
atagttattaaatgtttca

SEQ ID NO: 5237366 - DNA, 14 bp, Homo sapiens
atagttattaatgt

SEQ ID NO: 5237367 - DNA, 18 bp, Homo sapiens
atagttattattgctgtt

SEQ ID NO: 5237368 - DNA, 17 bp, Homo sapiens
atagttattatttaatt

SEQ ID NO: 5237369 - DNA, 21 bp, Homo sapiens
atagttattttaataccttta

SEQ ID NO: 5237370 - DNA, 14 bp, Homo sapiens
atagttcaccccct

SEQ ID NO: 5237371 - DNA, 18 bp, Homo sapiens
atagttcagaatttagtg

SEQ ID NO: 5237372 - DNA, 21 bp, Homo sapiens
atagttcagaatttagtgtat

SEQ ID NO: 5237373 - DNA, 13 bp, Homo sapiens
atagttcaggatt

SEQ ID NO: 5237374 - DNA, 21 bp, Homo sapiens
atagttcagtagaattaccat

SEQ ID NO: 5237375 - DNA, 11 bp, Homo sapiens
atagttccagt

SEQ ID NO: 5237376 - DNA, 16 bp, Homo sapiens
atagttccttgcctta

SEQ ID NO: 5237377 - DNA, 21 bp, Homo sapiens
atagttccttgccttaataaa

SEQ ID NO: 5237378 - DNA, 22 bp, Homo sapiens
atagttccttgccttaataaat

SEQ ID NO: 5237379 - DNA, 18 bp, Homo sapiens
atagttctatttctatct

SEQ ID NO: 5237380 - DNA, 21 bp, Homo sapiens
atagttctccagttgtatgga

SEQ ID NO: 5237381 - DNA, 19 bp, Homo sapiens
atagttctgaggtccctgt

SEQ ID NO: 5237382 - DNA, 19 bp, Homo sapiens
atagttctgcaataacagt

SEQ ID NO: 5237383 - DNA, 19 bp, Homo sapiens
atagttcttagctttgaaa

SEQ ID NO: 5237384 - DNA, 21 bp, Homo sapiens
atagttcttagctttgaaact

SEQ ID NO: 5237385 - DNA, 14 bp, Homo sapiens
atagttgaaagtaa

SEQ ID NO: 5237386 - DNA, 22 bp, Homo sapiens
atagttgaaagtaaaaaaataa

SEQ ID NO: 5237387 - DNA, 21 bp, Homo sapiens
atagttgaacctatttctctt

SEQ ID NO: 5237388 - DNA, 19 bp, Homo sapiens
atagttgaagggaggtgaa

SEQ ID NO: 5237389 - DNA, 21 bp, Homo sapiens
atagttgagccagcagacatt

SEQ ID NO: 5237390 - DNA, 20 bp, Homo sapiens
atagttgatatgtaacagtt

SEQ ID NO: 5237391 - DNA, 20 bp, Homo sapiens
atagttgcagcccaaggaca

SEQ ID NO: 5237392 - DNA, 21 bp, Homo sapiens
atagttgcatagcagtatatg

SEQ ID NO: 5237393 - DNA, 22 bp, Homo sapiens
atagttgccaatctaaaatggc

SEQ ID NO: 5237394 - DNA, 20 bp, Homo sapiens
atagttgcttttgaaggaat

SEQ ID NO: 5237395 - DNA, 12 bp, Homo sapiens
atagttgtaaag

SEQ ID NO: 5237396 - DNA, 15 bp, Homo sapiens
atagttgtaaatata

SEQ ID NO: 5237397 - DNA, 13 bp, Homo sapiens
atagttgtatttt

SEQ ID NO: 5237398 - DNA, 15 bp, Homo sapiens
atagttgtattttgt

SEQ ID NO: 5237399 - DNA, 16 bp, Homo sapiens
atagttgtcagaatat

SEQ ID NO: 5237400 - DNA, 22 bp, Homo sapiens
atagttgtcagtattattctac

SEQ ID NO: 5237401 - DNA, 13 bp, Homo sapiens
atagttgtctgtg

SEQ ID NO: 5237402 - DNA, 15 bp, Homo sapiens
atagttgtctttctt

SEQ ID NO: 5237403 - DNA, 19 bp, Homo sapiens
atagttgtctttctttgct

SEQ ID NO: 5237404 - DNA, 20 bp, Homo sapiens
atagttgtgttaagcttgcg

SEQ ID NO: 5237405 - DNA, 22 bp, Homo sapiens
atagtttaaaaatctgccacct

SEQ ID NO: 5237406 - DNA, 13 bp, Homo sapiens
atagtttaaaaca

SEQ ID NO: 5237407 - DNA, 15 bp, Homo sapiens
atagtttacaaacaa

SEQ ID NO: 5237408 - DNA, 15 bp, Homo sapiens
atagtttactatttt

SEQ ID NO: 5237409 - DNA, 16 bp, Homo sapiens
atagtttactatttta

SEQ ID NO: 5237410 - DNA, 12 bp, Homo sapiens
atagtttatttc

SEQ ID NO: 5237411 - DNA, 17 bp, Homo sapiens
atagtttatttctgtga

SEQ ID NO: 5237412 - DNA, 19 bp, Homo sapiens
atagtttattttaaaacaa

SEQ ID NO: 5237413 - DNA, 16 bp, Homo sapiens
atagtttcaaatctgt

SEQ ID NO: 5237414 - DNA, 19 bp, Homo sapiens
atagtttcaccactcctct

SEQ ID NO: 5237415 - DNA, 21 bp, Homo sapiens
atagtttcaccactcctctcc

SEQ ID NO: 5237416 - DNA, 14 bp, Homo sapiens
atagtttcagatat

SEQ ID NO: 5237417 - DNA, 17 bp, Homo sapiens
atagtttccaagaaatt

SEQ ID NO: 5237418 - DNA, 22 bp, Homo sapiens
atagtttctaaaccatgaaaag

SEQ ID NO: 5237419 - DNA, 14 bp, Homo sapiens
atagtttctgtaat

SEQ ID NO: 5237420 - DNA, 15 bp, Homo sapiens
atagtttctgtaatt

SEQ ID NO: 5237421 - DNA, 13 bp, Homo sapiens
atagtttctttat

SEQ ID NO: 5237422 - DNA, 18 bp, Homo sapiens
atagtttctttattttgt

SEQ ID NO: 5237423 - DNA, 17 bp, Homo sapiens
atagtttgaaatagaaa

SEQ ID NO: 5237424 - DNA, 13 bp, Homo sapiens
atagtttgacagg

SEQ ID NO: 5237425 - DNA, 22 bp, Homo sapiens
atagtttgctttgctttttaat

SEQ ID NO: 5237426 - DNA, 21 bp, Homo sapiens
atagtttgctttgtttaagca

SEQ ID NO: 5237427 - DNA, 19 bp, Homo sapiens
atagtttggatatgtaaaa

SEQ ID NO: 5237428 - DNA, 13 bp, Homo sapiens
atagtttgtacat

SEQ ID NO: 5237429 - DNA, 12 bp, Homo sapiens
atagtttgtcat

SEQ ID NO: 5237430 - DNA, 15 bp, Homo sapiens
atagtttgtctattt

SEQ ID NO: 5237431 - DNA, 16 bp, Homo sapiens
atagtttgtctatttt

SEQ ID NO: 5237432 - DNA, 14 bp, Homo sapiens
atagtttgtgaatc

SEQ ID NO: 5237433 - DNA, 12 bp, Homo sapiens
atagtttgttat

SEQ ID NO: 5237434 - DNA, 15 bp, Homo sapiens
atagtttgttttctt

SEQ ID NO: 5237435 - DNA, 21 bp, Homo sapiens
atagttttaaatatgaacaaa

SEQ ID NO: 5237436 - DNA, 23 bp, Homo sapiens
atagttttacactctagtgccat

SEQ ID NO: 5237437 - DNA, 15 bp, Homo sapiens
atagttttacccata

SEQ ID NO: 5237438 - DNA, 21 bp, Homo sapiens
atagttttacttttaaactgt

SEQ ID NO: 5237439 - DNA, 24 bp, Homo sapiens
atagttttatttatatttattgac

SEQ ID NO: 5237440 - DNA, 22 bp, Homo sapiens
atagttttcacccaagagctgt

SEQ ID NO: 5237441 - DNA, 20 bp, Homo sapiens
atagttttcatccataactg

SEQ ID NO: 5237442 - DNA, 22 bp, Homo sapiens
atagttttcatccataactgaa

SEQ ID NO: 5237443 - DNA, 23 bp, Homo sapiens
atagttttcatccataactgaac

SEQ ID NO: 5237444 - DNA, 19 bp, Homo sapiens
atagttttcattttaactg

SEQ ID NO: 5237445 - DNA, 13 bp, Homo sapiens
atagttttctaaa

SEQ ID NO: 5237446 - DNA, 13 bp, Homo sapiens
atagttttctaga

SEQ ID NO: 5237447 - DNA, 17 bp, Homo sapiens
atagttttgtaagtaac

SEQ ID NO: 5237448 - DNA, 21 bp, Homo sapiens
atagtttttttcttttttaat

SEQ ID NO: 5237449 - DNA, 20 bp, Homo sapiens
atagtttttttttttttcct

SEQ ID NO: 5237450 - DNA, 17 bp, Homo sapiens
atataaaaaatatatgt

SEQ ID NO: 5237451 - DNA, 15 bp, Homo sapiens
ataaacaagaatgaa

SEQ ID NO: 5237452 - DNA, 15 bp, Homo sapiens
ataaacaagcatttc

SEQ ID NO: 5237453 - DNA, 23 bp, Homo sapiens
ataaacacatagattcacctgta

SEQ ID NO: 5237454 - DNA, 24 bp, Homo sapiens
ataaacacatagattcacctgtaa

SEQ ID NO: 5237455 - DNA, 16 bp, Homo sapiens
ataaacacattgaatg

SEQ ID NO: 5237456 - DNA, 22 bp, Homo sapiens
ataaacacattgaatgcgcttt

SEQ ID NO: 5237457 - DNA, 16 bp, Homo sapiens
ataaacacatttccat

SEQ ID NO: 5237458 - DNA, 18 bp, Homo sapiens
ataaacaccactggatta

SEQ ID NO: 5237459 - DNA, 20 bp, Homo sapiens
ataaacaccactggattaat

SEQ ID NO: 5237460 - DNA, 14 bp, Homo sapiens
ataaacactacaga

SEQ ID NO: 5237461 - DNA, 23 bp, Homo sapiens
ataaacactcttgaaaaatgcat

SEQ ID NO: 5237462 - DNA, 17 bp, Homo sapiens
ataaacactggctctgg

SEQ ID NO: 5237463 - DNA, 19 bp, Homo sapiens
ataaacactggtgccaacc

SEQ ID NO: 5237464 - DNA, 20 bp, Homo sapiens
ataaacactggttgtagtca

SEQ ID NO: 5237465 - DNA, 12 bp, Homo sapiens
ataaacactgtt

SEQ ID NO: 5237466 - DNA, 17 bp, Homo sapiens
ataaacagaaatgctct

SEQ ID NO: 5237467 - DNA, 14 bp, Homo sapiens
ataaacagacaata

SEQ ID NO: 5237468 - DNA, 19 bp, Homo sapiens
ataaacagacaatatgtga

SEQ ID NO: 5237469 - DNA, 20 bp, Homo sapiens
ataaacagactgttaattat

SEQ ID NO: 5237470 - DNA, 13 bp, Homo sapiens
ataaacagcacac

SEQ ID NO: 5237471 - DNA, 15 bp, Homo sapiens
ataaacagcagggtt

SEQ ID NO: 5237472 - DNA, 21 bp, Homo sapiens
ataaacagcagggtttgagca

SEQ ID NO: 5237473 - DNA, 12 bp, Homo sapiens
ataaacagcatt

SEQ ID NO: 5237474 - DNA, 14 bp, Homo sapiens
ataaacagcattta

SEQ ID NO: 5237475 - DNA, 15 bp, Homo sapiens
ataaacaggagttca

SEQ ID NO: 5237476 - DNA, 13 bp, Homo sapiens
ataaacagtaatg

SEQ ID NO: 5237477 - DNA, 12 bp, Homo sapiens
ataaacagtcac

SEQ ID NO: 5237478 - DNA, 20 bp, Homo sapiens
ataaacagtgagcatatctg

SEQ ID NO: 5237479 - DNA, 16 bp, Homo sapiens
ataaacagtttgacaa

SEQ ID NO: 5237480 - DNA, 21 bp, Homo sapiens
ataaacatatttttatacttt

SEQ ID NO: 5237481 - DNA, 17 bp, Homo sapiens
ataaacatcacacacac

SEQ ID NO: 5237482 - DNA, 19 bp, Homo sapiens
ataaacatcaggttaggca

SEQ ID NO: 5237483 - DNA, 15 bp, Homo sapiens
ataaacatccttgta

SEQ ID NO: 5237484 - DNA, 16 bp, Homo sapiens
ataaacattaaaagaa

SEQ ID NO: 5237485 - DNA, 14 bp, Homo sapiens
ataaacattaaaca

SEQ ID NO: 5237486 - DNA, 15 bp, Homo sapiens
ataaacattaaacac

SEQ ID NO: 5237487 - DNA, 23 bp, Homo sapiens
ataaacattaagattgaggcctg

SEQ ID NO: 5237488 - DNA, 22 bp, Homo sapiens
ataaacatttgtagcatcctct

SEQ ID NO: 5237489 - DNA, 13 bp, Homo sapiens
ataaacattttat

SEQ ID NO: 5237490 - DNA, 14 bp, Homo sapiens
ataaacattttatt

SEQ ID NO: 5237491 - DNA, 17 bp, Homo sapiens
ataaaccaaaaacattt

SEQ ID NO: 5237492 - DNA, 20 bp, Homo sapiens
ataaaccaaacccagccact

SEQ ID NO: 5237493 - DNA, 16 bp, Homo sapiens
ataaaccaaaggacat

SEQ ID NO: 5237494 - DNA, 20 bp, Homo sapiens
ataaaccaaaggacattatg

SEQ ID NO: 5237495 - DNA, 22 bp, Homo sapiens
ataaaccaaatatgttaaagtt

SEQ ID NO: 5237496 - DNA, 15 bp, Homo sapiens
ataaaccacaagcat

SEQ ID NO: 5237497 - DNA, 16 bp, Homo sapiens
ataaaccacaagcatc

SEQ ID NO: 5237498 - DNA, 14 bp, Homo sapiens
ataaaccactcagt

SEQ ID NO: 5237499 - DNA, 18 bp, Homo sapiens
ataaaccacttgagccta

SEQ ID NO: 5237500 - DNA, 16 bp, Homo sapiens
ataaaccagatcaaat

SEQ ID NO: 5237501 - DNA, 22 bp, Homo sapiens
ataaaccagctacttgatgtaa

SEQ ID NO: 5237502 - DNA, 11 bp, Homo sapiens
ataaaccagtg

SEQ ID NO: 5237503 - DNA, 13 bp, Homo sapiens
ataaaccagtgtg

SEQ ID NO: 5237504 - DNA, 14 bp, Homo sapiens
ataaaccagtgtga

SEQ ID NO: 5237505 - DNA, 16 bp, Homo sapiens
ataaaccagtgtgaac

SEQ ID NO: 5237506 - DNA, 17 bp, Homo sapiens
ataaaccagtgtgaacc

SEQ ID NO: 5237507 - DNA, 19 bp, Homo sapiens
ataaaccagtgtgaacccc

SEQ ID NO: 5237508 - DNA, 13 bp, Homo sapiens
ataaaccattcca

SEQ ID NO: 5237509 - DNA, 16 bp, Homo sapiens
ataaaccattggacag

SEQ ID NO: 5237510 - DNA, 16 bp, Homo sapiens
ataaacccattttggt

SEQ ID NO: 5237511 - DNA, 23 bp, Homo sapiens
ataaacccattttggtgcaatat

SEQ ID NO: 5237512 - DNA, 16 bp, Homo sapiens
ataaaccgaactgatg

SEQ ID NO: 5237513 - DNA, 17 bp, Homo sapiens
ataaaccggatcctgtt

SEQ ID NO: 5237514 - DNA, 23 bp, Homo sapiens
ataaaccgtgtatttattacatt

SEQ ID NO: 5237515 - DNA, 17 bp, Homo sapiens
ataaacctaatattcaa

SEQ ID NO: 5237516 - DNA, 15 bp, Homo sapiens
ataaacctatgaata

SEQ ID NO: 5237517 - DNA, 20 bp, Homo sapiens
ataaacctctaatttatttt

SEQ ID NO: 5237518 - DNA, 22 bp, Homo sapiens
ataaacctctaatttattttgt

SEQ ID NO: 5237519 - DNA, 17 bp, Homo sapiens
ataaacctgcactgaaa

SEQ ID NO: 5237520 - DNA, 14 bp, Homo sapiens
ataaacctggagat

SEQ ID NO: 5237521 - DNA, 16 bp, Homo sapiens
ataaacctggagatga

SEQ ID NO: 5237522 - DNA, 23 bp, Homo sapiens
ataaacctgggcaagtgaggcaa

SEQ ID NO: 5237523 - DNA, 16 bp, Homo sapiens
ataaacctgttttgca

SEQ ID NO: 5237524 - DNA, 16 bp, Homo sapiens
ataaaccttaagtaag

SEQ ID NO: 5237525 - DNA, 20 bp, Homo sapiens
ataaaccttgtttctttctg

SEQ ID NO: 5237526 - DNA, 16 bp, Homo sapiens
ataaacgaaacacaga

SEQ ID NO: 5237527 - DNA, 15 bp, Homo sapiens
ataaacgaaacattt

SEQ ID NO: 5237528 - DNA, 22 bp, Homo sapiens
ataaacgaaacatttagacaat

SEQ ID NO: 5237529 - DNA, 19 bp, Homo sapiens
ataaacgatatatgtaaat

SEQ ID NO: 5237530 - DNA, 20 bp, Homo sapiens
ataaacgatatatgtaaata

SEQ ID NO: 5237531 - DNA, 18 bp, Homo sapiens
ataaacgatgttgtgatg

SEQ ID NO: 5237532 - DNA, 15 bp, Homo sapiens
ataaacgatttaatt

SEQ ID NO: 5237533 - DNA, 19 bp, Homo sapiens
ataaacgatttaattctct

SEQ ID NO: 5237534 - DNA, 20 bp, Homo sapiens
ataaacgatttaattctctt

SEQ ID NO: 5237535 - DNA, 20 bp, Homo sapiens
ataaacgcgggaaaaaagat

SEQ ID NO: 5237536 - DNA, 16 bp, Homo sapiens
ataaacggttcctggt

SEQ ID NO: 5237537 - DNA, 15 bp, Homo sapiens
ataaacgtcttaaat

SEQ ID NO: 5237538 - DNA, 18 bp, Homo sapiens
ataaacgtcttaaatatt

SEQ ID NO: 5237539 - DNA, 20 bp, Homo sapiens
ataaacgtgcgcggactgtc

SEQ ID NO: 5237540 - DNA, 18 bp, Homo sapiens
ataaacgtggatgttact

SEQ ID NO: 5237541 - DNA, 19 bp, Homo sapiens
ataaacgtggattttaaaa

SEQ ID NO: 5237542 - DNA, 14 bp, Homo sapiens
ataaacgtttgaaa

SEQ ID NO: 5237543 - DNA, 12 bp, Homo sapiens
ataaactaaaga

SEQ ID NO: 5237544 - DNA, 15 bp, Homo sapiens
ataaactaataattg

SEQ ID NO: 5237545 - DNA, 17 bp, Homo sapiens
ataaactaataattgca

SEQ ID NO: 5237546 - DNA, 22 bp, Homo sapiens
ataaactaatggtccacaccca

SEQ ID NO: 5237547 - DNA, 15 bp, Homo sapiens
ataaactactgtaat

SEQ ID NO: 5237548 - DNA, 22 bp, Homo sapiens
ataaactagatactgttgatct

SEQ ID NO: 5237549 - DNA, 14 bp, Homo sapiens
ataaactagatctc

SEQ ID NO: 5237550 - DNA, 15 bp, Homo sapiens
ataaactagatctcc

SEQ ID NO: 5237551 - DNA, 23 bp, Homo sapiens
ataaactagggttttggcctgcc

SEQ ID NO: 5237552 - DNA, 12 bp, Homo sapiens
ataaactagttt

SEQ ID NO: 5237553 - DNA, 12 bp, Homo sapiens
ataaactataaa

SEQ ID NO: 5237554 - DNA, 16 bp, Homo sapiens
ataaactataaaacaa

SEQ ID NO: 5237555 - DNA, 16 bp, Homo sapiens
ataaactataaactta

SEQ ID NO: 5237556 - DNA, 17 bp, Homo sapiens
ataaactataaacttaa

SEQ ID NO: 5237557 - DNA, 20 bp, Homo sapiens
ataaactatttttttcttaa

SEQ ID NO: 5237558 - DNA, 16 bp, Homo sapiens
ataaactcagatctga

SEQ ID NO: 5237559 - DNA, 18 bp, Homo sapiens
ataaactcagatctgatc

SEQ ID NO: 5237560 - DNA, 17 bp, Homo sapiens
ataaactcataaaactc

SEQ ID NO: 5237561 - DNA, 15 bp, Homo sapiens
ataaactcatttcta

SEQ ID NO: 5237562 - DNA, 17 bp, Homo sapiens
ataaactcattttgctt

SEQ ID NO: 5237563 - DNA, 12 bp, Homo sapiens
ataaactcttca

SEQ ID NO: 5237564 - DNA, 19 bp, Homo sapiens
ataaactcttcaaggccaa

SEQ ID NO: 5237565 - DNA, 17 bp, Homo sapiens
ataaactgaaaaatgtc

SEQ ID NO: 5237566 - DNA, 14 bp, Homo sapiens
ataaactgaatatt

SEQ ID NO: 5237567 - DNA, 20 bp, Homo sapiens
ataaactgaatattttggaa

SEQ ID NO: 5237568 - DNA, 13 bp, Homo sapiens
ataaactgaattt

SEQ ID NO: 5237569 - DNA, 17 bp, Homo sapiens
ataaactgcaagttcat

SEQ ID NO: 5237570 - DNA, 16 bp, Homo sapiens
ataaactgctgtcaat

SEQ ID NO: 5237571 - DNA, 23 bp, Homo sapiens
ataaactggggagttataaaaat

SEQ ID NO: 5237572 - DNA, 13 bp, Homo sapiens
ataaactgtaaac

SEQ ID NO: 5237573 - DNA, 21 bp, Homo sapiens
ataaactgtagcgaccccaga

SEQ ID NO: 5237574 - DNA, 17 bp, Homo sapiens
ataaactgtcctctttc

SEQ ID NO: 5237575 - DNA, 11 bp, Homo sapiens
ataaactgtga

SEQ ID NO: 5237576 - DNA, 12 bp, Homo sapiens
ataaactgtgtg

SEQ ID NO: 5237577 - DNA, 14 bp, Homo sapiens
ataaactgtgtgca

SEQ ID NO: 5237578 - DNA, 12 bp, Homo sapiens
ataaactgttta

SEQ ID NO: 5237579 - DNA, 21 bp, Homo sapiens
ataaactgtttcagatttttt

SEQ ID NO: 5237580 - DNA, 14 bp, Homo sapiens
ataaacttaaagct

SEQ ID NO: 5237581 - DNA, 22 bp, Homo sapiens
ataaacttaaagctactgtaga

SEQ ID NO: 5237582 - DNA, 15 bp, Homo sapiens
ataaacttagaataa

SEQ ID NO: 5237583 - DNA, 11 bp, Homo sapiens
ataaacttcag

SEQ ID NO: 5237584 - DNA, 12 bp, Homo sapiens
ataaacttctta

SEQ ID NO: 5237585 - DNA, 17 bp, Homo sapiens
ataaacttgtgcctcca

SEQ ID NO: 5237586 - DNA, 20 bp, Homo sapiens
ataaactttaatataaagta

SEQ ID NO: 5237587 - DNA, 16 bp, Homo sapiens
ataaactttacctttt

SEQ ID NO: 5237588 - DNA, 17 bp, Homo sapiens
ataaactttataaattc

SEQ ID NO: 5237589 - DNA, 19 bp, Homo sapiens
ataaactttgaataaaaga

SEQ ID NO: 5237590 - DNA, 20 bp, Homo sapiens
ataaactttgaataaaagaa

SEQ ID NO: 5237591 - DNA, 12 bp, Homo sapiens
ataaacttttat

SEQ ID NO: 5237592 - DNA, 21 bp, Homo sapiens
ataaacttttatacttgggta

SEQ ID NO: 5237593 - DNA, 20 bp, Homo sapiens
ataaacttttttcttactgt

SEQ ID NO: 5237594 - DNA, 17 bp, Homo sapiens
ataaactttttttcaat

SEQ ID NO: 5237595 - DNA, 20 bp, Homo sapiens
ataaactttttttcaatgtg

SEQ ID NO: 5237596 - DNA, 13 bp, Homo sapiens
ataaagaaaaaaa

SEQ ID NO: 5237597 - DNA, 18 bp, Homo sapiens
ataaagaaaaaaatagtt

SEQ ID NO: 5237598 - DNA, 18 bp, Homo sapiens
ataaagaaaaagaagtac

SEQ ID NO: 5237599 - DNA, 13 bp, Homo sapiens
ataaagaaaaata

SEQ ID NO: 5237600 - DNA, 18 bp, Homo sapiens
ataaagaaaacctttcta

SEQ ID NO: 5237601 - DNA, 13 bp, Homo sapiens
ataaagaaaagat

SEQ ID NO: 5237602 - DNA, 14 bp, Homo sapiens
ataaagaaaagatg

SEQ ID NO: 5237603 - DNA, 15 bp, Homo sapiens
ataaagaaaagatgc

SEQ ID NO: 5237604 - DNA, 13 bp, Homo sapiens
ataaagaaaatga

SEQ ID NO: 5237605 - DNA, 16 bp, Homo sapiens
ataaagaaacactttc

SEQ ID NO: 5237606 - DNA, 14 bp, Homo sapiens
ataaagaaaccttt

SEQ ID NO: 5237607 - DNA, 18 bp, Homo sapiens
ataaagaaatagaacaag

SEQ ID NO: 5237608 - DNA, 15 bp, Homo sapiens
ataaagaaattcaag

SEQ ID NO: 5237609 - DNA, 17 bp, Homo sapiens
ataaagaaattcaagaa

SEQ ID NO: 5237610 - DNA, 17 bp, Homo sapiens
ataaagaaatttggtac

SEQ ID NO: 5237611 - DNA, 21 bp, Homo sapiens
ataaagaactccttattttgt

SEQ ID NO: 5237612 - DNA, 19 bp, Homo sapiens
ataaagaaggataaattgt

SEQ ID NO: 5237613 - DNA, 23 bp, Homo sapiens
ataaagaaggatgatgtcttttt

SEQ ID NO: 5237614 - DNA, 13 bp, Homo sapiens
ataaagaatactt

SEQ ID NO: 5237615 - DNA, 15 bp, Homo sapiens
ataaagaatatatat

SEQ ID NO: 5237616 - DNA, 17 bp, Homo sapiens
ataaagacaacaaaaga

SEQ ID NO: 5237617 - DNA, 18 bp, Homo sapiens
ataaagacaacaaaagaa

SEQ ID NO: 5237618 - DNA, 17 bp, Homo sapiens
ataaagacagctgacag

SEQ ID NO: 5237619 - DNA, 20 bp, Homo sapiens
ataaagacagctgacagata

SEQ ID NO: 5237620 - DNA, 23 bp, Homo sapiens
ataaagacggattctaaggactc

SEQ ID NO: 5237621 - DNA, 21 bp, Homo sapiens
ataaagacgttttataagcat

SEQ ID NO: 5237622 - DNA, 23 bp, Homo sapiens
ataaagactcctaatagcttttc

SEQ ID NO: 5237623 - DNA, 13 bp, Homo sapiens
ataaagactttta

SEQ ID NO: 5237624 - DNA, 13 bp, Homo sapiens
ataaagagaaata

SEQ ID NO: 5237625 - DNA, 16 bp, Homo sapiens
ataaagagaaccatgt

SEQ ID NO: 5237626 - DNA, 17 bp, Homo sapiens
ataaagagaaccatgtg

SEQ ID NO: 5237627 - DNA, 20 bp, Homo sapiens
ataaagagatacgaatttct

SEQ ID NO: 5237628 - DNA, 19 bp, Homo sapiens
ataaagaggcgttgctttc

SEQ ID NO: 5237629 - DNA, 21 bp, Homo sapiens
ataaagataacccttattcca

SEQ ID NO: 5237630 - DNA, 18 bp, Homo sapiens
ataaagatacatgattga

SEQ ID NO: 5237631 - DNA, 19 bp, Homo sapiens
atataaaaaatatatgtaa

SEQ ID NO: 5237632 - DNA, 21 bp, Homo sapiens
atataaaaaatatatgtaata

SEQ ID NO: 5237633 - DNA, 22 bp, Homo sapiens
atataaaaaatatatgtaatat

SEQ ID NO: 5237634 - DNA, 14 bp, Homo sapiens
atataaaaacaaaa

SEQ ID NO: 5237635 - DNA, 13 bp, Homo sapiens
atataaaaacaac

SEQ ID NO: 5237636 - DNA, 15 bp, Homo sapiens
atataaaaacaacaa

SEQ ID NO: 5237637 - DNA, 13 bp, Homo sapiens
atataaaaacaga

SEQ ID NO: 5237638 - DNA, 20 bp, Homo sapiens
atataaaaacagattctgat

SEQ ID NO: 5237639 - DNA, 21 bp, Homo sapiens
atataaaaactcctgggctta

SEQ ID NO: 5237640 - DNA, 22 bp, Homo sapiens
atataaaaagcagcagaggtga

SEQ ID NO: 5237641 - DNA, 17 bp, Homo sapiens
atataaaaatatatata

SEQ ID NO: 5237642 - DNA, 17 bp, Homo sapiens
atataaaaatgtgaatc

SEQ ID NO: 5237643 - DNA, 13 bp, Homo sapiens
atataaaactgcg

SEQ ID NO: 5237644 - DNA, 22 bp, Homo sapiens
atataaaactgcgttaaaggct

SEQ ID NO: 5237645 - DNA, 15 bp, Homo sapiens
atataaaagaaatat

SEQ ID NO: 5237646 - DNA, 16 bp, Homo sapiens
atataaaagaaatata

SEQ ID NO: 5237647 - DNA, 19 bp, Homo sapiens
atataaaaggttgtgtaca

SEQ ID NO: 5237648 - DNA, 14 bp, Homo sapiens
atataaaataaata

SEQ ID NO: 5237649 - DNA, 15 bp, Homo sapiens
atataaaataaatat

SEQ ID NO: 5237650 - DNA, 22 bp, Homo sapiens
atataaaataaatatactaata

SEQ ID NO: 5237651 - DNA, 14 bp, Homo sapiens
atataaaataatgc

SEQ ID NO: 5237652 - DNA, 13 bp, Homo sapiens
atataaaatacac

SEQ ID NO: 5237653 - DNA, 21 bp, Homo sapiens
atataaaatagttgtccatat

SEQ ID NO: 5237654 - DNA, 22 bp, Homo sapiens
atataaaatatctatattctat

SEQ ID NO: 5237655 - DNA, 13 bp, Homo sapiens
atataaaatattt

SEQ ID NO: 5237656 - DNA, 16 bp, Homo sapiens
atataaaatgctgata

SEQ ID NO: 5237657 - DNA, 18 bp, Homo sapiens
atataaaatgctgatatt

SEQ ID NO: 5237658 - DNA, 14 bp, Homo sapiens
atataaaatggcaa

SEQ ID NO: 5237659 - DNA, 23 bp, Homo sapiens
atataaaatggcaacaaactgca

SEQ ID NO: 5237660 - DNA, 15 bp, Homo sapiens
atataaaatgtattc

SEQ ID NO: 5237661 - DNA, 18 bp, Homo sapiens
atataaaatgtattcaag

SEQ ID NO: 5237662 - DNA, 20 bp, Homo sapiens
atataaaatgtattcaagca

SEQ ID NO: 5237663 - DNA, 13 bp, Homo sapiens
atataaaatgttt

SEQ ID NO: 5237664 - DNA, 15 bp, Homo sapiens
atataaaatttcagg

SEQ ID NO: 5237665 - DNA, 15 bp, Homo sapiens
atataaacaaacaaa

SEQ ID NO: 5237666 - DNA, 13 bp, Homo sapiens
atataaacaatgt

SEQ ID NO: 5237667 - DNA, 15 bp, Homo sapiens
atataaacaatgttc

SEQ ID NO: 5237668 - DNA, 13 bp, Homo sapiens
atataaacagcaa

SEQ ID NO: 5237669 - DNA, 14 bp, Homo sapiens
atataaacatttta

SEQ ID NO: 5237670 - DNA, 11 bp, Homo sapiens
atataaaccgt

SEQ ID NO: 5237671 - DNA, 19 bp, Homo sapiens
atataaacctaaaaaagat

SEQ ID NO: 5237672 - DNA, 17 bp, Homo sapiens
atataaaccttaaatga

SEQ ID NO: 5237673 - DNA, 14 bp, Homo sapiens
atataaacgatata

SEQ ID NO: 5237674 - DNA, 17 bp, Homo sapiens
atataaacgatatatgt

SEQ ID NO: 5237675 - DNA, 22 bp, Homo sapiens
atataaacgatatatgtaaata

SEQ ID NO: 5237676 - DNA, 16 bp, Homo sapiens
atataaactcatttat

SEQ ID NO: 5237677 - DNA, 15 bp, Homo sapiens
atataaactgtgaga

SEQ ID NO: 5237678 - DNA, 16 bp, Homo sapiens
atataaactgtgagat

SEQ ID NO: 5237679 - DNA, 12 bp, Homo sapiens
atataaacttgt

SEQ ID NO: 5237680 - DNA, 16 bp, Homo sapiens
atataaacttgtgtat

SEQ ID NO: 5237681 - DNA, 14 bp, Homo sapiens
atataaagaatata

SEQ ID NO: 5237682 - DNA, 13 bp, Homo sapiens
atataaagacaac

SEQ ID NO: 5237683 - DNA, 18 bp, Homo sapiens
atataaagacctataaat

SEQ ID NO: 5237684 - DNA, 15 bp, Homo sapiens
atataaagagaaaat

SEQ ID NO: 5237685 - DNA, 17 bp, Homo sapiens
atataaagagaaaattg

SEQ ID NO: 5237686 - DNA, 18 bp, Homo sapiens
atataaagagaaaattga

SEQ ID NO: 5237687 - DNA, 19 bp, Homo sapiens
atataaagagaaaattgaa

SEQ ID NO: 5237688 - DNA, 21 bp, Homo sapiens
atataaagagaaaattgaatt

SEQ ID NO: 5237689 - DNA, 15 bp, Homo sapiens
atataaagatatata

SEQ ID NO: 5237690 - DNA, 16 bp, Homo sapiens
atataaagattaacac

SEQ ID NO: 5237691 - DNA, 20 bp, Homo sapiens
atataaagcatctaaacttt

SEQ ID NO: 5237692 - DNA, 19 bp, Homo sapiens
atataaagcctcaaatctt

SEQ ID NO: 5237693 - DNA, 13 bp, Homo sapiens
atataaagcttaa

SEQ ID NO: 5237694 - DNA, 21 bp, Homo sapiens
atataaagggggagggaaata

SEQ ID NO: 5237695 - DNA, 19 bp, Homo sapiens
atataaaggttatgaaaca

SEQ ID NO: 5237696 - DNA, 20 bp, Homo sapiens
atataaaggttatgaaacat

SEQ ID NO: 5237697 - DNA, 21 bp, Homo sapiens
atataaaggttatgaaacata

SEQ ID NO: 5237698 - DNA, 22 bp, Homo sapiens
atataaaggttatgaaacatat

SEQ ID NO: 5237699 - DNA, 19 bp, Homo sapiens
atataaagtagtcctgtga

SEQ ID NO: 5237700 - DNA, 15 bp, Homo sapiens
atataaagtattctt

SEQ ID NO: 5237701 - DNA, 20 bp, Homo sapiens
atataaagtattctttttct

SEQ ID NO: 5237702 - DNA, 13 bp, Homo sapiens
atataaagtcagt

SEQ ID NO: 5237703 - DNA, 17 bp, Homo sapiens
atataaagttttatata

SEQ ID NO: 5237704 - DNA, 19 bp, Homo sapiens
atataaagttttatatatt

SEQ ID NO: 5237705 - DNA, 15 bp, Homo sapiens
atataaataaatata

SEQ ID NO: 5237706 - DNA, 16 bp, Homo sapiens
atataaataaatatat

SEQ ID NO: 5237707 - DNA, 18 bp, Homo sapiens
atataaataaatgtttct

SEQ ID NO: 5237708 - DNA, 17 bp, Homo sapiens
atataaatacatgcaca

SEQ ID NO: 5237709 - DNA, 15 bp, Homo sapiens
atataaatagaatgt

SEQ ID NO: 5237710 - DNA, 16 bp, Homo sapiens
atataaatagctgaaa

SEQ ID NO: 5237711 - DNA, 19 bp, Homo sapiens
atataaatagctgaaaact

SEQ ID NO: 5237712 - DNA, 11 bp, Homo sapiens
atataaatata

SEQ ID NO: 5237713 - DNA, 12 bp, Homo sapiens
atataaatatat

SEQ ID NO: 5237714 - DNA, 17 bp, Homo sapiens
atataaatatatataaa

SEQ ID NO: 5237715 - DNA, 21 bp, Homo sapiens
atataaatatatatttttcaa

SEQ ID NO: 5237716 - DNA, 13 bp, Homo sapiens
atataaatatatg

SEQ ID NO: 5237717 - DNA, 16 bp, Homo sapiens
atataaatatattatt

SEQ ID NO: 5237718 - DNA, 14 bp, Homo sapiens
atataaatatcaca

SEQ ID NO: 5237719 - DNA, 16 bp, Homo sapiens
atataaatattagaaa

SEQ ID NO: 5237720 - DNA, 13 bp, Homo sapiens
atataaatatttg

SEQ ID NO: 5237721 - DNA, 22 bp, Homo sapiens
atataaatatttggtaattctg

SEQ ID NO: 5237722 - DNA, 22 bp, Homo sapiens
atataaatgaagtattatctgt

SEQ ID NO: 5237723 - DNA, 17 bp, Homo sapiens
atataaatgatgattga

SEQ ID NO: 5237724 - DNA, 12 bp, Homo sapiens
atataaatgcaa

SEQ ID NO: 5237725 - DNA, 14 bp, Homo sapiens
atataaatgcatga

SEQ ID NO: 5237726 - DNA, 18 bp, Homo sapiens
atataaatgcatgatttt

SEQ ID NO: 5237727 - DNA, 23 bp, Homo sapiens
atataaatgcatgattttataca

SEQ ID NO: 5237728 - DNA, 22 bp, Homo sapiens
atataaatgcttttaaaaatct

SEQ ID NO: 5237729 - DNA, 13 bp, Homo sapiens
atataaatgggaa

SEQ ID NO: 5237730 - DNA, 23 bp, Homo sapiens
atataaatggtgagaattaaaat

SEQ ID NO: 5237731 - DNA, 16 bp, Homo sapiens
atataaatgtgtgtat

SEQ ID NO: 5237732 - DNA, 16 bp, Homo sapiens
atataaatgtttatat

SEQ ID NO: 5237733 - DNA, 15 bp, Homo sapiens
atataaattaaaata

SEQ ID NO: 5237734 - DNA, 17 bp, Homo sapiens
atataaattaagacttt

SEQ ID NO: 5237735 - DNA, 12 bp, Homo sapiens
atataaattatc

SEQ ID NO: 5237736 - DNA, 20 bp, Homo sapiens
atataaattatctgaatatt

SEQ ID NO: 5237737 - DNA, 12 bp, Homo sapiens
atataaattctg

SEQ ID NO: 5237738 - DNA, 19 bp, Homo sapiens
atataaatttaagcaaacg

SEQ ID NO: 5237739 - DNA, 16 bp, Homo sapiens
atataaattttcagaa

SEQ ID NO: 5237740 - DNA, 15 bp, Homo sapiens
atataaattttttgt

SEQ ID NO: 5237741 - DNA, 12 bp, Homo sapiens
atataacaaaaa

SEQ ID NO: 5237742 - DNA, 18 bp, Homo sapiens
atataacaatatatgata

SEQ ID NO: 5237743 - DNA, 20 bp, Homo sapiens
atataacaatatatgatata

SEQ ID NO: 5237744 - DNA, 15 bp, Homo sapiens
atataacaatgctgt

SEQ ID NO: 5237745 - DNA, 15 bp, Homo sapiens
atataacacattttt

SEQ ID NO: 5237746 - DNA, 12 bp, Homo sapiens
atataacatgaa

SEQ ID NO: 5237747 - DNA, 13 bp, Homo sapiens
atataacatgaaa

SEQ ID NO: 5237748 - DNA, 14 bp, Homo sapiens
atataacatgcaaa

SEQ ID NO: 5237749 - DNA, 20 bp, Homo sapiens
atataacatgcaaacaggtt

SEQ ID NO: 5237750 - DNA, 17 bp, Homo sapiens
atataaccacatttcta

SEQ ID NO: 5237751 - DNA, 19 bp, Homo sapiens
atataaccattacatgttt

SEQ ID NO: 5237752 - DNA, 18 bp, Homo sapiens
atataaccctaggaattt

SEQ ID NO: 5237753 - DNA, 20 bp, Homo sapiens
atataaccttcatttttaag

SEQ ID NO: 5237754 - DNA, 14 bp, Homo sapiens
atataactacatta

SEQ ID NO: 5237755 - DNA, 20 bp, Homo sapiens
atataactacattaaaagct

SEQ ID NO: 5237756 - DNA, 18 bp, Homo sapiens
atataactattgcccagg

SEQ ID NO: 5237757 - DNA, 12 bp, Homo sapiens
atataactcttt

SEQ ID NO: 5237758 - DNA, 12 bp, Homo sapiens
atataactgaga

SEQ ID NO: 5237759 - DNA, 20 bp, Homo sapiens
atataactgccttaaaactt

SEQ ID NO: 5237760 - DNA, 14 bp, Homo sapiens
atataactgtacaa

SEQ ID NO: 5237761 - DNA, 20 bp, Homo sapiens
atataactgtcttgtttcag

SEQ ID NO: 5237762 - DNA, 19 bp, Homo sapiens
atataactgttgttgataa

SEQ ID NO: 5237763 - DNA, 20 bp, Homo sapiens
atataacttatattgtaaga

SEQ ID NO: 5237764 - DNA, 21 bp, Homo sapiens
atataacttatattgtaagaa

SEQ ID NO: 5237765 - DNA, 18 bp, Homo sapiens
atataactttagaaataa

SEQ ID NO: 5237766 - DNA, 15 bp, Homo sapiens
atataagaaaatgct

SEQ ID NO: 5237767 - DNA, 12 bp, Homo sapiens
atataagaaaga

SEQ ID NO: 5237768 - DNA, 14 bp, Homo sapiens
atataagaaagaca

SEQ ID NO: 5237769 - DNA, 16 bp, Homo sapiens
atataagaaagacatc

SEQ ID NO: 5237770 - DNA, 13 bp, Homo sapiens
atataagacaaat

SEQ ID NO: 5237771 - DNA, 18 bp, Homo sapiens
atataagaccactacagt

SEQ ID NO: 5237772 - DNA, 18 bp, Homo sapiens
atataagacttaatatgt

SEQ ID NO: 5237773 - DNA, 20 bp, Homo sapiens
atataagacttaatatgttt

SEQ ID NO: 5237774 - DNA, 21 bp, Homo sapiens
atataagagaagtctcattcg

SEQ ID NO: 5237775 - DNA, 16 bp, Homo sapiens
atataagatttgtaca

SEQ ID NO: 5237776 - DNA, 19 bp, Homo sapiens
atataagatttgtacatat

SEQ ID NO: 5237777 - DNA, 20 bp, Homo sapiens
atataagatttgtacatatt

SEQ ID NO: 5237778 - DNA, 13 bp, Homo sapiens
atataagccatag

SEQ ID NO: 5237779 - DNA, 21 bp, Homo sapiens
atataagcccttaataataat

SEQ ID NO: 5237780 - DNA, 16 bp, Homo sapiens
atataagccttttata

SEQ ID NO: 5237781 - DNA, 23 bp, Homo sapiens
atataagcttaaaataagtgaat

SEQ ID NO: 5237782 - DNA, 21 bp, Homo sapiens
atataaggacagaccaaaaat

SEQ ID NO: 5237783 - DNA, 14 bp, Homo sapiens
atataaggaggaaa

SEQ ID NO: 5237784 - DNA, 14 bp, Homo sapiens
atataagtaaagtg

SEQ ID NO: 5237785 - DNA, 22 bp, Homo sapiens
atataagtaaagtgattaaagt

SEQ ID NO: 5237786 - DNA, 22 bp, Homo sapiens
atataagtattctaaattttat

SEQ ID NO: 5237787 - DNA, 23 bp, Homo sapiens
atataagtcttggtaacaaataa

SEQ ID NO: 5237788 - DNA, 18 bp, Homo sapiens
atataagtgctgtataaa

SEQ ID NO: 5237789 - DNA, 20 bp, Homo sapiens
atataagtgctgtataaaat

SEQ ID NO: 5237790 - DNA, 18 bp, Homo sapiens
atataagtgtacatatgt

SEQ ID NO: 5237791 - DNA, 17 bp, Homo sapiens
atataagttaaagagac

SEQ ID NO: 5237792 - DNA, 18 bp, Homo sapiens
atataagttaaagagaca

SEQ ID NO: 5237793 - DNA, 19 bp, Homo sapiens
atataagttaaagagacaa

SEQ ID NO: 5237794 - DNA, 14 bp, Homo sapiens
atataagtttcttt

SEQ ID NO: 5237795 - DNA, 13 bp, Homo sapiens
atataataaaaga

SEQ ID NO: 5237796 - DNA, 15 bp, Homo sapiens
atataataaaagtta

SEQ ID NO: 5237797 - DNA, 23 bp, Homo sapiens
atataataaagaagctactattt

SEQ ID NO: 5237798 - DNA, 15 bp, Homo sapiens
atataataaagtatt

SEQ ID NO: 5237799 - DNA, 22 bp, Homo sapiens
atataataaatacaagttcttt

SEQ ID NO: 5237800 - DNA, 18 bp, Homo sapiens
atataataaatactcagt

SEQ ID NO: 5237801 - DNA, 19 bp, Homo sapiens
atataataaatatatattt

SEQ ID NO: 5237802 - DNA, 21 bp, Homo sapiens
atataataaatatatatttat

SEQ ID NO: 5237803 - DNA, 21 bp, Homo sapiens
atataataaattaatttttca

SEQ ID NO: 5237804 - DNA, 14 bp, Homo sapiens
atataataatatgt

SEQ ID NO: 5237805 - DNA, 16 bp, Homo sapiens
atataataatgatgat

SEQ ID NO: 5237806 - DNA, 16 bp, Homo sapiens
atataatacacaaaat

SEQ ID NO: 5237807 - DNA, 18 bp, Homo sapiens
atataatacacaaaatca

SEQ ID NO: 5237808 - DNA, 17 bp, Homo sapiens
atataatacctttctaa

SEQ ID NO: 5237809 - DNA, 15 bp, Homo sapiens
atataatatgaatat

SEQ ID NO: 5237810 - DNA, 23 bp, Homo sapiens
atataatatgcacacagtgcttt

SEQ ID NO: 5237811 - DNA, 14 bp, Homo sapiens
ataaagatatatag

SEQ ID NO: 5237812 - DNA, 17 bp, Homo sapiens
ataaagatatttccaag

SEQ ID NO: 5237813 - DNA, 15 bp, Homo sapiens
ataaagatcacacat

SEQ ID NO: 5237814 - DNA, 12 bp, Homo sapiens
ataaagatgagt

SEQ ID NO: 5237815 - DNA, 14 bp, Homo sapiens
ataaagatgatcta

SEQ ID NO: 5237816 - DNA, 20 bp, Homo sapiens
ataaagatgatctactcaga

SEQ ID NO: 5237817 - DNA, 14 bp, Homo sapiens
ataaagatgctctt

SEQ ID NO: 5237818 - DNA, 19 bp, Homo sapiens
ataaagatgtcaaatatct

SEQ ID NO: 5237819 - DNA, 16 bp, Homo sapiens
ataaagatgtgaaaac

SEQ ID NO: 5237820 - DNA, 14 bp, Homo sapiens
ataaagatgttaaa

SEQ ID NO: 5237821 - DNA, 19 bp, Homo sapiens
ataaagatgttaaatggaa

SEQ ID NO: 5237822 - DNA, 23 bp, Homo sapiens
ataaagattaacactcatttcca

SEQ ID NO: 5237823 - DNA, 19 bp, Homo sapiens
ataaagattataatatgtg

SEQ ID NO: 5237824 - DNA, 20 bp, Homo sapiens
ataaagattataatatgtgc

SEQ ID NO: 5237825 - DNA, 18 bp, Homo sapiens
ataaagattatataaaga

SEQ ID NO: 5237826 - DNA, 15 bp, Homo sapiens
ataaagattgtactt

SEQ ID NO: 5237827 - DNA, 16 bp, Homo sapiens
ataaagattgtactta

SEQ ID NO: 5237828 - DNA, 16 bp, Homo sapiens
ataaagattttttaat

SEQ ID NO: 5237829 - DNA, 21 bp, Homo sapiens
ataaagattttttaataattt

SEQ ID NO: 5237830 - DNA, 13 bp, Homo sapiens
ataaagcaatttt

SEQ ID NO: 5237831 - DNA, 16 bp, Homo sapiens
ataaagcaattttcct

SEQ ID NO: 5237832 - DNA, 17 bp, Homo sapiens
ataaagcaattttcctt

SEQ ID NO: 5237833 - DNA, 19 bp, Homo sapiens
ataaagcaattttccttga

SEQ ID NO: 5237834 - DNA, 18 bp, Homo sapiens
ataaagcactgtttggat

SEQ ID NO: 5237835 - DNA, 19 bp, Homo sapiens
ataaagcagagccaaggcc

SEQ ID NO: 5237836 - DNA, 20 bp, Homo sapiens
ataaagcagagccaaggcca

SEQ ID NO: 5237837 - DNA, 19 bp, Homo sapiens
ataaagcagattacctctt

SEQ ID NO: 5237838 - DNA, 16 bp, Homo sapiens
ataaagcagcctgatt

SEQ ID NO: 5237839 - DNA, 14 bp, Homo sapiens
ataaagcagtattt

SEQ ID NO: 5237840 - DNA, 16 bp, Homo sapiens
ataaagcagtattttt

SEQ ID NO: 5237841 - DNA, 14 bp, Homo sapiens
ataaagcataagta

SEQ ID NO: 5237842 - DNA, 17 bp, Homo sapiens
ataaagcattactcttt

SEQ ID NO: 5237843 - DNA, 11 bp, Homo sapiens
ataaagcattc

SEQ ID NO: 5237844 - DNA, 12 bp, Homo sapiens
ataaagcattct

SEQ ID NO: 5237845 - DNA, 13 bp, Homo sapiens
ataaagcattctt

SEQ ID NO: 5237846 - DNA, 16 bp, Homo sapiens
ataaagcattctttaa

SEQ ID NO: 5237847 - DNA, 14 bp, Homo sapiens
ataaagcatttaac

SEQ ID NO: 5237848 - DNA, 16 bp, Homo sapiens
ataaagcattttgcaa

SEQ ID NO: 5237849 - DNA, 17 bp, Homo sapiens
ataaagcattttgcaaa

SEQ ID NO: 5237850 - DNA, 15 bp, Homo sapiens
ataaagccaaatttc

SEQ ID NO: 5237851 - DNA, 13 bp, Homo sapiens
ataaagccaagaa

SEQ ID NO: 5237852 - DNA, 16 bp, Homo sapiens
ataaagccactgaaaa

SEQ ID NO: 5237853 - DNA, 12 bp, Homo sapiens
ataaagccactt

SEQ ID NO: 5237854 - DNA, 19 bp, Homo sapiens
ataaagccatatttagtat

SEQ ID NO: 5237855 - DNA, 12 bp, Homo sapiens
ataaagcctgct

SEQ ID NO: 5237856 - DNA, 16 bp, Homo sapiens
ataaagcctttaaaac

SEQ ID NO: 5237857 - DNA, 19 bp, Homo sapiens
ataaagcctttaaaaccag

SEQ ID NO: 5237858 - DNA, 17 bp, Homo sapiens
ataaagcctttgtatct

SEQ ID NO: 5237859 - DNA, 15 bp, Homo sapiens
ataaagccttttaaa

SEQ ID NO: 5237860 - DNA, 15 bp, Homo sapiens
ataaagctactgaat

SEQ ID NO: 5237861 - DNA, 12 bp, Homo sapiens
ataaagctcaag

SEQ ID NO: 5237862 - DNA, 14 bp, Homo sapiens
ataaagctcacact

SEQ ID NO: 5237863 - DNA, 14 bp, Homo sapiens
ataaagctcctctg

SEQ ID NO: 5237864 - DNA, 19 bp, Homo sapiens
ataaagctctcaaatgtga

SEQ ID NO: 5237865 - DNA, 21 bp, Homo sapiens
ataaagctgccccatctgggg

SEQ ID NO: 5237866 - DNA, 19 bp, Homo sapiens
ataaagctgttcttgaaag

SEQ ID NO: 5237867 - DNA, 11 bp, Homo sapiens
ataaagcttaa

SEQ ID NO: 5237868 - DNA, 15 bp, Homo sapiens
ataaagcttaaattt

SEQ ID NO: 5237869 - DNA, 13 bp, Homo sapiens
ataaagcttctct

SEQ ID NO: 5237870 - DNA, 16 bp, Homo sapiens
ataaagcttctctctg

SEQ ID NO: 5237871 - DNA, 17 bp, Homo sapiens
ataaagcttctctctga

SEQ ID NO: 5237872 - DNA, 19 bp, Homo sapiens
ataaagcttctctctgagc

SEQ ID NO: 5237873 - DNA, 17 bp, Homo sapiens
ataaagcttgtggcccc

SEQ ID NO: 5237874 - DNA, 22 bp, Homo sapiens
ataaaggaaacacgtttagaaa

SEQ ID NO: 5237875 - DNA, 15 bp, Homo sapiens
ataaaggaatctagc

SEQ ID NO: 5237876 - DNA, 18 bp, Homo sapiens
ataaaggaccctgtttct

SEQ ID NO: 5237877 - DNA, 15 bp, Homo sapiens
ataaaggagaagaga

SEQ ID NO: 5237878 - DNA, 21 bp, Homo sapiens
ataaaggagaggttaaagcaa

SEQ ID NO: 5237879 - DNA, 12 bp, Homo sapiens
ataaaggaggaa

SEQ ID NO: 5237880 - DNA, 21 bp, Homo sapiens
ataaaggataaacttttagaa

SEQ ID NO: 5237881 - DNA, 14 bp, Homo sapiens
ataaaggataaaga

SEQ ID NO: 5237882 - DNA, 17 bp, Homo sapiens
ataaaggatgtgattgt

SEQ ID NO: 5237883 - DNA, 18 bp, Homo sapiens
ataaaggattaatgtcaa

SEQ ID NO: 5237884 - DNA, 11 bp, Homo sapiens
ataaaggcagc

SEQ ID NO: 5237885 - DNA, 12 bp, Homo sapiens
ataaaggcagct

SEQ ID NO: 5237886 - DNA, 18 bp, Homo sapiens
ataaaggcagctgcctct

SEQ ID NO: 5237887 - DNA, 19 bp, Homo sapiens
ataaaggcagctgcctctg

SEQ ID NO: 5237888 - DNA, 14 bp, Homo sapiens
ataaaggccttttt

SEQ ID NO: 5237889 - DNA, 16 bp, Homo sapiens
ataaaggctaactatg

SEQ ID NO: 5237890 - DNA, 13 bp, Homo sapiens
ataaaggctctgt

SEQ ID NO: 5237891 - DNA, 17 bp, Homo sapiens
ataaaggctgaagcttt

SEQ ID NO: 5237892 - DNA, 23 bp, Homo sapiens
ataaagggagaatggtgctgttt

SEQ ID NO: 5237893 - DNA, 17 bp, Homo sapiens
ataaagggtcaggcccg

SEQ ID NO: 5237894 - DNA, 17 bp, Homo sapiens
ataaagggtgccaggtc

SEQ ID NO: 5237895 - DNA, 15 bp, Homo sapiens
ataaaggtaaaacaa

SEQ ID NO: 5237896 - DNA, 19 bp, Homo sapiens
ataaaggtaaaatcacttc

SEQ ID NO: 5237897 - DNA, 13 bp, Homo sapiens
ataaaggtattta

SEQ ID NO: 5237898 - DNA, 21 bp, Homo sapiens
ataaaggtatttagaatatat

SEQ ID NO: 5237899 - DNA, 11 bp, Homo sapiens
ataaaggtcat

SEQ ID NO: 5237900 - DNA, 23 bp, Homo sapiens
ataaaggtcatattggaaacata

SEQ ID NO: 5237901 - DNA, 18 bp, Homo sapiens
ataaaggtcttaaataat

SEQ ID NO: 5237902 - DNA, 19 bp, Homo sapiens
ataaaggtggtatgtgtgt

SEQ ID NO: 5237903 - DNA, 21 bp, Homo sapiens
ataaaggtggtatgtgtgtgt

SEQ ID NO: 5237904 - DNA, 14 bp, Homo sapiens
ataaaggtgtagaa

SEQ ID NO: 5237905 - DNA, 19 bp, Homo sapiens
ataaaggtgtgctgtgtcc

SEQ ID NO: 5237906 - DNA, 17 bp, Homo sapiens
ataaaggttatgaaaca

SEQ ID NO: 5237907 - DNA, 19 bp, Homo sapiens
ataaaggttatgaaacata

SEQ ID NO: 5237908 - DNA, 23 bp, Homo sapiens
ataaaggttatgaaacatatcat

SEQ ID NO: 5237909 - DNA, 19 bp, Homo sapiens
ataaaggttattttctcct

SEQ ID NO: 5237910 - DNA, 20 bp, Homo sapiens
ataaaggttattttctcctg

SEQ ID NO: 5237911 - DNA, 14 bp, Homo sapiens
ataaaggttctatg

SEQ ID NO: 5237912 - DNA, 17 bp, Homo sapiens
ataaaggttctatgata

SEQ ID NO: 5237913 - DNA, 18 bp, Homo sapiens
ataaaggttctatgatat

SEQ ID NO: 5237914 - DNA, 21 bp, Homo sapiens
ataaaggttgacaataaatgt

SEQ ID NO: 5237915 - DNA, 18 bp, Homo sapiens
ataaaggtttacagtgaa

SEQ ID NO: 5237916 - DNA, 16 bp, Homo sapiens
ataaagtaaaaaagtt

SEQ ID NO: 5237917 - DNA, 14 bp, Homo sapiens
ataaagtaataatg

SEQ ID NO: 5237918 - DNA, 15 bp, Homo sapiens
ataaagtacaaatga

SEQ ID NO: 5237919 - DNA, 19 bp, Homo sapiens
ataaagtacgtgtttactt

SEQ ID NO: 5237920 - DNA, 18 bp, Homo sapiens
ataaagtactactgtaga

SEQ ID NO: 5237921 - DNA, 15 bp, Homo sapiens
ataaagtacttgact

SEQ ID NO: 5237922 - DNA, 16 bp, Homo sapiens
ataaagtacttgacta

SEQ ID NO: 5237923 - DNA, 17 bp, Homo sapiens
ataaagtaggaaagaat

SEQ ID NO: 5237924 - DNA, 16 bp, Homo sapiens
ataaagtagtaaaaat

SEQ ID NO: 5237925 - DNA, 16 bp, Homo sapiens
ataaagtagtaaaaga

SEQ ID NO: 5237926 - DNA, 16 bp, Homo sapiens
ataaagtagtcctgtg

SEQ ID NO: 5237927 - DNA, 20 bp, Homo sapiens
ataaagtatagagagaagtt

SEQ ID NO: 5237928 - DNA, 14 bp, Homo sapiens
ataaagtatatatt

SEQ ID NO: 5237929 - DNA, 14 bp, Homo sapiens
ataaagtatcatca

SEQ ID NO: 5237930 - DNA, 18 bp, Homo sapiens
ataaagtatcatgcattc

SEQ ID NO: 5237931 - DNA, 16 bp, Homo sapiens
ataaagtatgaatatt

SEQ ID NO: 5237932 - DNA, 22 bp, Homo sapiens
ataaagtatgaatatttcattt

SEQ ID NO: 5237933 - DNA, 18 bp, Homo sapiens
ataaagtattccacctta

SEQ ID NO: 5237934 - DNA, 14 bp, Homo sapiens
ataaagtattcttt

SEQ ID NO: 5237935 - DNA, 14 bp, Homo sapiens
ataaagtatttaat

SEQ ID NO: 5237936 - DNA, 17 bp, Homo sapiens
ataaagtatttaattag

SEQ ID NO: 5237937 - DNA, 15 bp, Homo sapiens
ataaagtattttctt

SEQ ID NO: 5237938 - DNA, 16 bp, Homo sapiens
ataaagtatttttata

SEQ ID NO: 5237939 - DNA, 19 bp, Homo sapiens
ataaagtcacttccagtgt

SEQ ID NO: 5237940 - DNA, 21 bp, Homo sapiens
ataaagtcacttccagtgttg

SEQ ID NO: 5237941 - DNA, 13 bp, Homo sapiens
ataaagtcagtga

SEQ ID NO: 5237942 - DNA, 14 bp, Homo sapiens
ataaagtcatcaaa

SEQ ID NO: 5237943 - DNA, 18 bp, Homo sapiens
ataaagtcatttgtgaaa

SEQ ID NO: 5237944 - DNA, 15 bp, Homo sapiens
ataaagtcctcttcc

SEQ ID NO: 5237945 - DNA, 16 bp, Homo sapiens
ataaagtctaagcaag

SEQ ID NO: 5237946 - DNA, 20 bp, Homo sapiens
ataaagtctaagcaagatgt

SEQ ID NO: 5237947 - DNA, 22 bp, Homo sapiens
ataaagtctaagcaagatgttt

SEQ ID NO: 5237948 - DNA, 14 bp, Homo sapiens
ataaagtctgagaa

SEQ ID NO: 5237949 - DNA, 19 bp, Homo sapiens
ataaagtctgtctgcactg

SEQ ID NO: 5237950 - DNA, 13 bp, Homo sapiens
ataaagtgacaaa

SEQ ID NO: 5237951 - DNA, 20 bp, Homo sapiens
ataaagtgaccctgctctca

SEQ ID NO: 5237952 - DNA, 13 bp, Homo sapiens
ataaagtgattga

SEQ ID NO: 5237953 - DNA, 22 bp, Homo sapiens
ataaagtgcacacctttattca

SEQ ID NO: 5237954 - DNA, 23 bp, Homo sapiens
ataaagtgcacacctttattcag

SEQ ID NO: 5237955 - DNA, 18 bp, Homo sapiens
ataaagtgcctataaagg

SEQ ID NO: 5237956 - DNA, 14 bp, Homo sapiens
ataaagtgccttct

SEQ ID NO: 5237957 - DNA, 24 bp, Homo sapiens
ataaagtgctgcggagcaagagga

SEQ ID NO: 5237958 - DNA, 17 bp, Homo sapiens
ataaagtgcttgtgtaa

SEQ ID NO: 5237959 - DNA, 12 bp, Homo sapiens
ataaagtggaaa

SEQ ID NO: 5237960 - DNA, 15 bp, Homo sapiens
ataaagtgttttcag

SEQ ID NO: 5237961 - DNA, 17 bp, Homo sapiens
ataaagtgttttcagag

SEQ ID NO: 5237962 - DNA, 18 bp, Homo sapiens
ataaagtgttttcagagc

SEQ ID NO: 5237963 - DNA, 14 bp, Homo sapiens
ataaagttaaaagt

SEQ ID NO: 5237964 - DNA, 15 bp, Homo sapiens
ataaagttaaactga

SEQ ID NO: 5237965 - DNA, 13 bp, Homo sapiens
ataaagttaaagt

SEQ ID NO: 5237966 - DNA, 21 bp, Homo sapiens
ataaagttacaccgttgttgt

SEQ ID NO: 5237967 - DNA, 17 bp, Homo sapiens
ataaagttagaatctat

SEQ ID NO: 5237968 - DNA, 22 bp, Homo sapiens
ataaagttagaatctattttct

SEQ ID NO: 5237969 - DNA, 22 bp, Homo sapiens
ataaagttattcttgtcatttt

SEQ ID NO: 5237970 - DNA, 15 bp, Homo sapiens
ataaagttcagatgt

SEQ ID NO: 5237971 - DNA, 21 bp, Homo sapiens
ataaagttcctgtcattcctc

SEQ ID NO: 5237972 - DNA, 20 bp, Homo sapiens
ataaagttctgcaaaataca

SEQ ID NO: 5237973 - DNA, 20 bp, Homo sapiens
ataaagttgaatattatata

SEQ ID NO: 5237974 - DNA, 16 bp, Homo sapiens
ataaagttgataaaga

SEQ ID NO: 5237975 - DNA, 14 bp, Homo sapiens
ataaagttgctttt

SEQ ID NO: 5237976 - DNA, 16 bp, Homo sapiens
ataaagttggtgacag

SEQ ID NO: 5237977 - DNA, 14 bp, Homo sapiens
ataaagttgtaaat

SEQ ID NO: 5237978 - DNA, 15 bp, Homo sapiens
ataaagttgtaaata

SEQ ID NO: 5237979 - DNA, 17 bp, Homo sapiens
ataaagttgtattgcat

SEQ ID NO: 5237980 - DNA, 14 bp, Homo sapiens
ataaagttgtattt

SEQ ID NO: 5237981 - DNA, 16 bp, Homo sapiens
ataaagttgtatttca

SEQ ID NO: 5237982 - DNA, 18 bp, Homo sapiens
ataaagttgttgcattcc

SEQ ID NO: 5237983 - DNA, 16 bp, Homo sapiens
ataaagtttacaagcg

SEQ ID NO: 5237984 - DNA, 15 bp, Homo sapiens
ataaagtttatcaga

SEQ ID NO: 5237985 - DNA, 16 bp, Homo sapiens
ataaagtttatcagat

SEQ ID NO: 5237986 - DNA, 18 bp, Homo sapiens
ataaagtttatcagatat

SEQ ID NO: 5237987 - DNA, 17 bp, Homo sapiens
ataaagttttatatatt

SEQ ID NO: 5237988 - DNA, 22 bp, Homo sapiens
ataaagttttatatattatatg

SEQ ID NO: 5237989 - DNA, 21 bp, Homo sapiens
ataaagttttgccccatgata

SEQ ID NO: 5237990 - DNA, 20 bp, Homo sapiens
ataaagtttttttatttctt

SEQ ID NO: 5237991 - DNA, 19 bp, Homo sapiens
ataaagtttttttccttaa

SEQ ID NO: 5237992 - DNA, 22 bp, Homo sapiens
atataatatggatcagagcatt

SEQ ID NO: 5237993 - DNA, 13 bp, Homo sapiens
atataatatgtca

SEQ ID NO: 5237994 - DNA, 23 bp, Homo sapiens
atataatatgtcttcataatata

SEQ ID NO: 5237995 - DNA, 21 bp, Homo sapiens
atataatcaaatgattcattt

SEQ ID NO: 5237996 - DNA, 20 bp, Homo sapiens
atataatctgaatcctgtta

SEQ ID NO: 5237997 - DNA, 21 bp, Homo sapiens
atataatcttggcttcttaaa

SEQ ID NO: 5237998 - DNA, 22 bp, Homo sapiens
atataatcttggcttcttaaaa

SEQ ID NO: 5237999 - DNA, 17 bp, Homo sapiens
atataatctttcaaacc

SEQ ID NO: 5238000 - DNA, 11 bp, Homo sapiens
atataatgaac

SEQ ID NO: 5238001 - DNA, 14 bp, Homo sapiens
atataatgaacacg

SEQ ID NO: 5238002 - DNA, 13 bp, Homo sapiens
atataatgaattc

SEQ ID NO: 5238003 - DNA, 21 bp, Homo sapiens
atataatgatcagcaaaaaga

SEQ ID NO: 5238004 - DNA, 22 bp, Homo sapiens
atataatgctttgcagtatctg

SEQ ID NO: 5238005 - DNA, 18 bp, Homo sapiens
atataatggcctcttaaa

SEQ ID NO: 5238006 - DNA, 17 bp, Homo sapiens
atataatgggctgcaaa

SEQ ID NO: 5238007 - DNA, 21 bp, Homo sapiens
atataatgggctgcaaaatga

SEQ ID NO: 5238008 - DNA, 21 bp, Homo sapiens
atataatggtaatagaatagc

SEQ ID NO: 5238009 - DNA, 13 bp, Homo sapiens
atataatgtattt

SEQ ID NO: 5238010 - DNA, 14 bp, Homo sapiens
atataatgtatttt

SEQ ID NO: 5238011 - DNA, 22 bp, Homo sapiens
atataatgttgttatttaaaga

SEQ ID NO: 5238012 - DNA, 14 bp, Homo sapiens
atataattatcgga

SEQ ID NO: 5238013 - DNA, 18 bp, Homo sapiens
atataattcactcaagca

SEQ ID NO: 5238014 - DNA, 16 bp, Homo sapiens
atataattcctgtttt

SEQ ID NO: 5238015 - DNA, 22 bp, Homo sapiens
atataattcctgtttttattat

SEQ ID NO: 5238016 - DNA, 12 bp, Homo sapiens
atataattctgt

SEQ ID NO: 5238017 - DNA, 14 bp, Homo sapiens
atataattctgtac

SEQ ID NO: 5238018 - DNA, 15 bp, Homo sapiens
atataattgtactgt

SEQ ID NO: 5238019 - DNA, 17 bp, Homo sapiens
atataattgtactgtgt

SEQ ID NO: 5238020 - DNA, 21 bp, Homo sapiens
atataattgttttttatcttt

SEQ ID NO: 5238021 - DNA, 14 bp, Homo sapiens
atataatttaaaga

SEQ ID NO: 5238022 - DNA, 20 bp, Homo sapiens
atataatttaaagaaacact

SEQ ID NO: 5238023 - DNA, 18 bp, Homo sapiens
atataatttactttgtag

SEQ ID NO: 5238024 - DNA, 19 bp, Homo sapiens
atataatttataagcattg

SEQ ID NO: 5238025 - DNA, 18 bp, Homo sapiens
atataatttcctcactgc

SEQ ID NO: 5238026 - DNA, 21 bp, Homo sapiens
atataatttgagtgtatatat

SEQ ID NO: 5238027 - DNA, 20 bp, Homo sapiens
atataatttgccagacagag

SEQ ID NO: 5238028 - DNA, 10 bp, Homo sapiens
atataatttt

SEQ ID NO: 5238029 - DNA, 16 bp, Homo sapiens
atataatttttccttt

SEQ ID NO: 5238030 - DNA, 21 bp, Homo sapiens
atataatttttttatgttttg

SEQ ID NO: 5238031 - DNA, 23 bp, Homo sapiens
atataatttttttatgttttgtt

SEQ ID NO: 5238032 - DNA, 16 bp, Homo sapiens
atatacaaaactttat

SEQ ID NO: 5238033 - DNA, 14 bp, Homo sapiens
atatacaaaagcaa

SEQ ID NO: 5238034 - DNA, 21 bp, Homo sapiens
atatacaacaccaaaaaatat

SEQ ID NO: 5238035 - DNA, 14 bp, Homo sapiens
atatacaagctaca

SEQ ID NO: 5238036 - DNA, 13 bp, Homo sapiens
atatacaagtaaa

SEQ ID NO: 5238037 - DNA, 15 bp, Homo sapiens
atatacaataatgga

SEQ ID NO: 5238038 - DNA, 12 bp, Homo sapiens
atatacaatata

SEQ ID NO: 5238039 - DNA, 20 bp, Homo sapiens
atatacaatatatattttgt

SEQ ID NO: 5238040 - DNA, 11 bp, Homo sapiens
atatacaatta

SEQ ID NO: 5238041 - DNA, 14 bp, Homo sapiens
atatacaatttcta

SEQ ID NO: 5238042 - DNA, 17 bp, Homo sapiens
atatacacacacaaaga

SEQ ID NO: 5238043 - DNA, 21 bp, Homo sapiens
atatacacacacaaagagagt

SEQ ID NO: 5238044 - DNA, 14 bp, Homo sapiens
atatacacatacat

SEQ ID NO: 5238045 - DNA, 15 bp, Homo sapiens
atatacacatacata

SEQ ID NO: 5238046 - DNA, 22 bp, Homo sapiens
atatacacatacatacacatac

SEQ ID NO: 5238047 - DNA, 15 bp, Homo sapiens
atatacacattttgt

SEQ ID NO: 5238048 - DNA, 22 bp, Homo sapiens
atatacacattttgtaaatctg

SEQ ID NO: 5238049 - DNA, 23 bp, Homo sapiens
atatacacattttgtaaatctgt

SEQ ID NO: 5238050 - DNA, 13 bp, Homo sapiens
atatacacgaata

SEQ ID NO: 5238051 - DNA, 22 bp, Homo sapiens
atatacacgaatagacatcaaa

SEQ ID NO: 5238052 - DNA, 21 bp, Homo sapiens
atatacacggattattatttg

SEQ ID NO: 5238053 - DNA, 15 bp, Homo sapiens
atatacactttacat

SEQ ID NO: 5238054 - DNA, 13 bp, Homo sapiens
atatacagaaaaa

SEQ ID NO: 5238055 - DNA, 16 bp, Homo sapiens
atatacagagcctgtt

SEQ ID NO: 5238056 - DNA, 13 bp, Homo sapiens
atatacagatgaa

SEQ ID NO: 5238057 - DNA, 20 bp, Homo sapiens
atatacagcaggatgtgcct

SEQ ID NO: 5238058 - DNA, 15 bp, Homo sapiens
atatacagctcagaa

SEQ ID NO: 5238059 - DNA, 17 bp, Homo sapiens
atatacagtaactttat

SEQ ID NO: 5238060 - DNA, 22 bp, Homo sapiens
atatacagtaactttatgtgta

SEQ ID NO: 5238061 - DNA, 12 bp, Homo sapiens
atatacagttat

SEQ ID NO: 5238062 - DNA, 16 bp, Homo sapiens
atatacagttattttg

SEQ ID NO: 5238063 - DNA, 11 bp, Homo sapiens
atatacagttt

SEQ ID NO: 5238064 - DNA, 17 bp, Homo sapiens
atatacagtttgacttt

SEQ ID NO: 5238065 - DNA, 13 bp, Homo sapiens
atatacatacact

SEQ ID NO: 5238066 - DNA, 21 bp, Homo sapiens
atatacatacacttgtataaa

SEQ ID NO: 5238067 - DNA, 17 bp, Homo sapiens
atatacatatacacaaa

SEQ ID NO: 5238068 - DNA, 18 bp, Homo sapiens
atatacatatatatatac

SEQ ID NO: 5238069 - DNA, 13 bp, Homo sapiens
atatacatatgat

SEQ ID NO: 5238070 - DNA, 19 bp, Homo sapiens
atatacatattataaataa

SEQ ID NO: 5238071 - DNA, 20 bp, Homo sapiens
atatacatattcaaagtata

SEQ ID NO: 5238072 - DNA, 15 bp, Homo sapiens
atatacatattgtat

SEQ ID NO: 5238073 - DNA, 18 bp, Homo sapiens
atatacatgtgtgtatat

SEQ ID NO: 5238074 - DNA, 16 bp, Homo sapiens
atatacatgtttatgt

SEQ ID NO: 5238075 - DNA, 17 bp, Homo sapiens
atatacattatttctgt

SEQ ID NO: 5238076 - DNA, 18 bp, Homo sapiens
atatacattatttctgta

SEQ ID NO: 5238077 - DNA, 13 bp, Homo sapiens
atatacattgtgt

SEQ ID NO: 5238078 - DNA, 11 bp, Homo sapiens
atatacatttc

SEQ ID NO: 5238079 - DNA, 23 bp, Homo sapiens
atatacattttctaaataaaaat

SEQ ID NO: 5238080 - DNA, 22 bp, Homo sapiens
atatacattttgttgcaggaaa

SEQ ID NO: 5238081 - DNA, 12 bp, Homo sapiens
atataccaaagc

SEQ ID NO: 5238082 - DNA, 14 bp, Homo sapiens
atataccaaattaa

SEQ ID NO: 5238083 - DNA, 20 bp, Homo sapiens
atataccactctttaccttt

SEQ ID NO: 5238084 - DNA, 14 bp, Homo sapiens
atatacctataatg

SEQ ID NO: 5238085 - DNA, 18 bp, Homo sapiens
atatacctataatgtgtg

SEQ ID NO: 5238086 - DNA, 20 bp, Homo sapiens
atatacctcttgaagaagaa

SEQ ID NO: 5238087 - DNA, 14 bp, Homo sapiens
atatacctggttta

SEQ ID NO: 5238088 - DNA, 15 bp, Homo sapiens
atataccttctcaaa

SEQ ID NO: 5238089 - DNA, 16 bp, Homo sapiens
atatacgaacaaaaca

SEQ ID NO: 5238090 - DNA, 21 bp, Homo sapiens
atatactaaaccaactctaat

SEQ ID NO: 5238091 - DNA, 22 bp, Homo sapiens
atatactaagatgttcactgtg

SEQ ID NO: 5238092 - DNA, 12 bp, Homo sapiens
atatactaataa

SEQ ID NO: 5238093 - DNA, 22 bp, Homo sapiens
atatactataattgtaaatatt

SEQ ID NO: 5238094 - DNA, 23 bp, Homo sapiens
atatactataattgtaaatattt

SEQ ID NO: 5238095 - DNA, 16 bp, Homo sapiens
atatactatacaacaa

SEQ ID NO: 5238096 - DNA, 17 bp, Homo sapiens
atatactatacaacaat

SEQ ID NO: 5238097 - DNA, 18 bp, Homo sapiens
atatactatacaacaatg

SEQ ID NO: 5238098 - DNA, 14 bp, Homo sapiens
atatactcaagttt

SEQ ID NO: 5238099 - DNA, 14 bp, Homo sapiens
atatactcatttgg

SEQ ID NO: 5238100 - DNA, 15 bp, Homo sapiens
atatactgcagcttt

SEQ ID NO: 5238101 - DNA, 12 bp, Homo sapiens
atatactgcata

SEQ ID NO: 5238102 - DNA, 17 bp, Homo sapiens
atatactgcttgtcatc

SEQ ID NO: 5238103 - DNA, 13 bp, Homo sapiens
atatactgtaaag

SEQ ID NO: 5238104 - DNA, 14 bp, Homo sapiens
atatactgtaaaga

SEQ ID NO: 5238105 - DNA, 15 bp, Homo sapiens
atatactgtaaagaa

SEQ ID NO: 5238106 - DNA, 18 bp, Homo sapiens
atatactgtaaagaaaga

SEQ ID NO: 5238107 - DNA, 23 bp, Homo sapiens
atatactgtaaagaaagagagaa

SEQ ID NO: 5238108 - DNA, 13 bp, Homo sapiens
atatactgtgtgc

SEQ ID NO: 5238109 - DNA, 13 bp, Homo sapiens
atatacttagaaa

SEQ ID NO: 5238110 - DNA, 19 bp, Homo sapiens
atatacttgttgtttaatg

SEQ ID NO: 5238111 - DNA, 20 bp, Homo sapiens
atatacttgttgtttaatgt

SEQ ID NO: 5238112 - DNA, 15 bp, Homo sapiens
atatactttactttt

SEQ ID NO: 5238113 - DNA, 17 bp, Homo sapiens
atatactttactttttc

SEQ ID NO: 5238114 - DNA, 18 bp, Homo sapiens
atatactttactttttcc

SEQ ID NO: 5238115 - DNA, 18 bp, Homo sapiens
atatactttgtctttctg

SEQ ID NO: 5238116 - DNA, 14 bp, Homo sapiens
atatactttgtgga

SEQ ID NO: 5238117 - DNA, 21 bp, Homo sapiens
atatactttgtggaccaatta

SEQ ID NO: 5238118 - DNA, 17 bp, Homo sapiens
atatacttttaaattat

SEQ ID NO: 5238119 - DNA, 18 bp, Homo sapiens
atatacttttaaattatg

SEQ ID NO: 5238120 - DNA, 15 bp, Homo sapiens
atatactttttcatg

SEQ ID NO: 5238121 - DNA, 17 bp, Homo sapiens
atatactttttcatgaa

SEQ ID NO: 5238122 - DNA, 14 bp, Homo sapiens
atatagaaaatctt

SEQ ID NO: 5238123 - DNA, 14 bp, Homo sapiens
atatagaaatatat

SEQ ID NO: 5238124 - DNA, 13 bp, Homo sapiens
atatagaatatat

SEQ ID NO: 5238125 - DNA, 13 bp, Homo sapiens
atatagaattgta

SEQ ID NO: 5238126 - DNA, 20 bp, Homo sapiens
atatagaattgtagactgat

SEQ ID NO: 5238127 - DNA, 14 bp, Homo sapiens
atatagaatttcct

SEQ ID NO: 5238128 - DNA, 15 bp, Homo sapiens
atatagaatttcctg

SEQ ID NO: 5238129 - DNA, 23 bp, Homo sapiens
atatagaatttcctgtaatatat

SEQ ID NO: 5238130 - DNA, 18 bp, Homo sapiens
atatagacattctcacat

SEQ ID NO: 5238131 - DNA, 20 bp, Homo sapiens
atatagaccaattgaagcat

SEQ ID NO: 5238132 - DNA, 21 bp, Homo sapiens
atatagaccaattgaagcatg

SEQ ID NO: 5238133 - DNA, 17 bp, Homo sapiens
atatagacctatgataa

SEQ ID NO: 5238134 - DNA, 16 bp, Homo sapiens
atatagactatataat

SEQ ID NO: 5238135 - DNA, 15 bp, Homo sapiens
atatagactgtacat

SEQ ID NO: 5238136 - DNA, 15 bp, Homo sapiens
atatagacttggaga

SEQ ID NO: 5238137 - DNA, 16 bp, Homo sapiens
atatagacttggagaa

SEQ ID NO: 5238138 - DNA, 21 bp, Homo sapiens
atatagagacaggacagaatg

SEQ ID NO: 5238139 - DNA, 23 bp, Homo sapiens
atatagagacaggacagaatgtg

SEQ ID NO: 5238140 - DNA, 16 bp, Homo sapiens
atatagagatgcattc

SEQ ID NO: 5238141 - DNA, 15 bp, Homo sapiens
atatagagatgtttt

SEQ ID NO: 5238142 - DNA, 16 bp, Homo sapiens
atatagagatgttttt

SEQ ID NO: 5238143 - DNA, 19 bp, Homo sapiens
atatagagtcattgtaatg

SEQ ID NO: 5238144 - DNA, 15 bp, Homo sapiens
atatagataacagat

SEQ ID NO: 5238145 - DNA, 19 bp, Homo sapiens
atatagatacccaattgtt

SEQ ID NO: 5238146 - DNA, 20 bp, Homo sapiens
atatagatgtctgtgtatac

SEQ ID NO: 5238147 - DNA, 15 bp, Homo sapiens
atatagattagaaaa

SEQ ID NO: 5238148 - DNA, 17 bp, Homo sapiens
atatagattagaaaaat

SEQ ID NO: 5238149 - DNA, 23 bp, Homo sapiens
atatagattataacttgtctaaa

SEQ ID NO: 5238150 - DNA, 12 bp, Homo sapiens
atatagatttta

SEQ ID NO: 5238151 - DNA, 14 bp, Homo sapiens
atatagattttatt

SEQ ID NO: 5238152 - DNA, 20 bp, Homo sapiens
atatagcaaaacttttaaac

SEQ ID NO: 5238153 - DNA, 21 bp, Homo sapiens
atatagcaaaacttttaaact

SEQ ID NO: 5238154 - DNA, 14 bp, Homo sapiens
atatagcaaaatga

SEQ ID NO: 5238155 - DNA, 12 bp, Homo sapiens
atatagcaaaga

SEQ ID NO: 5238156 - DNA, 15 bp, Homo sapiens
atatagcaaagatat

SEQ ID NO: 5238157 - DNA, 17 bp, Homo sapiens
atatagcaaagatatat

SEQ ID NO: 5238158 - DNA, 19 bp, Homo sapiens
atatagcaaagatatatat

SEQ ID NO: 5238159 - DNA, 20 bp, Homo sapiens
atatagcagcaaaaatataa

SEQ ID NO: 5238160 - DNA, 16 bp, Homo sapiens
atatagcatctttcat

SEQ ID NO: 5238161 - DNA, 19 bp, Homo sapiens
atatagcattaataaaact

SEQ ID NO: 5238162 - DNA, 12 bp, Homo sapiens
atatagccaggg

SEQ ID NO: 5238163 - DNA, 16 bp, Homo sapiens
atatagcccagccagg

SEQ ID NO: 5238164 - DNA, 15 bp, Homo sapiens
atatagcctttaaat

SEQ ID NO: 5238165 - DNA, 21 bp, Homo sapiens
atatagcgttcccaacaacat

SEQ ID NO: 5238166 - DNA, 20 bp, Homo sapiens
atatagctctacacaacatg

SEQ ID NO: 5238167 - DNA, 17 bp, Homo sapiens
atatagctgatcagttt

SEQ ID NO: 5238168 - DNA, 18 bp, Homo sapiens
atatagctgatcagtttt

SEQ ID NO: 5238169 - DNA, 18 bp, Homo sapiens
atatagctgtacaaatat

SEQ ID NO: 5238170 - DNA, 19 bp, Homo sapiens
atatagctgtacaaatata

SEQ ID NO: 5238171 - DNA, 14 bp, Homo sapiens
atatagctttgcaa

SEQ ID NO: 5238172 - DNA, 16 bp, Homo sapiens
ataaataaaaataatt

SEQ ID NO: 5238173 - DNA, 18 bp, Homo sapiens
ataaataaaaatattctc

SEQ ID NO: 5238174 - DNA, 15 bp, Homo sapiens
ataaataaaactgaa

SEQ ID NO: 5238175 - DNA, 17 bp, Homo sapiens
ataaataaaagaaaaat

SEQ ID NO: 5238176 - DNA, 22 bp, Homo sapiens
ataaataaaagctagatactgg

SEQ ID NO: 5238177 - DNA, 16 bp, Homo sapiens
ataaataaaagtacag

SEQ ID NO: 5238178 - DNA, 21 bp, Homo sapiens
ataaataaagaagaaaataac

SEQ ID NO: 5238179 - DNA, 16 bp, Homo sapiens
ataaataaatgcaata

SEQ ID NO: 5238180 - DNA, 14 bp, Homo sapiens
ataaataaatgcca

SEQ ID NO: 5238181 - DNA, 19 bp, Homo sapiens
ataaataactcaatggaaa

SEQ ID NO: 5238182 - DNA, 17 bp, Homo sapiens
ataaataagagcatgat

SEQ ID NO: 5238183 - DNA, 22 bp, Homo sapiens
ataaataagtaaatacattatt

SEQ ID NO: 5238184 - DNA, 13 bp, Homo sapiens
ataaataataaag

SEQ ID NO: 5238185 - DNA, 21 bp, Homo sapiens
ataaataataaaggttctatg

SEQ ID NO: 5238186 - DNA, 16 bp, Homo sapiens
ataaatacaaaaatga

SEQ ID NO: 5238187 - DNA, 16 bp, Homo sapiens
ataaatacaaatctgt

SEQ ID NO: 5238188 - DNA, 17 bp, Homo sapiens
ataaatacaagttcttt

SEQ ID NO: 5238189 - DNA, 16 bp, Homo sapiens
ataaatacacagcatg

SEQ ID NO: 5238190 - DNA, 21 bp, Homo sapiens
ataaatacacagcatgcagac

SEQ ID NO: 5238191 - DNA, 20 bp, Homo sapiens
ataaatacagcatacttcaa

SEQ ID NO: 5238192 - DNA, 19 bp, Homo sapiens
ataaatacataaataaaag

SEQ ID NO: 5238193 - DNA, 13 bp, Homo sapiens
ataaatacatata

SEQ ID NO: 5238194 - DNA, 14 bp, Homo sapiens
ataaataccaaaga

SEQ ID NO: 5238195 - DNA, 21 bp, Homo sapiens
ataaataccaattatggaaat

SEQ ID NO: 5238196 - DNA, 21 bp, Homo sapiens
ataaatacgtattacaaacaa

SEQ ID NO: 5238197 - DNA, 23 bp, Homo sapiens
ataaatacgtgtcaaaaaagaat

SEQ ID NO: 5238198 - DNA, 19 bp, Homo sapiens
ataaatactgacaatgtat

SEQ ID NO: 5238199 - DNA, 18 bp, Homo sapiens
ataaatagaaaagtagac

SEQ ID NO: 5238200 - DNA, 19 bp, Homo sapiens
ataaatagaatgtaaatgt

SEQ ID NO: 5238201 - DNA, 12 bp, Homo sapiens
ataaatagatgt

SEQ ID NO: 5238202 - DNA, 15 bp, Homo sapiens
ataaatagatttagt

SEQ ID NO: 5238203 - DNA, 20 bp, Homo sapiens
ataaatagatttgattattt

SEQ ID NO: 5238204 - DNA, 16 bp, Homo sapiens
ataaatagcatttgga

SEQ ID NO: 5238205 - DNA, 12 bp, Homo sapiens
ataaatagcctt

SEQ ID NO: 5238206 - DNA, 17 bp, Homo sapiens
ataaatagctaaatggc

SEQ ID NO: 5238207 - DNA, 16 bp, Homo sapiens
ataaatagctagactg

SEQ ID NO: 5238208 - DNA, 21 bp, Homo sapiens
ataaatagctatatccatgta

SEQ ID NO: 5238209 - DNA, 16 bp, Homo sapiens
ataaataggagaggat

SEQ ID NO: 5238210 - DNA, 22 bp, Homo sapiens
ataaatagggaagatggagaca

SEQ ID NO: 5238211 - DNA, 15 bp, Homo sapiens
ataaatagtgttatt

SEQ ID NO: 5238212 - DNA, 14 bp, Homo sapiens
ataaatataaatat

SEQ ID NO: 5238213 - DNA, 16 bp, Homo sapiens
ataaatataatttata

SEQ ID NO: 5238214 - DNA, 22 bp, Homo sapiens
ataaatataatttataagcatt

SEQ ID NO: 5238215 - DNA, 14 bp, Homo sapiens
ataaatatactaat

SEQ ID NO: 5238216 - DNA, 18 bp, Homo sapiens
ataaatatactaataaaa

SEQ ID NO: 5238217 - DNA, 20 bp, Homo sapiens
ataaatatactaataaaaag

SEQ ID NO: 5238218 - DNA, 14 bp, Homo sapiens
ataaatatatataa

SEQ ID NO: 5238219 - DNA, 16 bp, Homo sapiens
ataaatatatataaac

SEQ ID NO: 5238220 - DNA, 22 bp, Homo sapiens
ataaatatatataaacctaaaa

SEQ ID NO: 5238221 - DNA, 19 bp, Homo sapiens
ataaatatatataaagaat

SEQ ID NO: 5238222 - DNA, 20 bp, Homo sapiens
ataaatatatataaatatat

SEQ ID NO: 5238223 - DNA, 21 bp, Homo sapiens
ataaatatatataaatatata

SEQ ID NO: 5238224 - DNA, 23 bp, Homo sapiens
ataaatatatatatatataaaat

SEQ ID NO: 5238225 - DNA, 18 bp, Homo sapiens
ataaatatatatttttaa

SEQ ID NO: 5238226 - DNA, 20 bp, Homo sapiens
ataaatatatatttttcaaa

SEQ ID NO: 5238227 - DNA, 22 bp, Homo sapiens
ataaatatatatttttcaaata

SEQ ID NO: 5238228 - DNA, 14 bp, Homo sapiens
ataaatatcacaaa

SEQ ID NO: 5238229 - DNA, 16 bp, Homo sapiens
ataaatatctatttat

SEQ ID NO: 5238230 - DNA, 12 bp, Homo sapiens
ataaatatgaag

SEQ ID NO: 5238231 - DNA, 15 bp, Homo sapiens
ataaatatgagtgcc

SEQ ID NO: 5238232 - DNA, 14 bp, Homo sapiens
ataaatatgcagtg

SEQ ID NO: 5238233 - DNA, 22 bp, Homo sapiens
ataaatatgcctctcctttgta

SEQ ID NO: 5238234 - DNA, 20 bp, Homo sapiens
ataaatatgtgattatcatt

SEQ ID NO: 5238235 - DNA, 22 bp, Homo sapiens
ataaatattatattatatatat

SEQ ID NO: 5238236 - DNA, 19 bp, Homo sapiens
ataaatattcacacttgaa

SEQ ID NO: 5238237 - DNA, 13 bp, Homo sapiens
ataaatattgtat

SEQ ID NO: 5238238 - DNA, 16 bp, Homo sapiens
ataaatattgtatttt

SEQ ID NO: 5238239 - DNA, 21 bp, Homo sapiens
ataaatattgtattttagata

SEQ ID NO: 5238240 - DNA, 21 bp, Homo sapiens
ataaatattgtcctgtttctt

SEQ ID NO: 5238241 - DNA, 20 bp, Homo sapiens
ataaatattgtctttttgta

SEQ ID NO: 5238242 - DNA, 23 bp, Homo sapiens
ataaatattgtctttttgtatgt

SEQ ID NO: 5238243 - DNA, 16 bp, Homo sapiens
ataaatatttatgctt

SEQ ID NO: 5238244 - DNA, 14 bp, Homo sapiens
ataaatatttatgt

SEQ ID NO: 5238245 - DNA, 18 bp, Homo sapiens
ataaatatttgtttgggt

SEQ ID NO: 5238246 - DNA, 15 bp, Homo sapiens
ataaatattttccgt

SEQ ID NO: 5238247 - DNA, 17 bp, Homo sapiens
ataaatcaatcttatta

SEQ ID NO: 5238248 - DNA, 14 bp, Homo sapiens
ataaatcaatgtca

SEQ ID NO: 5238249 - DNA, 20 bp, Homo sapiens
ataaatcaattcatgtttaa

SEQ ID NO: 5238250 - DNA, 23 bp, Homo sapiens
ataaatcagcacatttgaaagaa

SEQ ID NO: 5238251 - DNA, 18 bp, Homo sapiens
ataaatcagccgcaagga

SEQ ID NO: 5238252 - DNA, 17 bp, Homo sapiens
ataaatcagtatttttt

SEQ ID NO: 5238253 - DNA, 18 bp, Homo sapiens
ataaatcataaagtcagt

SEQ ID NO: 5238254 - DNA, 20 bp, Homo sapiens
ataaatcatattgatgaaaa

SEQ ID NO: 5238255 - DNA, 15 bp, Homo sapiens
ataaatcatgggcat

SEQ ID NO: 5238256 - DNA, 22 bp, Homo sapiens
ataaatcatgtggcctaatatt

SEQ ID NO: 5238257 - DNA, 15 bp, Homo sapiens
ataaatcatgttgtt

SEQ ID NO: 5238258 - DNA, 20 bp, Homo sapiens
ataaatcattcttactaaaa

SEQ ID NO: 5238259 - DNA, 19 bp, Homo sapiens
ataaatcattttatgtcaa

SEQ ID NO: 5238260 - DNA, 15 bp, Homo sapiens
ataaatccaaagtaa

SEQ ID NO: 5238261 - DNA, 14 bp, Homo sapiens
ataaatccaagact

SEQ ID NO: 5238262 - DNA, 17 bp, Homo sapiens
ataaatccaatatcatg

SEQ ID NO: 5238263 - DNA, 20 bp, Homo sapiens
ataaatccacccatgttatc

SEQ ID NO: 5238264 - DNA, 15 bp, Homo sapiens
ataaatccagttcta

SEQ ID NO: 5238265 - DNA, 14 bp, Homo sapiens
ataaatcgcttttg

SEQ ID NO: 5238266 - DNA, 21 bp, Homo sapiens
ataaatcgcttttgataatca

SEQ ID NO: 5238267 - DNA, 15 bp, Homo sapiens
ataaatcgggaaatt

SEQ ID NO: 5238268 - DNA, 16 bp, Homo sapiens
ataaatcgggaaattt

SEQ ID NO: 5238269 - DNA, 21 bp, Homo sapiens
ataaatctaaatgattatctt

SEQ ID NO: 5238270 - DNA, 21 bp, Homo sapiens
ataaatctaatgacattcaat

SEQ ID NO: 5238271 - DNA, 20 bp, Homo sapiens
ataaatctatatttttgtga

SEQ ID NO: 5238272 - DNA, 22 bp, Homo sapiens
ataaatctgagcctaaatctaa

SEQ ID NO: 5238273 - DNA, 22 bp, Homo sapiens
ataaatctgtgaacttgaaatt

SEQ ID NO: 5238274 - DNA, 18 bp, Homo sapiens
ataaatctgttagcatta

SEQ ID NO: 5238275 - DNA, 22 bp, Homo sapiens
ataaatctgttctgggctcttt

SEQ ID NO: 5238276 - DNA, 14 bp, Homo sapiens
ataaatctgttgcc

SEQ ID NO: 5238277 - DNA, 14 bp, Homo sapiens
ataaatcttaaaaa

SEQ ID NO: 5238278 - DNA, 18 bp, Homo sapiens
ataaatcttccaaagttt

SEQ ID NO: 5238279 - DNA, 16 bp, Homo sapiens
ataaatgaaagaaacc

SEQ ID NO: 5238280 - DNA, 12 bp, Homo sapiens
ataaatgaaata

SEQ ID NO: 5238281 - DNA, 16 bp, Homo sapiens
ataaatgaaatttgca

SEQ ID NO: 5238282 - DNA, 14 bp, Homo sapiens
ataaatgaacattt

SEQ ID NO: 5238283 - DNA, 16 bp, Homo sapiens
ataaatgaagatgcat

SEQ ID NO: 5238284 - DNA, 18 bp, Homo sapiens
ataaatgaagcagcttta

SEQ ID NO: 5238285 - DNA, 20 bp, Homo sapiens
ataaatgaagcagctttaaa

SEQ ID NO: 5238286 - DNA, 17 bp, Homo sapiens
ataaatgaagtttatac

SEQ ID NO: 5238287 - DNA, 13 bp, Homo sapiens
ataaatgaatgaa

SEQ ID NO: 5238288 - DNA, 18 bp, Homo sapiens
ataaatgaatgaaatata

SEQ ID NO: 5238289 - DNA, 14 bp, Homo sapiens
ataaatgaccagtt

SEQ ID NO: 5238290 - DNA, 16 bp, Homo sapiens
ataaatgaccagttta

SEQ ID NO: 5238291 - DNA, 20 bp, Homo sapiens
ataaatgaccagtttacctg

SEQ ID NO: 5238292 - DNA, 13 bp, Homo sapiens
ataaatgactatt

SEQ ID NO: 5238293 - DNA, 17 bp, Homo sapiens
ataaatgactattgtaa

SEQ ID NO: 5238294 - DNA, 23 bp, Homo sapiens
ataaatgagacccctttaaactg

SEQ ID NO: 5238295 - DNA, 14 bp, Homo sapiens
ataaatgagcattt

SEQ ID NO: 5238296 - DNA, 17 bp, Homo sapiens
ataaatgagctatgtat

SEQ ID NO: 5238297 - DNA, 20 bp, Homo sapiens
ataaatgagctatgtattaa

SEQ ID NO: 5238298 - DNA, 15 bp, Homo sapiens
ataaatgaggtcact

SEQ ID NO: 5238299 - DNA, 22 bp, Homo sapiens
ataaatgatatctatattctaa

SEQ ID NO: 5238300 - DNA, 15 bp, Homo sapiens
ataaatgattatatt

SEQ ID NO: 5238301 - DNA, 13 bp, Homo sapiens
ataaatgcaaata

SEQ ID NO: 5238302 - DNA, 20 bp, Homo sapiens
ataaatgcaatatgtattaa

SEQ ID NO: 5238303 - DNA, 15 bp, Homo sapiens
ataaatgcatagagc

SEQ ID NO: 5238304 - DNA, 19 bp, Homo sapiens
ataaatgcatagagcaatt

SEQ ID NO: 5238305 - DNA, 13 bp, Homo sapiens
ataaatgcatgat

SEQ ID NO: 5238306 - DNA, 23 bp, Homo sapiens
ataaatgcatgattttatacata

SEQ ID NO: 5238307 - DNA, 17 bp, Homo sapiens
ataaatgccaacatacc

SEQ ID NO: 5238308 - DNA, 15 bp, Homo sapiens
ataaatgccagagcc

SEQ ID NO: 5238309 - DNA, 14 bp, Homo sapiens
ataaatgcctttat

SEQ ID NO: 5238310 - DNA, 19 bp, Homo sapiens
ataaatgctattttttatt

SEQ ID NO: 5238311 - DNA, 15 bp, Homo sapiens
ataaatgctctattt

SEQ ID NO: 5238312 - DNA, 18 bp, Homo sapiens
ataaatgctgaatgaatc

SEQ ID NO: 5238313 - DNA, 15 bp, Homo sapiens
ataaatgctgctttg

SEQ ID NO: 5238314 - DNA, 23 bp, Homo sapiens
ataaatgctgctttggggatatt

SEQ ID NO: 5238315 - DNA, 12 bp, Homo sapiens
ataaatgcttta

SEQ ID NO: 5238316 - DNA, 15 bp, Homo sapiens
ataaatgctttaaat

SEQ ID NO: 5238317 - DNA, 18 bp, Homo sapiens
ataaatgctttaaatagt

SEQ ID NO: 5238318 - DNA, 21 bp, Homo sapiens
ataaatgcttttaaaaatcta

SEQ ID NO: 5238319 - DNA, 15 bp, Homo sapiens
ataaatggaaatcat

SEQ ID NO: 5238320 - DNA, 13 bp, Homo sapiens
ataaatggacttg

SEQ ID NO: 5238321 - DNA, 21 bp, Homo sapiens
ataaatggccagtgctgcttc

SEQ ID NO: 5238322 - DNA, 23 bp, Homo sapiens
ataaatggcccggacatgtcttg

SEQ ID NO: 5238323 - DNA, 13 bp, Homo sapiens
ataaatggctggt

SEQ ID NO: 5238324 - DNA, 15 bp, Homo sapiens
ataaatgggaaatgt

SEQ ID NO: 5238325 - DNA, 18 bp, Homo sapiens
ataaatgggaaatgtcga

SEQ ID NO: 5238326 - DNA, 23 bp, Homo sapiens
ataaatgggtgtatataatttta

SEQ ID NO: 5238327 - DNA, 19 bp, Homo sapiens
ataaatggtgagaattaaa

SEQ ID NO: 5238328 - DNA, 12 bp, Homo sapiens
ataaatgtacat

SEQ ID NO: 5238329 - DNA, 17 bp, Homo sapiens
ataaatgtataaatata

SEQ ID NO: 5238330 - DNA, 20 bp, Homo sapiens
ataaatgtataaatatacag

SEQ ID NO: 5238331 - DNA, 15 bp, Homo sapiens
ataaatgtatataca

SEQ ID NO: 5238332 - DNA, 16 bp, Homo sapiens
ataaatgtatatacac

SEQ ID NO: 5238333 - DNA, 20 bp, Homo sapiens
ataaatgtatatacacatat

SEQ ID NO: 5238334 - DNA, 11 bp, Homo sapiens
ataaatgtatc

SEQ ID NO: 5238335 - DNA, 18 bp, Homo sapiens
ataaatgtatcttattca

SEQ ID NO: 5238336 - DNA, 15 bp, Homo sapiens
ataaatgtcacaata

SEQ ID NO: 5238337 - DNA, 12 bp, Homo sapiens
ataaatgtcact

SEQ ID NO: 5238338 - DNA, 19 bp, Homo sapiens
ataaatgtcactttttgag

SEQ ID NO: 5238339 - DNA, 14 bp, Homo sapiens
ataaatgtgtattc

SEQ ID NO: 5238340 - DNA, 11 bp, Homo sapiens
ataaatgtgtg

SEQ ID NO: 5238341 - DNA, 14 bp, Homo sapiens
ataaatgtgtgtat

SEQ ID NO: 5238342 - DNA, 17 bp, Homo sapiens
ataaatgtgtgtatgtg

SEQ ID NO: 5238343 - DNA, 20 bp, Homo sapiens
ataaatgtgtgtatgtgtgt

SEQ ID NO: 5238344 - DNA, 16 bp, Homo sapiens
ataaatgttaagaaaa

SEQ ID NO: 5238345 - DNA, 21 bp, Homo sapiens
ataaatgttacctaattatta

SEQ ID NO: 5238346 - DNA, 16 bp, Homo sapiens
ataaatgttagttcta

SEQ ID NO: 5238347 - DNA, 12 bp, Homo sapiens
ataaatgttgaa

SEQ ID NO: 5238348 - DNA, 14 bp, Homo sapiens
ataaatgttgaaaa

SEQ ID NO: 5238349 - DNA, 16 bp, Homo sapiens
ataaatgttgctctaa

SEQ ID NO: 5238350 - DNA, 18 bp, Homo sapiens
ataaatgtttatattgtt

SEQ ID NO: 5238351 - DNA, 13 bp, Homo sapiens
atataggaaaata

SEQ ID NO: 5238352 - DNA, 16 bp, Homo sapiens
atataggaacttaaat

SEQ ID NO: 5238353 - DNA, 13 bp, Homo sapiens
atataggaagcat

SEQ ID NO: 5238354 - DNA, 18 bp, Homo sapiens
atataggacaaaatgtta

SEQ ID NO: 5238355 - DNA, 14 bp, Homo sapiens
atataggagcaata

SEQ ID NO: 5238356 - DNA, 16 bp, Homo sapiens
atataggataaaataa

SEQ ID NO: 5238357 - DNA, 19 bp, Homo sapiens
atataggatagacactgga

SEQ ID NO: 5238358 - DNA, 20 bp, Homo sapiens
atataggatagacactggac

SEQ ID NO: 5238359 - DNA, 22 bp, Homo sapiens
atataggctattttctaaagac

SEQ ID NO: 5238360 - DNA, 18 bp, Homo sapiens
atataggggttaaggaaa

SEQ ID NO: 5238361 - DNA, 19 bp, Homo sapiens
atataggtctcttctccca

SEQ ID NO: 5238362 - DNA, 15 bp, Homo sapiens
atataggttgtgcaa

SEQ ID NO: 5238363 - DNA, 22 bp, Homo sapiens
atataggttgtgcaaattaaca

SEQ ID NO: 5238364 - DNA, 18 bp, Homo sapiens
atataggttttgtttgct

SEQ ID NO: 5238365 - DNA, 21 bp, Homo sapiens
atataggttttgtttgctatc

SEQ ID NO: 5238366 - DNA, 23 bp, Homo sapiens
atatagtaactactttttatact

SEQ ID NO: 5238367 - DNA, 17 bp, Homo sapiens
atatagtacctttgctc

SEQ ID NO: 5238368 - DNA, 20 bp, Homo sapiens
atatagtatatttatactct

SEQ ID NO: 5238369 - DNA, 15 bp, Homo sapiens
atatagtattcattt

SEQ ID NO: 5238370 - DNA, 21 bp, Homo sapiens
atatagtctattcattaagta

SEQ ID NO: 5238371 - DNA, 13 bp, Homo sapiens
atatagtgaaaaa

SEQ ID NO: 5238372 - DNA, 18 bp, Homo sapiens
atatagtgctatatatat

SEQ ID NO: 5238373 - DNA, 13 bp, Homo sapiens
atatagtgctgtt

SEQ ID NO: 5238374 - DNA, 15 bp, Homo sapiens
atatagtgctgttta

SEQ ID NO: 5238375 - DNA, 18 bp, Homo sapiens
atatagtgggtacatcaa

SEQ ID NO: 5238376 - DNA, 17 bp, Homo sapiens
atatagttagctaataa

SEQ ID NO: 5238377 - DNA, 22 bp, Homo sapiens
atatagttagctaataaaaagc

SEQ ID NO: 5238378 - DNA, 15 bp, Homo sapiens
atatagttagcttta

SEQ ID NO: 5238379 - DNA, 18 bp, Homo sapiens
atatagttccttgcctta

SEQ ID NO: 5238380 - DNA, 15 bp, Homo sapiens
atatagttgaacaag

SEQ ID NO: 5238381 - DNA, 11 bp, Homo sapiens
atatagtttgt

SEQ ID NO: 5238382 - DNA, 23 bp, Homo sapiens
atatagttttacttttaaactgt

SEQ ID NO: 5238383 - DNA, 21 bp, Homo sapiens
atatagtttttaccttttatg

SEQ ID NO: 5238384 - DNA, 17 bp, Homo sapiens
atatataaaaagaaacg

SEQ ID NO: 5238385 - DNA, 11 bp, Homo sapiens
atatataaaag

SEQ ID NO: 5238386 - DNA, 18 bp, Homo sapiens
atatataaaagaaatata

SEQ ID NO: 5238387 - DNA, 11 bp, Homo sapiens
atatataaaat

SEQ ID NO: 5238388 - DNA, 20 bp, Homo sapiens
atatataaaataaatatact

SEQ ID NO: 5238389 - DNA, 21 bp, Homo sapiens
atatataaaataaatatacta

SEQ ID NO: 5238390 - DNA, 17 bp, Homo sapiens
atatataaaatatctat

SEQ ID NO: 5238391 - DNA, 15 bp, Homo sapiens
atatataaagaatat

SEQ ID NO: 5238392 - DNA, 17 bp, Homo sapiens
atatataaagaatatat

SEQ ID NO: 5238393 - DNA, 19 bp, Homo sapiens
atatataaagacaacaaaa

SEQ ID NO: 5238394 - DNA, 21 bp, Homo sapiens
atatataaagacaacaaaaga

SEQ ID NO: 5238395 - DNA, 13 bp, Homo sapiens
atatataaagtat

SEQ ID NO: 5238396 - DNA, 15 bp, Homo sapiens
atatataaatatcta

SEQ ID NO: 5238397 - DNA, 19 bp, Homo sapiens
atatataacaatgctgtat

SEQ ID NO: 5238398 - DNA, 12 bp, Homo sapiens
atatataaccag

SEQ ID NO: 5238399 - DNA, 13 bp, Homo sapiens
atatataactatt

SEQ ID NO: 5238400 - DNA, 22 bp, Homo sapiens
atatataagatggaagcttcca

SEQ ID NO: 5238401 - DNA, 16 bp, Homo sapiens
atatataagtgtacat

SEQ ID NO: 5238402 - DNA, 12 bp, Homo sapiens
atatataataaa

SEQ ID NO: 5238403 - DNA, 13 bp, Homo sapiens
atatataatatat

SEQ ID NO: 5238404 - DNA, 15 bp, Homo sapiens
atatataatatgtat

SEQ ID NO: 5238405 - DNA, 17 bp, Homo sapiens
atatataatgttgccag

SEQ ID NO: 5238406 - DNA, 21 bp, Homo sapiens
atatataatttaatgtaaata

SEQ ID NO: 5238407 - DNA, 12 bp, Homo sapiens
atatataatttg

SEQ ID NO: 5238408 - DNA, 17 bp, Homo sapiens
atatatacaaaaagaaa

SEQ ID NO: 5238409 - DNA, 13 bp, Homo sapiens
atatatacacaca

SEQ ID NO: 5238410 - DNA, 15 bp, Homo sapiens
atatatacacacaca

SEQ ID NO: 5238411 - DNA, 13 bp, Homo sapiens
atatatacacata

SEQ ID NO: 5238412 - DNA, 23 bp, Homo sapiens
atatatacacatacatacacata

SEQ ID NO: 5238413 - DNA, 22 bp, Homo sapiens
atatatacacattagaaatatt

SEQ ID NO: 5238414 - DNA, 20 bp, Homo sapiens
atatatacagtaactttatg

SEQ ID NO: 5238415 - DNA, 10 bp, Homo sapiens
atatatacat

SEQ ID NO: 5238416 - DNA, 14 bp, Homo sapiens
atatatacatacac

SEQ ID NO: 5238417 - DNA, 16 bp, Homo sapiens
atatatacatacactt

SEQ ID NO: 5238418 - DNA, 13 bp, Homo sapiens
atatatacatacg

SEQ ID NO: 5238419 - DNA, 15 bp, Homo sapiens
atatatacatacgca

SEQ ID NO: 5238420 - DNA, 22 bp, Homo sapiens
atatatacatacgcaattgtat

SEQ ID NO: 5238421 - DNA, 14 bp, Homo sapiens
atatatacatatat

SEQ ID NO: 5238422 - DNA, 13 bp, Homo sapiens
atatatacatatg

SEQ ID NO: 5238423 - DNA, 13 bp, Homo sapiens
atatatacatgta

SEQ ID NO: 5238424 - DNA, 15 bp, Homo sapiens
atatatacatgtttt

SEQ ID NO: 5238425 - DNA, 11 bp, Homo sapiens
atatatacatt

SEQ ID NO: 5238426 - DNA, 16 bp, Homo sapiens
atatatacattttgca

SEQ ID NO: 5238427 - DNA, 22 bp, Homo sapiens
atatatacgaacaaaacacacg

SEQ ID NO: 5238428 - DNA, 14 bp, Homo sapiens
atatatactattaa

SEQ ID NO: 5238429 - DNA, 19 bp, Homo sapiens
atatatactcaagagtggt

SEQ ID NO: 5238430 - DNA, 13 bp, Homo sapiens
atatatactggaa

SEQ ID NO: 5238431 - DNA, 14 bp, Homo sapiens
atatatactggaag

SEQ ID NO: 5238432 - DNA, 15 bp, Homo sapiens
atatatactggaagt

SEQ ID NO: 5238433 - DNA, 15 bp, Homo sapiens
atatatacttgtggt

SEQ ID NO: 5238434 - DNA, 12 bp, Homo sapiens
atatatagaaaa

SEQ ID NO: 5238435 - DNA, 14 bp, Homo sapiens
atatatagaaaaga

SEQ ID NO: 5238436 - DNA, 13 bp, Homo sapiens
atatatagaatct

SEQ ID NO: 5238437 - DNA, 17 bp, Homo sapiens
atatatagaattgtaga

SEQ ID NO: 5238438 - DNA, 13 bp, Homo sapiens
atatatagagaaa

SEQ ID NO: 5238439 - DNA, 14 bp, Homo sapiens
atatatagcattta

SEQ ID NO: 5238440 - DNA, 23 bp, Homo sapiens
atatatagctacattcacacact

SEQ ID NO: 5238441 - DNA, 14 bp, Homo sapiens
atatataggcagtt

SEQ ID NO: 5238442 - DNA, 15 bp, Homo sapiens
atatatagtatttaa

SEQ ID NO: 5238443 - DNA, 19 bp, Homo sapiens
atatatagtgggtacatca

SEQ ID NO: 5238444 - DNA, 20 bp, Homo sapiens
atatatagttacaacattaa

SEQ ID NO: 5238445 - DNA, 14 bp, Homo sapiens
atatatataaaata

SEQ ID NO: 5238446 - DNA, 13 bp, Homo sapiens
atatatataaagt

SEQ ID NO: 5238447 - DNA, 13 bp, Homo sapiens
atatatataaata

SEQ ID NO: 5238448 - DNA, 14 bp, Homo sapiens
atatatataaatat

SEQ ID NO: 5238449 - DNA, 15 bp, Homo sapiens
atatatataaatata

SEQ ID NO: 5238450 - DNA, 11 bp, Homo sapiens
atatatataat

SEQ ID NO: 5238451 - DNA, 10 bp, Homo sapiens
atatatatat

SEQ ID NO: 5238452 - DNA, 13 bp, Homo sapiens
atatatatataaa

SEQ ID NO: 5238453 - DNA, 15 bp, Homo sapiens
atatatatataaaga

SEQ ID NO: 5238454 - DNA, 13 bp, Homo sapiens
atatatatatata

SEQ ID NO: 5238455 - DNA, 15 bp, Homo sapiens
atatatatatataac

SEQ ID NO: 5238456 - DNA, 14 bp, Homo sapiens
atatatatatatca

SEQ ID NO: 5238457 - DNA, 12 bp, Homo sapiens
atatatatatgt

SEQ ID NO: 5238458 - DNA, 14 bp, Homo sapiens
atatatatatgtat

SEQ ID NO: 5238459 - DNA, 14 bp, Homo sapiens
atatatatatgtgt

SEQ ID NO: 5238460 - DNA, 13 bp, Homo sapiens
atatatatattta

SEQ ID NO: 5238461 - DNA, 21 bp, Homo sapiens
atatatatctatatatataat

SEQ ID NO: 5238462 - DNA, 15 bp, Homo sapiens
atatatatgaataaa

SEQ ID NO: 5238463 - DNA, 16 bp, Homo sapiens
atatatatgccatgat

SEQ ID NO: 5238464 - DNA, 20 bp, Homo sapiens
atatatatggtcatatacat

SEQ ID NO: 5238465 - DNA, 16 bp, Homo sapiens
atatatatgtacagtt

SEQ ID NO: 5238466 - DNA, 14 bp, Homo sapiens
atatatatgtatat

SEQ ID NO: 5238467 - DNA, 22 bp, Homo sapiens
atatatatgtatatgtatatat

SEQ ID NO: 5238468 - DNA, 13 bp, Homo sapiens
atatatatgtcaa

SEQ ID NO: 5238469 - DNA, 12 bp, Homo sapiens
atatatatgtga

SEQ ID NO: 5238470 - DNA, 15 bp, Homo sapiens
atatatatgtgaact

SEQ ID NO: 5238471 - DNA, 14 bp, Homo sapiens
atatatatgtgtgt

SEQ ID NO: 5238472 - DNA, 20 bp, Homo sapiens
atatatatgtgtgtgtatgt

SEQ ID NO: 5238473 - DNA, 14 bp, Homo sapiens
atatatattaaaat

SEQ ID NO: 5238474 - DNA, 12 bp, Homo sapiens
atatatattata

SEQ ID NO: 5238475 - DNA, 16 bp, Homo sapiens
atatatattattctca

SEQ ID NO: 5238476 - DNA, 15 bp, Homo sapiens
atatatattctcagc

SEQ ID NO: 5238477 - DNA, 14 bp, Homo sapiens
atatatattgtaaa

SEQ ID NO: 5238478 - DNA, 17 bp, Homo sapiens
atatatattgtaaagaa

SEQ ID NO: 5238479 - DNA, 10 bp, Homo sapiens
atatatattt

SEQ ID NO: 5238480 - DNA, 15 bp, Homo sapiens
atatatatttatcat

SEQ ID NO: 5238481 - DNA, 17 bp, Homo sapiens
atatatatttccaaata

SEQ ID NO: 5238482 - DNA, 19 bp, Homo sapiens
atatatatttccaaatatt

SEQ ID NO: 5238483 - DNA, 16 bp, Homo sapiens
atatatatttgtaaca

SEQ ID NO: 5238484 - DNA, 17 bp, Homo sapiens
atatatatttgtaacat

SEQ ID NO: 5238485 - DNA, 15 bp, Homo sapiens
atatatattttaagg

SEQ ID NO: 5238486 - DNA, 13 bp, Homo sapiens
atatatattttgt

SEQ ID NO: 5238487 - DNA, 15 bp, Homo sapiens
atatatcaaaacgtt

SEQ ID NO: 5238488 - DNA, 19 bp, Homo sapiens
atatatcaagaagtcttga

SEQ ID NO: 5238489 - DNA, 17 bp, Homo sapiens
atatatcacccagacat

SEQ ID NO: 5238490 - DNA, 21 bp, Homo sapiens
atatatcacccagacataaag

SEQ ID NO: 5238491 - DNA, 16 bp, Homo sapiens
atatatcagaatctgt

SEQ ID NO: 5238492 - DNA, 15 bp, Homo sapiens
atatatcagttataa

SEQ ID NO: 5238493 - DNA, 15 bp, Homo sapiens
atatatcagtttgat

SEQ ID NO: 5238494 - DNA, 22 bp, Homo sapiens
atatatcataaaggatatttca

SEQ ID NO: 5238495 - DNA, 15 bp, Homo sapiens
atatatcataaagta

SEQ ID NO: 5238496 - DNA, 14 bp, Homo sapiens
atatatcataactt

SEQ ID NO: 5238497 - DNA, 14 bp, Homo sapiens
atatatcatagtat

SEQ ID NO: 5238498 - DNA, 18 bp, Homo sapiens
atatatccacacatttgt

SEQ ID NO: 5238499 - DNA, 16 bp, Homo sapiens
atatatccccactact

SEQ ID NO: 5238500 - DNA, 17 bp, Homo sapiens
atatatccctgataaat

SEQ ID NO: 5238501 - DNA, 22 bp, Homo sapiens
atatatccctgataaatattca

SEQ ID NO: 5238502 - DNA, 13 bp, Homo sapiens
atatatcctgttt

SEQ ID NO: 5238503 - DNA, 17 bp, Homo sapiens
atatatctacaatatat

SEQ ID NO: 5238504 - DNA, 20 bp, Homo sapiens
atatatctacaatatatatt

SEQ ID NO: 5238505 - DNA, 23 bp, Homo sapiens
atatatctatatcatatttctgt

SEQ ID NO: 5238506 - DNA, 16 bp, Homo sapiens
atatatctatctattt

SEQ ID NO: 5238507 - DNA, 18 bp, Homo sapiens
atatatctatctatttga

SEQ ID NO: 5238508 - DNA, 13 bp, Homo sapiens
atatatctattat

SEQ ID NO: 5238509 - DNA, 14 bp, Homo sapiens
atatatctcaaatt

SEQ ID NO: 5238510 - DNA, 16 bp, Homo sapiens
atatatctcaaattgt

SEQ ID NO: 5238511 - DNA, 17 bp, Homo sapiens
atatatctgagttgtgc

SEQ ID NO: 5238512 - DNA, 22 bp, Homo sapiens
atatatctgataaaattgtgat

SEQ ID NO: 5238513 - DNA, 21 bp, Homo sapiens
atatatctgatggcacctata

SEQ ID NO: 5238514 - DNA, 17 bp, Homo sapiens
atatatctgcttcagtg

SEQ ID NO: 5238515 - DNA, 11 bp, Homo sapiens
atatatctgta

SEQ ID NO: 5238516 - DNA, 22 bp, Homo sapiens
atatatctgtaacactattaca

SEQ ID NO: 5238517 - DNA, 23 bp, Homo sapiens
atatatcttaagcaggtttgttt

SEQ ID NO: 5238518 - DNA, 20 bp, Homo sapiens
atatatcttatccaattcat

SEQ ID NO: 5238519 - DNA, 12 bp, Homo sapiens
atatatcttatg

SEQ ID NO: 5238520 - DNA, 15 bp, Homo sapiens
atatatctttgtaaa

SEQ ID NO: 5238521 - DNA, 13 bp, Homo sapiens
atatatcttttgt

SEQ ID NO: 5238522 - DNA, 15 bp, Homo sapiens
atatatcttttgtaa

SEQ ID NO: 5238523 - DNA, 15 bp, Homo sapiens
atatatgaaaactat

SEQ ID NO: 5238524 - DNA, 22 bp, Homo sapiens
atatatgaaaggcttctgggac

SEQ ID NO: 5238525 - DNA, 20 bp, Homo sapiens
atatatgaagacaataattc

SEQ ID NO: 5238526 - DNA, 13 bp, Homo sapiens
atatatgatatat

SEQ ID NO: 5238527 - DNA, 13 bp, Homo sapiens
atatatgatcatt

SEQ ID NO: 5238528 - DNA, 18 bp, Homo sapiens
atatatgatttgcatgtg

SEQ ID NO: 5238529 - DNA, 16 bp, Homo sapiens
atatatgccttactat

SEQ ID NO: 5238530 - DNA, 13 bp, Homo sapiens
atatatgctgtat

SEQ ID NO: 5238531 - DNA, 13 bp, Homo sapiens
atatatgcttttg

SEQ ID NO: 5238532 - DNA, 22 bp, Homo sapiens
atatatggaagataattttatg

SEQ ID NO: 5238533 - DNA, 21 bp, Homo sapiens
atatatggaataagtgtacat

SEQ ID NO: 5238534 - DNA, 12 bp, Homo sapiens
atatatggacat

SEQ ID NO: 5238535 - DNA, 13 bp, Homo sapiens
ataaatgtttcaa

SEQ ID NO: 5238536 - DNA, 16 bp, Homo sapiens
ataaatgtttcatgaa

SEQ ID NO: 5238537 - DNA, 20 bp, Homo sapiens
ataaatgtttcccccactcc

SEQ ID NO: 5238538 - DNA, 17 bp, Homo sapiens
ataaatgtttttattaa

SEQ ID NO: 5238539 - DNA, 20 bp, Homo sapiens
ataaattaaataaactgttt

SEQ ID NO: 5238540 - DNA, 19 bp, Homo sapiens
ataaattaaatatatgtat

SEQ ID NO: 5238541 - DNA, 18 bp, Homo sapiens
ataaattaacattatatt

SEQ ID NO: 5238542 - DNA, 13 bp, Homo sapiens
ataaattaataca

SEQ ID NO: 5238543 - DNA, 21 bp, Homo sapiens
ataaattaatacataagttaa

SEQ ID NO: 5238544 - DNA, 16 bp, Homo sapiens
ataaattaatattgta

SEQ ID NO: 5238545 - DNA, 16 bp, Homo sapiens
ataaattaatgagttt

SEQ ID NO: 5238546 - DNA, 22 bp, Homo sapiens
ataaattaatgagttttatcca

SEQ ID NO: 5238547 - DNA, 17 bp, Homo sapiens
ataaattaattgtgcct

SEQ ID NO: 5238548 - DNA, 14 bp, Homo sapiens
ataaattaatttgt

SEQ ID NO: 5238549 - DNA, 14 bp, Homo sapiens
ataaattacatgca

SEQ ID NO: 5238550 - DNA, 19 bp, Homo sapiens
ataaattactaattatctt

SEQ ID NO: 5238551 - DNA, 20 bp, Homo sapiens
ataaattactatctgttgaa

SEQ ID NO: 5238552 - DNA, 14 bp, Homo sapiens
ataaattactgttt

SEQ ID NO: 5238553 - DNA, 13 bp, Homo sapiens
ataaattataagt

SEQ ID NO: 5238554 - DNA, 17 bp, Homo sapiens
ataaattatgagatttt

SEQ ID NO: 5238555 - DNA, 22 bp, Homo sapiens
ataaattatgagctatcctttc

SEQ ID NO: 5238556 - DNA, 19 bp, Homo sapiens
ataaattatggcatttcta

SEQ ID NO: 5238557 - DNA, 14 bp, Homo sapiens
ataaattattactt

SEQ ID NO: 5238558 - DNA, 14 bp, Homo sapiens
ataaattattcaga

SEQ ID NO: 5238559 - DNA, 21 bp, Homo sapiens
ataaattattcagaactattt

SEQ ID NO: 5238560 - DNA, 16 bp, Homo sapiens
ataaattatttctaaa

SEQ ID NO: 5238561 - DNA, 17 bp, Homo sapiens
ataaattcaaaccattt

SEQ ID NO: 5238562 - DNA, 20 bp, Homo sapiens
ataaattcaactttgtaaaa

SEQ ID NO: 5238563 - DNA, 12 bp, Homo sapiens
ataaattcagat

SEQ ID NO: 5238564 - DNA, 22 bp, Homo sapiens
ataaattcagatatatttttca

SEQ ID NO: 5238565 - DNA, 17 bp, Homo sapiens
ataaattcataactggt

SEQ ID NO: 5238566 - DNA, 15 bp, Homo sapiens
ataaattcatcagaa

SEQ ID NO: 5238567 - DNA, 19 bp, Homo sapiens
ataaattccagaggactct

SEQ ID NO: 5238568 - DNA, 20 bp, Homo sapiens
ataaattcctctttgctttg

SEQ ID NO: 5238569 - DNA, 12 bp, Homo sapiens
ataaattctaaa

SEQ ID NO: 5238570 - DNA, 13 bp, Homo sapiens
ataaattctaaat

SEQ ID NO: 5238571 - DNA, 21 bp, Homo sapiens
ataaattctaaattacaaagg

SEQ ID NO: 5238572 - DNA, 16 bp, Homo sapiens
ataaattctactaagt

SEQ ID NO: 5238573 - DNA, 17 bp, Homo sapiens
ataaattctactaagtt

SEQ ID NO: 5238574 - DNA, 19 bp, Homo sapiens
ataaattctactaagttat

SEQ ID NO: 5238575 - DNA, 16 bp, Homo sapiens
ataaattctataggaa

SEQ ID NO: 5238576 - DNA, 13 bp, Homo sapiens
ataaattctgatt

SEQ ID NO: 5238577 - DNA, 17 bp, Homo sapiens
ataaattgaaattgtga

SEQ ID NO: 5238578 - DNA, 19 bp, Homo sapiens
ataaattgatttttataaa

SEQ ID NO: 5238579 - DNA, 17 bp, Homo sapiens
ataaattgcataaagca

SEQ ID NO: 5238580 - DNA, 18 bp, Homo sapiens
ataaattgcataaagcat

SEQ ID NO: 5238581 - DNA, 19 bp, Homo sapiens
ataaattgccataatatga

SEQ ID NO: 5238582 - DNA, 20 bp, Homo sapiens
ataaattgccataatatgat

SEQ ID NO: 5238583 - DNA, 20 bp, Homo sapiens
ataaattgcctcccttcctc

SEQ ID NO: 5238584 - DNA, 19 bp, Homo sapiens
ataaattgctaatgttgct

SEQ ID NO: 5238585 - DNA, 13 bp, Homo sapiens
ataaattgctcct

SEQ ID NO: 5238586 - DNA, 16 bp, Homo sapiens
ataaattgctccttga

SEQ ID NO: 5238587 - DNA, 17 bp, Homo sapiens
ataaattgcttactgat

SEQ ID NO: 5238588 - DNA, 19 bp, Homo sapiens
ataaattggctcctttccc

SEQ ID NO: 5238589 - DNA, 23 bp, Homo sapiens
ataaattggctcctttcccacag

SEQ ID NO: 5238590 - DNA, 13 bp, Homo sapiens
ataaattgtacat

SEQ ID NO: 5238591 - DNA, 16 bp, Homo sapiens
ataaattgtacatttt

SEQ ID NO: 5238592 - DNA, 18 bp, Homo sapiens
ataaattgtagggcttta

SEQ ID NO: 5238593 - DNA, 14 bp, Homo sapiens
ataaattgtatatt

SEQ ID NO: 5238594 - DNA, 16 bp, Homo sapiens
ataaattgtatattca

SEQ ID NO: 5238595 - DNA, 17 bp, Homo sapiens
ataaattgtatattcac

SEQ ID NO: 5238596 - DNA, 13 bp, Homo sapiens
ataaattgtcttt

SEQ ID NO: 5238597 - DNA, 17 bp, Homo sapiens
ataaattgtctttaaaa

SEQ ID NO: 5238598 - DNA, 22 bp, Homo sapiens
ataaattgtctttaaaaactgt

SEQ ID NO: 5238599 - DNA, 14 bp, Homo sapiens
ataaattgtttagt

SEQ ID NO: 5238600 - DNA, 22 bp, Homo sapiens
ataaattgtttagtggaaaata

SEQ ID NO: 5238601 - DNA, 12 bp, Homo sapiens
ataaatttaaaa

SEQ ID NO: 5238602 - DNA, 17 bp, Homo sapiens
ataaatttaaaacacag

SEQ ID NO: 5238603 - DNA, 16 bp, Homo sapiens
ataaatttaactttaa

SEQ ID NO: 5238604 - DNA, 18 bp, Homo sapiens
ataaatttaagaaaacaa

SEQ ID NO: 5238605 - DNA, 20 bp, Homo sapiens
ataaatttaagaaaacaagt

SEQ ID NO: 5238606 - DNA, 17 bp, Homo sapiens
ataaatttaagtttttc

SEQ ID NO: 5238607 - DNA, 14 bp, Homo sapiens
ataaatttaataaa

SEQ ID NO: 5238608 - DNA, 14 bp, Homo sapiens
ataaatttaatgta

SEQ ID NO: 5238609 - DNA, 16 bp, Homo sapiens
ataaatttactttaca

SEQ ID NO: 5238610 - DNA, 15 bp, Homo sapiens
ataaatttatttact

SEQ ID NO: 5238611 - DNA, 12 bp, Homo sapiens
ataaatttccac

SEQ ID NO: 5238612 - DNA, 23 bp, Homo sapiens
ataaatttcccagttaaagatta

SEQ ID NO: 5238613 - DNA, 13 bp, Homo sapiens
ataaatttctgct

SEQ ID NO: 5238614 - DNA, 12 bp, Homo sapiens
ataaatttgaat

SEQ ID NO: 5238615 - DNA, 18 bp, Homo sapiens
ataaatttggccatgaaa

SEQ ID NO: 5238616 - DNA, 20 bp, Homo sapiens
ataaatttgtgtaatattac

SEQ ID NO: 5238617 - DNA, 22 bp, Homo sapiens
ataaatttgttgtcatgtgtat

SEQ ID NO: 5238618 - DNA, 17 bp, Homo sapiens
ataaattttaattcaag

SEQ ID NO: 5238619 - DNA, 18 bp, Homo sapiens
ataaattttaattcaaga

SEQ ID NO: 5238620 - DNA, 23 bp, Homo sapiens
ataaattttaattcaagaaatga

SEQ ID NO: 5238621 - DNA, 13 bp, Homo sapiens
ataaattttatct

SEQ ID NO: 5238622 - DNA, 13 bp, Homo sapiens
ataaattttcaaa

SEQ ID NO: 5238623 - DNA, 16 bp, Homo sapiens
ataaattttcagaatt

SEQ ID NO: 5238624 - DNA, 16 bp, Homo sapiens
ataaattttgaaaagt

SEQ ID NO: 5238625 - DNA, 19 bp, Homo sapiens
ataaattttggaagaattc

SEQ ID NO: 5238626 - DNA, 21 bp, Homo sapiens
ataaattttggaagaattcat

SEQ ID NO: 5238627 - DNA, 11 bp, Homo sapiens
ataaattttgt

SEQ ID NO: 5238628 - DNA, 15 bp, Homo sapiens
ataaattttgtgcaa

SEQ ID NO: 5238629 - DNA, 15 bp, Homo sapiens
ataaattttttataa

SEQ ID NO: 5238630 - DNA, 15 bp, Homo sapiens
ataaattttttgaaa

SEQ ID NO: 5238631 - DNA, 22 bp, Homo sapiens
ataaattttttgacctatttta

SEQ ID NO: 5238632 - DNA, 22 bp, Homo sapiens
ataaattttttttggtcaaatt

SEQ ID NO: 5238633 - DNA, 11 bp, Homo sapiens
ataacaaaaaa

SEQ ID NO: 5238634 - DNA, 17 bp, Homo sapiens
ataacaaaaaagagaaa

SEQ ID NO: 5238635 - DNA, 15 bp, Homo sapiens
ataacaaaaaataaa

SEQ ID NO: 5238636 - DNA, 16 bp, Homo sapiens
ataacaaaaaataaat

SEQ ID NO: 5238637 - DNA, 12 bp, Homo sapiens
ataacaaaagca

SEQ ID NO: 5238638 - DNA, 22 bp, Homo sapiens
ataacaaaatcacaagcaataa

SEQ ID NO: 5238639 - DNA, 17 bp, Homo sapiens
ataacaaagatatcttt

SEQ ID NO: 5238640 - DNA, 20 bp, Homo sapiens
ataacaaagatatcttttct

SEQ ID NO: 5238641 - DNA, 23 bp, Homo sapiens
ataacaaagatatcttttcttta

SEQ ID NO: 5238642 - DNA, 22 bp, Homo sapiens
ataacaaagcacataactggat

SEQ ID NO: 5238643 - DNA, 20 bp, Homo sapiens
ataacaaaggatacttattt

SEQ ID NO: 5238644 - DNA, 20 bp, Homo sapiens
ataacaaatgccaaattaaa

SEQ ID NO: 5238645 - DNA, 17 bp, Homo sapiens
ataacaacaacttaatg

SEQ ID NO: 5238646 - DNA, 20 bp, Homo sapiens
ataacaacactaatacacta

SEQ ID NO: 5238647 - DNA, 16 bp, Homo sapiens
ataacaacactgtgtt

SEQ ID NO: 5238648 - DNA, 16 bp, Homo sapiens
ataacaaccttttaca

SEQ ID NO: 5238649 - DNA, 21 bp, Homo sapiens
ataacaaccttttacattgtg

SEQ ID NO: 5238650 - DNA, 20 bp, Homo sapiens
ataacaactatttttgttgt

SEQ ID NO: 5238651 - DNA, 19 bp, Homo sapiens
ataacaactgagatgttaa

SEQ ID NO: 5238652 - DNA, 13 bp, Homo sapiens
ataacaagaaaat

SEQ ID NO: 5238653 - DNA, 17 bp, Homo sapiens
ataacaagaagcccagt

SEQ ID NO: 5238654 - DNA, 16 bp, Homo sapiens
ataacaatatatagaa

SEQ ID NO: 5238655 - DNA, 15 bp, Homo sapiens
ataacaatgctgtat

SEQ ID NO: 5238656 - DNA, 17 bp, Homo sapiens
ataacaatgtatgtgaa

SEQ ID NO: 5238657 - DNA, 18 bp, Homo sapiens
ataacaatgttaaatgca

SEQ ID NO: 5238658 - DNA, 14 bp, Homo sapiens
ataacaattcctct

SEQ ID NO: 5238659 - DNA, 14 bp, Homo sapiens
ataacacaatatga

SEQ ID NO: 5238660 - DNA, 12 bp, Homo sapiens
ataacacatttt

SEQ ID NO: 5238661 - DNA, 13 bp, Homo sapiens
ataacacattttt

SEQ ID NO: 5238662 - DNA, 23 bp, Homo sapiens
ataacacatttttttgcatgcat

SEQ ID NO: 5238663 - DNA, 18 bp, Homo sapiens
ataacaccaccattcaca

SEQ ID NO: 5238664 - DNA, 22 bp, Homo sapiens
ataacaccgtcccagggctctg

SEQ ID NO: 5238665 - DNA, 14 bp, Homo sapiens
ataacacctgccac

SEQ ID NO: 5238666 - DNA, 15 bp, Homo sapiens
ataacactaaaattt

SEQ ID NO: 5238667 - DNA, 16 bp, Homo sapiens
ataacactaaatgctg

SEQ ID NO: 5238668 - DNA, 17 bp, Homo sapiens
ataacactatatttatt

SEQ ID NO: 5238669 - DNA, 12 bp, Homo sapiens
ataacactgact

SEQ ID NO: 5238670 - DNA, 15 bp, Homo sapiens
ataacactggagtgg

SEQ ID NO: 5238671 - DNA, 21 bp, Homo sapiens
ataacactgtattttaatgta

SEQ ID NO: 5238672 - DNA, 12 bp, Homo sapiens
ataacactgtct

SEQ ID NO: 5238673 - DNA, 17 bp, Homo sapiens
ataacactgtgaagagc

SEQ ID NO: 5238674 - DNA, 14 bp, Homo sapiens
ataacacttaactt

SEQ ID NO: 5238675 - DNA, 14 bp, Homo sapiens
ataacacttgtcag

SEQ ID NO: 5238676 - DNA, 21 bp, Homo sapiens
ataacacttgtcagcctcaga

SEQ ID NO: 5238677 - DNA, 17 bp, Homo sapiens
ataacagaaatacatca

SEQ ID NO: 5238678 - DNA, 21 bp, Homo sapiens
ataacagaagaaaatagaatt

SEQ ID NO: 5238679 - DNA, 16 bp, Homo sapiens
ataacagatcctttca

SEQ ID NO: 5238680 - DNA, 14 bp, Homo sapiens
ataacagcaaataa

SEQ ID NO: 5238681 - DNA, 16 bp, Homo sapiens
ataacagccgctccag

SEQ ID NO: 5238682 - DNA, 13 bp, Homo sapiens
ataacagcctctt

SEQ ID NO: 5238683 - DNA, 19 bp, Homo sapiens
ataacagccttaaatcctt

SEQ ID NO: 5238684 - DNA, 19 bp, Homo sapiens
ataacagcgtttattatac

SEQ ID NO: 5238685 - DNA, 14 bp, Homo sapiens
ataacagctccttt

SEQ ID NO: 5238686 - DNA, 17 bp, Homo sapiens
ataacagctcctttatt

SEQ ID NO: 5238687 - DNA, 19 bp, Homo sapiens
ataacagctgcaattccct

SEQ ID NO: 5238688 - DNA, 22 bp, Homo sapiens
ataacagctgcaattccctgga

SEQ ID NO: 5238689 - DNA, 15 bp, Homo sapiens
ataacaggcattgca

SEQ ID NO: 5238690 - DNA, 21 bp, Homo sapiens
ataacaggcattgcactaaaa

SEQ ID NO: 5238691 - DNA, 22 bp, Homo sapiens
ataacagggtaaattattcagt

SEQ ID NO: 5238692 - DNA, 13 bp, Homo sapiens
ataacaggttatt

SEQ ID NO: 5238693 - DNA, 18 bp, Homo sapiens
ataacaggttattttagt

SEQ ID NO: 5238694 - DNA, 14 bp, Homo sapiens
ataacagtgccatt

SEQ ID NO: 5238695 - DNA, 17 bp, Homo sapiens
ataacagttataaagaa

SEQ ID NO: 5238696 - DNA, 24 bp, Homo sapiens
ataacagttataaagaaagattgt

SEQ ID NO: 5238697 - DNA, 19 bp, Homo sapiens
ataacagttatatttttgt

SEQ ID NO: 5238698 - DNA, 14 bp, Homo sapiens
ataacataaatctg

SEQ ID NO: 5238699 - DNA, 16 bp, Homo sapiens
ataacataaatttttt

SEQ ID NO: 5238700 - DNA, 15 bp, Homo sapiens
ataacataacaaata

SEQ ID NO: 5238701 - DNA, 16 bp, Homo sapiens
ataacataagctagaa

SEQ ID NO: 5238702 - DNA, 20 bp, Homo sapiens
ataacatatatggaagagga

SEQ ID NO: 5238703 - DNA, 17 bp, Homo sapiens
ataacatatcaaatgaa

SEQ ID NO: 5238704 - DNA, 18 bp, Homo sapiens
ataacatatctaaagtca

SEQ ID NO: 5238705 - DNA, 20 bp, Homo sapiens
ataacatattcttgctttca

SEQ ID NO: 5238706 - DNA, 17 bp, Homo sapiens
ataacatattttttctt

SEQ ID NO: 5238707 - DNA, 14 bp, Homo sapiens
ataacatcattgta

SEQ ID NO: 5238708 - DNA, 23 bp, Homo sapiens
ataacatcgaaaagttattttgt

SEQ ID NO: 5238709 - DNA, 14 bp, Homo sapiens
ataacatctgaaaa

SEQ ID NO: 5238710 - DNA, 17 bp, Homo sapiens
ataacatctgaaaagaa

SEQ ID NO: 5238711 - DNA, 21 bp, Homo sapiens
ataacatctgaaaagaaatgc

SEQ ID NO: 5238712 - DNA, 11 bp, Homo sapiens
ataacatcttt

SEQ ID NO: 5238713 - DNA, 18 bp, Homo sapiens
ataacatctttattgaaa

SEQ ID NO: 5238714 - DNA, 19 bp, Homo sapiens
ataacatctttgaaaagaa

SEQ ID NO: 5238715 - DNA, 14 bp, Homo sapiens
atatatggacatgg

SEQ ID NO: 5238716 - DNA, 15 bp, Homo sapiens
atatatggacatggc

SEQ ID NO: 5238717 - DNA, 12 bp, Homo sapiens
atatatggacct

SEQ ID NO: 5238718 - DNA, 13 bp, Homo sapiens
atatatggaccta

SEQ ID NO: 5238719 - DNA, 14 bp, Homo sapiens
atatatggataatg

SEQ ID NO: 5238720 - DNA, 13 bp, Homo sapiens
atatatggatcag

SEQ ID NO: 5238721 - DNA, 17 bp, Homo sapiens
atatatggcagagttgt

SEQ ID NO: 5238722 - DNA, 19 bp, Homo sapiens
atatatggcagagttgtaa

SEQ ID NO: 5238723 - DNA, 20 bp, Homo sapiens
atatatggcagagttgtaaa

SEQ ID NO: 5238724 - DNA, 14 bp, Homo sapiens
atatatggcatatt

SEQ ID NO: 5238725 - DNA, 17 bp, Homo sapiens
atatatggcatttgcag

SEQ ID NO: 5238726 - DNA, 22 bp, Homo sapiens
atatatggggatggtagttttt

SEQ ID NO: 5238727 - DNA, 20 bp, Homo sapiens
atatatgggggaaaattatt

SEQ ID NO: 5238728 - DNA, 19 bp, Homo sapiens
atatatggtcatatacata

SEQ ID NO: 5238729 - DNA, 18 bp, Homo sapiens
atatatggtctaatgttt

SEQ ID NO: 5238730 - DNA, 17 bp, Homo sapiens
atatatgtaaatagctt

SEQ ID NO: 5238731 - DNA, 17 bp, Homo sapiens
atatatgtaatatatac

SEQ ID NO: 5238732 - DNA, 14 bp, Homo sapiens
atatatgtacagtt

SEQ ID NO: 5238733 - DNA, 15 bp, Homo sapiens
atatatgtagagaaa

SEQ ID NO: 5238734 - DNA, 17 bp, Homo sapiens
atatatgtagagaaaga

SEQ ID NO: 5238735 - DNA, 18 bp, Homo sapiens
atatatgtagccagacag

SEQ ID NO: 5238736 - DNA, 17 bp, Homo sapiens
atatatgtataatatat

SEQ ID NO: 5238737 - DNA, 15 bp, Homo sapiens
atatatgtatatgta

SEQ ID NO: 5238738 - DNA, 16 bp, Homo sapiens
atatatgtatatgtat

SEQ ID NO: 5238739 - DNA, 19 bp, Homo sapiens
atatatgtatatgtatata

SEQ ID NO: 5238740 - DNA, 20 bp, Homo sapiens
atatatgtatatgtatatct

SEQ ID NO: 5238741 - DNA, 19 bp, Homo sapiens
atatatgtatgtaaaaatg

SEQ ID NO: 5238742 - DNA, 22 bp, Homo sapiens
atatatgtatgtatgtgtgtgt

SEQ ID NO: 5238743 - DNA, 20 bp, Homo sapiens
atatatgtattatttataat

SEQ ID NO: 5238744 - DNA, 17 bp, Homo sapiens
atatatgtatttattgt

SEQ ID NO: 5238745 - DNA, 13 bp, Homo sapiens
atatatgtcaata

SEQ ID NO: 5238746 - DNA, 18 bp, Homo sapiens
atatatgtcctattcatt

SEQ ID NO: 5238747 - DNA, 19 bp, Homo sapiens
atatatgtcctattcattc

SEQ ID NO: 5238748 - DNA, 17 bp, Homo sapiens
atatatgtgtatacata

SEQ ID NO: 5238749 - DNA, 15 bp, Homo sapiens
atatatgtgtatgta

SEQ ID NO: 5238750 - DNA, 18 bp, Homo sapiens
atatatgtgtgtttaaat

SEQ ID NO: 5238751 - DNA, 23 bp, Homo sapiens
atatatgtgtgtttaaataaagt

SEQ ID NO: 5238752 - DNA, 13 bp, Homo sapiens
atatatgtgtttt

SEQ ID NO: 5238753 - DNA, 14 bp, Homo sapiens
atatatgttcatat

SEQ ID NO: 5238754 - DNA, 21 bp, Homo sapiens
atatatgttctgcaagaatta

SEQ ID NO: 5238755 - DNA, 16 bp, Homo sapiens
atatatgttgatttct

SEQ ID NO: 5238756 - DNA, 16 bp, Homo sapiens
atatatgtttgtggaa

SEQ ID NO: 5238757 - DNA, 23 bp, Homo sapiens
atatatgtttgtggaatggattt

SEQ ID NO: 5238758 - DNA, 13 bp, Homo sapiens
atatatgttttaa

SEQ ID NO: 5238759 - DNA, 13 bp, Homo sapiens
atatatgttttga

SEQ ID NO: 5238760 - DNA, 14 bp, Homo sapiens
atatatgttttgag

SEQ ID NO: 5238761 - DNA, 18 bp, Homo sapiens
atatatgtttttgaaggc

SEQ ID NO: 5238762 - DNA, 17 bp, Homo sapiens
atatattaaaaatataa

SEQ ID NO: 5238763 - DNA, 18 bp, Homo sapiens
atatattaaaaatataaa

SEQ ID NO: 5238764 - DNA, 22 bp, Homo sapiens
atatattaaaaatataaaactg

SEQ ID NO: 5238765 - DNA, 13 bp, Homo sapiens
atatattaaaaca

SEQ ID NO: 5238766 - DNA, 19 bp, Homo sapiens
atatattactgatttagaa

SEQ ID NO: 5238767 - DNA, 16 bp, Homo sapiens
atatattaggcactac

SEQ ID NO: 5238768 - DNA, 17 bp, Homo sapiens
atatattataaatatat

SEQ ID NO: 5238769 - DNA, 22 bp, Homo sapiens
atatattatacttgtaattatg

SEQ ID NO: 5238770 - DNA, 12 bp, Homo sapiens
atatattatata

SEQ ID NO: 5238771 - DNA, 15 bp, Homo sapiens
atatattatatacat

SEQ ID NO: 5238772 - DNA, 15 bp, Homo sapiens
atatattatatatac

SEQ ID NO: 5238773 - DNA, 16 bp, Homo sapiens
atatattatatataca

SEQ ID NO: 5238774 - DNA, 17 bp, Homo sapiens
atatattatatatatct

SEQ ID NO: 5238775 - DNA, 21 bp, Homo sapiens
atatattatatatttttctga

SEQ ID NO: 5238776 - DNA, 15 bp, Homo sapiens
atatattatatggaa

SEQ ID NO: 5238777 - DNA, 20 bp, Homo sapiens
atatattatatggaaatata

SEQ ID NO: 5238778 - DNA, 15 bp, Homo sapiens
atatattatcttttc

SEQ ID NO: 5238779 - DNA, 16 bp, Homo sapiens
atatattatgtgaaga

SEQ ID NO: 5238780 - DNA, 14 bp, Homo sapiens
atatattattactt

SEQ ID NO: 5238781 - DNA, 18 bp, Homo sapiens
atatattattacttgtaa

SEQ ID NO: 5238782 - DNA, 13 bp, Homo sapiens
atatattcacttt

SEQ ID NO: 5238783 - DNA, 20 bp, Homo sapiens
atatattcactttcattttt

SEQ ID NO: 5238784 - DNA, 12 bp, Homo sapiens
atatattcatgt

SEQ ID NO: 5238785 - DNA, 13 bp, Homo sapiens
atatattcatgta

SEQ ID NO: 5238786 - DNA, 15 bp, Homo sapiens
atatattcatgtaat

SEQ ID NO: 5238787 - DNA, 19 bp, Homo sapiens
atatattcccaagctgaat

SEQ ID NO: 5238788 - DNA, 15 bp, Homo sapiens
atatattcccaatag

SEQ ID NO: 5238789 - DNA, 22 bp, Homo sapiens
atatattcccctaagatttgat

SEQ ID NO: 5238790 - DNA, 23 bp, Homo sapiens
atatattctacacatatatgtat

SEQ ID NO: 5238791 - DNA, 23 bp, Homo sapiens
atatattctattccatgtccata

SEQ ID NO: 5238792 - DNA, 13 bp, Homo sapiens
atatattctcagc

SEQ ID NO: 5238793 - DNA, 12 bp, Homo sapiens
atatattctctt

SEQ ID NO: 5238794 - DNA, 21 bp, Homo sapiens
atatattctgaagcaacattt

SEQ ID NO: 5238795 - DNA, 18 bp, Homo sapiens
atatattctttccatgca

SEQ ID NO: 5238796 - DNA, 20 bp, Homo sapiens
atatattgaaagttgctttt

SEQ ID NO: 5238797 - DNA, 21 bp, Homo sapiens
atatattgaaagttgctttta

SEQ ID NO: 5238798 - DNA, 13 bp, Homo sapiens
atatattgaacac

SEQ ID NO: 5238799 - DNA, 15 bp, Homo sapiens
atatattgaactttt

SEQ ID NO: 5238800 - DNA, 12 bp, Homo sapiens
atatattgcata

SEQ ID NO: 5238801 - DNA, 13 bp, Homo sapiens
atatattgcattt

SEQ ID NO: 5238802 - DNA, 14 bp, Homo sapiens
atatattgcatttc

SEQ ID NO: 5238803 - DNA, 15 bp, Homo sapiens
atatattgcatttct

SEQ ID NO: 5238804 - DNA, 21 bp, Homo sapiens
atatattgcatttctgtattt

SEQ ID NO: 5238805 - DNA, 23 bp, Homo sapiens
atatattgccagtatataagctg

SEQ ID NO: 5238806 - DNA, 16 bp, Homo sapiens
atatattgctgcattt

SEQ ID NO: 5238807 - DNA, 17 bp, Homo sapiens
atatattgggttccatt

SEQ ID NO: 5238808 - DNA, 21 bp, Homo sapiens
atatattgggttccattctca

SEQ ID NO: 5238809 - DNA, 19 bp, Homo sapiens
atatattggtaacatcctt

SEQ ID NO: 5238810 - DNA, 15 bp, Homo sapiens
atatattgtaaagaa

SEQ ID NO: 5238811 - DNA, 13 bp, Homo sapiens
atatattgtacaa

SEQ ID NO: 5238812 - DNA, 16 bp, Homo sapiens
atatattgtacaaatg

SEQ ID NO: 5238813 - DNA, 23 bp, Homo sapiens
atatattgtgttgactttataaa

SEQ ID NO: 5238814 - DNA, 18 bp, Homo sapiens
atatattgttgttacttt

SEQ ID NO: 5238815 - DNA, 12 bp, Homo sapiens
atatatttaaaa

SEQ ID NO: 5238816 - DNA, 20 bp, Homo sapiens
atatatttaaagggaaattg

SEQ ID NO: 5238817 - DNA, 21 bp, Homo sapiens
atatatttaaagggaaattga

SEQ ID NO: 5238818 - DNA, 16 bp, Homo sapiens
atatatttaaatgcaa

SEQ ID NO: 5238819 - DNA, 19 bp, Homo sapiens
atatatttaactatttaga

SEQ ID NO: 5238820 - DNA, 15 bp, Homo sapiens
atatatttaatgata

SEQ ID NO: 5238821 - DNA, 16 bp, Homo sapiens
atatatttacagaaga

SEQ ID NO: 5238822 - DNA, 19 bp, Homo sapiens
atatatttactaaaagaat

SEQ ID NO: 5238823 - DNA, 16 bp, Homo sapiens
atatatttataactca

SEQ ID NO: 5238824 - DNA, 23 bp, Homo sapiens
atatatttataactcatcataaa

SEQ ID NO: 5238825 - DNA, 14 bp, Homo sapiens
atatatttatatac

SEQ ID NO: 5238826 - DNA, 18 bp, Homo sapiens
atatatttatatactttt

SEQ ID NO: 5238827 - DNA, 19 bp, Homo sapiens
atatatttatttaaagcat

SEQ ID NO: 5238828 - DNA, 15 bp, Homo sapiens
atatatttattttat

SEQ ID NO: 5238829 - DNA, 22 bp, Homo sapiens
atatatttattttattctatgt

SEQ ID NO: 5238830 - DNA, 22 bp, Homo sapiens
atatatttcacgtgttccctct

SEQ ID NO: 5238831 - DNA, 17 bp, Homo sapiens
atatatttcacttttgt

SEQ ID NO: 5238832 - DNA, 14 bp, Homo sapiens
atatatttcattct

SEQ ID NO: 5238833 - DNA, 23 bp, Homo sapiens
atatatttccaaatattctaaaa

SEQ ID NO: 5238834 - DNA, 13 bp, Homo sapiens
atatatttctatt

SEQ ID NO: 5238835 - DNA, 17 bp, Homo sapiens
atatatttctattatta

SEQ ID NO: 5238836 - DNA, 14 bp, Homo sapiens
atatatttcttaat

SEQ ID NO: 5238837 - DNA, 15 bp, Homo sapiens
atatatttctttaaa

SEQ ID NO: 5238838 - DNA, 21 bp, Homo sapiens
atatatttgaatatcattaaa

SEQ ID NO: 5238839 - DNA, 22 bp, Homo sapiens
atatatttgattgtaaaaacaa

SEQ ID NO: 5238840 - DNA, 14 bp, Homo sapiens
atatatttgcataa

SEQ ID NO: 5238841 - DNA, 18 bp, Homo sapiens
atatatttgcataatatg

SEQ ID NO: 5238842 - DNA, 22 bp, Homo sapiens
atatatttggagtttttctgaa

SEQ ID NO: 5238843 - DNA, 22 bp, Homo sapiens
atatatttggctgggtgttttc

SEQ ID NO: 5238844 - DNA, 20 bp, Homo sapiens
atatatttgtaaaagatgaa

SEQ ID NO: 5238845 - DNA, 17 bp, Homo sapiens
atatatttgtaacattg

SEQ ID NO: 5238846 - DNA, 18 bp, Homo sapiens
atatatttgtaacattgt

SEQ ID NO: 5238847 - DNA, 23 bp, Homo sapiens
atatatttgtaacattgtaaagt

SEQ ID NO: 5238848 - DNA, 14 bp, Homo sapiens
atatatttgtcact

SEQ ID NO: 5238849 - DNA, 15 bp, Homo sapiens
atatatttgtcactt

SEQ ID NO: 5238850 - DNA, 16 bp, Homo sapiens
atatattttaaaaaca

SEQ ID NO: 5238851 - DNA, 18 bp, Homo sapiens
atatattttaaaaacact

SEQ ID NO: 5238852 - DNA, 13 bp, Homo sapiens
atatattttaaga

SEQ ID NO: 5238853 - DNA, 14 bp, Homo sapiens
atatattttaagac

SEQ ID NO: 5238854 - DNA, 16 bp, Homo sapiens
atatattttacaattt

SEQ ID NO: 5238855 - DNA, 21 bp, Homo sapiens
atatattttaccatacattta

SEQ ID NO: 5238856 - DNA, 13 bp, Homo sapiens
atatattttcaag

SEQ ID NO: 5238857 - DNA, 16 bp, Homo sapiens
atatattttcagtaca

SEQ ID NO: 5238858 - DNA, 12 bp, Homo sapiens
atatattttcat

SEQ ID NO: 5238859 - DNA, 18 bp, Homo sapiens
atatattttctttctagt

SEQ ID NO: 5238860 - DNA, 13 bp, Homo sapiens
atatattttgaaa

SEQ ID NO: 5238861 - DNA, 13 bp, Homo sapiens
atatattttgtat

SEQ ID NO: 5238862 - DNA, 14 bp, Homo sapiens
atatattttgtatg

SEQ ID NO: 5238863 - DNA, 16 bp, Homo sapiens
atatattttgtgtgaa

SEQ ID NO: 5238864 - DNA, 22 bp, Homo sapiens
atatattttgtgtgaaattgca

SEQ ID NO: 5238865 - DNA, 18 bp, Homo sapiens
atatattttgttgttcct

SEQ ID NO: 5238866 - DNA, 14 bp, Homo sapiens
atatatttttaatg

SEQ ID NO: 5238867 - DNA, 16 bp, Homo sapiens
atatatttttaatgga

SEQ ID NO: 5238868 - DNA, 18 bp, Homo sapiens
atatatttttaatggaaa

SEQ ID NO: 5238869 - DNA, 20 bp, Homo sapiens
atatatttttatatttacta

SEQ ID NO: 5238870 - DNA, 14 bp, Homo sapiens
atatatttttcaac

SEQ ID NO: 5238871 - DNA, 19 bp, Homo sapiens
atatatttttcaaccagca

SEQ ID NO: 5238872 - DNA, 14 bp, Homo sapiens
atatatttttctga

SEQ ID NO: 5238873 - DNA, 16 bp, Homo sapiens
atatatttttctgaga

SEQ ID NO: 5238874 - DNA, 17 bp, Homo sapiens
atatatttttcttattt

SEQ ID NO: 5238875 - DNA, 20 bp, Homo sapiens
atatatttttcttatttatg

SEQ ID NO: 5238876 - DNA, 15 bp, Homo sapiens
atatatttttggttg

SEQ ID NO: 5238877 - DNA, 22 bp, Homo sapiens
atatattttttaaaataagtct

SEQ ID NO: 5238878 - DNA, 23 bp, Homo sapiens
atatattttttaatttgatgaaa

SEQ ID NO: 5238879 - DNA, 20 bp, Homo sapiens
atatattttttgaactttgt

SEQ ID NO: 5238880 - DNA, 16 bp, Homo sapiens
atatattttttgcttt

SEQ ID NO: 5238881 - DNA, 14 bp, Homo sapiens
atatattttttgta

SEQ ID NO: 5238882 - DNA, 17 bp, Homo sapiens
atatatttttttttgga

SEQ ID NO: 5238883 - DNA, 21 bp, Homo sapiens
atatcaaaaaacctttacagt

SEQ ID NO: 5238884 - DNA, 23 bp, Homo sapiens
atatcaaaaaggagctcttcttg

SEQ ID NO: 5238885 - DNA, 15 bp, Homo sapiens
atatcaaacattaaa

SEQ ID NO: 5238886 - DNA, 17 bp, Homo sapiens
atatcaaagagaagatg

SEQ ID NO: 5238887 - DNA, 13 bp, Homo sapiens
atatcaaagtcat

SEQ ID NO: 5238888 - DNA, 14 bp, Homo sapiens
atatcaaataaaat

SEQ ID NO: 5238889 - DNA, 15 bp, Homo sapiens
atatcaaataaaata

SEQ ID NO: 5238890 - DNA, 17 bp, Homo sapiens
atatcaaataaaatatc

SEQ ID NO: 5238891 - DNA, 13 bp, Homo sapiens
atatcaaatgcag

SEQ ID NO: 5238892 - DNA, 13 bp, Homo sapiens
atatcaaattaat

SEQ ID NO: 5238893 - DNA, 19 bp, Homo sapiens
atatcaaattaattgtgtg

SEQ ID NO: 5238894 - DNA, 15 bp, Homo sapiens
atatcaacaacaagt

SEQ ID NO: 5238895 - DNA, 21 bp, Homo sapiens
ataacatctttgaaaagaaaa

SEQ ID NO: 5238896 - DNA, 22 bp, Homo sapiens
ataacatctttgaaaagaaaaa

SEQ ID NO: 5238897 - DNA, 14 bp, Homo sapiens
ataacatgaaatga

SEQ ID NO: 5238898 - DNA, 22 bp, Homo sapiens
ataacatggagctcttgttgca

SEQ ID NO: 5238899 - DNA, 18 bp, Homo sapiens
ataacatgtaattaagta

SEQ ID NO: 5238900 - DNA, 20 bp, Homo sapiens
ataacatgtaattaagtact

SEQ ID NO: 5238901 - DNA, 19 bp, Homo sapiens
ataacatgtgaaaagaata

SEQ ID NO: 5238902 - DNA, 14 bp, Homo sapiens
ataacattacctta

SEQ ID NO: 5238903 - DNA, 15 bp, Homo sapiens
ataacattatataac

SEQ ID NO: 5238904 - DNA, 18 bp, Homo sapiens
ataacattcaatttgcta

SEQ ID NO: 5238905 - DNA, 15 bp, Homo sapiens
ataacattcagttcc

SEQ ID NO: 5238906 - DNA, 18 bp, Homo sapiens
ataacattcatgagattg

SEQ ID NO: 5238907 - DNA, 12 bp, Homo sapiens
ataacattctga

SEQ ID NO: 5238908 - DNA, 22 bp, Homo sapiens
ataacattgcactttataaaca

SEQ ID NO: 5238909 - DNA, 15 bp, Homo sapiens
ataacattgtatgtt

SEQ ID NO: 5238910 - DNA, 13 bp, Homo sapiens
ataacatttaaag

SEQ ID NO: 5238911 - DNA, 17 bp, Homo sapiens
ataacatttaaattcca

SEQ ID NO: 5238912 - DNA, 18 bp, Homo sapiens
ataacatttaatttagat

SEQ ID NO: 5238913 - DNA, 21 bp, Homo sapiens
ataacatttaatttagatatt

SEQ ID NO: 5238914 - DNA, 18 bp, Homo sapiens
ataacatttgctgaatat

SEQ ID NO: 5238915 - DNA, 19 bp, Homo sapiens
ataacattttatacaattt

SEQ ID NO: 5238916 - DNA, 16 bp, Homo sapiens
ataacattttgagaaa

SEQ ID NO: 5238917 - DNA, 15 bp, Homo sapiens
ataacattttgttta

SEQ ID NO: 5238918 - DNA, 16 bp, Homo sapiens
ataacattttgtttat

SEQ ID NO: 5238919 - DNA, 12 bp, Homo sapiens
ataaccaaagag

SEQ ID NO: 5238920 - DNA, 20 bp, Homo sapiens
ataaccaaagcccaaagtgg

SEQ ID NO: 5238921 - DNA, 14 bp, Homo sapiens
ataaccaagtgtgc

SEQ ID NO: 5238922 - DNA, 15 bp, Homo sapiens
ataaccaagtttatt

SEQ ID NO: 5238923 - DNA, 21 bp, Homo sapiens
ataaccaatagttgccaatct

SEQ ID NO: 5238924 - DNA, 16 bp, Homo sapiens
ataaccaatctacaat

SEQ ID NO: 5238925 - DNA, 13 bp, Homo sapiens
ataaccacttaaa

SEQ ID NO: 5238926 - DNA, 22 bp, Homo sapiens
ataaccacttaaaaaatgtcca

SEQ ID NO: 5238927 - DNA, 20 bp, Homo sapiens
ataaccagtgttgtggattt

SEQ ID NO: 5238928 - DNA, 16 bp, Homo sapiens
ataaccatctgaaagt

SEQ ID NO: 5238929 - DNA, 14 bp, Homo sapiens
ataaccatgagaat

SEQ ID NO: 5238930 - DNA, 16 bp, Homo sapiens
ataaccatgagaattt

SEQ ID NO: 5238931 - DNA, 20 bp, Homo sapiens
ataaccatgttctatattct

SEQ ID NO: 5238932 - DNA, 13 bp, Homo sapiens
ataaccccacctt

SEQ ID NO: 5238933 - DNA, 21 bp, Homo sapiens
ataaccccaccttgccaagct

SEQ ID NO: 5238934 - DNA, 15 bp, Homo sapiens
ataaccccagcctga

SEQ ID NO: 5238935 - DNA, 16 bp, Homo sapiens
ataaccccagcctgac

SEQ ID NO: 5238936 - DNA, 15 bp, Homo sapiens
ataaccccaggcact

SEQ ID NO: 5238937 - DNA, 18 bp, Homo sapiens
ataaccccaggcactgtt

SEQ ID NO: 5238938 - DNA, 16 bp, Homo sapiens
ataacccctgcctgga

SEQ ID NO: 5238939 - DNA, 15 bp, Homo sapiens
ataaccccttgaaac

SEQ ID NO: 5238940 - DNA, 13 bp, Homo sapiens
ataaccctgccag

SEQ ID NO: 5238941 - DNA, 18 bp, Homo sapiens
ataaccctgccagtgcca

SEQ ID NO: 5238942 - DNA, 13 bp, Homo sapiens
ataacccttcaac

SEQ ID NO: 5238943 - DNA, 14 bp, Homo sapiens
ataacctaattaat

SEQ ID NO: 5238944 - DNA, 20 bp, Homo sapiens
ataacctagttaaagaaagg

SEQ ID NO: 5238945 - DNA, 13 bp, Homo sapiens
ataacctatatga

SEQ ID NO: 5238946 - DNA, 18 bp, Homo sapiens
ataacctatatgatttat

SEQ ID NO: 5238947 - DNA, 23 bp, Homo sapiens
ataacctattttgaaaaattcct

SEQ ID NO: 5238948 - DNA, 21 bp, Homo sapiens
ataacctcagagtatctttac

SEQ ID NO: 5238949 - DNA, 16 bp, Homo sapiens
ataacctctggccctt

SEQ ID NO: 5238950 - DNA, 22 bp, Homo sapiens
ataacctgatgccataaataca

SEQ ID NO: 5238951 - DNA, 18 bp, Homo sapiens
ataacctgccagtcccag

SEQ ID NO: 5238952 - DNA, 22 bp, Homo sapiens
ataacctgtctcacctggactt

SEQ ID NO: 5238953 - DNA, 16 bp, Homo sapiens
ataaccttcatgatga

SEQ ID NO: 5238954 - DNA, 18 bp, Homo sapiens
ataaccttcatttttaag

SEQ ID NO: 5238955 - DNA, 22 bp, Homo sapiens
ataacgataaaagacagtgaaa

SEQ ID NO: 5238956 - DNA, 16 bp, Homo sapiens
ataacgcttaaaggaa

SEQ ID NO: 5238957 - DNA, 18 bp, Homo sapiens
ataacgcttaaaggaagt

SEQ ID NO: 5238958 - DNA, 20 bp, Homo sapiens
ataacggatcagaaatacag

SEQ ID NO: 5238959 - DNA, 23 bp, Homo sapiens
ataacgggtggcattgggtggca

SEQ ID NO: 5238960 - DNA, 16 bp, Homo sapiens
ataacgtgatacattt

SEQ ID NO: 5238961 - DNA, 14 bp, Homo sapiens
ataacgttctcagt

SEQ ID NO: 5238962 - DNA, 20 bp, Homo sapiens
ataacgtttaagccaaaaca

SEQ ID NO: 5238963 - DNA, 13 bp, Homo sapiens
ataactaaaattc

SEQ ID NO: 5238964 - DNA, 15 bp, Homo sapiens
ataactaaaattctg

SEQ ID NO: 5238965 - DNA, 14 bp, Homo sapiens
ataactaaatttga

SEQ ID NO: 5238966 - DNA, 20 bp, Homo sapiens
ataactaaatttgatactta

SEQ ID NO: 5238967 - DNA, 21 bp, Homo sapiens
ataactaaatttgatacttat

SEQ ID NO: 5238968 - DNA, 16 bp, Homo sapiens
ataactaagagattct

SEQ ID NO: 5238969 - DNA, 19 bp, Homo sapiens
ataactaagatatagaaac

SEQ ID NO: 5238970 - DNA, 18 bp, Homo sapiens
ataactaaggaatatata

SEQ ID NO: 5238971 - DNA, 12 bp, Homo sapiens
ataactaatatg

SEQ ID NO: 5238972 - DNA, 17 bp, Homo sapiens
ataactaatgaattgaa

SEQ ID NO: 5238973 - DNA, 14 bp, Homo sapiens
ataactacattaaa

SEQ ID NO: 5238974 - DNA, 24 bp, Homo sapiens
ataactacattaaaagctttagat

SEQ ID NO: 5238975 - DNA, 20 bp, Homo sapiens
ataactaccaggaataatga

SEQ ID NO: 5238976 - DNA, 20 bp, Homo sapiens
ataactactccggagacagg

SEQ ID NO: 5238977 - DNA, 19 bp, Homo sapiens
ataactagaactgaatttt

SEQ ID NO: 5238978 - DNA, 21 bp, Homo sapiens
ataactagacatctgctgtta

SEQ ID NO: 5238979 - DNA, 13 bp, Homo sapiens
ataactagagtat

SEQ ID NO: 5238980 - DNA, 15 bp, Homo sapiens
ataactagagtatgt

SEQ ID NO: 5238981 - DNA, 20 bp, Homo sapiens
ataactagatctcctgtaat

SEQ ID NO: 5238982 - DNA, 21 bp, Homo sapiens
ataactagatctcctgtaatt

SEQ ID NO: 5238983 - DNA, 19 bp, Homo sapiens
ataactagatggtgctgag

SEQ ID NO: 5238984 - DNA, 16 bp, Homo sapiens
ataactagtgttgctt

SEQ ID NO: 5238985 - DNA, 11 bp, Homo sapiens
ataactatata

SEQ ID NO: 5238986 - DNA, 19 bp, Homo sapiens
ataactatataagacatta

SEQ ID NO: 5238987 - DNA, 14 bp, Homo sapiens
ataactatcaggca

SEQ ID NO: 5238988 - DNA, 19 bp, Homo sapiens
ataactatcaggcagaaga

SEQ ID NO: 5238989 - DNA, 20 bp, Homo sapiens
ataactatctcacttccaga

SEQ ID NO: 5238990 - DNA, 22 bp, Homo sapiens
ataactatggtaaataactgtg

SEQ ID NO: 5238991 - DNA, 14 bp, Homo sapiens
ataactattacagt

SEQ ID NO: 5238992 - DNA, 15 bp, Homo sapiens
ataactattacagtg

SEQ ID NO: 5238993 - DNA, 16 bp, Homo sapiens
ataactattacagtgt

SEQ ID NO: 5238994 - DNA, 18 bp, Homo sapiens
ataactattacagtgttg

SEQ ID NO: 5238995 - DNA, 19 bp, Homo sapiens
ataactattacagtgttgg

SEQ ID NO: 5238996 - DNA, 13 bp, Homo sapiens
ataactattgctg

SEQ ID NO: 5238997 - DNA, 14 bp, Homo sapiens
ataactatttacat

SEQ ID NO: 5238998 - DNA, 18 bp, Homo sapiens
ataactatttacatataa

SEQ ID NO: 5238999 - DNA, 13 bp, Homo sapiens
ataactcaacatt

SEQ ID NO: 5239000 - DNA, 17 bp, Homo sapiens
ataactcaccatcttga

SEQ ID NO: 5239001 - DNA, 15 bp, Homo sapiens
ataactcatcataaa

SEQ ID NO: 5239002 - DNA, 19 bp, Homo sapiens
ataactcatcataaaataa

SEQ ID NO: 5239003 - DNA, 19 bp, Homo sapiens
ataactcatttgttgtttg

SEQ ID NO: 5239004 - DNA, 15 bp, Homo sapiens
ataactcctcattgt

SEQ ID NO: 5239005 - DNA, 12 bp, Homo sapiens
ataactccttct

SEQ ID NO: 5239006 - DNA, 20 bp, Homo sapiens
ataactccttcttgtagtag

SEQ ID NO: 5239007 - DNA, 19 bp, Homo sapiens
ataactctagggatataaa

SEQ ID NO: 5239008 - DNA, 20 bp, Homo sapiens
ataactctctttccttgagc

SEQ ID NO: 5239009 - DNA, 11 bp, Homo sapiens
ataactctgca

SEQ ID NO: 5239010 - DNA, 19 bp, Homo sapiens
ataactctgtaaaaacact

SEQ ID NO: 5239011 - DNA, 13 bp, Homo sapiens
ataactctttgga

SEQ ID NO: 5239012 - DNA, 13 bp, Homo sapiens
ataactgaaaatg

SEQ ID NO: 5239013 - DNA, 14 bp, Homo sapiens
ataactgaacatcc

SEQ ID NO: 5239014 - DNA, 13 bp, Homo sapiens
ataactgaaccaa

SEQ ID NO: 5239015 - DNA, 14 bp, Homo sapiens
ataactgaactgtt

SEQ ID NO: 5239016 - DNA, 18 bp, Homo sapiens
ataactgaaggagaaggt

SEQ ID NO: 5239017 - DNA, 14 bp, Homo sapiens
ataactgaataaaa

SEQ ID NO: 5239018 - DNA, 17 bp, Homo sapiens
ataactgaataaaaaat

SEQ ID NO: 5239019 - DNA, 15 bp, Homo sapiens
ataactgaatttgga

SEQ ID NO: 5239020 - DNA, 16 bp, Homo sapiens
ataactgacttagttc

SEQ ID NO: 5239021 - DNA, 16 bp, Homo sapiens
ataactgagatgaatg

SEQ ID NO: 5239022 - DNA, 16 bp, Homo sapiens
ataactgagcttagag

SEQ ID NO: 5239023 - DNA, 14 bp, Homo sapiens
ataactgatctatt

SEQ ID NO: 5239024 - DNA, 22 bp, Homo sapiens
ataactgatctcaagtatatgt

SEQ ID NO: 5239025 - DNA, 16 bp, Homo sapiens
ataactgatggcaata

SEQ ID NO: 5239026 - DNA, 16 bp, Homo sapiens
ataactgatttctatg

SEQ ID NO: 5239027 - DNA, 19 bp, Homo sapiens
ataactgatttctatggct

SEQ ID NO: 5239028 - DNA, 21 bp, Homo sapiens
ataactgatttctatggcttt

SEQ ID NO: 5239029 - DNA, 20 bp, Homo sapiens
ataactgcaaagtgaagttg

SEQ ID NO: 5239030 - DNA, 13 bp, Homo sapiens
ataactgcccagc

SEQ ID NO: 5239031 - DNA, 17 bp, Homo sapiens
ataactgccttgaacct

SEQ ID NO: 5239032 - DNA, 23 bp, Homo sapiens
ataactgccttgaacctgtgagt

SEQ ID NO: 5239033 - DNA, 17 bp, Homo sapiens
ataactggaaaacagaa

SEQ ID NO: 5239034 - DNA, 15 bp, Homo sapiens
ataactggaaagaag

SEQ ID NO: 5239035 - DNA, 16 bp, Homo sapiens
ataactggaacactct

SEQ ID NO: 5239036 - DNA, 18 bp, Homo sapiens
ataactggatattcttta

SEQ ID NO: 5239037 - DNA, 14 bp, Homo sapiens
ataactgtcttctg

SEQ ID NO: 5239038 - DNA, 12 bp, Homo sapiens
ataactgtcttg

SEQ ID NO: 5239039 - DNA, 13 bp, Homo sapiens
ataactgtcttgt

SEQ ID NO: 5239040 - DNA, 12 bp, Homo sapiens
ataactgtgaag

SEQ ID NO: 5239041 - DNA, 14 bp, Homo sapiens
ataactgtgatgaa

SEQ ID NO: 5239042 - DNA, 23 bp, Homo sapiens
ataactgtgatgaaatatgaaac

SEQ ID NO: 5239043 - DNA, 17 bp, Homo sapiens
ataactgtgcagagact

SEQ ID NO: 5239044 - DNA, 15 bp, Homo sapiens
ataactgtgtactgt

SEQ ID NO: 5239045 - DNA, 22 bp, Homo sapiens
ataactgttcttcaataaaatg

SEQ ID NO: 5239046 - DNA, 21 bp, Homo sapiens
ataactgttgttgataaggaa

SEQ ID NO: 5239047 - DNA, 16 bp, Homo sapiens
ataactgtttatatgt

SEQ ID NO: 5239048 - DNA, 16 bp, Homo sapiens
ataacttaaaaaaatg

SEQ ID NO: 5239049 - DNA, 14 bp, Homo sapiens
ataacttaaaataa

SEQ ID NO: 5239050 - DNA, 16 bp, Homo sapiens
ataacttaaaatattt

SEQ ID NO: 5239051 - DNA, 15 bp, Homo sapiens
ataacttaatgaaaa

SEQ ID NO: 5239052 - DNA, 13 bp, Homo sapiens
ataacttagaatg

SEQ ID NO: 5239053 - DNA, 18 bp, Homo sapiens
ataacttattgctgattt

SEQ ID NO: 5239054 - DNA, 15 bp, Homo sapiens
ataacttcagagaag

SEQ ID NO: 5239055 - DNA, 16 bp, Homo sapiens
ataacttcagagaagt

SEQ ID NO: 5239056 - DNA, 23 bp, Homo sapiens
ataacttcagatacttgtgaaca

SEQ ID NO: 5239057 - DNA, 14 bp, Homo sapiens
ataacttcagtcct

SEQ ID NO: 5239058 - DNA, 12 bp, Homo sapiens
ataacttcataa

SEQ ID NO: 5239059 - DNA, 17 bp, Homo sapiens
ataacttccagtatcat

SEQ ID NO: 5239060 - DNA, 14 bp, Homo sapiens
ataacttcctggct

SEQ ID NO: 5239061 - DNA, 13 bp, Homo sapiens
ataacttccttca

SEQ ID NO: 5239062 - DNA, 13 bp, Homo sapiens
ataacttctatat

SEQ ID NO: 5239063 - DNA, 22 bp, Homo sapiens
ataacttctatattttaataga

SEQ ID NO: 5239064 - DNA, 15 bp, Homo sapiens
ataacttctcatgta

SEQ ID NO: 5239065 - DNA, 14 bp, Homo sapiens
ataacttctgacct

SEQ ID NO: 5239066 - DNA, 19 bp, Homo sapiens
ataacttcttaaaagttgt

SEQ ID NO: 5239067 - DNA, 14 bp, Homo sapiens
ataacttcttcctg

SEQ ID NO: 5239068 - DNA, 15 bp, Homo sapiens
ataacttcttcctgc

SEQ ID NO: 5239069 - DNA, 24 bp, Homo sapiens
ataacttcttcctgctggacagag

SEQ ID NO: 5239070 - DNA, 15 bp, Homo sapiens
ataacttcttgaaaa

SEQ ID NO: 5239071 - DNA, 16 bp, Homo sapiens
ataacttgatgcatgt

SEQ ID NO: 5239072 - DNA, 19 bp, Homo sapiens
ataacttgctgaatttcag

SEQ ID NO: 5239073 - DNA, 12 bp, Homo sapiens
ataacttgtaag

SEQ ID NO: 5239074 - DNA, 13 bp, Homo sapiens
ataacttgtaagt

SEQ ID NO: 5239075 - DNA, 13 bp, Homo sapiens
ataacttgtctaa

SEQ ID NO: 5239076 - DNA, 21 bp, Homo sapiens
atatcaacagatagttgtgtt

SEQ ID NO: 5239077 - DNA, 13 bp, Homo sapiens
atatcaactctca

SEQ ID NO: 5239078 - DNA, 14 bp, Homo sapiens
atatcaactctgaa

SEQ ID NO: 5239079 - DNA, 17 bp, Homo sapiens
atatcaagaagtcttga

SEQ ID NO: 5239080 - DNA, 21 bp, Homo sapiens
atatcaagaatagttgtcaga

SEQ ID NO: 5239081 - DNA, 16 bp, Homo sapiens
atatcaagatgattct

SEQ ID NO: 5239082 - DNA, 23 bp, Homo sapiens
atatcaatatggtgtcttgatat

SEQ ID NO: 5239083 - DNA, 15 bp, Homo sapiens
atatcaatcacatta

SEQ ID NO: 5239084 - DNA, 22 bp, Homo sapiens
atatcacaaagttgtttaacta

SEQ ID NO: 5239085 - DNA, 14 bp, Homo sapiens
atatcacacacatt

SEQ ID NO: 5239086 - DNA, 16 bp, Homo sapiens
atatcacagagccact

SEQ ID NO: 5239087 - DNA, 18 bp, Homo sapiens
atatcacagagccactct

SEQ ID NO: 5239088 - DNA, 14 bp, Homo sapiens
atatcacccagaca

SEQ ID NO: 5239089 - DNA, 16 bp, Homo sapiens
atatcacccagacata

SEQ ID NO: 5239090 - DNA, 14 bp, Homo sapiens
atatcactaaataa

SEQ ID NO: 5239091 - DNA, 16 bp, Homo sapiens
atatcactaaataaac

SEQ ID NO: 5239092 - DNA, 21 bp, Homo sapiens
atatcactaatttcttcttta

SEQ ID NO: 5239093 - DNA, 21 bp, Homo sapiens
atatcactatgaacttggata

SEQ ID NO: 5239094 - DNA, 20 bp, Homo sapiens
atatcactcaagccagtgtt

SEQ ID NO: 5239095 - DNA, 12 bp, Homo sapiens
atatcacttaaa

SEQ ID NO: 5239096 - DNA, 18 bp, Homo sapiens
atatcacttgtcaataaa

SEQ ID NO: 5239097 - DNA, 21 bp, Homo sapiens
atatcactttggtctccattt

SEQ ID NO: 5239098 - DNA, 22 bp, Homo sapiens
atatcactttgtattctctgtc

SEQ ID NO: 5239099 - DNA, 12 bp, Homo sapiens
atatcagaaaag

SEQ ID NO: 5239100 - DNA, 14 bp, Homo sapiens
atatcagaaaaggg

SEQ ID NO: 5239101 - DNA, 19 bp, Homo sapiens
atatcagaatatgattcac

SEQ ID NO: 5239102 - DNA, 20 bp, Homo sapiens
atatcagacaagcactattt

SEQ ID NO: 5239103 - DNA, 20 bp, Homo sapiens
atatcagacctctgatccct

SEQ ID NO: 5239104 - DNA, 18 bp, Homo sapiens
atatcagagctcttaatg

SEQ ID NO: 5239105 - DNA, 14 bp, Homo sapiens
atatcagcaagtct

SEQ ID NO: 5239106 - DNA, 16 bp, Homo sapiens
atatcagcacatattt

SEQ ID NO: 5239107 - DNA, 13 bp, Homo sapiens
atatcagcactgg

SEQ ID NO: 5239108 - DNA, 15 bp, Homo sapiens
atatcagcactggat

SEQ ID NO: 5239109 - DNA, 20 bp, Homo sapiens
atatcagcctgagtctcctg

SEQ ID NO: 5239110 - DNA, 22 bp, Homo sapiens
atatcagccttgggcaactgca

SEQ ID NO: 5239111 - DNA, 15 bp, Homo sapiens
atatcagctttatcc

SEQ ID NO: 5239112 - DNA, 14 bp, Homo sapiens
atatcagctttgat

SEQ ID NO: 5239113 - DNA, 14 bp, Homo sapiens
atatcagggcctga

SEQ ID NO: 5239114 - DNA, 19 bp, Homo sapiens
atatcaggtgtataaatgt

SEQ ID NO: 5239115 - DNA, 21 bp, Homo sapiens
atatcagtattctgacatgta

SEQ ID NO: 5239116 - DNA, 15 bp, Homo sapiens
atatcagtcatgact

SEQ ID NO: 5239117 - DNA, 19 bp, Homo sapiens
atatcagtcgtgtcaccag

SEQ ID NO: 5239118 - DNA, 22 bp, Homo sapiens
atatcagtgggctctcttacca

SEQ ID NO: 5239119 - DNA, 16 bp, Homo sapiens
atatcagttacagtgg

SEQ ID NO: 5239120 - DNA, 17 bp, Homo sapiens
atatcagttacagtggc

SEQ ID NO: 5239121 - DNA, 17 bp, Homo sapiens
atatcagttactcagcc

SEQ ID NO: 5239122 - DNA, 16 bp, Homo sapiens
atatcagttgacagaa

SEQ ID NO: 5239123 - DNA, 18 bp, Homo sapiens
atatcagttgacagaatg

SEQ ID NO: 5239124 - DNA, 14 bp, Homo sapiens
atatcataaagcat

SEQ ID NO: 5239125 - DNA, 16 bp, Homo sapiens
atatcataaagcattt

SEQ ID NO: 5239126 - DNA, 15 bp, Homo sapiens
atatcataatgtaat

SEQ ID NO: 5239127 - DNA, 13 bp, Homo sapiens
atatcatacaaat

SEQ ID NO: 5239128 - DNA, 19 bp, Homo sapiens
atatcatactgttcaatgg

SEQ ID NO: 5239129 - DNA, 17 bp, Homo sapiens
atatcatagtataaatc

SEQ ID NO: 5239130 - DNA, 16 bp, Homo sapiens
atatcatatataaaag

SEQ ID NO: 5239131 - DNA, 15 bp, Homo sapiens
atatcatatgtatct

SEQ ID NO: 5239132 - DNA, 22 bp, Homo sapiens
atatcatattctaaaagtaata

SEQ ID NO: 5239133 - DNA, 19 bp, Homo sapiens
atatcatattggtattcac

SEQ ID NO: 5239134 - DNA, 18 bp, Homo sapiens
atatcatcacgtatgtta

SEQ ID NO: 5239135 - DNA, 18 bp, Homo sapiens
atatcatcagcatacctt

SEQ ID NO: 5239136 - DNA, 20 bp, Homo sapiens
atatcatcagcataccttta

SEQ ID NO: 5239137 - DNA, 13 bp, Homo sapiens
atatcatcagtat

SEQ ID NO: 5239138 - DNA, 16 bp, Homo sapiens
atatcatccacacatg

SEQ ID NO: 5239139 - DNA, 16 bp, Homo sapiens
atatcatcgtatttct

SEQ ID NO: 5239140 - DNA, 20 bp, Homo sapiens
atatcatctacctagattta

SEQ ID NO: 5239141 - DNA, 15 bp, Homo sapiens
atatcatctgtcatt

SEQ ID NO: 5239142 - DNA, 20 bp, Homo sapiens
atatcatctgtcattatatt

SEQ ID NO: 5239143 - DNA, 23 bp, Homo sapiens
atatcatctgtcattatattcta

SEQ ID NO: 5239144 - DNA, 22 bp, Homo sapiens
atatcatgaatgtgagtcatta

SEQ ID NO: 5239145 - DNA, 21 bp, Homo sapiens
atatcatgagtgaataaatgt

SEQ ID NO: 5239146 - DNA, 13 bp, Homo sapiens
atatcatgctaaa

SEQ ID NO: 5239147 - DNA, 19 bp, Homo sapiens
atatcatgctaaaattcta

SEQ ID NO: 5239148 - DNA, 20 bp, Homo sapiens
atatcatgcttggttttctt

SEQ ID NO: 5239149 - DNA, 22 bp, Homo sapiens
atatcatggtaatgacagatgc

SEQ ID NO: 5239150 - DNA, 18 bp, Homo sapiens
atatcatgtaaagaaatg

SEQ ID NO: 5239151 - DNA, 19 bp, Homo sapiens
atatcatgtaaagaaatgt

SEQ ID NO: 5239152 - DNA, 18 bp, Homo sapiens
atatcatgtcttgtgcat

SEQ ID NO: 5239153 - DNA, 16 bp, Homo sapiens
atatcatgtgtagata

SEQ ID NO: 5239154 - DNA, 19 bp, Homo sapiens
atatcatgtgtagatatta

SEQ ID NO: 5239155 - DNA, 19 bp, Homo sapiens
atatcattaaacaaataaa

SEQ ID NO: 5239156 - DNA, 19 bp, Homo sapiens
atatcattctacagaataa

SEQ ID NO: 5239157 - DNA, 20 bp, Homo sapiens
atatcattctgggtgtgttc

SEQ ID NO: 5239158 - DNA, 23 bp, Homo sapiens
atatcattgttggtgttaattga

SEQ ID NO: 5239159 - DNA, 13 bp, Homo sapiens
atatcatttactc

SEQ ID NO: 5239160 - DNA, 13 bp, Homo sapiens
atatcatttgtga

SEQ ID NO: 5239161 - DNA, 16 bp, Homo sapiens
atatcatttgtgaaga

SEQ ID NO: 5239162 - DNA, 18 bp, Homo sapiens
atatcatttgtgaagaat

SEQ ID NO: 5239163 - DNA, 11 bp, Homo sapiens
atatcatttta

SEQ ID NO: 5239164 - DNA, 13 bp, Homo sapiens
atatcattttaaa

SEQ ID NO: 5239165 - DNA, 17 bp, Homo sapiens
atatcattttaaaatgt

SEQ ID NO: 5239166 - DNA, 19 bp, Homo sapiens
atatcattttaaaatgtct

SEQ ID NO: 5239167 - DNA, 15 bp, Homo sapiens
atatcattttataga

SEQ ID NO: 5239168 - DNA, 17 bp, Homo sapiens
atatcattttatagaaa

SEQ ID NO: 5239169 - DNA, 16 bp, Homo sapiens
atatcattttattcac

SEQ ID NO: 5239170 - DNA, 22 bp, Homo sapiens
atatcatttttataaattttaa

SEQ ID NO: 5239171 - DNA, 15 bp, Homo sapiens
atatccaaagactgt

SEQ ID NO: 5239172 - DNA, 17 bp, Homo sapiens
atatccaaagactgtac

SEQ ID NO: 5239173 - DNA, 23 bp, Homo sapiens
atatccaagatcaattccctctc

SEQ ID NO: 5239174 - DNA, 21 bp, Homo sapiens
atatccaagtaccaatgctgt

SEQ ID NO: 5239175 - DNA, 22 bp, Homo sapiens
atatccaagtaccaatgctgtt

SEQ ID NO: 5239176 - DNA, 22 bp, Homo sapiens
atatccacagactccctcccct

SEQ ID NO: 5239177 - DNA, 20 bp, Homo sapiens
atatccacataaatgctcct

SEQ ID NO: 5239178 - DNA, 20 bp, Homo sapiens
atatccacatctttaagtat

SEQ ID NO: 5239179 - DNA, 14 bp, Homo sapiens
atatccaccacctc

SEQ ID NO: 5239180 - DNA, 20 bp, Homo sapiens
atatccacccagcaggcaga

SEQ ID NO: 5239181 - DNA, 19 bp, Homo sapiens
atatccaggtcaacagaat

SEQ ID NO: 5239182 - DNA, 15 bp, Homo sapiens
atatccaggtgtgcc

SEQ ID NO: 5239183 - DNA, 13 bp, Homo sapiens
atatccatctttt

SEQ ID NO: 5239184 - DNA, 16 bp, Homo sapiens
atatccatctttttct

SEQ ID NO: 5239185 - DNA, 21 bp, Homo sapiens
atatccatgacctagttttcc

SEQ ID NO: 5239186 - DNA, 14 bp, Homo sapiens
atatccatgtactg

SEQ ID NO: 5239187 - DNA, 15 bp, Homo sapiens
atatccatgtactgt

SEQ ID NO: 5239188 - DNA, 18 bp, Homo sapiens
atatccatgtactgtagt

SEQ ID NO: 5239189 - DNA, 14 bp, Homo sapiens
atatccattctcgt

SEQ ID NO: 5239190 - DNA, 17 bp, Homo sapiens
atatccattctttctga

SEQ ID NO: 5239191 - DNA, 18 bp, Homo sapiens
atatcccaacattctgca

SEQ ID NO: 5239192 - DNA, 11 bp, Homo sapiens
atatcccaagt

SEQ ID NO: 5239193 - DNA, 13 bp, Homo sapiens
atatcccactggg

SEQ ID NO: 5239194 - DNA, 16 bp, Homo sapiens
atatcccagctttaaa

SEQ ID NO: 5239195 - DNA, 21 bp, Homo sapiens
atatcccagctttaaaaagaa

SEQ ID NO: 5239196 - DNA, 17 bp, Homo sapiens
atatccccactactcaa

SEQ ID NO: 5239197 - DNA, 18 bp, Homo sapiens
atatccctaatgttttgc

SEQ ID NO: 5239198 - DNA, 20 bp, Homo sapiens
atatccctatgtcccagccc

SEQ ID NO: 5239199 - DNA, 17 bp, Homo sapiens
atatccctcatttcatt

SEQ ID NO: 5239200 - DNA, 15 bp, Homo sapiens
atatccctcttgtaa

SEQ ID NO: 5239201 - DNA, 16 bp, Homo sapiens
atatccctcttgtaag

SEQ ID NO: 5239202 - DNA, 12 bp, Homo sapiens
atatccctgccc

SEQ ID NO: 5239203 - DNA, 19 bp, Homo sapiens
atatccctgcccagcctgt

SEQ ID NO: 5239204 - DNA, 18 bp, Homo sapiens
atatcccttggacatttt

SEQ ID NO: 5239205 - DNA, 19 bp, Homo sapiens
atatcccttggacatttta

SEQ ID NO: 5239206 - DNA, 14 bp, Homo sapiens
atatccgggtgctc

SEQ ID NO: 5239207 - DNA, 21 bp, Homo sapiens
atatccgggtgctcaataaac

SEQ ID NO: 5239208 - DNA, 22 bp, Homo sapiens
atatccgtgaagggatttctta

SEQ ID NO: 5239209 - DNA, 12 bp, Homo sapiens
atatcctaataa

SEQ ID NO: 5239210 - DNA, 14 bp, Homo sapiens
atatcctatatagg

SEQ ID NO: 5239211 - DNA, 18 bp, Homo sapiens
atatcctccttctcctgt

SEQ ID NO: 5239212 - DNA, 20 bp, Homo sapiens
atatcctccttctcctgttc

SEQ ID NO: 5239213 - DNA, 11 bp, Homo sapiens
atatcctctgt

SEQ ID NO: 5239214 - DNA, 15 bp, Homo sapiens
atatcctgagccatc

SEQ ID NO: 5239215 - DNA, 13 bp, Homo sapiens
atatcctgcctca

SEQ ID NO: 5239216 - DNA, 14 bp, Homo sapiens
atatcctgcctcag

SEQ ID NO: 5239217 - DNA, 13 bp, Homo sapiens
atatcctgcttga

SEQ ID NO: 5239218 - DNA, 19 bp, Homo sapiens
atatcctggtgtctagttt

SEQ ID NO: 5239219 - DNA, 15 bp, Homo sapiens
atatcctgtaactac

SEQ ID NO: 5239220 - DNA, 19 bp, Homo sapiens
atatcctgtattcttgttt

SEQ ID NO: 5239221 - DNA, 10 bp, Homo sapiens
atatcctgtg

SEQ ID NO: 5239222 - DNA, 20 bp, Homo sapiens
atatcctgtgactgtctcac

SEQ ID NO: 5239223 - DNA, 15 bp, Homo sapiens
atatcctgtttgtat

SEQ ID NO: 5239224 - DNA, 14 bp, Homo sapiens
atatcctttgcctc

SEQ ID NO: 5239225 - DNA, 17 bp, Homo sapiens
atatcctttggtcctgg

SEQ ID NO: 5239226 - DNA, 21 bp, Homo sapiens
atatccttttagtctgcatat

SEQ ID NO: 5239227 - DNA, 19 bp, Homo sapiens
atatcgaatatagttctgt

SEQ ID NO: 5239228 - DNA, 17 bp, Homo sapiens
atatcgacttgtttttg

SEQ ID NO: 5239229 - DNA, 16 bp, Homo sapiens
atatcggaggtggtgg

SEQ ID NO: 5239230 - DNA, 21 bp, Homo sapiens
atatctaaaatattattttat

SEQ ID NO: 5239231 - DNA, 15 bp, Homo sapiens
atatctaaatagtat

SEQ ID NO: 5239232 - DNA, 13 bp, Homo sapiens
atatctaaattga

SEQ ID NO: 5239233 - DNA, 14 bp, Homo sapiens
atatctaaatttag

SEQ ID NO: 5239234 - DNA, 23 bp, Homo sapiens
atatctaactttgtaaccagaat

SEQ ID NO: 5239235 - DNA, 20 bp, Homo sapiens
atatctaattattttgcagt

SEQ ID NO: 5239236 - DNA, 15 bp, Homo sapiens
atatctaatttacca

SEQ ID NO: 5239237 - DNA, 14 bp, Homo sapiens
atatctaatttata

SEQ ID NO: 5239238 - DNA, 15 bp, Homo sapiens
atatctaatttatac

SEQ ID NO: 5239239 - DNA, 17 bp, Homo sapiens
atatctaatttatacaa

SEQ ID NO: 5239240 - DNA, 19 bp, Homo sapiens
atatctaatttatacaaaa

SEQ ID NO: 5239241 - DNA, 22 bp, Homo sapiens
atatctaatttatacaaaataa

SEQ ID NO: 5239242 - DNA, 17 bp, Homo sapiens
atatctacaatatatat

SEQ ID NO: 5239243 - DNA, 18 bp, Homo sapiens
atatctacaatatatatt

SEQ ID NO: 5239244 - DNA, 19 bp, Homo sapiens
atatctacacatacagaaa

SEQ ID NO: 5239245 - DNA, 14 bp, Homo sapiens
atatctacagtact

SEQ ID NO: 5239246 - DNA, 18 bp, Homo sapiens
atatctacctgccctctc

SEQ ID NO: 5239247 - DNA, 22 bp, Homo sapiens
atatctacctgccctctctcag

SEQ ID NO: 5239248 - DNA, 19 bp, Homo sapiens
atatctaggtttatgacag

SEQ ID NO: 5239249 - DNA, 22 bp, Homo sapiens
atatctagtaatatatttaaag

SEQ ID NO: 5239250 - DNA, 20 bp, Homo sapiens
atatctagtgctaaacctat

SEQ ID NO: 5239251 - DNA, 21 bp, Homo sapiens
atatctagtgctaaacctatc

SEQ ID NO: 5239252 - DNA, 23 bp, Homo sapiens
atatctagtgctaaacctatctg

SEQ ID NO: 5239253 - DNA, 23 bp, Homo sapiens
atatctataaaatagatataaat

SEQ ID NO: 5239254 - DNA, 14 bp, Homo sapiens
atatctatatataa

SEQ ID NO: 5239255 - DNA, 20 bp, Homo sapiens
ataacttgtgttactaattt

SEQ ID NO: 5239256 - DNA, 16 bp, Homo sapiens
ataacttgttttgact

SEQ ID NO: 5239257 - DNA, 16 bp, Homo sapiens
ataactttaacttctg

SEQ ID NO: 5239258 - DNA, 17 bp, Homo sapiens
ataactttaacttctgt

SEQ ID NO: 5239259 - DNA, 14 bp, Homo sapiens
ataactttatgaag

SEQ ID NO: 5239260 - DNA, 17 bp, Homo sapiens
ataactttatgaagtgc

SEQ ID NO: 5239261 - DNA, 15 bp, Homo sapiens
ataactttattgcat

SEQ ID NO: 5239262 - DNA, 17 bp, Homo sapiens
ataactttattgcatat

SEQ ID NO: 5239263 - DNA, 12 bp, Homo sapiens
ataactttttaa

SEQ ID NO: 5239264 - DNA, 20 bp, Homo sapiens
ataacttttttgagtcattg

SEQ ID NO: 5239265 - DNA, 23 bp, Homo sapiens
ataacttttttgagtcattgact

SEQ ID NO: 5239266 - DNA, 16 bp, Homo sapiens
ataactttttttcaat

SEQ ID NO: 5239267 - DNA, 20 bp, Homo sapiens
ataactttttttgagaagga

SEQ ID NO: 5239268 - DNA, 23 bp, Homo sapiens
ataacttttttttttctttataa

SEQ ID NO: 5239269 - DNA, 11 bp, Homo sapiens
ataagaaaaac

SEQ ID NO: 5239270 - DNA, 13 bp, Homo sapiens
ataagaaaaagaa

SEQ ID NO: 5239271 - DNA, 12 bp, Homo sapiens
ataagaaaaagg

SEQ ID NO: 5239272 - DNA, 16 bp, Homo sapiens
ataagaaaaatcatgt

SEQ ID NO: 5239273 - DNA, 18 bp, Homo sapiens
ataagaaaacatgtaaag

SEQ ID NO: 5239274 - DNA, 18 bp, Homo sapiens
ataagaaaactacatgta

SEQ ID NO: 5239275 - DNA, 19 bp, Homo sapiens
ataagaaaactacatgtaa

SEQ ID NO: 5239276 - DNA, 11 bp, Homo sapiens
ataagaaaaga

SEQ ID NO: 5239277 - DNA, 18 bp, Homo sapiens
ataagaaaagatgtagat

SEQ ID NO: 5239278 - DNA, 21 bp, Homo sapiens
ataagaaaagatgtagattta

SEQ ID NO: 5239279 - DNA, 14 bp, Homo sapiens
ataagaaaagtaat

SEQ ID NO: 5239280 - DNA, 16 bp, Homo sapiens
ataagaaacagtttaa

SEQ ID NO: 5239281 - DNA, 22 bp, Homo sapiens
ataagaaacagtttaacagaaa

SEQ ID NO: 5239282 - DNA, 20 bp, Homo sapiens
ataagaaacatgatgtgaga

SEQ ID NO: 5239283 - DNA, 11 bp, Homo sapiens
ataagaaagcc

SEQ ID NO: 5239284 - DNA, 18 bp, Homo sapiens
ataagaaagccctaaaat

SEQ ID NO: 5239285 - DNA, 20 bp, Homo sapiens
ataagaaagcctaaaattga

SEQ ID NO: 5239286 - DNA, 13 bp, Homo sapiens
ataagaaagcctg

SEQ ID NO: 5239287 - DNA, 14 bp, Homo sapiens
ataagaaagcctga

SEQ ID NO: 5239288 - DNA, 15 bp, Homo sapiens
ataagaaatactaga

SEQ ID NO: 5239289 - DNA, 12 bp, Homo sapiens
ataagaaatgaa

SEQ ID NO: 5239290 - DNA, 13 bp, Homo sapiens
ataagaaatttta

SEQ ID NO: 5239291 - DNA, 15 bp, Homo sapiens
ataagaaattttatt

SEQ ID NO: 5239292 - DNA, 15 bp, Homo sapiens
ataagaacaagtttt

SEQ ID NO: 5239293 - DNA, 13 bp, Homo sapiens
ataagaacttgat

SEQ ID NO: 5239294 - DNA, 16 bp, Homo sapiens
ataagaactttgagct

SEQ ID NO: 5239295 - DNA, 14 bp, Homo sapiens
ataagaagaagaga

SEQ ID NO: 5239296 - DNA, 15 bp, Homo sapiens
ataagaagaagagag

SEQ ID NO: 5239297 - DNA, 23 bp, Homo sapiens
ataagaagaagttcatgtccaaa

SEQ ID NO: 5239298 - DNA, 12 bp, Homo sapiens
ataagaagactt

SEQ ID NO: 5239299 - DNA, 14 bp, Homo sapiens
ataagaagcaaata

SEQ ID NO: 5239300 - DNA, 21 bp, Homo sapiens
ataagaagcaatctttgaaat

SEQ ID NO: 5239301 - DNA, 22 bp, Homo sapiens
ataagaagccttaatttgcaca

SEQ ID NO: 5239302 - DNA, 13 bp, Homo sapiens
ataagaaggcaat

SEQ ID NO: 5239303 - DNA, 21 bp, Homo sapiens
ataagaagggatggattccaa

SEQ ID NO: 5239304 - DNA, 22 bp, Homo sapiens
ataagaagggggagtgaaacag

SEQ ID NO: 5239305 - DNA, 19 bp, Homo sapiens
ataagaatgctggttttcc

SEQ ID NO: 5239306 - DNA, 11 bp, Homo sapiens
ataagaattaa

SEQ ID NO: 5239307 - DNA, 17 bp, Homo sapiens
ataagaattattttgat

SEQ ID NO: 5239308 - DNA, 16 bp, Homo sapiens
ataagaattcagacat

SEQ ID NO: 5239309 - DNA, 18 bp, Homo sapiens
ataagaattgtctctggg

SEQ ID NO: 5239310 - DNA, 14 bp, Homo sapiens
ataagacaaaaata

SEQ ID NO: 5239311 - DNA, 13 bp, Homo sapiens
ataagacaaaatt

SEQ ID NO: 5239312 - DNA, 23 bp, Homo sapiens
ataagacaaatattcctttgcat

SEQ ID NO: 5239313 - DNA, 22 bp, Homo sapiens
ataagacatatctctaattcca

SEQ ID NO: 5239314 - DNA, 19 bp, Homo sapiens
ataagacatgcttactttt

SEQ ID NO: 5239315 - DNA, 20 bp, Homo sapiens
ataagacatgcttacttttt

SEQ ID NO: 5239316 - DNA, 18 bp, Homo sapiens
ataagacatttgtttgct

SEQ ID NO: 5239317 - DNA, 22 bp, Homo sapiens
ataagacattttgtttttactg

SEQ ID NO: 5239318 - DNA, 20 bp, Homo sapiens
ataagaccgtgtcccaagga

SEQ ID NO: 5239319 - DNA, 16 bp, Homo sapiens
ataagactataaataa

SEQ ID NO: 5239320 - DNA, 17 bp, Homo sapiens
ataagactataaataaa

SEQ ID NO: 5239321 - DNA, 14 bp, Homo sapiens
ataagactgtcatg

SEQ ID NO: 5239322 - DNA, 19 bp, Homo sapiens
ataagactgtttttaagta

SEQ ID NO: 5239323 - DNA, 17 bp, Homo sapiens
ataagacttagattgtg

SEQ ID NO: 5239324 - DNA, 14 bp, Homo sapiens
ataagagaaacctg

SEQ ID NO: 5239325 - DNA, 17 bp, Homo sapiens
ataagagaaacctgcca

SEQ ID NO: 5239326 - DNA, 19 bp, Homo sapiens
ataagagaaagaggccaga

SEQ ID NO: 5239327 - DNA, 22 bp, Homo sapiens
ataagagacaaagtttggaagt

SEQ ID NO: 5239328 - DNA, 16 bp, Homo sapiens
ataagagagtcataaa

SEQ ID NO: 5239329 - DNA, 19 bp, Homo sapiens
ataagagagtcataaacct

SEQ ID NO: 5239330 - DNA, 17 bp, Homo sapiens
ataagagcatgatttga

SEQ ID NO: 5239331 - DNA, 21 bp, Homo sapiens
ataagagcatgatttgaaaaa

SEQ ID NO: 5239332 - DNA, 21 bp, Homo sapiens
ataagagggaacaaattttca

SEQ ID NO: 5239333 - DNA, 17 bp, Homo sapiens
ataagagggcacacact

SEQ ID NO: 5239334 - DNA, 18 bp, Homo sapiens
ataagaggtactaatagt

SEQ ID NO: 5239335 - DNA, 22 bp, Homo sapiens
ataagaggtgtgggtgtctgtt

SEQ ID NO: 5239336 - DNA, 22 bp, Homo sapiens
ataagagtaacagtcatcattt

SEQ ID NO: 5239337 - DNA, 16 bp, Homo sapiens
ataagagtctccttct

SEQ ID NO: 5239338 - DNA, 17 bp, Homo sapiens
ataagagtctccttctc

SEQ ID NO: 5239339 - DNA, 21 bp, Homo sapiens
ataagagtctccttctcttct

SEQ ID NO: 5239340 - DNA, 20 bp, Homo sapiens
ataagagtgattagagctgc

SEQ ID NO: 5239341 - DNA, 16 bp, Homo sapiens
ataagagttggctggt

SEQ ID NO: 5239342 - DNA, 18 bp, Homo sapiens
ataagataaaataaaatt

SEQ ID NO: 5239343 - DNA, 16 bp, Homo sapiens
ataagatagttacatt

SEQ ID NO: 5239344 - DNA, 15 bp, Homo sapiens
ataagatattcttta

SEQ ID NO: 5239345 - DNA, 15 bp, Homo sapiens
ataagatattttatt

SEQ ID NO: 5239346 - DNA, 20 bp, Homo sapiens
ataagatcttttattttgcc

SEQ ID NO: 5239347 - DNA, 20 bp, Homo sapiens
ataagatgatgttaaatgcc

SEQ ID NO: 5239348 - DNA, 18 bp, Homo sapiens
ataagatggagaataaat

SEQ ID NO: 5239349 - DNA, 14 bp, Homo sapiens
ataagattaaagga

SEQ ID NO: 5239350 - DNA, 19 bp, Homo sapiens
ataagattaaaggaaggaa

SEQ ID NO: 5239351 - DNA, 16 bp, Homo sapiens
ataagattaataagat

SEQ ID NO: 5239352 - DNA, 13 bp, Homo sapiens
ataagattagaat

SEQ ID NO: 5239353 - DNA, 16 bp, Homo sapiens
ataagattatatacaa

SEQ ID NO: 5239354 - DNA, 14 bp, Homo sapiens
ataagattatatgg

SEQ ID NO: 5239355 - DNA, 11 bp, Homo sapiens
ataagattcta

SEQ ID NO: 5239356 - DNA, 17 bp, Homo sapiens
ataagattctaacggtc

SEQ ID NO: 5239357 - DNA, 18 bp, Homo sapiens
ataagatttaattgtaat

SEQ ID NO: 5239358 - DNA, 13 bp, Homo sapiens
ataagatttagtt

SEQ ID NO: 5239359 - DNA, 18 bp, Homo sapiens
ataagatttgtacatatt

SEQ ID NO: 5239360 - DNA, 20 bp, Homo sapiens
ataagatttgtacatattat

SEQ ID NO: 5239361 - DNA, 22 bp, Homo sapiens
ataagatttgtacatattatca

SEQ ID NO: 5239362 - DNA, 22 bp, Homo sapiens
ataagattttctgggataacag

SEQ ID NO: 5239363 - DNA, 13 bp, Homo sapiens
ataagatttttca

SEQ ID NO: 5239364 - DNA, 15 bp, Homo sapiens
ataagatttttgaaa

SEQ ID NO: 5239365 - DNA, 23 bp, Homo sapiens
ataagatttttgaaaatcctgaa

SEQ ID NO: 5239366 - DNA, 14 bp, Homo sapiens
ataagcaaaaagat

SEQ ID NO: 5239367 - DNA, 14 bp, Homo sapiens
ataagcaaaatgaa

SEQ ID NO: 5239368 - DNA, 23 bp, Homo sapiens
ataagcaaagggagcactgggtt

SEQ ID NO: 5239369 - DNA, 15 bp, Homo sapiens
ataagcaaataaaca

SEQ ID NO: 5239370 - DNA, 17 bp, Homo sapiens
ataagcaaattagtaat

SEQ ID NO: 5239371 - DNA, 14 bp, Homo sapiens
ataagcaaatttca

SEQ ID NO: 5239372 - DNA, 19 bp, Homo sapiens
ataagcaaatttcaaaaga

SEQ ID NO: 5239373 - DNA, 18 bp, Homo sapiens
ataagcaacaattttcag

SEQ ID NO: 5239374 - DNA, 19 bp, Homo sapiens
ataagcaacaattttcaga

SEQ ID NO: 5239375 - DNA, 20 bp, Homo sapiens
ataagcaacaattttcagat

SEQ ID NO: 5239376 - DNA, 16 bp, Homo sapiens
ataagcaagaaggcaa

SEQ ID NO: 5239377 - DNA, 20 bp, Homo sapiens
ataagcaagagacaataata

SEQ ID NO: 5239378 - DNA, 14 bp, Homo sapiens
ataagcaagagaga

SEQ ID NO: 5239379 - DNA, 16 bp, Homo sapiens
ataagcaagagagatg

SEQ ID NO: 5239380 - DNA, 18 bp, Homo sapiens
ataagcacagacaattct

SEQ ID NO: 5239381 - DNA, 23 bp, Homo sapiens
ataagcacagacaattctaatgg

SEQ ID NO: 5239382 - DNA, 19 bp, Homo sapiens
ataagcacctaaaacccaa

SEQ ID NO: 5239383 - DNA, 20 bp, Homo sapiens
ataagcactgaaaaacaaca

SEQ ID NO: 5239384 - DNA, 13 bp, Homo sapiens
ataagcactgtaa

SEQ ID NO: 5239385 - DNA, 17 bp, Homo sapiens
ataagcactgtgctaat

SEQ ID NO: 5239386 - DNA, 18 bp, Homo sapiens
ataagcactgtgctaata

SEQ ID NO: 5239387 - DNA, 21 bp, Homo sapiens
ataagcacttgaatcagtttt

SEQ ID NO: 5239388 - DNA, 22 bp, Homo sapiens
ataagcacttgcctggaataaa

SEQ ID NO: 5239389 - DNA, 14 bp, Homo sapiens
ataagcagaacata

SEQ ID NO: 5239390 - DNA, 14 bp, Homo sapiens
ataagcagaggtgg

SEQ ID NO: 5239391 - DNA, 13 bp, Homo sapiens
ataagcaggaagg

SEQ ID NO: 5239392 - DNA, 17 bp, Homo sapiens
ataagcaggtggatcta

SEQ ID NO: 5239393 - DNA, 17 bp, Homo sapiens
ataagcatctgtgtaac

SEQ ID NO: 5239394 - DNA, 21 bp, Homo sapiens
ataagcatctgtgtaacctcc

SEQ ID NO: 5239395 - DNA, 12 bp, Homo sapiens
ataagcatgctt

SEQ ID NO: 5239396 - DNA, 14 bp, Homo sapiens
ataagcatgctttc

SEQ ID NO: 5239397 - DNA, 15 bp, Homo sapiens
ataagcattgaaatt

SEQ ID NO: 5239398 - DNA, 14 bp, Homo sapiens
ataagccaaaatta

SEQ ID NO: 5239399 - DNA, 21 bp, Homo sapiens
ataagccaagggctaggctct

SEQ ID NO: 5239400 - DNA, 18 bp, Homo sapiens
ataagccaatttttctgc

SEQ ID NO: 5239401 - DNA, 14 bp, Homo sapiens
ataagccagacatc

SEQ ID NO: 5239402 - DNA, 22 bp, Homo sapiens
ataagccagacatcaacagata

SEQ ID NO: 5239403 - DNA, 19 bp, Homo sapiens
ataagccatagccccaggc

SEQ ID NO: 5239404 - DNA, 16 bp, Homo sapiens
ataagccatgagaatg

SEQ ID NO: 5239405 - DNA, 13 bp, Homo sapiens
ataagccatgctg

SEQ ID NO: 5239406 - DNA, 19 bp, Homo sapiens
ataagcccaaatggctctg

SEQ ID NO: 5239407 - DNA, 19 bp, Homo sapiens
ataagccctgagactcccg

SEQ ID NO: 5239408 - DNA, 17 bp, Homo sapiens
ataagcccttaataata

SEQ ID NO: 5239409 - DNA, 20 bp, Homo sapiens
ataagcccttaataataatg

SEQ ID NO: 5239410 - DNA, 22 bp, Homo sapiens
ataagcctcaggcctggccctt

SEQ ID NO: 5239411 - DNA, 18 bp, Homo sapiens
ataagccttcgaaaagaa

SEQ ID NO: 5239412 - DNA, 21 bp, Homo sapiens
ataagccttcgaaaagaaatt

SEQ ID NO: 5239413 - DNA, 17 bp, Homo sapiens
ataagctaaagaggctg

SEQ ID NO: 5239414 - DNA, 21 bp, Homo sapiens
ataagctaacaccagacagac

SEQ ID NO: 5239415 - DNA, 21 bp, Homo sapiens
ataagctacctgaatggagaa

SEQ ID NO: 5239416 - DNA, 16 bp, Homo sapiens
ataagctactagcaaa

SEQ ID NO: 5239417 - DNA, 22 bp, Homo sapiens
ataagctactagcaaaataaaa

SEQ ID NO: 5239418 - DNA, 15 bp, Homo sapiens
ataagctagttgaat

SEQ ID NO: 5239419 - DNA, 21 bp, Homo sapiens
ataagctagttgaatacttga

SEQ ID NO: 5239420 - DNA, 12 bp, Homo sapiens
ataagctatttt

SEQ ID NO: 5239421 - DNA, 15 bp, Homo sapiens
ataagctattttggt

SEQ ID NO: 5239422 - DNA, 15 bp, Homo sapiens
ataagctcagaatcc

SEQ ID NO: 5239423 - DNA, 21 bp, Homo sapiens
ataagctggtatcagtggttc

SEQ ID NO: 5239424 - DNA, 17 bp, Homo sapiens
ataagctgtaatatcat

SEQ ID NO: 5239425 - DNA, 20 bp, Homo sapiens
ataagctgtaatatcatttt

SEQ ID NO: 5239426 - DNA, 19 bp, Homo sapiens
ataagctgtagaactctgc

SEQ ID NO: 5239427 - DNA, 21 bp, Homo sapiens
ataagctgttctggtggcagt

SEQ ID NO: 5239428 - DNA, 15 bp, Homo sapiens
ataagcttaaaataa

SEQ ID NO: 5239429 - DNA, 18 bp, Homo sapiens
ataagcttatgcttaaat

SEQ ID NO: 5239430 - DNA, 13 bp, Homo sapiens
ataagcttccagg

SEQ ID NO: 5239431 - DNA, 22 bp, Homo sapiens
ataagcttccattttaatttta

SEQ ID NO: 5239432 - DNA, 14 bp, Homo sapiens
ataagcttctcaat

SEQ ID NO: 5239433 - DNA, 13 bp, Homo sapiens
ataagctttcaat

SEQ ID NO: 5239434 - DNA, 23 bp, Homo sapiens
atatctatatataattctgtaca

SEQ ID NO: 5239435 - DNA, 18 bp, Homo sapiens
atatctatatatataatt

SEQ ID NO: 5239436 - DNA, 17 bp, Homo sapiens
atatctatattttacat

SEQ ID NO: 5239437 - DNA, 20 bp, Homo sapiens
atatctatattttacataaa

SEQ ID NO: 5239438 - DNA, 15 bp, Homo sapiens
atatctatctaatca

SEQ ID NO: 5239439 - DNA, 16 bp, Homo sapiens
atatctatctatttga

SEQ ID NO: 5239440 - DNA, 21 bp, Homo sapiens
atatctatcttatatagttta

SEQ ID NO: 5239441 - DNA, 16 bp, Homo sapiens
atatctatgttttacc

SEQ ID NO: 5239442 - DNA, 22 bp, Homo sapiens
atatctattaatatatgtatta

SEQ ID NO: 5239443 - DNA, 12 bp, Homo sapiens
atatctattatt

SEQ ID NO: 5239444 - DNA, 13 bp, Homo sapiens
atatctatttatc

SEQ ID NO: 5239445 - DNA, 23 bp, Homo sapiens
atatctatttatctgtctgagcc

SEQ ID NO: 5239446 - DNA, 16 bp, Homo sapiens
atatctatttgaataa

SEQ ID NO: 5239447 - DNA, 22 bp, Homo sapiens
atatctatttgagagcagatgc

SEQ ID NO: 5239448 - DNA, 12 bp, Homo sapiens
atatctcatctc

SEQ ID NO: 5239449 - DNA, 22 bp, Homo sapiens
atatctccatggccctgtccca

SEQ ID NO: 5239450 - DNA, 18 bp, Homo sapiens
atatctcctttaatgaca

SEQ ID NO: 5239451 - DNA, 23 bp, Homo sapiens
atatctcctttgtattctgtctt

SEQ ID NO: 5239452 - DNA, 16 bp, Homo sapiens
atatctctatttgaga

SEQ ID NO: 5239453 - DNA, 23 bp, Homo sapiens
atatctctgccatcacatagtat

SEQ ID NO: 5239454 - DNA, 19 bp, Homo sapiens
atatctctgtatgccatta

SEQ ID NO: 5239455 - DNA, 14 bp, Homo sapiens
atatctcttggaaa

SEQ ID NO: 5239456 - DNA, 15 bp, Homo sapiens
atatctcttgtgctt

SEQ ID NO: 5239457 - DNA, 16 bp, Homo sapiens
atatctgaaaactgga

SEQ ID NO: 5239458 - DNA, 17 bp, Homo sapiens
atatctgaaaatgtatg

SEQ ID NO: 5239459 - DNA, 20 bp, Homo sapiens
atatctgaaaatgtatgtgt

SEQ ID NO: 5239460 - DNA, 16 bp, Homo sapiens
atatctgaagattgaa

SEQ ID NO: 5239461 - DNA, 17 bp, Homo sapiens
atatctgagaagtgtat

SEQ ID NO: 5239462 - DNA, 18 bp, Homo sapiens
atatctgagaagtgtata

SEQ ID NO: 5239463 - DNA, 19 bp, Homo sapiens
atatctgagaagtgtatat

SEQ ID NO: 5239464 - DNA, 14 bp, Homo sapiens
atatctgagcaagg

SEQ ID NO: 5239465 - DNA, 15 bp, Homo sapiens
atatctgaggaattc

SEQ ID NO: 5239466 - DNA, 16 bp, Homo sapiens
atatctgaggaattct

SEQ ID NO: 5239467 - DNA, 18 bp, Homo sapiens
atatctgaggaattctgt

SEQ ID NO: 5239468 - DNA, 19 bp, Homo sapiens
atatctgaggaattctgta

SEQ ID NO: 5239469 - DNA, 23 bp, Homo sapiens
atatctgaggaattctgtataga

SEQ ID NO: 5239470 - DNA, 17 bp, Homo sapiens
atatctgataaaattgt

SEQ ID NO: 5239471 - DNA, 16 bp, Homo sapiens
atatctgatactgtat

SEQ ID NO: 5239472 - DNA, 14 bp, Homo sapiens
atatctgattgttg

SEQ ID NO: 5239473 - DNA, 16 bp, Homo sapiens
atatctgcctttattg

SEQ ID NO: 5239474 - DNA, 11 bp, Homo sapiens
atatctgctgt

SEQ ID NO: 5239475 - DNA, 16 bp, Homo sapiens
atatctgctgtatgtc

SEQ ID NO: 5239476 - DNA, 12 bp, Homo sapiens
atatctgctgtc

SEQ ID NO: 5239477 - DNA, 13 bp, Homo sapiens
atatctgctgtcc

SEQ ID NO: 5239478 - DNA, 17 bp, Homo sapiens
atatctgcttctagctt

SEQ ID NO: 5239479 - DNA, 11 bp, Homo sapiens
atatctgcttt

SEQ ID NO: 5239480 - DNA, 16 bp, Homo sapiens
atatctggagcctgat

SEQ ID NO: 5239481 - DNA, 13 bp, Homo sapiens
atatctggcactg

SEQ ID NO: 5239482 - DNA, 14 bp, Homo sapiens
atatctggcactgt

SEQ ID NO: 5239483 - DNA, 21 bp, Homo sapiens
atatctggcctaaaatcttgg

SEQ ID NO: 5239484 - DNA, 13 bp, Homo sapiens
atatctggcctct

SEQ ID NO: 5239485 - DNA, 21 bp, Homo sapiens
atatctgggattctactttaa

SEQ ID NO: 5239486 - DNA, 20 bp, Homo sapiens
atatctggtatatgtcatta

SEQ ID NO: 5239487 - DNA, 22 bp, Homo sapiens
atatctggtatatgtcattatt

SEQ ID NO: 5239488 - DNA, 18 bp, Homo sapiens
atatctgtaacactatta

SEQ ID NO: 5239489 - DNA, 23 bp, Homo sapiens
atatctgtaacactattacagta

SEQ ID NO: 5239490 - DNA, 15 bp, Homo sapiens
atatctgtaatatat

SEQ ID NO: 5239491 - DNA, 15 bp, Homo sapiens
atatctgtatataaa

SEQ ID NO: 5239492 - DNA, 13 bp, Homo sapiens
atatctgtatgta

SEQ ID NO: 5239493 - DNA, 20 bp, Homo sapiens
atatctgtatttaattttga

SEQ ID NO: 5239494 - DNA, 13 bp, Homo sapiens
atatctgtgaaat

SEQ ID NO: 5239495 - DNA, 15 bp, Homo sapiens
atatctgtgaaatat

SEQ ID NO: 5239496 - DNA, 18 bp, Homo sapiens
atatctgtggtcttcaaa

SEQ ID NO: 5239497 - DNA, 16 bp, Homo sapiens
atatctgttagatgct

SEQ ID NO: 5239498 - DNA, 15 bp, Homo sapiens
atatctgttcacttt

SEQ ID NO: 5239499 - DNA, 18 bp, Homo sapiens
atatctgtttattctggg

SEQ ID NO: 5239500 - DNA, 14 bp, Homo sapiens
atatctgtttgtat

SEQ ID NO: 5239501 - DNA, 21 bp, Homo sapiens
atatctgtttgtatatttgca

SEQ ID NO: 5239502 - DNA, 20 bp, Homo sapiens
atatctgttttgtttcttga

SEQ ID NO: 5239503 - DNA, 16 bp, Homo sapiens
atatcttaaagaaaca

SEQ ID NO: 5239504 - DNA, 17 bp, Homo sapiens
atatcttactaaggcct

SEQ ID NO: 5239505 - DNA, 16 bp, Homo sapiens
atatcttataactgtt

SEQ ID NO: 5239506 - DNA, 19 bp, Homo sapiens
atatcttataactgtttta

SEQ ID NO: 5239507 - DNA, 15 bp, Homo sapiens
atatcttatgttaaa

SEQ ID NO: 5239508 - DNA, 18 bp, Homo sapiens
atatcttcagtttaatgc

SEQ ID NO: 5239509 - DNA, 14 bp, Homo sapiens
atatcttcatttct

SEQ ID NO: 5239510 - DNA, 18 bp, Homo sapiens
atatcttcgttagtaatc

SEQ ID NO: 5239511 - DNA, 23 bp, Homo sapiens
atatcttcgttagtaatctgtat

SEQ ID NO: 5239512 - DNA, 13 bp, Homo sapiens
atatcttctacat

SEQ ID NO: 5239513 - DNA, 15 bp, Homo sapiens
atatcttctgtttca

SEQ ID NO: 5239514 - DNA, 21 bp, Homo sapiens
atatcttggcaggtaggaata

SEQ ID NO: 5239515 - DNA, 13 bp, Homo sapiens
atatcttgtagct

SEQ ID NO: 5239516 - DNA, 21 bp, Homo sapiens
atatcttgttattaatgtttc

SEQ ID NO: 5239517 - DNA, 13 bp, Homo sapiens
atatcttgtttac

SEQ ID NO: 5239518 - DNA, 22 bp, Homo sapiens
atatcttgtttacaataaagaa

SEQ ID NO: 5239519 - DNA, 20 bp, Homo sapiens
atatctttaataagtaatct

SEQ ID NO: 5239520 - DNA, 15 bp, Homo sapiens
atatctttatactta

SEQ ID NO: 5239521 - DNA, 13 bp, Homo sapiens
atatctttattaa

SEQ ID NO: 5239522 - DNA, 13 bp, Homo sapiens
atatctttcagtt

SEQ ID NO: 5239523 - DNA, 15 bp, Homo sapiens
atatctttctcatta

SEQ ID NO: 5239524 - DNA, 20 bp, Homo sapiens
atatctttctcattaccagt

SEQ ID NO: 5239525 - DNA, 13 bp, Homo sapiens
atatctttctctt

SEQ ID NO: 5239526 - DNA, 15 bp, Homo sapiens
atatctttgtaaatt

SEQ ID NO: 5239527 - DNA, 22 bp, Homo sapiens
atatctttgtgataatttaaga

SEQ ID NO: 5239528 - DNA, 23 bp, Homo sapiens
atatctttgtgataatttaagag

SEQ ID NO: 5239529 - DNA, 17 bp, Homo sapiens
atatcttttatgtttga

SEQ ID NO: 5239530 - DNA, 20 bp, Homo sapiens
atatcttttatgtttgaata

SEQ ID NO: 5239531 - DNA, 16 bp, Homo sapiens
atatcttttcttctcc

SEQ ID NO: 5239532 - DNA, 20 bp, Homo sapiens
atatcttttgtaagacattt

SEQ ID NO: 5239533 - DNA, 14 bp, Homo sapiens
atatctttttattg

SEQ ID NO: 5239534 - DNA, 21 bp, Homo sapiens
atatctttttattgatgtgca

SEQ ID NO: 5239535 - DNA, 14 bp, Homo sapiens
atatgaaaaatatg

SEQ ID NO: 5239536 - DNA, 18 bp, Homo sapiens
atatgaaaaatatgatat

SEQ ID NO: 5239537 - DNA, 15 bp, Homo sapiens
atatgaaaaatgaga

SEQ ID NO: 5239538 - DNA, 16 bp, Homo sapiens
atatgaaaaatgagat

SEQ ID NO: 5239539 - DNA, 14 bp, Homo sapiens
atatgaaaacaata

SEQ ID NO: 5239540 - DNA, 21 bp, Homo sapiens
atatgaaaacactcaaaatga

SEQ ID NO: 5239541 - DNA, 21 bp, Homo sapiens
atatgaaactcatctgtaaac

SEQ ID NO: 5239542 - DNA, 23 bp, Homo sapiens
atatgaaactcatctgtaaactt

SEQ ID NO: 5239543 - DNA, 13 bp, Homo sapiens
atatgaaagccac

SEQ ID NO: 5239544 - DNA, 13 bp, Homo sapiens
atatgaaagctga

SEQ ID NO: 5239545 - DNA, 17 bp, Homo sapiens
atatgaaagctgatttt

SEQ ID NO: 5239546 - DNA, 13 bp, Homo sapiens
atatgaaatataa

SEQ ID NO: 5239547 - DNA, 22 bp, Homo sapiens
atatgaaatataaattatctga

SEQ ID NO: 5239548 - DNA, 23 bp, Homo sapiens
atatgaaatataaattatctgaa

SEQ ID NO: 5239549 - DNA, 15 bp, Homo sapiens
atatgaaatattttg

SEQ ID NO: 5239550 - DNA, 16 bp, Homo sapiens
atatgaaattccagca

SEQ ID NO: 5239551 - DNA, 11 bp, Homo sapiens
atatgaacaaa

SEQ ID NO: 5239552 - DNA, 17 bp, Homo sapiens
atatgaacagggcccag

SEQ ID NO: 5239553 - DNA, 20 bp, Homo sapiens
atatgaacagggcccaggcc

SEQ ID NO: 5239554 - DNA, 18 bp, Homo sapiens
atatgaacatacaaatgc

SEQ ID NO: 5239555 - DNA, 18 bp, Homo sapiens
atatgaaccctttgtttc

SEQ ID NO: 5239556 - DNA, 20 bp, Homo sapiens
atatgaacctattttcattt

SEQ ID NO: 5239557 - DNA, 22 bp, Homo sapiens
atatgaacctattttcatttgt

SEQ ID NO: 5239558 - DNA, 23 bp, Homo sapiens
atatgaacctattttcatttgta

SEQ ID NO: 5239559 - DNA, 16 bp, Homo sapiens
atatgaagacataaac

SEQ ID NO: 5239560 - DNA, 15 bp, Homo sapiens
atatgaagagttttt

SEQ ID NO: 5239561 - DNA, 16 bp, Homo sapiens
atatgaagcaagctgt

SEQ ID NO: 5239562 - DNA, 16 bp, Homo sapiens
atatgaagcagaatga

SEQ ID NO: 5239563 - DNA, 17 bp, Homo sapiens
atatgaagctcacctgt

SEQ ID NO: 5239564 - DNA, 23 bp, Homo sapiens
atatgaaggactattaattccaa

SEQ ID NO: 5239565 - DNA, 22 bp, Homo sapiens
atatgaaggtttgagagcaggc

SEQ ID NO: 5239566 - DNA, 20 bp, Homo sapiens
atatgaagtaagttctgaaa

SEQ ID NO: 5239567 - DNA, 23 bp, Homo sapiens
atatgaagtatctaaaagtgtca

SEQ ID NO: 5239568 - DNA, 22 bp, Homo sapiens
atatgaatatatacataaaaat

SEQ ID NO: 5239569 - DNA, 16 bp, Homo sapiens
atatgaatatatagtg

SEQ ID NO: 5239570 - DNA, 17 bp, Homo sapiens
atatgaatattacatgt

SEQ ID NO: 5239571 - DNA, 12 bp, Homo sapiens
atatgaatctat

SEQ ID NO: 5239572 - DNA, 13 bp, Homo sapiens
atatgaatgaaac

SEQ ID NO: 5239573 - DNA, 14 bp, Homo sapiens
atatgaatgcagca

SEQ ID NO: 5239574 - DNA, 14 bp, Homo sapiens
atatgaatgtcaca

SEQ ID NO: 5239575 - DNA, 15 bp, Homo sapiens
atatgaatgtcacat

SEQ ID NO: 5239576 - DNA, 17 bp, Homo sapiens
atatgaatttaaatata

SEQ ID NO: 5239577 - DNA, 17 bp, Homo sapiens
atatgacaaatgtttct

SEQ ID NO: 5239578 - DNA, 18 bp, Homo sapiens
atatgacaatttcaaaat

SEQ ID NO: 5239579 - DNA, 14 bp, Homo sapiens
atatgacagctgtc

SEQ ID NO: 5239580 - DNA, 16 bp, Homo sapiens
atatgacatttaaatg

SEQ ID NO: 5239581 - DNA, 23 bp, Homo sapiens
atatgaccaaatatcaccaggac

SEQ ID NO: 5239582 - DNA, 12 bp, Homo sapiens
atatgaccagaa

SEQ ID NO: 5239583 - DNA, 20 bp, Homo sapiens
atatgaccagaagccttgga

SEQ ID NO: 5239584 - DNA, 16 bp, Homo sapiens
atatgaccattgaaaa

SEQ ID NO: 5239585 - DNA, 22 bp, Homo sapiens
atatgaccattgaaaaaggaaa

SEQ ID NO: 5239586 - DNA, 17 bp, Homo sapiens
atatgacccacactgcc

SEQ ID NO: 5239587 - DNA, 20 bp, Homo sapiens
atatgacggaagaacataga

SEQ ID NO: 5239588 - DNA, 15 bp, Homo sapiens
atatgactcaggagc

SEQ ID NO: 5239589 - DNA, 15 bp, Homo sapiens
atatgactgttttta

SEQ ID NO: 5239590 - DNA, 21 bp, Homo sapiens
atatgactgtttttcggacag

SEQ ID NO: 5239591 - DNA, 15 bp, Homo sapiens
atatgactttttata

SEQ ID NO: 5239592 - DNA, 13 bp, Homo sapiens
atatgagaagaat

SEQ ID NO: 5239593 - DNA, 23 bp, Homo sapiens
atatgagaaggtgcctcaagaat

SEQ ID NO: 5239594 - DNA, 21 bp, Homo sapiens
atatgagactattatgaaatc

SEQ ID NO: 5239595 - DNA, 24 bp, Homo sapiens
atatgagactattatgaaatcata

SEQ ID NO: 5239596 - DNA, 22 bp, Homo sapiens
atatgagatgtagcaaattcca

SEQ ID NO: 5239597 - DNA, 23 bp, Homo sapiens
atatgagccggttattacttctg

SEQ ID NO: 5239598 - DNA, 24 bp, Homo sapiens
atatgagcttcaatataagaagca

SEQ ID NO: 5239599 - DNA, 22 bp, Homo sapiens
atatgagcttccttctgtgaaa

SEQ ID NO: 5239600 - DNA, 20 bp, Homo sapiens
atatgagctttatgtaataa

SEQ ID NO: 5239601 - DNA, 14 bp, Homo sapiens
atatgaggatgtat

SEQ ID NO: 5239602 - DNA, 15 bp, Homo sapiens
atatgaggatgtatg

SEQ ID NO: 5239603 - DNA, 20 bp, Homo sapiens
atatgaggatgtatgtgtat

SEQ ID NO: 5239604 - DNA, 21 bp, Homo sapiens
atatgaggatgtatgtgtata

SEQ ID NO: 5239605 - DNA, 21 bp, Homo sapiens
atatgagtatacaatatataa

SEQ ID NO: 5239606 - DNA, 13 bp, Homo sapiens
atatgataaaaca

SEQ ID NO: 5239607 - DNA, 19 bp, Homo sapiens
atatgatagcttcgcatgg

SEQ ID NO: 5239608 - DNA, 13 bp, Homo sapiens
atatgatatgcat

SEQ ID NO: 5239609 - DNA, 23 bp, Homo sapiens
atatgatatgcatgtagcatata

SEQ ID NO: 5239610 - DNA, 17 bp, Homo sapiens
atatgatattctttaaa

SEQ ID NO: 5239611 - DNA, 19 bp, Homo sapiens
atatgatattctttaaaca

SEQ ID NO: 5239612 - DNA, 16 bp, Homo sapiens
ataagcttttggtaat

SEQ ID NO: 5239613 - DNA, 11 bp, Homo sapiens
ataaggaaact

SEQ ID NO: 5239614 - DNA, 15 bp, Homo sapiens
ataaggaaactttat

SEQ ID NO: 5239615 - DNA, 16 bp, Homo sapiens
ataaggaaactttatt

SEQ ID NO: 5239616 - DNA, 22 bp, Homo sapiens
ataaggaaactttatttaaatg

SEQ ID NO: 5239617 - DNA, 23 bp, Homo sapiens
ataaggaaactttatttaaatgc

SEQ ID NO: 5239618 - DNA, 20 bp, Homo sapiens
ataaggaaatatcataatgt

SEQ ID NO: 5239619 - DNA, 14 bp, Homo sapiens
ataaggaacattta

SEQ ID NO: 5239620 - DNA, 15 bp, Homo sapiens
ataaggaacatttat

SEQ ID NO: 5239621 - DNA, 13 bp, Homo sapiens
ataaggaagttat

SEQ ID NO: 5239622 - DNA, 15 bp, Homo sapiens
ataaggaatagcttt

SEQ ID NO: 5239623 - DNA, 15 bp, Homo sapiens
ataaggacagcagct

SEQ ID NO: 5239624 - DNA, 22 bp, Homo sapiens
ataaggacgtgtgtaaatatgt

SEQ ID NO: 5239625 - DNA, 10 bp, Homo sapiens
ataaggactg

SEQ ID NO: 5239626 - DNA, 12 bp, Homo sapiens
ataaggactgca

SEQ ID NO: 5239627 - DNA, 14 bp, Homo sapiens
ataaggactgcatg

SEQ ID NO: 5239628 - DNA, 15 bp, Homo sapiens
ataaggagaaagaaa

SEQ ID NO: 5239629 - DNA, 13 bp, Homo sapiens
ataaggagaatgt

SEQ ID NO: 5239630 - DNA, 15 bp, Homo sapiens
ataaggagctttgct

SEQ ID NO: 5239631 - DNA, 16 bp, Homo sapiens
ataaggagctttgctc

SEQ ID NO: 5239632 - DNA, 21 bp, Homo sapiens
ataaggagctttgctcttgga

SEQ ID NO: 5239633 - DNA, 13 bp, Homo sapiens
ataaggaggaaaa

SEQ ID NO: 5239634 - DNA, 24 bp, Homo sapiens
ataaggagttagaaccacagcaga

SEQ ID NO: 5239635 - DNA, 20 bp, Homo sapiens
ataaggatcaattgtaatat

SEQ ID NO: 5239636 - DNA, 14 bp, Homo sapiens
ataaggatcagaac

SEQ ID NO: 5239637 - DNA, 19 bp, Homo sapiens
ataaggatcttttgtaaat

SEQ ID NO: 5239638 - DNA, 15 bp, Homo sapiens
ataaggatgactttt

SEQ ID NO: 5239639 - DNA, 19 bp, Homo sapiens
ataaggatgatacagtctc

SEQ ID NO: 5239640 - DNA, 15 bp, Homo sapiens
ataaggattctgaag

SEQ ID NO: 5239641 - DNA, 19 bp, Homo sapiens
ataaggattctgaagtttt

SEQ ID NO: 5239642 - DNA, 13 bp, Homo sapiens
ataaggcaggcat

SEQ ID NO: 5239643 - DNA, 17 bp, Homo sapiens
ataaggccgagcccaca

SEQ ID NO: 5239644 - DNA, 21 bp, Homo sapiens
ataaggcggcgtgggcgaggc

SEQ ID NO: 5239645 - DNA, 22 bp, Homo sapiens
ataaggcggcgtgggcgaggcc

SEQ ID NO: 5239646 - DNA, 14 bp, Homo sapiens
ataaggctaaatgt

SEQ ID NO: 5239647 - DNA, 16 bp, Homo sapiens
ataagggaaaaatcaa

SEQ ID NO: 5239648 - DNA, 12 bp, Homo sapiens
ataagggagagc

SEQ ID NO: 5239649 - DNA, 19 bp, Homo sapiens
ataagggagagctgagcca

SEQ ID NO: 5239650 - DNA, 20 bp, Homo sapiens
ataagggagcgtagaatctg

SEQ ID NO: 5239651 - DNA, 19 bp, Homo sapiens
ataagggcaaattggagaa

SEQ ID NO: 5239652 - DNA, 18 bp, Homo sapiens
ataagggcattatgtaac

SEQ ID NO: 5239653 - DNA, 18 bp, Homo sapiens
ataaggggccttgctctg

SEQ ID NO: 5239654 - DNA, 17 bp, Homo sapiens
ataaggtcaagggaaaa

SEQ ID NO: 5239655 - DNA, 17 bp, Homo sapiens
ataaggtgctctctttc

SEQ ID NO: 5239656 - DNA, 14 bp, Homo sapiens
ataaggtggcttct

SEQ ID NO: 5239657 - DNA, 14 bp, Homo sapiens
ataaggtgtattgc

SEQ ID NO: 5239658 - DNA, 20 bp, Homo sapiens
ataaggtgttttctgtgtaa

SEQ ID NO: 5239659 - DNA, 19 bp, Homo sapiens
ataaggttttaatttagta

SEQ ID NO: 5239660 - DNA, 14 bp, Homo sapiens
ataagtaaacaaca

SEQ ID NO: 5239661 - DNA, 15 bp, Homo sapiens
ataagtaaacaacat

SEQ ID NO: 5239662 - DNA, 23 bp, Homo sapiens
ataagtaaagtgattaaagtgct

SEQ ID NO: 5239663 - DNA, 16 bp, Homo sapiens
ataagtaaatacatta

SEQ ID NO: 5239664 - DNA, 23 bp, Homo sapiens
ataagtaaatatattatatatgg

SEQ ID NO: 5239665 - DNA, 20 bp, Homo sapiens
ataagtaaatgtcttcatgt

SEQ ID NO: 5239666 - DNA, 17 bp, Homo sapiens
ataagtaagaaaatatt

SEQ ID NO: 5239667 - DNA, 18 bp, Homo sapiens
ataagtaagaaaatattt

SEQ ID NO: 5239668 - DNA, 19 bp, Homo sapiens
ataagtaagaaaatatttt

SEQ ID NO: 5239669 - DNA, 18 bp, Homo sapiens
ataagtaagacttgattg

SEQ ID NO: 5239670 - DNA, 15 bp, Homo sapiens
ataagtaatatcttt

SEQ ID NO: 5239671 - DNA, 19 bp, Homo sapiens
ataagtaatatctttcagt

SEQ ID NO: 5239672 - DNA, 21 bp, Homo sapiens
ataagtaatatttaaagatta

SEQ ID NO: 5239673 - DNA, 22 bp, Homo sapiens
ataagtaatgaaggcatatttc

SEQ ID NO: 5239674 - DNA, 22 bp, Homo sapiens
ataagtagatctgctttctgtt

SEQ ID NO: 5239675 - DNA, 17 bp, Homo sapiens
ataagtagcattcatgt

SEQ ID NO: 5239676 - DNA, 13 bp, Homo sapiens
ataagtagttggt

SEQ ID NO: 5239677 - DNA, 14 bp, Homo sapiens
ataagtagttggtt

SEQ ID NO: 5239678 - DNA, 15 bp, Homo sapiens
ataagtatacagttc

SEQ ID NO: 5239679 - DNA, 22 bp, Homo sapiens
ataagtatactgggggcaaaat

SEQ ID NO: 5239680 - DNA, 22 bp, Homo sapiens
ataagtatccagtactttataa

SEQ ID NO: 5239681 - DNA, 19 bp, Homo sapiens
ataagtatttaattcatgt

SEQ ID NO: 5239682 - DNA, 19 bp, Homo sapiens
ataagtatttataatagca

SEQ ID NO: 5239683 - DNA, 16 bp, Homo sapiens
ataagtatttcaaatt

SEQ ID NO: 5239684 - DNA, 19 bp, Homo sapiens
ataagtatttcaaattgga

SEQ ID NO: 5239685 - DNA, 14 bp, Homo sapiens
ataagtatttctga

SEQ ID NO: 5239686 - DNA, 17 bp, Homo sapiens
ataagtcaaaaggaaca

SEQ ID NO: 5239687 - DNA, 14 bp, Homo sapiens
ataagtcaagcaca

SEQ ID NO: 5239688 - DNA, 18 bp, Homo sapiens
ataagtcaagcacatgta

SEQ ID NO: 5239689 - DNA, 21 bp, Homo sapiens
ataagtcaagcacatgtaata

SEQ ID NO: 5239690 - DNA, 18 bp, Homo sapiens
ataagtcatggagcctga

SEQ ID NO: 5239691 - DNA, 19 bp, Homo sapiens
ataagtccatgaatgttca

SEQ ID NO: 5239692 - DNA, 16 bp, Homo sapiens
ataagtccattaactg

SEQ ID NO: 5239693 - DNA, 19 bp, Homo sapiens
ataagtccattaactgctt

SEQ ID NO: 5239694 - DNA, 14 bp, Homo sapiens
ataagtctaaataa

SEQ ID NO: 5239695 - DNA, 14 bp, Homo sapiens
ataagtctgttatt

SEQ ID NO: 5239696 - DNA, 20 bp, Homo sapiens
ataagtgaaattttaaaagt

SEQ ID NO: 5239697 - DNA, 22 bp, Homo sapiens
ataagtgaacaactggaaataa

SEQ ID NO: 5239698 - DNA, 15 bp, Homo sapiens
ataagtgaatttata

SEQ ID NO: 5239699 - DNA, 17 bp, Homo sapiens
ataagtgagagaaatga

SEQ ID NO: 5239700 - DNA, 22 bp, Homo sapiens
ataagtgagatggtatgaaata

SEQ ID NO: 5239701 - DNA, 19 bp, Homo sapiens
ataagtgaggaagagttta

SEQ ID NO: 5239702 - DNA, 19 bp, Homo sapiens
ataagtgcacacagaaata

SEQ ID NO: 5239703 - DNA, 17 bp, Homo sapiens
ataagtgcagggaggaa

SEQ ID NO: 5239704 - DNA, 15 bp, Homo sapiens
ataagtgctcagtat

SEQ ID NO: 5239705 - DNA, 17 bp, Homo sapiens
ataagtgctgtataaaa

SEQ ID NO: 5239706 - DNA, 19 bp, Homo sapiens
ataagtgctgtataaaatc

SEQ ID NO: 5239707 - DNA, 20 bp, Homo sapiens
ataagtgctgtataaaatca

SEQ ID NO: 5239708 - DNA, 16 bp, Homo sapiens
ataagtgctgtttgag

SEQ ID NO: 5239709 - DNA, 22 bp, Homo sapiens
ataagtgctgtttgagatgtga

SEQ ID NO: 5239710 - DNA, 13 bp, Homo sapiens
ataagtggaaaaa

SEQ ID NO: 5239711 - DNA, 14 bp, Homo sapiens
ataagtggaaaaaa

SEQ ID NO: 5239712 - DNA, 21 bp, Homo sapiens
ataagtggaaaaaagagaaaa

SEQ ID NO: 5239713 - DNA, 18 bp, Homo sapiens
ataagtggaggcacttta

SEQ ID NO: 5239714 - DNA, 16 bp, Homo sapiens
ataagtggcatacttt

SEQ ID NO: 5239715 - DNA, 19 bp, Homo sapiens
ataagtggccttgacacat

SEQ ID NO: 5239716 - DNA, 17 bp, Homo sapiens
ataagtggtgcttagaa

SEQ ID NO: 5239717 - DNA, 15 bp, Homo sapiens
ataagtggtgtgtgt

SEQ ID NO: 5239718 - DNA, 21 bp, Homo sapiens
ataagtggttttcttcaggaa

SEQ ID NO: 5239719 - DNA, 13 bp, Homo sapiens
ataagtgtaaata

SEQ ID NO: 5239720 - DNA, 13 bp, Homo sapiens
ataagtgtacata

SEQ ID NO: 5239721 - DNA, 21 bp, Homo sapiens
ataagtgtattttgaaattgt

SEQ ID NO: 5239722 - DNA, 16 bp, Homo sapiens
ataagtgtctttctgg

SEQ ID NO: 5239723 - DNA, 23 bp, Homo sapiens
ataagtgtgaccagttttgatat

SEQ ID NO: 5239724 - DNA, 20 bp, Homo sapiens
ataagtgtgtggtagaaaca

SEQ ID NO: 5239725 - DNA, 15 bp, Homo sapiens
ataagtgttcagtgt

SEQ ID NO: 5239726 - DNA, 16 bp, Homo sapiens
ataagtgttcagtgtt

SEQ ID NO: 5239727 - DNA, 17 bp, Homo sapiens
ataagtgttcagtgttg

SEQ ID NO: 5239728 - DNA, 22 bp, Homo sapiens
ataagtgttcttcagtgtaatg

SEQ ID NO: 5239729 - DNA, 19 bp, Homo sapiens
ataagttaaaacaaaggaa

SEQ ID NO: 5239730 - DNA, 22 bp, Homo sapiens
ataagttaaaacaaaggaacta

SEQ ID NO: 5239731 - DNA, 19 bp, Homo sapiens
ataagttaaagagacaaat

SEQ ID NO: 5239732 - DNA, 20 bp, Homo sapiens
ataagttaaaggcagtccag

SEQ ID NO: 5239733 - DNA, 17 bp, Homo sapiens
ataagttaacttccaat

SEQ ID NO: 5239734 - DNA, 13 bp, Homo sapiens
ataagttattgca

SEQ ID NO: 5239735 - DNA, 24 bp, Homo sapiens
ataagttattgcagtttatcattc

SEQ ID NO: 5239736 - DNA, 24 bp, Homo sapiens
ataagttcaaattcttctgaactc

SEQ ID NO: 5239737 - DNA, 16 bp, Homo sapiens
ataagttcacaaaatg

SEQ ID NO: 5239738 - DNA, 11 bp, Homo sapiens
ataagttcata

SEQ ID NO: 5239739 - DNA, 13 bp, Homo sapiens
ataagttcataca

SEQ ID NO: 5239740 - DNA, 20 bp, Homo sapiens
ataagttcttatgccatgtt

SEQ ID NO: 5239741 - DNA, 17 bp, Homo sapiens
ataagttgaatgataat

SEQ ID NO: 5239742 - DNA, 19 bp, Homo sapiens
ataagttgagaaggtgcct

SEQ ID NO: 5239743 - DNA, 20 bp, Homo sapiens
ataagttgagaaggtgcctg

SEQ ID NO: 5239744 - DNA, 13 bp, Homo sapiens
ataagttgatgtt

SEQ ID NO: 5239745 - DNA, 21 bp, Homo sapiens
ataagttgcatttagaaatca

SEQ ID NO: 5239746 - DNA, 22 bp, Homo sapiens
ataagttgcatttagaaatcaa

SEQ ID NO: 5239747 - DNA, 16 bp, Homo sapiens
ataagttgctgtaaaa

SEQ ID NO: 5239748 - DNA, 13 bp, Homo sapiens
ataagttgctttc

SEQ ID NO: 5239749 - DNA, 14 bp, Homo sapiens
ataagttgctttcc

SEQ ID NO: 5239750 - DNA, 19 bp, Homo sapiens
ataagttgctttcctctta

SEQ ID NO: 5239751 - DNA, 17 bp, Homo sapiens
ataagttggaaacacta

SEQ ID NO: 5239752 - DNA, 18 bp, Homo sapiens
ataagttggaaacactaa

SEQ ID NO: 5239753 - DNA, 22 bp, Homo sapiens
ataagttggaaacactaaatgt

SEQ ID NO: 5239754 - DNA, 18 bp, Homo sapiens
ataagttgtaccaaaaca

SEQ ID NO: 5239755 - DNA, 21 bp, Homo sapiens
ataagttgtaccaaaacatcc

SEQ ID NO: 5239756 - DNA, 13 bp, Homo sapiens
ataagttgtttca

SEQ ID NO: 5239757 - DNA, 22 bp, Homo sapiens
ataagttgttttgttttatagc

SEQ ID NO: 5239758 - DNA, 15 bp, Homo sapiens
ataagtttaacttta

SEQ ID NO: 5239759 - DNA, 20 bp, Homo sapiens
ataagtttaactttaaaact

SEQ ID NO: 5239760 - DNA, 22 bp, Homo sapiens
ataagtttaactttaaaactgt

SEQ ID NO: 5239761 - DNA, 23 bp, Homo sapiens
ataagtttaactttaaaactgta

SEQ ID NO: 5239762 - DNA, 12 bp, Homo sapiens
ataagtttattt

SEQ ID NO: 5239763 - DNA, 20 bp, Homo sapiens
ataagtttcactgacttaga

SEQ ID NO: 5239764 - DNA, 16 bp, Homo sapiens
ataagtttctattctg

SEQ ID NO: 5239765 - DNA, 13 bp, Homo sapiens
ataagtttgaagg

SEQ ID NO: 5239766 - DNA, 19 bp, Homo sapiens
ataagtttgaaggaaacag

SEQ ID NO: 5239767 - DNA, 21 bp, Homo sapiens
ataagtttgaaggaaacagtt

SEQ ID NO: 5239768 - DNA, 21 bp, Homo sapiens
ataagtttgtgttagaaaagt

SEQ ID NO: 5239769 - DNA, 12 bp, Homo sapiens
ataagttttaga

SEQ ID NO: 5239770 - DNA, 22 bp, Homo sapiens
ataagttttatacataaacagt

SEQ ID NO: 5239771 - DNA, 19 bp, Homo sapiens
ataagttttgatataatct

SEQ ID NO: 5239772 - DNA, 21 bp, Homo sapiens
ataagttttgatataatcttg

SEQ ID NO: 5239773 - DNA, 11 bp, Homo sapiens
ataagttttgt

SEQ ID NO: 5239774 - DNA, 17 bp, Homo sapiens
ataagtttttctttaat

SEQ ID NO: 5239775 - DNA, 19 bp, Homo sapiens
ataataaaaaattatgaca

SEQ ID NO: 5239776 - DNA, 14 bp, Homo sapiens
ataataaaaagata

SEQ ID NO: 5239777 - DNA, 11 bp, Homo sapiens
ataataaaaat

SEQ ID NO: 5239778 - DNA, 13 bp, Homo sapiens
ataataaaaatca

SEQ ID NO: 5239779 - DNA, 15 bp, Homo sapiens
ataataaaagaatca

SEQ ID NO: 5239780 - DNA, 15 bp, Homo sapiens
ataataaaaggaaaa

SEQ ID NO: 5239781 - DNA, 23 bp, Homo sapiens
ataataaaagtgccttagcatgt

SEQ ID NO: 5239782 - DNA, 13 bp, Homo sapiens
ataataaaatagt

SEQ ID NO: 5239783 - DNA, 14 bp, Homo sapiens
ataataaaatgcaa

SEQ ID NO: 5239784 - DNA, 15 bp, Homo sapiens
ataataaaatgcaaa

SEQ ID NO: 5239785 - DNA, 18 bp, Homo sapiens
ataataaaatgcaaatga

SEQ ID NO: 5239786 - DNA, 20 bp, Homo sapiens
ataataaaatgcaaatgaat

SEQ ID NO: 5239787 - DNA, 22 bp, Homo sapiens
ataataaaatgcaaatgaatca

SEQ ID NO: 5239788 - DNA, 15 bp, Homo sapiens
ataataaaattcatt

SEQ ID NO: 5239789 - DNA, 14 bp, Homo sapiens
ataataaaatttct

SEQ ID NO: 5239790 - DNA, 20 bp, Homo sapiens
ataataaactcttaagagaa

SEQ ID NO: 5239791 - DNA, 16 bp, Homo sapiens
atatgatattgcatat

SEQ ID NO: 5239792 - DNA, 18 bp, Homo sapiens
atatgatcagtgttactg

SEQ ID NO: 5239793 - DNA, 19 bp, Homo sapiens
atatgatcattgaaatact

SEQ ID NO: 5239794 - DNA, 20 bp, Homo sapiens
atatgatccagagcagagtt

SEQ ID NO: 5239795 - DNA, 20 bp, Homo sapiens
atatgatccctaatgtgttt

SEQ ID NO: 5239796 - DNA, 13 bp, Homo sapiens
atatgatctaata

SEQ ID NO: 5239797 - DNA, 15 bp, Homo sapiens
atatgatctaataca

SEQ ID NO: 5239798 - DNA, 16 bp, Homo sapiens
atatgatctaatacaa

SEQ ID NO: 5239799 - DNA, 16 bp, Homo sapiens
atatgatctgtctgtg

SEQ ID NO: 5239800 - DNA, 13 bp, Homo sapiens
atatgatctgttt

SEQ ID NO: 5239801 - DNA, 14 bp, Homo sapiens
atatgatctgtttt

SEQ ID NO: 5239802 - DNA, 17 bp, Homo sapiens
atatgattaaagaaaat

SEQ ID NO: 5239803 - DNA, 16 bp, Homo sapiens
atatgattaaattatc

SEQ ID NO: 5239804 - DNA, 21 bp, Homo sapiens
atatgattaaattatcattgt

SEQ ID NO: 5239805 - DNA, 17 bp, Homo sapiens
atatgattctcctctcc

SEQ ID NO: 5239806 - DNA, 22 bp, Homo sapiens
atatgattctcctctcccaaat

SEQ ID NO: 5239807 - DNA, 15 bp, Homo sapiens
atatgattctctgtg

SEQ ID NO: 5239808 - DNA, 15 bp, Homo sapiens
atatgattctgcttt

SEQ ID NO: 5239809 - DNA, 19 bp, Homo sapiens
atatgattgtataatgtga

SEQ ID NO: 5239810 - DNA, 15 bp, Homo sapiens
atatgatttaaaaca

SEQ ID NO: 5239811 - DNA, 13 bp, Homo sapiens
atatgatttatag

SEQ ID NO: 5239812 - DNA, 14 bp, Homo sapiens
atatgatttatagt

SEQ ID NO: 5239813 - DNA, 18 bp, Homo sapiens
atatgatttcactagaaa

SEQ ID NO: 5239814 - DNA, 22 bp, Homo sapiens
atatgatttgcattttttaaat

SEQ ID NO: 5239815 - DNA, 19 bp, Homo sapiens
atatgattttatttgacaa

SEQ ID NO: 5239816 - DNA, 13 bp, Homo sapiens
atatgcaaagcac

SEQ ID NO: 5239817 - DNA, 14 bp, Homo sapiens
atatgcaacattgt

SEQ ID NO: 5239818 - DNA, 21 bp, Homo sapiens
atatgcaacttattgtatctg

SEQ ID NO: 5239819 - DNA, 13 bp, Homo sapiens
atatgcaagtaag

SEQ ID NO: 5239820 - DNA, 22 bp, Homo sapiens
atatgcaagtaagaaataatgc

SEQ ID NO: 5239821 - DNA, 15 bp, Homo sapiens
atatgcaataaatat

SEQ ID NO: 5239822 - DNA, 13 bp, Homo sapiens
atatgcaatttgt

SEQ ID NO: 5239823 - DNA, 14 bp, Homo sapiens
atatgcacacattt

SEQ ID NO: 5239824 - DNA, 22 bp, Homo sapiens
atatgcacacattttttaaatg

SEQ ID NO: 5239825 - DNA, 15 bp, Homo sapiens
atatgcaccttgtgt

SEQ ID NO: 5239826 - DNA, 17 bp, Homo sapiens
atatgcaccttgtgtct

SEQ ID NO: 5239827 - DNA, 13 bp, Homo sapiens
atatgcacttata

SEQ ID NO: 5239828 - DNA, 20 bp, Homo sapiens
atatgcactttccctagaaa

SEQ ID NO: 5239829 - DNA, 13 bp, Homo sapiens
atatgcaggctgt

SEQ ID NO: 5239830 - DNA, 16 bp, Homo sapiens
atatgcagttttcctt

SEQ ID NO: 5239831 - DNA, 16 bp, Homo sapiens
atatgcataaacaaca

SEQ ID NO: 5239832 - DNA, 23 bp, Homo sapiens
atatgcatactaatttttgctta

SEQ ID NO: 5239833 - DNA, 21 bp, Homo sapiens
atatgcatctggcccaggaat

SEQ ID NO: 5239834 - DNA, 22 bp, Homo sapiens
atatgcatctggcccaggaatt

SEQ ID NO: 5239835 - DNA, 14 bp, Homo sapiens
atatgcatgccagg

SEQ ID NO: 5239836 - DNA, 16 bp, Homo sapiens
atatgcatgccaggct

SEQ ID NO: 5239837 - DNA, 20 bp, Homo sapiens
atatgcatgtagcatataaa

SEQ ID NO: 5239838 - DNA, 20 bp, Homo sapiens
atatgcatttaattctgaaa

SEQ ID NO: 5239839 - DNA, 17 bp, Homo sapiens
atatgccactgaccgat

SEQ ID NO: 5239840 - DNA, 19 bp, Homo sapiens
atatgccagtgactgctgc

SEQ ID NO: 5239841 - DNA, 22 bp, Homo sapiens
atatgccatttatagagataag

SEQ ID NO: 5239842 - DNA, 23 bp, Homo sapiens
atatgccccttcttgggccccag

SEQ ID NO: 5239843 - DNA, 18 bp, Homo sapiens
atatgccctcaagtaaaa

SEQ ID NO: 5239844 - DNA, 16 bp, Homo sapiens
atatgccctcctggtg

SEQ ID NO: 5239845 - DNA, 15 bp, Homo sapiens
atatgcctatattta

SEQ ID NO: 5239846 - DNA, 22 bp, Homo sapiens
atatgcctctcctttgtatatt

SEQ ID NO: 5239847 - DNA, 22 bp, Homo sapiens
atatgccttaatttagaaactg

SEQ ID NO: 5239848 - DNA, 19 bp, Homo sapiens
atatgcgggacatgatgct

SEQ ID NO: 5239849 - DNA, 15 bp, Homo sapiens
atatgctaatttggg

SEQ ID NO: 5239850 - DNA, 20 bp, Homo sapiens
atatgctacacatatgtgct

SEQ ID NO: 5239851 - DNA, 19 bp, Homo sapiens
atatgctaccaccagctgt

SEQ ID NO: 5239852 - DNA, 18 bp, Homo sapiens
atatgctatttctatatt

SEQ ID NO: 5239853 - DNA, 18 bp, Homo sapiens
atatgctcctagagagga

SEQ ID NO: 5239854 - DNA, 19 bp, Homo sapiens
atatgctcctagagaggag

SEQ ID NO: 5239855 - DNA, 19 bp, Homo sapiens
atatgctgaacgcagaaga

SEQ ID NO: 5239856 - DNA, 22 bp, Homo sapiens
atatgctgaacgcagaagaaag

SEQ ID NO: 5239857 - DNA, 13 bp, Homo sapiens
atatgctgagaaa

SEQ ID NO: 5239858 - DNA, 16 bp, Homo sapiens
atatgctgagaaatta

SEQ ID NO: 5239859 - DNA, 15 bp, Homo sapiens
atatgctgcaacaaa

SEQ ID NO: 5239860 - DNA, 18 bp, Homo sapiens
atatgcttactaaatctt

SEQ ID NO: 5239861 - DNA, 15 bp, Homo sapiens
atatgcttagtaatg

SEQ ID NO: 5239862 - DNA, 13 bp, Homo sapiens
atatgcttcttta

SEQ ID NO: 5239863 - DNA, 15 bp, Homo sapiens
atatgcttctttaaa

SEQ ID NO: 5239864 - DNA, 16 bp, Homo sapiens
atatgcttttggaagt

SEQ ID NO: 5239865 - DNA, 19 bp, Homo sapiens
atatgcttttttgcaataa

SEQ ID NO: 5239866 - DNA, 13 bp, Homo sapiens
atatggaaacaga

SEQ ID NO: 5239867 - DNA, 18 bp, Homo sapiens
atatggaaacagaagaca

SEQ ID NO: 5239868 - DNA, 16 bp, Homo sapiens
atatggaaatatatat

SEQ ID NO: 5239869 - DNA, 14 bp, Homo sapiens
atatggaaatgtta

SEQ ID NO: 5239870 - DNA, 12 bp, Homo sapiens
atatggaacctt

SEQ ID NO: 5239871 - DNA, 22 bp, Homo sapiens
atatggaagataattttatgtg

SEQ ID NO: 5239872 - DNA, 17 bp, Homo sapiens
atatggacaaatggact

SEQ ID NO: 5239873 - DNA, 20 bp, Homo sapiens
atatggacacttaatactac

SEQ ID NO: 5239874 - DNA, 17 bp, Homo sapiens
atatggacagctttatt

SEQ ID NO: 5239875 - DNA, 17 bp, Homo sapiens
atatggacctagcttga

SEQ ID NO: 5239876 - DNA, 21 bp, Homo sapiens
atatggactcagccttgcaaa

SEQ ID NO: 5239877 - DNA, 16 bp, Homo sapiens
atatggactctgcaca

SEQ ID NO: 5239878 - DNA, 19 bp, Homo sapiens
atatggacttaaatgttaa

SEQ ID NO: 5239879 - DNA, 21 bp, Homo sapiens
atatggagaattgctgaaggg

SEQ ID NO: 5239880 - DNA, 19 bp, Homo sapiens
atatggagcatttttcaga

SEQ ID NO: 5239881 - DNA, 22 bp, Homo sapiens
atatggagtgagtcacctgctc

SEQ ID NO: 5239882 - DNA, 16 bp, Homo sapiens
atatggataatctgag

SEQ ID NO: 5239883 - DNA, 14 bp, Homo sapiens
atatggatcagagg

SEQ ID NO: 5239884 - DNA, 22 bp, Homo sapiens
atatggatgttactctcttgca

SEQ ID NO: 5239885 - DNA, 23 bp, Homo sapiens
atatggatgttactctcttgcac

SEQ ID NO: 5239886 - DNA, 13 bp, Homo sapiens
atatggatttctt

SEQ ID NO: 5239887 - DNA, 16 bp, Homo sapiens
atatggatttcttaga

SEQ ID NO: 5239888 - DNA, 16 bp, Homo sapiens
atatggcaaaaatggc

SEQ ID NO: 5239889 - DNA, 13 bp, Homo sapiens
atatggcaagaaa

SEQ ID NO: 5239890 - DNA, 19 bp, Homo sapiens
atatggcaagaaagctggt

SEQ ID NO: 5239891 - DNA, 12 bp, Homo sapiens
atatggcagaag

SEQ ID NO: 5239892 - DNA, 16 bp, Homo sapiens
atatggcagagttgta

SEQ ID NO: 5239893 - DNA, 17 bp, Homo sapiens
atatggcagagttgtaa

SEQ ID NO: 5239894 - DNA, 18 bp, Homo sapiens
atatggcagagttgtaaa

SEQ ID NO: 5239895 - DNA, 20 bp, Homo sapiens
atatggcagagttgtaaata

SEQ ID NO: 5239896 - DNA, 23 bp, Homo sapiens
atatggcagagttgtaaatatat

SEQ ID NO: 5239897 - DNA, 14 bp, Homo sapiens
atatggcaggactc

SEQ ID NO: 5239898 - DNA, 23 bp, Homo sapiens
atatggccacagtagtcttgatg

SEQ ID NO: 5239899 - DNA, 19 bp, Homo sapiens
atatggcgttttgtctgtg

SEQ ID NO: 5239900 - DNA, 23 bp, Homo sapiens
atatggcgttttgtctgtgttgc

SEQ ID NO: 5239901 - DNA, 16 bp, Homo sapiens
atatggctagttttca

SEQ ID NO: 5239902 - DNA, 11 bp, Homo sapiens
atatggctgcc

SEQ ID NO: 5239903 - DNA, 15 bp, Homo sapiens
atatggcttcaagtt

SEQ ID NO: 5239904 - DNA, 19 bp, Homo sapiens
atatggcttcaccaagaag

SEQ ID NO: 5239905 - DNA, 14 bp, Homo sapiens
atatgggactgagc

SEQ ID NO: 5239906 - DNA, 19 bp, Homo sapiens
atatgggctttctctttgg

SEQ ID NO: 5239907 - DNA, 20 bp, Homo sapiens
atatggggatgcagcattat

SEQ ID NO: 5239908 - DNA, 17 bp, Homo sapiens
atatgggggcatctctt

SEQ ID NO: 5239909 - DNA, 18 bp, Homo sapiens
atatggggggccaacacc

SEQ ID NO: 5239910 - DNA, 23 bp, Homo sapiens
atatggggggccaacaccaggga

SEQ ID NO: 5239911 - DNA, 16 bp, Homo sapiens
atatgggtagtatttt

SEQ ID NO: 5239912 - DNA, 16 bp, Homo sapiens
atatgggtgctggcag

SEQ ID NO: 5239913 - DNA, 20 bp, Homo sapiens
atatgggtgggattttgcaa

SEQ ID NO: 5239914 - DNA, 13 bp, Homo sapiens
atatggtaggacc

SEQ ID NO: 5239915 - DNA, 15 bp, Homo sapiens
atatggtaggaccct

SEQ ID NO: 5239916 - DNA, 18 bp, Homo sapiens
atatggtatatatacata

SEQ ID NO: 5239917 - DNA, 13 bp, Homo sapiens
atatggtctaatg

SEQ ID NO: 5239918 - DNA, 18 bp, Homo sapiens
atatggtcttgagccagt

SEQ ID NO: 5239919 - DNA, 12 bp, Homo sapiens
atatggtgaagg

SEQ ID NO: 5239920 - DNA, 22 bp, Homo sapiens
atatggtgcagagaagctggac

SEQ ID NO: 5239921 - DNA, 19 bp, Homo sapiens
atatggtggccctggggaa

SEQ ID NO: 5239922 - DNA, 21 bp, Homo sapiens
atatggtggtaataagggaaa

SEQ ID NO: 5239923 - DNA, 18 bp, Homo sapiens
atatgtaaaacatttatt

SEQ ID NO: 5239924 - DNA, 12 bp, Homo sapiens
atatgtaaaata

SEQ ID NO: 5239925 - DNA, 15 bp, Homo sapiens
atatgtaaaataaaa

SEQ ID NO: 5239926 - DNA, 11 bp, Homo sapiens
atatgtaaact

SEQ ID NO: 5239927 - DNA, 22 bp, Homo sapiens
atatgtaaatagcttttcatca

SEQ ID NO: 5239928 - DNA, 12 bp, Homo sapiens
atatgtaaatgt

SEQ ID NO: 5239929 - DNA, 16 bp, Homo sapiens
atatgtaaatttttca

SEQ ID NO: 5239930 - DNA, 17 bp, Homo sapiens
atatgtaacaagccacc

SEQ ID NO: 5239931 - DNA, 20 bp, Homo sapiens
atatgtaacagtcaaatatc

SEQ ID NO: 5239932 - DNA, 14 bp, Homo sapiens
atatgtaacagttg

SEQ ID NO: 5239933 - DNA, 22 bp, Homo sapiens
atatgtaacagttggtgatttt

SEQ ID NO: 5239934 - DNA, 17 bp, Homo sapiens
atatgtaacagtttaaa

SEQ ID NO: 5239935 - DNA, 18 bp, Homo sapiens
atatgtaacagtttaaaa

SEQ ID NO: 5239936 - DNA, 15 bp, Homo sapiens
atatgtaacatgtct

SEQ ID NO: 5239937 - DNA, 15 bp, Homo sapiens
atatgtaacttcaga

SEQ ID NO: 5239938 - DNA, 22 bp, Homo sapiens
atatgtaacttcagatgtttcc

SEQ ID NO: 5239939 - DNA, 15 bp, Homo sapiens
atatgtaagtacttc

SEQ ID NO: 5239940 - DNA, 20 bp, Homo sapiens
atatgtaatctctaggaagt

SEQ ID NO: 5239941 - DNA, 23 bp, Homo sapiens
atatgtaatttcaaaatacattt

SEQ ID NO: 5239942 - DNA, 15 bp, Homo sapiens
atatgtacaaataat

SEQ ID NO: 5239943 - DNA, 16 bp, Homo sapiens
atatgtacagttatct

SEQ ID NO: 5239944 - DNA, 13 bp, Homo sapiens
atatgtacagttt

SEQ ID NO: 5239945 - DNA, 19 bp, Homo sapiens
atatgtacagtttattgat

SEQ ID NO: 5239946 - DNA, 22 bp, Homo sapiens
atatgtacagtttattgatatt

SEQ ID NO: 5239947 - DNA, 13 bp, Homo sapiens
atatgtacatttc

SEQ ID NO: 5239948 - DNA, 15 bp, Homo sapiens
atatgtacatttctc

SEQ ID NO: 5239949 - DNA, 18 bp, Homo sapiens
atatgtacatttctcagg

SEQ ID NO: 5239950 - DNA, 14 bp, Homo sapiens
atatgtaccatgta

SEQ ID NO: 5239951 - DNA, 21 bp, Homo sapiens
atatgtaccctctgaaataca

SEQ ID NO: 5239952 - DNA, 18 bp, Homo sapiens
atatgtactaagaatgtc

SEQ ID NO: 5239953 - DNA, 14 bp, Homo sapiens
atatgtactgtata

SEQ ID NO: 5239954 - DNA, 10 bp, Homo sapiens
atatgtactt

SEQ ID NO: 5239955 - DNA, 13 bp, Homo sapiens
atatgtacttttc

SEQ ID NO: 5239956 - DNA, 14 bp, Homo sapiens
atatgtacttttcc

SEQ ID NO: 5239957 - DNA, 19 bp, Homo sapiens
atatgtagactatatacat

SEQ ID NO: 5239958 - DNA, 20 bp, Homo sapiens
atatgtagactatatacatg

SEQ ID NO: 5239959 - DNA, 16 bp, Homo sapiens
atatgtagatgtatgc

SEQ ID NO: 5239960 - DNA, 18 bp, Homo sapiens
atatgtagatgtatgcac

SEQ ID NO: 5239961 - DNA, 17 bp, Homo sapiens
atatgtagccagacagt

SEQ ID NO: 5239962 - DNA, 18 bp, Homo sapiens
atatgtagccttcacaca

SEQ ID NO: 5239963 - DNA, 18 bp, Homo sapiens
atatgtagtataaagaaa

SEQ ID NO: 5239964 - DNA, 21 bp, Homo sapiens
atatgtagttaaatagctata

SEQ ID NO: 5239965 - DNA, 14 bp, Homo sapiens
atatgtataaatta

SEQ ID NO: 5239966 - DNA, 15 bp, Homo sapiens
atatgtataacttta

SEQ ID NO: 5239967 - DNA, 20 bp, Homo sapiens
atatgtatatatatgtatgt

SEQ ID NO: 5239968 - DNA, 17 bp, Homo sapiens
atatgtatatatattct

SEQ ID NO: 5239969 - DNA, 19 bp, Homo sapiens
atatgtatatatgtatttc

SEQ ID NO: 5239970 - DNA, 14 bp, Homo sapiens
ataataaacttctg

SEQ ID NO: 5239971 - DNA, 17 bp, Homo sapiens
ataataaacttctggtg

SEQ ID NO: 5239972 - DNA, 23 bp, Homo sapiens
ataataaagaatagctttaatga

SEQ ID NO: 5239973 - DNA, 15 bp, Homo sapiens
ataataaagatgtga

SEQ ID NO: 5239974 - DNA, 13 bp, Homo sapiens
ataataaagcaat

SEQ ID NO: 5239975 - DNA, 13 bp, Homo sapiens
ataataaaggact

SEQ ID NO: 5239976 - DNA, 17 bp, Homo sapiens
ataataaaggtcacata

SEQ ID NO: 5239977 - DNA, 20 bp, Homo sapiens
ataataaaggtcacataaac

SEQ ID NO: 5239978 - DNA, 21 bp, Homo sapiens
ataataaaggtcacataaact

SEQ ID NO: 5239979 - DNA, 23 bp, Homo sapiens
ataataaaggtcacataaacttt

SEQ ID NO: 5239980 - DNA, 17 bp, Homo sapiens
ataataaaggttctatg

SEQ ID NO: 5239981 - DNA, 18 bp, Homo sapiens
ataataaaggttctatga

SEQ ID NO: 5239982 - DNA, 19 bp, Homo sapiens
ataataaagtagcaaaaca

SEQ ID NO: 5239983 - DNA, 14 bp, Homo sapiens
ataataaagtattt

SEQ ID NO: 5239984 - DNA, 23 bp, Homo sapiens
ataataaagtgttacgttttatt

SEQ ID NO: 5239985 - DNA, 14 bp, Homo sapiens
ataataaagtgttt

SEQ ID NO: 5239986 - DNA, 15 bp, Homo sapiens
ataataaagttgttt

SEQ ID NO: 5239987 - DNA, 12 bp, Homo sapiens
ataataaatact

SEQ ID NO: 5239988 - DNA, 14 bp, Homo sapiens
ataataaatactca

SEQ ID NO: 5239989 - DNA, 12 bp, Homo sapiens
ataataaatagt

SEQ ID NO: 5239990 - DNA, 13 bp, Homo sapiens
ataataaatagtt

SEQ ID NO: 5239991 - DNA, 19 bp, Homo sapiens
ataataaatcacacattca

SEQ ID NO: 5239992 - DNA, 21 bp, Homo sapiens
ataataaatcgatccatgttt

SEQ ID NO: 5239993 - DNA, 12 bp, Homo sapiens
ataataaatgca

SEQ ID NO: 5239994 - DNA, 16 bp, Homo sapiens
ataataaatgcataga

SEQ ID NO: 5239995 - DNA, 13 bp, Homo sapiens
ataataaatggga

SEQ ID NO: 5239996 - DNA, 15 bp, Homo sapiens
ataataaatgtacat

SEQ ID NO: 5239997 - DNA, 15 bp, Homo sapiens
ataataaattaacat

SEQ ID NO: 5239998 - DNA, 17 bp, Homo sapiens
ataataaattaacatta

SEQ ID NO: 5239999 - DNA, 23 bp, Homo sapiens
ataataaattaatttttcaattt

SEQ ID NO: 5240000 - DNA, 23 bp, Homo sapiens
ataataaattccctggcctttca

SEQ ID NO: 5240001 - DNA, 18 bp, Homo sapiens
ataataaattgatttgtt

SEQ ID NO: 5240002 - DNA, 15 bp, Homo sapiens
ataataacatatata

SEQ ID NO: 5240003 - DNA, 20 bp, Homo sapiens
ataataactgaactgtttgg

SEQ ID NO: 5240004 - DNA, 17 bp, Homo sapiens
ataataactgtcttctg

SEQ ID NO: 5240005 - DNA, 17 bp, Homo sapiens
ataataactttattgca

SEQ ID NO: 5240006 - DNA, 22 bp, Homo sapiens
ataataactttattgcatatag

SEQ ID NO: 5240007 - DNA, 23 bp, Homo sapiens
ataataagagaatgttcctactc

SEQ ID NO: 5240008 - DNA, 13 bp, Homo sapiens
ataataagcaaaa

SEQ ID NO: 5240009 - DNA, 17 bp, Homo sapiens
ataataagcaggatgtt

SEQ ID NO: 5240010 - DNA, 15 bp, Homo sapiens
ataataagctaaaga

SEQ ID NO: 5240011 - DNA, 21 bp, Homo sapiens
ataataagtccatctgtcact

SEQ ID NO: 5240012 - DNA, 12 bp, Homo sapiens
ataataagtttt

SEQ ID NO: 5240013 - DNA, 16 bp, Homo sapiens
ataataagttttgata

SEQ ID NO: 5240014 - DNA, 19 bp, Homo sapiens
ataataagttttgatataa

SEQ ID NO: 5240015 - DNA, 14 bp, Homo sapiens
ataataataaagtg

SEQ ID NO: 5240016 - DNA, 14 bp, Homo sapiens
ataataatctcagt

SEQ ID NO: 5240017 - DNA, 23 bp, Homo sapiens
ataataatgactctaaagaaaca

SEQ ID NO: 5240018 - DNA, 20 bp, Homo sapiens
ataataatgcccttaatgtg

SEQ ID NO: 5240019 - DNA, 22 bp, Homo sapiens
ataataatgcccttaatgtgag

SEQ ID NO: 5240020 - DNA, 14 bp, Homo sapiens
ataataatgggttt

SEQ ID NO: 5240021 - DNA, 14 bp, Homo sapiens
ataataattagtaa

SEQ ID NO: 5240022 - DNA, 14 bp, Homo sapiens
ataataattgaaga

SEQ ID NO: 5240023 - DNA, 16 bp, Homo sapiens
ataataattgaagaat

SEQ ID NO: 5240024 - DNA, 13 bp, Homo sapiens
ataatacaaaagg

SEQ ID NO: 5240025 - DNA, 14 bp, Homo sapiens
ataatacacaaaat

SEQ ID NO: 5240026 - DNA, 22 bp, Homo sapiens
ataatacacaaaatcaaataat

SEQ ID NO: 5240027 - DNA, 12 bp, Homo sapiens
ataatacaccac

SEQ ID NO: 5240028 - DNA, 21 bp, Homo sapiens
ataatacagccaaagataatc

SEQ ID NO: 5240029 - DNA, 17 bp, Homo sapiens
ataatacatactaatga

SEQ ID NO: 5240030 - DNA, 23 bp, Homo sapiens
ataatacatctttatcattaaac

SEQ ID NO: 5240031 - DNA, 17 bp, Homo sapiens
ataataccaagactaag

SEQ ID NO: 5240032 - DNA, 21 bp, Homo sapiens
ataataccccaacagatgagc

SEQ ID NO: 5240033 - DNA, 16 bp, Homo sapiens
ataatacctcaatgtt

SEQ ID NO: 5240034 - DNA, 18 bp, Homo sapiens
ataatacctcaatgtttg

SEQ ID NO: 5240035 - DNA, 14 bp, Homo sapiens
ataatactaattta

SEQ ID NO: 5240036 - DNA, 15 bp, Homo sapiens
ataatactgaaccac

SEQ ID NO: 5240037 - DNA, 12 bp, Homo sapiens
ataatactgttt

SEQ ID NO: 5240038 - DNA, 22 bp, Homo sapiens
ataatacttaaaaatatgtgag

SEQ ID NO: 5240039 - DNA, 23 bp, Homo sapiens
ataatacttgacctctgtgacca

SEQ ID NO: 5240040 - DNA, 23 bp, Homo sapiens
ataatacttgcaactaaggacaa

SEQ ID NO: 5240041 - DNA, 19 bp, Homo sapiens
ataatacttgctttggaaa

SEQ ID NO: 5240042 - DNA, 17 bp, Homo sapiens
ataatactttaggaaat

SEQ ID NO: 5240043 - DNA, 17 bp, Homo sapiens
ataatactttgtataca

SEQ ID NO: 5240044 - DNA, 12 bp, Homo sapiens
ataatagaagaa

SEQ ID NO: 5240045 - DNA, 18 bp, Homo sapiens
ataatagaatttcctaat

SEQ ID NO: 5240046 - DNA, 12 bp, Homo sapiens
ataatagacata

SEQ ID NO: 5240047 - DNA, 17 bp, Homo sapiens
ataatagagataagtcc

SEQ ID NO: 5240048 - DNA, 14 bp, Homo sapiens
ataatagatgatgg

SEQ ID NO: 5240049 - DNA, 18 bp, Homo sapiens
ataatagattgtgaataa

SEQ ID NO: 5240050 - DNA, 21 bp, Homo sapiens
ataatagcaacttttgtgtaa

SEQ ID NO: 5240051 - DNA, 18 bp, Homo sapiens
ataatagcacatgatttg

SEQ ID NO: 5240052 - DNA, 22 bp, Homo sapiens
ataataggaacaatctttgctg

SEQ ID NO: 5240053 - DNA, 22 bp, Homo sapiens
ataataggatataaaacacatc

SEQ ID NO: 5240054 - DNA, 17 bp, Homo sapiens
ataataggtagcctgct

SEQ ID NO: 5240055 - DNA, 23 bp, Homo sapiens
ataataggtagcctgctgtgggg

SEQ ID NO: 5240056 - DNA, 16 bp, Homo sapiens
ataataggtatataga

SEQ ID NO: 5240057 - DNA, 22 bp, Homo sapiens
ataataggtatatagaacacaa

SEQ ID NO: 5240058 - DNA, 20 bp, Homo sapiens
ataatagtagatttgaacag

SEQ ID NO: 5240059 - DNA, 16 bp, Homo sapiens
ataatagtcaatttct

SEQ ID NO: 5240060 - DNA, 15 bp, Homo sapiens
ataatagttaatgaa

SEQ ID NO: 5240061 - DNA, 14 bp, Homo sapiens
ataatagtttacat

SEQ ID NO: 5240062 - DNA, 15 bp, Homo sapiens
ataatataaatgaat

SEQ ID NO: 5240063 - DNA, 18 bp, Homo sapiens
ataatataagaatcatag

SEQ ID NO: 5240064 - DNA, 14 bp, Homo sapiens
ataatataatgaat

SEQ ID NO: 5240065 - DNA, 18 bp, Homo sapiens
ataatataccaatgcttt

SEQ ID NO: 5240066 - DNA, 14 bp, Homo sapiens
ataatatacttgtg

SEQ ID NO: 5240067 - DNA, 14 bp, Homo sapiens
ataatatactttta

SEQ ID NO: 5240068 - DNA, 22 bp, Homo sapiens
ataatatacttttacattaaag

SEQ ID NO: 5240069 - DNA, 14 bp, Homo sapiens
ataatatagaaaga

SEQ ID NO: 5240070 - DNA, 18 bp, Homo sapiens
ataatatagaaagaaaat

SEQ ID NO: 5240071 - DNA, 12 bp, Homo sapiens
ataatatagctt

SEQ ID NO: 5240072 - DNA, 23 bp, Homo sapiens
ataatatataaacaataaaaaca

SEQ ID NO: 5240073 - DNA, 13 bp, Homo sapiens
ataatatatatat

SEQ ID NO: 5240074 - DNA, 14 bp, Homo sapiens
ataatatatatcta

SEQ ID NO: 5240075 - DNA, 14 bp, Homo sapiens
ataatatatattaa

SEQ ID NO: 5240076 - DNA, 13 bp, Homo sapiens
ataatatattgct

SEQ ID NO: 5240077 - DNA, 13 bp, Homo sapiens
ataatatatttct

SEQ ID NO: 5240078 - DNA, 16 bp, Homo sapiens
ataatatatttgcaga

SEQ ID NO: 5240079 - DNA, 17 bp, Homo sapiens
ataatatatttgcagat

SEQ ID NO: 5240080 - DNA, 17 bp, Homo sapiens
ataatatcaaataaaat

SEQ ID NO: 5240081 - DNA, 13 bp, Homo sapiens
ataatatcattta

SEQ ID NO: 5240082 - DNA, 16 bp, Homo sapiens
ataatatcatttataa

SEQ ID NO: 5240083 - DNA, 20 bp, Homo sapiens
ataatatccaggtcaacaga

SEQ ID NO: 5240084 - DNA, 22 bp, Homo sapiens
ataatatccaggtcaacagaat

SEQ ID NO: 5240085 - DNA, 15 bp, Homo sapiens
ataatatgagaatca

SEQ ID NO: 5240086 - DNA, 17 bp, Homo sapiens
ataatatgatgcaaact

SEQ ID NO: 5240087 - DNA, 12 bp, Homo sapiens
ataatatgcaca

SEQ ID NO: 5240088 - DNA, 20 bp, Homo sapiens
ataatatgcacacagtgctt

SEQ ID NO: 5240089 - DNA, 21 bp, Homo sapiens
ataatatgctgccaaattttg

SEQ ID NO: 5240090 - DNA, 22 bp, Homo sapiens
ataatatggctatgcttaaaag

SEQ ID NO: 5240091 - DNA, 23 bp, Homo sapiens
ataatatggctatgcttaaaagg

SEQ ID NO: 5240092 - DNA, 17 bp, Homo sapiens
ataatatgtacaaataa

SEQ ID NO: 5240093 - DNA, 18 bp, Homo sapiens
ataatatgtttccttccc

SEQ ID NO: 5240094 - DNA, 15 bp, Homo sapiens
ataatattagtgatt

SEQ ID NO: 5240095 - DNA, 21 bp, Homo sapiens
ataatattcatacaacaaaga

SEQ ID NO: 5240096 - DNA, 12 bp, Homo sapiens
ataatattcatt

SEQ ID NO: 5240097 - DNA, 15 bp, Homo sapiens
ataatattcattggt

SEQ ID NO: 5240098 - DNA, 18 bp, Homo sapiens
ataatattgaaaattgaa

SEQ ID NO: 5240099 - DNA, 21 bp, Homo sapiens
ataatattgaaaattgaaaag

SEQ ID NO: 5240100 - DNA, 15 bp, Homo sapiens
ataatattgatttct

SEQ ID NO: 5240101 - DNA, 14 bp, Homo sapiens
ataatattgccttg

SEQ ID NO: 5240102 - DNA, 18 bp, Homo sapiens
ataatattgccttgatgt

SEQ ID NO: 5240103 - DNA, 23 bp, Homo sapiens
ataatattgccttgatgtttcta

SEQ ID NO: 5240104 - DNA, 14 bp, Homo sapiens
ataatattgttgta

SEQ ID NO: 5240105 - DNA, 17 bp, Homo sapiens
ataatattgttgtataa

SEQ ID NO: 5240106 - DNA, 22 bp, Homo sapiens
ataatattgttgtataatttcg

SEQ ID NO: 5240107 - DNA, 16 bp, Homo sapiens
ataatatttactgtta

SEQ ID NO: 5240108 - DNA, 18 bp, Homo sapiens
ataatatttcaagtgcct

SEQ ID NO: 5240109 - DNA, 19 bp, Homo sapiens
ataatatttcaagtgccta

SEQ ID NO: 5240110 - DNA, 14 bp, Homo sapiens
ataatatttcagtg

SEQ ID NO: 5240111 - DNA, 19 bp, Homo sapiens
ataatatttcagtggaata

SEQ ID NO: 5240112 - DNA, 12 bp, Homo sapiens
ataatatttctt

SEQ ID NO: 5240113 - DNA, 13 bp, Homo sapiens
ataatatttctta

SEQ ID NO: 5240114 - DNA, 14 bp, Homo sapiens
ataatatttcttaa

SEQ ID NO: 5240115 - DNA, 15 bp, Homo sapiens
ataatatttcttaat

SEQ ID NO: 5240116 - DNA, 22 bp, Homo sapiens
ataatatttcttaatttggata

SEQ ID NO: 5240117 - DNA, 16 bp, Homo sapiens
ataatattttctttct

SEQ ID NO: 5240118 - DNA, 15 bp, Homo sapiens
ataatcaaaataata

SEQ ID NO: 5240119 - DNA, 17 bp, Homo sapiens
ataatcaaatacatttt

SEQ ID NO: 5240120 - DNA, 13 bp, Homo sapiens
ataatcaaatgat

SEQ ID NO: 5240121 - DNA, 21 bp, Homo sapiens
ataatcaaatgatttcatatt

SEQ ID NO: 5240122 - DNA, 12 bp, Homo sapiens
ataatcaagatt

SEQ ID NO: 5240123 - DNA, 20 bp, Homo sapiens
ataatcaattattacattta

SEQ ID NO: 5240124 - DNA, 21 bp, Homo sapiens
ataatcaattattacatttat

SEQ ID NO: 5240125 - DNA, 17 bp, Homo sapiens
ataatcacaagtaaagg

SEQ ID NO: 5240126 - DNA, 18 bp, Homo sapiens
ataatcacgctttcctga

SEQ ID NO: 5240127 - DNA, 21 bp, Homo sapiens
ataatcacttggggtttgtac

SEQ ID NO: 5240128 - DNA, 20 bp, Homo sapiens
ataatcagaaaagtaatttt

SEQ ID NO: 5240129 - DNA, 13 bp, Homo sapiens
ataatcagaacac

SEQ ID NO: 5240130 - DNA, 13 bp, Homo sapiens
ataatcagcctct

SEQ ID NO: 5240131 - DNA, 16 bp, Homo sapiens
ataatcagcctcttaa

SEQ ID NO: 5240132 - DNA, 13 bp, Homo sapiens
ataatcaggaaaa

SEQ ID NO: 5240133 - DNA, 17 bp, Homo sapiens
ataatcagggaaactaa

SEQ ID NO: 5240134 - DNA, 20 bp, Homo sapiens
ataatcagtgtgtctaaatt

SEQ ID NO: 5240135 - DNA, 15 bp, Homo sapiens
ataatcatcaggttt

SEQ ID NO: 5240136 - DNA, 18 bp, Homo sapiens
ataatcatctctgtcaca

SEQ ID NO: 5240137 - DNA, 18 bp, Homo sapiens
ataatcatgctcatgtat

SEQ ID NO: 5240138 - DNA, 17 bp, Homo sapiens
ataatcatgtaaatgct

SEQ ID NO: 5240139 - DNA, 19 bp, Homo sapiens
ataatcatgtgaaatgttt

SEQ ID NO: 5240140 - DNA, 15 bp, Homo sapiens
ataatcatgttagag

SEQ ID NO: 5240141 - DNA, 23 bp, Homo sapiens
ataatcattagttttagaggcat

SEQ ID NO: 5240142 - DNA, 21 bp, Homo sapiens
ataatcattctttcccctcag

SEQ ID NO: 5240143 - DNA, 16 bp, Homo sapiens
ataatcattttagaat

SEQ ID NO: 5240144 - DNA, 15 bp, Homo sapiens
ataatccacccccag

SEQ ID NO: 5240145 - DNA, 17 bp, Homo sapiens
ataatccagtaaaataa

SEQ ID NO: 5240146 - DNA, 17 bp, Homo sapiens
ataatccagtcttcact

SEQ ID NO: 5240147 - DNA, 20 bp, Homo sapiens
ataatccattccaaaataca

SEQ ID NO: 5240148 - DNA, 21 bp, Homo sapiens
ataatccattccaaaatacaa

SEQ ID NO: 5240149 - DNA, 13 bp, Homo sapiens
ataatcccagcta

SEQ ID NO: 5240150 - DNA, 22 bp, Homo sapiens
atatgtatatcattctacagaa

SEQ ID NO: 5240151 - DNA, 13 bp, Homo sapiens
atatgtatatcta

SEQ ID NO: 5240152 - DNA, 16 bp, Homo sapiens
atatgtatatctgtgt

SEQ ID NO: 5240153 - DNA, 14 bp, Homo sapiens
atatgtatatgtat

SEQ ID NO: 5240154 - DNA, 18 bp, Homo sapiens
atatgtatatgtatatat

SEQ ID NO: 5240155 - DNA, 20 bp, Homo sapiens
atatgtatctacaatacata

SEQ ID NO: 5240156 - DNA, 10 bp, Homo sapiens
atatgtatgc

SEQ ID NO: 5240157 - DNA, 13 bp, Homo sapiens
atatgtatgcttt

SEQ ID NO: 5240158 - DNA, 14 bp, Homo sapiens
atatgtatgctttt

SEQ ID NO: 5240159 - DNA, 12 bp, Homo sapiens
atatgtatgggt

SEQ ID NO: 5240160 - DNA, 23 bp, Homo sapiens
atatgtatgggtagggtaaatca

SEQ ID NO: 5240161 - DNA, 13 bp, Homo sapiens
atatgtatgtaaa

SEQ ID NO: 5240162 - DNA, 14 bp, Homo sapiens
atatgtatgtctaa

SEQ ID NO: 5240163 - DNA, 12 bp, Homo sapiens
atatgtatgtgt

SEQ ID NO: 5240164 - DNA, 13 bp, Homo sapiens
atatgtatgtgtg

SEQ ID NO: 5240165 - DNA, 14 bp, Homo sapiens
atatgtatgtgttt

SEQ ID NO: 5240166 - DNA, 21 bp, Homo sapiens
atatgtatgtgtttagaattg

SEQ ID NO: 5240167 - DNA, 23 bp, Homo sapiens
atatgtatgtgtttagaattgaa

SEQ ID NO: 5240168 - DNA, 15 bp, Homo sapiens
atatgtattaatact

SEQ ID NO: 5240169 - DNA, 17 bp, Homo sapiens
atatgtattacaaatgg

SEQ ID NO: 5240170 - DNA, 16 bp, Homo sapiens
atatgtattatttata

SEQ ID NO: 5240171 - DNA, 17 bp, Homo sapiens
atatgtattcccttgta

SEQ ID NO: 5240172 - DNA, 13 bp, Homo sapiens
atatgtattctaa

SEQ ID NO: 5240173 - DNA, 21 bp, Homo sapiens
atatgtattctgtaaaagaaa

SEQ ID NO: 5240174 - DNA, 20 bp, Homo sapiens
atatgtattcttttctcagt

SEQ ID NO: 5240175 - DNA, 10 bp, Homo sapiens
atatgtattt

SEQ ID NO: 5240176 - DNA, 12 bp, Homo sapiens
atatgtatttaa

SEQ ID NO: 5240177 - DNA, 17 bp, Homo sapiens
atatgtatttaaaaaca

SEQ ID NO: 5240178 - DNA, 14 bp, Homo sapiens
atatgtatttaaga

SEQ ID NO: 5240179 - DNA, 16 bp, Homo sapiens
atatgtatttaccaaa

SEQ ID NO: 5240180 - DNA, 18 bp, Homo sapiens
atatgtatttattgtcat

SEQ ID NO: 5240181 - DNA, 20 bp, Homo sapiens
atatgtatttattgtcatta

SEQ ID NO: 5240182 - DNA, 16 bp, Homo sapiens
atatgtatttgttgaa

SEQ ID NO: 5240183 - DNA, 11 bp, Homo sapiens
atatgtatttt

SEQ ID NO: 5240184 - DNA, 22 bp, Homo sapiens
atatgtattttatgtatgttta

SEQ ID NO: 5240185 - DNA, 16 bp, Homo sapiens
atatgtattttcctaa

SEQ ID NO: 5240186 - DNA, 17 bp, Homo sapiens
atatgtatttttatata

SEQ ID NO: 5240187 - DNA, 16 bp, Homo sapiens
atatgtattttttgaa

SEQ ID NO: 5240188 - DNA, 19 bp, Homo sapiens
atatgtattttttgaatct

SEQ ID NO: 5240189 - DNA, 18 bp, Homo sapiens
atatgtcaaaaatatttt

SEQ ID NO: 5240190 - DNA, 13 bp, Homo sapiens
atatgtcaaattg

SEQ ID NO: 5240191 - DNA, 14 bp, Homo sapiens
atatgtcaaattgt

SEQ ID NO: 5240192 - DNA, 22 bp, Homo sapiens
atatgtcacctggcacattcat

SEQ ID NO: 5240193 - DNA, 20 bp, Homo sapiens
atatgtcacgaacttgaaag

SEQ ID NO: 5240194 - DNA, 17 bp, Homo sapiens
atatgtcactagaatgg

SEQ ID NO: 5240195 - DNA, 21 bp, Homo sapiens
atatgtcagacatgaaaacta

SEQ ID NO: 5240196 - DNA, 18 bp, Homo sapiens
atatgtcattatttattg

SEQ ID NO: 5240197 - DNA, 16 bp, Homo sapiens
atatgtccactgttct

SEQ ID NO: 5240198 - DNA, 13 bp, Homo sapiens
atatgtcctattc

SEQ ID NO: 5240199 - DNA, 18 bp, Homo sapiens
atatgtcctattcattca

SEQ ID NO: 5240200 - DNA, 16 bp, Homo sapiens
atatgtcgtagaattc

SEQ ID NO: 5240201 - DNA, 19 bp, Homo sapiens
atatgtctagataaaagga

SEQ ID NO: 5240202 - DNA, 20 bp, Homo sapiens
atatgtctagataaaaggag

SEQ ID NO: 5240203 - DNA, 20 bp, Homo sapiens
atatgtctagggtgtgattt

SEQ ID NO: 5240204 - DNA, 15 bp, Homo sapiens
atatgtctataagta

SEQ ID NO: 5240205 - DNA, 23 bp, Homo sapiens
atatgtctataagtatataaata

SEQ ID NO: 5240206 - DNA, 18 bp, Homo sapiens
atatgtctgccacagaga

SEQ ID NO: 5240207 - DNA, 22 bp, Homo sapiens
atatgtctgcttctgtccagga

SEQ ID NO: 5240208 - DNA, 13 bp, Homo sapiens
atatgtctgtatc

SEQ ID NO: 5240209 - DNA, 22 bp, Homo sapiens
atatgtcttactactttaaatc

SEQ ID NO: 5240210 - DNA, 15 bp, Homo sapiens
atatgtcttgcaaag

SEQ ID NO: 5240211 - DNA, 14 bp, Homo sapiens
atatgtgaaaatga

SEQ ID NO: 5240212 - DNA, 15 bp, Homo sapiens
atatgtgaaacattt

SEQ ID NO: 5240213 - DNA, 18 bp, Homo sapiens
atatgtgaacgcccagag

SEQ ID NO: 5240214 - DNA, 17 bp, Homo sapiens
atatgtgaactttctca

SEQ ID NO: 5240215 - DNA, 21 bp, Homo sapiens
atatgtgaatcctcttcttta

SEQ ID NO: 5240216 - DNA, 14 bp, Homo sapiens
atatgtgagaaatc

SEQ ID NO: 5240217 - DNA, 14 bp, Homo sapiens
atatgtgagcatga

SEQ ID NO: 5240218 - DNA, 17 bp, Homo sapiens
atatgtgattatcattt

SEQ ID NO: 5240219 - DNA, 12 bp, Homo sapiens
atatgtgatttt

SEQ ID NO: 5240220 - DNA, 13 bp, Homo sapiens
atatgtgattttc

SEQ ID NO: 5240221 - DNA, 11 bp, Homo sapiens
atatgtgcagt

SEQ ID NO: 5240222 - DNA, 17 bp, Homo sapiens
atatgtgcagtcttgct

SEQ ID NO: 5240223 - DNA, 22 bp, Homo sapiens
atatgtgccaatgtgacaacat

SEQ ID NO: 5240224 - DNA, 16 bp, Homo sapiens
atatgtgccacatttt

SEQ ID NO: 5240225 - DNA, 19 bp, Homo sapiens
atatgtgctggaattctaa

SEQ ID NO: 5240226 - DNA, 24 bp, Homo sapiens
atatgtgcttctcagttgcagaaa

SEQ ID NO: 5240227 - DNA, 18 bp, Homo sapiens
atatgtgcttgcctcagt

SEQ ID NO: 5240228 - DNA, 23 bp, Homo sapiens
atatgtgcttgtgctcatgtgtg

SEQ ID NO: 5240229 - DNA, 16 bp, Homo sapiens
atatgtgcttgtgtgt

SEQ ID NO: 5240230 - DNA, 16 bp, Homo sapiens
atatgtggagttcatc

SEQ ID NO: 5240231 - DNA, 22 bp, Homo sapiens
atatgtggcattcctttcttta

SEQ ID NO: 5240232 - DNA, 16 bp, Homo sapiens
atatgtgtaaatgtta

SEQ ID NO: 5240233 - DNA, 14 bp, Homo sapiens
atatgtgtaacttt

SEQ ID NO: 5240234 - DNA, 15 bp, Homo sapiens
atatgtgtaatatca

SEQ ID NO: 5240235 - DNA, 16 bp, Homo sapiens
atatgtgtaatatcat

SEQ ID NO: 5240236 - DNA, 15 bp, Homo sapiens
atatgtgtaattttt

SEQ ID NO: 5240237 - DNA, 15 bp, Homo sapiens
atatgtgtatacata

SEQ ID NO: 5240238 - DNA, 15 bp, Homo sapiens
atatgtgtatatata

SEQ ID NO: 5240239 - DNA, 18 bp, Homo sapiens
atatgtgtatatatacat

SEQ ID NO: 5240240 - DNA, 21 bp, Homo sapiens
atatgtgtatatatacataca

SEQ ID NO: 5240241 - DNA, 18 bp, Homo sapiens
atatgtgtatctcaaatt

SEQ ID NO: 5240242 - DNA, 22 bp, Homo sapiens
atatgtgtatgcacagtaaaaa

SEQ ID NO: 5240243 - DNA, 14 bp, Homo sapiens
atatgtgtatgtac

SEQ ID NO: 5240244 - DNA, 16 bp, Homo sapiens
atatgtgtatgtacgt

SEQ ID NO: 5240245 - DNA, 23 bp, Homo sapiens
atatgtgtgtgtgtgtgttgctt

SEQ ID NO: 5240246 - DNA, 19 bp, Homo sapiens
atatgtgtgtttaaataaa

SEQ ID NO: 5240247 - DNA, 20 bp, Homo sapiens
atatgtgtgtttaaataaag

SEQ ID NO: 5240248 - DNA, 18 bp, Homo sapiens
atatgtgttacttcaagt

SEQ ID NO: 5240249 - DNA, 17 bp, Homo sapiens
atatgtgtttttcacat

SEQ ID NO: 5240250 - DNA, 22 bp, Homo sapiens
atatgtgtttttcacatttgcg

SEQ ID NO: 5240251 - DNA, 14 bp, Homo sapiens
atatgttaaagttt

SEQ ID NO: 5240252 - DNA, 23 bp, Homo sapiens
atatgttaagcagctaaattttc

SEQ ID NO: 5240253 - DNA, 18 bp, Homo sapiens
atatgttaataaactgca

SEQ ID NO: 5240254 - DNA, 17 bp, Homo sapiens
atatgttaatttgttat

SEQ ID NO: 5240255 - DNA, 23 bp, Homo sapiens
atatgttaccattaatcagaaac

SEQ ID NO: 5240256 - DNA, 22 bp, Homo sapiens
atatgttagattaggtgtaaga

SEQ ID NO: 5240257 - DNA, 15 bp, Homo sapiens
atatgttcaactgga

SEQ ID NO: 5240258 - DNA, 12 bp, Homo sapiens
atatgttcacat

SEQ ID NO: 5240259 - DNA, 16 bp, Homo sapiens
atatgttcatattgga

SEQ ID NO: 5240260 - DNA, 14 bp, Homo sapiens
atatgttcattaaa

SEQ ID NO: 5240261 - DNA, 19 bp, Homo sapiens
atatgttcattaaattttc

SEQ ID NO: 5240262 - DNA, 19 bp, Homo sapiens
atatgttccatgcctggcc

SEQ ID NO: 5240263 - DNA, 16 bp, Homo sapiens
atatgttctgacataa

SEQ ID NO: 5240264 - DNA, 13 bp, Homo sapiens
atatgttctggac

SEQ ID NO: 5240265 - DNA, 14 bp, Homo sapiens
atatgttgaatact

SEQ ID NO: 5240266 - DNA, 16 bp, Homo sapiens
atatgttgaatacttt

SEQ ID NO: 5240267 - DNA, 22 bp, Homo sapiens
atatgttgatgaaaaatagcaa

SEQ ID NO: 5240268 - DNA, 17 bp, Homo sapiens
atatgttgatgaaattc

SEQ ID NO: 5240269 - DNA, 13 bp, Homo sapiens
atatgttgctcag

SEQ ID NO: 5240270 - DNA, 12 bp, Homo sapiens
atatgttgctga

SEQ ID NO: 5240271 - DNA, 15 bp, Homo sapiens
atatgttgctgaaac

SEQ ID NO: 5240272 - DNA, 15 bp, Homo sapiens
atatgttggtttaat

SEQ ID NO: 5240273 - DNA, 16 bp, Homo sapiens
atatgttgttaaacac

SEQ ID NO: 5240274 - DNA, 21 bp, Homo sapiens
atatgtttaaaataaaatgaa

SEQ ID NO: 5240275 - DNA, 13 bp, Homo sapiens
atatgtttaatat

SEQ ID NO: 5240276 - DNA, 16 bp, Homo sapiens
atatgtttaatgttca

SEQ ID NO: 5240277 - DNA, 17 bp, Homo sapiens
atatgtttaccttttaa

SEQ ID NO: 5240278 - DNA, 20 bp, Homo sapiens
atatgtttaccttttaatta

SEQ ID NO: 5240279 - DNA, 20 bp, Homo sapiens
atatgtttagttttacattt

SEQ ID NO: 5240280 - DNA, 16 bp, Homo sapiens
atatgtttatacacac

SEQ ID NO: 5240281 - DNA, 14 bp, Homo sapiens
atatgtttatatac

SEQ ID NO: 5240282 - DNA, 20 bp, Homo sapiens
atatgtttattcaaaatatt

SEQ ID NO: 5240283 - DNA, 16 bp, Homo sapiens
atatgtttcaaacttt

SEQ ID NO: 5240284 - DNA, 14 bp, Homo sapiens
atatgtttcacaca

SEQ ID NO: 5240285 - DNA, 18 bp, Homo sapiens
atatgtttcacacaaaca

SEQ ID NO: 5240286 - DNA, 21 bp, Homo sapiens
atatgtttcacacaaacaagg

SEQ ID NO: 5240287 - DNA, 16 bp, Homo sapiens
atatgtttccttccct

SEQ ID NO: 5240288 - DNA, 17 bp, Homo sapiens
atatgtttccttccctc

SEQ ID NO: 5240289 - DNA, 14 bp, Homo sapiens
atatgtttctgcta

SEQ ID NO: 5240290 - DNA, 14 bp, Homo sapiens
atatgtttgtggaa

SEQ ID NO: 5240291 - DNA, 15 bp, Homo sapiens
atatgttttaaagtt

SEQ ID NO: 5240292 - DNA, 20 bp, Homo sapiens
atatgttttaaagttaaaac

SEQ ID NO: 5240293 - DNA, 15 bp, Homo sapiens
atatgttttataatt

SEQ ID NO: 5240294 - DNA, 20 bp, Homo sapiens
atatgttttccacataaatt

SEQ ID NO: 5240295 - DNA, 23 bp, Homo sapiens
atatgttttccacataaatttta

SEQ ID NO: 5240296 - DNA, 20 bp, Homo sapiens
atatgttttccttttattca

SEQ ID NO: 5240297 - DNA, 20 bp, Homo sapiens
atatgtttttatttaaaaga

SEQ ID NO: 5240298 - DNA, 14 bp, Homo sapiens
atatgttttttaga

SEQ ID NO: 5240299 - DNA, 15 bp, Homo sapiens
atattaaaaaaatgc

SEQ ID NO: 5240300 - DNA, 12 bp, Homo sapiens
atattaaaaaac

SEQ ID NO: 5240301 - DNA, 20 bp, Homo sapiens
atattaaaaagaagtttcta

SEQ ID NO: 5240302 - DNA, 12 bp, Homo sapiens
atattaaaaagt

SEQ ID NO: 5240303 - DNA, 15 bp, Homo sapiens
atattaaaaagtctt

SEQ ID NO: 5240304 - DNA, 16 bp, Homo sapiens
atattaaaaatataaa

SEQ ID NO: 5240305 - DNA, 21 bp, Homo sapiens
atattaaaaatataaaactgc

SEQ ID NO: 5240306 - DNA, 19 bp, Homo sapiens
atattaaaaatataaacaa

SEQ ID NO: 5240307 - DNA, 14 bp, Homo sapiens
atattaaaaattaa

SEQ ID NO: 5240308 - DNA, 16 bp, Homo sapiens
atattaaaaattaatt

SEQ ID NO: 5240309 - DNA, 17 bp, Homo sapiens
atattaaaaattaattc

SEQ ID NO: 5240310 - DNA, 19 bp, Homo sapiens
atattaaaaattaattctt

SEQ ID NO: 5240311 - DNA, 16 bp, Homo sapiens
atattaaaaattgaaa

SEQ ID NO: 5240312 - DNA, 19 bp, Homo sapiens
atattaaaacaataatgca

SEQ ID NO: 5240313 - DNA, 14 bp, Homo sapiens
atattaaaagaaag

SEQ ID NO: 5240314 - DNA, 18 bp, Homo sapiens
atattaaaagtcacaatg

SEQ ID NO: 5240315 - DNA, 14 bp, Homo sapiens
atattaaaataagc

SEQ ID NO: 5240316 - DNA, 16 bp, Homo sapiens
atattaaaatatgaag

SEQ ID NO: 5240317 - DNA, 13 bp, Homo sapiens
atattaaaatcac

SEQ ID NO: 5240318 - DNA, 16 bp, Homo sapiens
atattaaaattacaga

SEQ ID NO: 5240319 - DNA, 23 bp, Homo sapiens
atattaaaattacagatgtgaaa

SEQ ID NO: 5240320 - DNA, 15 bp, Homo sapiens
atattaaaattccaa

SEQ ID NO: 5240321 - DNA, 19 bp, Homo sapiens
atattaaaatttggtgctt

SEQ ID NO: 5240322 - DNA, 21 bp, Homo sapiens
atattaaaatttggtgcttat

SEQ ID NO: 5240323 - DNA, 12 bp, Homo sapiens
atattaaacaaa

SEQ ID NO: 5240324 - DNA, 22 bp, Homo sapiens
atattaaacaaaaacaaagaaa

SEQ ID NO: 5240325 - DNA, 22 bp, Homo sapiens
atattaaacaaagtttcagagt

SEQ ID NO: 5240326 - DNA, 23 bp, Homo sapiens
atattaaacatacataatacaat

SEQ ID NO: 5240327 - DNA, 15 bp, Homo sapiens
atattaaacctttca

SEQ ID NO: 5240328 - DNA, 17 bp, Homo sapiens
atattaaacgtgtaaat

SEQ ID NO: 5240329 - DNA, 16 bp, Homo sapiens
atattaaagaaaaact

SEQ ID NO: 5240330 - DNA, 20 bp, Homo sapiens
atattaaagaaaaactttaa

SEQ ID NO: 5240331 - DNA, 16 bp, Homo sapiens
ataatcctagagtctt

SEQ ID NO: 5240332 - DNA, 18 bp, Homo sapiens
ataatcctgcaaagtaca

SEQ ID NO: 5240333 - DNA, 16 bp, Homo sapiens
ataatccttaaatctt

SEQ ID NO: 5240334 - DNA, 19 bp, Homo sapiens
ataatccttgataatatat

SEQ ID NO: 5240335 - DNA, 18 bp, Homo sapiens
ataatcgctcttttccac

SEQ ID NO: 5240336 - DNA, 21 bp, Homo sapiens
ataatcgctcttttccactcc

SEQ ID NO: 5240337 - DNA, 15 bp, Homo sapiens
ataatctatatgctg

SEQ ID NO: 5240338 - DNA, 15 bp, Homo sapiens
ataatctatattaaa

SEQ ID NO: 5240339 - DNA, 20 bp, Homo sapiens
ataatctatattaaatgagg

SEQ ID NO: 5240340 - DNA, 15 bp, Homo sapiens
ataatctatgatgaa

SEQ ID NO: 5240341 - DNA, 17 bp, Homo sapiens
ataatctatttctatga

SEQ ID NO: 5240342 - DNA, 21 bp, Homo sapiens
ataatctatttctatgagaaa

SEQ ID NO: 5240343 - DNA, 21 bp, Homo sapiens
ataatctcaaaggagaaaaaa

SEQ ID NO: 5240344 - DNA, 15 bp, Homo sapiens
ataatctcatgctgt

SEQ ID NO: 5240345 - DNA, 17 bp, Homo sapiens
ataatctccatttcaaa

SEQ ID NO: 5240346 - DNA, 15 bp, Homo sapiens
ataatctcctctgct

SEQ ID NO: 5240347 - DNA, 18 bp, Homo sapiens
ataatctctccattcccg

SEQ ID NO: 5240348 - DNA, 16 bp, Homo sapiens
ataatctcttcttata

SEQ ID NO: 5240349 - DNA, 15 bp, Homo sapiens
ataatctctttccat

SEQ ID NO: 5240350 - DNA, 16 bp, Homo sapiens
ataatctgaaaacatc

SEQ ID NO: 5240351 - DNA, 15 bp, Homo sapiens
ataatctgaaatgac

SEQ ID NO: 5240352 - DNA, 23 bp, Homo sapiens
ataatctgatgggcctggctggg

SEQ ID NO: 5240353 - DNA, 19 bp, Homo sapiens
ataatctggactcctctgt

SEQ ID NO: 5240354 - DNA, 22 bp, Homo sapiens
ataatctggactcctctgtcca

SEQ ID NO: 5240355 - DNA, 19 bp, Homo sapiens
ataatctggtgacaaatat

SEQ ID NO: 5240356 - DNA, 17 bp, Homo sapiens
ataatctgtacaatgaa

SEQ ID NO: 5240357 - DNA, 12 bp, Homo sapiens
ataatctgtcaa

SEQ ID NO: 5240358 - DNA, 20 bp, Homo sapiens
ataatctgtttttacgtatg

SEQ ID NO: 5240359 - DNA, 18 bp, Homo sapiens
ataatcttaaattttgac

SEQ ID NO: 5240360 - DNA, 12 bp, Homo sapiens
ataatcttcagg

SEQ ID NO: 5240361 - DNA, 14 bp, Homo sapiens
ataatcttctgcct

SEQ ID NO: 5240362 - DNA, 15 bp, Homo sapiens
ataatcttctgcctt

SEQ ID NO: 5240363 - DNA, 18 bp, Homo sapiens
ataatcttggcttcttaa

SEQ ID NO: 5240364 - DNA, 21 bp, Homo sapiens
ataatcttggcttcttaaaaa

SEQ ID NO: 5240365 - DNA, 20 bp, Homo sapiens
ataatcttgtttctgaaaag

SEQ ID NO: 5240366 - DNA, 14 bp, Homo sapiens
ataatctttcacag

SEQ ID NO: 5240367 - DNA, 21 bp, Homo sapiens
ataatctttcacaggggacag

SEQ ID NO: 5240368 - DNA, 14 bp, Homo sapiens
ataatcttttacat

SEQ ID NO: 5240369 - DNA, 22 bp, Homo sapiens
ataatgaaaataaaacacacct

SEQ ID NO: 5240370 - DNA, 15 bp, Homo sapiens
ataatgaaatctgtt

SEQ ID NO: 5240371 - DNA, 13 bp, Homo sapiens
ataatgaacaatt

SEQ ID NO: 5240372 - DNA, 13 bp, Homo sapiens
ataatgaacagaa

SEQ ID NO: 5240373 - DNA, 19 bp, Homo sapiens
ataatgaacagaatttatg

SEQ ID NO: 5240374 - DNA, 20 bp, Homo sapiens
ataatgaacagaatttatga

SEQ ID NO: 5240375 - DNA, 22 bp, Homo sapiens
ataatgaacagaatttatgact

SEQ ID NO: 5240376 - DNA, 14 bp, Homo sapiens
ataatgaacagcag

SEQ ID NO: 5240377 - DNA, 23 bp, Homo sapiens
ataatgaaccgtttacagtgtat

SEQ ID NO: 5240378 - DNA, 16 bp, Homo sapiens
ataatgaagaacactg

SEQ ID NO: 5240379 - DNA, 12 bp, Homo sapiens
ataatgaagccc

SEQ ID NO: 5240380 - DNA, 13 bp, Homo sapiens
ataatgaataaat

SEQ ID NO: 5240381 - DNA, 21 bp, Homo sapiens
ataatgacactgtttcctgat

SEQ ID NO: 5240382 - DNA, 21 bp, Homo sapiens
ataatgacgtattgtgaaatt

SEQ ID NO: 5240383 - DNA, 13 bp, Homo sapiens
ataatgactctaa

SEQ ID NO: 5240384 - DNA, 14 bp, Homo sapiens
ataatgacttttaa

SEQ ID NO: 5240385 - DNA, 19 bp, Homo sapiens
ataatgagagcaaatgcaa

SEQ ID NO: 5240386 - DNA, 19 bp, Homo sapiens
ataatgagctattaaaact

SEQ ID NO: 5240387 - DNA, 21 bp, Homo sapiens
ataatgagctattaaaactca

SEQ ID NO: 5240388 - DNA, 22 bp, Homo sapiens
ataatgaggatgattattttca

SEQ ID NO: 5240389 - DNA, 20 bp, Homo sapiens
ataatgagtctgcataaact

SEQ ID NO: 5240390 - DNA, 18 bp, Homo sapiens
ataatgagttttacatta

SEQ ID NO: 5240391 - DNA, 14 bp, Homo sapiens
ataatgatacttaa

SEQ ID NO: 5240392 - DNA, 15 bp, Homo sapiens
ataatgatagtgttt

SEQ ID NO: 5240393 - DNA, 15 bp, Homo sapiens
ataatgatcaaagtt

SEQ ID NO: 5240394 - DNA, 18 bp, Homo sapiens
ataatgatttcctctgaa

SEQ ID NO: 5240395 - DNA, 14 bp, Homo sapiens
ataatgcaaagaat

SEQ ID NO: 5240396 - DNA, 15 bp, Homo sapiens
ataatgcaattagat

SEQ ID NO: 5240397 - DNA, 17 bp, Homo sapiens
ataatgcagaagtattc

SEQ ID NO: 5240398 - DNA, 15 bp, Homo sapiens
ataatgcagataaat

SEQ ID NO: 5240399 - DNA, 15 bp, Homo sapiens
ataatgcagtatggt

SEQ ID NO: 5240400 - DNA, 15 bp, Homo sapiens
ataatgcatgaagca

SEQ ID NO: 5240401 - DNA, 16 bp, Homo sapiens
ataatgcatgaagcaa

SEQ ID NO: 5240402 - DNA, 20 bp, Homo sapiens
ataatgccattttaaggaaa

SEQ ID NO: 5240403 - DNA, 17 bp, Homo sapiens
ataatgccggtgagaat

SEQ ID NO: 5240404 - DNA, 15 bp, Homo sapiens
ataatgccttgtatg

SEQ ID NO: 5240405 - DNA, 15 bp, Homo sapiens
ataatgcctttgtaa

SEQ ID NO: 5240406 - DNA, 15 bp, Homo sapiens
ataatgcgtgcatac

SEQ ID NO: 5240407 - DNA, 20 bp, Homo sapiens
ataatgctattttaaaaaat

SEQ ID NO: 5240408 - DNA, 18 bp, Homo sapiens
ataatgctgttgcctcat

SEQ ID NO: 5240409 - DNA, 22 bp, Homo sapiens
ataatgcttaacataaacttgt

SEQ ID NO: 5240410 - DNA, 15 bp, Homo sapiens
ataatgcttaatttc

SEQ ID NO: 5240411 - DNA, 14 bp, Homo sapiens
ataatgcttcagat

SEQ ID NO: 5240412 - DNA, 20 bp, Homo sapiens
ataatgcttggaatgggaga

SEQ ID NO: 5240413 - DNA, 16 bp, Homo sapiens
ataatgctttggaaaa

SEQ ID NO: 5240414 - DNA, 15 bp, Homo sapiens
ataatgcttttacta

SEQ ID NO: 5240415 - DNA, 21 bp, Homo sapiens
ataatggaaaaaaaaaaaaga

SEQ ID NO: 5240416 - DNA, 22 bp, Homo sapiens
ataatggaaaaaaaaaaaagag

SEQ ID NO: 5240417 - DNA, 18 bp, Homo sapiens
ataatggaaaaaaagact

SEQ ID NO: 5240418 - DNA, 12 bp, Homo sapiens
ataatggaaaca

SEQ ID NO: 5240419 - DNA, 18 bp, Homo sapiens
ataatggaagagaaatct

SEQ ID NO: 5240420 - DNA, 20 bp, Homo sapiens
ataatggaagagaaatctca

SEQ ID NO: 5240421 - DNA, 21 bp, Homo sapiens
ataatggaagagaaatctcat

SEQ ID NO: 5240422 - DNA, 20 bp, Homo sapiens
ataatggacagattaatatt

SEQ ID NO: 5240423 - DNA, 20 bp, Homo sapiens
ataatggactcagctctgtc

SEQ ID NO: 5240424 - DNA, 21 bp, Homo sapiens
ataatggactcagctctgtct

SEQ ID NO: 5240425 - DNA, 16 bp, Homo sapiens
ataatggagaacaagt

SEQ ID NO: 5240426 - DNA, 16 bp, Homo sapiens
ataatggcctcttaaa

SEQ ID NO: 5240427 - DNA, 19 bp, Homo sapiens
ataatggcctcttaaaaat

SEQ ID NO: 5240428 - DNA, 22 bp, Homo sapiens
ataatggcctggtaggtctgga

SEQ ID NO: 5240429 - DNA, 18 bp, Homo sapiens
ataatgggattagaaaca

SEQ ID NO: 5240430 - DNA, 23 bp, Homo sapiens
ataatgggccactgaaatctgtc

SEQ ID NO: 5240431 - DNA, 22 bp, Homo sapiens
ataatgggctgcaaaatgaaga

SEQ ID NO: 5240432 - DNA, 14 bp, Homo sapiens
ataatggtaattta

SEQ ID NO: 5240433 - DNA, 17 bp, Homo sapiens
ataatggtgaacatttt

SEQ ID NO: 5240434 - DNA, 18 bp, Homo sapiens
ataatggtgaatgttcaa

SEQ ID NO: 5240435 - DNA, 21 bp, Homo sapiens
ataatggtgttactaaagtca

SEQ ID NO: 5240436 - DNA, 14 bp, Homo sapiens
ataatggttgactg

SEQ ID NO: 5240437 - DNA, 12 bp, Homo sapiens
ataatggttgga

SEQ ID NO: 5240438 - DNA, 14 bp, Homo sapiens
ataatggttgtgaa

SEQ ID NO: 5240439 - DNA, 19 bp, Homo sapiens
ataatggttgtgaaatgta

SEQ ID NO: 5240440 - DNA, 20 bp, Homo sapiens
ataatggttgtgaaatgtaa

SEQ ID NO: 5240441 - DNA, 17 bp, Homo sapiens
ataatggtttactgctg

SEQ ID NO: 5240442 - DNA, 18 bp, Homo sapiens
ataatggtttactgctgt

SEQ ID NO: 5240443 - DNA, 23 bp, Homo sapiens
ataatgtaatcggcttgaatttt

SEQ ID NO: 5240444 - DNA, 22 bp, Homo sapiens
ataatgtaatgtttttatttca

SEQ ID NO: 5240445 - DNA, 15 bp, Homo sapiens
ataatgtaatttagt

SEQ ID NO: 5240446 - DNA, 22 bp, Homo sapiens
ataatgtacagaggaagctgtt

SEQ ID NO: 5240447 - DNA, 11 bp, Homo sapiens
ataatgtacct

SEQ ID NO: 5240448 - DNA, 15 bp, Homo sapiens
ataatgtactcacat

SEQ ID NO: 5240449 - DNA, 16 bp, Homo sapiens
ataatgtactcacata

SEQ ID NO: 5240450 - DNA, 20 bp, Homo sapiens
ataatgtactgatttcagta

SEQ ID NO: 5240451 - DNA, 15 bp, Homo sapiens
ataatgtagcagctc

SEQ ID NO: 5240452 - DNA, 16 bp, Homo sapiens
ataatgtagttttgtg

SEQ ID NO: 5240453 - DNA, 18 bp, Homo sapiens
ataatgtagttttgttta

SEQ ID NO: 5240454 - DNA, 18 bp, Homo sapiens
ataatgtatgaattttgt

SEQ ID NO: 5240455 - DNA, 15 bp, Homo sapiens
ataatgtattcatat

SEQ ID NO: 5240456 - DNA, 23 bp, Homo sapiens
ataatgtattcatatttgtactt

SEQ ID NO: 5240457 - DNA, 13 bp, Homo sapiens
ataatgtatttga

SEQ ID NO: 5240458 - DNA, 14 bp, Homo sapiens
ataatgtatttgaa

SEQ ID NO: 5240459 - DNA, 15 bp, Homo sapiens
ataatgtatttgaaa

SEQ ID NO: 5240460 - DNA, 17 bp, Homo sapiens
ataatgtattttcagct

SEQ ID NO: 5240461 - DNA, 19 bp, Homo sapiens
ataatgtcagcttatccta

SEQ ID NO: 5240462 - DNA, 18 bp, Homo sapiens
ataatgtcattaatatat

SEQ ID NO: 5240463 - DNA, 16 bp, Homo sapiens
ataatgtccaaatact

SEQ ID NO: 5240464 - DNA, 12 bp, Homo sapiens
ataatgtccaga

SEQ ID NO: 5240465 - DNA, 15 bp, Homo sapiens
ataatgtcctttccc

SEQ ID NO: 5240466 - DNA, 21 bp, Homo sapiens
ataatgtcctttccctggagt

SEQ ID NO: 5240467 - DNA, 22 bp, Homo sapiens
ataatgtctagattttgaaaaa

SEQ ID NO: 5240468 - DNA, 11 bp, Homo sapiens
ataatgtctct

SEQ ID NO: 5240469 - DNA, 17 bp, Homo sapiens
ataatgtcttgttaata

SEQ ID NO: 5240470 - DNA, 18 bp, Homo sapiens
ataatgtgaaactggatt

SEQ ID NO: 5240471 - DNA, 12 bp, Homo sapiens
ataatgtgaagt

SEQ ID NO: 5240472 - DNA, 12 bp, Homo sapiens
ataatgtgaatg

SEQ ID NO: 5240473 - DNA, 19 bp, Homo sapiens
ataatgtgcaaattttgca

SEQ ID NO: 5240474 - DNA, 23 bp, Homo sapiens
ataatgtgcaaattttgcattta

SEQ ID NO: 5240475 - DNA, 13 bp, Homo sapiens
ataatgtgcccaa

SEQ ID NO: 5240476 - DNA, 13 bp, Homo sapiens
ataatgtgcttta

SEQ ID NO: 5240477 - DNA, 21 bp, Homo sapiens
ataatgtgctttatttgcaaa

SEQ ID NO: 5240478 - DNA, 18 bp, Homo sapiens
ataatgtggattaaaacc

SEQ ID NO: 5240479 - DNA, 19 bp, Homo sapiens
ataatgtggattaaaacct

SEQ ID NO: 5240480 - DNA, 20 bp, Homo sapiens
ataatgtgtagttcatgtaa

SEQ ID NO: 5240481 - DNA, 23 bp, Homo sapiens
ataatgtgtagttcatgtaaata

SEQ ID NO: 5240482 - DNA, 22 bp, Homo sapiens
ataatgtgtctgtgttgcttca

SEQ ID NO: 5240483 - DNA, 23 bp, Homo sapiens
ataatgtgtctgtgttgcttcaa

SEQ ID NO: 5240484 - DNA, 13 bp, Homo sapiens
ataatgtgtgtat

SEQ ID NO: 5240485 - DNA, 16 bp, Homo sapiens
ataatgtgtgtatgtg

SEQ ID NO: 5240486 - DNA, 18 bp, Homo sapiens
ataatgtgtgtatgtgta

SEQ ID NO: 5240487 - DNA, 19 bp, Homo sapiens
ataatgtgtgtatgtgtat

SEQ ID NO: 5240488 - DNA, 12 bp, Homo sapiens
ataatgtgttaa

SEQ ID NO: 5240489 - DNA, 23 bp, Homo sapiens
ataatgttaaatttgtaagtttc

SEQ ID NO: 5240490 - DNA, 20 bp, Homo sapiens
ataatgttaaccaaggaaat

SEQ ID NO: 5240491 - DNA, 19 bp, Homo sapiens
ataatgttatcggctctat

SEQ ID NO: 5240492 - DNA, 13 bp, Homo sapiens
ataatgttcacta

SEQ ID NO: 5240493 - DNA, 18 bp, Homo sapiens
ataatgttcattttgaaa

SEQ ID NO: 5240494 - DNA, 19 bp, Homo sapiens
ataatgttcattttgaaaa

SEQ ID NO: 5240495 - DNA, 22 bp, Homo sapiens
ataatgttcattttgaaaatat

SEQ ID NO: 5240496 - DNA, 12 bp, Homo sapiens
ataatgttcctt

SEQ ID NO: 5240497 - DNA, 15 bp, Homo sapiens
ataatgttccttagt

SEQ ID NO: 5240498 - DNA, 17 bp, Homo sapiens
ataatgttccttagtgg

SEQ ID NO: 5240499 - DNA, 19 bp, Homo sapiens
ataatgttccttagtggta

SEQ ID NO: 5240500 - DNA, 21 bp, Homo sapiens
ataatgttggtgtggagtttt

SEQ ID NO: 5240501 - DNA, 22 bp, Homo sapiens
ataatgttggtgtggagttttc

SEQ ID NO: 5240502 - DNA, 20 bp, Homo sapiens
ataatgttgtatttaatttt

SEQ ID NO: 5240503 - DNA, 18 bp, Homo sapiens
ataatgttgtggtttgtt

SEQ ID NO: 5240504 - DNA, 12 bp, Homo sapiens
ataatgtttaaa

SEQ ID NO: 5240505 - DNA, 18 bp, Homo sapiens
ataatgtttaaatcatgt

SEQ ID NO: 5240506 - DNA, 19 bp, Homo sapiens
ataatgtttaatattgaga

SEQ ID NO: 5240507 - DNA, 22 bp, Homo sapiens
ataatgtttaatattgagaaag

SEQ ID NO: 5240508 - DNA, 19 bp, Homo sapiens
ataatgtttattaaatgct

SEQ ID NO: 5240509 - DNA, 13 bp, Homo sapiens
atattaaagattt

SEQ ID NO: 5240510 - DNA, 21 bp, Homo sapiens
atattaaagatttatttagct

SEQ ID NO: 5240511 - DNA, 22 bp, Homo sapiens
atattaaagatttatttagcta

SEQ ID NO: 5240512 - DNA, 14 bp, Homo sapiens
atattaaagatttc

SEQ ID NO: 5240513 - DNA, 14 bp, Homo sapiens
atattaaaggagtt

SEQ ID NO: 5240514 - DNA, 14 bp, Homo sapiens
atattaaaggcttt

SEQ ID NO: 5240515 - DNA, 16 bp, Homo sapiens
atattaaaggtataca

SEQ ID NO: 5240516 - DNA, 21 bp, Homo sapiens
atattaaaggtgaaaattgta

SEQ ID NO: 5240517 - DNA, 18 bp, Homo sapiens
atattaaataaatgtgca

SEQ ID NO: 5240518 - DNA, 21 bp, Homo sapiens
atattaaataacatgtttctc

SEQ ID NO: 5240519 - DNA, 13 bp, Homo sapiens
atattaaatacag

SEQ ID NO: 5240520 - DNA, 20 bp, Homo sapiens
atattaaatacagacactaa

SEQ ID NO: 5240521 - DNA, 13 bp, Homo sapiens
atattaaatatta

SEQ ID NO: 5240522 - DNA, 19 bp, Homo sapiens
atattaaatgactttttga

SEQ ID NO: 5240523 - DNA, 22 bp, Homo sapiens
atattaaatgactttttgaatg

SEQ ID NO: 5240524 - DNA, 20 bp, Homo sapiens
atattaaattctcaaagttt

SEQ ID NO: 5240525 - DNA, 21 bp, Homo sapiens
atattaaattctcaaagtttt

SEQ ID NO: 5240526 - DNA, 19 bp, Homo sapiens
atattaacaaattgcattt

SEQ ID NO: 5240527 - DNA, 22 bp, Homo sapiens
atattaacaaattgcatttgtg

SEQ ID NO: 5240528 - DNA, 15 bp, Homo sapiens
atattaacatcatct

SEQ ID NO: 5240529 - DNA, 17 bp, Homo sapiens
atattaacatcatctta

SEQ ID NO: 5240530 - DNA, 18 bp, Homo sapiens
atattaaccagatatata

SEQ ID NO: 5240531 - DNA, 17 bp, Homo sapiens
atattaactacagaaaa

SEQ ID NO: 5240532 - DNA, 22 bp, Homo sapiens
atattaactactgtagaactga

SEQ ID NO: 5240533 - DNA, 21 bp, Homo sapiens
atattaactgacgaagaagca

SEQ ID NO: 5240534 - DNA, 16 bp, Homo sapiens
atattaacttttaatg

SEQ ID NO: 5240535 - DNA, 18 bp, Homo sapiens
atattaacttttaatggt

SEQ ID NO: 5240536 - DNA, 12 bp, Homo sapiens
atattaagaaaa

SEQ ID NO: 5240537 - DNA, 16 bp, Homo sapiens
atattaagaaaatatt

SEQ ID NO: 5240538 - DNA, 18 bp, Homo sapiens
atattaagaaacaattta

SEQ ID NO: 5240539 - DNA, 16 bp, Homo sapiens
atattaagaaagacta

SEQ ID NO: 5240540 - DNA, 17 bp, Homo sapiens
atattaagaatgatctg

SEQ ID NO: 5240541 - DNA, 18 bp, Homo sapiens
atattaagacagtgtaca

SEQ ID NO: 5240542 - DNA, 20 bp, Homo sapiens
atattaagagctattttaga

SEQ ID NO: 5240543 - DNA, 13 bp, Homo sapiens
atattaagcacat

SEQ ID NO: 5240544 - DNA, 15 bp, Homo sapiens
atattaagcacttta

SEQ ID NO: 5240545 - DNA, 20 bp, Homo sapiens
atattaagcactttaagctc

SEQ ID NO: 5240546 - DNA, 23 bp, Homo sapiens
atattaagcatgacagaaaatat

SEQ ID NO: 5240547 - DNA, 17 bp, Homo sapiens
atattaaggtagttatt

SEQ ID NO: 5240548 - DNA, 19 bp, Homo sapiens
atattaagtaatttcccca

SEQ ID NO: 5240549 - DNA, 23 bp, Homo sapiens
atattaagtaatttccccactct

SEQ ID NO: 5240550 - DNA, 22 bp, Homo sapiens
atattaagtgtgccaaatcagt

SEQ ID NO: 5240551 - DNA, 15 bp, Homo sapiens
atattaagtgttgta

SEQ ID NO: 5240552 - DNA, 13 bp, Homo sapiens
atattaataagaa

SEQ ID NO: 5240553 - DNA, 14 bp, Homo sapiens
atattaatacagat

SEQ ID NO: 5240554 - DNA, 14 bp, Homo sapiens
atattaatatgtac

SEQ ID NO: 5240555 - DNA, 18 bp, Homo sapiens
atattaatatgtactttt

SEQ ID NO: 5240556 - DNA, 12 bp, Homo sapiens
atattaatcaaa

SEQ ID NO: 5240557 - DNA, 14 bp, Homo sapiens
atattaatcccagc

SEQ ID NO: 5240558 - DNA, 20 bp, Homo sapiens
atattaatgcgatttcttcc

SEQ ID NO: 5240559 - DNA, 18 bp, Homo sapiens
atattaatgtacttgttt

SEQ ID NO: 5240560 - DNA, 21 bp, Homo sapiens
atattaattataataaaggtc

SEQ ID NO: 5240561 - DNA, 14 bp, Homo sapiens
atattaattttcca

SEQ ID NO: 5240562 - DNA, 15 bp, Homo sapiens
atattaattttctac

SEQ ID NO: 5240563 - DNA, 21 bp, Homo sapiens
atattaattttctacaaataa

SEQ ID NO: 5240564 - DNA, 18 bp, Homo sapiens
atattacaacatttatgt

SEQ ID NO: 5240565 - DNA, 20 bp, Homo sapiens
atattacaacatttatgtga

SEQ ID NO: 5240566 - DNA, 21 bp, Homo sapiens
atattacaataccgttaagat

SEQ ID NO: 5240567 - DNA, 20 bp, Homo sapiens
atattacacaaatacttatt

SEQ ID NO: 5240568 - DNA, 22 bp, Homo sapiens
atattacacaaatacttattca

SEQ ID NO: 5240569 - DNA, 22 bp, Homo sapiens
atattacacaggaggcttcgga

SEQ ID NO: 5240570 - DNA, 15 bp, Homo sapiens
atattacacatttgt

SEQ ID NO: 5240571 - DNA, 16 bp, Homo sapiens
atattacacatttgta

SEQ ID NO: 5240572 - DNA, 14 bp, Homo sapiens
atattacattgcat

SEQ ID NO: 5240573 - DNA, 23 bp, Homo sapiens
atattacattgcattcaaaatct

SEQ ID NO: 5240574 - DNA, 12 bp, Homo sapiens
atattacattta

SEQ ID NO: 5240575 - DNA, 12 bp, Homo sapiens
atattaccaaaa

SEQ ID NO: 5240576 - DNA, 22 bp, Homo sapiens
atattaccacagacatactaac

SEQ ID NO: 5240577 - DNA, 14 bp, Homo sapiens
atattaccagaaaa

SEQ ID NO: 5240578 - DNA, 19 bp, Homo sapiens
atattaccagaaaatgagt

SEQ ID NO: 5240579 - DNA, 15 bp, Homo sapiens
atattaccagcaaga

SEQ ID NO: 5240580 - DNA, 22 bp, Homo sapiens
atattaccatcttaatctttat

SEQ ID NO: 5240581 - DNA, 23 bp, Homo sapiens
atattaccatcttaatctttatt

SEQ ID NO: 5240582 - DNA, 21 bp, Homo sapiens
atattaccccttcatgtccta

SEQ ID NO: 5240583 - DNA, 15 bp, Homo sapiens
atattacctggatta

SEQ ID NO: 5240584 - DNA, 23 bp, Homo sapiens
atattaccttaagatttttcttt

SEQ ID NO: 5240585 - DNA, 21 bp, Homo sapiens
atattactcctatttttgtaa

SEQ ID NO: 5240586 - DNA, 13 bp, Homo sapiens
atattactctatg

SEQ ID NO: 5240587 - DNA, 23 bp, Homo sapiens
atattactctcaaaatctttgta

SEQ ID NO: 5240588 - DNA, 17 bp, Homo sapiens
atattactctgcctgtc

SEQ ID NO: 5240589 - DNA, 13 bp, Homo sapiens
atattactgattt

SEQ ID NO: 5240590 - DNA, 16 bp, Homo sapiens
atattactgatttaga

SEQ ID NO: 5240591 - DNA, 21 bp, Homo sapiens
atattactgatttagaagcaa

SEQ ID NO: 5240592 - DNA, 17 bp, Homo sapiens
atattactgtacatggg

SEQ ID NO: 5240593 - DNA, 20 bp, Homo sapiens
atattactgtctttattctt

SEQ ID NO: 5240594 - DNA, 19 bp, Homo sapiens
atattactgtcttttctat

SEQ ID NO: 5240595 - DNA, 21 bp, Homo sapiens
atattactgtcttttctatta

SEQ ID NO: 5240596 - DNA, 22 bp, Homo sapiens
atattactgtcttttctattaa

SEQ ID NO: 5240597 - DNA, 21 bp, Homo sapiens
atattactgttgcatttactt

SEQ ID NO: 5240598 - DNA, 17 bp, Homo sapiens
atattactttgtctttt

SEQ ID NO: 5240599 - DNA, 13 bp, Homo sapiens
atattacttttgt

SEQ ID NO: 5240600 - DNA, 18 bp, Homo sapiens
atattacttttgtaaata

SEQ ID NO: 5240601 - DNA, 20 bp, Homo sapiens
atattacttttgtaaatatt

SEQ ID NO: 5240602 - DNA, 22 bp, Homo sapiens
atattacttttgtaaatattct

SEQ ID NO: 5240603 - DNA, 23 bp, Homo sapiens
atattacttttgtaaatattctt

SEQ ID NO: 5240604 - DNA, 20 bp, Homo sapiens
atattagaaaactttgttag

SEQ ID NO: 5240605 - DNA, 15 bp, Homo sapiens
atattagacatcaat

SEQ ID NO: 5240606 - DNA, 21 bp, Homo sapiens
atattagacttctgttttcaa

SEQ ID NO: 5240607 - DNA, 22 bp, Homo sapiens
atattagacttctgttttcaat

SEQ ID NO: 5240608 - DNA, 16 bp, Homo sapiens
atattagagtgccctt

SEQ ID NO: 5240609 - DNA, 17 bp, Homo sapiens
atattagagtgccctta

SEQ ID NO: 5240610 - DNA, 23 bp, Homo sapiens
atattagagtgcccttaaaataa

SEQ ID NO: 5240611 - DNA, 21 bp, Homo sapiens
atattagatgctctgagaaat

SEQ ID NO: 5240612 - DNA, 23 bp, Homo sapiens
atattagatgctctgagaaattg

SEQ ID NO: 5240613 - DNA, 15 bp, Homo sapiens
atattagcatttagt

SEQ ID NO: 5240614 - DNA, 21 bp, Homo sapiens
atattaggatctgcaaacaat

SEQ ID NO: 5240615 - DNA, 19 bp, Homo sapiens
atattaggccagttgaagt

SEQ ID NO: 5240616 - DNA, 22 bp, Homo sapiens
atattagggactgtggtataat

SEQ ID NO: 5240617 - DNA, 15 bp, Homo sapiens
atattagtatgtatg

SEQ ID NO: 5240618 - DNA, 15 bp, Homo sapiens
atattagtgattctg

SEQ ID NO: 5240619 - DNA, 18 bp, Homo sapiens
atattagtgattctgatt

SEQ ID NO: 5240620 - DNA, 13 bp, Homo sapiens
atattagttgctt

SEQ ID NO: 5240621 - DNA, 18 bp, Homo sapiens
atattagttgctttgtta

SEQ ID NO: 5240622 - DNA, 19 bp, Homo sapiens
atattataaaggataaaga

SEQ ID NO: 5240623 - DNA, 20 bp, Homo sapiens
atattataaataaatgccaa

SEQ ID NO: 5240624 - DNA, 11 bp, Homo sapiens
atattataagt

SEQ ID NO: 5240625 - DNA, 16 bp, Homo sapiens
atattataagttgacc

SEQ ID NO: 5240626 - DNA, 22 bp, Homo sapiens
atattataataatgttctctgg

SEQ ID NO: 5240627 - DNA, 17 bp, Homo sapiens
atattataattggaagt

SEQ ID NO: 5240628 - DNA, 20 bp, Homo sapiens
atattatacaggaaagcaat

SEQ ID NO: 5240629 - DNA, 22 bp, Homo sapiens
atattataccagatgaacattt

SEQ ID NO: 5240630 - DNA, 14 bp, Homo sapiens
atattatagaaaat

SEQ ID NO: 5240631 - DNA, 14 bp, Homo sapiens
atattatagagagt

SEQ ID NO: 5240632 - DNA, 24 bp, Homo sapiens
atattatataacccactgctgaaa

SEQ ID NO: 5240633 - DNA, 16 bp, Homo sapiens
atattatataaggaca

SEQ ID NO: 5240634 - DNA, 15 bp, Homo sapiens
atattatataggata

SEQ ID NO: 5240635 - DNA, 15 bp, Homo sapiens
atattatatatacat

SEQ ID NO: 5240636 - DNA, 16 bp, Homo sapiens
atattatatatacatt

SEQ ID NO: 5240637 - DNA, 15 bp, Homo sapiens
atattatatatatat

SEQ ID NO: 5240638 - DNA, 12 bp, Homo sapiens
atattatatgga

SEQ ID NO: 5240639 - DNA, 19 bp, Homo sapiens
atattatatggaaatatat

SEQ ID NO: 5240640 - DNA, 20 bp, Homo sapiens
atattatatggaaatatata

SEQ ID NO: 5240641 - DNA, 15 bp, Homo sapiens
atattatattgtatt

SEQ ID NO: 5240642 - DNA, 12 bp, Homo sapiens
atattatatttg

SEQ ID NO: 5240643 - DNA, 14 bp, Homo sapiens
atattatatttgga

SEQ ID NO: 5240644 - DNA, 15 bp, Homo sapiens
atattatcataacat

SEQ ID NO: 5240645 - DNA, 22 bp, Homo sapiens
atattatctacctgttctgtag

SEQ ID NO: 5240646 - DNA, 23 bp, Homo sapiens
atattatctacctgttctgtagc

SEQ ID NO: 5240647 - DNA, 13 bp, Homo sapiens
atattatctgaac

SEQ ID NO: 5240648 - DNA, 14 bp, Homo sapiens
atattatgatttta

SEQ ID NO: 5240649 - DNA, 17 bp, Homo sapiens
atattatgcaaattccc

SEQ ID NO: 5240650 - DNA, 20 bp, Homo sapiens
atattatgccttgagaatga

SEQ ID NO: 5240651 - DNA, 13 bp, Homo sapiens
atattatgctgct

SEQ ID NO: 5240652 - DNA, 14 bp, Homo sapiens
atattatgctgctt

SEQ ID NO: 5240653 - DNA, 17 bp, Homo sapiens
atattatggtgtaatgc

SEQ ID NO: 5240654 - DNA, 17 bp, Homo sapiens
atattatgtatagaaaa

SEQ ID NO: 5240655 - DNA, 18 bp, Homo sapiens
atattatgtcttcttttg

SEQ ID NO: 5240656 - DNA, 14 bp, Homo sapiens
atattatgtgaaga

SEQ ID NO: 5240657 - DNA, 13 bp, Homo sapiens
atattatgttaaa

SEQ ID NO: 5240658 - DNA, 16 bp, Homo sapiens
atattatgttatgaaa

SEQ ID NO: 5240659 - DNA, 23 bp, Homo sapiens
atattatgttcctcaaggtccat

SEQ ID NO: 5240660 - DNA, 18 bp, Homo sapiens
atattatgtttaattatt

SEQ ID NO: 5240661 - DNA, 17 bp, Homo sapiens
atattattacttgtaaa

SEQ ID NO: 5240662 - DNA, 13 bp, Homo sapiens
atattattagaaa

SEQ ID NO: 5240663 - DNA, 19 bp, Homo sapiens
atattattagaaattagaa

SEQ ID NO: 5240664 - DNA, 23 bp, Homo sapiens
atattattcaccatgtaaaacaa

SEQ ID NO: 5240665 - DNA, 20 bp, Homo sapiens
atattattccgtattacatt

SEQ ID NO: 5240666 - DNA, 23 bp, Homo sapiens
atattattccgtattacattttt

SEQ ID NO: 5240667 - DNA, 19 bp, Homo sapiens
atattattcctcaaaaaat

SEQ ID NO: 5240668 - DNA, 19 bp, Homo sapiens
atattattctcatttagtg

SEQ ID NO: 5240669 - DNA, 18 bp, Homo sapiens
atattattgctatatttg

SEQ ID NO: 5240670 - DNA, 12 bp, Homo sapiens
atattattgggg

SEQ ID NO: 5240671 - DNA, 23 bp, Homo sapiens
atattattggtcaagaaaagcat

SEQ ID NO: 5240672 - DNA, 12 bp, Homo sapiens
atattatttctt

SEQ ID NO: 5240673 - DNA, 15 bp, Homo sapiens
atattatttcttctc

SEQ ID NO: 5240674 - DNA, 14 bp, Homo sapiens
atattatttgatat

SEQ ID NO: 5240675 - DNA, 18 bp, Homo sapiens
atattatttgatgatact

SEQ ID NO: 5240676 - DNA, 23 bp, Homo sapiens
atattatttgctaattaaaaagt

SEQ ID NO: 5240677 - DNA, 12 bp, Homo sapiens
atattatttggc

SEQ ID NO: 5240678 - DNA, 14 bp, Homo sapiens
atattatttggcag

SEQ ID NO: 5240679 - DNA, 21 bp, Homo sapiens
atattatttggcagtttggta

SEQ ID NO: 5240680 - DNA, 17 bp, Homo sapiens
atattatttgtgtttcc

SEQ ID NO: 5240681 - DNA, 12 bp, Homo sapiens
atattattttaa

SEQ ID NO: 5240682 - DNA, 19 bp, Homo sapiens
atattattttagcttcagt

SEQ ID NO: 5240683 - DNA, 14 bp, Homo sapiens
atattattttctgg

SEQ ID NO: 5240684 - DNA, 15 bp, Homo sapiens
atattattttctgta

SEQ ID NO: 5240685 - DNA, 18 bp, Homo sapiens
atattattttctgtaatt

SEQ ID NO: 5240686 - DNA, 13 bp, Homo sapiens
ataatgtttcaaa

SEQ ID NO: 5240687 - DNA, 14 bp, Homo sapiens
ataatgttttggga

SEQ ID NO: 5240688 - DNA, 20 bp, Homo sapiens
ataatgttttgggaaacact

SEQ ID NO: 5240689 - DNA, 17 bp, Homo sapiens
ataatgtttttaatatt

SEQ ID NO: 5240690 - DNA, 19 bp, Homo sapiens
ataattaaaaaaaaaactt

SEQ ID NO: 5240691 - DNA, 23 bp, Homo sapiens
ataattaaaaaccactgaacatt

SEQ ID NO: 5240692 - DNA, 17 bp, Homo sapiens
ataattaaaatttatct

SEQ ID NO: 5240693 - DNA, 14 bp, Homo sapiens
ataattaaacttct

SEQ ID NO: 5240694 - DNA, 13 bp, Homo sapiens
ataattaaagaaa

SEQ ID NO: 5240695 - DNA, 15 bp, Homo sapiens
ataattaaagaaaat

SEQ ID NO: 5240696 - DNA, 19 bp, Homo sapiens
ataattaaagaaaattgcc

SEQ ID NO: 5240697 - DNA, 20 bp, Homo sapiens
ataattaaagaaaattgcca

SEQ ID NO: 5240698 - DNA, 13 bp, Homo sapiens
ataattaaagact

SEQ ID NO: 5240699 - DNA, 12 bp, Homo sapiens
ataattaaagat

SEQ ID NO: 5240700 - DNA, 22 bp, Homo sapiens
ataattaaagatgccatagcat

SEQ ID NO: 5240701 - DNA, 20 bp, Homo sapiens
ataattaaagtgtccattga

SEQ ID NO: 5240702 - DNA, 18 bp, Homo sapiens
ataattaacttaactgaa

SEQ ID NO: 5240703 - DNA, 17 bp, Homo sapiens
ataattaatgtgtgtct

SEQ ID NO: 5240704 - DNA, 12 bp, Homo sapiens
ataattaatgtt

SEQ ID NO: 5240705 - DNA, 23 bp, Homo sapiens
ataattacattcctaactagaat

SEQ ID NO: 5240706 - DNA, 13 bp, Homo sapiens
ataattactacat

SEQ ID NO: 5240707 - DNA, 14 bp, Homo sapiens
ataattacttaatg

SEQ ID NO: 5240708 - DNA, 16 bp, Homo sapiens
ataattagagttgtga

SEQ ID NO: 5240709 - DNA, 17 bp, Homo sapiens
ataattagagttgtgat

SEQ ID NO: 5240710 - DNA, 16 bp, Homo sapiens
ataattaggttaacat

SEQ ID NO: 5240711 - DNA, 19 bp, Homo sapiens
ataattatatgctatttct

SEQ ID NO: 5240712 - DNA, 14 bp, Homo sapiens
ataattatatgttg

SEQ ID NO: 5240713 - DNA, 22 bp, Homo sapiens
ataattatcggaagcagtgcct

SEQ ID NO: 5240714 - DNA, 13 bp, Homo sapiens
ataattatgaaaa

SEQ ID NO: 5240715 - DNA, 14 bp, Homo sapiens
ataattatgaaaac

SEQ ID NO: 5240716 - DNA, 18 bp, Homo sapiens
ataattatgacagttata

SEQ ID NO: 5240717 - DNA, 20 bp, Homo sapiens
ataattatgacagttatact

SEQ ID NO: 5240718 - DNA, 22 bp, Homo sapiens
ataattatgttattgaaaaaaa

SEQ ID NO: 5240719 - DNA, 17 bp, Homo sapiens
ataattatttatttaat

SEQ ID NO: 5240720 - DNA, 14 bp, Homo sapiens
ataattatttcaga

SEQ ID NO: 5240721 - DNA, 18 bp, Homo sapiens
ataattattttattgtgt

SEQ ID NO: 5240722 - DNA, 18 bp, Homo sapiens
ataattcaattttaaaga

SEQ ID NO: 5240723 - DNA, 16 bp, Homo sapiens
ataattcactcaagca

SEQ ID NO: 5240724 - DNA, 18 bp, Homo sapiens
ataattcactcaagcact

SEQ ID NO: 5240725 - DNA, 20 bp, Homo sapiens
ataattcactcaagcactga

SEQ ID NO: 5240726 - DNA, 22 bp, Homo sapiens
ataattcactcaagcactgata

SEQ ID NO: 5240727 - DNA, 22 bp, Homo sapiens
ataattcactgtactatcaggt

SEQ ID NO: 5240728 - DNA, 17 bp, Homo sapiens
ataattcagaactaaat

SEQ ID NO: 5240729 - DNA, 17 bp, Homo sapiens
ataattcagtatgtttt

SEQ ID NO: 5240730 - DNA, 14 bp, Homo sapiens
ataattcatatcta

SEQ ID NO: 5240731 - DNA, 16 bp, Homo sapiens
ataattcatatctaaa

SEQ ID NO: 5240732 - DNA, 13 bp, Homo sapiens
ataattcatattc

SEQ ID NO: 5240733 - DNA, 12 bp, Homo sapiens
ataattcattaa

SEQ ID NO: 5240734 - DNA, 12 bp, Homo sapiens
ataattcattta

SEQ ID NO: 5240735 - DNA, 18 bp, Homo sapiens
ataattcatttaagaaca

SEQ ID NO: 5240736 - DNA, 20 bp, Homo sapiens
ataattcatttaagaacaag

SEQ ID NO: 5240737 - DNA, 22 bp, Homo sapiens
ataattccagtcacagtttttg

SEQ ID NO: 5240738 - DNA, 20 bp, Homo sapiens
ataattccctatcttttagt

SEQ ID NO: 5240739 - DNA, 13 bp, Homo sapiens
ataattcctacag

SEQ ID NO: 5240740 - DNA, 16 bp, Homo sapiens
ataattcctacagcac

SEQ ID NO: 5240741 - DNA, 19 bp, Homo sapiens
ataattcctacagcactac

SEQ ID NO: 5240742 - DNA, 22 bp, Homo sapiens
ataattcctatatcctgtgact

SEQ ID NO: 5240743 - DNA, 18 bp, Homo sapiens
ataattccttaaaatttt

SEQ ID NO: 5240744 - DNA, 20 bp, Homo sapiens
ataattccttaaaattttca

SEQ ID NO: 5240745 - DNA, 16 bp, Homo sapiens
ataattcgagcaaaca

SEQ ID NO: 5240746 - DNA, 19 bp, Homo sapiens
ataattcgagcaaacaact

SEQ ID NO: 5240747 - DNA, 12 bp, Homo sapiens
ataattctaaag

SEQ ID NO: 5240748 - DNA, 21 bp, Homo sapiens
ataattctaagttatttactt

SEQ ID NO: 5240749 - DNA, 19 bp, Homo sapiens
ataattctacatgttgtct

SEQ ID NO: 5240750 - DNA, 19 bp, Homo sapiens
ataattctgaagttatatt

SEQ ID NO: 5240751 - DNA, 23 bp, Homo sapiens
ataattctgagttttgtgtttgt

SEQ ID NO: 5240752 - DNA, 14 bp, Homo sapiens
ataattctgtaaat

SEQ ID NO: 5240753 - DNA, 23 bp, Homo sapiens
ataattctgtacatagcctatat

SEQ ID NO: 5240754 - DNA, 16 bp, Homo sapiens
ataattcttattttgt

SEQ ID NO: 5240755 - DNA, 22 bp, Homo sapiens
ataattcttccagtgcaacaaa

SEQ ID NO: 5240756 - DNA, 14 bp, Homo sapiens
ataattcttgtata

SEQ ID NO: 5240757 - DNA, 14 bp, Homo sapiens
ataattctttgatt

SEQ ID NO: 5240758 - DNA, 15 bp, Homo sapiens
ataattcttttctga

SEQ ID NO: 5240759 - DNA, 14 bp, Homo sapiens
ataattctttttta

SEQ ID NO: 5240760 - DNA, 19 bp, Homo sapiens
ataattcttttttattaat

SEQ ID NO: 5240761 - DNA, 22 bp, Homo sapiens
ataattgaaaggaaatgtttga

SEQ ID NO: 5240762 - DNA, 18 bp, Homo sapiens
ataattgaacaataaagt

SEQ ID NO: 5240763 - DNA, 19 bp, Homo sapiens
ataattgaacaataaagtt

SEQ ID NO: 5240764 - DNA, 22 bp, Homo sapiens
ataattgacaggattattggaa

SEQ ID NO: 5240765 - DNA, 20 bp, Homo sapiens
ataattgactggtggaagga

SEQ ID NO: 5240766 - DNA, 18 bp, Homo sapiens
ataattgagactgaaaga

SEQ ID NO: 5240767 - DNA, 20 bp, Homo sapiens
ataattgagactgaaagaaa

SEQ ID NO: 5240768 - DNA, 14 bp, Homo sapiens
ataattgatcaaat

SEQ ID NO: 5240769 - DNA, 15 bp, Homo sapiens
ataattgatcaaatt

SEQ ID NO: 5240770 - DNA, 13 bp, Homo sapiens
ataattgcatcta

SEQ ID NO: 5240771 - DNA, 15 bp, Homo sapiens
ataattgcatgaaaa

SEQ ID NO: 5240772 - DNA, 16 bp, Homo sapiens
ataattgcatgaaaat

SEQ ID NO: 5240773 - DNA, 14 bp, Homo sapiens
ataattgcattgac

SEQ ID NO: 5240774 - DNA, 22 bp, Homo sapiens
ataattgcattgactttcccca

SEQ ID NO: 5240775 - DNA, 22 bp, Homo sapiens
ataattgccaaaaagtgaaata

SEQ ID NO: 5240776 - DNA, 23 bp, Homo sapiens
ataattgccaaaaagtgaaataa

SEQ ID NO: 5240777 - DNA, 16 bp, Homo sapiens
ataattgcctacattt

SEQ ID NO: 5240778 - DNA, 20 bp, Homo sapiens
ataattgcctacatttatca

SEQ ID NO: 5240779 - DNA, 16 bp, Homo sapiens
ataattgctatttatt

SEQ ID NO: 5240780 - DNA, 20 bp, Homo sapiens
ataattgctatttattttta

SEQ ID NO: 5240781 - DNA, 12 bp, Homo sapiens
ataattggaata

SEQ ID NO: 5240782 - DNA, 11 bp, Homo sapiens
ataattggctt

SEQ ID NO: 5240783 - DNA, 12 bp, Homo sapiens
ataattggctta

SEQ ID NO: 5240784 - DNA, 19 bp, Homo sapiens
ataattgggtcatagaaat

SEQ ID NO: 5240785 - DNA, 16 bp, Homo sapiens
ataattggtgctattt

SEQ ID NO: 5240786 - DNA, 19 bp, Homo sapiens
ataattggtgctatttgaa

SEQ ID NO: 5240787 - DNA, 20 bp, Homo sapiens
ataattggtgctatttgaag

SEQ ID NO: 5240788 - DNA, 23 bp, Homo sapiens
ataattggtgctatttgaagaaa

SEQ ID NO: 5240789 - DNA, 17 bp, Homo sapiens
ataattggtttgactgt

SEQ ID NO: 5240790 - DNA, 16 bp, Homo sapiens
ataattgtaaaggtga

SEQ ID NO: 5240791 - DNA, 19 bp, Homo sapiens
ataattgtaccaacctcat

SEQ ID NO: 5240792 - DNA, 13 bp, Homo sapiens
ataattgtactgt

SEQ ID NO: 5240793 - DNA, 15 bp, Homo sapiens
ataattgtactgtgt

SEQ ID NO: 5240794 - DNA, 17 bp, Homo sapiens
ataattgtactttgaaa

SEQ ID NO: 5240795 - DNA, 12 bp, Homo sapiens
ataattgtatca

SEQ ID NO: 5240796 - DNA, 17 bp, Homo sapiens
ataattgtatcagaggc

SEQ ID NO: 5240797 - DNA, 23 bp, Homo sapiens
ataattgtatcagaggcctataa

SEQ ID NO: 5240798 - DNA, 22 bp, Homo sapiens
ataattgtatcgtatagctgta

SEQ ID NO: 5240799 - DNA, 23 bp, Homo sapiens
ataattgtcatgactttcagatt

SEQ ID NO: 5240800 - DNA, 20 bp, Homo sapiens
ataattgtggagaggagaga

SEQ ID NO: 5240801 - DNA, 15 bp, Homo sapiens
ataattgtgtacaaa

SEQ ID NO: 5240802 - DNA, 18 bp, Homo sapiens
ataattgtgtgatatttc

SEQ ID NO: 5240803 - DNA, 22 bp, Homo sapiens
ataattgtgtgatatttcagaa

SEQ ID NO: 5240804 - DNA, 18 bp, Homo sapiens
ataattgttgaaattttg

SEQ ID NO: 5240805 - DNA, 20 bp, Homo sapiens
ataattgttgaaattttgca

SEQ ID NO: 5240806 - DNA, 14 bp, Homo sapiens
ataattgttgatat

SEQ ID NO: 5240807 - DNA, 14 bp, Homo sapiens
ataattgttgcata

SEQ ID NO: 5240808 - DNA, 15 bp, Homo sapiens
ataattgttgtgtgt

SEQ ID NO: 5240809 - DNA, 15 bp, Homo sapiens
ataattgttgttctg

SEQ ID NO: 5240810 - DNA, 18 bp, Homo sapiens
ataattgttgttctgtta

SEQ ID NO: 5240811 - DNA, 21 bp, Homo sapiens
ataattgtttccaacttgtct

SEQ ID NO: 5240812 - DNA, 19 bp, Homo sapiens
ataattgttttttatcttt

SEQ ID NO: 5240813 - DNA, 17 bp, Homo sapiens
ataatttaaaaatatat

SEQ ID NO: 5240814 - DNA, 13 bp, Homo sapiens
ataatttaaaata

SEQ ID NO: 5240815 - DNA, 16 bp, Homo sapiens
ataatttaaaataaat

SEQ ID NO: 5240816 - DNA, 13 bp, Homo sapiens
ataatttaaagtt

SEQ ID NO: 5240817 - DNA, 13 bp, Homo sapiens
ataatttaaatga

SEQ ID NO: 5240818 - DNA, 15 bp, Homo sapiens
ataatttaaatgata

SEQ ID NO: 5240819 - DNA, 12 bp, Homo sapiens
ataatttaacta

SEQ ID NO: 5240820 - DNA, 13 bp, Homo sapiens
ataatttaactaa

SEQ ID NO: 5240821 - DNA, 19 bp, Homo sapiens
ataatttaactaatttaaa

SEQ ID NO: 5240822 - DNA, 18 bp, Homo sapiens
ataatttaataaaaagga

SEQ ID NO: 5240823 - DNA, 15 bp, Homo sapiens
ataatttaatgcatg

SEQ ID NO: 5240824 - DNA, 13 bp, Homo sapiens
ataatttaatgta

SEQ ID NO: 5240825 - DNA, 17 bp, Homo sapiens
ataatttaatgtaaata

SEQ ID NO: 5240826 - DNA, 21 bp, Homo sapiens
ataatttaatgtaaataaaac

SEQ ID NO: 5240827 - DNA, 20 bp, Homo sapiens
ataatttacaagatattatt

SEQ ID NO: 5240828 - DNA, 13 bp, Homo sapiens
ataatttacctaa

SEQ ID NO: 5240829 - DNA, 23 bp, Homo sapiens
ataatttacctaagattacaaat

SEQ ID NO: 5240830 - DNA, 14 bp, Homo sapiens
ataatttagaaata

SEQ ID NO: 5240831 - DNA, 15 bp, Homo sapiens
ataatttagttgttt

SEQ ID NO: 5240832 - DNA, 17 bp, Homo sapiens
ataatttagtttcatat

SEQ ID NO: 5240833 - DNA, 17 bp, Homo sapiens
ataatttataagcattg

SEQ ID NO: 5240834 - DNA, 23 bp, Homo sapiens
ataatttattgtaccaaagctgt

SEQ ID NO: 5240835 - DNA, 16 bp, Homo sapiens
ataatttcaattttta

SEQ ID NO: 5240836 - DNA, 19 bp, Homo sapiens
ataatttcacttaataatt

SEQ ID NO: 5240837 - DNA, 14 bp, Homo sapiens
ataatttcatattc

SEQ ID NO: 5240838 - DNA, 21 bp, Homo sapiens
ataatttccatgatacaaaga

SEQ ID NO: 5240839 - DNA, 22 bp, Homo sapiens
ataatttccatttacttaagac

SEQ ID NO: 5240840 - DNA, 11 bp, Homo sapiens
ataatttccca

SEQ ID NO: 5240841 - DNA, 13 bp, Homo sapiens
ataatttcctcac

SEQ ID NO: 5240842 - DNA, 20 bp, Homo sapiens
ataatttcctcactgcctgg

SEQ ID NO: 5240843 - DNA, 14 bp, Homo sapiens
ataatttccttcag

SEQ ID NO: 5240844 - DNA, 19 bp, Homo sapiens
ataatttccttcaggcagc

SEQ ID NO: 5240845 - DNA, 14 bp, Homo sapiens
ataatttctaatgt

SEQ ID NO: 5240846 - DNA, 23 bp, Homo sapiens
ataatttctactctgtcttaaat

SEQ ID NO: 5240847 - DNA, 19 bp, Homo sapiens
ataatttctattaatatca

SEQ ID NO: 5240848 - DNA, 13 bp, Homo sapiens
ataatttctgttt

SEQ ID NO: 5240849 - DNA, 11 bp, Homo sapiens
ataatttgaat

SEQ ID NO: 5240850 - DNA, 14 bp, Homo sapiens
ataatttgaattaa

SEQ ID NO: 5240851 - DNA, 15 bp, Homo sapiens
ataatttgagtgtat

SEQ ID NO: 5240852 - DNA, 13 bp, Homo sapiens
ataatttgcactg

SEQ ID NO: 5240853 - DNA, 14 bp, Homo sapiens
ataatttgcactga

SEQ ID NO: 5240854 - DNA, 17 bp, Homo sapiens
ataatttgcataaaggg

SEQ ID NO: 5240855 - DNA, 21 bp, Homo sapiens
ataatttgcatattctattgt

SEQ ID NO: 5240856 - DNA, 13 bp, Homo sapiens
ataatttgtaaat

SEQ ID NO: 5240857 - DNA, 15 bp, Homo sapiens
ataatttgtaaatga

SEQ ID NO: 5240858 - DNA, 13 bp, Homo sapiens
ataatttgtctta

SEQ ID NO: 5240859 - DNA, 17 bp, Homo sapiens
ataatttgttgtacttt

SEQ ID NO: 5240860 - DNA, 13 bp, Homo sapiens
ataatttgtttaa

SEQ ID NO: 5240861 - DNA, 14 bp, Homo sapiens
ataatttgtttaaa

SEQ ID NO: 5240862 - DNA, 19 bp, Homo sapiens
ataatttgtttaaaattct

SEQ ID NO: 5240863 - DNA, 20 bp, Homo sapiens
ataatttgtttaaaattctc

SEQ ID NO: 5240864 - DNA, 16 bp, Homo sapiens
ataatttgtttccagc

SEQ ID NO: 5240865 - DNA, 11 bp, Homo sapiens
ataattttaaa

SEQ ID NO: 5240866 - DNA, 16 bp, Homo sapiens
atattcaaacacacag

SEQ ID NO: 5240867 - DNA, 15 bp, Homo sapiens
atattcaaagtatat

SEQ ID NO: 5240868 - DNA, 22 bp, Homo sapiens
atattcaaagtatatacagagc

SEQ ID NO: 5240869 - DNA, 16 bp, Homo sapiens
atattcaaatcagcaa

SEQ ID NO: 5240870 - DNA, 16 bp, Homo sapiens
atattcaacacactgc

SEQ ID NO: 5240871 - DNA, 21 bp, Homo sapiens
atattcaaccatggactttat

SEQ ID NO: 5240872 - DNA, 20 bp, Homo sapiens
atattcaactcataagactt

SEQ ID NO: 5240873 - DNA, 15 bp, Homo sapiens
atattcaagcctttg

SEQ ID NO: 5240874 - DNA, 16 bp, Homo sapiens
atattcaagcctttgg

SEQ ID NO: 5240875 - DNA, 14 bp, Homo sapiens
atattcaaggcttt

SEQ ID NO: 5240876 - DNA, 14 bp, Homo sapiens
atattcaagtaaca

SEQ ID NO: 5240877 - DNA, 13 bp, Homo sapiens
atattcaataaag

SEQ ID NO: 5240878 - DNA, 16 bp, Homo sapiens
atattcaatgaacttc

SEQ ID NO: 5240879 - DNA, 19 bp, Homo sapiens
atattcaatgcatttaaaa

SEQ ID NO: 5240880 - DNA, 16 bp, Homo sapiens
atattcaatgtattga

SEQ ID NO: 5240881 - DNA, 21 bp, Homo sapiens
atattcacaatggaaacttta

SEQ ID NO: 5240882 - DNA, 22 bp, Homo sapiens
atattcacaatggaaactttag

SEQ ID NO: 5240883 - DNA, 15 bp, Homo sapiens
atattcacacttgaa

SEQ ID NO: 5240884 - DNA, 12 bp, Homo sapiens
atattcacagtt

SEQ ID NO: 5240885 - DNA, 13 bp, Homo sapiens
atattcacatctt

SEQ ID NO: 5240886 - DNA, 20 bp, Homo sapiens
atattcaccatccccacccc

SEQ ID NO: 5240887 - DNA, 22 bp, Homo sapiens
atattcactctgtggtccagag

SEQ ID NO: 5240888 - DNA, 15 bp, Homo sapiens
atattcactgggcca

SEQ ID NO: 5240889 - DNA, 16 bp, Homo sapiens
atattcactgggccaa

SEQ ID NO: 5240890 - DNA, 21 bp, Homo sapiens
atattcactttcatttttgac

SEQ ID NO: 5240891 - DNA, 13 bp, Homo sapiens
atattcagaaatt

SEQ ID NO: 5240892 - DNA, 18 bp, Homo sapiens
atattcagacaaaatgga

SEQ ID NO: 5240893 - DNA, 19 bp, Homo sapiens
atattcagacaaaatggat

SEQ ID NO: 5240894 - DNA, 14 bp, Homo sapiens
atattcaggaagct

SEQ ID NO: 5240895 - DNA, 14 bp, Homo sapiens
atattcagtgaaaa

SEQ ID NO: 5240896 - DNA, 22 bp, Homo sapiens
atattcagtgctgtggcctggg

SEQ ID NO: 5240897 - DNA, 23 bp, Homo sapiens
atattcagtggtgaaatcttgtt

SEQ ID NO: 5240898 - DNA, 20 bp, Homo sapiens
atattcataaagttacagtt

SEQ ID NO: 5240899 - DNA, 12 bp, Homo sapiens
atattcatacaa

SEQ ID NO: 5240900 - DNA, 18 bp, Homo sapiens
atattcatcagaatgtta

SEQ ID NO: 5240901 - DNA, 12 bp, Homo sapiens
atattcatctgt

SEQ ID NO: 5240902 - DNA, 19 bp, Homo sapiens
atattcatgaaatgtggaa

SEQ ID NO: 5240903 - DNA, 16 bp, Homo sapiens
atattcatgaagagtt

SEQ ID NO: 5240904 - DNA, 18 bp, Homo sapiens
atattcatgcttcttcct

SEQ ID NO: 5240905 - DNA, 21 bp, Homo sapiens
atattcatgcttgccatctgt

SEQ ID NO: 5240906 - DNA, 16 bp, Homo sapiens
atattcattgtataaa

SEQ ID NO: 5240907 - DNA, 23 bp, Homo sapiens
atattcattgtataaaaatagaa

SEQ ID NO: 5240908 - DNA, 15 bp, Homo sapiens
atattcatttacatg

SEQ ID NO: 5240909 - DNA, 12 bp, Homo sapiens
atattccaaaat

SEQ ID NO: 5240910 - DNA, 16 bp, Homo sapiens
atattccaaaataaaa

SEQ ID NO: 5240911 - DNA, 21 bp, Homo sapiens
atattccaaggaaaattgaaa

SEQ ID NO: 5240912 - DNA, 17 bp, Homo sapiens
atattccaccattcaca

SEQ ID NO: 5240913 - DNA, 20 bp, Homo sapiens
atattccaccattcacattt

SEQ ID NO: 5240914 - DNA, 20 bp, Homo sapiens
atattccatagtatattaaa

SEQ ID NO: 5240915 - DNA, 22 bp, Homo sapiens
atattccatagtatattaaaaa

SEQ ID NO: 5240916 - DNA, 23 bp, Homo sapiens
atattccatagtatattaaaaat

SEQ ID NO: 5240917 - DNA, 14 bp, Homo sapiens
atattccatgtata

SEQ ID NO: 5240918 - DNA, 21 bp, Homo sapiens
atattccatttacataaggat

SEQ ID NO: 5240919 - DNA, 18 bp, Homo sapiens
atattcccctatctctag

SEQ ID NO: 5240920 - DNA, 16 bp, Homo sapiens
atattccctgcacaca

SEQ ID NO: 5240921 - DNA, 22 bp, Homo sapiens
atattccctgcacacacatgca

SEQ ID NO: 5240922 - DNA, 18 bp, Homo sapiens
atattccgtatttaaagt

SEQ ID NO: 5240923 - DNA, 21 bp, Homo sapiens
atattcctacttgcagtacat

SEQ ID NO: 5240924 - DNA, 12 bp, Homo sapiens
atattcctccag

SEQ ID NO: 5240925 - DNA, 15 bp, Homo sapiens
atattcctccagctg

SEQ ID NO: 5240926 - DNA, 21 bp, Homo sapiens
atattcctctaaaactctcaa

SEQ ID NO: 5240927 - DNA, 18 bp, Homo sapiens
atattcctgaatgaaata

SEQ ID NO: 5240928 - DNA, 23 bp, Homo sapiens
atattcctgaatgaaatatcaga

SEQ ID NO: 5240929 - DNA, 14 bp, Homo sapiens
atattcctggactt

SEQ ID NO: 5240930 - DNA, 22 bp, Homo sapiens
atattccttactagaaatatat

SEQ ID NO: 5240931 - DNA, 12 bp, Homo sapiens
atattcctttgc

SEQ ID NO: 5240932 - DNA, 11 bp, Homo sapiens
atattcctttt

SEQ ID NO: 5240933 - DNA, 16 bp, Homo sapiens
atattccttttaaaga

SEQ ID NO: 5240934 - DNA, 18 bp, Homo sapiens
atattcgctagtgtttaa

SEQ ID NO: 5240935 - DNA, 22 bp, Homo sapiens
atattctaaaaaagatactgta

SEQ ID NO: 5240936 - DNA, 16 bp, Homo sapiens
atattctaaaaccatt

SEQ ID NO: 5240937 - DNA, 14 bp, Homo sapiens
atattctaaattca

SEQ ID NO: 5240938 - DNA, 16 bp, Homo sapiens
atattctaaattcact

SEQ ID NO: 5240939 - DNA, 18 bp, Homo sapiens
atattctaaattcactgt

SEQ ID NO: 5240940 - DNA, 14 bp, Homo sapiens
atattctaacattt

SEQ ID NO: 5240941 - DNA, 13 bp, Homo sapiens
atattctaagact

SEQ ID NO: 5240942 - DNA, 14 bp, Homo sapiens
atattctaattaaa

SEQ ID NO: 5240943 - DNA, 21 bp, Homo sapiens
atattctacacatgtaaaata

SEQ ID NO: 5240944 - DNA, 19 bp, Homo sapiens
atattctagtaataaagac

SEQ ID NO: 5240945 - DNA, 17 bp, Homo sapiens
atattctattgtttact

SEQ ID NO: 5240946 - DNA, 19 bp, Homo sapiens
atattctattttgcagata

SEQ ID NO: 5240947 - DNA, 18 bp, Homo sapiens
atattctcacagctccaa

SEQ ID NO: 5240948 - DNA, 23 bp, Homo sapiens
atattctcacagctccaagaatt

SEQ ID NO: 5240949 - DNA, 22 bp, Homo sapiens
atattctcacgggcagtagctg

SEQ ID NO: 5240950 - DNA, 17 bp, Homo sapiens
atattctcatggctttg

SEQ ID NO: 5240951 - DNA, 19 bp, Homo sapiens
atattctcatttttctaaa

SEQ ID NO: 5240952 - DNA, 15 bp, Homo sapiens
atattctccccaccc

SEQ ID NO: 5240953 - DNA, 16 bp, Homo sapiens
atattctccccaccca

SEQ ID NO: 5240954 - DNA, 14 bp, Homo sapiens
atattctccttcct

SEQ ID NO: 5240955 - DNA, 13 bp, Homo sapiens
atattctctaata

SEQ ID NO: 5240956 - DNA, 15 bp, Homo sapiens
atattctctaataaa

SEQ ID NO: 5240957 - DNA, 19 bp, Homo sapiens
atattctctagtcatttgt

SEQ ID NO: 5240958 - DNA, 23 bp, Homo sapiens
atattctctccgccattgagaat

SEQ ID NO: 5240959 - DNA, 13 bp, Homo sapiens
atattctctctgt

SEQ ID NO: 5240960 - DNA, 15 bp, Homo sapiens
atattctctgatgtt

SEQ ID NO: 5240961 - DNA, 18 bp, Homo sapiens
atattctgatgtttctca

SEQ ID NO: 5240962 - DNA, 21 bp, Homo sapiens
atattctggaaaaaaaatata

SEQ ID NO: 5240963 - DNA, 21 bp, Homo sapiens
atattctggccagactcgatg

SEQ ID NO: 5240964 - DNA, 17 bp, Homo sapiens
atattctggctgataaa

SEQ ID NO: 5240965 - DNA, 17 bp, Homo sapiens
atattctggttcttgaa

SEQ ID NO: 5240966 - DNA, 17 bp, Homo sapiens
atattctgtcattggtt

SEQ ID NO: 5240967 - DNA, 16 bp, Homo sapiens
atattctgttggccag

SEQ ID NO: 5240968 - DNA, 17 bp, Homo sapiens
atattcttattggaaat

SEQ ID NO: 5240969 - DNA, 21 bp, Homo sapiens
atattcttattggaaatgtac

SEQ ID NO: 5240970 - DNA, 22 bp, Homo sapiens
atattcttattggaaatgtact

SEQ ID NO: 5240971 - DNA, 15 bp, Homo sapiens
atattcttcaaatgt

SEQ ID NO: 5240972 - DNA, 14 bp, Homo sapiens
atattcttctcttg

SEQ ID NO: 5240973 - DNA, 18 bp, Homo sapiens
atattcttctcttgcttt

SEQ ID NO: 5240974 - DNA, 15 bp, Homo sapiens
atattcttgtgcttt

SEQ ID NO: 5240975 - DNA, 22 bp, Homo sapiens
atattctttagcttacctgggc

SEQ ID NO: 5240976 - DNA, 16 bp, Homo sapiens
atattctttatatact

SEQ ID NO: 5240977 - DNA, 12 bp, Homo sapiens
atattctttcaa

SEQ ID NO: 5240978 - DNA, 24 bp, Homo sapiens
atattctttctcataaaactgtga

SEQ ID NO: 5240979 - DNA, 12 bp, Homo sapiens
atattctttctt

SEQ ID NO: 5240980 - DNA, 13 bp, Homo sapiens
atattctttgaaa

SEQ ID NO: 5240981 - DNA, 16 bp, Homo sapiens
atattcttttgtttcc

SEQ ID NO: 5240982 - DNA, 14 bp, Homo sapiens
atattgaaaagata

SEQ ID NO: 5240983 - DNA, 16 bp, Homo sapiens
atattgaaaatgtcac

SEQ ID NO: 5240984 - DNA, 23 bp, Homo sapiens
atattgaaaattgaaaagtacaa

SEQ ID NO: 5240985 - DNA, 20 bp, Homo sapiens
atattgaaaggcaaacattt

SEQ ID NO: 5240986 - DNA, 21 bp, Homo sapiens
atattgaaagttgcttttatt

SEQ ID NO: 5240987 - DNA, 18 bp, Homo sapiens
atattgaacttttgtact

SEQ ID NO: 5240988 - DNA, 20 bp, Homo sapiens
atattgaacttttgtactga

SEQ ID NO: 5240989 - DNA, 19 bp, Homo sapiens
atattgaagaatttgtttt

SEQ ID NO: 5240990 - DNA, 20 bp, Homo sapiens
atattgaagacaatttgata

SEQ ID NO: 5240991 - DNA, 13 bp, Homo sapiens
atattgaagttgt

SEQ ID NO: 5240992 - DNA, 12 bp, Homo sapiens
atattgaataaa

SEQ ID NO: 5240993 - DNA, 23 bp, Homo sapiens
atattgaataaaaaatagacatg

SEQ ID NO: 5240994 - DNA, 20 bp, Homo sapiens
atattgaataggcattaaat

SEQ ID NO: 5240995 - DNA, 15 bp, Homo sapiens
atattgaatgcctta

SEQ ID NO: 5240996 - DNA, 16 bp, Homo sapiens
atattgaatgccttat

SEQ ID NO: 5240997 - DNA, 13 bp, Homo sapiens
atattgaatgtga

SEQ ID NO: 5240998 - DNA, 16 bp, Homo sapiens
atattgaatgtgaaac

SEQ ID NO: 5240999 - DNA, 16 bp, Homo sapiens
atattgaatttttcct

SEQ ID NO: 5241000 - DNA, 21 bp, Homo sapiens
atattgacaagtttaaaggct

SEQ ID NO: 5241001 - DNA, 20 bp, Homo sapiens
atattgacactgtccctctt

SEQ ID NO: 5241002 - DNA, 13 bp, Homo sapiens
atattgacatttg

SEQ ID NO: 5241003 - DNA, 15 bp, Homo sapiens
atattgacatttgta

SEQ ID NO: 5241004 - DNA, 17 bp, Homo sapiens
atattgactcaaaccat

SEQ ID NO: 5241005 - DNA, 19 bp, Homo sapiens
atattgacttctcttgaat

SEQ ID NO: 5241006 - DNA, 13 bp, Homo sapiens
atattgagaatca

SEQ ID NO: 5241007 - DNA, 17 bp, Homo sapiens
atattgagaatcaggtt

SEQ ID NO: 5241008 - DNA, 15 bp, Homo sapiens
atattgagacaaaaa

SEQ ID NO: 5241009 - DNA, 16 bp, Homo sapiens
atattgagacaaaaat

SEQ ID NO: 5241010 - DNA, 16 bp, Homo sapiens
atattgagatcagcat

SEQ ID NO: 5241011 - DNA, 21 bp, Homo sapiens
atattgagatcagcattcaaa

SEQ ID NO: 5241012 - DNA, 22 bp, Homo sapiens
atattgagatcagcattcaaaa

SEQ ID NO: 5241013 - DNA, 18 bp, Homo sapiens
atattgagcaatatgtca

SEQ ID NO: 5241014 - DNA, 20 bp, Homo sapiens
atattgagcaatatgtcagt

SEQ ID NO: 5241015 - DNA, 22 bp, Homo sapiens
atattgaggctttgtgttgtaa

SEQ ID NO: 5241016 - DNA, 15 bp, Homo sapiens
atattgataaatttt

SEQ ID NO: 5241017 - DNA, 22 bp, Homo sapiens
atattgataagctattgtctgt

SEQ ID NO: 5241018 - DNA, 15 bp, Homo sapiens
atattgataataaaa

SEQ ID NO: 5241019 - DNA, 22 bp, Homo sapiens
atattgatcaaatatagaaagt

SEQ ID NO: 5241020 - DNA, 16 bp, Homo sapiens
atattgatctgtatta

SEQ ID NO: 5241021 - DNA, 20 bp, Homo sapiens
atattgatctgtattaagct

SEQ ID NO: 5241022 - DNA, 17 bp, Homo sapiens
atattgatctttttatc

SEQ ID NO: 5241023 - DNA, 14 bp, Homo sapiens
atattgatgaaaag

SEQ ID NO: 5241024 - DNA, 15 bp, Homo sapiens
atattgatgtcagta

SEQ ID NO: 5241025 - DNA, 17 bp, Homo sapiens
atattgattctgaaatt

SEQ ID NO: 5241026 - DNA, 15 bp, Homo sapiens
atattgattgggaaa

SEQ ID NO: 5241027 - DNA, 19 bp, Homo sapiens
atattgattgggaaaacat

SEQ ID NO: 5241028 - DNA, 21 bp, Homo sapiens
atattgattgggaaaacattt

SEQ ID NO: 5241029 - DNA, 16 bp, Homo sapiens
atattgattgtccttt

SEQ ID NO: 5241030 - DNA, 19 bp, Homo sapiens
atattgatttccgttaaaa

SEQ ID NO: 5241031 - DNA, 21 bp, Homo sapiens
atattgatttccgttaaaata

SEQ ID NO: 5241032 - DNA, 15 bp, Homo sapiens
atattgattttaaat

SEQ ID NO: 5241033 - DNA, 21 bp, Homo sapiens
atattgcacaactctactgtt

SEQ ID NO: 5241034 - DNA, 17 bp, Homo sapiens
atattgcacaattataa

SEQ ID NO: 5241035 - DNA, 15 bp, Homo sapiens
atattgcacatgtct

SEQ ID NO: 5241036 - DNA, 16 bp, Homo sapiens
atattgcacatgtctt

SEQ ID NO: 5241037 - DNA, 17 bp, Homo sapiens
atattgcacatgtctta

SEQ ID NO: 5241038 - DNA, 17 bp, Homo sapiens
atattgcaggagacatt

SEQ ID NO: 5241039 - DNA, 18 bp, Homo sapiens
atattgcaggagacattt

SEQ ID NO: 5241040 - DNA, 22 bp, Homo sapiens
atattgcagttcatactgaatg

SEQ ID NO: 5241041 - DNA, 22 bp, Homo sapiens
atattgcatactattaaacatg

SEQ ID NO: 5241042 - DNA, 16 bp, Homo sapiens
atattgcatatgcata

SEQ ID NO: 5241043 - DNA, 13 bp, Homo sapiens
atattgcatttct

SEQ ID NO: 5241044 - DNA, 16 bp, Homo sapiens
atattgcccaaataat

SEQ ID NO: 5241045 - DNA, 21 bp, Homo sapiens
ataattttaaaaaagccttcc

SEQ ID NO: 5241046 - DNA, 16 bp, Homo sapiens
ataattttaaaattgc

SEQ ID NO: 5241047 - DNA, 18 bp, Homo sapiens
ataattttaaaattgcag

SEQ ID NO: 5241048 - DNA, 15 bp, Homo sapiens
ataattttaaacaaa

SEQ ID NO: 5241049 - DNA, 17 bp, Homo sapiens
ataattttaaataacct

SEQ ID NO: 5241050 - DNA, 22 bp, Homo sapiens
ataattttaaataacctctggc

SEQ ID NO: 5241051 - DNA, 20 bp, Homo sapiens
ataattttaacagacatgta

SEQ ID NO: 5241052 - DNA, 14 bp, Homo sapiens
ataattttaagaaa

SEQ ID NO: 5241053 - DNA, 13 bp, Homo sapiens
ataattttaagat

SEQ ID NO: 5241054 - DNA, 15 bp, Homo sapiens
ataattttacatgtc

SEQ ID NO: 5241055 - DNA, 23 bp, Homo sapiens
ataattttactcactcactctga

SEQ ID NO: 5241056 - DNA, 20 bp, Homo sapiens
ataattttagtaatttccta

SEQ ID NO: 5241057 - DNA, 19 bp, Homo sapiens
ataattttatctgtataag

SEQ ID NO: 5241058 - DNA, 13 bp, Homo sapiens
ataattttattag

SEQ ID NO: 5241059 - DNA, 17 bp, Homo sapiens
ataattttattgctgga

SEQ ID NO: 5241060 - DNA, 22 bp, Homo sapiens
ataattttcagctgcaaggatt

SEQ ID NO: 5241061 - DNA, 11 bp, Homo sapiens
ataattttcat

SEQ ID NO: 5241062 - DNA, 13 bp, Homo sapiens
ataattttcattt

SEQ ID NO: 5241063 - DNA, 16 bp, Homo sapiens
ataattttcattttta

SEQ ID NO: 5241064 - DNA, 21 bp, Homo sapiens
ataattttccagtataaaaca

SEQ ID NO: 5241065 - DNA, 19 bp, Homo sapiens
ataattttcctttaatatg

SEQ ID NO: 5241066 - DNA, 15 bp, Homo sapiens
ataattttctgaaag

SEQ ID NO: 5241067 - DNA, 13 bp, Homo sapiens
ataattttcttca

SEQ ID NO: 5241068 - DNA, 22 bp, Homo sapiens
ataattttcttcatgcaatgac

SEQ ID NO: 5241069 - DNA, 13 bp, Homo sapiens
ataattttgatag

SEQ ID NO: 5241070 - DNA, 17 bp, Homo sapiens
ataattttgcagcagaa

SEQ ID NO: 5241071 - DNA, 12 bp, Homo sapiens
ataattttgcat

SEQ ID NO: 5241072 - DNA, 13 bp, Homo sapiens
ataattttgcata

SEQ ID NO: 5241073 - DNA, 21 bp, Homo sapiens
ataattttggaataatttcta

SEQ ID NO: 5241074 - DNA, 20 bp, Homo sapiens
ataattttgtgaagcaaaat

SEQ ID NO: 5241075 - DNA, 17 bp, Homo sapiens
ataattttgtgttgtac

SEQ ID NO: 5241076 - DNA, 16 bp, Homo sapiens
ataattttgttttaat

SEQ ID NO: 5241077 - DNA, 16 bp, Homo sapiens
ataatttttaaaagag

SEQ ID NO: 5241078 - DNA, 12 bp, Homo sapiens
ataatttttaac

SEQ ID NO: 5241079 - DNA, 12 bp, Homo sapiens
ataatttttaat

SEQ ID NO: 5241080 - DNA, 16 bp, Homo sapiens
ataatttttacctaat

SEQ ID NO: 5241081 - DNA, 18 bp, Homo sapiens
ataatttttacctaatct

SEQ ID NO: 5241082 - DNA, 13 bp, Homo sapiens
ataatttttctag

SEQ ID NO: 5241083 - DNA, 15 bp, Homo sapiens
ataatttttgtacat

SEQ ID NO: 5241084 - DNA, 20 bp, Homo sapiens
ataatttttgtacatcccaa

SEQ ID NO: 5241085 - DNA, 13 bp, Homo sapiens
ataattttttaat

SEQ ID NO: 5241086 - DNA, 17 bp, Homo sapiens
ataattttttagttaaa

SEQ ID NO: 5241087 - DNA, 21 bp, Homo sapiens
ataattttttagttaaaatct

SEQ ID NO: 5241088 - DNA, 22 bp, Homo sapiens
ataattttttagttaaaatcta

SEQ ID NO: 5241089 - DNA, 17 bp, Homo sapiens
ataattttttattcaag

SEQ ID NO: 5241090 - DNA, 23 bp, Homo sapiens
ataattttttgcagtcttttgct

SEQ ID NO: 5241091 - DNA, 22 bp, Homo sapiens
ataattttttgtaatgtgtgaa

SEQ ID NO: 5241092 - DNA, 20 bp, Homo sapiens
ataatttttttcaatattta

SEQ ID NO: 5241093 - DNA, 18 bp, Homo sapiens
ataattttttttaaaata

SEQ ID NO: 5241094 - DNA, 22 bp, Homo sapiens
atacaaaaaaaaaaaaaaatta

SEQ ID NO: 5241095 - DNA, 14 bp, Homo sapiens
atacaaaaaaaagt

SEQ ID NO: 5241096 - DNA, 19 bp, Homo sapiens
atacaaaaaaaatctttaa

SEQ ID NO: 5241097 - DNA, 22 bp, Homo sapiens
atacaaaaaaaatctttaatgg

SEQ ID NO: 5241098 - DNA, 18 bp, Homo sapiens
atacaaaaacatacttca

SEQ ID NO: 5241099 - DNA, 22 bp, Homo sapiens
atacaaaaacatacttcaaaaa

SEQ ID NO: 5241100 - DNA, 23 bp, Homo sapiens
atacaaaaagccaacaaaccaag

SEQ ID NO: 5241101 - DNA, 14 bp, Homo sapiens
atacaaaaatatat

SEQ ID NO: 5241102 - DNA, 15 bp, Homo sapiens
atacaaaaatatatt

SEQ ID NO: 5241103 - DNA, 19 bp, Homo sapiens
atacaaaaattagccgggc

SEQ ID NO: 5241104 - DNA, 16 bp, Homo sapiens
atacaaaagagcatgg

SEQ ID NO: 5241105 - DNA, 23 bp, Homo sapiens
atacaaaagttcaacctcttaca

SEQ ID NO: 5241106 - DNA, 13 bp, Homo sapiens
atacaaaataatt

SEQ ID NO: 5241107 - DNA, 15 bp, Homo sapiens
atacaaaataattta

SEQ ID NO: 5241108 - DNA, 21 bp, Homo sapiens
atacaaaataatttaactaat

SEQ ID NO: 5241109 - DNA, 16 bp, Homo sapiens
atacaaacaatctctt

SEQ ID NO: 5241110 - DNA, 15 bp, Homo sapiens
atacaaactttgtaa

SEQ ID NO: 5241111 - DNA, 13 bp, Homo sapiens
atacaaagaaact

SEQ ID NO: 5241112 - DNA, 14 bp, Homo sapiens
atacaaagatgact

SEQ ID NO: 5241113 - DNA, 17 bp, Homo sapiens
atacaaagatgactggt

SEQ ID NO: 5241114 - DNA, 11 bp, Homo sapiens
atacaaagcat

SEQ ID NO: 5241115 - DNA, 18 bp, Homo sapiens
atacaaagcgtgcacaag

SEQ ID NO: 5241116 - DNA, 22 bp, Homo sapiens
atacaaagctgtcactcacaaa

SEQ ID NO: 5241117 - DNA, 17 bp, Homo sapiens
atacaaagtaaatacaa

SEQ ID NO: 5241118 - DNA, 21 bp, Homo sapiens
atacaaagtaaatacaagact

SEQ ID NO: 5241119 - DNA, 16 bp, Homo sapiens
atacaaagtggaaact

SEQ ID NO: 5241120 - DNA, 12 bp, Homo sapiens
atacaaataaat

SEQ ID NO: 5241121 - DNA, 18 bp, Homo sapiens
atacaaatctcactgtat

SEQ ID NO: 5241122 - DNA, 21 bp, Homo sapiens
atacaaatctcactgtattaa

SEQ ID NO: 5241123 - DNA, 12 bp, Homo sapiens
atacaaatctgt

SEQ ID NO: 5241124 - DNA, 16 bp, Homo sapiens
atacaaatctgtataa

SEQ ID NO: 5241125 - DNA, 21 bp, Homo sapiens
atacaaatctgtataaatgtc

SEQ ID NO: 5241126 - DNA, 24 bp, Homo sapiens
atacaaatctgtataaatgtctat

SEQ ID NO: 5241127 - DNA, 22 bp, Homo sapiens
atacaaatgcatctttgatgtg

SEQ ID NO: 5241128 - DNA, 23 bp, Homo sapiens
atacaaattggttggttttgact

SEQ ID NO: 5241129 - DNA, 14 bp, Homo sapiens
atacaaatttggcc

SEQ ID NO: 5241130 - DNA, 19 bp, Homo sapiens
atacaaattttcagaaggt

SEQ ID NO: 5241131 - DNA, 15 bp, Homo sapiens
atacaaattttccca

SEQ ID NO: 5241132 - DNA, 19 bp, Homo sapiens
atacaacaaaggcaagtta

SEQ ID NO: 5241133 - DNA, 13 bp, Homo sapiens
atacaacacatct

SEQ ID NO: 5241134 - DNA, 17 bp, Homo sapiens
atacaacaccaaaaaat

SEQ ID NO: 5241135 - DNA, 20 bp, Homo sapiens
atacaacaccaaaaaatatc

SEQ ID NO: 5241136 - DNA, 18 bp, Homo sapiens
atacaacagaaaccagaa

SEQ ID NO: 5241137 - DNA, 20 bp, Homo sapiens
atacaacagcaaaccctgat

SEQ ID NO: 5241138 - DNA, 17 bp, Homo sapiens
atacaacaggagagaga

SEQ ID NO: 5241139 - DNA, 15 bp, Homo sapiens
atacaacaggatttt

SEQ ID NO: 5241140 - DNA, 21 bp, Homo sapiens
atacaacagtgctaaaaatgg

SEQ ID NO: 5241141 - DNA, 16 bp, Homo sapiens
atacaacctaacttat

SEQ ID NO: 5241142 - DNA, 15 bp, Homo sapiens
atacaacctatgtaa

SEQ ID NO: 5241143 - DNA, 16 bp, Homo sapiens
atacaacctccctctt

SEQ ID NO: 5241144 - DNA, 20 bp, Homo sapiens
atacaacctccctcttgttt

SEQ ID NO: 5241145 - DNA, 23 bp, Homo sapiens
atacaacctccctcttgttttgt

SEQ ID NO: 5241146 - DNA, 23 bp, Homo sapiens
atacaacctgagccttttcttat

SEQ ID NO: 5241147 - DNA, 18 bp, Homo sapiens
atacaaccttcatttaaa

SEQ ID NO: 5241148 - DNA, 19 bp, Homo sapiens
atacaactgtaaagcaaat

SEQ ID NO: 5241149 - DNA, 20 bp, Homo sapiens
atacaactttggaatttgaa

SEQ ID NO: 5241150 - DNA, 20 bp, Homo sapiens
atacaagaaaaagtagaaaa

SEQ ID NO: 5241151 - DNA, 12 bp, Homo sapiens
atacaagactgc

SEQ ID NO: 5241152 - DNA, 12 bp, Homo sapiens
atacaagataag

SEQ ID NO: 5241153 - DNA, 17 bp, Homo sapiens
atacaagatattatgta

SEQ ID NO: 5241154 - DNA, 16 bp, Homo sapiens
atacaagcaagcaaaa

SEQ ID NO: 5241155 - DNA, 15 bp, Homo sapiens
atacaagcatatgtt

SEQ ID NO: 5241156 - DNA, 23 bp, Homo sapiens
atacaagccatttactttgcaag

SEQ ID NO: 5241157 - DNA, 21 bp, Homo sapiens
atacaagctgggaacttctaa

SEQ ID NO: 5241158 - DNA, 19 bp, Homo sapiens
atacaaggacattcactgc

SEQ ID NO: 5241159 - DNA, 20 bp, Homo sapiens
atacaaggagggcctctggt

SEQ ID NO: 5241160 - DNA, 20 bp, Homo sapiens
atacaaggtataataaaatt

SEQ ID NO: 5241161 - DNA, 13 bp, Homo sapiens
atacaagtaattt

SEQ ID NO: 5241162 - DNA, 20 bp, Homo sapiens
atacaagtgaacaaaataag

SEQ ID NO: 5241163 - DNA, 13 bp, Homo sapiens
atacaagtgtttc

SEQ ID NO: 5241164 - DNA, 18 bp, Homo sapiens
atacaagtttcagacagg

SEQ ID NO: 5241165 - DNA, 10 bp, Homo sapiens
atacaataaa

SEQ ID NO: 5241166 - DNA, 11 bp, Homo sapiens
atacaataaaa

SEQ ID NO: 5241167 - DNA, 23 bp, Homo sapiens
atacaataaaacaaataaatatg

SEQ ID NO: 5241168 - DNA, 12 bp, Homo sapiens
atacaataaatt

SEQ ID NO: 5241169 - DNA, 17 bp, Homo sapiens
atacaataaattgctaa

SEQ ID NO: 5241170 - DNA, 14 bp, Homo sapiens
atacaataacccag

SEQ ID NO: 5241171 - DNA, 15 bp, Homo sapiens
atacaataacccagt

SEQ ID NO: 5241172 - DNA, 19 bp, Homo sapiens
atacaataacccagttact

SEQ ID NO: 5241173 - DNA, 15 bp, Homo sapiens
atacaataatggaaa

SEQ ID NO: 5241174 - DNA, 19 bp, Homo sapiens
atacaataatggaaaaaaa

SEQ ID NO: 5241175 - DNA, 16 bp, Homo sapiens
atacaataatgtaatt

SEQ ID NO: 5241176 - DNA, 16 bp, Homo sapiens
atacaataattgaagt

SEQ ID NO: 5241177 - DNA, 14 bp, Homo sapiens
atacaatagcattg

SEQ ID NO: 5241178 - DNA, 16 bp, Homo sapiens
atacaatatatagctg

SEQ ID NO: 5241179 - DNA, 20 bp, Homo sapiens
atacaatattaattataata

SEQ ID NO: 5241180 - DNA, 23 bp, Homo sapiens
atacaatattaattataataaag

SEQ ID NO: 5241181 - DNA, 16 bp, Homo sapiens
atacaatcagcccagt

SEQ ID NO: 5241182 - DNA, 21 bp, Homo sapiens
atacaatcagcccagtgcaaa

SEQ ID NO: 5241183 - DNA, 15 bp, Homo sapiens
atacaatcagctgct

SEQ ID NO: 5241184 - DNA, 16 bp, Homo sapiens
atacaatcagctgctt

SEQ ID NO: 5241185 - DNA, 18 bp, Homo sapiens
atacaatcatagcattgt

SEQ ID NO: 5241186 - DNA, 17 bp, Homo sapiens
atacaatctcactctgt

SEQ ID NO: 5241187 - DNA, 16 bp, Homo sapiens
atacaatgatgctatt

SEQ ID NO: 5241188 - DNA, 14 bp, Homo sapiens
atacaatgctgtgc

SEQ ID NO: 5241189 - DNA, 17 bp, Homo sapiens
atacaatggaataaatt

SEQ ID NO: 5241190 - DNA, 12 bp, Homo sapiens
atacaatgtatg

SEQ ID NO: 5241191 - DNA, 15 bp, Homo sapiens
atacaatgtatgtac

SEQ ID NO: 5241192 - DNA, 17 bp, Homo sapiens
atacaatgtatgtacaa

SEQ ID NO: 5241193 - DNA, 14 bp, Homo sapiens
atacaattattgta

SEQ ID NO: 5241194 - DNA, 16 bp, Homo sapiens
atacaattcaaatgct

SEQ ID NO: 5241195 - DNA, 17 bp, Homo sapiens
atacaattcaaatgctt

SEQ ID NO: 5241196 - DNA, 18 bp, Homo sapiens
atacaattcagttttagt

SEQ ID NO: 5241197 - DNA, 15 bp, Homo sapiens
atacaattctacatt

SEQ ID NO: 5241198 - DNA, 24 bp, Homo sapiens
atacaatttccatatagtctattc

SEQ ID NO: 5241199 - DNA, 14 bp, Homo sapiens
atacaatttgcact

SEQ ID NO: 5241200 - DNA, 15 bp, Homo sapiens
atacaatttgcactg

SEQ ID NO: 5241201 - DNA, 14 bp, Homo sapiens
atacaatttgtact

SEQ ID NO: 5241202 - DNA, 14 bp, Homo sapiens
atacacaaaatcaa

SEQ ID NO: 5241203 - DNA, 16 bp, Homo sapiens
atacacaaaatcaaat

SEQ ID NO: 5241204 - DNA, 18 bp, Homo sapiens
atacacaaaatcaaataa

SEQ ID NO: 5241205 - DNA, 22 bp, Homo sapiens
atacacaaagctttcttttcta

SEQ ID NO: 5241206 - DNA, 13 bp, Homo sapiens
atacacaactttg

SEQ ID NO: 5241207 - DNA, 21 bp, Homo sapiens
atacacaagagggactgtatt

SEQ ID NO: 5241208 - DNA, 13 bp, Homo sapiens
atacacacaaaaa

SEQ ID NO: 5241209 - DNA, 11 bp, Homo sapiens
atacacacaca

SEQ ID NO: 5241210 - DNA, 14 bp, Homo sapiens
atacacacacacac

SEQ ID NO: 5241211 - DNA, 20 bp, Homo sapiens
atacacacacacacacagcc

SEQ ID NO: 5241212 - DNA, 22 bp, Homo sapiens
atacacacacacagacatatat

SEQ ID NO: 5241213 - DNA, 15 bp, Homo sapiens
atacacacagttact

SEQ ID NO: 5241214 - DNA, 11 bp, Homo sapiens
atacacacata

SEQ ID NO: 5241215 - DNA, 14 bp, Homo sapiens
atacacacatacat

SEQ ID NO: 5241216 - DNA, 13 bp, Homo sapiens
atacacacatata

SEQ ID NO: 5241217 - DNA, 15 bp, Homo sapiens
atacacacatataca

SEQ ID NO: 5241218 - DNA, 20 bp, Homo sapiens
atacacacatatacatatat

SEQ ID NO: 5241219 - DNA, 14 bp, Homo sapiens
atacacacatatgt

SEQ ID NO: 5241220 - DNA, 20 bp, Homo sapiens
atacacaccctgcccctgca

SEQ ID NO: 5241221 - DNA, 15 bp, Homo sapiens
atacacacgctgcct

SEQ ID NO: 5241222 - DNA, 17 bp, Homo sapiens
atacacactcaaatcaa

SEQ ID NO: 5241223 - DNA, 18 bp, Homo sapiens
atacacactcaaatcaag

SEQ ID NO: 5241224 - DNA, 20 bp, Homo sapiens
atacacactcaaatcaagaa

SEQ ID NO: 5241225 - DNA, 18 bp, Homo sapiens
atattgccctaattaaaa

SEQ ID NO: 5241226 - DNA, 20 bp, Homo sapiens
atattgccctaattaaaaac

SEQ ID NO: 5241227 - DNA, 22 bp, Homo sapiens
atattgccctaattaaaaactg

SEQ ID NO: 5241228 - DNA, 23 bp, Homo sapiens
atattgccctaattaaaaactgt

SEQ ID NO: 5241229 - DNA, 16 bp, Homo sapiens
atattgccgcactagg

SEQ ID NO: 5241230 - DNA, 23 bp, Homo sapiens
atattgcctaagaataaacattt

SEQ ID NO: 5241231 - DNA, 11 bp, Homo sapiens
atattgcctta

SEQ ID NO: 5241232 - DNA, 12 bp, Homo sapiens
atattgccttat

SEQ ID NO: 5241233 - DNA, 15 bp, Homo sapiens
atattgccttatttg

SEQ ID NO: 5241234 - DNA, 24 bp, Homo sapiens
atattgccttgatgtttctatatg

SEQ ID NO: 5241235 - DNA, 15 bp, Homo sapiens
atattgcgagaaaca

SEQ ID NO: 5241236 - DNA, 17 bp, Homo sapiens
atattgcgagaaacaga

SEQ ID NO: 5241237 - DNA, 18 bp, Homo sapiens
atattgctaaaagtgcat

SEQ ID NO: 5241238 - DNA, 18 bp, Homo sapiens
atattgctactataatca

SEQ ID NO: 5241239 - DNA, 18 bp, Homo sapiens
atattgctctatgttagt

SEQ ID NO: 5241240 - DNA, 20 bp, Homo sapiens
atattgctcttaaaaatctt

SEQ ID NO: 5241241 - DNA, 21 bp, Homo sapiens
atattgctcttaaaaatcttg

SEQ ID NO: 5241242 - DNA, 21 bp, Homo sapiens
atattgctgaagaatctactt

SEQ ID NO: 5241243 - DNA, 18 bp, Homo sapiens
atattgctgaatgcaaga

SEQ ID NO: 5241244 - DNA, 19 bp, Homo sapiens
atattgcttcaatttcaaa

SEQ ID NO: 5241245 - DNA, 14 bp, Homo sapiens
atattgcttcctgt

SEQ ID NO: 5241246 - DNA, 16 bp, Homo sapiens
atattgctttttctaa

SEQ ID NO: 5241247 - DNA, 21 bp, Homo sapiens
atattggattgcgcctttgta

SEQ ID NO: 5241248 - DNA, 17 bp, Homo sapiens
atattggcatggatttc

SEQ ID NO: 5241249 - DNA, 21 bp, Homo sapiens
atattggccaaggaaaggcac

SEQ ID NO: 5241250 - DNA, 16 bp, Homo sapiens
atattggggaccaaat

SEQ ID NO: 5241251 - DNA, 20 bp, Homo sapiens
atattggggaccaaatcaaa

SEQ ID NO: 5241252 - DNA, 15 bp, Homo sapiens
atattgggtgtagat

SEQ ID NO: 5241253 - DNA, 16 bp, Homo sapiens
atattgggtgtagatt

SEQ ID NO: 5241254 - DNA, 15 bp, Homo sapiens
atattggtaattaaa

SEQ ID NO: 5241255 - DNA, 16 bp, Homo sapiens
atattggtattaaaga

SEQ ID NO: 5241256 - DNA, 18 bp, Homo sapiens
atattggtattaaagaat

SEQ ID NO: 5241257 - DNA, 23 bp, Homo sapiens
atattggtccagaagttcaaaat

SEQ ID NO: 5241258 - DNA, 22 bp, Homo sapiens
atattggtgctatttaacattt

SEQ ID NO: 5241259 - DNA, 22 bp, Homo sapiens
atattggtggccggtggttttg

SEQ ID NO: 5241260 - DNA, 16 bp, Homo sapiens
atattggtgtatatta

SEQ ID NO: 5241261 - DNA, 18 bp, Homo sapiens
atattggtgtatattata

SEQ ID NO: 5241262 - DNA, 14 bp, Homo sapiens
atattggtgtgaat

SEQ ID NO: 5241263 - DNA, 23 bp, Homo sapiens
atattggtgtgaatgctgtacct

SEQ ID NO: 5241264 - DNA, 17 bp, Homo sapiens
atattggtttatgtagt

SEQ ID NO: 5241265 - DNA, 18 bp, Homo sapiens
atattggttttatgatga

SEQ ID NO: 5241266 - DNA, 16 bp, Homo sapiens
atattgtaaaacaggt

SEQ ID NO: 5241267 - DNA, 22 bp, Homo sapiens
atattgtaaaactttggtgcat

SEQ ID NO: 5241268 - DNA, 15 bp, Homo sapiens
atattgtaaatgcta

SEQ ID NO: 5241269 - DNA, 14 bp, Homo sapiens
atattgtaactcac

SEQ ID NO: 5241270 - DNA, 15 bp, Homo sapiens
atattgtaagaaata

SEQ ID NO: 5241271 - DNA, 18 bp, Homo sapiens
atattgtaatatgacaga

SEQ ID NO: 5241272 - DNA, 16 bp, Homo sapiens
atattgtaatcacatt

SEQ ID NO: 5241273 - DNA, 12 bp, Homo sapiens
atattgtacact

SEQ ID NO: 5241274 - DNA, 15 bp, Homo sapiens
atattgtacactttt

SEQ ID NO: 5241275 - DNA, 13 bp, Homo sapiens
atattgtacagtt

SEQ ID NO: 5241276 - DNA, 14 bp, Homo sapiens
atattgtacataaa

SEQ ID NO: 5241277 - DNA, 20 bp, Homo sapiens
atattgtagcagttacagct

SEQ ID NO: 5241278 - DNA, 14 bp, Homo sapiens
atattgtatattct

SEQ ID NO: 5241279 - DNA, 15 bp, Homo sapiens
atattgtatattctg

SEQ ID NO: 5241280 - DNA, 18 bp, Homo sapiens
atattgtatattctggaa

SEQ ID NO: 5241281 - DNA, 12 bp, Homo sapiens
atattgtatctc

SEQ ID NO: 5241282 - DNA, 20 bp, Homo sapiens
atattgtattgctgctgtgc

SEQ ID NO: 5241283 - DNA, 20 bp, Homo sapiens
atattgtattttagatatat

SEQ ID NO: 5241284 - DNA, 12 bp, Homo sapiens
atattgtcagat

SEQ ID NO: 5241285 - DNA, 12 bp, Homo sapiens
atattgtcatct

SEQ ID NO: 5241286 - DNA, 23 bp, Homo sapiens
atattgtcatgtttattctaata

SEQ ID NO: 5241287 - DNA, 15 bp, Homo sapiens
atattgtcattcctg

SEQ ID NO: 5241288 - DNA, 20 bp, Homo sapiens
atattgtctcttttttaagt

SEQ ID NO: 5241289 - DNA, 13 bp, Homo sapiens
atattgtgattct

SEQ ID NO: 5241290 - DNA, 19 bp, Homo sapiens
atattgtgattctgccttt

SEQ ID NO: 5241291 - DNA, 20 bp, Homo sapiens
atattgtgcacatttaataa

SEQ ID NO: 5241292 - DNA, 13 bp, Homo sapiens
atattgtgccaag

SEQ ID NO: 5241293 - DNA, 20 bp, Homo sapiens
atattgtggaataaatcctt

SEQ ID NO: 5241294 - DNA, 18 bp, Homo sapiens
atattgtggatgtgttca

SEQ ID NO: 5241295 - DNA, 14 bp, Homo sapiens
atattgtgtaattt

SEQ ID NO: 5241296 - DNA, 18 bp, Homo sapiens
atattgtgtcatagaatt

SEQ ID NO: 5241297 - DNA, 18 bp, Homo sapiens
atattgtgttttaacacc

SEQ ID NO: 5241298 - DNA, 12 bp, Homo sapiens
atattgttaagg

SEQ ID NO: 5241299 - DNA, 15 bp, Homo sapiens
atattgttataaata

SEQ ID NO: 5241300 - DNA, 15 bp, Homo sapiens
atattgttcaaacaa

SEQ ID NO: 5241301 - DNA, 21 bp, Homo sapiens
atattgttcaaacaatatcat

SEQ ID NO: 5241302 - DNA, 14 bp, Homo sapiens
atattgttcctaag

SEQ ID NO: 5241303 - DNA, 19 bp, Homo sapiens
atattgttcctaagttctt

SEQ ID NO: 5241304 - DNA, 23 bp, Homo sapiens
atattgttctgctgtctgggact

SEQ ID NO: 5241305 - DNA, 15 bp, Homo sapiens
atattgttcttccca

SEQ ID NO: 5241306 - DNA, 17 bp, Homo sapiens
atattgttggcacagaa

SEQ ID NO: 5241307 - DNA, 21 bp, Homo sapiens
atattgttggcacagaacagg

SEQ ID NO: 5241308 - DNA, 16 bp, Homo sapiens
atattgtttaatgcaa

SEQ ID NO: 5241309 - DNA, 18 bp, Homo sapiens
atattgtttaatgcaaat

SEQ ID NO: 5241310 - DNA, 14 bp, Homo sapiens
atattgtttgctaa

SEQ ID NO: 5241311 - DNA, 14 bp, Homo sapiens
atattgtttgctgt

SEQ ID NO: 5241312 - DNA, 16 bp, Homo sapiens
atattgtttggtaaat

SEQ ID NO: 5241313 - DNA, 18 bp, Homo sapiens
atattgtttggtaaatgt

SEQ ID NO: 5241314 - DNA, 21 bp, Homo sapiens
atattgtttggtaaatgtttc

SEQ ID NO: 5241315 - DNA, 19 bp, Homo sapiens
atattgttttacaatagtt

SEQ ID NO: 5241316 - DNA, 19 bp, Homo sapiens
atattgttttctcctttct

SEQ ID NO: 5241317 - DNA, 21 bp, Homo sapiens
atattgttttctcctttctgg

SEQ ID NO: 5241318 - DNA, 16 bp, Homo sapiens
atattgttttgtgact

SEQ ID NO: 5241319 - DNA, 17 bp, Homo sapiens
atattgtttttatatat

SEQ ID NO: 5241320 - DNA, 18 bp, Homo sapiens
atattgtttttgtattta

SEQ ID NO: 5241321 - DNA, 21 bp, Homo sapiens
atatttaaaaaaaaaatcagt

SEQ ID NO: 5241322 - DNA, 17 bp, Homo sapiens
atatttaaaaaattaaa

SEQ ID NO: 5241323 - DNA, 20 bp, Homo sapiens
atatttaaaaaattatggaa

SEQ ID NO: 5241324 - DNA, 14 bp, Homo sapiens
atatttaaaaataa

SEQ ID NO: 5241325 - DNA, 14 bp, Homo sapiens
atatttaaaaatgt

SEQ ID NO: 5241326 - DNA, 15 bp, Homo sapiens
atatttaaaaatgtc

SEQ ID NO: 5241327 - DNA, 14 bp, Homo sapiens
atatttaaaaattg

SEQ ID NO: 5241328 - DNA, 22 bp, Homo sapiens
atatttaaaaattgtttcttga

SEQ ID NO: 5241329 - DNA, 21 bp, Homo sapiens
atatttaaaagacaaacacct

SEQ ID NO: 5241330 - DNA, 22 bp, Homo sapiens
atatttaaaagacaaacacctt

SEQ ID NO: 5241331 - DNA, 18 bp, Homo sapiens
atatttaaacagcagtgt

SEQ ID NO: 5241332 - DNA, 15 bp, Homo sapiens
atatttaaactcaag

SEQ ID NO: 5241333 - DNA, 23 bp, Homo sapiens
atatttaaactcaagacaatgca

SEQ ID NO: 5241334 - DNA, 15 bp, Homo sapiens
atatttaaagaatga

SEQ ID NO: 5241335 - DNA, 13 bp, Homo sapiens
atatttaaagatt

SEQ ID NO: 5241336 - DNA, 14 bp, Homo sapiens
atatttaaagatta

SEQ ID NO: 5241337 - DNA, 22 bp, Homo sapiens
atatttaaagccaaatgtaaat

SEQ ID NO: 5241338 - DNA, 12 bp, Homo sapiens
atatttaaaggg

SEQ ID NO: 5241339 - DNA, 15 bp, Homo sapiens
atatttaaagggaat

SEQ ID NO: 5241340 - DNA, 22 bp, Homo sapiens
atatttaaaggggagatactct

SEQ ID NO: 5241341 - DNA, 13 bp, Homo sapiens
atatttaaagtct

SEQ ID NO: 5241342 - DNA, 13 bp, Homo sapiens
atatttaaattat

SEQ ID NO: 5241343 - DNA, 22 bp, Homo sapiens
atatttaacaatttattctgat

SEQ ID NO: 5241344 - DNA, 22 bp, Homo sapiens
atatttaacattatttatatgg

SEQ ID NO: 5241345 - DNA, 19 bp, Homo sapiens
atatttaaccccacacagc

SEQ ID NO: 5241346 - DNA, 16 bp, Homo sapiens
atatttaactggtgca

SEQ ID NO: 5241347 - DNA, 13 bp, Homo sapiens
atatttaactttt

SEQ ID NO: 5241348 - DNA, 22 bp, Homo sapiens
atatttaagaaaatacaataaa

SEQ ID NO: 5241349 - DNA, 17 bp, Homo sapiens
atatttaagcaataaaa

SEQ ID NO: 5241350 - DNA, 22 bp, Homo sapiens
atatttaaggatagtgtgaaga

SEQ ID NO: 5241351 - DNA, 22 bp, Homo sapiens
atatttaaggtatacaacatga

SEQ ID NO: 5241352 - DNA, 14 bp, Homo sapiens
atatttaagtatat

SEQ ID NO: 5241353 - DNA, 19 bp, Homo sapiens
atatttaagtattcaagaa

SEQ ID NO: 5241354 - DNA, 11 bp, Homo sapiens
atatttaagtg

SEQ ID NO: 5241355 - DNA, 14 bp, Homo sapiens
atatttaagtttgt

SEQ ID NO: 5241356 - DNA, 9 bp, Homo sapiens
atatttaat

SEQ ID NO: 5241357 - DNA, 16 bp, Homo sapiens
atatttaataatgctt

SEQ ID NO: 5241358 - DNA, 20 bp, Homo sapiens
atatttaataggataaatta

SEQ ID NO: 5241359 - DNA, 19 bp, Homo sapiens
atatttaatatattgaata

SEQ ID NO: 5241360 - DNA, 15 bp, Homo sapiens
atatttaatatcaaa

SEQ ID NO: 5241361 - DNA, 12 bp, Homo sapiens
atatttaatgat

SEQ ID NO: 5241362 - DNA, 14 bp, Homo sapiens
atatttaatgatgt

SEQ ID NO: 5241363 - DNA, 23 bp, Homo sapiens
atatttaatgcattaaacctgtc

SEQ ID NO: 5241364 - DNA, 21 bp, Homo sapiens
atatttaatggcactgagaaa

SEQ ID NO: 5241365 - DNA, 16 bp, Homo sapiens
atatttaatgttgaac

SEQ ID NO: 5241366 - DNA, 16 bp, Homo sapiens
atatttaattaaagca

SEQ ID NO: 5241367 - DNA, 15 bp, Homo sapiens
atatttaattgtgtc

SEQ ID NO: 5241368 - DNA, 15 bp, Homo sapiens
atatttaatttgaag

SEQ ID NO: 5241369 - DNA, 22 bp, Homo sapiens
atatttacaacactttaatggg

SEQ ID NO: 5241370 - DNA, 20 bp, Homo sapiens
atatttacaataaatgaaga

SEQ ID NO: 5241371 - DNA, 18 bp, Homo sapiens
atatttacataaagactg

SEQ ID NO: 5241372 - DNA, 18 bp, Homo sapiens
atatttacatatgaaatt

SEQ ID NO: 5241373 - DNA, 20 bp, Homo sapiens
atatttacatatgaaattta

SEQ ID NO: 5241374 - DNA, 17 bp, Homo sapiens
atatttacatgctacta

SEQ ID NO: 5241375 - DNA, 16 bp, Homo sapiens
atatttaccaaagtag

SEQ ID NO: 5241376 - DNA, 19 bp, Homo sapiens
atatttacctcagcctggg

SEQ ID NO: 5241377 - DNA, 15 bp, Homo sapiens
atatttaccttgaaa

SEQ ID NO: 5241378 - DNA, 20 bp, Homo sapiens
atatttactaaaatggactg

SEQ ID NO: 5241379 - DNA, 18 bp, Homo sapiens
atatttactaactaaata

SEQ ID NO: 5241380 - DNA, 15 bp, Homo sapiens
atatttactatttca

SEQ ID NO: 5241381 - DNA, 16 bp, Homo sapiens
atatttactctttgca

SEQ ID NO: 5241382 - DNA, 17 bp, Homo sapiens
atatttactctttgcaa

SEQ ID NO: 5241383 - DNA, 13 bp, Homo sapiens
atatttactgttt

SEQ ID NO: 5241384 - DNA, 15 bp, Homo sapiens
atatttacttactgc

SEQ ID NO: 5241385 - DNA, 15 bp, Homo sapiens
atatttagaccctgt

SEQ ID NO: 5241386 - DNA, 20 bp, Homo sapiens
atatttagatgtaattttgt

SEQ ID NO: 5241387 - DNA, 22 bp, Homo sapiens
atatttagatgtaattttgtgt

SEQ ID NO: 5241388 - DNA, 19 bp, Homo sapiens
atatttagcaaataatttc

SEQ ID NO: 5241389 - DNA, 23 bp, Homo sapiens
atatttagcataaatttaatgta

SEQ ID NO: 5241390 - DNA, 18 bp, Homo sapiens
atatttagcatccctgga

SEQ ID NO: 5241391 - DNA, 13 bp, Homo sapiens
atatttagctgtt

SEQ ID NO: 5241392 - DNA, 14 bp, Homo sapiens
atatttaggaaaat

SEQ ID NO: 5241393 - DNA, 20 bp, Homo sapiens
atatttaggaaaatgcttat

SEQ ID NO: 5241394 - DNA, 21 bp, Homo sapiens
atatttaggaaaatgcttatt

SEQ ID NO: 5241395 - DNA, 19 bp, Homo sapiens
atatttaggatttgtgttt

SEQ ID NO: 5241396 - DNA, 16 bp, Homo sapiens
atatttaggcaagaga

SEQ ID NO: 5241397 - DNA, 20 bp, Homo sapiens
atatttagtaaagcttttct

SEQ ID NO: 5241398 - DNA, 14 bp, Homo sapiens
atatttagtatacc

SEQ ID NO: 5241399 - DNA, 18 bp, Homo sapiens
atatttagtgttcataaa

SEQ ID NO: 5241400 - DNA, 23 bp, Homo sapiens
atatttagttacgtataatgctt

SEQ ID NO: 5241401 - DNA, 21 bp, Homo sapiens
atatttagttatagtttcaga

SEQ ID NO: 5241402 - DNA, 14 bp, Homo sapiens
atatttataaatat

SEQ ID NO: 5241403 - DNA, 15 bp, Homo sapiens
atatttataactcat

SEQ ID NO: 5241404 - DNA, 21 bp, Homo sapiens
atacacagaggagtgcagcct

SEQ ID NO: 5241405 - DNA, 14 bp, Homo sapiens
atacacaggatcct

SEQ ID NO: 5241406 - DNA, 17 bp, Homo sapiens
atacacaggtgagaaag

SEQ ID NO: 5241407 - DNA, 13 bp, Homo sapiens
atacacagtaatt

SEQ ID NO: 5241408 - DNA, 17 bp, Homo sapiens
atacacagttaaataaa

SEQ ID NO: 5241409 - DNA, 20 bp, Homo sapiens
atacacagttaaataaatag

SEQ ID NO: 5241410 - DNA, 22 bp, Homo sapiens
atacacataattaaagtgtcca

SEQ ID NO: 5241411 - DNA, 12 bp, Homo sapiens
atacacatacat

SEQ ID NO: 5241412 - DNA, 22 bp, Homo sapiens
atacacatacatatatacattt

SEQ ID NO: 5241413 - DNA, 20 bp, Homo sapiens
atacacatagttctgtaata

SEQ ID NO: 5241414 - DNA, 16 bp, Homo sapiens
atacacatataaaaac

SEQ ID NO: 5241415 - DNA, 14 bp, Homo sapiens
atacacatatacct

SEQ ID NO: 5241416 - DNA, 18 bp, Homo sapiens
atacacatctctgtcagt

SEQ ID NO: 5241417 - DNA, 16 bp, Homo sapiens
atacacatggatgcac

SEQ ID NO: 5241418 - DNA, 19 bp, Homo sapiens
atacacattacagccaggt

SEQ ID NO: 5241419 - DNA, 21 bp, Homo sapiens
atacacattatcactgaaaaa

SEQ ID NO: 5241420 - DNA, 14 bp, Homo sapiens
atacacatttgcta

SEQ ID NO: 5241421 - DNA, 14 bp, Homo sapiens
atacacattttgta

SEQ ID NO: 5241422 - DNA, 15 bp, Homo sapiens
atacacattttgtaa

SEQ ID NO: 5241423 - DNA, 15 bp, Homo sapiens
atacaccaaacattt

SEQ ID NO: 5241424 - DNA, 16 bp, Homo sapiens
atacaccaaatagctt

SEQ ID NO: 5241425 - DNA, 16 bp, Homo sapiens
atacaccaattgattt

SEQ ID NO: 5241426 - DNA, 21 bp, Homo sapiens
atacaccacctcactcctgtt

SEQ ID NO: 5241427 - DNA, 18 bp, Homo sapiens
atacaccactacattctg

SEQ ID NO: 5241428 - DNA, 19 bp, Homo sapiens
atacaccactacattctgt

SEQ ID NO: 5241429 - DNA, 17 bp, Homo sapiens
atacaccagcattcctt

SEQ ID NO: 5241430 - DNA, 18 bp, Homo sapiens
atacaccagcattccttt

SEQ ID NO: 5241431 - DNA, 24 bp, Homo sapiens
atacacccaagatgggcatctttt

SEQ ID NO: 5241432 - DNA, 18 bp, Homo sapiens
atacaccgggcctggaga

SEQ ID NO: 5241433 - DNA, 16 bp, Homo sapiens
atacaccgtttagaaa

SEQ ID NO: 5241434 - DNA, 23 bp, Homo sapiens
atacaccgtttagaaaaaacaat

SEQ ID NO: 5241435 - DNA, 14 bp, Homo sapiens
atacacctggaaca

SEQ ID NO: 5241436 - DNA, 17 bp, Homo sapiens
atacacgaggtatgagg

SEQ ID NO: 5241437 - DNA, 19 bp, Homo sapiens
atacactaattcctttcta

SEQ ID NO: 5241438 - DNA, 13 bp, Homo sapiens
atacactacaaat

SEQ ID NO: 5241439 - DNA, 17 bp, Homo sapiens
atacactagcttgaact

SEQ ID NO: 5241440 - DNA, 15 bp, Homo sapiens
atacactatgaaatt

SEQ ID NO: 5241441 - DNA, 17 bp, Homo sapiens
atacactatgaaattca

SEQ ID NO: 5241442 - DNA, 19 bp, Homo sapiens
atacactccacttgaagca

SEQ ID NO: 5241443 - DNA, 14 bp, Homo sapiens
atacactcctgctg

SEQ ID NO: 5241444 - DNA, 17 bp, Homo sapiens
atacactgacttggtgc

SEQ ID NO: 5241445 - DNA, 19 bp, Homo sapiens
atacactgcactttgttta

SEQ ID NO: 5241446 - DNA, 23 bp, Homo sapiens
atacactgcactttgtttagaaa

SEQ ID NO: 5241447 - DNA, 12 bp, Homo sapiens
atacactgcatt

SEQ ID NO: 5241448 - DNA, 14 bp, Homo sapiens
atacactgcattcg

SEQ ID NO: 5241449 - DNA, 15 bp, Homo sapiens
atacactgcattcgt

SEQ ID NO: 5241450 - DNA, 11 bp, Homo sapiens
atacactggaa

SEQ ID NO: 5241451 - DNA, 15 bp, Homo sapiens
atacactggaattca

SEQ ID NO: 5241452 - DNA, 17 bp, Homo sapiens
atacactggaattcaga

SEQ ID NO: 5241453 - DNA, 15 bp, Homo sapiens
atacactgtaagctt

SEQ ID NO: 5241454 - DNA, 15 bp, Homo sapiens
atacactgtatctaa

SEQ ID NO: 5241455 - DNA, 23 bp, Homo sapiens
atacactgtatctaaaaaataac

SEQ ID NO: 5241456 - DNA, 14 bp, Homo sapiens
atacactgtgaact

SEQ ID NO: 5241457 - DNA, 22 bp, Homo sapiens
atacacttaaacttgcacattt

SEQ ID NO: 5241458 - DNA, 13 bp, Homo sapiens
atacacttacact

SEQ ID NO: 5241459 - DNA, 22 bp, Homo sapiens
atacacttattggaactctgct

SEQ ID NO: 5241460 - DNA, 19 bp, Homo sapiens
atacacttcttttgaacat

SEQ ID NO: 5241461 - DNA, 16 bp, Homo sapiens
atacacttgtaaataa

SEQ ID NO: 5241462 - DNA, 19 bp, Homo sapiens
atacacttgtataaatgta

SEQ ID NO: 5241463 - DNA, 20 bp, Homo sapiens
atacacttgtgattataaaa

SEQ ID NO: 5241464 - DNA, 15 bp, Homo sapiens
atacactttgttgca

SEQ ID NO: 5241465 - DNA, 23 bp, Homo sapiens
atacactttttctctttccatga

SEQ ID NO: 5241466 - DNA, 12 bp, Homo sapiens
atacagaaaaat

SEQ ID NO: 5241467 - DNA, 23 bp, Homo sapiens
atacagaaagatggatgtgcttt

SEQ ID NO: 5241468 - DNA, 20 bp, Homo sapiens
atacagaactctttcaaaac

SEQ ID NO: 5241469 - DNA, 20 bp, Homo sapiens
atacagaagcccatgtcttc

SEQ ID NO: 5241470 - DNA, 15 bp, Homo sapiens
atacagaatttatag

SEQ ID NO: 5241471 - DNA, 18 bp, Homo sapiens
atacagacactaagttat

SEQ ID NO: 5241472 - DNA, 21 bp, Homo sapiens
atacagaccgaactgttgtat

SEQ ID NO: 5241473 - DNA, 20 bp, Homo sapiens
atacagacctaatatcattt

SEQ ID NO: 5241474 - DNA, 15 bp, Homo sapiens
atacagagaagtcac

SEQ ID NO: 5241475 - DNA, 21 bp, Homo sapiens
atacagagatatacaaatata

SEQ ID NO: 5241476 - DNA, 23 bp, Homo sapiens
atacagagcctgttttaaaaaat

SEQ ID NO: 5241477 - DNA, 14 bp, Homo sapiens
atacagagctctct

SEQ ID NO: 5241478 - DNA, 12 bp, Homo sapiens
atacagaggaaa

SEQ ID NO: 5241479 - DNA, 21 bp, Homo sapiens
atacagaggaaatctgtaaca

SEQ ID NO: 5241480 - DNA, 15 bp, Homo sapiens
atacagaggatgcct

SEQ ID NO: 5241481 - DNA, 13 bp, Homo sapiens
atacagagtaatt

SEQ ID NO: 5241482 - DNA, 19 bp, Homo sapiens
atacagagtaattatagga

SEQ ID NO: 5241483 - DNA, 17 bp, Homo sapiens
atacagagtacgttaaa

SEQ ID NO: 5241484 - DNA, 21 bp, Homo sapiens
atacagagtacgttaaaagca

SEQ ID NO: 5241485 - DNA, 15 bp, Homo sapiens
atacagagtatattt

SEQ ID NO: 5241486 - DNA, 18 bp, Homo sapiens
atacagataaatgattca

SEQ ID NO: 5241487 - DNA, 20 bp, Homo sapiens
atacagataattcatttgta

SEQ ID NO: 5241488 - DNA, 23 bp, Homo sapiens
atacagatagatatatgctctgc

SEQ ID NO: 5241489 - DNA, 14 bp, Homo sapiens
atacagatatattt

SEQ ID NO: 5241490 - DNA, 18 bp, Homo sapiens
atacagatatattttctt

SEQ ID NO: 5241491 - DNA, 16 bp, Homo sapiens
atacagatccgcatgt

SEQ ID NO: 5241492 - DNA, 17 bp, Homo sapiens
atacagatccgcatgtg

SEQ ID NO: 5241493 - DNA, 20 bp, Homo sapiens
atacagatccgcatgtgtct

SEQ ID NO: 5241494 - DNA, 22 bp, Homo sapiens
atacagatgaaaatttgagact

SEQ ID NO: 5241495 - DNA, 19 bp, Homo sapiens
atacagatggagcaaatgt

SEQ ID NO: 5241496 - DNA, 23 bp, Homo sapiens
atacagatggtgtcctgcatgta

SEQ ID NO: 5241497 - DNA, 22 bp, Homo sapiens
atacagattctagccaaactat

SEQ ID NO: 5241498 - DNA, 14 bp, Homo sapiens
atacagatttgtaa

SEQ ID NO: 5241499 - DNA, 16 bp, Homo sapiens
atacagatttgtaaca

SEQ ID NO: 5241500 - DNA, 15 bp, Homo sapiens
atacagcagcaagaa

SEQ ID NO: 5241501 - DNA, 17 bp, Homo sapiens
atacagcagcaagaaaa

SEQ ID NO: 5241502 - DNA, 20 bp, Homo sapiens
atacagcagcaagaaaaaaa

SEQ ID NO: 5241503 - DNA, 16 bp, Homo sapiens
atacagcatacttcaa

SEQ ID NO: 5241504 - DNA, 13 bp, Homo sapiens
atacagcatgaga

SEQ ID NO: 5241505 - DNA, 22 bp, Homo sapiens
atacagcatgagattgtacatt

SEQ ID NO: 5241506 - DNA, 20 bp, Homo sapiens
atacagcattacaaattgct

SEQ ID NO: 5241507 - DNA, 19 bp, Homo sapiens
atacagcattgactcagat

SEQ ID NO: 5241508 - DNA, 16 bp, Homo sapiens
atacagcatttctttg

SEQ ID NO: 5241509 - DNA, 21 bp, Homo sapiens
atacagcatttctttggaaac

SEQ ID NO: 5241510 - DNA, 20 bp, Homo sapiens
atacagccctcccccagcag

SEQ ID NO: 5241511 - DNA, 22 bp, Homo sapiens
atacagcctctacagccgtccc

SEQ ID NO: 5241512 - DNA, 20 bp, Homo sapiens
atacagcctgaataaaccaa

SEQ ID NO: 5241513 - DNA, 15 bp, Homo sapiens
atacagctattaaaa

SEQ ID NO: 5241514 - DNA, 17 bp, Homo sapiens
atacagctgaagtcaaa

SEQ ID NO: 5241515 - DNA, 15 bp, Homo sapiens
atacagctgcactga

SEQ ID NO: 5241516 - DNA, 12 bp, Homo sapiens
atacagctggct

SEQ ID NO: 5241517 - DNA, 12 bp, Homo sapiens
atacagcttcat

SEQ ID NO: 5241518 - DNA, 13 bp, Homo sapiens
atacagctttctg

SEQ ID NO: 5241519 - DNA, 22 bp, Homo sapiens
atacaggaaaagctgctgacag

SEQ ID NO: 5241520 - DNA, 14 bp, Homo sapiens
atacaggaaacagt

SEQ ID NO: 5241521 - DNA, 16 bp, Homo sapiens
atacaggaaacagttg

SEQ ID NO: 5241522 - DNA, 20 bp, Homo sapiens
atacaggagacccaacaatg

SEQ ID NO: 5241523 - DNA, 17 bp, Homo sapiens
atacaggaggatgtgaa

SEQ ID NO: 5241524 - DNA, 21 bp, Homo sapiens
atacaggagttttcactttct

SEQ ID NO: 5241525 - DNA, 21 bp, Homo sapiens
atacaggatgatgactatgga

SEQ ID NO: 5241526 - DNA, 17 bp, Homo sapiens
atacaggattattttga

SEQ ID NO: 5241527 - DNA, 16 bp, Homo sapiens
atacaggggaatattt

SEQ ID NO: 5241528 - DNA, 15 bp, Homo sapiens
atacaggtaacatta

SEQ ID NO: 5241529 - DNA, 22 bp, Homo sapiens
atacaggtaacattataaatga

SEQ ID NO: 5241530 - DNA, 11 bp, Homo sapiens
atacaggtgct

SEQ ID NO: 5241531 - DNA, 20 bp, Homo sapiens
atacaggttaacctgcagaa

SEQ ID NO: 5241532 - DNA, 22 bp, Homo sapiens
atacaggttaacctgcagaaac

SEQ ID NO: 5241533 - DNA, 13 bp, Homo sapiens
atacagtaaagtt

SEQ ID NO: 5241534 - DNA, 20 bp, Homo sapiens
atacagtaaagtttaaaaaa

SEQ ID NO: 5241535 - DNA, 20 bp, Homo sapiens
atacagtaactttatgtgta

SEQ ID NO: 5241536 - DNA, 13 bp, Homo sapiens
atacagtaagcat

SEQ ID NO: 5241537 - DNA, 15 bp, Homo sapiens
atacagtacaggcag

SEQ ID NO: 5241538 - DNA, 10 bp, Homo sapiens
atacagtagt

SEQ ID NO: 5241539 - DNA, 20 bp, Homo sapiens
atacagtagtgagaagaata

SEQ ID NO: 5241540 - DNA, 23 bp, Homo sapiens
atacagtattatagacaaaagaa

SEQ ID NO: 5241541 - DNA, 18 bp, Homo sapiens
atacagtattatagatat

SEQ ID NO: 5241542 - DNA, 22 bp, Homo sapiens
atacagtattatttagtaaaat

SEQ ID NO: 5241543 - DNA, 14 bp, Homo sapiens
atacagtattctgt

SEQ ID NO: 5241544 - DNA, 15 bp, Homo sapiens
atacagtcaacaagc

SEQ ID NO: 5241545 - DNA, 15 bp, Homo sapiens
atacagtcaggacac

SEQ ID NO: 5241546 - DNA, 21 bp, Homo sapiens
atacagtcattatttaaagca

SEQ ID NO: 5241547 - DNA, 13 bp, Homo sapiens
atacagtcattcc

SEQ ID NO: 5241548 - DNA, 17 bp, Homo sapiens
atacagtcattccaaga

SEQ ID NO: 5241549 - DNA, 17 bp, Homo sapiens
atacagtccctaaagaa

SEQ ID NO: 5241550 - DNA, 18 bp, Homo sapiens
atacagtccctaaagaaa

SEQ ID NO: 5241551 - DNA, 20 bp, Homo sapiens
atacagtccctaaagaaaaa

SEQ ID NO: 5241552 - DNA, 17 bp, Homo sapiens
atacagtcctagagaat

SEQ ID NO: 5241553 - DNA, 17 bp, Homo sapiens
atacagtcttccacaaa

SEQ ID NO: 5241554 - DNA, 18 bp, Homo sapiens
atacagtcttccacaaag

SEQ ID NO: 5241555 - DNA, 21 bp, Homo sapiens
atacagtcttccacaaagaaa

SEQ ID NO: 5241556 - DNA, 19 bp, Homo sapiens
atacagtcttccatttgca

SEQ ID NO: 5241557 - DNA, 22 bp, Homo sapiens
atacagtgagtcctcctcttcc

SEQ ID NO: 5241558 - DNA, 17 bp, Homo sapiens
atacagtgcagagcctt

SEQ ID NO: 5241559 - DNA, 21 bp, Homo sapiens
atacagtgcagagccttctca

SEQ ID NO: 5241560 - DNA, 12 bp, Homo sapiens
atacagtgcatc

SEQ ID NO: 5241561 - DNA, 13 bp, Homo sapiens
atacagtgcccac

SEQ ID NO: 5241562 - DNA, 15 bp, Homo sapiens
atacagtgcccaccg

SEQ ID NO: 5241563 - DNA, 12 bp, Homo sapiens
atacagtgcctt

SEQ ID NO: 5241564 - DNA, 14 bp, Homo sapiens
atacagtgctttat

SEQ ID NO: 5241565 - DNA, 16 bp, Homo sapiens
atacagtgctttatgg

SEQ ID NO: 5241566 - DNA, 15 bp, Homo sapiens
atacagtgtacatgt

SEQ ID NO: 5241567 - DNA, 18 bp, Homo sapiens
atacagtgtacatgtaca

SEQ ID NO: 5241568 - DNA, 14 bp, Homo sapiens
atacagtgttaaaa

SEQ ID NO: 5241569 - DNA, 14 bp, Homo sapiens
atacagtgttattt

SEQ ID NO: 5241570 - DNA, 15 bp, Homo sapiens
atacagtgttatttt

SEQ ID NO: 5241571 - DNA, 23 bp, Homo sapiens
atacagtgttattttctttgaaa

SEQ ID NO: 5241572 - DNA, 17 bp, Homo sapiens
atacagtgttttttagg

SEQ ID NO: 5241573 - DNA, 22 bp, Homo sapiens
atacagttaacacaatgtgaat

SEQ ID NO: 5241574 - DNA, 16 bp, Homo sapiens
atacagttacttaatg

SEQ ID NO: 5241575 - DNA, 15 bp, Homo sapiens
atacagttataaaat

SEQ ID NO: 5241576 - DNA, 14 bp, Homo sapiens
atacagttattttg

SEQ ID NO: 5241577 - DNA, 21 bp, Homo sapiens
atacagttctgctctggttgt

SEQ ID NO: 5241578 - DNA, 22 bp, Homo sapiens
atacagttgtataaactgtatt

SEQ ID NO: 5241579 - DNA, 16 bp, Homo sapiens
atacagttgttggcct

SEQ ID NO: 5241580 - DNA, 21 bp, Homo sapiens
atacagtttataaagccaaga

SEQ ID NO: 5241581 - DNA, 23 bp, Homo sapiens
atacagtttataaagccaagaat

SEQ ID NO: 5241582 - DNA, 17 bp, Homo sapiens
atatttataactcatca

SEQ ID NO: 5241583 - DNA, 20 bp, Homo sapiens
atatttataactcatcataa

SEQ ID NO: 5241584 - DNA, 14 bp, Homo sapiens
atatttataattaa

SEQ ID NO: 5241585 - DNA, 18 bp, Homo sapiens
atatttataattaaagaa

SEQ ID NO: 5241586 - DNA, 20 bp, Homo sapiens
atatttatactctagaacat

SEQ ID NO: 5241587 - DNA, 21 bp, Homo sapiens
atatttatagcaaagttatct

SEQ ID NO: 5241588 - DNA, 13 bp, Homo sapiens
atatttatatact

SEQ ID NO: 5241589 - DNA, 19 bp, Homo sapiens
atatttatatactttttca

SEQ ID NO: 5241590 - DNA, 22 bp, Homo sapiens
atatttatcaaacttgtgctga

SEQ ID NO: 5241591 - DNA, 18 bp, Homo sapiens
atatttatcatatttaat

SEQ ID NO: 5241592 - DNA, 12 bp, Homo sapiens
atatttatccaa

SEQ ID NO: 5241593 - DNA, 13 bp, Homo sapiens
atatttatgaaga

SEQ ID NO: 5241594 - DNA, 21 bp, Homo sapiens
atatttatgcagaaggtattt

SEQ ID NO: 5241595 - DNA, 21 bp, Homo sapiens
atatttatgcttaaaatatgt

SEQ ID NO: 5241596 - DNA, 19 bp, Homo sapiens
atatttatggggggagaac

SEQ ID NO: 5241597 - DNA, 19 bp, Homo sapiens
atatttatgtctatttaag

SEQ ID NO: 5241598 - DNA, 19 bp, Homo sapiens
atatttatgtgttttaata

SEQ ID NO: 5241599 - DNA, 16 bp, Homo sapiens
atatttattaaataaa

SEQ ID NO: 5241600 - DNA, 15 bp, Homo sapiens
atatttattaaattt

SEQ ID NO: 5241601 - DNA, 13 bp, Homo sapiens
atatttattactt

SEQ ID NO: 5241602 - DNA, 15 bp, Homo sapiens
atatttattatataa

SEQ ID NO: 5241603 - DNA, 17 bp, Homo sapiens
atatttattattttcat

SEQ ID NO: 5241604 - DNA, 19 bp, Homo sapiens
atatttattattttcatat

SEQ ID NO: 5241605 - DNA, 18 bp, Homo sapiens
atatttattcataatgaa

SEQ ID NO: 5241606 - DNA, 17 bp, Homo sapiens
atatttattcatctgca

SEQ ID NO: 5241607 - DNA, 19 bp, Homo sapiens
atatttattcattatttgt

SEQ ID NO: 5241608 - DNA, 14 bp, Homo sapiens
atatttattgaatt

SEQ ID NO: 5241609 - DNA, 22 bp, Homo sapiens
atatttattgaattattttgtt

SEQ ID NO: 5241610 - DNA, 18 bp, Homo sapiens
atatttattgactcttga

SEQ ID NO: 5241611 - DNA, 17 bp, Homo sapiens
atatttattgatgtttt

SEQ ID NO: 5241612 - DNA, 14 bp, Homo sapiens
atatttattgcttt

SEQ ID NO: 5241613 - DNA, 21 bp, Homo sapiens
atatttattgctttataaata

SEQ ID NO: 5241614 - DNA, 13 bp, Homo sapiens
atatttattgtat

SEQ ID NO: 5241615 - DNA, 23 bp, Homo sapiens
atatttattgtgcattaaaatta

SEQ ID NO: 5241616 - DNA, 22 bp, Homo sapiens
atatttattgtttatttatcag

SEQ ID NO: 5241617 - DNA, 20 bp, Homo sapiens
atatttatttaaaatttcgt

SEQ ID NO: 5241618 - DNA, 15 bp, Homo sapiens
atatttatttcagat

SEQ ID NO: 5241619 - DNA, 14 bp, Homo sapiens
atatttatttcctg

SEQ ID NO: 5241620 - DNA, 15 bp, Homo sapiens
atatttatttcctgc

SEQ ID NO: 5241621 - DNA, 14 bp, Homo sapiens
atatttatttctag

SEQ ID NO: 5241622 - DNA, 13 bp, Homo sapiens
atatttattttaa

SEQ ID NO: 5241623 - DNA, 14 bp, Homo sapiens
atatttattttaat

SEQ ID NO: 5241624 - DNA, 20 bp, Homo sapiens
atatttattttcagtatact

SEQ ID NO: 5241625 - DNA, 13 bp, Homo sapiens
atatttattttct

SEQ ID NO: 5241626 - DNA, 22 bp, Homo sapiens
atatttattttcttttgaattg

SEQ ID NO: 5241627 - DNA, 13 bp, Homo sapiens
atatttattttta

SEQ ID NO: 5241628 - DNA, 17 bp, Homo sapiens
atatttcaaacattttg

SEQ ID NO: 5241629 - DNA, 19 bp, Homo sapiens
atatttcaaatgattatga

SEQ ID NO: 5241630 - DNA, 20 bp, Homo sapiens
atatttcaaatgattatgat

SEQ ID NO: 5241631 - DNA, 19 bp, Homo sapiens
atatttcaagctcatgtca

SEQ ID NO: 5241632 - DNA, 12 bp, Homo sapiens
atatttcaagtg

SEQ ID NO: 5241633 - DNA, 12 bp, Homo sapiens
atatttcaatct

SEQ ID NO: 5241634 - DNA, 14 bp, Homo sapiens
atatttcaatcttt

SEQ ID NO: 5241635 - DNA, 16 bp, Homo sapiens
atatttcaatctttta

SEQ ID NO: 5241636 - DNA, 16 bp, Homo sapiens
atatttcacaggctgt

SEQ ID NO: 5241637 - DNA, 12 bp, Homo sapiens
atatttcactta

SEQ ID NO: 5241638 - DNA, 12 bp, Homo sapiens
atatttcagaaa

SEQ ID NO: 5241639 - DNA, 15 bp, Homo sapiens
atatttcagaaatac

SEQ ID NO: 5241640 - DNA, 20 bp, Homo sapiens
atatttcagaaatacagata

SEQ ID NO: 5241641 - DNA, 14 bp, Homo sapiens
atatttcagacatt

SEQ ID NO: 5241642 - DNA, 15 bp, Homo sapiens
atatttcagacattt

SEQ ID NO: 5241643 - DNA, 23 bp, Homo sapiens
atatttcagatatcaaaattcta

SEQ ID NO: 5241644 - DNA, 23 bp, Homo sapiens
atatttcattttaacatgatttc

SEQ ID NO: 5241645 - DNA, 16 bp, Homo sapiens
atatttcattttgaga

SEQ ID NO: 5241646 - DNA, 15 bp, Homo sapiens
atatttccaaatatt

SEQ ID NO: 5241647 - DNA, 20 bp, Homo sapiens
atatttccaaatattctaaa

SEQ ID NO: 5241648 - DNA, 18 bp, Homo sapiens
atatttccatatggattt

SEQ ID NO: 5241649 - DNA, 16 bp, Homo sapiens
atatttccattcagac

SEQ ID NO: 5241650 - DNA, 14 bp, Homo sapiens
atatttccatttct

SEQ ID NO: 5241651 - DNA, 19 bp, Homo sapiens
atatttcccatgatttcat

SEQ ID NO: 5241652 - DNA, 21 bp, Homo sapiens
atatttccctcccctggggac

SEQ ID NO: 5241653 - DNA, 19 bp, Homo sapiens
atatttccctgaaggaacc

SEQ ID NO: 5241654 - DNA, 19 bp, Homo sapiens
atatttcccttacaattaa

SEQ ID NO: 5241655 - DNA, 16 bp, Homo sapiens
atatttcctaaggcat

SEQ ID NO: 5241656 - DNA, 19 bp, Homo sapiens
atatttcctccattcctgc

SEQ ID NO: 5241657 - DNA, 14 bp, Homo sapiens
atatttcctgtatt

SEQ ID NO: 5241658 - DNA, 21 bp, Homo sapiens
atatttccttaaactgtgtgg

SEQ ID NO: 5241659 - DNA, 14 bp, Homo sapiens
atatttcctttatg

SEQ ID NO: 5241660 - DNA, 12 bp, Homo sapiens
atatttcctttt

SEQ ID NO: 5241661 - DNA, 19 bp, Homo sapiens
atatttccttttgtaaagt

SEQ ID NO: 5241662 - DNA, 15 bp, Homo sapiens
atatttcgaaagctg

SEQ ID NO: 5241663 - DNA, 14 bp, Homo sapiens
atatttctaactat

SEQ ID NO: 5241664 - DNA, 21 bp, Homo sapiens
atatttctacaaggtgttcat

SEQ ID NO: 5241665 - DNA, 16 bp, Homo sapiens
atatttctatgttgta

SEQ ID NO: 5241666 - DNA, 14 bp, Homo sapiens
atatttctattgaa

SEQ ID NO: 5241667 - DNA, 13 bp, Homo sapiens
atatttctatttt

SEQ ID NO: 5241668 - DNA, 15 bp, Homo sapiens
atatttctattttat

SEQ ID NO: 5241669 - DNA, 18 bp, Homo sapiens
atatttctcgtatttaat

SEQ ID NO: 5241670 - DNA, 13 bp, Homo sapiens
atatttctctagt

SEQ ID NO: 5241671 - DNA, 23 bp, Homo sapiens
atatttctgaggagcctgcaaca

SEQ ID NO: 5241672 - DNA, 12 bp, Homo sapiens
atatttctgtat

SEQ ID NO: 5241673 - DNA, 17 bp, Homo sapiens
atatttctgtatatttg

SEQ ID NO: 5241674 - DNA, 21 bp, Homo sapiens
atatttctgtatatttgtcat

SEQ ID NO: 5241675 - DNA, 22 bp, Homo sapiens
atatttctgtggagggttgcca

SEQ ID NO: 5241676 - DNA, 23 bp, Homo sapiens
atatttctgtggagggttgccat

SEQ ID NO: 5241677 - DNA, 13 bp, Homo sapiens
atatttctgtgta

SEQ ID NO: 5241678 - DNA, 16 bp, Homo sapiens
atatttctgtgtagta

SEQ ID NO: 5241679 - DNA, 12 bp, Homo sapiens
atatttcttaat

SEQ ID NO: 5241680 - DNA, 20 bp, Homo sapiens
atatttcttaatttggataa

SEQ ID NO: 5241681 - DNA, 16 bp, Homo sapiens
atatttcttcaagtga

SEQ ID NO: 5241682 - DNA, 19 bp, Homo sapiens
atatttcttcgttcttttt

SEQ ID NO: 5241683 - DNA, 24 bp, Homo sapiens
atatttcttcttctaagaagacat

SEQ ID NO: 5241684 - DNA, 18 bp, Homo sapiens
atatttcttgagtaattt

SEQ ID NO: 5241685 - DNA, 19 bp, Homo sapiens
atatttcttgctgcttcta

SEQ ID NO: 5241686 - DNA, 20 bp, Homo sapiens
atatttcttgctttcaatta

SEQ ID NO: 5241687 - DNA, 15 bp, Homo sapiens
atatttgaaaaaaac

SEQ ID NO: 5241688 - DNA, 23 bp, Homo sapiens
atatttgaaaaaaacttcattct

SEQ ID NO: 5241689 - DNA, 18 bp, Homo sapiens
atatttgaaaaccatatt

SEQ ID NO: 5241690 - DNA, 17 bp, Homo sapiens
atatttgaaaattacct

SEQ ID NO: 5241691 - DNA, 11 bp, Homo sapiens
atatttgaaag

SEQ ID NO: 5241692 - DNA, 18 bp, Homo sapiens
atatttgaaatagtatac

SEQ ID NO: 5241693 - DNA, 23 bp, Homo sapiens
atatttgaaatattgacttttta

SEQ ID NO: 5241694 - DNA, 16 bp, Homo sapiens
atatttgaaattttat

SEQ ID NO: 5241695 - DNA, 10 bp, Homo sapiens
atatttgaat

SEQ ID NO: 5241696 - DNA, 11 bp, Homo sapiens
atatttgaatc

SEQ ID NO: 5241697 - DNA, 13 bp, Homo sapiens
atatttgaatctt

SEQ ID NO: 5241698 - DNA, 16 bp, Homo sapiens
atatttgaatcttgtc

SEQ ID NO: 5241699 - DNA, 12 bp, Homo sapiens
atatttgaatga

SEQ ID NO: 5241700 - DNA, 21 bp, Homo sapiens
atatttgaatgtatgcttcat

SEQ ID NO: 5241701 - DNA, 15 bp, Homo sapiens
atatttgaattggcc

SEQ ID NO: 5241702 - DNA, 18 bp, Homo sapiens
atatttgaattggcctga

SEQ ID NO: 5241703 - DNA, 22 bp, Homo sapiens
atatttgactctttcaaagaaa

SEQ ID NO: 5241704 - DNA, 17 bp, Homo sapiens
atatttgaggagtgtta

SEQ ID NO: 5241705 - DNA, 19 bp, Homo sapiens
atatttgagtcacttgtgt

SEQ ID NO: 5241706 - DNA, 16 bp, Homo sapiens
atatttgatctaagtt

SEQ ID NO: 5241707 - DNA, 18 bp, Homo sapiens
atatttgattatgtatgg

SEQ ID NO: 5241708 - DNA, 23 bp, Homo sapiens
atatttgattgtaaaaacaaaaa

SEQ ID NO: 5241709 - DNA, 14 bp, Homo sapiens
atatttgatttatt

SEQ ID NO: 5241710 - DNA, 16 bp, Homo sapiens
atatttgatttattaa

SEQ ID NO: 5241711 - DNA, 18 bp, Homo sapiens
atatttgatttattaact

SEQ ID NO: 5241712 - DNA, 23 bp, Homo sapiens
atatttgatttattaacttaata

SEQ ID NO: 5241713 - DNA, 13 bp, Homo sapiens
atatttgatttct

SEQ ID NO: 5241714 - DNA, 15 bp, Homo sapiens
atatttgatttctaa

SEQ ID NO: 5241715 - DNA, 16 bp, Homo sapiens
atatttgatttctaat

SEQ ID NO: 5241716 - DNA, 23 bp, Homo sapiens
atatttgcaaaccctttgtatta

SEQ ID NO: 5241717 - DNA, 17 bp, Homo sapiens
atatttgcaaagtgtat

SEQ ID NO: 5241718 - DNA, 15 bp, Homo sapiens
atatttgcacatggg

SEQ ID NO: 5241719 - DNA, 21 bp, Homo sapiens
atatttgcataatatgcatat

SEQ ID NO: 5241720 - DNA, 19 bp, Homo sapiens
atatttgcatgggaggggg

SEQ ID NO: 5241721 - DNA, 18 bp, Homo sapiens
atatttgccaataaagct

SEQ ID NO: 5241722 - DNA, 18 bp, Homo sapiens
atatttgcctgtctgttt

SEQ ID NO: 5241723 - DNA, 17 bp, Homo sapiens
atatttgctaataccaa

SEQ ID NO: 5241724 - DNA, 21 bp, Homo sapiens
atatttgctaataccaactat

SEQ ID NO: 5241725 - DNA, 14 bp, Homo sapiens
atatttgctgcaaa

SEQ ID NO: 5241726 - DNA, 16 bp, Homo sapiens
atatttgctgcaaaga

SEQ ID NO: 5241727 - DNA, 21 bp, Homo sapiens
atatttgctggagtgctggct

SEQ ID NO: 5241728 - DNA, 22 bp, Homo sapiens
atatttgctggagtgctggctc

SEQ ID NO: 5241729 - DNA, 23 bp, Homo sapiens
atatttgctggagtgctggctcc

SEQ ID NO: 5241730 - DNA, 14 bp, Homo sapiens
atatttgcttattt

SEQ ID NO: 5241731 - DNA, 17 bp, Homo sapiens
atatttgcttatttata

SEQ ID NO: 5241732 - DNA, 19 bp, Homo sapiens
atatttgcttatttatatt

SEQ ID NO: 5241733 - DNA, 17 bp, Homo sapiens
atatttgcttctaatgt

SEQ ID NO: 5241734 - DNA, 23 bp, Homo sapiens
atatttgctttatactgagcttt

SEQ ID NO: 5241735 - DNA, 15 bp, Homo sapiens
atatttggaaagaga

SEQ ID NO: 5241736 - DNA, 17 bp, Homo sapiens
atatttggatgcagagt

SEQ ID NO: 5241737 - DNA, 20 bp, Homo sapiens
atatttggatgcagagttca

SEQ ID NO: 5241738 - DNA, 16 bp, Homo sapiens
atatttggattcacag

SEQ ID NO: 5241739 - DNA, 15 bp, Homo sapiens
atatttggattgtca

SEQ ID NO: 5241740 - DNA, 16 bp, Homo sapiens
atatttggtgatgaga

SEQ ID NO: 5241741 - DNA, 14 bp, Homo sapiens
atatttgtaaaaat

SEQ ID NO: 5241742 - DNA, 16 bp, Homo sapiens
atatttgtaaaagcta

SEQ ID NO: 5241743 - DNA, 19 bp, Homo sapiens
atatttgtaaaatgacaat

SEQ ID NO: 5241744 - DNA, 21 bp, Homo sapiens
atatttgtaactttgcatgtt

SEQ ID NO: 5241745 - DNA, 21 bp, Homo sapiens
atatttgtaaggcttgttcca

SEQ ID NO: 5241746 - DNA, 11 bp, Homo sapiens
atatttgtaca

SEQ ID NO: 5241747 - DNA, 15 bp, Homo sapiens
atatttgtactttct

SEQ ID NO: 5241748 - DNA, 12 bp, Homo sapiens
atatttgtagaa

SEQ ID NO: 5241749 - DNA, 15 bp, Homo sapiens
atatttgtaggtata

SEQ ID NO: 5241750 - DNA, 23 bp, Homo sapiens
atatttgtaggtatactatgtaa

SEQ ID NO: 5241751 - DNA, 23 bp, Homo sapiens
atatttgtatatattttatatgt

SEQ ID NO: 5241752 - DNA, 22 bp, Homo sapiens
atatttgtatcacaaatcttaa

SEQ ID NO: 5241753 - DNA, 20 bp, Homo sapiens
atatttgtatgtttttctgt

SEQ ID NO: 5241754 - DNA, 12 bp, Homo sapiens
atatttgtattt

SEQ ID NO: 5241755 - DNA, 20 bp, Homo sapiens
atatttgtatttaaatgaaa

SEQ ID NO: 5241756 - DNA, 18 bp, Homo sapiens
atatttgtatttattctt

SEQ ID NO: 5241757 - DNA, 21 bp, Homo sapiens
atatttgtatttatttccaga

SEQ ID NO: 5241758 - DNA, 17 bp, Homo sapiens
atatttgtcaacagatt

SEQ ID NO: 5241759 - DNA, 23 bp, Homo sapiens
atatttgtcaatttatgaatata

SEQ ID NO: 5241760 - DNA, 12 bp, Homo sapiens
atatttgtcatg

SEQ ID NO: 5241761 - DNA, 21 bp, Homo sapiens
atacagtttatttttaaagat

SEQ ID NO: 5241762 - DNA, 22 bp, Homo sapiens
atacagtttgtcacatgaaaca

SEQ ID NO: 5241763 - DNA, 13 bp, Homo sapiens
atacagttttatg

SEQ ID NO: 5241764 - DNA, 16 bp, Homo sapiens
atacagttttcagaaa

SEQ ID NO: 5241765 - DNA, 15 bp, Homo sapiens
atacagttttcctaa

SEQ ID NO: 5241766 - DNA, 20 bp, Homo sapiens
atacagttttcctaaatgta

SEQ ID NO: 5241767 - DNA, 15 bp, Homo sapiens
atacagtttttgtaa

SEQ ID NO: 5241768 - DNA, 14 bp, Homo sapiens
atacataaaaaagt

SEQ ID NO: 5241769 - DNA, 15 bp, Homo sapiens
atacataaaaaagtg

SEQ ID NO: 5241770 - DNA, 18 bp, Homo sapiens
atacataaaagaaataaa

SEQ ID NO: 5241771 - DNA, 18 bp, Homo sapiens
atacataaaagaatgtac

SEQ ID NO: 5241772 - DNA, 22 bp, Homo sapiens
atacataaaagaatgtacagaa

SEQ ID NO: 5241773 - DNA, 15 bp, Homo sapiens
atacataaacagttt

SEQ ID NO: 5241774 - DNA, 17 bp, Homo sapiens
atacataaacagttttg

SEQ ID NO: 5241775 - DNA, 14 bp, Homo sapiens
atacataaactgtc

SEQ ID NO: 5241776 - DNA, 14 bp, Homo sapiens
atacataaagacta

SEQ ID NO: 5241777 - DNA, 12 bp, Homo sapiens
atacataaatag

SEQ ID NO: 5241778 - DNA, 21 bp, Homo sapiens
atacataactaaatttgatac

SEQ ID NO: 5241779 - DNA, 14 bp, Homo sapiens
atacataataaagt

SEQ ID NO: 5241780 - DNA, 12 bp, Homo sapiens
atacataatggg

SEQ ID NO: 5241781 - DNA, 22 bp, Homo sapiens
atacataatgggccactgaaat

SEQ ID NO: 5241782 - DNA, 19 bp, Homo sapiens
atacatacaaatatatgta

SEQ ID NO: 5241783 - DNA, 22 bp, Homo sapiens
atacatacaaatatatgtatat

SEQ ID NO: 5241784 - DNA, 22 bp, Homo sapiens
atacatacaacctatgtaattt

SEQ ID NO: 5241785 - DNA, 23 bp, Homo sapiens
atacatacaccagcattcctttt

SEQ ID NO: 5241786 - DNA, 22 bp, Homo sapiens
atacatacacttgtataaatgt

SEQ ID NO: 5241787 - DNA, 13 bp, Homo sapiens
atacatacataca

SEQ ID NO: 5241788 - DNA, 14 bp, Homo sapiens
atacatacatacaa

SEQ ID NO: 5241789 - DNA, 16 bp, Homo sapiens
atacatacatacatat

SEQ ID NO: 5241790 - DNA, 13 bp, Homo sapiens
atacatacatata

SEQ ID NO: 5241791 - DNA, 15 bp, Homo sapiens
atacatacatatata

SEQ ID NO: 5241792 - DNA, 16 bp, Homo sapiens
atacatacatgtatct

SEQ ID NO: 5241793 - DNA, 17 bp, Homo sapiens
atacatacctctctcta

SEQ ID NO: 5241794 - DNA, 20 bp, Homo sapiens
atacatacgcaattgtatat

SEQ ID NO: 5241795 - DNA, 21 bp, Homo sapiens
atacatacgcaattgtatata

SEQ ID NO: 5241796 - DNA, 20 bp, Homo sapiens
atacatacggtcaggtttaa

SEQ ID NO: 5241797 - DNA, 22 bp, Homo sapiens
atacatacggtcaggtttaaca

SEQ ID NO: 5241798 - DNA, 13 bp, Homo sapiens
atacatactaatg

SEQ ID NO: 5241799 - DNA, 16 bp, Homo sapiens
atacatagacatttca

SEQ ID NO: 5241800 - DNA, 16 bp, Homo sapiens
atacatagatcttcat

SEQ ID NO: 5241801 - DNA, 19 bp, Homo sapiens
atacataggcatcatttca

SEQ ID NO: 5241802 - DNA, 22 bp, Homo sapiens
atacataggtctgtatggctgt

SEQ ID NO: 5241803 - DNA, 16 bp, Homo sapiens
atacatagtaaatggt

SEQ ID NO: 5241804 - DNA, 14 bp, Homo sapiens
atacatagtcacaa

SEQ ID NO: 5241805 - DNA, 18 bp, Homo sapiens
atacatagtcacaaaaat

SEQ ID NO: 5241806 - DNA, 16 bp, Homo sapiens
atacatagtgaaaatt

SEQ ID NO: 5241807 - DNA, 18 bp, Homo sapiens
atacatagtgaaaattgt

SEQ ID NO: 5241808 - DNA, 20 bp, Homo sapiens
atacatataaagattaacac

SEQ ID NO: 5241809 - DNA, 19 bp, Homo sapiens
atacatatactgattctgt

SEQ ID NO: 5241810 - DNA, 16 bp, Homo sapiens
atacatatatacattt

SEQ ID NO: 5241811 - DNA, 20 bp, Homo sapiens
atacatatatacattttgca

SEQ ID NO: 5241812 - DNA, 17 bp, Homo sapiens
atacatatatatatttg

SEQ ID NO: 5241813 - DNA, 20 bp, Homo sapiens
atacatatatatatttgtaa

SEQ ID NO: 5241814 - DNA, 24 bp, Homo sapiens
atacatatatatatttgtaacatt

SEQ ID NO: 5241815 - DNA, 20 bp, Homo sapiens
atacatatatatctgataaa

SEQ ID NO: 5241816 - DNA, 19 bp, Homo sapiens
atacatatatctacacata

SEQ ID NO: 5241817 - DNA, 16 bp, Homo sapiens
atacatatcagaaaag

SEQ ID NO: 5241818 - DNA, 20 bp, Homo sapiens
atacatatcagaaaagtaga

SEQ ID NO: 5241819 - DNA, 14 bp, Homo sapiens
atacatatctttat

SEQ ID NO: 5241820 - DNA, 16 bp, Homo sapiens
atacatatctttatta

SEQ ID NO: 5241821 - DNA, 21 bp, Homo sapiens
atacatatgagaatatacctt

SEQ ID NO: 5241822 - DNA, 17 bp, Homo sapiens
atacatatgatcaaata

SEQ ID NO: 5241823 - DNA, 19 bp, Homo sapiens
atacatatgatcaaatact

SEQ ID NO: 5241824 - DNA, 23 bp, Homo sapiens
atacatatgcagatacttattaa

SEQ ID NO: 5241825 - DNA, 15 bp, Homo sapiens
atacatatggatgtt

SEQ ID NO: 5241826 - DNA, 18 bp, Homo sapiens
atacatatgtagactata

SEQ ID NO: 5241827 - DNA, 14 bp, Homo sapiens
atacatatgtatgt

SEQ ID NO: 5241828 - DNA, 14 bp, Homo sapiens
atacatattataaa

SEQ ID NO: 5241829 - DNA, 22 bp, Homo sapiens
atacatattgtatatatattca

SEQ ID NO: 5241830 - DNA, 12 bp, Homo sapiens
atacatatttca

SEQ ID NO: 5241831 - DNA, 13 bp, Homo sapiens
atacatcaaaaat

SEQ ID NO: 5241832 - DNA, 14 bp, Homo sapiens
atacatcaatatgt

SEQ ID NO: 5241833 - DNA, 15 bp, Homo sapiens
atacatcaatatgta

SEQ ID NO: 5241834 - DNA, 18 bp, Homo sapiens
atacatcacatcttattt

SEQ ID NO: 5241835 - DNA, 13 bp, Homo sapiens
atacatcactgct

SEQ ID NO: 5241836 - DNA, 15 bp, Homo sapiens
atacatcactgcttg

SEQ ID NO: 5241837 - DNA, 22 bp, Homo sapiens
atacatcactgcttgatgaagc

SEQ ID NO: 5241838 - DNA, 13 bp, Homo sapiens
atacatcactgta

SEQ ID NO: 5241839 - DNA, 14 bp, Homo sapiens
atacatcactgtat

SEQ ID NO: 5241840 - DNA, 14 bp, Homo sapiens
atacatcagaaaat

SEQ ID NO: 5241841 - DNA, 17 bp, Homo sapiens
atacatcagaaaataaa

SEQ ID NO: 5241842 - DNA, 20 bp, Homo sapiens
atacatcattttttgtttct

SEQ ID NO: 5241843 - DNA, 18 bp, Homo sapiens
atacatcctgggtaatga

SEQ ID NO: 5241844 - DNA, 18 bp, Homo sapiens
atacatcctttttctgct

SEQ ID NO: 5241845 - DNA, 14 bp, Homo sapiens
atacatctgctgtg

SEQ ID NO: 5241846 - DNA, 12 bp, Homo sapiens
atacatcttcat

SEQ ID NO: 5241847 - DNA, 14 bp, Homo sapiens
atacatcttcatta

SEQ ID NO: 5241848 - DNA, 19 bp, Homo sapiens
atacatctttatcattaaa

SEQ ID NO: 5241849 - DNA, 13 bp, Homo sapiens
atacatgaagctt

SEQ ID NO: 5241850 - DNA, 15 bp, Homo sapiens
atacatgagaaagat

SEQ ID NO: 5241851 - DNA, 16 bp, Homo sapiens
atacatgatgatttca

SEQ ID NO: 5241852 - DNA, 13 bp, Homo sapiens
atacatgcatata

SEQ ID NO: 5241853 - DNA, 20 bp, Homo sapiens
atacatgcatataatgaata

SEQ ID NO: 5241854 - DNA, 10 bp, Homo sapiens
atacatgcca

SEQ ID NO: 5241855 - DNA, 17 bp, Homo sapiens
atacatgctaagaaagc

SEQ ID NO: 5241856 - DNA, 19 bp, Homo sapiens
atacatgctaagaaagcaa

SEQ ID NO: 5241857 - DNA, 15 bp, Homo sapiens
atacatggtagcagg

SEQ ID NO: 5241858 - DNA, 16 bp, Homo sapiens
atacatggtagcaggg

SEQ ID NO: 5241859 - DNA, 22 bp, Homo sapiens
atacatggtagccagttgaatt

SEQ ID NO: 5241860 - DNA, 13 bp, Homo sapiens
atacatgtatagt

SEQ ID NO: 5241861 - DNA, 15 bp, Homo sapiens
atacatgtatagtga

SEQ ID NO: 5241862 - DNA, 15 bp, Homo sapiens
atacatgtgtacata

SEQ ID NO: 5241863 - DNA, 16 bp, Homo sapiens
atacatgtgtacatat

SEQ ID NO: 5241864 - DNA, 23 bp, Homo sapiens
atacatgtgtacatatatgtata

SEQ ID NO: 5241865 - DNA, 19 bp, Homo sapiens
atacatgtgtatattcctt

SEQ ID NO: 5241866 - DNA, 15 bp, Homo sapiens
atacatgtgtggatg

SEQ ID NO: 5241867 - DNA, 12 bp, Homo sapiens
atacatgtgtgt

SEQ ID NO: 5241868 - DNA, 13 bp, Homo sapiens
atacatgtgtgta

SEQ ID NO: 5241869 - DNA, 17 bp, Homo sapiens
atacatgtgtgtatata

SEQ ID NO: 5241870 - DNA, 18 bp, Homo sapiens
atacatgtgtgtatatat

SEQ ID NO: 5241871 - DNA, 20 bp, Homo sapiens
atacatgtgtgtatatatgt

SEQ ID NO: 5241872 - DNA, 17 bp, Homo sapiens
atacatgttgggcatga

SEQ ID NO: 5241873 - DNA, 22 bp, Homo sapiens
atacatgtttatgtaaacaaat

SEQ ID NO: 5241874 - DNA, 13 bp, Homo sapiens
atacatgtttgtt

SEQ ID NO: 5241875 - DNA, 13 bp, Homo sapiens
atacattaaaact

SEQ ID NO: 5241876 - DNA, 14 bp, Homo sapiens
atacattaaaacta

SEQ ID NO: 5241877 - DNA, 14 bp, Homo sapiens
atacattaaaagaa

SEQ ID NO: 5241878 - DNA, 15 bp, Homo sapiens
atacattaaaataac

SEQ ID NO: 5241879 - DNA, 12 bp, Homo sapiens
atacattaaagc

SEQ ID NO: 5241880 - DNA, 15 bp, Homo sapiens
atacattaaagcagt

SEQ ID NO: 5241881 - DNA, 16 bp, Homo sapiens
atacattaaagcagtc

SEQ ID NO: 5241882 - DNA, 17 bp, Homo sapiens
atacattagacacacat

SEQ ID NO: 5241883 - DNA, 21 bp, Homo sapiens
atacattagacacacatatac

SEQ ID NO: 5241884 - DNA, 20 bp, Homo sapiens
atacattagcagctatgtaa

SEQ ID NO: 5241885 - DNA, 23 bp, Homo sapiens
atacattaggaagtggcagttct

SEQ ID NO: 5241886 - DNA, 13 bp, Homo sapiens
atacattagtaaa

SEQ ID NO: 5241887 - DNA, 16 bp, Homo sapiens
atacattagtaaatgt

SEQ ID NO: 5241888 - DNA, 16 bp, Homo sapiens
atacattagttttaat

SEQ ID NO: 5241889 - DNA, 20 bp, Homo sapiens
atacattagttttaatctct

SEQ ID NO: 5241890 - DNA, 21 bp, Homo sapiens
atacattattgaaaagcaaat

SEQ ID NO: 5241891 - DNA, 17 bp, Homo sapiens
atacattatttctgtat

SEQ ID NO: 5241892 - DNA, 23 bp, Homo sapiens
atacattatttctgtatatagat

SEQ ID NO: 5241893 - DNA, 21 bp, Homo sapiens
atacattcaaatttgtctggt

SEQ ID NO: 5241894 - DNA, 23 bp, Homo sapiens
atacattccagtgtattttctgt

SEQ ID NO: 5241895 - DNA, 16 bp, Homo sapiens
atacattccattgttt

SEQ ID NO: 5241896 - DNA, 22 bp, Homo sapiens
atacattccctatcaaaacata

SEQ ID NO: 5241897 - DNA, 11 bp, Homo sapiens
atacattcctg

SEQ ID NO: 5241898 - DNA, 13 bp, Homo sapiens
atacattctagat

SEQ ID NO: 5241899 - DNA, 17 bp, Homo sapiens
atacattctatgacatt

SEQ ID NO: 5241900 - DNA, 20 bp, Homo sapiens
atacattcttcaagatccca

SEQ ID NO: 5241901 - DNA, 14 bp, Homo sapiens
atacattctttgct

SEQ ID NO: 5241902 - DNA, 21 bp, Homo sapiens
atacattctttttgctctaaa

SEQ ID NO: 5241903 - DNA, 17 bp, Homo sapiens
atacattgaattagaaa

SEQ ID NO: 5241904 - DNA, 17 bp, Homo sapiens
atacattgaattcatta

SEQ ID NO: 5241905 - DNA, 21 bp, Homo sapiens
atacattgtattaataccaaa

SEQ ID NO: 5241906 - DNA, 21 bp, Homo sapiens
atacattgtctctaaattgtg

SEQ ID NO: 5241907 - DNA, 23 bp, Homo sapiens
atacattgtcttgatgttttttc

SEQ ID NO: 5241908 - DNA, 20 bp, Homo sapiens
atacattgtgtgaaaaaaga

SEQ ID NO: 5241909 - DNA, 18 bp, Homo sapiens
atacattgtgttttccta

SEQ ID NO: 5241910 - DNA, 14 bp, Homo sapiens
atacatttaaaaaa

SEQ ID NO: 5241911 - DNA, 19 bp, Homo sapiens
atacatttaaaaaacattt

SEQ ID NO: 5241912 - DNA, 16 bp, Homo sapiens
atacatttaaaacatt

SEQ ID NO: 5241913 - DNA, 21 bp, Homo sapiens
atacatttaaaacattaaaat

SEQ ID NO: 5241914 - DNA, 14 bp, Homo sapiens
atacatttaaaact

SEQ ID NO: 5241915 - DNA, 14 bp, Homo sapiens
atacatttaaagat

SEQ ID NO: 5241916 - DNA, 11 bp, Homo sapiens
atacatttaat

SEQ ID NO: 5241917 - DNA, 15 bp, Homo sapiens
atacatttagaacct

SEQ ID NO: 5241918 - DNA, 12 bp, Homo sapiens
atacatttagtt

SEQ ID NO: 5241919 - DNA, 23 bp, Homo sapiens
atacatttataatgtttgctatt

SEQ ID NO: 5241920 - DNA, 16 bp, Homo sapiens
atacatttatcttctg

SEQ ID NO: 5241921 - DNA, 18 bp, Homo sapiens
atacatttatcttctgtt

SEQ ID NO: 5241922 - DNA, 14 bp, Homo sapiens
atacatttcatctg

SEQ ID NO: 5241923 - DNA, 20 bp, Homo sapiens
atacatttctcctttgataa

SEQ ID NO: 5241924 - DNA, 22 bp, Homo sapiens
atacatttctcctttgataaaa

SEQ ID NO: 5241925 - DNA, 19 bp, Homo sapiens
atacatttgaggggaaaac

SEQ ID NO: 5241926 - DNA, 19 bp, Homo sapiens
atacatttgatttgttcat

SEQ ID NO: 5241927 - DNA, 23 bp, Homo sapiens
atacatttgtaagtgtaaaaaat

SEQ ID NO: 5241928 - DNA, 17 bp, Homo sapiens
atacatttgtatgttgt

SEQ ID NO: 5241929 - DNA, 21 bp, Homo sapiens
atacatttgtatgttgtgaag

SEQ ID NO: 5241930 - DNA, 15 bp, Homo sapiens
atacatttgtatttt

SEQ ID NO: 5241931 - DNA, 16 bp, Homo sapiens
atacatttgtattttg

SEQ ID NO: 5241932 - DNA, 14 bp, Homo sapiens
atacattttataat

SEQ ID NO: 5241933 - DNA, 17 bp, Homo sapiens
atacattttataatttc

SEQ ID NO: 5241934 - DNA, 17 bp, Homo sapiens
atacattttatatctgg

SEQ ID NO: 5241935 - DNA, 21 bp, Homo sapiens
atacattttatatctggattt

SEQ ID NO: 5241936 - DNA, 13 bp, Homo sapiens
atacattttctaa

SEQ ID NO: 5241937 - DNA, 22 bp, Homo sapiens
atacattttctaaataaaaata

SEQ ID NO: 5241938 - DNA, 15 bp, Homo sapiens
atacattttgaaaat

SEQ ID NO: 5241939 - DNA, 21 bp, Homo sapiens
atacattttgtatattaactt

SEQ ID NO: 5241940 - DNA, 19 bp, Homo sapiens
atacattttgttatagaat

SEQ ID NO: 5241941 - DNA, 21 bp, Homo sapiens
atatttgtcatgctgggattt

SEQ ID NO: 5241942 - DNA, 15 bp, Homo sapiens
atatttgtcattttc

SEQ ID NO: 5241943 - DNA, 18 bp, Homo sapiens
atatttgtctcattttgt

SEQ ID NO: 5241944 - DNA, 14 bp, Homo sapiens
atatttgtctgtgt

SEQ ID NO: 5241945 - DNA, 17 bp, Homo sapiens
atatttgtctgtgtgct

SEQ ID NO: 5241946 - DNA, 23 bp, Homo sapiens
atatttgtctgtgtgctactaac

SEQ ID NO: 5241947 - DNA, 13 bp, Homo sapiens
atatttgtcttcc

SEQ ID NO: 5241948 - DNA, 17 bp, Homo sapiens
atatttgtctttaaaca

SEQ ID NO: 5241949 - DNA, 17 bp, Homo sapiens
atatttgtctttgaatc

SEQ ID NO: 5241950 - DNA, 18 bp, Homo sapiens
atatttgtgacaaaaaat

SEQ ID NO: 5241951 - DNA, 21 bp, Homo sapiens
atatttgtgatagcactttct

SEQ ID NO: 5241952 - DNA, 17 bp, Homo sapiens
atatttgtgcattttct

SEQ ID NO: 5241953 - DNA, 18 bp, Homo sapiens
atatttgtgcattttcta

SEQ ID NO: 5241954 - DNA, 15 bp, Homo sapiens
atatttgtgccgtaa

SEQ ID NO: 5241955 - DNA, 17 bp, Homo sapiens
atatttgtgctatagta

SEQ ID NO: 5241956 - DNA, 19 bp, Homo sapiens
atatttgtgctttgaaaaa

SEQ ID NO: 5241957 - DNA, 16 bp, Homo sapiens
atatttgtgtatgtgt

SEQ ID NO: 5241958 - DNA, 17 bp, Homo sapiens
atatttgtgtatgtgta

SEQ ID NO: 5241959 - DNA, 16 bp, Homo sapiens
atatttgtgtgctaaa

SEQ ID NO: 5241960 - DNA, 22 bp, Homo sapiens
atatttgtgtgctaaacgtgta

SEQ ID NO: 5241961 - DNA, 22 bp, Homo sapiens
atatttgttaaatatttacata

SEQ ID NO: 5241962 - DNA, 20 bp, Homo sapiens
atatttgttatgataaaagg

SEQ ID NO: 5241963 - DNA, 15 bp, Homo sapiens
atatttgttcttata

SEQ ID NO: 5241964 - DNA, 14 bp, Homo sapiens
atatttgtttagtt

SEQ ID NO: 5241965 - DNA, 23 bp, Homo sapiens
atatttgtttagttcagcaaaac

SEQ ID NO: 5241966 - DNA, 15 bp, Homo sapiens
atatttgttttaata

SEQ ID NO: 5241967 - DNA, 20 bp, Homo sapiens
atattttaaaaaatcaaaag

SEQ ID NO: 5241968 - DNA, 14 bp, Homo sapiens
atattttaaaaaca

SEQ ID NO: 5241969 - DNA, 20 bp, Homo sapiens
atattttaaaatctcctaaa

SEQ ID NO: 5241970 - DNA, 13 bp, Homo sapiens
atattttaaaatt

SEQ ID NO: 5241971 - DNA, 15 bp, Homo sapiens
atattttaaaatttg

SEQ ID NO: 5241972 - DNA, 15 bp, Homo sapiens
atattttaaagaatt

SEQ ID NO: 5241973 - DNA, 20 bp, Homo sapiens
atattttaaagaattgtgtc

SEQ ID NO: 5241974 - DNA, 17 bp, Homo sapiens
atattttaactccactg

SEQ ID NO: 5241975 - DNA, 14 bp, Homo sapiens
atattttaagacga

SEQ ID NO: 5241976 - DNA, 20 bp, Homo sapiens
atattttaataaaataaact

SEQ ID NO: 5241977 - DNA, 14 bp, Homo sapiens
atattttaatcatt

SEQ ID NO: 5241978 - DNA, 21 bp, Homo sapiens
atattttaatcattatttgag

SEQ ID NO: 5241979 - DNA, 15 bp, Homo sapiens
atattttaatgaata

SEQ ID NO: 5241980 - DNA, 19 bp, Homo sapiens
atattttaatgcagttgct

SEQ ID NO: 5241981 - DNA, 12 bp, Homo sapiens
atattttaatgt

SEQ ID NO: 5241982 - DNA, 11 bp, Homo sapiens
atattttaatt

SEQ ID NO: 5241983 - DNA, 14 bp, Homo sapiens
atattttaatttca

SEQ ID NO: 5241984 - DNA, 17 bp, Homo sapiens
atattttaatttcaagc

SEQ ID NO: 5241985 - DNA, 13 bp, Homo sapiens
atattttaatttt

SEQ ID NO: 5241986 - DNA, 15 bp, Homo sapiens
atattttaattttta

SEQ ID NO: 5241987 - DNA, 21 bp, Homo sapiens
atattttagatgcaatgtgat

SEQ ID NO: 5241988 - DNA, 23 bp, Homo sapiens
atattttagcattttaattctct

SEQ ID NO: 5241989 - DNA, 13 bp, Homo sapiens
atattttagcctt

SEQ ID NO: 5241990 - DNA, 13 bp, Homo sapiens
atattttatactg

SEQ ID NO: 5241991 - DNA, 14 bp, Homo sapiens
atattttatactgc

SEQ ID NO: 5241992 - DNA, 22 bp, Homo sapiens
atattttatatgaaatgtttca

SEQ ID NO: 5241993 - DNA, 14 bp, Homo sapiens
atattttatattac

SEQ ID NO: 5241994 - DNA, 14 bp, Homo sapiens
atattttatcctgt

SEQ ID NO: 5241995 - DNA, 15 bp, Homo sapiens
atattttatcctgta

SEQ ID NO: 5241996 - DNA, 14 bp, Homo sapiens
atattttatgaaca

SEQ ID NO: 5241997 - DNA, 16 bp, Homo sapiens
atattttatgaacatt

SEQ ID NO: 5241998 - DNA, 20 bp, Homo sapiens
atattttatgaacattgtac

SEQ ID NO: 5241999 - DNA, 23 bp, Homo sapiens
atattttatgaacattgtactgt

SEQ ID NO: 5242000 - DNA, 12 bp, Homo sapiens
atattttatgat

SEQ ID NO: 5242001 - DNA, 16 bp, Homo sapiens
atattttatgatttaa

SEQ ID NO: 5242002 - DNA, 15 bp, Homo sapiens
atattttatggttat

SEQ ID NO: 5242003 - DNA, 19 bp, Homo sapiens
atattttatggttatgttt

SEQ ID NO: 5242004 - DNA, 20 bp, Homo sapiens
atattttatgtgagagaaag

SEQ ID NO: 5242005 - DNA, 15 bp, Homo sapiens
atattttatgtgtaa

SEQ ID NO: 5242006 - DNA, 16 bp, Homo sapiens
atattttattaaaaca

SEQ ID NO: 5242007 - DNA, 17 bp, Homo sapiens
atattttattgtatttt

SEQ ID NO: 5242008 - DNA, 17 bp, Homo sapiens
atattttatttatcttt

SEQ ID NO: 5242009 - DNA, 15 bp, Homo sapiens
atattttatttcaat

SEQ ID NO: 5242010 - DNA, 21 bp, Homo sapiens
atattttatttcaatgtaatt

SEQ ID NO: 5242011 - DNA, 14 bp, Homo sapiens
atattttatttgaa

SEQ ID NO: 5242012 - DNA, 15 bp, Homo sapiens
atattttatttgaaa

SEQ ID NO: 5242013 - DNA, 17 bp, Homo sapiens
atattttatttgaaaaa

SEQ ID NO: 5242014 - DNA, 15 bp, Homo sapiens
atattttattttcat

SEQ ID NO: 5242015 - DNA, 19 bp, Homo sapiens
atattttcaaagtacataa

SEQ ID NO: 5242016 - DNA, 14 bp, Homo sapiens
atattttcaacaat

SEQ ID NO: 5242017 - DNA, 19 bp, Homo sapiens
atattttcaacgcagccct

SEQ ID NO: 5242018 - DNA, 20 bp, Homo sapiens
atattttcaactatgtaggt

SEQ ID NO: 5242019 - DNA, 17 bp, Homo sapiens
atattttcacaatgtca

SEQ ID NO: 5242020 - DNA, 19 bp, Homo sapiens
atattttcacactggtaaa

SEQ ID NO: 5242021 - DNA, 12 bp, Homo sapiens
atattttcacag

SEQ ID NO: 5242022 - DNA, 21 bp, Homo sapiens
atattttcaccatttgattat

SEQ ID NO: 5242023 - DNA, 13 bp, Homo sapiens
atattttcatgta

SEQ ID NO: 5242024 - DNA, 12 bp, Homo sapiens
atattttccata

SEQ ID NO: 5242025 - DNA, 17 bp, Homo sapiens
atattttccataaattt

SEQ ID NO: 5242026 - DNA, 13 bp, Homo sapiens
atattttccatat

SEQ ID NO: 5242027 - DNA, 18 bp, Homo sapiens
atattttccatgaaaatg

SEQ ID NO: 5242028 - DNA, 22 bp, Homo sapiens
atattttccctacctaagaatt

SEQ ID NO: 5242029 - DNA, 18 bp, Homo sapiens
atattttccctttttaaa

SEQ ID NO: 5242030 - DNA, 11 bp, Homo sapiens
atattttcctg

SEQ ID NO: 5242031 - DNA, 19 bp, Homo sapiens
atattttcctgatagcata

SEQ ID NO: 5242032 - DNA, 15 bp, Homo sapiens
atattttcctttaga

SEQ ID NO: 5242033 - DNA, 18 bp, Homo sapiens
atattttctattacacaa

SEQ ID NO: 5242034 - DNA, 20 bp, Homo sapiens
atattttctatttctctgtg

SEQ ID NO: 5242035 - DNA, 12 bp, Homo sapiens
atattttctcta

SEQ ID NO: 5242036 - DNA, 12 bp, Homo sapiens
atattttctgtg

SEQ ID NO: 5242037 - DNA, 15 bp, Homo sapiens
atattttctgtgtgt

SEQ ID NO: 5242038 - DNA, 20 bp, Homo sapiens
atattttctgtgtgttcctg

SEQ ID NO: 5242039 - DNA, 21 bp, Homo sapiens
atattttctgtgtgttcctgg

SEQ ID NO: 5242040 - DNA, 22 bp, Homo sapiens
atattttctgtgtgttcctggc

SEQ ID NO: 5242041 - DNA, 12 bp, Homo sapiens
atattttctgtt

SEQ ID NO: 5242042 - DNA, 13 bp, Homo sapiens
atattttctgttt

SEQ ID NO: 5242043 - DNA, 19 bp, Homo sapiens
atattttcttccaagcaaa

SEQ ID NO: 5242044 - DNA, 23 bp, Homo sapiens
atattttcttccaagcaaaggtg

SEQ ID NO: 5242045 - DNA, 18 bp, Homo sapiens
atattttctttaatgctt

SEQ ID NO: 5242046 - DNA, 18 bp, Homo sapiens
atattttctttatttgta

SEQ ID NO: 5242047 - DNA, 13 bp, Homo sapiens
atattttcttttc

SEQ ID NO: 5242048 - DNA, 14 bp, Homo sapiens
atattttgaaatat

SEQ ID NO: 5242049 - DNA, 15 bp, Homo sapiens
atattttgaaatgaa

SEQ ID NO: 5242050 - DNA, 13 bp, Homo sapiens
atattttgaatca

SEQ ID NO: 5242051 - DNA, 14 bp, Homo sapiens
atattttgaatcaa

SEQ ID NO: 5242052 - DNA, 14 bp, Homo sapiens
atattttgataata

SEQ ID NO: 5242053 - DNA, 16 bp, Homo sapiens
atattttgatacaaat

SEQ ID NO: 5242054 - DNA, 12 bp, Homo sapiens
atattttgatct

SEQ ID NO: 5242055 - DNA, 19 bp, Homo sapiens
atattttgatcttcaacaa

SEQ ID NO: 5242056 - DNA, 13 bp, Homo sapiens
atattttgattat

SEQ ID NO: 5242057 - DNA, 12 bp, Homo sapiens
atattttgctaa

SEQ ID NO: 5242058 - DNA, 19 bp, Homo sapiens
atattttgctaactggtta

SEQ ID NO: 5242059 - DNA, 19 bp, Homo sapiens
atattttggaaactgctaa

SEQ ID NO: 5242060 - DNA, 20 bp, Homo sapiens
atattttggaaactgctaaa

SEQ ID NO: 5242061 - DNA, 17 bp, Homo sapiens
atattttgtaatattct

SEQ ID NO: 5242062 - DNA, 13 bp, Homo sapiens
atattttgtatat

SEQ ID NO: 5242063 - DNA, 16 bp, Homo sapiens
atattttgtatgcaag

SEQ ID NO: 5242064 - DNA, 22 bp, Homo sapiens
atattttgtattattgctgttg

SEQ ID NO: 5242065 - DNA, 13 bp, Homo sapiens
atattttgtcact

SEQ ID NO: 5242066 - DNA, 14 bp, Homo sapiens
atattttgtcactg

SEQ ID NO: 5242067 - DNA, 18 bp, Homo sapiens
atattttgtgtgaaattg

SEQ ID NO: 5242068 - DNA, 20 bp, Homo sapiens
atattttgttatagttcata

SEQ ID NO: 5242069 - DNA, 21 bp, Homo sapiens
atattttgttgctttcttacc

SEQ ID NO: 5242070 - DNA, 15 bp, Homo sapiens
atatttttaaaaaac

SEQ ID NO: 5242071 - DNA, 20 bp, Homo sapiens
atatttttaaagaatgttag

SEQ ID NO: 5242072 - DNA, 15 bp, Homo sapiens
atatttttaaagatc

SEQ ID NO: 5242073 - DNA, 12 bp, Homo sapiens
atatttttaaga

SEQ ID NO: 5242074 - DNA, 20 bp, Homo sapiens
atatttttaatggaaagttt

SEQ ID NO: 5242075 - DNA, 17 bp, Homo sapiens
atatttttaatttatga

SEQ ID NO: 5242076 - DNA, 14 bp, Homo sapiens
atatttttactgct

SEQ ID NO: 5242077 - DNA, 20 bp, Homo sapiens
atatttttactgctttctga

SEQ ID NO: 5242078 - DNA, 21 bp, Homo sapiens
atatttttactgctttctgaa

SEQ ID NO: 5242079 - DNA, 16 bp, Homo sapiens
atatttttatacttta

SEQ ID NO: 5242080 - DNA, 17 bp, Homo sapiens
atatttttatactttat

SEQ ID NO: 5242081 - DNA, 14 bp, Homo sapiens
atatttttatagac

SEQ ID NO: 5242082 - DNA, 15 bp, Homo sapiens
atatttttatcttta

SEQ ID NO: 5242083 - DNA, 21 bp, Homo sapiens
atatttttatgtgaaggtgtt

SEQ ID NO: 5242084 - DNA, 17 bp, Homo sapiens
atatttttatgtgcagc

SEQ ID NO: 5242085 - DNA, 18 bp, Homo sapiens
atatttttatgtgcagcg

SEQ ID NO: 5242086 - DNA, 13 bp, Homo sapiens
atatttttatttc

SEQ ID NO: 5242087 - DNA, 15 bp, Homo sapiens
atatttttatttcat

SEQ ID NO: 5242088 - DNA, 22 bp, Homo sapiens
atatttttatttcattcacatt

SEQ ID NO: 5242089 - DNA, 12 bp, Homo sapiens
atatttttcaaa

SEQ ID NO: 5242090 - DNA, 18 bp, Homo sapiens
atatttttcaaaatcaaa

SEQ ID NO: 5242091 - DNA, 19 bp, Homo sapiens
atatttttcaaaatcaaag

SEQ ID NO: 5242092 - DNA, 20 bp, Homo sapiens
atatttttcaaccagcattt

SEQ ID NO: 5242093 - DNA, 21 bp, Homo sapiens
atatttttcaaccagcatttt

SEQ ID NO: 5242094 - DNA, 22 bp, Homo sapiens
atatttttcaaccagcatttta

SEQ ID NO: 5242095 - DNA, 24 bp, Homo sapiens
atatttttcaaccagcattttact

SEQ ID NO: 5242096 - DNA, 20 bp, Homo sapiens
atatttttcaacttcttcta

SEQ ID NO: 5242097 - DNA, 15 bp, Homo sapiens
atatttttcacatat

SEQ ID NO: 5242098 - DNA, 23 bp, Homo sapiens
atatttttccatttatttatgaa

SEQ ID NO: 5242099 - DNA, 18 bp, Homo sapiens
atatttttctaaagaaat

SEQ ID NO: 5242100 - DNA, 16 bp, Homo sapiens
atatttttctgagatt

SEQ ID NO: 5242101 - DNA, 12 bp, Homo sapiens
atatttttctgg

SEQ ID NO: 5242102 - DNA, 14 bp, Homo sapiens
atatttttcttaaa

SEQ ID NO: 5242103 - DNA, 18 bp, Homo sapiens
atatttttcttaaaaagt

SEQ ID NO: 5242104 - DNA, 21 bp, Homo sapiens
atatttttcttatttatgtaa

SEQ ID NO: 5242105 - DNA, 22 bp, Homo sapiens
atatttttcttatttatgtaac

SEQ ID NO: 5242106 - DNA, 19 bp, Homo sapiens
atatttttgataccttcaa

SEQ ID NO: 5242107 - DNA, 19 bp, Homo sapiens
atatttttggcattcctct

SEQ ID NO: 5242108 - DNA, 15 bp, Homo sapiens
atatttttggggcat

SEQ ID NO: 5242109 - DNA, 22 bp, Homo sapiens
atatttttggggcatcctggat

SEQ ID NO: 5242110 - DNA, 16 bp, Homo sapiens
atatttttgtatgtca

SEQ ID NO: 5242111 - DNA, 18 bp, Homo sapiens
atatttttgtctgcagct

SEQ ID NO: 5242112 - DNA, 21 bp, Homo sapiens
atatttttgtgttttcttgta

SEQ ID NO: 5242113 - DNA, 23 bp, Homo sapiens
atattttttaaaataagtctgat

SEQ ID NO: 5242114 - DNA, 20 bp, Homo sapiens
atattttttatatatacagt

SEQ ID NO: 5242115 - DNA, 16 bp, Homo sapiens
atattttttatttcta

SEQ ID NO: 5242116 - DNA, 19 bp, Homo sapiens
atattttttatttctaagt

SEQ ID NO: 5242117 - DNA, 19 bp, Homo sapiens
atattttttgaaggtttca

SEQ ID NO: 5242118 - DNA, 15 bp, Homo sapiens
atattttttgtctgt

SEQ ID NO: 5242119 - DNA, 18 bp, Homo sapiens
atattttttgttaaatga

SEQ ID NO: 5242120 - DNA, 20 bp, Homo sapiens
atattttttgttaaatgatt

SEQ ID NO: 5242121 - DNA, 21 bp, Homo sapiens
atacattttgttatagaatac

SEQ ID NO: 5242122 - DNA, 12 bp, Homo sapiens
atacatttttaa

SEQ ID NO: 5242123 - DNA, 12 bp, Homo sapiens
atacatttttat

SEQ ID NO: 5242124 - DNA, 15 bp, Homo sapiens
ataccaaaatgttgc

SEQ ID NO: 5242125 - DNA, 22 bp, Homo sapiens
ataccaaagataatgcatattt

SEQ ID NO: 5242126 - DNA, 12 bp, Homo sapiens
ataccaaatatt

SEQ ID NO: 5242127 - DNA, 14 bp, Homo sapiens
ataccaacctgaaa

SEQ ID NO: 5242128 - DNA, 16 bp, Homo sapiens
ataccaactatttcaa

SEQ ID NO: 5242129 - DNA, 21 bp, Homo sapiens
ataccaactatttcaataagt

SEQ ID NO: 5242130 - DNA, 24 bp, Homo sapiens
ataccaactgggcctctgatgttc

SEQ ID NO: 5242131 - DNA, 18 bp, Homo sapiens
ataccaaggtacaactgt

SEQ ID NO: 5242132 - DNA, 19 bp, Homo sapiens
ataccaagttgatacttga

SEQ ID NO: 5242133 - DNA, 12 bp, Homo sapiens
ataccaataaag

SEQ ID NO: 5242134 - DNA, 14 bp, Homo sapiens
ataccaataaagtg

SEQ ID NO: 5242135 - DNA, 21 bp, Homo sapiens
ataccaataaagtgaccctgc

SEQ ID NO: 5242136 - DNA, 20 bp, Homo sapiens
ataccaatgcttttatcaaa

SEQ ID NO: 5242137 - DNA, 20 bp, Homo sapiens
ataccaattacccataaaca

SEQ ID NO: 5242138 - DNA, 14 bp, Homo sapiens
ataccaattatgga

SEQ ID NO: 5242139 - DNA, 16 bp, Homo sapiens
ataccaattatggaaa

SEQ ID NO: 5242140 - DNA, 19 bp, Homo sapiens
ataccaccaccaagaaagc

SEQ ID NO: 5242141 - DNA, 20 bp, Homo sapiens
ataccaccgacatttttcaa

SEQ ID NO: 5242142 - DNA, 23 bp, Homo sapiens
ataccacctgtacatacattgta

SEQ ID NO: 5242143 - DNA, 16 bp, Homo sapiens
ataccacctttactgt

SEQ ID NO: 5242144 - DNA, 15 bp, Homo sapiens
ataccactctgtaat

SEQ ID NO: 5242145 - DNA, 18 bp, Homo sapiens
ataccactctgtaattgc

SEQ ID NO: 5242146 - DNA, 16 bp, Homo sapiens
ataccacttacctcaa

SEQ ID NO: 5242147 - DNA, 18 bp, Homo sapiens
ataccacttttgttcttg

SEQ ID NO: 5242148 - DNA, 23 bp, Homo sapiens
ataccagagccttcaagtgccaa

SEQ ID NO: 5242149 - DNA, 19 bp, Homo sapiens
ataccagatcactcaaaaa

SEQ ID NO: 5242150 - DNA, 22 bp, Homo sapiens
ataccagattttataaaatatt

SEQ ID NO: 5242151 - DNA, 13 bp, Homo sapiens
ataccagcaaaag

SEQ ID NO: 5242152 - DNA, 19 bp, Homo sapiens
ataccagcagcaactgaaa

SEQ ID NO: 5242153 - DNA, 22 bp, Homo sapiens
ataccagcgaggaggctccaga

SEQ ID NO: 5242154 - DNA, 18 bp, Homo sapiens
ataccagcttagatttta

SEQ ID NO: 5242155 - DNA, 19 bp, Homo sapiens
ataccaggttacctcactt

SEQ ID NO: 5242156 - DNA, 13 bp, Homo sapiens
ataccagtacttg

SEQ ID NO: 5242157 - DNA, 14 bp, Homo sapiens
ataccagtacttga

SEQ ID NO: 5242158 - DNA, 19 bp, Homo sapiens
ataccagtgaaccaaagag

SEQ ID NO: 5242159 - DNA, 17 bp, Homo sapiens
ataccagttcagacact

SEQ ID NO: 5242160 - DNA, 18 bp, Homo sapiens
ataccagttcttgcaata

SEQ ID NO: 5242161 - DNA, 18 bp, Homo sapiens
ataccatagagtccagat

SEQ ID NO: 5242162 - DNA, 19 bp, Homo sapiens
ataccatatgtctgcttct

SEQ ID NO: 5242163 - DNA, 18 bp, Homo sapiens
ataccattattatgtaaa

SEQ ID NO: 5242164 - DNA, 20 bp, Homo sapiens
ataccattctattctccaga

SEQ ID NO: 5242165 - DNA, 21 bp, Homo sapiens
ataccattctattctccagac

SEQ ID NO: 5242166 - DNA, 15 bp, Homo sapiens
ataccattgaaatca

SEQ ID NO: 5242167 - DNA, 15 bp, Homo sapiens
ataccattgacacat

SEQ ID NO: 5242168 - DNA, 14 bp, Homo sapiens
ataccattttgaaa

SEQ ID NO: 5242169 - DNA, 17 bp, Homo sapiens
ataccattttgaaatat

SEQ ID NO: 5242170 - DNA, 14 bp, Homo sapiens
atacccaaatcctc

SEQ ID NO: 5242171 - DNA, 18 bp, Homo sapiens
atacccaaatcctctcca

SEQ ID NO: 5242172 - DNA, 23 bp, Homo sapiens
atacccaaatcctctccagctat

SEQ ID NO: 5242173 - DNA, 16 bp, Homo sapiens
atacccaaccccagat

SEQ ID NO: 5242174 - DNA, 21 bp, Homo sapiens
atacccacacattccagggct

SEQ ID NO: 5242175 - DNA, 13 bp, Homo sapiens
atacccacccaga

SEQ ID NO: 5242176 - DNA, 13 bp, Homo sapiens
atacccagagaga

SEQ ID NO: 5242177 - DNA, 14 bp, Homo sapiens
atacccagagcacc

SEQ ID NO: 5242178 - DNA, 23 bp, Homo sapiens
atacccagatgttttatttatga

SEQ ID NO: 5242179 - DNA, 16 bp, Homo sapiens
atacccagcagaggga

SEQ ID NO: 5242180 - DNA, 13 bp, Homo sapiens
atacccaggaaga

SEQ ID NO: 5242181 - DNA, 19 bp, Homo sapiens
atacccagtgtttggggtg

SEQ ID NO: 5242182 - DNA, 17 bp, Homo sapiens
ataccccaagtccacct

SEQ ID NO: 5242183 - DNA, 16 bp, Homo sapiens
atacccccagagacct

SEQ ID NO: 5242184 - DNA, 18 bp, Homo sapiens
atacccccattaaattca

SEQ ID NO: 5242185 - DNA, 17 bp, Homo sapiens
atacccccccatgcagt

SEQ ID NO: 5242186 - DNA, 22 bp, Homo sapiens
atacccccctacttaatgtaat

SEQ ID NO: 5242187 - DNA, 21 bp, Homo sapiens
atacccccgtcggaatggtaa

SEQ ID NO: 5242188 - DNA, 22 bp, Homo sapiens
atacccccgtcggaatggtaac

SEQ ID NO: 5242189 - DNA, 22 bp, Homo sapiens
ataccccctgcaaagcccagct

SEQ ID NO: 5242190 - DNA, 14 bp, Homo sapiens
ataccccctgcccc

SEQ ID NO: 5242191 - DNA, 16 bp, Homo sapiens
ataccccctgccccag

SEQ ID NO: 5242192 - DNA, 19 bp, Homo sapiens
ataccccctgccccagaga

SEQ ID NO: 5242193 - DNA, 15 bp, Homo sapiens
atacccctcatcaca

SEQ ID NO: 5242194 - DNA, 22 bp, Homo sapiens
atacccctgcctgggttttcta

SEQ ID NO: 5242195 - DNA, 17 bp, Homo sapiens
ataccccttaaccccgg

SEQ ID NO: 5242196 - DNA, 16 bp, Homo sapiens
ataccccttattgctg

SEQ ID NO: 5242197 - DNA, 18 bp, Homo sapiens
ataccccttattgctgcc

SEQ ID NO: 5242198 - DNA, 13 bp, Homo sapiens
ataccctactgtg

SEQ ID NO: 5242199 - DNA, 18 bp, Homo sapiens
ataccctagaagaaaacc

SEQ ID NO: 5242200 - DNA, 23 bp, Homo sapiens
ataccctaggtctccacccctca

SEQ ID NO: 5242201 - DNA, 12 bp, Homo sapiens
ataccctccccc

SEQ ID NO: 5242202 - DNA, 22 bp, Homo sapiens
ataccctccctccctaccctaa

SEQ ID NO: 5242203 - DNA, 13 bp, Homo sapiens
ataccctctgaga

SEQ ID NO: 5242204 - DNA, 20 bp, Homo sapiens
ataccctctgagacagagag

SEQ ID NO: 5242205 - DNA, 20 bp, Homo sapiens
atacccttctttaaatcaaa

SEQ ID NO: 5242206 - DNA, 21 bp, Homo sapiens
atacccttctttaaatcaaaa

SEQ ID NO: 5242207 - DNA, 21 bp, Homo sapiens
ataccgaccatcgtccagccc

SEQ ID NO: 5242208 - DNA, 19 bp, Homo sapiens
ataccgcctcgtgccagca

SEQ ID NO: 5242209 - DNA, 16 bp, Homo sapiens
ataccggaattacttt

SEQ ID NO: 5242210 - DNA, 14 bp, Homo sapiens
ataccgtgccactt

SEQ ID NO: 5242211 - DNA, 18 bp, Homo sapiens
ataccgtttggtgtctga

SEQ ID NO: 5242212 - DNA, 23 bp, Homo sapiens
ataccgtttggtgtctgatgtgt

SEQ ID NO: 5242213 - DNA, 13 bp, Homo sapiens
atacctaaaacat

SEQ ID NO: 5242214 - DNA, 15 bp, Homo sapiens
atacctaagaagtac

SEQ ID NO: 5242215 - DNA, 21 bp, Homo sapiens
atacctaagaagtacattgtt

SEQ ID NO: 5242216 - DNA, 15 bp, Homo sapiens
atacctaagtactgt

SEQ ID NO: 5242217 - DNA, 16 bp, Homo sapiens
atacctaagtactgta

SEQ ID NO: 5242218 - DNA, 20 bp, Homo sapiens
atacctaagtactgtaataa

SEQ ID NO: 5242219 - DNA, 22 bp, Homo sapiens
atacctaagtactgtaataata

SEQ ID NO: 5242220 - DNA, 16 bp, Homo sapiens
atacctaattgtggat

SEQ ID NO: 5242221 - DNA, 17 bp, Homo sapiens
atacctaattgtggatg

SEQ ID NO: 5242222 - DNA, 19 bp, Homo sapiens
atacctacaataaactggt

SEQ ID NO: 5242223 - DNA, 17 bp, Homo sapiens
atacctacatgtatttg

SEQ ID NO: 5242224 - DNA, 22 bp, Homo sapiens
atacctactgactgatgacaaa

SEQ ID NO: 5242225 - DNA, 24 bp, Homo sapiens
atacctagtgatacggatttagct

SEQ ID NO: 5242226 - DNA, 14 bp, Homo sapiens
atacctataatgtg

SEQ ID NO: 5242227 - DNA, 19 bp, Homo sapiens
atacctatgtcaacagtat

SEQ ID NO: 5242228 - DNA, 17 bp, Homo sapiens
atacctattaaaggaaa

SEQ ID NO: 5242229 - DNA, 22 bp, Homo sapiens
atacctattcaagaagatagtt

SEQ ID NO: 5242230 - DNA, 14 bp, Homo sapiens
atacctcaatgttt

SEQ ID NO: 5242231 - DNA, 20 bp, Homo sapiens
atacctcaattttcactgtg

SEQ ID NO: 5242232 - DNA, 24 bp, Homo sapiens
atacctcactagccatgctttatg

SEQ ID NO: 5242233 - DNA, 16 bp, Homo sapiens
atacctcagccctggc

SEQ ID NO: 5242234 - DNA, 19 bp, Homo sapiens
atacctcaggaaagaatag

SEQ ID NO: 5242235 - DNA, 15 bp, Homo sapiens
atacctcatcatcca

SEQ ID NO: 5242236 - DNA, 18 bp, Homo sapiens
atacctcatcatccaccc

SEQ ID NO: 5242237 - DNA, 20 bp, Homo sapiens
atacctcatcatccacccgc

SEQ ID NO: 5242238 - DNA, 21 bp, Homo sapiens
atacctcatcatccacccgct

SEQ ID NO: 5242239 - DNA, 17 bp, Homo sapiens
atacctcatgtttatga

SEQ ID NO: 5242240 - DNA, 15 bp, Homo sapiens
atacctccaaccctg

SEQ ID NO: 5242241 - DNA, 18 bp, Homo sapiens
atacctccattaaatggt

SEQ ID NO: 5242242 - DNA, 19 bp, Homo sapiens
atacctcctccctaatgct

SEQ ID NO: 5242243 - DNA, 21 bp, Homo sapiens
atacctcctccctaatgctca

SEQ ID NO: 5242244 - DNA, 20 bp, Homo sapiens
atacctctaatagtataaac

SEQ ID NO: 5242245 - DNA, 20 bp, Homo sapiens
atacctctctctatatatac

SEQ ID NO: 5242246 - DNA, 14 bp, Homo sapiens
atacctctgaccaa

SEQ ID NO: 5242247 - DNA, 13 bp, Homo sapiens
atacctctgtgtg

SEQ ID NO: 5242248 - DNA, 17 bp, Homo sapiens
atacctcttagctgagt

SEQ ID NO: 5242249 - DNA, 16 bp, Homo sapiens
atacctctttgaaaga

SEQ ID NO: 5242250 - DNA, 17 bp, Homo sapiens
atacctctttgaaagaa

SEQ ID NO: 5242251 - DNA, 23 bp, Homo sapiens
atacctgattgatcacacagtgt

SEQ ID NO: 5242252 - DNA, 11 bp, Homo sapiens
atacctgcccc

SEQ ID NO: 5242253 - DNA, 11 bp, Homo sapiens
atacctgccct

SEQ ID NO: 5242254 - DNA, 17 bp, Homo sapiens
atacctgcctgggacag

SEQ ID NO: 5242255 - DNA, 11 bp, Homo sapiens
atacctggagc

SEQ ID NO: 5242256 - DNA, 23 bp, Homo sapiens
atacctggatccagccattcctg

SEQ ID NO: 5242257 - DNA, 19 bp, Homo sapiens
atacctggcttttacttta

SEQ ID NO: 5242258 - DNA, 22 bp, Homo sapiens
atacctggcttttactttatta

SEQ ID NO: 5242259 - DNA, 16 bp, Homo sapiens
atacctggctttttaa

SEQ ID NO: 5242260 - DNA, 18 bp, Homo sapiens
atacctgggcatactaat

SEQ ID NO: 5242261 - DNA, 16 bp, Homo sapiens
atacctgtacacacac

SEQ ID NO: 5242262 - DNA, 18 bp, Homo sapiens
atacctgtacacacacag

SEQ ID NO: 5242263 - DNA, 23 bp, Homo sapiens
atacctgtacacacacagacaca

SEQ ID NO: 5242264 - DNA, 14 bp, Homo sapiens
atacctgtcaatac

SEQ ID NO: 5242265 - DNA, 14 bp, Homo sapiens
atacctgtccccct

SEQ ID NO: 5242266 - DNA, 15 bp, Homo sapiens
atacctgtccccctg

SEQ ID NO: 5242267 - DNA, 12 bp, Homo sapiens
atacctgtgagg

SEQ ID NO: 5242268 - DNA, 21 bp, Homo sapiens
atacctgtgcctgcttctggg

SEQ ID NO: 5242269 - DNA, 20 bp, Homo sapiens
atacctgtggtttggtttta

SEQ ID NO: 5242270 - DNA, 12 bp, Homo sapiens
atacctgttgct

SEQ ID NO: 5242271 - DNA, 15 bp, Homo sapiens
atacctgtttaaatt

SEQ ID NO: 5242272 - DNA, 17 bp, Homo sapiens
ataccttaaaatttgaa

SEQ ID NO: 5242273 - DNA, 16 bp, Homo sapiens
ataccttagactgaaa

SEQ ID NO: 5242274 - DNA, 17 bp, Homo sapiens
ataccttctatgtatta

SEQ ID NO: 5242275 - DNA, 16 bp, Homo sapiens
ataccttctcccaggc

SEQ ID NO: 5242276 - DNA, 22 bp, Homo sapiens
ataccttctcccaggcctctgc

SEQ ID NO: 5242277 - DNA, 19 bp, Homo sapiens
ataccttctgacagcccaa

SEQ ID NO: 5242278 - DNA, 22 bp, Homo sapiens
ataccttctgatgaagttgtac

SEQ ID NO: 5242279 - DNA, 17 bp, Homo sapiens
ataccttctggctgtgc

SEQ ID NO: 5242280 - DNA, 16 bp, Homo sapiens
ataccttgcttcttca

SEQ ID NO: 5242281 - DNA, 18 bp, Homo sapiens
atacctttaaatatcatt

SEQ ID NO: 5242282 - DNA, 19 bp, Homo sapiens
atacctttaaatatcattc

SEQ ID NO: 5242283 - DNA, 17 bp, Homo sapiens
atacctttcaaagaact

SEQ ID NO: 5242284 - DNA, 18 bp, Homo sapiens
atacctttcaaagaactc

SEQ ID NO: 5242285 - DNA, 13 bp, Homo sapiens
atacctttccagg

SEQ ID NO: 5242286 - DNA, 13 bp, Homo sapiens
atacctttctaag

SEQ ID NO: 5242287 - DNA, 14 bp, Homo sapiens
ataccttttatttt

SEQ ID NO: 5242288 - DNA, 22 bp, Homo sapiens
atacgaaaaagtgattgtgaag

SEQ ID NO: 5242289 - DNA, 14 bp, Homo sapiens
atacgaaataattg

SEQ ID NO: 5242290 - DNA, 21 bp, Homo sapiens
atacgaaataattgttgttct

SEQ ID NO: 5242291 - DNA, 11 bp, Homo sapiens
atacgaacaaa

SEQ ID NO: 5242292 - DNA, 19 bp, Homo sapiens
atacgaatttctatagact

SEQ ID NO: 5242293 - DNA, 20 bp, Homo sapiens
atacgagagcagaggtctcc

SEQ ID NO: 5242294 - DNA, 13 bp, Homo sapiens
atacgagtgaccg

SEQ ID NO: 5242295 - DNA, 15 bp, Homo sapiens
atacgatcctgcagg

SEQ ID NO: 5242296 - DNA, 20 bp, Homo sapiens
atacgcaaaaacttccttta

SEQ ID NO: 5242297 - DNA, 14 bp, Homo sapiens
atacgcaattgtat

SEQ ID NO: 5242298 - DNA, 15 bp, Homo sapiens
atacgcaattgtata

SEQ ID NO: 5242299 - DNA, 17 bp, Homo sapiens
atatttttttaactgtg

SEQ ID NO: 5242300 - DNA, 18 bp, Homo sapiens
atatttttttaactgtga

SEQ ID NO: 5242301 - DNA, 14 bp, Homo sapiens
atatttttttaagt

SEQ ID NO: 5242302 - DNA, 16 bp, Homo sapiens
atatttttttaattta

SEQ ID NO: 5242303 - DNA, 13 bp, Homo sapiens
atatttttttcct

SEQ ID NO: 5242304 - DNA, 16 bp, Homo sapiens
atatttttttcctatg

SEQ ID NO: 5242305 - DNA, 14 bp, Homo sapiens
atatttttttcctt

SEQ ID NO: 5242306 - DNA, 18 bp, Homo sapiens
atatttttttctgaaatt

SEQ ID NO: 5242307 - DNA, 19 bp, Homo sapiens
atatttttttctgaaattt

SEQ ID NO: 5242308 - DNA, 16 bp, Homo sapiens
atatttttttctgtaa

SEQ ID NO: 5242309 - DNA, 21 bp, Homo sapiens
atatttttttctgtaaaagtt

SEQ ID NO: 5242310 - DNA, 18 bp, Homo sapiens
atatttttttcttttctt

SEQ ID NO: 5242311 - DNA, 18 bp, Homo sapiens
atatttttttttaagctc

SEQ ID NO: 5242312 - DNA, 16 bp, Homo sapiens
atatttttttttggat

SEQ ID NO: 5242313 - DNA, 15 bp, Homo sapiens
atcaaaaaacagaaa

SEQ ID NO: 5242314 - DNA, 12 bp, Homo sapiens
atcaaaaacttt

SEQ ID NO: 5242315 - DNA, 15 bp, Homo sapiens
atcaaaaacttttca

SEQ ID NO: 5242316 - DNA, 23 bp, Homo sapiens
atcaaaaacttttcatttcagat

SEQ ID NO: 5242317 - DNA, 12 bp, Homo sapiens
atcaaaaagaaa

SEQ ID NO: 5242318 - DNA, 12 bp, Homo sapiens
atcaaaaagcct

SEQ ID NO: 5242319 - DNA, 16 bp, Homo sapiens
atcaaaaataaactag

SEQ ID NO: 5242320 - DNA, 19 bp, Homo sapiens
atcaaaaataaactagttt

SEQ ID NO: 5242321 - DNA, 12 bp, Homo sapiens
atcaaaaataat

SEQ ID NO: 5242322 - DNA, 14 bp, Homo sapiens
atcaaaacaagtac

SEQ ID NO: 5242323 - DNA, 13 bp, Homo sapiens
atcaaaacacact

SEQ ID NO: 5242324 - DNA, 21 bp, Homo sapiens
atcaaaacacactactacctc

SEQ ID NO: 5242325 - DNA, 19 bp, Homo sapiens
atcaaaacctaccctgtcc

SEQ ID NO: 5242326 - DNA, 14 bp, Homo sapiens
atcaaaaccttcct

SEQ ID NO: 5242327 - DNA, 21 bp, Homo sapiens
atcaaaactttcttttctgga

SEQ ID NO: 5242328 - DNA, 19 bp, Homo sapiens
atcaaaagaaaattgatat

SEQ ID NO: 5242329 - DNA, 13 bp, Homo sapiens
atcaaaagaaata

SEQ ID NO: 5242330 - DNA, 16 bp, Homo sapiens
atcaaaagaaatagaa

SEQ ID NO: 5242331 - DNA, 16 bp, Homo sapiens
atcaaaagaatgtcca

SEQ ID NO: 5242332 - DNA, 15 bp, Homo sapiens
atcaaaagacaattc

SEQ ID NO: 5242333 - DNA, 18 bp, Homo sapiens
atcaaaagacaattcttt

SEQ ID NO: 5242334 - DNA, 23 bp, Homo sapiens
atcaaaagacaattctttataca

SEQ ID NO: 5242335 - DNA, 20 bp, Homo sapiens
atcaaaaggtaatgcacatc

SEQ ID NO: 5242336 - DNA, 20 bp, Homo sapiens
atcaaaaggttaataaagta

SEQ ID NO: 5242337 - DNA, 18 bp, Homo sapiens
atcaaaataaaaagtgac

SEQ ID NO: 5242338 - DNA, 16 bp, Homo sapiens
atcaaaataaattgaa

SEQ ID NO: 5242339 - DNA, 19 bp, Homo sapiens
atcaaaataaattgaaata

SEQ ID NO: 5242340 - DNA, 13 bp, Homo sapiens
atcaaaatagttt

SEQ ID NO: 5242341 - DNA, 23 bp, Homo sapiens
atcaaaatagtttaggaaaatga

SEQ ID NO: 5242342 - DNA, 18 bp, Homo sapiens
atcaaaatcactatcttt

SEQ ID NO: 5242343 - DNA, 21 bp, Homo sapiens
atcaaaatccctatttaattt

SEQ ID NO: 5242344 - DNA, 20 bp, Homo sapiens
atcaaaatcttaatcattat

SEQ ID NO: 5242345 - DNA, 13 bp, Homo sapiens
atcaaaatgacct

SEQ ID NO: 5242346 - DNA, 15 bp, Homo sapiens
atcaaaatgctctta

SEQ ID NO: 5242347 - DNA, 20 bp, Homo sapiens
atcaaaatgctcttatttca

SEQ ID NO: 5242348 - DNA, 21 bp, Homo sapiens
atcaaaatgctcttatttcat

SEQ ID NO: 5242349 - DNA, 14 bp, Homo sapiens
atcaaaatgtagct

SEQ ID NO: 5242350 - DNA, 17 bp, Homo sapiens
atcaaaatgtagctttt

SEQ ID NO: 5242351 - DNA, 14 bp, Homo sapiens
atcaaaattacata

SEQ ID NO: 5242352 - DNA, 21 bp, Homo sapiens
atcaaaattctgttttgtaaa

SEQ ID NO: 5242353 - DNA, 23 bp, Homo sapiens
atcaaaattgttacccatttgaa

SEQ ID NO: 5242354 - DNA, 14 bp, Homo sapiens
atcaaacaaccttc

SEQ ID NO: 5242355 - DNA, 22 bp, Homo sapiens
atcaaacagccccagtcttcct

SEQ ID NO: 5242356 - DNA, 14 bp, Homo sapiens
atcaaacagctcag

SEQ ID NO: 5242357 - DNA, 17 bp, Homo sapiens
atcaaacatttgccaag

SEQ ID NO: 5242358 - DNA, 19 bp, Homo sapiens
atcaaacctttctggcctg

SEQ ID NO: 5242359 - DNA, 23 bp, Homo sapiens
atcaaactctttgcccagttcat

SEQ ID NO: 5242360 - DNA, 11 bp, Homo sapiens
atcaaactgct

SEQ ID NO: 5242361 - DNA, 22 bp, Homo sapiens
atcaaactgcttatgaaaagta

SEQ ID NO: 5242362 - DNA, 24 bp, Homo sapiens
atcaaagaaaaacaatgaaattga

SEQ ID NO: 5242363 - DNA, 16 bp, Homo sapiens
atcaaagaaaagactt

SEQ ID NO: 5242364 - DNA, 16 bp, Homo sapiens
atcaaagaaattcaga

SEQ ID NO: 5242365 - DNA, 17 bp, Homo sapiens
atcaaagaaattcagaa

SEQ ID NO: 5242366 - DNA, 13 bp, Homo sapiens
atcaaagaacaga

SEQ ID NO: 5242367 - DNA, 15 bp, Homo sapiens
atcaaagaacagatg

SEQ ID NO: 5242368 - DNA, 13 bp, Homo sapiens
atcaaagaagatg

SEQ ID NO: 5242369 - DNA, 13 bp, Homo sapiens
atcaaagaattac

SEQ ID NO: 5242370 - DNA, 16 bp, Homo sapiens
atcaaagacatttcat

SEQ ID NO: 5242371 - DNA, 18 bp, Homo sapiens
atcaaagagagaaaataa

SEQ ID NO: 5242372 - DNA, 22 bp, Homo sapiens
atcaaagagcacttgagctgtc

SEQ ID NO: 5242373 - DNA, 20 bp, Homo sapiens
atcaaagaggttttaaaaaa

SEQ ID NO: 5242374 - DNA, 13 bp, Homo sapiens
atcaaagatgact

SEQ ID NO: 5242375 - DNA, 20 bp, Homo sapiens
atcaaagcaagggctccagc

SEQ ID NO: 5242376 - DNA, 23 bp, Homo sapiens
atcaaagcacttggactcttgct

SEQ ID NO: 5242377 - DNA, 18 bp, Homo sapiens
atcaaagcatcttgcatt

SEQ ID NO: 5242378 - DNA, 17 bp, Homo sapiens
atcaaagcattttataa

SEQ ID NO: 5242379 - DNA, 16 bp, Homo sapiens
atcaaagccagggtct

SEQ ID NO: 5242380 - DNA, 15 bp, Homo sapiens
atcaaagctaggaaa

SEQ ID NO: 5242381 - DNA, 16 bp, Homo sapiens
atcaaaggcagaaagg

SEQ ID NO: 5242382 - DNA, 20 bp, Homo sapiens
atcaaagggataaagaaaaa

SEQ ID NO: 5242383 - DNA, 19 bp, Homo sapiens
atcaaaggggatatatgtt

SEQ ID NO: 5242384 - DNA, 15 bp, Homo sapiens
atcaaagtaaaaaat

SEQ ID NO: 5242385 - DNA, 20 bp, Homo sapiens
atcaaagtcaaaaatagcaa

SEQ ID NO: 5242386 - DNA, 19 bp, Homo sapiens
atcaaagtcattaaagaca

SEQ ID NO: 5242387 - DNA, 20 bp, Homo sapiens
atcaaagtggggtacagtaa

SEQ ID NO: 5242388 - DNA, 22 bp, Homo sapiens
atcaaagtggtaaatactgtga

SEQ ID NO: 5242389 - DNA, 15 bp, Homo sapiens
atcaaagtgtttaat

SEQ ID NO: 5242390 - DNA, 19 bp, Homo sapiens
atcaaagtgtttaattgta

SEQ ID NO: 5242391 - DNA, 21 bp, Homo sapiens
atcaaagtgtttaattgtata

SEQ ID NO: 5242392 - DNA, 23 bp, Homo sapiens
atcaaagtgtttaattgtataaa

SEQ ID NO: 5242393 - DNA, 22 bp, Homo sapiens
atcaaagttcctgttcacctta

SEQ ID NO: 5242394 - DNA, 16 bp, Homo sapiens
atcaaagttctgcttt

SEQ ID NO: 5242395 - DNA, 23 bp, Homo sapiens
atcaaagttctgctttctcccca

SEQ ID NO: 5242396 - DNA, 17 bp, Homo sapiens
atcaaataaaaattcta

SEQ ID NO: 5242397 - DNA, 21 bp, Homo sapiens
atcaaataaaaattctagatt

SEQ ID NO: 5242398 - DNA, 15 bp, Homo sapiens
atcaaataaatttct

SEQ ID NO: 5242399 - DNA, 15 bp, Homo sapiens
atcaaataagaaata

SEQ ID NO: 5242400 - DNA, 19 bp, Homo sapiens
atcaaataagtatttataa

SEQ ID NO: 5242401 - DNA, 20 bp, Homo sapiens
atcaaataagtatttataat

SEQ ID NO: 5242402 - DNA, 15 bp, Homo sapiens
atcaaataataaagt

SEQ ID NO: 5242403 - DNA, 14 bp, Homo sapiens
atcaaataatacat

SEQ ID NO: 5242404 - DNA, 17 bp, Homo sapiens
atcaaataataccttag

SEQ ID NO: 5242405 - DNA, 22 bp, Homo sapiens
atcaaataatcacaaaatcaca

SEQ ID NO: 5242406 - DNA, 13 bp, Homo sapiens
atcaaatacattt

SEQ ID NO: 5242407 - DNA, 20 bp, Homo sapiens
atcaaatagaaccactatga

SEQ ID NO: 5242408 - DNA, 14 bp, Homo sapiens
atcaaatatgcaaa

SEQ ID NO: 5242409 - DNA, 15 bp, Homo sapiens
atcaaatatgcaaag

SEQ ID NO: 5242410 - DNA, 18 bp, Homo sapiens
atcaaatatgcaaagcac

SEQ ID NO: 5242411 - DNA, 15 bp, Homo sapiens
atcaaatattagatg

SEQ ID NO: 5242412 - DNA, 16 bp, Homo sapiens
atcaaatattagatgt

SEQ ID NO: 5242413 - DNA, 16 bp, Homo sapiens
atcaaatattttttga

SEQ ID NO: 5242414 - DNA, 16 bp, Homo sapiens
atcaaatcattcaaaa

SEQ ID NO: 5242415 - DNA, 22 bp, Homo sapiens
atcaaatcattcaaaactttca

SEQ ID NO: 5242416 - DNA, 22 bp, Homo sapiens
atcaaatctgtatatgttgtaa

SEQ ID NO: 5242417 - DNA, 13 bp, Homo sapiens
atcaaatgaatga

SEQ ID NO: 5242418 - DNA, 23 bp, Homo sapiens
atcaaatgagcatctcaaatgtt

SEQ ID NO: 5242419 - DNA, 20 bp, Homo sapiens
atcaaatgatttcatattga

SEQ ID NO: 5242420 - DNA, 21 bp, Homo sapiens
atcaaatgatttcatattgat

SEQ ID NO: 5242421 - DNA, 14 bp, Homo sapiens
atcaaatgcatgcg

SEQ ID NO: 5242422 - DNA, 22 bp, Homo sapiens
atcaaatggaaaggagaggaaa

SEQ ID NO: 5242423 - DNA, 17 bp, Homo sapiens
atcaaatggaagacaca

SEQ ID NO: 5242424 - DNA, 13 bp, Homo sapiens
atcaaatgtaaag

SEQ ID NO: 5242425 - DNA, 14 bp, Homo sapiens
atcaaatgtacatc

SEQ ID NO: 5242426 - DNA, 13 bp, Homo sapiens
atcaaatgtatgt

SEQ ID NO: 5242427 - DNA, 12 bp, Homo sapiens
atcaaatgttta

SEQ ID NO: 5242428 - DNA, 17 bp, Homo sapiens
atcaaatgtttaatcat

SEQ ID NO: 5242429 - DNA, 17 bp, Homo sapiens
atcaaattaattgtgtg

SEQ ID NO: 5242430 - DNA, 16 bp, Homo sapiens
atcaaattctgtctgg

SEQ ID NO: 5242431 - DNA, 23 bp, Homo sapiens
atcaaattgcttaaaaaagagtt

SEQ ID NO: 5242432 - DNA, 21 bp, Homo sapiens
atcaacaaaagggagaacatg

SEQ ID NO: 5242433 - DNA, 23 bp, Homo sapiens
atcaacaatagtaactctttctt

SEQ ID NO: 5242434 - DNA, 12 bp, Homo sapiens
atcaacaatgat

SEQ ID NO: 5242435 - DNA, 13 bp, Homo sapiens
atcaacagaagca

SEQ ID NO: 5242436 - DNA, 17 bp, Homo sapiens
atcaacagaattgttct

SEQ ID NO: 5242437 - DNA, 22 bp, Homo sapiens
atcaacagaattgttctttttc

SEQ ID NO: 5242438 - DNA, 20 bp, Homo sapiens
atcaacagcatgtctactgc

SEQ ID NO: 5242439 - DNA, 19 bp, Homo sapiens
atcaacagccaaactgctg

SEQ ID NO: 5242440 - DNA, 20 bp, Homo sapiens
atcaacagtgaacagcttca

SEQ ID NO: 5242441 - DNA, 17 bp, Homo sapiens
atcaacagtgagagact

SEQ ID NO: 5242442 - DNA, 12 bp, Homo sapiens
atcaacattctt

SEQ ID NO: 5242443 - DNA, 21 bp, Homo sapiens
atcaacattcttgtgtctgtt

SEQ ID NO: 5242444 - DNA, 14 bp, Homo sapiens
atcaacatttatga

SEQ ID NO: 5242445 - DNA, 16 bp, Homo sapiens
atcaacatttatgacc

SEQ ID NO: 5242446 - DNA, 19 bp, Homo sapiens
atcaacatttatgacctaa

SEQ ID NO: 5242447 - DNA, 11 bp, Homo sapiens
atcaaccaaag

SEQ ID NO: 5242448 - DNA, 20 bp, Homo sapiens
atcaaccaaagttagttcag

SEQ ID NO: 5242449 - DNA, 17 bp, Homo sapiens
atcaaccaactgcacaa

SEQ ID NO: 5242450 - DNA, 16 bp, Homo sapiens
atcaaccaggcagagt

SEQ ID NO: 5242451 - DNA, 20 bp, Homo sapiens
atcaaccccttcgctcctgt

SEQ ID NO: 5242452 - DNA, 11 bp, Homo sapiens
atcaacccttc

SEQ ID NO: 5242453 - DNA, 21 bp, Homo sapiens
atcaacctattaaaatacatt

SEQ ID NO: 5242454 - DNA, 16 bp, Homo sapiens
atcaacctgcacttca

SEQ ID NO: 5242455 - DNA, 19 bp, Homo sapiens
atcaacctgcacttcatat

SEQ ID NO: 5242456 - DNA, 17 bp, Homo sapiens
atcaactagcagaaaat

SEQ ID NO: 5242457 - DNA, 21 bp, Homo sapiens
atcaactaggtatttaagact

SEQ ID NO: 5242458 - DNA, 13 bp, Homo sapiens
atcaactcatgtt

SEQ ID NO: 5242459 - DNA, 16 bp, Homo sapiens
atcaactccagctccc

SEQ ID NO: 5242460 - DNA, 20 bp, Homo sapiens
atcaactcccaacttcttcc

SEQ ID NO: 5242461 - DNA, 13 bp, Homo sapiens
atcaactctaata

SEQ ID NO: 5242462 - DNA, 20 bp, Homo sapiens
atcaactctgaaagagcaaa

SEQ ID NO: 5242463 - DNA, 23 bp, Homo sapiens
atcaactgaaagtgtttccttca

SEQ ID NO: 5242464 - DNA, 16 bp, Homo sapiens
atcaactgtcaaatat

SEQ ID NO: 5242465 - DNA, 16 bp, Homo sapiens
atcaacttaaagtgaa

SEQ ID NO: 5242466 - DNA, 18 bp, Homo sapiens
atcaacttcgctagaaaa

SEQ ID NO: 5242467 - DNA, 15 bp, Homo sapiens
atcaactttaatcaa

SEQ ID NO: 5242468 - DNA, 23 bp, Homo sapiens
atcaacttttctgagctggtgta

SEQ ID NO: 5242469 - DNA, 21 bp, Homo sapiens
atcaactttttattgccttct

SEQ ID NO: 5242470 - DNA, 21 bp, Homo sapiens
atcaagaagactttaggaatg

SEQ ID NO: 5242471 - DNA, 23 bp, Homo sapiens
atcaagaagtcagagaaaacact

SEQ ID NO: 5242472 - DNA, 14 bp, Homo sapiens
atcaagaatattca

SEQ ID NO: 5242473 - DNA, 12 bp, Homo sapiens
atcaagaatcat

SEQ ID NO: 5242474 - DNA, 14 bp, Homo sapiens
atcaagaatcattg

SEQ ID NO: 5242475 - DNA, 15 bp, Homo sapiens
atcaagaatcattga

SEQ ID NO: 5242476 - DNA, 15 bp, Homo sapiens
atcaagacaagtgtt

SEQ ID NO: 5242477 - DNA, 19 bp, Homo sapiens
atcaagacactagttcaga

SEQ ID NO: 5242478 - DNA, 13 bp, Homo sapiens
atacgcacgcacc

SEQ ID NO: 5242479 - DNA, 16 bp, Homo sapiens
atacgcacgcacccac

SEQ ID NO: 5242480 - DNA, 16 bp, Homo sapiens
atacgcactacatgtg

SEQ ID NO: 5242481 - DNA, 22 bp, Homo sapiens
atacgcatcccatctctcccac

SEQ ID NO: 5242482 - DNA, 20 bp, Homo sapiens
atacgcattaagggcctgct

SEQ ID NO: 5242483 - DNA, 23 bp, Homo sapiens
atacgcggaggagttttctgtgt

SEQ ID NO: 5242484 - DNA, 19 bp, Homo sapiens
atacgctactataaagaga

SEQ ID NO: 5242485 - DNA, 14 bp, Homo sapiens
atacgctcagctca

SEQ ID NO: 5242486 - DNA, 15 bp, Homo sapiens
atacgcttttctttg

SEQ ID NO: 5242487 - DNA, 15 bp, Homo sapiens
atacggaacactgtc

SEQ ID NO: 5242488 - DNA, 17 bp, Homo sapiens
atacggaacactgtcaa

SEQ ID NO: 5242489 - DNA, 20 bp, Homo sapiens
atacgggggttccctttccc

SEQ ID NO: 5242490 - DNA, 21 bp, Homo sapiens
atacgggggttccctttcccc

SEQ ID NO: 5242491 - DNA, 22 bp, Homo sapiens
atacgggggttccctttcccca

SEQ ID NO: 5242492 - DNA, 15 bp, Homo sapiens
atacggggtcttgct

SEQ ID NO: 5242493 - DNA, 16 bp, Homo sapiens
atacggggtcttgctc

SEQ ID NO: 5242494 - DNA, 23 bp, Homo sapiens
atacggggtggctgaaagtaaag

SEQ ID NO: 5242495 - DNA, 18 bp, Homo sapiens
atacggtcaggtttaaca

SEQ ID NO: 5242496 - DNA, 23 bp, Homo sapiens
atacgtacatacacacatacata

SEQ ID NO: 5242497 - DNA, 14 bp, Homo sapiens
atacgtacattcct

SEQ ID NO: 5242498 - DNA, 16 bp, Homo sapiens
atacgtattacaaaca

SEQ ID NO: 5242499 - DNA, 20 bp, Homo sapiens
atacgtccgtgtgtcccaga

SEQ ID NO: 5242500 - DNA, 13 bp, Homo sapiens
atacgtgcacagg

SEQ ID NO: 5242501 - DNA, 15 bp, Homo sapiens
atacgtgcacagggt

SEQ ID NO: 5242502 - DNA, 24 bp, Homo sapiens
atacgtgcccatttcacacaactg

SEQ ID NO: 5242503 - DNA, 23 bp, Homo sapiens
atacgtgtgtgtgtgtgtatgtg

SEQ ID NO: 5242504 - DNA, 15 bp, Homo sapiens
atacgtgttcaaaaa

SEQ ID NO: 5242505 - DNA, 16 bp, Homo sapiens
atacgttcactggtct

SEQ ID NO: 5242506 - DNA, 21 bp, Homo sapiens
atacgttttggtgttgctttt

SEQ ID NO: 5242507 - DNA, 13 bp, Homo sapiens
atactaaaaagaa

SEQ ID NO: 5242508 - DNA, 15 bp, Homo sapiens
atactaaaactcaga

SEQ ID NO: 5242509 - DNA, 13 bp, Homo sapiens
atactaaaagcaa

SEQ ID NO: 5242510 - DNA, 14 bp, Homo sapiens
atactaaaagcaaa

SEQ ID NO: 5242511 - DNA, 14 bp, Homo sapiens
atactaaaatatgt

SEQ ID NO: 5242512 - DNA, 18 bp, Homo sapiens
atactaaaccaactctaa

SEQ ID NO: 5242513 - DNA, 20 bp, Homo sapiens
atactaaaccaactctaata

SEQ ID NO: 5242514 - DNA, 12 bp, Homo sapiens
atactaaagcaa

SEQ ID NO: 5242515 - DNA, 14 bp, Homo sapiens
atactaaagtgtct

SEQ ID NO: 5242516 - DNA, 13 bp, Homo sapiens
atactaaataaaa

SEQ ID NO: 5242517 - DNA, 17 bp, Homo sapiens
atactaaataaaacaat

SEQ ID NO: 5242518 - DNA, 18 bp, Homo sapiens
atactaaatatgaaattt

SEQ ID NO: 5242519 - DNA, 23 bp, Homo sapiens
atactaacgaccgacgcccctcc

SEQ ID NO: 5242520 - DNA, 15 bp, Homo sapiens
atactaacttattta

SEQ ID NO: 5242521 - DNA, 14 bp, Homo sapiens
atactaagagtaaa

SEQ ID NO: 5242522 - DNA, 16 bp, Homo sapiens
atactaaggagcctaa

SEQ ID NO: 5242523 - DNA, 18 bp, Homo sapiens
atactaagggaaagaatt

SEQ ID NO: 5242524 - DNA, 15 bp, Homo sapiens
atactaagtcctcag

SEQ ID NO: 5242525 - DNA, 19 bp, Homo sapiens
atactaagtcctcagagct

SEQ ID NO: 5242526 - DNA, 14 bp, Homo sapiens
atactaataaaaag

SEQ ID NO: 5242527 - DNA, 15 bp, Homo sapiens
atactaataaaaagg

SEQ ID NO: 5242528 - DNA, 21 bp, Homo sapiens
atactaatgaaaacagaatgt

SEQ ID NO: 5242529 - DNA, 14 bp, Homo sapiens
atactaatttattg

SEQ ID NO: 5242530 - DNA, 24 bp, Homo sapiens
atactaatttttgcttaacattag

SEQ ID NO: 5242531 - DNA, 15 bp, Homo sapiens
atactacaacttttg

SEQ ID NO: 5242532 - DNA, 16 bp, Homo sapiens
atactacagcataaat

SEQ ID NO: 5242533 - DNA, 18 bp, Homo sapiens
atactacagcataaatct

SEQ ID NO: 5242534 - DNA, 14 bp, Homo sapiens
atactacagtagtt

SEQ ID NO: 5242535 - DNA, 17 bp, Homo sapiens
atactacagtagttcca

SEQ ID NO: 5242536 - DNA, 20 bp, Homo sapiens
atactaccagggtctctcag

SEQ ID NO: 5242537 - DNA, 22 bp, Homo sapiens
atactaccagggtctctcaggg

SEQ ID NO: 5242538 - DNA, 16 bp, Homo sapiens
atactaccctttgctg

SEQ ID NO: 5242539 - DNA, 23 bp, Homo sapiens
atactacctcactactacatctg

SEQ ID NO: 5242540 - DNA, 14 bp, Homo sapiens
atactaccttgaaa

SEQ ID NO: 5242541 - DNA, 13 bp, Homo sapiens
atactactcctgt

SEQ ID NO: 5242542 - DNA, 14 bp, Homo sapiens
atactactgctttg

SEQ ID NO: 5242543 - DNA, 19 bp, Homo sapiens
atactactttctctttttc

SEQ ID NO: 5242544 - DNA, 23 bp, Homo sapiens
atactagaaagctctgcatgtgt

SEQ ID NO: 5242545 - DNA, 18 bp, Homo sapiens
atactagccagagctcct

SEQ ID NO: 5242546 - DNA, 17 bp, Homo sapiens
atactaggatacagaaa

SEQ ID NO: 5242547 - DNA, 21 bp, Homo sapiens
atactagggagccatttgaga

SEQ ID NO: 5242548 - DNA, 14 bp, Homo sapiens
atactaggtgcctt

SEQ ID NO: 5242549 - DNA, 16 bp, Homo sapiens
atactaggtgcctttt

SEQ ID NO: 5242550 - DNA, 20 bp, Homo sapiens
atactagttgtgaccttagt

SEQ ID NO: 5242551 - DNA, 12 bp, Homo sapiens
atactatacaac

SEQ ID NO: 5242552 - DNA, 17 bp, Homo sapiens
atactatattaactttt

SEQ ID NO: 5242553 - DNA, 18 bp, Homo sapiens
atactatattaactttta

SEQ ID NO: 5242554 - DNA, 20 bp, Homo sapiens
atactatgtaagggctttaa

SEQ ID NO: 5242555 - DNA, 21 bp, Homo sapiens
atactatgtaagggctttaaa

SEQ ID NO: 5242556 - DNA, 22 bp, Homo sapiens
atactatgtaagggctttaaat

SEQ ID NO: 5242557 - DNA, 13 bp, Homo sapiens
atactatgttcat

SEQ ID NO: 5242558 - DNA, 21 bp, Homo sapiens
atactattaaaaaggtttaca

SEQ ID NO: 5242559 - DNA, 22 bp, Homo sapiens
atactattaaaaaggtttacag

SEQ ID NO: 5242560 - DNA, 17 bp, Homo sapiens
atactattaaacatgct

SEQ ID NO: 5242561 - DNA, 14 bp, Homo sapiens
atactattaaagta

SEQ ID NO: 5242562 - DNA, 18 bp, Homo sapiens
atactattggacagacac

SEQ ID NO: 5242563 - DNA, 21 bp, Homo sapiens
atactatttaagatgtgaaaa

SEQ ID NO: 5242564 - DNA, 22 bp, Homo sapiens
atactatttaagatgtgaaaat

SEQ ID NO: 5242565 - DNA, 13 bp, Homo sapiens
atactcaaatggt

SEQ ID NO: 5242566 - DNA, 17 bp, Homo sapiens
atactcaaatggtgtca

SEQ ID NO: 5242567 - DNA, 23 bp, Homo sapiens
atactcaaatggtgtcatggctg

SEQ ID NO: 5242568 - DNA, 23 bp, Homo sapiens
atactcaagagtggtatcttgca

SEQ ID NO: 5242569 - DNA, 17 bp, Homo sapiens
atactcaagtttcaggt

SEQ ID NO: 5242570 - DNA, 18 bp, Homo sapiens
atactcaagtttcaggta

SEQ ID NO: 5242571 - DNA, 23 bp, Homo sapiens
atactcaatcaagcaaaatttct

SEQ ID NO: 5242572 - DNA, 15 bp, Homo sapiens
atactcacctcctcc

SEQ ID NO: 5242573 - DNA, 23 bp, Homo sapiens
atactcagaactgtcccatcccc

SEQ ID NO: 5242574 - DNA, 24 bp, Homo sapiens
atactcagaactgtcccatcccca

SEQ ID NO: 5242575 - DNA, 12 bp, Homo sapiens
atactcagcctg

SEQ ID NO: 5242576 - DNA, 20 bp, Homo sapiens
atactcaggataacagagaa

SEQ ID NO: 5242577 - DNA, 15 bp, Homo sapiens
atactcataatgtga

SEQ ID NO: 5242578 - DNA, 18 bp, Homo sapiens
atactcataatgtgaagt

SEQ ID NO: 5242579 - DNA, 12 bp, Homo sapiens
atactcatgtgt

SEQ ID NO: 5242580 - DNA, 14 bp, Homo sapiens
atactcatgtgtat

SEQ ID NO: 5242581 - DNA, 23 bp, Homo sapiens
atactcattagaattaccatttg

SEQ ID NO: 5242582 - DNA, 23 bp, Homo sapiens
atactcatttggatataaatctt

SEQ ID NO: 5242583 - DNA, 17 bp, Homo sapiens
atactcatttttcatga

SEQ ID NO: 5242584 - DNA, 17 bp, Homo sapiens
atactcatttttcatta

SEQ ID NO: 5242585 - DNA, 17 bp, Homo sapiens
atactccaagcttcaag

SEQ ID NO: 5242586 - DNA, 13 bp, Homo sapiens
atactccactcca

SEQ ID NO: 5242587 - DNA, 17 bp, Homo sapiens
atactccactcccagca

SEQ ID NO: 5242588 - DNA, 12 bp, Homo sapiens
atactccagaga

SEQ ID NO: 5242589 - DNA, 22 bp, Homo sapiens
atactccctttttgagtaattt

SEQ ID NO: 5242590 - DNA, 20 bp, Homo sapiens
atactccgtgaggctgctgc

SEQ ID NO: 5242591 - DNA, 22 bp, Homo sapiens
atactcctcccctcttctcttt

SEQ ID NO: 5242592 - DNA, 23 bp, Homo sapiens
atactcctgcccatgatccattc

SEQ ID NO: 5242593 - DNA, 13 bp, Homo sapiens
atactcctgtcac

SEQ ID NO: 5242594 - DNA, 21 bp, Homo sapiens
atactcctgtcacctagaacg

SEQ ID NO: 5242595 - DNA, 23 bp, Homo sapiens
atactcctgttagtagcagaaat

SEQ ID NO: 5242596 - DNA, 18 bp, Homo sapiens
atactccttgcttcctga

SEQ ID NO: 5242597 - DNA, 21 bp, Homo sapiens
atactcgttattcatacaaat

SEQ ID NO: 5242598 - DNA, 16 bp, Homo sapiens
atactctaattctaac

SEQ ID NO: 5242599 - DNA, 18 bp, Homo sapiens
atactctagaacatgcac

SEQ ID NO: 5242600 - DNA, 19 bp, Homo sapiens
atactctagaacatgcaca

SEQ ID NO: 5242601 - DNA, 20 bp, Homo sapiens
atactctagaacatgcacat

SEQ ID NO: 5242602 - DNA, 21 bp, Homo sapiens
atactctagaacatgcacatt

SEQ ID NO: 5242603 - DNA, 17 bp, Homo sapiens
atactctagatgaagtt

SEQ ID NO: 5242604 - DNA, 20 bp, Homo sapiens
atactctagattttgttttg

SEQ ID NO: 5242605 - DNA, 21 bp, Homo sapiens
atactctagattttgttttgc

SEQ ID NO: 5242606 - DNA, 21 bp, Homo sapiens
atactctagtgaatgtgcctt

SEQ ID NO: 5242607 - DNA, 20 bp, Homo sapiens
atactctcaccatttggatc

SEQ ID NO: 5242608 - DNA, 15 bp, Homo sapiens
atactctcagcacca

SEQ ID NO: 5242609 - DNA, 12 bp, Homo sapiens
atactctccagg

SEQ ID NO: 5242610 - DNA, 12 bp, Homo sapiens
atactctcttcc

SEQ ID NO: 5242611 - DNA, 16 bp, Homo sapiens
atactctcttcccttt

SEQ ID NO: 5242612 - DNA, 13 bp, Homo sapiens
atactctgctatt

SEQ ID NO: 5242613 - DNA, 22 bp, Homo sapiens
atactctgctatttctcttgct

SEQ ID NO: 5242614 - DNA, 22 bp, Homo sapiens
atactctgtagtctcagttcgt

SEQ ID NO: 5242615 - DNA, 14 bp, Homo sapiens
atactctgtctccc

SEQ ID NO: 5242616 - DNA, 18 bp, Homo sapiens
atactctgtgtaatctct

SEQ ID NO: 5242617 - DNA, 21 bp, Homo sapiens
atactctgtgtaatctctgat

SEQ ID NO: 5242618 - DNA, 16 bp, Homo sapiens
atactctgttgcctcc

SEQ ID NO: 5242619 - DNA, 17 bp, Homo sapiens
atactctgttgcctcct

SEQ ID NO: 5242620 - DNA, 17 bp, Homo sapiens
atactcttaaattttat

SEQ ID NO: 5242621 - DNA, 21 bp, Homo sapiens
atactcttaggaagagaaacc

SEQ ID NO: 5242622 - DNA, 22 bp, Homo sapiens
atactcttaggaagagaaacca

SEQ ID NO: 5242623 - DNA, 13 bp, Homo sapiens
atactcttcccac

SEQ ID NO: 5242624 - DNA, 22 bp, Homo sapiens
atactcttcctatttttgtagt

SEQ ID NO: 5242625 - DNA, 20 bp, Homo sapiens
atactcttgaattcctctca

SEQ ID NO: 5242626 - DNA, 19 bp, Homo sapiens
atactcttggtcacctcaa

SEQ ID NO: 5242627 - DNA, 15 bp, Homo sapiens
atactctttcaataa

SEQ ID NO: 5242628 - DNA, 15 bp, Homo sapiens
atactctttctgtat

SEQ ID NO: 5242629 - DNA, 22 bp, Homo sapiens
atactgaaaaaaaattcctttc

SEQ ID NO: 5242630 - DNA, 18 bp, Homo sapiens
atactgaaaaaatgctga

SEQ ID NO: 5242631 - DNA, 21 bp, Homo sapiens
atactgaaaaaatgctgagcc

SEQ ID NO: 5242632 - DNA, 21 bp, Homo sapiens
atactgaaaaagaatgaaaac

SEQ ID NO: 5242633 - DNA, 16 bp, Homo sapiens
atactgaaagatctct

SEQ ID NO: 5242634 - DNA, 20 bp, Homo sapiens
atactgaacatctgagtcct

SEQ ID NO: 5242635 - DNA, 22 bp, Homo sapiens
atactgaacatctgagtcctgg

SEQ ID NO: 5242636 - DNA, 23 bp, Homo sapiens
atactgaaccacttgtagatttg

SEQ ID NO: 5242637 - DNA, 18 bp, Homo sapiens
atactgaaccactttgat

SEQ ID NO: 5242638 - DNA, 12 bp, Homo sapiens
atactgaaccag

SEQ ID NO: 5242639 - DNA, 17 bp, Homo sapiens
atactgaaccaggccag

SEQ ID NO: 5242640 - DNA, 14 bp, Homo sapiens
atactgaaggaaaa

SEQ ID NO: 5242641 - DNA, 19 bp, Homo sapiens
atactgaattgttatgtaa

SEQ ID NO: 5242642 - DNA, 18 bp, Homo sapiens
atactgaatttctttgat

SEQ ID NO: 5242643 - DNA, 15 bp, Homo sapiens
atactgacaatgtat

SEQ ID NO: 5242644 - DNA, 22 bp, Homo sapiens
atactgacaatgtattttggaa

SEQ ID NO: 5242645 - DNA, 22 bp, Homo sapiens
atactgactccaaccattcaaa

SEQ ID NO: 5242646 - DNA, 12 bp, Homo sapiens
atactgagaatc

SEQ ID NO: 5242647 - DNA, 18 bp, Homo sapiens
atactgagccaagtataa

SEQ ID NO: 5242648 - DNA, 21 bp, Homo sapiens
atactgagcttttgagtgttc

SEQ ID NO: 5242649 - DNA, 15 bp, Homo sapiens
atactgagtcagttt

SEQ ID NO: 5242650 - DNA, 16 bp, Homo sapiens
atactgagtgcctgca

SEQ ID NO: 5242651 - DNA, 14 bp, Homo sapiens
atactgatgagaca

SEQ ID NO: 5242652 - DNA, 20 bp, Homo sapiens
atactgatgagacaacacac

SEQ ID NO: 5242653 - DNA, 13 bp, Homo sapiens
atactgatggaat

SEQ ID NO: 5242654 - DNA, 22 bp, Homo sapiens
atactgatggaatttttttgta

SEQ ID NO: 5242655 - DNA, 14 bp, Homo sapiens
atcaagaccaaaga

SEQ ID NO: 5242656 - DNA, 15 bp, Homo sapiens
atcaagactatctac

SEQ ID NO: 5242657 - DNA, 20 bp, Homo sapiens
atcaagactatctacaaaaa

SEQ ID NO: 5242658 - DNA, 15 bp, Homo sapiens
atcaagactggaagg

SEQ ID NO: 5242659 - DNA, 12 bp, Homo sapiens
atcaagagaaac

SEQ ID NO: 5242660 - DNA, 15 bp, Homo sapiens
atcaagagaaacttc

SEQ ID NO: 5242661 - DNA, 12 bp, Homo sapiens
atcaagagaatc

SEQ ID NO: 5242662 - DNA, 14 bp, Homo sapiens
atcaagagaatcaa

SEQ ID NO: 5242663 - DNA, 13 bp, Homo sapiens
atcaagagactga

SEQ ID NO: 5242664 - DNA, 18 bp, Homo sapiens
atcaagagccttaaaaca

SEQ ID NO: 5242665 - DNA, 20 bp, Homo sapiens
atcaagagctgccctccttg

SEQ ID NO: 5242666 - DNA, 22 bp, Homo sapiens
atcaagaggcaggttagaagaa

SEQ ID NO: 5242667 - DNA, 20 bp, Homo sapiens
atcaagagtccggatttcta

SEQ ID NO: 5242668 - DNA, 21 bp, Homo sapiens
atcaagagtccggatttctaa

SEQ ID NO: 5242669 - DNA, 15 bp, Homo sapiens
atcaagagtctctcc

SEQ ID NO: 5242670 - DNA, 21 bp, Homo sapiens
atcaagagttgtgacaacttc

SEQ ID NO: 5242671 - DNA, 16 bp, Homo sapiens
atcaagatatatgtgt

SEQ ID NO: 5242672 - DNA, 14 bp, Homo sapiens
atcaagatgggtga

SEQ ID NO: 5242673 - DNA, 14 bp, Homo sapiens
atcaagattaatta

SEQ ID NO: 5242674 - DNA, 18 bp, Homo sapiens
atcaagatttttttcctg

SEQ ID NO: 5242675 - DNA, 18 bp, Homo sapiens
atcaagcaaaatttctgt

SEQ ID NO: 5242676 - DNA, 20 bp, Homo sapiens
atcaagcaatccagcctcat

SEQ ID NO: 5242677 - DNA, 16 bp, Homo sapiens
atcaagcacagaagga

SEQ ID NO: 5242678 - DNA, 17 bp, Homo sapiens
atcaagcataaatcact

SEQ ID NO: 5242679 - DNA, 20 bp, Homo sapiens
atcaagcatggaacaaagca

SEQ ID NO: 5242680 - DNA, 20 bp, Homo sapiens
atcaagccatcaaacctggg

SEQ ID NO: 5242681 - DNA, 12 bp, Homo sapiens
atcaagcccctg

SEQ ID NO: 5242682 - DNA, 13 bp, Homo sapiens
atcaagcccttta

SEQ ID NO: 5242683 - DNA, 14 bp, Homo sapiens
atcaagcctttatg

SEQ ID NO: 5242684 - DNA, 17 bp, Homo sapiens
atcaagctagaaggcca

SEQ ID NO: 5242685 - DNA, 18 bp, Homo sapiens
atcaagctgtacatttgg

SEQ ID NO: 5242686 - DNA, 12 bp, Homo sapiens
atcaagctgtga

SEQ ID NO: 5242687 - DNA, 12 bp, Homo sapiens
atcaagcttgtg

SEQ ID NO: 5242688 - DNA, 15 bp, Homo sapiens
atcaagcttgtgtac

SEQ ID NO: 5242689 - DNA, 17 bp, Homo sapiens
atcaagcttgtgtactt

SEQ ID NO: 5242690 - DNA, 15 bp, Homo sapiens
atcaagcttttctgt

SEQ ID NO: 5242691 - DNA, 17 bp, Homo sapiens
atcaagcttttctgtag

SEQ ID NO: 5242692 - DNA, 19 bp, Homo sapiens
atcaagcttttctgtagat

SEQ ID NO: 5242693 - DNA, 19 bp, Homo sapiens
atcaaggaagtcttcaaat

SEQ ID NO: 5242694 - DNA, 14 bp, Homo sapiens
atcaaggagcctcc

SEQ ID NO: 5242695 - DNA, 15 bp, Homo sapiens
atcaaggagggagaa

SEQ ID NO: 5242696 - DNA, 18 bp, Homo sapiens
atcaaggattttcatgtt

SEQ ID NO: 5242697 - DNA, 20 bp, Homo sapiens
atcaaggattttcatgttga

SEQ ID NO: 5242698 - DNA, 19 bp, Homo sapiens
atcaaggcaaaaatatcag

SEQ ID NO: 5242699 - DNA, 14 bp, Homo sapiens
atcaaggcaaaagg

SEQ ID NO: 5242700 - DNA, 13 bp, Homo sapiens
atcaaggcactgc

SEQ ID NO: 5242701 - DNA, 15 bp, Homo sapiens
atcaaggcactgcct

SEQ ID NO: 5242702 - DNA, 18 bp, Homo sapiens
atcaaggccttattggaa

SEQ ID NO: 5242703 - DNA, 22 bp, Homo sapiens
atcaaggccttattggaaagca

SEQ ID NO: 5242704 - DNA, 15 bp, Homo sapiens
atcaaggctgcctgg

SEQ ID NO: 5242705 - DNA, 19 bp, Homo sapiens
atcaaggctgcctggagaa

SEQ ID NO: 5242706 - DNA, 21 bp, Homo sapiens
atcaaggctgcctggagaaag

SEQ ID NO: 5242707 - DNA, 22 bp, Homo sapiens
atcaagggagacaccagtggtg

SEQ ID NO: 5242708 - DNA, 16 bp, Homo sapiens
atcaagggcactgtga

SEQ ID NO: 5242709 - DNA, 17 bp, Homo sapiens
atcaagggtcaggcctt

SEQ ID NO: 5242710 - DNA, 19 bp, Homo sapiens
atcaagggtgcgtctggga

SEQ ID NO: 5242711 - DNA, 13 bp, Homo sapiens
atcaaggtgctct

SEQ ID NO: 5242712 - DNA, 18 bp, Homo sapiens
atcaaggtggaaatggcc

SEQ ID NO: 5242713 - DNA, 15 bp, Homo sapiens
atcaagtaatacaaa

SEQ ID NO: 5242714 - DNA, 17 bp, Homo sapiens
atcaagtaatacaaact

SEQ ID NO: 5242715 - DNA, 13 bp, Homo sapiens
atcaagtaatgaa

SEQ ID NO: 5242716 - DNA, 15 bp, Homo sapiens
atcaagtacctatat

SEQ ID NO: 5242717 - DNA, 19 bp, Homo sapiens
atcaagtactacattttct

SEQ ID NO: 5242718 - DNA, 20 bp, Homo sapiens
atcaagtagaacaaaaacta

SEQ ID NO: 5242719 - DNA, 23 bp, Homo sapiens
atcaagtagtagtacttaatagt

SEQ ID NO: 5242720 - DNA, 13 bp, Homo sapiens
atcaagtatagaa

SEQ ID NO: 5242721 - DNA, 15 bp, Homo sapiens
atcaagtatagaaaa

SEQ ID NO: 5242722 - DNA, 12 bp, Homo sapiens
atcaagtattac

SEQ ID NO: 5242723 - DNA, 14 bp, Homo sapiens
atcaagtattataa

SEQ ID NO: 5242724 - DNA, 18 bp, Homo sapiens
atcaagtattataccttt

SEQ ID NO: 5242725 - DNA, 16 bp, Homo sapiens
atcaagtatttgggaa

SEQ ID NO: 5242726 - DNA, 14 bp, Homo sapiens
atcaagtccagagc

SEQ ID NO: 5242727 - DNA, 20 bp, Homo sapiens
atcaagtccatctgacaaaa

SEQ ID NO: 5242728 - DNA, 17 bp, Homo sapiens
atcaagtcccaaattca

SEQ ID NO: 5242729 - DNA, 17 bp, Homo sapiens
atcaagtcccgaggcag

SEQ ID NO: 5242730 - DNA, 23 bp, Homo sapiens
atcaagtcccgaggcagcaacag

SEQ ID NO: 5242731 - DNA, 14 bp, Homo sapiens
atcaagtctgtgaa

SEQ ID NO: 5242732 - DNA, 19 bp, Homo sapiens
atcaagtgcatttctgggc

SEQ ID NO: 5242733 - DNA, 17 bp, Homo sapiens
atcaagtggcatgtgct

SEQ ID NO: 5242734 - DNA, 12 bp, Homo sapiens
atcaagtgtaat

SEQ ID NO: 5242735 - DNA, 15 bp, Homo sapiens
atcaagtgtaattag

SEQ ID NO: 5242736 - DNA, 16 bp, Homo sapiens
atcaagtgtgctttag

SEQ ID NO: 5242737 - DNA, 16 bp, Homo sapiens
atcaagttgttgactg

SEQ ID NO: 5242738 - DNA, 18 bp, Homo sapiens
atcaagttgttgactgtg

SEQ ID NO: 5242739 - DNA, 23 bp, Homo sapiens
atcaagttgttgactgtgattag

SEQ ID NO: 5242740 - DNA, 15 bp, Homo sapiens
atcaagtttccaagc

SEQ ID NO: 5242741 - DNA, 22 bp, Homo sapiens
atcaagtttccaagcaaatgtt

SEQ ID NO: 5242742 - DNA, 21 bp, Homo sapiens
atcaagtttgaccagtgcagt

SEQ ID NO: 5242743 - DNA, 17 bp, Homo sapiens
atcaataaaaaattatg

SEQ ID NO: 5242744 - DNA, 12 bp, Homo sapiens
atcaataaaaat

SEQ ID NO: 5242745 - DNA, 16 bp, Homo sapiens
atcaataaaatgtgat

SEQ ID NO: 5242746 - DNA, 19 bp, Homo sapiens
atcaataaaattctgtaat

SEQ ID NO: 5242747 - DNA, 10 bp, Homo sapiens
atcaataaat

SEQ ID NO: 5242748 - DNA, 12 bp, Homo sapiens
atcaatacacta

SEQ ID NO: 5242749 - DNA, 19 bp, Homo sapiens
atcaatacactagttgttt

SEQ ID NO: 5242750 - DNA, 11 bp, Homo sapiens
atcaatacaga

SEQ ID NO: 5242751 - DNA, 18 bp, Homo sapiens
atcaatacagcttcatta

SEQ ID NO: 5242752 - DNA, 16 bp, Homo sapiens
atcaatacagtttata

SEQ ID NO: 5242753 - DNA, 14 bp, Homo sapiens
atcaatacttttgt

SEQ ID NO: 5242754 - DNA, 17 bp, Homo sapiens
atcaatacttttgtgta

SEQ ID NO: 5242755 - DNA, 19 bp, Homo sapiens
atcaataggcaaaagtgta

SEQ ID NO: 5242756 - DNA, 23 bp, Homo sapiens
atcaatatcccaacattctgcaa

SEQ ID NO: 5242757 - DNA, 18 bp, Homo sapiens
atcaatatctaatatata

SEQ ID NO: 5242758 - DNA, 15 bp, Homo sapiens
atcaatatgcagaat

SEQ ID NO: 5242759 - DNA, 23 bp, Homo sapiens
atcaatatgcagaatggcatttg

SEQ ID NO: 5242760 - DNA, 15 bp, Homo sapiens
atcaatattttctgc

SEQ ID NO: 5242761 - DNA, 23 bp, Homo sapiens
atcaatattttctgcaatccaat

SEQ ID NO: 5242762 - DNA, 13 bp, Homo sapiens
atcaatcaactta

SEQ ID NO: 5242763 - DNA, 12 bp, Homo sapiens
atcaatcaatgg

SEQ ID NO: 5242764 - DNA, 23 bp, Homo sapiens
atcaatcacaaaagtatattcaa

SEQ ID NO: 5242765 - DNA, 14 bp, Homo sapiens
atcaatcacagctt

SEQ ID NO: 5242766 - DNA, 13 bp, Homo sapiens
atcaatcattgta

SEQ ID NO: 5242767 - DNA, 21 bp, Homo sapiens
atcaatcattttctagccctc

SEQ ID NO: 5242768 - DNA, 21 bp, Homo sapiens
atcaatccaaattccctctgg

SEQ ID NO: 5242769 - DNA, 19 bp, Homo sapiens
atcaatccaggatgttatt

SEQ ID NO: 5242770 - DNA, 19 bp, Homo sapiens
atcaatcctgattcctctc

SEQ ID NO: 5242771 - DNA, 14 bp, Homo sapiens
atcaatcctgcccc

SEQ ID NO: 5242772 - DNA, 16 bp, Homo sapiens
atcaatcctgccccca

SEQ ID NO: 5242773 - DNA, 17 bp, Homo sapiens
atcaatcctgcccccag

SEQ ID NO: 5242774 - DNA, 22 bp, Homo sapiens
atcaatcctgggcaatcagaca

SEQ ID NO: 5242775 - DNA, 22 bp, Homo sapiens
atcaatccttcttatgtttgct

SEQ ID NO: 5242776 - DNA, 14 bp, Homo sapiens
atcaatcctttatt

SEQ ID NO: 5242777 - DNA, 21 bp, Homo sapiens
atcaatctgcagtttgtgaac

SEQ ID NO: 5242778 - DNA, 15 bp, Homo sapiens
atcaatctggcttct

SEQ ID NO: 5242779 - DNA, 19 bp, Homo sapiens
atcaatctggcttctgcat

SEQ ID NO: 5242780 - DNA, 12 bp, Homo sapiens
atcaatgacaga

SEQ ID NO: 5242781 - DNA, 23 bp, Homo sapiens
atcaatggaaaaaaataaacttt

SEQ ID NO: 5242782 - DNA, 21 bp, Homo sapiens
atcaatggcgcagtgcctctg

SEQ ID NO: 5242783 - DNA, 14 bp, Homo sapiens
atcaatgggaaata

SEQ ID NO: 5242784 - DNA, 17 bp, Homo sapiens
atcaatgggattttcta

SEQ ID NO: 5242785 - DNA, 14 bp, Homo sapiens
atcaatggtgcaaa

SEQ ID NO: 5242786 - DNA, 22 bp, Homo sapiens
atcaatggtgcaaaaaaaaact

SEQ ID NO: 5242787 - DNA, 23 bp, Homo sapiens
atcaatgtaccttttttggtagt

SEQ ID NO: 5242788 - DNA, 21 bp, Homo sapiens
atcaatgttcacgcaacttga

SEQ ID NO: 5242789 - DNA, 14 bp, Homo sapiens
atcaatgttcattg

SEQ ID NO: 5242790 - DNA, 16 bp, Homo sapiens
atcaatgttcattgta

SEQ ID NO: 5242791 - DNA, 14 bp, Homo sapiens
atcaattaaatgta

SEQ ID NO: 5242792 - DNA, 15 bp, Homo sapiens
atcaattaaatgtag

SEQ ID NO: 5242793 - DNA, 15 bp, Homo sapiens
atcaattaattctta

SEQ ID NO: 5242794 - DNA, 15 bp, Homo sapiens
atcaattaatttttt

SEQ ID NO: 5242795 - DNA, 16 bp, Homo sapiens
atcaattatagtttct

SEQ ID NO: 5242796 - DNA, 18 bp, Homo sapiens
atcaattatagtttctga

SEQ ID NO: 5242797 - DNA, 15 bp, Homo sapiens
atcaattcaacacat

SEQ ID NO: 5242798 - DNA, 16 bp, Homo sapiens
atcaattcatgtttaa

SEQ ID NO: 5242799 - DNA, 19 bp, Homo sapiens
atcaattcattgtgtatga

SEQ ID NO: 5242800 - DNA, 15 bp, Homo sapiens
atcaattctctatca

SEQ ID NO: 5242801 - DNA, 19 bp, Homo sapiens
atcaattctgtattccaga

SEQ ID NO: 5242802 - DNA, 19 bp, Homo sapiens
atcaattggcagtgacttt

SEQ ID NO: 5242803 - DNA, 21 bp, Homo sapiens
atcaattggcagtgactttgt

SEQ ID NO: 5242804 - DNA, 13 bp, Homo sapiens
atcaattgtaata

SEQ ID NO: 5242805 - DNA, 13 bp, Homo sapiens
atcaatttaaaaa

SEQ ID NO: 5242806 - DNA, 18 bp, Homo sapiens
atcaatttaaaaagcaaa

SEQ ID NO: 5242807 - DNA, 19 bp, Homo sapiens
atcaatttaaaatcattca

SEQ ID NO: 5242808 - DNA, 21 bp, Homo sapiens
atcaatttaaaatcattcaat

SEQ ID NO: 5242809 - DNA, 16 bp, Homo sapiens
atcaatttaaacccat

SEQ ID NO: 5242810 - DNA, 17 bp, Homo sapiens
atcaatttaaacccatt

SEQ ID NO: 5242811 - DNA, 15 bp, Homo sapiens
atcaatttaaatgtt

SEQ ID NO: 5242812 - DNA, 12 bp, Homo sapiens
atcaatttaagt

SEQ ID NO: 5242813 - DNA, 13 bp, Homo sapiens
atcaatttcccag

SEQ ID NO: 5242814 - DNA, 15 bp, Homo sapiens
atcaatttctaatgt

SEQ ID NO: 5242815 - DNA, 13 bp, Homo sapiens
atcaatttctcaa

SEQ ID NO: 5242816 - DNA, 22 bp, Homo sapiens
atcaatttctcaatagttctta

SEQ ID NO: 5242817 - DNA, 17 bp, Homo sapiens
atcaattttaccctgag

SEQ ID NO: 5242818 - DNA, 19 bp, Homo sapiens
atcaattttcattaaactt

SEQ ID NO: 5242819 - DNA, 13 bp, Homo sapiens
atcaatttttata

SEQ ID NO: 5242820 - DNA, 14 bp, Homo sapiens
atcaatttttatac

SEQ ID NO: 5242821 - DNA, 21 bp, Homo sapiens
atcaatttttatacatatcag

SEQ ID NO: 5242822 - DNA, 13 bp, Homo sapiens
atcaatttttccc

SEQ ID NO: 5242823 - DNA, 19 bp, Homo sapiens
atcaatttttcccagtatt

SEQ ID NO: 5242824 - DNA, 19 bp, Homo sapiens
atcaattttttaaaccact

SEQ ID NO: 5242825 - DNA, 21 bp, Homo sapiens
atcacaaaaacaaaaaaacta

SEQ ID NO: 5242826 - DNA, 15 bp, Homo sapiens
atcacaaactgaatg

SEQ ID NO: 5242827 - DNA, 24 bp, Homo sapiens
atcacaaagtggaacgaaaatgaa

SEQ ID NO: 5242828 - DNA, 22 bp, Homo sapiens
atcacaaatagtgttgatcaga

SEQ ID NO: 5242829 - DNA, 19 bp, Homo sapiens
atcacaaatccaaaggaaa

SEQ ID NO: 5242830 - DNA, 11 bp, Homo sapiens
atcacaaatga

SEQ ID NO: 5242831 - DNA, 12 bp, Homo sapiens
atcacaaatgac

SEQ ID NO: 5242832 - DNA, 14 bp, Homo sapiens
atcacaaatggaat

SEQ ID NO: 5242833 - DNA, 15 bp, Homo sapiens
atcacaactcagcat

SEQ ID NO: 5242834 - DNA, 16 bp, Homo sapiens
atcacaagatggaatt

SEQ ID NO: 5242835 - DNA, 15 bp, Homo sapiens
atcacaagcaataat

SEQ ID NO: 5242836 - DNA, 19 bp, Homo sapiens
atactgattctgtgtatct

SEQ ID NO: 5242837 - DNA, 18 bp, Homo sapiens
atactgattgggaggtgc

SEQ ID NO: 5242838 - DNA, 12 bp, Homo sapiens
atactgattttt

SEQ ID NO: 5242839 - DNA, 16 bp, Homo sapiens
atactgatttttaagt

SEQ ID NO: 5242840 - DNA, 18 bp, Homo sapiens
atactgcacagtggcaca

SEQ ID NO: 5242841 - DNA, 13 bp, Homo sapiens
atactgcacttac

SEQ ID NO: 5242842 - DNA, 15 bp, Homo sapiens
atactgcatactttt

SEQ ID NO: 5242843 - DNA, 21 bp, Homo sapiens
atactgcatatcctggtgtct

SEQ ID NO: 5242844 - DNA, 19 bp, Homo sapiens
atactgcatgtttgctgtt

SEQ ID NO: 5242845 - DNA, 16 bp, Homo sapiens
atactgccagatgctg

SEQ ID NO: 5242846 - DNA, 17 bp, Homo sapiens
atactgccgctgccccc

SEQ ID NO: 5242847 - DNA, 23 bp, Homo sapiens
atactgccgctgcccccaccctg

SEQ ID NO: 5242848 - DNA, 15 bp, Homo sapiens
atactgcctactgtt

SEQ ID NO: 5242849 - DNA, 20 bp, Homo sapiens
atactgcctactgttactct

SEQ ID NO: 5242850 - DNA, 13 bp, Homo sapiens
atactgcctcccc

SEQ ID NO: 5242851 - DNA, 23 bp, Homo sapiens
atactgccttgtttaatgttaat

SEQ ID NO: 5242852 - DNA, 16 bp, Homo sapiens
atactgctactgtaat

SEQ ID NO: 5242853 - DNA, 22 bp, Homo sapiens
atactgctactgtaattttata

SEQ ID NO: 5242854 - DNA, 10 bp, Homo sapiens
atactgcttg

SEQ ID NO: 5242855 - DNA, 22 bp, Homo sapiens
atactgcttgcttacaatcttt

SEQ ID NO: 5242856 - DNA, 15 bp, Homo sapiens
atactgcttggagct

SEQ ID NO: 5242857 - DNA, 20 bp, Homo sapiens
atactgcttggagctgagca

SEQ ID NO: 5242858 - DNA, 14 bp, Homo sapiens
atactggaaagctt

SEQ ID NO: 5242859 - DNA, 14 bp, Homo sapiens
atactggaagtttt

SEQ ID NO: 5242860 - DNA, 19 bp, Homo sapiens
atactggaagttttgcatt

SEQ ID NO: 5242861 - DNA, 14 bp, Homo sapiens
atactggaataatt

SEQ ID NO: 5242862 - DNA, 19 bp, Homo sapiens
atactggaataatttgtaa

SEQ ID NO: 5242863 - DNA, 21 bp, Homo sapiens
atactggaataatttgtaaat

SEQ ID NO: 5242864 - DNA, 23 bp, Homo sapiens
atactggaataatttgtaaatga

SEQ ID NO: 5242865 - DNA, 14 bp, Homo sapiens
atactggactaagt

SEQ ID NO: 5242866 - DNA, 15 bp, Homo sapiens
atactggactaagtg

SEQ ID NO: 5242867 - DNA, 12 bp, Homo sapiens
atactggactca

SEQ ID NO: 5242868 - DNA, 15 bp, Homo sapiens
atactggactcagga

SEQ ID NO: 5242869 - DNA, 16 bp, Homo sapiens
atactggactcaggaa

SEQ ID NO: 5242870 - DNA, 20 bp, Homo sapiens
atactggactcaggaacttt

SEQ ID NO: 5242871 - DNA, 16 bp, Homo sapiens
atactggactcttcaa

SEQ ID NO: 5242872 - DNA, 15 bp, Homo sapiens
atactggcacagagg

SEQ ID NO: 5242873 - DNA, 14 bp, Homo sapiens
atactggcctggac

SEQ ID NO: 5242874 - DNA, 23 bp, Homo sapiens
atactgggacaccattaccaaaa

SEQ ID NO: 5242875 - DNA, 15 bp, Homo sapiens
atactgggagagaag

SEQ ID NO: 5242876 - DNA, 17 bp, Homo sapiens
atactgggtttcaagaa

SEQ ID NO: 5242877 - DNA, 18 bp, Homo sapiens
atactgggtttcaagaaa

SEQ ID NO: 5242878 - DNA, 23 bp, Homo sapiens
atactggttatagttgatatgta

SEQ ID NO: 5242879 - DNA, 23 bp, Homo sapiens
atactggttatcctgtgctacag

SEQ ID NO: 5242880 - DNA, 17 bp, Homo sapiens
atactgtaaaagttata

SEQ ID NO: 5242881 - DNA, 24 bp, Homo sapiens
atactgtaaaagttataataactg

SEQ ID NO: 5242882 - DNA, 15 bp, Homo sapiens
atactgtaaagaaag

SEQ ID NO: 5242883 - DNA, 16 bp, Homo sapiens
atactgtaaagaaaga

SEQ ID NO: 5242884 - DNA, 20 bp, Homo sapiens
atactgtaaagaaagagaga

SEQ ID NO: 5242885 - DNA, 21 bp, Homo sapiens
atactgtaaagaaagagagaa

SEQ ID NO: 5242886 - DNA, 23 bp, Homo sapiens
atactgtaaagaaagagagaaaa

SEQ ID NO: 5242887 - DNA, 19 bp, Homo sapiens
atactgtaaggaaatgtta

SEQ ID NO: 5242888 - DNA, 10 bp, Homo sapiens
atactgtaat

SEQ ID NO: 5242889 - DNA, 18 bp, Homo sapiens
atactgtaatcgtgctat

SEQ ID NO: 5242890 - DNA, 11 bp, Homo sapiens
atactgtacac

SEQ ID NO: 5242891 - DNA, 15 bp, Homo sapiens
atactgtacacattt

SEQ ID NO: 5242892 - DNA, 16 bp, Homo sapiens
atactgtacacatttc

SEQ ID NO: 5242893 - DNA, 18 bp, Homo sapiens
atactgtacacatttctt

SEQ ID NO: 5242894 - DNA, 11 bp, Homo sapiens
atactgtacat

SEQ ID NO: 5242895 - DNA, 12 bp, Homo sapiens
atactgtacatg

SEQ ID NO: 5242896 - DNA, 16 bp, Homo sapiens
atactgtacatgctat

SEQ ID NO: 5242897 - DNA, 22 bp, Homo sapiens
atactgtactgatactattcaa

SEQ ID NO: 5242898 - DNA, 15 bp, Homo sapiens
atactgtagaacctg

SEQ ID NO: 5242899 - DNA, 18 bp, Homo sapiens
atactgtagacactctga

SEQ ID NO: 5242900 - DNA, 12 bp, Homo sapiens
atactgtagcaa

SEQ ID NO: 5242901 - DNA, 22 bp, Homo sapiens
atactgtagggaaaaaaatgct

SEQ ID NO: 5242902 - DNA, 16 bp, Homo sapiens
atactgtagtattctt

SEQ ID NO: 5242903 - DNA, 19 bp, Homo sapiens
atactgtatatgtcaaaaa

SEQ ID NO: 5242904 - DNA, 21 bp, Homo sapiens
atactgtatcctgaaaggcaa

SEQ ID NO: 5242905 - DNA, 22 bp, Homo sapiens
atactgtatgccggctccttca

SEQ ID NO: 5242906 - DNA, 13 bp, Homo sapiens
atactgtattaag

SEQ ID NO: 5242907 - DNA, 16 bp, Homo sapiens
atactgtattaagagt

SEQ ID NO: 5242908 - DNA, 16 bp, Homo sapiens
atactgtattgaatat

SEQ ID NO: 5242909 - DNA, 13 bp, Homo sapiens
atactgtatttct

SEQ ID NO: 5242910 - DNA, 15 bp, Homo sapiens
atactgtcatataat

SEQ ID NO: 5242911 - DNA, 18 bp, Homo sapiens
atactgtcatataatgca

SEQ ID NO: 5242912 - DNA, 21 bp, Homo sapiens
atactgtcggttttttttaaa

SEQ ID NO: 5242913 - DNA, 14 bp, Homo sapiens
atactgtctaagaa

SEQ ID NO: 5242914 - DNA, 20 bp, Homo sapiens
atactgtctaagaataatga

SEQ ID NO: 5242915 - DNA, 18 bp, Homo sapiens
atactgtctctccagtga

SEQ ID NO: 5242916 - DNA, 13 bp, Homo sapiens
atactgtctctgg

SEQ ID NO: 5242917 - DNA, 14 bp, Homo sapiens
atactgtctgtatc

SEQ ID NO: 5242918 - DNA, 15 bp, Homo sapiens
atactgtctttgtgc

SEQ ID NO: 5242919 - DNA, 19 bp, Homo sapiens
atactgtgaagttacatgc

SEQ ID NO: 5242920 - DNA, 23 bp, Homo sapiens
atactgtgaagttacatgcataa

SEQ ID NO: 5242921 - DNA, 20 bp, Homo sapiens
atactgtgagcttacattga

SEQ ID NO: 5242922 - DNA, 21 bp, Homo sapiens
atactgtgtcatggtgatgca

SEQ ID NO: 5242923 - DNA, 21 bp, Homo sapiens
atactgtgttaccttttaaaa

SEQ ID NO: 5242924 - DNA, 23 bp, Homo sapiens
atactgtgttaccttttaaaata

SEQ ID NO: 5242925 - DNA, 16 bp, Homo sapiens
atactgttattctttg

SEQ ID NO: 5242926 - DNA, 18 bp, Homo sapiens
atactgttattctttgca

SEQ ID NO: 5242927 - DNA, 22 bp, Homo sapiens
atactgttattctttgcacttt

SEQ ID NO: 5242928 - DNA, 21 bp, Homo sapiens
atactgttgatccatctcagt

SEQ ID NO: 5242929 - DNA, 11 bp, Homo sapiens
atactgttgca

SEQ ID NO: 5242930 - DNA, 12 bp, Homo sapiens
atactgttgcac

SEQ ID NO: 5242931 - DNA, 19 bp, Homo sapiens
atactgttgcccttttcct

SEQ ID NO: 5242932 - DNA, 15 bp, Homo sapiens
atactgttgtgcgca

SEQ ID NO: 5242933 - DNA, 15 bp, Homo sapiens
atactgtttcttgca

SEQ ID NO: 5242934 - DNA, 17 bp, Homo sapiens
atactgtttcttgcact

SEQ ID NO: 5242935 - DNA, 12 bp, Homo sapiens
atactgtttgag

SEQ ID NO: 5242936 - DNA, 16 bp, Homo sapiens
atactgtttgaggttt

SEQ ID NO: 5242937 - DNA, 16 bp, Homo sapiens
atacttaaaaatatgt

SEQ ID NO: 5242938 - DNA, 18 bp, Homo sapiens
atacttaaaaatatgtga

SEQ ID NO: 5242939 - DNA, 17 bp, Homo sapiens
atacttaaaatgacaaa

SEQ ID NO: 5242940 - DNA, 14 bp, Homo sapiens
atacttaaataaac

SEQ ID NO: 5242941 - DNA, 14 bp, Homo sapiens
atacttaaatgtta

SEQ ID NO: 5242942 - DNA, 20 bp, Homo sapiens
atacttaaatgttatgtata

SEQ ID NO: 5242943 - DNA, 20 bp, Homo sapiens
atacttaacacgtgaatatt

SEQ ID NO: 5242944 - DNA, 14 bp, Homo sapiens
atacttaacatttc

SEQ ID NO: 5242945 - DNA, 16 bp, Homo sapiens
atacttaacatttcat

SEQ ID NO: 5242946 - DNA, 18 bp, Homo sapiens
atacttaatactgaattt

SEQ ID NO: 5242947 - DNA, 15 bp, Homo sapiens
atacttaatctcaca

SEQ ID NO: 5242948 - DNA, 16 bp, Homo sapiens
atacttacatatctga

SEQ ID NO: 5242949 - DNA, 13 bp, Homo sapiens
atacttacattct

SEQ ID NO: 5242950 - DNA, 22 bp, Homo sapiens
atacttacattctctaataaga

SEQ ID NO: 5242951 - DNA, 13 bp, Homo sapiens
atacttacatttc

SEQ ID NO: 5242952 - DNA, 20 bp, Homo sapiens
atacttacatttccatttat

SEQ ID NO: 5242953 - DNA, 22 bp, Homo sapiens
atacttacatttccatttattg

SEQ ID NO: 5242954 - DNA, 24 bp, Homo sapiens
atacttactgaactgtgtgtaatt

SEQ ID NO: 5242955 - DNA, 22 bp, Homo sapiens
atacttagagaacctatagcat

SEQ ID NO: 5242956 - DNA, 17 bp, Homo sapiens
atacttagcaaaaagtg

SEQ ID NO: 5242957 - DNA, 21 bp, Homo sapiens
atacttatatttttaataaaa

SEQ ID NO: 5242958 - DNA, 15 bp, Homo sapiens
atacttatctctctg

SEQ ID NO: 5242959 - DNA, 17 bp, Homo sapiens
atacttatctctctgtg

SEQ ID NO: 5242960 - DNA, 18 bp, Homo sapiens
atacttatctctctgtgc

SEQ ID NO: 5242961 - DNA, 17 bp, Homo sapiens
atacttatgttgtattg

SEQ ID NO: 5242962 - DNA, 14 bp, Homo sapiens
atacttattaagag

SEQ ID NO: 5242963 - DNA, 15 bp, Homo sapiens
atacttattaagttc

SEQ ID NO: 5242964 - DNA, 14 bp, Homo sapiens
atacttattatgta

SEQ ID NO: 5242965 - DNA, 17 bp, Homo sapiens
atacttattattttgca

SEQ ID NO: 5242966 - DNA, 18 bp, Homo sapiens
atacttatttgtatatgg

SEQ ID NO: 5242967 - DNA, 20 bp, Homo sapiens
atacttattttctgttcaga

SEQ ID NO: 5242968 - DNA, 18 bp, Homo sapiens
atacttcaaaaataatgt

SEQ ID NO: 5242969 - DNA, 17 bp, Homo sapiens
atacttcaaaagccata

SEQ ID NO: 5242970 - DNA, 13 bp, Homo sapiens
atacttcaaatgt

SEQ ID NO: 5242971 - DNA, 14 bp, Homo sapiens
atacttcaaatgtc

SEQ ID NO: 5242972 - DNA, 16 bp, Homo sapiens
atacttcaaatgtcat

SEQ ID NO: 5242973 - DNA, 13 bp, Homo sapiens
atacttcaagtaa

SEQ ID NO: 5242974 - DNA, 14 bp, Homo sapiens
atacttcacactga

SEQ ID NO: 5242975 - DNA, 18 bp, Homo sapiens
atacttcacctttcctct

SEQ ID NO: 5242976 - DNA, 24 bp, Homo sapiens
atacttcactggtgtacatcgttt

SEQ ID NO: 5242977 - DNA, 22 bp, Homo sapiens
atacttcagctcacacatgaga

SEQ ID NO: 5242978 - DNA, 16 bp, Homo sapiens
atacttcaggtgcttt

SEQ ID NO: 5242979 - DNA, 21 bp, Homo sapiens
atacttcatgaaatcctgggt

SEQ ID NO: 5242980 - DNA, 19 bp, Homo sapiens
atacttcatgagcattcat

SEQ ID NO: 5242981 - DNA, 18 bp, Homo sapiens
atacttcattaatttcaa

SEQ ID NO: 5242982 - DNA, 20 bp, Homo sapiens
atacttcattaatttcaatc

SEQ ID NO: 5242983 - DNA, 17 bp, Homo sapiens
atacttcatttaaaaaa

SEQ ID NO: 5242984 - DNA, 16 bp, Homo sapiens
atacttccagcgaaat

SEQ ID NO: 5242985 - DNA, 13 bp, Homo sapiens
atacttcccaaag

SEQ ID NO: 5242986 - DNA, 11 bp, Homo sapiens
atacttcctgg

SEQ ID NO: 5242987 - DNA, 14 bp, Homo sapiens
atacttcctggatt

SEQ ID NO: 5242988 - DNA, 22 bp, Homo sapiens
atacttcctggattttctttct

SEQ ID NO: 5242989 - DNA, 12 bp, Homo sapiens
atacttcctggg

SEQ ID NO: 5242990 - DNA, 14 bp, Homo sapiens
atacttccttataa

SEQ ID NO: 5242991 - DNA, 21 bp, Homo sapiens
atacttccttatgcttctttc

SEQ ID NO: 5242992 - DNA, 15 bp, Homo sapiens
atacttctgataatt

SEQ ID NO: 5242993 - DNA, 18 bp, Homo sapiens
atacttcttacttgtctg

SEQ ID NO: 5242994 - DNA, 19 bp, Homo sapiens
atacttctttgttattata

SEQ ID NO: 5242995 - DNA, 15 bp, Homo sapiens
atacttgaaaaatgt

SEQ ID NO: 5242996 - DNA, 19 bp, Homo sapiens
atacttgaaaaatgttata

SEQ ID NO: 5242997 - DNA, 16 bp, Homo sapiens
atacttgaaaattaac

SEQ ID NO: 5242998 - DNA, 18 bp, Homo sapiens
atacttgaaaccagtatt

SEQ ID NO: 5242999 - DNA, 13 bp, Homo sapiens
atacttgaaccat

SEQ ID NO: 5243000 - DNA, 18 bp, Homo sapiens
atacttgaaccataaaat

SEQ ID NO: 5243001 - DNA, 22 bp, Homo sapiens
atacttgaaccataaaatgtcc

SEQ ID NO: 5243002 - DNA, 21 bp, Homo sapiens
atacttgaacttgcctctttt

SEQ ID NO: 5243003 - DNA, 17 bp, Homo sapiens
atacttgaagaaacaga

SEQ ID NO: 5243004 - DNA, 18 bp, Homo sapiens
atacttgaagggccagag

SEQ ID NO: 5243005 - DNA, 21 bp, Homo sapiens
atacttgaagggccagagcca

SEQ ID NO: 5243006 - DNA, 21 bp, Homo sapiens
atacttgaattttttgaaatg

SEQ ID NO: 5243007 - DNA, 22 bp, Homo sapiens
atacttgactcatttaaagcta

SEQ ID NO: 5243008 - DNA, 15 bp, Homo sapiens
atacttgactctaat

SEQ ID NO: 5243009 - DNA, 13 bp, Homo sapiens
atacttgagaaat

SEQ ID NO: 5243010 - DNA, 15 bp, Homo sapiens
atacttgagaaattt

SEQ ID NO: 5243011 - DNA, 19 bp, Homo sapiens
atacttgagaccaactttt

SEQ ID NO: 5243012 - DNA, 17 bp, Homo sapiens
atacttgagctgtatat

SEQ ID NO: 5243013 - DNA, 18 bp, Homo sapiens
atacttgagctgtatata

SEQ ID NO: 5243014 - DNA, 19 bp, Homo sapiens
atacttgagctgtatatat

SEQ ID NO: 5243015 - DNA, 13 bp, Homo sapiens
atcacaaggggaa

SEQ ID NO: 5243016 - DNA, 15 bp, Homo sapiens
atcacaaggtcagga

SEQ ID NO: 5243017 - DNA, 14 bp, Homo sapiens
atcacaatacagat

SEQ ID NO: 5243018 - DNA, 15 bp, Homo sapiens
atcacaatgagaaaa

SEQ ID NO: 5243019 - DNA, 20 bp, Homo sapiens
atcacaatgagaaaaataaa

SEQ ID NO: 5243020 - DNA, 18 bp, Homo sapiens
atcacaattttcctgtgg

SEQ ID NO: 5243021 - DNA, 17 bp, Homo sapiens
atcacaatttttaatgg

SEQ ID NO: 5243022 - DNA, 21 bp, Homo sapiens
atcacacaatatagttttttc

SEQ ID NO: 5243023 - DNA, 11 bp, Homo sapiens
atcacacacac

SEQ ID NO: 5243024 - DNA, 13 bp, Homo sapiens
atcacacacatgg

SEQ ID NO: 5243025 - DNA, 24 bp, Homo sapiens
atcacacagctaataaaagtcaga

SEQ ID NO: 5243026 - DNA, 15 bp, Homo sapiens
atcacacagtggcac

SEQ ID NO: 5243027 - DNA, 23 bp, Homo sapiens
atcacacatcaagactatctaca

SEQ ID NO: 5243028 - DNA, 16 bp, Homo sapiens
atcacacctctgggct

SEQ ID NO: 5243029 - DNA, 14 bp, Homo sapiens
atcacacctgccct

SEQ ID NO: 5243030 - DNA, 16 bp, Homo sapiens
atcacactattttaga

SEQ ID NO: 5243031 - DNA, 23 bp, Homo sapiens
atcacactcaaggacaggagcct

SEQ ID NO: 5243032 - DNA, 16 bp, Homo sapiens
atcacactcgtctttc

SEQ ID NO: 5243033 - DNA, 21 bp, Homo sapiens
atcacactctaagttctattg

SEQ ID NO: 5243034 - DNA, 23 bp, Homo sapiens
atcacacttatattttatgaaca

SEQ ID NO: 5243035 - DNA, 18 bp, Homo sapiens
atcacacttgcaaatgaa

SEQ ID NO: 5243036 - DNA, 19 bp, Homo sapiens
atcacacttgcaaatgaat

SEQ ID NO: 5243037 - DNA, 14 bp, Homo sapiens
atcacagaccacag

SEQ ID NO: 5243038 - DNA, 18 bp, Homo sapiens
atcacagaccacaggaag

SEQ ID NO: 5243039 - DNA, 14 bp, Homo sapiens
atcacagaccccag

SEQ ID NO: 5243040 - DNA, 19 bp, Homo sapiens
atcacagaccccagctggg

SEQ ID NO: 5243041 - DNA, 14 bp, Homo sapiens
atcacagagacatt

SEQ ID NO: 5243042 - DNA, 16 bp, Homo sapiens
atcacagagacattcc

SEQ ID NO: 5243043 - DNA, 17 bp, Homo sapiens
atcacagagacattcct

SEQ ID NO: 5243044 - DNA, 14 bp, Homo sapiens
atcacagaggcttc

SEQ ID NO: 5243045 - DNA, 20 bp, Homo sapiens
atcacagatgcatatagaca

SEQ ID NO: 5243046 - DNA, 14 bp, Homo sapiens
atcacagatgtaaa

SEQ ID NO: 5243047 - DNA, 13 bp, Homo sapiens
atcacagatgtgc

SEQ ID NO: 5243048 - DNA, 14 bp, Homo sapiens
atcacagatgtgcc

SEQ ID NO: 5243049 - DNA, 22 bp, Homo sapiens
atcacagatttgctaataatgt

SEQ ID NO: 5243050 - DNA, 18 bp, Homo sapiens
atcacagcacccactacc

SEQ ID NO: 5243051 - DNA, 14 bp, Homo sapiens
atcacagcagaatg

SEQ ID NO: 5243052 - DNA, 12 bp, Homo sapiens
atcacagcagcc

SEQ ID NO: 5243053 - DNA, 14 bp, Homo sapiens
atcacagcagggcc

SEQ ID NO: 5243054 - DNA, 15 bp, Homo sapiens
atcacagcatgtgca

SEQ ID NO: 5243055 - DNA, 17 bp, Homo sapiens
atcacagcatgtgcaat

SEQ ID NO: 5243056 - DNA, 15 bp, Homo sapiens
atcacagccagccca

SEQ ID NO: 5243057 - DNA, 23 bp, Homo sapiens
atcacagccccacccttgtccct

SEQ ID NO: 5243058 - DNA, 10 bp, Homo sapiens
atcacagcct

SEQ ID NO: 5243059 - DNA, 16 bp, Homo sapiens
atcacagcctcacccc

SEQ ID NO: 5243060 - DNA, 19 bp, Homo sapiens
atcacagcctcacccctgc

SEQ ID NO: 5243061 - DNA, 13 bp, Homo sapiens
atcacagcctcca

SEQ ID NO: 5243062 - DNA, 15 bp, Homo sapiens
atcacagcctccagg

SEQ ID NO: 5243063 - DNA, 17 bp, Homo sapiens
atcacagcgtttcagga

SEQ ID NO: 5243064 - DNA, 12 bp, Homo sapiens
atcacagctgct

SEQ ID NO: 5243065 - DNA, 14 bp, Homo sapiens
atcacaggctgggc

SEQ ID NO: 5243066 - DNA, 22 bp, Homo sapiens
atcacaggctgggctgggcact

SEQ ID NO: 5243067 - DNA, 19 bp, Homo sapiens
atcacagggaatggccaca

SEQ ID NO: 5243068 - DNA, 12 bp, Homo sapiens
atcacagggcag

SEQ ID NO: 5243069 - DNA, 15 bp, Homo sapiens
atcacagggcagagc

SEQ ID NO: 5243070 - DNA, 19 bp, Homo sapiens
atcacagggcagagccggg

SEQ ID NO: 5243071 - DNA, 12 bp, Homo sapiens
atcacagggccc

SEQ ID NO: 5243072 - DNA, 16 bp, Homo sapiens
atcacagggccccaga

SEQ ID NO: 5243073 - DNA, 22 bp, Homo sapiens
atcacagggccccagaaggcag

SEQ ID NO: 5243074 - DNA, 19 bp, Homo sapiens
atcacagggttgggcccag

SEQ ID NO: 5243075 - DNA, 20 bp, Homo sapiens
atcacagtattatctgtgtt

SEQ ID NO: 5243076 - DNA, 18 bp, Homo sapiens
atcacagtctaattttta

SEQ ID NO: 5243077 - DNA, 17 bp, Homo sapiens
atcacagtctcagttct

SEQ ID NO: 5243078 - DNA, 18 bp, Homo sapiens
atcacagtggccacggcc

SEQ ID NO: 5243079 - DNA, 19 bp, Homo sapiens
atcacagtgggaagaatag

SEQ ID NO: 5243080 - DNA, 21 bp, Homo sapiens
atcacagtgtttttattgctc

SEQ ID NO: 5243081 - DNA, 18 bp, Homo sapiens
atcacagtttttcctgga

SEQ ID NO: 5243082 - DNA, 14 bp, Homo sapiens
atcacataaagaaa

SEQ ID NO: 5243083 - DNA, 22 bp, Homo sapiens
atcacataaagaaattcaagaa

SEQ ID NO: 5243084 - DNA, 18 bp, Homo sapiens
atcacataaccttaaaaa

SEQ ID NO: 5243085 - DNA, 18 bp, Homo sapiens
atcacatacaatttgcac

SEQ ID NO: 5243086 - DNA, 17 bp, Homo sapiens
atcacatagtgaaagtt

SEQ ID NO: 5243087 - DNA, 18 bp, Homo sapiens
atcacatcaagcatgcaa

SEQ ID NO: 5243088 - DNA, 16 bp, Homo sapiens
atcacatctaaagctt

SEQ ID NO: 5243089 - DNA, 18 bp, Homo sapiens
atcacatctaaagcttta

SEQ ID NO: 5243090 - DNA, 14 bp, Homo sapiens
atcacatctcacct

SEQ ID NO: 5243091 - DNA, 16 bp, Homo sapiens
atcacatctcacctcc

SEQ ID NO: 5243092 - DNA, 13 bp, Homo sapiens
atcacatcttatt

SEQ ID NO: 5243093 - DNA, 14 bp, Homo sapiens
atcacatcttattt

SEQ ID NO: 5243094 - DNA, 19 bp, Homo sapiens
atcacatcttttaagacaa

SEQ ID NO: 5243095 - DNA, 22 bp, Homo sapiens
atcacatgaattattacagtgt

SEQ ID NO: 5243096 - DNA, 16 bp, Homo sapiens
atcacatggcatgttt

SEQ ID NO: 5243097 - DNA, 23 bp, Homo sapiens
atcacatggcatgttttgtcatt

SEQ ID NO: 5243098 - DNA, 13 bp, Homo sapiens
atcacatgtatgt

SEQ ID NO: 5243099 - DNA, 14 bp, Homo sapiens
atcacatgtatgtt

SEQ ID NO: 5243100 - DNA, 16 bp, Homo sapiens
atcacatgtatgtttt

SEQ ID NO: 5243101 - DNA, 13 bp, Homo sapiens
atcacatgtgaaa

SEQ ID NO: 5243102 - DNA, 20 bp, Homo sapiens
atcacattaacattttgagc

SEQ ID NO: 5243103 - DNA, 17 bp, Homo sapiens
atcacattaatctcaaa

SEQ ID NO: 5243104 - DNA, 18 bp, Homo sapiens
atcacattaatctcaaag

SEQ ID NO: 5243105 - DNA, 24 bp, Homo sapiens
atcacattcaggcatgcgaatgag

SEQ ID NO: 5243106 - DNA, 19 bp, Homo sapiens
atcacattctgcatactaa

SEQ ID NO: 5243107 - DNA, 24 bp, Homo sapiens
atcacattgagctgatataaattc

SEQ ID NO: 5243108 - DNA, 14 bp, Homo sapiens
atcacatttctatg

SEQ ID NO: 5243109 - DNA, 14 bp, Homo sapiens
atcacatttgtaaa

SEQ ID NO: 5243110 - DNA, 15 bp, Homo sapiens
atcacattttaagtg

SEQ ID NO: 5243111 - DNA, 16 bp, Homo sapiens
atcacattttattaaa

SEQ ID NO: 5243112 - DNA, 17 bp, Homo sapiens
atcacattttattaaac

SEQ ID NO: 5243113 - DNA, 23 bp, Homo sapiens
atcacattttgtatggagttaaa

SEQ ID NO: 5243114 - DNA, 16 bp, Homo sapiens
atcaccaattaaaaac

SEQ ID NO: 5243115 - DNA, 13 bp, Homo sapiens
atcaccacagttt

SEQ ID NO: 5243116 - DNA, 20 bp, Homo sapiens
atcaccaccacacccctgcc

SEQ ID NO: 5243117 - DNA, 17 bp, Homo sapiens
atcaccaccgcctctgg

SEQ ID NO: 5243118 - DNA, 13 bp, Homo sapiens
atcaccagaataa

SEQ ID NO: 5243119 - DNA, 23 bp, Homo sapiens
atcaccagagagggactgacacc

SEQ ID NO: 5243120 - DNA, 13 bp, Homo sapiens
atcaccagtctgt

SEQ ID NO: 5243121 - DNA, 16 bp, Homo sapiens
atcaccataacctctg

SEQ ID NO: 5243122 - DNA, 21 bp, Homo sapiens
atcaccatgggaggtggggcc

SEQ ID NO: 5243123 - DNA, 18 bp, Homo sapiens
atcaccattatattttga

SEQ ID NO: 5243124 - DNA, 14 bp, Homo sapiens
atcaccatttggtg

SEQ ID NO: 5243125 - DNA, 14 bp, Homo sapiens
atcacccaaaactt

SEQ ID NO: 5243126 - DNA, 11 bp, Homo sapiens
atcacccaagc

SEQ ID NO: 5243127 - DNA, 16 bp, Homo sapiens
atcacccaatcccagt

SEQ ID NO: 5243128 - DNA, 17 bp, Homo sapiens
atcacccaatcccagtt

SEQ ID NO: 5243129 - DNA, 14 bp, Homo sapiens
atcacccactccta

SEQ ID NO: 5243130 - DNA, 23 bp, Homo sapiens
atcacccagacataaaggaaaag

SEQ ID NO: 5243131 - DNA, 16 bp, Homo sapiens
atcaccccagccccca

SEQ ID NO: 5243132 - DNA, 20 bp, Homo sapiens
atcaccccagcctcactcca

SEQ ID NO: 5243133 - DNA, 21 bp, Homo sapiens
atcaccccagcctcactccat

SEQ ID NO: 5243134 - DNA, 16 bp, Homo sapiens
atcacccccaggacct

SEQ ID NO: 5243135 - DNA, 16 bp, Homo sapiens
atcacccccctgctta

SEQ ID NO: 5243136 - DNA, 18 bp, Homo sapiens
atcaccccctccctacac

SEQ ID NO: 5243137 - DNA, 19 bp, Homo sapiens
atcaccccctccctacaca

SEQ ID NO: 5243138 - DNA, 16 bp, Homo sapiens
atcacccctctgcccc

SEQ ID NO: 5243139 - DNA, 20 bp, Homo sapiens
atcacccctctgcccctgca

SEQ ID NO: 5243140 - DNA, 21 bp, Homo sapiens
atcacccctctgcccctgcag

SEQ ID NO: 5243141 - DNA, 22 bp, Homo sapiens
atcacccctctgcccctgcagc

SEQ ID NO: 5243142 - DNA, 23 bp, Homo sapiens
atcacccctctgcccctgcagct

SEQ ID NO: 5243143 - DNA, 22 bp, Homo sapiens
atcacccctggtggctgcaggc

SEQ ID NO: 5243144 - DNA, 19 bp, Homo sapiens
atcacccgcccctggactt

SEQ ID NO: 5243145 - DNA, 17 bp, Homo sapiens
atcaccctcacccactc

SEQ ID NO: 5243146 - DNA, 16 bp, Homo sapiens
atcaccctctgggcag

SEQ ID NO: 5243147 - DNA, 13 bp, Homo sapiens
atcacccttccga

SEQ ID NO: 5243148 - DNA, 18 bp, Homo sapiens
atcaccctttccggcaca

SEQ ID NO: 5243149 - DNA, 20 bp, Homo sapiens
atcaccgacgcgtctcctgt

SEQ ID NO: 5243150 - DNA, 17 bp, Homo sapiens
atcaccgattcttcctt

SEQ ID NO: 5243151 - DNA, 18 bp, Homo sapiens
atcaccgattcttccttg

SEQ ID NO: 5243152 - DNA, 13 bp, Homo sapiens
atcaccgctgggt

SEQ ID NO: 5243153 - DNA, 14 bp, Homo sapiens
atcaccgctgggtg

SEQ ID NO: 5243154 - DNA, 16 bp, Homo sapiens
atcaccgctgggtggt

SEQ ID NO: 5243155 - DNA, 14 bp, Homo sapiens
atcaccggaggagc

SEQ ID NO: 5243156 - DNA, 19 bp, Homo sapiens
atcacctaagcacttctag

SEQ ID NO: 5243157 - DNA, 15 bp, Homo sapiens
atcacctagaaactt

SEQ ID NO: 5243158 - DNA, 16 bp, Homo sapiens
atcacctatttaatgt

SEQ ID NO: 5243159 - DNA, 22 bp, Homo sapiens
atcacctcagatggcagctttt

SEQ ID NO: 5243160 - DNA, 15 bp, Homo sapiens
atcacctcaggccag

SEQ ID NO: 5243161 - DNA, 15 bp, Homo sapiens
atcacctcagggcat

SEQ ID NO: 5243162 - DNA, 16 bp, Homo sapiens
atcacctcattctgaa

SEQ ID NO: 5243163 - DNA, 18 bp, Homo sapiens
atcacctcattctgaacc

SEQ ID NO: 5243164 - DNA, 14 bp, Homo sapiens
atcacctctttgcc

SEQ ID NO: 5243165 - DNA, 17 bp, Homo sapiens
atcacctgaaacactgg

SEQ ID NO: 5243166 - DNA, 19 bp, Homo sapiens
atcacctgaaccccagagg

SEQ ID NO: 5243167 - DNA, 20 bp, Homo sapiens
atcacctgaaccccagaggc

SEQ ID NO: 5243168 - DNA, 21 bp, Homo sapiens
atcacctgaattattaatgaa

SEQ ID NO: 5243169 - DNA, 12 bp, Homo sapiens
atcacctggagg

SEQ ID NO: 5243170 - DNA, 13 bp, Homo sapiens
atcacctggctga

SEQ ID NO: 5243171 - DNA, 22 bp, Homo sapiens
atcacctggctgagcagttccc

SEQ ID NO: 5243172 - DNA, 19 bp, Homo sapiens
atcacctggggtgctgcct

SEQ ID NO: 5243173 - DNA, 15 bp, Homo sapiens
atcaccttaggcagg

SEQ ID NO: 5243174 - DNA, 17 bp, Homo sapiens
atcaccttcctgaattc

SEQ ID NO: 5243175 - DNA, 17 bp, Homo sapiens
atcacctttccaaggcc

SEQ ID NO: 5243176 - DNA, 19 bp, Homo sapiens
atcacgagatcttccttcc

SEQ ID NO: 5243177 - DNA, 15 bp, Homo sapiens
atcacgatgtaaatt

SEQ ID NO: 5243178 - DNA, 19 bp, Homo sapiens
atcacgatgtaaattatta

SEQ ID NO: 5243179 - DNA, 14 bp, Homo sapiens
atcacgccactgca

SEQ ID NO: 5243180 - DNA, 17 bp, Homo sapiens
atcacgccactgcacta

SEQ ID NO: 5243181 - DNA, 14 bp, Homo sapiens
atcacgctttcctg

SEQ ID NO: 5243182 - DNA, 18 bp, Homo sapiens
atcacgctttcctgaatc

SEQ ID NO: 5243183 - DNA, 21 bp, Homo sapiens
atcacgtaaagctagaaatga

SEQ ID NO: 5243184 - DNA, 17 bp, Homo sapiens
atcacgtaccccactgg

SEQ ID NO: 5243185 - DNA, 16 bp, Homo sapiens
atcacgtgtactggct

SEQ ID NO: 5243186 - DNA, 23 bp, Homo sapiens
atcacgttgctggtggtttttca

SEQ ID NO: 5243187 - DNA, 13 bp, Homo sapiens
atcactaaaagca

SEQ ID NO: 5243188 - DNA, 14 bp, Homo sapiens
atcactaaaagcat

SEQ ID NO: 5243189 - DNA, 20 bp, Homo sapiens
atcactaaaccgataatgca

SEQ ID NO: 5243190 - DNA, 12 bp, Homo sapiens
atcactaaactt

SEQ ID NO: 5243191 - DNA, 14 bp, Homo sapiens
atcactaaacttta

SEQ ID NO: 5243192 - DNA, 14 bp, Homo sapiens
atcactaacattat

SEQ ID NO: 5243193 - DNA, 15 bp, Homo sapiens
atcactacaaaaaga

SEQ ID NO: 5243194 - DNA, 19 bp, Homo sapiens
atcactacaaaaagaagag

SEQ ID NO: 5243195 - DNA, 23 bp, Homo sapiens
atcactacagtattactcttaca

SEQ ID NO: 5243196 - DNA, 16 bp, Homo sapiens
atacttgatgcactta

SEQ ID NO: 5243197 - DNA, 12 bp, Homo sapiens
atacttgcaact

SEQ ID NO: 5243198 - DNA, 14 bp, Homo sapiens
atacttgcaactaa

SEQ ID NO: 5243199 - DNA, 17 bp, Homo sapiens
atacttgcaactaagga

SEQ ID NO: 5243200 - DNA, 19 bp, Homo sapiens
atacttgcaactaaggaca

SEQ ID NO: 5243201 - DNA, 17 bp, Homo sapiens
atacttgcactctttaa

SEQ ID NO: 5243202 - DNA, 15 bp, Homo sapiens
atacttgcagttgtg

SEQ ID NO: 5243203 - DNA, 22 bp, Homo sapiens
atacttgcagttgtgatataaa

SEQ ID NO: 5243204 - DNA, 18 bp, Homo sapiens
atacttgcattccagagt

SEQ ID NO: 5243205 - DNA, 12 bp, Homo sapiens
atacttgctttg

SEQ ID NO: 5243206 - DNA, 17 bp, Homo sapiens
atacttggagggcccag

SEQ ID NO: 5243207 - DNA, 18 bp, Homo sapiens
atacttggagggcccagc

SEQ ID NO: 5243208 - DNA, 19 bp, Homo sapiens
atacttggctgcttcctgt

SEQ ID NO: 5243209 - DNA, 20 bp, Homo sapiens
atacttggctgcttcctgtg

SEQ ID NO: 5243210 - DNA, 16 bp, Homo sapiens
atacttgtaattatgg

SEQ ID NO: 5243211 - DNA, 21 bp, Homo sapiens
atacttgtaattatggagtca

SEQ ID NO: 5243212 - DNA, 12 bp, Homo sapiens
atacttgtgaaa

SEQ ID NO: 5243213 - DNA, 17 bp, Homo sapiens
atacttgttccagatgg

SEQ ID NO: 5243214 - DNA, 14 bp, Homo sapiens
atacttgttctgta

SEQ ID NO: 5243215 - DNA, 19 bp, Homo sapiens
atacttgtttttgtaaaga

SEQ ID NO: 5243216 - DNA, 20 bp, Homo sapiens
atacttgtttttgtaaagaa

SEQ ID NO: 5243217 - DNA, 23 bp, Homo sapiens
atactttaaaggaaaaaatgttg

SEQ ID NO: 5243218 - DNA, 19 bp, Homo sapiens
atactttaagttaaatatg

SEQ ID NO: 5243219 - DNA, 18 bp, Homo sapiens
atactttaattcatgaag

SEQ ID NO: 5243220 - DNA, 14 bp, Homo sapiens
atactttacaaacc

SEQ ID NO: 5243221 - DNA, 12 bp, Homo sapiens
atactttacagt

SEQ ID NO: 5243222 - DNA, 16 bp, Homo sapiens
atactttacagtaaaa

SEQ ID NO: 5243223 - DNA, 18 bp, Homo sapiens
atactttactttttccat

SEQ ID NO: 5243224 - DNA, 19 bp, Homo sapiens
atactttagtacaatttca

SEQ ID NO: 5243225 - DNA, 20 bp, Homo sapiens
atactttagtacaatttcaa

SEQ ID NO: 5243226 - DNA, 15 bp, Homo sapiens
atactttagtgaacg

SEQ ID NO: 5243227 - DNA, 23 bp, Homo sapiens
atactttagtgaacgtggactcc

SEQ ID NO: 5243228 - DNA, 13 bp, Homo sapiens
atactttatatat

SEQ ID NO: 5243229 - DNA, 18 bp, Homo sapiens
atactttatatctgtaat

SEQ ID NO: 5243230 - DNA, 20 bp, Homo sapiens
atactttatatctgtaatga

SEQ ID NO: 5243231 - DNA, 14 bp, Homo sapiens
atactttattgaaa

SEQ ID NO: 5243232 - DNA, 14 bp, Homo sapiens
atactttatttctg

SEQ ID NO: 5243233 - DNA, 22 bp, Homo sapiens
atactttcaggggtggcccaat

SEQ ID NO: 5243234 - DNA, 23 bp, Homo sapiens
atactttccctaccctctagaga

SEQ ID NO: 5243235 - DNA, 21 bp, Homo sapiens
atactttcggagaaattctct

SEQ ID NO: 5243236 - DNA, 16 bp, Homo sapiens
atactttctatgtgac

SEQ ID NO: 5243237 - DNA, 15 bp, Homo sapiens
atactttctcacatg

SEQ ID NO: 5243238 - DNA, 20 bp, Homo sapiens
atactttctgagatggtggt

SEQ ID NO: 5243239 - DNA, 23 bp, Homo sapiens
atactttgaaaggagatgtcttg

SEQ ID NO: 5243240 - DNA, 13 bp, Homo sapiens
atactttgaatgt

SEQ ID NO: 5243241 - DNA, 18 bp, Homo sapiens
atactttgacaaggaaaa

SEQ ID NO: 5243242 - DNA, 16 bp, Homo sapiens
atactttgagttttga

SEQ ID NO: 5243243 - DNA, 18 bp, Homo sapiens
atactttgcattgtctgt

SEQ ID NO: 5243244 - DNA, 14 bp, Homo sapiens
atactttgccactg

SEQ ID NO: 5243245 - DNA, 16 bp, Homo sapiens
atactttgccactgct

SEQ ID NO: 5243246 - DNA, 18 bp, Homo sapiens
atactttgccactgctgt

SEQ ID NO: 5243247 - DNA, 22 bp, Homo sapiens
atactttgctgttgaagaaact

SEQ ID NO: 5243248 - DNA, 10 bp, Homo sapiens
atactttgta

SEQ ID NO: 5243249 - DNA, 13 bp, Homo sapiens
atactttgtattg

SEQ ID NO: 5243250 - DNA, 18 bp, Homo sapiens
atactttgtattgtccta

SEQ ID NO: 5243251 - DNA, 14 bp, Homo sapiens
atactttgtatttt

SEQ ID NO: 5243252 - DNA, 14 bp, Homo sapiens
atactttgttctgt

SEQ ID NO: 5243253 - DNA, 18 bp, Homo sapiens
atactttgttctgttgtc

SEQ ID NO: 5243254 - DNA, 19 bp, Homo sapiens
atactttgtttattgtaaa

SEQ ID NO: 5243255 - DNA, 14 bp, Homo sapiens
atacttttaaatta

SEQ ID NO: 5243256 - DNA, 17 bp, Homo sapiens
atacttttaaattatgg

SEQ ID NO: 5243257 - DNA, 20 bp, Homo sapiens
atacttttacaagtaacaaa

SEQ ID NO: 5243258 - DNA, 20 bp, Homo sapiens
atacttttacattaaagaaa

SEQ ID NO: 5243259 - DNA, 17 bp, Homo sapiens
atacttttactctgcct

SEQ ID NO: 5243260 - DNA, 14 bp, Homo sapiens
atacttttcaaagc

SEQ ID NO: 5243261 - DNA, 23 bp, Homo sapiens
atacttttcaggcactttagaaa

SEQ ID NO: 5243262 - DNA, 20 bp, Homo sapiens
atacttttcccctgttaaac

SEQ ID NO: 5243263 - DNA, 22 bp, Homo sapiens
atacttttcccctgttaaacag

SEQ ID NO: 5243264 - DNA, 12 bp, Homo sapiens
atacttttcctt

SEQ ID NO: 5243265 - DNA, 11 bp, Homo sapiens
atacttttctt

SEQ ID NO: 5243266 - DNA, 12 bp, Homo sapiens
atacttttgcaa

SEQ ID NO: 5243267 - DNA, 17 bp, Homo sapiens
atacttttggggaggag

SEQ ID NO: 5243268 - DNA, 17 bp, Homo sapiens
atacttttgtgtattct

SEQ ID NO: 5243269 - DNA, 18 bp, Homo sapiens
atacttttgtgtattctg

SEQ ID NO: 5243270 - DNA, 22 bp, Homo sapiens
atactttttacccaaatatgtt

SEQ ID NO: 5243271 - DNA, 13 bp, Homo sapiens
atactttttcaag

SEQ ID NO: 5243272 - DNA, 13 bp, Homo sapiens
atactttttcatg

SEQ ID NO: 5243273 - DNA, 17 bp, Homo sapiens
atactttttctaatgag

SEQ ID NO: 5243274 - DNA, 15 bp, Homo sapiens
atactttttcttttg

SEQ ID NO: 5243275 - DNA, 18 bp, Homo sapiens
atactttttcttttgtaa

SEQ ID NO: 5243276 - DNA, 19 bp, Homo sapiens
atacttttttctattttgt

SEQ ID NO: 5243277 - DNA, 17 bp, Homo sapiens
atagaaaaaaacattct

SEQ ID NO: 5243278 - DNA, 15 bp, Homo sapiens
atagaaaaagcacag

SEQ ID NO: 5243279 - DNA, 14 bp, Homo sapiens
atagaaaaaggatg

SEQ ID NO: 5243280 - DNA, 19 bp, Homo sapiens
atagaaaaaggatggaaga

SEQ ID NO: 5243281 - DNA, 10 bp, Homo sapiens
atagaaaaat

SEQ ID NO: 5243282 - DNA, 16 bp, Homo sapiens
atagaaaaatgatgtc

SEQ ID NO: 5243283 - DNA, 15 bp, Homo sapiens
atagaaaagcacttg

SEQ ID NO: 5243284 - DNA, 13 bp, Homo sapiens
atagaaaaggaac

SEQ ID NO: 5243285 - DNA, 18 bp, Homo sapiens
atagaaaaggaagacagc

SEQ ID NO: 5243286 - DNA, 19 bp, Homo sapiens
atagaaaagtctccacccc

SEQ ID NO: 5243287 - DNA, 21 bp, Homo sapiens
atagaaaagtctccaccccta

SEQ ID NO: 5243288 - DNA, 13 bp, Homo sapiens
atagaaaataaaa

SEQ ID NO: 5243289 - DNA, 17 bp, Homo sapiens
atagaaaatcttagtat

SEQ ID NO: 5243290 - DNA, 14 bp, Homo sapiens
atagaaaattattt

SEQ ID NO: 5243291 - DNA, 16 bp, Homo sapiens
atagaaacatacacaa

SEQ ID NO: 5243292 - DNA, 19 bp, Homo sapiens
atagaaacgtaaactatga

SEQ ID NO: 5243293 - DNA, 23 bp, Homo sapiens
atagaaactgtctagcacttcct

SEQ ID NO: 5243294 - DNA, 15 bp, Homo sapiens
atagaaacttttagt

SEQ ID NO: 5243295 - DNA, 13 bp, Homo sapiens
atagaaagaaagt

SEQ ID NO: 5243296 - DNA, 15 bp, Homo sapiens
atagaaagaaattac

SEQ ID NO: 5243297 - DNA, 14 bp, Homo sapiens
atagaaagaagcca

SEQ ID NO: 5243298 - DNA, 15 bp, Homo sapiens
atagaaagaagccat

SEQ ID NO: 5243299 - DNA, 12 bp, Homo sapiens
atagaaagaata

SEQ ID NO: 5243300 - DNA, 14 bp, Homo sapiens
atagaaagacatgg

SEQ ID NO: 5243301 - DNA, 15 bp, Homo sapiens
atagaaagacatggg

SEQ ID NO: 5243302 - DNA, 15 bp, Homo sapiens
atagaaagagttcta

SEQ ID NO: 5243303 - DNA, 15 bp, Homo sapiens
atagaaagcaaacat

SEQ ID NO: 5243304 - DNA, 14 bp, Homo sapiens
atagaaagcaataa

SEQ ID NO: 5243305 - DNA, 12 bp, Homo sapiens
atagaaagcatt

SEQ ID NO: 5243306 - DNA, 21 bp, Homo sapiens
atagaaagctggactgaccaa

SEQ ID NO: 5243307 - DNA, 21 bp, Homo sapiens
atagaaagctgtttatttatt

SEQ ID NO: 5243308 - DNA, 15 bp, Homo sapiens
atagaaagctttgtt

SEQ ID NO: 5243309 - DNA, 20 bp, Homo sapiens
atagaaagtataatttcagt

SEQ ID NO: 5243310 - DNA, 17 bp, Homo sapiens
atagaaagtcagatgac

SEQ ID NO: 5243311 - DNA, 20 bp, Homo sapiens
atagaaagtgttctgttaca

SEQ ID NO: 5243312 - DNA, 23 bp, Homo sapiens
atagaaagtgttctgttacaaaa

SEQ ID NO: 5243313 - DNA, 14 bp, Homo sapiens
atagaaataaattc

SEQ ID NO: 5243314 - DNA, 18 bp, Homo sapiens
atagaaataaattcctaa

SEQ ID NO: 5243315 - DNA, 12 bp, Homo sapiens
atagaaatacat

SEQ ID NO: 5243316 - DNA, 19 bp, Homo sapiens
atagaaatgctggtttttc

SEQ ID NO: 5243317 - DNA, 19 bp, Homo sapiens
atagaaatggtttcctctg

SEQ ID NO: 5243318 - DNA, 20 bp, Homo sapiens
atagaaatggtttcctctgg

SEQ ID NO: 5243319 - DNA, 21 bp, Homo sapiens
atagaaatgtaggtcctcaga

SEQ ID NO: 5243320 - DNA, 19 bp, Homo sapiens
atagaaattagatttgtgc

SEQ ID NO: 5243321 - DNA, 19 bp, Homo sapiens
atagaaatttactatgtaa

SEQ ID NO: 5243322 - DNA, 14 bp, Homo sapiens
atagaaattttgta

SEQ ID NO: 5243323 - DNA, 14 bp, Homo sapiens
atagaacaaaagag

SEQ ID NO: 5243324 - DNA, 21 bp, Homo sapiens
atagaacaagaccctgtctca

SEQ ID NO: 5243325 - DNA, 14 bp, Homo sapiens
atagaacaaggctg

SEQ ID NO: 5243326 - DNA, 20 bp, Homo sapiens
atagaacacagagtgtgttt

SEQ ID NO: 5243327 - DNA, 15 bp, Homo sapiens
atagaacacttcaga

SEQ ID NO: 5243328 - DNA, 15 bp, Homo sapiens
atagaacagaaatat

SEQ ID NO: 5243329 - DNA, 19 bp, Homo sapiens
atagaacaggacctctgct

SEQ ID NO: 5243330 - DNA, 12 bp, Homo sapiens
atagaacattga

SEQ ID NO: 5243331 - DNA, 20 bp, Homo sapiens
atagaacattgatctgtttt

SEQ ID NO: 5243332 - DNA, 13 bp, Homo sapiens
atagaaccatgaa

SEQ ID NO: 5243333 - DNA, 15 bp, Homo sapiens
atagaactctgggct

SEQ ID NO: 5243334 - DNA, 16 bp, Homo sapiens
atagaacttcatggat

SEQ ID NO: 5243335 - DNA, 17 bp, Homo sapiens
atagaagaaaaaagaat

SEQ ID NO: 5243336 - DNA, 14 bp, Homo sapiens
atagaagaacagca

SEQ ID NO: 5243337 - DNA, 15 bp, Homo sapiens
atagaagaactgcaa

SEQ ID NO: 5243338 - DNA, 20 bp, Homo sapiens
atagaagaaggactgaagaa

SEQ ID NO: 5243339 - DNA, 13 bp, Homo sapiens
atagaagaatgca

SEQ ID NO: 5243340 - DNA, 19 bp, Homo sapiens
atagaagacttagaataga

SEQ ID NO: 5243341 - DNA, 16 bp, Homo sapiens
atagaagagaagagcc

SEQ ID NO: 5243342 - DNA, 23 bp, Homo sapiens
atagaagagtttaaaagcatgaa

SEQ ID NO: 5243343 - DNA, 23 bp, Homo sapiens
atagaagctgcagtggtattaat

SEQ ID NO: 5243344 - DNA, 16 bp, Homo sapiens
atagaagctgtagtag

SEQ ID NO: 5243345 - DNA, 15 bp, Homo sapiens
atagaagcttaaaat

SEQ ID NO: 5243346 - DNA, 15 bp, Homo sapiens
atagaagcttcagca

SEQ ID NO: 5243347 - DNA, 21 bp, Homo sapiens
atagaagcttcttgctcctgt

SEQ ID NO: 5243348 - DNA, 12 bp, Homo sapiens
atagaaggaaac

SEQ ID NO: 5243349 - DNA, 18 bp, Homo sapiens
atagaaggaaactagctt

SEQ ID NO: 5243350 - DNA, 18 bp, Homo sapiens
atagaaggaatttgtact

SEQ ID NO: 5243351 - DNA, 10 bp, Homo sapiens
atagaaggag

SEQ ID NO: 5243352 - DNA, 19 bp, Homo sapiens
atagaaggatgtacatttc

SEQ ID NO: 5243353 - DNA, 14 bp, Homo sapiens
atagaagtcttcat

SEQ ID NO: 5243354 - DNA, 20 bp, Homo sapiens
atagaagtcttcatgaaatg

SEQ ID NO: 5243355 - DNA, 21 bp, Homo sapiens
atagaagtcttcatgaaatgc

SEQ ID NO: 5243356 - DNA, 19 bp, Homo sapiens
atagaagttcaatggctgc

SEQ ID NO: 5243357 - DNA, 22 bp, Homo sapiens
atagaagtttgtccatttgtaa

SEQ ID NO: 5243358 - DNA, 17 bp, Homo sapiens
atagaagttttcctgat

SEQ ID NO: 5243359 - DNA, 18 bp, Homo sapiens
atagaagttttcctgata

SEQ ID NO: 5243360 - DNA, 16 bp, Homo sapiens
atagaataaaagctgt

SEQ ID NO: 5243361 - DNA, 19 bp, Homo sapiens
atagaataaaatttttaat

SEQ ID NO: 5243362 - DNA, 19 bp, Homo sapiens
atagaataaaggcagtttt

SEQ ID NO: 5243363 - DNA, 20 bp, Homo sapiens
atagaataattcttttctga

SEQ ID NO: 5243364 - DNA, 21 bp, Homo sapiens
atagaatacttttttctagtt

SEQ ID NO: 5243365 - DNA, 22 bp, Homo sapiens
atagaatacttttttctagttt

SEQ ID NO: 5243366 - DNA, 13 bp, Homo sapiens
atagaatagcaca

SEQ ID NO: 5243367 - DNA, 16 bp, Homo sapiens
atagaatagcctgagg

SEQ ID NO: 5243368 - DNA, 23 bp, Homo sapiens
atagaatagcctgaggtcccctc

SEQ ID NO: 5243369 - DNA, 22 bp, Homo sapiens
atagaataggcactttaaaaca

SEQ ID NO: 5243370 - DNA, 17 bp, Homo sapiens
atagaatatagcatctt

SEQ ID NO: 5243371 - DNA, 15 bp, Homo sapiens
atagaatatataaac

SEQ ID NO: 5243372 - DNA, 19 bp, Homo sapiens
atagaatatttattacctc

SEQ ID NO: 5243373 - DNA, 12 bp, Homo sapiens
atagaatgctgc

SEQ ID NO: 5243374 - DNA, 14 bp, Homo sapiens
atagaatgtaaatg

SEQ ID NO: 5243375 - DNA, 17 bp, Homo sapiens
atagaatgtaaatgtct

SEQ ID NO: 5243376 - DNA, 20 bp, Homo sapiens
atagaatgtggccacttatt

SEQ ID NO: 5243377 - DNA, 14 bp, Homo sapiens
atcactactgcagt

SEQ ID NO: 5243378 - DNA, 13 bp, Homo sapiens
atcactactgtat

SEQ ID NO: 5243379 - DNA, 18 bp, Homo sapiens
atcactagagtgctctga

SEQ ID NO: 5243380 - DNA, 22 bp, Homo sapiens
atcactagccctcctttttcca

SEQ ID NO: 5243381 - DNA, 17 bp, Homo sapiens
atcactagtcaagaaaa

SEQ ID NO: 5243382 - DNA, 16 bp, Homo sapiens
atcactagtggcaaat

SEQ ID NO: 5243383 - DNA, 19 bp, Homo sapiens
atcactataaccatcagtt

SEQ ID NO: 5243384 - DNA, 20 bp, Homo sapiens
atcactataaccatcagtta

SEQ ID NO: 5243385 - DNA, 18 bp, Homo sapiens
atcactatcaattttaag

SEQ ID NO: 5243386 - DNA, 21 bp, Homo sapiens
atcactatccatgcaccaaac

SEQ ID NO: 5243387 - DNA, 15 bp, Homo sapiens
atcactatctttctg

SEQ ID NO: 5243388 - DNA, 16 bp, Homo sapiens
atcactatctttctga

SEQ ID NO: 5243389 - DNA, 13 bp, Homo sapiens
atcactattctta

SEQ ID NO: 5243390 - DNA, 16 bp, Homo sapiens
atcactattgaaaaat

SEQ ID NO: 5243391 - DNA, 12 bp, Homo sapiens
atcactcaccat

SEQ ID NO: 5243392 - DNA, 22 bp, Homo sapiens
atcactcactcactccccactc

SEQ ID NO: 5243393 - DNA, 14 bp, Homo sapiens
atcactcagagcag

SEQ ID NO: 5243394 - DNA, 12 bp, Homo sapiens
atcactcagccc

SEQ ID NO: 5243395 - DNA, 12 bp, Homo sapiens
atcactcccatt

SEQ ID NO: 5243396 - DNA, 16 bp, Homo sapiens
atcactccctggatgt

SEQ ID NO: 5243397 - DNA, 13 bp, Homo sapiens
atcactcgcagga

SEQ ID NO: 5243398 - DNA, 14 bp, Homo sapiens
atcactcgcaggac

SEQ ID NO: 5243399 - DNA, 20 bp, Homo sapiens
atcactctaattaattgtaa

SEQ ID NO: 5243400 - DNA, 12 bp, Homo sapiens
atcactctagaa

SEQ ID NO: 5243401 - DNA, 21 bp, Homo sapiens
atcactctcagtgcttcttac

SEQ ID NO: 5243402 - DNA, 14 bp, Homo sapiens
atcactctctgctg

SEQ ID NO: 5243403 - DNA, 14 bp, Homo sapiens
atcactctgcaatg

SEQ ID NO: 5243404 - DNA, 14 bp, Homo sapiens
atcactctgctgct

SEQ ID NO: 5243405 - DNA, 21 bp, Homo sapiens
atcactctgctgcttagacat

SEQ ID NO: 5243406 - DNA, 13 bp, Homo sapiens
atcactctgtcct

SEQ ID NO: 5243407 - DNA, 16 bp, Homo sapiens
atcactctgtgtctga

SEQ ID NO: 5243408 - DNA, 20 bp, Homo sapiens
atcactctgtgtctgagtgg

SEQ ID NO: 5243409 - DNA, 22 bp, Homo sapiens
atcactctgttcattcctccag

SEQ ID NO: 5243410 - DNA, 14 bp, Homo sapiens
atcactcttgtgga

SEQ ID NO: 5243411 - DNA, 13 bp, Homo sapiens
atcactgaaacaa

SEQ ID NO: 5243412 - DNA, 17 bp, Homo sapiens
atcactgaacaaactaa

SEQ ID NO: 5243413 - DNA, 20 bp, Homo sapiens
atcactgaacaaactaaagg

SEQ ID NO: 5243414 - DNA, 21 bp, Homo sapiens
atcactgaactttgctgagcc

SEQ ID NO: 5243415 - DNA, 14 bp, Homo sapiens
atcactgaactttt

SEQ ID NO: 5243416 - DNA, 21 bp, Homo sapiens
atcactgaacttttcaaaata

SEQ ID NO: 5243417 - DNA, 12 bp, Homo sapiens
atcactgaagga

SEQ ID NO: 5243418 - DNA, 22 bp, Homo sapiens
atcactgacacatcagcatgtt

SEQ ID NO: 5243419 - DNA, 16 bp, Homo sapiens
atcactgactctgact

SEQ ID NO: 5243420 - DNA, 18 bp, Homo sapiens
atcactgagccatcattt

SEQ ID NO: 5243421 - DNA, 13 bp, Homo sapiens
atcactgatggga

SEQ ID NO: 5243422 - DNA, 22 bp, Homo sapiens
atcactgatgggaataaaagta

SEQ ID NO: 5243423 - DNA, 23 bp, Homo sapiens
atcactgattgggtgccatgtgg

SEQ ID NO: 5243424 - DNA, 13 bp, Homo sapiens
atcactgcagccc

SEQ ID NO: 5243425 - DNA, 15 bp, Homo sapiens
atcactgcagcccag

SEQ ID NO: 5243426 - DNA, 12 bp, Homo sapiens
atcactgcatta

SEQ ID NO: 5243427 - DNA, 19 bp, Homo sapiens
atcactgcattatcttgct

SEQ ID NO: 5243428 - DNA, 22 bp, Homo sapiens
atcactgccacactctccatca

SEQ ID NO: 5243429 - DNA, 18 bp, Homo sapiens
atcactgccttggcccct

SEQ ID NO: 5243430 - DNA, 19 bp, Homo sapiens
atcactgccttggcccctc

SEQ ID NO: 5243431 - DNA, 13 bp, Homo sapiens
atcactgctccag

SEQ ID NO: 5243432 - DNA, 17 bp, Homo sapiens
atcactgctccaggcct

SEQ ID NO: 5243433 - DNA, 12 bp, Homo sapiens
atcactgctccc

SEQ ID NO: 5243434 - DNA, 14 bp, Homo sapiens
atcactgcttgatg

SEQ ID NO: 5243435 - DNA, 19 bp, Homo sapiens
atcactgcttgatgaagca

SEQ ID NO: 5243436 - DNA, 17 bp, Homo sapiens
atcactggcaatatttg

SEQ ID NO: 5243437 - DNA, 15 bp, Homo sapiens
atcactgggcccaga

SEQ ID NO: 5243438 - DNA, 19 bp, Homo sapiens
atcactgggcccagaggag

SEQ ID NO: 5243439 - DNA, 22 bp, Homo sapiens
atcactgggcccagaggagagg

SEQ ID NO: 5243440 - DNA, 22 bp, Homo sapiens
atcactgtaaagacaaataaat

SEQ ID NO: 5243441 - DNA, 19 bp, Homo sapiens
atcactgtatcattttctt

SEQ ID NO: 5243442 - DNA, 15 bp, Homo sapiens
atcactgtcctccac

SEQ ID NO: 5243443 - DNA, 18 bp, Homo sapiens
atcactgtctttcctaga

SEQ ID NO: 5243444 - DNA, 15 bp, Homo sapiens
atcactgtgctcagc

SEQ ID NO: 5243445 - DNA, 14 bp, Homo sapiens
atcactgtggctgt

SEQ ID NO: 5243446 - DNA, 17 bp, Homo sapiens
atcactgtgtatatttg

SEQ ID NO: 5243447 - DNA, 18 bp, Homo sapiens
atcactgtgtatatttga

SEQ ID NO: 5243448 - DNA, 20 bp, Homo sapiens
atcactgtgtatatttgatt

SEQ ID NO: 5243449 - DNA, 17 bp, Homo sapiens
atcactgttgctttgaa

SEQ ID NO: 5243450 - DNA, 14 bp, Homo sapiens
atcactgtttttag

SEQ ID NO: 5243451 - DNA, 15 bp, Homo sapiens
atcacttaaaacacg

SEQ ID NO: 5243452 - DNA, 14 bp, Homo sapiens
atcacttaaaactt

SEQ ID NO: 5243453 - DNA, 17 bp, Homo sapiens
atcacttaaacttgcat

SEQ ID NO: 5243454 - DNA, 23 bp, Homo sapiens
atcacttaacggaccaaagcaag

SEQ ID NO: 5243455 - DNA, 14 bp, Homo sapiens
atcacttactcagt

SEQ ID NO: 5243456 - DNA, 20 bp, Homo sapiens
atcacttaggaaatggcttt

SEQ ID NO: 5243457 - DNA, 14 bp, Homo sapiens
atcacttccatgac

SEQ ID NO: 5243458 - DNA, 13 bp, Homo sapiens
atcacttcctgtt

SEQ ID NO: 5243459 - DNA, 13 bp, Homo sapiens
atcacttcttcca

SEQ ID NO: 5243460 - DNA, 13 bp, Homo sapiens
atcacttgaaccc

SEQ ID NO: 5243461 - DNA, 20 bp, Homo sapiens
atcacttgagctcaggaggt

SEQ ID NO: 5243462 - DNA, 13 bp, Homo sapiens
atcacttgaggtc

SEQ ID NO: 5243463 - DNA, 19 bp, Homo sapiens
atcacttgggcccaggagg

SEQ ID NO: 5243464 - DNA, 19 bp, Homo sapiens
atcacttggggtttgtaca

SEQ ID NO: 5243465 - DNA, 15 bp, Homo sapiens
atcacttgtaaataa

SEQ ID NO: 5243466 - DNA, 17 bp, Homo sapiens
atcacttgtaaataaat

SEQ ID NO: 5243467 - DNA, 18 bp, Homo sapiens
atcacttgtaaataaata

SEQ ID NO: 5243468 - DNA, 21 bp, Homo sapiens
atcacttgtacaaaataaaca

SEQ ID NO: 5243469 - DNA, 18 bp, Homo sapiens
atcacttgttttattgac

SEQ ID NO: 5243470 - DNA, 16 bp, Homo sapiens
atcactttctcagttt

SEQ ID NO: 5243471 - DNA, 21 bp, Homo sapiens
atcactttctcagttttcata

SEQ ID NO: 5243472 - DNA, 22 bp, Homo sapiens
atcactttgagcctgggaaata

SEQ ID NO: 5243473 - DNA, 12 bp, Homo sapiens
atcactttgctc

SEQ ID NO: 5243474 - DNA, 15 bp, Homo sapiens
atcactttgctctga

SEQ ID NO: 5243475 - DNA, 16 bp, Homo sapiens
atcactttgtctaact

SEQ ID NO: 5243476 - DNA, 14 bp, Homo sapiens
atcactttgttaaa

SEQ ID NO: 5243477 - DNA, 15 bp, Homo sapiens
atcactttttgaact

SEQ ID NO: 5243478 - DNA, 21 bp, Homo sapiens
atcactttttgaactaagaaa

SEQ ID NO: 5243479 - DNA, 14 bp, Homo sapiens
atcacttttttcca

SEQ ID NO: 5243480 - DNA, 17 bp, Homo sapiens
atcagaaaaatggagca

SEQ ID NO: 5243481 - DNA, 18 bp, Homo sapiens
atcagaaaaatggagcaa

SEQ ID NO: 5243482 - DNA, 17 bp, Homo sapiens
atcagaaaaccaaaggg

SEQ ID NO: 5243483 - DNA, 13 bp, Homo sapiens
atcagaaaagtag

SEQ ID NO: 5243484 - DNA, 20 bp, Homo sapiens
atcagaaaagtagaattata

SEQ ID NO: 5243485 - DNA, 15 bp, Homo sapiens
atcagaaacagtatt

SEQ ID NO: 5243486 - DNA, 23 bp, Homo sapiens
atcagaaacagtattttcttccc

SEQ ID NO: 5243487 - DNA, 20 bp, Homo sapiens
atcagaaagacattcttagt

SEQ ID NO: 5243488 - DNA, 14 bp, Homo sapiens
atcagaaagaggca

SEQ ID NO: 5243489 - DNA, 16 bp, Homo sapiens
atcagaaagctttatt

SEQ ID NO: 5243490 - DNA, 22 bp, Homo sapiens
atcagaaaggaaaaacaaactc

SEQ ID NO: 5243491 - DNA, 19 bp, Homo sapiens
atcagaaagggagggctct

SEQ ID NO: 5243492 - DNA, 20 bp, Homo sapiens
atcagaaagggagggctctg

SEQ ID NO: 5243493 - DNA, 21 bp, Homo sapiens
atcagaaagggagggctctga

SEQ ID NO: 5243494 - DNA, 22 bp, Homo sapiens
atcagaaagggagggctctgag

SEQ ID NO: 5243495 - DNA, 23 bp, Homo sapiens
atcagaaagggagggctctgagg

SEQ ID NO: 5243496 - DNA, 18 bp, Homo sapiens
atcagaaagtaacaatct

SEQ ID NO: 5243497 - DNA, 22 bp, Homo sapiens
atcagaaagtaacaatctatgg

SEQ ID NO: 5243498 - DNA, 22 bp, Homo sapiens
atcagaaagtaatttcttctca

SEQ ID NO: 5243499 - DNA, 17 bp, Homo sapiens
atcagaaagtgacattt

SEQ ID NO: 5243500 - DNA, 16 bp, Homo sapiens
atcagaaatacaaaaa

SEQ ID NO: 5243501 - DNA, 17 bp, Homo sapiens
atcagaaatacaaaaaa

SEQ ID NO: 5243502 - DNA, 23 bp, Homo sapiens
atcagaaatacagattttgatag

SEQ ID NO: 5243503 - DNA, 12 bp, Homo sapiens
atcagaaatagg

SEQ ID NO: 5243504 - DNA, 20 bp, Homo sapiens
atcagaaatgtcatcaaata

SEQ ID NO: 5243505 - DNA, 21 bp, Homo sapiens
atcagaaatgtcatcaaatat

SEQ ID NO: 5243506 - DNA, 14 bp, Homo sapiens
atcagaaattttta

SEQ ID NO: 5243507 - DNA, 15 bp, Homo sapiens
atcagaaatttttat

SEQ ID NO: 5243508 - DNA, 18 bp, Homo sapiens
atcagaacaaaacttcta

SEQ ID NO: 5243509 - DNA, 17 bp, Homo sapiens
atcagaacaaaagaaaa

SEQ ID NO: 5243510 - DNA, 15 bp, Homo sapiens
atcagaacagctgtt

SEQ ID NO: 5243511 - DNA, 12 bp, Homo sapiens
atcagaacagga

SEQ ID NO: 5243512 - DNA, 13 bp, Homo sapiens
atcagaacatgaa

SEQ ID NO: 5243513 - DNA, 22 bp, Homo sapiens
atcagaactcaaatggggccag

SEQ ID NO: 5243514 - DNA, 18 bp, Homo sapiens
atcagaactcctttctaa

SEQ ID NO: 5243515 - DNA, 23 bp, Homo sapiens
atcagaactctcctatctgaacc

SEQ ID NO: 5243516 - DNA, 16 bp, Homo sapiens
atcagaactcttcctc

SEQ ID NO: 5243517 - DNA, 15 bp, Homo sapiens
atcagaactgaaata

SEQ ID NO: 5243518 - DNA, 23 bp, Homo sapiens
atcagaactgggaaaacagtgaa

SEQ ID NO: 5243519 - DNA, 15 bp, Homo sapiens
atcagaagaaaagga

SEQ ID NO: 5243520 - DNA, 14 bp, Homo sapiens
atcagaagaaaggc

SEQ ID NO: 5243521 - DNA, 17 bp, Homo sapiens
atcagaagaaaggccaa

SEQ ID NO: 5243522 - DNA, 22 bp, Homo sapiens
atcagaagaaaggccaaggtgc

SEQ ID NO: 5243523 - DNA, 22 bp, Homo sapiens
atcagaagaccacaaaaattga

SEQ ID NO: 5243524 - DNA, 16 bp, Homo sapiens
atcagaagactttaat

SEQ ID NO: 5243525 - DNA, 14 bp, Homo sapiens
atcagaagataact

SEQ ID NO: 5243526 - DNA, 13 bp, Homo sapiens
atcagaagcaagg

SEQ ID NO: 5243527 - DNA, 14 bp, Homo sapiens
atcagaagcaagga

SEQ ID NO: 5243528 - DNA, 19 bp, Homo sapiens
atcagaaggctggggccag

SEQ ID NO: 5243529 - DNA, 23 bp, Homo sapiens
atcagaaggctggggccagtgta

SEQ ID NO: 5243530 - DNA, 19 bp, Homo sapiens
atcagaaggtattttttaa

SEQ ID NO: 5243531 - DNA, 19 bp, Homo sapiens
atcagaagtaactcccact

SEQ ID NO: 5243532 - DNA, 20 bp, Homo sapiens
atcagaagtaactcccactc

SEQ ID NO: 5243533 - DNA, 17 bp, Homo sapiens
atcagaagtatatctgt

SEQ ID NO: 5243534 - DNA, 18 bp, Homo sapiens
atcagaagtcatcttgct

SEQ ID NO: 5243535 - DNA, 14 bp, Homo sapiens
atcagaagttgtat

SEQ ID NO: 5243536 - DNA, 15 bp, Homo sapiens
atcagaagtttgcat

SEQ ID NO: 5243537 - DNA, 11 bp, Homo sapiens
atcagaataaa

SEQ ID NO: 5243538 - DNA, 23 bp, Homo sapiens
atcagaataaagttgtatttcaa

SEQ ID NO: 5243539 - DNA, 21 bp, Homo sapiens
atcagaatcaaatctgagcct

SEQ ID NO: 5243540 - DNA, 15 bp, Homo sapiens
atcagaatccccgaa

SEQ ID NO: 5243541 - DNA, 13 bp, Homo sapiens
atcagaatctgtg

SEQ ID NO: 5243542 - DNA, 16 bp, Homo sapiens
atcagaatgttaattt

SEQ ID NO: 5243543 - DNA, 18 bp, Homo sapiens
atcagaattgaaacactt

SEQ ID NO: 5243544 - DNA, 16 bp, Homo sapiens
atcagaattttaccaa

SEQ ID NO: 5243545 - DNA, 12 bp, Homo sapiens
atcagacaagca

SEQ ID NO: 5243546 - DNA, 14 bp, Homo sapiens
atcagacaagcact

SEQ ID NO: 5243547 - DNA, 20 bp, Homo sapiens
atcagacaagcactatttta

SEQ ID NO: 5243548 - DNA, 14 bp, Homo sapiens
atcagacaagtgtt

SEQ ID NO: 5243549 - DNA, 22 bp, Homo sapiens
atcagacaatttatccaaagca

SEQ ID NO: 5243550 - DNA, 11 bp, Homo sapiens
atcagacacaa

SEQ ID NO: 5243551 - DNA, 19 bp, Homo sapiens
atcagacacaattagagaa

SEQ ID NO: 5243552 - DNA, 19 bp, Homo sapiens
atcagacaccctctcctta

SEQ ID NO: 5243553 - DNA, 19 bp, Homo sapiens
atcagacactctggctggt

SEQ ID NO: 5243554 - DNA, 16 bp, Homo sapiens
atcagaccataatgtt

SEQ ID NO: 5243555 - DNA, 15 bp, Homo sapiens
atcagaccctacccc

SEQ ID NO: 5243556 - DNA, 16 bp, Homo sapiens
atcagaccctacccca

SEQ ID NO: 5243557 - DNA, 15 bp, Homo sapiens
atagaattagctttt

SEQ ID NO: 5243558 - DNA, 21 bp, Homo sapiens
atagaattatttttgagcagg

SEQ ID NO: 5243559 - DNA, 13 bp, Homo sapiens
atagaattcagaa

SEQ ID NO: 5243560 - DNA, 14 bp, Homo sapiens
atagaattctagct

SEQ ID NO: 5243561 - DNA, 18 bp, Homo sapiens
atagaattgcaatctata

SEQ ID NO: 5243562 - DNA, 18 bp, Homo sapiens
atagaattgcaattttaa

SEQ ID NO: 5243563 - DNA, 20 bp, Homo sapiens
atagaatttcctaatgagat

SEQ ID NO: 5243564 - DNA, 17 bp, Homo sapiens
atagaatttggcccaga

SEQ ID NO: 5243565 - DNA, 23 bp, Homo sapiens
atagacaagtagttaagagctaa

SEQ ID NO: 5243566 - DNA, 21 bp, Homo sapiens
atagacaagtgttttgggttt

SEQ ID NO: 5243567 - DNA, 14 bp, Homo sapiens
atagacaagttttg

SEQ ID NO: 5243568 - DNA, 22 bp, Homo sapiens
atagacaatttattatggcaca

SEQ ID NO: 5243569 - DNA, 23 bp, Homo sapiens
atagacaatttattatggcacat

SEQ ID NO: 5243570 - DNA, 13 bp, Homo sapiens
atagacacacata

SEQ ID NO: 5243571 - DNA, 14 bp, Homo sapiens
atagacacatcaaa

SEQ ID NO: 5243572 - DNA, 15 bp, Homo sapiens
atagacacatcaaat

SEQ ID NO: 5243573 - DNA, 18 bp, Homo sapiens
atagacacatcaaatgcc

SEQ ID NO: 5243574 - DNA, 22 bp, Homo sapiens
atagacacttgagttaactttt

SEQ ID NO: 5243575 - DNA, 14 bp, Homo sapiens
atagacagaaacag

SEQ ID NO: 5243576 - DNA, 14 bp, Homo sapiens
atagacagaagaaa

SEQ ID NO: 5243577 - DNA, 17 bp, Homo sapiens
atagacagaagaaacaa

SEQ ID NO: 5243578 - DNA, 18 bp, Homo sapiens
atagacagaagaaacaag

SEQ ID NO: 5243579 - DNA, 21 bp, Homo sapiens
atagacagaatagatagcact

SEQ ID NO: 5243580 - DNA, 14 bp, Homo sapiens
atagacagaggttt

SEQ ID NO: 5243581 - DNA, 22 bp, Homo sapiens
atagacaggagaagaaagaact

SEQ ID NO: 5243582 - DNA, 16 bp, Homo sapiens
atagacagtaaaatac

SEQ ID NO: 5243583 - DNA, 14 bp, Homo sapiens
atagacagtttgta

SEQ ID NO: 5243584 - DNA, 18 bp, Homo sapiens
atagacataaattgtaat

SEQ ID NO: 5243585 - DNA, 21 bp, Homo sapiens
atagacataaattgtaatttg

SEQ ID NO: 5243586 - DNA, 13 bp, Homo sapiens
atagacatgaaag

SEQ ID NO: 5243587 - DNA, 15 bp, Homo sapiens
atagacatttcaaaa

SEQ ID NO: 5243588 - DNA, 20 bp, Homo sapiens
atagacatttcaaaattaat

SEQ ID NO: 5243589 - DNA, 12 bp, Homo sapiens
atagacattttt

SEQ ID NO: 5243590 - DNA, 15 bp, Homo sapiens
atagaccaaagcaaa

SEQ ID NO: 5243591 - DNA, 16 bp, Homo sapiens
atagaccaattgaagc

SEQ ID NO: 5243592 - DNA, 17 bp, Homo sapiens
atagaccaattgaagca

SEQ ID NO: 5243593 - DNA, 18 bp, Homo sapiens
atagacccacaagaggca

SEQ ID NO: 5243594 - DNA, 15 bp, Homo sapiens
atagacccatctgga

SEQ ID NO: 5243595 - DNA, 16 bp, Homo sapiens
atagacctaactgtga

SEQ ID NO: 5243596 - DNA, 18 bp, Homo sapiens
atagacctctagtagctg

SEQ ID NO: 5243597 - DNA, 22 bp, Homo sapiens
atagacctgtgacctggtctgg

SEQ ID NO: 5243598 - DNA, 19 bp, Homo sapiens
atagacgagttgatttcct

SEQ ID NO: 5243599 - DNA, 15 bp, Homo sapiens
atagacgggttgaaa

SEQ ID NO: 5243600 - DNA, 17 bp, Homo sapiens
atagacgggttgaaaga

SEQ ID NO: 5243601 - DNA, 19 bp, Homo sapiens
atagacgggttgaaagaca

SEQ ID NO: 5243602 - DNA, 22 bp, Homo sapiens
atagacgtttggactgatttgt

SEQ ID NO: 5243603 - DNA, 15 bp, Homo sapiens
atagactagagaaac

SEQ ID NO: 5243604 - DNA, 17 bp, Homo sapiens
atagactagagaaaccg

SEQ ID NO: 5243605 - DNA, 17 bp, Homo sapiens
atagactgaagatttat

SEQ ID NO: 5243606 - DNA, 21 bp, Homo sapiens
atagactgactttttccattt

SEQ ID NO: 5243607 - DNA, 21 bp, Homo sapiens
atagactgaggtataaagaca

SEQ ID NO: 5243608 - DNA, 15 bp, Homo sapiens
atagacttaaatctc

SEQ ID NO: 5243609 - DNA, 23 bp, Homo sapiens
atagacttactaataaaatgtga

SEQ ID NO: 5243610 - DNA, 20 bp, Homo sapiens
atagacttattcttttataa

SEQ ID NO: 5243611 - DNA, 18 bp, Homo sapiens
atagacttctcttacatt

SEQ ID NO: 5243612 - DNA, 20 bp, Homo sapiens
atagacttggagaatactgc

SEQ ID NO: 5243613 - DNA, 12 bp, Homo sapiens
atagacttggga

SEQ ID NO: 5243614 - DNA, 18 bp, Homo sapiens
atagagaaaagtgtatta

SEQ ID NO: 5243615 - DNA, 17 bp, Homo sapiens
atagagaaaattcaggt

SEQ ID NO: 5243616 - DNA, 20 bp, Homo sapiens
atagagaaaattcaggtctg

SEQ ID NO: 5243617 - DNA, 22 bp, Homo sapiens
atagagaaggaaagctttggca

SEQ ID NO: 5243618 - DNA, 17 bp, Homo sapiens
atagagaatacacatat

SEQ ID NO: 5243619 - DNA, 17 bp, Homo sapiens
atagagaatgttccaga

SEQ ID NO: 5243620 - DNA, 20 bp, Homo sapiens
atagagacaggacagaatgt

SEQ ID NO: 5243621 - DNA, 21 bp, Homo sapiens
atagagacaggacagaatgtg

SEQ ID NO: 5243622 - DNA, 14 bp, Homo sapiens
atagagactgtaga

SEQ ID NO: 5243623 - DNA, 14 bp, Homo sapiens
atagagagagaggt

SEQ ID NO: 5243624 - DNA, 21 bp, Homo sapiens
atagagagggagaagaagtca

SEQ ID NO: 5243625 - DNA, 17 bp, Homo sapiens
atagagagggggctctc

SEQ ID NO: 5243626 - DNA, 14 bp, Homo sapiens
atagagatatttaa

SEQ ID NO: 5243627 - DNA, 15 bp, Homo sapiens
atagagatgcattca

SEQ ID NO: 5243628 - DNA, 18 bp, Homo sapiens
atagagcaaaatcaacat

SEQ ID NO: 5243629 - DNA, 22 bp, Homo sapiens
atagagcaaaatcaacatgact

SEQ ID NO: 5243630 - DNA, 15 bp, Homo sapiens
atagagcaaaattga

SEQ ID NO: 5243631 - DNA, 21 bp, Homo sapiens
atagagcaaaattgatgtgtt

SEQ ID NO: 5243632 - DNA, 13 bp, Homo sapiens
atagagcaatgtt

SEQ ID NO: 5243633 - DNA, 12 bp, Homo sapiens
atagagcacaat

SEQ ID NO: 5243634 - DNA, 14 bp, Homo sapiens
atagagcacaatat

SEQ ID NO: 5243635 - DNA, 21 bp, Homo sapiens
atagagcacaatattaagtgt

SEQ ID NO: 5243636 - DNA, 19 bp, Homo sapiens
atagagcagaaattctgtt

SEQ ID NO: 5243637 - DNA, 20 bp, Homo sapiens
atagagcagaactgaactta

SEQ ID NO: 5243638 - DNA, 17 bp, Homo sapiens
atagagccaactgattt

SEQ ID NO: 5243639 - DNA, 21 bp, Homo sapiens
atagagccctggccagccctt

SEQ ID NO: 5243640 - DNA, 22 bp, Homo sapiens
atagagctagctaatctctaca

SEQ ID NO: 5243641 - DNA, 22 bp, Homo sapiens
atagagctgcagggtggattgt

SEQ ID NO: 5243642 - DNA, 23 bp, Homo sapiens
atagagctgttcaacatcactga

SEQ ID NO: 5243643 - DNA, 18 bp, Homo sapiens
atagagcttttaaaaatg

SEQ ID NO: 5243644 - DNA, 13 bp, Homo sapiens
atagaggaagaaa

SEQ ID NO: 5243645 - DNA, 14 bp, Homo sapiens
atagaggaagaaat

SEQ ID NO: 5243646 - DNA, 22 bp, Homo sapiens
atagaggaagcctgattaaaga

SEQ ID NO: 5243647 - DNA, 18 bp, Homo sapiens
atagaggatgatgtaatt

SEQ ID NO: 5243648 - DNA, 21 bp, Homo sapiens
atagaggatgatgtaattaaa

SEQ ID NO: 5243649 - DNA, 22 bp, Homo sapiens
atagaggatggtcttacagcag

SEQ ID NO: 5243650 - DNA, 16 bp, Homo sapiens
atagaggcattacttg

SEQ ID NO: 5243651 - DNA, 20 bp, Homo sapiens
atagaggcattacttgcttt

SEQ ID NO: 5243652 - DNA, 23 bp, Homo sapiens
atagaggccaaattaatctttta

SEQ ID NO: 5243653 - DNA, 14 bp, Homo sapiens
atagaggccaaggt

SEQ ID NO: 5243654 - DNA, 17 bp, Homo sapiens
atagaggcccaggcacc

SEQ ID NO: 5243655 - DNA, 12 bp, Homo sapiens
atagaggctagc

SEQ ID NO: 5243656 - DNA, 22 bp, Homo sapiens
atagaggcttctccgccagcct

SEQ ID NO: 5243657 - DNA, 19 bp, Homo sapiens
atagagggagtagaaagct

SEQ ID NO: 5243658 - DNA, 13 bp, Homo sapiens
atagaggggctgc

SEQ ID NO: 5243659 - DNA, 16 bp, Homo sapiens
atagaggggttttaga

SEQ ID NO: 5243660 - DNA, 16 bp, Homo sapiens
atagaggtaccagcaa

SEQ ID NO: 5243661 - DNA, 18 bp, Homo sapiens
atagaggtatattggaag

SEQ ID NO: 5243662 - DNA, 19 bp, Homo sapiens
atagaggtatattggaaga

SEQ ID NO: 5243663 - DNA, 17 bp, Homo sapiens
atagaggtctgtaaaga

SEQ ID NO: 5243664 - DNA, 14 bp, Homo sapiens
atagaggtgagaaa

SEQ ID NO: 5243665 - DNA, 22 bp, Homo sapiens
atagaggtgagggaagcctgaa

SEQ ID NO: 5243666 - DNA, 19 bp, Homo sapiens
atagagtacttaatatact

SEQ ID NO: 5243667 - DNA, 14 bp, Homo sapiens
atagagtcacagct

SEQ ID NO: 5243668 - DNA, 13 bp, Homo sapiens
atagagtcttgct

SEQ ID NO: 5243669 - DNA, 17 bp, Homo sapiens
atagagtgacttggaga

SEQ ID NO: 5243670 - DNA, 13 bp, Homo sapiens
atagagtgcagtg

SEQ ID NO: 5243671 - DNA, 19 bp, Homo sapiens
atagagtgggacagttcct

SEQ ID NO: 5243672 - DNA, 16 bp, Homo sapiens
atagagtgtgatgtat

SEQ ID NO: 5243673 - DNA, 17 bp, Homo sapiens
atagagttcatagaaat

SEQ ID NO: 5243674 - DNA, 15 bp, Homo sapiens
atagagttggagttt

SEQ ID NO: 5243675 - DNA, 18 bp, Homo sapiens
atagagttggagttttat

SEQ ID NO: 5243676 - DNA, 18 bp, Homo sapiens
atagagtttaacagatat

SEQ ID NO: 5243677 - DNA, 14 bp, Homo sapiens
atagataacagaga

SEQ ID NO: 5243678 - DNA, 14 bp, Homo sapiens
atagataaccaatt

SEQ ID NO: 5243679 - DNA, 17 bp, Homo sapiens
atagataactctttgga

SEQ ID NO: 5243680 - DNA, 22 bp, Homo sapiens
atagataactgctcttttacta

SEQ ID NO: 5243681 - DNA, 20 bp, Homo sapiens
atagataagagtagaaactg

SEQ ID NO: 5243682 - DNA, 15 bp, Homo sapiens
atagataatagtaca

SEQ ID NO: 5243683 - DNA, 15 bp, Homo sapiens
atagataatattgtt

SEQ ID NO: 5243684 - DNA, 22 bp, Homo sapiens
atagataccattttgaaatatt

SEQ ID NO: 5243685 - DNA, 22 bp, Homo sapiens
atagatacccaattgtttcagt

SEQ ID NO: 5243686 - DNA, 21 bp, Homo sapiens
atagataccctacgctgtcca

SEQ ID NO: 5243687 - DNA, 16 bp, Homo sapiens
atagatacttttgata

SEQ ID NO: 5243688 - DNA, 14 bp, Homo sapiens
atagatataaagcc

SEQ ID NO: 5243689 - DNA, 17 bp, Homo sapiens
atagatataaagccatt

SEQ ID NO: 5243690 - DNA, 14 bp, Homo sapiens
atagatataaagga

SEQ ID NO: 5243691 - DNA, 14 bp, Homo sapiens
atagatataaatat

SEQ ID NO: 5243692 - DNA, 13 bp, Homo sapiens
atagatataatga

SEQ ID NO: 5243693 - DNA, 19 bp, Homo sapiens
atagatatctatattttta

SEQ ID NO: 5243694 - DNA, 15 bp, Homo sapiens
atagatattggaaga

SEQ ID NO: 5243695 - DNA, 13 bp, Homo sapiens
atagatattttca

SEQ ID NO: 5243696 - DNA, 15 bp, Homo sapiens
atagatcacataaca

SEQ ID NO: 5243697 - DNA, 17 bp, Homo sapiens
atagatcacataacaga

SEQ ID NO: 5243698 - DNA, 21 bp, Homo sapiens
atagatcagcatccaaaagca

SEQ ID NO: 5243699 - DNA, 21 bp, Homo sapiens
atagatcagccattaaaataa

SEQ ID NO: 5243700 - DNA, 15 bp, Homo sapiens
atagatcagtatttc

SEQ ID NO: 5243701 - DNA, 14 bp, Homo sapiens
atagatcatttcta

SEQ ID NO: 5243702 - DNA, 15 bp, Homo sapiens
atagatcatttctag

SEQ ID NO: 5243703 - DNA, 22 bp, Homo sapiens
atagatccatttggacaaaatg

SEQ ID NO: 5243704 - DNA, 20 bp, Homo sapiens
atagatcccacgttgatgtc

SEQ ID NO: 5243705 - DNA, 15 bp, Homo sapiens
atagatcccccagac

SEQ ID NO: 5243706 - DNA, 23 bp, Homo sapiens
atagatcctctgatatacaatta

SEQ ID NO: 5243707 - DNA, 15 bp, Homo sapiens
atagatcctgagctc

SEQ ID NO: 5243708 - DNA, 21 bp, Homo sapiens
atagatctgatggtgagctgg

SEQ ID NO: 5243709 - DNA, 18 bp, Homo sapiens
atagatgaactttttaac

SEQ ID NO: 5243710 - DNA, 16 bp, Homo sapiens
atagatgactttgcag

SEQ ID NO: 5243711 - DNA, 22 bp, Homo sapiens
atagatgatggtatgattctat

SEQ ID NO: 5243712 - DNA, 19 bp, Homo sapiens
atagatgcaagatatttat

SEQ ID NO: 5243713 - DNA, 21 bp, Homo sapiens
atagatgcaagatatttatat

SEQ ID NO: 5243714 - DNA, 18 bp, Homo sapiens
atagatgcctcttaggac

SEQ ID NO: 5243715 - DNA, 17 bp, Homo sapiens
atagatgctggcccagg

SEQ ID NO: 5243716 - DNA, 23 bp, Homo sapiens
atagatgctggcccagggcccag

SEQ ID NO: 5243717 - DNA, 13 bp, Homo sapiens
atagatgggtctg

SEQ ID NO: 5243718 - DNA, 14 bp, Homo sapiens
atagatggtagaaa

SEQ ID NO: 5243719 - DNA, 21 bp, Homo sapiens
atagatgtaatttttcaaaat

SEQ ID NO: 5243720 - DNA, 18 bp, Homo sapiens
atagatgtctaggtactt

SEQ ID NO: 5243721 - DNA, 17 bp, Homo sapiens
atagatgtctgtgtata

SEQ ID NO: 5243722 - DNA, 19 bp, Homo sapiens
atagatgtctgtgtataca

SEQ ID NO: 5243723 - DNA, 13 bp, Homo sapiens
atagatgtctttt

SEQ ID NO: 5243724 - DNA, 17 bp, Homo sapiens
atagatgtcttttatag

SEQ ID NO: 5243725 - DNA, 20 bp, Homo sapiens
atagatgtcttttatagtgg

SEQ ID NO: 5243726 - DNA, 17 bp, Homo sapiens
atagatgtcttttccca

SEQ ID NO: 5243727 - DNA, 14 bp, Homo sapiens
atagatgtgaaaat

SEQ ID NO: 5243728 - DNA, 17 bp, Homo sapiens
atagatgtgaaaatgct

SEQ ID NO: 5243729 - DNA, 18 bp, Homo sapiens
atagatgtgaaaatgctt

SEQ ID NO: 5243730 - DNA, 13 bp, Homo sapiens
atagatgtgcaag

SEQ ID NO: 5243731 - DNA, 12 bp, Homo sapiens
atagatgtgtgg

SEQ ID NO: 5243732 - DNA, 21 bp, Homo sapiens
atagatgttgctctttcacct

SEQ ID NO: 5243733 - DNA, 21 bp, Homo sapiens
atagatgtttgactttaaaga

SEQ ID NO: 5243734 - DNA, 19 bp, Homo sapiens
atagatgttttaacttatt

SEQ ID NO: 5243735 - DNA, 12 bp, Homo sapiens
atcagacctctg

SEQ ID NO: 5243736 - DNA, 18 bp, Homo sapiens
atcagacctctgatccct

SEQ ID NO: 5243737 - DNA, 20 bp, Homo sapiens
atcagactaagccagcaccg

SEQ ID NO: 5243738 - DNA, 22 bp, Homo sapiens
atcagactagtgacaagctcct

SEQ ID NO: 5243739 - DNA, 14 bp, Homo sapiens
atcagacttgattt

SEQ ID NO: 5243740 - DNA, 15 bp, Homo sapiens
atcagacttgattta

SEQ ID NO: 5243741 - DNA, 19 bp, Homo sapiens
atcagacttgatttacaag

SEQ ID NO: 5243742 - DNA, 16 bp, Homo sapiens
atcagagaacagtcat

SEQ ID NO: 5243743 - DNA, 14 bp, Homo sapiens
atcagagaaggaac

SEQ ID NO: 5243744 - DNA, 22 bp, Homo sapiens
atcagagacaaaatatttccca

SEQ ID NO: 5243745 - DNA, 13 bp, Homo sapiens
atcagagaccagg

SEQ ID NO: 5243746 - DNA, 13 bp, Homo sapiens
atcagagagccta

SEQ ID NO: 5243747 - DNA, 15 bp, Homo sapiens
atcagagaggcaagg

SEQ ID NO: 5243748 - DNA, 23 bp, Homo sapiens
atcagagcctttcctcaaaactg

SEQ ID NO: 5243749 - DNA, 17 bp, Homo sapiens
atcagagcgcacaggga

SEQ ID NO: 5243750 - DNA, 13 bp, Homo sapiens
atcagagctcctc

SEQ ID NO: 5243751 - DNA, 20 bp, Homo sapiens
atcagagctcctctgtcctg

SEQ ID NO: 5243752 - DNA, 21 bp, Homo sapiens
atcagagctggcagcctccag

SEQ ID NO: 5243753 - DNA, 22 bp, Homo sapiens
atcagagcttgaacacaggctt

SEQ ID NO: 5243754 - DNA, 22 bp, Homo sapiens
atcagaggcatttgagcagctg

SEQ ID NO: 5243755 - DNA, 15 bp, Homo sapiens
atcagaggcctataa

SEQ ID NO: 5243756 - DNA, 17 bp, Homo sapiens
atcagaggctgggggag

SEQ ID NO: 5243757 - DNA, 16 bp, Homo sapiens
atcagagggtggagat

SEQ ID NO: 5243758 - DNA, 14 bp, Homo sapiens
atcagaggtgtaca

SEQ ID NO: 5243759 - DNA, 22 bp, Homo sapiens
atcagaggtttgcttcctcagt

SEQ ID NO: 5243760 - DNA, 21 bp, Homo sapiens
atcagagtaacgagaagacaa

SEQ ID NO: 5243761 - DNA, 21 bp, Homo sapiens
atcagagtagaaataaaagtg

SEQ ID NO: 5243762 - DNA, 18 bp, Homo sapiens
atcagagtgcattagaaa

SEQ ID NO: 5243763 - DNA, 19 bp, Homo sapiens
atcagagtgtatttttgta

SEQ ID NO: 5243764 - DNA, 15 bp, Homo sapiens
atcagataacaactg

SEQ ID NO: 5243765 - DNA, 13 bp, Homo sapiens
atcagatacatca

SEQ ID NO: 5243766 - DNA, 17 bp, Homo sapiens
atcagatacatcactgc

SEQ ID NO: 5243767 - DNA, 20 bp, Homo sapiens
atcagatatgcttactaaat

SEQ ID NO: 5243768 - DNA, 15 bp, Homo sapiens
atcagatatttctta

SEQ ID NO: 5243769 - DNA, 21 bp, Homo sapiens
atcagatctggggcagcaccc

SEQ ID NO: 5243770 - DNA, 23 bp, Homo sapiens
atcagatgaactcttagaaatga

SEQ ID NO: 5243771 - DNA, 14 bp, Homo sapiens
atcagatgaattga

SEQ ID NO: 5243772 - DNA, 12 bp, Homo sapiens
atcagatgacaa

SEQ ID NO: 5243773 - DNA, 23 bp, Homo sapiens
atcagatgactagaaagtgaata

SEQ ID NO: 5243774 - DNA, 20 bp, Homo sapiens
atcagatgctccaagattct

SEQ ID NO: 5243775 - DNA, 21 bp, Homo sapiens
atcagatgctgaattgagaat

SEQ ID NO: 5243776 - DNA, 14 bp, Homo sapiens
atcagatgctggtg

SEQ ID NO: 5243777 - DNA, 21 bp, Homo sapiens
atcagatggaaatattttgat

SEQ ID NO: 5243778 - DNA, 22 bp, Homo sapiens
atcagatggaaatattttgata

SEQ ID NO: 5243779 - DNA, 23 bp, Homo sapiens
atcagatggaaatattttgataa

SEQ ID NO: 5243780 - DNA, 16 bp, Homo sapiens
atcagatggtgtcatt

SEQ ID NO: 5243781 - DNA, 17 bp, Homo sapiens
atcagatggtgtcattt

SEQ ID NO: 5243782 - DNA, 18 bp, Homo sapiens
atcagatgtgtgttctca

SEQ ID NO: 5243783 - DNA, 19 bp, Homo sapiens
atcagatgtgttcctccat

SEQ ID NO: 5243784 - DNA, 21 bp, Homo sapiens
atcagatgttttggtcaagta

SEQ ID NO: 5243785 - DNA, 16 bp, Homo sapiens
atcagattagaccagt

SEQ ID NO: 5243786 - DNA, 15 bp, Homo sapiens
atcagattgcatgtg

SEQ ID NO: 5243787 - DNA, 16 bp, Homo sapiens
atcagattgcatgtga

SEQ ID NO: 5243788 - DNA, 18 bp, Homo sapiens
atcagattgcatgtgact

SEQ ID NO: 5243789 - DNA, 19 bp, Homo sapiens
atcagattgcttttgtgca

SEQ ID NO: 5243790 - DNA, 19 bp, Homo sapiens
atcagattgttaagggcat

SEQ ID NO: 5243791 - DNA, 13 bp, Homo sapiens
atcagatttctta

SEQ ID NO: 5243792 - DNA, 17 bp, Homo sapiens
atcagattttaacagct

SEQ ID NO: 5243793 - DNA, 17 bp, Homo sapiens
atcagattttctcctgt

SEQ ID NO: 5243794 - DNA, 12 bp, Homo sapiens
atcagcaaaaaa

SEQ ID NO: 5243795 - DNA, 15 bp, Homo sapiens
atcagcaaacacaat

SEQ ID NO: 5243796 - DNA, 19 bp, Homo sapiens
atcagcaaatttaagagaa

SEQ ID NO: 5243797 - DNA, 16 bp, Homo sapiens
atcagcaatgccccaa

SEQ ID NO: 5243798 - DNA, 22 bp, Homo sapiens
atcagcacagataaaaagtgga

SEQ ID NO: 5243799 - DNA, 14 bp, Homo sapiens
atcagcaccccagt

SEQ ID NO: 5243800 - DNA, 16 bp, Homo sapiens
atcagcacgatttctg

SEQ ID NO: 5243801 - DNA, 19 bp, Homo sapiens
atcagcacgatttctgttt

SEQ ID NO: 5243802 - DNA, 23 bp, Homo sapiens
atcagcacgatttctgtttagat

SEQ ID NO: 5243803 - DNA, 17 bp, Homo sapiens
atcagcagaacctgtag

SEQ ID NO: 5243804 - DNA, 14 bp, Homo sapiens
atcagcagcaacaa

SEQ ID NO: 5243805 - DNA, 19 bp, Homo sapiens
atcagcagcggcagcagca

SEQ ID NO: 5243806 - DNA, 19 bp, Homo sapiens
atcagcaggctccagttga

SEQ ID NO: 5243807 - DNA, 12 bp, Homo sapiens
atcagcagtgat

SEQ ID NO: 5243808 - DNA, 15 bp, Homo sapiens
atcagcagtgattga

SEQ ID NO: 5243809 - DNA, 16 bp, Homo sapiens
atcagcagtggcagga

SEQ ID NO: 5243810 - DNA, 20 bp, Homo sapiens
atcagcatctgacaggtgaa

SEQ ID NO: 5243811 - DNA, 15 bp, Homo sapiens
atcagcatgacaaaa

SEQ ID NO: 5243812 - DNA, 17 bp, Homo sapiens
atcagcatgacaaaaat

SEQ ID NO: 5243813 - DNA, 21 bp, Homo sapiens
atcagcatgacaaaaataaca

SEQ ID NO: 5243814 - DNA, 22 bp, Homo sapiens
atcagcatgacaaaaataacac

SEQ ID NO: 5243815 - DNA, 13 bp, Homo sapiens
atcagcatgcctg

SEQ ID NO: 5243816 - DNA, 21 bp, Homo sapiens
atcagcatgcctgtcctttca

SEQ ID NO: 5243817 - DNA, 14 bp, Homo sapiens
atcagcatgttttc

SEQ ID NO: 5243818 - DNA, 20 bp, Homo sapiens
atcagcattagagaaatgaa

SEQ ID NO: 5243819 - DNA, 14 bp, Homo sapiens
atcagcattcaaaa

SEQ ID NO: 5243820 - DNA, 22 bp, Homo sapiens
atcagcattcaaaatagttcta

SEQ ID NO: 5243821 - DNA, 17 bp, Homo sapiens
atcagcattgtgacttg

SEQ ID NO: 5243822 - DNA, 15 bp, Homo sapiens
atcagcattgtttca

SEQ ID NO: 5243823 - DNA, 22 bp, Homo sapiens
atcagcattttagaaactacaa

SEQ ID NO: 5243824 - DNA, 19 bp, Homo sapiens
atcagccaagttttataat

SEQ ID NO: 5243825 - DNA, 16 bp, Homo sapiens
atcagccaattatgtt

SEQ ID NO: 5243826 - DNA, 16 bp, Homo sapiens
atcagccagccttccc

SEQ ID NO: 5243827 - DNA, 12 bp, Homo sapiens
atcagccagctg

SEQ ID NO: 5243828 - DNA, 13 bp, Homo sapiens
atcagccagctgc

SEQ ID NO: 5243829 - DNA, 17 bp, Homo sapiens
atcagccagtgaatctg

SEQ ID NO: 5243830 - DNA, 13 bp, Homo sapiens
atcagccagtgac

SEQ ID NO: 5243831 - DNA, 14 bp, Homo sapiens
atcagccatgtttg

SEQ ID NO: 5243832 - DNA, 16 bp, Homo sapiens
atcagccatttgccat

SEQ ID NO: 5243833 - DNA, 20 bp, Homo sapiens
atcagcccaatccctgatcc

SEQ ID NO: 5243834 - DNA, 16 bp, Homo sapiens
atcagccccaccctgg

SEQ ID NO: 5243835 - DNA, 22 bp, Homo sapiens
atcagccccagagtgctttaaa

SEQ ID NO: 5243836 - DNA, 19 bp, Homo sapiens
atcagccccgcctgtcaca

SEQ ID NO: 5243837 - DNA, 20 bp, Homo sapiens
atcagccccgcctgtcacaa

SEQ ID NO: 5243838 - DNA, 21 bp, Homo sapiens
atcagccccgcctgtcacaat

SEQ ID NO: 5243839 - DNA, 23 bp, Homo sapiens
atcagccccgctcctcccctctt

SEQ ID NO: 5243840 - DNA, 18 bp, Homo sapiens
atcagcccctcaaaggga

SEQ ID NO: 5243841 - DNA, 13 bp, Homo sapiens
atcagcccctgct

SEQ ID NO: 5243842 - DNA, 14 bp, Homo sapiens
atcagcccctgctg

SEQ ID NO: 5243843 - DNA, 17 bp, Homo sapiens
atcagcccctgctgctc

SEQ ID NO: 5243844 - DNA, 23 bp, Homo sapiens
atcagcccctgggaacaggcccc

SEQ ID NO: 5243845 - DNA, 16 bp, Homo sapiens
atcagcccttgggggt

SEQ ID NO: 5243846 - DNA, 20 bp, Homo sapiens
atcagcctccgccattccaa

SEQ ID NO: 5243847 - DNA, 16 bp, Homo sapiens
atcagcctctggccag

SEQ ID NO: 5243848 - DNA, 12 bp, Homo sapiens
atcagcctgagt

SEQ ID NO: 5243849 - DNA, 17 bp, Homo sapiens
atcagcctgagtctcct

SEQ ID NO: 5243850 - DNA, 19 bp, Homo sapiens
atcagcctgagtctcctgt

SEQ ID NO: 5243851 - DNA, 20 bp, Homo sapiens
atcagcctgagtctcctgtg

SEQ ID NO: 5243852 - DNA, 17 bp, Homo sapiens
atcagcctgctccagct

SEQ ID NO: 5243853 - DNA, 20 bp, Homo sapiens
atcagcctgggcaatgtgat

SEQ ID NO: 5243854 - DNA, 20 bp, Homo sapiens
atcagcctggggcctgggga

SEQ ID NO: 5243855 - DNA, 19 bp, Homo sapiens
atcagcctgtctcttccat

SEQ ID NO: 5243856 - DNA, 23 bp, Homo sapiens
atcagccttttatgtattttcca

SEQ ID NO: 5243857 - DNA, 17 bp, Homo sapiens
atcagcgggtctcctcc

SEQ ID NO: 5243858 - DNA, 20 bp, Homo sapiens
atcagcgggtctcctcccag

SEQ ID NO: 5243859 - DNA, 21 bp, Homo sapiens
atcagcgggtctcctcccagc

SEQ ID NO: 5243860 - DNA, 16 bp, Homo sapiens
atcagcgtggccttgt

SEQ ID NO: 5243861 - DNA, 19 bp, Homo sapiens
atcagctacttaagagaaa

SEQ ID NO: 5243862 - DNA, 20 bp, Homo sapiens
atcagctacttaagagaaat

SEQ ID NO: 5243863 - DNA, 22 bp, Homo sapiens
atcagctacttaagagaaatgg

SEQ ID NO: 5243864 - DNA, 13 bp, Homo sapiens
atcagctagattt

SEQ ID NO: 5243865 - DNA, 14 bp, Homo sapiens
atcagctatatact

SEQ ID NO: 5243866 - DNA, 14 bp, Homo sapiens
atcagctatttact

SEQ ID NO: 5243867 - DNA, 13 bp, Homo sapiens
atcagctcccaac

SEQ ID NO: 5243868 - DNA, 11 bp, Homo sapiens
atcagctccct

SEQ ID NO: 5243869 - DNA, 14 bp, Homo sapiens
atcagctctaaagc

SEQ ID NO: 5243870 - DNA, 16 bp, Homo sapiens
atcagctctctgcaga

SEQ ID NO: 5243871 - DNA, 15 bp, Homo sapiens
atcagctctctgctg

SEQ ID NO: 5243872 - DNA, 22 bp, Homo sapiens
atcagctctgcataagattata

SEQ ID NO: 5243873 - DNA, 13 bp, Homo sapiens
atcagctctgcct

SEQ ID NO: 5243874 - DNA, 18 bp, Homo sapiens
atcagctgaattcactta

SEQ ID NO: 5243875 - DNA, 12 bp, Homo sapiens
atcagctgctac

SEQ ID NO: 5243876 - DNA, 23 bp, Homo sapiens
atcagctgctactactcctgtag

SEQ ID NO: 5243877 - DNA, 21 bp, Homo sapiens
atcagctgctgaaacaacaaa

SEQ ID NO: 5243878 - DNA, 23 bp, Homo sapiens
atcagctgctgaaacaacaaata

SEQ ID NO: 5243879 - DNA, 13 bp, Homo sapiens
atcagctgctgac

SEQ ID NO: 5243880 - DNA, 13 bp, Homo sapiens
atcagctgctttg

SEQ ID NO: 5243881 - DNA, 13 bp, Homo sapiens
atcagctggacat

SEQ ID NO: 5243882 - DNA, 14 bp, Homo sapiens
atcagctgggcagt

SEQ ID NO: 5243883 - DNA, 13 bp, Homo sapiens
atcagcttattgt

SEQ ID NO: 5243884 - DNA, 12 bp, Homo sapiens
atcagctttata

SEQ ID NO: 5243885 - DNA, 20 bp, Homo sapiens
atcagctttataataaactg

SEQ ID NO: 5243886 - DNA, 21 bp, Homo sapiens
atcagctttataataaactgt

SEQ ID NO: 5243887 - DNA, 22 bp, Homo sapiens
atcagctttataataaactgtt

SEQ ID NO: 5243888 - DNA, 16 bp, Homo sapiens
atcagctttccctggc

SEQ ID NO: 5243889 - DNA, 19 bp, Homo sapiens
atcagctttccctggctca

SEQ ID NO: 5243890 - DNA, 19 bp, Homo sapiens
atcagcttttaataaaatt

SEQ ID NO: 5243891 - DNA, 19 bp, Homo sapiens
atcagcttttgttctagac

SEQ ID NO: 5243892 - DNA, 20 bp, Homo sapiens
atcagcttttgttctagact

SEQ ID NO: 5243893 - DNA, 22 bp, Homo sapiens
atcagctttttgtattaacaaa

SEQ ID NO: 5243894 - DNA, 23 bp, Homo sapiens
atcagctttttgtattaacaaag

SEQ ID NO: 5243895 - DNA, 14 bp, Homo sapiens
atcaggaaaggctg

SEQ ID NO: 5243896 - DNA, 16 bp, Homo sapiens
atcaggaaaggctgta

SEQ ID NO: 5243897 - DNA, 23 bp, Homo sapiens
atcaggaaaggctgtagaaggaa

SEQ ID NO: 5243898 - DNA, 14 bp, Homo sapiens
atcaggaaccaggg

SEQ ID NO: 5243899 - DNA, 13 bp, Homo sapiens
atcaggaacgttt

SEQ ID NO: 5243900 - DNA, 14 bp, Homo sapiens
atcaggaagcctgt

SEQ ID NO: 5243901 - DNA, 22 bp, Homo sapiens
atcaggaaggtaaaaacccagc

SEQ ID NO: 5243902 - DNA, 17 bp, Homo sapiens
atcaggaatataaatat

SEQ ID NO: 5243903 - DNA, 17 bp, Homo sapiens
atcaggaatgagtcaat

SEQ ID NO: 5243904 - DNA, 18 bp, Homo sapiens
atcaggacccagaggaag

SEQ ID NO: 5243905 - DNA, 21 bp, Homo sapiens
atcaggactgtgaccaaagca

SEQ ID NO: 5243906 - DNA, 22 bp, Homo sapiens
atcaggagactgggctctggct

SEQ ID NO: 5243907 - DNA, 20 bp, Homo sapiens
atcaggagcccccaacacag

SEQ ID NO: 5243908 - DNA, 15 bp, Homo sapiens
atcaggagcctgcta

SEQ ID NO: 5243909 - DNA, 18 bp, Homo sapiens
atcaggaggagattaaca

SEQ ID NO: 5243910 - DNA, 17 bp, Homo sapiens
atcaggagttccagtgc

SEQ ID NO: 5243911 - DNA, 19 bp, Homo sapiens
atcaggataccagaggaag

SEQ ID NO: 5243912 - DNA, 16 bp, Homo sapiens
atcaggatcagctttg

SEQ ID NO: 5243913 - DNA, 15 bp, Homo sapiens
atcaggattccttct

SEQ ID NO: 5243914 - DNA, 13 bp, Homo sapiens
atcaggattttaa

SEQ ID NO: 5243915 - DNA, 15 bp, Homo sapiens
atcaggattttaaac

SEQ ID NO: 5243916 - DNA, 16 bp, Homo sapiens
atcaggcacaggcagg

SEQ ID NO: 5243917 - DNA, 15 bp, Homo sapiens
atcaggcacaggtca

SEQ ID NO: 5243918 - DNA, 13 bp, Homo sapiens
atcaggcactggt

SEQ ID NO: 5243919 - DNA, 17 bp, Homo sapiens
atcaggcactggtggca

SEQ ID NO: 5243920 - DNA, 22 bp, Homo sapiens
atcaggcagataactgctgtat

SEQ ID NO: 5243921 - DNA, 21 bp, Homo sapiens
atcaggcatgtgtcccttcca

SEQ ID NO: 5243922 - DNA, 15 bp, Homo sapiens
atcaggccaggccct

SEQ ID NO: 5243923 - DNA, 20 bp, Homo sapiens
atcaggccaggccctctgcc

SEQ ID NO: 5243924 - DNA, 22 bp, Homo sapiens
atcaggccaggccctctgccca

SEQ ID NO: 5243925 - DNA, 23 bp, Homo sapiens
atcaggccaggccctctgcccac

SEQ ID NO: 5243926 - DNA, 16 bp, Homo sapiens
atcaggccattgtccc

SEQ ID NO: 5243927 - DNA, 20 bp, Homo sapiens
atcaggctaagaccctgtgt

SEQ ID NO: 5243928 - DNA, 16 bp, Homo sapiens
atcaggctactagaat

SEQ ID NO: 5243929 - DNA, 13 bp, Homo sapiens
atcaggctagccc

SEQ ID NO: 5243930 - DNA, 20 bp, Homo sapiens
atcaggctagccctgccctc

SEQ ID NO: 5243931 - DNA, 16 bp, Homo sapiens
atcaggctctgcctca

SEQ ID NO: 5243932 - DNA, 15 bp, Homo sapiens
atcaggcttcctggt

SEQ ID NO: 5243933 - DNA, 19 bp, Homo sapiens
atcaggcttcctggtgaga

SEQ ID NO: 5243934 - DNA, 22 bp, Homo sapiens
atcaggcttcctggtgagaact

SEQ ID NO: 5243935 - DNA, 17 bp, Homo sapiens
atcaggcttggaatgaa

SEQ ID NO: 5243936 - DNA, 21 bp, Homo sapiens
atcaggctttccttgttttga

SEQ ID NO: 5243937 - DNA, 22 bp, Homo sapiens
atcaggctttcttaaagtgaga

SEQ ID NO: 5243938 - DNA, 22 bp, Homo sapiens
atcaggctttcttttttttctt

SEQ ID NO: 5243939 - DNA, 14 bp, Homo sapiens
atcagggaatccag

SEQ ID NO: 5243940 - DNA, 18 bp, Homo sapiens
atcagggaggtcattttg

SEQ ID NO: 5243941 - DNA, 16 bp, Homo sapiens
atcagggatctcagag

SEQ ID NO: 5243942 - DNA, 19 bp, Homo sapiens
atcagggcattgcctgtga

SEQ ID NO: 5243943 - DNA, 15 bp, Homo sapiens
atcagggccctgccc

SEQ ID NO: 5243944 - DNA, 20 bp, Homo sapiens
atcagggccctgccccaggc

SEQ ID NO: 5243945 - DNA, 20 bp, Homo sapiens
atcagggcctgccccctggg

SEQ ID NO: 5243946 - DNA, 22 bp, Homo sapiens
atcagggcctgccccctgggga

SEQ ID NO: 5243947 - DNA, 15 bp, Homo sapiens
atcagggcctggggc

SEQ ID NO: 5243948 - DNA, 17 bp, Homo sapiens
atcagggcctggggcct

SEQ ID NO: 5243949 - DNA, 19 bp, Homo sapiens
atcagggcctggggcctga

SEQ ID NO: 5243950 - DNA, 24 bp, Homo sapiens
atcagggcctggggcctgagagaa

SEQ ID NO: 5243951 - DNA, 18 bp, Homo sapiens
atcagggcctttctcctc

SEQ ID NO: 5243952 - DNA, 18 bp, Homo sapiens
atcagggcggcctcccag

SEQ ID NO: 5243953 - DNA, 20 bp, Homo sapiens
atcagggcggcctcccaggt

SEQ ID NO: 5243954 - DNA, 19 bp, Homo sapiens
atcaggggacaaaccaggg

SEQ ID NO: 5243955 - DNA, 21 bp, Homo sapiens
atcaggggatgtacatctctc

SEQ ID NO: 5243956 - DNA, 12 bp, Homo sapiens
atcaggggccag

SEQ ID NO: 5243957 - DNA, 14 bp, Homo sapiens
atcaggggccagag

SEQ ID NO: 5243958 - DNA, 16 bp, Homo sapiens
atcaggggccagagag

SEQ ID NO: 5243959 - DNA, 23 bp, Homo sapiens
atcagggggaagaagcagagaga

SEQ ID NO: 5243960 - DNA, 20 bp, Homo sapiens
atcaggggtaggaatggaaa

SEQ ID NO: 5243961 - DNA, 18 bp, Homo sapiens
atcagggtagcagcagag

SEQ ID NO: 5243962 - DNA, 23 bp, Homo sapiens
atcaggtaactaactgcatacac

SEQ ID NO: 5243963 - DNA, 21 bp, Homo sapiens
atcaggtcagggacttggaca

SEQ ID NO: 5243964 - DNA, 20 bp, Homo sapiens
atcaggtcctcagagaattt

SEQ ID NO: 5243965 - DNA, 19 bp, Homo sapiens
atcaggtgatccacctgcc

SEQ ID NO: 5243966 - DNA, 13 bp, Homo sapiens
atcaggtgcaggt

SEQ ID NO: 5243967 - DNA, 20 bp, Homo sapiens
atcaggtgcccatccctgga

SEQ ID NO: 5243968 - DNA, 18 bp, Homo sapiens
atcaggtgtataaatgta

SEQ ID NO: 5243969 - DNA, 17 bp, Homo sapiens
atcaggtgtgctcaggg

SEQ ID NO: 5243970 - DNA, 17 bp, Homo sapiens
atcaggttaggcagtat

SEQ ID NO: 5243971 - DNA, 22 bp, Homo sapiens
atcaggttaggcagtataaaga

SEQ ID NO: 5243972 - DNA, 14 bp, Homo sapiens
atcaggttgcaaaa

SEQ ID NO: 5243973 - DNA, 17 bp, Homo sapiens
atcaggttgttaatgtt

SEQ ID NO: 5243974 - DNA, 13 bp, Homo sapiens
atcaggtttccaa

SEQ ID NO: 5243975 - DNA, 14 bp, Homo sapiens
atcaggtttttccc

SEQ ID NO: 5243976 - DNA, 13 bp, Homo sapiens
atcagtaaaatta

SEQ ID NO: 5243977 - DNA, 17 bp, Homo sapiens
atcagtaaaattatact

SEQ ID NO: 5243978 - DNA, 19 bp, Homo sapiens
atcagtaaaattatactgt

SEQ ID NO: 5243979 - DNA, 18 bp, Homo sapiens
atcagtaaatagtgtcat

SEQ ID NO: 5243980 - DNA, 23 bp, Homo sapiens
atcagtaagaggtgttatttgga

SEQ ID NO: 5243981 - DNA, 13 bp, Homo sapiens
atcagtacaattc

SEQ ID NO: 5243982 - DNA, 20 bp, Homo sapiens
atcagtacatgagccaaaaa

SEQ ID NO: 5243983 - DNA, 15 bp, Homo sapiens
atcagtaccatttga

SEQ ID NO: 5243984 - DNA, 13 bp, Homo sapiens
atcagtagaaaga

SEQ ID NO: 5243985 - DNA, 14 bp, Homo sapiens
atcagtagaaagag

SEQ ID NO: 5243986 - DNA, 16 bp, Homo sapiens
atcagtaggaccaggc

SEQ ID NO: 5243987 - DNA, 16 bp, Homo sapiens
atcagtaggatatact

SEQ ID NO: 5243988 - DNA, 15 bp, Homo sapiens
atcagtatatttggt

SEQ ID NO: 5243989 - DNA, 20 bp, Homo sapiens
atcagtatattttctgtatt

SEQ ID NO: 5243990 - DNA, 23 bp, Homo sapiens
atcagtatattttctgtatttaa

SEQ ID NO: 5243991 - DNA, 20 bp, Homo sapiens
atcagtatcacgatttgcag

SEQ ID NO: 5243992 - DNA, 21 bp, Homo sapiens
atcagtatgctgttttaataa

SEQ ID NO: 5243993 - DNA, 18 bp, Homo sapiens
atcagtatggtgctaatg

SEQ ID NO: 5243994 - DNA, 17 bp, Homo sapiens
atcagtattaatactaa

SEQ ID NO: 5243995 - DNA, 13 bp, Homo sapiens
atcagtattctga

SEQ ID NO: 5243996 - DNA, 22 bp, Homo sapiens
atcagtattgaagcattttata

SEQ ID NO: 5243997 - DNA, 15 bp, Homo sapiens
atcagtatttccttc

SEQ ID NO: 5243998 - DNA, 18 bp, Homo sapiens
atcagtatttccttccac

SEQ ID NO: 5243999 - DNA, 19 bp, Homo sapiens
atcagtatttccttccact

SEQ ID NO: 5244000 - DNA, 21 bp, Homo sapiens
atcagtatttccttccactgt

SEQ ID NO: 5244001 - DNA, 21 bp, Homo sapiens
atcagtatttttttttaattt

SEQ ID NO: 5244002 - DNA, 19 bp, Homo sapiens
atcagtcataactaaataa

SEQ ID NO: 5244003 - DNA, 19 bp, Homo sapiens
atcagtcatgaggaaagac

SEQ ID NO: 5244004 - DNA, 17 bp, Homo sapiens
atcagtccaactgaacg

SEQ ID NO: 5244005 - DNA, 22 bp, Homo sapiens
atcagtccacccccattgtgaa

SEQ ID NO: 5244006 - DNA, 23 bp, Homo sapiens
atcagtcccctcccatctgggag

SEQ ID NO: 5244007 - DNA, 16 bp, Homo sapiens
atcagtcctagaatgt

SEQ ID NO: 5244008 - DNA, 21 bp, Homo sapiens
atcagtcctagaatgtttcat

SEQ ID NO: 5244009 - DNA, 23 bp, Homo sapiens
atcagtcctagaatgtttcattt

SEQ ID NO: 5244010 - DNA, 14 bp, Homo sapiens
atcagtcctttgat

SEQ ID NO: 5244011 - DNA, 17 bp, Homo sapiens
atcagtcgttttagtgt

SEQ ID NO: 5244012 - DNA, 18 bp, Homo sapiens
atcagtcgttttagtgtc

SEQ ID NO: 5244013 - DNA, 22 bp, Homo sapiens
atcagtcgttttagtgtctgac

SEQ ID NO: 5244014 - DNA, 21 bp, Homo sapiens
atcagtcttaatattcagaga

SEQ ID NO: 5244015 - DNA, 15 bp, Homo sapiens
atcagtctttgtcaa

SEQ ID NO: 5244016 - DNA, 23 bp, Homo sapiens
atcagtctttgtcaatgctctaa

SEQ ID NO: 5244017 - DNA, 15 bp, Homo sapiens
atcagtgaatataaa

SEQ ID NO: 5244018 - DNA, 20 bp, Homo sapiens
atcagtgaatataaatgtac

SEQ ID NO: 5244019 - DNA, 17 bp, Homo sapiens
atcagtgacttctgaat

SEQ ID NO: 5244020 - DNA, 22 bp, Homo sapiens
atcagtgagctcaggagagagc

SEQ ID NO: 5244021 - DNA, 12 bp, Homo sapiens
atcagtgaggag

SEQ ID NO: 5244022 - DNA, 17 bp, Homo sapiens
atcagtgaggagggatg

SEQ ID NO: 5244023 - DNA, 15 bp, Homo sapiens
atcagtgatctatgt

SEQ ID NO: 5244024 - DNA, 19 bp, Homo sapiens
atcagtgatctatgtttgt

SEQ ID NO: 5244025 - DNA, 18 bp, Homo sapiens
atcagtgattatttttcc

SEQ ID NO: 5244026 - DNA, 19 bp, Homo sapiens
atcagtgattatttttcca

SEQ ID NO: 5244027 - DNA, 19 bp, Homo sapiens
atcagtgattttcaaacct

SEQ ID NO: 5244028 - DNA, 19 bp, Homo sapiens
atcagtgccagcccctgct

SEQ ID NO: 5244029 - DNA, 20 bp, Homo sapiens
atcagtgctcgagacacagt

SEQ ID NO: 5244030 - DNA, 17 bp, Homo sapiens
atcagtgctctgtaaaa

SEQ ID NO: 5244031 - DNA, 22 bp, Homo sapiens
atcagtgctctgtaaaacacac

SEQ ID NO: 5244032 - DNA, 13 bp, Homo sapiens
atcagtggagcca

SEQ ID NO: 5244033 - DNA, 18 bp, Homo sapiens
atcagtggatttcccatc

SEQ ID NO: 5244034 - DNA, 19 bp, Homo sapiens
atcagtggtgttacatttt

SEQ ID NO: 5244035 - DNA, 19 bp, Homo sapiens
atcagtggttatttaggga

SEQ ID NO: 5244036 - DNA, 21 bp, Homo sapiens
atcagtggttcgggggaaata

SEQ ID NO: 5244037 - DNA, 15 bp, Homo sapiens
atcagtgtgctaacc

SEQ ID NO: 5244038 - DNA, 14 bp, Homo sapiens
atcagtgtgtaaat

SEQ ID NO: 5244039 - DNA, 22 bp, Homo sapiens
atcagtgtgtaaataatttgca

SEQ ID NO: 5244040 - DNA, 17 bp, Homo sapiens
atcagtgttaaattcat

SEQ ID NO: 5244041 - DNA, 18 bp, Homo sapiens
atcagtgtttaaataaag

SEQ ID NO: 5244042 - DNA, 21 bp, Homo sapiens
atcagtgtttaaataaagacc

SEQ ID NO: 5244043 - DNA, 14 bp, Homo sapiens
atcagtgtttgttg

SEQ ID NO: 5244044 - DNA, 23 bp, Homo sapiens
atcagtgtttgttggatccgttt

SEQ ID NO: 5244045 - DNA, 15 bp, Homo sapiens
atcagttaaaatcac

SEQ ID NO: 5244046 - DNA, 12 bp, Homo sapiens
atcagttaacta

SEQ ID NO: 5244047 - DNA, 18 bp, Homo sapiens
atcagttaactattgcat

SEQ ID NO: 5244048 - DNA, 18 bp, Homo sapiens
atcagttaagaaatttca

SEQ ID NO: 5244049 - DNA, 15 bp, Homo sapiens
atcagttacagtggc

SEQ ID NO: 5244050 - DNA, 17 bp, Homo sapiens
atcagttacagtggcag

SEQ ID NO: 5244051 - DNA, 21 bp, Homo sapiens
atcagttacagtggcagtatt

SEQ ID NO: 5244052 - DNA, 19 bp, Homo sapiens
atcagttaccaaacattac

SEQ ID NO: 5244053 - DNA, 15 bp, Homo sapiens
atcagttactcagcc

SEQ ID NO: 5244054 - DNA, 19 bp, Homo sapiens
atcagttactcagccctgg

SEQ ID NO: 5244055 - DNA, 15 bp, Homo sapiens
atcagttagagctga

SEQ ID NO: 5244056 - DNA, 19 bp, Homo sapiens
atcagttataattattcca

SEQ ID NO: 5244057 - DNA, 22 bp, Homo sapiens
atcagttatacagttataaaat

SEQ ID NO: 5244058 - DNA, 15 bp, Homo sapiens
atcagttatatgata

SEQ ID NO: 5244059 - DNA, 21 bp, Homo sapiens
atcagttatattttgctgttt

SEQ ID NO: 5244060 - DNA, 19 bp, Homo sapiens
atcagttcccccagtacct

SEQ ID NO: 5244061 - DNA, 19 bp, Homo sapiens
atcagttcctttgatctcg

SEQ ID NO: 5244062 - DNA, 15 bp, Homo sapiens
atcagttctgtgtgg

SEQ ID NO: 5244063 - DNA, 22 bp, Homo sapiens
atcagttctgtgtggtgcattc

SEQ ID NO: 5244064 - DNA, 13 bp, Homo sapiens
atcagttgacaga

SEQ ID NO: 5244065 - DNA, 16 bp, Homo sapiens
atcagttgactttaag

SEQ ID NO: 5244066 - DNA, 16 bp, Homo sapiens
atcagttgatttttct

SEQ ID NO: 5244067 - DNA, 21 bp, Homo sapiens
atcagttgcaggtgccaatga

SEQ ID NO: 5244068 - DNA, 22 bp, Homo sapiens
atcagttggacagtaagatttt

SEQ ID NO: 5244069 - DNA, 23 bp, Homo sapiens
atcagttggagtttgtgtctgtt

SEQ ID NO: 5244070 - DNA, 22 bp, Homo sapiens
atcagttgggatccctcctcca

SEQ ID NO: 5244071 - DNA, 14 bp, Homo sapiens
atcagttgtgaata

SEQ ID NO: 5244072 - DNA, 16 bp, Homo sapiens
atcagtttaaaagcac

SEQ ID NO: 5244073 - DNA, 20 bp, Homo sapiens
atcagtttaggccttggctt

SEQ ID NO: 5244074 - DNA, 23 bp, Homo sapiens
atcagtttatcctgacatattca

SEQ ID NO: 5244075 - DNA, 14 bp, Homo sapiens
atcagtttattaaa

SEQ ID NO: 5244076 - DNA, 16 bp, Homo sapiens
atcagtttcatgaaat

SEQ ID NO: 5244077 - DNA, 22 bp, Homo sapiens
atcagtttgatcacactatttt

SEQ ID NO: 5244078 - DNA, 21 bp, Homo sapiens
atcagtttgttccttttgtac

SEQ ID NO: 5244079 - DNA, 22 bp, Homo sapiens
atcagttttggaatctaagctg

SEQ ID NO: 5244080 - DNA, 24 bp, Homo sapiens
atcagttttggaatctaagctgtt

SEQ ID NO: 5244081 - DNA, 20 bp, Homo sapiens
atcagttttgtataacttaa

SEQ ID NO: 5244082 - DNA, 14 bp, Homo sapiens
atcagttttgtgta

SEQ ID NO: 5244083 - DNA, 17 bp, Homo sapiens
atcagttttgtgtacag

SEQ ID NO: 5244084 - DNA, 22 bp, Homo sapiens
atcagttttgtgtacagtatgt

SEQ ID NO: 5244085 - DNA, 23 bp, Homo sapiens
atcagttttgtgtacagtatgtg

SEQ ID NO: 5244086 - DNA, 14 bp, Homo sapiens
atcagtttttgttc

SEQ ID NO: 5244087 - DNA, 15 bp, Homo sapiens
atcataaactggaaa

SEQ ID NO: 5244088 - DNA, 21 bp, Homo sapiens
atagatgttttaacttattta

SEQ ID NO: 5244089 - DNA, 22 bp, Homo sapiens
atagatgttttggtagattaaa

SEQ ID NO: 5244090 - DNA, 14 bp, Homo sapiens
atagattaaatcat

SEQ ID NO: 5244091 - DNA, 13 bp, Homo sapiens
atagattagaatt

SEQ ID NO: 5244092 - DNA, 16 bp, Homo sapiens
atagattagaattctg

SEQ ID NO: 5244093 - DNA, 15 bp, Homo sapiens
atagattaggtttgc

SEQ ID NO: 5244094 - DNA, 20 bp, Homo sapiens
atagattattataaactata

SEQ ID NO: 5244095 - DNA, 21 bp, Homo sapiens
atagattattataaactataa

SEQ ID NO: 5244096 - DNA, 14 bp, Homo sapiens
atagattatttcat

SEQ ID NO: 5244097 - DNA, 15 bp, Homo sapiens
atagattatttcata

SEQ ID NO: 5244098 - DNA, 21 bp, Homo sapiens
atagattatttcatatactat

SEQ ID NO: 5244099 - DNA, 22 bp, Homo sapiens
atagattcacctgtaaaacttt

SEQ ID NO: 5244100 - DNA, 14 bp, Homo sapiens
atagattcagagaa

SEQ ID NO: 5244101 - DNA, 18 bp, Homo sapiens
atagattctaaagattct

SEQ ID NO: 5244102 - DNA, 19 bp, Homo sapiens
atagattgatttacctttg

SEQ ID NO: 5244103 - DNA, 23 bp, Homo sapiens
atagattggagccaccatgccca

SEQ ID NO: 5244104 - DNA, 17 bp, Homo sapiens
atagattgtatctctta

SEQ ID NO: 5244105 - DNA, 21 bp, Homo sapiens
atagattgtccttttgcaaag

SEQ ID NO: 5244106 - DNA, 14 bp, Homo sapiens
atagattgtcttaa

SEQ ID NO: 5244107 - DNA, 19 bp, Homo sapiens
atagattgtgaataatgat

SEQ ID NO: 5244108 - DNA, 22 bp, Homo sapiens
atagatttagtctgttatattt

SEQ ID NO: 5244109 - DNA, 14 bp, Homo sapiens
atagatttatttta

SEQ ID NO: 5244110 - DNA, 20 bp, Homo sapiens
atagatttatttttcagttc

SEQ ID NO: 5244111 - DNA, 21 bp, Homo sapiens
atagatttatttttcagttcc

SEQ ID NO: 5244112 - DNA, 22 bp, Homo sapiens
atagatttatttttcagttcca

SEQ ID NO: 5244113 - DNA, 23 bp, Homo sapiens
atagatttatttttcagttccaa

SEQ ID NO: 5244114 - DNA, 13 bp, Homo sapiens
atagatttgaaaa

SEQ ID NO: 5244115 - DNA, 13 bp, Homo sapiens
atagatttgacct

SEQ ID NO: 5244116 - DNA, 23 bp, Homo sapiens
atagatttgtattttaaaacata

SEQ ID NO: 5244117 - DNA, 17 bp, Homo sapiens
atagattttattatgtt

SEQ ID NO: 5244118 - DNA, 22 bp, Homo sapiens
atagattttctctggaaataaa

SEQ ID NO: 5244119 - DNA, 16 bp, Homo sapiens
atagatttttgattca

SEQ ID NO: 5244120 - DNA, 11 bp, Homo sapiens
atagatttttt

SEQ ID NO: 5244121 - DNA, 15 bp, Homo sapiens
atagcaaaagaagaa

SEQ ID NO: 5244122 - DNA, 16 bp, Homo sapiens
atagcaaaagaagaag

SEQ ID NO: 5244123 - DNA, 15 bp, Homo sapiens
atagcaaaatcaaga

SEQ ID NO: 5244124 - DNA, 14 bp, Homo sapiens
atagcaaactccag

SEQ ID NO: 5244125 - DNA, 14 bp, Homo sapiens
atagcaaagatata

SEQ ID NO: 5244126 - DNA, 19 bp, Homo sapiens
atagcaaatgaaggatgaa

SEQ ID NO: 5244127 - DNA, 16 bp, Homo sapiens
atagcaacaacaattg

SEQ ID NO: 5244128 - DNA, 18 bp, Homo sapiens
atagcaacaacaattggt

SEQ ID NO: 5244129 - DNA, 15 bp, Homo sapiens
atagcaacagagcac

SEQ ID NO: 5244130 - DNA, 22 bp, Homo sapiens
atagcaacctatttgactgctt

SEQ ID NO: 5244131 - DNA, 14 bp, Homo sapiens
atagcaactaatgt

SEQ ID NO: 5244132 - DNA, 17 bp, Homo sapiens
atagcaactaatgtttg

SEQ ID NO: 5244133 - DNA, 23 bp, Homo sapiens
atagcaactaatgtttgaacaaa

SEQ ID NO: 5244134 - DNA, 18 bp, Homo sapiens
atagcaagacctcatctc

SEQ ID NO: 5244135 - DNA, 20 bp, Homo sapiens
atagcaagatattgatcaaa

SEQ ID NO: 5244136 - DNA, 17 bp, Homo sapiens
atagcaaggccagggca

SEQ ID NO: 5244137 - DNA, 23 bp, Homo sapiens
atagcaaggccagggcacagctg

SEQ ID NO: 5244138 - DNA, 13 bp, Homo sapiens
atagcaagtccca

SEQ ID NO: 5244139 - DNA, 15 bp, Homo sapiens
atagcaatacttgga

SEQ ID NO: 5244140 - DNA, 17 bp, Homo sapiens
atagcaatgtaaaaatg

SEQ ID NO: 5244141 - DNA, 12 bp, Homo sapiens
atagcaattaaa

SEQ ID NO: 5244142 - DNA, 16 bp, Homo sapiens
atagcacaagataaat

SEQ ID NO: 5244143 - DNA, 15 bp, Homo sapiens
atagcacagaccctg

SEQ ID NO: 5244144 - DNA, 17 bp, Homo sapiens
atagcacagaccctgcc

SEQ ID NO: 5244145 - DNA, 19 bp, Homo sapiens
atagcacatggcagatttg

SEQ ID NO: 5244146 - DNA, 18 bp, Homo sapiens
atagcacccctactcaca

SEQ ID NO: 5244147 - DNA, 18 bp, Homo sapiens
atagcacccgtggtgcat

SEQ ID NO: 5244148 - DNA, 19 bp, Homo sapiens
atagcactggtttgtttct

SEQ ID NO: 5244149 - DNA, 14 bp, Homo sapiens
atagcactttgaaa

SEQ ID NO: 5244150 - DNA, 19 bp, Homo sapiens
atagcactttgaaatacct

SEQ ID NO: 5244151 - DNA, 21 bp, Homo sapiens
atagcactttgaaatacctca

SEQ ID NO: 5244152 - DNA, 21 bp, Homo sapiens
atagcagaaaaaccaacatct

SEQ ID NO: 5244153 - DNA, 12 bp, Homo sapiens
atagcagaaaga

SEQ ID NO: 5244154 - DNA, 12 bp, Homo sapiens
atagcagaagag

SEQ ID NO: 5244155 - DNA, 16 bp, Homo sapiens
atagcagacagtgttt

SEQ ID NO: 5244156 - DNA, 17 bp, Homo sapiens
atagcagacattgttac

SEQ ID NO: 5244157 - DNA, 22 bp, Homo sapiens
atagcagactttcccaaatgta

SEQ ID NO: 5244158 - DNA, 21 bp, Homo sapiens
atagcagagagccaaatctga

SEQ ID NO: 5244159 - DNA, 14 bp, Homo sapiens
atagcagaggaaaa

SEQ ID NO: 5244160 - DNA, 13 bp, Homo sapiens
atagcagaggggc

SEQ ID NO: 5244161 - DNA, 15 bp, Homo sapiens
atagcagaggggcca

SEQ ID NO: 5244162 - DNA, 16 bp, Homo sapiens
atagcagaggggccag

SEQ ID NO: 5244163 - DNA, 20 bp, Homo sapiens
atagcagaggggccaggccc

SEQ ID NO: 5244164 - DNA, 21 bp, Homo sapiens
atagcagagtccttattcttc

SEQ ID NO: 5244165 - DNA, 19 bp, Homo sapiens
atagcagatctgttttgtg

SEQ ID NO: 5244166 - DNA, 22 bp, Homo sapiens
atagcagccctcaattgtgaaa

SEQ ID NO: 5244167 - DNA, 15 bp, Homo sapiens
atagcagcctggctc

SEQ ID NO: 5244168 - DNA, 19 bp, Homo sapiens
atagcagcctttctctctt

SEQ ID NO: 5244169 - DNA, 12 bp, Homo sapiens
atagcagctttg

SEQ ID NO: 5244170 - DNA, 12 bp, Homo sapiens
atagcagggctg

SEQ ID NO: 5244171 - DNA, 22 bp, Homo sapiens
atagcagggctgggctctgtct

SEQ ID NO: 5244172 - DNA, 21 bp, Homo sapiens
atagcagtaaaaaatggtgtt

SEQ ID NO: 5244173 - DNA, 17 bp, Homo sapiens
atagcagtggcaaaata

SEQ ID NO: 5244174 - DNA, 15 bp, Homo sapiens
atagcagtgttctct

SEQ ID NO: 5244175 - DNA, 22 bp, Homo sapiens
atagcagttataacagatgtga

SEQ ID NO: 5244176 - DNA, 21 bp, Homo sapiens
atagcataatatgaagccttt

SEQ ID NO: 5244177 - DNA, 20 bp, Homo sapiens
atagcatacaccaaacattt

SEQ ID NO: 5244178 - DNA, 15 bp, Homo sapiens
atagcatactgtgta

SEQ ID NO: 5244179 - DNA, 18 bp, Homo sapiens
atagcatactgtgtatgt

SEQ ID NO: 5244180 - DNA, 15 bp, Homo sapiens
atagcatagccagca

SEQ ID NO: 5244181 - DNA, 16 bp, Homo sapiens
atagcataggctgggg

SEQ ID NO: 5244182 - DNA, 22 bp, Homo sapiens
atagcatatattcatacctgtt

SEQ ID NO: 5244183 - DNA, 18 bp, Homo sapiens
atagcatatgacaaatgt

SEQ ID NO: 5244184 - DNA, 19 bp, Homo sapiens
atagcatatgacaaatgtt

SEQ ID NO: 5244185 - DNA, 23 bp, Homo sapiens
atagcatccactggaaaaggtga

SEQ ID NO: 5244186 - DNA, 14 bp, Homo sapiens
atagcatcccatct

SEQ ID NO: 5244187 - DNA, 23 bp, Homo sapiens
atagcatcctgattattgaatgt

SEQ ID NO: 5244188 - DNA, 19 bp, Homo sapiens
atagcatctgctcttctct

SEQ ID NO: 5244189 - DNA, 21 bp, Homo sapiens
atagcatctggaagatcattt

SEQ ID NO: 5244190 - DNA, 23 bp, Homo sapiens
atagcatctttgaatacaaagaa

SEQ ID NO: 5244191 - DNA, 16 bp, Homo sapiens
atagcatgaaataaaa

SEQ ID NO: 5244192 - DNA, 12 bp, Homo sapiens
atagcatgaatt

SEQ ID NO: 5244193 - DNA, 19 bp, Homo sapiens
atagcatgcttcctttctc

SEQ ID NO: 5244194 - DNA, 18 bp, Homo sapiens
atagcatgtattgtgtct

SEQ ID NO: 5244195 - DNA, 23 bp, Homo sapiens
atagcatgtattgtgtcttttgc

SEQ ID NO: 5244196 - DNA, 22 bp, Homo sapiens
atagcatgtcaacttttgacta

SEQ ID NO: 5244197 - DNA, 20 bp, Homo sapiens
atagcatgttcgtattacaa

SEQ ID NO: 5244198 - DNA, 13 bp, Homo sapiens
atagcattaacta

SEQ ID NO: 5244199 - DNA, 15 bp, Homo sapiens
atagcattaactaat

SEQ ID NO: 5244200 - DNA, 18 bp, Homo sapiens
atagcattaataaaactg

SEQ ID NO: 5244201 - DNA, 19 bp, Homo sapiens
atagcattaataaaactgt

SEQ ID NO: 5244202 - DNA, 21 bp, Homo sapiens
atagcattgataatcttcagg

SEQ ID NO: 5244203 - DNA, 16 bp, Homo sapiens
atagcattgtgaactg

SEQ ID NO: 5244204 - DNA, 17 bp, Homo sapiens
atagcatttatggtaat

SEQ ID NO: 5244205 - DNA, 21 bp, Homo sapiens
atagcatttttgatttatgca

SEQ ID NO: 5244206 - DNA, 14 bp, Homo sapiens
atagccaaacagga

SEQ ID NO: 5244207 - DNA, 14 bp, Homo sapiens
atagccaaagccag

SEQ ID NO: 5244208 - DNA, 15 bp, Homo sapiens
atagccaaagccagg

SEQ ID NO: 5244209 - DNA, 22 bp, Homo sapiens
atagccacatttggaatacttt

SEQ ID NO: 5244210 - DNA, 20 bp, Homo sapiens
atagccactaaccttgcctg

SEQ ID NO: 5244211 - DNA, 19 bp, Homo sapiens
atagccacttaccttcaat

SEQ ID NO: 5244212 - DNA, 23 bp, Homo sapiens
atagccacttaccttcaataaag

SEQ ID NO: 5244213 - DNA, 15 bp, Homo sapiens
atagccagacacatg

SEQ ID NO: 5244214 - DNA, 15 bp, Homo sapiens
atagccagagaggag

SEQ ID NO: 5244215 - DNA, 16 bp, Homo sapiens
atagccagagaggagc

SEQ ID NO: 5244216 - DNA, 22 bp, Homo sapiens
atagccagagaggagcacctga

SEQ ID NO: 5244217 - DNA, 19 bp, Homo sapiens
atagccagcattcagcaca

SEQ ID NO: 5244218 - DNA, 13 bp, Homo sapiens
atagccagcattt

SEQ ID NO: 5244219 - DNA, 12 bp, Homo sapiens
atagccaggagc

SEQ ID NO: 5244220 - DNA, 21 bp, Homo sapiens
atagccaggcctgacctcaag

SEQ ID NO: 5244221 - DNA, 16 bp, Homo sapiens
atagccatatttgtaa

SEQ ID NO: 5244222 - DNA, 23 bp, Homo sapiens
atagccatatttgtaaaatgaca

SEQ ID NO: 5244223 - DNA, 20 bp, Homo sapiens
atagccatcgactcctgcct

SEQ ID NO: 5244224 - DNA, 21 bp, Homo sapiens
atagccattgatcataaactg

SEQ ID NO: 5244225 - DNA, 22 bp, Homo sapiens
atagccatttccatggctctgt

SEQ ID NO: 5244226 - DNA, 13 bp, Homo sapiens
atagcccacttac

SEQ ID NO: 5244227 - DNA, 15 bp, Homo sapiens
atagcccacttacat

SEQ ID NO: 5244228 - DNA, 13 bp, Homo sapiens
atagcccagacac

SEQ ID NO: 5244229 - DNA, 17 bp, Homo sapiens
atagcccagacacagaa

SEQ ID NO: 5244230 - DNA, 18 bp, Homo sapiens
atagcccaggatatattt

SEQ ID NO: 5244231 - DNA, 14 bp, Homo sapiens
atagcccaggtcct

SEQ ID NO: 5244232 - DNA, 17 bp, Homo sapiens
atagcccatccctgcct

SEQ ID NO: 5244233 - DNA, 18 bp, Homo sapiens
atagcccatccctgcctg

SEQ ID NO: 5244234 - DNA, 21 bp, Homo sapiens
atagccccagactgggcccag

SEQ ID NO: 5244235 - DNA, 13 bp, Homo sapiens
atagccccaggcc

SEQ ID NO: 5244236 - DNA, 14 bp, Homo sapiens
atagccccaggccc

SEQ ID NO: 5244237 - DNA, 22 bp, Homo sapiens
atagcccctggtgtgtaaataa

SEQ ID NO: 5244238 - DNA, 14 bp, Homo sapiens
atagccctgtcctg

SEQ ID NO: 5244239 - DNA, 18 bp, Homo sapiens
atagccctgtcctggtgg

SEQ ID NO: 5244240 - DNA, 21 bp, Homo sapiens
atagccgaactccaggctggg

SEQ ID NO: 5244241 - DNA, 19 bp, Homo sapiens
atagccgatatcagaattt

SEQ ID NO: 5244242 - DNA, 19 bp, Homo sapiens
atagccgattctctgcccg

SEQ ID NO: 5244243 - DNA, 20 bp, Homo sapiens
atagccgattctctgcccgg

SEQ ID NO: 5244244 - DNA, 14 bp, Homo sapiens
atagccgggcatgg

SEQ ID NO: 5244245 - DNA, 14 bp, Homo sapiens
atagcctaaaagat

SEQ ID NO: 5244246 - DNA, 22 bp, Homo sapiens
atagcctcaacaacaattttaa

SEQ ID NO: 5244247 - DNA, 17 bp, Homo sapiens
atagcctccacggagag

SEQ ID NO: 5244248 - DNA, 15 bp, Homo sapiens
atagcctctcctttg

SEQ ID NO: 5244249 - DNA, 13 bp, Homo sapiens
atagcctgaattt

SEQ ID NO: 5244250 - DNA, 16 bp, Homo sapiens
atagcctgaatttgag

SEQ ID NO: 5244251 - DNA, 15 bp, Homo sapiens
atagcctgaggtccc

SEQ ID NO: 5244252 - DNA, 16 bp, Homo sapiens
atagcctgcctcagtg

SEQ ID NO: 5244253 - DNA, 16 bp, Homo sapiens
atagcctgcctgatcc

SEQ ID NO: 5244254 - DNA, 19 bp, Homo sapiens
atagcctgcctgatccctg

SEQ ID NO: 5244255 - DNA, 18 bp, Homo sapiens
atagcctggactgctacc

SEQ ID NO: 5244256 - DNA, 11 bp, Homo sapiens
atagcctgtgg

SEQ ID NO: 5244257 - DNA, 19 bp, Homo sapiens
atagccttggggttggaca

SEQ ID NO: 5244258 - DNA, 14 bp, Homo sapiens
atagcggccctgga

SEQ ID NO: 5244259 - DNA, 20 bp, Homo sapiens
atagcgggttactttcacat

SEQ ID NO: 5244260 - DNA, 14 bp, Homo sapiens
atagcgttcttgta

SEQ ID NO: 5244261 - DNA, 13 bp, Homo sapiens
atagcgttggaat

SEQ ID NO: 5244262 - DNA, 20 bp, Homo sapiens
atagcgttggaattaaaaca

SEQ ID NO: 5244263 - DNA, 21 bp, Homo sapiens
atagctaaataacttgccatt

SEQ ID NO: 5244264 - DNA, 22 bp, Homo sapiens
atagctaaataacttgccattt

SEQ ID NO: 5244265 - DNA, 13 bp, Homo sapiens
atagctaaatggc

SEQ ID NO: 5244266 - DNA, 14 bp, Homo sapiens
atcataaactgtgt

SEQ ID NO: 5244267 - DNA, 14 bp, Homo sapiens
atcataaagcattt

SEQ ID NO: 5244268 - DNA, 19 bp, Homo sapiens
atcataaaggatatttcaa

SEQ ID NO: 5244269 - DNA, 12 bp, Homo sapiens
atcataaagtat

SEQ ID NO: 5244270 - DNA, 14 bp, Homo sapiens
atcataaagttaga

SEQ ID NO: 5244271 - DNA, 15 bp, Homo sapiens
atcataaagttagaa

SEQ ID NO: 5244272 - DNA, 21 bp, Homo sapiens
atcataaatcttcttattaaa

SEQ ID NO: 5244273 - DNA, 15 bp, Homo sapiens
atcataacattgatt

SEQ ID NO: 5244274 - DNA, 23 bp, Homo sapiens
atcataactggcttctgcttgtc

SEQ ID NO: 5244275 - DNA, 20 bp, Homo sapiens
atcataagatagttacattt

SEQ ID NO: 5244276 - DNA, 22 bp, Homo sapiens
atcataaggttttattcatata

SEQ ID NO: 5244277 - DNA, 17 bp, Homo sapiens
atcataagtatttggaa

SEQ ID NO: 5244278 - DNA, 18 bp, Homo sapiens
atcataagtatttggaat

SEQ ID NO: 5244279 - DNA, 16 bp, Homo sapiens
atcataattaaactgt

SEQ ID NO: 5244280 - DNA, 12 bp, Homo sapiens
atcataattaca

SEQ ID NO: 5244281 - DNA, 13 bp, Homo sapiens
atcataattacat

SEQ ID NO: 5244282 - DNA, 19 bp, Homo sapiens
atcataattacattcctaa

SEQ ID NO: 5244283 - DNA, 14 bp, Homo sapiens
atcataatttcttt

SEQ ID NO: 5244284 - DNA, 22 bp, Homo sapiens
atcataatttctttttggtaaa

SEQ ID NO: 5244285 - DNA, 14 bp, Homo sapiens
atcataattttcaa

SEQ ID NO: 5244286 - DNA, 15 bp, Homo sapiens
atcataattttcaag

SEQ ID NO: 5244287 - DNA, 16 bp, Homo sapiens
atcatacaaactctca

SEQ ID NO: 5244288 - DNA, 13 bp, Homo sapiens
atcatacaaatac

SEQ ID NO: 5244289 - DNA, 13 bp, Homo sapiens
atcatacagtttt

SEQ ID NO: 5244290 - DNA, 15 bp, Homo sapiens
atcataccagttgtt

SEQ ID NO: 5244291 - DNA, 15 bp, Homo sapiens
atcatactcttctaa

SEQ ID NO: 5244292 - DNA, 16 bp, Homo sapiens
atcatactcttctaaa

SEQ ID NO: 5244293 - DNA, 21 bp, Homo sapiens
atcatactgagacttgttctt

SEQ ID NO: 5244294 - DNA, 18 bp, Homo sapiens
atcatactgcctactgtt

SEQ ID NO: 5244295 - DNA, 23 bp, Homo sapiens
atcatacttgctccttgaataag

SEQ ID NO: 5244296 - DNA, 19 bp, Homo sapiens
atcatagaacagaaatata

SEQ ID NO: 5244297 - DNA, 20 bp, Homo sapiens
atcatagaacagaaatatat

SEQ ID NO: 5244298 - DNA, 21 bp, Homo sapiens
atcatagaaggagagcccagg

SEQ ID NO: 5244299 - DNA, 19 bp, Homo sapiens
atcatagatttctgatttt

SEQ ID NO: 5244300 - DNA, 16 bp, Homo sapiens
atcatagcttgtttta

SEQ ID NO: 5244301 - DNA, 22 bp, Homo sapiens
atcataggaagtggctggtctg

SEQ ID NO: 5244302 - DNA, 14 bp, Homo sapiens
atcataggtacaat

SEQ ID NO: 5244303 - DNA, 16 bp, Homo sapiens
atcataggtatttcaa

SEQ ID NO: 5244304 - DNA, 14 bp, Homo sapiens
atcatagttaacat

SEQ ID NO: 5244305 - DNA, 16 bp, Homo sapiens
atcatagttactgtgt

SEQ ID NO: 5244306 - DNA, 19 bp, Homo sapiens
atcatagttttatttatat

SEQ ID NO: 5244307 - DNA, 16 bp, Homo sapiens
atcatataaaatttca

SEQ ID NO: 5244308 - DNA, 17 bp, Homo sapiens
atcatataaaatttcag

SEQ ID NO: 5244309 - DNA, 14 bp, Homo sapiens
atcatataaacatt

SEQ ID NO: 5244310 - DNA, 17 bp, Homo sapiens
atcatataaacatttta

SEQ ID NO: 5244311 - DNA, 23 bp, Homo sapiens
atcatataaatagaatgtaaatg

SEQ ID NO: 5244312 - DNA, 24 bp, Homo sapiens
atcatataaatagaatgtaaatgt

SEQ ID NO: 5244313 - DNA, 16 bp, Homo sapiens
atcatataataaatgt

SEQ ID NO: 5244314 - DNA, 22 bp, Homo sapiens
atcatatagaccaattgaagca

SEQ ID NO: 5244315 - DNA, 23 bp, Homo sapiens
atcatatagaccaattgaagcat

SEQ ID NO: 5244316 - DNA, 16 bp, Homo sapiens
atcatatatcataaag

SEQ ID NO: 5244317 - DNA, 11 bp, Homo sapiens
atcatatatgc

SEQ ID NO: 5244318 - DNA, 13 bp, Homo sapiens
atcatatatgctt

SEQ ID NO: 5244319 - DNA, 18 bp, Homo sapiens
atcatatcaattggcagt

SEQ ID NO: 5244320 - DNA, 14 bp, Homo sapiens
atcatatcctcaga

SEQ ID NO: 5244321 - DNA, 11 bp, Homo sapiens
atcatatgaat

SEQ ID NO: 5244322 - DNA, 18 bp, Homo sapiens
atcatatgaccattgaaa

SEQ ID NO: 5244323 - DNA, 19 bp, Homo sapiens
atcatatgaccattgaaaa

SEQ ID NO: 5244324 - DNA, 21 bp, Homo sapiens
atcatatgcctgaccccttgc

SEQ ID NO: 5244325 - DNA, 17 bp, Homo sapiens
atcatatggtaggaccc

SEQ ID NO: 5244326 - DNA, 16 bp, Homo sapiens
atcatatgtgtcttta

SEQ ID NO: 5244327 - DNA, 20 bp, Homo sapiens
atcatattaaaaatatacaa

SEQ ID NO: 5244328 - DNA, 16 bp, Homo sapiens
atcatattaacatatt

SEQ ID NO: 5244329 - DNA, 17 bp, Homo sapiens
atcatattatttttaaa

SEQ ID NO: 5244330 - DNA, 13 bp, Homo sapiens
atcatattctaaa

SEQ ID NO: 5244331 - DNA, 13 bp, Homo sapiens
atcatattgatga

SEQ ID NO: 5244332 - DNA, 14 bp, Homo sapiens
atcatattgatgaa

SEQ ID NO: 5244333 - DNA, 17 bp, Homo sapiens
atcatattgatgaaaag

SEQ ID NO: 5244334 - DNA, 23 bp, Homo sapiens
atcatatttaataggataaatta

SEQ ID NO: 5244335 - DNA, 13 bp, Homo sapiens
atcatatttgaaa

SEQ ID NO: 5244336 - DNA, 14 bp, Homo sapiens
atcatcaaaaagaa

SEQ ID NO: 5244337 - DNA, 18 bp, Homo sapiens
atcatcaagaagggctgc

SEQ ID NO: 5244338 - DNA, 20 bp, Homo sapiens
atcatcaagaagggctgcat

SEQ ID NO: 5244339 - DNA, 21 bp, Homo sapiens
atcatcaagaagggctgcatg

SEQ ID NO: 5244340 - DNA, 18 bp, Homo sapiens
atcatcaaggcactgcct

SEQ ID NO: 5244341 - DNA, 16 bp, Homo sapiens
atcatcaagtaataca

SEQ ID NO: 5244342 - DNA, 18 bp, Homo sapiens
atcatcaagtaatacaaa

SEQ ID NO: 5244343 - DNA, 16 bp, Homo sapiens
atcatcacaaatggct

SEQ ID NO: 5244344 - DNA, 22 bp, Homo sapiens
atcatcaccacaccgtgagcag

SEQ ID NO: 5244345 - DNA, 20 bp, Homo sapiens
atcatcaccgattcttcctt

SEQ ID NO: 5244346 - DNA, 17 bp, Homo sapiens
atcatcacgtatgttat

SEQ ID NO: 5244347 - DNA, 12 bp, Homo sapiens
atcatcactgta

SEQ ID NO: 5244348 - DNA, 15 bp, Homo sapiens
atcatcactgtaaag

SEQ ID NO: 5244349 - DNA, 17 bp, Homo sapiens
atcatcactgtaaagac

SEQ ID NO: 5244350 - DNA, 18 bp, Homo sapiens
atcatcactgtaaagaca

SEQ ID NO: 5244351 - DNA, 20 bp, Homo sapiens
atcatcagaaaggaaaaaca

SEQ ID NO: 5244352 - DNA, 20 bp, Homo sapiens
atcatcagactagtatcaag

SEQ ID NO: 5244353 - DNA, 21 bp, Homo sapiens
atcatcagacttgcggccaca

SEQ ID NO: 5244354 - DNA, 20 bp, Homo sapiens
atcatcagcatacctttatt

SEQ ID NO: 5244355 - DNA, 14 bp, Homo sapiens
atcatcaggaccct

SEQ ID NO: 5244356 - DNA, 12 bp, Homo sapiens
atcatcaggttt

SEQ ID NO: 5244357 - DNA, 19 bp, Homo sapiens
atcatcagtattgaagcat

SEQ ID NO: 5244358 - DNA, 14 bp, Homo sapiens
atcatcagtgcctc

SEQ ID NO: 5244359 - DNA, 22 bp, Homo sapiens
atcatcatagaggatgatgtaa

SEQ ID NO: 5244360 - DNA, 23 bp, Homo sapiens
atcatcataggtaaggttttcaa

SEQ ID NO: 5244361 - DNA, 19 bp, Homo sapiens
atcatcatagtaaaagaaa

SEQ ID NO: 5244362 - DNA, 14 bp, Homo sapiens
atcatcatcgttgt

SEQ ID NO: 5244363 - DNA, 22 bp, Homo sapiens
atcatcatgtagaatatggcta

SEQ ID NO: 5244364 - DNA, 16 bp, Homo sapiens
atcatcattattatta

SEQ ID NO: 5244365 - DNA, 23 bp, Homo sapiens
atcatcattcttgtgggagacag

SEQ ID NO: 5244366 - DNA, 16 bp, Homo sapiens
atcatccacattgttt

SEQ ID NO: 5244367 - DNA, 14 bp, Homo sapiens
atcatccagaagtt

SEQ ID NO: 5244368 - DNA, 16 bp, Homo sapiens
atcatccaggcctcag

SEQ ID NO: 5244369 - DNA, 19 bp, Homo sapiens
atcatccccatcctccaga

SEQ ID NO: 5244370 - DNA, 14 bp, Homo sapiens
atcatccccgaggg

SEQ ID NO: 5244371 - DNA, 23 bp, Homo sapiens
atcatccctccctgcctaaggaa

SEQ ID NO: 5244372 - DNA, 16 bp, Homo sapiens
atcatcccttaataaa

SEQ ID NO: 5244373 - DNA, 15 bp, Homo sapiens
atcatcctattgtct

SEQ ID NO: 5244374 - DNA, 17 bp, Homo sapiens
atcatcctccattgctc

SEQ ID NO: 5244375 - DNA, 13 bp, Homo sapiens
atcatcctctggc

SEQ ID NO: 5244376 - DNA, 17 bp, Homo sapiens
atcatcctgcagacaga

SEQ ID NO: 5244377 - DNA, 17 bp, Homo sapiens
atcatcctgttttctct

SEQ ID NO: 5244378 - DNA, 18 bp, Homo sapiens
atcatcctgttttctctg

SEQ ID NO: 5244379 - DNA, 21 bp, Homo sapiens
atcatcctttaggtaagaagt

SEQ ID NO: 5244380 - DNA, 14 bp, Homo sapiens
atcatcctttcagt

SEQ ID NO: 5244381 - DNA, 17 bp, Homo sapiens
atcatcgaagtcttccc

SEQ ID NO: 5244382 - DNA, 16 bp, Homo sapiens
atcatcgccagaggtg

SEQ ID NO: 5244383 - DNA, 24 bp, Homo sapiens
atcatcggagtcagccaggagctg

SEQ ID NO: 5244384 - DNA, 18 bp, Homo sapiens
atcatcgttgttattaaa

SEQ ID NO: 5244385 - DNA, 14 bp, Homo sapiens
atcatctattttga

SEQ ID NO: 5244386 - DNA, 16 bp, Homo sapiens
atcatctattttgatg

SEQ ID NO: 5244387 - DNA, 19 bp, Homo sapiens
atcatctattttgatgcag

SEQ ID NO: 5244388 - DNA, 13 bp, Homo sapiens
atcatctccaaac

SEQ ID NO: 5244389 - DNA, 14 bp, Homo sapiens
atcatctctgcctt

SEQ ID NO: 5244390 - DNA, 17 bp, Homo sapiens
atcatctctgcctttga

SEQ ID NO: 5244391 - DNA, 12 bp, Homo sapiens
atcatctctgtg

SEQ ID NO: 5244392 - DNA, 13 bp, Homo sapiens
atcatctcttcct

SEQ ID NO: 5244393 - DNA, 12 bp, Homo sapiens
atcatctcttga

SEQ ID NO: 5244394 - DNA, 22 bp, Homo sapiens
atcatctgcagttctttttgta

SEQ ID NO: 5244395 - DNA, 23 bp, Homo sapiens
atcatctggtttttaaaagataa

SEQ ID NO: 5244396 - DNA, 13 bp, Homo sapiens
atcatctgtcatt

SEQ ID NO: 5244397 - DNA, 15 bp, Homo sapiens
atcatctgtcattat

SEQ ID NO: 5244398 - DNA, 21 bp, Homo sapiens
atcatctgtcattatattcta

SEQ ID NO: 5244399 - DNA, 18 bp, Homo sapiens
atcatcttagactttgca

SEQ ID NO: 5244400 - DNA, 14 bp, Homo sapiens
atcatcttattcag

SEQ ID NO: 5244401 - DNA, 14 bp, Homo sapiens
atcatcttctccca

SEQ ID NO: 5244402 - DNA, 21 bp, Homo sapiens
atcatcttctctttttccaga

SEQ ID NO: 5244403 - DNA, 21 bp, Homo sapiens
atcatcttgaacattaatcca

SEQ ID NO: 5244404 - DNA, 16 bp, Homo sapiens
atcatcttgaatattt

SEQ ID NO: 5244405 - DNA, 19 bp, Homo sapiens
atcatctttatctcctggg

SEQ ID NO: 5244406 - DNA, 23 bp, Homo sapiens
atcatctttgttggctcagaaaa

SEQ ID NO: 5244407 - DNA, 17 bp, Homo sapiens
atcatgaaaagaggaac

SEQ ID NO: 5244408 - DNA, 18 bp, Homo sapiens
atcatgaaatatgcatct

SEQ ID NO: 5244409 - DNA, 19 bp, Homo sapiens
atcatgaacagctctgaga

SEQ ID NO: 5244410 - DNA, 15 bp, Homo sapiens
atcatgaactggctt

SEQ ID NO: 5244411 - DNA, 18 bp, Homo sapiens
atcatgaagatatttttc

SEQ ID NO: 5244412 - DNA, 11 bp, Homo sapiens
atcatgaagcc

SEQ ID NO: 5244413 - DNA, 15 bp, Homo sapiens
atcatgaagccttgc

SEQ ID NO: 5244414 - DNA, 16 bp, Homo sapiens
atcatgaagccttgct

SEQ ID NO: 5244415 - DNA, 22 bp, Homo sapiens
atcatgaagccttgctgaacta

SEQ ID NO: 5244416 - DNA, 23 bp, Homo sapiens
atcatgaataactgattagtaag

SEQ ID NO: 5244417 - DNA, 16 bp, Homo sapiens
atcatgaatgctttta

SEQ ID NO: 5244418 - DNA, 18 bp, Homo sapiens
atcatgaatgcttttagt

SEQ ID NO: 5244419 - DNA, 18 bp, Homo sapiens
atcatgaatgtgtaacac

SEQ ID NO: 5244420 - DNA, 20 bp, Homo sapiens
atcatgaattcccttttaat

SEQ ID NO: 5244421 - DNA, 20 bp, Homo sapiens
atcatgacaaagactgagta

SEQ ID NO: 5244422 - DNA, 17 bp, Homo sapiens
atcatgaccagcaaata

SEQ ID NO: 5244423 - DNA, 15 bp, Homo sapiens
atcatgagcctgctg

SEQ ID NO: 5244424 - DNA, 13 bp, Homo sapiens
atcatgagcctgt

SEQ ID NO: 5244425 - DNA, 14 bp, Homo sapiens
atcatgagcctgtt

SEQ ID NO: 5244426 - DNA, 15 bp, Homo sapiens
atcatgagcctgttt

SEQ ID NO: 5244427 - DNA, 18 bp, Homo sapiens
atcatgagcctgtttatt

SEQ ID NO: 5244428 - DNA, 19 bp, Homo sapiens
atcatgagcctgtttattg

SEQ ID NO: 5244429 - DNA, 19 bp, Homo sapiens
atcatgagccttcagtcag

SEQ ID NO: 5244430 - DNA, 20 bp, Homo sapiens
atcatgaggtcaggagatca

SEQ ID NO: 5244431 - DNA, 16 bp, Homo sapiens
atcatgatagacttgt

SEQ ID NO: 5244432 - DNA, 23 bp, Homo sapiens
atcatgatctgactttaattgtg

SEQ ID NO: 5244433 - DNA, 19 bp, Homo sapiens
atcatgcacacaattagat

SEQ ID NO: 5244434 - DNA, 22 bp, Homo sapiens
atcatgcagctcaactttctgt

SEQ ID NO: 5244435 - DNA, 12 bp, Homo sapiens
atcatgcaggaa

SEQ ID NO: 5244436 - DNA, 15 bp, Homo sapiens
atcatgcattcacaa

SEQ ID NO: 5244437 - DNA, 19 bp, Homo sapiens
atcatgccagtatttttaa

SEQ ID NO: 5244438 - DNA, 19 bp, Homo sapiens
atcatgccctctctcggga

SEQ ID NO: 5244439 - DNA, 14 bp, Homo sapiens
atcatgcctctgag

SEQ ID NO: 5244440 - DNA, 15 bp, Homo sapiens
atcatgcctctgagg

SEQ ID NO: 5244441 - DNA, 17 bp, Homo sapiens
atcatgcctctgaggcc

SEQ ID NO: 5244442 - DNA, 23 bp, Homo sapiens
atcatgcctctgaggccagcctg

SEQ ID NO: 5244443 - DNA, 22 bp, Homo sapiens
atcatgccttgataaatatata

SEQ ID NO: 5244444 - DNA, 23 bp, Homo sapiens
atcatgccttgataaatatatat

SEQ ID NO: 5244445 - DNA, 15 bp, Homo sapiens
aaagagacagtgata

SEQ ID NO: 5244446 - DNA, 15 bp, Homo sapiens
aaagagacatttcaa

SEQ ID NO: 5244447 - DNA, 20 bp, Homo sapiens
aaagagaccacccatatcat

SEQ ID NO: 5244448 - DNA, 21 bp, Homo sapiens
aaagagacctacctcaggttg

SEQ ID NO: 5244449 - DNA, 18 bp, Homo sapiens
aaagagagaaaacttatt

SEQ ID NO: 5244450 - DNA, 18 bp, Homo sapiens
aaagagagaaaataaaaa

SEQ ID NO: 5244451 - DNA, 19 bp, Homo sapiens
aaagagagaaaataaaaag

SEQ ID NO: 5244452 - DNA, 16 bp, Homo sapiens
aaagagagaagccagc

SEQ ID NO: 5244453 - DNA, 13 bp, Homo sapiens
aaagagagaatgt

SEQ ID NO: 5244454 - DNA, 20 bp, Homo sapiens
aaagagagacacagctgcag

SEQ ID NO: 5244455 - DNA, 12 bp, Homo sapiens
aaagagagagag

SEQ ID NO: 5244456 - DNA, 17 bp, Homo sapiens
aaagagaggatctagga

SEQ ID NO: 5244457 - DNA, 12 bp, Homo sapiens
aaagagaggtta

SEQ ID NO: 5244458 - DNA, 20 bp, Homo sapiens
aaagagagttaatcaactga

SEQ ID NO: 5244459 - DNA, 16 bp, Homo sapiens
aaagagataataagat

SEQ ID NO: 5244460 - DNA, 14 bp, Homo sapiens
aaagagatacagag

SEQ ID NO: 5244461 - DNA, 17 bp, Homo sapiens
aaagagatagcttctct

SEQ ID NO: 5244462 - DNA, 21 bp, Homo sapiens
aaagagatgagacaaacatgc

SEQ ID NO: 5244463 - DNA, 19 bp, Homo sapiens
aaagagatgatgaaaatat

SEQ ID NO: 5244464 - DNA, 22 bp, Homo sapiens
aaagagatgatgaaaatattta

SEQ ID NO: 5244465 - DNA, 13 bp, Homo sapiens
aaagagattcgaa

SEQ ID NO: 5244466 - DNA, 13 bp, Homo sapiens
aaagagatttcaa

SEQ ID NO: 5244467 - DNA, 14 bp, Homo sapiens
aaagagatttcaag

SEQ ID NO: 5244468 - DNA, 15 bp, Homo sapiens
aaagagcaagtctgg

SEQ ID NO: 5244469 - DNA, 23 bp, Homo sapiens
aaagagcaagtctggatctggga

SEQ ID NO: 5244470 - DNA, 11 bp, Homo sapiens
aaagagcactg

SEQ ID NO: 5244471 - DNA, 20 bp, Homo sapiens
aaagagcacttaagagaata

SEQ ID NO: 5244472 - DNA, 22 bp, Homo sapiens
aaagagcacttaagagaatatt

SEQ ID NO: 5244473 - DNA, 18 bp, Homo sapiens
aaagagcacttactgtaa

SEQ ID NO: 5244474 - DNA, 21 bp, Homo sapiens
aaagagccagactctgtctca

SEQ ID NO: 5244475 - DNA, 23 bp, Homo sapiens
aaagagccttctgggagttagtg

SEQ ID NO: 5244476 - DNA, 12 bp, Homo sapiens
aaagagctactc

SEQ ID NO: 5244477 - DNA, 20 bp, Homo sapiens
aaagagctaggaaccctgga

SEQ ID NO: 5244478 - DNA, 22 bp, Homo sapiens
aaagagctaggaaccctggagg

SEQ ID NO: 5244479 - DNA, 20 bp, Homo sapiens
aaagagctcaggcttttcca

SEQ ID NO: 5244480 - DNA, 16 bp, Homo sapiens
aaagagctgcacagca

SEQ ID NO: 5244481 - DNA, 13 bp, Homo sapiens
aaagagctgccta

SEQ ID NO: 5244482 - DNA, 16 bp, Homo sapiens
aaagagctgcctggat

SEQ ID NO: 5244483 - DNA, 22 bp, Homo sapiens
aaagagctttagtcctagagga

SEQ ID NO: 5244484 - DNA, 17 bp, Homo sapiens
aaagaggaaattaaata

SEQ ID NO: 5244485 - DNA, 13 bp, Homo sapiens
aaagaggacacca

SEQ ID NO: 5244486 - DNA, 18 bp, Homo sapiens
aaagaggacagaaaaatt

SEQ ID NO: 5244487 - DNA, 19 bp, Homo sapiens
aaagaggactcgcttgtaa

SEQ ID NO: 5244488 - DNA, 12 bp, Homo sapiens
aaagaggagaag

SEQ ID NO: 5244489 - DNA, 21 bp, Homo sapiens
aaagaggagaaggagagggag

SEQ ID NO: 5244490 - DNA, 19 bp, Homo sapiens
aaagaggagaggaaaacta

SEQ ID NO: 5244491 - DNA, 18 bp, Homo sapiens
aaagaggaggcagaaaga

SEQ ID NO: 5244492 - DNA, 20 bp, Homo sapiens
aaagaggaggcagaaagatt

SEQ ID NO: 5244493 - DNA, 19 bp, Homo sapiens
aaagaggatgatttcagaa

SEQ ID NO: 5244494 - DNA, 21 bp, Homo sapiens
aaagaggattagacagtaaga

SEQ ID NO: 5244495 - DNA, 15 bp, Homo sapiens
aaagaggcagcttga

SEQ ID NO: 5244496 - DNA, 21 bp, Homo sapiens
aaagaggccaaacaggccctc

SEQ ID NO: 5244497 - DNA, 20 bp, Homo sapiens
aaagaggcgtctgtatattt

SEQ ID NO: 5244498 - DNA, 18 bp, Homo sapiens
aaagaggcgtcttgtatt

SEQ ID NO: 5244499 - DNA, 20 bp, Homo sapiens
aaagaggcgtcttgtatttt

SEQ ID NO: 5244500 - DNA, 16 bp, Homo sapiens
aaagaggctgaaagag

SEQ ID NO: 5244501 - DNA, 19 bp, Homo sapiens
aaagaggctgaggcctgga

SEQ ID NO: 5244502 - DNA, 20 bp, Homo sapiens
aaagaggctgcccctctcac

SEQ ID NO: 5244503 - DNA, 22 bp, Homo sapiens
aaagaggctgcccctctcacca

SEQ ID NO: 5244504 - DNA, 20 bp, Homo sapiens
aaagaggcttccaagcatta

SEQ ID NO: 5244505 - DNA, 13 bp, Homo sapiens
aaagagggacaag

SEQ ID NO: 5244506 - DNA, 18 bp, Homo sapiens
aaagagggagaagaaaga

SEQ ID NO: 5244507 - DNA, 21 bp, Homo sapiens
aaagagggagggaaatctttc

SEQ ID NO: 5244508 - DNA, 15 bp, Homo sapiens
aaagagggcttcctc

SEQ ID NO: 5244509 - DNA, 20 bp, Homo sapiens
aaagagggggaagatggttc

SEQ ID NO: 5244510 - DNA, 21 bp, Homo sapiens
aaagagggtgagggccttctt

SEQ ID NO: 5244511 - DNA, 21 bp, Homo sapiens
aaagaggtctccccatcccca

SEQ ID NO: 5244512 - DNA, 19 bp, Homo sapiens
aaagaggtgaaaatgaaga

SEQ ID NO: 5244513 - DNA, 18 bp, Homo sapiens
aaagaggtgaccccaggg

SEQ ID NO: 5244514 - DNA, 24 bp, Homo sapiens
aaagaggtgactgggccctgcctc

SEQ ID NO: 5244515 - DNA, 24 bp, Homo sapiens
aaagaggtgctgctttgcttcttc

SEQ ID NO: 5244516 - DNA, 21 bp, Homo sapiens
aaagaggtggattcctgggca

SEQ ID NO: 5244517 - DNA, 14 bp, Homo sapiens
aaagaggtgtcatg

SEQ ID NO: 5244518 - DNA, 13 bp, Homo sapiens
aaagaggtgtgca

SEQ ID NO: 5244519 - DNA, 15 bp, Homo sapiens
aaagaggttacttta

SEQ ID NO: 5244520 - DNA, 18 bp, Homo sapiens
aaagaggttactttagtt

SEQ ID NO: 5244521 - DNA, 21 bp, Homo sapiens
aaagagtacactcagccactg

SEQ ID NO: 5244522 - DNA, 18 bp, Homo sapiens
aaagagtagaattgcatt

SEQ ID NO: 5244523 - DNA, 20 bp, Homo sapiens
aaagagtatcaaaggcagaa

SEQ ID NO: 5244524 - DNA, 21 bp, Homo sapiens
aaagagtatcaaaggcagaaa

SEQ ID NO: 5244525 - DNA, 20 bp, Homo sapiens
aaagagtcagacatttcttt

SEQ ID NO: 5244526 - DNA, 20 bp, Homo sapiens
aaagagtccattgtttaaaa

SEQ ID NO: 5244527 - DNA, 11 bp, Homo sapiens
aaagagtcctc

SEQ ID NO: 5244528 - DNA, 14 bp, Homo sapiens
aaagagtctagatt

SEQ ID NO: 5244529 - DNA, 21 bp, Homo sapiens
aaagagtctctacccctttct

SEQ ID NO: 5244530 - DNA, 21 bp, Homo sapiens
aaagagtcttaattttctaaa

SEQ ID NO: 5244531 - DNA, 14 bp, Homo sapiens
aaagagtctttctt

SEQ ID NO: 5244532 - DNA, 13 bp, Homo sapiens
aaagagtgaaata

SEQ ID NO: 5244533 - DNA, 23 bp, Homo sapiens
aaagagtgaatgccatttagaat

SEQ ID NO: 5244534 - DNA, 14 bp, Homo sapiens
aaagagtgagaact

SEQ ID NO: 5244535 - DNA, 15 bp, Homo sapiens
aaagagtgagaacta

SEQ ID NO: 5244536 - DNA, 11 bp, Homo sapiens
aaagagtggag

SEQ ID NO: 5244537 - DNA, 20 bp, Homo sapiens
aaagagtggagcaaatgctt

SEQ ID NO: 5244538 - DNA, 16 bp, Homo sapiens
aaagagtgtaaaatat

SEQ ID NO: 5244539 - DNA, 20 bp, Homo sapiens
aaagagtgtgttataaaata

SEQ ID NO: 5244540 - DNA, 13 bp, Homo sapiens
aaagagttaagaa

SEQ ID NO: 5244541 - DNA, 15 bp, Homo sapiens
aaagagttgagcaca

SEQ ID NO: 5244542 - DNA, 18 bp, Homo sapiens
aaagagttgtcctgatgt

SEQ ID NO: 5244543 - DNA, 18 bp, Homo sapiens
aaagagtttgagacctga

SEQ ID NO: 5244544 - DNA, 19 bp, Homo sapiens
aaagagtttgagacctgaa

SEQ ID NO: 5244545 - DNA, 14 bp, Homo sapiens
aaagagttttctat

SEQ ID NO: 5244546 - DNA, 12 bp, Homo sapiens
aaagataaacac

SEQ ID NO: 5244547 - DNA, 17 bp, Homo sapiens
aaagataaacacaagat

SEQ ID NO: 5244548 - DNA, 18 bp, Homo sapiens
aaagataaacacaagatt

SEQ ID NO: 5244549 - DNA, 14 bp, Homo sapiens
aaagataaatatta

SEQ ID NO: 5244550 - DNA, 13 bp, Homo sapiens
aaagataaatgat

SEQ ID NO: 5244551 - DNA, 14 bp, Homo sapiens
aaagataacattgt

SEQ ID NO: 5244552 - DNA, 20 bp, Homo sapiens
aaagataacgcaggagagag

SEQ ID NO: 5244553 - DNA, 21 bp, Homo sapiens
aaagataacttcatgaagact

SEQ ID NO: 5244554 - DNA, 14 bp, Homo sapiens
aaagataagacttc

SEQ ID NO: 5244555 - DNA, 18 bp, Homo sapiens
aaagataaggcaacaaaa

SEQ ID NO: 5244556 - DNA, 16 bp, Homo sapiens
aaagataataaattga

SEQ ID NO: 5244557 - DNA, 19 bp, Homo sapiens
aaagataatctcagtgctt

SEQ ID NO: 5244558 - DNA, 17 bp, Homo sapiens
aaagataatgcatattt

SEQ ID NO: 5244559 - DNA, 16 bp, Homo sapiens
aaagatacatgattga

SEQ ID NO: 5244560 - DNA, 17 bp, Homo sapiens
aaagatacatgattgaa

SEQ ID NO: 5244561 - DNA, 19 bp, Homo sapiens
aaagatacatttgtatgtt

SEQ ID NO: 5244562 - DNA, 17 bp, Homo sapiens
aaagataccttaaaatt

SEQ ID NO: 5244563 - DNA, 19 bp, Homo sapiens
aaagataccttaaaatttg

SEQ ID NO: 5244564 - DNA, 21 bp, Homo sapiens
aaagataccttaaaatttgaa

SEQ ID NO: 5244565 - DNA, 13 bp, Homo sapiens
aaagatacttaca

SEQ ID NO: 5244566 - DNA, 19 bp, Homo sapiens
aaagatacttgatgcactt

SEQ ID NO: 5244567 - DNA, 20 bp, Homo sapiens
aaagatacttgatgcactta

SEQ ID NO: 5244568 - DNA, 21 bp, Homo sapiens
aaagatacttgatgcacttat

SEQ ID NO: 5244569 - DNA, 22 bp, Homo sapiens
aaagatacttgatgcacttatt

SEQ ID NO: 5244570 - DNA, 23 bp, Homo sapiens
aaagatagaatggcttctctgtt

SEQ ID NO: 5244571 - DNA, 22 bp, Homo sapiens
aaagatagagattgtttttaga

SEQ ID NO: 5244572 - DNA, 19 bp, Homo sapiens
aaagatagcagaagagtag

SEQ ID NO: 5244573 - DNA, 22 bp, Homo sapiens
aaagataggattgggaaagaag

SEQ ID NO: 5244574 - DNA, 22 bp, Homo sapiens
aaagatagtatcttttaaaatg

SEQ ID NO: 5244575 - DNA, 21 bp, Homo sapiens
aaagatataagtgctgtataa

SEQ ID NO: 5244576 - DNA, 14 bp, Homo sapiens
aaagatatctatga

SEQ ID NO: 5244577 - DNA, 17 bp, Homo sapiens
aaagatatgaagaacta

SEQ ID NO: 5244578 - DNA, 15 bp, Homo sapiens
aaagatatgtatatt

SEQ ID NO: 5244579 - DNA, 16 bp, Homo sapiens
aaagatatgtatattt

SEQ ID NO: 5244580 - DNA, 15 bp, Homo sapiens
aaagatatgtattct

SEQ ID NO: 5244581 - DNA, 13 bp, Homo sapiens
aaagatattgtat

SEQ ID NO: 5244582 - DNA, 21 bp, Homo sapiens
aaagatattgtattatcatat

SEQ ID NO: 5244583 - DNA, 15 bp, Homo sapiens
aaagatattgttcaa

SEQ ID NO: 5244584 - DNA, 22 bp, Homo sapiens
aaagatattgttcaaacaatat

SEQ ID NO: 5244585 - DNA, 21 bp, Homo sapiens
aaagatattttatttctgatg

SEQ ID NO: 5244586 - DNA, 17 bp, Homo sapiens
aaagatattttgctttg

SEQ ID NO: 5244587 - DNA, 16 bp, Homo sapiens
aaagatcaaaataaaa

SEQ ID NO: 5244588 - DNA, 18 bp, Homo sapiens
aaagatcacaccaattta

SEQ ID NO: 5244589 - DNA, 16 bp, Homo sapiens
aaagatcaccttgtat

SEQ ID NO: 5244590 - DNA, 18 bp, Homo sapiens
aaagatcaccttgtattc

SEQ ID NO: 5244591 - DNA, 15 bp, Homo sapiens
aaagatcagctattc

SEQ ID NO: 5244592 - DNA, 22 bp, Homo sapiens
aaagatcatttataatactgtt

SEQ ID NO: 5244593 - DNA, 23 bp, Homo sapiens
aaagatcatttataatactgttt

SEQ ID NO: 5244594 - DNA, 17 bp, Homo sapiens
aaagatccagggatgga

SEQ ID NO: 5244595 - DNA, 20 bp, Homo sapiens
aaagatccagggatggagat

SEQ ID NO: 5244596 - DNA, 15 bp, Homo sapiens
aaagatctcaacatg

SEQ ID NO: 5244597 - DNA, 21 bp, Homo sapiens
aaagatctcggtgctgaacga

SEQ ID NO: 5244598 - DNA, 17 bp, Homo sapiens
aaagatctctagagttt

SEQ ID NO: 5244599 - DNA, 23 bp, Homo sapiens
aaagatctctgtcacatccaact

SEQ ID NO: 5244600 - DNA, 13 bp, Homo sapiens
aaagatctgtttt

SEQ ID NO: 5244601 - DNA, 16 bp, Homo sapiens
aaagatctgttttgaa

SEQ ID NO: 5244602 - DNA, 20 bp, Homo sapiens
aaagatctttcattttgcac

SEQ ID NO: 5244603 - DNA, 19 bp, Homo sapiens
aaagatgaaaaagaataaa

SEQ ID NO: 5244604 - DNA, 13 bp, Homo sapiens
aaagatgaaaata

SEQ ID NO: 5244605 - DNA, 16 bp, Homo sapiens
aaagatgaaactgaaa

SEQ ID NO: 5244606 - DNA, 23 bp, Homo sapiens
aaagatgaactctgaactttgga

SEQ ID NO: 5244607 - DNA, 20 bp, Homo sapiens
aaagatgaaggctgtatcta

SEQ ID NO: 5244608 - DNA, 18 bp, Homo sapiens
aaagatgaaggtctgttt

SEQ ID NO: 5244609 - DNA, 17 bp, Homo sapiens
aaagatgaatttgtcca

SEQ ID NO: 5244610 - DNA, 12 bp, Homo sapiens
aaagatgacaaa

SEQ ID NO: 5244611 - DNA, 22 bp, Homo sapiens
aaagatgacctgtggtaagcaa

SEQ ID NO: 5244612 - DNA, 19 bp, Homo sapiens
aaagatgagaggggctcag

SEQ ID NO: 5244613 - DNA, 18 bp, Homo sapiens
aaagatgatcgctgtatt

SEQ ID NO: 5244614 - DNA, 16 bp, Homo sapiens
aaagatgatgctcagt

SEQ ID NO: 5244615 - DNA, 13 bp, Homo sapiens
aaagatgatttaa

SEQ ID NO: 5244616 - DNA, 16 bp, Homo sapiens
aaagatgattttgctt

SEQ ID NO: 5244617 - DNA, 13 bp, Homo sapiens
aaagatgcacaga

SEQ ID NO: 5244618 - DNA, 22 bp, Homo sapiens
aaagatgcactttgctttaata

SEQ ID NO: 5244619 - DNA, 23 bp, Homo sapiens
aaagatgcactttgctttaatat

SEQ ID NO: 5244620 - DNA, 21 bp, Homo sapiens
aaagatgcagccgccttcctt

SEQ ID NO: 5244621 - DNA, 19 bp, Homo sapiens
aaagatgcagtcctcagga

SEQ ID NO: 5244622 - DNA, 22 bp, Homo sapiens
atagctaacattttaaataaaa

SEQ ID NO: 5244623 - DNA, 15 bp, Homo sapiens
atagctaactgtaaa

SEQ ID NO: 5244624 - DNA, 16 bp, Homo sapiens
atagctaactgtaaat

SEQ ID NO: 5244625 - DNA, 22 bp, Homo sapiens
atagctaagatataatttaaac

SEQ ID NO: 5244626 - DNA, 13 bp, Homo sapiens
atagctaagtaca

SEQ ID NO: 5244627 - DNA, 15 bp, Homo sapiens
atagctaagtacaca

SEQ ID NO: 5244628 - DNA, 18 bp, Homo sapiens
atagctaagtacacaata

SEQ ID NO: 5244629 - DNA, 15 bp, Homo sapiens
atagctaataataaa

SEQ ID NO: 5244630 - DNA, 17 bp, Homo sapiens
atagctaataatgttaa

SEQ ID NO: 5244631 - DNA, 17 bp, Homo sapiens
atagctacaaatgaaaa

SEQ ID NO: 5244632 - DNA, 16 bp, Homo sapiens
atagctacaggaagca

SEQ ID NO: 5244633 - DNA, 17 bp, Homo sapiens
atagctacatgttcttt

SEQ ID NO: 5244634 - DNA, 16 bp, Homo sapiens
atagctacccaaaaga

SEQ ID NO: 5244635 - DNA, 14 bp, Homo sapiens
atagctacccacag

SEQ ID NO: 5244636 - DNA, 18 bp, Homo sapiens
atagctacccacagagca

SEQ ID NO: 5244637 - DNA, 19 bp, Homo sapiens
atagctacccacagagcaa

SEQ ID NO: 5244638 - DNA, 16 bp, Homo sapiens
atagctactaaatata

SEQ ID NO: 5244639 - DNA, 14 bp, Homo sapiens
atagctactatatg

SEQ ID NO: 5244640 - DNA, 23 bp, Homo sapiens
atagctactatatgcataaacaa

SEQ ID NO: 5244641 - DNA, 20 bp, Homo sapiens
atagctactgtagaaaggaa

SEQ ID NO: 5244642 - DNA, 21 bp, Homo sapiens
atagctactgtagaaaggaaa

SEQ ID NO: 5244643 - DNA, 22 bp, Homo sapiens
atagctactgtagaaaggaaat

SEQ ID NO: 5244644 - DNA, 14 bp, Homo sapiens
atagctagactggt

SEQ ID NO: 5244645 - DNA, 19 bp, Homo sapiens
atagctagactggtgactg

SEQ ID NO: 5244646 - DNA, 18 bp, Homo sapiens
atagctagttatgtgaga

SEQ ID NO: 5244647 - DNA, 17 bp, Homo sapiens
atagctatatccatgta

SEQ ID NO: 5244648 - DNA, 20 bp, Homo sapiens
atagctatatccatgtactg

SEQ ID NO: 5244649 - DNA, 23 bp, Homo sapiens
atagctatcatttcttttccaaa

SEQ ID NO: 5244650 - DNA, 22 bp, Homo sapiens
atagctattactgtctggtttt

SEQ ID NO: 5244651 - DNA, 16 bp, Homo sapiens
atagctattgcatgta

SEQ ID NO: 5244652 - DNA, 20 bp, Homo sapiens
atagctattgcatgtaaaat

SEQ ID NO: 5244653 - DNA, 23 bp, Homo sapiens
atagctattgcatgtaaaatgca

SEQ ID NO: 5244654 - DNA, 13 bp, Homo sapiens
atagctatttaga

SEQ ID NO: 5244655 - DNA, 18 bp, Homo sapiens
atagctatttagagatat

SEQ ID NO: 5244656 - DNA, 16 bp, Homo sapiens
atagctattttccttg

SEQ ID NO: 5244657 - DNA, 17 bp, Homo sapiens
atagctcaaatattgaa

SEQ ID NO: 5244658 - DNA, 17 bp, Homo sapiens
atagctcaatactctct

SEQ ID NO: 5244659 - DNA, 17 bp, Homo sapiens
atagctcactgcagcct

SEQ ID NO: 5244660 - DNA, 20 bp, Homo sapiens
atagctcactgcagcctcat

SEQ ID NO: 5244661 - DNA, 15 bp, Homo sapiens
atagctcagggtaag

SEQ ID NO: 5244662 - DNA, 22 bp, Homo sapiens
atagctcaggtgtccctgcact

SEQ ID NO: 5244663 - DNA, 13 bp, Homo sapiens
atagctcagttta

SEQ ID NO: 5244664 - DNA, 22 bp, Homo sapiens
atagctcagtttatccaaggtg

SEQ ID NO: 5244665 - DNA, 14 bp, Homo sapiens
atagctcatcctta

SEQ ID NO: 5244666 - DNA, 15 bp, Homo sapiens
atagctccaagctgt

SEQ ID NO: 5244667 - DNA, 16 bp, Homo sapiens
atagctccaagctgtt

SEQ ID NO: 5244668 - DNA, 19 bp, Homo sapiens
atagctccaagctgttaaa

SEQ ID NO: 5244669 - DNA, 18 bp, Homo sapiens
atagctcccaaaagaatg

SEQ ID NO: 5244670 - DNA, 20 bp, Homo sapiens
atagctccccgcttctgcct

SEQ ID NO: 5244671 - DNA, 18 bp, Homo sapiens
atagctctaatgtttgca

SEQ ID NO: 5244672 - DNA, 20 bp, Homo sapiens
atagctctaatgtttgcata

SEQ ID NO: 5244673 - DNA, 21 bp, Homo sapiens
atagctctaatgtttgcatat

SEQ ID NO: 5244674 - DNA, 17 bp, Homo sapiens
atagctctacacaacat

SEQ ID NO: 5244675 - DNA, 19 bp, Homo sapiens
atagctctacacaacatgt

SEQ ID NO: 5244676 - DNA, 18 bp, Homo sapiens
atagctctgaagttaaaa

SEQ ID NO: 5244677 - DNA, 12 bp, Homo sapiens
atagctctgggg

SEQ ID NO: 5244678 - DNA, 13 bp, Homo sapiens
atagctctggggt

SEQ ID NO: 5244679 - DNA, 20 bp, Homo sapiens
atagctcttcacttcctcca

SEQ ID NO: 5244680 - DNA, 23 bp, Homo sapiens
atagctgaaattccagtttagga

SEQ ID NO: 5244681 - DNA, 18 bp, Homo sapiens
atagctgacatctcctct

SEQ ID NO: 5244682 - DNA, 17 bp, Homo sapiens
atagctgagattcctgg

SEQ ID NO: 5244683 - DNA, 14 bp, Homo sapiens
atagctgagctgga

SEQ ID NO: 5244684 - DNA, 23 bp, Homo sapiens
atagctgcttggattctctgaga

SEQ ID NO: 5244685 - DNA, 17 bp, Homo sapiens
atagctggaaaaaacaa

SEQ ID NO: 5244686 - DNA, 23 bp, Homo sapiens
atagctggtcttatttgtaaagc

SEQ ID NO: 5244687 - DNA, 17 bp, Homo sapiens
atagctgtacaaatata

SEQ ID NO: 5244688 - DNA, 23 bp, Homo sapiens
atagctgtacaaatataagaata

SEQ ID NO: 5244689 - DNA, 15 bp, Homo sapiens
atagctgtacttctt

SEQ ID NO: 5244690 - DNA, 13 bp, Homo sapiens
atagctgtattga

SEQ ID NO: 5244691 - DNA, 16 bp, Homo sapiens
atagctgtattgaatc

SEQ ID NO: 5244692 - DNA, 18 bp, Homo sapiens
atagctgtattgaatcat

SEQ ID NO: 5244693 - DNA, 19 bp, Homo sapiens
atagctgtgatttttggta

SEQ ID NO: 5244694 - DNA, 19 bp, Homo sapiens
atagcttaactaatttgaa

SEQ ID NO: 5244695 - DNA, 20 bp, Homo sapiens
atagcttaactaatttgaat

SEQ ID NO: 5244696 - DNA, 18 bp, Homo sapiens
atagcttacactgaggac

SEQ ID NO: 5244697 - DNA, 18 bp, Homo sapiens
atagcttatgaaaagaat

SEQ ID NO: 5244698 - DNA, 21 bp, Homo sapiens
atagcttcaccccaatcccag

SEQ ID NO: 5244699 - DNA, 18 bp, Homo sapiens
atagcttcaggatactgt

SEQ ID NO: 5244700 - DNA, 20 bp, Homo sapiens
atagcttcaggatactgtag

SEQ ID NO: 5244701 - DNA, 17 bp, Homo sapiens
atagcttcgcatggtgg

SEQ ID NO: 5244702 - DNA, 19 bp, Homo sapiens
atagcttctgtgtgtgagc

SEQ ID NO: 5244703 - DNA, 14 bp, Homo sapiens
atagcttgtatagt

SEQ ID NO: 5244704 - DNA, 15 bp, Homo sapiens
atagctttaacattt

SEQ ID NO: 5244705 - DNA, 19 bp, Homo sapiens
atagctttactgtttctca

SEQ ID NO: 5244706 - DNA, 20 bp, Homo sapiens
atagctttagagaagccata

SEQ ID NO: 5244707 - DNA, 10 bp, Homo sapiens
atagctttat

SEQ ID NO: 5244708 - DNA, 18 bp, Homo sapiens
atagctttataaagcagt

SEQ ID NO: 5244709 - DNA, 18 bp, Homo sapiens
atagctttattttttaag

SEQ ID NO: 5244710 - DNA, 19 bp, Homo sapiens
atagctttattttttaagt

SEQ ID NO: 5244711 - DNA, 21 bp, Homo sapiens
atagctttattttttaagtat

SEQ ID NO: 5244712 - DNA, 17 bp, Homo sapiens
atagcttttattgtata

SEQ ID NO: 5244713 - DNA, 18 bp, Homo sapiens
atagcttttcatcaattc

SEQ ID NO: 5244714 - DNA, 22 bp, Homo sapiens
atagcttttcctgttaaggcag

SEQ ID NO: 5244715 - DNA, 16 bp, Homo sapiens
atagcttttgattagt

SEQ ID NO: 5244716 - DNA, 22 bp, Homo sapiens
atagcttttggtgtttgagtgt

SEQ ID NO: 5244717 - DNA, 14 bp, Homo sapiens
ataggaaaaactga

SEQ ID NO: 5244718 - DNA, 15 bp, Homo sapiens
ataggaaaactgaat

SEQ ID NO: 5244719 - DNA, 15 bp, Homo sapiens
ataggaaaatacatt

SEQ ID NO: 5244720 - DNA, 15 bp, Homo sapiens
ataggaaactgaagc

SEQ ID NO: 5244721 - DNA, 22 bp, Homo sapiens
ataggaaagatttaatgttaca

SEQ ID NO: 5244722 - DNA, 15 bp, Homo sapiens
ataggaaataaatct

SEQ ID NO: 5244723 - DNA, 18 bp, Homo sapiens
ataggaacaatctttgct

SEQ ID NO: 5244724 - DNA, 18 bp, Homo sapiens
ataggaacatatgaaaat

SEQ ID NO: 5244725 - DNA, 19 bp, Homo sapiens
ataggaacttaaataatgt

SEQ ID NO: 5244726 - DNA, 15 bp, Homo sapiens
ataggaagaacagta

SEQ ID NO: 5244727 - DNA, 22 bp, Homo sapiens
ataggaagacataaaactttaa

SEQ ID NO: 5244728 - DNA, 19 bp, Homo sapiens
ataggaagacgcagagcaa

SEQ ID NO: 5244729 - DNA, 22 bp, Homo sapiens
ataggaagattaaaaccacaga

SEQ ID NO: 5244730 - DNA, 18 bp, Homo sapiens
ataggaagtgccccaggg

SEQ ID NO: 5244731 - DNA, 16 bp, Homo sapiens
ataggaagtggctggt

SEQ ID NO: 5244732 - DNA, 20 bp, Homo sapiens
ataggaagttcttttttgta

SEQ ID NO: 5244733 - DNA, 21 bp, Homo sapiens
ataggaatcattcagaaatgt

SEQ ID NO: 5244734 - DNA, 11 bp, Homo sapiens
ataggaattca

SEQ ID NO: 5244735 - DNA, 12 bp, Homo sapiens
ataggaatttag

SEQ ID NO: 5244736 - DNA, 15 bp, Homo sapiens
ataggacaaatgata

SEQ ID NO: 5244737 - DNA, 14 bp, Homo sapiens
ataggacagaggga

SEQ ID NO: 5244738 - DNA, 18 bp, Homo sapiens
ataggacatactgcatgt

SEQ ID NO: 5244739 - DNA, 16 bp, Homo sapiens
ataggaccttgggcca

SEQ ID NO: 5244740 - DNA, 23 bp, Homo sapiens
ataggactccatttctttcttcc

SEQ ID NO: 5244741 - DNA, 19 bp, Homo sapiens
ataggacttaatttagcag

SEQ ID NO: 5244742 - DNA, 17 bp, Homo sapiens
ataggagaaaatgaaag

SEQ ID NO: 5244743 - DNA, 20 bp, Homo sapiens
ataggagaaagcaaaataca

SEQ ID NO: 5244744 - DNA, 22 bp, Homo sapiens
ataggagaagaggcatcctgcc

SEQ ID NO: 5244745 - DNA, 14 bp, Homo sapiens
ataggagactgcgt

SEQ ID NO: 5244746 - DNA, 22 bp, Homo sapiens
ataggagagagatcatgagaaa

SEQ ID NO: 5244747 - DNA, 20 bp, Homo sapiens
ataggagagattgggagaaa

SEQ ID NO: 5244748 - DNA, 14 bp, Homo sapiens
ataggagaggaaaa

SEQ ID NO: 5244749 - DNA, 23 bp, Homo sapiens
ataggagaggatgagagcccaga

SEQ ID NO: 5244750 - DNA, 12 bp, Homo sapiens
ataggagcctgc

SEQ ID NO: 5244751 - DNA, 15 bp, Homo sapiens
ataggagcctgctgg

SEQ ID NO: 5244752 - DNA, 16 bp, Homo sapiens
ataggagcctgctggt

SEQ ID NO: 5244753 - DNA, 21 bp, Homo sapiens
ataggaggaaaacacagcctc

SEQ ID NO: 5244754 - DNA, 23 bp, Homo sapiens
ataggaggagctctcaattttat

SEQ ID NO: 5244755 - DNA, 13 bp, Homo sapiens
ataggagggtgcc

SEQ ID NO: 5244756 - DNA, 18 bp, Homo sapiens
ataggagttctcctggag

SEQ ID NO: 5244757 - DNA, 16 bp, Homo sapiens
ataggagttctctgat

SEQ ID NO: 5244758 - DNA, 23 bp, Homo sapiens
ataggagttctctgatgcagaaa

SEQ ID NO: 5244759 - DNA, 13 bp, Homo sapiens
ataggataaaata

SEQ ID NO: 5244760 - DNA, 23 bp, Homo sapiens
ataggataaagttggccatgtat

SEQ ID NO: 5244761 - DNA, 17 bp, Homo sapiens
ataggataaattacatt

SEQ ID NO: 5244762 - DNA, 19 bp, Homo sapiens
ataggataaattacattaa

SEQ ID NO: 5244763 - DNA, 17 bp, Homo sapiens
ataggatagacactgga

SEQ ID NO: 5244764 - DNA, 18 bp, Homo sapiens
ataggatagacactggac

SEQ ID NO: 5244765 - DNA, 19 bp, Homo sapiens
ataggatagacactggaca

SEQ ID NO: 5244766 - DNA, 21 bp, Homo sapiens
ataggatattgctaattgtgt

SEQ ID NO: 5244767 - DNA, 15 bp, Homo sapiens
ataggatcccccttc

SEQ ID NO: 5244768 - DNA, 14 bp, Homo sapiens
ataggatcctggag

SEQ ID NO: 5244769 - DNA, 15 bp, Homo sapiens
ataggatcctggagg

SEQ ID NO: 5244770 - DNA, 19 bp, Homo sapiens
ataggatgtactgttgaaa

SEQ ID NO: 5244771 - DNA, 13 bp, Homo sapiens
ataggatttgcac

SEQ ID NO: 5244772 - DNA, 19 bp, Homo sapiens
ataggatttgcactgcttt

SEQ ID NO: 5244773 - DNA, 13 bp, Homo sapiens
ataggcaattaga

SEQ ID NO: 5244774 - DNA, 19 bp, Homo sapiens
ataggcaccttttactgtg

SEQ ID NO: 5244775 - DNA, 19 bp, Homo sapiens
ataggcagctgtcctgtga

SEQ ID NO: 5244776 - DNA, 18 bp, Homo sapiens
ataggcagcttctaagag

SEQ ID NO: 5244777 - DNA, 15 bp, Homo sapiens
ataggcatgagccac

SEQ ID NO: 5244778 - DNA, 23 bp, Homo sapiens
ataggcccaaccaccagatgaga

SEQ ID NO: 5244779 - DNA, 14 bp, Homo sapiens
ataggcccaaggtc

SEQ ID NO: 5244780 - DNA, 22 bp, Homo sapiens
ataggcccaaggtcccctccac

SEQ ID NO: 5244781 - DNA, 17 bp, Homo sapiens
ataggcccacacacagg

SEQ ID NO: 5244782 - DNA, 13 bp, Homo sapiens
ataggcccagcca

SEQ ID NO: 5244783 - DNA, 20 bp, Homo sapiens
ataggccctttcataaaaac

SEQ ID NO: 5244784 - DNA, 19 bp, Homo sapiens
ataggcctgtcccttgcct

SEQ ID NO: 5244785 - DNA, 21 bp, Homo sapiens
ataggcctgtcccttgcctct

SEQ ID NO: 5244786 - DNA, 22 bp, Homo sapiens
ataggcctgtcccttgcctctg

SEQ ID NO: 5244787 - DNA, 21 bp, Homo sapiens
ataggcggtcatgtgtgcatg

SEQ ID NO: 5244788 - DNA, 21 bp, Homo sapiens
ataggctattttctaaagact

SEQ ID NO: 5244789 - DNA, 22 bp, Homo sapiens
ataggctattttctaaagactt

SEQ ID NO: 5244790 - DNA, 19 bp, Homo sapiens
ataggctctgcacagatgg

SEQ ID NO: 5244791 - DNA, 22 bp, Homo sapiens
ataggctctgcacagatggatt

SEQ ID NO: 5244792 - DNA, 21 bp, Homo sapiens
ataggctggagaagctcaccc

SEQ ID NO: 5244793 - DNA, 14 bp, Homo sapiens
ataggctggggaca

SEQ ID NO: 5244794 - DNA, 14 bp, Homo sapiens
ataggctttagaag

SEQ ID NO: 5244795 - DNA, 15 bp, Homo sapiens
ataggctttttaatc

SEQ ID NO: 5244796 - DNA, 23 bp, Homo sapiens
atagggaagagagaaacatttat

SEQ ID NO: 5244797 - DNA, 14 bp, Homo sapiens
atagggaattttca

SEQ ID NO: 5244798 - DNA, 15 bp, Homo sapiens
atagggagaaaccaa

SEQ ID NO: 5244799 - DNA, 17 bp, Homo sapiens
atcatgcgttttatatc

SEQ ID NO: 5244800 - DNA, 19 bp, Homo sapiens
atcatgcgttttatatctt

SEQ ID NO: 5244801 - DNA, 15 bp, Homo sapiens
atcatgctaaaattc

SEQ ID NO: 5244802 - DNA, 17 bp, Homo sapiens
atcatgctcatgtatat

SEQ ID NO: 5244803 - DNA, 17 bp, Homo sapiens
atcatgctgcagtgggt

SEQ ID NO: 5244804 - DNA, 17 bp, Homo sapiens
atcatgctgttctcttt

SEQ ID NO: 5244805 - DNA, 22 bp, Homo sapiens
atcatgctgttctctttgctga

SEQ ID NO: 5244806 - DNA, 14 bp, Homo sapiens
atcatgctgttgca

SEQ ID NO: 5244807 - DNA, 12 bp, Homo sapiens
atcatgcttcta

SEQ ID NO: 5244808 - DNA, 17 bp, Homo sapiens
atcatgctttaaagtgt

SEQ ID NO: 5244809 - DNA, 20 bp, Homo sapiens
atcatgctttaaagtgtaat

SEQ ID NO: 5244810 - DNA, 19 bp, Homo sapiens
atcatggaaatattatgca

SEQ ID NO: 5244811 - DNA, 13 bp, Homo sapiens
atcatggaagaaa

SEQ ID NO: 5244812 - DNA, 15 bp, Homo sapiens
atcatggaatttcca

SEQ ID NO: 5244813 - DNA, 12 bp, Homo sapiens
atcatggagtga

SEQ ID NO: 5244814 - DNA, 15 bp, Homo sapiens
atcatggatcaacca

SEQ ID NO: 5244815 - DNA, 21 bp, Homo sapiens
atcatggattcattacagctt

SEQ ID NO: 5244816 - DNA, 21 bp, Homo sapiens
atcatggatttattttttgta

SEQ ID NO: 5244817 - DNA, 21 bp, Homo sapiens
atcatggcagtgggaccaagc

SEQ ID NO: 5244818 - DNA, 14 bp, Homo sapiens
atcatggccagctg

SEQ ID NO: 5244819 - DNA, 17 bp, Homo sapiens
atcatggccagctggag

SEQ ID NO: 5244820 - DNA, 19 bp, Homo sapiens
atcatggccagctggaggc

SEQ ID NO: 5244821 - DNA, 19 bp, Homo sapiens
atcatggctaagcttaaaa

SEQ ID NO: 5244822 - DNA, 15 bp, Homo sapiens
atcatggctatctgt

SEQ ID NO: 5244823 - DNA, 18 bp, Homo sapiens
atcatggctcactgcagc

SEQ ID NO: 5244824 - DNA, 16 bp, Homo sapiens
atcatgggaattttaa

SEQ ID NO: 5244825 - DNA, 18 bp, Homo sapiens
atcatgggggatttttca

SEQ ID NO: 5244826 - DNA, 22 bp, Homo sapiens
atcatggggtggaataaaggct

SEQ ID NO: 5244827 - DNA, 14 bp, Homo sapiens
atcatgggttcctc

SEQ ID NO: 5244828 - DNA, 17 bp, Homo sapiens
atcatggtcaagttccc

SEQ ID NO: 5244829 - DNA, 19 bp, Homo sapiens
atcatggtcagctcacacc

SEQ ID NO: 5244830 - DNA, 20 bp, Homo sapiens
atcatggtcagctcacaccc

SEQ ID NO: 5244831 - DNA, 18 bp, Homo sapiens
atcatggtgtaataagac

SEQ ID NO: 5244832 - DNA, 19 bp, Homo sapiens
atcatggtgtaataagaca

SEQ ID NO: 5244833 - DNA, 20 bp, Homo sapiens
atcatggtgtaataagacat

SEQ ID NO: 5244834 - DNA, 21 bp, Homo sapiens
atcatggtgtaataagacata

SEQ ID NO: 5244835 - DNA, 23 bp, Homo sapiens
atcatggtgtaataagacataac

SEQ ID NO: 5244836 - DNA, 13 bp, Homo sapiens
atcatgtacattt

SEQ ID NO: 5244837 - DNA, 15 bp, Homo sapiens
atcatgtacatttct

SEQ ID NO: 5244838 - DNA, 17 bp, Homo sapiens
atcatgtactttttagt

SEQ ID NO: 5244839 - DNA, 15 bp, Homo sapiens
atcatgtattttgta

SEQ ID NO: 5244840 - DNA, 18 bp, Homo sapiens
atcatgtcaggcctgtgt

SEQ ID NO: 5244841 - DNA, 16 bp, Homo sapiens
atcatgtccatacact

SEQ ID NO: 5244842 - DNA, 20 bp, Homo sapiens
atcatgtccatcccttttcc

SEQ ID NO: 5244843 - DNA, 21 bp, Homo sapiens
atcatgtccatcccttttcct

SEQ ID NO: 5244844 - DNA, 12 bp, Homo sapiens
atcatgtcccca

SEQ ID NO: 5244845 - DNA, 12 bp, Homo sapiens
atcatgtctatt

SEQ ID NO: 5244846 - DNA, 16 bp, Homo sapiens
atcatgtctgtatact

SEQ ID NO: 5244847 - DNA, 22 bp, Homo sapiens
atcatgtcttcattttttaatg

SEQ ID NO: 5244848 - DNA, 12 bp, Homo sapiens
atcatgtgaaat

SEQ ID NO: 5244849 - DNA, 14 bp, Homo sapiens
atcatgtgaaatca

SEQ ID NO: 5244850 - DNA, 15 bp, Homo sapiens
atcatgtgaaatcat

SEQ ID NO: 5244851 - DNA, 17 bp, Homo sapiens
atcatgtgcctggaaat

SEQ ID NO: 5244852 - DNA, 16 bp, Homo sapiens
atcatgtggccagccc

SEQ ID NO: 5244853 - DNA, 22 bp, Homo sapiens
atcatgtgtttaaattatttta

SEQ ID NO: 5244854 - DNA, 20 bp, Homo sapiens
atcatgttaaattagaatga

SEQ ID NO: 5244855 - DNA, 19 bp, Homo sapiens
atcatgttaatcctagctg

SEQ ID NO: 5244856 - DNA, 19 bp, Homo sapiens
atcatgttacttgagaagt

SEQ ID NO: 5244857 - DNA, 21 bp, Homo sapiens
atcatgttagtaatacctcta

SEQ ID NO: 5244858 - DNA, 15 bp, Homo sapiens
atcatgttatgataa

SEQ ID NO: 5244859 - DNA, 14 bp, Homo sapiens
atcatgttatttta

SEQ ID NO: 5244860 - DNA, 22 bp, Homo sapiens
atcatgttccccctaaacatgg

SEQ ID NO: 5244861 - DNA, 14 bp, Homo sapiens
atcatgttgttgtg

SEQ ID NO: 5244862 - DNA, 18 bp, Homo sapiens
atcatgtttacagaggac

SEQ ID NO: 5244863 - DNA, 17 bp, Homo sapiens
atcatgtttatgagaaa

SEQ ID NO: 5244864 - DNA, 18 bp, Homo sapiens
atcatgtttctgagacca

SEQ ID NO: 5244865 - DNA, 15 bp, Homo sapiens
atcatgtttgctctc

SEQ ID NO: 5244866 - DNA, 17 bp, Homo sapiens
atcatgttttataattt

SEQ ID NO: 5244867 - DNA, 20 bp, Homo sapiens
atcatgttttataatttgaa

SEQ ID NO: 5244868 - DNA, 23 bp, Homo sapiens
atcatgttttgatgagaaaaaac

SEQ ID NO: 5244869 - DNA, 14 bp, Homo sapiens
atcatgttttggtg

SEQ ID NO: 5244870 - DNA, 22 bp, Homo sapiens
atcatgttttttctgcaatgac

SEQ ID NO: 5244871 - DNA, 20 bp, Homo sapiens
atcattaaaaattaccttta

SEQ ID NO: 5244872 - DNA, 12 bp, Homo sapiens
atcattaaaata

SEQ ID NO: 5244873 - DNA, 19 bp, Homo sapiens
atcattaaaatatatgttc

SEQ ID NO: 5244874 - DNA, 22 bp, Homo sapiens
atcattaaaatatatgttctgc

SEQ ID NO: 5244875 - DNA, 11 bp, Homo sapiens
atcattaaagt

SEQ ID NO: 5244876 - DNA, 14 bp, Homo sapiens
atcattaaagttct

SEQ ID NO: 5244877 - DNA, 16 bp, Homo sapiens
atcattaaattggaat

SEQ ID NO: 5244878 - DNA, 23 bp, Homo sapiens
atcattaaattggaattttctta

SEQ ID NO: 5244879 - DNA, 11 bp, Homo sapiens
atcattaatac

SEQ ID NO: 5244880 - DNA, 21 bp, Homo sapiens
atcattaatgtaggtttagat

SEQ ID NO: 5244881 - DNA, 16 bp, Homo sapiens
atcattaatttttaat

SEQ ID NO: 5244882 - DNA, 18 bp, Homo sapiens
atcattacaatacagtat

SEQ ID NO: 5244883 - DNA, 19 bp, Homo sapiens
atcattacaatacagtatt

SEQ ID NO: 5244884 - DNA, 20 bp, Homo sapiens
atcattacaattttctgtaa

SEQ ID NO: 5244885 - DNA, 17 bp, Homo sapiens
atcattactaacttctt

SEQ ID NO: 5244886 - DNA, 16 bp, Homo sapiens
atcattactggtaaag

SEQ ID NO: 5244887 - DNA, 19 bp, Homo sapiens
atcattagggggaactcta

SEQ ID NO: 5244888 - DNA, 16 bp, Homo sapiens
atcattaggtgtgact

SEQ ID NO: 5244889 - DNA, 19 bp, Homo sapiens
atcattatagcatgtaata

SEQ ID NO: 5244890 - DNA, 17 bp, Homo sapiens
atcattatcttcatgtt

SEQ ID NO: 5244891 - DNA, 17 bp, Homo sapiens
atcattatctttgctgt

SEQ ID NO: 5244892 - DNA, 15 bp, Homo sapiens
atcattatttcatga

SEQ ID NO: 5244893 - DNA, 13 bp, Homo sapiens
atcattatttgag

SEQ ID NO: 5244894 - DNA, 14 bp, Homo sapiens
atcattatttgaga

SEQ ID NO: 5244895 - DNA, 14 bp, Homo sapiens
atcattcaaaacaa

SEQ ID NO: 5244896 - DNA, 12 bp, Homo sapiens
atcattcagaaa

SEQ ID NO: 5244897 - DNA, 14 bp, Homo sapiens
atcattcagaaatg

SEQ ID NO: 5244898 - DNA, 20 bp, Homo sapiens
atcattcagcaaatgccttt

SEQ ID NO: 5244899 - DNA, 23 bp, Homo sapiens
atcattcagcaaatgccttttca

SEQ ID NO: 5244900 - DNA, 17 bp, Homo sapiens
atcattcattcactgta

SEQ ID NO: 5244901 - DNA, 18 bp, Homo sapiens
atcattcattcactgtat

SEQ ID NO: 5244902 - DNA, 21 bp, Homo sapiens
atcattcattcactgtatagt

SEQ ID NO: 5244903 - DNA, 16 bp, Homo sapiens
atcattccttctggcc

SEQ ID NO: 5244904 - DNA, 14 bp, Homo sapiens
atcattctaaagat

SEQ ID NO: 5244905 - DNA, 12 bp, Homo sapiens
atcattctacaa

SEQ ID NO: 5244906 - DNA, 23 bp, Homo sapiens
atcattctacaagtaattttgca

SEQ ID NO: 5244907 - DNA, 22 bp, Homo sapiens
atcattctgcttccgtatttta

SEQ ID NO: 5244908 - DNA, 16 bp, Homo sapiens
atcattctgtgattaa

SEQ ID NO: 5244909 - DNA, 20 bp, Homo sapiens
atcattctgtgattaaatct

SEQ ID NO: 5244910 - DNA, 12 bp, Homo sapiens
atcattctgtgt

SEQ ID NO: 5244911 - DNA, 18 bp, Homo sapiens
atcattcttactaaaaag

SEQ ID NO: 5244912 - DNA, 23 bp, Homo sapiens
atcattcttactaaaaagtataa

SEQ ID NO: 5244913 - DNA, 20 bp, Homo sapiens
atcattcttatttcatgaaa

SEQ ID NO: 5244914 - DNA, 16 bp, Homo sapiens
atcattctttctgcta

SEQ ID NO: 5244915 - DNA, 20 bp, Homo sapiens
atcattctttgtatcttaaa

SEQ ID NO: 5244916 - DNA, 23 bp, Homo sapiens
atcattctttgtatcttaaatct

SEQ ID NO: 5244917 - DNA, 17 bp, Homo sapiens
atcattgaaacatttat

SEQ ID NO: 5244918 - DNA, 18 bp, Homo sapiens
atcattgaaatacttttt

SEQ ID NO: 5244919 - DNA, 14 bp, Homo sapiens
atcattgaaatctt

SEQ ID NO: 5244920 - DNA, 22 bp, Homo sapiens
atcattgacctaattgttaaat

SEQ ID NO: 5244921 - DNA, 18 bp, Homo sapiens
atcattgattgtcagcta

SEQ ID NO: 5244922 - DNA, 13 bp, Homo sapiens
atcattgcatttc

SEQ ID NO: 5244923 - DNA, 23 bp, Homo sapiens
atcattgccatcaccatttggtg

SEQ ID NO: 5244924 - DNA, 15 bp, Homo sapiens
atcattgctcccctg

SEQ ID NO: 5244925 - DNA, 23 bp, Homo sapiens
atcattgctgctgtagcaacaga

SEQ ID NO: 5244926 - DNA, 14 bp, Homo sapiens
atcattgctgtctg

SEQ ID NO: 5244927 - DNA, 16 bp, Homo sapiens
atcattgctgtctgca

SEQ ID NO: 5244928 - DNA, 14 bp, Homo sapiens
atcattgcttatgt

SEQ ID NO: 5244929 - DNA, 20 bp, Homo sapiens
atcattggaacaactgatac

SEQ ID NO: 5244930 - DNA, 17 bp, Homo sapiens
atcattggaatacagga

SEQ ID NO: 5244931 - DNA, 21 bp, Homo sapiens
atcattggattctgagagctg

SEQ ID NO: 5244932 - DNA, 19 bp, Homo sapiens
atcattggtatctgatatc

SEQ ID NO: 5244933 - DNA, 22 bp, Homo sapiens
atcattgtacagtttgtttaca

SEQ ID NO: 5244934 - DNA, 23 bp, Homo sapiens
atcattgtatcaaattattttta

SEQ ID NO: 5244935 - DNA, 17 bp, Homo sapiens
atcattgtattaacgca

SEQ ID NO: 5244936 - DNA, 21 bp, Homo sapiens
atcattgtcagccttgctact

SEQ ID NO: 5244937 - DNA, 14 bp, Homo sapiens
atcattgtccagag

SEQ ID NO: 5244938 - DNA, 19 bp, Homo sapiens
atcattgtgcttaataata

SEQ ID NO: 5244939 - DNA, 15 bp, Homo sapiens
atcattgttgtgtat

SEQ ID NO: 5244940 - DNA, 16 bp, Homo sapiens
atcattgttgtgtata

SEQ ID NO: 5244941 - DNA, 17 bp, Homo sapiens
atcattgttgtgtataa

SEQ ID NO: 5244942 - DNA, 15 bp, Homo sapiens
atcattgttttgaat

SEQ ID NO: 5244943 - DNA, 12 bp, Homo sapiens
atcatttaataa

SEQ ID NO: 5244944 - DNA, 14 bp, Homo sapiens
atcatttaatttct

SEQ ID NO: 5244945 - DNA, 21 bp, Homo sapiens
atcatttatcttatctagcaa

SEQ ID NO: 5244946 - DNA, 15 bp, Homo sapiens
atcatttattcattg

SEQ ID NO: 5244947 - DNA, 21 bp, Homo sapiens
atcatttattttaagcactct

SEQ ID NO: 5244948 - DNA, 21 bp, Homo sapiens
atcatttatttttaaaataat

SEQ ID NO: 5244949 - DNA, 19 bp, Homo sapiens
atcatttattttttacatt

SEQ ID NO: 5244950 - DNA, 13 bp, Homo sapiens
atcatttcaagaa

SEQ ID NO: 5244951 - DNA, 22 bp, Homo sapiens
atcatttcacctgctgcttgcc

SEQ ID NO: 5244952 - DNA, 15 bp, Homo sapiens
atcatttcactgtct

SEQ ID NO: 5244953 - DNA, 12 bp, Homo sapiens
atcatttcatgc

SEQ ID NO: 5244954 - DNA, 14 bp, Homo sapiens
atcatttcattcgt

SEQ ID NO: 5244955 - DNA, 13 bp, Homo sapiens
atcatttccagca

SEQ ID NO: 5244956 - DNA, 20 bp, Homo sapiens
atcatttccgttttgcctgt

SEQ ID NO: 5244957 - DNA, 21 bp, Homo sapiens
atcatttccgttttgcctgtg

SEQ ID NO: 5244958 - DNA, 23 bp, Homo sapiens
atcatttctgtctttaagaacta

SEQ ID NO: 5244959 - DNA, 15 bp, Homo sapiens
atcatttcttgggcc

SEQ ID NO: 5244960 - DNA, 11 bp, Homo sapiens
atcatttgagt

SEQ ID NO: 5244961 - DNA, 14 bp, Homo sapiens
atcatttgagttca

SEQ ID NO: 5244962 - DNA, 14 bp, Homo sapiens
atcatttgtgaaga

SEQ ID NO: 5244963 - DNA, 16 bp, Homo sapiens
atcatttgtgaagaat

SEQ ID NO: 5244964 - DNA, 13 bp, Homo sapiens
atcatttgtttaa

SEQ ID NO: 5244965 - DNA, 15 bp, Homo sapiens
atcatttgtttaaaa

SEQ ID NO: 5244966 - DNA, 14 bp, Homo sapiens
atcattttaaaaac

SEQ ID NO: 5244967 - DNA, 14 bp, Homo sapiens
atcattttaaaatg

SEQ ID NO: 5244968 - DNA, 15 bp, Homo sapiens
atcattttaaaatgt

SEQ ID NO: 5244969 - DNA, 16 bp, Homo sapiens
atcattttaaaatgtc

SEQ ID NO: 5244970 - DNA, 17 bp, Homo sapiens
atcattttaaattccac

SEQ ID NO: 5244971 - DNA, 22 bp, Homo sapiens
atcattttaaattccactgaaa

SEQ ID NO: 5244972 - DNA, 17 bp, Homo sapiens
atcattttaataaagtt

SEQ ID NO: 5244973 - DNA, 16 bp, Homo sapiens
atcattttagaagact

SEQ ID NO: 5244974 - DNA, 22 bp, Homo sapiens
atcattttagaagactctacca

SEQ ID NO: 5244975 - DNA, 23 bp, Homo sapiens
atcattttagaagactctaccag

SEQ ID NO: 5244976 - DNA, 15 bp, Homo sapiens
atcattttaggaaag

SEQ ID NO: 5244977 - DNA, 20 bp, Homo sapiens
atcattttagtatagttttc

SEQ ID NO: 5244978 - DNA, 15 bp, Homo sapiens
atagggagaatattt

SEQ ID NO: 5244979 - DNA, 18 bp, Homo sapiens
atagggagaatatttact

SEQ ID NO: 5244980 - DNA, 22 bp, Homo sapiens
atagggcaattaattccttcag

SEQ ID NO: 5244981 - DNA, 11 bp, Homo sapiens
atagggctggg

SEQ ID NO: 5244982 - DNA, 23 bp, Homo sapiens
ataggggaaaatattatttttat

SEQ ID NO: 5244983 - DNA, 14 bp, Homo sapiens
ataggggaaagaag

SEQ ID NO: 5244984 - DNA, 17 bp, Homo sapiens
ataggggatacttgaaa

SEQ ID NO: 5244985 - DNA, 18 bp, Homo sapiens
atagggggaagacagata

SEQ ID NO: 5244986 - DNA, 12 bp, Homo sapiens
atagggggctgc

SEQ ID NO: 5244987 - DNA, 13 bp, Homo sapiens
ataggggggaggg

SEQ ID NO: 5244988 - DNA, 14 bp, Homo sapiens
ataggggggagggt

SEQ ID NO: 5244989 - DNA, 15 bp, Homo sapiens
ataggggggagggtc

SEQ ID NO: 5244990 - DNA, 23 bp, Homo sapiens
ataggggttaaggaaaaaaaacg

SEQ ID NO: 5244991 - DNA, 14 bp, Homo sapiens
ataggggttccagg

SEQ ID NO: 5244992 - DNA, 22 bp, Homo sapiens
atagggtaaggggaggctgctt

SEQ ID NO: 5244993 - DNA, 20 bp, Homo sapiens
atagggtagtttgcaaacaa

SEQ ID NO: 5244994 - DNA, 22 bp, Homo sapiens
atagggtctaccaatacaaaat

SEQ ID NO: 5244995 - DNA, 23 bp, Homo sapiens
atagggtctaccaatacaaaatg

SEQ ID NO: 5244996 - DNA, 14 bp, Homo sapiens
atagggtggacaga

SEQ ID NO: 5244997 - DNA, 18 bp, Homo sapiens
atagggtggacagaagct

SEQ ID NO: 5244998 - DNA, 16 bp, Homo sapiens
ataggtaaaatctctg

SEQ ID NO: 5244999 - DNA, 21 bp, Homo sapiens
ataggtaacgtgattgattca

SEQ ID NO: 5245000 - DNA, 14 bp, Homo sapiens
ataggtaatcaatg

SEQ ID NO: 5245001 - DNA, 17 bp, Homo sapiens
ataggtaattaaggcag

SEQ ID NO: 5245002 - DNA, 15 bp, Homo sapiens
ataggtaatttttca

SEQ ID NO: 5245003 - DNA, 18 bp, Homo sapiens
ataggtagaatgtaaagc

SEQ ID NO: 5245004 - DNA, 20 bp, Homo sapiens
ataggtagaatgtaaagctt

SEQ ID NO: 5245005 - DNA, 19 bp, Homo sapiens
ataggtagagtcattcata

SEQ ID NO: 5245006 - DNA, 16 bp, Homo sapiens
ataggtagctggggag

SEQ ID NO: 5245007 - DNA, 21 bp, Homo sapiens
ataggtagctggggagcccta

SEQ ID NO: 5245008 - DNA, 14 bp, Homo sapiens
ataggtaggagacc

SEQ ID NO: 5245009 - DNA, 19 bp, Homo sapiens
ataggtaggtatctttata

SEQ ID NO: 5245010 - DNA, 17 bp, Homo sapiens
ataggtagttagcaata

SEQ ID NO: 5245011 - DNA, 15 bp, Homo sapiens
ataggtagtttggat

SEQ ID NO: 5245012 - DNA, 16 bp, Homo sapiens
ataggtatatagaaca

SEQ ID NO: 5245013 - DNA, 23 bp, Homo sapiens
ataggtatttcttccagtgatgt

SEQ ID NO: 5245014 - DNA, 15 bp, Homo sapiens
ataggtcactggctc

SEQ ID NO: 5245015 - DNA, 16 bp, Homo sapiens
ataggtcactggctct

SEQ ID NO: 5245016 - DNA, 20 bp, Homo sapiens
ataggtcactggctctccaa

SEQ ID NO: 5245017 - DNA, 18 bp, Homo sapiens
ataggtcataaagcattg

SEQ ID NO: 5245018 - DNA, 17 bp, Homo sapiens
ataggtcatcatgaaag

SEQ ID NO: 5245019 - DNA, 18 bp, Homo sapiens
ataggtccagaagtcctt

SEQ ID NO: 5245020 - DNA, 20 bp, Homo sapiens
ataggtctcttctcccagaa

SEQ ID NO: 5245021 - DNA, 15 bp, Homo sapiens
ataggtctgaaattt

SEQ ID NO: 5245022 - DNA, 15 bp, Homo sapiens
ataggtggaaagaga

SEQ ID NO: 5245023 - DNA, 20 bp, Homo sapiens
ataggtggaaagagaaatga

SEQ ID NO: 5245024 - DNA, 23 bp, Homo sapiens
ataggttaataaagatgattgaa

SEQ ID NO: 5245025 - DNA, 14 bp, Homo sapiens
ataggttagatata

SEQ ID NO: 5245026 - DNA, 18 bp, Homo sapiens
ataggttagattctcatt

SEQ ID NO: 5245027 - DNA, 13 bp, Homo sapiens
ataggttatatgc

SEQ ID NO: 5245028 - DNA, 14 bp, Homo sapiens
ataggttatatgca

SEQ ID NO: 5245029 - DNA, 16 bp, Homo sapiens
ataggttatatgcaag

SEQ ID NO: 5245030 - DNA, 18 bp, Homo sapiens
ataggttctgctttctga

SEQ ID NO: 5245031 - DNA, 21 bp, Homo sapiens
ataggttcttctatagtgatg

SEQ ID NO: 5245032 - DNA, 20 bp, Homo sapiens
ataggttgccaataatacac

SEQ ID NO: 5245033 - DNA, 12 bp, Homo sapiens
ataggtttagag

SEQ ID NO: 5245034 - DNA, 15 bp, Homo sapiens
ataggtttgtaaaat

SEQ ID NO: 5245035 - DNA, 17 bp, Homo sapiens
ataggttttgtttgcta

SEQ ID NO: 5245036 - DNA, 19 bp, Homo sapiens
ataggtttttaaagactag

SEQ ID NO: 5245037 - DNA, 20 bp, Homo sapiens
atagtaaaaagattctctgc

SEQ ID NO: 5245038 - DNA, 14 bp, Homo sapiens
atagtaaaaataaa

SEQ ID NO: 5245039 - DNA, 17 bp, Homo sapiens
atagtaaaacacttatt

SEQ ID NO: 5245040 - DNA, 14 bp, Homo sapiens
atagtaaaagaaat

SEQ ID NO: 5245041 - DNA, 16 bp, Homo sapiens
atagtaaaattctact

SEQ ID NO: 5245042 - DNA, 15 bp, Homo sapiens
atagtaaactaaagt

SEQ ID NO: 5245043 - DNA, 16 bp, Homo sapiens
atagtaaagtattttt

SEQ ID NO: 5245044 - DNA, 19 bp, Homo sapiens
atagtaaatcacgcttttt

SEQ ID NO: 5245045 - DNA, 14 bp, Homo sapiens
atagtaaatgtagt

SEQ ID NO: 5245046 - DNA, 16 bp, Homo sapiens
atagtaaatgtagttc

SEQ ID NO: 5245047 - DNA, 13 bp, Homo sapiens
atagtaacaggcc

SEQ ID NO: 5245048 - DNA, 17 bp, Homo sapiens
atagtaacgtgttactg

SEQ ID NO: 5245049 - DNA, 22 bp, Homo sapiens
atagtaactactttttatactc

SEQ ID NO: 5245050 - DNA, 15 bp, Homo sapiens
atagtaactataaga

SEQ ID NO: 5245051 - DNA, 13 bp, Homo sapiens
atagtaactctta

SEQ ID NO: 5245052 - DNA, 19 bp, Homo sapiens
atagtaactgacatgatta

SEQ ID NO: 5245053 - DNA, 20 bp, Homo sapiens
atagtaatcattgactaaag

SEQ ID NO: 5245054 - DNA, 23 bp, Homo sapiens
atagtaatgagtttaaaaatcaa

SEQ ID NO: 5245055 - DNA, 19 bp, Homo sapiens
atagtaattagtagaaatg

SEQ ID NO: 5245056 - DNA, 16 bp, Homo sapiens
atagtaatttgtaaag

SEQ ID NO: 5245057 - DNA, 17 bp, Homo sapiens
atagtacatcatgtaag

SEQ ID NO: 5245058 - DNA, 20 bp, Homo sapiens
atagtacatgataaatgata

SEQ ID NO: 5245059 - DNA, 16 bp, Homo sapiens
atagtaccagaagcaa

SEQ ID NO: 5245060 - DNA, 21 bp, Homo sapiens
atagtaccatttatacaaatt

SEQ ID NO: 5245061 - DNA, 15 bp, Homo sapiens
atagtactgctttac

SEQ ID NO: 5245062 - DNA, 16 bp, Homo sapiens
atagtactgctttact

SEQ ID NO: 5245063 - DNA, 19 bp, Homo sapiens
atagtactgctttactgtg

SEQ ID NO: 5245064 - DNA, 15 bp, Homo sapiens
atagtagaaaaatca

SEQ ID NO: 5245065 - DNA, 15 bp, Homo sapiens
atagtagatttgaac

SEQ ID NO: 5245066 - DNA, 19 bp, Homo sapiens
atagtagcagagtcattgt

SEQ ID NO: 5245067 - DNA, 20 bp, Homo sapiens
atagtagcagagtcattgtt

SEQ ID NO: 5245068 - DNA, 15 bp, Homo sapiens
atagtagcatacatt

SEQ ID NO: 5245069 - DNA, 18 bp, Homo sapiens
atagtaggaccaatgttg

SEQ ID NO: 5245070 - DNA, 20 bp, Homo sapiens
atagtaggcactaaatacat

SEQ ID NO: 5245071 - DNA, 17 bp, Homo sapiens
atagtaggctaaaaaca

SEQ ID NO: 5245072 - DNA, 19 bp, Homo sapiens
atagtaggggttgaagaaa

SEQ ID NO: 5245073 - DNA, 20 bp, Homo sapiens
atagtaggggttgaagaaaa

SEQ ID NO: 5245074 - DNA, 15 bp, Homo sapiens
atagtagtaaaatta

SEQ ID NO: 5245075 - DNA, 21 bp, Homo sapiens
atagtagtcaattagtacagt

SEQ ID NO: 5245076 - DNA, 18 bp, Homo sapiens
atagtagtctttaaaaga

SEQ ID NO: 5245077 - DNA, 17 bp, Homo sapiens
atagtagttaaataact

SEQ ID NO: 5245078 - DNA, 21 bp, Homo sapiens
atagtagttagcttaagtagt

SEQ ID NO: 5245079 - DNA, 12 bp, Homo sapiens
atagtataaacc

SEQ ID NO: 5245080 - DNA, 15 bp, Homo sapiens
atagtataactttaa

SEQ ID NO: 5245081 - DNA, 15 bp, Homo sapiens
atagtatacattgtc

SEQ ID NO: 5245082 - DNA, 18 bp, Homo sapiens
atagtatacattgtcttg

SEQ ID NO: 5245083 - DNA, 15 bp, Homo sapiens
atagtatacatttta

SEQ ID NO: 5245084 - DNA, 12 bp, Homo sapiens
atagtatagaaa

SEQ ID NO: 5245085 - DNA, 14 bp, Homo sapiens
atagtatagaaaat

SEQ ID NO: 5245086 - DNA, 23 bp, Homo sapiens
atagtatagaaaatggaaaatat

SEQ ID NO: 5245087 - DNA, 16 bp, Homo sapiens
atagtatagaatgaac

SEQ ID NO: 5245088 - DNA, 15 bp, Homo sapiens
atagtatatttatac

SEQ ID NO: 5245089 - DNA, 18 bp, Homo sapiens
atagtatatttatactct

SEQ ID NO: 5245090 - DNA, 18 bp, Homo sapiens
atagtatcctccaggttt

SEQ ID NO: 5245091 - DNA, 15 bp, Homo sapiens
atagtatctgtatat

SEQ ID NO: 5245092 - DNA, 20 bp, Homo sapiens
atagtatgagggttgaagac

SEQ ID NO: 5245093 - DNA, 23 bp, Homo sapiens
atagtatgggaaaaaaactgaag

SEQ ID NO: 5245094 - DNA, 16 bp, Homo sapiens
atagtatggtggctgg

SEQ ID NO: 5245095 - DNA, 13 bp, Homo sapiens
atagtatgtaatt

SEQ ID NO: 5245096 - DNA, 14 bp, Homo sapiens
atagtatgtaattt

SEQ ID NO: 5245097 - DNA, 13 bp, Homo sapiens
atagtatgtgact

SEQ ID NO: 5245098 - DNA, 15 bp, Homo sapiens
atagtatgtgacttt

SEQ ID NO: 5245099 - DNA, 16 bp, Homo sapiens
atagtatgtgactttt

SEQ ID NO: 5245100 - DNA, 22 bp, Homo sapiens
atagtatgtgacttttctgatt

SEQ ID NO: 5245101 - DNA, 13 bp, Homo sapiens
atagtattaacta

SEQ ID NO: 5245102 - DNA, 17 bp, Homo sapiens
atagtattaagtgaaat

SEQ ID NO: 5245103 - DNA, 20 bp, Homo sapiens
atagtattggaaaataaaaa

SEQ ID NO: 5245104 - DNA, 12 bp, Homo sapiens
atagtattggag

SEQ ID NO: 5245105 - DNA, 13 bp, Homo sapiens
atagtattggagc

SEQ ID NO: 5245106 - DNA, 23 bp, Homo sapiens
atagtatttcagatacttgaaga

SEQ ID NO: 5245107 - DNA, 13 bp, Homo sapiens
atagtatttctcc

SEQ ID NO: 5245108 - DNA, 20 bp, Homo sapiens
atagtatttctcctttgcaa

SEQ ID NO: 5245109 - DNA, 14 bp, Homo sapiens
atagtatttgaaaa

SEQ ID NO: 5245110 - DNA, 20 bp, Homo sapiens
atagtatttgaaaacagaaa

SEQ ID NO: 5245111 - DNA, 21 bp, Homo sapiens
atagtcaaaaattaaatatat

SEQ ID NO: 5245112 - DNA, 14 bp, Homo sapiens
atagtcaaattgtg

SEQ ID NO: 5245113 - DNA, 17 bp, Homo sapiens
atagtcaaattgtgtga

SEQ ID NO: 5245114 - DNA, 21 bp, Homo sapiens
atagtcaagaaaaattattgt

SEQ ID NO: 5245115 - DNA, 22 bp, Homo sapiens
atagtcaagaaaaattattgta

SEQ ID NO: 5245116 - DNA, 22 bp, Homo sapiens
atagtcaatatggggcattaat

SEQ ID NO: 5245117 - DNA, 16 bp, Homo sapiens
atagtcaatcaaacag

SEQ ID NO: 5245118 - DNA, 17 bp, Homo sapiens
atagtcaatcaaacagg

SEQ ID NO: 5245119 - DNA, 21 bp, Homo sapiens
atagtcaatcaaacagggaca

SEQ ID NO: 5245120 - DNA, 19 bp, Homo sapiens
atagtcaatggcttgttca

SEQ ID NO: 5245121 - DNA, 15 bp, Homo sapiens
atagtcacaaaaatg

SEQ ID NO: 5245122 - DNA, 16 bp, Homo sapiens
atagtcaccttttaaa

SEQ ID NO: 5245123 - DNA, 15 bp, Homo sapiens
atagtcagcagcagc

SEQ ID NO: 5245124 - DNA, 20 bp, Homo sapiens
atagtcagcagcagctctga

SEQ ID NO: 5245125 - DNA, 10 bp, Homo sapiens
atagtcagtg

SEQ ID NO: 5245126 - DNA, 16 bp, Homo sapiens
atagtcatatgtgaag

SEQ ID NO: 5245127 - DNA, 23 bp, Homo sapiens
atagtcatctcctaatttgtttc

SEQ ID NO: 5245128 - DNA, 13 bp, Homo sapiens
atagtcatgattc

SEQ ID NO: 5245129 - DNA, 24 bp, Homo sapiens
atagtcatgattctatgtaatgta

SEQ ID NO: 5245130 - DNA, 21 bp, Homo sapiens
atagtcatgctgctagatctt

SEQ ID NO: 5245131 - DNA, 19 bp, Homo sapiens
atagtcatgtttctgcagt

SEQ ID NO: 5245132 - DNA, 13 bp, Homo sapiens
atagtccaatatt

SEQ ID NO: 5245133 - DNA, 14 bp, Homo sapiens
atagtccaatattt

SEQ ID NO: 5245134 - DNA, 21 bp, Homo sapiens
atagtccatggacaatataaa

SEQ ID NO: 5245135 - DNA, 13 bp, Homo sapiens
atagtccttcctg

SEQ ID NO: 5245136 - DNA, 11 bp, Homo sapiens
atagtcctttt

SEQ ID NO: 5245137 - DNA, 15 bp, Homo sapiens
atagtcctttttcca

SEQ ID NO: 5245138 - DNA, 17 bp, Homo sapiens
atagtcctttttccaat

SEQ ID NO: 5245139 - DNA, 19 bp, Homo sapiens
atagtcctttttccaatgt

SEQ ID NO: 5245140 - DNA, 15 bp, Homo sapiens
atagtcgtaagtgga

SEQ ID NO: 5245141 - DNA, 14 bp, Homo sapiens
atagtctacagttg

SEQ ID NO: 5245142 - DNA, 17 bp, Homo sapiens
atagtctagtgtagtat

SEQ ID NO: 5245143 - DNA, 18 bp, Homo sapiens
atagtctcaaatcaaata

SEQ ID NO: 5245144 - DNA, 20 bp, Homo sapiens
atagtctctacctatagaaa

SEQ ID NO: 5245145 - DNA, 17 bp, Homo sapiens
atagtctcttgtttgtc

SEQ ID NO: 5245146 - DNA, 22 bp, Homo sapiens
atagtctgattttaatgaaatc

SEQ ID NO: 5245147 - DNA, 12 bp, Homo sapiens
atagtctggaaa

SEQ ID NO: 5245148 - DNA, 15 bp, Homo sapiens
atagtctgggtcaga

SEQ ID NO: 5245149 - DNA, 13 bp, Homo sapiens
atagtctgtactt

SEQ ID NO: 5245150 - DNA, 19 bp, Homo sapiens
atagtctgtgtgcacaatg

SEQ ID NO: 5245151 - DNA, 15 bp, Homo sapiens
atagtcttgaaatga

SEQ ID NO: 5245152 - DNA, 23 bp, Homo sapiens
atagtcttgaaatgaaagggaaa

SEQ ID NO: 5245153 - DNA, 22 bp, Homo sapiens
atagtcttggaagctgtttgga

SEQ ID NO: 5245154 - DNA, 13 bp, Homo sapiens
atagtctttcagt

SEQ ID NO: 5245155 - DNA, 14 bp, Homo sapiens
atagtcttttgctt

SEQ ID NO: 5245156 - DNA, 16 bp, Homo sapiens
atagtcttttgctttt

SEQ ID NO: 5245157 - DNA, 17 bp, Homo sapiens
atagtcttttgcttttg

SEQ ID NO: 5245158 - DNA, 17 bp, Homo sapiens
atcattttatagaaaat

SEQ ID NO: 5245159 - DNA, 14 bp, Homo sapiens
atcattttatgtca

SEQ ID NO: 5245160 - DNA, 23 bp, Homo sapiens
atcattttatgtcaagggcagct

SEQ ID NO: 5245161 - DNA, 14 bp, Homo sapiens
atcattttattata

SEQ ID NO: 5245162 - DNA, 17 bp, Homo sapiens
atcattttattcacata

SEQ ID NO: 5245163 - DNA, 24 bp, Homo sapiens
atcattttattcacatatgtctta

SEQ ID NO: 5245164 - DNA, 19 bp, Homo sapiens
atcattttccaattaatta

SEQ ID NO: 5245165 - DNA, 13 bp, Homo sapiens
atcattttccccc

SEQ ID NO: 5245166 - DNA, 17 bp, Homo sapiens
atcattttccccccact

SEQ ID NO: 5245167 - DNA, 13 bp, Homo sapiens
atcattttcctgg

SEQ ID NO: 5245168 - DNA, 22 bp, Homo sapiens
atcattttctagccctctccct

SEQ ID NO: 5245169 - DNA, 16 bp, Homo sapiens
atcattttctccacct

SEQ ID NO: 5245170 - DNA, 14 bp, Homo sapiens
atcattttgaaatt

SEQ ID NO: 5245171 - DNA, 15 bp, Homo sapiens
atcattttgaaattg

SEQ ID NO: 5245172 - DNA, 17 bp, Homo sapiens
atcattttgatgtatta

SEQ ID NO: 5245173 - DNA, 15 bp, Homo sapiens
atcattttgcattca

SEQ ID NO: 5245174 - DNA, 14 bp, Homo sapiens
atcattttgggaaa

SEQ ID NO: 5245175 - DNA, 22 bp, Homo sapiens
atcatttttataaccatggttt

SEQ ID NO: 5245176 - DNA, 17 bp, Homo sapiens
atcatttttatatgaaa

SEQ ID NO: 5245177 - DNA, 20 bp, Homo sapiens
atcatttttatatgaaataa

SEQ ID NO: 5245178 - DNA, 17 bp, Homo sapiens
atcatttttatattata

SEQ ID NO: 5245179 - DNA, 21 bp, Homo sapiens
atcatttttccaggactcttt

SEQ ID NO: 5245180 - DNA, 20 bp, Homo sapiens
atcatttttgtacagtttgc

SEQ ID NO: 5245181 - DNA, 15 bp, Homo sapiens
atcatttttgtataa

SEQ ID NO: 5245182 - DNA, 20 bp, Homo sapiens
atcatttttgtataaaaagg

SEQ ID NO: 5245183 - DNA, 14 bp, Homo sapiens
atcatttttgtgca

SEQ ID NO: 5245184 - DNA, 17 bp, Homo sapiens
atcattttttatatata

SEQ ID NO: 5245185 - DNA, 21 bp, Homo sapiens
atcattttttatatatatgca

SEQ ID NO: 5245186 - DNA, 17 bp, Homo sapiens
atcattttttgtttctt

SEQ ID NO: 5245187 - DNA, 12 bp, Homo sapiens
atccaaaagaaa

SEQ ID NO: 5245188 - DNA, 14 bp, Homo sapiens
atccaaaagaaaaa

SEQ ID NO: 5245189 - DNA, 19 bp, Homo sapiens
atccaaaagaagcccccag

SEQ ID NO: 5245190 - DNA, 20 bp, Homo sapiens
atccaaaagacaaaaatcaa

SEQ ID NO: 5245191 - DNA, 19 bp, Homo sapiens
atccaaaatagtcatgttt

SEQ ID NO: 5245192 - DNA, 19 bp, Homo sapiens
atccaaaatattttttgca

SEQ ID NO: 5245193 - DNA, 20 bp, Homo sapiens
atccaaaatattttttgcaa

SEQ ID NO: 5245194 - DNA, 13 bp, Homo sapiens
atccaaaatgctt

SEQ ID NO: 5245195 - DNA, 14 bp, Homo sapiens
atccaaaatgtgta

SEQ ID NO: 5245196 - DNA, 13 bp, Homo sapiens
atccaaacaattt

SEQ ID NO: 5245197 - DNA, 13 bp, Homo sapiens
atccaaacagaaa

SEQ ID NO: 5245198 - DNA, 20 bp, Homo sapiens
atccaaacatgtatttatgt

SEQ ID NO: 5245199 - DNA, 15 bp, Homo sapiens
atccaaacctacctt

SEQ ID NO: 5245200 - DNA, 22 bp, Homo sapiens
atccaaactcagaaggctttgg

SEQ ID NO: 5245201 - DNA, 18 bp, Homo sapiens
atccaaactgctgtctct

SEQ ID NO: 5245202 - DNA, 17 bp, Homo sapiens
atccaaagaactatgta

SEQ ID NO: 5245203 - DNA, 21 bp, Homo sapiens
atccaaagaacttgatttgca

SEQ ID NO: 5245204 - DNA, 15 bp, Homo sapiens
atccaaagcagacag

SEQ ID NO: 5245205 - DNA, 20 bp, Homo sapiens
atccaaagcattgcagaaca

SEQ ID NO: 5245206 - DNA, 20 bp, Homo sapiens
atccaaagcttattttgtaa

SEQ ID NO: 5245207 - DNA, 21 bp, Homo sapiens
atccaaagcttattttgtaag

SEQ ID NO: 5245208 - DNA, 21 bp, Homo sapiens
atccaaaggaatcagctgcag

SEQ ID NO: 5245209 - DNA, 14 bp, Homo sapiens
atccaaataatgaa

SEQ ID NO: 5245210 - DNA, 21 bp, Homo sapiens
atccaaatcttgaatttctgc

SEQ ID NO: 5245211 - DNA, 22 bp, Homo sapiens
atccaaatgctgtgcaaacagt

SEQ ID NO: 5245212 - DNA, 17 bp, Homo sapiens
atccaaatgtgaaagat

SEQ ID NO: 5245213 - DNA, 16 bp, Homo sapiens
atccaaattccctctg

SEQ ID NO: 5245214 - DNA, 20 bp, Homo sapiens
atccaaattgtgcttctccc

SEQ ID NO: 5245215 - DNA, 14 bp, Homo sapiens
atccaacaagaaga

SEQ ID NO: 5245216 - DNA, 22 bp, Homo sapiens
atccaacaagaagaaatatgaa

SEQ ID NO: 5245217 - DNA, 19 bp, Homo sapiens
atccaacagacctggtgct

SEQ ID NO: 5245218 - DNA, 15 bp, Homo sapiens
atccaaccattttca

SEQ ID NO: 5245219 - DNA, 18 bp, Homo sapiens
atccaacccatgcatggc

SEQ ID NO: 5245220 - DNA, 18 bp, Homo sapiens
atccaaccccccacctgc

SEQ ID NO: 5245221 - DNA, 14 bp, Homo sapiens
atccaactccagca

SEQ ID NO: 5245222 - DNA, 13 bp, Homo sapiens
atccaactccgaa

SEQ ID NO: 5245223 - DNA, 16 bp, Homo sapiens
atccaactctctgaga

SEQ ID NO: 5245224 - DNA, 14 bp, Homo sapiens
atccaactggaagg

SEQ ID NO: 5245225 - DNA, 21 bp, Homo sapiens
atccaactgtcagatctggat

SEQ ID NO: 5245226 - DNA, 21 bp, Homo sapiens
atccaagaaaatggccagtga

SEQ ID NO: 5245227 - DNA, 16 bp, Homo sapiens
atccaagcaagactga

SEQ ID NO: 5245228 - DNA, 17 bp, Homo sapiens
atccaagcctccacagc

SEQ ID NO: 5245229 - DNA, 20 bp, Homo sapiens
atccaagctcctattagaaa

SEQ ID NO: 5245230 - DNA, 18 bp, Homo sapiens
atccaagctggtcccact

SEQ ID NO: 5245231 - DNA, 23 bp, Homo sapiens
atccaagcttttttaaagtaaaa

SEQ ID NO: 5245232 - DNA, 15 bp, Homo sapiens
atccaaggaaacatg

SEQ ID NO: 5245233 - DNA, 21 bp, Homo sapiens
atccaaggaacctaattgaaa

SEQ ID NO: 5245234 - DNA, 21 bp, Homo sapiens
atccaaggaacttcatgcttg

SEQ ID NO: 5245235 - DNA, 13 bp, Homo sapiens
atccaaggagaaa

SEQ ID NO: 5245236 - DNA, 14 bp, Homo sapiens
atccaaggagaaac

SEQ ID NO: 5245237 - DNA, 16 bp, Homo sapiens
atccaaggcaaacaat

SEQ ID NO: 5245238 - DNA, 17 bp, Homo sapiens
atccaagggttgagagc

SEQ ID NO: 5245239 - DNA, 14 bp, Homo sapiens
atccaagtaccaat

SEQ ID NO: 5245240 - DNA, 22 bp, Homo sapiens
atccaagtattttatctgtgtt

SEQ ID NO: 5245241 - DNA, 19 bp, Homo sapiens
atccaagttgaaatcagaa

SEQ ID NO: 5245242 - DNA, 21 bp, Homo sapiens
atccaagttgaaatcagaagc

SEQ ID NO: 5245243 - DNA, 20 bp, Homo sapiens
atccaataattttcctgtga

SEQ ID NO: 5245244 - DNA, 17 bp, Homo sapiens
atccaataggatctcgt

SEQ ID NO: 5245245 - DNA, 16 bp, Homo sapiens
atccaatatcatgtct

SEQ ID NO: 5245246 - DNA, 22 bp, Homo sapiens
atccaatatcatgtcttgtgca

SEQ ID NO: 5245247 - DNA, 15 bp, Homo sapiens
atccaatatgactca

SEQ ID NO: 5245248 - DNA, 19 bp, Homo sapiens
atccaatatgactcagaga

SEQ ID NO: 5245249 - DNA, 19 bp, Homo sapiens
atccaatattttctttaat

SEQ ID NO: 5245250 - DNA, 16 bp, Homo sapiens
atccaatcagagacca

SEQ ID NO: 5245251 - DNA, 17 bp, Homo sapiens
atccaatcagagaccag

SEQ ID NO: 5245252 - DNA, 12 bp, Homo sapiens
atccaatcctca

SEQ ID NO: 5245253 - DNA, 14 bp, Homo sapiens
atccaatcctcagg

SEQ ID NO: 5245254 - DNA, 15 bp, Homo sapiens
atccaatcctcagga

SEQ ID NO: 5245255 - DNA, 21 bp, Homo sapiens
atccaatcctcaggatttcat

SEQ ID NO: 5245256 - DNA, 16 bp, Homo sapiens
atccaatctcaaggaa

SEQ ID NO: 5245257 - DNA, 17 bp, Homo sapiens
atccaatctgtaatttc

SEQ ID NO: 5245258 - DNA, 18 bp, Homo sapiens
atccaatgtcttttgaca

SEQ ID NO: 5245259 - DNA, 12 bp, Homo sapiens
atccaatgttag

SEQ ID NO: 5245260 - DNA, 18 bp, Homo sapiens
atccaattaatgattcaa

SEQ ID NO: 5245261 - DNA, 20 bp, Homo sapiens
atccaattaatgattcaatt

SEQ ID NO: 5245262 - DNA, 16 bp, Homo sapiens
atccaattatgtgaca

SEQ ID NO: 5245263 - DNA, 21 bp, Homo sapiens
atccaattcccaccactaaaa

SEQ ID NO: 5245264 - DNA, 17 bp, Homo sapiens
atccaattgctctttca

SEQ ID NO: 5245265 - DNA, 17 bp, Homo sapiens
atccaattttaaaatga

SEQ ID NO: 5245266 - DNA, 20 bp, Homo sapiens
atccaattttaaaatgaaat

SEQ ID NO: 5245267 - DNA, 22 bp, Homo sapiens
atccaattttaaaatgaaatgc

SEQ ID NO: 5245268 - DNA, 15 bp, Homo sapiens
atccaattttaatat

SEQ ID NO: 5245269 - DNA, 17 bp, Homo sapiens
atccacaaaagaagtga

SEQ ID NO: 5245270 - DNA, 13 bp, Homo sapiens
atccacaaatatg

SEQ ID NO: 5245271 - DNA, 16 bp, Homo sapiens
atccacaaatgctatt

SEQ ID NO: 5245272 - DNA, 20 bp, Homo sapiens
atccacaactaatgagggaa

SEQ ID NO: 5245273 - DNA, 22 bp, Homo sapiens
atccacaaggacctctttactc

SEQ ID NO: 5245274 - DNA, 21 bp, Homo sapiens
atccacaagtcacggtctaaa

SEQ ID NO: 5245275 - DNA, 13 bp, Homo sapiens
atccacaattatt

SEQ ID NO: 5245276 - DNA, 12 bp, Homo sapiens
atccacacaaat

SEQ ID NO: 5245277 - DNA, 15 bp, Homo sapiens
atccacacacagagg

SEQ ID NO: 5245278 - DNA, 20 bp, Homo sapiens
atccacacacagaggaagag

SEQ ID NO: 5245279 - DNA, 13 bp, Homo sapiens
atccacacacagt

SEQ ID NO: 5245280 - DNA, 19 bp, Homo sapiens
atccacacacgcaggaact

SEQ ID NO: 5245281 - DNA, 15 bp, Homo sapiens
atccacaccctctcc

SEQ ID NO: 5245282 - DNA, 13 bp, Homo sapiens
atccacagagagt

SEQ ID NO: 5245283 - DNA, 16 bp, Homo sapiens
atccacagccaacaaa

SEQ ID NO: 5245284 - DNA, 17 bp, Homo sapiens
atccacagccaacaaac

SEQ ID NO: 5245285 - DNA, 22 bp, Homo sapiens
atccacagccttgcagcggctc

SEQ ID NO: 5245286 - DNA, 17 bp, Homo sapiens
atccacagctatatcct

SEQ ID NO: 5245287 - DNA, 23 bp, Homo sapiens
atccacaggatattaaacgtgta

SEQ ID NO: 5245288 - DNA, 14 bp, Homo sapiens
atccacagtaatct

SEQ ID NO: 5245289 - DNA, 18 bp, Homo sapiens
atccacagtatgttacat

SEQ ID NO: 5245290 - DNA, 17 bp, Homo sapiens
atccacagtgagttggg

SEQ ID NO: 5245291 - DNA, 14 bp, Homo sapiens
atccacataaaaga

SEQ ID NO: 5245292 - DNA, 12 bp, Homo sapiens
atccacataaat

SEQ ID NO: 5245293 - DNA, 16 bp, Homo sapiens
atccacataaatgctc

SEQ ID NO: 5245294 - DNA, 22 bp, Homo sapiens
atccacataaatgctccttgtg

SEQ ID NO: 5245295 - DNA, 18 bp, Homo sapiens
atccacataaccctgtca

SEQ ID NO: 5245296 - DNA, 15 bp, Homo sapiens
atccacatgcacatg

SEQ ID NO: 5245297 - DNA, 15 bp, Homo sapiens
atccacattgtttta

SEQ ID NO: 5245298 - DNA, 17 bp, Homo sapiens
atccacattgttttaaa

SEQ ID NO: 5245299 - DNA, 19 bp, Homo sapiens
atccacattgttttaaaaa

SEQ ID NO: 5245300 - DNA, 16 bp, Homo sapiens
atccacattttaacag

SEQ ID NO: 5245301 - DNA, 19 bp, Homo sapiens
atccaccaccaaaattatt

SEQ ID NO: 5245302 - DNA, 14 bp, Homo sapiens
atccaccaccccac

SEQ ID NO: 5245303 - DNA, 16 bp, Homo sapiens
atccaccaccccaccc

SEQ ID NO: 5245304 - DNA, 17 bp, Homo sapiens
atccaccacctccctca

SEQ ID NO: 5245305 - DNA, 14 bp, Homo sapiens
atccaccagtgtgt

SEQ ID NO: 5245306 - DNA, 17 bp, Homo sapiens
atccacccacctcagcc

SEQ ID NO: 5245307 - DNA, 14 bp, Homo sapiens
atccacccacctgg

SEQ ID NO: 5245308 - DNA, 18 bp, Homo sapiens
atccacccagcaggcaga

SEQ ID NO: 5245309 - DNA, 14 bp, Homo sapiens
atccacccagccca

SEQ ID NO: 5245310 - DNA, 13 bp, Homo sapiens
atccaccccagcc

SEQ ID NO: 5245311 - DNA, 14 bp, Homo sapiens
atccaccccagccc

SEQ ID NO: 5245312 - DNA, 22 bp, Homo sapiens
atccaccccagccccactgccc

SEQ ID NO: 5245313 - DNA, 12 bp, Homo sapiens
atccacccccag

SEQ ID NO: 5245314 - DNA, 17 bp, Homo sapiens
atccacccccaggtgca

SEQ ID NO: 5245315 - DNA, 21 bp, Homo sapiens
atccacccccaggtgcagccc

SEQ ID NO: 5245316 - DNA, 23 bp, Homo sapiens
atccaccccggctccccctgcca

SEQ ID NO: 5245317 - DNA, 16 bp, Homo sapiens
atccacccctctggca

SEQ ID NO: 5245318 - DNA, 22 bp, Homo sapiens
atccacccgctgcccctccccg

SEQ ID NO: 5245319 - DNA, 20 bp, Homo sapiens
atccacccgggggagcccag

SEQ ID NO: 5245320 - DNA, 21 bp, Homo sapiens
atccaccctatccctgtacag

SEQ ID NO: 5245321 - DNA, 22 bp, Homo sapiens
atccaccctatccctgtacaga

SEQ ID NO: 5245322 - DNA, 16 bp, Homo sapiens
atccaccgccacccca

SEQ ID NO: 5245323 - DNA, 17 bp, Homo sapiens
atccaccgccaccccac

SEQ ID NO: 5245324 - DNA, 17 bp, Homo sapiens
atccaccgccagcttcc

SEQ ID NO: 5245325 - DNA, 17 bp, Homo sapiens
atccaccggcctcggcc

SEQ ID NO: 5245326 - DNA, 16 bp, Homo sapiens
atccaccgtcccctcc

SEQ ID NO: 5245327 - DNA, 21 bp, Homo sapiens
atccacctcatcactggactg

SEQ ID NO: 5245328 - DNA, 16 bp, Homo sapiens
atccacctccctacca

SEQ ID NO: 5245329 - DNA, 22 bp, Homo sapiens
atccacctcggagcatggtgtt

SEQ ID NO: 5245330 - DNA, 13 bp, Homo sapiens
atccacctgcaca

SEQ ID NO: 5245331 - DNA, 17 bp, Homo sapiens
atccacctgccttggcc

SEQ ID NO: 5245332 - DNA, 20 bp, Homo sapiens
atccacctggtggccctgcg

SEQ ID NO: 5245333 - DNA, 18 bp, Homo sapiens
atccacctgtcttggcct

SEQ ID NO: 5245334 - DNA, 12 bp, Homo sapiens
atccaccttcag

SEQ ID NO: 5245335 - DNA, 17 bp, Homo sapiens
atccaccttcaggcccc

SEQ ID NO: 5245336 - DNA, 15 bp, Homo sapiens
atccaccttcctgcc

SEQ ID NO: 5245337 - DNA, 18 bp, Homo sapiens
atagtctttttcagttcc

SEQ ID NO: 5245338 - DNA, 12 bp, Homo sapiens
atagtgaaaatt

SEQ ID NO: 5245339 - DNA, 18 bp, Homo sapiens
atagtgaaacatgtactt

SEQ ID NO: 5245340 - DNA, 15 bp, Homo sapiens
atagtgaacacagca

SEQ ID NO: 5245341 - DNA, 19 bp, Homo sapiens
atagtgaacacagcagacc

SEQ ID NO: 5245342 - DNA, 12 bp, Homo sapiens
atagtgaagaat

SEQ ID NO: 5245343 - DNA, 19 bp, Homo sapiens
atagtgaagcaatttgaaa

SEQ ID NO: 5245344 - DNA, 22 bp, Homo sapiens
atagtgaagtgttaatacatca

SEQ ID NO: 5245345 - DNA, 13 bp, Homo sapiens
atagtgaatactg

SEQ ID NO: 5245346 - DNA, 23 bp, Homo sapiens
atagtgaatacttactataattt

SEQ ID NO: 5245347 - DNA, 12 bp, Homo sapiens
atagtgaatttt

SEQ ID NO: 5245348 - DNA, 20 bp, Homo sapiens
atagtgaattttaaaatgta

SEQ ID NO: 5245349 - DNA, 17 bp, Homo sapiens
atagtgacatgcagtta

SEQ ID NO: 5245350 - DNA, 14 bp, Homo sapiens
atagtgacgatact

SEQ ID NO: 5245351 - DNA, 15 bp, Homo sapiens
atagtgactaaacta

SEQ ID NO: 5245352 - DNA, 15 bp, Homo sapiens
atagtgagaacccat

SEQ ID NO: 5245353 - DNA, 17 bp, Homo sapiens
atagtgagatttaagtt

SEQ ID NO: 5245354 - DNA, 21 bp, Homo sapiens
atagtgagccatgattttcta

SEQ ID NO: 5245355 - DNA, 21 bp, Homo sapiens
atagtgaggcatcgcaatgta

SEQ ID NO: 5245356 - DNA, 15 bp, Homo sapiens
atagtgatcaagaag

SEQ ID NO: 5245357 - DNA, 20 bp, Homo sapiens
atagtgatcaagaagacttt

SEQ ID NO: 5245358 - DNA, 20 bp, Homo sapiens
atagtgatgtaatcttgaat

SEQ ID NO: 5245359 - DNA, 18 bp, Homo sapiens
atagtgcaaaactgtgtc

SEQ ID NO: 5245360 - DNA, 20 bp, Homo sapiens
atagtgcaaaactgtgtcac

SEQ ID NO: 5245361 - DNA, 18 bp, Homo sapiens
atagtgcaactgttttga

SEQ ID NO: 5245362 - DNA, 16 bp, Homo sapiens
atagtgcaatagtgca

SEQ ID NO: 5245363 - DNA, 13 bp, Homo sapiens
atagtgcaatata

SEQ ID NO: 5245364 - DNA, 20 bp, Homo sapiens
atagtgcaatatattttgta

SEQ ID NO: 5245365 - DNA, 19 bp, Homo sapiens
atagtgcagaaaacgtggc

SEQ ID NO: 5245366 - DNA, 22 bp, Homo sapiens
atagtgcattgtttctgtgggc

SEQ ID NO: 5245367 - DNA, 13 bp, Homo sapiens
atagtgccaggtg

SEQ ID NO: 5245368 - DNA, 14 bp, Homo sapiens
atagtgctaacatg

SEQ ID NO: 5245369 - DNA, 22 bp, Homo sapiens
atagtgctaacatgaagacctt

SEQ ID NO: 5245370 - DNA, 14 bp, Homo sapiens
atagtgctatatat

SEQ ID NO: 5245371 - DNA, 16 bp, Homo sapiens
atagtgctatatatat

SEQ ID NO: 5245372 - DNA, 18 bp, Homo sapiens
atagtgctgtttaagcta

SEQ ID NO: 5245373 - DNA, 17 bp, Homo sapiens
atagtgcttaaaaatca

SEQ ID NO: 5245374 - DNA, 17 bp, Homo sapiens
atagtgcttcttgtaat

SEQ ID NO: 5245375 - DNA, 16 bp, Homo sapiens
atagtggaacattttc

SEQ ID NO: 5245376 - DNA, 20 bp, Homo sapiens
atagtggatctcagttttta

SEQ ID NO: 5245377 - DNA, 15 bp, Homo sapiens
atagtggatggacag

SEQ ID NO: 5245378 - DNA, 19 bp, Homo sapiens
atagtggcataccaaatgg

SEQ ID NO: 5245379 - DNA, 13 bp, Homo sapiens
atagtggccagac

SEQ ID NO: 5245380 - DNA, 15 bp, Homo sapiens
atagtggctttcatt

SEQ ID NO: 5245381 - DNA, 15 bp, Homo sapiens
atagtgggatttcca

SEQ ID NO: 5245382 - DNA, 22 bp, Homo sapiens
atagtgggccttcattaaatgt

SEQ ID NO: 5245383 - DNA, 16 bp, Homo sapiens
atagtggggagacttc

SEQ ID NO: 5245384 - DNA, 14 bp, Homo sapiens
atagtggtatttta

SEQ ID NO: 5245385 - DNA, 17 bp, Homo sapiens
atagtggtcatttggtg

SEQ ID NO: 5245386 - DNA, 15 bp, Homo sapiens
atagtggtgtgattt

SEQ ID NO: 5245387 - DNA, 13 bp, Homo sapiens
atagtgtaaaata

SEQ ID NO: 5245388 - DNA, 20 bp, Homo sapiens
atagtgtaagaactgtacat

SEQ ID NO: 5245389 - DNA, 23 bp, Homo sapiens
atagtgtaagaactgtacattgt

SEQ ID NO: 5245390 - DNA, 16 bp, Homo sapiens
atagtgtaataatgtt

SEQ ID NO: 5245391 - DNA, 22 bp, Homo sapiens
atagtgtataccacctgtacat

SEQ ID NO: 5245392 - DNA, 20 bp, Homo sapiens
atagtgtcatataaactcat

SEQ ID NO: 5245393 - DNA, 16 bp, Homo sapiens
atagtgtcctgcccac

SEQ ID NO: 5245394 - DNA, 14 bp, Homo sapiens
atagtgtgtccatg

SEQ ID NO: 5245395 - DNA, 12 bp, Homo sapiens
atagtgtgttct

SEQ ID NO: 5245396 - DNA, 13 bp, Homo sapiens
atagtgtgttctg

SEQ ID NO: 5245397 - DNA, 23 bp, Homo sapiens
atagtgtgttctgattagaaatg

SEQ ID NO: 5245398 - DNA, 17 bp, Homo sapiens
atagtgttaactgtcag

SEQ ID NO: 5245399 - DNA, 19 bp, Homo sapiens
atagtgttcacaaactgtg

SEQ ID NO: 5245400 - DNA, 14 bp, Homo sapiens
atagtgttctctgt

SEQ ID NO: 5245401 - DNA, 14 bp, Homo sapiens
atagtgttgaggag

SEQ ID NO: 5245402 - DNA, 14 bp, Homo sapiens
atagtgttgtgtta

SEQ ID NO: 5245403 - DNA, 19 bp, Homo sapiens
atagtgttgtgttacaata

SEQ ID NO: 5245404 - DNA, 18 bp, Homo sapiens
atagtgtttaactggcat

SEQ ID NO: 5245405 - DNA, 16 bp, Homo sapiens
atagtgttttgtactt

SEQ ID NO: 5245406 - DNA, 15 bp, Homo sapiens
atagttaaaaattaa

SEQ ID NO: 5245407 - DNA, 14 bp, Homo sapiens
atagttaaaatgct

SEQ ID NO: 5245408 - DNA, 21 bp, Homo sapiens
atagttaaatgttacctctga

SEQ ID NO: 5245409 - DNA, 14 bp, Homo sapiens
atagttaacacact

SEQ ID NO: 5245410 - DNA, 15 bp, Homo sapiens
atagttaacacacta

SEQ ID NO: 5245411 - DNA, 22 bp, Homo sapiens
atagttaacatagtaagttcag

SEQ ID NO: 5245412 - DNA, 20 bp, Homo sapiens
atagttaagcaaatttcatt

SEQ ID NO: 5245413 - DNA, 23 bp, Homo sapiens
atagttaatgaaggtgtgctaca

SEQ ID NO: 5245414 - DNA, 18 bp, Homo sapiens
atagttacaacattaatt

SEQ ID NO: 5245415 - DNA, 13 bp, Homo sapiens
atagttacataat

SEQ ID NO: 5245416 - DNA, 19 bp, Homo sapiens
atagttaccgatggtgtcc

SEQ ID NO: 5245417 - DNA, 18 bp, Homo sapiens
atagttactgtaaaatgc

SEQ ID NO: 5245418 - DNA, 17 bp, Homo sapiens
atagttactgtgtaaac

SEQ ID NO: 5245419 - DNA, 18 bp, Homo sapiens
atagttactgtgtaaact

SEQ ID NO: 5245420 - DNA, 20 bp, Homo sapiens
atagttactgtgtaaactca

SEQ ID NO: 5245421 - DNA, 12 bp, Homo sapiens
atagttactgtt

SEQ ID NO: 5245422 - DNA, 19 bp, Homo sapiens
atagttagaactgattaca

SEQ ID NO: 5245423 - DNA, 18 bp, Homo sapiens
atagttagatctttgtaa

SEQ ID NO: 5245424 - DNA, 23 bp, Homo sapiens
atagttagatctttgtaaatgca

SEQ ID NO: 5245425 - DNA, 14 bp, Homo sapiens
atagttagctttat

SEQ ID NO: 5245426 - DNA, 18 bp, Homo sapiens
atagttatatgtacagtt

SEQ ID NO: 5245427 - DNA, 18 bp, Homo sapiens
atagttatgtaaataatt

SEQ ID NO: 5245428 - DNA, 16 bp, Homo sapiens
atagttattaaatgtt

SEQ ID NO: 5245429 - DNA, 22 bp, Homo sapiens
atagttattgttttatgttcta

SEQ ID NO: 5245430 - DNA, 22 bp, Homo sapiens
atagttatttacttgaaagatg

SEQ ID NO: 5245431 - DNA, 22 bp, Homo sapiens
atagttattttaatacctttaa

SEQ ID NO: 5245432 - DNA, 15 bp, Homo sapiens
atagttcaaagccaa

SEQ ID NO: 5245433 - DNA, 15 bp, Homo sapiens
atagttcaaggaact

SEQ ID NO: 5245434 - DNA, 19 bp, Homo sapiens
atagttcactgacacagta

SEQ ID NO: 5245435 - DNA, 20 bp, Homo sapiens
atagttcacttactcttaca

SEQ ID NO: 5245436 - DNA, 21 bp, Homo sapiens
atagttcatagttggaaatat

SEQ ID NO: 5245437 - DNA, 18 bp, Homo sapiens
atagttccattctatgac

SEQ ID NO: 5245438 - DNA, 20 bp, Homo sapiens
atagttcccaggtgatattt

SEQ ID NO: 5245439 - DNA, 12 bp, Homo sapiens
atagttctaaac

SEQ ID NO: 5245440 - DNA, 20 bp, Homo sapiens
atagttctaaacacattctt

SEQ ID NO: 5245441 - DNA, 12 bp, Homo sapiens
atagttctaggc

SEQ ID NO: 5245442 - DNA, 18 bp, Homo sapiens
atagttctagtgcagctg

SEQ ID NO: 5245443 - DNA, 16 bp, Homo sapiens
atagttctatcctttt

SEQ ID NO: 5245444 - DNA, 13 bp, Homo sapiens
atagttctatttc

SEQ ID NO: 5245445 - DNA, 20 bp, Homo sapiens
atagttctatttctatctgc

SEQ ID NO: 5245446 - DNA, 14 bp, Homo sapiens
atagttctgcaggt

SEQ ID NO: 5245447 - DNA, 18 bp, Homo sapiens
atagttctgtaataaaac

SEQ ID NO: 5245448 - DNA, 14 bp, Homo sapiens
atagttctgtatat

SEQ ID NO: 5245449 - DNA, 22 bp, Homo sapiens
atagttctgttaaatatttttg

SEQ ID NO: 5245450 - DNA, 16 bp, Homo sapiens
atagttcttaaaatta

SEQ ID NO: 5245451 - DNA, 19 bp, Homo sapiens
atagttcttaaaattagtg

SEQ ID NO: 5245452 - DNA, 20 bp, Homo sapiens
atagttgaaagtaaaaaaat

SEQ ID NO: 5245453 - DNA, 13 bp, Homo sapiens
atagttgaagatt

SEQ ID NO: 5245454 - DNA, 20 bp, Homo sapiens
atagttgagattgtactgtt

SEQ ID NO: 5245455 - DNA, 17 bp, Homo sapiens
atagttgagccagcaga

SEQ ID NO: 5245456 - DNA, 18 bp, Homo sapiens
atagttgagccagcagac

SEQ ID NO: 5245457 - DNA, 22 bp, Homo sapiens
atagttgagccagcagacattg

SEQ ID NO: 5245458 - DNA, 15 bp, Homo sapiens
atagttgatgcatgt

SEQ ID NO: 5245459 - DNA, 14 bp, Homo sapiens
atagttgcagccca

SEQ ID NO: 5245460 - DNA, 15 bp, Homo sapiens
atagttgcagcccaa

SEQ ID NO: 5245461 - DNA, 20 bp, Homo sapiens
atagttgcatagcagtatat

SEQ ID NO: 5245462 - DNA, 15 bp, Homo sapiens
atagttgctgtcccc

SEQ ID NO: 5245463 - DNA, 13 bp, Homo sapiens
atagttggaaata

SEQ ID NO: 5245464 - DNA, 19 bp, Homo sapiens
atagttggaaatatttgcg

SEQ ID NO: 5245465 - DNA, 22 bp, Homo sapiens
atagttggaaatatttgcgtaa

SEQ ID NO: 5245466 - DNA, 22 bp, Homo sapiens
atagttggctaggacccctcca

SEQ ID NO: 5245467 - DNA, 17 bp, Homo sapiens
atagttggttcttttac

SEQ ID NO: 5245468 - DNA, 13 bp, Homo sapiens
atagttgtaacta

SEQ ID NO: 5245469 - DNA, 20 bp, Homo sapiens
atagttgtaccgcaatgtga

SEQ ID NO: 5245470 - DNA, 18 bp, Homo sapiens
atagttgtagacaaagta

SEQ ID NO: 5245471 - DNA, 15 bp, Homo sapiens
atagttgtagactat

SEQ ID NO: 5245472 - DNA, 18 bp, Homo sapiens
atagttgtcagaatatgt

SEQ ID NO: 5245473 - DNA, 23 bp, Homo sapiens
atagttgtctttctttgctgctg

SEQ ID NO: 5245474 - DNA, 19 bp, Homo sapiens
atagtttaaaaatctgcca

SEQ ID NO: 5245475 - DNA, 14 bp, Homo sapiens
atagtttacatgta

SEQ ID NO: 5245476 - DNA, 16 bp, Homo sapiens
atagtttaggagaaac

SEQ ID NO: 5245477 - DNA, 13 bp, Homo sapiens
atagtttatctta

SEQ ID NO: 5245478 - DNA, 17 bp, Homo sapiens
atagtttattatagtct

SEQ ID NO: 5245479 - DNA, 22 bp, Homo sapiens
atagtttattatagtctgtact

SEQ ID NO: 5245480 - DNA, 13 bp, Homo sapiens
atagtttattgac

SEQ ID NO: 5245481 - DNA, 14 bp, Homo sapiens
atagtttctgaggc

SEQ ID NO: 5245482 - DNA, 19 bp, Homo sapiens
atagtttctgaggctttat

SEQ ID NO: 5245483 - DNA, 19 bp, Homo sapiens
atagtttctgtaattggct

SEQ ID NO: 5245484 - DNA, 22 bp, Homo sapiens
atagtttctttattttgtgtaa

SEQ ID NO: 5245485 - DNA, 12 bp, Homo sapiens
atagtttggcat

SEQ ID NO: 5245486 - DNA, 14 bp, Homo sapiens
atagtttggcattt

SEQ ID NO: 5245487 - DNA, 19 bp, Homo sapiens
atagtttgttttctttttc

SEQ ID NO: 5245488 - DNA, 21 bp, Homo sapiens
atagtttgttttctttttctg

SEQ ID NO: 5245489 - DNA, 15 bp, Homo sapiens
atagttttaaatatg

SEQ ID NO: 5245490 - DNA, 18 bp, Homo sapiens
atagttttacattaacat

SEQ ID NO: 5245491 - DNA, 20 bp, Homo sapiens
atagttttacccataagtaa

SEQ ID NO: 5245492 - DNA, 16 bp, Homo sapiens
atagttttattaataa

SEQ ID NO: 5245493 - DNA, 18 bp, Homo sapiens
atagttttatttatattt

SEQ ID NO: 5245494 - DNA, 11 bp, Homo sapiens
atagttttcac

SEQ ID NO: 5245495 - DNA, 13 bp, Homo sapiens
atagttttcatcc

SEQ ID NO: 5245496 - DNA, 13 bp, Homo sapiens
atagttttcattt

SEQ ID NO: 5245497 - DNA, 15 bp, Homo sapiens
atagttttctaaatg

SEQ ID NO: 5245498 - DNA, 23 bp, Homo sapiens
atagttttcttcctttgaaagac

SEQ ID NO: 5245499 - DNA, 23 bp, Homo sapiens
atagttttgctaggtataaaaaa

SEQ ID NO: 5245500 - DNA, 19 bp, Homo sapiens
atagttttgctttgttgaa

SEQ ID NO: 5245501 - DNA, 22 bp, Homo sapiens
atagttttgctttgttgaataa

SEQ ID NO: 5245502 - DNA, 14 bp, Homo sapiens
atagttttgtttaa

SEQ ID NO: 5245503 - DNA, 22 bp, Homo sapiens
atataaaaacaacaaatacttc

SEQ ID NO: 5245504 - DNA, 19 bp, Homo sapiens
atataaaaacagattctga

SEQ ID NO: 5245505 - DNA, 18 bp, Homo sapiens
atataaaaagaaaagata

SEQ ID NO: 5245506 - DNA, 22 bp, Homo sapiens
atataaaaagaaaagataaaga

SEQ ID NO: 5245507 - DNA, 23 bp, Homo sapiens
atataaaaagaaaagataaagat

SEQ ID NO: 5245508 - DNA, 23 bp, Homo sapiens
atataaaaagcagatagatggcg

SEQ ID NO: 5245509 - DNA, 22 bp, Homo sapiens
atataaaaataattaaaacaaa

SEQ ID NO: 5245510 - DNA, 18 bp, Homo sapiens
atataaaaatatatgttg

SEQ ID NO: 5245511 - DNA, 19 bp, Homo sapiens
atataaaaatatatgttga

SEQ ID NO: 5245512 - DNA, 15 bp, Homo sapiens
atataaaaatggctt

SEQ ID NO: 5245513 - DNA, 15 bp, Homo sapiens
atataaaaatgtgaa

SEQ ID NO: 5245514 - DNA, 16 bp, Homo sapiens
atataaaaatgtgaat

SEQ ID NO: 5245515 - DNA, 15 bp, Homo sapiens
atataaaacaaaaca

SEQ ID NO: 5245516 - DNA, 17 bp, Homo sapiens
atccaccttcctgccca

SEQ ID NO: 5245517 - DNA, 19 bp, Homo sapiens
atccaccttcctgcccagg

SEQ ID NO: 5245518 - DNA, 13 bp, Homo sapiens
atccaccttggct

SEQ ID NO: 5245519 - DNA, 15 bp, Homo sapiens
atccaccttggctct

SEQ ID NO: 5245520 - DNA, 22 bp, Homo sapiens
atccaccttggctctgccagtg

SEQ ID NO: 5245521 - DNA, 15 bp, Homo sapiens
atccacgcacacatg

SEQ ID NO: 5245522 - DNA, 16 bp, Homo sapiens
atccacgcacacatgg

SEQ ID NO: 5245523 - DNA, 23 bp, Homo sapiens
atccacgctgggcctaggatggg

SEQ ID NO: 5245524 - DNA, 21 bp, Homo sapiens
atccacgtagggggcaggggc

SEQ ID NO: 5245525 - DNA, 23 bp, Homo sapiens
atccactaatattcagtcctgta

SEQ ID NO: 5245526 - DNA, 21 bp, Homo sapiens
atccactagtgcaaatcatag

SEQ ID NO: 5245527 - DNA, 13 bp, Homo sapiens
atccactcgcctt

SEQ ID NO: 5245528 - DNA, 16 bp, Homo sapiens
atccactctaccctcc

SEQ ID NO: 5245529 - DNA, 22 bp, Homo sapiens
atccactctaccctcccacccc

SEQ ID NO: 5245530 - DNA, 19 bp, Homo sapiens
atccactctgcctgcttac

SEQ ID NO: 5245531 - DNA, 16 bp, Homo sapiens
atccactgcaatacta

SEQ ID NO: 5245532 - DNA, 24 bp, Homo sapiens
atccactggacactgtgaaataca

SEQ ID NO: 5245533 - DNA, 20 bp, Homo sapiens
atccactgggtgtaaacaca

SEQ ID NO: 5245534 - DNA, 15 bp, Homo sapiens
atccacttcttaatg

SEQ ID NO: 5245535 - DNA, 20 bp, Homo sapiens
atccacttcttggttcctgg

SEQ ID NO: 5245536 - DNA, 21 bp, Homo sapiens
atccacttcttggttcctggg

SEQ ID NO: 5245537 - DNA, 24 bp, Homo sapiens
atccacttcttggttcctgggatg

SEQ ID NO: 5245538 - DNA, 17 bp, Homo sapiens
atccacttttcttcttc

SEQ ID NO: 5245539 - DNA, 17 bp, Homo sapiens
atccagaaaactgtgat

SEQ ID NO: 5245540 - DNA, 20 bp, Homo sapiens
atccagaaacttgttcttcc

SEQ ID NO: 5245541 - DNA, 13 bp, Homo sapiens
atccagaaagaaa

SEQ ID NO: 5245542 - DNA, 14 bp, Homo sapiens
atccagaaagctga

SEQ ID NO: 5245543 - DNA, 15 bp, Homo sapiens
atccagaaagctgag

SEQ ID NO: 5245544 - DNA, 21 bp, Homo sapiens
atccagaactgtcttagtcat

SEQ ID NO: 5245545 - DNA, 15 bp, Homo sapiens
atccagaaggaagct

SEQ ID NO: 5245546 - DNA, 23 bp, Homo sapiens
atccagactcagagctctctcta

SEQ ID NO: 5245547 - DNA, 18 bp, Homo sapiens
atccagactttctttttc

SEQ ID NO: 5245548 - DNA, 15 bp, Homo sapiens
atccagagaccaaat

SEQ ID NO: 5245549 - DNA, 14 bp, Homo sapiens
atccagagacctgc

SEQ ID NO: 5245550 - DNA, 17 bp, Homo sapiens
atccagagattcatttt

SEQ ID NO: 5245551 - DNA, 23 bp, Homo sapiens
atccagagattcattttctagat

SEQ ID NO: 5245552 - DNA, 12 bp, Homo sapiens
atccagaggaac

SEQ ID NO: 5245553 - DNA, 20 bp, Homo sapiens
atccagagtccctgcctgga

SEQ ID NO: 5245554 - DNA, 20 bp, Homo sapiens
atccagatacacccaaagta

SEQ ID NO: 5245555 - DNA, 18 bp, Homo sapiens
atccagatagcctagggt

SEQ ID NO: 5245556 - DNA, 15 bp, Homo sapiens
atccagatggtggga

SEQ ID NO: 5245557 - DNA, 20 bp, Homo sapiens
atccagatggtgggatgtgg

SEQ ID NO: 5245558 - DNA, 23 bp, Homo sapiens
atccagatgtggctactgacata

SEQ ID NO: 5245559 - DNA, 17 bp, Homo sapiens
atccagattcccaggcc

SEQ ID NO: 5245560 - DNA, 15 bp, Homo sapiens
atccagcaggtcaca

SEQ ID NO: 5245561 - DNA, 18 bp, Homo sapiens
atccagcagtctctgcct

SEQ ID NO: 5245562 - DNA, 16 bp, Homo sapiens
atccagcagtgttgct

SEQ ID NO: 5245563 - DNA, 17 bp, Homo sapiens
atccagcagtgttgctc

SEQ ID NO: 5245564 - DNA, 22 bp, Homo sapiens
atccagcagtgttgctcagctc

SEQ ID NO: 5245565 - DNA, 16 bp, Homo sapiens
atccagcatcccaaga

SEQ ID NO: 5245566 - DNA, 13 bp, Homo sapiens
atccagcatgtgt

SEQ ID NO: 5245567 - DNA, 17 bp, Homo sapiens
atccagcatgtgtgtgt

SEQ ID NO: 5245568 - DNA, 11 bp, Homo sapiens
atccagccact

SEQ ID NO: 5245569 - DNA, 19 bp, Homo sapiens
atccagccacttccccctc

SEQ ID NO: 5245570 - DNA, 15 bp, Homo sapiens
atccagccattcctg

SEQ ID NO: 5245571 - DNA, 15 bp, Homo sapiens
atccagcccaaacct

SEQ ID NO: 5245572 - DNA, 21 bp, Homo sapiens
atccagccctgagttcctagc

SEQ ID NO: 5245573 - DNA, 23 bp, Homo sapiens
atccagcctaacttacattctta

SEQ ID NO: 5245574 - DNA, 23 bp, Homo sapiens
atccagcctcagagatctccctt

SEQ ID NO: 5245575 - DNA, 17 bp, Homo sapiens
atccagcctccagggca

SEQ ID NO: 5245576 - DNA, 22 bp, Homo sapiens
atccagcctccagggcattgct

SEQ ID NO: 5245577 - DNA, 21 bp, Homo sapiens
atccagcctggggctgaggct

SEQ ID NO: 5245578 - DNA, 20 bp, Homo sapiens
atccagcctgtgtgttctgt

SEQ ID NO: 5245579 - DNA, 15 bp, Homo sapiens
atccagccttcttcc

SEQ ID NO: 5245580 - DNA, 13 bp, Homo sapiens
atccagccttgga

SEQ ID NO: 5245581 - DNA, 13 bp, Homo sapiens
atccagcggggct

SEQ ID NO: 5245582 - DNA, 17 bp, Homo sapiens
atccagcggggcttctg

SEQ ID NO: 5245583 - DNA, 18 bp, Homo sapiens
atccagctagtgccaaat

SEQ ID NO: 5245584 - DNA, 13 bp, Homo sapiens
atccagctcctct

SEQ ID NO: 5245585 - DNA, 17 bp, Homo sapiens
atccagctcctctaggg

SEQ ID NO: 5245586 - DNA, 23 bp, Homo sapiens
atccagctcctctaggggcagcc

SEQ ID NO: 5245587 - DNA, 14 bp, Homo sapiens
atccagctctggga

SEQ ID NO: 5245588 - DNA, 18 bp, Homo sapiens
atccagctgcccctccct

SEQ ID NO: 5245589 - DNA, 22 bp, Homo sapiens
atccagctgcccctccctcagg

SEQ ID NO: 5245590 - DNA, 22 bp, Homo sapiens
atccagctgggctagaggctga

SEQ ID NO: 5245591 - DNA, 15 bp, Homo sapiens
atccagcttctcatg

SEQ ID NO: 5245592 - DNA, 16 bp, Homo sapiens
atccaggaacacatgc

SEQ ID NO: 5245593 - DNA, 17 bp, Homo sapiens
atccaggaacacatgca

SEQ ID NO: 5245594 - DNA, 21 bp, Homo sapiens
atccaggaacacatgcacaca

SEQ ID NO: 5245595 - DNA, 18 bp, Homo sapiens
atccaggaatatgacaca

SEQ ID NO: 5245596 - DNA, 18 bp, Homo sapiens
atccaggaccctgccagg

SEQ ID NO: 5245597 - DNA, 13 bp, Homo sapiens
atccaggactctg

SEQ ID NO: 5245598 - DNA, 20 bp, Homo sapiens
atccaggagataattgtttc

SEQ ID NO: 5245599 - DNA, 15 bp, Homo sapiens
atccaggagctccag

SEQ ID NO: 5245600 - DNA, 21 bp, Homo sapiens
atccaggagctccagtgtcct

SEQ ID NO: 5245601 - DNA, 16 bp, Homo sapiens
atccaggaggcagtgg

SEQ ID NO: 5245602 - DNA, 18 bp, Homo sapiens
atccaggagggctaatta

SEQ ID NO: 5245603 - DNA, 16 bp, Homo sapiens
atccaggattggcctg

SEQ ID NO: 5245604 - DNA, 20 bp, Homo sapiens
atccaggcaatcgttctgct

SEQ ID NO: 5245605 - DNA, 14 bp, Homo sapiens
atccaggcagatcc

SEQ ID NO: 5245606 - DNA, 16 bp, Homo sapiens
atccaggcagatccag

SEQ ID NO: 5245607 - DNA, 16 bp, Homo sapiens
atccaggccaaagccc

SEQ ID NO: 5245608 - DNA, 23 bp, Homo sapiens
atccaggcctgaggctgctgacg

SEQ ID NO: 5245609 - DNA, 12 bp, Homo sapiens
atccaggcgtgg

SEQ ID NO: 5245610 - DNA, 13 bp, Homo sapiens
atccaggcttctc

SEQ ID NO: 5245611 - DNA, 14 bp, Homo sapiens
atccaggcttctcc

SEQ ID NO: 5245612 - DNA, 16 bp, Homo sapiens
atccaggcttctcccg

SEQ ID NO: 5245613 - DNA, 23 bp, Homo sapiens
atccaggcttctcccggacctgg

SEQ ID NO: 5245614 - DNA, 16 bp, Homo sapiens
atccagggacagaggc

SEQ ID NO: 5245615 - DNA, 20 bp, Homo sapiens
atccagggacagaggcccca

SEQ ID NO: 5245616 - DNA, 18 bp, Homo sapiens
atccagggatggagatgg

SEQ ID NO: 5245617 - DNA, 15 bp, Homo sapiens
atccagggctgccag

SEQ ID NO: 5245618 - DNA, 23 bp, Homo sapiens
atccaggggaagccagtgacact

SEQ ID NO: 5245619 - DNA, 21 bp, Homo sapiens
atccagggtctggcagagcct

SEQ ID NO: 5245620 - DNA, 15 bp, Homo sapiens
atccaggtacgcaca

SEQ ID NO: 5245621 - DNA, 17 bp, Homo sapiens
atccaggtacgcacaga

SEQ ID NO: 5245622 - DNA, 20 bp, Homo sapiens
atccaggtacgcacagacag

SEQ ID NO: 5245623 - DNA, 22 bp, Homo sapiens
atccaggtacgcacagacaggt

SEQ ID NO: 5245624 - DNA, 17 bp, Homo sapiens
atccaggtcaacagaat

SEQ ID NO: 5245625 - DNA, 23 bp, Homo sapiens
atccaggtcaacagaatgaaaaa

SEQ ID NO: 5245626 - DNA, 10 bp, Homo sapiens
atccaggtgg

SEQ ID NO: 5245627 - DNA, 16 bp, Homo sapiens
atccaggtgggagaga

SEQ ID NO: 5245628 - DNA, 15 bp, Homo sapiens
atccaggttcagctt

SEQ ID NO: 5245629 - DNA, 16 bp, Homo sapiens
atccaggttcagcttg

SEQ ID NO: 5245630 - DNA, 17 bp, Homo sapiens
atccaggttcagcttgt

SEQ ID NO: 5245631 - DNA, 19 bp, Homo sapiens
atccaggttccctcccaga

SEQ ID NO: 5245632 - DNA, 15 bp, Homo sapiens
atccagtaaaataat

SEQ ID NO: 5245633 - DNA, 19 bp, Homo sapiens
atccagtacatttaattga

SEQ ID NO: 5245634 - DNA, 13 bp, Homo sapiens
atccagtataaga

SEQ ID NO: 5245635 - DNA, 14 bp, Homo sapiens
atccagtattatat

SEQ ID NO: 5245636 - DNA, 20 bp, Homo sapiens
atccagtattgctgatttta

SEQ ID NO: 5245637 - DNA, 23 bp, Homo sapiens
atccagtcattttattttgtaat

SEQ ID NO: 5245638 - DNA, 14 bp, Homo sapiens
atccagtctgcaga

SEQ ID NO: 5245639 - DNA, 13 bp, Homo sapiens
atccagtgacatg

SEQ ID NO: 5245640 - DNA, 17 bp, Homo sapiens
atccagtgacctctctc

SEQ ID NO: 5245641 - DNA, 19 bp, Homo sapiens
atccagtgacttgttctga

SEQ ID NO: 5245642 - DNA, 21 bp, Homo sapiens
atccagtgatcctcaaacaca

SEQ ID NO: 5245643 - DNA, 21 bp, Homo sapiens
atccagtgatccttacaagtt

SEQ ID NO: 5245644 - DNA, 10 bp, Homo sapiens
atccagtgca

SEQ ID NO: 5245645 - DNA, 18 bp, Homo sapiens
atccagtggggaaaaaaa

SEQ ID NO: 5245646 - DNA, 16 bp, Homo sapiens
atccagtggtgggtaa

SEQ ID NO: 5245647 - DNA, 19 bp, Homo sapiens
atccagtggtgggtaattg

SEQ ID NO: 5245648 - DNA, 14 bp, Homo sapiens
atccagtgtgagat

SEQ ID NO: 5245649 - DNA, 19 bp, Homo sapiens
atccagtgttacaatcagt

SEQ ID NO: 5245650 - DNA, 15 bp, Homo sapiens
atccagttcctgctc

SEQ ID NO: 5245651 - DNA, 17 bp, Homo sapiens
atccagttgcaataaaa

SEQ ID NO: 5245652 - DNA, 19 bp, Homo sapiens
atccagtttcccaccacct

SEQ ID NO: 5245653 - DNA, 20 bp, Homo sapiens
atccagttttgtttggacca

SEQ ID NO: 5245654 - DNA, 11 bp, Homo sapiens
atccataaaga

SEQ ID NO: 5245655 - DNA, 17 bp, Homo sapiens
atccataaagaagcaat

SEQ ID NO: 5245656 - DNA, 21 bp, Homo sapiens
atccataaagaagcaataaag

SEQ ID NO: 5245657 - DNA, 14 bp, Homo sapiens
atccataactgaac

SEQ ID NO: 5245658 - DNA, 16 bp, Homo sapiens
atccataaggtgcagt

SEQ ID NO: 5245659 - DNA, 23 bp, Homo sapiens
atccataagtgtgcctctgcctt

SEQ ID NO: 5245660 - DNA, 12 bp, Homo sapiens
atccataatgat

SEQ ID NO: 5245661 - DNA, 19 bp, Homo sapiens
atccataatgatggattta

SEQ ID NO: 5245662 - DNA, 13 bp, Homo sapiens
atccataccccct

SEQ ID NO: 5245663 - DNA, 20 bp, Homo sapiens
atccataccccctgccccag

SEQ ID NO: 5245664 - DNA, 22 bp, Homo sapiens
atccataccccctgccccagag

SEQ ID NO: 5245665 - DNA, 14 bp, Homo sapiens
atccatactgaaaa

SEQ ID NO: 5245666 - DNA, 21 bp, Homo sapiens
atccatactgaaaaaatgctg

SEQ ID NO: 5245667 - DNA, 20 bp, Homo sapiens
atccatactgtagacactct

SEQ ID NO: 5245668 - DNA, 16 bp, Homo sapiens
atccatactgtttaat

SEQ ID NO: 5245669 - DNA, 20 bp, Homo sapiens
atccatagatttattttaca

SEQ ID NO: 5245670 - DNA, 19 bp, Homo sapiens
atccatagcacaagataaa

SEQ ID NO: 5245671 - DNA, 22 bp, Homo sapiens
atccatagccaatacatttaca

SEQ ID NO: 5245672 - DNA, 20 bp, Homo sapiens
atccataggactaccgcagg

SEQ ID NO: 5245673 - DNA, 22 bp, Homo sapiens
atccataggtttctctccctcc

SEQ ID NO: 5245674 - DNA, 22 bp, Homo sapiens
atccatagtgacttttcaagta

SEQ ID NO: 5245675 - DNA, 14 bp, Homo sapiens
atccatatcagctc

SEQ ID NO: 5245676 - DNA, 16 bp, Homo sapiens
atccatatcagctctg

SEQ ID NO: 5245677 - DNA, 23 bp, Homo sapiens
atccatatcttaaagaaacagct

SEQ ID NO: 5245678 - DNA, 15 bp, Homo sapiens
atccatatgaaattc

SEQ ID NO: 5245679 - DNA, 15 bp, Homo sapiens
atccatattgcacaa

SEQ ID NO: 5245680 - DNA, 13 bp, Homo sapiens
atccatatttctt

SEQ ID NO: 5245681 - DNA, 13 bp, Homo sapiens
atccatattttat

SEQ ID NO: 5245682 - DNA, 19 bp, Homo sapiens
atccatattttattactgt

SEQ ID NO: 5245683 - DNA, 17 bp, Homo sapiens
atccatcagcaatgctt

SEQ ID NO: 5245684 - DNA, 13 bp, Homo sapiens
atccatcagtgcc

SEQ ID NO: 5245685 - DNA, 15 bp, Homo sapiens
atccatcagtgccaa

SEQ ID NO: 5245686 - DNA, 18 bp, Homo sapiens
atccatcatcatgtgtgt

SEQ ID NO: 5245687 - DNA, 14 bp, Homo sapiens
atccatccagaggc

SEQ ID NO: 5245688 - DNA, 15 bp, Homo sapiens
atccatccatctcca

SEQ ID NO: 5245689 - DNA, 16 bp, Homo sapiens
atccatccatctccag

SEQ ID NO: 5245690 - DNA, 23 bp, Homo sapiens
atccatccatctctctcttgcct

SEQ ID NO: 5245691 - DNA, 20 bp, Homo sapiens
atccatccctggtgaaagag

SEQ ID NO: 5245692 - DNA, 22 bp, Homo sapiens
atccatccctggtgaaagagta

SEQ ID NO: 5245693 - DNA, 12 bp, Homo sapiens
atccatcctgag

SEQ ID NO: 5245694 - DNA, 17 bp, Homo sapiens
atataaaacaaataaaa

SEQ ID NO: 5245695 - DNA, 15 bp, Homo sapiens
atataaaactgaaat

SEQ ID NO: 5245696 - DNA, 17 bp, Homo sapiens
atataaaactgtacttc

SEQ ID NO: 5245697 - DNA, 12 bp, Homo sapiens
atataaaactta

SEQ ID NO: 5245698 - DNA, 13 bp, Homo sapiens
atataaaagatat

SEQ ID NO: 5245699 - DNA, 19 bp, Homo sapiens
atataaaagatcttgcaga

SEQ ID NO: 5245700 - DNA, 22 bp, Homo sapiens
atataaaaggtgagctcagctc

SEQ ID NO: 5245701 - DNA, 21 bp, Homo sapiens
atataaaataaatatatataa

SEQ ID NO: 5245702 - DNA, 24 bp, Homo sapiens
atataaaataaatatatataaacc

SEQ ID NO: 5245703 - DNA, 13 bp, Homo sapiens
atataaaataact

SEQ ID NO: 5245704 - DNA, 19 bp, Homo sapiens
atataaaatacacgtgtat

SEQ ID NO: 5245705 - DNA, 19 bp, Homo sapiens
atataaaatacataaaaga

SEQ ID NO: 5245706 - DNA, 16 bp, Homo sapiens
atataaaatatattta

SEQ ID NO: 5245707 - DNA, 13 bp, Homo sapiens
atataaaatgaaa

SEQ ID NO: 5245708 - DNA, 23 bp, Homo sapiens
atataaaatgaaagatttttact

SEQ ID NO: 5245709 - DNA, 13 bp, Homo sapiens
atataaaatgcca

SEQ ID NO: 5245710 - DNA, 15 bp, Homo sapiens
atataaaatgccaag

SEQ ID NO: 5245711 - DNA, 19 bp, Homo sapiens
atataaaatggcaacaaac

SEQ ID NO: 5245712 - DNA, 14 bp, Homo sapiens
atataaaatgtatt

SEQ ID NO: 5245713 - DNA, 12 bp, Homo sapiens
atataaaattat

SEQ ID NO: 5245714 - DNA, 12 bp, Homo sapiens
atataaacacag

SEQ ID NO: 5245715 - DNA, 14 bp, Homo sapiens
atataaacacataa

SEQ ID NO: 5245716 - DNA, 24 bp, Homo sapiens
atataaacacattaaaagacaaat

SEQ ID NO: 5245717 - DNA, 20 bp, Homo sapiens
atataaacagaactcccttc

SEQ ID NO: 5245718 - DNA, 12 bp, Homo sapiens
atataaacatct

SEQ ID NO: 5245719 - DNA, 21 bp, Homo sapiens
atataaaccgtggtctcatgt

SEQ ID NO: 5245720 - DNA, 20 bp, Homo sapiens
atataaacgatatatgtaaa

SEQ ID NO: 5245721 - DNA, 14 bp, Homo sapiens
atataaactcattt

SEQ ID NO: 5245722 - DNA, 12 bp, Homo sapiens
atataaactgtg

SEQ ID NO: 5245723 - DNA, 15 bp, Homo sapiens
atataaactgtgcca

SEQ ID NO: 5245724 - DNA, 14 bp, Homo sapiens
atataaagaaaatc

SEQ ID NO: 5245725 - DNA, 15 bp, Homo sapiens
atataaagaatatat

SEQ ID NO: 5245726 - DNA, 17 bp, Homo sapiens
atataaagacaacaaaa

SEQ ID NO: 5245727 - DNA, 23 bp, Homo sapiens
atataaagacaacaaaagaaatc

SEQ ID NO: 5245728 - DNA, 16 bp, Homo sapiens
atataaagacgtttta

SEQ ID NO: 5245729 - DNA, 20 bp, Homo sapiens
atataaagacgttttataag

SEQ ID NO: 5245730 - DNA, 22 bp, Homo sapiens
atataaagacgttttataagca

SEQ ID NO: 5245731 - DNA, 20 bp, Homo sapiens
atataaagagaaaattgaat

SEQ ID NO: 5245732 - DNA, 22 bp, Homo sapiens
atataaagagaaaattgaattt

SEQ ID NO: 5245733 - DNA, 18 bp, Homo sapiens
atataaagcatctaaact

SEQ ID NO: 5245734 - DNA, 19 bp, Homo sapiens
atataaagcatctaaactt

SEQ ID NO: 5245735 - DNA, 14 bp, Homo sapiens
atataaagccattt

SEQ ID NO: 5245736 - DNA, 21 bp, Homo sapiens
atataaaggaaaggccctgca

SEQ ID NO: 5245737 - DNA, 21 bp, Homo sapiens
atataaaggaccctgtttctg

SEQ ID NO: 5245738 - DNA, 20 bp, Homo sapiens
atataaaggcaaggaaatta

SEQ ID NO: 5245739 - DNA, 17 bp, Homo sapiens
atataaagtactactgt

SEQ ID NO: 5245740 - DNA, 21 bp, Homo sapiens
atataaagtactactgtagaa

SEQ ID NO: 5245741 - DNA, 14 bp, Homo sapiens
atataaagtataga

SEQ ID NO: 5245742 - DNA, 16 bp, Homo sapiens
atataaagtatatgtt

SEQ ID NO: 5245743 - DNA, 24 bp, Homo sapiens
atataaagtatcatcagtgtagaa

SEQ ID NO: 5245744 - DNA, 12 bp, Homo sapiens
atataaagtatt

SEQ ID NO: 5245745 - DNA, 17 bp, Homo sapiens
atataaagtattcaaca

SEQ ID NO: 5245746 - DNA, 13 bp, Homo sapiens
atataaagtattt

SEQ ID NO: 5245747 - DNA, 19 bp, Homo sapiens
atataaagtatttttataa

SEQ ID NO: 5245748 - DNA, 22 bp, Homo sapiens
atataaagtatttttataatga

SEQ ID NO: 5245749 - DNA, 12 bp, Homo sapiens
atataaagtcag

SEQ ID NO: 5245750 - DNA, 13 bp, Homo sapiens
atataaagttaaa

SEQ ID NO: 5245751 - DNA, 13 bp, Homo sapiens
atataaagtttta

SEQ ID NO: 5245752 - DNA, 14 bp, Homo sapiens
atataaagttttgc

SEQ ID NO: 5245753 - DNA, 14 bp, Homo sapiens
atataaataaagca

SEQ ID NO: 5245754 - DNA, 20 bp, Homo sapiens
atataaataaagcaaatata

SEQ ID NO: 5245755 - DNA, 14 bp, Homo sapiens
atataaataaatat

SEQ ID NO: 5245756 - DNA, 19 bp, Homo sapiens
atataaataaatatatata

SEQ ID NO: 5245757 - DNA, 22 bp, Homo sapiens
atataaataaatatatatatcc

SEQ ID NO: 5245758 - DNA, 15 bp, Homo sapiens
atataaatactatag

SEQ ID NO: 5245759 - DNA, 22 bp, Homo sapiens
atataaatactgacaatgtatt

SEQ ID NO: 5245760 - DNA, 12 bp, Homo sapiens
atataaatagct

SEQ ID NO: 5245761 - DNA, 14 bp, Homo sapiens
atataaatatatat

SEQ ID NO: 5245762 - DNA, 23 bp, Homo sapiens
atataaatatatatatatataaa

SEQ ID NO: 5245763 - DNA, 16 bp, Homo sapiens
atataaatatatattc

SEQ ID NO: 5245764 - DNA, 21 bp, Homo sapiens
atataaatatatgtatacata

SEQ ID NO: 5245765 - DNA, 17 bp, Homo sapiens
atataaatatattttct

SEQ ID NO: 5245766 - DNA, 22 bp, Homo sapiens
atataaatatattttctttcta

SEQ ID NO: 5245767 - DNA, 15 bp, Homo sapiens
atataaatatcacaa

SEQ ID NO: 5245768 - DNA, 22 bp, Homo sapiens
atataaatattagaaacagctt

SEQ ID NO: 5245769 - DNA, 15 bp, Homo sapiens
atataaatcacagat

SEQ ID NO: 5245770 - DNA, 17 bp, Homo sapiens
atataaatcacagattt

SEQ ID NO: 5245771 - DNA, 11 bp, Homo sapiens
atataaatgca

SEQ ID NO: 5245772 - DNA, 14 bp, Homo sapiens
atataaatgggaac

SEQ ID NO: 5245773 - DNA, 16 bp, Homo sapiens
atataaatggtgagaa

SEQ ID NO: 5245774 - DNA, 18 bp, Homo sapiens
atataaatggtgagaatt

SEQ ID NO: 5245775 - DNA, 19 bp, Homo sapiens
atataaatgttaagaaaaa

SEQ ID NO: 5245776 - DNA, 12 bp, Homo sapiens
atataaatgttg

SEQ ID NO: 5245777 - DNA, 12 bp, Homo sapiens
atataaattaag

SEQ ID NO: 5245778 - DNA, 15 bp, Homo sapiens
atataaattaataca

SEQ ID NO: 5245779 - DNA, 22 bp, Homo sapiens
atataaattgagcttgcttctt

SEQ ID NO: 5245780 - DNA, 14 bp, Homo sapiens
atataaattgtaca

SEQ ID NO: 5245781 - DNA, 15 bp, Homo sapiens
atataaattgtacat

SEQ ID NO: 5245782 - DNA, 22 bp, Homo sapiens
atataaattgtacattttgtaa

SEQ ID NO: 5245783 - DNA, 14 bp, Homo sapiens
atataaatttaagc

SEQ ID NO: 5245784 - DNA, 20 bp, Homo sapiens
atataaatttttaagagaaa

SEQ ID NO: 5245785 - DNA, 12 bp, Homo sapiens
atataacaatgc

SEQ ID NO: 5245786 - DNA, 12 bp, Homo sapiens
atataacacatt

SEQ ID NO: 5245787 - DNA, 14 bp, Homo sapiens
atataacacttaac

SEQ ID NO: 5245788 - DNA, 13 bp, Homo sapiens
atataacatatat

SEQ ID NO: 5245789 - DNA, 17 bp, Homo sapiens
atataacatgaaagtca

SEQ ID NO: 5245790 - DNA, 16 bp, Homo sapiens
atataacatgaaatga

SEQ ID NO: 5245791 - DNA, 15 bp, Homo sapiens
atataacatgtaaaa

SEQ ID NO: 5245792 - DNA, 11 bp, Homo sapiens
atataaccaat

SEQ ID NO: 5245793 - DNA, 16 bp, Homo sapiens
atataaccctaggaat

SEQ ID NO: 5245794 - DNA, 14 bp, Homo sapiens
atataactatttta

SEQ ID NO: 5245795 - DNA, 23 bp, Homo sapiens
atataactattttaaatatccat

SEQ ID NO: 5245796 - DNA, 17 bp, Homo sapiens
atataactgagttatat

SEQ ID NO: 5245797 - DNA, 13 bp, Homo sapiens
atataactgcctt

SEQ ID NO: 5245798 - DNA, 13 bp, Homo sapiens
atataactgtaca

SEQ ID NO: 5245799 - DNA, 17 bp, Homo sapiens
atataactgtcttgttt

SEQ ID NO: 5245800 - DNA, 18 bp, Homo sapiens
atataactgtcttgtttc

SEQ ID NO: 5245801 - DNA, 21 bp, Homo sapiens
atataactgtcttgtttcagt

SEQ ID NO: 5245802 - DNA, 22 bp, Homo sapiens
atataactgtcttgtttcagtg

SEQ ID NO: 5245803 - DNA, 13 bp, Homo sapiens
atataactgtgat

SEQ ID NO: 5245804 - DNA, 16 bp, Homo sapiens
atataacttatattgt

SEQ ID NO: 5245805 - DNA, 22 bp, Homo sapiens
atataacttatattgtaagaaa

SEQ ID NO: 5245806 - DNA, 16 bp, Homo sapiens
atataactttttttag

SEQ ID NO: 5245807 - DNA, 16 bp, Homo sapiens
atataagaaaaaattc

SEQ ID NO: 5245808 - DNA, 23 bp, Homo sapiens
atataagaaaagtaatgaagaat

SEQ ID NO: 5245809 - DNA, 18 bp, Homo sapiens
atataagaaagacatctt

SEQ ID NO: 5245810 - DNA, 22 bp, Homo sapiens
atataagaagcaatctttgaaa

SEQ ID NO: 5245811 - DNA, 14 bp, Homo sapiens
atataagacaagaa

SEQ ID NO: 5245812 - DNA, 16 bp, Homo sapiens
atataagacatttgtt

SEQ ID NO: 5245813 - DNA, 15 bp, Homo sapiens
atataagactgctgc

SEQ ID NO: 5245814 - DNA, 21 bp, Homo sapiens
atataagatttgtacatatta

SEQ ID NO: 5245815 - DNA, 12 bp, Homo sapiens
atataagatttt

SEQ ID NO: 5245816 - DNA, 14 bp, Homo sapiens
atataagcataaaa

SEQ ID NO: 5245817 - DNA, 16 bp, Homo sapiens
atataagcataaaaga

SEQ ID NO: 5245818 - DNA, 14 bp, Homo sapiens
atataagccatagc

SEQ ID NO: 5245819 - DNA, 16 bp, Homo sapiens
atataagccatagccc

SEQ ID NO: 5245820 - DNA, 13 bp, Homo sapiens
atataagcttttt

SEQ ID NO: 5245821 - DNA, 17 bp, Homo sapiens
atataagtattctaaat

SEQ ID NO: 5245822 - DNA, 15 bp, Homo sapiens
atataagtgacttga

SEQ ID NO: 5245823 - DNA, 18 bp, Homo sapiens
atataagtgacttgaaca

SEQ ID NO: 5245824 - DNA, 15 bp, Homo sapiens
atataagtgattgct

SEQ ID NO: 5245825 - DNA, 15 bp, Homo sapiens
atataagtgctgtat

SEQ ID NO: 5245826 - DNA, 20 bp, Homo sapiens
atataagtggtgcttagaaa

SEQ ID NO: 5245827 - DNA, 15 bp, Homo sapiens
atataagtgtgtgtt

SEQ ID NO: 5245828 - DNA, 17 bp, Homo sapiens
atataagtttctttaga

SEQ ID NO: 5245829 - DNA, 19 bp, Homo sapiens
atataagtttgaaggaaac

SEQ ID NO: 5245830 - DNA, 18 bp, Homo sapiens
atataataaagctactga

SEQ ID NO: 5245831 - DNA, 12 bp, Homo sapiens
atataataaata

SEQ ID NO: 5245832 - DNA, 21 bp, Homo sapiens
atataataaatagaaattttg

SEQ ID NO: 5245833 - DNA, 21 bp, Homo sapiens
atataataaatgtacattaat

SEQ ID NO: 5245834 - DNA, 14 bp, Homo sapiens
atataataacttta

SEQ ID NO: 5245835 - DNA, 20 bp, Homo sapiens
atataataactttattgcat

SEQ ID NO: 5245836 - DNA, 19 bp, Homo sapiens
atataatacacaaaatcaa

SEQ ID NO: 5245837 - DNA, 13 bp, Homo sapiens
atataatacatat

SEQ ID NO: 5245838 - DNA, 19 bp, Homo sapiens
atataatactaaagtgtct

SEQ ID NO: 5245839 - DNA, 20 bp, Homo sapiens
atataatatatatatatatc

SEQ ID NO: 5245840 - DNA, 15 bp, Homo sapiens
atataatatatgtca

SEQ ID NO: 5245841 - DNA, 13 bp, Homo sapiens
atataatattcag

SEQ ID NO: 5245842 - DNA, 23 bp, Homo sapiens
atataatattcagccagcttaaa

SEQ ID NO: 5245843 - DNA, 18 bp, Homo sapiens
atataatattgtctcttt

SEQ ID NO: 5245844 - DNA, 19 bp, Homo sapiens
atataatcttggcttctta

SEQ ID NO: 5245845 - DNA, 20 bp, Homo sapiens
atataatcttggcttcttaa

SEQ ID NO: 5245846 - DNA, 14 bp, Homo sapiens
atataatgcaacag

SEQ ID NO: 5245847 - DNA, 16 bp, Homo sapiens
atataatggaagagaa

SEQ ID NO: 5245848 - DNA, 19 bp, Homo sapiens
atataatggaagagaaatc

SEQ ID NO: 5245849 - DNA, 17 bp, Homo sapiens
atataatggtttactgc

SEQ ID NO: 5245850 - DNA, 15 bp, Homo sapiens
atataatggtttcaa

SEQ ID NO: 5245851 - DNA, 22 bp, Homo sapiens
atataatgtattttctttttat

SEQ ID NO: 5245852 - DNA, 12 bp, Homo sapiens
atataatgtgtg

SEQ ID NO: 5245853 - DNA, 21 bp, Homo sapiens
atataatgttgttatttaaag

SEQ ID NO: 5245854 - DNA, 21 bp, Homo sapiens
atataattacttaatgtgatg

SEQ ID NO: 5245855 - DNA, 21 bp, Homo sapiens
atataattatcggaagcagtg

SEQ ID NO: 5245856 - DNA, 11 bp, Homo sapiens
atataattatg

SEQ ID NO: 5245857 - DNA, 14 bp, Homo sapiens
atataattatgtta

SEQ ID NO: 5245858 - DNA, 16 bp, Homo sapiens
atataattctgtaaat

SEQ ID NO: 5245859 - DNA, 17 bp, Homo sapiens
atataattctgtaaatg

SEQ ID NO: 5245860 - DNA, 22 bp, Homo sapiens
atataattctgtacatagccta

SEQ ID NO: 5245861 - DNA, 15 bp, Homo sapiens
atataattgccaaaa

SEQ ID NO: 5245862 - DNA, 22 bp, Homo sapiens
atataattgtaccaacctcata

SEQ ID NO: 5245863 - DNA, 13 bp, Homo sapiens
atataattgtgaa

SEQ ID NO: 5245864 - DNA, 22 bp, Homo sapiens
atataattgttttttatctttt

SEQ ID NO: 5245865 - DNA, 14 bp, Homo sapiens
atataatttaacag

SEQ ID NO: 5245866 - DNA, 15 bp, Homo sapiens
atataatttaacaga

SEQ ID NO: 5245867 - DNA, 15 bp, Homo sapiens
atataatttaatgta

SEQ ID NO: 5245868 - DNA, 21 bp, Homo sapiens
atataatttaatgtaaataaa

SEQ ID NO: 5245869 - DNA, 22 bp, Homo sapiens
atataatttaatgtaaataaaa

SEQ ID NO: 5245870 - DNA, 17 bp, Homo sapiens
atataatttataagcat

SEQ ID NO: 5245871 - DNA, 20 bp, Homo sapiens
atataatttgagtgtatata

SEQ ID NO: 5245872 - DNA, 21 bp, Homo sapiens
atataatttgccagacagaga

SEQ ID NO: 5245873 - DNA, 22 bp, Homo sapiens
atataatttgccagacagagat

SEQ ID NO: 5245874 - DNA, 21 bp, Homo sapiens
atccatcctgcaaaggccctt

SEQ ID NO: 5245875 - DNA, 17 bp, Homo sapiens
atccatcctgctcttcc

SEQ ID NO: 5245876 - DNA, 17 bp, Homo sapiens
atccatccttttgcttc

SEQ ID NO: 5245877 - DNA, 19 bp, Homo sapiens
atccatccttttgcttcat

SEQ ID NO: 5245878 - DNA, 18 bp, Homo sapiens
atccatcgatttgtatta

SEQ ID NO: 5245879 - DNA, 21 bp, Homo sapiens
atccatcgatttgtattaatg

SEQ ID NO: 5245880 - DNA, 20 bp, Homo sapiens
atccatctcagtcacttttt

SEQ ID NO: 5245881 - DNA, 13 bp, Homo sapiens
atccatctgtccg

SEQ ID NO: 5245882 - DNA, 23 bp, Homo sapiens
atccatctgtccgtccagagccg

SEQ ID NO: 5245883 - DNA, 23 bp, Homo sapiens
atccatcttccctacccttcctg

SEQ ID NO: 5245884 - DNA, 22 bp, Homo sapiens
atccatgacaggcctgaagata

SEQ ID NO: 5245885 - DNA, 21 bp, Homo sapiens
atccatgacctagttttccat

SEQ ID NO: 5245886 - DNA, 19 bp, Homo sapiens
atccatgatcaaaatgcat

SEQ ID NO: 5245887 - DNA, 21 bp, Homo sapiens
atccatgatcacacagctaat

SEQ ID NO: 5245888 - DNA, 22 bp, Homo sapiens
atccatgcactttaattgaaga

SEQ ID NO: 5245889 - DNA, 16 bp, Homo sapiens
atccatgcattatata

SEQ ID NO: 5245890 - DNA, 13 bp, Homo sapiens
atccatgccctcc

SEQ ID NO: 5245891 - DNA, 19 bp, Homo sapiens
atccatgccctcccaggac

SEQ ID NO: 5245892 - DNA, 23 bp, Homo sapiens
atccatgcggccggcctggggcc

SEQ ID NO: 5245893 - DNA, 13 bp, Homo sapiens
atccatgcttcac

SEQ ID NO: 5245894 - DNA, 18 bp, Homo sapiens
atccatggatgcagaaat

SEQ ID NO: 5245895 - DNA, 18 bp, Homo sapiens
atccatggggtctctcac

SEQ ID NO: 5245896 - DNA, 16 bp, Homo sapiens
atccatgtactttccc

SEQ ID NO: 5245897 - DNA, 17 bp, Homo sapiens
atccatgtactttccct

SEQ ID NO: 5245898 - DNA, 18 bp, Homo sapiens
atccatgtgaccattctg

SEQ ID NO: 5245899 - DNA, 19 bp, Homo sapiens
atccatgtgctgctgtggc

SEQ ID NO: 5245900 - DNA, 13 bp, Homo sapiens
atccatgtgttcc

SEQ ID NO: 5245901 - DNA, 18 bp, Homo sapiens
atccattacctccatcca

SEQ ID NO: 5245902 - DNA, 20 bp, Homo sapiens
atccattacgtgcatttaaa

SEQ ID NO: 5245903 - DNA, 22 bp, Homo sapiens
atccattacgtgcatttaaact

SEQ ID NO: 5245904 - DNA, 15 bp, Homo sapiens
atccattaggccagc

SEQ ID NO: 5245905 - DNA, 19 bp, Homo sapiens
atccattaggccagcaacg

SEQ ID NO: 5245906 - DNA, 16 bp, Homo sapiens
atccattatcatgtgt

SEQ ID NO: 5245907 - DNA, 17 bp, Homo sapiens
atccattatcatgtgta

SEQ ID NO: 5245908 - DNA, 16 bp, Homo sapiens
atccattatcctttat

SEQ ID NO: 5245909 - DNA, 17 bp, Homo sapiens
atccattatcctttatt

SEQ ID NO: 5245910 - DNA, 16 bp, Homo sapiens
atccattcacaagcct

SEQ ID NO: 5245911 - DNA, 19 bp, Homo sapiens
atccattcccaagatgcct

SEQ ID NO: 5245912 - DNA, 14 bp, Homo sapiens
atccattctacatc

SEQ ID NO: 5245913 - DNA, 15 bp, Homo sapiens
atccattctcctgag

SEQ ID NO: 5245914 - DNA, 14 bp, Homo sapiens
atccattctctctg

SEQ ID NO: 5245915 - DNA, 15 bp, Homo sapiens
atccattctctctgc

SEQ ID NO: 5245916 - DNA, 16 bp, Homo sapiens
atccattctttctgat

SEQ ID NO: 5245917 - DNA, 17 bp, Homo sapiens
atccattgaaagtgctt

SEQ ID NO: 5245918 - DNA, 13 bp, Homo sapiens
atccattgttgtg

SEQ ID NO: 5245919 - DNA, 14 bp, Homo sapiens
atccatttaaaaca

SEQ ID NO: 5245920 - DNA, 16 bp, Homo sapiens
atccatttaaaacaag

SEQ ID NO: 5245921 - DNA, 21 bp, Homo sapiens
atccatttaaaacaagctgat

SEQ ID NO: 5245922 - DNA, 14 bp, Homo sapiens
atccatttatcttt

SEQ ID NO: 5245923 - DNA, 18 bp, Homo sapiens
atccatttcatctatttc

SEQ ID NO: 5245924 - DNA, 22 bp, Homo sapiens
atccatttcatctatttctgag

SEQ ID NO: 5245925 - DNA, 17 bp, Homo sapiens
atccatttccattgctt

SEQ ID NO: 5245926 - DNA, 18 bp, Homo sapiens
atccatttcccctccttc

SEQ ID NO: 5245927 - DNA, 19 bp, Homo sapiens
atccatttcccctccttcc

SEQ ID NO: 5245928 - DNA, 14 bp, Homo sapiens
atccatttctaatt

SEQ ID NO: 5245929 - DNA, 23 bp, Homo sapiens
atccatttctaattatgtagctc

SEQ ID NO: 5245930 - DNA, 11 bp, Homo sapiens
atccatttctt

SEQ ID NO: 5245931 - DNA, 15 bp, Homo sapiens
atccatttgaacagt

SEQ ID NO: 5245932 - DNA, 12 bp, Homo sapiens
atccatttgcct

SEQ ID NO: 5245933 - DNA, 20 bp, Homo sapiens
atccatttggaaatctttaa

SEQ ID NO: 5245934 - DNA, 18 bp, Homo sapiens
atccatttggcagaactg

SEQ ID NO: 5245935 - DNA, 13 bp, Homo sapiens
atccatttgtaat

SEQ ID NO: 5245936 - DNA, 19 bp, Homo sapiens
atccattttacacagcacc

SEQ ID NO: 5245937 - DNA, 14 bp, Homo sapiens
atccattttacact

SEQ ID NO: 5245938 - DNA, 21 bp, Homo sapiens
atcccaaactttaaaatgcga

SEQ ID NO: 5245939 - DNA, 20 bp, Homo sapiens
atcccaaaggacagccgcct

SEQ ID NO: 5245940 - DNA, 21 bp, Homo sapiens
atcccaaatctatagcattta

SEQ ID NO: 5245941 - DNA, 15 bp, Homo sapiens
atcccaacaaaaaaa

SEQ ID NO: 5245942 - DNA, 15 bp, Homo sapiens
atcccaacaaacttt

SEQ ID NO: 5245943 - DNA, 18 bp, Homo sapiens
atcccaacaagcaagggt

SEQ ID NO: 5245944 - DNA, 17 bp, Homo sapiens
atcccaacactgccagc

SEQ ID NO: 5245945 - DNA, 17 bp, Homo sapiens
atcccaacagcccagca

SEQ ID NO: 5245946 - DNA, 16 bp, Homo sapiens
atcccaacatggtcct

SEQ ID NO: 5245947 - DNA, 17 bp, Homo sapiens
atcccaacatggtccta

SEQ ID NO: 5245948 - DNA, 18 bp, Homo sapiens
atcccaacattctgcaat

SEQ ID NO: 5245949 - DNA, 22 bp, Homo sapiens
atcccaaccaggcacctcttcc

SEQ ID NO: 5245950 - DNA, 15 bp, Homo sapiens
atcccaaccagtgcc

SEQ ID NO: 5245951 - DNA, 17 bp, Homo sapiens
atcccaaccagtgccaa

SEQ ID NO: 5245952 - DNA, 19 bp, Homo sapiens
atcccaacctctcccaact

SEQ ID NO: 5245953 - DNA, 18 bp, Homo sapiens
atcccaacctctttttcc

SEQ ID NO: 5245954 - DNA, 17 bp, Homo sapiens
atcccaactactcagaa

SEQ ID NO: 5245955 - DNA, 18 bp, Homo sapiens
atcccaactactcagaag

SEQ ID NO: 5245956 - DNA, 17 bp, Homo sapiens
atcccaagacccagggc

SEQ ID NO: 5245957 - DNA, 20 bp, Homo sapiens
atcccaagacctcatctgcc

SEQ ID NO: 5245958 - DNA, 17 bp, Homo sapiens
atcccaagtagaatctc

SEQ ID NO: 5245959 - DNA, 19 bp, Homo sapiens
atcccaagttggaagggac

SEQ ID NO: 5245960 - DNA, 19 bp, Homo sapiens
atcccaatagaatacctcc

SEQ ID NO: 5245961 - DNA, 17 bp, Homo sapiens
atcccaatcaaagaatt

SEQ ID NO: 5245962 - DNA, 21 bp, Homo sapiens
atcccaatcaaagaattacag

SEQ ID NO: 5245963 - DNA, 22 bp, Homo sapiens
atcccaatcaaagaattacagt

SEQ ID NO: 5245964 - DNA, 16 bp, Homo sapiens
atcccaatcattgttg

SEQ ID NO: 5245965 - DNA, 15 bp, Homo sapiens
atcccaatctttcta

SEQ ID NO: 5245966 - DNA, 16 bp, Homo sapiens
atcccaatctttctat

SEQ ID NO: 5245967 - DNA, 15 bp, Homo sapiens
atcccacaattgaaa

SEQ ID NO: 5245968 - DNA, 14 bp, Homo sapiens
atcccacaccctgg

SEQ ID NO: 5245969 - DNA, 14 bp, Homo sapiens
atcccacagccagt

SEQ ID NO: 5245970 - DNA, 15 bp, Homo sapiens
atcccacagccctag

SEQ ID NO: 5245971 - DNA, 15 bp, Homo sapiens
atcccacccacatgt

SEQ ID NO: 5245972 - DNA, 20 bp, Homo sapiens
atcccacccacatgtgacac

SEQ ID NO: 5245973 - DNA, 23 bp, Homo sapiens
atcccacccacatgtgacacata

SEQ ID NO: 5245974 - DNA, 13 bp, Homo sapiens
atcccacccacct

SEQ ID NO: 5245975 - DNA, 18 bp, Homo sapiens
atcccaccccatcctcca

SEQ ID NO: 5245976 - DNA, 20 bp, Homo sapiens
atcccacccccgaccctgcc

SEQ ID NO: 5245977 - DNA, 23 bp, Homo sapiens
atcccacccccgaccctgccctg

SEQ ID NO: 5245978 - DNA, 21 bp, Homo sapiens
atcccaccccctcctccccca

SEQ ID NO: 5245979 - DNA, 21 bp, Homo sapiens
atcccaccgacccttcctggc

SEQ ID NO: 5245980 - DNA, 16 bp, Homo sapiens
atcccacctagcccag

SEQ ID NO: 5245981 - DNA, 10 bp, Homo sapiens
atcccacctc

SEQ ID NO: 5245982 - DNA, 14 bp, Homo sapiens
atcccacctccagc

SEQ ID NO: 5245983 - DNA, 15 bp, Homo sapiens
atcccaccttcccac

SEQ ID NO: 5245984 - DNA, 19 bp, Homo sapiens
atcccaccttgccaaagca

SEQ ID NO: 5245985 - DNA, 20 bp, Homo sapiens
atcccacggaaaatgccaat

SEQ ID NO: 5245986 - DNA, 18 bp, Homo sapiens
atcccactcacaacagct

SEQ ID NO: 5245987 - DNA, 21 bp, Homo sapiens
atcccactgatatcacgggcc

SEQ ID NO: 5245988 - DNA, 18 bp, Homo sapiens
atcccactggatctggct

SEQ ID NO: 5245989 - DNA, 20 bp, Homo sapiens
atcccactgtatagatccac

SEQ ID NO: 5245990 - DNA, 20 bp, Homo sapiens
atcccacttatcaaatcatt

SEQ ID NO: 5245991 - DNA, 16 bp, Homo sapiens
atcccacttgcccctg

SEQ ID NO: 5245992 - DNA, 18 bp, Homo sapiens
atcccagaaaaagtaact

SEQ ID NO: 5245993 - DNA, 20 bp, Homo sapiens
atcccagaaagtatatactg

SEQ ID NO: 5245994 - DNA, 21 bp, Homo sapiens
atcccagagaacaatcactat

SEQ ID NO: 5245995 - DNA, 22 bp, Homo sapiens
atcccagagaacaatcactatt

SEQ ID NO: 5245996 - DNA, 18 bp, Homo sapiens
atcccagagagcccgagg

SEQ ID NO: 5245997 - DNA, 20 bp, Homo sapiens
atcccagagcttcccaggat

SEQ ID NO: 5245998 - DNA, 20 bp, Homo sapiens
atcccagagggtgggcttca

SEQ ID NO: 5245999 - DNA, 14 bp, Homo sapiens
atcccagagttatt

SEQ ID NO: 5246000 - DNA, 16 bp, Homo sapiens
atcccagcacctgcca

SEQ ID NO: 5246001 - DNA, 17 bp, Homo sapiens
atcccagcacctgccag

SEQ ID NO: 5246002 - DNA, 14 bp, Homo sapiens
atcccagcactttg

SEQ ID NO: 5246003 - DNA, 17 bp, Homo sapiens
atcccagcactttggga

SEQ ID NO: 5246004 - DNA, 18 bp, Homo sapiens
atcccagcactttgggag

SEQ ID NO: 5246005 - DNA, 19 bp, Homo sapiens
atcccagcactttgggagg

SEQ ID NO: 5246006 - DNA, 20 bp, Homo sapiens
atcccagcactttgggaggc

SEQ ID NO: 5246007 - DNA, 14 bp, Homo sapiens
atcccagcagcaga

SEQ ID NO: 5246008 - DNA, 18 bp, Homo sapiens
atcccagcagcccaagct

SEQ ID NO: 5246009 - DNA, 23 bp, Homo sapiens
atcccagcatctcagagtccagt

SEQ ID NO: 5246010 - DNA, 12 bp, Homo sapiens
atcccagcccaa

SEQ ID NO: 5246011 - DNA, 17 bp, Homo sapiens
atcccagcccaccctgc

SEQ ID NO: 5246012 - DNA, 12 bp, Homo sapiens
atcccagcccca

SEQ ID NO: 5246013 - DNA, 24 bp, Homo sapiens
atcccagccccctgaccactcaga

SEQ ID NO: 5246014 - DNA, 21 bp, Homo sapiens
atcccagccctacccttgtta

SEQ ID NO: 5246015 - DNA, 23 bp, Homo sapiens
atcccagccctttgggaggctga

SEQ ID NO: 5246016 - DNA, 14 bp, Homo sapiens
atcccagcctcaga

SEQ ID NO: 5246017 - DNA, 19 bp, Homo sapiens
atcccagcctcagaagcct

SEQ ID NO: 5246018 - DNA, 21 bp, Homo sapiens
atcccagcctcagaagccttc

SEQ ID NO: 5246019 - DNA, 12 bp, Homo sapiens
atcccagcctgg

SEQ ID NO: 5246020 - DNA, 15 bp, Homo sapiens
atcccagcctggggg

SEQ ID NO: 5246021 - DNA, 13 bp, Homo sapiens
atcccagccttgg

SEQ ID NO: 5246022 - DNA, 18 bp, Homo sapiens
atcccagcggctggtgca

SEQ ID NO: 5246023 - DNA, 18 bp, Homo sapiens
atcccagctacccaggag

SEQ ID NO: 5246024 - DNA, 17 bp, Homo sapiens
atcccagctactcagga

SEQ ID NO: 5246025 - DNA, 21 bp, Homo sapiens
atcccagctcactgcagcctc

SEQ ID NO: 5246026 - DNA, 20 bp, Homo sapiens
atcccagcttcggcatttga

SEQ ID NO: 5246027 - DNA, 18 bp, Homo sapiens
atcccagcttgctgaggg

SEQ ID NO: 5246028 - DNA, 19 bp, Homo sapiens
atcccagcttgctgagggg

SEQ ID NO: 5246029 - DNA, 21 bp, Homo sapiens
atcccagcttgctgaggggca

SEQ ID NO: 5246030 - DNA, 20 bp, Homo sapiens
atcccagctttaaaaagaaa

SEQ ID NO: 5246031 - DNA, 22 bp, Homo sapiens
atcccagctttaaaaagaaaaa

SEQ ID NO: 5246032 - DNA, 13 bp, Homo sapiens
atcccaggccagg

SEQ ID NO: 5246033 - DNA, 17 bp, Homo sapiens
atcccagggaaggactt

SEQ ID NO: 5246034 - DNA, 18 bp, Homo sapiens
atcccagggctggctctg

SEQ ID NO: 5246035 - DNA, 17 bp, Homo sapiens
atcccaggggcccaagg

SEQ ID NO: 5246036 - DNA, 17 bp, Homo sapiens
atcccagggtacactct

SEQ ID NO: 5246037 - DNA, 12 bp, Homo sapiens
atcccagggtcc

SEQ ID NO: 5246038 - DNA, 19 bp, Homo sapiens
atcccagggtcccaccccc

SEQ ID NO: 5246039 - DNA, 22 bp, Homo sapiens
atcccaggtgaggaatttgaag

SEQ ID NO: 5246040 - DNA, 21 bp, Homo sapiens
atcccaggtgcgtgtgtctct

SEQ ID NO: 5246041 - DNA, 18 bp, Homo sapiens
atcccagtagtgtttgga

SEQ ID NO: 5246042 - DNA, 21 bp, Homo sapiens
atcccagtagtgtttggaatt

SEQ ID NO: 5246043 - DNA, 23 bp, Homo sapiens
atcccagtcacagtggggttttt

SEQ ID NO: 5246044 - DNA, 22 bp, Homo sapiens
atcccagtttaatattccaata

SEQ ID NO: 5246045 - DNA, 18 bp, Homo sapiens
atcccataaagaaagtga

SEQ ID NO: 5246046 - DNA, 22 bp, Homo sapiens
atcccatatatttaatatgtca

SEQ ID NO: 5246047 - DNA, 17 bp, Homo sapiens
atcccatatgcctgggc

SEQ ID NO: 5246048 - DNA, 18 bp, Homo sapiens
atcccatatgcctgggca

SEQ ID NO: 5246049 - DNA, 13 bp, Homo sapiens
atcccatcaaaga

SEQ ID NO: 5246050 - DNA, 11 bp, Homo sapiens
atcccatcagg

SEQ ID NO: 5246051 - DNA, 13 bp, Homo sapiens
atataattttatg

SEQ ID NO: 5246052 - DNA, 20 bp, Homo sapiens
atataattttttagagagct

SEQ ID NO: 5246053 - DNA, 22 bp, Homo sapiens
atatacaaatatatttaattgt

SEQ ID NO: 5246054 - DNA, 18 bp, Homo sapiens
atatacaactgtaaagca

SEQ ID NO: 5246055 - DNA, 18 bp, Homo sapiens
atatacaagctacagttg

SEQ ID NO: 5246056 - DNA, 14 bp, Homo sapiens
atatacaagtagat

SEQ ID NO: 5246057 - DNA, 15 bp, Homo sapiens
atatacaagtagatc

SEQ ID NO: 5246058 - DNA, 15 bp, Homo sapiens
atatacaataatgta

SEQ ID NO: 5246059 - DNA, 13 bp, Homo sapiens
atatacaatatat

SEQ ID NO: 5246060 - DNA, 14 bp, Homo sapiens
atatacaattatat

SEQ ID NO: 5246061 - DNA, 16 bp, Homo sapiens
atatacacaaagatat

SEQ ID NO: 5246062 - DNA, 12 bp, Homo sapiens
atatacacacac

SEQ ID NO: 5246063 - DNA, 15 bp, Homo sapiens
atatacacacacaca

SEQ ID NO: 5246064 - DNA, 13 bp, Homo sapiens
atatacacacagc

SEQ ID NO: 5246065 - DNA, 19 bp, Homo sapiens
atatacacaggatcctatt

SEQ ID NO: 5246066 - DNA, 13 bp, Homo sapiens
atatacacataca

SEQ ID NO: 5246067 - DNA, 17 bp, Homo sapiens
atatacacatacataca

SEQ ID NO: 5246068 - DNA, 16 bp, Homo sapiens
atatacacatatacct

SEQ ID NO: 5246069 - DNA, 20 bp, Homo sapiens
atatacacattagaaatatt

SEQ ID NO: 5246070 - DNA, 16 bp, Homo sapiens
atatacacattttgta

SEQ ID NO: 5246071 - DNA, 21 bp, Homo sapiens
atatacacgaatagacatcaa

SEQ ID NO: 5246072 - DNA, 16 bp, Homo sapiens
atatacagacctccag

SEQ ID NO: 5246073 - DNA, 18 bp, Homo sapiens
atatacagacctccagat

SEQ ID NO: 5246074 - DNA, 13 bp, Homo sapiens
atatacagagcct

SEQ ID NO: 5246075 - DNA, 15 bp, Homo sapiens
atatacagagcctgt

SEQ ID NO: 5246076 - DNA, 19 bp, Homo sapiens
atatacagagcctgtttta

SEQ ID NO: 5246077 - DNA, 13 bp, Homo sapiens
atatacagaggaa

SEQ ID NO: 5246078 - DNA, 15 bp, Homo sapiens
atatacagatgaaaa

SEQ ID NO: 5246079 - DNA, 16 bp, Homo sapiens
atatacagatgaaaat

SEQ ID NO: 5246080 - DNA, 18 bp, Homo sapiens
atatacagatgaaaattt

SEQ ID NO: 5246081 - DNA, 20 bp, Homo sapiens
atatacagcatgagattgta

SEQ ID NO: 5246082 - DNA, 23 bp, Homo sapiens
atatacagtaactttatgtgtaa

SEQ ID NO: 5246083 - DNA, 11 bp, Homo sapiens
atatacagtta

SEQ ID NO: 5246084 - DNA, 18 bp, Homo sapiens
atatacagttattttgga

SEQ ID NO: 5246085 - DNA, 14 bp, Homo sapiens
atatacataaaaat

SEQ ID NO: 5246086 - DNA, 14 bp, Homo sapiens
atatacataacagg

SEQ ID NO: 5246087 - DNA, 12 bp, Homo sapiens
atatacatacac

SEQ ID NO: 5246088 - DNA, 16 bp, Homo sapiens
atatacatacacttgt

SEQ ID NO: 5246089 - DNA, 21 bp, Homo sapiens
atatacatacgcaattgtata

SEQ ID NO: 5246090 - DNA, 18 bp, Homo sapiens
atatacatactgcatctt

SEQ ID NO: 5246091 - DNA, 22 bp, Homo sapiens
atatacatacttacatgtgtgt

SEQ ID NO: 5246092 - DNA, 14 bp, Homo sapiens
atatacatatatat

SEQ ID NO: 5246093 - DNA, 16 bp, Homo sapiens
atatacatattataaa

SEQ ID NO: 5246094 - DNA, 17 bp, Homo sapiens
atatacatctgtgtatt

SEQ ID NO: 5246095 - DNA, 13 bp, Homo sapiens
atatacatgtgtg

SEQ ID NO: 5246096 - DNA, 23 bp, Homo sapiens
atatacatgtgtgtatatatgtg

SEQ ID NO: 5246097 - DNA, 15 bp, Homo sapiens
atatacatgtttatg

SEQ ID NO: 5246098 - DNA, 19 bp, Homo sapiens
atatacattatttctgtat

SEQ ID NO: 5246099 - DNA, 20 bp, Homo sapiens
atatacattatttctgtata

SEQ ID NO: 5246100 - DNA, 23 bp, Homo sapiens
atatacattatttctgtatatag

SEQ ID NO: 5246101 - DNA, 18 bp, Homo sapiens
atatacattcaaacttaa

SEQ ID NO: 5246102 - DNA, 18 bp, Homo sapiens
atatacattctttatctt

SEQ ID NO: 5246103 - DNA, 16 bp, Homo sapiens
atatacattgcttaga

SEQ ID NO: 5246104 - DNA, 14 bp, Homo sapiens
atatacattgtgtg

SEQ ID NO: 5246105 - DNA, 17 bp, Homo sapiens
atatacattgtgtgaaa

SEQ ID NO: 5246106 - DNA, 22 bp, Homo sapiens
atatacatttcataaggcctgc

SEQ ID NO: 5246107 - DNA, 11 bp, Homo sapiens
atatacatttg

SEQ ID NO: 5246108 - DNA, 23 bp, Homo sapiens
atatacatttgttggtaactaat

SEQ ID NO: 5246109 - DNA, 13 bp, Homo sapiens
atatacattttct

SEQ ID NO: 5246110 - DNA, 14 bp, Homo sapiens
atatacattttcta

SEQ ID NO: 5246111 - DNA, 16 bp, Homo sapiens
atatacattttctaaa

SEQ ID NO: 5246112 - DNA, 17 bp, Homo sapiens
atataccaaagcacatt

SEQ ID NO: 5246113 - DNA, 16 bp, Homo sapiens
atataccaaattaaaa

SEQ ID NO: 5246114 - DNA, 18 bp, Homo sapiens
atataccaatgacttcca

SEQ ID NO: 5246115 - DNA, 22 bp, Homo sapiens
atataccactctttacctttat

SEQ ID NO: 5246116 - DNA, 18 bp, Homo sapiens
atataccccaaattgtgt

SEQ ID NO: 5246117 - DNA, 20 bp, Homo sapiens
atataccccaaattgtgtat

SEQ ID NO: 5246118 - DNA, 15 bp, Homo sapiens
atatacctataatgt

SEQ ID NO: 5246119 - DNA, 17 bp, Homo sapiens
atatacctataatgtgt

SEQ ID NO: 5246120 - DNA, 20 bp, Homo sapiens
atatacctataatgtgtgta

SEQ ID NO: 5246121 - DNA, 21 bp, Homo sapiens
atatacctcttgaagaagaag

SEQ ID NO: 5246122 - DNA, 18 bp, Homo sapiens
atatacctggcttttact

SEQ ID NO: 5246123 - DNA, 16 bp, Homo sapiens
atatacctggtttact

SEQ ID NO: 5246124 - DNA, 15 bp, Homo sapiens
atatacgaaaagcca

SEQ ID NO: 5246125 - DNA, 22 bp, Homo sapiens
atatacgtttatataaatatat

SEQ ID NO: 5246126 - DNA, 16 bp, Homo sapiens
atatactaataaaaag

SEQ ID NO: 5246127 - DNA, 19 bp, Homo sapiens
atatactaataaaaaggtt

SEQ ID NO: 5246128 - DNA, 12 bp, Homo sapiens
atatactataat

SEQ ID NO: 5246129 - DNA, 22 bp, Homo sapiens
atatactattaaaaaggtttac

SEQ ID NO: 5246130 - DNA, 19 bp, Homo sapiens
atatactcaagagtggtat

SEQ ID NO: 5246131 - DNA, 15 bp, Homo sapiens
atatactcattagaa

SEQ ID NO: 5246132 - DNA, 19 bp, Homo sapiens
atatactgagctgctaaaa

SEQ ID NO: 5246133 - DNA, 21 bp, Homo sapiens
atatactgattttgaaaagta

SEQ ID NO: 5246134 - DNA, 13 bp, Homo sapiens
atatactgcagct

SEQ ID NO: 5246135 - DNA, 14 bp, Homo sapiens
atatactgcatatc

SEQ ID NO: 5246136 - DNA, 19 bp, Homo sapiens
atatactgtaaagaaagag

SEQ ID NO: 5246137 - DNA, 20 bp, Homo sapiens
atatactgtaaagaaagaga

SEQ ID NO: 5246138 - DNA, 21 bp, Homo sapiens
atatactgtaaagaaagagag

SEQ ID NO: 5246139 - DNA, 21 bp, Homo sapiens
atatactgtcgcatcttttta

SEQ ID NO: 5246140 - DNA, 15 bp, Homo sapiens
atatacttaaatgga

SEQ ID NO: 5246141 - DNA, 15 bp, Homo sapiens
atatacttaagaata

SEQ ID NO: 5246142 - DNA, 22 bp, Homo sapiens
atatacttctgctgtgggaaaa

SEQ ID NO: 5246143 - DNA, 14 bp, Homo sapiens
atatacttgactct

SEQ ID NO: 5246144 - DNA, 18 bp, Homo sapiens
atatacttgactctaata

SEQ ID NO: 5246145 - DNA, 14 bp, Homo sapiens
atatactttgccac

SEQ ID NO: 5246146 - DNA, 12 bp, Homo sapiens
atatacttttaa

SEQ ID NO: 5246147 - DNA, 13 bp, Homo sapiens
atatacttttaaa

SEQ ID NO: 5246148 - DNA, 20 bp, Homo sapiens
atatacttttaaattatgga

SEQ ID NO: 5246149 - DNA, 18 bp, Homo sapiens
atatacttttacaagtaa

SEQ ID NO: 5246150 - DNA, 19 bp, Homo sapiens
atatactttttcatgaaaa

SEQ ID NO: 5246151 - DNA, 12 bp, Homo sapiens
atatagaaaaca

SEQ ID NO: 5246152 - DNA, 14 bp, Homo sapiens
atatagaaaactaa

SEQ ID NO: 5246153 - DNA, 18 bp, Homo sapiens
atatagaaagctgtttat

SEQ ID NO: 5246154 - DNA, 15 bp, Homo sapiens
atatagaacagtgct

SEQ ID NO: 5246155 - DNA, 14 bp, Homo sapiens
atatagaagcattt

SEQ ID NO: 5246156 - DNA, 20 bp, Homo sapiens
atatagaaggactgcagcca

SEQ ID NO: 5246157 - DNA, 20 bp, Homo sapiens
atatagaagtataaagaatt

SEQ ID NO: 5246158 - DNA, 18 bp, Homo sapiens
atatagaattcagaaaat

SEQ ID NO: 5246159 - DNA, 22 bp, Homo sapiens
atatagaattgtagactgatgt

SEQ ID NO: 5246160 - DNA, 17 bp, Homo sapiens
atatagaatttcctgta

SEQ ID NO: 5246161 - DNA, 17 bp, Homo sapiens
atatagacacacataca

SEQ ID NO: 5246162 - DNA, 19 bp, Homo sapiens
atatagacacacatacata

SEQ ID NO: 5246163 - DNA, 20 bp, Homo sapiens
atatagacacacatacataa

SEQ ID NO: 5246164 - DNA, 20 bp, Homo sapiens
atatagacagtccttaaaaa

SEQ ID NO: 5246165 - DNA, 19 bp, Homo sapiens
atatagaccaattgaagca

SEQ ID NO: 5246166 - DNA, 21 bp, Homo sapiens
atatagaccccaagcattctg

SEQ ID NO: 5246167 - DNA, 18 bp, Homo sapiens
atatagacctatgataaa

SEQ ID NO: 5246168 - DNA, 14 bp, Homo sapiens
atatagactgttga

SEQ ID NO: 5246169 - DNA, 12 bp, Homo sapiens
atatagacttgg

SEQ ID NO: 5246170 - DNA, 15 bp, Homo sapiens
atatagagactgtgt

SEQ ID NO: 5246171 - DNA, 21 bp, Homo sapiens
atatagagacttctaaatcat

SEQ ID NO: 5246172 - DNA, 13 bp, Homo sapiens
atatagagatgtt

SEQ ID NO: 5246173 - DNA, 14 bp, Homo sapiens
atatagagatgttt

SEQ ID NO: 5246174 - DNA, 22 bp, Homo sapiens
atatagagatgtttttaaaagt

SEQ ID NO: 5246175 - DNA, 22 bp, Homo sapiens
atatagagtcattgtaatgttg

SEQ ID NO: 5246176 - DNA, 14 bp, Homo sapiens
atatagatcacata

SEQ ID NO: 5246177 - DNA, 20 bp, Homo sapiens
atatagatcacataacagaa

SEQ ID NO: 5246178 - DNA, 23 bp, Homo sapiens
atatagatcagttataagtagca

SEQ ID NO: 5246179 - DNA, 14 bp, Homo sapiens
atatagatgtctgt

SEQ ID NO: 5246180 - DNA, 19 bp, Homo sapiens
atatagatgtctgtgtata

SEQ ID NO: 5246181 - DNA, 13 bp, Homo sapiens
atatagattagaa

SEQ ID NO: 5246182 - DNA, 14 bp, Homo sapiens
atatagattagaaa

SEQ ID NO: 5246183 - DNA, 22 bp, Homo sapiens
atatagcaaaacttttaaacta

SEQ ID NO: 5246184 - DNA, 16 bp, Homo sapiens
atatagcaaagatata

SEQ ID NO: 5246185 - DNA, 17 bp, Homo sapiens
atatagcagcaaaaata

SEQ ID NO: 5246186 - DNA, 14 bp, Homo sapiens
atatagcatctttc

SEQ ID NO: 5246187 - DNA, 14 bp, Homo sapiens
atatagcattgata

SEQ ID NO: 5246188 - DNA, 17 bp, Homo sapiens
atatagcattgataatc

SEQ ID NO: 5246189 - DNA, 19 bp, Homo sapiens
atatagcattgataatctt

SEQ ID NO: 5246190 - DNA, 18 bp, Homo sapiens
atatagcatttatggtaa

SEQ ID NO: 5246191 - DNA, 20 bp, Homo sapiens
atatagcatttatggtaatc

SEQ ID NO: 5246192 - DNA, 12 bp, Homo sapiens
atatagcctgcc

SEQ ID NO: 5246193 - DNA, 15 bp, Homo sapiens
atatagcctgcctca

SEQ ID NO: 5246194 - DNA, 18 bp, Homo sapiens
atatagcgttcccaacaa

SEQ ID NO: 5246195 - DNA, 18 bp, Homo sapiens
atatagctcgagcaaaat

SEQ ID NO: 5246196 - DNA, 17 bp, Homo sapiens
atatagctctacacaac

SEQ ID NO: 5246197 - DNA, 13 bp, Homo sapiens
atatagctggcaa

SEQ ID NO: 5246198 - DNA, 18 bp, Homo sapiens
atatagcttgaaacatag

SEQ ID NO: 5246199 - DNA, 18 bp, Homo sapiens
atataggaaaacaataat

SEQ ID NO: 5246200 - DNA, 17 bp, Homo sapiens
atataggaaaatacatt

SEQ ID NO: 5246201 - DNA, 15 bp, Homo sapiens
atataggaattaaga

SEQ ID NO: 5246202 - DNA, 17 bp, Homo sapiens
atataggataaaataat

SEQ ID NO: 5246203 - DNA, 19 bp, Homo sapiens
atataggattatagatact

SEQ ID NO: 5246204 - DNA, 23 bp, Homo sapiens
atataggggcaaaaatttgacat

SEQ ID NO: 5246205 - DNA, 19 bp, Homo sapiens
atatagggtgtggctccta

SEQ ID NO: 5246206 - DNA, 23 bp, Homo sapiens
atatagggtgtggctcctaccag

SEQ ID NO: 5246207 - DNA, 15 bp, Homo sapiens
atatagggttttttt

SEQ ID NO: 5246208 - DNA, 21 bp, Homo sapiens
atataggtcctgtgttaaaca

SEQ ID NO: 5246209 - DNA, 18 bp, Homo sapiens
atataggtgatgtttgct

SEQ ID NO: 5246210 - DNA, 18 bp, Homo sapiens
atataggttcttttctct

SEQ ID NO: 5246211 - DNA, 19 bp, Homo sapiens
atataggttttgtttgcta

SEQ ID NO: 5246212 - DNA, 14 bp, Homo sapiens
atatagtaaacact

SEQ ID NO: 5246213 - DNA, 21 bp, Homo sapiens
atatagtatatttatactcta

SEQ ID NO: 5246214 - DNA, 20 bp, Homo sapiens
atatagtatctttaaaattt

SEQ ID NO: 5246215 - DNA, 18 bp, Homo sapiens
atatagtcaacttattct

SEQ ID NO: 5246216 - DNA, 18 bp, Homo sapiens
atatagtgaaaaatgtca

SEQ ID NO: 5246217 - DNA, 16 bp, Homo sapiens
atatagtgaagcaatt

SEQ ID NO: 5246218 - DNA, 20 bp, Homo sapiens
atatagtgctgtttaagcta

SEQ ID NO: 5246219 - DNA, 21 bp, Homo sapiens
atatagtggatgatatacaca

SEQ ID NO: 5246220 - DNA, 23 bp, Homo sapiens
atatagtggatgatatacacagt

SEQ ID NO: 5246221 - DNA, 17 bp, Homo sapiens
atatagtgggtacatca

SEQ ID NO: 5246222 - DNA, 19 bp, Homo sapiens
atatagtgttgtgttacaa

SEQ ID NO: 5246223 - DNA, 15 bp, Homo sapiens
atatagttaaactga

SEQ ID NO: 5246224 - DNA, 16 bp, Homo sapiens
atatagttcctaagaa

SEQ ID NO: 5246225 - DNA, 21 bp, Homo sapiens
atatagttcctaagaagcttc

SEQ ID NO: 5246226 - DNA, 20 bp, Homo sapiens
atatagttctgtgtagagaa

SEQ ID NO: 5246227 - DNA, 23 bp, Homo sapiens
atatagttctgtgtagagaatgt

SEQ ID NO: 5246228 - DNA, 14 bp, Homo sapiens
atatagttgaaagt

SEQ ID NO: 5246229 - DNA, 16 bp, Homo sapiens
atatagttgaaagtaa

SEQ ID NO: 5246230 - DNA, 19 bp, Homo sapiens
atcccatccatcagctccc

SEQ ID NO: 5246231 - DNA, 14 bp, Homo sapiens
atcccatcccatcc

SEQ ID NO: 5246232 - DNA, 15 bp, Homo sapiens
atcccatcccatccc

SEQ ID NO: 5246233 - DNA, 16 bp, Homo sapiens
atcccatcccatccca

SEQ ID NO: 5246234 - DNA, 18 bp, Homo sapiens
atcccatcccatcccatc

SEQ ID NO: 5246235 - DNA, 15 bp, Homo sapiens
atcccatcccgctct

SEQ ID NO: 5246236 - DNA, 17 bp, Homo sapiens
atcccatccttaagaga

SEQ ID NO: 5246237 - DNA, 18 bp, Homo sapiens
atcccatctaagctgcag

SEQ ID NO: 5246238 - DNA, 19 bp, Homo sapiens
atcccatctaagctgcagc

SEQ ID NO: 5246239 - DNA, 20 bp, Homo sapiens
atcccatctaagctgcagct

SEQ ID NO: 5246240 - DNA, 15 bp, Homo sapiens
atcccatctcacttt

SEQ ID NO: 5246241 - DNA, 16 bp, Homo sapiens
atcccatctcagaaga

SEQ ID NO: 5246242 - DNA, 12 bp, Homo sapiens
atcccatctctc

SEQ ID NO: 5246243 - DNA, 15 bp, Homo sapiens
atcccatctctccca

SEQ ID NO: 5246244 - DNA, 17 bp, Homo sapiens
atcccatctctcccact

SEQ ID NO: 5246245 - DNA, 20 bp, Homo sapiens
atcccatctctcccacttcc

SEQ ID NO: 5246246 - DNA, 16 bp, Homo sapiens
atcccatgagcctcag

SEQ ID NO: 5246247 - DNA, 21 bp, Homo sapiens
atcccatggatgagtaaactg

SEQ ID NO: 5246248 - DNA, 20 bp, Homo sapiens
atcccatggatgtttcttct

SEQ ID NO: 5246249 - DNA, 22 bp, Homo sapiens
atcccatgggggtgctgcagcc

SEQ ID NO: 5246250 - DNA, 18 bp, Homo sapiens
atcccatgtaacagaaag

SEQ ID NO: 5246251 - DNA, 23 bp, Homo sapiens
atcccatgtaacagaaagggcaa

SEQ ID NO: 5246252 - DNA, 16 bp, Homo sapiens
atcccatgtcacctca

SEQ ID NO: 5246253 - DNA, 21 bp, Homo sapiens
atcccattaatcatttcccca

SEQ ID NO: 5246254 - DNA, 15 bp, Homo sapiens
atcccattcacttct

SEQ ID NO: 5246255 - DNA, 14 bp, Homo sapiens
atcccattccaggc

SEQ ID NO: 5246256 - DNA, 13 bp, Homo sapiens
atcccattcttta

SEQ ID NO: 5246257 - DNA, 19 bp, Homo sapiens
atcccatttagtgtgaata

SEQ ID NO: 5246258 - DNA, 13 bp, Homo sapiens
atcccatttcttg

SEQ ID NO: 5246259 - DNA, 15 bp, Homo sapiens
atcccatttcttgaa

SEQ ID NO: 5246260 - DNA, 15 bp, Homo sapiens
atcccattttcatcc

SEQ ID NO: 5246261 - DNA, 21 bp, Homo sapiens
atccccaaatgtgtcttgtat

SEQ ID NO: 5246262 - DNA, 18 bp, Homo sapiens
atccccaactgctccagc

SEQ ID NO: 5246263 - DNA, 13 bp, Homo sapiens
atccccaagcctg

SEQ ID NO: 5246264 - DNA, 16 bp, Homo sapiens
atccccaagcctggca

SEQ ID NO: 5246265 - DNA, 17 bp, Homo sapiens
atccccaagctggccac

SEQ ID NO: 5246266 - DNA, 15 bp, Homo sapiens
atccccaatcagctc

SEQ ID NO: 5246267 - DNA, 22 bp, Homo sapiens
atccccacaggcacattaactg

SEQ ID NO: 5246268 - DNA, 12 bp, Homo sapiens
atccccaccact

SEQ ID NO: 5246269 - DNA, 13 bp, Homo sapiens
atccccaccagct

SEQ ID NO: 5246270 - DNA, 14 bp, Homo sapiens
atccccaccccacc

SEQ ID NO: 5246271 - DNA, 22 bp, Homo sapiens
atccccaccctcccctctcctg

SEQ ID NO: 5246272 - DNA, 16 bp, Homo sapiens
atccccaccctgggct

SEQ ID NO: 5246273 - DNA, 23 bp, Homo sapiens
atccccacctggcggagctctcc

SEQ ID NO: 5246274 - DNA, 17 bp, Homo sapiens
atccccacctgtcttca

SEQ ID NO: 5246275 - DNA, 21 bp, Homo sapiens
atccccacgccacagcccttt

SEQ ID NO: 5246276 - DNA, 21 bp, Homo sapiens
atccccactaggttcttttcc

SEQ ID NO: 5246277 - DNA, 15 bp, Homo sapiens
atccccactcctccg

SEQ ID NO: 5246278 - DNA, 15 bp, Homo sapiens
atccccagagcccag

SEQ ID NO: 5246279 - DNA, 18 bp, Homo sapiens
atccccagatatttatgt

SEQ ID NO: 5246280 - DNA, 18 bp, Homo sapiens
atccccagcccctcctcc

SEQ ID NO: 5246281 - DNA, 21 bp, Homo sapiens
atccccagcccctcctccctc

SEQ ID NO: 5246282 - DNA, 23 bp, Homo sapiens
atccccagcccctcctccctcag

SEQ ID NO: 5246283 - DNA, 12 bp, Homo sapiens
atccccagccta

SEQ ID NO: 5246284 - DNA, 13 bp, Homo sapiens
atccccagctgtt

SEQ ID NO: 5246285 - DNA, 16 bp, Homo sapiens
atccccagctttctcc

SEQ ID NO: 5246286 - DNA, 13 bp, Homo sapiens
atccccagggcag

SEQ ID NO: 5246287 - DNA, 14 bp, Homo sapiens
atccccagggcagc

SEQ ID NO: 5246288 - DNA, 15 bp, Homo sapiens
atccccagggcagcc

SEQ ID NO: 5246289 - DNA, 15 bp, Homo sapiens
atccccagtaaaatt

SEQ ID NO: 5246290 - DNA, 16 bp, Homo sapiens
atccccagtgcccggt

SEQ ID NO: 5246291 - DNA, 18 bp, Homo sapiens
atccccataatgcttctt

SEQ ID NO: 5246292 - DNA, 15 bp, Homo sapiens
atccccatcctccag

SEQ ID NO: 5246293 - DNA, 20 bp, Homo sapiens
atccccatcctccagcttct

SEQ ID NO: 5246294 - DNA, 15 bp, Homo sapiens
atccccatctccctg

SEQ ID NO: 5246295 - DNA, 16 bp, Homo sapiens
atccccatctccctgc

SEQ ID NO: 5246296 - DNA, 14 bp, Homo sapiens
atccccatgcctag

SEQ ID NO: 5246297 - DNA, 22 bp, Homo sapiens
atcccccaaacagcatgtgctc

SEQ ID NO: 5246298 - DNA, 15 bp, Homo sapiens
atcccccaatgacct

SEQ ID NO: 5246299 - DNA, 14 bp, Homo sapiens
atcccccactgcca

SEQ ID NO: 5246300 - DNA, 22 bp, Homo sapiens
atcccccactgccacaccctcc

SEQ ID NO: 5246301 - DNA, 12 bp, Homo sapiens
atcccccagaaa

SEQ ID NO: 5246302 - DNA, 17 bp, Homo sapiens
atcccccagaaaagaaa

SEQ ID NO: 5246303 - DNA, 12 bp, Homo sapiens
atcccccagcct

SEQ ID NO: 5246304 - DNA, 19 bp, Homo sapiens
atcccccagcgcttagaaa

SEQ ID NO: 5246305 - DNA, 19 bp, Homo sapiens
atcccccccacctctccct

SEQ ID NO: 5246306 - DNA, 11 bp, Homo sapiens
atcccccccag

SEQ ID NO: 5246307 - DNA, 12 bp, Homo sapiens
atcccccccagc

SEQ ID NO: 5246308 - DNA, 13 bp, Homo sapiens
atcccccctgctc

SEQ ID NO: 5246309 - DNA, 15 bp, Homo sapiens
atcccccctgctcag

SEQ ID NO: 5246310 - DNA, 19 bp, Homo sapiens
atcccccctgctgcccagt

SEQ ID NO: 5246311 - DNA, 11 bp, Homo sapiens
atcccccgccc

SEQ ID NO: 5246312 - DNA, 15 bp, Homo sapiens
atcccccggcacctc

SEQ ID NO: 5246313 - DNA, 22 bp, Homo sapiens
atcccccgtgtattcaggaccc

SEQ ID NO: 5246314 - DNA, 14 bp, Homo sapiens
atccccctaaacta

SEQ ID NO: 5246315 - DNA, 22 bp, Homo sapiens
atccccctacaaccccagcctc

SEQ ID NO: 5246316 - DNA, 22 bp, Homo sapiens
atccccctccaaagtcttgata

SEQ ID NO: 5246317 - DNA, 23 bp, Homo sapiens
atccccctctgtctgccctcaca

SEQ ID NO: 5246318 - DNA, 13 bp, Homo sapiens
atccccctgccct

SEQ ID NO: 5246319 - DNA, 17 bp, Homo sapiens
atcccccttaaagaaaa

SEQ ID NO: 5246320 - DNA, 13 bp, Homo sapiens
atcccccttcttc

SEQ ID NO: 5246321 - DNA, 19 bp, Homo sapiens
atcccccttcttcctcccc

SEQ ID NO: 5246322 - DNA, 22 bp, Homo sapiens
atcccccttcttcctcccctca

SEQ ID NO: 5246323 - DNA, 19 bp, Homo sapiens
atccccgacagtggctctc

SEQ ID NO: 5246324 - DNA, 22 bp, Homo sapiens
atccccgcagtgtgcactaagg

SEQ ID NO: 5246325 - DNA, 17 bp, Homo sapiens
atccccgcctggccagg

SEQ ID NO: 5246326 - DNA, 18 bp, Homo sapiens
atccccgcctggccagga

SEQ ID NO: 5246327 - DNA, 21 bp, Homo sapiens
atccccgcctggccaggagca

SEQ ID NO: 5246328 - DNA, 13 bp, Homo sapiens
atccccgctggct

SEQ ID NO: 5246329 - DNA, 13 bp, Homo sapiens
atccccgcttccc

SEQ ID NO: 5246330 - DNA, 21 bp, Homo sapiens
atccccggctgcttccttctg

SEQ ID NO: 5246331 - DNA, 22 bp, Homo sapiens
atccccggctgcttccttctgc

SEQ ID NO: 5246332 - DNA, 16 bp, Homo sapiens
atccccgtctctgccc

SEQ ID NO: 5246333 - DNA, 23 bp, Homo sapiens
atccccgtctctgccctgggctc

SEQ ID NO: 5246334 - DNA, 17 bp, Homo sapiens
atcccctcaacaccctg

SEQ ID NO: 5246335 - DNA, 15 bp, Homo sapiens
atcccctcagcctct

SEQ ID NO: 5246336 - DNA, 13 bp, Homo sapiens
atcccctcccagt

SEQ ID NO: 5246337 - DNA, 20 bp, Homo sapiens
atcccctccctccttcactc

SEQ ID NO: 5246338 - DNA, 17 bp, Homo sapiens
atcccctccctgcctgc

SEQ ID NO: 5246339 - DNA, 18 bp, Homo sapiens
atcccctccctgcctgct

SEQ ID NO: 5246340 - DNA, 19 bp, Homo sapiens
atcccctccctgtcaaagc

SEQ ID NO: 5246341 - DNA, 15 bp, Homo sapiens
atcccctcctagcac

SEQ ID NO: 5246342 - DNA, 22 bp, Homo sapiens
atcccctcgcttcataggcaga

SEQ ID NO: 5246343 - DNA, 23 bp, Homo sapiens
atcccctcgcttcataggcagag

SEQ ID NO: 5246344 - DNA, 16 bp, Homo sapiens
atcccctcgtcctgtc

SEQ ID NO: 5246345 - DNA, 21 bp, Homo sapiens
atcccctcgtcctgtcccaga

SEQ ID NO: 5246346 - DNA, 23 bp, Homo sapiens
atcccctcgtcctgtcccagagg

SEQ ID NO: 5246347 - DNA, 14 bp, Homo sapiens
atcccctctcagga

SEQ ID NO: 5246348 - DNA, 16 bp, Homo sapiens
atcccctctcaggaga

SEQ ID NO: 5246349 - DNA, 15 bp, Homo sapiens
atcccctctcctgcc

SEQ ID NO: 5246350 - DNA, 15 bp, Homo sapiens
atcccctgcctcctg

SEQ ID NO: 5246351 - DNA, 19 bp, Homo sapiens
atcccctgcctcctgccac

SEQ ID NO: 5246352 - DNA, 12 bp, Homo sapiens
atcccctgctac

SEQ ID NO: 5246353 - DNA, 22 bp, Homo sapiens
atcccctgtcccctggggctgg

SEQ ID NO: 5246354 - DNA, 23 bp, Homo sapiens
atccccttacccttagaatccac

SEQ ID NO: 5246355 - DNA, 20 bp, Homo sapiens
atccccttcccccatcccta

SEQ ID NO: 5246356 - DNA, 11 bp, Homo sapiens
atccccttcct

SEQ ID NO: 5246357 - DNA, 22 bp, Homo sapiens
atccccttctcccctgcactgt

SEQ ID NO: 5246358 - DNA, 23 bp, Homo sapiens
atccccttctcccctgcactgta

SEQ ID NO: 5246359 - DNA, 21 bp, Homo sapiens
atccccttgaggtctcagccc

SEQ ID NO: 5246360 - DNA, 18 bp, Homo sapiens
atcccctttactatcatt

SEQ ID NO: 5246361 - DNA, 16 bp, Homo sapiens
atcccctttcctcccc

SEQ ID NO: 5246362 - DNA, 20 bp, Homo sapiens
atcccctttggttttactac

SEQ ID NO: 5246363 - DNA, 13 bp, Homo sapiens
atcccgaagaatg

SEQ ID NO: 5246364 - DNA, 22 bp, Homo sapiens
atcccgaagaatggagaggaac

SEQ ID NO: 5246365 - DNA, 23 bp, Homo sapiens
atcccgaagccatcacttctccc

SEQ ID NO: 5246366 - DNA, 20 bp, Homo sapiens
atcccgagcaaccctctgaa

SEQ ID NO: 5246367 - DNA, 14 bp, Homo sapiens
atcccgagcacctc

SEQ ID NO: 5246368 - DNA, 14 bp, Homo sapiens
atcccgcagcctcg

SEQ ID NO: 5246369 - DNA, 15 bp, Homo sapiens
atcccgccttctcca

SEQ ID NO: 5246370 - DNA, 16 bp, Homo sapiens
atcccgccttctccag

SEQ ID NO: 5246371 - DNA, 16 bp, Homo sapiens
atcccgctcttttcct

SEQ ID NO: 5246372 - DNA, 21 bp, Homo sapiens
atcccgcttagcctgcctcac

SEQ ID NO: 5246373 - DNA, 22 bp, Homo sapiens
atcccgcttagcgctctggaca

SEQ ID NO: 5246374 - DNA, 14 bp, Homo sapiens
atcccggagcgcac

SEQ ID NO: 5246375 - DNA, 18 bp, Homo sapiens
atcccggagcgcacctgc

SEQ ID NO: 5246376 - DNA, 19 bp, Homo sapiens
atcccggagcgcacctgct

SEQ ID NO: 5246377 - DNA, 17 bp, Homo sapiens
atcccggaggaaatctg

SEQ ID NO: 5246378 - DNA, 19 bp, Homo sapiens
atcccggccggccctggct

SEQ ID NO: 5246379 - DNA, 20 bp, Homo sapiens
atcccggccggccctggctt

SEQ ID NO: 5246380 - DNA, 13 bp, Homo sapiens
atcccggcctctt

SEQ ID NO: 5246381 - DNA, 14 bp, Homo sapiens
atcccggctccaga

SEQ ID NO: 5246382 - DNA, 16 bp, Homo sapiens
atcccggctccagagc

SEQ ID NO: 5246383 - DNA, 18 bp, Homo sapiens
atcccggctccagagcag

SEQ ID NO: 5246384 - DNA, 14 bp, Homo sapiens
atcccggctgccct

SEQ ID NO: 5246385 - DNA, 21 bp, Homo sapiens
atcccggggccatggaagctg

SEQ ID NO: 5246386 - DNA, 21 bp, Homo sapiens
atcccggtgcatgcaggtctc

SEQ ID NO: 5246387 - DNA, 17 bp, Homo sapiens
atcccgtatcacagtgt

SEQ ID NO: 5246388 - DNA, 13 bp, Homo sapiens
atcccgtgttctc

SEQ ID NO: 5246389 - DNA, 18 bp, Homo sapiens
atcccgtttccctccagg

SEQ ID NO: 5246390 - DNA, 20 bp, Homo sapiens
atcccgttttccccatgaca

SEQ ID NO: 5246391 - DNA, 16 bp, Homo sapiens
atccctaagaattccc

SEQ ID NO: 5246392 - DNA, 16 bp, Homo sapiens
atccctaatgctgcag

SEQ ID NO: 5246393 - DNA, 14 bp, Homo sapiens
atccctacatgtat

SEQ ID NO: 5246394 - DNA, 12 bp, Homo sapiens
atccctaccact

SEQ ID NO: 5246395 - DNA, 14 bp, Homo sapiens
atccctaccactgt

SEQ ID NO: 5246396 - DNA, 17 bp, Homo sapiens
atccctaccgacccagg

SEQ ID NO: 5246397 - DNA, 19 bp, Homo sapiens
atccctaccgacccagggt

SEQ ID NO: 5246398 - DNA, 15 bp, Homo sapiens
atccctactgtaatt

SEQ ID NO: 5246399 - DNA, 19 bp, Homo sapiens
atccctagaagagcacaga

SEQ ID NO: 5246400 - DNA, 18 bp, Homo sapiens
atccctatgtcccagccc

SEQ ID NO: 5246401 - DNA, 20 bp, Homo sapiens
atccctattctgtgttttat

SEQ ID NO: 5246402 - DNA, 13 bp, Homo sapiens
atccctatttaat

SEQ ID NO: 5246403 - DNA, 23 bp, Homo sapiens
atccctcaaaccttgaggagaag

SEQ ID NO: 5246404 - DNA, 18 bp, Homo sapiens
atccctcaactgagggcc

SEQ ID NO: 5246405 - DNA, 14 bp, Homo sapiens
atccctcacctgta

SEQ ID NO: 5246406 - DNA, 16 bp, Homo sapiens
atccctcaccttctga

SEQ ID NO: 5246407 - DNA, 23 bp, Homo sapiens
atccctcatcctcatacccaccc

SEQ ID NO: 5246408 - DNA, 17 bp, Homo sapiens
atccctcatctgtccct

SEQ ID NO: 5246409 - DNA, 17 bp, Homo sapiens
atatagttgaaagtaaa

SEQ ID NO: 5246410 - DNA, 17 bp, Homo sapiens
atatagttgaacaagat

SEQ ID NO: 5246411 - DNA, 17 bp, Homo sapiens
atatagttgtctttctt

SEQ ID NO: 5246412 - DNA, 13 bp, Homo sapiens
atatagttttact

SEQ ID NO: 5246413 - DNA, 15 bp, Homo sapiens
atatataaaaagaaa

SEQ ID NO: 5246414 - DNA, 21 bp, Homo sapiens
atatataaaacggtgctgtga

SEQ ID NO: 5246415 - DNA, 17 bp, Homo sapiens
atatataaaagtctgag

SEQ ID NO: 5246416 - DNA, 18 bp, Homo sapiens
atatataaaagtctgagt

SEQ ID NO: 5246417 - DNA, 13 bp, Homo sapiens
atatataaaataa

SEQ ID NO: 5246418 - DNA, 16 bp, Homo sapiens
atatataaaataaata

SEQ ID NO: 5246419 - DNA, 17 bp, Homo sapiens
atatataaaataaatat

SEQ ID NO: 5246420 - DNA, 19 bp, Homo sapiens
atatataaaataaatatac

SEQ ID NO: 5246421 - DNA, 22 bp, Homo sapiens
atatataaaataaatatactaa

SEQ ID NO: 5246422 - DNA, 22 bp, Homo sapiens
atatataaaatacacgtgtata

SEQ ID NO: 5246423 - DNA, 23 bp, Homo sapiens
atatataaaatacacgtgtatat

SEQ ID NO: 5246424 - DNA, 13 bp, Homo sapiens
atatataaaatat

SEQ ID NO: 5246425 - DNA, 21 bp, Homo sapiens
atatataaacgatatatgtaa

SEQ ID NO: 5246426 - DNA, 16 bp, Homo sapiens
atatataaagaatata

SEQ ID NO: 5246427 - DNA, 14 bp, Homo sapiens
atatataaagatat

SEQ ID NO: 5246428 - DNA, 15 bp, Homo sapiens
atatataaagtatag

SEQ ID NO: 5246429 - DNA, 11 bp, Homo sapiens
atatataaata

SEQ ID NO: 5246430 - DNA, 16 bp, Homo sapiens
atatataaataaatat

SEQ ID NO: 5246431 - DNA, 17 bp, Homo sapiens
atatataaataaatata

SEQ ID NO: 5246432 - DNA, 18 bp, Homo sapiens
atatataaatatatataa

SEQ ID NO: 5246433 - DNA, 18 bp, Homo sapiens
atatataaatatattatt

SEQ ID NO: 5246434 - DNA, 19 bp, Homo sapiens
atatataaatatattatta

SEQ ID NO: 5246435 - DNA, 13 bp, Homo sapiens
atatataaatgta

SEQ ID NO: 5246436 - DNA, 17 bp, Homo sapiens
atatataacaatgctgt

SEQ ID NO: 5246437 - DNA, 18 bp, Homo sapiens
atatataacagatacatt

SEQ ID NO: 5246438 - DNA, 14 bp, Homo sapiens
atatataagaaaga

SEQ ID NO: 5246439 - DNA, 18 bp, Homo sapiens
atatataagaaagacatc

SEQ ID NO: 5246440 - DNA, 21 bp, Homo sapiens
atatataagactattccaact

SEQ ID NO: 5246441 - DNA, 16 bp, Homo sapiens
atatataataaatact

SEQ ID NO: 5246442 - DNA, 13 bp, Homo sapiens
atatataatcaaa

SEQ ID NO: 5246443 - DNA, 22 bp, Homo sapiens
atatataatggtttactgctgt

SEQ ID NO: 5246444 - DNA, 16 bp, Homo sapiens
atatataatttaatgt

SEQ ID NO: 5246445 - DNA, 19 bp, Homo sapiens
atatataatttgagtgtat

SEQ ID NO: 5246446 - DNA, 22 bp, Homo sapiens
atatataatttgagtgtatata

SEQ ID NO: 5246447 - DNA, 15 bp, Homo sapiens
atatatacaaggtga

SEQ ID NO: 5246448 - DNA, 14 bp, Homo sapiens
atatatacacatac

SEQ ID NO: 5246449 - DNA, 18 bp, Homo sapiens
atatatacacatacatac

SEQ ID NO: 5246450 - DNA, 16 bp, Homo sapiens
atatatacagtaactt

SEQ ID NO: 5246451 - DNA, 23 bp, Homo sapiens
atatatacagtaactttatgtgt

SEQ ID NO: 5246452 - DNA, 11 bp, Homo sapiens
atatatacata

SEQ ID NO: 5246453 - DNA, 13 bp, Homo sapiens
atatatacataaa

SEQ ID NO: 5246454 - DNA, 14 bp, Homo sapiens
atatatacataaaa

SEQ ID NO: 5246455 - DNA, 14 bp, Homo sapiens
atatatacatacgc

SEQ ID NO: 5246456 - DNA, 13 bp, Homo sapiens
atatatacatata

SEQ ID NO: 5246457 - DNA, 14 bp, Homo sapiens
atatatacatatgt

SEQ ID NO: 5246458 - DNA, 16 bp, Homo sapiens
atatatacatattcaa

SEQ ID NO: 5246459 - DNA, 14 bp, Homo sapiens
atatatacatcata

SEQ ID NO: 5246460 - DNA, 19 bp, Homo sapiens
atatatacccccccatgca

SEQ ID NO: 5246461 - DNA, 15 bp, Homo sapiens
atatatacttgcaag

SEQ ID NO: 5246462 - DNA, 13 bp, Homo sapiens
atatatagaaaag

SEQ ID NO: 5246463 - DNA, 20 bp, Homo sapiens
atatatagctggcaagaatg

SEQ ID NO: 5246464 - DNA, 14 bp, Homo sapiens
atatatagtcaaat

SEQ ID NO: 5246465 - DNA, 20 bp, Homo sapiens
atatatagtccagacactta

SEQ ID NO: 5246466 - DNA, 22 bp, Homo sapiens
atatatagtgaaaaatgtcact

SEQ ID NO: 5246467 - DNA, 15 bp, Homo sapiens
atatatagtgctata

SEQ ID NO: 5246468 - DNA, 18 bp, Homo sapiens
atatatagttagctttat

SEQ ID NO: 5246469 - DNA, 11 bp, Homo sapiens
atatatataaa

SEQ ID NO: 5246470 - DNA, 13 bp, Homo sapiens
atatatataaaat

SEQ ID NO: 5246471 - DNA, 13 bp, Homo sapiens
atatatataaacc

SEQ ID NO: 5246472 - DNA, 13 bp, Homo sapiens
atatatataaaga

SEQ ID NO: 5246473 - DNA, 14 bp, Homo sapiens
atatatataaataa

SEQ ID NO: 5246474 - DNA, 15 bp, Homo sapiens
atatatataaattga

SEQ ID NO: 5246475 - DNA, 12 bp, Homo sapiens
atatatatacat

SEQ ID NO: 5246476 - DNA, 14 bp, Homo sapiens
atatatatacatat

SEQ ID NO: 5246477 - DNA, 15 bp, Homo sapiens
atatatatagtcaaa

SEQ ID NO: 5246478 - DNA, 11 bp, Homo sapiens
atatatatata

SEQ ID NO: 5246479 - DNA, 15 bp, Homo sapiens
atatatatataaagt

SEQ ID NO: 5246480 - DNA, 14 bp, Homo sapiens
atatatatatataa

SEQ ID NO: 5246481 - DNA, 14 bp, Homo sapiens
atatatatatatac

SEQ ID NO: 5246482 - DNA, 14 bp, Homo sapiens
atatatatatatat

SEQ ID NO: 5246483 - DNA, 16 bp, Homo sapiens
atatatatatatataa

SEQ ID NO: 5246484 - DNA, 16 bp, Homo sapiens
atatatatatatatgt

SEQ ID NO: 5246485 - DNA, 14 bp, Homo sapiens
atatatatatatgt

SEQ ID NO: 5246486 - DNA, 14 bp, Homo sapiens
atatatatatattt

SEQ ID NO: 5246487 - DNA, 13 bp, Homo sapiens
atatatatattga

SEQ ID NO: 5246488 - DNA, 14 bp, Homo sapiens
atatatatatttaa

SEQ ID NO: 5246489 - DNA, 14 bp, Homo sapiens
atatatatatttgt

SEQ ID NO: 5246490 - DNA, 15 bp, Homo sapiens
atatatatctacaat

SEQ ID NO: 5246491 - DNA, 15 bp, Homo sapiens
atatatatctatata

SEQ ID NO: 5246492 - DNA, 13 bp, Homo sapiens
atatatatctgag

SEQ ID NO: 5246493 - DNA, 15 bp, Homo sapiens
atatatatgagtgaa

SEQ ID NO: 5246494 - DNA, 18 bp, Homo sapiens
atatatatgcacacatat

SEQ ID NO: 5246495 - DNA, 22 bp, Homo sapiens
atatatatgcatatatatatgt

SEQ ID NO: 5246496 - DNA, 19 bp, Homo sapiens
atatatatggaataagtgt

SEQ ID NO: 5246497 - DNA, 12 bp, Homo sapiens
atatatatgtat

SEQ ID NO: 5246498 - DNA, 13 bp, Homo sapiens
atatatatgtata

SEQ ID NO: 5246499 - DNA, 16 bp, Homo sapiens
atatatatgtatatgt

SEQ ID NO: 5246500 - DNA, 14 bp, Homo sapiens
atatatatgtatgt

SEQ ID NO: 5246501 - DNA, 15 bp, Homo sapiens
atatatatgtatgta

SEQ ID NO: 5246502 - DNA, 16 bp, Homo sapiens
atatatatgtcaatat

SEQ ID NO: 5246503 - DNA, 13 bp, Homo sapiens
atatatatgtgaa

SEQ ID NO: 5246504 - DNA, 14 bp, Homo sapiens
atatatatgtgaac

SEQ ID NO: 5246505 - DNA, 14 bp, Homo sapiens
atatatatgtgcag

SEQ ID NO: 5246506 - DNA, 16 bp, Homo sapiens
atatatatgtgtgtgt

SEQ ID NO: 5246507 - DNA, 18 bp, Homo sapiens
atatatatgttgatttct

SEQ ID NO: 5246508 - DNA, 17 bp, Homo sapiens
atatatattataaatat

SEQ ID NO: 5246509 - DNA, 20 bp, Homo sapiens
atatatattatcttttcata

SEQ ID NO: 5246510 - DNA, 21 bp, Homo sapiens
atatatattcatcagaatgtt

SEQ ID NO: 5246511 - DNA, 23 bp, Homo sapiens
atatatattctattacattttca

SEQ ID NO: 5246512 - DNA, 23 bp, Homo sapiens
atatatattctggctgataaaag

SEQ ID NO: 5246513 - DNA, 11 bp, Homo sapiens
atatatattta

SEQ ID NO: 5246514 - DNA, 14 bp, Homo sapiens
atatatatttgtaa

SEQ ID NO: 5246515 - DNA, 13 bp, Homo sapiens
atatatattttaa

SEQ ID NO: 5246516 - DNA, 15 bp, Homo sapiens
atatatatttttcaa

SEQ ID NO: 5246517 - DNA, 20 bp, Homo sapiens
atatatatttttcaaataga

SEQ ID NO: 5246518 - DNA, 13 bp, Homo sapiens
atatatcaaaacg

SEQ ID NO: 5246519 - DNA, 14 bp, Homo sapiens
atatatcaaagcag

SEQ ID NO: 5246520 - DNA, 16 bp, Homo sapiens
atatatcaaagtgaga

SEQ ID NO: 5246521 - DNA, 21 bp, Homo sapiens
atatatcaaatccaggacttt

SEQ ID NO: 5246522 - DNA, 17 bp, Homo sapiens
atatatcaagaagtctt

SEQ ID NO: 5246523 - DNA, 20 bp, Homo sapiens
atatatcaagaagtcttgaa

SEQ ID NO: 5246524 - DNA, 18 bp, Homo sapiens
atatatcactctagaaaa

SEQ ID NO: 5246525 - DNA, 13 bp, Homo sapiens
atatatcataaag

SEQ ID NO: 5246526 - DNA, 16 bp, Homo sapiens
atatatcataaagtat

SEQ ID NO: 5246527 - DNA, 13 bp, Homo sapiens
atatatcataact

SEQ ID NO: 5246528 - DNA, 23 bp, Homo sapiens
atatatcataacttaataaatat

SEQ ID NO: 5246529 - DNA, 20 bp, Homo sapiens
atatatcatattggtattca

SEQ ID NO: 5246530 - DNA, 14 bp, Homo sapiens
atatatcctatttg

SEQ ID NO: 5246531 - DNA, 12 bp, Homo sapiens
atatatcctctg

SEQ ID NO: 5246532 - DNA, 19 bp, Homo sapiens
atatatcctgaaagcatta

SEQ ID NO: 5246533 - DNA, 22 bp, Homo sapiens
atatatcctgaaagcattattt

SEQ ID NO: 5246534 - DNA, 20 bp, Homo sapiens
atatatcctgtgtacctcac

SEQ ID NO: 5246535 - DNA, 19 bp, Homo sapiens
atatatctaaattgaataa

SEQ ID NO: 5246536 - DNA, 24 bp, Homo sapiens
atatatctaccccagactagatgt

SEQ ID NO: 5246537 - DNA, 12 bp, Homo sapiens
atatatctatat

SEQ ID NO: 5246538 - DNA, 15 bp, Homo sapiens
atatatctatatcat

SEQ ID NO: 5246539 - DNA, 19 bp, Homo sapiens
atatatctatatcatattt

SEQ ID NO: 5246540 - DNA, 15 bp, Homo sapiens
atatatctatctatt

SEQ ID NO: 5246541 - DNA, 19 bp, Homo sapiens
atatatctatctatttgag

SEQ ID NO: 5246542 - DNA, 15 bp, Homo sapiens
atatatctatcttat

SEQ ID NO: 5246543 - DNA, 16 bp, Homo sapiens
atatatctctatttga

SEQ ID NO: 5246544 - DNA, 12 bp, Homo sapiens
atatatctgaaa

SEQ ID NO: 5246545 - DNA, 19 bp, Homo sapiens
atatatctgctgtccagac

SEQ ID NO: 5246546 - DNA, 20 bp, Homo sapiens
atatatctgctgtccagaca

SEQ ID NO: 5246547 - DNA, 15 bp, Homo sapiens
atatatctgcttcag

SEQ ID NO: 5246548 - DNA, 18 bp, Homo sapiens
atatatctgcttcagtgg

SEQ ID NO: 5246549 - DNA, 14 bp, Homo sapiens
atatatctgtaaca

SEQ ID NO: 5246550 - DNA, 19 bp, Homo sapiens
atatatctgtaacactatt

SEQ ID NO: 5246551 - DNA, 20 bp, Homo sapiens
atatatctgtaacactatta

SEQ ID NO: 5246552 - DNA, 21 bp, Homo sapiens
atatatctgttggagaaagaa

SEQ ID NO: 5246553 - DNA, 16 bp, Homo sapiens
atatatcttaagcagg

SEQ ID NO: 5246554 - DNA, 16 bp, Homo sapiens
atatatctttatactt

SEQ ID NO: 5246555 - DNA, 20 bp, Homo sapiens
atatatgaaaactatacaac

SEQ ID NO: 5246556 - DNA, 12 bp, Homo sapiens
atatatgacttc

SEQ ID NO: 5246557 - DNA, 14 bp, Homo sapiens
atatatgacttcct

SEQ ID NO: 5246558 - DNA, 17 bp, Homo sapiens
atatatgatcattgaaa

SEQ ID NO: 5246559 - DNA, 23 bp, Homo sapiens
atatatgatgtggacatatgtat

SEQ ID NO: 5246560 - DNA, 22 bp, Homo sapiens
atatatgattgtataatgtgat

SEQ ID NO: 5246561 - DNA, 15 bp, Homo sapiens
atatatgatttatat

SEQ ID NO: 5246562 - DNA, 13 bp, Homo sapiens
atatatgcatata

SEQ ID NO: 5246563 - DNA, 16 bp, Homo sapiens
atatatgcatatatat

SEQ ID NO: 5246564 - DNA, 16 bp, Homo sapiens
atatatgcctggcaca

SEQ ID NO: 5246565 - DNA, 20 bp, Homo sapiens
atatatgccttactattgta

SEQ ID NO: 5246566 - DNA, 16 bp, Homo sapiens
atatatgcctttttcc

SEQ ID NO: 5246567 - DNA, 17 bp, Homo sapiens
atatatgcctttttcct

SEQ ID NO: 5246568 - DNA, 18 bp, Homo sapiens
atatatgcctttttccta

SEQ ID NO: 5246569 - DNA, 13 bp, Homo sapiens
atatatgctaagt

SEQ ID NO: 5246570 - DNA, 22 bp, Homo sapiens
atatatgctgtatttctttgta

SEQ ID NO: 5246571 - DNA, 15 bp, Homo sapiens
atatatgcttacatt

SEQ ID NO: 5246572 - DNA, 20 bp, Homo sapiens
atatatgcttttttgcaata

SEQ ID NO: 5246573 - DNA, 15 bp, Homo sapiens
atatatggaagagga

SEQ ID NO: 5246574 - DNA, 20 bp, Homo sapiens
atatatggaaggttcctgtg

SEQ ID NO: 5246575 - DNA, 18 bp, Homo sapiens
atatatggaataagtgta

SEQ ID NO: 5246576 - DNA, 14 bp, Homo sapiens
atatatggacctag

SEQ ID NO: 5246577 - DNA, 15 bp, Homo sapiens
atatatggacctagc

SEQ ID NO: 5246578 - DNA, 15 bp, Homo sapiens
atatatggatgtgtg

SEQ ID NO: 5246579 - DNA, 13 bp, Homo sapiens
atatatggcagag

SEQ ID NO: 5246580 - DNA, 21 bp, Homo sapiens
atatatggcagagttgtaaat

SEQ ID NO: 5246581 - DNA, 19 bp, Homo sapiens
atatatggcatatttatat

SEQ ID NO: 5246582 - DNA, 23 bp, Homo sapiens
atatatggcatatttatattgta

SEQ ID NO: 5246583 - DNA, 15 bp, Homo sapiens
atatatggcatttgc

SEQ ID NO: 5246584 - DNA, 20 bp, Homo sapiens
atatatggggatggtagttt

SEQ ID NO: 5246585 - DNA, 19 bp, Homo sapiens
atatatgggggaaaattat

SEQ ID NO: 5246586 - DNA, 20 bp, Homo sapiens
atatatggtctaatgtttaa

SEQ ID NO: 5246587 - DNA, 14 bp, Homo sapiens
atatatgtaatata

SEQ ID NO: 5246588 - DNA, 13 bp, Homo sapiens
atatatgtacagt

SEQ ID NO: 5246589 - DNA, 15 bp, Homo sapiens
atatatgtacataca

SEQ ID NO: 5246590 - DNA, 19 bp, Homo sapiens
atatatgtataatatatat

SEQ ID NO: 5246591 - DNA, 21 bp, Homo sapiens
atatatgtataatatatatct

SEQ ID NO: 5246592 - DNA, 13 bp, Homo sapiens
atccctcattcat

SEQ ID NO: 5246593 - DNA, 15 bp, Homo sapiens
atccctccccagttc

SEQ ID NO: 5246594 - DNA, 19 bp, Homo sapiens
atccctcccccccatgcac

SEQ ID NO: 5246595 - DNA, 21 bp, Homo sapiens
atccctcccccccatgcactg

SEQ ID NO: 5246596 - DNA, 22 bp, Homo sapiens
atccctcccctcagcctcctga

SEQ ID NO: 5246597 - DNA, 22 bp, Homo sapiens
atccctcccctctctccctggt

SEQ ID NO: 5246598 - DNA, 23 bp, Homo sapiens
atccctccctccacctccctgca

SEQ ID NO: 5246599 - DNA, 13 bp, Homo sapiens
atccctccctccc

SEQ ID NO: 5246600 - DNA, 12 bp, Homo sapiens
atccctccctgc

SEQ ID NO: 5246601 - DNA, 13 bp, Homo sapiens
atccctcctgagc

SEQ ID NO: 5246602 - DNA, 15 bp, Homo sapiens
atccctcctgttggg

SEQ ID NO: 5246603 - DNA, 17 bp, Homo sapiens
atccctccttaagagat

SEQ ID NO: 5246604 - DNA, 18 bp, Homo sapiens
atccctcggaagccgtct

SEQ ID NO: 5246605 - DNA, 19 bp, Homo sapiens
atccctcggaagccgtctg

SEQ ID NO: 5246606 - DNA, 23 bp, Homo sapiens
atccctcgggaagcagccagctc

SEQ ID NO: 5246607 - DNA, 18 bp, Homo sapiens
atccctcggtcagcaccg

SEQ ID NO: 5246608 - DNA, 17 bp, Homo sapiens
atccctctacagagctt

SEQ ID NO: 5246609 - DNA, 20 bp, Homo sapiens
atccctctacagagcttccc

SEQ ID NO: 5246610 - DNA, 11 bp, Homo sapiens
atccctctcca

SEQ ID NO: 5246611 - DNA, 15 bp, Homo sapiens
atccctctccactct

SEQ ID NO: 5246612 - DNA, 14 bp, Homo sapiens
atccctctcctccc

SEQ ID NO: 5246613 - DNA, 17 bp, Homo sapiens
atccctctcctctcctc

SEQ ID NO: 5246614 - DNA, 23 bp, Homo sapiens
atccctctcctctcctcctctgt

SEQ ID NO: 5246615 - DNA, 21 bp, Homo sapiens
atccctctcctctgccctctg

SEQ ID NO: 5246616 - DNA, 19 bp, Homo sapiens
atccctctcttccccttcc

SEQ ID NO: 5246617 - DNA, 20 bp, Homo sapiens
atccctctggcccacacaga

SEQ ID NO: 5246618 - DNA, 15 bp, Homo sapiens
atccctctgggcact

SEQ ID NO: 5246619 - DNA, 19 bp, Homo sapiens
atccctctgggggctctgg

SEQ ID NO: 5246620 - DNA, 18 bp, Homo sapiens
atccctcttcctccaaag

SEQ ID NO: 5246621 - DNA, 15 bp, Homo sapiens
atccctcttgtaagt

SEQ ID NO: 5246622 - DNA, 21 bp, Homo sapiens
atccctgaaacattgcatgta

SEQ ID NO: 5246623 - DNA, 18 bp, Homo sapiens
atccctgaacccctggcc

SEQ ID NO: 5246624 - DNA, 21 bp, Homo sapiens
atccctgaacccctggccagc

SEQ ID NO: 5246625 - DNA, 22 bp, Homo sapiens
atccctgaatcccccttgccac

SEQ ID NO: 5246626 - DNA, 18 bp, Homo sapiens
atccctgactggccaaac

SEQ ID NO: 5246627 - DNA, 12 bp, Homo sapiens
atccctgagaga

SEQ ID NO: 5246628 - DNA, 20 bp, Homo sapiens
atccctgaggctggactcca

SEQ ID NO: 5246629 - DNA, 18 bp, Homo sapiens
atccctgaggtcacctgg

SEQ ID NO: 5246630 - DNA, 20 bp, Homo sapiens
atccctgatcccattttcct

SEQ ID NO: 5246631 - DNA, 22 bp, Homo sapiens
atccctgatggcagaactccca

SEQ ID NO: 5246632 - DNA, 15 bp, Homo sapiens
atccctgattctctc

SEQ ID NO: 5246633 - DNA, 22 bp, Homo sapiens
atccctgcacacggcacagagc

SEQ ID NO: 5246634 - DNA, 18 bp, Homo sapiens
atccctgcacataaactc

SEQ ID NO: 5246635 - DNA, 11 bp, Homo sapiens
atccctgcaga

SEQ ID NO: 5246636 - DNA, 23 bp, Homo sapiens
atccctgccacatacaggtgctc

SEQ ID NO: 5246637 - DNA, 14 bp, Homo sapiens
atccctgccactgg

SEQ ID NO: 5246638 - DNA, 22 bp, Homo sapiens
atccctgccactgggctctgga

SEQ ID NO: 5246639 - DNA, 20 bp, Homo sapiens
atccctgcctcaggccaagg

SEQ ID NO: 5246640 - DNA, 13 bp, Homo sapiens
atccctgcctgga

SEQ ID NO: 5246641 - DNA, 20 bp, Homo sapiens
atccctgcctggaggctcct

SEQ ID NO: 5246642 - DNA, 14 bp, Homo sapiens
atccctgctctctg

SEQ ID NO: 5246643 - DNA, 18 bp, Homo sapiens
atccctgcttgcccgctc

SEQ ID NO: 5246644 - DNA, 23 bp, Homo sapiens
atccctgcttgcccgctcccaca

SEQ ID NO: 5246645 - DNA, 16 bp, Homo sapiens
atccctggaggggctg

SEQ ID NO: 5246646 - DNA, 10 bp, Homo sapiens
atccctggcc

SEQ ID NO: 5246647 - DNA, 22 bp, Homo sapiens
atccctggccacctgccaggcc

SEQ ID NO: 5246648 - DNA, 12 bp, Homo sapiens
atccctggctga

SEQ ID NO: 5246649 - DNA, 20 bp, Homo sapiens
atccctggcttccccttcag

SEQ ID NO: 5246650 - DNA, 13 bp, Homo sapiens
atccctgggcccc

SEQ ID NO: 5246651 - DNA, 15 bp, Homo sapiens
atccctgggcccctc

SEQ ID NO: 5246652 - DNA, 16 bp, Homo sapiens
atccctgggcccctcc

SEQ ID NO: 5246653 - DNA, 18 bp, Homo sapiens
atccctggggctgtgcat

SEQ ID NO: 5246654 - DNA, 18 bp, Homo sapiens
atccctggttgcctcatg

SEQ ID NO: 5246655 - DNA, 21 bp, Homo sapiens
atccctggttgcctcatggcc

SEQ ID NO: 5246656 - DNA, 15 bp, Homo sapiens
atccctgtactctga

SEQ ID NO: 5246657 - DNA, 11 bp, Homo sapiens
atccctgtcct

SEQ ID NO: 5246658 - DNA, 12 bp, Homo sapiens
atccctgtcctc

SEQ ID NO: 5246659 - DNA, 16 bp, Homo sapiens
atccctgtctttccta

SEQ ID NO: 5246660 - DNA, 23 bp, Homo sapiens
atccctgtgttaactcaggatgc

SEQ ID NO: 5246661 - DNA, 18 bp, Homo sapiens
atccctgttacccagaga

SEQ ID NO: 5246662 - DNA, 14 bp, Homo sapiens
atccctgttcattg

SEQ ID NO: 5246663 - DNA, 13 bp, Homo sapiens
atccctgtttaat

SEQ ID NO: 5246664 - DNA, 18 bp, Homo sapiens
atccctgtttaatattta

SEQ ID NO: 5246665 - DNA, 21 bp, Homo sapiens
atccctgtttaatatttaaac

SEQ ID NO: 5246666 - DNA, 23 bp, Homo sapiens
atccctgtttaatatttaaacag

SEQ ID NO: 5246667 - DNA, 14 bp, Homo sapiens
atcccttaagaatg

SEQ ID NO: 5246668 - DNA, 23 bp, Homo sapiens
atcccttcaaggaagtgataaca

SEQ ID NO: 5246669 - DNA, 18 bp, Homo sapiens
atcccttcacagtcccag

SEQ ID NO: 5246670 - DNA, 16 bp, Homo sapiens
atcccttcatacttga

SEQ ID NO: 5246671 - DNA, 16 bp, Homo sapiens
atcccttccacctgct

SEQ ID NO: 5246672 - DNA, 19 bp, Homo sapiens
atcccttccacctgctctg

SEQ ID NO: 5246673 - DNA, 12 bp, Homo sapiens
atcccttcccca

SEQ ID NO: 5246674 - DNA, 15 bp, Homo sapiens
atcccttcctcccca

SEQ ID NO: 5246675 - DNA, 20 bp, Homo sapiens
atcccttcctcctctcctgg

SEQ ID NO: 5246676 - DNA, 12 bp, Homo sapiens
atcccttcctgg

SEQ ID NO: 5246677 - DNA, 17 bp, Homo sapiens
atcccttcctggaaaca

SEQ ID NO: 5246678 - DNA, 22 bp, Homo sapiens
atcccttcctggaaacagcatg

SEQ ID NO: 5246679 - DNA, 23 bp, Homo sapiens
atcccttcctggaaacagcatga

SEQ ID NO: 5246680 - DNA, 23 bp, Homo sapiens
atcccttcggagccaacaagacc

SEQ ID NO: 5246681 - DNA, 14 bp, Homo sapiens
atcccttctcacag

SEQ ID NO: 5246682 - DNA, 21 bp, Homo sapiens
atcccttctcttccaggcagc

SEQ ID NO: 5246683 - DNA, 14 bp, Homo sapiens
atcccttgaccagg

SEQ ID NO: 5246684 - DNA, 18 bp, Homo sapiens
atcccttgaccaggcctg

SEQ ID NO: 5246685 - DNA, 19 bp, Homo sapiens
atcccttggacattttatg

SEQ ID NO: 5246686 - DNA, 20 bp, Homo sapiens
atcccttggacattttatgt

SEQ ID NO: 5246687 - DNA, 13 bp, Homo sapiens
atcccttggcccc

SEQ ID NO: 5246688 - DNA, 14 bp, Homo sapiens
atcccttggcccct

SEQ ID NO: 5246689 - DNA, 15 bp, Homo sapiens
atcccttggcccctc

SEQ ID NO: 5246690 - DNA, 17 bp, Homo sapiens
atcccttggcccctctc

SEQ ID NO: 5246691 - DNA, 19 bp, Homo sapiens
atcccttggcccctctctg

SEQ ID NO: 5246692 - DNA, 15 bp, Homo sapiens
atcccttggggaagg

SEQ ID NO: 5246693 - DNA, 22 bp, Homo sapiens
atcccttggtttagaggaaccc

SEQ ID NO: 5246694 - DNA, 14 bp, Homo sapiens
atccctttacaatg

SEQ ID NO: 5246695 - DNA, 17 bp, Homo sapiens
atccctttacaatgtga

SEQ ID NO: 5246696 - DNA, 19 bp, Homo sapiens
atccctttacaatgtgaat

SEQ ID NO: 5246697 - DNA, 12 bp, Homo sapiens
atccctttagaa

SEQ ID NO: 5246698 - DNA, 22 bp, Homo sapiens
atccctttattaccccctcctt

SEQ ID NO: 5246699 - DNA, 22 bp, Homo sapiens
atccctttcatgtctttccact

SEQ ID NO: 5246700 - DNA, 22 bp, Homo sapiens
atccctttcccatgatccagaa

SEQ ID NO: 5246701 - DNA, 12 bp, Homo sapiens
atccctttctcc

SEQ ID NO: 5246702 - DNA, 16 bp, Homo sapiens
atcccttttcctgtca

SEQ ID NO: 5246703 - DNA, 14 bp, Homo sapiens
atcccttttcttga

SEQ ID NO: 5246704 - DNA, 22 bp, Homo sapiens
atccctttttcataaattattt

SEQ ID NO: 5246705 - DNA, 18 bp, Homo sapiens
atccctttttgaagtgta

SEQ ID NO: 5246706 - DNA, 15 bp, Homo sapiens
atccgaaatcagcag

SEQ ID NO: 5246707 - DNA, 20 bp, Homo sapiens
atccgaacctcctctgtgaa

SEQ ID NO: 5246708 - DNA, 15 bp, Homo sapiens
atccgactctaagct

SEQ ID NO: 5246709 - DNA, 21 bp, Homo sapiens
atccgactctaagctgtgtgc

SEQ ID NO: 5246710 - DNA, 13 bp, Homo sapiens
atccgagcccctg

SEQ ID NO: 5246711 - DNA, 16 bp, Homo sapiens
atccgagcccctgttt

SEQ ID NO: 5246712 - DNA, 18 bp, Homo sapiens
atccgagcgacggctcct

SEQ ID NO: 5246713 - DNA, 21 bp, Homo sapiens
atccgagcgacggctcctccc

SEQ ID NO: 5246714 - DNA, 22 bp, Homo sapiens
atccgagtgtgatttgaattct

SEQ ID NO: 5246715 - DNA, 17 bp, Homo sapiens
atccgattcgccatcac

SEQ ID NO: 5246716 - DNA, 16 bp, Homo sapiens
atccgcaatgtggagc

SEQ ID NO: 5246717 - DNA, 13 bp, Homo sapiens
atccgcagcccag

SEQ ID NO: 5246718 - DNA, 16 bp, Homo sapiens
atccgcatgtgtctgt

SEQ ID NO: 5246719 - DNA, 21 bp, Homo sapiens
atccgcatgtgtctgtattca

SEQ ID NO: 5246720 - DNA, 13 bp, Homo sapiens
atccgccagggcc

SEQ ID NO: 5246721 - DNA, 19 bp, Homo sapiens
atccgcccgcctcagcatc

SEQ ID NO: 5246722 - DNA, 14 bp, Homo sapiens
atccgccctgggct

SEQ ID NO: 5246723 - DNA, 20 bp, Homo sapiens
atccgccctgggctctgggt

SEQ ID NO: 5246724 - DNA, 16 bp, Homo sapiens
atccgcctctgagcca

SEQ ID NO: 5246725 - DNA, 19 bp, Homo sapiens
atccgcctctgagccagga

SEQ ID NO: 5246726 - DNA, 10 bp, Homo sapiens
atccgcctgc

SEQ ID NO: 5246727 - DNA, 15 bp, Homo sapiens
atccgcctgcctctg

SEQ ID NO: 5246728 - DNA, 13 bp, Homo sapiens
atccgcctgtggg

SEQ ID NO: 5246729 - DNA, 14 bp, Homo sapiens
atccgcctgtgggc

SEQ ID NO: 5246730 - DNA, 14 bp, Homo sapiens
atccgccttttgta

SEQ ID NO: 5246731 - DNA, 15 bp, Homo sapiens
atccgccttttgtat

SEQ ID NO: 5246732 - DNA, 16 bp, Homo sapiens
atccgcgtgtgcctgt

SEQ ID NO: 5246733 - DNA, 18 bp, Homo sapiens
atccgctctcttcctgcc

SEQ ID NO: 5246734 - DNA, 23 bp, Homo sapiens
atccgctgccaccacgtctgcca

SEQ ID NO: 5246735 - DNA, 20 bp, Homo sapiens
atccgctgccagccttgagc

SEQ ID NO: 5246736 - DNA, 13 bp, Homo sapiens
atccgcttctcct

SEQ ID NO: 5246737 - DNA, 17 bp, Homo sapiens
atccgcttctcctgcag

SEQ ID NO: 5246738 - DNA, 13 bp, Homo sapiens
atccggaaagaag

SEQ ID NO: 5246739 - DNA, 14 bp, Homo sapiens
atccggaggagaag

SEQ ID NO: 5246740 - DNA, 22 bp, Homo sapiens
atccggcaacatcaacccgagt

SEQ ID NO: 5246741 - DNA, 19 bp, Homo sapiens
atccggctgctcctccagc

SEQ ID NO: 5246742 - DNA, 15 bp, Homo sapiens
atccgggacacctgg

SEQ ID NO: 5246743 - DNA, 16 bp, Homo sapiens
atccgggacgcttcca

SEQ ID NO: 5246744 - DNA, 18 bp, Homo sapiens
atccgggacgcttccaga

SEQ ID NO: 5246745 - DNA, 20 bp, Homo sapiens
atccgggacgcttccagacc

SEQ ID NO: 5246746 - DNA, 21 bp, Homo sapiens
atccgggacgcttccagacca

SEQ ID NO: 5246747 - DNA, 14 bp, Homo sapiens
atccgggcaatgct

SEQ ID NO: 5246748 - DNA, 13 bp, Homo sapiens
atccgggtgctca

SEQ ID NO: 5246749 - DNA, 20 bp, Homo sapiens
atccgggtgctcaataaact

SEQ ID NO: 5246750 - DNA, 23 bp, Homo sapiens
atccgggtgctcaataaacttgt

SEQ ID NO: 5246751 - DNA, 20 bp, Homo sapiens
atccggtcccctgcctggaa

SEQ ID NO: 5246752 - DNA, 16 bp, Homo sapiens
atccgtatatatcccc

SEQ ID NO: 5246753 - DNA, 12 bp, Homo sapiens
atccgtattgaa

SEQ ID NO: 5246754 - DNA, 14 bp, Homo sapiens
atccgtattgaatt

SEQ ID NO: 5246755 - DNA, 18 bp, Homo sapiens
atccgtcattgctgctgc

SEQ ID NO: 5246756 - DNA, 19 bp, Homo sapiens
atccgtcattgctgctgct

SEQ ID NO: 5246757 - DNA, 15 bp, Homo sapiens
atccgtcctgggcgt

SEQ ID NO: 5246758 - DNA, 14 bp, Homo sapiens
atccgtctctgtcc

SEQ ID NO: 5246759 - DNA, 19 bp, Homo sapiens
atccgtctgtgtggggttc

SEQ ID NO: 5246760 - DNA, 15 bp, Homo sapiens
atccgtgaagggatt

SEQ ID NO: 5246761 - DNA, 17 bp, Homo sapiens
atccgtgaagtcacatt

SEQ ID NO: 5246762 - DNA, 18 bp, Homo sapiens
atccgtgaggcagggaca

SEQ ID NO: 5246763 - DNA, 13 bp, Homo sapiens
atccgtgtatttg

SEQ ID NO: 5246764 - DNA, 19 bp, Homo sapiens
atccgttcatagaaattgt

SEQ ID NO: 5246765 - DNA, 18 bp, Homo sapiens
atccgttcccttctgcca

SEQ ID NO: 5246766 - DNA, 21 bp, Homo sapiens
atccgttcccttctgccacct

SEQ ID NO: 5246767 - DNA, 15 bp, Homo sapiens
atccgtttgaccaat

SEQ ID NO: 5246768 - DNA, 17 bp, Homo sapiens
atccgtttgaccaattt

SEQ ID NO: 5246769 - DNA, 22 bp, Homo sapiens
atccgtttgaccaatttgcacc

SEQ ID NO: 5246770 - DNA, 14 bp, Homo sapiens
atcctaaaaatctg

SEQ ID NO: 5246771 - DNA, 15 bp, Homo sapiens
atatatgtatacata

SEQ ID NO: 5246772 - DNA, 17 bp, Homo sapiens
atatatgtatacatata

SEQ ID NO: 5246773 - DNA, 16 bp, Homo sapiens
atatatgtatacgcac

SEQ ID NO: 5246774 - DNA, 23 bp, Homo sapiens
atatatgtatacgcacgcaccca

SEQ ID NO: 5246775 - DNA, 15 bp, Homo sapiens
atatatgtatataca

SEQ ID NO: 5246776 - DNA, 18 bp, Homo sapiens
atatatgtatatacacat

SEQ ID NO: 5246777 - DNA, 23 bp, Homo sapiens
atatatgtatatatattctcagc

SEQ ID NO: 5246778 - DNA, 15 bp, Homo sapiens
atatatgtatatctg

SEQ ID NO: 5246779 - DNA, 14 bp, Homo sapiens
atatatgtatatgt

SEQ ID NO: 5246780 - DNA, 20 bp, Homo sapiens
atatatgtatatgtatatat

SEQ ID NO: 5246781 - DNA, 14 bp, Homo sapiens
atatatgtatattt

SEQ ID NO: 5246782 - DNA, 11 bp, Homo sapiens
atatatgtatg

SEQ ID NO: 5246783 - DNA, 15 bp, Homo sapiens
atatatgtatgtaaa

SEQ ID NO: 5246784 - DNA, 16 bp, Homo sapiens
atatatgtatgtaaaa

SEQ ID NO: 5246785 - DNA, 15 bp, Homo sapiens
atatatgtatttaaa

SEQ ID NO: 5246786 - DNA, 20 bp, Homo sapiens
atatatgtatttattgtcat

SEQ ID NO: 5246787 - DNA, 13 bp, Homo sapiens
atatatgtatttt

SEQ ID NO: 5246788 - DNA, 12 bp, Homo sapiens
atatatgtcaat

SEQ ID NO: 5246789 - DNA, 13 bp, Homo sapiens
atatatgtgaaag

SEQ ID NO: 5246790 - DNA, 19 bp, Homo sapiens
atatatgtgaactttctca

SEQ ID NO: 5246791 - DNA, 21 bp, Homo sapiens
atatatgtgaactttctcagc

SEQ ID NO: 5246792 - DNA, 18 bp, Homo sapiens
atatatgtgaggatgtat

SEQ ID NO: 5246793 - DNA, 12 bp, Homo sapiens
atatatgtgtat

SEQ ID NO: 5246794 - DNA, 15 bp, Homo sapiens
atatatgtgtataca

SEQ ID NO: 5246795 - DNA, 16 bp, Homo sapiens
atatatgtgtatacat

SEQ ID NO: 5246796 - DNA, 20 bp, Homo sapiens
atatatgtgtatacatacat

SEQ ID NO: 5246797 - DNA, 20 bp, Homo sapiens
atatatgtgtatatatacat

SEQ ID NO: 5246798 - DNA, 19 bp, Homo sapiens
atatatgtgtgccctggac

SEQ ID NO: 5246799 - DNA, 12 bp, Homo sapiens
atatatgtgtgt

SEQ ID NO: 5246800 - DNA, 16 bp, Homo sapiens
atatatgtgtgtgtat

SEQ ID NO: 5246801 - DNA, 19 bp, Homo sapiens
atatatgtgtgtgtatgtt

SEQ ID NO: 5246802 - DNA, 15 bp, Homo sapiens
atatatgtgtgtgtg

SEQ ID NO: 5246803 - DNA, 21 bp, Homo sapiens
atatatgtgtgtttaaataaa

SEQ ID NO: 5246804 - DNA, 15 bp, Homo sapiens
atatatgtgtttttc

SEQ ID NO: 5246805 - DNA, 21 bp, Homo sapiens
atatatgtgtttttcacattt

SEQ ID NO: 5246806 - DNA, 13 bp, Homo sapiens
atatatgttctgc

SEQ ID NO: 5246807 - DNA, 18 bp, Homo sapiens
atatatgttctgcaagaa

SEQ ID NO: 5246808 - DNA, 20 bp, Homo sapiens
atatatgttctgcaagaatt

SEQ ID NO: 5246809 - DNA, 20 bp, Homo sapiens
atatatgttgatttcttgta

SEQ ID NO: 5246810 - DNA, 15 bp, Homo sapiens
atatatgtttggctg

SEQ ID NO: 5246811 - DNA, 17 bp, Homo sapiens
atatatgtttgtggaat

SEQ ID NO: 5246812 - DNA, 12 bp, Homo sapiens
atatatgttttg

SEQ ID NO: 5246813 - DNA, 15 bp, Homo sapiens
atatatgttttgaga

SEQ ID NO: 5246814 - DNA, 17 bp, Homo sapiens
atatatgttttgagaaa

SEQ ID NO: 5246815 - DNA, 19 bp, Homo sapiens
atatatgttttgagaaaaa

SEQ ID NO: 5246816 - DNA, 22 bp, Homo sapiens
atatattaaaaatataaacaat

SEQ ID NO: 5246817 - DNA, 13 bp, Homo sapiens
atatattaaaatt

SEQ ID NO: 5246818 - DNA, 20 bp, Homo sapiens
atatattaaaattccaaatt

SEQ ID NO: 5246819 - DNA, 13 bp, Homo sapiens
atatattaaacct

SEQ ID NO: 5246820 - DNA, 22 bp, Homo sapiens
atatattaatcagcattagaga

SEQ ID NO: 5246821 - DNA, 19 bp, Homo sapiens
atatattaccgttatgtct

SEQ ID NO: 5246822 - DNA, 14 bp, Homo sapiens
atatattactgatt

SEQ ID NO: 5246823 - DNA, 18 bp, Homo sapiens
atatattactgatttaga

SEQ ID NO: 5246824 - DNA, 14 bp, Homo sapiens
atatattatataca

SEQ ID NO: 5246825 - DNA, 17 bp, Homo sapiens
atatattatatatacat

SEQ ID NO: 5246826 - DNA, 18 bp, Homo sapiens
atatattatatatacatt

SEQ ID NO: 5246827 - DNA, 15 bp, Homo sapiens
atatattatatatag

SEQ ID NO: 5246828 - DNA, 16 bp, Homo sapiens
atatattatatataga

SEQ ID NO: 5246829 - DNA, 14 bp, Homo sapiens
atatattatatgga

SEQ ID NO: 5246830 - DNA, 16 bp, Homo sapiens
atatattatatggaaa

SEQ ID NO: 5246831 - DNA, 17 bp, Homo sapiens
atatattatgtgaagaa

SEQ ID NO: 5246832 - DNA, 18 bp, Homo sapiens
atatattattataatctt

SEQ ID NO: 5246833 - DNA, 12 bp, Homo sapiens
atatattattct

SEQ ID NO: 5246834 - DNA, 18 bp, Homo sapiens
atatattattctcattta

SEQ ID NO: 5246835 - DNA, 13 bp, Homo sapiens
atatattattgta

SEQ ID NO: 5246836 - DNA, 15 bp, Homo sapiens
atatattattgtaag

SEQ ID NO: 5246837 - DNA, 19 bp, Homo sapiens
atatattattgtaagttgt

SEQ ID NO: 5246838 - DNA, 14 bp, Homo sapiens
atatattatttgca

SEQ ID NO: 5246839 - DNA, 18 bp, Homo sapiens
atatattcagcctggctt

SEQ ID NO: 5246840 - DNA, 19 bp, Homo sapiens
atatattcatacctgttgt

SEQ ID NO: 5246841 - DNA, 18 bp, Homo sapiens
atatattcatctaataaa

SEQ ID NO: 5246842 - DNA, 14 bp, Homo sapiens
atatattcatgtaa

SEQ ID NO: 5246843 - DNA, 23 bp, Homo sapiens
atatattcatgtaataaatctga

SEQ ID NO: 5246844 - DNA, 21 bp, Homo sapiens
atatattccttactagaaata

SEQ ID NO: 5246845 - DNA, 16 bp, Homo sapiens
atatattctctaataa

SEQ ID NO: 5246846 - DNA, 20 bp, Homo sapiens
atatattctctaataaaatt

SEQ ID NO: 5246847 - DNA, 18 bp, Homo sapiens
atatattctttcaaagga

SEQ ID NO: 5246848 - DNA, 14 bp, Homo sapiens
atatattgaataaa

SEQ ID NO: 5246849 - DNA, 13 bp, Homo sapiens
atatattgaatta

SEQ ID NO: 5246850 - DNA, 20 bp, Homo sapiens
atatattgcaaaaacatagt

SEQ ID NO: 5246851 - DNA, 16 bp, Homo sapiens
atatattgcatttctg

SEQ ID NO: 5246852 - DNA, 22 bp, Homo sapiens
atatattgccaaatattaagaa

SEQ ID NO: 5246853 - DNA, 20 bp, Homo sapiens
atatattgccagtatataag

SEQ ID NO: 5246854 - DNA, 17 bp, Homo sapiens
atatattggcactgcta

SEQ ID NO: 5246855 - DNA, 19 bp, Homo sapiens
atatattggcactgctaaa

SEQ ID NO: 5246856 - DNA, 21 bp, Homo sapiens
atatattggtaacatcctttc

SEQ ID NO: 5246857 - DNA, 14 bp, Homo sapiens
atatattgttaatc

SEQ ID NO: 5246858 - DNA, 19 bp, Homo sapiens
atatattgttaatctctgt

SEQ ID NO: 5246859 - DNA, 14 bp, Homo sapiens
atatattgttttcc

SEQ ID NO: 5246860 - DNA, 20 bp, Homo sapiens
atatatttaaaattcatatt

SEQ ID NO: 5246861 - DNA, 12 bp, Homo sapiens
atatatttaaca

SEQ ID NO: 5246862 - DNA, 13 bp, Homo sapiens
atatatttaacaa

SEQ ID NO: 5246863 - DNA, 16 bp, Homo sapiens
atatatttaatatgtc

SEQ ID NO: 5246864 - DNA, 14 bp, Homo sapiens
atatatttacagaa

SEQ ID NO: 5246865 - DNA, 18 bp, Homo sapiens
atatatttactaaaagaa

SEQ ID NO: 5246866 - DNA, 15 bp, Homo sapiens
atatatttaggattt

SEQ ID NO: 5246867 - DNA, 12 bp, Homo sapiens
atatatttataa

SEQ ID NO: 5246868 - DNA, 15 bp, Homo sapiens
atatatttataactc

SEQ ID NO: 5246869 - DNA, 15 bp, Homo sapiens
atatatttatagcaa

SEQ ID NO: 5246870 - DNA, 12 bp, Homo sapiens
atatatttatat

SEQ ID NO: 5246871 - DNA, 13 bp, Homo sapiens
atatatttatata

SEQ ID NO: 5246872 - DNA, 20 bp, Homo sapiens
atatatttatatcatatata

SEQ ID NO: 5246873 - DNA, 12 bp, Homo sapiens
atatatttatga

SEQ ID NO: 5246874 - DNA, 23 bp, Homo sapiens
atatatttatggccgggcagggt

SEQ ID NO: 5246875 - DNA, 22 bp, Homo sapiens
atatatttattattttcatata

SEQ ID NO: 5246876 - DNA, 16 bp, Homo sapiens
atatatttatttaaag

SEQ ID NO: 5246877 - DNA, 18 bp, Homo sapiens
atatatttattttattct

SEQ ID NO: 5246878 - DNA, 9 bp, Homo sapiens
atatatttc

SEQ ID NO: 5246879 - DNA, 23 bp, Homo sapiens
atatatttcacttttgttctgct

SEQ ID NO: 5246880 - DNA, 16 bp, Homo sapiens
atatatttccaaatat

SEQ ID NO: 5246881 - DNA, 19 bp, Homo sapiens
atatatttctaaatgtttg

SEQ ID NO: 5246882 - DNA, 12 bp, Homo sapiens
atatatttctat

SEQ ID NO: 5246883 - DNA, 23 bp, Homo sapiens
atatatttctattattaattgca

SEQ ID NO: 5246884 - DNA, 12 bp, Homo sapiens
atatatttgaaa

SEQ ID NO: 5246885 - DNA, 13 bp, Homo sapiens
atatatttgaaat

SEQ ID NO: 5246886 - DNA, 15 bp, Homo sapiens
atatatttgaaatag

SEQ ID NO: 5246887 - DNA, 16 bp, Homo sapiens
atatatttgaaatagt

SEQ ID NO: 5246888 - DNA, 19 bp, Homo sapiens
atatatttgaaatagtata

SEQ ID NO: 5246889 - DNA, 13 bp, Homo sapiens
atatatttgcaga

SEQ ID NO: 5246890 - DNA, 18 bp, Homo sapiens
atatatttgcagataatt

SEQ ID NO: 5246891 - DNA, 23 bp, Homo sapiens
atatatttgcataatatgcatat

SEQ ID NO: 5246892 - DNA, 15 bp, Homo sapiens
atatatttgtaacat

SEQ ID NO: 5246893 - DNA, 13 bp, Homo sapiens
atatatttgtgta

SEQ ID NO: 5246894 - DNA, 21 bp, Homo sapiens
atatatttgtgtatttaacag

SEQ ID NO: 5246895 - DNA, 22 bp, Homo sapiens
atatatttgtgtatttaacagg

SEQ ID NO: 5246896 - DNA, 22 bp, Homo sapiens
atatatttgtttcatttctgca

SEQ ID NO: 5246897 - DNA, 14 bp, Homo sapiens
atatattttaaatg

SEQ ID NO: 5246898 - DNA, 18 bp, Homo sapiens
atatattttaaatgtgga

SEQ ID NO: 5246899 - DNA, 12 bp, Homo sapiens
atatattttaag

SEQ ID NO: 5246900 - DNA, 15 bp, Homo sapiens
atatattttaagacg

SEQ ID NO: 5246901 - DNA, 13 bp, Homo sapiens
atatattttaagc

SEQ ID NO: 5246902 - DNA, 21 bp, Homo sapiens
atatattttaagccttcattt

SEQ ID NO: 5246903 - DNA, 20 bp, Homo sapiens
atatattttaaggttgcaca

SEQ ID NO: 5246904 - DNA, 13 bp, Homo sapiens
atatattttaatt

SEQ ID NO: 5246905 - DNA, 11 bp, Homo sapiens
atatattttag

SEQ ID NO: 5246906 - DNA, 16 bp, Homo sapiens
atatattttatatgtt

SEQ ID NO: 5246907 - DNA, 13 bp, Homo sapiens
atatattttatga

SEQ ID NO: 5246908 - DNA, 14 bp, Homo sapiens
atatattttatgat

SEQ ID NO: 5246909 - DNA, 18 bp, Homo sapiens
atatattttatgatttaa

SEQ ID NO: 5246910 - DNA, 22 bp, Homo sapiens
atatattttatttttagaattt

SEQ ID NO: 5246911 - DNA, 15 bp, Homo sapiens
atatattttctgttt

SEQ ID NO: 5246912 - DNA, 15 bp, Homo sapiens
atatattttgaaata

SEQ ID NO: 5246913 - DNA, 22 bp, Homo sapiens
atatattttgtactttgtggag

SEQ ID NO: 5246914 - DNA, 20 bp, Homo sapiens
atatattttgtatgcaagca

SEQ ID NO: 5246915 - DNA, 20 bp, Homo sapiens
atatattttgtgtgaaattg

SEQ ID NO: 5246916 - DNA, 19 bp, Homo sapiens
atatattttgttgttcctc

SEQ ID NO: 5246917 - DNA, 13 bp, Homo sapiens
atatatttttaaa

SEQ ID NO: 5246918 - DNA, 23 bp, Homo sapiens
atatatttttaaaatatttaact

SEQ ID NO: 5246919 - DNA, 16 bp, Homo sapiens
atatatttttaaagca

SEQ ID NO: 5246920 - DNA, 16 bp, Homo sapiens
atatatttttaagata

SEQ ID NO: 5246921 - DNA, 13 bp, Homo sapiens
atatatttttata

SEQ ID NO: 5246922 - DNA, 18 bp, Homo sapiens
atatatttttatatttac

SEQ ID NO: 5246923 - DNA, 21 bp, Homo sapiens
atatatttttcaaatagattt

SEQ ID NO: 5246924 - DNA, 21 bp, Homo sapiens
atatatttttccctgtttgcc

SEQ ID NO: 5246925 - DNA, 20 bp, Homo sapiens
atatatttttctgagatttt

SEQ ID NO: 5246926 - DNA, 21 bp, Homo sapiens
atatatttttcttatttatgt

SEQ ID NO: 5246927 - DNA, 18 bp, Homo sapiens
atatattttttaaaataa

SEQ ID NO: 5246928 - DNA, 17 bp, Homo sapiens
atatattttttaatttg

SEQ ID NO: 5246929 - DNA, 20 bp, Homo sapiens
atatattttttaatttgatg

SEQ ID NO: 5246930 - DNA, 15 bp, Homo sapiens
atatattttttacaa

SEQ ID NO: 5246931 - DNA, 21 bp, Homo sapiens
atatattttttattaatattt

SEQ ID NO: 5246932 - DNA, 21 bp, Homo sapiens
atatattttttgttattatta

SEQ ID NO: 5246933 - DNA, 18 bp, Homo sapiens
atatatttttttctgaaa

SEQ ID NO: 5246934 - DNA, 19 bp, Homo sapiens
atatatttttttctgaaat

SEQ ID NO: 5246935 - DNA, 18 bp, Homo sapiens
atatatttttttttggat

SEQ ID NO: 5246936 - DNA, 19 bp, Homo sapiens
atatcaaaaaacctttaca

SEQ ID NO: 5246937 - DNA, 20 bp, Homo sapiens
atatcaaaaaacctttacag

SEQ ID NO: 5246938 - DNA, 22 bp, Homo sapiens
atatcaaaataggatttcttaa

SEQ ID NO: 5246939 - DNA, 14 bp, Homo sapiens
atatcaaaattcta

SEQ ID NO: 5246940 - DNA, 22 bp, Homo sapiens
atatcaaagagaagatgcctgt

SEQ ID NO: 5246941 - DNA, 23 bp, Homo sapiens
atatcaaagagaagatgcctgtt

SEQ ID NO: 5246942 - DNA, 13 bp, Homo sapiens
atatcaaagtatt

SEQ ID NO: 5246943 - DNA, 14 bp, Homo sapiens
atatcaaagtattt

SEQ ID NO: 5246944 - DNA, 16 bp, Homo sapiens
atatcaaataataaag

SEQ ID NO: 5246945 - DNA, 16 bp, Homo sapiens
atatcaaatatattca

SEQ ID NO: 5246946 - DNA, 12 bp, Homo sapiens
atatcaaatgca

SEQ ID NO: 5246947 - DNA, 21 bp, Homo sapiens
atatcaaatgcagtatatttc

SEQ ID NO: 5246948 - DNA, 18 bp, Homo sapiens
atatcaaattaattgtgt

SEQ ID NO: 5246949 - DNA, 18 bp, Homo sapiens
atatcaacaacaagttgt

SEQ ID NO: 5246950 - DNA, 20 bp, Homo sapiens
atatcaactctgaagctaat

SEQ ID NO: 5246951 - DNA, 21 bp, Homo sapiens
atatcaagaagtcagagaaaa

SEQ ID NO: 5246952 - DNA, 16 bp, Homo sapiens
atcctaaaattgtttc

SEQ ID NO: 5246953 - DNA, 16 bp, Homo sapiens
atcctaaactttagac

SEQ ID NO: 5246954 - DNA, 22 bp, Homo sapiens
atcctaaataaaaaaagacaaa

SEQ ID NO: 5246955 - DNA, 16 bp, Homo sapiens
atcctaaccctgggct

SEQ ID NO: 5246956 - DNA, 23 bp, Homo sapiens
atcctaagaaatatgtgagattt

SEQ ID NO: 5246957 - DNA, 18 bp, Homo sapiens
atcctaagatgtgttctt

SEQ ID NO: 5246958 - DNA, 12 bp, Homo sapiens
atcctaagctat

SEQ ID NO: 5246959 - DNA, 22 bp, Homo sapiens
atcctaaggctgtccacgtact

SEQ ID NO: 5246960 - DNA, 22 bp, Homo sapiens
atcctaaggggagctacagcca

SEQ ID NO: 5246961 - DNA, 19 bp, Homo sapiens
atcctaagggtcgaaagct

SEQ ID NO: 5246962 - DNA, 23 bp, Homo sapiens
atcctaagggtcgaaagctctag

SEQ ID NO: 5246963 - DNA, 16 bp, Homo sapiens
atcctaaggttcttgc

SEQ ID NO: 5246964 - DNA, 19 bp, Homo sapiens
atcctaagttacctttcta

SEQ ID NO: 5246965 - DNA, 12 bp, Homo sapiens
atcctaataaaa

SEQ ID NO: 5246966 - DNA, 15 bp, Homo sapiens
atcctaataaaaagg

SEQ ID NO: 5246967 - DNA, 22 bp, Homo sapiens
atcctaataaaaaggtgaccat

SEQ ID NO: 5246968 - DNA, 16 bp, Homo sapiens
atcctaatttctcctc

SEQ ID NO: 5246969 - DNA, 20 bp, Homo sapiens
atcctaatttctcctccctt

SEQ ID NO: 5246970 - DNA, 23 bp, Homo sapiens
atcctaatttctcctcccttcct

SEQ ID NO: 5246971 - DNA, 11 bp, Homo sapiens
atcctacagta

SEQ ID NO: 5246972 - DNA, 17 bp, Homo sapiens
atcctacagtacaatca

SEQ ID NO: 5246973 - DNA, 13 bp, Homo sapiens
atcctaccaaagt

SEQ ID NO: 5246974 - DNA, 14 bp, Homo sapiens
atcctaccaacctc

SEQ ID NO: 5246975 - DNA, 18 bp, Homo sapiens
atcctaccaatgcatgca

SEQ ID NO: 5246976 - DNA, 23 bp, Homo sapiens
atcctacccagcgtggcccaggc

SEQ ID NO: 5246977 - DNA, 23 bp, Homo sapiens
atcctaccccctcttcaaagcag

SEQ ID NO: 5246978 - DNA, 21 bp, Homo sapiens
atcctaccctcgggcccacct

SEQ ID NO: 5246979 - DNA, 22 bp, Homo sapiens
atcctaccctcgggcccacctg

SEQ ID NO: 5246980 - DNA, 15 bp, Homo sapiens
atcctaccttgcttt

SEQ ID NO: 5246981 - DNA, 18 bp, Homo sapiens
atcctactaataaaccag

SEQ ID NO: 5246982 - DNA, 20 bp, Homo sapiens
atcctagaaaattgttttta

SEQ ID NO: 5246983 - DNA, 21 bp, Homo sapiens
atcctagactgctcctgggca

SEQ ID NO: 5246984 - DNA, 23 bp, Homo sapiens
atcctagagattcttagctcttg

SEQ ID NO: 5246985 - DNA, 23 bp, Homo sapiens
atcctagagatttggtgtacaat

SEQ ID NO: 5246986 - DNA, 17 bp, Homo sapiens
atcctagaggtagagaa

SEQ ID NO: 5246987 - DNA, 16 bp, Homo sapiens
atcctagagtcttaaa

SEQ ID NO: 5246988 - DNA, 16 bp, Homo sapiens
atcctagatcctaagg

SEQ ID NO: 5246989 - DNA, 23 bp, Homo sapiens
atcctagattatatcaaagtatt

SEQ ID NO: 5246990 - DNA, 21 bp, Homo sapiens
atcctagcacttgtctcagga

SEQ ID NO: 5246991 - DNA, 23 bp, Homo sapiens
atcctagcactttgggaggctga

SEQ ID NO: 5246992 - DNA, 15 bp, Homo sapiens
atcctagccccaccc

SEQ ID NO: 5246993 - DNA, 19 bp, Homo sapiens
atcctagcctttgggcaca

SEQ ID NO: 5246994 - DNA, 20 bp, Homo sapiens
atcctagctacttggcaggc

SEQ ID NO: 5246995 - DNA, 23 bp, Homo sapiens
atcctagctacttggcaggctga

SEQ ID NO: 5246996 - DNA, 16 bp, Homo sapiens
atcctaggcatttgct

SEQ ID NO: 5246997 - DNA, 17 bp, Homo sapiens
atcctagggcctgggtt

SEQ ID NO: 5246998 - DNA, 12 bp, Homo sapiens
atcctaggtgct

SEQ ID NO: 5246999 - DNA, 21 bp, Homo sapiens
atcctagtaattgcctagaaa

SEQ ID NO: 5247000 - DNA, 18 bp, Homo sapiens
atcctagtcttcacaact

SEQ ID NO: 5247001 - DNA, 15 bp, Homo sapiens
atcctagttccacca

SEQ ID NO: 5247002 - DNA, 15 bp, Homo sapiens
atcctagtttcctct

SEQ ID NO: 5247003 - DNA, 18 bp, Homo sapiens
atcctagtttcctctcct

SEQ ID NO: 5247004 - DNA, 16 bp, Homo sapiens
atcctagtttgctgtg

SEQ ID NO: 5247005 - DNA, 15 bp, Homo sapiens
atcctataaatgtga

SEQ ID NO: 5247006 - DNA, 14 bp, Homo sapiens
atcctatactggtt

SEQ ID NO: 5247007 - DNA, 13 bp, Homo sapiens
atcctatatctgt

SEQ ID NO: 5247008 - DNA, 17 bp, Homo sapiens
atcctatatctgtttgt

SEQ ID NO: 5247009 - DNA, 19 bp, Homo sapiens
atcctatcaacaacaaggt

SEQ ID NO: 5247010 - DNA, 18 bp, Homo sapiens
atcctatccactgggcac

SEQ ID NO: 5247011 - DNA, 19 bp, Homo sapiens
atcctatctggggagctcc

SEQ ID NO: 5247012 - DNA, 20 bp, Homo sapiens
atcctatgatttttagacta

SEQ ID NO: 5247013 - DNA, 13 bp, Homo sapiens
atcctatgcaata

SEQ ID NO: 5247014 - DNA, 13 bp, Homo sapiens
atcctatgcatgg

SEQ ID NO: 5247015 - DNA, 13 bp, Homo sapiens
atcctatgccttc

SEQ ID NO: 5247016 - DNA, 18 bp, Homo sapiens
atcctatgccttcaaata

SEQ ID NO: 5247017 - DNA, 19 bp, Homo sapiens
atcctatgccttcaaatag

SEQ ID NO: 5247018 - DNA, 14 bp, Homo sapiens
atcctatgcttaat

SEQ ID NO: 5247019 - DNA, 12 bp, Homo sapiens
atcctatgtttt

SEQ ID NO: 5247020 - DNA, 20 bp, Homo sapiens
atcctatgtttttgttcaaa

SEQ ID NO: 5247021 - DNA, 17 bp, Homo sapiens
atcctattacttttcat

SEQ ID NO: 5247022 - DNA, 18 bp, Homo sapiens
atcctattctcaccagga

SEQ ID NO: 5247023 - DNA, 20 bp, Homo sapiens
atcctattctcaccaggaag

SEQ ID NO: 5247024 - DNA, 16 bp, Homo sapiens
atcctattgttgatgg

SEQ ID NO: 5247025 - DNA, 23 bp, Homo sapiens
atcctattttgtaatttttttga

SEQ ID NO: 5247026 - DNA, 21 bp, Homo sapiens
atcctcaaagaaagtgtattg

SEQ ID NO: 5247027 - DNA, 20 bp, Homo sapiens
atcctcaacaacaaaccaaa

SEQ ID NO: 5247028 - DNA, 15 bp, Homo sapiens
atcctcaatccagct

SEQ ID NO: 5247029 - DNA, 16 bp, Homo sapiens
atcctcacactacaga

SEQ ID NO: 5247030 - DNA, 17 bp, Homo sapiens
atcctcacaggagcaga

SEQ ID NO: 5247031 - DNA, 20 bp, Homo sapiens
atcctcacaggagcagacag

SEQ ID NO: 5247032 - DNA, 21 bp, Homo sapiens
atcctcacaggagcagacaga

SEQ ID NO: 5247033 - DNA, 13 bp, Homo sapiens
atcctcacccaga

SEQ ID NO: 5247034 - DNA, 17 bp, Homo sapiens
atcctcacccagatcag

SEQ ID NO: 5247035 - DNA, 19 bp, Homo sapiens
atcctcacccagatcagga

SEQ ID NO: 5247036 - DNA, 16 bp, Homo sapiens
atcctcacgccttggc

SEQ ID NO: 5247037 - DNA, 22 bp, Homo sapiens
atcctcactgagaaggccccag

SEQ ID NO: 5247038 - DNA, 14 bp, Homo sapiens
atcctcactgggtg

SEQ ID NO: 5247039 - DNA, 14 bp, Homo sapiens
atcctcagaggctg

SEQ ID NO: 5247040 - DNA, 14 bp, Homo sapiens
atcctcagccccag

SEQ ID NO: 5247041 - DNA, 18 bp, Homo sapiens
atcctcagcccctccagt

SEQ ID NO: 5247042 - DNA, 19 bp, Homo sapiens
atcctcagccgagaaattg

SEQ ID NO: 5247043 - DNA, 21 bp, Homo sapiens
atcctcagccgagaaattggg

SEQ ID NO: 5247044 - DNA, 15 bp, Homo sapiens
atcctcaggatttca

SEQ ID NO: 5247045 - DNA, 20 bp, Homo sapiens
atcctcaggatttcattgac

SEQ ID NO: 5247046 - DNA, 18 bp, Homo sapiens
atcctcaggtagtactgg

SEQ ID NO: 5247047 - DNA, 20 bp, Homo sapiens
atcctcaggtagtactggga

SEQ ID NO: 5247048 - DNA, 21 bp, Homo sapiens
atcctcagttctcaaatgtgt

SEQ ID NO: 5247049 - DNA, 17 bp, Homo sapiens
atcctcagttggaatca

SEQ ID NO: 5247050 - DNA, 22 bp, Homo sapiens
atcctcatacccacccccaccc

SEQ ID NO: 5247051 - DNA, 15 bp, Homo sapiens
atcctcatccctgac

SEQ ID NO: 5247052 - DNA, 16 bp, Homo sapiens
atcctcatctctcttg

SEQ ID NO: 5247053 - DNA, 15 bp, Homo sapiens
atcctcatctttttt

SEQ ID NO: 5247054 - DNA, 23 bp, Homo sapiens
atcctcatggcccatcaggggca

SEQ ID NO: 5247055 - DNA, 13 bp, Homo sapiens
atcctcattcact

SEQ ID NO: 5247056 - DNA, 18 bp, Homo sapiens
atcctcattgcctcctgt

SEQ ID NO: 5247057 - DNA, 21 bp, Homo sapiens
atcctcattgcctcctgttct

SEQ ID NO: 5247058 - DNA, 15 bp, Homo sapiens
atcctcatttgcaaa

SEQ ID NO: 5247059 - DNA, 23 bp, Homo sapiens
atcctcatttggggtagctagag

SEQ ID NO: 5247060 - DNA, 19 bp, Homo sapiens
atcctccaacgttaaaaga

SEQ ID NO: 5247061 - DNA, 14 bp, Homo sapiens
atcctccaatgtct

SEQ ID NO: 5247062 - DNA, 15 bp, Homo sapiens
atcctccaatgtcta

SEQ ID NO: 5247063 - DNA, 15 bp, Homo sapiens
atcctccacagagag

SEQ ID NO: 5247064 - DNA, 15 bp, Homo sapiens
atcctccacatcctg

SEQ ID NO: 5247065 - DNA, 17 bp, Homo sapiens
atcctccacatcctgtg

SEQ ID NO: 5247066 - DNA, 18 bp, Homo sapiens
atcctccacttgttcagg

SEQ ID NO: 5247067 - DNA, 21 bp, Homo sapiens
atcctccagagaaacccaggg

SEQ ID NO: 5247068 - DNA, 13 bp, Homo sapiens
atcctccagcagg

SEQ ID NO: 5247069 - DNA, 14 bp, Homo sapiens
atcctccagcttct

SEQ ID NO: 5247070 - DNA, 12 bp, Homo sapiens
atcctccagggg

SEQ ID NO: 5247071 - DNA, 11 bp, Homo sapiens
atcctccaggt

SEQ ID NO: 5247072 - DNA, 13 bp, Homo sapiens
atcctccaggtgc

SEQ ID NO: 5247073 - DNA, 22 bp, Homo sapiens
atcctccaggtgcacaagctcc

SEQ ID NO: 5247074 - DNA, 18 bp, Homo sapiens
atcctccaggtttttcaa

SEQ ID NO: 5247075 - DNA, 20 bp, Homo sapiens
atcctccaggtttttcaatt

SEQ ID NO: 5247076 - DNA, 15 bp, Homo sapiens
atcctccatttttgt

SEQ ID NO: 5247077 - DNA, 15 bp, Homo sapiens
atcctcccacctcag

SEQ ID NO: 5247078 - DNA, 18 bp, Homo sapiens
atcctcccacctcagcct

SEQ ID NO: 5247079 - DNA, 19 bp, Homo sapiens
atcctcccacctcagcctc

SEQ ID NO: 5247080 - DNA, 13 bp, Homo sapiens
atcctccccacca

SEQ ID NO: 5247081 - DNA, 14 bp, Homo sapiens
atcctccccaccag

SEQ ID NO: 5247082 - DNA, 17 bp, Homo sapiens
atcctccccaccagagc

SEQ ID NO: 5247083 - DNA, 19 bp, Homo sapiens
atcctccccaccagagctg

SEQ ID NO: 5247084 - DNA, 17 bp, Homo sapiens
atcctccccgctctgcc

SEQ ID NO: 5247085 - DNA, 15 bp, Homo sapiens
atcctcccctggact

SEQ ID NO: 5247086 - DNA, 22 bp, Homo sapiens
atcctcccctggactcccgtgt

SEQ ID NO: 5247087 - DNA, 11 bp, Homo sapiens
atcctcccctt

SEQ ID NO: 5247088 - DNA, 19 bp, Homo sapiens
atcctccccttttaccact

SEQ ID NO: 5247089 - DNA, 18 bp, Homo sapiens
atcctcccgccccagcct

SEQ ID NO: 5247090 - DNA, 19 bp, Homo sapiens
atcctcccgccccagcctc

SEQ ID NO: 5247091 - DNA, 18 bp, Homo sapiens
atcctcccggctccctcc

SEQ ID NO: 5247092 - DNA, 23 bp, Homo sapiens
atcctccctacttccaagaaaaa

SEQ ID NO: 5247093 - DNA, 19 bp, Homo sapiens
atcctccctatcaagcact

SEQ ID NO: 5247094 - DNA, 14 bp, Homo sapiens
atcctccctccacc

SEQ ID NO: 5247095 - DNA, 18 bp, Homo sapiens
atcctccctccacctcaa

SEQ ID NO: 5247096 - DNA, 19 bp, Homo sapiens
atcctccctccacctcaag

SEQ ID NO: 5247097 - DNA, 21 bp, Homo sapiens
atcctccctgaccctgctcct

SEQ ID NO: 5247098 - DNA, 15 bp, Homo sapiens
atcctccctgcccat

SEQ ID NO: 5247099 - DNA, 17 bp, Homo sapiens
atcctccctgcccatcc

SEQ ID NO: 5247100 - DNA, 11 bp, Homo sapiens
atcctccctgg

SEQ ID NO: 5247101 - DNA, 20 bp, Homo sapiens
atcctccctggcagacacaa

SEQ ID NO: 5247102 - DNA, 15 bp, Homo sapiens
atcctccctgtaact

SEQ ID NO: 5247103 - DNA, 22 bp, Homo sapiens
atcctccctgttccccacaggt

SEQ ID NO: 5247104 - DNA, 15 bp, Homo sapiens
atcctcccttcccag

SEQ ID NO: 5247105 - DNA, 24 bp, Homo sapiens
atcctcccttcccaggaggtgcag

SEQ ID NO: 5247106 - DNA, 15 bp, Homo sapiens
atcctcccttcctcc

SEQ ID NO: 5247107 - DNA, 22 bp, Homo sapiens
atcctcccttgccccaggccag

SEQ ID NO: 5247108 - DNA, 16 bp, Homo sapiens
atcctccgcggaggcc

SEQ ID NO: 5247109 - DNA, 13 bp, Homo sapiens
atcctcctccagg

SEQ ID NO: 5247110 - DNA, 11 bp, Homo sapiens
atcctcctcct

SEQ ID NO: 5247111 - DNA, 19 bp, Homo sapiens
atcctcctctccatgcaag

SEQ ID NO: 5247112 - DNA, 20 bp, Homo sapiens
atcctcctgagtagctggga

SEQ ID NO: 5247113 - DNA, 12 bp, Homo sapiens
atcctcctgccc

SEQ ID NO: 5247114 - DNA, 13 bp, Homo sapiens
atcctcctgcctc

SEQ ID NO: 5247115 - DNA, 17 bp, Homo sapiens
atcctcctgcctcagcc

SEQ ID NO: 5247116 - DNA, 12 bp, Homo sapiens
atcctcctggaa

SEQ ID NO: 5247117 - DNA, 14 bp, Homo sapiens
atcctcctggaacc

SEQ ID NO: 5247118 - DNA, 16 bp, Homo sapiens
atcctcctggaacctt

SEQ ID NO: 5247119 - DNA, 22 bp, Homo sapiens
atcctcctggaaccttgctgtc

SEQ ID NO: 5247120 - DNA, 21 bp, Homo sapiens
atcctcctgtcttggcctccc

SEQ ID NO: 5247121 - DNA, 19 bp, Homo sapiens
atcctccttataagcccag

SEQ ID NO: 5247122 - DNA, 23 bp, Homo sapiens
atcctccttccaggccccaggct

SEQ ID NO: 5247123 - DNA, 12 bp, Homo sapiens
atcctcctttca

SEQ ID NO: 5247124 - DNA, 17 bp, Homo sapiens
atcctcctttcagttcg

SEQ ID NO: 5247125 - DNA, 18 bp, Homo sapiens
atcctcctttcagttcgt

SEQ ID NO: 5247126 - DNA, 19 bp, Homo sapiens
atcctcgcagccacaccta

SEQ ID NO: 5247127 - DNA, 14 bp, Homo sapiens
atcctcgctcccgg

SEQ ID NO: 5247128 - DNA, 19 bp, Homo sapiens
atcctctacggttatttcc

SEQ ID NO: 5247129 - DNA, 17 bp, Homo sapiens
atcctctactgtgcatc

SEQ ID NO: 5247130 - DNA, 12 bp, Homo sapiens
atatcaagaata

SEQ ID NO: 5247131 - DNA, 22 bp, Homo sapiens
atatcaaggagctcttctagct

SEQ ID NO: 5247132 - DNA, 18 bp, Homo sapiens
atatcaaggtggaaatgg

SEQ ID NO: 5247133 - DNA, 17 bp, Homo sapiens
atatcaattcaacacat

SEQ ID NO: 5247134 - DNA, 15 bp, Homo sapiens
atatcaatttaaaaa

SEQ ID NO: 5247135 - DNA, 13 bp, Homo sapiens
atatcacagaaaa

SEQ ID NO: 5247136 - DNA, 14 bp, Homo sapiens
atatcacagtatta

SEQ ID NO: 5247137 - DNA, 15 bp, Homo sapiens
atatcacagtattat

SEQ ID NO: 5247138 - DNA, 19 bp, Homo sapiens
atatcaccaggactgttac

SEQ ID NO: 5247139 - DNA, 20 bp, Homo sapiens
atatcacccagacataaagg

SEQ ID NO: 5247140 - DNA, 22 bp, Homo sapiens
atatcacccagacataaaggaa

SEQ ID NO: 5247141 - DNA, 15 bp, Homo sapiens
atatcactaaaagca

SEQ ID NO: 5247142 - DNA, 23 bp, Homo sapiens
atatcactaaaagcatgaattgg

SEQ ID NO: 5247143 - DNA, 13 bp, Homo sapiens
atatcactaattt

SEQ ID NO: 5247144 - DNA, 18 bp, Homo sapiens
atatcactcttgagtaaa

SEQ ID NO: 5247145 - DNA, 14 bp, Homo sapiens
atatcacttaaatc

SEQ ID NO: 5247146 - DNA, 11 bp, Homo sapiens
atatcacttcc

SEQ ID NO: 5247147 - DNA, 18 bp, Homo sapiens
atatcactttggtctcca

SEQ ID NO: 5247148 - DNA, 21 bp, Homo sapiens
atatcagaaaagtagaattat

SEQ ID NO: 5247149 - DNA, 22 bp, Homo sapiens
atatcagaaaagtagaattata

SEQ ID NO: 5247150 - DNA, 14 bp, Homo sapiens
atatcagacaagca

SEQ ID NO: 5247151 - DNA, 16 bp, Homo sapiens
atatcagacaagcact

SEQ ID NO: 5247152 - DNA, 14 bp, Homo sapiens
atatcagacctctg

SEQ ID NO: 5247153 - DNA, 19 bp, Homo sapiens
atatcagacttcaccaaat

SEQ ID NO: 5247154 - DNA, 17 bp, Homo sapiens
atatcagagctgggaaa

SEQ ID NO: 5247155 - DNA, 14 bp, Homo sapiens
atatcagcactgga

SEQ ID NO: 5247156 - DNA, 19 bp, Homo sapiens
atatcagcagacactccag

SEQ ID NO: 5247157 - DNA, 22 bp, Homo sapiens
atatcagcctgagtctcctgtg

SEQ ID NO: 5247158 - DNA, 11 bp, Homo sapiens
atatcagctct

SEQ ID NO: 5247159 - DNA, 19 bp, Homo sapiens
atatcagctttgataattg

SEQ ID NO: 5247160 - DNA, 23 bp, Homo sapiens
atatcaggctattatttattgta

SEQ ID NO: 5247161 - DNA, 12 bp, Homo sapiens
atatcagggcct

SEQ ID NO: 5247162 - DNA, 15 bp, Homo sapiens
atatcaggtgtataa

SEQ ID NO: 5247163 - DNA, 22 bp, Homo sapiens
atatcaggtgtataaatgtaca

SEQ ID NO: 5247164 - DNA, 23 bp, Homo sapiens
atatcaggtgtataaatgtacat

SEQ ID NO: 5247165 - DNA, 17 bp, Homo sapiens
atatcagtccagtttgt

SEQ ID NO: 5247166 - DNA, 17 bp, Homo sapiens
atatcagtcgttttagt

SEQ ID NO: 5247167 - DNA, 18 bp, Homo sapiens
atatcagtcgttttagtg

SEQ ID NO: 5247168 - DNA, 15 bp, Homo sapiens
atatcagtgttgtct

SEQ ID NO: 5247169 - DNA, 18 bp, Homo sapiens
atatcagtgttgtctcat

SEQ ID NO: 5247170 - DNA, 20 bp, Homo sapiens
atatcagttactcagccctg

SEQ ID NO: 5247171 - DNA, 21 bp, Homo sapiens
atatcagttactcagccctgg

SEQ ID NO: 5247172 - DNA, 22 bp, Homo sapiens
atatcagttactcagccctggg

SEQ ID NO: 5247173 - DNA, 23 bp, Homo sapiens
atatcagttactcagccctgggc

SEQ ID NO: 5247174 - DNA, 16 bp, Homo sapiens
atatcagttataatta

SEQ ID NO: 5247175 - DNA, 22 bp, Homo sapiens
atatcataaaggatatttcaaa

SEQ ID NO: 5247176 - DNA, 12 bp, Homo sapiens
atatcataaagt

SEQ ID NO: 5247177 - DNA, 15 bp, Homo sapiens
atatcataaagtatg

SEQ ID NO: 5247178 - DNA, 17 bp, Homo sapiens
atatcataacttaataa

SEQ ID NO: 5247179 - DNA, 19 bp, Homo sapiens
atatcataacttaataaat

SEQ ID NO: 5247180 - DNA, 16 bp, Homo sapiens
atatcataatgtaatg

SEQ ID NO: 5247181 - DNA, 14 bp, Homo sapiens
atatcatacagttt

SEQ ID NO: 5247182 - DNA, 22 bp, Homo sapiens
atatcatactgatttttaagtc

SEQ ID NO: 5247183 - DNA, 16 bp, Homo sapiens
atatcataggtacaat

SEQ ID NO: 5247184 - DNA, 14 bp, Homo sapiens
atatcatataaaat

SEQ ID NO: 5247185 - DNA, 14 bp, Homo sapiens
atatcatataaaca

SEQ ID NO: 5247186 - DNA, 17 bp, Homo sapiens
atatcatataaacattt

SEQ ID NO: 5247187 - DNA, 17 bp, Homo sapiens
atatcatatataaaagt

SEQ ID NO: 5247188 - DNA, 13 bp, Homo sapiens
atatcatatgtat

SEQ ID NO: 5247189 - DNA, 22 bp, Homo sapiens
atatcatatgtatctaaatgaa

SEQ ID NO: 5247190 - DNA, 18 bp, Homo sapiens
atatcatatttctgtgga

SEQ ID NO: 5247191 - DNA, 22 bp, Homo sapiens
atatcatcagtattgaagcatt

SEQ ID NO: 5247192 - DNA, 18 bp, Homo sapiens
atatcatccacacatgaa

SEQ ID NO: 5247193 - DNA, 16 bp, Homo sapiens
atatcatctacctaga

SEQ ID NO: 5247194 - DNA, 16 bp, Homo sapiens
atatcatctgtcatta

SEQ ID NO: 5247195 - DNA, 21 bp, Homo sapiens
atatcatctgtcattatattc

SEQ ID NO: 5247196 - DNA, 15 bp, Homo sapiens
atatcatgaaacact

SEQ ID NO: 5247197 - DNA, 17 bp, Homo sapiens
atatcatgaaagaataa

SEQ ID NO: 5247198 - DNA, 21 bp, Homo sapiens
atatcatgaagccttgctgaa

SEQ ID NO: 5247199 - DNA, 15 bp, Homo sapiens
atatcatgaatgtga

SEQ ID NO: 5247200 - DNA, 23 bp, Homo sapiens
atatcatgctaaaattctataga

SEQ ID NO: 5247201 - DNA, 19 bp, Homo sapiens
atatcatggtaatgacaga

SEQ ID NO: 5247202 - DNA, 22 bp, Homo sapiens
atatcatgtaaagaaatgtctt

SEQ ID NO: 5247203 - DNA, 19 bp, Homo sapiens
atatcatgtcttgtgcata

SEQ ID NO: 5247204 - DNA, 13 bp, Homo sapiens
atatcatgtgatt

SEQ ID NO: 5247205 - DNA, 19 bp, Homo sapiens
atatcatgttaaattagaa

SEQ ID NO: 5247206 - DNA, 23 bp, Homo sapiens
atatcatgttaaattagaatgaa

SEQ ID NO: 5247207 - DNA, 18 bp, Homo sapiens
atatcattaaacaaataa

SEQ ID NO: 5247208 - DNA, 17 bp, Homo sapiens
atatcattaaattggaa

SEQ ID NO: 5247209 - DNA, 13 bp, Homo sapiens
atatcattactaa

SEQ ID NO: 5247210 - DNA, 13 bp, Homo sapiens
atatcattatagc

SEQ ID NO: 5247211 - DNA, 17 bp, Homo sapiens
atatcattatagcatgt

SEQ ID NO: 5247212 - DNA, 14 bp, Homo sapiens
atatcattatttag

SEQ ID NO: 5247213 - DNA, 14 bp, Homo sapiens
atatcattcagaat

SEQ ID NO: 5247214 - DNA, 20 bp, Homo sapiens
atatcattcagcatctactc

SEQ ID NO: 5247215 - DNA, 15 bp, Homo sapiens
atatcattctaaaga

SEQ ID NO: 5247216 - DNA, 16 bp, Homo sapiens
atatcattctttgtat

SEQ ID NO: 5247217 - DNA, 19 bp, Homo sapiens
atatcattctttgtatctt

SEQ ID NO: 5247218 - DNA, 20 bp, Homo sapiens
atatcattgttggtgttaat

SEQ ID NO: 5247219 - DNA, 13 bp, Homo sapiens
atatcatttataa

SEQ ID NO: 5247220 - DNA, 21 bp, Homo sapiens
atatcatttattttttacatt

SEQ ID NO: 5247221 - DNA, 20 bp, Homo sapiens
atatcatttcactgtctagg

SEQ ID NO: 5247222 - DNA, 13 bp, Homo sapiens
atatcatttcata

SEQ ID NO: 5247223 - DNA, 12 bp, Homo sapiens
atatcatttgtg

SEQ ID NO: 5247224 - DNA, 20 bp, Homo sapiens
atatcatttgtgaagaatta

SEQ ID NO: 5247225 - DNA, 12 bp, Homo sapiens
atatcattttaa

SEQ ID NO: 5247226 - DNA, 18 bp, Homo sapiens
atatcattttaaaatgtc

SEQ ID NO: 5247227 - DNA, 13 bp, Homo sapiens
atatcattttata

SEQ ID NO: 5247228 - DNA, 15 bp, Homo sapiens
atatcattttattca

SEQ ID NO: 5247229 - DNA, 17 bp, Homo sapiens
atatcattttattcaca

SEQ ID NO: 5247230 - DNA, 16 bp, Homo sapiens
atatcattttcctggg

SEQ ID NO: 5247231 - DNA, 21 bp, Homo sapiens
atatccaaaattcagggcttt

SEQ ID NO: 5247232 - DNA, 20 bp, Homo sapiens
atatccaaagactgtactgg

SEQ ID NO: 5247233 - DNA, 23 bp, Homo sapiens
atatccaagtaccaatgctgttg

SEQ ID NO: 5247234 - DNA, 15 bp, Homo sapiens
atatccaattttaaa

SEQ ID NO: 5247235 - DNA, 20 bp, Homo sapiens
atatccaattttaaaatgaa

SEQ ID NO: 5247236 - DNA, 21 bp, Homo sapiens
atatccaattttaaaatgaaa

SEQ ID NO: 5247237 - DNA, 14 bp, Homo sapiens
atatccacacattt

SEQ ID NO: 5247238 - DNA, 11 bp, Homo sapiens
atatccacagt

SEQ ID NO: 5247239 - DNA, 13 bp, Homo sapiens
atatccacataaa

SEQ ID NO: 5247240 - DNA, 16 bp, Homo sapiens
atatccacatctttaa

SEQ ID NO: 5247241 - DNA, 21 bp, Homo sapiens
atatccacttgtccatgtgaa

SEQ ID NO: 5247242 - DNA, 22 bp, Homo sapiens
atatccaggtcaacagaatgaa

SEQ ID NO: 5247243 - DNA, 19 bp, Homo sapiens
atatccaggtgtgcccctc

SEQ ID NO: 5247244 - DNA, 15 bp, Homo sapiens
atatccataaaattg

SEQ ID NO: 5247245 - DNA, 15 bp, Homo sapiens
atatccatacatttt

SEQ ID NO: 5247246 - DNA, 17 bp, Homo sapiens
atatccatagtgacttt

SEQ ID NO: 5247247 - DNA, 12 bp, Homo sapiens
atatccatcttt

SEQ ID NO: 5247248 - DNA, 17 bp, Homo sapiens
atatccatgtactgtag

SEQ ID NO: 5247249 - DNA, 20 bp, Homo sapiens
atatcccaaacttcggaaac

SEQ ID NO: 5247250 - DNA, 17 bp, Homo sapiens
atatcccaacattctgc

SEQ ID NO: 5247251 - DNA, 20 bp, Homo sapiens
atatcccagagaacaatcac

SEQ ID NO: 5247252 - DNA, 16 bp, Homo sapiens
atatccccagggaaac

SEQ ID NO: 5247253 - DNA, 15 bp, Homo sapiens
atatcccctcccagt

SEQ ID NO: 5247254 - DNA, 13 bp, Homo sapiens
atatcccctgcta

SEQ ID NO: 5247255 - DNA, 21 bp, Homo sapiens
atatccctcttgacattcaaa

SEQ ID NO: 5247256 - DNA, 20 bp, Homo sapiens
atatcccttggacattttat

SEQ ID NO: 5247257 - DNA, 16 bp, Homo sapiens
atatcctaataaaaag

SEQ ID NO: 5247258 - DNA, 20 bp, Homo sapiens
atatcctaataaaaaggtga

SEQ ID NO: 5247259 - DNA, 19 bp, Homo sapiens
atatcctaggaggtaatga

SEQ ID NO: 5247260 - DNA, 14 bp, Homo sapiens
atatcctatactgg

SEQ ID NO: 5247261 - DNA, 16 bp, Homo sapiens
atatcctatactggtt

SEQ ID NO: 5247262 - DNA, 16 bp, Homo sapiens
atatcctcaattatct

SEQ ID NO: 5247263 - DNA, 18 bp, Homo sapiens
atatcctcagatatattt

SEQ ID NO: 5247264 - DNA, 15 bp, Homo sapiens
atatcctccgccctt

SEQ ID NO: 5247265 - DNA, 20 bp, Homo sapiens
atatcctctgcttaaaaact

SEQ ID NO: 5247266 - DNA, 13 bp, Homo sapiens
atatcctgagcca

SEQ ID NO: 5247267 - DNA, 14 bp, Homo sapiens
atatcctgagccat

SEQ ID NO: 5247268 - DNA, 14 bp, Homo sapiens
atatcctgtaacta

SEQ ID NO: 5247269 - DNA, 18 bp, Homo sapiens
atatcctgtattcttgtt

SEQ ID NO: 5247270 - DNA, 19 bp, Homo sapiens
atatcctgtgtacctcact

SEQ ID NO: 5247271 - DNA, 20 bp, Homo sapiens
atatccttaaccattctgtc

SEQ ID NO: 5247272 - DNA, 16 bp, Homo sapiens
atatccttactttatc

SEQ ID NO: 5247273 - DNA, 17 bp, Homo sapiens
atatccttataagagat

SEQ ID NO: 5247274 - DNA, 23 bp, Homo sapiens
atatccttctggctgtagataaa

SEQ ID NO: 5247275 - DNA, 16 bp, Homo sapiens
atatcctttctaacaa

SEQ ID NO: 5247276 - DNA, 16 bp, Homo sapiens
atatcctttgccccaa

SEQ ID NO: 5247277 - DNA, 14 bp, Homo sapiens
atatccttttcttc

SEQ ID NO: 5247278 - DNA, 21 bp, Homo sapiens
atatccttttcttctatgtag

SEQ ID NO: 5247279 - DNA, 18 bp, Homo sapiens
atatcgaatatagttctg

SEQ ID NO: 5247280 - DNA, 17 bp, Homo sapiens
atatcgagagtttctat

SEQ ID NO: 5247281 - DNA, 19 bp, Homo sapiens
atatcgctgatgcagacac

SEQ ID NO: 5247282 - DNA, 23 bp, Homo sapiens
atatcggaggtggtggaggagga

SEQ ID NO: 5247283 - DNA, 18 bp, Homo sapiens
atatcggctcacaaagag

SEQ ID NO: 5247284 - DNA, 19 bp, Homo sapiens
atatcggctcacaaagaga

SEQ ID NO: 5247285 - DNA, 22 bp, Homo sapiens
atatcggggggtggaccacgcc

SEQ ID NO: 5247286 - DNA, 19 bp, Homo sapiens
atatcggtgctatgtgttt

SEQ ID NO: 5247287 - DNA, 13 bp, Homo sapiens
atatcgtcatttt

SEQ ID NO: 5247288 - DNA, 22 bp, Homo sapiens
atatctaaagctttggacaagt

SEQ ID NO: 5247289 - DNA, 13 bp, Homo sapiens
atatctaaagtca

SEQ ID NO: 5247290 - DNA, 15 bp, Homo sapiens
atatctaaagttata

SEQ ID NO: 5247291 - DNA, 19 bp, Homo sapiens
atatctaaagttatatttc

SEQ ID NO: 5247292 - DNA, 18 bp, Homo sapiens
atatctaaatctgtccaa

SEQ ID NO: 5247293 - DNA, 14 bp, Homo sapiens
atatctaaattgaa

SEQ ID NO: 5247294 - DNA, 17 bp, Homo sapiens
atatctaaattgaataa

SEQ ID NO: 5247295 - DNA, 22 bp, Homo sapiens
atatctaaattgaataatggta

SEQ ID NO: 5247296 - DNA, 15 bp, Homo sapiens
atatctaacttcgaa

SEQ ID NO: 5247297 - DNA, 20 bp, Homo sapiens
atatctaacttcgaatatat

SEQ ID NO: 5247298 - DNA, 15 bp, Homo sapiens
atatctaactttgta

SEQ ID NO: 5247299 - DNA, 22 bp, Homo sapiens
atatctaagcaagtgaactcat

SEQ ID NO: 5247300 - DNA, 17 bp, Homo sapiens
atatctaatatatatga

SEQ ID NO: 5247301 - DNA, 23 bp, Homo sapiens
atatctacagatagagagttgtt

SEQ ID NO: 5247302 - DNA, 23 bp, Homo sapiens
atatctacctgccctctctcagt

SEQ ID NO: 5247303 - DNA, 14 bp, Homo sapiens
atatctagaactat

SEQ ID NO: 5247304 - DNA, 15 bp, Homo sapiens
atatctagatttcta

SEQ ID NO: 5247305 - DNA, 16 bp, Homo sapiens
atatctagatttctag

SEQ ID NO: 5247306 - DNA, 16 bp, Homo sapiens
atatctaggtttatga

SEQ ID NO: 5247307 - DNA, 18 bp, Homo sapiens
atatctaggtttatgaca

SEQ ID NO: 5247308 - DNA, 22 bp, Homo sapiens
atatctaggtttatgacagtaa

SEQ ID NO: 5247309 - DNA, 15 bp, Homo sapiens
atcctctcccccaca

SEQ ID NO: 5247310 - DNA, 16 bp, Homo sapiens
atcctctcctttgaaa

SEQ ID NO: 5247311 - DNA, 18 bp, Homo sapiens
atcctctctccaggcccc

SEQ ID NO: 5247312 - DNA, 14 bp, Homo sapiens
atcctctctcccct

SEQ ID NO: 5247313 - DNA, 14 bp, Homo sapiens
atcctctctctctc

SEQ ID NO: 5247314 - DNA, 15 bp, Homo sapiens
atcctctctctcttc

SEQ ID NO: 5247315 - DNA, 20 bp, Homo sapiens
atcctctctggggctgtgtt

SEQ ID NO: 5247316 - DNA, 15 bp, Homo sapiens
atcctctcttcctct

SEQ ID NO: 5247317 - DNA, 12 bp, Homo sapiens
atcctctgatct

SEQ ID NO: 5247318 - DNA, 19 bp, Homo sapiens
atcctctgctggttcctga

SEQ ID NO: 5247319 - DNA, 24 bp, Homo sapiens
atcctctgcttgtcattctgctaa

SEQ ID NO: 5247320 - DNA, 13 bp, Homo sapiens
atcctctggaagg

SEQ ID NO: 5247321 - DNA, 13 bp, Homo sapiens
atcctctggggtt

SEQ ID NO: 5247322 - DNA, 17 bp, Homo sapiens
atcctctgtacagagcc

SEQ ID NO: 5247323 - DNA, 20 bp, Homo sapiens
atcctctgtacagagcccac

SEQ ID NO: 5247324 - DNA, 13 bp, Homo sapiens
atcctctgttgat

SEQ ID NO: 5247325 - DNA, 20 bp, Homo sapiens
atcctcttatatgtgcccct

SEQ ID NO: 5247326 - DNA, 22 bp, Homo sapiens
atcctcttccatatggatccac

SEQ ID NO: 5247327 - DNA, 15 bp, Homo sapiens
atcctcttcctctga

SEQ ID NO: 5247328 - DNA, 16 bp, Homo sapiens
atcctcttctaactca

SEQ ID NO: 5247329 - DNA, 16 bp, Homo sapiens
atcctcttgagagaaa

SEQ ID NO: 5247330 - DNA, 17 bp, Homo sapiens
atcctcttgagagaaac

SEQ ID NO: 5247331 - DNA, 17 bp, Homo sapiens
atcctcttgccacatct

SEQ ID NO: 5247332 - DNA, 16 bp, Homo sapiens
atcctcttgtatactt

SEQ ID NO: 5247333 - DNA, 22 bp, Homo sapiens
atcctctttactctgggcagaa

SEQ ID NO: 5247334 - DNA, 19 bp, Homo sapiens
atcctctttagagttagac

SEQ ID NO: 5247335 - DNA, 20 bp, Homo sapiens
atcctctttccccactgaag

SEQ ID NO: 5247336 - DNA, 14 bp, Homo sapiens
atcctctttgtaat

SEQ ID NO: 5247337 - DNA, 15 bp, Homo sapiens
atcctctttttccaa

SEQ ID NO: 5247338 - DNA, 15 bp, Homo sapiens
atcctgaaaaaatga

SEQ ID NO: 5247339 - DNA, 15 bp, Homo sapiens
atcctgaaagccagc

SEQ ID NO: 5247340 - DNA, 21 bp, Homo sapiens
atcctgaaatagaggctaaat

SEQ ID NO: 5247341 - DNA, 14 bp, Homo sapiens
atcctgaaatttca

SEQ ID NO: 5247342 - DNA, 16 bp, Homo sapiens
atcctgaaatttcaga

SEQ ID NO: 5247343 - DNA, 14 bp, Homo sapiens
atcctgaacaagaa

SEQ ID NO: 5247344 - DNA, 15 bp, Homo sapiens
atcctgaacagcatg

SEQ ID NO: 5247345 - DNA, 19 bp, Homo sapiens
atcctgaactgcttctcca

SEQ ID NO: 5247346 - DNA, 19 bp, Homo sapiens
atcctgaagcagttcagaa

SEQ ID NO: 5247347 - DNA, 12 bp, Homo sapiens
atcctgaataac

SEQ ID NO: 5247348 - DNA, 19 bp, Homo sapiens
atcctgaatctgatctttt

SEQ ID NO: 5247349 - DNA, 15 bp, Homo sapiens
atcctgacacattct

SEQ ID NO: 5247350 - DNA, 21 bp, Homo sapiens
atcctgacacattttcaagtg

SEQ ID NO: 5247351 - DNA, 15 bp, Homo sapiens
atcctgacatattca

SEQ ID NO: 5247352 - DNA, 18 bp, Homo sapiens
atcctgactctgccccct

SEQ ID NO: 5247353 - DNA, 19 bp, Homo sapiens
atcctgactctgccccctg

SEQ ID NO: 5247354 - DNA, 22 bp, Homo sapiens
atcctgagaagtacctttgtta

SEQ ID NO: 5247355 - DNA, 13 bp, Homo sapiens
atcctgagccccg

SEQ ID NO: 5247356 - DNA, 18 bp, Homo sapiens
atcctgagctcacagagt

SEQ ID NO: 5247357 - DNA, 18 bp, Homo sapiens
atcctgaggccagtggcc

SEQ ID NO: 5247358 - DNA, 16 bp, Homo sapiens
atcctgaggctccact

SEQ ID NO: 5247359 - DNA, 14 bp, Homo sapiens
atcctgaggtgcct

SEQ ID NO: 5247360 - DNA, 17 bp, Homo sapiens
atcctgagtccagaatg

SEQ ID NO: 5247361 - DNA, 19 bp, Homo sapiens
atcctgatggacctgcccc

SEQ ID NO: 5247362 - DNA, 22 bp, Homo sapiens
atcctgatggcacccacacaga

SEQ ID NO: 5247363 - DNA, 13 bp, Homo sapiens
atcctgattccaa

SEQ ID NO: 5247364 - DNA, 15 bp, Homo sapiens
atcctgattcctctc

SEQ ID NO: 5247365 - DNA, 17 bp, Homo sapiens
atcctgattcctctcta

SEQ ID NO: 5247366 - DNA, 18 bp, Homo sapiens
atcctgattcctctctaa

SEQ ID NO: 5247367 - DNA, 20 bp, Homo sapiens
atcctgcaagggacaggaag

SEQ ID NO: 5247368 - DNA, 14 bp, Homo sapiens
atcctgcaccccag

SEQ ID NO: 5247369 - DNA, 17 bp, Homo sapiens
atcctgcaccccagcat

SEQ ID NO: 5247370 - DNA, 11 bp, Homo sapiens
atcctgcactc

SEQ ID NO: 5247371 - DNA, 15 bp, Homo sapiens
atcctgcactgactc

SEQ ID NO: 5247372 - DNA, 22 bp, Homo sapiens
atcctgcagatactttgaagtg

SEQ ID NO: 5247373 - DNA, 22 bp, Homo sapiens
atcctgcaggaacgagcactgg

SEQ ID NO: 5247374 - DNA, 15 bp, Homo sapiens
atcctgcagggcttc

SEQ ID NO: 5247375 - DNA, 19 bp, Homo sapiens
atcctgcagggcttctcct

SEQ ID NO: 5247376 - DNA, 20 bp, Homo sapiens
atcctgcagggcttctcctc

SEQ ID NO: 5247377 - DNA, 16 bp, Homo sapiens
atcctgcattgttagc

SEQ ID NO: 5247378 - DNA, 14 bp, Homo sapiens
atcctgccaccctg

SEQ ID NO: 5247379 - DNA, 21 bp, Homo sapiens
atcctgccagccccacacagc

SEQ ID NO: 5247380 - DNA, 14 bp, Homo sapiens
atcctgccaggagc

SEQ ID NO: 5247381 - DNA, 18 bp, Homo sapiens
atcctgccaggagcagcc

SEQ ID NO: 5247382 - DNA, 13 bp, Homo sapiens
atcctgccattta

SEQ ID NO: 5247383 - DNA, 16 bp, Homo sapiens
atcctgccatttaaaa

SEQ ID NO: 5247384 - DNA, 20 bp, Homo sapiens
atcctgcccaaaatgtgaag

SEQ ID NO: 5247385 - DNA, 16 bp, Homo sapiens
atcctgcccccaagtc

SEQ ID NO: 5247386 - DNA, 14 bp, Homo sapiens
atcctgcccccagc

SEQ ID NO: 5247387 - DNA, 17 bp, Homo sapiens
atcctgcccccagccat

SEQ ID NO: 5247388 - DNA, 20 bp, Homo sapiens
atcctgccccctgaaactta

SEQ ID NO: 5247389 - DNA, 18 bp, Homo sapiens
atcctgcccgagggcagc

SEQ ID NO: 5247390 - DNA, 13 bp, Homo sapiens
atcctgccctgca

SEQ ID NO: 5247391 - DNA, 17 bp, Homo sapiens
atcctgccctgcagcac

SEQ ID NO: 5247392 - DNA, 15 bp, Homo sapiens
atcctgccctggagg

SEQ ID NO: 5247393 - DNA, 18 bp, Homo sapiens
atcctgcctctccccaaa

SEQ ID NO: 5247394 - DNA, 14 bp, Homo sapiens
atcctgcctgggtg

SEQ ID NO: 5247395 - DNA, 15 bp, Homo sapiens
atcctgcctgggtgg

SEQ ID NO: 5247396 - DNA, 21 bp, Homo sapiens
atcctgcctgggtgggacagc

SEQ ID NO: 5247397 - DNA, 22 bp, Homo sapiens
atcctgccttagagccaggcac

SEQ ID NO: 5247398 - DNA, 17 bp, Homo sapiens
atcctgctagcacctcc

SEQ ID NO: 5247399 - DNA, 20 bp, Homo sapiens
atcctgctagcacctcccca

SEQ ID NO: 5247400 - DNA, 15 bp, Homo sapiens
atcctgctagcaggc

SEQ ID NO: 5247401 - DNA, 16 bp, Homo sapiens
atcctgctagctgtag

SEQ ID NO: 5247402 - DNA, 16 bp, Homo sapiens
atcctgctcaggaaac

SEQ ID NO: 5247403 - DNA, 19 bp, Homo sapiens
atcctgctcataacatctt

SEQ ID NO: 5247404 - DNA, 20 bp, Homo sapiens
atcctgctcataacatcttt

SEQ ID NO: 5247405 - DNA, 19 bp, Homo sapiens
atcctgctccagcagcaca

SEQ ID NO: 5247406 - DNA, 15 bp, Homo sapiens
atcctgctcttccat

SEQ ID NO: 5247407 - DNA, 19 bp, Homo sapiens
atcctgctcttttgtgatg

SEQ ID NO: 5247408 - DNA, 14 bp, Homo sapiens
atcctgctgacctc

SEQ ID NO: 5247409 - DNA, 22 bp, Homo sapiens
atcctgctgacctcactgtcct

SEQ ID NO: 5247410 - DNA, 11 bp, Homo sapiens
atcctgctggg

SEQ ID NO: 5247411 - DNA, 14 bp, Homo sapiens
atcctgctgtggcc

SEQ ID NO: 5247412 - DNA, 14 bp, Homo sapiens
atcctgcttcagtg

SEQ ID NO: 5247413 - DNA, 11 bp, Homo sapiens
atcctgcttcc

SEQ ID NO: 5247414 - DNA, 12 bp, Homo sapiens
atcctgcttcct

SEQ ID NO: 5247415 - DNA, 13 bp, Homo sapiens
atcctgcttcctg

SEQ ID NO: 5247416 - DNA, 21 bp, Homo sapiens
atcctgcttcctgaaagctgt

SEQ ID NO: 5247417 - DNA, 20 bp, Homo sapiens
atcctgcttctcttttcctc

SEQ ID NO: 5247418 - DNA, 21 bp, Homo sapiens
atcctgcttctgatatgcagt

SEQ ID NO: 5247419 - DNA, 15 bp, Homo sapiens
atcctgctttacagg

SEQ ID NO: 5247420 - DNA, 19 bp, Homo sapiens
atcctgctttccctcccca

SEQ ID NO: 5247421 - DNA, 16 bp, Homo sapiens
atcctggaaatttgtg

SEQ ID NO: 5247422 - DNA, 17 bp, Homo sapiens
atcctggaaggacacag

SEQ ID NO: 5247423 - DNA, 19 bp, Homo sapiens
atcctggaaggacacagtg

SEQ ID NO: 5247424 - DNA, 23 bp, Homo sapiens
atcctggaaggacacagtgatga

SEQ ID NO: 5247425 - DNA, 10 bp, Homo sapiens
atcctggagc

SEQ ID NO: 5247426 - DNA, 13 bp, Homo sapiens
atcctggagcccc

SEQ ID NO: 5247427 - DNA, 16 bp, Homo sapiens
atcctggagcccctgt

SEQ ID NO: 5247428 - DNA, 17 bp, Homo sapiens
atcctggaggcccagtt

SEQ ID NO: 5247429 - DNA, 19 bp, Homo sapiens
atcctggaggggtgttgta

SEQ ID NO: 5247430 - DNA, 14 bp, Homo sapiens
atcctggagtctca

SEQ ID NO: 5247431 - DNA, 15 bp, Homo sapiens
atcctggagttctgg

SEQ ID NO: 5247432 - DNA, 20 bp, Homo sapiens
atcctggattcactcactca

SEQ ID NO: 5247433 - DNA, 16 bp, Homo sapiens
atcctggcaagtgacc

SEQ ID NO: 5247434 - DNA, 21 bp, Homo sapiens
atcctggcacccggcccctgc

SEQ ID NO: 5247435 - DNA, 21 bp, Homo sapiens
atcctggcacgccctactcca

SEQ ID NO: 5247436 - DNA, 11 bp, Homo sapiens
atcctggcagc

SEQ ID NO: 5247437 - DNA, 13 bp, Homo sapiens
atcctggcagccc

SEQ ID NO: 5247438 - DNA, 16 bp, Homo sapiens
atcctggcagcccaga

SEQ ID NO: 5247439 - DNA, 12 bp, Homo sapiens
atcctggccaac

SEQ ID NO: 5247440 - DNA, 14 bp, Homo sapiens
atcctggcccagcc

SEQ ID NO: 5247441 - DNA, 17 bp, Homo sapiens
atcctggcccagcctct

SEQ ID NO: 5247442 - DNA, 17 bp, Homo sapiens
atcctggcccagggcat

SEQ ID NO: 5247443 - DNA, 21 bp, Homo sapiens
atcctggcccagggcatctgg

SEQ ID NO: 5247444 - DNA, 16 bp, Homo sapiens
atcctggcccatcagt

SEQ ID NO: 5247445 - DNA, 14 bp, Homo sapiens
atcctggcccctcc

SEQ ID NO: 5247446 - DNA, 16 bp, Homo sapiens
atcctggccctggggg

SEQ ID NO: 5247447 - DNA, 22 bp, Homo sapiens
atcctggccctgggggtctggg

SEQ ID NO: 5247448 - DNA, 11 bp, Homo sapiens
atcctggcctg

SEQ ID NO: 5247449 - DNA, 22 bp, Homo sapiens
atcctggctctgtggcttgcta

SEQ ID NO: 5247450 - DNA, 23 bp, Homo sapiens
atcctggctggagaatgtggaga

SEQ ID NO: 5247451 - DNA, 15 bp, Homo sapiens
atcctggctggctgt

SEQ ID NO: 5247452 - DNA, 18 bp, Homo sapiens
atcctggctggctgtgtc

SEQ ID NO: 5247453 - DNA, 23 bp, Homo sapiens
atcctggctggctgtgtcctctc

SEQ ID NO: 5247454 - DNA, 23 bp, Homo sapiens
atcctggcttgaaaaacagctct

SEQ ID NO: 5247455 - DNA, 23 bp, Homo sapiens
atcctgggacctccccagcccag

SEQ ID NO: 5247456 - DNA, 17 bp, Homo sapiens
atcctgggatccagtgt

SEQ ID NO: 5247457 - DNA, 21 bp, Homo sapiens
atcctgggcagcttgggctgg

SEQ ID NO: 5247458 - DNA, 17 bp, Homo sapiens
atcctgggcatccccag

SEQ ID NO: 5247459 - DNA, 24 bp, Homo sapiens
atcctgggcatccccagccccctg

SEQ ID NO: 5247460 - DNA, 12 bp, Homo sapiens
atcctgggcccc

SEQ ID NO: 5247461 - DNA, 16 bp, Homo sapiens
atcctgggcccccaga

SEQ ID NO: 5247462 - DNA, 21 bp, Homo sapiens
atcctgggctgggtggcccct

SEQ ID NO: 5247463 - DNA, 16 bp, Homo sapiens
atcctggggccctcag

SEQ ID NO: 5247464 - DNA, 20 bp, Homo sapiens
atcctggggctcccttcatc

SEQ ID NO: 5247465 - DNA, 15 bp, Homo sapiens
atcctgggggaagag

SEQ ID NO: 5247466 - DNA, 21 bp, Homo sapiens
atcctgggggatacgggggtt

SEQ ID NO: 5247467 - DNA, 11 bp, Homo sapiens
atcctgggtaa

SEQ ID NO: 5247468 - DNA, 22 bp, Homo sapiens
atcctgggtggtctgcaggcag

SEQ ID NO: 5247469 - DNA, 16 bp, Homo sapiens
atcctggtaaccaaat

SEQ ID NO: 5247470 - DNA, 19 bp, Homo sapiens
atcctggtaaccaaatatt

SEQ ID NO: 5247471 - DNA, 14 bp, Homo sapiens
atcctggtcagctg

SEQ ID NO: 5247472 - DNA, 16 bp, Homo sapiens
atcctggtgtctagtt

SEQ ID NO: 5247473 - DNA, 17 bp, Homo sapiens
atcctggttagaagaaa

SEQ ID NO: 5247474 - DNA, 22 bp, Homo sapiens
atcctggttcctaggggaatga

SEQ ID NO: 5247475 - DNA, 23 bp, Homo sapiens
atcctggtttcataacttcctgt

SEQ ID NO: 5247476 - DNA, 15 bp, Homo sapiens
atcctgtaactacaa

SEQ ID NO: 5247477 - DNA, 21 bp, Homo sapiens
atcctgtaactacaatgatgg

SEQ ID NO: 5247478 - DNA, 12 bp, Homo sapiens
atcctgtaataa

SEQ ID NO: 5247479 - DNA, 20 bp, Homo sapiens
atcctgtacaagtgctcagt

SEQ ID NO: 5247480 - DNA, 17 bp, Homo sapiens
atcctgtaccaaatctg

SEQ ID NO: 5247481 - DNA, 19 bp, Homo sapiens
atcctgtaggaaggtactg

SEQ ID NO: 5247482 - DNA, 18 bp, Homo sapiens
atcctgtattcagacaga

SEQ ID NO: 5247483 - DNA, 16 bp, Homo sapiens
atcctgtattcttcaa

SEQ ID NO: 5247484 - DNA, 21 bp, Homo sapiens
atcctgtattcttcaaccagt

SEQ ID NO: 5247485 - DNA, 16 bp, Homo sapiens
atcctgtcatctgaga

SEQ ID NO: 5247486 - DNA, 19 bp, Homo sapiens
atcctgtcgattagactgg

SEQ ID NO: 5247487 - DNA, 21 bp, Homo sapiens
atcctgtctttaaggaaaaaa

SEQ ID NO: 5247488 - DNA, 15 bp, Homo sapiens
atcctgtctttctga

SEQ ID NO: 5247489 - DNA, 23 bp, Homo sapiens
atatctaggtttatgacagtaat

SEQ ID NO: 5247490 - DNA, 17 bp, Homo sapiens
atatctagtcaataact

SEQ ID NO: 5247491 - DNA, 18 bp, Homo sapiens
atatctagtgctaaacct

SEQ ID NO: 5247492 - DNA, 14 bp, Homo sapiens
atatctataaaata

SEQ ID NO: 5247493 - DNA, 16 bp, Homo sapiens
atatctatatataatt

SEQ ID NO: 5247494 - DNA, 20 bp, Homo sapiens
atatctatatataattctgt

SEQ ID NO: 5247495 - DNA, 21 bp, Homo sapiens
atatctatatataattctgta

SEQ ID NO: 5247496 - DNA, 15 bp, Homo sapiens
atatctatatatata

SEQ ID NO: 5247497 - DNA, 17 bp, Homo sapiens
atatctatatcatattt

SEQ ID NO: 5247498 - DNA, 17 bp, Homo sapiens
atatctatatgtacttg

SEQ ID NO: 5247499 - DNA, 16 bp, Homo sapiens
atatctatattctaaa

SEQ ID NO: 5247500 - DNA, 16 bp, Homo sapiens
atatctatattctata

SEQ ID NO: 5247501 - DNA, 22 bp, Homo sapiens
atatctatatttttatttctac

SEQ ID NO: 5247502 - DNA, 15 bp, Homo sapiens
atatctatcagagta

SEQ ID NO: 5247503 - DNA, 21 bp, Homo sapiens
atatctatgactgtgtttaat

SEQ ID NO: 5247504 - DNA, 15 bp, Homo sapiens
atatctatgttttac

SEQ ID NO: 5247505 - DNA, 17 bp, Homo sapiens
atatctatgttttacca

SEQ ID NO: 5247506 - DNA, 12 bp, Homo sapiens
atatctattaat

SEQ ID NO: 5247507 - DNA, 14 bp, Homo sapiens
atatctattaatat

SEQ ID NO: 5247508 - DNA, 13 bp, Homo sapiens
atatctatttgaa

SEQ ID NO: 5247509 - DNA, 16 bp, Homo sapiens
atatctcaatctgcag

SEQ ID NO: 5247510 - DNA, 20 bp, Homo sapiens
atatctccgtcaactcatat

SEQ ID NO: 5247511 - DNA, 15 bp, Homo sapiens
atatctcctgaaaag

SEQ ID NO: 5247512 - DNA, 22 bp, Homo sapiens
atatctcctgaaaaggtttatg

SEQ ID NO: 5247513 - DNA, 22 bp, Homo sapiens
atatctcctttaatgacattga

SEQ ID NO: 5247514 - DNA, 14 bp, Homo sapiens
atatctcctttgta

SEQ ID NO: 5247515 - DNA, 15 bp, Homo sapiens
atatctctagtccct

SEQ ID NO: 5247516 - DNA, 12 bp, Homo sapiens
atatctctccct

SEQ ID NO: 5247517 - DNA, 22 bp, Homo sapiens
atatctcttggaaaataagaca

SEQ ID NO: 5247518 - DNA, 11 bp, Homo sapiens
atatctgaaaa

SEQ ID NO: 5247519 - DNA, 15 bp, Homo sapiens
atatctgaaccaaga

SEQ ID NO: 5247520 - DNA, 13 bp, Homo sapiens
atatctgaatgtt

SEQ ID NO: 5247521 - DNA, 21 bp, Homo sapiens
atatctgacatcttatttact

SEQ ID NO: 5247522 - DNA, 18 bp, Homo sapiens
atatctgagaattgcaaa

SEQ ID NO: 5247523 - DNA, 22 bp, Homo sapiens
atatctgattgttgtcaggcca

SEQ ID NO: 5247524 - DNA, 12 bp, Homo sapiens
atatctgcagcg

SEQ ID NO: 5247525 - DNA, 14 bp, Homo sapiens
atatctgcatgtgt

SEQ ID NO: 5247526 - DNA, 17 bp, Homo sapiens
atatctgcatgtgtcat

SEQ ID NO: 5247527 - DNA, 19 bp, Homo sapiens
atatctgccccagtagtca

SEQ ID NO: 5247528 - DNA, 14 bp, Homo sapiens
atatctgcctcccc

SEQ ID NO: 5247529 - DNA, 15 bp, Homo sapiens
atatctgcctcccct

SEQ ID NO: 5247530 - DNA, 14 bp, Homo sapiens
atatctgcctttat

SEQ ID NO: 5247531 - DNA, 18 bp, Homo sapiens
atatctgctgtccagaca

SEQ ID NO: 5247532 - DNA, 21 bp, Homo sapiens
atatctggagtgagaggcccc

SEQ ID NO: 5247533 - DNA, 23 bp, Homo sapiens
atatctggccacactgggctcac

SEQ ID NO: 5247534 - DNA, 19 bp, Homo sapiens
atatctggcctctgctttc

SEQ ID NO: 5247535 - DNA, 18 bp, Homo sapiens
atatctgggttaagtgtt

SEQ ID NO: 5247536 - DNA, 18 bp, Homo sapiens
atatctggtatatgtcat

SEQ ID NO: 5247537 - DNA, 14 bp, Homo sapiens
atatctgtaaagat

SEQ ID NO: 5247538 - DNA, 17 bp, Homo sapiens
atatctgtaacactatt

SEQ ID NO: 5247539 - DNA, 19 bp, Homo sapiens
atatctgtaatatataatc

SEQ ID NO: 5247540 - DNA, 13 bp, Homo sapiens
atatctgtacaga

SEQ ID NO: 5247541 - DNA, 18 bp, Homo sapiens
atatctgtatttaatttt

SEQ ID NO: 5247542 - DNA, 18 bp, Homo sapiens
atatctgtgcaatggaat

SEQ ID NO: 5247543 - DNA, 20 bp, Homo sapiens
atatctgtgcaatggaatat

SEQ ID NO: 5247544 - DNA, 22 bp, Homo sapiens
atatctgtgcaatggaatataa

SEQ ID NO: 5247545 - DNA, 22 bp, Homo sapiens
atatctgtgtgccctagggctc

SEQ ID NO: 5247546 - DNA, 19 bp, Homo sapiens
atatctgttagatgctact

SEQ ID NO: 5247547 - DNA, 21 bp, Homo sapiens
atatctgttattcaaatttga

SEQ ID NO: 5247548 - DNA, 17 bp, Homo sapiens
atatctgttcccagccc

SEQ ID NO: 5247549 - DNA, 18 bp, Homo sapiens
atatctgtttgtatattt

SEQ ID NO: 5247550 - DNA, 20 bp, Homo sapiens
atatctgtttgtatatttgc

SEQ ID NO: 5247551 - DNA, 21 bp, Homo sapiens
atatctgttttgtttcttgac

SEQ ID NO: 5247552 - DNA, 22 bp, Homo sapiens
atatctgttttgtttcttgact

SEQ ID NO: 5247553 - DNA, 14 bp, Homo sapiens
atatcttaaagaaa

SEQ ID NO: 5247554 - DNA, 19 bp, Homo sapiens
atatcttaaagaaacagct

SEQ ID NO: 5247555 - DNA, 17 bp, Homo sapiens
atatcttaatatatttc

SEQ ID NO: 5247556 - DNA, 20 bp, Homo sapiens
atatcttaattctttgttct

SEQ ID NO: 5247557 - DNA, 12 bp, Homo sapiens
atatcttactaa

SEQ ID NO: 5247558 - DNA, 21 bp, Homo sapiens
atatcttataactgttttaga

SEQ ID NO: 5247559 - DNA, 18 bp, Homo sapiens
atatcttatccaattcat

SEQ ID NO: 5247560 - DNA, 20 bp, Homo sapiens
atatcttcaagcctgggcgt

SEQ ID NO: 5247561 - DNA, 17 bp, Homo sapiens
atatcttcacattgtgt

SEQ ID NO: 5247562 - DNA, 14 bp, Homo sapiens
atatcttcagttta

SEQ ID NO: 5247563 - DNA, 18 bp, Homo sapiens
atatcttcatttctaaat

SEQ ID NO: 5247564 - DNA, 17 bp, Homo sapiens
atatcttcccatttaac

SEQ ID NO: 5247565 - DNA, 16 bp, Homo sapiens
atatcttctgtttcat

SEQ ID NO: 5247566 - DNA, 13 bp, Homo sapiens
atatcttgaagaa

SEQ ID NO: 5247567 - DNA, 15 bp, Homo sapiens
atatcttgaagaata

SEQ ID NO: 5247568 - DNA, 16 bp, Homo sapiens
atatcttgaagaatat

SEQ ID NO: 5247569 - DNA, 18 bp, Homo sapiens
atatcttgcgaatccaag

SEQ ID NO: 5247570 - DNA, 22 bp, Homo sapiens
atatcttgctggattaatgttt

SEQ ID NO: 5247571 - DNA, 14 bp, Homo sapiens
atatcttgcttgaa

SEQ ID NO: 5247572 - DNA, 20 bp, Homo sapiens
atatcttggacaaatcacat

SEQ ID NO: 5247573 - DNA, 15 bp, Homo sapiens
atatcttggcaggta

SEQ ID NO: 5247574 - DNA, 16 bp, Homo sapiens
atatctttattaatca

SEQ ID NO: 5247575 - DNA, 14 bp, Homo sapiens
atatctttattcac

SEQ ID NO: 5247576 - DNA, 17 bp, Homo sapiens
atatctttctcattacc

SEQ ID NO: 5247577 - DNA, 19 bp, Homo sapiens
atatctttctcttacctgt

SEQ ID NO: 5247578 - DNA, 17 bp, Homo sapiens
atatctttgacctcaat

SEQ ID NO: 5247579 - DNA, 19 bp, Homo sapiens
atatctttgagttcaacct

SEQ ID NO: 5247580 - DNA, 12 bp, Homo sapiens
atatctttgtaa

SEQ ID NO: 5247581 - DNA, 14 bp, Homo sapiens
atatctttgtaaat

SEQ ID NO: 5247582 - DNA, 22 bp, Homo sapiens
atatctttgtaaattattttat

SEQ ID NO: 5247583 - DNA, 16 bp, Homo sapiens
atatctttgtgataat

SEQ ID NO: 5247584 - DNA, 21 bp, Homo sapiens
atatctttgtgataatttaag

SEQ ID NO: 5247585 - DNA, 22 bp, Homo sapiens
atatcttttatgtttgaatatg

SEQ ID NO: 5247586 - DNA, 15 bp, Homo sapiens
atatcttttctttag

SEQ ID NO: 5247587 - DNA, 21 bp, Homo sapiens
atatcttttctttagagaact

SEQ ID NO: 5247588 - DNA, 23 bp, Homo sapiens
atatcttttctttagagaactga

SEQ ID NO: 5247589 - DNA, 14 bp, Homo sapiens
atatcttttggtta

SEQ ID NO: 5247590 - DNA, 15 bp, Homo sapiens
atatctttttattga

SEQ ID NO: 5247591 - DNA, 16 bp, Homo sapiens
atatctttttattgat

SEQ ID NO: 5247592 - DNA, 17 bp, Homo sapiens
atatctttttcattatt

SEQ ID NO: 5247593 - DNA, 20 bp, Homo sapiens
atatgaaaaaaatgcatttt

SEQ ID NO: 5247594 - DNA, 13 bp, Homo sapiens
atatgaaaaatat

SEQ ID NO: 5247595 - DNA, 19 bp, Homo sapiens
atatgaaaaatatgatatt

SEQ ID NO: 5247596 - DNA, 15 bp, Homo sapiens
atatgaaaaatgtaa

SEQ ID NO: 5247597 - DNA, 18 bp, Homo sapiens
atatgaaaaatgtaaata

SEQ ID NO: 5247598 - DNA, 19 bp, Homo sapiens
atatgaaaaatgtaaatac

SEQ ID NO: 5247599 - DNA, 11 bp, Homo sapiens
atatgaaaaca

SEQ ID NO: 5247600 - DNA, 20 bp, Homo sapiens
atatgaaaacaatactaaat

SEQ ID NO: 5247601 - DNA, 14 bp, Homo sapiens
atatgaaaacactc

SEQ ID NO: 5247602 - DNA, 17 bp, Homo sapiens
atatgaaaactatacaa

SEQ ID NO: 5247603 - DNA, 14 bp, Homo sapiens
atatgaaagagaaa

SEQ ID NO: 5247604 - DNA, 14 bp, Homo sapiens
atatgaaatataaa

SEQ ID NO: 5247605 - DNA, 21 bp, Homo sapiens
atatgaaatataaattatctg

SEQ ID NO: 5247606 - DNA, 13 bp, Homo sapiens
atatgaaatattt

SEQ ID NO: 5247607 - DNA, 22 bp, Homo sapiens
atatgaaatgataaagatgtca

SEQ ID NO: 5247608 - DNA, 13 bp, Homo sapiens
atatgaaatgttt

SEQ ID NO: 5247609 - DNA, 19 bp, Homo sapiens
atatgaaatgtttcactat

SEQ ID NO: 5247610 - DNA, 14 bp, Homo sapiens
atatgaaatttaat

SEQ ID NO: 5247611 - DNA, 22 bp, Homo sapiens
atatgaacaaagaaaaaaatat

SEQ ID NO: 5247612 - DNA, 12 bp, Homo sapiens
atatgaacatag

SEQ ID NO: 5247613 - DNA, 13 bp, Homo sapiens
atatgaacatata

SEQ ID NO: 5247614 - DNA, 20 bp, Homo sapiens
atatgaacatattgttgaaa

SEQ ID NO: 5247615 - DNA, 13 bp, Homo sapiens
atatgaagaacta

SEQ ID NO: 5247616 - DNA, 22 bp, Homo sapiens
atatgaagaactattatattga

SEQ ID NO: 5247617 - DNA, 14 bp, Homo sapiens
atatgaagacataa

SEQ ID NO: 5247618 - DNA, 13 bp, Homo sapiens
atatgaagcaagc

SEQ ID NO: 5247619 - DNA, 15 bp, Homo sapiens
atatgaagcaagctg

SEQ ID NO: 5247620 - DNA, 17 bp, Homo sapiens
atatgaagcaagctgtg

SEQ ID NO: 5247621 - DNA, 18 bp, Homo sapiens
atatgaagcaagctgtgt

SEQ ID NO: 5247622 - DNA, 19 bp, Homo sapiens
atatgaagcaagctgtgtt

SEQ ID NO: 5247623 - DNA, 20 bp, Homo sapiens
atatgaagcaagctgtgtta

SEQ ID NO: 5247624 - DNA, 22 bp, Homo sapiens
atatgaagcaagctgtgttact

SEQ ID NO: 5247625 - DNA, 19 bp, Homo sapiens
atatgaagtaagttctgaa

SEQ ID NO: 5247626 - DNA, 20 bp, Homo sapiens
atatgaagtattaaaatgca

SEQ ID NO: 5247627 - DNA, 12 bp, Homo sapiens
atatgaatatat

SEQ ID NO: 5247628 - DNA, 20 bp, Homo sapiens
atatgaatattacatgtaaa

SEQ ID NO: 5247629 - DNA, 13 bp, Homo sapiens
atatgaatctgct

SEQ ID NO: 5247630 - DNA, 11 bp, Homo sapiens
atatgaatgaa

SEQ ID NO: 5247631 - DNA, 12 bp, Homo sapiens
atatgaatgaat

SEQ ID NO: 5247632 - DNA, 12 bp, Homo sapiens
atatgaatgtca

SEQ ID NO: 5247633 - DNA, 13 bp, Homo sapiens
atatgaatgtcac

SEQ ID NO: 5247634 - DNA, 16 bp, Homo sapiens
atatgaattgctgtct

SEQ ID NO: 5247635 - DNA, 14 bp, Homo sapiens
atatgacaaatgtt

SEQ ID NO: 5247636 - DNA, 16 bp, Homo sapiens
atatgacaaatgtttc

SEQ ID NO: 5247637 - DNA, 18 bp, Homo sapiens
atatgacaaatgtttcta

SEQ ID NO: 5247638 - DNA, 19 bp, Homo sapiens
atatgacaatttcaaaatg

SEQ ID NO: 5247639 - DNA, 20 bp, Homo sapiens
atatgacacagcttgtgaat

SEQ ID NO: 5247640 - DNA, 21 bp, Homo sapiens
atatgacagctgtccctgtca

SEQ ID NO: 5247641 - DNA, 15 bp, Homo sapiens
atatgaccagaagcc

SEQ ID NO: 5247642 - DNA, 18 bp, Homo sapiens
atatgaccattgaaaaag

SEQ ID NO: 5247643 - DNA, 23 bp, Homo sapiens
atatgaccattgaaaaaggaaaa

SEQ ID NO: 5247644 - DNA, 23 bp, Homo sapiens
atatgacggaagaacatagaact

SEQ ID NO: 5247645 - DNA, 16 bp, Homo sapiens
atatgactaattcagg

SEQ ID NO: 5247646 - DNA, 16 bp, Homo sapiens
atatgactgcatttgt

SEQ ID NO: 5247647 - DNA, 21 bp, Homo sapiens
atatgacttcctagggatctg

SEQ ID NO: 5247648 - DNA, 15 bp, Homo sapiens
atatgacttcttgtt

SEQ ID NO: 5247649 - DNA, 19 bp, Homo sapiens
atatgacttcttgttcatg

SEQ ID NO: 5247650 - DNA, 22 bp, Homo sapiens
atatgagaaatataaaaataat

SEQ ID NO: 5247651 - DNA, 17 bp, Homo sapiens
atatgagagaactattg

SEQ ID NO: 5247652 - DNA, 13 bp, Homo sapiens
atatgagagggat

SEQ ID NO: 5247653 - DNA, 14 bp, Homo sapiens
atatgagattggaa

SEQ ID NO: 5247654 - DNA, 16 bp, Homo sapiens
atatgagattggaaaa

SEQ ID NO: 5247655 - DNA, 18 bp, Homo sapiens
atatgagattggaaaaaa

SEQ ID NO: 5247656 - DNA, 13 bp, Homo sapiens
atatgagcttcaa

SEQ ID NO: 5247657 - DNA, 20 bp, Homo sapiens
atatgagcttcaatataaga

SEQ ID NO: 5247658 - DNA, 16 bp, Homo sapiens
atatgagctttcgttg

SEQ ID NO: 5247659 - DNA, 16 bp, Homo sapiens
atatgaggagacattc

SEQ ID NO: 5247660 - DNA, 21 bp, Homo sapiens
atatgaggagacattctgtct

SEQ ID NO: 5247661 - DNA, 16 bp, Homo sapiens
atatgaggatgtatgt

SEQ ID NO: 5247662 - DNA, 17 bp, Homo sapiens
atatgaggatgtatgtg

SEQ ID NO: 5247663 - DNA, 19 bp, Homo sapiens
atatgaggatgtatgtgta

SEQ ID NO: 5247664 - DNA, 15 bp, Homo sapiens
atatgaggggaccca

SEQ ID NO: 5247665 - DNA, 19 bp, Homo sapiens
atatgagtagatactctca

SEQ ID NO: 5247666 - DNA, 20 bp, Homo sapiens
atatgagtagatactctcag

SEQ ID NO: 5247667 - DNA, 13 bp, Homo sapiens
atatgagtataca

SEQ ID NO: 5247668 - DNA, 14 bp, Homo sapiens
atatgagtatacaa

SEQ ID NO: 5247669 - DNA, 12 bp, Homo sapiens
atcctgtgaagt

SEQ ID NO: 5247670 - DNA, 16 bp, Homo sapiens
atcctgtgaagtaagg

SEQ ID NO: 5247671 - DNA, 15 bp, Homo sapiens
atcctgtgacatgta

SEQ ID NO: 5247672 - DNA, 18 bp, Homo sapiens
atcctgtgacatgtaaca

SEQ ID NO: 5247673 - DNA, 11 bp, Homo sapiens
atcctgtgact

SEQ ID NO: 5247674 - DNA, 21 bp, Homo sapiens
atcctgtgaggagccccatct

SEQ ID NO: 5247675 - DNA, 14 bp, Homo sapiens
atcctgtgctacag

SEQ ID NO: 5247676 - DNA, 23 bp, Homo sapiens
atcctgtgctatgctggacatta

SEQ ID NO: 5247677 - DNA, 17 bp, Homo sapiens
atcctgtggtcactgac

SEQ ID NO: 5247678 - DNA, 23 bp, Homo sapiens
atcctgtgtaacacttggctctt

SEQ ID NO: 5247679 - DNA, 21 bp, Homo sapiens
atcctgtgtacctcactgtcc

SEQ ID NO: 5247680 - DNA, 19 bp, Homo sapiens
atcctgtgtcccctgacct

SEQ ID NO: 5247681 - DNA, 21 bp, Homo sapiens
atcctgtgtccccttcatcct

SEQ ID NO: 5247682 - DNA, 14 bp, Homo sapiens
atcctgtgtggaga

SEQ ID NO: 5247683 - DNA, 18 bp, Homo sapiens
atcctgtgtggagaggga

SEQ ID NO: 5247684 - DNA, 22 bp, Homo sapiens
atcctgtgtggagagggaatgt

SEQ ID NO: 5247685 - DNA, 19 bp, Homo sapiens
atcctgtgtggggaggcag

SEQ ID NO: 5247686 - DNA, 21 bp, Homo sapiens
atcctgtgtggtttagtgtaa

SEQ ID NO: 5247687 - DNA, 11 bp, Homo sapiens
atcctgtgtgt

SEQ ID NO: 5247688 - DNA, 22 bp, Homo sapiens
atcctgtgtgtctttttttact

SEQ ID NO: 5247689 - DNA, 12 bp, Homo sapiens
atcctgtgtgtt

SEQ ID NO: 5247690 - DNA, 23 bp, Homo sapiens
atcctgtgtttcattacttgaat

SEQ ID NO: 5247691 - DNA, 18 bp, Homo sapiens
atcctgttaaattttctc

SEQ ID NO: 5247692 - DNA, 16 bp, Homo sapiens
atcctgttaacactgt

SEQ ID NO: 5247693 - DNA, 17 bp, Homo sapiens
atcctgttactctgtcc

SEQ ID NO: 5247694 - DNA, 22 bp, Homo sapiens
atcctgttacttgcttcagtgg

SEQ ID NO: 5247695 - DNA, 15 bp, Homo sapiens
atcctgttctgcgct

SEQ ID NO: 5247696 - DNA, 15 bp, Homo sapiens
atcctgttgaaaagc

SEQ ID NO: 5247697 - DNA, 17 bp, Homo sapiens
atcctgttgaaaagcca

SEQ ID NO: 5247698 - DNA, 14 bp, Homo sapiens
atcctgtttcagct

SEQ ID NO: 5247699 - DNA, 22 bp, Homo sapiens
atcctgtttgtatttttttcca

SEQ ID NO: 5247700 - DNA, 23 bp, Homo sapiens
atcctgtttgtatttttttccaa

SEQ ID NO: 5247701 - DNA, 16 bp, Homo sapiens
atcctgttttctctgt

SEQ ID NO: 5247702 - DNA, 18 bp, Homo sapiens
atcctgttttctctgtga

SEQ ID NO: 5247703 - DNA, 22 bp, Homo sapiens
atccttaaaaagaccatgcatt

SEQ ID NO: 5247704 - DNA, 14 bp, Homo sapiens
atccttaaattatt

SEQ ID NO: 5247705 - DNA, 14 bp, Homo sapiens
atccttaacatttc

SEQ ID NO: 5247706 - DNA, 20 bp, Homo sapiens
atccttaacatttctctcca

SEQ ID NO: 5247707 - DNA, 20 bp, Homo sapiens
atccttaagaattccatcta

SEQ ID NO: 5247708 - DNA, 22 bp, Homo sapiens
atccttaagagaagaaatgtta

SEQ ID NO: 5247709 - DNA, 16 bp, Homo sapiens
atccttacaaatgatt

SEQ ID NO: 5247710 - DNA, 21 bp, Homo sapiens
atccttacaaatgattgcttt

SEQ ID NO: 5247711 - DNA, 13 bp, Homo sapiens
atccttacaagtt

SEQ ID NO: 5247712 - DNA, 16 bp, Homo sapiens
atccttacatttcacc

SEQ ID NO: 5247713 - DNA, 17 bp, Homo sapiens
atccttacatttcacct

SEQ ID NO: 5247714 - DNA, 15 bp, Homo sapiens
atccttactgatatt

SEQ ID NO: 5247715 - DNA, 13 bp, Homo sapiens
atccttacttcca

SEQ ID NO: 5247716 - DNA, 16 bp, Homo sapiens
atccttacttccagca

SEQ ID NO: 5247717 - DNA, 21 bp, Homo sapiens
atccttagatgtgtctcctgt

SEQ ID NO: 5247718 - DNA, 21 bp, Homo sapiens
atccttaggaaaatgcttctg

SEQ ID NO: 5247719 - DNA, 23 bp, Homo sapiens
atccttaggaaaatgcttctgtt

SEQ ID NO: 5247720 - DNA, 21 bp, Homo sapiens
atccttataggcctgtccctt

SEQ ID NO: 5247721 - DNA, 20 bp, Homo sapiens
atccttatcagagctaaggg

SEQ ID NO: 5247722 - DNA, 16 bp, Homo sapiens
atccttatctataaaa

SEQ ID NO: 5247723 - DNA, 23 bp, Homo sapiens
atccttatgagactcttaaatat

SEQ ID NO: 5247724 - DNA, 17 bp, Homo sapiens
atccttatgcatgaaat

SEQ ID NO: 5247725 - DNA, 16 bp, Homo sapiens
atccttatgccacccc

SEQ ID NO: 5247726 - DNA, 20 bp, Homo sapiens
atccttcaaaataaaaagta

SEQ ID NO: 5247727 - DNA, 20 bp, Homo sapiens
atccttcacaggcagtgcat

SEQ ID NO: 5247728 - DNA, 21 bp, Homo sapiens
atccttcacaggcagtgcatg

SEQ ID NO: 5247729 - DNA, 23 bp, Homo sapiens
atccttcacaggcagtgcatgtg

SEQ ID NO: 5247730 - DNA, 20 bp, Homo sapiens
atccttcaccagagcccatg

SEQ ID NO: 5247731 - DNA, 14 bp, Homo sapiens
atccttcagcacag

SEQ ID NO: 5247732 - DNA, 21 bp, Homo sapiens
atccttcaggtcccctggccc

SEQ ID NO: 5247733 - DNA, 22 bp, Homo sapiens
atccttcaggtcccctggccct

SEQ ID NO: 5247734 - DNA, 19 bp, Homo sapiens
atccttcattatccacccc

SEQ ID NO: 5247735 - DNA, 12 bp, Homo sapiens
atccttcattgt

SEQ ID NO: 5247736 - DNA, 19 bp, Homo sapiens
atccttcattttagattaa

SEQ ID NO: 5247737 - DNA, 19 bp, Homo sapiens
atccttccaaaaaattaaa

SEQ ID NO: 5247738 - DNA, 18 bp, Homo sapiens
atccttccaaaaattatt

SEQ ID NO: 5247739 - DNA, 20 bp, Homo sapiens
atccttccaaaaattattat

SEQ ID NO: 5247740 - DNA, 18 bp, Homo sapiens
atccttccaaagaattct

SEQ ID NO: 5247741 - DNA, 16 bp, Homo sapiens
atccttccacctcagt

SEQ ID NO: 5247742 - DNA, 16 bp, Homo sapiens
atccttccatcctgag

SEQ ID NO: 5247743 - DNA, 16 bp, Homo sapiens
atccttccattccaca

SEQ ID NO: 5247744 - DNA, 14 bp, Homo sapiens
atccttccatttct

SEQ ID NO: 5247745 - DNA, 15 bp, Homo sapiens
atccttccatttctt

SEQ ID NO: 5247746 - DNA, 22 bp, Homo sapiens
atccttcccaaggtacagctgt

SEQ ID NO: 5247747 - DNA, 23 bp, Homo sapiens
atccttcccaagtaagaggctgg

SEQ ID NO: 5247748 - DNA, 14 bp, Homo sapiens
atccttcccagcag

SEQ ID NO: 5247749 - DNA, 11 bp, Homo sapiens
atccttcccca

SEQ ID NO: 5247750 - DNA, 23 bp, Homo sapiens
atccttcccgcagcaccagcctg

SEQ ID NO: 5247751 - DNA, 16 bp, Homo sapiens
atccttccctttggag

SEQ ID NO: 5247752 - DNA, 15 bp, Homo sapiens
atccttcctaaaccc

SEQ ID NO: 5247753 - DNA, 18 bp, Homo sapiens
atccttcctactttgctt

SEQ ID NO: 5247754 - DNA, 20 bp, Homo sapiens
atccttcctactttgcttct

SEQ ID NO: 5247755 - DNA, 14 bp, Homo sapiens
atccttcctataac

SEQ ID NO: 5247756 - DNA, 20 bp, Homo sapiens
atccttcctataacttgatg

SEQ ID NO: 5247757 - DNA, 14 bp, Homo sapiens
atccttcctgggga

SEQ ID NO: 5247758 - DNA, 14 bp, Homo sapiens
atccttccttccca

SEQ ID NO: 5247759 - DNA, 19 bp, Homo sapiens
atccttcgtgaacatcccc

SEQ ID NO: 5247760 - DNA, 23 bp, Homo sapiens
atccttcgtgaacatcccctccc

SEQ ID NO: 5247761 - DNA, 22 bp, Homo sapiens
atccttctaaagtgctgggatt

SEQ ID NO: 5247762 - DNA, 18 bp, Homo sapiens
atccttctaactaaacta

SEQ ID NO: 5247763 - DNA, 13 bp, Homo sapiens
atccttctaatct

SEQ ID NO: 5247764 - DNA, 12 bp, Homo sapiens
atccttctagtt

SEQ ID NO: 5247765 - DNA, 19 bp, Homo sapiens
atccttctagtttcccaca

SEQ ID NO: 5247766 - DNA, 17 bp, Homo sapiens
atccttctcattaccca

SEQ ID NO: 5247767 - DNA, 21 bp, Homo sapiens
atccttctctttcaatgtgtt

SEQ ID NO: 5247768 - DNA, 11 bp, Homo sapiens
atccttctgcc

SEQ ID NO: 5247769 - DNA, 19 bp, Homo sapiens
atccttctggctgtagata

SEQ ID NO: 5247770 - DNA, 16 bp, Homo sapiens
atccttcttccactgt

SEQ ID NO: 5247771 - DNA, 17 bp, Homo sapiens
atccttcttggcttcct

SEQ ID NO: 5247772 - DNA, 23 bp, Homo sapiens
atccttcttggcttcctggcgcc

SEQ ID NO: 5247773 - DNA, 13 bp, Homo sapiens
atccttctttcct

SEQ ID NO: 5247774 - DNA, 14 bp, Homo sapiens
atccttctttcctt

SEQ ID NO: 5247775 - DNA, 15 bp, Homo sapiens
atccttgaactgtca

SEQ ID NO: 5247776 - DNA, 16 bp, Homo sapiens
atccttgaactgtcag

SEQ ID NO: 5247777 - DNA, 14 bp, Homo sapiens
atccttgaaggtat

SEQ ID NO: 5247778 - DNA, 18 bp, Homo sapiens
atccttgagattctgaag

SEQ ID NO: 5247779 - DNA, 21 bp, Homo sapiens
atccttgcagtttaagatgac

SEQ ID NO: 5247780 - DNA, 13 bp, Homo sapiens
atccttgcctgtc

SEQ ID NO: 5247781 - DNA, 19 bp, Homo sapiens
atccttgcctgtctaaagc

SEQ ID NO: 5247782 - DNA, 18 bp, Homo sapiens
atccttgctgcagcttct

SEQ ID NO: 5247783 - DNA, 22 bp, Homo sapiens
atccttggaaaccgtgtgtcca

SEQ ID NO: 5247784 - DNA, 24 bp, Homo sapiens
atccttggaaaccgtgtgtccagc

SEQ ID NO: 5247785 - DNA, 19 bp, Homo sapiens
atccttggactgagaaatt

SEQ ID NO: 5247786 - DNA, 14 bp, Homo sapiens
atccttggagagca

SEQ ID NO: 5247787 - DNA, 18 bp, Homo sapiens
atccttggagtcccaggg

SEQ ID NO: 5247788 - DNA, 23 bp, Homo sapiens
atccttggagtcccaggggcagc

SEQ ID NO: 5247789 - DNA, 15 bp, Homo sapiens
atccttggcaccaaa

SEQ ID NO: 5247790 - DNA, 12 bp, Homo sapiens
atccttggctga

SEQ ID NO: 5247791 - DNA, 17 bp, Homo sapiens
atccttgggggctccca

SEQ ID NO: 5247792 - DNA, 22 bp, Homo sapiens
atccttgggggctcccagggca

SEQ ID NO: 5247793 - DNA, 18 bp, Homo sapiens
atccttggtgctcttgct

SEQ ID NO: 5247794 - DNA, 15 bp, Homo sapiens
atccttggtgctgtg

SEQ ID NO: 5247795 - DNA, 18 bp, Homo sapiens
atccttggtgctgtgtgc

SEQ ID NO: 5247796 - DNA, 13 bp, Homo sapiens
atccttgtaatac

SEQ ID NO: 5247797 - DNA, 23 bp, Homo sapiens
atccttgtctttactgacaagaa

SEQ ID NO: 5247798 - DNA, 19 bp, Homo sapiens
atccttgtgacttacaatt

SEQ ID NO: 5247799 - DNA, 21 bp, Homo sapiens
atccttgtgacttacaatttg

SEQ ID NO: 5247800 - DNA, 19 bp, Homo sapiens
atccttgtgtttatcagaa

SEQ ID NO: 5247801 - DNA, 18 bp, Homo sapiens
atccttgttgaagttttt

SEQ ID NO: 5247802 - DNA, 21 bp, Homo sapiens
atccttgttttgtgacatttt

SEQ ID NO: 5247803 - DNA, 19 bp, Homo sapiens
atcctttagggttctgcct

SEQ ID NO: 5247804 - DNA, 21 bp, Homo sapiens
atcctttagggttctgcctct

SEQ ID NO: 5247805 - DNA, 22 bp, Homo sapiens
atcctttatacagttgtataaa

SEQ ID NO: 5247806 - DNA, 20 bp, Homo sapiens
atcctttcaaaagaagagtt

SEQ ID NO: 5247807 - DNA, 20 bp, Homo sapiens
atcctttcacttctttccct

SEQ ID NO: 5247808 - DNA, 20 bp, Homo sapiens
atcctttcatatagttagct

SEQ ID NO: 5247809 - DNA, 14 bp, Homo sapiens
atcctttccagcat

SEQ ID NO: 5247810 - DNA, 19 bp, Homo sapiens
atcctttcctcattaaatt

SEQ ID NO: 5247811 - DNA, 22 bp, Homo sapiens
atcctttcctcattaaattacc

SEQ ID NO: 5247812 - DNA, 21 bp, Homo sapiens
atcctttcctctagcttttct

SEQ ID NO: 5247813 - DNA, 23 bp, Homo sapiens
atcctttcctctagcttttctat

SEQ ID NO: 5247814 - DNA, 15 bp, Homo sapiens
atcctttctaaacaa

SEQ ID NO: 5247815 - DNA, 15 bp, Homo sapiens
atcctttctattgaa

SEQ ID NO: 5247816 - DNA, 15 bp, Homo sapiens
atcctttctgccccc

SEQ ID NO: 5247817 - DNA, 20 bp, Homo sapiens
atcctttctgccccccaggg

SEQ ID NO: 5247818 - DNA, 23 bp, Homo sapiens
atcctttctgccccccagggcta

SEQ ID NO: 5247819 - DNA, 19 bp, Homo sapiens
atcctttctgcctctcaac

SEQ ID NO: 5247820 - DNA, 19 bp, Homo sapiens
atcctttgactgtgctgga

SEQ ID NO: 5247821 - DNA, 17 bp, Homo sapiens
atcctttgagaatgtga

SEQ ID NO: 5247822 - DNA, 15 bp, Homo sapiens
atcctttgcagggca

SEQ ID NO: 5247823 - DNA, 12 bp, Homo sapiens
atcctttgcatt

SEQ ID NO: 5247824 - DNA, 16 bp, Homo sapiens
atcctttgcatttctc

SEQ ID NO: 5247825 - DNA, 17 bp, Homo sapiens
atcctttgcatttctct

SEQ ID NO: 5247826 - DNA, 14 bp, Homo sapiens
atcctttgccccaa

SEQ ID NO: 5247827 - DNA, 22 bp, Homo sapiens
atcctttggggcttctgtgaaa

SEQ ID NO: 5247828 - DNA, 18 bp, Homo sapiens
atcctttggtcctggtgc

SEQ ID NO: 5247829 - DNA, 23 bp, Homo sapiens
atcctttgttttctgactaatta

SEQ ID NO: 5247830 - DNA, 18 bp, Homo sapiens
atccttttatctcacaaa

SEQ ID NO: 5247831 - DNA, 14 bp, Homo sapiens
atccttttcctaat

SEQ ID NO: 5247832 - DNA, 21 bp, Homo sapiens
atccttttccttatttgcctt

SEQ ID NO: 5247833 - DNA, 21 bp, Homo sapiens
atccttttctcatttggggag

SEQ ID NO: 5247834 - DNA, 15 bp, Homo sapiens
atccttttctgcaga

SEQ ID NO: 5247835 - DNA, 22 bp, Homo sapiens
atccttttgaaggtagttgcaa

SEQ ID NO: 5247836 - DNA, 21 bp, Homo sapiens
atccttttgcttcatctggag

SEQ ID NO: 5247837 - DNA, 11 bp, Homo sapiens
atccttttgta

SEQ ID NO: 5247838 - DNA, 22 bp, Homo sapiens
atcctttttaaattcagtccta

SEQ ID NO: 5247839 - DNA, 16 bp, Homo sapiens
atcctttttccatcat

SEQ ID NO: 5247840 - DNA, 17 bp, Homo sapiens
atcctttttccatcatt

SEQ ID NO: 5247841 - DNA, 14 bp, Homo sapiens
atcctttttctgct

SEQ ID NO: 5247842 - DNA, 15 bp, Homo sapiens
atccttttttctctt

SEQ ID NO: 5247843 - DNA, 17 bp, Homo sapiens
atcgaaataacaatgtt

SEQ ID NO: 5247844 - DNA, 22 bp, Homo sapiens
atcgaaataacaatgttaagga

SEQ ID NO: 5247845 - DNA, 15 bp, Homo sapiens
atatgagtatacaat

SEQ ID NO: 5247846 - DNA, 16 bp, Homo sapiens
atatgagtatacaata

SEQ ID NO: 5247847 - DNA, 22 bp, Homo sapiens
atatgagtatacaatatataaa

SEQ ID NO: 5247848 - DNA, 15 bp, Homo sapiens
atatgatactgatgc

SEQ ID NO: 5247849 - DNA, 22 bp, Homo sapiens
atatgatagcgggaaaaggaga

SEQ ID NO: 5247850 - DNA, 18 bp, Homo sapiens
atatgatatatatgtata

SEQ ID NO: 5247851 - DNA, 12 bp, Homo sapiens
atatgatatgca

SEQ ID NO: 5247852 - DNA, 14 bp, Homo sapiens
atatgatatgtaaa

SEQ ID NO: 5247853 - DNA, 16 bp, Homo sapiens
atatgatatgtaaaca

SEQ ID NO: 5247854 - DNA, 15 bp, Homo sapiens
atatgatccagagca

SEQ ID NO: 5247855 - DNA, 16 bp, Homo sapiens
atatgatctgtggaga

SEQ ID NO: 5247856 - DNA, 16 bp, Homo sapiens
atatgatgactgtttt

SEQ ID NO: 5247857 - DNA, 12 bp, Homo sapiens
atatgatgagca

SEQ ID NO: 5247858 - DNA, 15 bp, Homo sapiens
atatgatgcaaactg

SEQ ID NO: 5247859 - DNA, 17 bp, Homo sapiens
atatgatgcaaactgtg

SEQ ID NO: 5247860 - DNA, 14 bp, Homo sapiens
atatgatgtttaaa

SEQ ID NO: 5247861 - DNA, 18 bp, Homo sapiens
atatgatgtttaaaagca

SEQ ID NO: 5247862 - DNA, 21 bp, Homo sapiens
atatgattctagtacataatt

SEQ ID NO: 5247863 - DNA, 16 bp, Homo sapiens
atatgattctcctctc

SEQ ID NO: 5247864 - DNA, 18 bp, Homo sapiens
atatgattctcctctccc

SEQ ID NO: 5247865 - DNA, 19 bp, Homo sapiens
atatgattctcctctccca

SEQ ID NO: 5247866 - DNA, 12 bp, Homo sapiens
atatgattctct

SEQ ID NO: 5247867 - DNA, 14 bp, Homo sapiens
atatgattgaaaag

SEQ ID NO: 5247868 - DNA, 20 bp, Homo sapiens
atatgattgaaaagaagaaa

SEQ ID NO: 5247869 - DNA, 21 bp, Homo sapiens
atatgattgtaacatatttct

SEQ ID NO: 5247870 - DNA, 23 bp, Homo sapiens
atatgattgtataatgtgatttt

SEQ ID NO: 5247871 - DNA, 13 bp, Homo sapiens
atatgattgtatt

SEQ ID NO: 5247872 - DNA, 21 bp, Homo sapiens
atatgattgtatttaaaggta

SEQ ID NO: 5247873 - DNA, 13 bp, Homo sapiens
atatgattgtttc

SEQ ID NO: 5247874 - DNA, 16 bp, Homo sapiens
atatgatttaaaacat

SEQ ID NO: 5247875 - DNA, 13 bp, Homo sapiens
atatgatttgcat

SEQ ID NO: 5247876 - DNA, 16 bp, Homo sapiens
atatgatttgcatgtg

SEQ ID NO: 5247877 - DNA, 21 bp, Homo sapiens
atatgatttgcatgtgtaaat

SEQ ID NO: 5247878 - DNA, 14 bp, Homo sapiens
atatgatttgcatt

SEQ ID NO: 5247879 - DNA, 13 bp, Homo sapiens
atatgattttata

SEQ ID NO: 5247880 - DNA, 22 bp, Homo sapiens
atatgattttatttgacaaaat

SEQ ID NO: 5247881 - DNA, 16 bp, Homo sapiens
atatgattttttaaaa

SEQ ID NO: 5247882 - DNA, 17 bp, Homo sapiens
atatgattttttaaaag

SEQ ID NO: 5247883 - DNA, 20 bp, Homo sapiens
atatgcaaaaatgacccaag

SEQ ID NO: 5247884 - DNA, 14 bp, Homo sapiens
atatgcaaagcact

SEQ ID NO: 5247885 - DNA, 15 bp, Homo sapiens
atatgcaaagcactg

SEQ ID NO: 5247886 - DNA, 13 bp, Homo sapiens
atatgcaacctgt

SEQ ID NO: 5247887 - DNA, 16 bp, Homo sapiens
atatgcaacctgtgca

SEQ ID NO: 5247888 - DNA, 17 bp, Homo sapiens
atatgcaagcagctttt

SEQ ID NO: 5247889 - DNA, 19 bp, Homo sapiens
atatgcaagtgaacaaagt

SEQ ID NO: 5247890 - DNA, 17 bp, Homo sapiens
atatgcaataaatatta

SEQ ID NO: 5247891 - DNA, 18 bp, Homo sapiens
atatgcaatcactgaaaa

SEQ ID NO: 5247892 - DNA, 16 bp, Homo sapiens
atatgcaatgtgaagc

SEQ ID NO: 5247893 - DNA, 19 bp, Homo sapiens
atatgcacaaaactacttt

SEQ ID NO: 5247894 - DNA, 23 bp, Homo sapiens
atatgcacaaaactacttttcta

SEQ ID NO: 5247895 - DNA, 16 bp, Homo sapiens
atatgcacacattttt

SEQ ID NO: 5247896 - DNA, 20 bp, Homo sapiens
atatgcaccttgtgtctgta

SEQ ID NO: 5247897 - DNA, 19 bp, Homo sapiens
atatgcactaagtctcttt

SEQ ID NO: 5247898 - DNA, 23 bp, Homo sapiens
atatgcactaagtctctttttta

SEQ ID NO: 5247899 - DNA, 19 bp, Homo sapiens
atatgcactttccctagaa

SEQ ID NO: 5247900 - DNA, 18 bp, Homo sapiens
atatgcagaaatagacaa

SEQ ID NO: 5247901 - DNA, 17 bp, Homo sapiens
atatgcagaacgtattt

SEQ ID NO: 5247902 - DNA, 21 bp, Homo sapiens
atatgcagaacgtatttagcc

SEQ ID NO: 5247903 - DNA, 15 bp, Homo sapiens
atatgcagatactta

SEQ ID NO: 5247904 - DNA, 17 bp, Homo sapiens
atatgcagattttgccc

SEQ ID NO: 5247905 - DNA, 20 bp, Homo sapiens
atatgcagtaaaagaaagaa

SEQ ID NO: 5247906 - DNA, 17 bp, Homo sapiens
atatgcagtctctttat

SEQ ID NO: 5247907 - DNA, 13 bp, Homo sapiens
atatgcatatata

SEQ ID NO: 5247908 - DNA, 14 bp, Homo sapiens
atatgcatatatat

SEQ ID NO: 5247909 - DNA, 19 bp, Homo sapiens
atatgcatatatatatgtg

SEQ ID NO: 5247910 - DNA, 18 bp, Homo sapiens
atatgcatatatatgtat

SEQ ID NO: 5247911 - DNA, 19 bp, Homo sapiens
atatgcatatatatgtata

SEQ ID NO: 5247912 - DNA, 14 bp, Homo sapiens
atatgcatatttgt

SEQ ID NO: 5247913 - DNA, 18 bp, Homo sapiens
atatgcatcccacagcca

SEQ ID NO: 5247914 - DNA, 15 bp, Homo sapiens
atatgcatgcacagg

SEQ ID NO: 5247915 - DNA, 14 bp, Homo sapiens
atatgcatgtactt

SEQ ID NO: 5247916 - DNA, 15 bp, Homo sapiens
atatgcatgtagcat

SEQ ID NO: 5247917 - DNA, 15 bp, Homo sapiens
atatgcatgtgtgtg

SEQ ID NO: 5247918 - DNA, 15 bp, Homo sapiens
atatgcattcaagag

SEQ ID NO: 5247919 - DNA, 20 bp, Homo sapiens
atatgcattgtctgcaatgg

SEQ ID NO: 5247920 - DNA, 15 bp, Homo sapiens
atatgcatttaattc

SEQ ID NO: 5247921 - DNA, 17 bp, Homo sapiens
atatgccaccgattgca

SEQ ID NO: 5247922 - DNA, 18 bp, Homo sapiens
atatgccactaacttcta

SEQ ID NO: 5247923 - DNA, 13 bp, Homo sapiens
atatgccactgac

SEQ ID NO: 5247924 - DNA, 19 bp, Homo sapiens
atatgcccacatttagtct

SEQ ID NO: 5247925 - DNA, 21 bp, Homo sapiens
atatgcccacatttagtctct

SEQ ID NO: 5247926 - DNA, 22 bp, Homo sapiens
atatgcccattcttttcacttc

SEQ ID NO: 5247927 - DNA, 20 bp, Homo sapiens
atatgcctacttgtaatttc

SEQ ID NO: 5247928 - DNA, 21 bp, Homo sapiens
atatgcctacttgtaatttct

SEQ ID NO: 5247929 - DNA, 20 bp, Homo sapiens
atatgcctgaccccttgctc

SEQ ID NO: 5247930 - DNA, 16 bp, Homo sapiens
atatgccttatgtaat

SEQ ID NO: 5247931 - DNA, 15 bp, Homo sapiens
atatgctaaatgtta

SEQ ID NO: 5247932 - DNA, 16 bp, Homo sapiens
atatgctaccaccagc

SEQ ID NO: 5247933 - DNA, 16 bp, Homo sapiens
atatgctatttctata

SEQ ID NO: 5247934 - DNA, 23 bp, Homo sapiens
atatgctatttctatattttcat

SEQ ID NO: 5247935 - DNA, 16 bp, Homo sapiens
atatgctctgcatgtt

SEQ ID NO: 5247936 - DNA, 14 bp, Homo sapiens
atatgctctgcttt

SEQ ID NO: 5247937 - DNA, 17 bp, Homo sapiens
atatgctctgcttttag

SEQ ID NO: 5247938 - DNA, 11 bp, Homo sapiens
atatgctcttt

SEQ ID NO: 5247939 - DNA, 14 bp, Homo sapiens
atatgctgagaaat

SEQ ID NO: 5247940 - DNA, 16 bp, Homo sapiens
atatgctgatctttta

SEQ ID NO: 5247941 - DNA, 17 bp, Homo sapiens
atatgctgatcttttaa

SEQ ID NO: 5247942 - DNA, 11 bp, Homo sapiens
atatgctgcat

SEQ ID NO: 5247943 - DNA, 12 bp, Homo sapiens
atatgctgctca

SEQ ID NO: 5247944 - DNA, 16 bp, Homo sapiens
atatgctgcttgtgac

SEQ ID NO: 5247945 - DNA, 14 bp, Homo sapiens
atatgctgttatgt

SEQ ID NO: 5247946 - DNA, 16 bp, Homo sapiens
atatgcttaaaataag

SEQ ID NO: 5247947 - DNA, 18 bp, Homo sapiens
atatgcttaaaataagca

SEQ ID NO: 5247948 - DNA, 13 bp, Homo sapiens
atatgcttagtaa

SEQ ID NO: 5247949 - DNA, 19 bp, Homo sapiens
atatgcttgtaactaaaat

SEQ ID NO: 5247950 - DNA, 13 bp, Homo sapiens
atatgctttacac

SEQ ID NO: 5247951 - DNA, 14 bp, Homo sapiens
atatgctttattaa

SEQ ID NO: 5247952 - DNA, 19 bp, Homo sapiens
atatgctttattaatgttt

SEQ ID NO: 5247953 - DNA, 19 bp, Homo sapiens
atatgcttttggaagttaa

SEQ ID NO: 5247954 - DNA, 17 bp, Homo sapiens
atatgctttttctcaga

SEQ ID NO: 5247955 - DNA, 20 bp, Homo sapiens
atatgcttttttgcaataag

SEQ ID NO: 5247956 - DNA, 17 bp, Homo sapiens
atatggaaaaaatgtat

SEQ ID NO: 5247957 - DNA, 20 bp, Homo sapiens
atatggaaaaaatgtatgtg

SEQ ID NO: 5247958 - DNA, 23 bp, Homo sapiens
atatggaaatatatattatactt

SEQ ID NO: 5247959 - DNA, 19 bp, Homo sapiens
atatggaaatcttttacat

SEQ ID NO: 5247960 - DNA, 19 bp, Homo sapiens
atatggaaccttccctcca

SEQ ID NO: 5247961 - DNA, 15 bp, Homo sapiens
atatggaactgtaat

SEQ ID NO: 5247962 - DNA, 20 bp, Homo sapiens
atatggaacttctaatatat

SEQ ID NO: 5247963 - DNA, 14 bp, Homo sapiens
atatggaagaaagt

SEQ ID NO: 5247964 - DNA, 15 bp, Homo sapiens
atatggaagaaagta

SEQ ID NO: 5247965 - DNA, 16 bp, Homo sapiens
atatggaagaaagtaa

SEQ ID NO: 5247966 - DNA, 17 bp, Homo sapiens
atatggaagataatttt

SEQ ID NO: 5247967 - DNA, 16 bp, Homo sapiens
atatggaagcaaccag

SEQ ID NO: 5247968 - DNA, 17 bp, Homo sapiens
atatggaataagtgtac

SEQ ID NO: 5247969 - DNA, 20 bp, Homo sapiens
atatggaataagtgtacata

SEQ ID NO: 5247970 - DNA, 16 bp, Homo sapiens
atatggacactgtgac

SEQ ID NO: 5247971 - DNA, 11 bp, Homo sapiens
atatggaccta

SEQ ID NO: 5247972 - DNA, 20 bp, Homo sapiens
atatggactcagccttgcaa

SEQ ID NO: 5247973 - DNA, 18 bp, Homo sapiens
atatggacttaaatgtta

SEQ ID NO: 5247974 - DNA, 15 bp, Homo sapiens
atatggagctcatgt

SEQ ID NO: 5247975 - DNA, 21 bp, Homo sapiens
atatggaggattctttcccca

SEQ ID NO: 5247976 - DNA, 23 bp, Homo sapiens
atatggaggattctttccccaga

SEQ ID NO: 5247977 - DNA, 21 bp, Homo sapiens
atatggagtgagtcacctgct

SEQ ID NO: 5247978 - DNA, 18 bp, Homo sapiens
atatggatattagtcata

SEQ ID NO: 5247979 - DNA, 16 bp, Homo sapiens
atatggatgtgtgtgt

SEQ ID NO: 5247980 - DNA, 12 bp, Homo sapiens
atatggatgtta

SEQ ID NO: 5247981 - DNA, 14 bp, Homo sapiens
atatggatgttact

SEQ ID NO: 5247982 - DNA, 22 bp, Homo sapiens
atatggattttctattgttact

SEQ ID NO: 5247983 - DNA, 18 bp, Homo sapiens
atatggcaacgttcatgt

SEQ ID NO: 5247984 - DNA, 18 bp, Homo sapiens
atatggcaagaaagctgg

SEQ ID NO: 5247985 - DNA, 20 bp, Homo sapiens
atatggcagggaagctttca

SEQ ID NO: 5247986 - DNA, 16 bp, Homo sapiens
atatggcatttgcaga

SEQ ID NO: 5247987 - DNA, 15 bp, Homo sapiens
atatggcctcaagat

SEQ ID NO: 5247988 - DNA, 16 bp, Homo sapiens
atatggcctcaagatc

SEQ ID NO: 5247989 - DNA, 21 bp, Homo sapiens
atatggcttcaccaagaagca

SEQ ID NO: 5247990 - DNA, 17 bp, Homo sapiens
atatggcttgtagggtg

SEQ ID NO: 5247991 - DNA, 21 bp, Homo sapiens
atatgggaacaaattagagga

SEQ ID NO: 5247992 - DNA, 15 bp, Homo sapiens
atatgggacattttt

SEQ ID NO: 5247993 - DNA, 14 bp, Homo sapiens
atatgggagaaata

SEQ ID NO: 5247994 - DNA, 17 bp, Homo sapiens
atatgggcattgtagtt

SEQ ID NO: 5247995 - DNA, 16 bp, Homo sapiens
atatggggatgcagca

SEQ ID NO: 5247996 - DNA, 20 bp, Homo sapiens
atatggggatggtagttttt

SEQ ID NO: 5247997 - DNA, 15 bp, Homo sapiens
atatgggggaaaatt

SEQ ID NO: 5247998 - DNA, 18 bp, Homo sapiens
atatgggggaaaattatt

SEQ ID NO: 5247999 - DNA, 22 bp, Homo sapiens
atatgggtttataattttctga

SEQ ID NO: 5248000 - DNA, 22 bp, Homo sapiens
atatggtactaaggagaattaa

SEQ ID NO: 5248001 - DNA, 21 bp, Homo sapiens
atatggtaggaccctcgagag

SEQ ID NO: 5248002 - DNA, 15 bp, Homo sapiens
atatggtatatatac

SEQ ID NO: 5248003 - DNA, 19 bp, Homo sapiens
atatggtcatatacatatt

SEQ ID NO: 5248004 - DNA, 15 bp, Homo sapiens
atatggtctaatgtt

SEQ ID NO: 5248005 - DNA, 16 bp, Homo sapiens
atatggtctaatgttt

SEQ ID NO: 5248006 - DNA, 23 bp, Homo sapiens
atatggtcttgagccagtaatct

SEQ ID NO: 5248007 - DNA, 16 bp, Homo sapiens
atatggtgaagggaag

SEQ ID NO: 5248008 - DNA, 16 bp, Homo sapiens
atatggtgcaaaaatg

SEQ ID NO: 5248009 - DNA, 23 bp, Homo sapiens
atatggtgcagagaagctggact

SEQ ID NO: 5248010 - DNA, 13 bp, Homo sapiens
atatggtggaaaa

SEQ ID NO: 5248011 - DNA, 14 bp, Homo sapiens
atatggtgtatttt

SEQ ID NO: 5248012 - DNA, 21 bp, Homo sapiens
atatggtgtcttgatatattt

SEQ ID NO: 5248013 - DNA, 14 bp, Homo sapiens
atatggttctccaa

SEQ ID NO: 5248014 - DNA, 19 bp, Homo sapiens
atatggttctccaagaaac

SEQ ID NO: 5248015 - DNA, 21 bp, Homo sapiens
atatggttggagagccctgga

SEQ ID NO: 5248016 - DNA, 15 bp, Homo sapiens
atatggtttggtttt

SEQ ID NO: 5248017 - DNA, 18 bp, Homo sapiens
atatggttttgttttcaa

SEQ ID NO: 5248018 - DNA, 21 bp, Homo sapiens
atatggttttgttttcaatga

SEQ ID NO: 5248019 - DNA, 14 bp, Homo sapiens
atatgtaaaacatt

SEQ ID NO: 5248020 - DNA, 14 bp, Homo sapiens
atatgtaaaataaa

SEQ ID NO: 5248021 - DNA, 15 bp, Homo sapiens
atatgtaaaattaca

SEQ ID NO: 5248022 - DNA, 22 bp, Homo sapiens
atatgtaaacagtgagaaaaga

SEQ ID NO: 5248023 - DNA, 13 bp, Homo sapiens
atatgtaaacttt

SEQ ID NO: 5248024 - DNA, 14 bp, Homo sapiens
atatgtaaacttta

SEQ ID NO: 5248025 - DNA, 15 bp, Homo sapiens
atcgaaatgaattta

SEQ ID NO: 5248026 - DNA, 20 bp, Homo sapiens
atcgaaatgacggtgttaat

SEQ ID NO: 5248027 - DNA, 17 bp, Homo sapiens
atcgaagggtttttaga

SEQ ID NO: 5248028 - DNA, 15 bp, Homo sapiens
atcgacagacagcca

SEQ ID NO: 5248029 - DNA, 19 bp, Homo sapiens
atcgacatcctagccccac

SEQ ID NO: 5248030 - DNA, 14 bp, Homo sapiens
atcgacctcactgt

SEQ ID NO: 5248031 - DNA, 16 bp, Homo sapiens
atcgactcaaaaataa

SEQ ID NO: 5248032 - DNA, 21 bp, Homo sapiens
atcgacttgtttttgcacatg

SEQ ID NO: 5248033 - DNA, 15 bp, Homo sapiens
atcgagagtttctat

SEQ ID NO: 5248034 - DNA, 15 bp, Homo sapiens
atcgaggaaccagag

SEQ ID NO: 5248035 - DNA, 11 bp, Homo sapiens
atcgagtgtag

SEQ ID NO: 5248036 - DNA, 16 bp, Homo sapiens
atcgagtgtagctgtg

SEQ ID NO: 5248037 - DNA, 17 bp, Homo sapiens
atcgagtgtagctgtga

SEQ ID NO: 5248038 - DNA, 14 bp, Homo sapiens
atcgatatgaaaaa

SEQ ID NO: 5248039 - DNA, 17 bp, Homo sapiens
atcgatatgaaaaataa

SEQ ID NO: 5248040 - DNA, 14 bp, Homo sapiens
atcgatatgtatat

SEQ ID NO: 5248041 - DNA, 19 bp, Homo sapiens
atcgatctggaaagagctg

SEQ ID NO: 5248042 - DNA, 16 bp, Homo sapiens
atcgatctgtactgta

SEQ ID NO: 5248043 - DNA, 14 bp, Homo sapiens
atcgatgaatgtaa

SEQ ID NO: 5248044 - DNA, 22 bp, Homo sapiens
atcgatgggaagggtagaaaac

SEQ ID NO: 5248045 - DNA, 20 bp, Homo sapiens
atcgatgttaaacgtcacag

SEQ ID NO: 5248046 - DNA, 21 bp, Homo sapiens
atcgatgttaaacgtcacagc

SEQ ID NO: 5248047 - DNA, 13 bp, Homo sapiens
atcgatgttatgt

SEQ ID NO: 5248048 - DNA, 15 bp, Homo sapiens
atcgatgttatgtaa

SEQ ID NO: 5248049 - DNA, 16 bp, Homo sapiens
atcgatgttttattat

SEQ ID NO: 5248050 - DNA, 18 bp, Homo sapiens
atcgattcaaactgctcc

SEQ ID NO: 5248051 - DNA, 11 bp, Homo sapiens
atcgattggct

SEQ ID NO: 5248052 - DNA, 12 bp, Homo sapiens
atcgattggctt

SEQ ID NO: 5248053 - DNA, 21 bp, Homo sapiens
atcgattgtgtacttttcctt

SEQ ID NO: 5248054 - DNA, 18 bp, Homo sapiens
atcgatttctttcctcca

SEQ ID NO: 5248055 - DNA, 15 bp, Homo sapiens
atcgatttgtattaa

SEQ ID NO: 5248056 - DNA, 16 bp, Homo sapiens
atcgcaacatgaattt

SEQ ID NO: 5248057 - DNA, 21 bp, Homo sapiens
atcgcaagttaacttggaaat

SEQ ID NO: 5248058 - DNA, 17 bp, Homo sapiens
atcgcaccattctgact

SEQ ID NO: 5248059 - DNA, 22 bp, Homo sapiens
atcgcaccttttataccagaga

SEQ ID NO: 5248060 - DNA, 17 bp, Homo sapiens
atcgcactctggcagca

SEQ ID NO: 5248061 - DNA, 22 bp, Homo sapiens
atcgcatcattgcactctagcc

SEQ ID NO: 5248062 - DNA, 15 bp, Homo sapiens
atcgcatcccggctg

SEQ ID NO: 5248063 - DNA, 14 bp, Homo sapiens
atcgcattgcatac

SEQ ID NO: 5248064 - DNA, 19 bp, Homo sapiens
atcgccaacttgtctctgt

SEQ ID NO: 5248065 - DNA, 21 bp, Homo sapiens
atcgccaacttgtctctgtag

SEQ ID NO: 5248066 - DNA, 19 bp, Homo sapiens
atcgccaaggactgactga

SEQ ID NO: 5248067 - DNA, 21 bp, Homo sapiens
atcgccaaggactgactgaga

SEQ ID NO: 5248068 - DNA, 14 bp, Homo sapiens
atcgccacaaactc

SEQ ID NO: 5248069 - DNA, 20 bp, Homo sapiens
atcgccagccctgggcctgg

SEQ ID NO: 5248070 - DNA, 19 bp, Homo sapiens
atcgccagctgatgactca

SEQ ID NO: 5248071 - DNA, 20 bp, Homo sapiens
atcgccaggactggtgaata

SEQ ID NO: 5248072 - DNA, 16 bp, Homo sapiens
atcgccataggccaag

SEQ ID NO: 5248073 - DNA, 20 bp, Homo sapiens
atcgccataggccaaggtgc

SEQ ID NO: 5248074 - DNA, 18 bp, Homo sapiens
atcgccatcttcttccct

SEQ ID NO: 5248075 - DNA, 14 bp, Homo sapiens
atcgccattccagg

SEQ ID NO: 5248076 - DNA, 23 bp, Homo sapiens
atcgcccaggcctgggatgcagt

SEQ ID NO: 5248077 - DNA, 15 bp, Homo sapiens
atcgccccaactcca

SEQ ID NO: 5248078 - DNA, 20 bp, Homo sapiens
atcgccccaactccaacctc

SEQ ID NO: 5248079 - DNA, 15 bp, Homo sapiens
atcgccccaccgcag

SEQ ID NO: 5248080 - DNA, 16 bp, Homo sapiens
atcgccccaccgcagc

SEQ ID NO: 5248081 - DNA, 16 bp, Homo sapiens
atcgcccgataaagac

SEQ ID NO: 5248082 - DNA, 13 bp, Homo sapiens
atcgccctccttt

SEQ ID NO: 5248083 - DNA, 21 bp, Homo sapiens
atcgcctgggacgcccctttc

SEQ ID NO: 5248084 - DNA, 13 bp, Homo sapiens
atcgccttcccca

SEQ ID NO: 5248085 - DNA, 21 bp, Homo sapiens
atcgcgccagcgacctctctg

SEQ ID NO: 5248086 - DNA, 20 bp, Homo sapiens
atcgcgccagtacattccaa

SEQ ID NO: 5248087 - DNA, 20 bp, Homo sapiens
atcgctaaagggaccatctg

SEQ ID NO: 5248088 - DNA, 18 bp, Homo sapiens
atcgctaagctggctctg

SEQ ID NO: 5248089 - DNA, 14 bp, Homo sapiens
atcgctcactgttg

SEQ ID NO: 5248090 - DNA, 14 bp, Homo sapiens
atcgctgatgcaga

SEQ ID NO: 5248091 - DNA, 18 bp, Homo sapiens
atcgctgatgcagacaca

SEQ ID NO: 5248092 - DNA, 18 bp, Homo sapiens
atcgctgcacatggcctg

SEQ ID NO: 5248093 - DNA, 21 bp, Homo sapiens
atcgctgggaaatgagatgac

SEQ ID NO: 5248094 - DNA, 16 bp, Homo sapiens
atcgctgtgatgctgg

SEQ ID NO: 5248095 - DNA, 22 bp, Homo sapiens
atcgctgtgtgttagttcccaa

SEQ ID NO: 5248096 - DNA, 21 bp, Homo sapiens
atcgctgttctgggcatggca

SEQ ID NO: 5248097 - DNA, 13 bp, Homo sapiens
atcgcttcttttt

SEQ ID NO: 5248098 - DNA, 18 bp, Homo sapiens
atcgcttgaacctgggaa

SEQ ID NO: 5248099 - DNA, 16 bp, Homo sapiens
atcgcttgagcccagg

SEQ ID NO: 5248100 - DNA, 17 bp, Homo sapiens
atcgctttatgtttttg

SEQ ID NO: 5248101 - DNA, 21 bp, Homo sapiens
atcgctttatgtttttggtta

SEQ ID NO: 5248102 - DNA, 13 bp, Homo sapiens
atcggaaaaataa

SEQ ID NO: 5248103 - DNA, 14 bp, Homo sapiens
atcggaagcagtgc

SEQ ID NO: 5248104 - DNA, 16 bp, Homo sapiens
atcggacattctaatg

SEQ ID NO: 5248105 - DNA, 18 bp, Homo sapiens
atcggacattctaatgca

SEQ ID NO: 5248106 - DNA, 20 bp, Homo sapiens
atcggactaaactatctgta

SEQ ID NO: 5248107 - DNA, 17 bp, Homo sapiens
atcggactctgcccctg

SEQ ID NO: 5248108 - DNA, 13 bp, Homo sapiens
atcggactgccaa

SEQ ID NO: 5248109 - DNA, 15 bp, Homo sapiens
atcggagcctcctct

SEQ ID NO: 5248110 - DNA, 17 bp, Homo sapiens
atcggagggaaacagaa

SEQ ID NO: 5248111 - DNA, 18 bp, Homo sapiens
atcggagttgacagtgaa

SEQ ID NO: 5248112 - DNA, 17 bp, Homo sapiens
atcggcagatgatgctt

SEQ ID NO: 5248113 - DNA, 15 bp, Homo sapiens
atcggcatttgtttc

SEQ ID NO: 5248114 - DNA, 23 bp, Homo sapiens
atcggccaagaatacttgaagaa

SEQ ID NO: 5248115 - DNA, 19 bp, Homo sapiens
atcggcccacagctcccac

SEQ ID NO: 5248116 - DNA, 20 bp, Homo sapiens
atcggcccacagctcccacc

SEQ ID NO: 5248117 - DNA, 14 bp, Homo sapiens
atcggccctgtccc

SEQ ID NO: 5248118 - DNA, 15 bp, Homo sapiens
atcggccctgtcccc

SEQ ID NO: 5248119 - DNA, 17 bp, Homo sapiens
atcggccctgtcccctg

SEQ ID NO: 5248120 - DNA, 13 bp, Homo sapiens
atcggcctcctct

SEQ ID NO: 5248121 - DNA, 14 bp, Homo sapiens
atcggcctcctctt

SEQ ID NO: 5248122 - DNA, 23 bp, Homo sapiens
atcggctacccctcgactcagca

SEQ ID NO: 5248123 - DNA, 18 bp, Homo sapiens
atcggctcccgcttgctc

SEQ ID NO: 5248124 - DNA, 18 bp, Homo sapiens
atcggctctattctctaa

SEQ ID NO: 5248125 - DNA, 19 bp, Homo sapiens
atcggctgcattgaagatc

SEQ ID NO: 5248126 - DNA, 13 bp, Homo sapiens
atcggcttcctca

SEQ ID NO: 5248127 - DNA, 18 bp, Homo sapiens
atcgggaaagaagaaact

SEQ ID NO: 5248128 - DNA, 17 bp, Homo sapiens
atcgggaacagtgtttc

SEQ ID NO: 5248129 - DNA, 18 bp, Homo sapiens
atcgggagcacccagagc

SEQ ID NO: 5248130 - DNA, 16 bp, Homo sapiens
atcgggagcagtgtct

SEQ ID NO: 5248131 - DNA, 17 bp, Homo sapiens
atcgggagcagtgtctt

SEQ ID NO: 5248132 - DNA, 20 bp, Homo sapiens
atcgggataacaaaatcaca

SEQ ID NO: 5248133 - DNA, 15 bp, Homo sapiens
atcgggcccagggac

SEQ ID NO: 5248134 - DNA, 17 bp, Homo sapiens
atcgggctaaggtccct

SEQ ID NO: 5248135 - DNA, 17 bp, Homo sapiens
atcggggcactgcaggg

SEQ ID NO: 5248136 - DNA, 15 bp, Homo sapiens
atcggggccatttgg

SEQ ID NO: 5248137 - DNA, 21 bp, Homo sapiens
atcggggtggcccactgagtc

SEQ ID NO: 5248138 - DNA, 15 bp, Homo sapiens
atcggggtggggaca

SEQ ID NO: 5248139 - DNA, 14 bp, Homo sapiens
atcggtaggcaaag

SEQ ID NO: 5248140 - DNA, 19 bp, Homo sapiens
atcggtgaaactaacagat

SEQ ID NO: 5248141 - DNA, 21 bp, Homo sapiens
atcggtgaaactaacagataa

SEQ ID NO: 5248142 - DNA, 17 bp, Homo sapiens
atcggtgtccatttata

SEQ ID NO: 5248143 - DNA, 23 bp, Homo sapiens
atcggtgtccatttatagaataa

SEQ ID NO: 5248144 - DNA, 13 bp, Homo sapiens
atcggttgaccct

SEQ ID NO: 5248145 - DNA, 12 bp, Homo sapiens
atcgtaaaatta

SEQ ID NO: 5248146 - DNA, 14 bp, Homo sapiens
atcgtaaaattaag

SEQ ID NO: 5248147 - DNA, 13 bp, Homo sapiens
atcgtaaagtgct

SEQ ID NO: 5248148 - DNA, 15 bp, Homo sapiens
atcgtacctattgca

SEQ ID NO: 5248149 - DNA, 14 bp, Homo sapiens
atcgtacctgtccc

SEQ ID NO: 5248150 - DNA, 13 bp, Homo sapiens
atcgtaggcagcc

SEQ ID NO: 5248151 - DNA, 22 bp, Homo sapiens
atcgtccaccccagtgtgcacg

SEQ ID NO: 5248152 - DNA, 15 bp, Homo sapiens
atcgtccactgtcaa

SEQ ID NO: 5248153 - DNA, 12 bp, Homo sapiens
atcgtccaggga

SEQ ID NO: 5248154 - DNA, 20 bp, Homo sapiens
atcgtcccctcccccacccc

SEQ ID NO: 5248155 - DNA, 18 bp, Homo sapiens
atcgtctcatcctccttt

SEQ ID NO: 5248156 - DNA, 18 bp, Homo sapiens
atcgtctcatgtaaaata

SEQ ID NO: 5248157 - DNA, 18 bp, Homo sapiens
atcgtctccaattcgaaa

SEQ ID NO: 5248158 - DNA, 12 bp, Homo sapiens
atcgtctcggcc

SEQ ID NO: 5248159 - DNA, 15 bp, Homo sapiens
atcgtctcggcccct

SEQ ID NO: 5248160 - DNA, 16 bp, Homo sapiens
atcgtctcggcccctc

SEQ ID NO: 5248161 - DNA, 15 bp, Homo sapiens
atcgtgacagcagca

SEQ ID NO: 5248162 - DNA, 23 bp, Homo sapiens
atcgtgccgttactctccaacct

SEQ ID NO: 5248163 - DNA, 16 bp, Homo sapiens
atcgtgctaaattttc

SEQ ID NO: 5248164 - DNA, 14 bp, Homo sapiens
atcgtgctactgca

SEQ ID NO: 5248165 - DNA, 12 bp, Homo sapiens
atcgtggagaca

SEQ ID NO: 5248166 - DNA, 21 bp, Homo sapiens
atcgtggatgtctctgacaaa

SEQ ID NO: 5248167 - DNA, 19 bp, Homo sapiens
atcgtggcacgtattgctg

SEQ ID NO: 5248168 - DNA, 21 bp, Homo sapiens
atcgtggcacgtattgctgtg

SEQ ID NO: 5248169 - DNA, 22 bp, Homo sapiens
atcgtggcacgtattgctgtgt

SEQ ID NO: 5248170 - DNA, 21 bp, Homo sapiens
atcgtgtattgagatttctta

SEQ ID NO: 5248171 - DNA, 22 bp, Homo sapiens
atcgtgtggtgtattttttaaa

SEQ ID NO: 5248172 - DNA, 23 bp, Homo sapiens
atcgtgttggtattttcagagaa

SEQ ID NO: 5248173 - DNA, 15 bp, Homo sapiens
atcgtgtttgcaaag

SEQ ID NO: 5248174 - DNA, 17 bp, Homo sapiens
atcgttacccatttctt

SEQ ID NO: 5248175 - DNA, 22 bp, Homo sapiens
atcgttagtatctaacatgtat

SEQ ID NO: 5248176 - DNA, 20 bp, Homo sapiens
atcgttatagagagcaattt

SEQ ID NO: 5248177 - DNA, 12 bp, Homo sapiens
atcgttattata

SEQ ID NO: 5248178 - DNA, 15 bp, Homo sapiens
atcgttattataaat

SEQ ID NO: 5248179 - DNA, 22 bp, Homo sapiens
atcgttattataaatgttagtt

SEQ ID NO: 5248180 - DNA, 15 bp, Homo sapiens
atcgttcaactccac

SEQ ID NO: 5248181 - DNA, 14 bp, Homo sapiens
atcgttccccaccc

SEQ ID NO: 5248182 - DNA, 18 bp, Homo sapiens
atcgttctaaaatcaagt

SEQ ID NO: 5248183 - DNA, 18 bp, Homo sapiens
atcgttctctctttgcat

SEQ ID NO: 5248184 - DNA, 14 bp, Homo sapiens
atcgttgcccccat

SEQ ID NO: 5248185 - DNA, 15 bp, Homo sapiens
atcgttggaaaataa

SEQ ID NO: 5248186 - DNA, 17 bp, Homo sapiens
atcgttggactcattaa

SEQ ID NO: 5248187 - DNA, 14 bp, Homo sapiens
atcgtttaatgttt

SEQ ID NO: 5248188 - DNA, 15 bp, Homo sapiens
atcgtttaatgttta

SEQ ID NO: 5248189 - DNA, 23 bp, Homo sapiens
atcgtttaatgtttatacagagt

SEQ ID NO: 5248190 - DNA, 17 bp, Homo sapiens
atcgtttcacatctgta

SEQ ID NO: 5248191 - DNA, 18 bp, Homo sapiens
atcgtttcacatctgtat

SEQ ID NO: 5248192 - DNA, 19 bp, Homo sapiens
atcgtttcacatctgtata

SEQ ID NO: 5248193 - DNA, 13 bp, Homo sapiens
atcgtttctcaga

SEQ ID NO: 5248194 - DNA, 18 bp, Homo sapiens
atcgttttctttgctgtg

SEQ ID NO: 5248195 - DNA, 18 bp, Homo sapiens
atcgtttttgctgcagag

SEQ ID NO: 5248196 - DNA, 14 bp, Homo sapiens
atcgtttttgtttt

SEQ ID NO: 5248197 - DNA, 13 bp, Homo sapiens
atctaaaaaataa

SEQ ID NO: 5248198 - DNA, 14 bp, Homo sapiens
atctaaaaaataac

SEQ ID NO: 5248199 - DNA, 16 bp, Homo sapiens
atctaaaaatatacat

SEQ ID NO: 5248200 - DNA, 17 bp, Homo sapiens
atctaaaaatatacatg

SEQ ID NO: 5248201 - DNA, 18 bp, Homo sapiens
atctaaaaatatacatgt

SEQ ID NO: 5248202 - DNA, 13 bp, Homo sapiens
atctaaaacaaaa

SEQ ID NO: 5248203 - DNA, 18 bp, Homo sapiens
atctaaaagctctgttcc

SEQ ID NO: 5248204 - DNA, 17 bp, Homo sapiens
atctaaaagttaagtgt

SEQ ID NO: 5248205 - DNA, 20 bp, Homo sapiens
atctaaaatattattttatt

SEQ ID NO: 5248206 - DNA, 14 bp, Homo sapiens
atctaaaatgattg

SEQ ID NO: 5248207 - DNA, 22 bp, Homo sapiens
atctaaaatgattgtgcctctg

SEQ ID NO: 5248208 - DNA, 18 bp, Homo sapiens
atctaaacagttatttct

SEQ ID NO: 5248209 - DNA, 18 bp, Homo sapiens
atctaaacgtggtcacct

SEQ ID NO: 5248210 - DNA, 21 bp, Homo sapiens
atctaaacgtggtcaccttcg

SEQ ID NO: 5248211 - DNA, 15 bp, Homo sapiens
atctaaactgccccc

SEQ ID NO: 5248212 - DNA, 20 bp, Homo sapiens
atctaaactggagtgatgtt

SEQ ID NO: 5248213 - DNA, 15 bp, Homo sapiens
atctaaagcagcagg

SEQ ID NO: 5248214 - DNA, 14 bp, Homo sapiens
atctaaagctttat

SEQ ID NO: 5248215 - DNA, 22 bp, Homo sapiens
atctaaagctttatctttgtgt

SEQ ID NO: 5248216 - DNA, 20 bp, Homo sapiens
atctaaagctttggacaagt

SEQ ID NO: 5248217 - DNA, 17 bp, Homo sapiens
atctaaagtgtgttgtt

SEQ ID NO: 5248218 - DNA, 15 bp, Homo sapiens
atctaaagttatatt

SEQ ID NO: 5248219 - DNA, 18 bp, Homo sapiens
atctaaagttatatttca

SEQ ID NO: 5248220 - DNA, 13 bp, Homo sapiens
atctaaagtttgt

SEQ ID NO: 5248221 - DNA, 13 bp, Homo sapiens
atctaaagttttg

SEQ ID NO: 5248222 - DNA, 20 bp, Homo sapiens
atctaaatctatttattaat

SEQ ID NO: 5248223 - DNA, 15 bp, Homo sapiens
atctaaatgaaagtg

SEQ ID NO: 5248224 - DNA, 15 bp, Homo sapiens
atctaaatgttgaaa

SEQ ID NO: 5248225 - DNA, 14 bp, Homo sapiens
atctaaattctgat

SEQ ID NO: 5248226 - DNA, 13 bp, Homo sapiens
atctaaattgatc

SEQ ID NO: 5248227 - DNA, 14 bp, Homo sapiens
atctaaatttaatt

SEQ ID NO: 5248228 - DNA, 14 bp, Homo sapiens
atctaaatttcttt

SEQ ID NO: 5248229 - DNA, 19 bp, Homo sapiens
atctaaatttcttttgcta

SEQ ID NO: 5248230 - DNA, 19 bp, Homo sapiens
atctaacaataatatttca

SEQ ID NO: 5248231 - DNA, 20 bp, Homo sapiens
atctaacaataatatttcaa

SEQ ID NO: 5248232 - DNA, 23 bp, Homo sapiens
atctaacaataatatttcaagtg

SEQ ID NO: 5248233 - DNA, 19 bp, Homo sapiens
atctaaccccttacccatc

SEQ ID NO: 5248234 - DNA, 22 bp, Homo sapiens
atctaaccctcccatggcacct

SEQ ID NO: 5248235 - DNA, 21 bp, Homo sapiens
atctaactgatgagtaaactg

SEQ ID NO: 5248236 - DNA, 15 bp, Homo sapiens
atctaacttcgaata

SEQ ID NO: 5248237 - DNA, 14 bp, Homo sapiens
atctaactttcctt

SEQ ID NO: 5248238 - DNA, 16 bp, Homo sapiens
atctaagaataataaa

SEQ ID NO: 5248239 - DNA, 18 bp, Homo sapiens
atctaagaataataaaat

SEQ ID NO: 5248240 - DNA, 20 bp, Homo sapiens
atctaagaatacagctttct

SEQ ID NO: 5248241 - DNA, 17 bp, Homo sapiens
atctaagacaatcacgc

SEQ ID NO: 5248242 - DNA, 16 bp, Homo sapiens
atctaagacattcacc

SEQ ID NO: 5248243 - DNA, 16 bp, Homo sapiens
atctaagctgcagctt

SEQ ID NO: 5248244 - DNA, 18 bp, Homo sapiens
atctaaggtccccagcag

SEQ ID NO: 5248245 - DNA, 20 bp, Homo sapiens
atctaaggtccccagcagaa

SEQ ID NO: 5248246 - DNA, 13 bp, Homo sapiens
atctaagtgatat

SEQ ID NO: 5248247 - DNA, 15 bp, Homo sapiens
atctaagtgatataa

SEQ ID NO: 5248248 - DNA, 13 bp, Homo sapiens
atctaagttataa

SEQ ID NO: 5248249 - DNA, 22 bp, Homo sapiens
atctaataaactttatttttta

SEQ ID NO: 5248250 - DNA, 22 bp, Homo sapiens
atctaatacctctgtgtgctcc

SEQ ID NO: 5248251 - DNA, 13 bp, Homo sapiens
atctaatagagaa

SEQ ID NO: 5248252 - DNA, 19 bp, Homo sapiens
atctaatagagaacttttt

SEQ ID NO: 5248253 - DNA, 22 bp, Homo sapiens
atctaatagcgggttactttca

SEQ ID NO: 5248254 - DNA, 18 bp, Homo sapiens
atctaatatatatgaata

SEQ ID NO: 5248255 - DNA, 22 bp, Homo sapiens
atctaatatcccagaaaaagta

SEQ ID NO: 5248256 - DNA, 14 bp, Homo sapiens
atctaatatttcta

SEQ ID NO: 5248257 - DNA, 17 bp, Homo sapiens
atctaatatttctagta

SEQ ID NO: 5248258 - DNA, 17 bp, Homo sapiens
atctaatcctttaatga

SEQ ID NO: 5248259 - DNA, 21 bp, Homo sapiens
atctaatgtctcttcctctgt

SEQ ID NO: 5248260 - DNA, 15 bp, Homo sapiens
atctaattaaactaa

SEQ ID NO: 5248261 - DNA, 16 bp, Homo sapiens
atctaattattttgca

SEQ ID NO: 5248262 - DNA, 17 bp, Homo sapiens
atctaattcagatggat

SEQ ID NO: 5248263 - DNA, 13 bp, Homo sapiens
atctaattctgat

SEQ ID NO: 5248264 - DNA, 17 bp, Homo sapiens
atctaattctttaatga

SEQ ID NO: 5248265 - DNA, 21 bp, Homo sapiens
atctaattgggggaggtgtga

SEQ ID NO: 5248266 - DNA, 12 bp, Homo sapiens
atctaatttaat

SEQ ID NO: 5248267 - DNA, 15 bp, Homo sapiens
atctaatttataaaa

SEQ ID NO: 5248268 - DNA, 22 bp, Homo sapiens
atctaatttatacaaaataatt

SEQ ID NO: 5248269 - DNA, 23 bp, Homo sapiens
atctaatttatacaaaataattt

SEQ ID NO: 5248270 - DNA, 12 bp, Homo sapiens
atctaatttcaa

SEQ ID NO: 5248271 - DNA, 16 bp, Homo sapiens
atctaatttcattcaa

SEQ ID NO: 5248272 - DNA, 16 bp, Homo sapiens
atctacaaaagtgaac

SEQ ID NO: 5248273 - DNA, 15 bp, Homo sapiens
atctacaaactttta

SEQ ID NO: 5248274 - DNA, 12 bp, Homo sapiens
atctacaaagaa

SEQ ID NO: 5248275 - DNA, 20 bp, Homo sapiens
atctacaatacatatatcta

SEQ ID NO: 5248276 - DNA, 16 bp, Homo sapiens
atctacaatatatatt

SEQ ID NO: 5248277 - DNA, 23 bp, Homo sapiens
atctacaatatatattatatata

SEQ ID NO: 5248278 - DNA, 13 bp, Homo sapiens
atctacacagcct

SEQ ID NO: 5248279 - DNA, 14 bp, Homo sapiens
atctacacagcctg

SEQ ID NO: 5248280 - DNA, 22 bp, Homo sapiens
atctacacagcctggactttgg

SEQ ID NO: 5248281 - DNA, 14 bp, Homo sapiens
atctacacatacag

SEQ ID NO: 5248282 - DNA, 17 bp, Homo sapiens
atctacacatataaaca

SEQ ID NO: 5248283 - DNA, 21 bp, Homo sapiens
atctacacatataaacacagt

SEQ ID NO: 5248284 - DNA, 13 bp, Homo sapiens
atctacacatgtt

SEQ ID NO: 5248285 - DNA, 18 bp, Homo sapiens
atctacactccagtgaga

SEQ ID NO: 5248286 - DNA, 16 bp, Homo sapiens
atctacactgccttac

SEQ ID NO: 5248287 - DNA, 16 bp, Homo sapiens
atctacagaacaaaga

SEQ ID NO: 5248288 - DNA, 23 bp, Homo sapiens
atctacagaacaacccaccattt

SEQ ID NO: 5248289 - DNA, 14 bp, Homo sapiens
atctacagtaatga

SEQ ID NO: 5248290 - DNA, 15 bp, Homo sapiens
atctacagtaatgaa

SEQ ID NO: 5248291 - DNA, 16 bp, Homo sapiens
atctacatctccttca

SEQ ID NO: 5248292 - DNA, 14 bp, Homo sapiens
atctacatgtgttt

SEQ ID NO: 5248293 - DNA, 15 bp, Homo sapiens
atctacattaaaatg

SEQ ID NO: 5248294 - DNA, 16 bp, Homo sapiens
atctacattaaaatga

SEQ ID NO: 5248295 - DNA, 18 bp, Homo sapiens
atctacattaaaatgaca

SEQ ID NO: 5248296 - DNA, 20 bp, Homo sapiens
atctacattaaaatgacaaa

SEQ ID NO: 5248297 - DNA, 12 bp, Homo sapiens
atctaccaactt

SEQ ID NO: 5248298 - DNA, 17 bp, Homo sapiens
atctaccaactttcaag

SEQ ID NO: 5248299 - DNA, 18 bp, Homo sapiens
atctaccaactttcaaga

SEQ ID NO: 5248300 - DNA, 21 bp, Homo sapiens
atctacccaaaggatactgta

SEQ ID NO: 5248301 - DNA, 16 bp, Homo sapiens
atctaccccagggaga

SEQ ID NO: 5248302 - DNA, 16 bp, Homo sapiens
atctacccgtgcctgg

SEQ ID NO: 5248303 - DNA, 14 bp, Homo sapiens
atctaccctctagt

SEQ ID NO: 5248304 - DNA, 21 bp, Homo sapiens
atctaccgacctgtctccctg

SEQ ID NO: 5248305 - DNA, 15 bp, Homo sapiens
atctacctatactta

SEQ ID NO: 5248306 - DNA, 21 bp, Homo sapiens
atctacctcactattcaagta

SEQ ID NO: 5248307 - DNA, 13 bp, Homo sapiens
atctacctcccga

SEQ ID NO: 5248308 - DNA, 23 bp, Homo sapiens
atctacctgcaacacaacatttg

SEQ ID NO: 5248309 - DNA, 15 bp, Homo sapiens
atctacctgccctct

SEQ ID NO: 5248310 - DNA, 16 bp, Homo sapiens
atctacctgccctctc

SEQ ID NO: 5248311 - DNA, 19 bp, Homo sapiens
atctacctgccctctctca

SEQ ID NO: 5248312 - DNA, 21 bp, Homo sapiens
atctacctgccctctctcagt

SEQ ID NO: 5248313 - DNA, 14 bp, Homo sapiens
atctacctgctcct

SEQ ID NO: 5248314 - DNA, 18 bp, Homo sapiens
atctacctgttctgtagc

SEQ ID NO: 5248315 - DNA, 18 bp, Homo sapiens
atctacgaagccacaggc

SEQ ID NO: 5248316 - DNA, 19 bp, Homo sapiens
atctacgaagccacaggcc

SEQ ID NO: 5248317 - DNA, 22 bp, Homo sapiens
atctacgaagccacaggcctgg

SEQ ID NO: 5248318 - DNA, 15 bp, Homo sapiens
atctacgatgttaaa

SEQ ID NO: 5248319 - DNA, 22 bp, Homo sapiens
atctactaaaaatacaaaaatt

SEQ ID NO: 5248320 - DNA, 17 bp, Homo sapiens
atctactaagtttcctt

SEQ ID NO: 5248321 - DNA, 20 bp, Homo sapiens
atctactaccagaagggctt

SEQ ID NO: 5248322 - DNA, 22 bp, Homo sapiens
atctactatttgaaaaaagaag

SEQ ID NO: 5248323 - DNA, 15 bp, Homo sapiens
atctactcaaagcat

SEQ ID NO: 5248324 - DNA, 16 bp, Homo sapiens
atctactcagaaattt

SEQ ID NO: 5248325 - DNA, 23 bp, Homo sapiens
atctactccaaattattttcaag

SEQ ID NO: 5248326 - DNA, 20 bp, Homo sapiens
atctactctggaccaaggag

SEQ ID NO: 5248327 - DNA, 23 bp, Homo sapiens
atctactgaattggcttccagat

SEQ ID NO: 5248328 - DNA, 14 bp, Homo sapiens
atctactgagccac

SEQ ID NO: 5248329 - DNA, 22 bp, Homo sapiens
atctactggaaatgtagcactt

SEQ ID NO: 5248330 - DNA, 16 bp, Homo sapiens
atctactgtacacaat

SEQ ID NO: 5248331 - DNA, 20 bp, Homo sapiens
atctactgtatcaataaaat

SEQ ID NO: 5248332 - DNA, 18 bp, Homo sapiens
atctacttcatagctcct

SEQ ID NO: 5248333 - DNA, 17 bp, Homo sapiens
atctactttttgaactt

SEQ ID NO: 5248334 - DNA, 23 bp, Homo sapiens
atctactttttgaacttttcatt

SEQ ID NO: 5248335 - DNA, 17 bp, Homo sapiens
atctactttttgtattt

SEQ ID NO: 5248336 - DNA, 20 bp, Homo sapiens
atctactttttgtatttagt

SEQ ID NO: 5248337 - DNA, 21 bp, Homo sapiens
atctactttttgtatttagta

SEQ ID NO: 5248338 - DNA, 18 bp, Homo sapiens
atctagaaagtgggttca

SEQ ID NO: 5248339 - DNA, 21 bp, Homo sapiens
atctagaacacaggcaaaatc

SEQ ID NO: 5248340 - DNA, 15 bp, Homo sapiens
atctagaacattcag

SEQ ID NO: 5248341 - DNA, 16 bp, Homo sapiens
atctagaagaaatgaa

SEQ ID NO: 5248342 - DNA, 21 bp, Homo sapiens
atctagaagaaatgaaatttt

SEQ ID NO: 5248343 - DNA, 20 bp, Homo sapiens
atctagaagagtctattgtc

SEQ ID NO: 5248344 - DNA, 15 bp, Homo sapiens
atctagaagatgtgt

SEQ ID NO: 5248345 - DNA, 19 bp, Homo sapiens
atctagaagatgtgtaaac

SEQ ID NO: 5248346 - DNA, 21 bp, Homo sapiens
atctagaagctggtaaaaatg

SEQ ID NO: 5248347 - DNA, 21 bp, Homo sapiens
atctagaatgtgttttctgaa

SEQ ID NO: 5248348 - DNA, 15 bp, Homo sapiens
atctagaattcactg

SEQ ID NO: 5248349 - DNA, 18 bp, Homo sapiens
atctagaattcactgagt

SEQ ID NO: 5248350 - DNA, 19 bp, Homo sapiens
atctagacccatcttcttt

SEQ ID NO: 5248351 - DNA, 21 bp, Homo sapiens
atctagactcaaggttcccag

SEQ ID NO: 5248352 - DNA, 13 bp, Homo sapiens
atctagagatttt

SEQ ID NO: 5248353 - DNA, 20 bp, Homo sapiens
atctagagcttgatgccagt

SEQ ID NO: 5248354 - DNA, 17 bp, Homo sapiens
atctagaggcttccttc

SEQ ID NO: 5248355 - DNA, 23 bp, Homo sapiens
atctagaggcttccttcatttcc

SEQ ID NO: 5248356 - DNA, 18 bp, Homo sapiens
atctagatactgtatcat

SEQ ID NO: 5248357 - DNA, 22 bp, Homo sapiens
atctagatcaattaattcttaa

SEQ ID NO: 5248358 - DNA, 16 bp, Homo sapiens
atctagatttctagaa

SEQ ID NO: 5248359 - DNA, 14 bp, Homo sapiens
atctagcaaatgtt

SEQ ID NO: 5248360 - DNA, 21 bp, Homo sapiens
atctagcaagaagattctaaa

SEQ ID NO: 5248361 - DNA, 22 bp, Homo sapiens
atctagcaagaagattctaaaa

SEQ ID NO: 5248362 - DNA, 21 bp, Homo sapiens
atctagcactcctcaagactt

SEQ ID NO: 5248363 - DNA, 14 bp, Homo sapiens
atctagcagctggc

SEQ ID NO: 5248364 - DNA, 18 bp, Homo sapiens
atctagcagtaaaagata

SEQ ID NO: 5248365 - DNA, 23 bp, Homo sapiens
atctagccagagcccttcactgc

SEQ ID NO: 5248366 - DNA, 19 bp, Homo sapiens
atctagccagcccctcttc

SEQ ID NO: 5248367 - DNA, 21 bp, Homo sapiens
atctagccagcccctcttccc

SEQ ID NO: 5248368 - DNA, 19 bp, Homo sapiens
atctagccaggcctcccgc

SEQ ID NO: 5248369 - DNA, 14 bp, Homo sapiens
atctagccatggct

SEQ ID NO: 5248370 - DNA, 15 bp, Homo sapiens
atctagctagtaata

SEQ ID NO: 5248371 - DNA, 18 bp, Homo sapiens
atctagctctagttcaaa

SEQ ID NO: 5248372 - DNA, 16 bp, Homo sapiens
atctagcttcatgcct

SEQ ID NO: 5248373 - DNA, 16 bp, Homo sapiens
atctaggaaaatattt

SEQ ID NO: 5248374 - DNA, 22 bp, Homo sapiens
atctaggaaaatattttgatct

SEQ ID NO: 5248375 - DNA, 19 bp, Homo sapiens
atctaggaagactttggaa

SEQ ID NO: 5248376 - DNA, 14 bp, Homo sapiens
atctaggagaggag

SEQ ID NO: 5248377 - DNA, 16 bp, Homo sapiens
atctaggagaggagaa

SEQ ID NO: 5248378 - DNA, 18 bp, Homo sapiens
atctaggcaacatagtat

SEQ ID NO: 5248379 - DNA, 22 bp, Homo sapiens
atctaggcatttcattatgctt

SEQ ID NO: 5248380 - DNA, 14 bp, Homo sapiens
atctaggccacccc

SEQ ID NO: 5248381 - DNA, 23 bp, Homo sapiens
atctaggccaccccaacctctgt

SEQ ID NO: 5248382 - DNA, 16 bp, Homo sapiens
atatgtaaactttaac

SEQ ID NO: 5248383 - DNA, 13 bp, Homo sapiens
atatgtaaatata

SEQ ID NO: 5248384 - DNA, 13 bp, Homo sapiens
atatgtaaatgtg

SEQ ID NO: 5248385 - DNA, 13 bp, Homo sapiens
atatgtaacagtt

SEQ ID NO: 5248386 - DNA, 19 bp, Homo sapiens
atatgtaacatgtctaaag

SEQ ID NO: 5248387 - DNA, 21 bp, Homo sapiens
atatgtaacttcagatgtttc

SEQ ID NO: 5248388 - DNA, 14 bp, Homo sapiens
atatgtaagtactt

SEQ ID NO: 5248389 - DNA, 17 bp, Homo sapiens
atatgtacaattgtggg

SEQ ID NO: 5248390 - DNA, 15 bp, Homo sapiens
atatgtacagtttat

SEQ ID NO: 5248391 - DNA, 18 bp, Homo sapiens
atatgtacatacatatat

SEQ ID NO: 5248392 - DNA, 14 bp, Homo sapiens
atatgtacatgaga

SEQ ID NO: 5248393 - DNA, 11 bp, Homo sapiens
atatgtacatt

SEQ ID NO: 5248394 - DNA, 15 bp, Homo sapiens
atatgtacatttcta

SEQ ID NO: 5248395 - DNA, 13 bp, Homo sapiens
atatgtacatttg

SEQ ID NO: 5248396 - DNA, 23 bp, Homo sapiens
atatgtacctaacgaagtatcct

SEQ ID NO: 5248397 - DNA, 21 bp, Homo sapiens
atatgtactaagaatgtcctt

SEQ ID NO: 5248398 - DNA, 19 bp, Homo sapiens
atatgtacttgtttgctat

SEQ ID NO: 5248399 - DNA, 17 bp, Homo sapiens
atatgtagaaacattta

SEQ ID NO: 5248400 - DNA, 16 bp, Homo sapiens
atatgtagaaggcaca

SEQ ID NO: 5248401 - DNA, 15 bp, Homo sapiens
atatgtagaatgtaa

SEQ ID NO: 5248402 - DNA, 13 bp, Homo sapiens
atatgtagactat

SEQ ID NO: 5248403 - DNA, 12 bp, Homo sapiens
atatgtagcatt

SEQ ID NO: 5248404 - DNA, 17 bp, Homo sapiens
atatgtagcattaaata

SEQ ID NO: 5248405 - DNA, 19 bp, Homo sapiens
atatgtagcattaaatata

SEQ ID NO: 5248406 - DNA, 16 bp, Homo sapiens
atatgtaggaaaattt

SEQ ID NO: 5248407 - DNA, 19 bp, Homo sapiens
atatgtagtaaactctcat

SEQ ID NO: 5248408 - DNA, 19 bp, Homo sapiens
atatgtagtataaagaaaa

SEQ ID NO: 5248409 - DNA, 14 bp, Homo sapiens
atatgtagtattaa

SEQ ID NO: 5248410 - DNA, 15 bp, Homo sapiens
atatgtataaattaa

SEQ ID NO: 5248411 - DNA, 21 bp, Homo sapiens
atatgtataaattaatacaga

SEQ ID NO: 5248412 - DNA, 17 bp, Homo sapiens
atatgtataatatatat

SEQ ID NO: 5248413 - DNA, 17 bp, Homo sapiens
atatgtataatttcaca

SEQ ID NO: 5248414 - DNA, 17 bp, Homo sapiens
atatgtatacatataga

SEQ ID NO: 5248415 - DNA, 15 bp, Homo sapiens
atatgtatacatgtg

SEQ ID NO: 5248416 - DNA, 14 bp, Homo sapiens
atatgtatacgcac

SEQ ID NO: 5248417 - DNA, 23 bp, Homo sapiens
atatgtatacgcacgcacccaca

SEQ ID NO: 5248418 - DNA, 16 bp, Homo sapiens
atatgtatataaaata

SEQ ID NO: 5248419 - DNA, 14 bp, Homo sapiens
atatgtatatatat

SEQ ID NO: 5248420 - DNA, 20 bp, Homo sapiens
atatgtatatatattctcag

SEQ ID NO: 5248421 - DNA, 14 bp, Homo sapiens
atatgtatatatgt

SEQ ID NO: 5248422 - DNA, 16 bp, Homo sapiens
atatgtatatatgtat

SEQ ID NO: 5248423 - DNA, 22 bp, Homo sapiens
atatgtatatctatatctctaa

SEQ ID NO: 5248424 - DNA, 17 bp, Homo sapiens
atatgtatatctgtgta

SEQ ID NO: 5248425 - DNA, 19 bp, Homo sapiens
atatgtatatctgtgtaag

SEQ ID NO: 5248426 - DNA, 19 bp, Homo sapiens
atatgtatatctttgcact

SEQ ID NO: 5248427 - DNA, 21 bp, Homo sapiens
atatgtatatgacatttaaat

SEQ ID NO: 5248428 - DNA, 16 bp, Homo sapiens
atatgtatatgtatat

SEQ ID NO: 5248429 - DNA, 23 bp, Homo sapiens
atatgtatatttttttaatttaa

SEQ ID NO: 5248430 - DNA, 19 bp, Homo sapiens
atatgtatctaaatgaaaa

SEQ ID NO: 5248431 - DNA, 23 bp, Homo sapiens
atatgtatctacaatacatatat

SEQ ID NO: 5248432 - DNA, 14 bp, Homo sapiens
atatgtatctttgg

SEQ ID NO: 5248433 - DNA, 17 bp, Homo sapiens
atatgtatgggtagggt

SEQ ID NO: 5248434 - DNA, 16 bp, Homo sapiens
atatgtatgtatgtgt

SEQ ID NO: 5248435 - DNA, 19 bp, Homo sapiens
atatgtatgtctaattgag

SEQ ID NO: 5248436 - DNA, 24 bp, Homo sapiens
atatgtatgtgtgagtgtatgtat

SEQ ID NO: 5248437 - DNA, 16 bp, Homo sapiens
atatgtatgtgtgtat

SEQ ID NO: 5248438 - DNA, 17 bp, Homo sapiens
atatgtatgtgtttaga

SEQ ID NO: 5248439 - DNA, 21 bp, Homo sapiens
atatgtattaacactactcaa

SEQ ID NO: 5248440 - DNA, 17 bp, Homo sapiens
atatgtattaagccaaa

SEQ ID NO: 5248441 - DNA, 18 bp, Homo sapiens
atatgtattatttataat

SEQ ID NO: 5248442 - DNA, 18 bp, Homo sapiens
atatgtattcccttgtat

SEQ ID NO: 5248443 - DNA, 14 bp, Homo sapiens
atatgtatttaaaa

SEQ ID NO: 5248444 - DNA, 15 bp, Homo sapiens
atatgtatttaccaa

SEQ ID NO: 5248445 - DNA, 17 bp, Homo sapiens
atatgtattttatgtat

SEQ ID NO: 5248446 - DNA, 18 bp, Homo sapiens
atatgtattttatgtatg

SEQ ID NO: 5248447 - DNA, 21 bp, Homo sapiens
atatgtattttcctaagtgtt

SEQ ID NO: 5248448 - DNA, 18 bp, Homo sapiens
atatgtattttttgaatc

SEQ ID NO: 5248449 - DNA, 15 bp, Homo sapiens
atatgtcaaaaatat

SEQ ID NO: 5248450 - DNA, 17 bp, Homo sapiens
atatgtcaaaaatattt

SEQ ID NO: 5248451 - DNA, 15 bp, Homo sapiens
atatgtcaaattgtc

SEQ ID NO: 5248452 - DNA, 14 bp, Homo sapiens
atatgtcaagccat

SEQ ID NO: 5248453 - DNA, 14 bp, Homo sapiens
atatgtcacctggc

SEQ ID NO: 5248454 - DNA, 19 bp, Homo sapiens
atatgtcagacatgaaaac

SEQ ID NO: 5248455 - DNA, 19 bp, Homo sapiens
atatgtcagagctgttata

SEQ ID NO: 5248456 - DNA, 22 bp, Homo sapiens
atatgtcattatttattgttaa

SEQ ID NO: 5248457 - DNA, 18 bp, Homo sapiens
atatgtccagtcatcctg

SEQ ID NO: 5248458 - DNA, 20 bp, Homo sapiens
atatgtcctcttttgttgtt

SEQ ID NO: 5248459 - DNA, 11 bp, Homo sapiens
atatgtcctgg

SEQ ID NO: 5248460 - DNA, 20 bp, Homo sapiens
atatgtccttgggttgctgg

SEQ ID NO: 5248461 - DNA, 19 bp, Homo sapiens
atatgtcgtagaattcctt

SEQ ID NO: 5248462 - DNA, 16 bp, Homo sapiens
atatgtctgcaggttt

SEQ ID NO: 5248463 - DNA, 15 bp, Homo sapiens
atatgtctgcttctg

SEQ ID NO: 5248464 - DNA, 14 bp, Homo sapiens
atatgtctgtatct

SEQ ID NO: 5248465 - DNA, 19 bp, Homo sapiens
atatgtctgtctttgcaaa

SEQ ID NO: 5248466 - DNA, 19 bp, Homo sapiens
atatgtcttactactttaa

SEQ ID NO: 5248467 - DNA, 11 bp, Homo sapiens
atatgtctttt

SEQ ID NO: 5248468 - DNA, 13 bp, Homo sapiens
atatgtgaacagt

SEQ ID NO: 5248469 - DNA, 13 bp, Homo sapiens
atatgtgaacatt

SEQ ID NO: 5248470 - DNA, 11 bp, Homo sapiens
atatgtgaaga

SEQ ID NO: 5248471 - DNA, 14 bp, Homo sapiens
atatgtgaagaaaa

SEQ ID NO: 5248472 - DNA, 15 bp, Homo sapiens
atatgtgaatttgtt

SEQ ID NO: 5248473 - DNA, 17 bp, Homo sapiens
atatgtgacattcctga

SEQ ID NO: 5248474 - DNA, 22 bp, Homo sapiens
atatgtgagattttttattgct

SEQ ID NO: 5248475 - DNA, 20 bp, Homo sapiens
atatgtgagtgaaagtactt

SEQ ID NO: 5248476 - DNA, 16 bp, Homo sapiens
atatgtgatctgggca

SEQ ID NO: 5248477 - DNA, 15 bp, Homo sapiens
atatgtgatgattaa

SEQ ID NO: 5248478 - DNA, 18 bp, Homo sapiens
atatgtgattatcattta

SEQ ID NO: 5248479 - DNA, 20 bp, Homo sapiens
atatgtgattttcaaatatg

SEQ ID NO: 5248480 - DNA, 17 bp, Homo sapiens
atatgtgccacattttc

SEQ ID NO: 5248481 - DNA, 12 bp, Homo sapiens
atatgtgcccct

SEQ ID NO: 5248482 - DNA, 16 bp, Homo sapiens
atatgtgcggcttttc

SEQ ID NO: 5248483 - DNA, 14 bp, Homo sapiens
atatgtgcttgtgt

SEQ ID NO: 5248484 - DNA, 13 bp, Homo sapiens
atatgtggaaata

SEQ ID NO: 5248485 - DNA, 17 bp, Homo sapiens
atatgtggaaatatacc

SEQ ID NO: 5248486 - DNA, 15 bp, Homo sapiens
atatgtggagttcat

SEQ ID NO: 5248487 - DNA, 20 bp, Homo sapiens
atatgtggcattcctttctt

SEQ ID NO: 5248488 - DNA, 21 bp, Homo sapiens
atatgtgtaatatcatttcat

SEQ ID NO: 5248489 - DNA, 13 bp, Homo sapiens
atatgtgtacaca

SEQ ID NO: 5248490 - DNA, 16 bp, Homo sapiens
atatgtgtacacatat

SEQ ID NO: 5248491 - DNA, 19 bp, Homo sapiens
atatgtgtatatatacata

SEQ ID NO: 5248492 - DNA, 20 bp, Homo sapiens
atatgtgtatatatacatac

SEQ ID NO: 5248493 - DNA, 22 bp, Homo sapiens
atatgtgtatatatacatacac

SEQ ID NO: 5248494 - DNA, 17 bp, Homo sapiens
atatgtgtgccctggac

SEQ ID NO: 5248495 - DNA, 21 bp, Homo sapiens
atatgtgtgcctatttgtgtg

SEQ ID NO: 5248496 - DNA, 12 bp, Homo sapiens
atatgtgtgtgt

SEQ ID NO: 5248497 - DNA, 17 bp, Homo sapiens
atatgtgtgtgtatata

SEQ ID NO: 5248498 - DNA, 20 bp, Homo sapiens
atatgtgtgtgtatgtttgc

SEQ ID NO: 5248499 - DNA, 17 bp, Homo sapiens
atatgtgttacttcaag

SEQ ID NO: 5248500 - DNA, 20 bp, Homo sapiens
atatgtgttgaaaaccaaaa

SEQ ID NO: 5248501 - DNA, 11 bp, Homo sapiens
atatgttaaag

SEQ ID NO: 5248502 - DNA, 15 bp, Homo sapiens
atatgttaaagttta

SEQ ID NO: 5248503 - DNA, 20 bp, Homo sapiens
atatgttaacctcagtgtca

SEQ ID NO: 5248504 - DNA, 18 bp, Homo sapiens
atatgttagatacacaaa

SEQ ID NO: 5248505 - DNA, 15 bp, Homo sapiens
atatgttagcaagag

SEQ ID NO: 5248506 - DNA, 13 bp, Homo sapiens
atatgttattaaa

SEQ ID NO: 5248507 - DNA, 17 bp, Homo sapiens
atatgttattttaaaca

SEQ ID NO: 5248508 - DNA, 15 bp, Homo sapiens
atatgttatttttgg

SEQ ID NO: 5248509 - DNA, 16 bp, Homo sapiens
atatgttcaactggag

SEQ ID NO: 5248510 - DNA, 21 bp, Homo sapiens
atatgttcaccaggagattac

SEQ ID NO: 5248511 - DNA, 23 bp, Homo sapiens
atatgttcatatctatgggaaaa

SEQ ID NO: 5248512 - DNA, 15 bp, Homo sapiens
atatgttcattaaat

SEQ ID NO: 5248513 - DNA, 22 bp, Homo sapiens
atatgttccatgcctggccctt

SEQ ID NO: 5248514 - DNA, 20 bp, Homo sapiens
atatgttctgcaagaattaa

SEQ ID NO: 5248515 - DNA, 23 bp, Homo sapiens
atatgttctgcaagaattaaaac

SEQ ID NO: 5248516 - DNA, 15 bp, Homo sapiens
atatgttgaatactt

SEQ ID NO: 5248517 - DNA, 18 bp, Homo sapiens
atatgttgaatacttttt

SEQ ID NO: 5248518 - DNA, 11 bp, Homo sapiens
atatgttgtaa

SEQ ID NO: 5248519 - DNA, 22 bp, Homo sapiens
atatgttgtgtttggttcaatt

SEQ ID NO: 5248520 - DNA, 14 bp, Homo sapiens
atatgttgttctta

SEQ ID NO: 5248521 - DNA, 21 bp, Homo sapiens
atatgttgttcttacaaacca

SEQ ID NO: 5248522 - DNA, 15 bp, Homo sapiens
atatgtttaaaagta

SEQ ID NO: 5248523 - DNA, 17 bp, Homo sapiens
atatgtttaatgttcat

SEQ ID NO: 5248524 - DNA, 22 bp, Homo sapiens
atatgtttagttttacatttta

SEQ ID NO: 5248525 - DNA, 23 bp, Homo sapiens
atatgtttagttttacattttaa

SEQ ID NO: 5248526 - DNA, 15 bp, Homo sapiens
atatgtttatacaca

SEQ ID NO: 5248527 - DNA, 17 bp, Homo sapiens
atatgtttatacacaca

SEQ ID NO: 5248528 - DNA, 17 bp, Homo sapiens
atatgtttatcaccttt

SEQ ID NO: 5248529 - DNA, 15 bp, Homo sapiens
atatgtttattcaaa

SEQ ID NO: 5248530 - DNA, 13 bp, Homo sapiens
atatgtttcaaac

SEQ ID NO: 5248531 - DNA, 22 bp, Homo sapiens
atatgtttcaccctgtccctct

SEQ ID NO: 5248532 - DNA, 19 bp, Homo sapiens
atatgtttccccatctctg

SEQ ID NO: 5248533 - DNA, 20 bp, Homo sapiens
atatgtttctgctagctata

SEQ ID NO: 5248534 - DNA, 19 bp, Homo sapiens
atatgtttggctgaaatta

SEQ ID NO: 5248535 - DNA, 21 bp, Homo sapiens
atatgtttggctgaaattatg

SEQ ID NO: 5248536 - DNA, 20 bp, Homo sapiens
atatgttttaagaggcaggg

SEQ ID NO: 5248537 - DNA, 14 bp, Homo sapiens
atatgttttattca

SEQ ID NO: 5248538 - DNA, 18 bp, Homo sapiens
atatgttttccacataaa

SEQ ID NO: 5248539 - DNA, 19 bp, Homo sapiens
atatgttttccacataaat

SEQ ID NO: 5248540 - DNA, 14 bp, Homo sapiens
atatgttttgagaa

SEQ ID NO: 5248541 - DNA, 24 bp, Homo sapiens
atattaaaaaacttcatgtaattt

SEQ ID NO: 5248542 - DNA, 17 bp, Homo sapiens
atattaaaaaagagaca

SEQ ID NO: 5248543 - DNA, 23 bp, Homo sapiens
atattaaaaagccaagtgtcctg

SEQ ID NO: 5248544 - DNA, 14 bp, Homo sapiens
atattaaaaagtct

SEQ ID NO: 5248545 - DNA, 17 bp, Homo sapiens
atattaaaaagtctttt

SEQ ID NO: 5248546 - DNA, 19 bp, Homo sapiens
atattaaaaagtcttttaa

SEQ ID NO: 5248547 - DNA, 20 bp, Homo sapiens
atattaaaaagtcttttaaa

SEQ ID NO: 5248548 - DNA, 17 bp, Homo sapiens
atattaaaaatataaaa

SEQ ID NO: 5248549 - DNA, 18 bp, Homo sapiens
atattaaaaatataaaac

SEQ ID NO: 5248550 - DNA, 23 bp, Homo sapiens
atattaaaaatataaacaatgtt

SEQ ID NO: 5248551 - DNA, 16 bp, Homo sapiens
atattaaaaatataca

SEQ ID NO: 5248552 - DNA, 15 bp, Homo sapiens
atattaaaaatggta

SEQ ID NO: 5248553 - DNA, 16 bp, Homo sapiens
atattaaaaatggtaa

SEQ ID NO: 5248554 - DNA, 21 bp, Homo sapiens
atattaaaaattaattcttta

SEQ ID NO: 5248555 - DNA, 23 bp, Homo sapiens
atattaaaagaaagggttctgta

SEQ ID NO: 5248556 - DNA, 16 bp, Homo sapiens
atattaaaatagcata

SEQ ID NO: 5248557 - DNA, 18 bp, Homo sapiens
atattaaaatagcatact

SEQ ID NO: 5248558 - DNA, 21 bp, Homo sapiens
atattaaaatagcatactgtg

SEQ ID NO: 5248559 - DNA, 23 bp, Homo sapiens
atattaaaatagcatactgtgta

SEQ ID NO: 5248560 - DNA, 22 bp, Homo sapiens
atattaaaatatgaaggtttga

SEQ ID NO: 5248561 - DNA, 17 bp, Homo sapiens
atctaggggagccttga

SEQ ID NO: 5248562 - DNA, 20 bp, Homo sapiens
atctaggggagccttgattc

SEQ ID NO: 5248563 - DNA, 16 bp, Homo sapiens
atctaggtaattttta

SEQ ID NO: 5248564 - DNA, 18 bp, Homo sapiens
atctaggtggagttgaaa

SEQ ID NO: 5248565 - DNA, 19 bp, Homo sapiens
atctaggtgtggctgtgaa

SEQ ID NO: 5248566 - DNA, 14 bp, Homo sapiens
atctaggtttaact

SEQ ID NO: 5248567 - DNA, 16 bp, Homo sapiens
atctaggtttaactca

SEQ ID NO: 5248568 - DNA, 23 bp, Homo sapiens
atctaggtttatgacagtaattg

SEQ ID NO: 5248569 - DNA, 14 bp, Homo sapiens
atctagtaatatat

SEQ ID NO: 5248570 - DNA, 18 bp, Homo sapiens
atctagtaatatatttaa

SEQ ID NO: 5248571 - DNA, 22 bp, Homo sapiens
atctagtaatatatttaaaggg

SEQ ID NO: 5248572 - DNA, 23 bp, Homo sapiens
atctagtagttgtagaagaaaat

SEQ ID NO: 5248573 - DNA, 14 bp, Homo sapiens
atctagtatgaaat

SEQ ID NO: 5248574 - DNA, 16 bp, Homo sapiens
atctagtatgaaatta

SEQ ID NO: 5248575 - DNA, 19 bp, Homo sapiens
atctagtatgaaattatat

SEQ ID NO: 5248576 - DNA, 21 bp, Homo sapiens
atctagtcaataactctgatt

SEQ ID NO: 5248577 - DNA, 23 bp, Homo sapiens
atctagtccttgtcttgtaattg

SEQ ID NO: 5248578 - DNA, 22 bp, Homo sapiens
atctagtcttgacctctccagc

SEQ ID NO: 5248579 - DNA, 23 bp, Homo sapiens
atctagtcttgacctctccagca

SEQ ID NO: 5248580 - DNA, 21 bp, Homo sapiens
atctagtgcagctgattttaa

SEQ ID NO: 5248581 - DNA, 19 bp, Homo sapiens
atctagtgccattatttct

SEQ ID NO: 5248582 - DNA, 19 bp, Homo sapiens
atctagtgggttgaccttt

SEQ ID NO: 5248583 - DNA, 16 bp, Homo sapiens
atctagttaagtcgct

SEQ ID NO: 5248584 - DNA, 22 bp, Homo sapiens
atctagttaagtcgctgaacaa

SEQ ID NO: 5248585 - DNA, 17 bp, Homo sapiens
atctagttcccctgttt

SEQ ID NO: 5248586 - DNA, 19 bp, Homo sapiens
atctagttcccctgtttat

SEQ ID NO: 5248587 - DNA, 18 bp, Homo sapiens
atctagttgtcaataaat

SEQ ID NO: 5248588 - DNA, 17 bp, Homo sapiens
atctagtttacagaaaa

SEQ ID NO: 5248589 - DNA, 18 bp, Homo sapiens
atctagtttacagaaaaa

SEQ ID NO: 5248590 - DNA, 23 bp, Homo sapiens
atctagtttacttcctaaatttc

SEQ ID NO: 5248591 - DNA, 18 bp, Homo sapiens
atctagtttccctggtgc

SEQ ID NO: 5248592 - DNA, 12 bp, Homo sapiens
atctataaaagg

SEQ ID NO: 5248593 - DNA, 14 bp, Homo sapiens
atctataaaataga

SEQ ID NO: 5248594 - DNA, 20 bp, Homo sapiens
atctataaaatagatataaa

SEQ ID NO: 5248595 - DNA, 12 bp, Homo sapiens
atctataaagaa

SEQ ID NO: 5248596 - DNA, 12 bp, Homo sapiens
atctataaagcg

SEQ ID NO: 5248597 - DNA, 16 bp, Homo sapiens
atctataacaaatgct

SEQ ID NO: 5248598 - DNA, 16 bp, Homo sapiens
atctataacataaaga

SEQ ID NO: 5248599 - DNA, 18 bp, Homo sapiens
atctataacataaagaat

SEQ ID NO: 5248600 - DNA, 23 bp, Homo sapiens
atctataaggtgctctctttctg

SEQ ID NO: 5248601 - DNA, 16 bp, Homo sapiens
atctataatttaccta

SEQ ID NO: 5248602 - DNA, 23 bp, Homo sapiens
atctataatttacctaagattac

SEQ ID NO: 5248603 - DNA, 15 bp, Homo sapiens
atctatacttgcttt

SEQ ID NO: 5248604 - DNA, 16 bp, Homo sapiens
atctatagaaagctat

SEQ ID NO: 5248605 - DNA, 17 bp, Homo sapiens
atctatagaaagctata

SEQ ID NO: 5248606 - DNA, 17 bp, Homo sapiens
atctatagcatttaaag

SEQ ID NO: 5248607 - DNA, 18 bp, Homo sapiens
atctataggcagcttcta

SEQ ID NO: 5248608 - DNA, 22 bp, Homo sapiens
atctataggcagcttctaagag

SEQ ID NO: 5248609 - DNA, 19 bp, Homo sapiens
atctatagtatagaatgaa

SEQ ID NO: 5248610 - DNA, 23 bp, Homo sapiens
atctatagttatacatcttcatt

SEQ ID NO: 5248611 - DNA, 21 bp, Homo sapiens
atctatagttgatatgtttta

SEQ ID NO: 5248612 - DNA, 17 bp, Homo sapiens
atctatataaaataact

SEQ ID NO: 5248613 - DNA, 17 bp, Homo sapiens
atctatataaatcgcat

SEQ ID NO: 5248614 - DNA, 14 bp, Homo sapiens
atctatataatgta

SEQ ID NO: 5248615 - DNA, 17 bp, Homo sapiens
atctatatatgtatcta

SEQ ID NO: 5248616 - DNA, 15 bp, Homo sapiens
atctatatatgtgta

SEQ ID NO: 5248617 - DNA, 17 bp, Homo sapiens
atctatatatgtgtatg

SEQ ID NO: 5248618 - DNA, 19 bp, Homo sapiens
atctatatatgtgtatgta

SEQ ID NO: 5248619 - DNA, 15 bp, Homo sapiens
atctatatcatattt

SEQ ID NO: 5248620 - DNA, 16 bp, Homo sapiens
atctatatgtacttgt

SEQ ID NO: 5248621 - DNA, 15 bp, Homo sapiens
atctatattaaatga

SEQ ID NO: 5248622 - DNA, 12 bp, Homo sapiens
atctatattaga

SEQ ID NO: 5248623 - DNA, 15 bp, Homo sapiens
atctatcaatagtca

SEQ ID NO: 5248624 - DNA, 13 bp, Homo sapiens
atctatcacctgt

SEQ ID NO: 5248625 - DNA, 16 bp, Homo sapiens
atctatcactgcatta

SEQ ID NO: 5248626 - DNA, 14 bp, Homo sapiens
atctatcagagtat

SEQ ID NO: 5248627 - DNA, 15 bp, Homo sapiens
atctatccacactgt

SEQ ID NO: 5248628 - DNA, 12 bp, Homo sapiens
atctatctacaa

SEQ ID NO: 5248629 - DNA, 14 bp, Homo sapiens
atctatctacaaag

SEQ ID NO: 5248630 - DNA, 17 bp, Homo sapiens
atctatctacaaagaaa

SEQ ID NO: 5248631 - DNA, 16 bp, Homo sapiens
atctatctagttctaa

SEQ ID NO: 5248632 - DNA, 21 bp, Homo sapiens
atctatctgcctttacctaca

SEQ ID NO: 5248633 - DNA, 20 bp, Homo sapiens
atctatctgcttatgcagtt

SEQ ID NO: 5248634 - DNA, 18 bp, Homo sapiens
atctatctgtattttcat

SEQ ID NO: 5248635 - DNA, 13 bp, Homo sapiens
atctatctgtgct

SEQ ID NO: 5248636 - DNA, 13 bp, Homo sapiens
atctatcttccaa

SEQ ID NO: 5248637 - DNA, 14 bp, Homo sapiens
atctatcttttcca

SEQ ID NO: 5248638 - DNA, 23 bp, Homo sapiens
atctatcttttccacaaatatga

SEQ ID NO: 5248639 - DNA, 20 bp, Homo sapiens
atctatgaaaaccagtggct

SEQ ID NO: 5248640 - DNA, 15 bp, Homo sapiens
atctatgaagtatat

SEQ ID NO: 5248641 - DNA, 19 bp, Homo sapiens
atctatgaagtatataatg

SEQ ID NO: 5248642 - DNA, 20 bp, Homo sapiens
atctatgaagtatataatgg

SEQ ID NO: 5248643 - DNA, 18 bp, Homo sapiens
atctatgactgtgtttaa

SEQ ID NO: 5248644 - DNA, 23 bp, Homo sapiens
atctatgagggtgtttcctctaa

SEQ ID NO: 5248645 - DNA, 22 bp, Homo sapiens
atctatgcaaagcactctctgc

SEQ ID NO: 5248646 - DNA, 13 bp, Homo sapiens
atctatgcaattt

SEQ ID NO: 5248647 - DNA, 15 bp, Homo sapiens
atctatgcaattttt

SEQ ID NO: 5248648 - DNA, 16 bp, Homo sapiens
atctatgcaattttta

SEQ ID NO: 5248649 - DNA, 24 bp, Homo sapiens
atctatgcaatttttaaactagta

SEQ ID NO: 5248650 - DNA, 23 bp, Homo sapiens
atctatgcagaacaggcagaaat

SEQ ID NO: 5248651 - DNA, 14 bp, Homo sapiens
atctatgcagcatg

SEQ ID NO: 5248652 - DNA, 18 bp, Homo sapiens
atctatgcattttctgga

SEQ ID NO: 5248653 - DNA, 17 bp, Homo sapiens
atctatgccaaagatca

SEQ ID NO: 5248654 - DNA, 16 bp, Homo sapiens
atctatgcctttcaac

SEQ ID NO: 5248655 - DNA, 22 bp, Homo sapiens
atctatggaaatgtgagaaatg

SEQ ID NO: 5248656 - DNA, 15 bp, Homo sapiens
atctatggcagtcca

SEQ ID NO: 5248657 - DNA, 19 bp, Homo sapiens
atctatggcagtccagcca

SEQ ID NO: 5248658 - DNA, 20 bp, Homo sapiens
atctatggcagtccagccag

SEQ ID NO: 5248659 - DNA, 22 bp, Homo sapiens
atctatggcagtccagccagct

SEQ ID NO: 5248660 - DNA, 15 bp, Homo sapiens
atctatgggaaaaat

SEQ ID NO: 5248661 - DNA, 19 bp, Homo sapiens
atctatgggaaatctaggc

SEQ ID NO: 5248662 - DNA, 15 bp, Homo sapiens
atctatgggcatttg

SEQ ID NO: 5248663 - DNA, 16 bp, Homo sapiens
atctatggttctaaat

SEQ ID NO: 5248664 - DNA, 13 bp, Homo sapiens
atctatgtggaaa

SEQ ID NO: 5248665 - DNA, 15 bp, Homo sapiens
atctatgtgtatgtt

SEQ ID NO: 5248666 - DNA, 13 bp, Homo sapiens
atctatgtgtttc

SEQ ID NO: 5248667 - DNA, 16 bp, Homo sapiens
atctatgtgtttctgt

SEQ ID NO: 5248668 - DNA, 17 bp, Homo sapiens
atctatgtgtttctgta

SEQ ID NO: 5248669 - DNA, 19 bp, Homo sapiens
atctatgttgcatgataaa

SEQ ID NO: 5248670 - DNA, 20 bp, Homo sapiens
atctatgtttcatcttgttt

SEQ ID NO: 5248671 - DNA, 21 bp, Homo sapiens
atctatgtttgtgtgatttcc

SEQ ID NO: 5248672 - DNA, 15 bp, Homo sapiens
atctattaaaaccac

SEQ ID NO: 5248673 - DNA, 20 bp, Homo sapiens
atctattaaaattgccattt

SEQ ID NO: 5248674 - DNA, 19 bp, Homo sapiens
atctattactctgacataa

SEQ ID NO: 5248675 - DNA, 18 bp, Homo sapiens
atctattatactgtatta

SEQ ID NO: 5248676 - DNA, 21 bp, Homo sapiens
atctattcagacaagcaacag

SEQ ID NO: 5248677 - DNA, 23 bp, Homo sapiens
atctattcccatcgctggaaaac

SEQ ID NO: 5248678 - DNA, 19 bp, Homo sapiens
atctattcctggtagaata

SEQ ID NO: 5248679 - DNA, 24 bp, Homo sapiens
atctattcttctgaccatctagtg

SEQ ID NO: 5248680 - DNA, 17 bp, Homo sapiens
atctattgatttgaaaa

SEQ ID NO: 5248681 - DNA, 23 bp, Homo sapiens
atctattgcagagactcatttca

SEQ ID NO: 5248682 - DNA, 22 bp, Homo sapiens
atctattgggttcattattgga

SEQ ID NO: 5248683 - DNA, 12 bp, Homo sapiens
atctattgtaag

SEQ ID NO: 5248684 - DNA, 17 bp, Homo sapiens
atctattgtaagataaa

SEQ ID NO: 5248685 - DNA, 23 bp, Homo sapiens
atctattgtgttggctttacaaa

SEQ ID NO: 5248686 - DNA, 16 bp, Homo sapiens
atctatttaaaaaact

SEQ ID NO: 5248687 - DNA, 19 bp, Homo sapiens
atctatttaaaaaactgta

SEQ ID NO: 5248688 - DNA, 13 bp, Homo sapiens
atctatttaagta

SEQ ID NO: 5248689 - DNA, 18 bp, Homo sapiens
atctatttatatatcata

SEQ ID NO: 5248690 - DNA, 18 bp, Homo sapiens
atctatttatctgtctga

SEQ ID NO: 5248691 - DNA, 19 bp, Homo sapiens
atctatttatctgtctgag

SEQ ID NO: 5248692 - DNA, 16 bp, Homo sapiens
atctatttatcttcat

SEQ ID NO: 5248693 - DNA, 19 bp, Homo sapiens
atctatttattaatattta

SEQ ID NO: 5248694 - DNA, 14 bp, Homo sapiens
atctatttattgga

SEQ ID NO: 5248695 - DNA, 19 bp, Homo sapiens
atctatttcatgtttttga

SEQ ID NO: 5248696 - DNA, 15 bp, Homo sapiens
atctatttctatgag

SEQ ID NO: 5248697 - DNA, 14 bp, Homo sapiens
atctatttctgaga

SEQ ID NO: 5248698 - DNA, 14 bp, Homo sapiens
atctatttgaataa

SEQ ID NO: 5248699 - DNA, 20 bp, Homo sapiens
atctatttgaataaattatg

SEQ ID NO: 5248700 - DNA, 16 bp, Homo sapiens
atctatttgtacaatt

SEQ ID NO: 5248701 - DNA, 18 bp, Homo sapiens
atctatttgtacaatttt

SEQ ID NO: 5248702 - DNA, 23 bp, Homo sapiens
atctatttgtacaattttaaagt

SEQ ID NO: 5248703 - DNA, 21 bp, Homo sapiens
atctatttgtagattaggatt

SEQ ID NO: 5248704 - DNA, 12 bp, Homo sapiens
atctatttgtat

SEQ ID NO: 5248705 - DNA, 22 bp, Homo sapiens
atctatttgtatatatacataa

SEQ ID NO: 5248706 - DNA, 16 bp, Homo sapiens
atctatttgtgtgtgt

SEQ ID NO: 5248707 - DNA, 15 bp, Homo sapiens
atctattttatttta

SEQ ID NO: 5248708 - DNA, 17 bp, Homo sapiens
atctattttattttatt

SEQ ID NO: 5248709 - DNA, 22 bp, Homo sapiens
atctattttctatgtactagta

SEQ ID NO: 5248710 - DNA, 17 bp, Homo sapiens
atctattttctcagaat

SEQ ID NO: 5248711 - DNA, 13 bp, Homo sapiens
atctattttgagt

SEQ ID NO: 5248712 - DNA, 17 bp, Homo sapiens
atctattttgatgcagc

SEQ ID NO: 5248713 - DNA, 21 bp, Homo sapiens
atctattttgatgcagcattt

SEQ ID NO: 5248714 - DNA, 21 bp, Homo sapiens
atctatttttcttcagactga

SEQ ID NO: 5248715 - DNA, 15 bp, Homo sapiens
atctatttttgcact

SEQ ID NO: 5248716 - DNA, 15 bp, Homo sapiens
atctatttttggagg

SEQ ID NO: 5248717 - DNA, 21 bp, Homo sapiens
atctatttttggaggtttatt

SEQ ID NO: 5248718 - DNA, 20 bp, Homo sapiens
atctatttttttttcttttt

SEQ ID NO: 5248719 - DNA, 22 bp, Homo sapiens
atctcaaaaaaacaagttatta

SEQ ID NO: 5248720 - DNA, 14 bp, Homo sapiens
atctcaaaaaataa

SEQ ID NO: 5248721 - DNA, 19 bp, Homo sapiens
atctcaaaactgcactgtc

SEQ ID NO: 5248722 - DNA, 14 bp, Homo sapiens
atctcaaatgtttt

SEQ ID NO: 5248723 - DNA, 16 bp, Homo sapiens
atctcaaatgttttct

SEQ ID NO: 5248724 - DNA, 18 bp, Homo sapiens
atctcaaatgttttctgc

SEQ ID NO: 5248725 - DNA, 19 bp, Homo sapiens
atctcaaattgtaattaat

SEQ ID NO: 5248726 - DNA, 16 bp, Homo sapiens
atctcaaatttctaaa

SEQ ID NO: 5248727 - DNA, 17 bp, Homo sapiens
atctcaaatttctaaat

SEQ ID NO: 5248728 - DNA, 17 bp, Homo sapiens
atctcaacaacatgtca

SEQ ID NO: 5248729 - DNA, 20 bp, Homo sapiens
atctcaacaacatgtcaaag

SEQ ID NO: 5248730 - DNA, 22 bp, Homo sapiens
atctcaacagaattaaaatgtc

SEQ ID NO: 5248731 - DNA, 19 bp, Homo sapiens
atctcaagtaaaacaaatg

SEQ ID NO: 5248732 - DNA, 15 bp, Homo sapiens
atctcaataaagcac

SEQ ID NO: 5248733 - DNA, 13 bp, Homo sapiens
atctcaatatttc

SEQ ID NO: 5248734 - DNA, 13 bp, Homo sapiens
atctcaatcctgc

SEQ ID NO: 5248735 - DNA, 18 bp, Homo sapiens
atctcaatgaagccagct

SEQ ID NO: 5248736 - DNA, 22 bp, Homo sapiens
atctcaatgtgcaataacttgt

SEQ ID NO: 5248737 - DNA, 18 bp, Homo sapiens
atctcaattgtgctttgt

SEQ ID NO: 5248738 - DNA, 12 bp, Homo sapiens
atattaaaatgc

SEQ ID NO: 5248739 - DNA, 13 bp, Homo sapiens
atattaaaatgct

SEQ ID NO: 5248740 - DNA, 14 bp, Homo sapiens
atattaaaatgcta

SEQ ID NO: 5248741 - DNA, 17 bp, Homo sapiens
atattaaaattgattgt

SEQ ID NO: 5248742 - DNA, 15 bp, Homo sapiens
atattaaaatttggt

SEQ ID NO: 5248743 - DNA, 21 bp, Homo sapiens
atattaaacaaaaacaaagaa

SEQ ID NO: 5248744 - DNA, 17 bp, Homo sapiens
atattaaacatccacaa

SEQ ID NO: 5248745 - DNA, 19 bp, Homo sapiens
atattaaacctttcagtac

SEQ ID NO: 5248746 - DNA, 14 bp, Homo sapiens
atattaaacgtgta

SEQ ID NO: 5248747 - DNA, 21 bp, Homo sapiens
atattaaacgtgtaaattgca

SEQ ID NO: 5248748 - DNA, 17 bp, Homo sapiens
atattaaacttctgatt

SEQ ID NO: 5248749 - DNA, 12 bp, Homo sapiens
atattaaagaag

SEQ ID NO: 5248750 - DNA, 22 bp, Homo sapiens
atattaaagagaaagcccgctt

SEQ ID NO: 5248751 - DNA, 15 bp, Homo sapiens
atattaaagccatgt

SEQ ID NO: 5248752 - DNA, 20 bp, Homo sapiens
atattaaagcgcaaatgaat

SEQ ID NO: 5248753 - DNA, 20 bp, Homo sapiens
atattaaaggtatacaaata

SEQ ID NO: 5248754 - DNA, 17 bp, Homo sapiens
atattaaaggtgaaaat

SEQ ID NO: 5248755 - DNA, 12 bp, Homo sapiens
atattaaagtgt

SEQ ID NO: 5248756 - DNA, 17 bp, Homo sapiens
atattaaagtgttatac

SEQ ID NO: 5248757 - DNA, 13 bp, Homo sapiens
atattaaataaca

SEQ ID NO: 5248758 - DNA, 19 bp, Homo sapiens
atattaaataacatgtttc

SEQ ID NO: 5248759 - DNA, 22 bp, Homo sapiens
atattaaataacatgtttctct

SEQ ID NO: 5248760 - DNA, 13 bp, Homo sapiens
atattaaataata

SEQ ID NO: 5248761 - DNA, 12 bp, Homo sapiens
atattaaataca

SEQ ID NO: 5248762 - DNA, 12 bp, Homo sapiens
atattaaatctg

SEQ ID NO: 5248763 - DNA, 14 bp, Homo sapiens
atattaaatgaaag

SEQ ID NO: 5248764 - DNA, 21 bp, Homo sapiens
atattaaatgaaagaatatct

SEQ ID NO: 5248765 - DNA, 13 bp, Homo sapiens
atattaaatgagg

SEQ ID NO: 5248766 - DNA, 20 bp, Homo sapiens
atattaaatgagggtttctg

SEQ ID NO: 5248767 - DNA, 22 bp, Homo sapiens
atattaaattctgaatgcaatt

SEQ ID NO: 5248768 - DNA, 23 bp, Homo sapiens
atattaaattctgaatgcaattt

SEQ ID NO: 5248769 - DNA, 16 bp, Homo sapiens
atattaaattttttgt

SEQ ID NO: 5248770 - DNA, 16 bp, Homo sapiens
atattaacaaattgca

SEQ ID NO: 5248771 - DNA, 19 bp, Homo sapiens
atattaacatattatttca

SEQ ID NO: 5248772 - DNA, 14 bp, Homo sapiens
atattaacatattc

SEQ ID NO: 5248773 - DNA, 19 bp, Homo sapiens
atattaaccagatatatat

SEQ ID NO: 5248774 - DNA, 21 bp, Homo sapiens
atattaactactgtagaactg

SEQ ID NO: 5248775 - DNA, 18 bp, Homo sapiens
atattaactcaaaagttg

SEQ ID NO: 5248776 - DNA, 13 bp, Homo sapiens
atattaagaaaat

SEQ ID NO: 5248777 - DNA, 19 bp, Homo sapiens
atattaagaaaatattcta

SEQ ID NO: 5248778 - DNA, 22 bp, Homo sapiens
atattaagaaaatattctaaca

SEQ ID NO: 5248779 - DNA, 13 bp, Homo sapiens
atattaagaaaca

SEQ ID NO: 5248780 - DNA, 14 bp, Homo sapiens
atattaagaaacaa

SEQ ID NO: 5248781 - DNA, 15 bp, Homo sapiens
atattaagaaagact

SEQ ID NO: 5248782 - DNA, 17 bp, Homo sapiens
atattaagaaagactat

SEQ ID NO: 5248783 - DNA, 12 bp, Homo sapiens
atattaagacag

SEQ ID NO: 5248784 - DNA, 13 bp, Homo sapiens
atattaagacagt

SEQ ID NO: 5248785 - DNA, 17 bp, Homo sapiens
atattaagacagtgtac

SEQ ID NO: 5248786 - DNA, 20 bp, Homo sapiens
atattaagacagtgtacaaa

SEQ ID NO: 5248787 - DNA, 22 bp, Homo sapiens
atattaaggggatcagaagtag

SEQ ID NO: 5248788 - DNA, 20 bp, Homo sapiens
atattaagtaagtctcaagg

SEQ ID NO: 5248789 - DNA, 18 bp, Homo sapiens
atattaagtgtgccaaat

SEQ ID NO: 5248790 - DNA, 16 bp, Homo sapiens
atattaatataagttt

SEQ ID NO: 5248791 - DNA, 19 bp, Homo sapiens
atattaatataagtttctt

SEQ ID NO: 5248792 - DNA, 16 bp, Homo sapiens
atattaatatgtactt

SEQ ID NO: 5248793 - DNA, 14 bp, Homo sapiens
atattaatcaaaat

SEQ ID NO: 5248794 - DNA, 14 bp, Homo sapiens
atattaatcagcat

SEQ ID NO: 5248795 - DNA, 23 bp, Homo sapiens
atattaatgcctttaaagtatga

SEQ ID NO: 5248796 - DNA, 12 bp, Homo sapiens
atattaatgtac

SEQ ID NO: 5248797 - DNA, 24 bp, Homo sapiens
atattaattagtttatattactct

SEQ ID NO: 5248798 - DNA, 18 bp, Homo sapiens
atattaattattttccaa

SEQ ID NO: 5248799 - DNA, 14 bp, Homo sapiens
atattaattgcctg

SEQ ID NO: 5248800 - DNA, 16 bp, Homo sapiens
atattacaaaaacaaa

SEQ ID NO: 5248801 - DNA, 22 bp, Homo sapiens
atattacaaaaacaaaataaaa

SEQ ID NO: 5248802 - DNA, 15 bp, Homo sapiens
atattacaatatttg

SEQ ID NO: 5248803 - DNA, 17 bp, Homo sapiens
atattacaatatttgtg

SEQ ID NO: 5248804 - DNA, 23 bp, Homo sapiens
atattacacaaatacttattcat

SEQ ID NO: 5248805 - DNA, 12 bp, Homo sapiens
atattacaccaa

SEQ ID NO: 5248806 - DNA, 23 bp, Homo sapiens
atattacagataaaatgtaaact

SEQ ID NO: 5248807 - DNA, 20 bp, Homo sapiens
atattacaggggcttgaaca

SEQ ID NO: 5248808 - DNA, 18 bp, Homo sapiens
atattacatgtaaagctg

SEQ ID NO: 5248809 - DNA, 19 bp, Homo sapiens
atattacatgtaaagctgt

SEQ ID NO: 5248810 - DNA, 17 bp, Homo sapiens
atattacattgcattca

SEQ ID NO: 5248811 - DNA, 22 bp, Homo sapiens
atattacatttatttatccaga

SEQ ID NO: 5248812 - DNA, 17 bp, Homo sapiens
atattaccacagacata

SEQ ID NO: 5248813 - DNA, 14 bp, Homo sapiens
atattacctggatt

SEQ ID NO: 5248814 - DNA, 21 bp, Homo sapiens
atattaccttaagatttttct

SEQ ID NO: 5248815 - DNA, 18 bp, Homo sapiens
atattacggaggaacaga

SEQ ID NO: 5248816 - DNA, 15 bp, Homo sapiens
atattacgttgtttc

SEQ ID NO: 5248817 - DNA, 16 bp, Homo sapiens
atattacgttgtttct

SEQ ID NO: 5248818 - DNA, 16 bp, Homo sapiens
atattactactccttt

SEQ ID NO: 5248819 - DNA, 18 bp, Homo sapiens
atattactaggtgacatg

SEQ ID NO: 5248820 - DNA, 23 bp, Homo sapiens
atattactaggtgacatgtctac

SEQ ID NO: 5248821 - DNA, 22 bp, Homo sapiens
atattactcctatttttgtaaa

SEQ ID NO: 5248822 - DNA, 16 bp, Homo sapiens
atattactgacatttc

SEQ ID NO: 5248823 - DNA, 14 bp, Homo sapiens
atattactgattta

SEQ ID NO: 5248824 - DNA, 15 bp, Homo sapiens
atattactgatttag

SEQ ID NO: 5248825 - DNA, 17 bp, Homo sapiens
atattactgatttagaa

SEQ ID NO: 5248826 - DNA, 18 bp, Homo sapiens
atattactgttgcattta

SEQ ID NO: 5248827 - DNA, 18 bp, Homo sapiens
atattactgtttatttct

SEQ ID NO: 5248828 - DNA, 11 bp, Homo sapiens
atattacttta

SEQ ID NO: 5248829 - DNA, 17 bp, Homo sapiens
atattactttaacatgc

SEQ ID NO: 5248830 - DNA, 12 bp, Homo sapiens
atattactttat

SEQ ID NO: 5248831 - DNA, 14 bp, Homo sapiens
atattacttttgta

SEQ ID NO: 5248832 - DNA, 16 bp, Homo sapiens
atattacttttgtaaa

SEQ ID NO: 5248833 - DNA, 19 bp, Homo sapiens
atattacttttgtaaatat

SEQ ID NO: 5248834 - DNA, 15 bp, Homo sapiens
atattagaaaggctc

SEQ ID NO: 5248835 - DNA, 14 bp, Homo sapiens
atattagaagtgtt

SEQ ID NO: 5248836 - DNA, 15 bp, Homo sapiens
atattagacttctgt

SEQ ID NO: 5248837 - DNA, 15 bp, Homo sapiens
atattagatgtgatt

SEQ ID NO: 5248838 - DNA, 14 bp, Homo sapiens
atattagcaaagaa

SEQ ID NO: 5248839 - DNA, 22 bp, Homo sapiens
atattagcatttagtccaatgt

SEQ ID NO: 5248840 - DNA, 22 bp, Homo sapiens
atattagcgacaacagattgga

SEQ ID NO: 5248841 - DNA, 15 bp, Homo sapiens
atattagctgaaaca

SEQ ID NO: 5248842 - DNA, 20 bp, Homo sapiens
atattagctttactgtttgt

SEQ ID NO: 5248843 - DNA, 22 bp, Homo sapiens
atattaggatctgcaaacaatg

SEQ ID NO: 5248844 - DNA, 22 bp, Homo sapiens
atattaggcataaattaaaatg

SEQ ID NO: 5248845 - DNA, 18 bp, Homo sapiens
atattaggggatggagag

SEQ ID NO: 5248846 - DNA, 17 bp, Homo sapiens
atattaggggggaaagt

SEQ ID NO: 5248847 - DNA, 14 bp, Homo sapiens
atattagtgattct

SEQ ID NO: 5248848 - DNA, 23 bp, Homo sapiens
atattagtgattctgatttcagt

SEQ ID NO: 5248849 - DNA, 14 bp, Homo sapiens
atattagttaatga

SEQ ID NO: 5248850 - DNA, 16 bp, Homo sapiens
atattataaaaatatc

SEQ ID NO: 5248851 - DNA, 13 bp, Homo sapiens
atattataaagga

SEQ ID NO: 5248852 - DNA, 23 bp, Homo sapiens
atattataaaggataaagaagga

SEQ ID NO: 5248853 - DNA, 13 bp, Homo sapiens
atattataaataa

SEQ ID NO: 5248854 - DNA, 14 bp, Homo sapiens
atattataaataaa

SEQ ID NO: 5248855 - DNA, 15 bp, Homo sapiens
atattataaataaat

SEQ ID NO: 5248856 - DNA, 18 bp, Homo sapiens
atattataaataaatgcc

SEQ ID NO: 5248857 - DNA, 14 bp, Homo sapiens
atattataaatcca

SEQ ID NO: 5248858 - DNA, 21 bp, Homo sapiens
atattataactctgtataata

SEQ ID NO: 5248859 - DNA, 21 bp, Homo sapiens
atattataagttgacctttat

SEQ ID NO: 5248860 - DNA, 19 bp, Homo sapiens
atattataataatgttctc

SEQ ID NO: 5248861 - DNA, 22 bp, Homo sapiens
atattatacttgtaattatgga

SEQ ID NO: 5248862 - DNA, 13 bp, Homo sapiens
atattatagaaaa

SEQ ID NO: 5248863 - DNA, 22 bp, Homo sapiens
atattatagaaaattatttgta

SEQ ID NO: 5248864 - DNA, 14 bp, Homo sapiens
atattatataaaga

SEQ ID NO: 5248865 - DNA, 13 bp, Homo sapiens
atattatatagga

SEQ ID NO: 5248866 - DNA, 18 bp, Homo sapiens
atattatataggatattg

SEQ ID NO: 5248867 - DNA, 13 bp, Homo sapiens
atattatatatac

SEQ ID NO: 5248868 - DNA, 17 bp, Homo sapiens
atattatatatacatta

SEQ ID NO: 5248869 - DNA, 18 bp, Homo sapiens
atattatatatacattag

SEQ ID NO: 5248870 - DNA, 14 bp, Homo sapiens
atattatatataga

SEQ ID NO: 5248871 - DNA, 15 bp, Homo sapiens
atattatatatatct

SEQ ID NO: 5248872 - DNA, 22 bp, Homo sapiens
atattatatatattttgtttct

SEQ ID NO: 5248873 - DNA, 12 bp, Homo sapiens
atattatatatg

SEQ ID NO: 5248874 - DNA, 13 bp, Homo sapiens
atattatatggaa

SEQ ID NO: 5248875 - DNA, 17 bp, Homo sapiens
atattatattgtattta

SEQ ID NO: 5248876 - DNA, 13 bp, Homo sapiens
atattatatttgg

SEQ ID NO: 5248877 - DNA, 22 bp, Homo sapiens
atattatatttggatgcagagt

SEQ ID NO: 5248878 - DNA, 18 bp, Homo sapiens
atattatcagacaagatg

SEQ ID NO: 5248879 - DNA, 17 bp, Homo sapiens
atattatcataagaatt

SEQ ID NO: 5248880 - DNA, 18 bp, Homo sapiens
atattatcataagaattt

SEQ ID NO: 5248881 - DNA, 19 bp, Homo sapiens
atattatcatcctataaag

SEQ ID NO: 5248882 - DNA, 21 bp, Homo sapiens
atattatcatcctataaagaa

SEQ ID NO: 5248883 - DNA, 21 bp, Homo sapiens
atattatcatgcaaatgctgt

SEQ ID NO: 5248884 - DNA, 21 bp, Homo sapiens
atattatcatttctcctttaa

SEQ ID NO: 5248885 - DNA, 14 bp, Homo sapiens
atattatctgaact

SEQ ID NO: 5248886 - DNA, 20 bp, Homo sapiens
atattatcttatactgaaaa

SEQ ID NO: 5248887 - DNA, 21 bp, Homo sapiens
atattatcttatactgaaaaa

SEQ ID NO: 5248888 - DNA, 13 bp, Homo sapiens
atattatctttgt

SEQ ID NO: 5248889 - DNA, 13 bp, Homo sapiens
atattatcttttc

SEQ ID NO: 5248890 - DNA, 20 bp, Homo sapiens
atattatgaaaattaagatt

SEQ ID NO: 5248891 - DNA, 17 bp, Homo sapiens
atattatgaaatttcac

SEQ ID NO: 5248892 - DNA, 15 bp, Homo sapiens
atattatgaataaaa

SEQ ID NO: 5248893 - DNA, 14 bp, Homo sapiens
atattatgagatgc

SEQ ID NO: 5248894 - DNA, 16 bp, Homo sapiens
atattatgagatgctg

SEQ ID NO: 5248895 - DNA, 15 bp, Homo sapiens
atattatgattttat

SEQ ID NO: 5248896 - DNA, 16 bp, Homo sapiens
atattatgattttatt

SEQ ID NO: 5248897 - DNA, 19 bp, Homo sapiens
atattatgcaaattcccag

SEQ ID NO: 5248898 - DNA, 16 bp, Homo sapiens
atattatggaagattt

SEQ ID NO: 5248899 - DNA, 21 bp, Homo sapiens
atattatggcaagtgatatca

SEQ ID NO: 5248900 - DNA, 16 bp, Homo sapiens
atattatggtgtaatg

SEQ ID NO: 5248901 - DNA, 21 bp, Homo sapiens
atattatggtgtaatgcacaa

SEQ ID NO: 5248902 - DNA, 16 bp, Homo sapiens
atattatgtataaaat

SEQ ID NO: 5248903 - DNA, 19 bp, Homo sapiens
atattatgtataaaatgta

SEQ ID NO: 5248904 - DNA, 20 bp, Homo sapiens
atattatgtataaaatgtaa

SEQ ID NO: 5248905 - DNA, 18 bp, Homo sapiens
atattatgtatagaaaat

SEQ ID NO: 5248906 - DNA, 12 bp, Homo sapiens
atattatgtctt

SEQ ID NO: 5248907 - DNA, 15 bp, Homo sapiens
atattatgtgaagaa

SEQ ID NO: 5248908 - DNA, 16 bp, Homo sapiens
atattatgtgaagaat

SEQ ID NO: 5248909 - DNA, 18 bp, Homo sapiens
atattatgtgaagaattt

SEQ ID NO: 5248910 - DNA, 13 bp, Homo sapiens
atattatgtgttt

SEQ ID NO: 5248911 - DNA, 16 bp, Homo sapiens
atattatgttaaaact

SEQ ID NO: 5248912 - DNA, 16 bp, Homo sapiens
atattattaacttgta

SEQ ID NO: 5248913 - DNA, 14 bp, Homo sapiens
atattattaatata

SEQ ID NO: 5248914 - DNA, 19 bp, Homo sapiens
atattattacttgtaaata

SEQ ID NO: 5248915 - DNA, 22 bp, Homo sapiens
atattattagttttgatttaat

SEQ ID NO: 5248916 - DNA, 13 bp, Homo sapiens
atattattatata

SEQ ID NO: 5248917 - DNA, 15 bp, Homo sapiens
atattattatatata

SEQ ID NO: 5248918 - DNA, 13 bp, Homo sapiens
atctcaatttaag

SEQ ID NO: 5248919 - DNA, 14 bp, Homo sapiens
atctcaatttgagt

SEQ ID NO: 5248920 - DNA, 16 bp, Homo sapiens
atctcacaaataagta

SEQ ID NO: 5248921 - DNA, 15 bp, Homo sapiens
atctcacacatgagc

SEQ ID NO: 5248922 - DNA, 16 bp, Homo sapiens
atctcacacatgagca

SEQ ID NO: 5248923 - DNA, 11 bp, Homo sapiens
atctcacactc

SEQ ID NO: 5248924 - DNA, 22 bp, Homo sapiens
atctcacagcatttgccaagtc

SEQ ID NO: 5248925 - DNA, 12 bp, Homo sapiens
atctcacagcta

SEQ ID NO: 5248926 - DNA, 15 bp, Homo sapiens
atctcacagctatgc

SEQ ID NO: 5248927 - DNA, 18 bp, Homo sapiens
atctcacatatacaagta

SEQ ID NO: 5248928 - DNA, 18 bp, Homo sapiens
atctcaccaggcagcctc

SEQ ID NO: 5248929 - DNA, 23 bp, Homo sapiens
atctcacctaatggttgtacata

SEQ ID NO: 5248930 - DNA, 20 bp, Homo sapiens
atctcacctcctgctgggca

SEQ ID NO: 5248931 - DNA, 21 bp, Homo sapiens
atctcacctcctgctgggcag

SEQ ID NO: 5248932 - DNA, 20 bp, Homo sapiens
atctcacgctgatcattgga

SEQ ID NO: 5248933 - DNA, 23 bp, Homo sapiens
atctcacgctgccatttccctga

SEQ ID NO: 5248934 - DNA, 17 bp, Homo sapiens
atctcactgtattaaag

SEQ ID NO: 5248935 - DNA, 19 bp, Homo sapiens
atctcactgtattaaagat

SEQ ID NO: 5248936 - DNA, 20 bp, Homo sapiens
atctcacttcagttgtggcc

SEQ ID NO: 5248937 - DNA, 21 bp, Homo sapiens
atctcacttcagttgtggcct

SEQ ID NO: 5248938 - DNA, 13 bp, Homo sapiens
atctcacttgtgc

SEQ ID NO: 5248939 - DNA, 17 bp, Homo sapiens
atctcactttaataata

SEQ ID NO: 5248940 - DNA, 14 bp, Homo sapiens
atctcactttgtaa

SEQ ID NO: 5248941 - DNA, 15 bp, Homo sapiens
atctcagaaagtgcc

SEQ ID NO: 5248942 - DNA, 12 bp, Homo sapiens
atctcagaacct

SEQ ID NO: 5248943 - DNA, 23 bp, Homo sapiens
atctcagaaccttgtcccagcca

SEQ ID NO: 5248944 - DNA, 21 bp, Homo sapiens
atctcagaaggggatggtgtt

SEQ ID NO: 5248945 - DNA, 16 bp, Homo sapiens
atctcagacacacatg

SEQ ID NO: 5248946 - DNA, 13 bp, Homo sapiens
atctcagaccctg

SEQ ID NO: 5248947 - DNA, 14 bp, Homo sapiens
atctcagaccctgc

SEQ ID NO: 5248948 - DNA, 21 bp, Homo sapiens
atctcagaccctgcttaggat

SEQ ID NO: 5248949 - DNA, 19 bp, Homo sapiens
atctcagaggctcagagac

SEQ ID NO: 5248950 - DNA, 15 bp, Homo sapiens
atctcagatatttgc

SEQ ID NO: 5248951 - DNA, 17 bp, Homo sapiens
atctcagatatttgcac

SEQ ID NO: 5248952 - DNA, 20 bp, Homo sapiens
atctcagatcagtgtaccat

SEQ ID NO: 5248953 - DNA, 18 bp, Homo sapiens
atctcagatgttaaaata

SEQ ID NO: 5248954 - DNA, 23 bp, Homo sapiens
atctcagatgttaaaataaatgg

SEQ ID NO: 5248955 - DNA, 18 bp, Homo sapiens
atctcagattctgtctaa

SEQ ID NO: 5248956 - DNA, 22 bp, Homo sapiens
atctcagcaaagctacaggact

SEQ ID NO: 5248957 - DNA, 11 bp, Homo sapiens
atctcagcagc

SEQ ID NO: 5248958 - DNA, 23 bp, Homo sapiens
atctcagcagccagctcctggta

SEQ ID NO: 5248959 - DNA, 15 bp, Homo sapiens
atctcagccatccgc

SEQ ID NO: 5248960 - DNA, 11 bp, Homo sapiens
atctcagccca

SEQ ID NO: 5248961 - DNA, 14 bp, Homo sapiens
atctcagcctcctg

SEQ ID NO: 5248962 - DNA, 16 bp, Homo sapiens
atctcagcctcctgag

SEQ ID NO: 5248963 - DNA, 20 bp, Homo sapiens
atctcagcctcctgagcctg

SEQ ID NO: 5248964 - DNA, 14 bp, Homo sapiens
atctcagctcactg

SEQ ID NO: 5248965 - DNA, 15 bp, Homo sapiens
atctcagctcactgc

SEQ ID NO: 5248966 - DNA, 14 bp, Homo sapiens
atctcagcttgctg

SEQ ID NO: 5248967 - DNA, 14 bp, Homo sapiens
atctcaggagatgg

SEQ ID NO: 5248968 - DNA, 18 bp, Homo sapiens
atctcaggagatttcatg

SEQ ID NO: 5248969 - DNA, 12 bp, Homo sapiens
atctcaggagcc

SEQ ID NO: 5248970 - DNA, 21 bp, Homo sapiens
atctcaggagcttgcaagaag

SEQ ID NO: 5248971 - DNA, 14 bp, Homo sapiens
atctcaggccagag

SEQ ID NO: 5248972 - DNA, 16 bp, Homo sapiens
atctcaggcttctgca

SEQ ID NO: 5248973 - DNA, 17 bp, Homo sapiens
atctcaggcttctgcag

SEQ ID NO: 5248974 - DNA, 18 bp, Homo sapiens
atctcagggaagcccagc

SEQ ID NO: 5248975 - DNA, 12 bp, Homo sapiens
atctcagggagg

SEQ ID NO: 5248976 - DNA, 14 bp, Homo sapiens
atctcagggcctgg

SEQ ID NO: 5248977 - DNA, 16 bp, Homo sapiens
atctcaggggccagag

SEQ ID NO: 5248978 - DNA, 12 bp, Homo sapiens
atctcaggtgag

SEQ ID NO: 5248979 - DNA, 15 bp, Homo sapiens
atctcaggtgccact

SEQ ID NO: 5248980 - DNA, 16 bp, Homo sapiens
atctcaggtgccactc

SEQ ID NO: 5248981 - DNA, 23 bp, Homo sapiens
atctcaggttggcggcagacaca

SEQ ID NO: 5248982 - DNA, 18 bp, Homo sapiens
atctcagtcactttttcc

SEQ ID NO: 5248983 - DNA, 21 bp, Homo sapiens
atctcagtcactttttcccct

SEQ ID NO: 5248984 - DNA, 22 bp, Homo sapiens
atctcagtcactttttcccctg

SEQ ID NO: 5248985 - DNA, 14 bp, Homo sapiens
atctcagtgctttc

SEQ ID NO: 5248986 - DNA, 18 bp, Homo sapiens
atctcagtggtgtgtgaa

SEQ ID NO: 5248987 - DNA, 20 bp, Homo sapiens
atctcagtggtgtgtgaagt

SEQ ID NO: 5248988 - DNA, 14 bp, Homo sapiens
atctcagtttttaa

SEQ ID NO: 5248989 - DNA, 19 bp, Homo sapiens
atctcataatgctttgtta

SEQ ID NO: 5248990 - DNA, 15 bp, Homo sapiens
atctcatactgtctg

SEQ ID NO: 5248991 - DNA, 14 bp, Homo sapiens
atctcatagggatg

SEQ ID NO: 5248992 - DNA, 20 bp, Homo sapiens
atctcatagggatgctgtga

SEQ ID NO: 5248993 - DNA, 23 bp, Homo sapiens
atctcataggttgccaataatac

SEQ ID NO: 5248994 - DNA, 19 bp, Homo sapiens
atctcatcccaacaaactt

SEQ ID NO: 5248995 - DNA, 16 bp, Homo sapiens
atctcatcccaataaa

SEQ ID NO: 5248996 - DNA, 14 bp, Homo sapiens
atctcatcccccca

SEQ ID NO: 5248997 - DNA, 18 bp, Homo sapiens
atctcatccccccacccg

SEQ ID NO: 5248998 - DNA, 22 bp, Homo sapiens
atctcatcctattacttttcat

SEQ ID NO: 5248999 - DNA, 15 bp, Homo sapiens
atctcatctatctca

SEQ ID NO: 5249000 - DNA, 19 bp, Homo sapiens
atctcatctcagtgaagaa

SEQ ID NO: 5249001 - DNA, 15 bp, Homo sapiens
atctcatctgtctcg

SEQ ID NO: 5249002 - DNA, 18 bp, Homo sapiens
atctcatctgtctcggct

SEQ ID NO: 5249003 - DNA, 15 bp, Homo sapiens
atctcatgacattat

SEQ ID NO: 5249004 - DNA, 18 bp, Homo sapiens
atctcatgaggggagagg

SEQ ID NO: 5249005 - DNA, 13 bp, Homo sapiens
atctcatgctctc

SEQ ID NO: 5249006 - DNA, 15 bp, Homo sapiens
atctcatgctctctg

SEQ ID NO: 5249007 - DNA, 24 bp, Homo sapiens
atctcatggagaagcagaaataca

SEQ ID NO: 5249008 - DNA, 19 bp, Homo sapiens
atctcatgtatcatctgga

SEQ ID NO: 5249009 - DNA, 16 bp, Homo sapiens
atctcatgtgtgctca

SEQ ID NO: 5249010 - DNA, 22 bp, Homo sapiens
atctcattactgcttcattttt

SEQ ID NO: 5249011 - DNA, 14 bp, Homo sapiens
atctcattatttct

SEQ ID NO: 5249012 - DNA, 15 bp, Homo sapiens
atctcattatttctg

SEQ ID NO: 5249013 - DNA, 20 bp, Homo sapiens
atctcattgaaaaaaatata

SEQ ID NO: 5249014 - DNA, 14 bp, Homo sapiens
atctcattggaccc

SEQ ID NO: 5249015 - DNA, 20 bp, Homo sapiens
atctcattgttcaattccca

SEQ ID NO: 5249016 - DNA, 16 bp, Homo sapiens
atctcatttaagggaa

SEQ ID NO: 5249017 - DNA, 21 bp, Homo sapiens
atctcatttccaagcaagtat

SEQ ID NO: 5249018 - DNA, 23 bp, Homo sapiens
atctcatttccaagcaagtatta

SEQ ID NO: 5249019 - DNA, 13 bp, Homo sapiens
atctcatttggtt

SEQ ID NO: 5249020 - DNA, 21 bp, Homo sapiens
atctcatttttccgtaaaaat

SEQ ID NO: 5249021 - DNA, 13 bp, Homo sapiens
atctccaaaaaca

SEQ ID NO: 5249022 - DNA, 23 bp, Homo sapiens
atctccaaaaacagtaaaaataa

SEQ ID NO: 5249023 - DNA, 13 bp, Homo sapiens
atctccaaagctt

SEQ ID NO: 5249024 - DNA, 16 bp, Homo sapiens
atctccaaatcttgcc

SEQ ID NO: 5249025 - DNA, 21 bp, Homo sapiens
atctccaactttattttgaat

SEQ ID NO: 5249026 - DNA, 22 bp, Homo sapiens
atctccaactttattttgaatg

SEQ ID NO: 5249027 - DNA, 16 bp, Homo sapiens
atctccaagaatgctg

SEQ ID NO: 5249028 - DNA, 18 bp, Homo sapiens
atctccaagaatgctgaa

SEQ ID NO: 5249029 - DNA, 13 bp, Homo sapiens
atctccaagacct

SEQ ID NO: 5249030 - DNA, 15 bp, Homo sapiens
atctccaagacctgg

SEQ ID NO: 5249031 - DNA, 20 bp, Homo sapiens
atctccaagataagcctgag

SEQ ID NO: 5249032 - DNA, 21 bp, Homo sapiens
atctccaagataagcctgagc

SEQ ID NO: 5249033 - DNA, 12 bp, Homo sapiens
atctccaaggac

SEQ ID NO: 5249034 - DNA, 16 bp, Homo sapiens
atctccaaggaccagg

SEQ ID NO: 5249035 - DNA, 15 bp, Homo sapiens
atctccaattgcctc

SEQ ID NO: 5249036 - DNA, 17 bp, Homo sapiens
atctccaccagtcattt

SEQ ID NO: 5249037 - DNA, 20 bp, Homo sapiens
atctccacccaatgaatgat

SEQ ID NO: 5249038 - DNA, 15 bp, Homo sapiens
atctccacccccagc

SEQ ID NO: 5249039 - DNA, 19 bp, Homo sapiens
atctccaccctgagcctga

SEQ ID NO: 5249040 - DNA, 15 bp, Homo sapiens
atctccacctgctcc

SEQ ID NO: 5249041 - DNA, 19 bp, Homo sapiens
atctccacctgctcccagg

SEQ ID NO: 5249042 - DNA, 16 bp, Homo sapiens
atctccactggaccct

SEQ ID NO: 5249043 - DNA, 17 bp, Homo sapiens
atctccacttttttcat

SEQ ID NO: 5249044 - DNA, 17 bp, Homo sapiens
atctccagccaatttca

SEQ ID NO: 5249045 - DNA, 17 bp, Homo sapiens
atctccagcttactata

SEQ ID NO: 5249046 - DNA, 10 bp, Homo sapiens
atctccaggc

SEQ ID NO: 5249047 - DNA, 14 bp, Homo sapiens
atctccaggcccag

SEQ ID NO: 5249048 - DNA, 15 bp, Homo sapiens
atctccaggcccagc

SEQ ID NO: 5249049 - DNA, 18 bp, Homo sapiens
atctccaggcccagcctg

SEQ ID NO: 5249050 - DNA, 16 bp, Homo sapiens
atctccaggctccctc

SEQ ID NO: 5249051 - DNA, 14 bp, Homo sapiens
atctccagggaagc

SEQ ID NO: 5249052 - DNA, 15 bp, Homo sapiens
atctccagggaagcg

SEQ ID NO: 5249053 - DNA, 21 bp, Homo sapiens
atctccagggagcaagacaga

SEQ ID NO: 5249054 - DNA, 21 bp, Homo sapiens
atctccagggagtcccctccc

SEQ ID NO: 5249055 - DNA, 18 bp, Homo sapiens
atctccagggctgcccct

SEQ ID NO: 5249056 - DNA, 16 bp, Homo sapiens
atctccatactttgga

SEQ ID NO: 5249057 - DNA, 21 bp, Homo sapiens
atctccatccttaactgtcca

SEQ ID NO: 5249058 - DNA, 22 bp, Homo sapiens
atctccatccttaactgtccag

SEQ ID NO: 5249059 - DNA, 15 bp, Homo sapiens
atctccatctgtcaa

SEQ ID NO: 5249060 - DNA, 22 bp, Homo sapiens
atctccatgctctttcaccctg

SEQ ID NO: 5249061 - DNA, 15 bp, Homo sapiens
atctccatggcttcc

SEQ ID NO: 5249062 - DNA, 17 bp, Homo sapiens
atctccatggcttcctc

SEQ ID NO: 5249063 - DNA, 23 bp, Homo sapiens
atctccatgtagaataaatgaag

SEQ ID NO: 5249064 - DNA, 17 bp, Homo sapiens
atctccatttcacacag

SEQ ID NO: 5249065 - DNA, 18 bp, Homo sapiens
atctcccaaggctgccag

SEQ ID NO: 5249066 - DNA, 17 bp, Homo sapiens
atctcccagacttgttt

SEQ ID NO: 5249067 - DNA, 21 bp, Homo sapiens
atctcccagacttgtttcctg

SEQ ID NO: 5249068 - DNA, 19 bp, Homo sapiens
atctcccagataatgtgaa

SEQ ID NO: 5249069 - DNA, 16 bp, Homo sapiens
atctcccagatcctgg

SEQ ID NO: 5249070 - DNA, 18 bp, Homo sapiens
atctcccagcccacctca

SEQ ID NO: 5249071 - DNA, 11 bp, Homo sapiens
atctcccaggg

SEQ ID NO: 5249072 - DNA, 13 bp, Homo sapiens
atctcccagggct

SEQ ID NO: 5249073 - DNA, 21 bp, Homo sapiens
atctcccagggctctctggac

SEQ ID NO: 5249074 - DNA, 20 bp, Homo sapiens
atctcccatggtccctagca

SEQ ID NO: 5249075 - DNA, 20 bp, Homo sapiens
atctcccatgtgtgatgctg

SEQ ID NO: 5249076 - DNA, 13 bp, Homo sapiens
atctccccactct

SEQ ID NO: 5249077 - DNA, 14 bp, Homo sapiens
atctccccactcta

SEQ ID NO: 5249078 - DNA, 12 bp, Homo sapiens
atctccccaggc

SEQ ID NO: 5249079 - DNA, 22 bp, Homo sapiens
atctccccagtagagaaacatt

SEQ ID NO: 5249080 - DNA, 14 bp, Homo sapiens
atctcccccaaccc

SEQ ID NO: 5249081 - DNA, 17 bp, Homo sapiens
atctcccccaacccacc

SEQ ID NO: 5249082 - DNA, 21 bp, Homo sapiens
atctcccccaacccacctctg

SEQ ID NO: 5249083 - DNA, 19 bp, Homo sapiens
atctcccccaccctgtgcc

SEQ ID NO: 5249084 - DNA, 13 bp, Homo sapiens
atctcccccagcc

SEQ ID NO: 5249085 - DNA, 21 bp, Homo sapiens
atctcccccatagcaccctgc

SEQ ID NO: 5249086 - DNA, 18 bp, Homo sapiens
atctccccgaatctcaat

SEQ ID NO: 5249087 - DNA, 20 bp, Homo sapiens
atctcccctagctcaccagg

SEQ ID NO: 5249088 - DNA, 22 bp, Homo sapiens
atctcccctagctcaccaggcc

SEQ ID NO: 5249089 - DNA, 16 bp, Homo sapiens
atctcccctcctcaca

SEQ ID NO: 5249090 - DNA, 22 bp, Homo sapiens
atctcccctcctggcgagttct

SEQ ID NO: 5249091 - DNA, 23 bp, Homo sapiens
atctccccttgcactaaagtatg

SEQ ID NO: 5249092 - DNA, 15 bp, Homo sapiens
atctcccgctgctgc

SEQ ID NO: 5249093 - DNA, 14 bp, Homo sapiens
atctccctcccaca

SEQ ID NO: 5249094 - DNA, 14 bp, Homo sapiens
atctccctccccag

SEQ ID NO: 5249095 - DNA, 16 bp, Homo sapiens
atctccctgaccttct

SEQ ID NO: 5249096 - DNA, 17 bp, Homo sapiens
atctccctgccatcccc

SEQ ID NO: 5249097 - DNA, 21 bp, Homo sapiens
atctccctgccatccccctct

SEQ ID NO: 5249098 - DNA, 20 bp, Homo sapiens
atattattcaccatgtaaaa

SEQ ID NO: 5249099 - DNA, 17 bp, Homo sapiens
atattattcattcattt

SEQ ID NO: 5249100 - DNA, 15 bp, Homo sapiens
atattattctcattt

SEQ ID NO: 5249101 - DNA, 22 bp, Homo sapiens
atattattgctatatttgctaa

SEQ ID NO: 5249102 - DNA, 11 bp, Homo sapiens
atattattggg

SEQ ID NO: 5249103 - DNA, 19 bp, Homo sapiens
atattattgtaagttgtac

SEQ ID NO: 5249104 - DNA, 20 bp, Homo sapiens
atattatttctaggaagaat

SEQ ID NO: 5249105 - DNA, 13 bp, Homo sapiens
atattatttcttc

SEQ ID NO: 5249106 - DNA, 14 bp, Homo sapiens
atattatttcttct

SEQ ID NO: 5249107 - DNA, 16 bp, Homo sapiens
atattatttgatatct

SEQ ID NO: 5249108 - DNA, 22 bp, Homo sapiens
atattatttgcagtgcagtata

SEQ ID NO: 5249109 - DNA, 14 bp, Homo sapiens
atattattttaaat

SEQ ID NO: 5249110 - DNA, 14 bp, Homo sapiens
atattattttaatt

SEQ ID NO: 5249111 - DNA, 23 bp, Homo sapiens
atattattttaattttttctctt

SEQ ID NO: 5249112 - DNA, 20 bp, Homo sapiens
atattattttagcttcagtt

SEQ ID NO: 5249113 - DNA, 15 bp, Homo sapiens
atattattttagtgt

SEQ ID NO: 5249114 - DNA, 21 bp, Homo sapiens
atattattttagtgtgtaaaa

SEQ ID NO: 5249115 - DNA, 23 bp, Homo sapiens
atattattttagtgtgtaaaatt

SEQ ID NO: 5249116 - DNA, 14 bp, Homo sapiens
atattattttatgt

SEQ ID NO: 5249117 - DNA, 22 bp, Homo sapiens
atattattttatgttgcataga

SEQ ID NO: 5249118 - DNA, 13 bp, Homo sapiens
atattattttctg

SEQ ID NO: 5249119 - DNA, 21 bp, Homo sapiens
atattattttctgtaattctt

SEQ ID NO: 5249120 - DNA, 17 bp, Homo sapiens
atattcaaaaattatat

SEQ ID NO: 5249121 - DNA, 21 bp, Homo sapiens
atattcaaaaattatattttg

SEQ ID NO: 5249122 - DNA, 15 bp, Homo sapiens
atattcaaacacaca

SEQ ID NO: 5249123 - DNA, 21 bp, Homo sapiens
atattcaaagtatatacagag

SEQ ID NO: 5249124 - DNA, 14 bp, Homo sapiens
atattcaaattcat

SEQ ID NO: 5249125 - DNA, 15 bp, Homo sapiens
atattcaacacactg

SEQ ID NO: 5249126 - DNA, 22 bp, Homo sapiens
atattcaacacactgccttatt

SEQ ID NO: 5249127 - DNA, 23 bp, Homo sapiens
atattcaaccatggactttataa

SEQ ID NO: 5249128 - DNA, 15 bp, Homo sapiens
atattcaaggcttta

SEQ ID NO: 5249129 - DNA, 21 bp, Homo sapiens
atattcaaggctttaaaagtc

SEQ ID NO: 5249130 - DNA, 17 bp, Homo sapiens
atattcaagtaacactt

SEQ ID NO: 5249131 - DNA, 14 bp, Homo sapiens
atattcaagtgata

SEQ ID NO: 5249132 - DNA, 15 bp, Homo sapiens
atattcaatgcattt

SEQ ID NO: 5249133 - DNA, 16 bp, Homo sapiens
atattcaatgcattta

SEQ ID NO: 5249134 - DNA, 17 bp, Homo sapiens
atattcaatgcatttaa

SEQ ID NO: 5249135 - DNA, 16 bp, Homo sapiens
atattcacagactgat

SEQ ID NO: 5249136 - DNA, 21 bp, Homo sapiens
atattcacagactgattggaa

SEQ ID NO: 5249137 - DNA, 15 bp, Homo sapiens
atattcaccaatgtt

SEQ ID NO: 5249138 - DNA, 17 bp, Homo sapiens
atattcaccaatgttgt

SEQ ID NO: 5249139 - DNA, 18 bp, Homo sapiens
atattcaccaatgttgta

SEQ ID NO: 5249140 - DNA, 17 bp, Homo sapiens
atattcactctccatta

SEQ ID NO: 5249141 - DNA, 19 bp, Homo sapiens
atattcactggttttacac

SEQ ID NO: 5249142 - DNA, 21 bp, Homo sapiens
atattcactggttttacacag

SEQ ID NO: 5249143 - DNA, 22 bp, Homo sapiens
atattcactggttttacacaga

SEQ ID NO: 5249144 - DNA, 17 bp, Homo sapiens
atattcactttcatttt

SEQ ID NO: 5249145 - DNA, 12 bp, Homo sapiens
atattcagaaat

SEQ ID NO: 5249146 - DNA, 20 bp, Homo sapiens
atattcagaatctttgttaa

SEQ ID NO: 5249147 - DNA, 14 bp, Homo sapiens
atattcagacatca

SEQ ID NO: 5249148 - DNA, 15 bp, Homo sapiens
atattcagagaaaac

SEQ ID NO: 5249149 - DNA, 19 bp, Homo sapiens
atattcagagatgtaccat

SEQ ID NO: 5249150 - DNA, 14 bp, Homo sapiens
atattcagcatttg

SEQ ID NO: 5249151 - DNA, 19 bp, Homo sapiens
atattcagccagcttaaac

SEQ ID NO: 5249152 - DNA, 17 bp, Homo sapiens
atattcaggaaatgttc

SEQ ID NO: 5249153 - DNA, 16 bp, Homo sapiens
atattcaggaagctca

SEQ ID NO: 5249154 - DNA, 17 bp, Homo sapiens
atattcaggaagctcag

SEQ ID NO: 5249155 - DNA, 16 bp, Homo sapiens
atattcaggagttgga

SEQ ID NO: 5249156 - DNA, 18 bp, Homo sapiens
atattcaggctactcatt

SEQ ID NO: 5249157 - DNA, 21 bp, Homo sapiens
atattcaggctactcattcag

SEQ ID NO: 5249158 - DNA, 19 bp, Homo sapiens
atattcagggtaaatagga

SEQ ID NO: 5249159 - DNA, 16 bp, Homo sapiens
atattcataaagttac

SEQ ID NO: 5249160 - DNA, 22 bp, Homo sapiens
atattcataatatataaaagaa

SEQ ID NO: 5249161 - DNA, 16 bp, Homo sapiens
atattcatacaacaaa

SEQ ID NO: 5249162 - DNA, 18 bp, Homo sapiens
atattcatacaacaaaga

SEQ ID NO: 5249163 - DNA, 23 bp, Homo sapiens
atattcatacctgttgtacactt

SEQ ID NO: 5249164 - DNA, 14 bp, Homo sapiens
atattcatactttc

SEQ ID NO: 5249165 - DNA, 22 bp, Homo sapiens
atattcatattaggtggttctc

SEQ ID NO: 5249166 - DNA, 12 bp, Homo sapiens
atattcatattg

SEQ ID NO: 5249167 - DNA, 17 bp, Homo sapiens
atattcatattggaaaa

SEQ ID NO: 5249168 - DNA, 19 bp, Homo sapiens
atattcatattggaaaaat

SEQ ID NO: 5249169 - DNA, 21 bp, Homo sapiens
atattcatcaaataaaccttg

SEQ ID NO: 5249170 - DNA, 21 bp, Homo sapiens
atattcatctaataaatcagt

SEQ ID NO: 5249171 - DNA, 23 bp, Homo sapiens
atattcatgaagagttgtttata

SEQ ID NO: 5249172 - DNA, 15 bp, Homo sapiens
atattcatgctgcct

SEQ ID NO: 5249173 - DNA, 20 bp, Homo sapiens
atattcatgcttcttcctta

SEQ ID NO: 5249174 - DNA, 18 bp, Homo sapiens
atattcatggatggctca

SEQ ID NO: 5249175 - DNA, 18 bp, Homo sapiens
atattcatggttgttttt

SEQ ID NO: 5249176 - DNA, 14 bp, Homo sapiens
atattcatgtaaac

SEQ ID NO: 5249177 - DNA, 19 bp, Homo sapiens
atattcatgtaaacaaaat

SEQ ID NO: 5249178 - DNA, 22 bp, Homo sapiens
atattcatgtaaacaaaattta

SEQ ID NO: 5249179 - DNA, 14 bp, Homo sapiens
atattcatgtaata

SEQ ID NO: 5249180 - DNA, 21 bp, Homo sapiens
atattcatgtaataaatctga

SEQ ID NO: 5249181 - DNA, 20 bp, Homo sapiens
atattcatgtagatcaagtg

SEQ ID NO: 5249182 - DNA, 17 bp, Homo sapiens
atattcattaataggaa

SEQ ID NO: 5249183 - DNA, 21 bp, Homo sapiens
atattcattgtataaaaatag

SEQ ID NO: 5249184 - DNA, 13 bp, Homo sapiens
atattcatttgga

SEQ ID NO: 5249185 - DNA, 19 bp, Homo sapiens
atattccaacccagccacg

SEQ ID NO: 5249186 - DNA, 15 bp, Homo sapiens
atattccaaggaaaa

SEQ ID NO: 5249187 - DNA, 19 bp, Homo sapiens
atattccactatttgcaga

SEQ ID NO: 5249188 - DNA, 19 bp, Homo sapiens
atattccagcagtgaaact

SEQ ID NO: 5249189 - DNA, 17 bp, Homo sapiens
atattccagttttctct

SEQ ID NO: 5249190 - DNA, 19 bp, Homo sapiens
atattccagttttctctgc

SEQ ID NO: 5249191 - DNA, 18 bp, Homo sapiens
atattccatatattagca

SEQ ID NO: 5249192 - DNA, 15 bp, Homo sapiens
atattccatgggact

SEQ ID NO: 5249193 - DNA, 16 bp, Homo sapiens
atattccatgtataag

SEQ ID NO: 5249194 - DNA, 23 bp, Homo sapiens
atattcccctaagatttgatata

SEQ ID NO: 5249195 - DNA, 23 bp, Homo sapiens
atattccctagaaacttccaaat

SEQ ID NO: 5249196 - DNA, 20 bp, Homo sapiens
atattccctgcacacacatg

SEQ ID NO: 5249197 - DNA, 19 bp, Homo sapiens
atattccgtatttaaagtt

SEQ ID NO: 5249198 - DNA, 16 bp, Homo sapiens
atattcctccagctgg

SEQ ID NO: 5249199 - DNA, 22 bp, Homo sapiens
atattcctgaatgaaatatcag

SEQ ID NO: 5249200 - DNA, 14 bp, Homo sapiens
atattcctgccttt

SEQ ID NO: 5249201 - DNA, 22 bp, Homo sapiens
atattcctggacttacaaaatg

SEQ ID NO: 5249202 - DNA, 18 bp, Homo sapiens
atattccttactagaaat

SEQ ID NO: 5249203 - DNA, 20 bp, Homo sapiens
atattccttactagaaatat

SEQ ID NO: 5249204 - DNA, 22 bp, Homo sapiens
atattccttatttaagacatgt

SEQ ID NO: 5249205 - DNA, 16 bp, Homo sapiens
atattcctttgaagat

SEQ ID NO: 5249206 - DNA, 23 bp, Homo sapiens
atattcctttgcatattataaag

SEQ ID NO: 5249207 - DNA, 19 bp, Homo sapiens
atattccttttaaagaagc

SEQ ID NO: 5249208 - DNA, 21 bp, Homo sapiens
atattccttttaaagaagctt

SEQ ID NO: 5249209 - DNA, 17 bp, Homo sapiens
atattcctttttctatg

SEQ ID NO: 5249210 - DNA, 19 bp, Homo sapiens
atattctaaaaaagatact

SEQ ID NO: 5249211 - DNA, 22 bp, Homo sapiens
atattctaagaaatatctgtga

SEQ ID NO: 5249212 - DNA, 14 bp, Homo sapiens
atattctaagactt

SEQ ID NO: 5249213 - DNA, 16 bp, Homo sapiens
atattctaattaaaat

SEQ ID NO: 5249214 - DNA, 22 bp, Homo sapiens
atattctacacatgtaaaatat

SEQ ID NO: 5249215 - DNA, 19 bp, Homo sapiens
atattctactggcctgtaa

SEQ ID NO: 5249216 - DNA, 22 bp, Homo sapiens
atattctatacacaccctgccc

SEQ ID NO: 5249217 - DNA, 20 bp, Homo sapiens
atattctattccatgtccat

SEQ ID NO: 5249218 - DNA, 16 bp, Homo sapiens
atattctattttacaa

SEQ ID NO: 5249219 - DNA, 21 bp, Homo sapiens
atattctcacagctccaagaa

SEQ ID NO: 5249220 - DNA, 18 bp, Homo sapiens
atattctcatggctttgt

SEQ ID NO: 5249221 - DNA, 14 bp, Homo sapiens
atattctccccacc

SEQ ID NO: 5249222 - DNA, 14 bp, Homo sapiens
atattctctaataa

SEQ ID NO: 5249223 - DNA, 16 bp, Homo sapiens
atattctctaataaaa

SEQ ID NO: 5249224 - DNA, 18 bp, Homo sapiens
atattctctattttactt

SEQ ID NO: 5249225 - DNA, 20 bp, Homo sapiens
atattctctattttactttt

SEQ ID NO: 5249226 - DNA, 14 bp, Homo sapiens
atattctctgatgt

SEQ ID NO: 5249227 - DNA, 13 bp, Homo sapiens
atattctctgtac

SEQ ID NO: 5249228 - DNA, 20 bp, Homo sapiens
atattctcttgtctggctgc

SEQ ID NO: 5249229 - DNA, 13 bp, Homo sapiens
atattctctttgg

SEQ ID NO: 5249230 - DNA, 17 bp, Homo sapiens
atattctgaaaggaaat

SEQ ID NO: 5249231 - DNA, 23 bp, Homo sapiens
atattctgaaaggaaatacactt

SEQ ID NO: 5249232 - DNA, 13 bp, Homo sapiens
atattctggaaaa

SEQ ID NO: 5249233 - DNA, 21 bp, Homo sapiens
atattctggattataaaaatg

SEQ ID NO: 5249234 - DNA, 14 bp, Homo sapiens
atattctgtacatt

SEQ ID NO: 5249235 - DNA, 16 bp, Homo sapiens
atattctgttgcttta

SEQ ID NO: 5249236 - DNA, 22 bp, Homo sapiens
atattctgtttattatgacaaa

SEQ ID NO: 5249237 - DNA, 21 bp, Homo sapiens
atattctgttttgttaatata

SEQ ID NO: 5249238 - DNA, 13 bp, Homo sapiens
atattcttataaa

SEQ ID NO: 5249239 - DNA, 17 bp, Homo sapiens
atattcttatgttatca

SEQ ID NO: 5249240 - DNA, 13 bp, Homo sapiens
atattcttattgg

SEQ ID NO: 5249241 - DNA, 22 bp, Homo sapiens
atattcttccttgattgtgtag

SEQ ID NO: 5249242 - DNA, 22 bp, Homo sapiens
atattcttgctttcacaaatat

SEQ ID NO: 5249243 - DNA, 15 bp, Homo sapiens
atattcttgtaaata

SEQ ID NO: 5249244 - DNA, 12 bp, Homo sapiens
atattcttgtca

SEQ ID NO: 5249245 - DNA, 13 bp, Homo sapiens
atattcttgtcaa

SEQ ID NO: 5249246 - DNA, 19 bp, Homo sapiens
atattcttgtccacattct

SEQ ID NO: 5249247 - DNA, 23 bp, Homo sapiens
atattcttgtccacattctactt

SEQ ID NO: 5249248 - DNA, 22 bp, Homo sapiens
atattctttacaaactgaagat

SEQ ID NO: 5249249 - DNA, 13 bp, Homo sapiens
atattctttcaat

SEQ ID NO: 5249250 - DNA, 16 bp, Homo sapiens
atattctttccatgca

SEQ ID NO: 5249251 - DNA, 12 bp, Homo sapiens
atattcttttgt

SEQ ID NO: 5249252 - DNA, 13 bp, Homo sapiens
atattgaaaaaaa

SEQ ID NO: 5249253 - DNA, 16 bp, Homo sapiens
atattgaaaaaaataa

SEQ ID NO: 5249254 - DNA, 15 bp, Homo sapiens
atattgaaaatgtca

SEQ ID NO: 5249255 - DNA, 19 bp, Homo sapiens
atattgaactcaatgatag

SEQ ID NO: 5249256 - DNA, 16 bp, Homo sapiens
atattgaagacaattt

SEQ ID NO: 5249257 - DNA, 21 bp, Homo sapiens
atattgaagacaatttgatac

SEQ ID NO: 5249258 - DNA, 22 bp, Homo sapiens
atattgaagttgtttatcaact

SEQ ID NO: 5249259 - DNA, 13 bp, Homo sapiens
atattgaataaaa

SEQ ID NO: 5249260 - DNA, 22 bp, Homo sapiens
atattgaataaaaaatagacat

SEQ ID NO: 5249261 - DNA, 19 bp, Homo sapiens
atattgaataagtattctt

SEQ ID NO: 5249262 - DNA, 16 bp, Homo sapiens
atattgaataggcatt

SEQ ID NO: 5249263 - DNA, 18 bp, Homo sapiens
atattgaatataatatat

SEQ ID NO: 5249264 - DNA, 14 bp, Homo sapiens
atattgaatatatc

SEQ ID NO: 5249265 - DNA, 15 bp, Homo sapiens
atattgaatatatca

SEQ ID NO: 5249266 - DNA, 22 bp, Homo sapiens
atattgaatgccttatttttga

SEQ ID NO: 5249267 - DNA, 18 bp, Homo sapiens
atattgaatgtgaaacat

SEQ ID NO: 5249268 - DNA, 19 bp, Homo sapiens
atattgacactgtccctct

SEQ ID NO: 5249269 - DNA, 14 bp, Homo sapiens
atattgacacttag

SEQ ID NO: 5249270 - DNA, 15 bp, Homo sapiens
atattgaccatgtga

SEQ ID NO: 5249271 - DNA, 16 bp, Homo sapiens
atattgaccatgtgat

SEQ ID NO: 5249272 - DNA, 17 bp, Homo sapiens
atattgaccatgtgatt

SEQ ID NO: 5249273 - DNA, 19 bp, Homo sapiens
atattgaccatgtgattat

SEQ ID NO: 5249274 - DNA, 22 bp, Homo sapiens
atattgaccatgtgattatgga

SEQ ID NO: 5249275 - DNA, 19 bp, Homo sapiens
atctccctgcctcctgccg

SEQ ID NO: 5249276 - DNA, 13 bp, Homo sapiens
atctccctgcttc

SEQ ID NO: 5249277 - DNA, 22 bp, Homo sapiens
atctccctggagaagcaccagc

SEQ ID NO: 5249278 - DNA, 13 bp, Homo sapiens
atctccctggctc

SEQ ID NO: 5249279 - DNA, 14 bp, Homo sapiens
atctccctggctca

SEQ ID NO: 5249280 - DNA, 21 bp, Homo sapiens
atctccctggtgcttatgctc

SEQ ID NO: 5249281 - DNA, 18 bp, Homo sapiens
atctcccttcacaagttt

SEQ ID NO: 5249282 - DNA, 22 bp, Homo sapiens
atctcccttcagcaacttattt

SEQ ID NO: 5249283 - DNA, 18 bp, Homo sapiens
atctcccttccacctcac

SEQ ID NO: 5249284 - DNA, 21 bp, Homo sapiens
atctcccttctcatctcccca

SEQ ID NO: 5249285 - DNA, 18 bp, Homo sapiens
atctccgcctccacactg

SEQ ID NO: 5249286 - DNA, 22 bp, Homo sapiens
atctccgcctccacactgacca

SEQ ID NO: 5249287 - DNA, 21 bp, Homo sapiens
atctccggctcccagcctcag

SEQ ID NO: 5249288 - DNA, 20 bp, Homo sapiens
atctccggtgtgagcccacc

SEQ ID NO: 5249289 - DNA, 18 bp, Homo sapiens
atctccgtagaattttgc

SEQ ID NO: 5249290 - DNA, 17 bp, Homo sapiens
atctcctaacaaaagaa

SEQ ID NO: 5249291 - DNA, 19 bp, Homo sapiens
atctcctaactttggacct

SEQ ID NO: 5249292 - DNA, 17 bp, Homo sapiens
atctcctagggctatgg

SEQ ID NO: 5249293 - DNA, 17 bp, Homo sapiens
atctcctataatctgtc

SEQ ID NO: 5249294 - DNA, 18 bp, Homo sapiens
atctcctataatctgtca

SEQ ID NO: 5249295 - DNA, 20 bp, Homo sapiens
atctcctataatctgtcaaa

SEQ ID NO: 5249296 - DNA, 13 bp, Homo sapiens
atctcctattttt

SEQ ID NO: 5249297 - DNA, 14 bp, Homo sapiens
atctcctatttttt

SEQ ID NO: 5249298 - DNA, 20 bp, Homo sapiens
atctcctatttttttaaaat

SEQ ID NO: 5249299 - DNA, 22 bp, Homo sapiens
atctcctatttttttaaaatca

SEQ ID NO: 5249300 - DNA, 13 bp, Homo sapiens
atctcctcactga

SEQ ID NO: 5249301 - DNA, 16 bp, Homo sapiens
atctcctctgctcatt

SEQ ID NO: 5249302 - DNA, 14 bp, Homo sapiens
atctcctcttttgt

SEQ ID NO: 5249303 - DNA, 18 bp, Homo sapiens
atctcctgacagaaggtg

SEQ ID NO: 5249304 - DNA, 17 bp, Homo sapiens
atctcctgacctcgtga

SEQ ID NO: 5249305 - DNA, 21 bp, Homo sapiens
atctcctgacctcgtgatcca

SEQ ID NO: 5249306 - DNA, 16 bp, Homo sapiens
atctcctgagttgtat

SEQ ID NO: 5249307 - DNA, 19 bp, Homo sapiens
atctcctgagttgtataaa

SEQ ID NO: 5249308 - DNA, 20 bp, Homo sapiens
atctcctgagttgtataaaa

SEQ ID NO: 5249309 - DNA, 21 bp, Homo sapiens
atctcctgccagcccagctgg

SEQ ID NO: 5249310 - DNA, 20 bp, Homo sapiens
atctcctgccttcctcctgg

SEQ ID NO: 5249311 - DNA, 11 bp, Homo sapiens
atctcctgctc

SEQ ID NO: 5249312 - DNA, 17 bp, Homo sapiens
atctcctgctcaccacc

SEQ ID NO: 5249313 - DNA, 20 bp, Homo sapiens
atctcctgctcaccacctgc

SEQ ID NO: 5249314 - DNA, 17 bp, Homo sapiens
atctcctgctgcctttt

SEQ ID NO: 5249315 - DNA, 11 bp, Homo sapiens
atctcctggaa

SEQ ID NO: 5249316 - DNA, 23 bp, Homo sapiens
atctcctggaacactatagagaa

SEQ ID NO: 5249317 - DNA, 22 bp, Homo sapiens
atctcctggctttacagacaaa

SEQ ID NO: 5249318 - DNA, 20 bp, Homo sapiens
atctcctggtagcatgacct

SEQ ID NO: 5249319 - DNA, 13 bp, Homo sapiens
atctcctgtaatt

SEQ ID NO: 5249320 - DNA, 19 bp, Homo sapiens
atctcctgtcttttcaggt

SEQ ID NO: 5249321 - DNA, 21 bp, Homo sapiens
atctcctgtgcacctgacttt

SEQ ID NO: 5249322 - DNA, 19 bp, Homo sapiens
atctcctgtgcatgggtga

SEQ ID NO: 5249323 - DNA, 16 bp, Homo sapiens
atctccttacctctgg

SEQ ID NO: 5249324 - DNA, 18 bp, Homo sapiens
atctccttacctctggaa

SEQ ID NO: 5249325 - DNA, 15 bp, Homo sapiens
atctccttactgtgt

SEQ ID NO: 5249326 - DNA, 17 bp, Homo sapiens
atctccttcccccagcc

SEQ ID NO: 5249327 - DNA, 19 bp, Homo sapiens
atctccttcccccagccca

SEQ ID NO: 5249328 - DNA, 21 bp, Homo sapiens
atctccttcccccagcccaat

SEQ ID NO: 5249329 - DNA, 17 bp, Homo sapiens
atctccttcccctacac

SEQ ID NO: 5249330 - DNA, 18 bp, Homo sapiens
atctccttcccttctctt

SEQ ID NO: 5249331 - DNA, 16 bp, Homo sapiens
atctccttgtcttttt

SEQ ID NO: 5249332 - DNA, 15 bp, Homo sapiens
atctcctttcaggga

SEQ ID NO: 5249333 - DNA, 18 bp, Homo sapiens
atctcctttgaagaaggc

SEQ ID NO: 5249334 - DNA, 20 bp, Homo sapiens
atctcctttggaaggtgaca

SEQ ID NO: 5249335 - DNA, 21 bp, Homo sapiens
atctccttttatgctcacctg

SEQ ID NO: 5249336 - DNA, 15 bp, Homo sapiens
atctcgaatttgaag

SEQ ID NO: 5249337 - DNA, 16 bp, Homo sapiens
atctcgaatttgaaga

SEQ ID NO: 5249338 - DNA, 17 bp, Homo sapiens
atctcgaatttgaagag

SEQ ID NO: 5249339 - DNA, 20 bp, Homo sapiens
atctcgactcccccctggcc

SEQ ID NO: 5249340 - DNA, 16 bp, Homo sapiens
atctcgagccccctgg

SEQ ID NO: 5249341 - DNA, 18 bp, Homo sapiens
atctcgagccccctggat

SEQ ID NO: 5249342 - DNA, 17 bp, Homo sapiens
atctcgccaacccctct

SEQ ID NO: 5249343 - DNA, 21 bp, Homo sapiens
atctcgccacccctccttcct

SEQ ID NO: 5249344 - DNA, 19 bp, Homo sapiens
atctcgctccctcccagga

SEQ ID NO: 5249345 - DNA, 21 bp, Homo sapiens
atctcgctgtaagatttgtca

SEQ ID NO: 5249346 - DNA, 17 bp, Homo sapiens
atctcggctcagcctcc

SEQ ID NO: 5249347 - DNA, 22 bp, Homo sapiens
atctcggttctgcgccacttcc

SEQ ID NO: 5249348 - DNA, 18 bp, Homo sapiens
atctcgtaatagcttctg

SEQ ID NO: 5249349 - DNA, 15 bp, Homo sapiens
atctcgtatagaagt

SEQ ID NO: 5249350 - DNA, 19 bp, Homo sapiens
atctcgtatagaagtcttc

SEQ ID NO: 5249351 - DNA, 16 bp, Homo sapiens
atctcgtgatccgcct

SEQ ID NO: 5249352 - DNA, 23 bp, Homo sapiens
atctcgtgatccgcctgcctctg

SEQ ID NO: 5249353 - DNA, 14 bp, Homo sapiens
atctcgtgggagag

SEQ ID NO: 5249354 - DNA, 14 bp, Homo sapiens
atctcgttcccaaa

SEQ ID NO: 5249355 - DNA, 15 bp, Homo sapiens
atctcgttgaggcca

SEQ ID NO: 5249356 - DNA, 14 bp, Homo sapiens
atctcgtttcaaaa

SEQ ID NO: 5249357 - DNA, 15 bp, Homo sapiens
atctcgtttcaaaaa

SEQ ID NO: 5249358 - DNA, 22 bp, Homo sapiens
atctcgtttttcttcttaagac

SEQ ID NO: 5249359 - DNA, 23 bp, Homo sapiens
atctcgtttttcttcttaagact

SEQ ID NO: 5249360 - DNA, 18 bp, Homo sapiens
atctctaaaattctagtc

SEQ ID NO: 5249361 - DNA, 15 bp, Homo sapiens
atctctaaagagcat

SEQ ID NO: 5249362 - DNA, 18 bp, Homo sapiens
atctctaacagctcagga

SEQ ID NO: 5249363 - DNA, 15 bp, Homo sapiens
atctctaatatggca

SEQ ID NO: 5249364 - DNA, 21 bp, Homo sapiens
atctctaatgaaattgtgaaa

SEQ ID NO: 5249365 - DNA, 22 bp, Homo sapiens
atctctaatgagctagtgtctt

SEQ ID NO: 5249366 - DNA, 20 bp, Homo sapiens
atctctacaaaaataaagaa

SEQ ID NO: 5249367 - DNA, 15 bp, Homo sapiens
atctctaccatcatc

SEQ ID NO: 5249368 - DNA, 14 bp, Homo sapiens
atctctaccccaaa

SEQ ID NO: 5249369 - DNA, 17 bp, Homo sapiens
atctctacccctttctt

SEQ ID NO: 5249370 - DNA, 20 bp, Homo sapiens
atctctacccctttcttctc

SEQ ID NO: 5249371 - DNA, 17 bp, Homo sapiens
atctctactaaaaatac

SEQ ID NO: 5249372 - DNA, 18 bp, Homo sapiens
atctctactaaaaataca

SEQ ID NO: 5249373 - DNA, 19 bp, Homo sapiens
atctctactaccacaagga

SEQ ID NO: 5249374 - DNA, 21 bp, Homo sapiens
atctctactaccacaaggaaa

SEQ ID NO: 5249375 - DNA, 16 bp, Homo sapiens
atctctactttcctga

SEQ ID NO: 5249376 - DNA, 22 bp, Homo sapiens
atctctactttcctgatgttga

SEQ ID NO: 5249377 - DNA, 23 bp, Homo sapiens
atctctactttcctgatgttgat

SEQ ID NO: 5249378 - DNA, 16 bp, Homo sapiens
atctctagaattttaa

SEQ ID NO: 5249379 - DNA, 21 bp, Homo sapiens
atctctagaattttaagtgct

SEQ ID NO: 5249380 - DNA, 17 bp, Homo sapiens
atctctagcctctttgt

SEQ ID NO: 5249381 - DNA, 13 bp, Homo sapiens
atctctatataaa

SEQ ID NO: 5249382 - DNA, 23 bp, Homo sapiens
atctctatataaaaaatatatgt

SEQ ID NO: 5249383 - DNA, 21 bp, Homo sapiens
atctctatataaaaacaaaaa

SEQ ID NO: 5249384 - DNA, 20 bp, Homo sapiens
atctctatcagaaatacaaa

SEQ ID NO: 5249385 - DNA, 17 bp, Homo sapiens
atctctattattggaaa

SEQ ID NO: 5249386 - DNA, 17 bp, Homo sapiens
atctctattccccaccc

SEQ ID NO: 5249387 - DNA, 13 bp, Homo sapiens
atctctatttaat

SEQ ID NO: 5249388 - DNA, 14 bp, Homo sapiens
atctctcaaaacaa

SEQ ID NO: 5249389 - DNA, 15 bp, Homo sapiens
atctctcaaaacaat

SEQ ID NO: 5249390 - DNA, 15 bp, Homo sapiens
atctctcaaaatgtg

SEQ ID NO: 5249391 - DNA, 17 bp, Homo sapiens
atctctcaaatctgtta

SEQ ID NO: 5249392 - DNA, 17 bp, Homo sapiens
atctctcagaagggagg

SEQ ID NO: 5249393 - DNA, 13 bp, Homo sapiens
atctctcaggagc

SEQ ID NO: 5249394 - DNA, 23 bp, Homo sapiens
atctctcaggagcacaggcagct

SEQ ID NO: 5249395 - DNA, 16 bp, Homo sapiens
atctctccaccttcca

SEQ ID NO: 5249396 - DNA, 14 bp, Homo sapiens
atctctccactgtg

SEQ ID NO: 5249397 - DNA, 20 bp, Homo sapiens
atctctccactttcagctgt

SEQ ID NO: 5249398 - DNA, 19 bp, Homo sapiens
atctctcccacttcctcct

SEQ ID NO: 5249399 - DNA, 21 bp, Homo sapiens
atctctcccacttcctcctac

SEQ ID NO: 5249400 - DNA, 11 bp, Homo sapiens
atctctccctc

SEQ ID NO: 5249401 - DNA, 15 bp, Homo sapiens
atctctccctcctgg

SEQ ID NO: 5249402 - DNA, 17 bp, Homo sapiens
atctctcccttacccat

SEQ ID NO: 5249403 - DNA, 15 bp, Homo sapiens
atctctcccttcttt

SEQ ID NO: 5249404 - DNA, 12 bp, Homo sapiens
atctctcctcca

SEQ ID NO: 5249405 - DNA, 20 bp, Homo sapiens
atctctcctccaagacactg

SEQ ID NO: 5249406 - DNA, 12 bp, Homo sapiens
atctctcctggc

SEQ ID NO: 5249407 - DNA, 22 bp, Homo sapiens
atctctcgtgattgataagaac

SEQ ID NO: 5249408 - DNA, 15 bp, Homo sapiens
atctctctacctcca

SEQ ID NO: 5249409 - DNA, 18 bp, Homo sapiens
atctctctacctccaccc

SEQ ID NO: 5249410 - DNA, 20 bp, Homo sapiens
atctctctactgctggactg

SEQ ID NO: 5249411 - DNA, 10 bp, Homo sapiens
atctctctct

SEQ ID NO: 5249412 - DNA, 14 bp, Homo sapiens
atctctctctgtgt

SEQ ID NO: 5249413 - DNA, 13 bp, Homo sapiens
atctctctcttgc

SEQ ID NO: 5249414 - DNA, 17 bp, Homo sapiens
atctctctcttgcctga

SEQ ID NO: 5249415 - DNA, 23 bp, Homo sapiens
atctctctcttgcctgaggggaa

SEQ ID NO: 5249416 - DNA, 22 bp, Homo sapiens
atctctctgaatcctaagggct

SEQ ID NO: 5249417 - DNA, 14 bp, Homo sapiens
atctctctgcagct

SEQ ID NO: 5249418 - DNA, 21 bp, Homo sapiens
atctctctgccctctccctgt

SEQ ID NO: 5249419 - DNA, 12 bp, Homo sapiens
atctctctggct

SEQ ID NO: 5249420 - DNA, 19 bp, Homo sapiens
atctctctggcttctgaag

SEQ ID NO: 5249421 - DNA, 20 bp, Homo sapiens
atctctctggggccctgggc

SEQ ID NO: 5249422 - DNA, 23 bp, Homo sapiens
atctctctggggccctgggcctc

SEQ ID NO: 5249423 - DNA, 13 bp, Homo sapiens
atctctctgtctt

SEQ ID NO: 5249424 - DNA, 21 bp, Homo sapiens
atctctctgtcttttttctct

SEQ ID NO: 5249425 - DNA, 22 bp, Homo sapiens
atctctctgtcttttttctctc

SEQ ID NO: 5249426 - DNA, 23 bp, Homo sapiens
atctctctgtgctgtggaagcaa

SEQ ID NO: 5249427 - DNA, 23 bp, Homo sapiens
atctctcttccctaatcctccaa

SEQ ID NO: 5249428 - DNA, 20 bp, Homo sapiens
atctctcttgggccaagcca

SEQ ID NO: 5249429 - DNA, 12 bp, Homo sapiens
atctctgaaaac

SEQ ID NO: 5249430 - DNA, 15 bp, Homo sapiens
atctctgaaaattct

SEQ ID NO: 5249431 - DNA, 16 bp, Homo sapiens
atctctgaaaattctg

SEQ ID NO: 5249432 - DNA, 19 bp, Homo sapiens
atctctgaaaattctggaa

SEQ ID NO: 5249433 - DNA, 20 bp, Homo sapiens
atctctgaaaattctggaag

SEQ ID NO: 5249434 - DNA, 14 bp, Homo sapiens
atctctgaaacata

SEQ ID NO: 5249435 - DNA, 16 bp, Homo sapiens
atctctgaaacatatt

SEQ ID NO: 5249436 - DNA, 11 bp, Homo sapiens
atctctgaaag

SEQ ID NO: 5249437 - DNA, 17 bp, Homo sapiens
atctctgaacttcagct

SEQ ID NO: 5249438 - DNA, 18 bp, Homo sapiens
atctctgaagatctaaac

SEQ ID NO: 5249439 - DNA, 14 bp, Homo sapiens
atctctgacctctg

SEQ ID NO: 5249440 - DNA, 23 bp, Homo sapiens
atctctgactttctttagtcttt

SEQ ID NO: 5249441 - DNA, 23 bp, Homo sapiens
atctctgagtgtctctgcctgga

SEQ ID NO: 5249442 - DNA, 20 bp, Homo sapiens
atctctgagttctgtgtatt

SEQ ID NO: 5249443 - DNA, 18 bp, Homo sapiens
atctctgattaaatttaa

SEQ ID NO: 5249444 - DNA, 20 bp, Homo sapiens
atctctgattaaatttaata

SEQ ID NO: 5249445 - DNA, 18 bp, Homo sapiens
atctctgcaatcttctca

SEQ ID NO: 5249446 - DNA, 20 bp, Homo sapiens
atctctgcaccctggggcct

SEQ ID NO: 5249447 - DNA, 23 bp, Homo sapiens
atctctgcaccctggggcctgga

SEQ ID NO: 5249448 - DNA, 22 bp, Homo sapiens
atctctgcaggaaatggctgtg

SEQ ID NO: 5249449 - DNA, 20 bp, Homo sapiens
atctctgcagtttttcccaa

SEQ ID NO: 5249450 - DNA, 17 bp, Homo sapiens
atctctgccgtctctcc

SEQ ID NO: 5249451 - DNA, 19 bp, Homo sapiens
atctctgccgtctctcctg

SEQ ID NO: 5249452 - DNA, 14 bp, Homo sapiens
atattgagaatcag

SEQ ID NO: 5249453 - DNA, 16 bp, Homo sapiens
atattgagcagaattc

SEQ ID NO: 5249454 - DNA, 18 bp, Homo sapiens
atattgaggccaagaata

SEQ ID NO: 5249455 - DNA, 19 bp, Homo sapiens
atattgaggccaagaatat

SEQ ID NO: 5249456 - DNA, 17 bp, Homo sapiens
atattgaggctttgtgt

SEQ ID NO: 5249457 - DNA, 19 bp, Homo sapiens
atattgaggctttgtgttg

SEQ ID NO: 5249458 - DNA, 17 bp, Homo sapiens
atattgagtcaaatggt

SEQ ID NO: 5249459 - DNA, 16 bp, Homo sapiens
atattgataaatttta

SEQ ID NO: 5249460 - DNA, 20 bp, Homo sapiens
atattgataataaaattcat

SEQ ID NO: 5249461 - DNA, 15 bp, Homo sapiens
atattgatatgctta

SEQ ID NO: 5249462 - DNA, 22 bp, Homo sapiens
atattgatcattttagacactg

SEQ ID NO: 5249463 - DNA, 22 bp, Homo sapiens
atattgatctttttatcatgat

SEQ ID NO: 5249464 - DNA, 16 bp, Homo sapiens
atattgatgttaacaa

SEQ ID NO: 5249465 - DNA, 20 bp, Homo sapiens
atattgattatagcaatgtg

SEQ ID NO: 5249466 - DNA, 18 bp, Homo sapiens
atattgattctgaaattt

SEQ ID NO: 5249467 - DNA, 24 bp, Homo sapiens
atattgatttaaaattgttctact

SEQ ID NO: 5249468 - DNA, 16 bp, Homo sapiens
atattgatttctgcct

SEQ ID NO: 5249469 - DNA, 14 bp, Homo sapiens
atattgattttaaa

SEQ ID NO: 5249470 - DNA, 18 bp, Homo sapiens
atattgcaaaaacatagt

SEQ ID NO: 5249471 - DNA, 15 bp, Homo sapiens
atattgcaaaataca

SEQ ID NO: 5249472 - DNA, 19 bp, Homo sapiens
atattgcaaaatacatgaa

SEQ ID NO: 5249473 - DNA, 22 bp, Homo sapiens
atattgcaaggtgtgatggtct

SEQ ID NO: 5249474 - DNA, 18 bp, Homo sapiens
atattgcaattgatgtga

SEQ ID NO: 5249475 - DNA, 13 bp, Homo sapiens
atattgcacatgt

SEQ ID NO: 5249476 - DNA, 18 bp, Homo sapiens
atattgcagattgaatat

SEQ ID NO: 5249477 - DNA, 19 bp, Homo sapiens
atattgcaggagacatttt

SEQ ID NO: 5249478 - DNA, 12 bp, Homo sapiens
atattgcagttc

SEQ ID NO: 5249479 - DNA, 20 bp, Homo sapiens
atattgcatcatagtttgct

SEQ ID NO: 5249480 - DNA, 19 bp, Homo sapiens
atattgcatttctgtattt

SEQ ID NO: 5249481 - DNA, 21 bp, Homo sapiens
atattgccaaatattaagaag

SEQ ID NO: 5249482 - DNA, 20 bp, Homo sapiens
atattgccagtatataagct

SEQ ID NO: 5249483 - DNA, 14 bp, Homo sapiens
atattgccatgtgt

SEQ ID NO: 5249484 - DNA, 21 bp, Homo sapiens
atattgccttatttgtctgta

SEQ ID NO: 5249485 - DNA, 18 bp, Homo sapiens
atattgccttgatgtttc

SEQ ID NO: 5249486 - DNA, 15 bp, Homo sapiens
atattgctaaaagca

SEQ ID NO: 5249487 - DNA, 14 bp, Homo sapiens
atattgctaaaagt

SEQ ID NO: 5249488 - DNA, 15 bp, Homo sapiens
atattgctaaaagtg

SEQ ID NO: 5249489 - DNA, 16 bp, Homo sapiens
atattgctaaaagtgc

SEQ ID NO: 5249490 - DNA, 18 bp, Homo sapiens
atattgctaattgtgtat

SEQ ID NO: 5249491 - DNA, 13 bp, Homo sapiens
atattgctactat

SEQ ID NO: 5249492 - DNA, 21 bp, Homo sapiens
atattgctactataatcaaat

SEQ ID NO: 5249493 - DNA, 20 bp, Homo sapiens
atattgctattgtttatagg

SEQ ID NO: 5249494 - DNA, 21 bp, Homo sapiens
atattgctattgtttatagga

SEQ ID NO: 5249495 - DNA, 13 bp, Homo sapiens
atattgctcttaa

SEQ ID NO: 5249496 - DNA, 19 bp, Homo sapiens
atattgctgaagaatctac

SEQ ID NO: 5249497 - DNA, 17 bp, Homo sapiens
atattgctgatggtgca

SEQ ID NO: 5249498 - DNA, 23 bp, Homo sapiens
atattgctgtatggtatatgcat

SEQ ID NO: 5249499 - DNA, 12 bp, Homo sapiens
atattgctgtct

SEQ ID NO: 5249500 - DNA, 24 bp, Homo sapiens
atattgctgtgtcttcattttcat

SEQ ID NO: 5249501 - DNA, 18 bp, Homo sapiens
atattgcttcaatttcaa

SEQ ID NO: 5249502 - DNA, 23 bp, Homo sapiens
atattgcttcctgtgtaacatct

SEQ ID NO: 5249503 - DNA, 12 bp, Homo sapiens
atattgcttctt

SEQ ID NO: 5249504 - DNA, 17 bp, Homo sapiens
atattgcttcttctcct

SEQ ID NO: 5249505 - DNA, 16 bp, Homo sapiens
atattgcttcttgtgt

SEQ ID NO: 5249506 - DNA, 21 bp, Homo sapiens
atattgcttcttgtgttttac

SEQ ID NO: 5249507 - DNA, 12 bp, Homo sapiens
atattgctttat

SEQ ID NO: 5249508 - DNA, 13 bp, Homo sapiens
atattgctttttc

SEQ ID NO: 5249509 - DNA, 15 bp, Homo sapiens
atattgctttttcta

SEQ ID NO: 5249510 - DNA, 18 bp, Homo sapiens
atattgctttttctaatg

SEQ ID NO: 5249511 - DNA, 15 bp, Homo sapiens
atattggaaaaatca

SEQ ID NO: 5249512 - DNA, 19 bp, Homo sapiens
atattggaattataaatat

SEQ ID NO: 5249513 - DNA, 12 bp, Homo sapiens
atattggacatt

SEQ ID NO: 5249514 - DNA, 18 bp, Homo sapiens
atattggagggaaatctt

SEQ ID NO: 5249515 - DNA, 17 bp, Homo sapiens
atattggccaaggaaag

SEQ ID NO: 5249516 - DNA, 14 bp, Homo sapiens
atattgggaagctg

SEQ ID NO: 5249517 - DNA, 19 bp, Homo sapiens
atattgggaaggaaatata

SEQ ID NO: 5249518 - DNA, 22 bp, Homo sapiens
atattgggaaggaaatatattt

SEQ ID NO: 5249519 - DNA, 18 bp, Homo sapiens
atattgggtgtagatttc

SEQ ID NO: 5249520 - DNA, 19 bp, Homo sapiens
atattgggtgtagatttct

SEQ ID NO: 5249521 - DNA, 19 bp, Homo sapiens
atattgggttccattctca

SEQ ID NO: 5249522 - DNA, 18 bp, Homo sapiens
atattggtaattaaaaga

SEQ ID NO: 5249523 - DNA, 24 bp, Homo sapiens
atattggtatgtaacacaggataa

SEQ ID NO: 5249524 - DNA, 17 bp, Homo sapiens
atattggtattaaagaa

SEQ ID NO: 5249525 - DNA, 22 bp, Homo sapiens
atattggtattaaagaatgctg

SEQ ID NO: 5249526 - DNA, 13 bp, Homo sapiens
atattggtattca

SEQ ID NO: 5249527 - DNA, 15 bp, Homo sapiens
atattggtcacgtca

SEQ ID NO: 5249528 - DNA, 19 bp, Homo sapiens
atattggtgcgtttttaca

SEQ ID NO: 5249529 - DNA, 20 bp, Homo sapiens
atattggtgcgtttttacag

SEQ ID NO: 5249530 - DNA, 14 bp, Homo sapiens
atattggtgctgag

SEQ ID NO: 5249531 - DNA, 15 bp, Homo sapiens
atattggtgctgagt

SEQ ID NO: 5249532 - DNA, 18 bp, Homo sapiens
atattggtgtactgtaat

SEQ ID NO: 5249533 - DNA, 21 bp, Homo sapiens
atattggtgtatattatataa

SEQ ID NO: 5249534 - DNA, 13 bp, Homo sapiens
atattggtgtgaa

SEQ ID NO: 5249535 - DNA, 17 bp, Homo sapiens
atattggttctatttat

SEQ ID NO: 5249536 - DNA, 14 bp, Homo sapiens
atattggttcttcc

SEQ ID NO: 5249537 - DNA, 19 bp, Homo sapiens
atattggttgggatgactt

SEQ ID NO: 5249538 - DNA, 22 bp, Homo sapiens
atattggtttgcacaagttccc

SEQ ID NO: 5249539 - DNA, 13 bp, Homo sapiens
atattggttttat

SEQ ID NO: 5249540 - DNA, 17 bp, Homo sapiens
atattgtaaaacaggta

SEQ ID NO: 5249541 - DNA, 12 bp, Homo sapiens
atattgtaaaga

SEQ ID NO: 5249542 - DNA, 14 bp, Homo sapiens
atattgtaaagaag

SEQ ID NO: 5249543 - DNA, 22 bp, Homo sapiens
atattgtaaatactggactcag

SEQ ID NO: 5249544 - DNA, 12 bp, Homo sapiens
atattgtaaatg

SEQ ID NO: 5249545 - DNA, 18 bp, Homo sapiens
atattgtaaatgctatta

SEQ ID NO: 5249546 - DNA, 21 bp, Homo sapiens
atattgtaaatgctattatac

SEQ ID NO: 5249547 - DNA, 23 bp, Homo sapiens
atattgtaactcacatgccttct

SEQ ID NO: 5249548 - DNA, 13 bp, Homo sapiens
atattgtaagaaa

SEQ ID NO: 5249549 - DNA, 15 bp, Homo sapiens
atattgtaatatgac

SEQ ID NO: 5249550 - DNA, 17 bp, Homo sapiens
atattgtaatatgacag

SEQ ID NO: 5249551 - DNA, 19 bp, Homo sapiens
atattgtaatatgacagat

SEQ ID NO: 5249552 - DNA, 13 bp, Homo sapiens
atattgtacactt

SEQ ID NO: 5249553 - DNA, 14 bp, Homo sapiens
atattgtacacttt

SEQ ID NO: 5249554 - DNA, 22 bp, Homo sapiens
atattgtagcagttacagctct

SEQ ID NO: 5249555 - DNA, 24 bp, Homo sapiens
atattgtagcagttacagctctgt

SEQ ID NO: 5249556 - DNA, 16 bp, Homo sapiens
atattgtatattctgg

SEQ ID NO: 5249557 - DNA, 20 bp, Homo sapiens
atattgtatattctggaaaa

SEQ ID NO: 5249558 - DNA, 14 bp, Homo sapiens
atattgtatgtacc

SEQ ID NO: 5249559 - DNA, 16 bp, Homo sapiens
atattgtattaagggc

SEQ ID NO: 5249560 - DNA, 18 bp, Homo sapiens
atattgtattactagaag

SEQ ID NO: 5249561 - DNA, 14 bp, Homo sapiens
atattgtattatca

SEQ ID NO: 5249562 - DNA, 17 bp, Homo sapiens
atattgtattatcatat

SEQ ID NO: 5249563 - DNA, 20 bp, Homo sapiens
atattgtattatcatatatg

SEQ ID NO: 5249564 - DNA, 16 bp, Homo sapiens
atattgtattatgcta

SEQ ID NO: 5249565 - DNA, 19 bp, Homo sapiens
atattgtattttagatata

SEQ ID NO: 5249566 - DNA, 15 bp, Homo sapiens
atattgtcagatatt

SEQ ID NO: 5249567 - DNA, 17 bp, Homo sapiens
atattgtcagatatttt

SEQ ID NO: 5249568 - DNA, 16 bp, Homo sapiens
atattgtcatatcagc

SEQ ID NO: 5249569 - DNA, 23 bp, Homo sapiens
atattgtcatctttttctagagt

SEQ ID NO: 5249570 - DNA, 13 bp, Homo sapiens
atattgtcattgt

SEQ ID NO: 5249571 - DNA, 13 bp, Homo sapiens
atattgtctgtaa

SEQ ID NO: 5249572 - DNA, 15 bp, Homo sapiens
atattgtctgtaaaa

SEQ ID NO: 5249573 - DNA, 18 bp, Homo sapiens
atattgtctgtaaaaaat

SEQ ID NO: 5249574 - DNA, 14 bp, Homo sapiens
atattgtctttttg

SEQ ID NO: 5249575 - DNA, 17 bp, Homo sapiens
atattgtctttttgtat

SEQ ID NO: 5249576 - DNA, 14 bp, Homo sapiens
atattgtgaacatt

SEQ ID NO: 5249577 - DNA, 19 bp, Homo sapiens
atattgtgccaatatgtat

SEQ ID NO: 5249578 - DNA, 23 bp, Homo sapiens
atattgtgcttactcaagtgtta

SEQ ID NO: 5249579 - DNA, 14 bp, Homo sapiens
atattgtggctccc

SEQ ID NO: 5249580 - DNA, 16 bp, Homo sapiens
atattgtggctccctg

SEQ ID NO: 5249581 - DNA, 11 bp, Homo sapiens
atattgtgtaa

SEQ ID NO: 5249582 - DNA, 18 bp, Homo sapiens
atattgtgttgtgaatgt

SEQ ID NO: 5249583 - DNA, 17 bp, Homo sapiens
atattgtgtttgtgtat

SEQ ID NO: 5249584 - DNA, 17 bp, Homo sapiens
atattgttaatctctgt

SEQ ID NO: 5249585 - DNA, 21 bp, Homo sapiens
atattgttagtggacttgttt

SEQ ID NO: 5249586 - DNA, 16 bp, Homo sapiens
atattgttataaataa

SEQ ID NO: 5249587 - DNA, 20 bp, Homo sapiens
atattgttattatataatta

SEQ ID NO: 5249588 - DNA, 18 bp, Homo sapiens
atattgttcaaacaatat

SEQ ID NO: 5249589 - DNA, 22 bp, Homo sapiens
atattgttcaaacaatatcata

SEQ ID NO: 5249590 - DNA, 18 bp, Homo sapiens
atattgttcctaagttct

SEQ ID NO: 5249591 - DNA, 14 bp, Homo sapiens
atattgttctgctg

SEQ ID NO: 5249592 - DNA, 18 bp, Homo sapiens
atattgttgtataatttc

SEQ ID NO: 5249593 - DNA, 22 bp, Homo sapiens
atattgttgtataatttcgaga

SEQ ID NO: 5249594 - DNA, 14 bp, Homo sapiens
atattgtttaaaat

SEQ ID NO: 5249595 - DNA, 16 bp, Homo sapiens
atattgtttaaaattc

SEQ ID NO: 5249596 - DNA, 17 bp, Homo sapiens
atattgtttaatgcaaa

SEQ ID NO: 5249597 - DNA, 19 bp, Homo sapiens
atattgtttctgcattcat

SEQ ID NO: 5249598 - DNA, 14 bp, Homo sapiens
atattgtttggtaa

SEQ ID NO: 5249599 - DNA, 14 bp, Homo sapiens
atattgttttataa

SEQ ID NO: 5249600 - DNA, 13 bp, Homo sapiens
atattgttttcag

SEQ ID NO: 5249601 - DNA, 12 bp, Homo sapiens
atattgttttct

SEQ ID NO: 5249602 - DNA, 18 bp, Homo sapiens
atattgttttctgtaaat

SEQ ID NO: 5249603 - DNA, 19 bp, Homo sapiens
atattgttttctgtaaata

SEQ ID NO: 5249604 - DNA, 23 bp, Homo sapiens
atattgttttctgtaaataacct

SEQ ID NO: 5249605 - DNA, 21 bp, Homo sapiens
atattgttttgcattgtctgt

SEQ ID NO: 5249606 - DNA, 19 bp, Homo sapiens
atattgtttttgtatttat

SEQ ID NO: 5249607 - DNA, 9 bp, Homo sapiens
atatttaaa

SEQ ID NO: 5249608 - DNA, 16 bp, Homo sapiens
atatttaaaaataagt

SEQ ID NO: 5249609 - DNA, 18 bp, Homo sapiens
atatttaaaaatgtcttg

SEQ ID NO: 5249610 - DNA, 16 bp, Homo sapiens
atatttaaaaattgtt

SEQ ID NO: 5249611 - DNA, 12 bp, Homo sapiens
atatttaaaatt

SEQ ID NO: 5249612 - DNA, 14 bp, Homo sapiens
atatttaaaattca

SEQ ID NO: 5249613 - DNA, 21 bp, Homo sapiens
atatttaaacatggttacaat

SEQ ID NO: 5249614 - DNA, 23 bp, Homo sapiens
atatttaaacatggttacaatca

SEQ ID NO: 5249615 - DNA, 21 bp, Homo sapiens
atatttaaacctttttcttga

SEQ ID NO: 5249616 - DNA, 20 bp, Homo sapiens
atatttaaagaatgagaaac

SEQ ID NO: 5249617 - DNA, 14 bp, Homo sapiens
atatttaaagacag

SEQ ID NO: 5249618 - DNA, 14 bp, Homo sapiens
atatttaaagggaa

SEQ ID NO: 5249619 - DNA, 13 bp, Homo sapiens
atatttaaatcat

SEQ ID NO: 5249620 - DNA, 21 bp, Homo sapiens
atatttaaatgtaaagacaaa

SEQ ID NO: 5249621 - DNA, 14 bp, Homo sapiens
atatttaaattata

SEQ ID NO: 5249622 - DNA, 23 bp, Homo sapiens
atatttaaatttatgagtgttaa

SEQ ID NO: 5249623 - DNA, 15 bp, Homo sapiens
atatttaacaatgac

SEQ ID NO: 5249624 - DNA, 23 bp, Homo sapiens
atatttaacaatttattctgata

SEQ ID NO: 5249625 - DNA, 23 bp, Homo sapiens
atatttaacgaatttaaaaagct

SEQ ID NO: 5249626 - DNA, 19 bp, Homo sapiens
atatttaactctctttatg

SEQ ID NO: 5249627 - DNA, 13 bp, Homo sapiens
atatttaactggt

SEQ ID NO: 5249628 - DNA, 14 bp, Homo sapiens
atatttaacttttt

SEQ ID NO: 5249629 - DNA, 14 bp, Homo sapiens
atatttaagaaaag

SEQ ID NO: 5249630 - DNA, 16 bp, Homo sapiens
atatttaagaaaagca

SEQ ID NO: 5249631 - DNA, 20 bp, Homo sapiens
atctctgcctagaatcttta

SEQ ID NO: 5249632 - DNA, 22 bp, Homo sapiens
atctctgcctagaatctttatt

SEQ ID NO: 5249633 - DNA, 21 bp, Homo sapiens
atctctgcctctcccaggctg

SEQ ID NO: 5249634 - DNA, 13 bp, Homo sapiens
atctctgcctttg

SEQ ID NO: 5249635 - DNA, 14 bp, Homo sapiens
atctctgcctttga

SEQ ID NO: 5249636 - DNA, 15 bp, Homo sapiens
atctctgcctttgag

SEQ ID NO: 5249637 - DNA, 17 bp, Homo sapiens
atctctgctctctatgt

SEQ ID NO: 5249638 - DNA, 12 bp, Homo sapiens
atctctgctgaa

SEQ ID NO: 5249639 - DNA, 16 bp, Homo sapiens
atctctgctgcttctg

SEQ ID NO: 5249640 - DNA, 12 bp, Homo sapiens
atctctgctggg

SEQ ID NO: 5249641 - DNA, 18 bp, Homo sapiens
atctctggaaggggcagc

SEQ ID NO: 5249642 - DNA, 22 bp, Homo sapiens
atctctggaaggggcagccctg

SEQ ID NO: 5249643 - DNA, 18 bp, Homo sapiens
atctctggcaccacacta

SEQ ID NO: 5249644 - DNA, 20 bp, Homo sapiens
atctctggcaccacactagg

SEQ ID NO: 5249645 - DNA, 21 bp, Homo sapiens
atctctggcccagaaagcctc

SEQ ID NO: 5249646 - DNA, 19 bp, Homo sapiens
atctctggcctcctggggg

SEQ ID NO: 5249647 - DNA, 23 bp, Homo sapiens
atctctgggctggatgagctccc

SEQ ID NO: 5249648 - DNA, 19 bp, Homo sapiens
atctctggttttcttgcca

SEQ ID NO: 5249649 - DNA, 22 bp, Homo sapiens
atctctggttttcttgccaccc

SEQ ID NO: 5249650 - DNA, 12 bp, Homo sapiens
atctctgtaaaa

SEQ ID NO: 5249651 - DNA, 13 bp, Homo sapiens
atctctgtaaaat

SEQ ID NO: 5249652 - DNA, 13 bp, Homo sapiens
atctctgtaaagc

SEQ ID NO: 5249653 - DNA, 20 bp, Homo sapiens
atctctgtagtggccccctc

SEQ ID NO: 5249654 - DNA, 22 bp, Homo sapiens
atctctgtagtggccccctcct

SEQ ID NO: 5249655 - DNA, 15 bp, Homo sapiens
atctctgtcagtgtg

SEQ ID NO: 5249656 - DNA, 19 bp, Homo sapiens
atctctgtctaccatctcc

SEQ ID NO: 5249657 - DNA, 15 bp, Homo sapiens
atctctgtctggggc

SEQ ID NO: 5249658 - DNA, 22 bp, Homo sapiens
atctctgtgactcgcttagctg

SEQ ID NO: 5249659 - DNA, 19 bp, Homo sapiens
atctctgtgattacctctc

SEQ ID NO: 5249660 - DNA, 13 bp, Homo sapiens
atctctgtgcctt

SEQ ID NO: 5249661 - DNA, 14 bp, Homo sapiens
atctctgtgccttc

SEQ ID NO: 5249662 - DNA, 16 bp, Homo sapiens
atctctgttccttctc

SEQ ID NO: 5249663 - DNA, 23 bp, Homo sapiens
atctctgttctttcatactacat

SEQ ID NO: 5249664 - DNA, 24 bp, Homo sapiens
atctctgttctttcatactacatt

SEQ ID NO: 5249665 - DNA, 15 bp, Homo sapiens
atctctgttcttttc

SEQ ID NO: 5249666 - DNA, 22 bp, Homo sapiens
atctctgttcttttcccgcctc

SEQ ID NO: 5249667 - DNA, 14 bp, Homo sapiens
atctcttaaactct

SEQ ID NO: 5249668 - DNA, 15 bp, Homo sapiens
atctcttaaattggg

SEQ ID NO: 5249669 - DNA, 18 bp, Homo sapiens
atctcttaatattgagaa

SEQ ID NO: 5249670 - DNA, 20 bp, Homo sapiens
atctcttaatattgagaatc

SEQ ID NO: 5249671 - DNA, 22 bp, Homo sapiens
atctcttaatattgagaatcag

SEQ ID NO: 5249672 - DNA, 18 bp, Homo sapiens
atctcttagcattttaat

SEQ ID NO: 5249673 - DNA, 16 bp, Homo sapiens
atctcttagctcccct

SEQ ID NO: 5249674 - DNA, 19 bp, Homo sapiens
atctcttagctcccctcca

SEQ ID NO: 5249675 - DNA, 23 bp, Homo sapiens
atctcttagctcccctccaacct

SEQ ID NO: 5249676 - DNA, 17 bp, Homo sapiens
atctcttcactaccctg

SEQ ID NO: 5249677 - DNA, 19 bp, Homo sapiens
atctcttcactaccctgat

SEQ ID NO: 5249678 - DNA, 14 bp, Homo sapiens
atctcttcaggttc

SEQ ID NO: 5249679 - DNA, 19 bp, Homo sapiens
atctcttcatgcttgacat

SEQ ID NO: 5249680 - DNA, 13 bp, Homo sapiens
atctcttcattat

SEQ ID NO: 5249681 - DNA, 20 bp, Homo sapiens
atctcttcattcaaactgca

SEQ ID NO: 5249682 - DNA, 24 bp, Homo sapiens
atctcttcattcaaactgcacttt

SEQ ID NO: 5249683 - DNA, 15 bp, Homo sapiens
atctcttccccagag

SEQ ID NO: 5249684 - DNA, 12 bp, Homo sapiens
atctcttctgca

SEQ ID NO: 5249685 - DNA, 14 bp, Homo sapiens
atctcttctgcaag

SEQ ID NO: 5249686 - DNA, 15 bp, Homo sapiens
atctcttctgcaagc

SEQ ID NO: 5249687 - DNA, 23 bp, Homo sapiens
atctcttctgcaagcctcatgcc

SEQ ID NO: 5249688 - DNA, 19 bp, Homo sapiens
atctcttctgggttccttc

SEQ ID NO: 5249689 - DNA, 13 bp, Homo sapiens
atctcttctgtgt

SEQ ID NO: 5249690 - DNA, 18 bp, Homo sapiens
atctcttcttaatgtaca

SEQ ID NO: 5249691 - DNA, 15 bp, Homo sapiens
atctcttcttataca

SEQ ID NO: 5249692 - DNA, 17 bp, Homo sapiens
atctcttcttatacaga

SEQ ID NO: 5249693 - DNA, 13 bp, Homo sapiens
atctcttcttcct

SEQ ID NO: 5249694 - DNA, 15 bp, Homo sapiens
atctcttgagcctgg

SEQ ID NO: 5249695 - DNA, 18 bp, Homo sapiens
atctcttgattataaatg

SEQ ID NO: 5249696 - DNA, 20 bp, Homo sapiens
atctcttgattataaatgtt

SEQ ID NO: 5249697 - DNA, 18 bp, Homo sapiens
atctcttggaaaataaga

SEQ ID NO: 5249698 - DNA, 18 bp, Homo sapiens
atctcttgggagtcttgg

SEQ ID NO: 5249699 - DNA, 23 bp, Homo sapiens
atctcttgggagtcttgggtggc

SEQ ID NO: 5249700 - DNA, 17 bp, Homo sapiens
atctcttgtcattctca

SEQ ID NO: 5249701 - DNA, 14 bp, Homo sapiens
atctctttcccttc

SEQ ID NO: 5249702 - DNA, 13 bp, Homo sapiens
atctctttctctc

SEQ ID NO: 5249703 - DNA, 20 bp, Homo sapiens
atctctttctctttaatgga

SEQ ID NO: 5249704 - DNA, 22 bp, Homo sapiens
atctctttctttctctttctgt

SEQ ID NO: 5249705 - DNA, 20 bp, Homo sapiens
atctctttgtacaggaactg

SEQ ID NO: 5249706 - DNA, 11 bp, Homo sapiens
atctcttttat

SEQ ID NO: 5249707 - DNA, 12 bp, Homo sapiens
atctcttttata

SEQ ID NO: 5249708 - DNA, 23 bp, Homo sapiens
atctcttttccactccattgtcg

SEQ ID NO: 5249709 - DNA, 22 bp, Homo sapiens
atctcttttgaatccatgcttg

SEQ ID NO: 5249710 - DNA, 16 bp, Homo sapiens
atctctttttaagata

SEQ ID NO: 5249711 - DNA, 16 bp, Homo sapiens
atctctttttgtttgc

SEQ ID NO: 5249712 - DNA, 21 bp, Homo sapiens
atctcttttttcaactggctg

SEQ ID NO: 5249713 - DNA, 19 bp, Homo sapiens
atctgaaaaatacttttgg

SEQ ID NO: 5249714 - DNA, 15 bp, Homo sapiens
atctgaaaactggaa

SEQ ID NO: 5249715 - DNA, 14 bp, Homo sapiens
atctgaaaagaaat

SEQ ID NO: 5249716 - DNA, 16 bp, Homo sapiens
atctgaaaatagcaac

SEQ ID NO: 5249717 - DNA, 14 bp, Homo sapiens
atctgaaaatgtat

SEQ ID NO: 5249718 - DNA, 16 bp, Homo sapiens
atctgaaaatgtatgt

SEQ ID NO: 5249719 - DNA, 20 bp, Homo sapiens
atctgaaaggccagcagctg

SEQ ID NO: 5249720 - DNA, 16 bp, Homo sapiens
atctgaaagtaaagtt

SEQ ID NO: 5249721 - DNA, 14 bp, Homo sapiens
atctgaaagtatat

SEQ ID NO: 5249722 - DNA, 15 bp, Homo sapiens
atctgaaatccataa

SEQ ID NO: 5249723 - DNA, 18 bp, Homo sapiens
atctgaaatccataaact

SEQ ID NO: 5249724 - DNA, 13 bp, Homo sapiens
atctgaaatctac

SEQ ID NO: 5249725 - DNA, 14 bp, Homo sapiens
atctgaaatctaca

SEQ ID NO: 5249726 - DNA, 18 bp, Homo sapiens
atctgaaatctacaacat

SEQ ID NO: 5249727 - DNA, 13 bp, Homo sapiens
atctgaaatgtga

SEQ ID NO: 5249728 - DNA, 13 bp, Homo sapiens
atctgaaattcta

SEQ ID NO: 5249729 - DNA, 14 bp, Homo sapiens
atctgaacccagct

SEQ ID NO: 5249730 - DNA, 22 bp, Homo sapiens
atctgaactcacagactgctgt

SEQ ID NO: 5249731 - DNA, 18 bp, Homo sapiens
atctgaactttgtttcca

SEQ ID NO: 5249732 - DNA, 11 bp, Homo sapiens
atctgaagaaa

SEQ ID NO: 5249733 - DNA, 16 bp, Homo sapiens
atctgaagaaagttat

SEQ ID NO: 5249734 - DNA, 21 bp, Homo sapiens
atctgaagaaagttattcttg

SEQ ID NO: 5249735 - DNA, 18 bp, Homo sapiens
atctgaagacctaccagg

SEQ ID NO: 5249736 - DNA, 22 bp, Homo sapiens
atctgaagaggcttctcctgtt

SEQ ID NO: 5249737 - DNA, 22 bp, Homo sapiens
atctgaagagtatccttccttc

SEQ ID NO: 5249738 - DNA, 13 bp, Homo sapiens
atctgaagagtgg

SEQ ID NO: 5249739 - DNA, 15 bp, Homo sapiens
atctgaagagtggaa

SEQ ID NO: 5249740 - DNA, 16 bp, Homo sapiens
atctgaagattgttta

SEQ ID NO: 5249741 - DNA, 20 bp, Homo sapiens
atctgaagattgtttatcta

SEQ ID NO: 5249742 - DNA, 18 bp, Homo sapiens
atctgaagccctcccagg

SEQ ID NO: 5249743 - DNA, 21 bp, Homo sapiens
atctgaaggggcaaattcttt

SEQ ID NO: 5249744 - DNA, 23 bp, Homo sapiens
atctgaaggggcaaattcttttg

SEQ ID NO: 5249745 - DNA, 18 bp, Homo sapiens
atctgaatagtgtcacca

SEQ ID NO: 5249746 - DNA, 12 bp, Homo sapiens
atctgaatgttc

SEQ ID NO: 5249747 - DNA, 18 bp, Homo sapiens
atctgaattaaataaata

SEQ ID NO: 5249748 - DNA, 13 bp, Homo sapiens
atctgaatttcta

SEQ ID NO: 5249749 - DNA, 21 bp, Homo sapiens
atctgaattttaaaacatgct

SEQ ID NO: 5249750 - DNA, 22 bp, Homo sapiens
atctgaattttgcaatgtattt

SEQ ID NO: 5249751 - DNA, 18 bp, Homo sapiens
atctgaatttttaaacaa

SEQ ID NO: 5249752 - DNA, 20 bp, Homo sapiens
atctgaatttttaaacaagt

SEQ ID NO: 5249753 - DNA, 12 bp, Homo sapiens
atctgacaaatt

SEQ ID NO: 5249754 - DNA, 16 bp, Homo sapiens
atctgacagcaggcca

SEQ ID NO: 5249755 - DNA, 13 bp, Homo sapiens
atctgacatatta

SEQ ID NO: 5249756 - DNA, 17 bp, Homo sapiens
atctgacatattatgcc

SEQ ID NO: 5249757 - DNA, 18 bp, Homo sapiens
atctgacatattatgcct

SEQ ID NO: 5249758 - DNA, 20 bp, Homo sapiens
atctgacatattatgcctga

SEQ ID NO: 5249759 - DNA, 16 bp, Homo sapiens
atctgacatccccact

SEQ ID NO: 5249760 - DNA, 20 bp, Homo sapiens
atctgacatctctgcaatct

SEQ ID NO: 5249761 - DNA, 15 bp, Homo sapiens
atctgaccacagaca

SEQ ID NO: 5249762 - DNA, 17 bp, Homo sapiens
atctgaccacagacact

SEQ ID NO: 5249763 - DNA, 12 bp, Homo sapiens
atctgacccagt

SEQ ID NO: 5249764 - DNA, 13 bp, Homo sapiens
atctgacccagtg

SEQ ID NO: 5249765 - DNA, 14 bp, Homo sapiens
atctgacccagtgc

SEQ ID NO: 5249766 - DNA, 23 bp, Homo sapiens
atctgaccccaagggggctgctg

SEQ ID NO: 5249767 - DNA, 16 bp, Homo sapiens
atctgaccctcccagt

SEQ ID NO: 5249768 - DNA, 18 bp, Homo sapiens
atctgaccctcccagtct

SEQ ID NO: 5249769 - DNA, 21 bp, Homo sapiens
atctgacccttctccaaaggc

SEQ ID NO: 5249770 - DNA, 18 bp, Homo sapiens
atctgaccgttctattgt

SEQ ID NO: 5249771 - DNA, 17 bp, Homo sapiens
atctgactatgacataa

SEQ ID NO: 5249772 - DNA, 17 bp, Homo sapiens
atctgactgccaaataa

SEQ ID NO: 5249773 - DNA, 16 bp, Homo sapiens
atctgactgccaagcc

SEQ ID NO: 5249774 - DNA, 17 bp, Homo sapiens
atctgactgccaagcca

SEQ ID NO: 5249775 - DNA, 18 bp, Homo sapiens
atctgactgccaagccag

SEQ ID NO: 5249776 - DNA, 17 bp, Homo sapiens
atctgactttaattgtg

SEQ ID NO: 5249777 - DNA, 18 bp, Homo sapiens
atctgagaaaagctttga

SEQ ID NO: 5249778 - DNA, 22 bp, Homo sapiens
atctgagaaaagctttgaaccc

SEQ ID NO: 5249779 - DNA, 14 bp, Homo sapiens
atctgagaatgaac

SEQ ID NO: 5249780 - DNA, 17 bp, Homo sapiens
atctgagaatgaacaaa

SEQ ID NO: 5249781 - DNA, 20 bp, Homo sapiens
atctgagaggccacagtgca

SEQ ID NO: 5249782 - DNA, 18 bp, Homo sapiens
atctgagatctccctcca

SEQ ID NO: 5249783 - DNA, 21 bp, Homo sapiens
atctgagatctccctccaggg

SEQ ID NO: 5249784 - DNA, 21 bp, Homo sapiens
atctgagcaaacaccagtgag

SEQ ID NO: 5249785 - DNA, 18 bp, Homo sapiens
atctgagcaataacttct

SEQ ID NO: 5249786 - DNA, 13 bp, Homo sapiens
atctgagccctcc

SEQ ID NO: 5249787 - DNA, 23 bp, Homo sapiens
atctgagccctccctcttcccag

SEQ ID NO: 5249788 - DNA, 21 bp, Homo sapiens
atctgagcctaaatctaatca

SEQ ID NO: 5249789 - DNA, 19 bp, Homo sapiens
atctgagctctttgcacta

SEQ ID NO: 5249790 - DNA, 17 bp, Homo sapiens
atctgagctgagccagg

SEQ ID NO: 5249791 - DNA, 18 bp, Homo sapiens
atctgagctgagccaggc

SEQ ID NO: 5249792 - DNA, 19 bp, Homo sapiens
atctgagctgagccaggct

SEQ ID NO: 5249793 - DNA, 16 bp, Homo sapiens
atctgagctgcagcct

SEQ ID NO: 5249794 - DNA, 21 bp, Homo sapiens
atctgaggaaaatggaagacc

SEQ ID NO: 5249795 - DNA, 15 bp, Homo sapiens
atctgaggaattctg

SEQ ID NO: 5249796 - DNA, 16 bp, Homo sapiens
atctgaggatgagaca

SEQ ID NO: 5249797 - DNA, 19 bp, Homo sapiens
atctgaggcatcctctgac

SEQ ID NO: 5249798 - DNA, 17 bp, Homo sapiens
atctgagggaaatgttt

SEQ ID NO: 5249799 - DNA, 22 bp, Homo sapiens
atctgagggcactctctgccag

SEQ ID NO: 5249800 - DNA, 18 bp, Homo sapiens
atctgagggttaatttct

SEQ ID NO: 5249801 - DNA, 20 bp, Homo sapiens
atctgaggttggatttgctc

SEQ ID NO: 5249802 - DNA, 16 bp, Homo sapiens
atctgagtccagctcc

SEQ ID NO: 5249803 - DNA, 17 bp, Homo sapiens
atctgagtcctggatga

SEQ ID NO: 5249804 - DNA, 23 bp, Homo sapiens
atctgagttgccaagacaaatca

SEQ ID NO: 5249805 - DNA, 16 bp, Homo sapiens
atctgataaaattgtg

SEQ ID NO: 5249806 - DNA, 12 bp, Homo sapiens
atctgataaagt

SEQ ID NO: 5249807 - DNA, 17 bp, Homo sapiens
atctgataggaaaagaa

SEQ ID NO: 5249808 - DNA, 12 bp, Homo sapiens
atctgatagggt

SEQ ID NO: 5249809 - DNA, 20 bp, Homo sapiens
atctgatatcaggaaatatc

SEQ ID NO: 5249810 - DNA, 17 bp, Homo sapiens
atatttaagaaaagcac

SEQ ID NO: 5249811 - DNA, 22 bp, Homo sapiens
atatttaagaaaagcacttttg

SEQ ID NO: 5249812 - DNA, 21 bp, Homo sapiens
atatttaagagattaagaata

SEQ ID NO: 5249813 - DNA, 12 bp, Homo sapiens
atatttaagcct

SEQ ID NO: 5249814 - DNA, 14 bp, Homo sapiens
atatttaaggagat

SEQ ID NO: 5249815 - DNA, 23 bp, Homo sapiens
atatttaaggatagtgtgaagat

SEQ ID NO: 5249816 - DNA, 21 bp, Homo sapiens
atatttaagtataaaatacaa

SEQ ID NO: 5249817 - DNA, 20 bp, Homo sapiens
atatttaagtattcaagaaa

SEQ ID NO: 5249818 - DNA, 13 bp, Homo sapiens
atatttaatatca

SEQ ID NO: 5249819 - DNA, 13 bp, Homo sapiens
atatttaatcttt

SEQ ID NO: 5249820 - DNA, 13 bp, Homo sapiens
atatttaatgata

SEQ ID NO: 5249821 - DNA, 14 bp, Homo sapiens
atatttaatgcatt

SEQ ID NO: 5249822 - DNA, 22 bp, Homo sapiens
atatttaatgcattaaacctgt

SEQ ID NO: 5249823 - DNA, 15 bp, Homo sapiens
atatttaattaaagc

SEQ ID NO: 5249824 - DNA, 14 bp, Homo sapiens
atatttaattatta

SEQ ID NO: 5249825 - DNA, 17 bp, Homo sapiens
atatttaattattaact

SEQ ID NO: 5249826 - DNA, 13 bp, Homo sapiens
atatttacaacct

SEQ ID NO: 5249827 - DNA, 14 bp, Homo sapiens
atatttacaataaa

SEQ ID NO: 5249828 - DNA, 16 bp, Homo sapiens
atatttacaatgtatt

SEQ ID NO: 5249829 - DNA, 13 bp, Homo sapiens
atatttacagaag

SEQ ID NO: 5249830 - DNA, 16 bp, Homo sapiens
atatttacagaagaaa

SEQ ID NO: 5249831 - DNA, 23 bp, Homo sapiens
atatttacagtgaaaatgtaagc

SEQ ID NO: 5249832 - DNA, 17 bp, Homo sapiens
atatttacatccagctt

SEQ ID NO: 5249833 - DNA, 21 bp, Homo sapiens
atatttacatgaattgcattt

SEQ ID NO: 5249834 - DNA, 16 bp, Homo sapiens
atatttacctcagcct

SEQ ID NO: 5249835 - DNA, 17 bp, Homo sapiens
atatttacctcagcctg

SEQ ID NO: 5249836 - DNA, 19 bp, Homo sapiens
atatttacctgtatttaag

SEQ ID NO: 5249837 - DNA, 16 bp, Homo sapiens
atatttaccttgaaaa

SEQ ID NO: 5249838 - DNA, 18 bp, Homo sapiens
atatttactaaaatggac

SEQ ID NO: 5249839 - DNA, 18 bp, Homo sapiens
atatttactctttgcaaa

SEQ ID NO: 5249840 - DNA, 22 bp, Homo sapiens
atatttactgagacttcgaaga

SEQ ID NO: 5249841 - DNA, 15 bp, Homo sapiens
atatttactgctctt

SEQ ID NO: 5249842 - DNA, 19 bp, Homo sapiens
atatttagattgttaaaat

SEQ ID NO: 5249843 - DNA, 18 bp, Homo sapiens
atatttagcagtattgtt

SEQ ID NO: 5249844 - DNA, 14 bp, Homo sapiens
atatttagctgtaa

SEQ ID NO: 5249845 - DNA, 14 bp, Homo sapiens
atatttaggcaaga

SEQ ID NO: 5249846 - DNA, 19 bp, Homo sapiens
atatttaggccagggtctc

SEQ ID NO: 5249847 - DNA, 17 bp, Homo sapiens
atatttagtattgaata

SEQ ID NO: 5249848 - DNA, 22 bp, Homo sapiens
atatttagttacgtataatgct

SEQ ID NO: 5249849 - DNA, 14 bp, Homo sapiens
atatttataaaact

SEQ ID NO: 5249850 - DNA, 16 bp, Homo sapiens
atatttataacagcat

SEQ ID NO: 5249851 - DNA, 14 bp, Homo sapiens
atatttataagaga

SEQ ID NO: 5249852 - DNA, 19 bp, Homo sapiens
atatttataattaaagaaa

SEQ ID NO: 5249853 - DNA, 14 bp, Homo sapiens
atatttatactcta

SEQ ID NO: 5249854 - DNA, 15 bp, Homo sapiens
atatttatactttgc

SEQ ID NO: 5249855 - DNA, 23 bp, Homo sapiens
atatttatagagttcatagaaat

SEQ ID NO: 5249856 - DNA, 23 bp, Homo sapiens
atatttatagcaaagttatctta

SEQ ID NO: 5249857 - DNA, 15 bp, Homo sapiens
atatttatagggctt

SEQ ID NO: 5249858 - DNA, 15 bp, Homo sapiens
atatttatagtcaca

SEQ ID NO: 5249859 - DNA, 14 bp, Homo sapiens
atatttatataatt

SEQ ID NO: 5249860 - DNA, 20 bp, Homo sapiens
atatttatataattatgtta

SEQ ID NO: 5249861 - DNA, 22 bp, Homo sapiens
atatttatataattatgttatt

SEQ ID NO: 5249862 - DNA, 14 bp, Homo sapiens
atatttatatatat

SEQ ID NO: 5249863 - DNA, 15 bp, Homo sapiens
atatttatatatatt

SEQ ID NO: 5249864 - DNA, 22 bp, Homo sapiens
atatttatatcatatataaaag

SEQ ID NO: 5249865 - DNA, 12 bp, Homo sapiens
atatttatatgt

SEQ ID NO: 5249866 - DNA, 17 bp, Homo sapiens
atatttatatgttatta

SEQ ID NO: 5249867 - DNA, 17 bp, Homo sapiens
atatttatattgtatat

SEQ ID NO: 5249868 - DNA, 14 bp, Homo sapiens
atatttatatttca

SEQ ID NO: 5249869 - DNA, 15 bp, Homo sapiens
atatttatccaaaat

SEQ ID NO: 5249870 - DNA, 19 bp, Homo sapiens
atatttatgaagaaaatac

SEQ ID NO: 5249871 - DNA, 19 bp, Homo sapiens
atatttatgaccagagcaa

SEQ ID NO: 5249872 - DNA, 21 bp, Homo sapiens
atatttatgaccagagcaaaa

SEQ ID NO: 5249873 - DNA, 21 bp, Homo sapiens
atatttatgacctcaacaaag

SEQ ID NO: 5249874 - DNA, 22 bp, Homo sapiens
atatttatgacctcaacaaaga

SEQ ID NO: 5249875 - DNA, 20 bp, Homo sapiens
atatttatgcagaaggtatt

SEQ ID NO: 5249876 - DNA, 23 bp, Homo sapiens
atatttatgcttaaaatatgtat

SEQ ID NO: 5249877 - DNA, 14 bp, Homo sapiens
atatttatgtagat

SEQ ID NO: 5249878 - DNA, 20 bp, Homo sapiens
atatttatgtagatgtgcat

SEQ ID NO: 5249879 - DNA, 15 bp, Homo sapiens
atatttatgtatctt

SEQ ID NO: 5249880 - DNA, 21 bp, Homo sapiens
atatttatgtctatttaagcc

SEQ ID NO: 5249881 - DNA, 20 bp, Homo sapiens
atatttatgtgttttaataa

SEQ ID NO: 5249882 - DNA, 20 bp, Homo sapiens
atatttattaaataaaatca

SEQ ID NO: 5249883 - DNA, 15 bp, Homo sapiens
atatttattacacaa

SEQ ID NO: 5249884 - DNA, 16 bp, Homo sapiens
atatttattacctctg

SEQ ID NO: 5249885 - DNA, 14 bp, Homo sapiens
atatttattactgt

SEQ ID NO: 5249886 - DNA, 19 bp, Homo sapiens
atatttattactgtaagaa

SEQ ID NO: 5249887 - DNA, 23 bp, Homo sapiens
atatttattctgggttttgtagc

SEQ ID NO: 5249888 - DNA, 13 bp, Homo sapiens
atatttattgctt

SEQ ID NO: 5249889 - DNA, 11 bp, Homo sapiens
atatttattgt

SEQ ID NO: 5249890 - DNA, 14 bp, Homo sapiens
atatttattgtgct

SEQ ID NO: 5249891 - DNA, 13 bp, Homo sapiens
atatttattgtta

SEQ ID NO: 5249892 - DNA, 16 bp, Homo sapiens
atatttattgttagaa

SEQ ID NO: 5249893 - DNA, 19 bp, Homo sapiens
atatttattgttagaaaat

SEQ ID NO: 5249894 - DNA, 23 bp, Homo sapiens
atatttattgtttatttatcagt

SEQ ID NO: 5249895 - DNA, 13 bp, Homo sapiens
atatttatttaaa

SEQ ID NO: 5249896 - DNA, 18 bp, Homo sapiens
atatttatttaaacaaat

SEQ ID NO: 5249897 - DNA, 19 bp, Homo sapiens
atatttatttaaacaaatg

SEQ ID NO: 5249898 - DNA, 16 bp, Homo sapiens
atatttatttaaagca

SEQ ID NO: 5249899 - DNA, 17 bp, Homo sapiens
atatttatttaaagcat

SEQ ID NO: 5249900 - DNA, 19 bp, Homo sapiens
atatttatttatgctaata

SEQ ID NO: 5249901 - DNA, 13 bp, Homo sapiens
atatttatttcag

SEQ ID NO: 5249902 - DNA, 18 bp, Homo sapiens
atatttattttaataatg

SEQ ID NO: 5249903 - DNA, 19 bp, Homo sapiens
atatttattttattctatg

SEQ ID NO: 5249904 - DNA, 14 bp, Homo sapiens
atatttatttttgg

SEQ ID NO: 5249905 - DNA, 15 bp, Homo sapiens
atatttcaaaataaa

SEQ ID NO: 5249906 - DNA, 15 bp, Homo sapiens
atatttcaaacatca

SEQ ID NO: 5249907 - DNA, 21 bp, Homo sapiens
atatttcaaacatcagctgaa

SEQ ID NO: 5249908 - DNA, 17 bp, Homo sapiens
atatttcaaatgaacac

SEQ ID NO: 5249909 - DNA, 19 bp, Homo sapiens
atatttcaagtacactgaa

SEQ ID NO: 5249910 - DNA, 14 bp, Homo sapiens
atatttcaataaat

SEQ ID NO: 5249911 - DNA, 22 bp, Homo sapiens
atatttcacagcaccaaaataa

SEQ ID NO: 5249912 - DNA, 13 bp, Homo sapiens
atatttcacatgt

SEQ ID NO: 5249913 - DNA, 14 bp, Homo sapiens
atatttcagaaata

SEQ ID NO: 5249914 - DNA, 23 bp, Homo sapiens
atatttcagataatcacaataca

SEQ ID NO: 5249915 - DNA, 17 bp, Homo sapiens
atatttcagatatcaaa

SEQ ID NO: 5249916 - DNA, 14 bp, Homo sapiens
atatttcagttctt

SEQ ID NO: 5249917 - DNA, 13 bp, Homo sapiens
atatttcatgtgc

SEQ ID NO: 5249918 - DNA, 14 bp, Homo sapiens
atatttcatgtgct

SEQ ID NO: 5249919 - DNA, 12 bp, Homo sapiens
atatttccaaat

SEQ ID NO: 5249920 - DNA, 14 bp, Homo sapiens
atatttccaaatat

SEQ ID NO: 5249921 - DNA, 18 bp, Homo sapiens
atatttccaaatattcta

SEQ ID NO: 5249922 - DNA, 21 bp, Homo sapiens
atatttccaaatattctaaaa

SEQ ID NO: 5249923 - DNA, 22 bp, Homo sapiens
atatttccaggctgcatttgta

SEQ ID NO: 5249924 - DNA, 15 bp, Homo sapiens
atatttccatttctt

SEQ ID NO: 5249925 - DNA, 16 bp, Homo sapiens
atatttccatttcttc

SEQ ID NO: 5249926 - DNA, 21 bp, Homo sapiens
atatttcccatttgtgccaga

SEQ ID NO: 5249927 - DNA, 16 bp, Homo sapiens
atatttccccttggac

SEQ ID NO: 5249928 - DNA, 22 bp, Homo sapiens
atatttccctaaaatacattta

SEQ ID NO: 5249929 - DNA, 13 bp, Homo sapiens
atatttcctgact

SEQ ID NO: 5249930 - DNA, 15 bp, Homo sapiens
atatttcctgacttg

SEQ ID NO: 5249931 - DNA, 17 bp, Homo sapiens
atatttcctgacttgag

SEQ ID NO: 5249932 - DNA, 18 bp, Homo sapiens
atatttcctgtattgctt

SEQ ID NO: 5249933 - DNA, 12 bp, Homo sapiens
atatttccttta

SEQ ID NO: 5249934 - DNA, 15 bp, Homo sapiens
atatttcctttatgt

SEQ ID NO: 5249935 - DNA, 20 bp, Homo sapiens
atatttcctttatgtgaatt

SEQ ID NO: 5249936 - DNA, 21 bp, Homo sapiens
atatttcctttatgtgaattt

SEQ ID NO: 5249937 - DNA, 22 bp, Homo sapiens
atatttccttttgtaaagtaaa

SEQ ID NO: 5249938 - DNA, 17 bp, Homo sapiens
atatttcgaccctgggg

SEQ ID NO: 5249939 - DNA, 15 bp, Homo sapiens
atatttctaactata

SEQ ID NO: 5249940 - DNA, 18 bp, Homo sapiens
atatttctaagcttattt

SEQ ID NO: 5249941 - DNA, 21 bp, Homo sapiens
atatttctaagcttatttcta

SEQ ID NO: 5249942 - DNA, 20 bp, Homo sapiens
atatttctacaaggtgttca

SEQ ID NO: 5249943 - DNA, 22 bp, Homo sapiens
atatttctacagagaaaatgaa

SEQ ID NO: 5249944 - DNA, 16 bp, Homo sapiens
atatttctattgaatt

SEQ ID NO: 5249945 - DNA, 21 bp, Homo sapiens
atatttctattttattatgaa

SEQ ID NO: 5249946 - DNA, 11 bp, Homo sapiens
atatttctcaa

SEQ ID NO: 5249947 - DNA, 13 bp, Homo sapiens
atatttctcataa

SEQ ID NO: 5249948 - DNA, 17 bp, Homo sapiens
atatttctcatttagca

SEQ ID NO: 5249949 - DNA, 17 bp, Homo sapiens
atatttctcgtatttaa

SEQ ID NO: 5249950 - DNA, 15 bp, Homo sapiens
atatttctgatataa

SEQ ID NO: 5249951 - DNA, 19 bp, Homo sapiens
atatttctgctttcaaagt

SEQ ID NO: 5249952 - DNA, 20 bp, Homo sapiens
atatttctgctttctttgat

SEQ ID NO: 5249953 - DNA, 23 bp, Homo sapiens
atatttctgtatatttgtcatga

SEQ ID NO: 5249954 - DNA, 12 bp, Homo sapiens
atatttctgtgt

SEQ ID NO: 5249955 - DNA, 21 bp, Homo sapiens
atatttctgtgtacacatcta

SEQ ID NO: 5249956 - DNA, 21 bp, Homo sapiens
atatttctgtgtagtatttat

SEQ ID NO: 5249957 - DNA, 22 bp, Homo sapiens
atatttcttaatttggataata

SEQ ID NO: 5249958 - DNA, 13 bp, Homo sapiens
atatttcttcaaa

SEQ ID NO: 5249959 - DNA, 15 bp, Homo sapiens
atatttcttcaaata

SEQ ID NO: 5249960 - DNA, 22 bp, Homo sapiens
atatttcttcttctaagaagac

SEQ ID NO: 5249961 - DNA, 13 bp, Homo sapiens
atatttcttgctt

SEQ ID NO: 5249962 - DNA, 14 bp, Homo sapiens
atatttcttgcttt

SEQ ID NO: 5249963 - DNA, 21 bp, Homo sapiens
atatttctttttagattgtct

SEQ ID NO: 5249964 - DNA, 19 bp, Homo sapiens
atatttgaaaattaccttt

SEQ ID NO: 5249965 - DNA, 20 bp, Homo sapiens
atatttgaaaattaccttta

SEQ ID NO: 5249966 - DNA, 12 bp, Homo sapiens
atatttgaaaga

SEQ ID NO: 5249967 - DNA, 23 bp, Homo sapiens
atatttgaaatagtatacattgt

SEQ ID NO: 5249968 - DNA, 13 bp, Homo sapiens
atatttgaaatat

SEQ ID NO: 5249969 - DNA, 15 bp, Homo sapiens
atatttgaagcagct

SEQ ID NO: 5249970 - DNA, 14 bp, Homo sapiens
atatttgaatcttg

SEQ ID NO: 5249971 - DNA, 17 bp, Homo sapiens
atatttgaatcttgtct

SEQ ID NO: 5249972 - DNA, 19 bp, Homo sapiens
atatttgaatcttgtctca

SEQ ID NO: 5249973 - DNA, 21 bp, Homo sapiens
atatttgaatcttgtctcaat

SEQ ID NO: 5249974 - DNA, 14 bp, Homo sapiens
atatttgaatgaaa

SEQ ID NO: 5249975 - DNA, 12 bp, Homo sapiens
atatttgaattt

SEQ ID NO: 5249976 - DNA, 20 bp, Homo sapiens
atatttgaattttaaatcta

SEQ ID NO: 5249977 - DNA, 14 bp, Homo sapiens
atatttgacagaca

SEQ ID NO: 5249978 - DNA, 15 bp, Homo sapiens
atatttgacagacat

SEQ ID NO: 5249979 - DNA, 15 bp, Homo sapiens
atatttgactattct

SEQ ID NO: 5249980 - DNA, 18 bp, Homo sapiens
atatttgactctttcaaa

SEQ ID NO: 5249981 - DNA, 23 bp, Homo sapiens
atatttgactctttcaaagaaat

SEQ ID NO: 5249982 - DNA, 15 bp, Homo sapiens
atatttgacttgcat

SEQ ID NO: 5249983 - DNA, 22 bp, Homo sapiens
atatttgacttgcatgaagaga

SEQ ID NO: 5249984 - DNA, 22 bp, Homo sapiens
atatttgagttgtgattgaaag

SEQ ID NO: 5249985 - DNA, 16 bp, Homo sapiens
atatttgatacatata

SEQ ID NO: 5249986 - DNA, 16 bp, Homo sapiens
atatttgatatttggt

SEQ ID NO: 5249987 - DNA, 17 bp, Homo sapiens
atatttgatcacttaaa

SEQ ID NO: 5249988 - DNA, 15 bp, Homo sapiens
atatttgatgcaaat

SEQ ID NO: 5249989 - DNA, 15 bp, Homo sapiens
atatttgattatgta

SEQ ID NO: 5249990 - DNA, 19 bp, Homo sapiens
atctgatatgcagagtatt

SEQ ID NO: 5249991 - DNA, 13 bp, Homo sapiens
atctgatatgctg

SEQ ID NO: 5249992 - DNA, 21 bp, Homo sapiens
atctgatatgctgagaaatta

SEQ ID NO: 5249993 - DNA, 18 bp, Homo sapiens
atctgatatgtattgttt

SEQ ID NO: 5249994 - DNA, 21 bp, Homo sapiens
atctgatattcaaacacacag

SEQ ID NO: 5249995 - DNA, 19 bp, Homo sapiens
atctgatcccataaagaaa

SEQ ID NO: 5249996 - DNA, 17 bp, Homo sapiens
atctgatccccatgcct

SEQ ID NO: 5249997 - DNA, 19 bp, Homo sapiens
atctgatcgggataacaaa

SEQ ID NO: 5249998 - DNA, 22 bp, Homo sapiens
atctgatcgggataacaaaatc

SEQ ID NO: 5249999 - DNA, 15 bp, Homo sapiens
atctgatctgtgatt

SEQ ID NO: 5250000 - DNA, 14 bp, Homo sapiens
atctgatcttcctc

SEQ ID NO: 5250001 - DNA, 18 bp, Homo sapiens
atctgatctttttataca

SEQ ID NO: 5250002 - DNA, 19 bp, Homo sapiens
atctgatggccttaatttc

SEQ ID NO: 5250003 - DNA, 22 bp, Homo sapiens
atctgatggccttaatttcctt

SEQ ID NO: 5250004 - DNA, 18 bp, Homo sapiens
atctgatggcttctccag

SEQ ID NO: 5250005 - DNA, 17 bp, Homo sapiens
atctgatggtgagctgg

SEQ ID NO: 5250006 - DNA, 13 bp, Homo sapiens
atctgatgtttca

SEQ ID NO: 5250007 - DNA, 12 bp, Homo sapiens
atctgatgtttg

SEQ ID NO: 5250008 - DNA, 15 bp, Homo sapiens
atctgattcctttaa

SEQ ID NO: 5250009 - DNA, 18 bp, Homo sapiens
atctgattggcagatgag

SEQ ID NO: 5250010 - DNA, 13 bp, Homo sapiens
atctgatttaatg

SEQ ID NO: 5250011 - DNA, 11 bp, Homo sapiens
atctgatttac

SEQ ID NO: 5250012 - DNA, 13 bp, Homo sapiens
atctgatttcatt

SEQ ID NO: 5250013 - DNA, 21 bp, Homo sapiens
atctgatttgtaacccactga

SEQ ID NO: 5250014 - DNA, 13 bp, Homo sapiens
atctgcaaaatgt

SEQ ID NO: 5250015 - DNA, 17 bp, Homo sapiens
atctgcaagaacactgg

SEQ ID NO: 5250016 - DNA, 14 bp, Homo sapiens
atctgcaaggattt

SEQ ID NO: 5250017 - DNA, 14 bp, Homo sapiens
atctgcaatatgaa

SEQ ID NO: 5250018 - DNA, 15 bp, Homo sapiens
atctgcaatatgaat

SEQ ID NO: 5250019 - DNA, 22 bp, Homo sapiens
atctgcaatgtttttgtgtaga

SEQ ID NO: 5250020 - DNA, 21 bp, Homo sapiens
atctgcaattcaaaagttcca

SEQ ID NO: 5250021 - DNA, 12 bp, Homo sapiens
atctgcaatttg

SEQ ID NO: 5250022 - DNA, 16 bp, Homo sapiens
atctgcacactctctt

SEQ ID NO: 5250023 - DNA, 10 bp, Homo sapiens
atctgcaccc

SEQ ID NO: 5250024 - DNA, 17 bp, Homo sapiens
atctgcacccccctggg

SEQ ID NO: 5250025 - DNA, 22 bp, Homo sapiens
atctgcaccccttctctcctcc

SEQ ID NO: 5250026 - DNA, 16 bp, Homo sapiens
atctgcacccttcttt

SEQ ID NO: 5250027 - DNA, 21 bp, Homo sapiens
atctgcaccgacgcctgcccc

SEQ ID NO: 5250028 - DNA, 15 bp, Homo sapiens
atctgcactcctgtc

SEQ ID NO: 5250029 - DNA, 16 bp, Homo sapiens
atctgcactcctgtct

SEQ ID NO: 5250030 - DNA, 17 bp, Homo sapiens
atctgcactctaaactg

SEQ ID NO: 5250031 - DNA, 20 bp, Homo sapiens
atctgcactctaaactgcaa

SEQ ID NO: 5250032 - DNA, 11 bp, Homo sapiens
atctgcagaac

SEQ ID NO: 5250033 - DNA, 20 bp, Homo sapiens
atctgcagaaggaaaaatgt

SEQ ID NO: 5250034 - DNA, 19 bp, Homo sapiens
atctgcagaatgggccact

SEQ ID NO: 5250035 - DNA, 18 bp, Homo sapiens
atctgcagatatgttgag

SEQ ID NO: 5250036 - DNA, 21 bp, Homo sapiens
atctgcagccattcttcaggt

SEQ ID NO: 5250037 - DNA, 23 bp, Homo sapiens
atctgcaggcaccgggctggctg

SEQ ID NO: 5250038 - DNA, 15 bp, Homo sapiens
atctgcaggcagaca

SEQ ID NO: 5250039 - DNA, 16 bp, Homo sapiens
atctgcaggcagacac

SEQ ID NO: 5250040 - DNA, 17 bp, Homo sapiens
atctgcaggcagacacg

SEQ ID NO: 5250041 - DNA, 16 bp, Homo sapiens
atctgcaggcttctta

SEQ ID NO: 5250042 - DNA, 23 bp, Homo sapiens
atctgcaggggtctgggagtcag

SEQ ID NO: 5250043 - DNA, 17 bp, Homo sapiens
atctgcagtacagtctt

SEQ ID NO: 5250044 - DNA, 16 bp, Homo sapiens
atctgcagtcacttcg

SEQ ID NO: 5250045 - DNA, 20 bp, Homo sapiens
atctgcagttctttttgtac

SEQ ID NO: 5250046 - DNA, 16 bp, Homo sapiens
atctgcatatttctgt

SEQ ID NO: 5250047 - DNA, 17 bp, Homo sapiens
atctgcatatttctgta

SEQ ID NO: 5250048 - DNA, 18 bp, Homo sapiens
atctgcatatttctgtat

SEQ ID NO: 5250049 - DNA, 21 bp, Homo sapiens
atctgcatatttctgtatatt

SEQ ID NO: 5250050 - DNA, 18 bp, Homo sapiens
atctgcatgtaaaatctt

SEQ ID NO: 5250051 - DNA, 21 bp, Homo sapiens
atctgcatgtaaaatcttcag

SEQ ID NO: 5250052 - DNA, 12 bp, Homo sapiens
atctgcatgttt

SEQ ID NO: 5250053 - DNA, 16 bp, Homo sapiens
atctgcattccccgct

SEQ ID NO: 5250054 - DNA, 21 bp, Homo sapiens
atctgcattccccgctgccca

SEQ ID NO: 5250055 - DNA, 21 bp, Homo sapiens
atctgcattgcccagtctttc

SEQ ID NO: 5250056 - DNA, 22 bp, Homo sapiens
atctgcattgcccagtctttca

SEQ ID NO: 5250057 - DNA, 11 bp, Homo sapiens
atctgcattta

SEQ ID NO: 5250058 - DNA, 16 bp, Homo sapiens
atctgcatttagcaca

SEQ ID NO: 5250059 - DNA, 14 bp, Homo sapiens
atctgcatttataa

SEQ ID NO: 5250060 - DNA, 20 bp, Homo sapiens
atctgcatttataaatgtgt

SEQ ID NO: 5250061 - DNA, 22 bp, Homo sapiens
atctgcatttataaatgtgtgg

SEQ ID NO: 5250062 - DNA, 19 bp, Homo sapiens
atctgcattttcaccccac

SEQ ID NO: 5250063 - DNA, 13 bp, Homo sapiens
atctgccaaaatg

SEQ ID NO: 5250064 - DNA, 13 bp, Homo sapiens
atctgccaatgcc

SEQ ID NO: 5250065 - DNA, 14 bp, Homo sapiens
atctgccaatgcca

SEQ ID NO: 5250066 - DNA, 19 bp, Homo sapiens
atctgccacaaaaatgttc

SEQ ID NO: 5250067 - DNA, 21 bp, Homo sapiens
atctgccatgtccatagccat

SEQ ID NO: 5250068 - DNA, 18 bp, Homo sapiens
atctgccatttatttcct

SEQ ID NO: 5250069 - DNA, 13 bp, Homo sapiens
atctgcccaggac

SEQ ID NO: 5250070 - DNA, 16 bp, Homo sapiens
atctgcccaggggtgc

SEQ ID NO: 5250071 - DNA, 21 bp, Homo sapiens
atctgcccaggggtgccccct

SEQ ID NO: 5250072 - DNA, 22 bp, Homo sapiens
atctgcccaggggtgccccctc

SEQ ID NO: 5250073 - DNA, 18 bp, Homo sapiens
atctgccccacagtctcc

SEQ ID NO: 5250074 - DNA, 11 bp, Homo sapiens
atctgccccag

SEQ ID NO: 5250075 - DNA, 14 bp, Homo sapiens
atctgccccaggta

SEQ ID NO: 5250076 - DNA, 23 bp, Homo sapiens
atctgccccctagttcaggtcca

SEQ ID NO: 5250077 - DNA, 11 bp, Homo sapiens
atctgcccctc

SEQ ID NO: 5250078 - DNA, 14 bp, Homo sapiens
atctgcccctccct

SEQ ID NO: 5250079 - DNA, 15 bp, Homo sapiens
atctgcccctgttga

SEQ ID NO: 5250080 - DNA, 21 bp, Homo sapiens
atctgcccgcctcggcctccc

SEQ ID NO: 5250081 - DNA, 23 bp, Homo sapiens
atctgcccgcctcggcctcccaa

SEQ ID NO: 5250082 - DNA, 22 bp, Homo sapiens
atctgccctccctgtttctcca

SEQ ID NO: 5250083 - DNA, 18 bp, Homo sapiens
atctgccgctttgtctgt

SEQ ID NO: 5250084 - DNA, 19 bp, Homo sapiens
atctgccggcccccaggac

SEQ ID NO: 5250085 - DNA, 13 bp, Homo sapiens
atctgcctaagga

SEQ ID NO: 5250086 - DNA, 22 bp, Homo sapiens
atctgcctaaggacttctttaa

SEQ ID NO: 5250087 - DNA, 14 bp, Homo sapiens
atctgcctcccctg

SEQ ID NO: 5250088 - DNA, 18 bp, Homo sapiens
atctgcctcccctgtgga

SEQ ID NO: 5250089 - DNA, 20 bp, Homo sapiens
atctgcctcccctgtggaaa

SEQ ID NO: 5250090 - DNA, 14 bp, Homo sapiens
atctgcctcctctc

SEQ ID NO: 5250091 - DNA, 22 bp, Homo sapiens
atctgcctcctctcctcctcag

SEQ ID NO: 5250092 - DNA, 23 bp, Homo sapiens
atctgcctcctgtgcctcccttt

SEQ ID NO: 5250093 - DNA, 19 bp, Homo sapiens
atctgcctgacaggctgtg

SEQ ID NO: 5250094 - DNA, 22 bp, Homo sapiens
atctgcctgacaggctgtgact

SEQ ID NO: 5250095 - DNA, 14 bp, Homo sapiens
atctgcctggaaag

SEQ ID NO: 5250096 - DNA, 13 bp, Homo sapiens
atctgcctggagc

SEQ ID NO: 5250097 - DNA, 12 bp, Homo sapiens
atctgcctggcc

SEQ ID NO: 5250098 - DNA, 14 bp, Homo sapiens
atctgcctggcctg

SEQ ID NO: 5250099 - DNA, 12 bp, Homo sapiens
atctgcctgggc

SEQ ID NO: 5250100 - DNA, 15 bp, Homo sapiens
atctgcctgggcctg

SEQ ID NO: 5250101 - DNA, 17 bp, Homo sapiens
atctgcctgggcctgtg

SEQ ID NO: 5250102 - DNA, 19 bp, Homo sapiens
atctgcctgggcctgtgca

SEQ ID NO: 5250103 - DNA, 21 bp, Homo sapiens
atctgcctgggcctgtgcagc

SEQ ID NO: 5250104 - DNA, 18 bp, Homo sapiens
atctgcctgtggccttgc

SEQ ID NO: 5250105 - DNA, 14 bp, Homo sapiens
atctgccttataca

SEQ ID NO: 5250106 - DNA, 18 bp, Homo sapiens
atctgccttccagcccag

SEQ ID NO: 5250107 - DNA, 21 bp, Homo sapiens
atctgccttccagcccagacc

SEQ ID NO: 5250108 - DNA, 19 bp, Homo sapiens
atctgcctttattgtgttt

SEQ ID NO: 5250109 - DNA, 21 bp, Homo sapiens
atctgcctttattgtgtttgt

SEQ ID NO: 5250110 - DNA, 15 bp, Homo sapiens
atctgcctttgtttc

SEQ ID NO: 5250111 - DNA, 22 bp, Homo sapiens
atctgcggatctcagctttgag

SEQ ID NO: 5250112 - DNA, 20 bp, Homo sapiens
atctgcggggcttctgggtg

SEQ ID NO: 5250113 - DNA, 14 bp, Homo sapiens
atctgctaataaaa

SEQ ID NO: 5250114 - DNA, 14 bp, Homo sapiens
atctgctagaaagt

SEQ ID NO: 5250115 - DNA, 16 bp, Homo sapiens
atctgctagtgctgta

SEQ ID NO: 5250116 - DNA, 15 bp, Homo sapiens
atctgctataaactt

SEQ ID NO: 5250117 - DNA, 13 bp, Homo sapiens
atctgctatgctt

SEQ ID NO: 5250118 - DNA, 16 bp, Homo sapiens
atctgctatgcttgaa

SEQ ID NO: 5250119 - DNA, 18 bp, Homo sapiens
atctgctcactttaaacc

SEQ ID NO: 5250120 - DNA, 13 bp, Homo sapiens
atctgctcagccc

SEQ ID NO: 5250121 - DNA, 14 bp, Homo sapiens
atctgctcagccct

SEQ ID NO: 5250122 - DNA, 17 bp, Homo sapiens
atctgctcagccctgga

SEQ ID NO: 5250123 - DNA, 18 bp, Homo sapiens
atctgctcagccctggag

SEQ ID NO: 5250124 - DNA, 16 bp, Homo sapiens
atctgctccatgcaga

SEQ ID NO: 5250125 - DNA, 13 bp, Homo sapiens
atctgctcctccc

SEQ ID NO: 5250126 - DNA, 15 bp, Homo sapiens
atctgctccttcctg

SEQ ID NO: 5250127 - DNA, 20 bp, Homo sapiens
atctgctctagattcataaa

SEQ ID NO: 5250128 - DNA, 17 bp, Homo sapiens
atctgctctccttcctg

SEQ ID NO: 5250129 - DNA, 10 bp, Homo sapiens
atctgctgca

SEQ ID NO: 5250130 - DNA, 16 bp, Homo sapiens
atctgctgcacatagc

SEQ ID NO: 5250131 - DNA, 16 bp, Homo sapiens
atctgctgcagagcag

SEQ ID NO: 5250132 - DNA, 12 bp, Homo sapiens
atctgctgcagt

SEQ ID NO: 5250133 - DNA, 20 bp, Homo sapiens
atctgctgcagttaccacag

SEQ ID NO: 5250134 - DNA, 13 bp, Homo sapiens
atctgctgcatag

SEQ ID NO: 5250135 - DNA, 12 bp, Homo sapiens
atctgctgcccc

SEQ ID NO: 5250136 - DNA, 13 bp, Homo sapiens
atctgctgccccg

SEQ ID NO: 5250137 - DNA, 20 bp, Homo sapiens
atctgctgcctctgaaaata

SEQ ID NO: 5250138 - DNA, 22 bp, Homo sapiens
atctgctgcctctgaaaatatt

SEQ ID NO: 5250139 - DNA, 18 bp, Homo sapiens
atctgctggagtttcatg

SEQ ID NO: 5250140 - DNA, 13 bp, Homo sapiens
atctgctgggctg

SEQ ID NO: 5250141 - DNA, 18 bp, Homo sapiens
atctgctgtccagacagc

SEQ ID NO: 5250142 - DNA, 16 bp, Homo sapiens
atctgctgtcctgttt

SEQ ID NO: 5250143 - DNA, 14 bp, Homo sapiens
atctgctgtgtgga

SEQ ID NO: 5250144 - DNA, 17 bp, Homo sapiens
atctgctgtgtggaaaa

SEQ ID NO: 5250145 - DNA, 15 bp, Homo sapiens
atctgctgttgccat

SEQ ID NO: 5250146 - DNA, 22 bp, Homo sapiens
atctgctgttgccatagcccca

SEQ ID NO: 5250147 - DNA, 19 bp, Homo sapiens
atctgcttacaattccctg

SEQ ID NO: 5250148 - DNA, 15 bp, Homo sapiens
atctgcttatgcagt

SEQ ID NO: 5250149 - DNA, 20 bp, Homo sapiens
atctgcttcatccaatgtga

SEQ ID NO: 5250150 - DNA, 17 bp, Homo sapiens
atctgcttccctggggc

SEQ ID NO: 5250151 - DNA, 16 bp, Homo sapiens
atctgcttgtattttc

SEQ ID NO: 5250152 - DNA, 16 bp, Homo sapiens
atctgctttattgcct

SEQ ID NO: 5250153 - DNA, 11 bp, Homo sapiens
atctgctttca

SEQ ID NO: 5250154 - DNA, 14 bp, Homo sapiens
atctgctttctgtt

SEQ ID NO: 5250155 - DNA, 16 bp, Homo sapiens
atctgctttctgttca

SEQ ID NO: 5250156 - DNA, 19 bp, Homo sapiens
atctgctttctgttcatct

SEQ ID NO: 5250157 - DNA, 18 bp, Homo sapiens
atctgctttgttaatgaa

SEQ ID NO: 5250158 - DNA, 19 bp, Homo sapiens
atctgcttttaatggatgt

SEQ ID NO: 5250159 - DNA, 19 bp, Homo sapiens
atctgcttttcctctgcct

SEQ ID NO: 5250160 - DNA, 23 bp, Homo sapiens
atctggaaacctctacatattta

SEQ ID NO: 5250161 - DNA, 17 bp, Homo sapiens
atctggaaatctgtttt

SEQ ID NO: 5250162 - DNA, 18 bp, Homo sapiens
atctggaaccatcagaaa

SEQ ID NO: 5250163 - DNA, 16 bp, Homo sapiens
atctggaacctcagcc

SEQ ID NO: 5250164 - DNA, 21 bp, Homo sapiens
atctggaacctcagcctggcc

SEQ ID NO: 5250165 - DNA, 23 bp, Homo sapiens
atctggaacgctctaggcagaag

SEQ ID NO: 5250166 - DNA, 22 bp, Homo sapiens
atctggaagaaagccctgtgct

SEQ ID NO: 5250167 - DNA, 23 bp, Homo sapiens
atctggaagaaagccctgtgctt

SEQ ID NO: 5250168 - DNA, 20 bp, Homo sapiens
atctggaaggggatcccacc

SEQ ID NO: 5250169 - DNA, 18 bp, Homo sapiens
atctggaatctgaggcat

SEQ ID NO: 5250170 - DNA, 11 bp, Homo sapiens
atatttgcaaa

SEQ ID NO: 5250171 - DNA, 19 bp, Homo sapiens
atatttgcaaaccctttgt

SEQ ID NO: 5250172 - DNA, 20 bp, Homo sapiens
atatttgcaaagtgtattag

SEQ ID NO: 5250173 - DNA, 21 bp, Homo sapiens
atatttgcacatgggattgct

SEQ ID NO: 5250174 - DNA, 12 bp, Homo sapiens
atatttgcacta

SEQ ID NO: 5250175 - DNA, 23 bp, Homo sapiens
atatttgcagtttttcattttaa

SEQ ID NO: 5250176 - DNA, 15 bp, Homo sapiens
atatttgcataatat

SEQ ID NO: 5250177 - DNA, 18 bp, Homo sapiens
atatttgcatatttttct

SEQ ID NO: 5250178 - DNA, 18 bp, Homo sapiens
atatttgcattatgtatt

SEQ ID NO: 5250179 - DNA, 22 bp, Homo sapiens
atatttgcgtaaatggttttca

SEQ ID NO: 5250180 - DNA, 12 bp, Homo sapiens
atatttgctgca

SEQ ID NO: 5250181 - DNA, 20 bp, Homo sapiens
atatttgcttatttatattc

SEQ ID NO: 5250182 - DNA, 13 bp, Homo sapiens
atatttgcttttt

SEQ ID NO: 5250183 - DNA, 13 bp, Homo sapiens
atatttggaaaga

SEQ ID NO: 5250184 - DNA, 14 bp, Homo sapiens
atatttggaataaa

SEQ ID NO: 5250185 - DNA, 23 bp, Homo sapiens
atatttggaataaaaattccaga

SEQ ID NO: 5250186 - DNA, 23 bp, Homo sapiens
atatttggagctatcagtgcttt

SEQ ID NO: 5250187 - DNA, 20 bp, Homo sapiens
atatttggagtttttctgaa

SEQ ID NO: 5250188 - DNA, 21 bp, Homo sapiens
atatttggcccaaactcatct

SEQ ID NO: 5250189 - DNA, 15 bp, Homo sapiens
atatttggcttaaat

SEQ ID NO: 5250190 - DNA, 18 bp, Homo sapiens
atatttggcttaaatata

SEQ ID NO: 5250191 - DNA, 13 bp, Homo sapiens
atatttgtaaaag

SEQ ID NO: 5250192 - DNA, 19 bp, Homo sapiens
atatttgtaaactacaaag

SEQ ID NO: 5250193 - DNA, 16 bp, Homo sapiens
atatttgtaaagctat

SEQ ID NO: 5250194 - DNA, 13 bp, Homo sapiens
atatttgtaaata

SEQ ID NO: 5250195 - DNA, 20 bp, Homo sapiens
atatttgtaaatttatgtga

SEQ ID NO: 5250196 - DNA, 11 bp, Homo sapiens
atatttgtaac

SEQ ID NO: 5250197 - DNA, 15 bp, Homo sapiens
atatttgtaacattg

SEQ ID NO: 5250198 - DNA, 14 bp, Homo sapiens
atatttgtaacttt

SEQ ID NO: 5250199 - DNA, 18 bp, Homo sapiens
atatttgtaactttgcat

SEQ ID NO: 5250200 - DNA, 18 bp, Homo sapiens
atatttgtaatatatgat

SEQ ID NO: 5250201 - DNA, 18 bp, Homo sapiens
atatttgtactgtttaat

SEQ ID NO: 5250202 - DNA, 19 bp, Homo sapiens
atatttgtactttctgtta

SEQ ID NO: 5250203 - DNA, 20 bp, Homo sapiens
atatttgtactttctgttaa

SEQ ID NO: 5250204 - DNA, 21 bp, Homo sapiens
atatttgtactttctgttaaa

SEQ ID NO: 5250205 - DNA, 18 bp, Homo sapiens
atatttgtagatttatcc

SEQ ID NO: 5250206 - DNA, 20 bp, Homo sapiens
atatttgtaggtatactatg

SEQ ID NO: 5250207 - DNA, 18 bp, Homo sapiens
atatttgtatgtttttct

SEQ ID NO: 5250208 - DNA, 17 bp, Homo sapiens
atatttgtatttattct

SEQ ID NO: 5250209 - DNA, 16 bp, Homo sapiens
atatttgtcatgacag

SEQ ID NO: 5250210 - DNA, 14 bp, Homo sapiens
atatttgtccagat

SEQ ID NO: 5250211 - DNA, 20 bp, Homo sapiens
atatttgtctgtgtgctact

SEQ ID NO: 5250212 - DNA, 21 bp, Homo sapiens
atatttgtctgtgtgctacta

SEQ ID NO: 5250213 - DNA, 16 bp, Homo sapiens
atatttgtctttgaat

SEQ ID NO: 5250214 - DNA, 12 bp, Homo sapiens
atatttgtgaaa

SEQ ID NO: 5250215 - DNA, 21 bp, Homo sapiens
atatttgtgcattttctaaac

SEQ ID NO: 5250216 - DNA, 22 bp, Homo sapiens
atatttgtgctatagtatttga

SEQ ID NO: 5250217 - DNA, 13 bp, Homo sapiens
atatttgtgtaaa

SEQ ID NO: 5250218 - DNA, 17 bp, Homo sapiens
atatttgtgtatttaac

SEQ ID NO: 5250219 - DNA, 23 bp, Homo sapiens
atatttgtgtgctaaacgtgtat

SEQ ID NO: 5250220 - DNA, 13 bp, Homo sapiens
atatttgttaaat

SEQ ID NO: 5250221 - DNA, 15 bp, Homo sapiens
atatttgttatgtag

SEQ ID NO: 5250222 - DNA, 16 bp, Homo sapiens
atatttgttttaatac

SEQ ID NO: 5250223 - DNA, 20 bp, Homo sapiens
atatttgttttatgctactg

SEQ ID NO: 5250224 - DNA, 15 bp, Homo sapiens
atattttaaaaaatc

SEQ ID NO: 5250225 - DNA, 19 bp, Homo sapiens
atattttaaaaaatcaaaa

SEQ ID NO: 5250226 - DNA, 16 bp, Homo sapiens
atattttaaaaataaa

SEQ ID NO: 5250227 - DNA, 17 bp, Homo sapiens
atattttaaaataaact

SEQ ID NO: 5250228 - DNA, 18 bp, Homo sapiens
atattttaaaatttgttc

SEQ ID NO: 5250229 - DNA, 14 bp, Homo sapiens
atattttaaacaga

SEQ ID NO: 5250230 - DNA, 14 bp, Homo sapiens
atattttaaagaat

SEQ ID NO: 5250231 - DNA, 16 bp, Homo sapiens
atattttaaagaattg

SEQ ID NO: 5250232 - DNA, 12 bp, Homo sapiens
atattttaaata

SEQ ID NO: 5250233 - DNA, 14 bp, Homo sapiens
atattttaaatctg

SEQ ID NO: 5250234 - DNA, 12 bp, Homo sapiens
atattttaactt

SEQ ID NO: 5250235 - DNA, 17 bp, Homo sapiens
atattttaagaaagaga

SEQ ID NO: 5250236 - DNA, 15 bp, Homo sapiens
atattttaagcatta

SEQ ID NO: 5250237 - DNA, 21 bp, Homo sapiens
atattttaagcattactcttg

SEQ ID NO: 5250238 - DNA, 23 bp, Homo sapiens
atattttaagcattactcttgta

SEQ ID NO: 5250239 - DNA, 13 bp, Homo sapiens
atattttaataaa

SEQ ID NO: 5250240 - DNA, 16 bp, Homo sapiens
atattttaataaagta

SEQ ID NO: 5250241 - DNA, 19 bp, Homo sapiens
atattttaatagaattttt

SEQ ID NO: 5250242 - DNA, 12 bp, Homo sapiens
atattttacagt

SEQ ID NO: 5250243 - DNA, 16 bp, Homo sapiens
atattttacataaatt

SEQ ID NO: 5250244 - DNA, 20 bp, Homo sapiens
atattttacataaatttagt

SEQ ID NO: 5250245 - DNA, 17 bp, Homo sapiens
atattttacctcttatt

SEQ ID NO: 5250246 - DNA, 23 bp, Homo sapiens
atattttacctcttattgcaaaa

SEQ ID NO: 5250247 - DNA, 13 bp, Homo sapiens
atattttacttga

SEQ ID NO: 5250248 - DNA, 15 bp, Homo sapiens
atattttagaagcta

SEQ ID NO: 5250249 - DNA, 14 bp, Homo sapiens
atattttagattac

SEQ ID NO: 5250250 - DNA, 14 bp, Homo sapiens
atattttagcattt

SEQ ID NO: 5250251 - DNA, 22 bp, Homo sapiens
atattttagcattttaattctc

SEQ ID NO: 5250252 - DNA, 13 bp, Homo sapiens
atattttaggaaa

SEQ ID NO: 5250253 - DNA, 14 bp, Homo sapiens
atattttataattt

SEQ ID NO: 5250254 - DNA, 15 bp, Homo sapiens
atattttatataaag

SEQ ID NO: 5250255 - DNA, 22 bp, Homo sapiens
atattttatataaagtattctt

SEQ ID NO: 5250256 - DNA, 21 bp, Homo sapiens
atattttatatgaaatgtttc

SEQ ID NO: 5250257 - DNA, 15 bp, Homo sapiens
atattttatatgttc

SEQ ID NO: 5250258 - DNA, 16 bp, Homo sapiens
atattttatatgttca

SEQ ID NO: 5250259 - DNA, 12 bp, Homo sapiens
atattttatctt

SEQ ID NO: 5250260 - DNA, 18 bp, Homo sapiens
atattttatgaacattgt

SEQ ID NO: 5250261 - DNA, 13 bp, Homo sapiens
atattttatgatc

SEQ ID NO: 5250262 - DNA, 22 bp, Homo sapiens
atattttatgatccagcagatt

SEQ ID NO: 5250263 - DNA, 13 bp, Homo sapiens
atattttatgatt

SEQ ID NO: 5250264 - DNA, 16 bp, Homo sapiens
atattttattgctaca

SEQ ID NO: 5250265 - DNA, 17 bp, Homo sapiens
atattttatttcaatgt

SEQ ID NO: 5250266 - DNA, 19 bp, Homo sapiens
atattttatttcaatgtaa

SEQ ID NO: 5250267 - DNA, 13 bp, Homo sapiens
atattttcaaaat

SEQ ID NO: 5250268 - DNA, 17 bp, Homo sapiens
atattttcaaattgtat

SEQ ID NO: 5250269 - DNA, 13 bp, Homo sapiens
atattttcaacta

SEQ ID NO: 5250270 - DNA, 18 bp, Homo sapiens
atattttcaactatgtag

SEQ ID NO: 5250271 - DNA, 13 bp, Homo sapiens
atattttcacaat

SEQ ID NO: 5250272 - DNA, 22 bp, Homo sapiens
atattttccataaatttggact

SEQ ID NO: 5250273 - DNA, 16 bp, Homo sapiens
atattttccatatatt

SEQ ID NO: 5250274 - DNA, 20 bp, Homo sapiens
atattttccatatattggca

SEQ ID NO: 5250275 - DNA, 16 bp, Homo sapiens
atattttcccatggaa

SEQ ID NO: 5250276 - DNA, 18 bp, Homo sapiens
atattttccctacctaag

SEQ ID NO: 5250277 - DNA, 13 bp, Homo sapiens
atattttccctct

SEQ ID NO: 5250278 - DNA, 18 bp, Homo sapiens
atattttccctctcttgc

SEQ ID NO: 5250279 - DNA, 21 bp, Homo sapiens
atattttcctagtagatctat

SEQ ID NO: 5250280 - DNA, 13 bp, Homo sapiens
atattttcctata

SEQ ID NO: 5250281 - DNA, 19 bp, Homo sapiens
atattttcctatattacgg

SEQ ID NO: 5250282 - DNA, 13 bp, Homo sapiens
atattttccttta

SEQ ID NO: 5250283 - DNA, 18 bp, Homo sapiens
atattttcctttatgtga

SEQ ID NO: 5250284 - DNA, 13 bp, Homo sapiens
atattttctattt

SEQ ID NO: 5250285 - DNA, 21 bp, Homo sapiens
atattttctatttctctgtgt

SEQ ID NO: 5250286 - DNA, 13 bp, Homo sapiens
atattttctctag

SEQ ID NO: 5250287 - DNA, 16 bp, Homo sapiens
atattttctctaggaa

SEQ ID NO: 5250288 - DNA, 18 bp, Homo sapiens
atattttctctgtacttt

SEQ ID NO: 5250289 - DNA, 19 bp, Homo sapiens
atattttctgagtagcata

SEQ ID NO: 5250290 - DNA, 13 bp, Homo sapiens
atattttctgtat

SEQ ID NO: 5250291 - DNA, 14 bp, Homo sapiens
atattttctgtatt

SEQ ID NO: 5250292 - DNA, 13 bp, Homo sapiens
atattttctgtgt

SEQ ID NO: 5250293 - DNA, 14 bp, Homo sapiens
atattttctgtgtg

SEQ ID NO: 5250294 - DNA, 13 bp, Homo sapiens
atattttcttaat

SEQ ID NO: 5250295 - DNA, 13 bp, Homo sapiens
atattttcttcct

SEQ ID NO: 5250296 - DNA, 17 bp, Homo sapiens
atattttctttatttgt

SEQ ID NO: 5250297 - DNA, 13 bp, Homo sapiens
atattttctttct

SEQ ID NO: 5250298 - DNA, 20 bp, Homo sapiens
atattttctttctagtttgt

SEQ ID NO: 5250299 - DNA, 14 bp, Homo sapiens
atattttctttctt

SEQ ID NO: 5250300 - DNA, 16 bp, Homo sapiens
atattttcttttatgg

SEQ ID NO: 5250301 - DNA, 19 bp, Homo sapiens
atattttgaatcaataata

SEQ ID NO: 5250302 - DNA, 13 bp, Homo sapiens
atattttgataca

SEQ ID NO: 5250303 - DNA, 17 bp, Homo sapiens
atattttgatacaaatg

SEQ ID NO: 5250304 - DNA, 15 bp, Homo sapiens
atattttgatcttca

SEQ ID NO: 5250305 - DNA, 17 bp, Homo sapiens
atattttgattttacat

SEQ ID NO: 5250306 - DNA, 21 bp, Homo sapiens
atattttgcacagttagcaaa

SEQ ID NO: 5250307 - DNA, 12 bp, Homo sapiens
atattttgcagt

SEQ ID NO: 5250308 - DNA, 15 bp, Homo sapiens
atattttgctaactg

SEQ ID NO: 5250309 - DNA, 16 bp, Homo sapiens
atattttgctaactgg

SEQ ID NO: 5250310 - DNA, 17 bp, Homo sapiens
atattttgctaactggt

SEQ ID NO: 5250311 - DNA, 20 bp, Homo sapiens
atattttgctaactggttaa

SEQ ID NO: 5250312 - DNA, 21 bp, Homo sapiens
atattttgctaactggttaaa

SEQ ID NO: 5250313 - DNA, 13 bp, Homo sapiens
atattttgctgct

SEQ ID NO: 5250314 - DNA, 19 bp, Homo sapiens
atattttgctgctgaattt

SEQ ID NO: 5250315 - DNA, 23 bp, Homo sapiens
atattttggaaactgctaaattc

SEQ ID NO: 5250316 - DNA, 19 bp, Homo sapiens
atattttgtaaaatgtatt

SEQ ID NO: 5250317 - DNA, 13 bp, Homo sapiens
atattttgtaaat

SEQ ID NO: 5250318 - DNA, 21 bp, Homo sapiens
atattttgtatatatctgctt

SEQ ID NO: 5250319 - DNA, 15 bp, Homo sapiens
atattttgtcactgc

SEQ ID NO: 5250320 - DNA, 18 bp, Homo sapiens
atattttgtcactgctgt

SEQ ID NO: 5250321 - DNA, 21 bp, Homo sapiens
atattttgtcactgctgtaaa

SEQ ID NO: 5250322 - DNA, 22 bp, Homo sapiens
atattttgtcactgctgtaaag

SEQ ID NO: 5250323 - DNA, 17 bp, Homo sapiens
atattttgtctaaaatg

SEQ ID NO: 5250324 - DNA, 19 bp, Homo sapiens
atattttgttaacttttgt

SEQ ID NO: 5250325 - DNA, 16 bp, Homo sapiens
atattttgttgttcct

SEQ ID NO: 5250326 - DNA, 17 bp, Homo sapiens
atatttttaaaaaatga

SEQ ID NO: 5250327 - DNA, 21 bp, Homo sapiens
atatttttaaaatatttaact

SEQ ID NO: 5250328 - DNA, 20 bp, Homo sapiens
atatttttaaaatatttatt

SEQ ID NO: 5250329 - DNA, 15 bp, Homo sapiens
atatttttaaagaag

SEQ ID NO: 5250330 - DNA, 17 bp, Homo sapiens
atatttttaaagaagga

SEQ ID NO: 5250331 - DNA, 23 bp, Homo sapiens
atatttttaaaggaaaaatcata

SEQ ID NO: 5250332 - DNA, 17 bp, Homo sapiens
atatttttaatggaaag

SEQ ID NO: 5250333 - DNA, 12 bp, Homo sapiens
atatttttacaa

SEQ ID NO: 5250334 - DNA, 13 bp, Homo sapiens
atatttttacaaa

SEQ ID NO: 5250335 - DNA, 18 bp, Homo sapiens
atatttttacaaataatt

SEQ ID NO: 5250336 - DNA, 15 bp, Homo sapiens
atatttttagctctg

SEQ ID NO: 5250337 - DNA, 19 bp, Homo sapiens
atatttttatagacaaata

SEQ ID NO: 5250338 - DNA, 13 bp, Homo sapiens
atatttttatagg

SEQ ID NO: 5250339 - DNA, 23 bp, Homo sapiens
atatttttatataatatgaatat

SEQ ID NO: 5250340 - DNA, 17 bp, Homo sapiens
atatttttatatgtgga

SEQ ID NO: 5250341 - DNA, 14 bp, Homo sapiens
atatttttatattg

SEQ ID NO: 5250342 - DNA, 22 bp, Homo sapiens
atatttttatctatataaaata

SEQ ID NO: 5250343 - DNA, 20 bp, Homo sapiens
atatttttatctttatatga

SEQ ID NO: 5250344 - DNA, 16 bp, Homo sapiens
atatttttatttcatt

SEQ ID NO: 5250345 - DNA, 15 bp, Homo sapiens
atatttttcaaatag

SEQ ID NO: 5250346 - DNA, 12 bp, Homo sapiens
atatttttcaac

SEQ ID NO: 5250347 - DNA, 19 bp, Homo sapiens
atatttttcaattttgaaa

SEQ ID NO: 5250348 - DNA, 12 bp, Homo sapiens
atatttttcaca

SEQ ID NO: 5250349 - DNA, 14 bp, Homo sapiens
atatttttcacata

SEQ ID NO: 5250350 - DNA, 17 bp, Homo sapiens
atatttttcataaacaa

SEQ ID NO: 5250351 - DNA, 23 bp, Homo sapiens
atctggaatctgaggcatcctct

SEQ ID NO: 5250352 - DNA, 21 bp, Homo sapiens
atctggaatctggagaccagg

SEQ ID NO: 5250353 - DNA, 16 bp, Homo sapiens
atctggaatttaatta

SEQ ID NO: 5250354 - DNA, 16 bp, Homo sapiens
atctggacacttcttt

SEQ ID NO: 5250355 - DNA, 17 bp, Homo sapiens
atctggacagaacattt

SEQ ID NO: 5250356 - DNA, 20 bp, Homo sapiens
atctggaccccaaagaatag

SEQ ID NO: 5250357 - DNA, 22 bp, Homo sapiens
atctggaccccatctgtgaata

SEQ ID NO: 5250358 - DNA, 15 bp, Homo sapiens
atctggactcctctg

SEQ ID NO: 5250359 - DNA, 16 bp, Homo sapiens
atctggactcctctgt

SEQ ID NO: 5250360 - DNA, 19 bp, Homo sapiens
atctggactcctctgtcca

SEQ ID NO: 5250361 - DNA, 19 bp, Homo sapiens
atctggacttcctataata

SEQ ID NO: 5250362 - DNA, 22 bp, Homo sapiens
atctggagaccagggagccttt

SEQ ID NO: 5250363 - DNA, 15 bp, Homo sapiens
atctggagagctaga

SEQ ID NO: 5250364 - DNA, 23 bp, Homo sapiens
atctggagagctagaacctggag

SEQ ID NO: 5250365 - DNA, 20 bp, Homo sapiens
atctggagcacttgttttaa

SEQ ID NO: 5250366 - DNA, 21 bp, Homo sapiens
atctggaggccttccagctgc

SEQ ID NO: 5250367 - DNA, 22 bp, Homo sapiens
atctggaggccttccagctgct

SEQ ID NO: 5250368 - DNA, 23 bp, Homo sapiens
atctggaggccttccagctgctg

SEQ ID NO: 5250369 - DNA, 14 bp, Homo sapiens
atctggaggctgcg

SEQ ID NO: 5250370 - DNA, 16 bp, Homo sapiens
atctggaggctgcgtc

SEQ ID NO: 5250371 - DNA, 21 bp, Homo sapiens
atctggagtctgaaggagagg

SEQ ID NO: 5250372 - DNA, 18 bp, Homo sapiens
atctggagtcttcctgta

SEQ ID NO: 5250373 - DNA, 20 bp, Homo sapiens
atctggagtgagaggccccc

SEQ ID NO: 5250374 - DNA, 22 bp, Homo sapiens
atctggataggagcctgctggt

SEQ ID NO: 5250375 - DNA, 17 bp, Homo sapiens
atctggatgtaaatcct

SEQ ID NO: 5250376 - DNA, 15 bp, Homo sapiens
atctggattcaaatt

SEQ ID NO: 5250377 - DNA, 15 bp, Homo sapiens
atctggattccagag

SEQ ID NO: 5250378 - DNA, 16 bp, Homo sapiens
atctggattctacaaa

SEQ ID NO: 5250379 - DNA, 16 bp, Homo sapiens
atctggcaacatcttt

SEQ ID NO: 5250380 - DNA, 17 bp, Homo sapiens
atctggcacgtggccag

SEQ ID NO: 5250381 - DNA, 22 bp, Homo sapiens
atctggcacgtggccaggagcc

SEQ ID NO: 5250382 - DNA, 13 bp, Homo sapiens
atctggcactgtt

SEQ ID NO: 5250383 - DNA, 19 bp, Homo sapiens
atctggcattctacacctg

SEQ ID NO: 5250384 - DNA, 17 bp, Homo sapiens
atctggcccaagctggg

SEQ ID NO: 5250385 - DNA, 19 bp, Homo sapiens
atctggcccaagctgggct

SEQ ID NO: 5250386 - DNA, 12 bp, Homo sapiens
atctggcccagg

SEQ ID NO: 5250387 - DNA, 21 bp, Homo sapiens
atctggccctcgacactcacc

SEQ ID NO: 5250388 - DNA, 12 bp, Homo sapiens
atctggccctga

SEQ ID NO: 5250389 - DNA, 13 bp, Homo sapiens
atctggccctgac

SEQ ID NO: 5250390 - DNA, 18 bp, Homo sapiens
atctggccctgctgcccc

SEQ ID NO: 5250391 - DNA, 14 bp, Homo sapiens
atctggcccttaca

SEQ ID NO: 5250392 - DNA, 23 bp, Homo sapiens
atctggccgttgatgttggctgg

SEQ ID NO: 5250393 - DNA, 12 bp, Homo sapiens
atctggcctggc

SEQ ID NO: 5250394 - DNA, 19 bp, Homo sapiens
atctggcctggccagtgcc

SEQ ID NO: 5250395 - DNA, 21 bp, Homo sapiens
atctggcggaggtctctggga

SEQ ID NO: 5250396 - DNA, 15 bp, Homo sapiens
atctggctaaggcat

SEQ ID NO: 5250397 - DNA, 14 bp, Homo sapiens
atctggctcctgtt

SEQ ID NO: 5250398 - DNA, 18 bp, Homo sapiens
atctggctcctgtttcca

SEQ ID NO: 5250399 - DNA, 19 bp, Homo sapiens
atctggctcctttacaaaa

SEQ ID NO: 5250400 - DNA, 17 bp, Homo sapiens
atctggctgcacaggct

SEQ ID NO: 5250401 - DNA, 14 bp, Homo sapiens
atctggctgtgaca

SEQ ID NO: 5250402 - DNA, 16 bp, Homo sapiens
atctggctgtttagca

SEQ ID NO: 5250403 - DNA, 17 bp, Homo sapiens
atctggcttagtgccac

SEQ ID NO: 5250404 - DNA, 17 bp, Homo sapiens
atctggcttattttaat

SEQ ID NO: 5250405 - DNA, 13 bp, Homo sapiens
atctggcttccct

SEQ ID NO: 5250406 - DNA, 18 bp, Homo sapiens
atctggcttccctggaag

SEQ ID NO: 5250407 - DNA, 12 bp, Homo sapiens
atctggcttctg

SEQ ID NO: 5250408 - DNA, 23 bp, Homo sapiens
atctggcttttcgcttgcttctg

SEQ ID NO: 5250409 - DNA, 12 bp, Homo sapiens
atctggcttttt

SEQ ID NO: 5250410 - DNA, 17 bp, Homo sapiens
atctggctttttctgcc

SEQ ID NO: 5250411 - DNA, 16 bp, Homo sapiens
atctgggaactcccaa

SEQ ID NO: 5250412 - DNA, 16 bp, Homo sapiens
atctgggaagatttct

SEQ ID NO: 5250413 - DNA, 19 bp, Homo sapiens
atctgggaagatttgaaaa

SEQ ID NO: 5250414 - DNA, 16 bp, Homo sapiens
atctgggaccctttcc

SEQ ID NO: 5250415 - DNA, 17 bp, Homo sapiens
atctgggaccctttcct

SEQ ID NO: 5250416 - DNA, 22 bp, Homo sapiens
atctgggaccctttccttcctt

SEQ ID NO: 5250417 - DNA, 19 bp, Homo sapiens
atctgggactgtgcctggc

SEQ ID NO: 5250418 - DNA, 20 bp, Homo sapiens
atctgggactgtgcctggct

SEQ ID NO: 5250419 - DNA, 23 bp, Homo sapiens
atctgggagcagggcataggaag

SEQ ID NO: 5250420 - DNA, 13 bp, Homo sapiens
atctgggaggctg

SEQ ID NO: 5250421 - DNA, 24 bp, Homo sapiens
atctgggaggctggtctccctcca

SEQ ID NO: 5250422 - DNA, 15 bp, Homo sapiens
atctgggagggaagt

SEQ ID NO: 5250423 - DNA, 20 bp, Homo sapiens
atctgggagtccccttttct

SEQ ID NO: 5250424 - DNA, 16 bp, Homo sapiens
atctgggattattctt

SEQ ID NO: 5250425 - DNA, 22 bp, Homo sapiens
atctgggattcccaccaaggtc

SEQ ID NO: 5250426 - DNA, 12 bp, Homo sapiens
atctgggcacaa

SEQ ID NO: 5250427 - DNA, 20 bp, Homo sapiens
atctgggcattttcctcctc

SEQ ID NO: 5250428 - DNA, 12 bp, Homo sapiens
atctgggcctgg

SEQ ID NO: 5250429 - DNA, 14 bp, Homo sapiens
atctgggcctgggc

SEQ ID NO: 5250430 - DNA, 16 bp, Homo sapiens
atctgggccttggcct

SEQ ID NO: 5250431 - DNA, 19 bp, Homo sapiens
atctgggccttggcctgga

SEQ ID NO: 5250432 - DNA, 22 bp, Homo sapiens
atctgggctcctaaccttcctg

SEQ ID NO: 5250433 - DNA, 21 bp, Homo sapiens
atctgggcttatatgtacttt

SEQ ID NO: 5250434 - DNA, 15 bp, Homo sapiens
atctgggcttcctgg

SEQ ID NO: 5250435 - DNA, 17 bp, Homo sapiens
atctggggaaggaccaa

SEQ ID NO: 5250436 - DNA, 18 bp, Homo sapiens
atctggggaaggaccaac

SEQ ID NO: 5250437 - DNA, 21 bp, Homo sapiens
atctggggagagcggctggag

SEQ ID NO: 5250438 - DNA, 19 bp, Homo sapiens
atctggggagcaggcagcc

SEQ ID NO: 5250439 - DNA, 14 bp, Homo sapiens
atctggggagctcc

SEQ ID NO: 5250440 - DNA, 16 bp, Homo sapiens
atctggggagctcctg

SEQ ID NO: 5250441 - DNA, 21 bp, Homo sapiens
atctggggagctcctggccag

SEQ ID NO: 5250442 - DNA, 23 bp, Homo sapiens
atctggggaggcaggcattcctg

SEQ ID NO: 5250443 - DNA, 22 bp, Homo sapiens
atctggggatggagaatgccag

SEQ ID NO: 5250444 - DNA, 19 bp, Homo sapiens
atctggggggtggggagga

SEQ ID NO: 5250445 - DNA, 13 bp, Homo sapiens
atctgggggtgag

SEQ ID NO: 5250446 - DNA, 13 bp, Homo sapiens
atctggggtgggg

SEQ ID NO: 5250447 - DNA, 21 bp, Homo sapiens
atctggggttggcaacaggac

SEQ ID NO: 5250448 - DNA, 15 bp, Homo sapiens
atctgggtagctgta

SEQ ID NO: 5250449 - DNA, 14 bp, Homo sapiens
atctgggtccttgc

SEQ ID NO: 5250450 - DNA, 18 bp, Homo sapiens
atctgggtctctaatctg

SEQ ID NO: 5250451 - DNA, 15 bp, Homo sapiens
atctgggtgactgag

SEQ ID NO: 5250452 - DNA, 21 bp, Homo sapiens
atctgggtgcatgatcttgag

SEQ ID NO: 5250453 - DNA, 22 bp, Homo sapiens
atctgggtgcatgatcttgagc

SEQ ID NO: 5250454 - DNA, 21 bp, Homo sapiens
atctgggtgggataatggact

SEQ ID NO: 5250455 - DNA, 21 bp, Homo sapiens
atctgggtggtaactgccagc

SEQ ID NO: 5250456 - DNA, 16 bp, Homo sapiens
atctgggttaagtgtt

SEQ ID NO: 5250457 - DNA, 19 bp, Homo sapiens
atctgggttcactgcaacc

SEQ ID NO: 5250458 - DNA, 19 bp, Homo sapiens
atctgggttttgcctctgc

SEQ ID NO: 5250459 - DNA, 17 bp, Homo sapiens
atctggtagatttttaa

SEQ ID NO: 5250460 - DNA, 17 bp, Homo sapiens
atctggtatatgtcatt

SEQ ID NO: 5250461 - DNA, 14 bp, Homo sapiens
atctggtcatttgg

SEQ ID NO: 5250462 - DNA, 14 bp, Homo sapiens
atctggtcctaccc

SEQ ID NO: 5250463 - DNA, 17 bp, Homo sapiens
atctggtcctacccatc

SEQ ID NO: 5250464 - DNA, 22 bp, Homo sapiens
atctggtctcgtgttcgctggc

SEQ ID NO: 5250465 - DNA, 13 bp, Homo sapiens
atctggtctcttc

SEQ ID NO: 5250466 - DNA, 18 bp, Homo sapiens
atctggtcttgttagaaa

SEQ ID NO: 5250467 - DNA, 21 bp, Homo sapiens
atctggtcttgttagaaaaca

SEQ ID NO: 5250468 - DNA, 18 bp, Homo sapiens
atctggtgacaaatattc

SEQ ID NO: 5250469 - DNA, 14 bp, Homo sapiens
atctggtgatctcc

SEQ ID NO: 5250470 - DNA, 22 bp, Homo sapiens
atctggtgccaaatgaagattt

SEQ ID NO: 5250471 - DNA, 14 bp, Homo sapiens
atctggtgcctcct

SEQ ID NO: 5250472 - DNA, 17 bp, Homo sapiens
atctggtgcctcctcaa

SEQ ID NO: 5250473 - DNA, 23 bp, Homo sapiens
atctggtgcgtgtggccctgtgg

SEQ ID NO: 5250474 - DNA, 15 bp, Homo sapiens
atctggtggtcagcc

SEQ ID NO: 5250475 - DNA, 20 bp, Homo sapiens
atctggtggtcagccctagg

SEQ ID NO: 5250476 - DNA, 16 bp, Homo sapiens
atctggtgtccagcat

SEQ ID NO: 5250477 - DNA, 22 bp, Homo sapiens
atctggttagataatgaatgat

SEQ ID NO: 5250478 - DNA, 19 bp, Homo sapiens
atctggttatatcattctg

SEQ ID NO: 5250479 - DNA, 17 bp, Homo sapiens
atctggttctatatgaa

SEQ ID NO: 5250480 - DNA, 21 bp, Homo sapiens
atctggttgtgactctaagct

SEQ ID NO: 5250481 - DNA, 22 bp, Homo sapiens
atctggttgtgactctaagctc

SEQ ID NO: 5250482 - DNA, 15 bp, Homo sapiens
atctggttttctctc

SEQ ID NO: 5250483 - DNA, 15 bp, Homo sapiens
atctggttttgctat

SEQ ID NO: 5250484 - DNA, 23 bp, Homo sapiens
atctggtttttaaaagataaaca

SEQ ID NO: 5250485 - DNA, 15 bp, Homo sapiens
atctgtaaaaaagaa

SEQ ID NO: 5250486 - DNA, 16 bp, Homo sapiens
atctgtaaaaaagaaa

SEQ ID NO: 5250487 - DNA, 19 bp, Homo sapiens
atctgtaaaaaagaaaaac

SEQ ID NO: 5250488 - DNA, 18 bp, Homo sapiens
atctgtaaaaccaggctg

SEQ ID NO: 5250489 - DNA, 13 bp, Homo sapiens
atctgtaaactgt

SEQ ID NO: 5250490 - DNA, 16 bp, Homo sapiens
atctgtaaagaaaacc

SEQ ID NO: 5250491 - DNA, 18 bp, Homo sapiens
atctgtaaagccagttag

SEQ ID NO: 5250492 - DNA, 18 bp, Homo sapiens
atctgtaaatatcccaga

SEQ ID NO: 5250493 - DNA, 21 bp, Homo sapiens
atctgtaaatttaactgcata

SEQ ID NO: 5250494 - DNA, 18 bp, Homo sapiens
atctgtaaatttggactg

SEQ ID NO: 5250495 - DNA, 20 bp, Homo sapiens
atctgtaacaggtattttgt

SEQ ID NO: 5250496 - DNA, 22 bp, Homo sapiens
atctgtaacccttgaatttcta

SEQ ID NO: 5250497 - DNA, 21 bp, Homo sapiens
atctgtaagaggtactaaaaa

SEQ ID NO: 5250498 - DNA, 19 bp, Homo sapiens
atctgtaaggaactggaac

SEQ ID NO: 5250499 - DNA, 15 bp, Homo sapiens
atctgtaatcacatt

SEQ ID NO: 5250500 - DNA, 16 bp, Homo sapiens
atctgtaatcctagct

SEQ ID NO: 5250501 - DNA, 12 bp, Homo sapiens
atctgtaatgat

SEQ ID NO: 5250502 - DNA, 20 bp, Homo sapiens
atctgtaattgtaattccaa

SEQ ID NO: 5250503 - DNA, 14 bp, Homo sapiens
atctgtacaaaatg

SEQ ID NO: 5250504 - DNA, 16 bp, Homo sapiens
atctgtacaaaatggt

SEQ ID NO: 5250505 - DNA, 16 bp, Homo sapiens
atctgtacatactttt

SEQ ID NO: 5250506 - DNA, 15 bp, Homo sapiens
atctgtacattttgt

SEQ ID NO: 5250507 - DNA, 20 bp, Homo sapiens
atctgtacattttgttgtaa

SEQ ID NO: 5250508 - DNA, 21 bp, Homo sapiens
atctgtacattttgttgtaaa

SEQ ID NO: 5250509 - DNA, 22 bp, Homo sapiens
atctgtacattttgttgtaaaa

SEQ ID NO: 5250510 - DNA, 23 bp, Homo sapiens
atctgtacattttgttgtaaaaa

SEQ ID NO: 5250511 - DNA, 13 bp, Homo sapiens
atctgtactgtaa

SEQ ID NO: 5250512 - DNA, 13 bp, Homo sapiens
atctgtacttttt

SEQ ID NO: 5250513 - DNA, 16 bp, Homo sapiens
atctgtagaggagcct

SEQ ID NO: 5250514 - DNA, 21 bp, Homo sapiens
atctgtagaggagcctggagt

SEQ ID NO: 5250515 - DNA, 15 bp, Homo sapiens
atctgtagggctgga

SEQ ID NO: 5250516 - DNA, 17 bp, Homo sapiens
atctgtagggctggacc

SEQ ID NO: 5250517 - DNA, 23 bp, Homo sapiens
atctgtaggtcactctccagcag

SEQ ID NO: 5250518 - DNA, 13 bp, Homo sapiens
atctgtagtaatt

SEQ ID NO: 5250519 - DNA, 22 bp, Homo sapiens
atctgtagtaatttattgtctg

SEQ ID NO: 5250520 - DNA, 15 bp, Homo sapiens
atctgtagtgatgga

SEQ ID NO: 5250521 - DNA, 20 bp, Homo sapiens
atctgtagtgatggagttcc

SEQ ID NO: 5250522 - DNA, 17 bp, Homo sapiens
atctgtataaaaatgta

SEQ ID NO: 5250523 - DNA, 16 bp, Homo sapiens
atctgtataaatgtga

SEQ ID NO: 5250524 - DNA, 21 bp, Homo sapiens
atctgtataagctgtaatatc

SEQ ID NO: 5250525 - DNA, 18 bp, Homo sapiens
atctgtataatactttgt

SEQ ID NO: 5250526 - DNA, 16 bp, Homo sapiens
atctgtatataaaata

SEQ ID NO: 5250527 - DNA, 17 bp, Homo sapiens
atctgtatataaaatat

SEQ ID NO: 5250528 - DNA, 18 bp, Homo sapiens
atatttttcataaacaag

SEQ ID NO: 5250529 - DNA, 17 bp, Homo sapiens
atatttttccatttatt

SEQ ID NO: 5250530 - DNA, 18 bp, Homo sapiens
atatttttcctcaaagat

SEQ ID NO: 5250531 - DNA, 15 bp, Homo sapiens
atatttttctaaaga

SEQ ID NO: 5250532 - DNA, 16 bp, Homo sapiens
atatttttctaaagaa

SEQ ID NO: 5250533 - DNA, 17 bp, Homo sapiens
atatttttcttaaaaag

SEQ ID NO: 5250534 - DNA, 14 bp, Homo sapiens
atatttttgatcat

SEQ ID NO: 5250535 - DNA, 22 bp, Homo sapiens
atatttttgatctttgagtgta

SEQ ID NO: 5250536 - DNA, 18 bp, Homo sapiens
atatttttggcattcctc

SEQ ID NO: 5250537 - DNA, 21 bp, Homo sapiens
atatttttggttgtcaatatt

SEQ ID NO: 5250538 - DNA, 15 bp, Homo sapiens
atatttttgtaaata

SEQ ID NO: 5250539 - DNA, 18 bp, Homo sapiens
atatttttgtaaatatga

SEQ ID NO: 5250540 - DNA, 16 bp, Homo sapiens
atatttttgtacatat

SEQ ID NO: 5250541 - DNA, 21 bp, Homo sapiens
atatttttgtacatattgtta

SEQ ID NO: 5250542 - DNA, 22 bp, Homo sapiens
atatttttgtacatattgttag

SEQ ID NO: 5250543 - DNA, 22 bp, Homo sapiens
atatttttgtacgttatatatt

SEQ ID NO: 5250544 - DNA, 15 bp, Homo sapiens
atatttttgtagcac

SEQ ID NO: 5250545 - DNA, 16 bp, Homo sapiens
atatttttgtagcact

SEQ ID NO: 5250546 - DNA, 23 bp, Homo sapiens
atatttttgtagcactgacagat

SEQ ID NO: 5250547 - DNA, 14 bp, Homo sapiens
atatttttgtattt

SEQ ID NO: 5250548 - DNA, 16 bp, Homo sapiens
atatttttgtatttct

SEQ ID NO: 5250549 - DNA, 19 bp, Homo sapiens
atatttttgtatttctcta

SEQ ID NO: 5250550 - DNA, 15 bp, Homo sapiens
atatttttgtctgca

SEQ ID NO: 5250551 - DNA, 23 bp, Homo sapiens
atatttttgtggacatgcataaa

SEQ ID NO: 5250552 - DNA, 22 bp, Homo sapiens
atatttttgtgttttcttgtaa

SEQ ID NO: 5250553 - DNA, 19 bp, Homo sapiens
atatttttgtttgttttgt

SEQ ID NO: 5250554 - DNA, 17 bp, Homo sapiens
atattttttaaaaatct

SEQ ID NO: 5250555 - DNA, 23 bp, Homo sapiens
atattttttaaaaatctatattt

SEQ ID NO: 5250556 - DNA, 17 bp, Homo sapiens
atattttttaaaataag

SEQ ID NO: 5250557 - DNA, 23 bp, Homo sapiens
atattttttaatgtattcccttc

SEQ ID NO: 5250558 - DNA, 21 bp, Homo sapiens
atattttttaatttaaagctt

SEQ ID NO: 5250559 - DNA, 14 bp, Homo sapiens
atattttttacaaa

SEQ ID NO: 5250560 - DNA, 12 bp, Homo sapiens
atattttttgca

SEQ ID NO: 5250561 - DNA, 20 bp, Homo sapiens
atattttttggtgtgccctg

SEQ ID NO: 5250562 - DNA, 15 bp, Homo sapiens
atatttttttaactg

SEQ ID NO: 5250563 - DNA, 16 bp, Homo sapiens
atatttttttaactgt

SEQ ID NO: 5250564 - DNA, 21 bp, Homo sapiens
atatttttttaactgtgataa

SEQ ID NO: 5250565 - DNA, 15 bp, Homo sapiens
atatttttttacttg

SEQ ID NO: 5250566 - DNA, 19 bp, Homo sapiens
atatttttttccttacata

SEQ ID NO: 5250567 - DNA, 16 bp, Homo sapiens
atatttttttcctttg

SEQ ID NO: 5250568 - DNA, 14 bp, Homo sapiens
atatttttttctgt

SEQ ID NO: 5250569 - DNA, 18 bp, Homo sapiens
atatttttttctgtaaaa

SEQ ID NO: 5250570 - DNA, 19 bp, Homo sapiens
atatttttttctttctttg

SEQ ID NO: 5250571 - DNA, 15 bp, Homo sapiens
atatttttttgtaga

SEQ ID NO: 5250572 - DNA, 22 bp, Homo sapiens
atattttttttaactgcattct

SEQ ID NO: 5250573 - DNA, 21 bp, Homo sapiens
atatttttttttaagctctga

SEQ ID NO: 5250574 - DNA, 23 bp, Homo sapiens
atatttttttttaagctctgagc

SEQ ID NO: 5250575 - DNA, 20 bp, Homo sapiens
atcaaaaaaagactcagcca

SEQ ID NO: 5250576 - DNA, 15 bp, Homo sapiens
atcaaaaaacaagtc

SEQ ID NO: 5250577 - DNA, 22 bp, Homo sapiens
atcaaaaacaggcaggtacagg

SEQ ID NO: 5250578 - DNA, 14 bp, Homo sapiens
atcaaaaactgact

SEQ ID NO: 5250579 - DNA, 19 bp, Homo sapiens
atcaaaaactgactttatt

SEQ ID NO: 5250580 - DNA, 22 bp, Homo sapiens
atcaaaaacttttcatttcaga

SEQ ID NO: 5250581 - DNA, 13 bp, Homo sapiens
atcaaaaagaaaa

SEQ ID NO: 5250582 - DNA, 20 bp, Homo sapiens
atcaaaaagaaactttgttt

SEQ ID NO: 5250583 - DNA, 13 bp, Homo sapiens
atcaaaaagagtc

SEQ ID NO: 5250584 - DNA, 12 bp, Homo sapiens
atcaaaaaggct

SEQ ID NO: 5250585 - DNA, 21 bp, Homo sapiens
atcaaaaaggcttataaaaca

SEQ ID NO: 5250586 - DNA, 13 bp, Homo sapiens
atcaaaaataatg

SEQ ID NO: 5250587 - DNA, 19 bp, Homo sapiens
atcaaaaattgaagagaga

SEQ ID NO: 5250588 - DNA, 18 bp, Homo sapiens
atcaaaacaagtactggt

SEQ ID NO: 5250589 - DNA, 16 bp, Homo sapiens
atcaaaacaagtgaaa

SEQ ID NO: 5250590 - DNA, 14 bp, Homo sapiens
atcaaaacacacta

SEQ ID NO: 5250591 - DNA, 12 bp, Homo sapiens
atcaaaacatat

SEQ ID NO: 5250592 - DNA, 20 bp, Homo sapiens
atcaaaacatatcaattcaa

SEQ ID NO: 5250593 - DNA, 22 bp, Homo sapiens
atcaaaacctgtgccaggctga

SEQ ID NO: 5250594 - DNA, 19 bp, Homo sapiens
atcaaaaccttccttccct

SEQ ID NO: 5250595 - DNA, 22 bp, Homo sapiens
atcaaaaccttccttccctggc

SEQ ID NO: 5250596 - DNA, 16 bp, Homo sapiens
atcaaaacttaagatg

SEQ ID NO: 5250597 - DNA, 17 bp, Homo sapiens
atcaaaactttcgttgt

SEQ ID NO: 5250598 - DNA, 14 bp, Homo sapiens
atcaaaagaatgtc

SEQ ID NO: 5250599 - DNA, 14 bp, Homo sapiens
atcaaaagacaatt

SEQ ID NO: 5250600 - DNA, 19 bp, Homo sapiens
atcaaaagacaattcttta

SEQ ID NO: 5250601 - DNA, 21 bp, Homo sapiens
atcaaaagacaattctttata

SEQ ID NO: 5250602 - DNA, 12 bp, Homo sapiens
atcaaaagacag

SEQ ID NO: 5250603 - DNA, 15 bp, Homo sapiens
atcaaaagctgcttg

SEQ ID NO: 5250604 - DNA, 18 bp, Homo sapiens
atcaaaaggcactgtgaa

SEQ ID NO: 5250605 - DNA, 19 bp, Homo sapiens
atcaaaaggcactgtgaac

SEQ ID NO: 5250606 - DNA, 21 bp, Homo sapiens
atcaaaaggcactgtgaacta

SEQ ID NO: 5250607 - DNA, 18 bp, Homo sapiens
atcaaaagggccaaagaa

SEQ ID NO: 5250608 - DNA, 22 bp, Homo sapiens
atcaaaagggccaaagaaccaa

SEQ ID NO: 5250609 - DNA, 24 bp, Homo sapiens
atcaaaaggttaataaagtaatta

SEQ ID NO: 5250610 - DNA, 23 bp, Homo sapiens
atcaaaagtccttagaatgaggg

SEQ ID NO: 5250611 - DNA, 21 bp, Homo sapiens
atcaaaagtgatcagcaatga

SEQ ID NO: 5250612 - DNA, 23 bp, Homo sapiens
atcaaaagtgatcagcaatgaag

SEQ ID NO: 5250613 - DNA, 19 bp, Homo sapiens
atcaaaataaaagaaatat

SEQ ID NO: 5250614 - DNA, 17 bp, Homo sapiens
atcaaaataaattgaaa

SEQ ID NO: 5250615 - DNA, 14 bp, Homo sapiens
atcaaaatagtcta

SEQ ID NO: 5250616 - DNA, 21 bp, Homo sapiens
atcaaaatcactatctttctg

SEQ ID NO: 5250617 - DNA, 13 bp, Homo sapiens
atcaaaatctctc

SEQ ID NO: 5250618 - DNA, 15 bp, Homo sapiens
atcaaaatctctcca

SEQ ID NO: 5250619 - DNA, 11 bp, Homo sapiens
atcaaaatctt

SEQ ID NO: 5250620 - DNA, 12 bp, Homo sapiens
atcaaaatgcat

SEQ ID NO: 5250621 - DNA, 22 bp, Homo sapiens
atcaaaatgcatacgtattgtt

SEQ ID NO: 5250622 - DNA, 19 bp, Homo sapiens
atcaaaatgctcttatttc

SEQ ID NO: 5250623 - DNA, 12 bp, Homo sapiens
atcaaaatgctt

SEQ ID NO: 5250624 - DNA, 22 bp, Homo sapiens
atcaaaatgctttttatttctg

SEQ ID NO: 5250625 - DNA, 12 bp, Homo sapiens
atcaaaatgtag

SEQ ID NO: 5250626 - DNA, 14 bp, Homo sapiens
atcaaaattctgtt

SEQ ID NO: 5250627 - DNA, 15 bp, Homo sapiens
atcaaaattctgttt

SEQ ID NO: 5250628 - DNA, 23 bp, Homo sapiens
atcaaaattctgttttgtaaatg

SEQ ID NO: 5250629 - DNA, 22 bp, Homo sapiens
atcaaacaaatcattttgatgt

SEQ ID NO: 5250630 - DNA, 16 bp, Homo sapiens
atcaaacaaccttcag

SEQ ID NO: 5250631 - DNA, 17 bp, Homo sapiens
atcaaacaaccttcagc

SEQ ID NO: 5250632 - DNA, 12 bp, Homo sapiens
atcaaacacaac

SEQ ID NO: 5250633 - DNA, 17 bp, Homo sapiens
atcaaacacaacacaag

SEQ ID NO: 5250634 - DNA, 22 bp, Homo sapiens
atcaaacaccaacataaaaatg

SEQ ID NO: 5250635 - DNA, 12 bp, Homo sapiens
atcaaacatgaa

SEQ ID NO: 5250636 - DNA, 14 bp, Homo sapiens
atcaaacatgaaaa

SEQ ID NO: 5250637 - DNA, 16 bp, Homo sapiens
atcaaacatgaaaaca

SEQ ID NO: 5250638 - DNA, 17 bp, Homo sapiens
atcaaacatgaaaacat

SEQ ID NO: 5250639 - DNA, 15 bp, Homo sapiens
atcaaacatgcacac

SEQ ID NO: 5250640 - DNA, 15 bp, Homo sapiens
atcaaacattaaaaa

SEQ ID NO: 5250641 - DNA, 20 bp, Homo sapiens
atcaaaccctagccttgctt

SEQ ID NO: 5250642 - DNA, 22 bp, Homo sapiens
atcaaaccctagccttgcttgt

SEQ ID NO: 5250643 - DNA, 20 bp, Homo sapiens
atcaaacctcacatttgtga

SEQ ID NO: 5250644 - DNA, 15 bp, Homo sapiens
atcaaacctttgagt

SEQ ID NO: 5250645 - DNA, 16 bp, Homo sapiens
atcaaactcaatgctt

SEQ ID NO: 5250646 - DNA, 16 bp, Homo sapiens
atcaaactcgtctgat

SEQ ID NO: 5250647 - DNA, 15 bp, Homo sapiens
atcaaacttgtgctg

SEQ ID NO: 5250648 - DNA, 13 bp, Homo sapiens
atcaaagaaaaca

SEQ ID NO: 5250649 - DNA, 13 bp, Homo sapiens
atcaaagaaaaga

SEQ ID NO: 5250650 - DNA, 17 bp, Homo sapiens
atcaaagaaaagacttt

SEQ ID NO: 5250651 - DNA, 14 bp, Homo sapiens
atcaaagaacagat

SEQ ID NO: 5250652 - DNA, 16 bp, Homo sapiens
atcaaagaacagatgg

SEQ ID NO: 5250653 - DNA, 15 bp, Homo sapiens
atcaaagaattacag

SEQ ID NO: 5250654 - DNA, 17 bp, Homo sapiens
atcaaagacatttcatc

SEQ ID NO: 5250655 - DNA, 12 bp, Homo sapiens
atcaaagcaatg

SEQ ID NO: 5250656 - DNA, 11 bp, Homo sapiens
atcaaagcagt

SEQ ID NO: 5250657 - DNA, 16 bp, Homo sapiens
atcaaagccacactct

SEQ ID NO: 5250658 - DNA, 13 bp, Homo sapiens
atcaaagccaggg

SEQ ID NO: 5250659 - DNA, 22 bp, Homo sapiens
atcaaagccctccctgtctgtc

SEQ ID NO: 5250660 - DNA, 21 bp, Homo sapiens
atcaaagctaggaaaggcaga

SEQ ID NO: 5250661 - DNA, 22 bp, Homo sapiens
atcaaagctaggaaaggcagaa

SEQ ID NO: 5250662 - DNA, 18 bp, Homo sapiens
atcaaagcttcaaaaact

SEQ ID NO: 5250663 - DNA, 17 bp, Homo sapiens
atcaaaggcagaaagga

SEQ ID NO: 5250664 - DNA, 20 bp, Homo sapiens
atcaaagggtgaaaattatt

SEQ ID NO: 5250665 - DNA, 17 bp, Homo sapiens
atcaaaggtagatttta

SEQ ID NO: 5250666 - DNA, 14 bp, Homo sapiens
atcaaagtaaaaaa

SEQ ID NO: 5250667 - DNA, 16 bp, Homo sapiens
atcaaagtagcaaatg

SEQ ID NO: 5250668 - DNA, 15 bp, Homo sapiens
atcaaagtgatttta

SEQ ID NO: 5250669 - DNA, 17 bp, Homo sapiens
atcaaagtggggtacag

SEQ ID NO: 5250670 - DNA, 22 bp, Homo sapiens
atcaaagtgtttaattgtataa

SEQ ID NO: 5250671 - DNA, 16 bp, Homo sapiens
atcaaagttttgatgt

SEQ ID NO: 5250672 - DNA, 14 bp, Homo sapiens
atcaaataagaaat

SEQ ID NO: 5250673 - DNA, 14 bp, Homo sapiens
atcaaataataaag

SEQ ID NO: 5250674 - DNA, 15 bp, Homo sapiens
atcaaataatacatc

SEQ ID NO: 5250675 - DNA, 17 bp, Homo sapiens
atcaaataatacatctt

SEQ ID NO: 5250676 - DNA, 11 bp, Homo sapiens
atcaaatactt

SEQ ID NO: 5250677 - DNA, 20 bp, Homo sapiens
atcaaatactttaaaggaaa

SEQ ID NO: 5250678 - DNA, 21 bp, Homo sapiens
atcaaatagaaccactatgaa

SEQ ID NO: 5250679 - DNA, 11 bp, Homo sapiens
atcaaatatag

SEQ ID NO: 5250680 - DNA, 15 bp, Homo sapiens
atcaaatatagaaag

SEQ ID NO: 5250681 - DNA, 16 bp, Homo sapiens
atcaaatatagaaagt

SEQ ID NO: 5250682 - DNA, 14 bp, Homo sapiens
atcaaatatattca

SEQ ID NO: 5250683 - DNA, 19 bp, Homo sapiens
atcaaatattagatgtgat

SEQ ID NO: 5250684 - DNA, 17 bp, Homo sapiens
atcaaatccaggacttt

SEQ ID NO: 5250685 - DNA, 19 bp, Homo sapiens
atcaaatccaggactttgt

SEQ ID NO: 5250686 - DNA, 18 bp, Homo sapiens
atcaaatctcctgctgat

SEQ ID NO: 5250687 - DNA, 16 bp, Homo sapiens
atcaaatctgagcctt

SEQ ID NO: 5250688 - DNA, 21 bp, Homo sapiens
atcaaatctgtatatgttgta

SEQ ID NO: 5250689 - DNA, 20 bp, Homo sapiens
atcaaatctgtgctctttca

SEQ ID NO: 5250690 - DNA, 20 bp, Homo sapiens
atcaaatgaaaagtaaaaca

SEQ ID NO: 5250691 - DNA, 22 bp, Homo sapiens
atcaaatgattcatttttctgt

SEQ ID NO: 5250692 - DNA, 15 bp, Homo sapiens
atcaaatgatttcat

SEQ ID NO: 5250693 - DNA, 23 bp, Homo sapiens
atcaaatgatttcatattgatct

SEQ ID NO: 5250694 - DNA, 17 bp, Homo sapiens
atcaaatgcagtatatt

SEQ ID NO: 5250695 - DNA, 22 bp, Homo sapiens
atcaaatgctgtagaatgcttg

SEQ ID NO: 5250696 - DNA, 21 bp, Homo sapiens
atcaaatggaagacacattga

SEQ ID NO: 5250697 - DNA, 14 bp, Homo sapiens
atcaaatgtaaagt

SEQ ID NO: 5250698 - DNA, 18 bp, Homo sapiens
atcaaatgtaacttactg

SEQ ID NO: 5250699 - DNA, 19 bp, Homo sapiens
atcaaatgtggctgtatcc

SEQ ID NO: 5250700 - DNA, 15 bp, Homo sapiens
atcaaatgttacagt

SEQ ID NO: 5250701 - DNA, 14 bp, Homo sapiens
atcaaatgtttaat

SEQ ID NO: 5250702 - DNA, 18 bp, Homo sapiens
atcaaatgtttaatcata

SEQ ID NO: 5250703 - DNA, 21 bp, Homo sapiens
atcaaatgtttaatcatataa

SEQ ID NO: 5250704 - DNA, 12 bp, Homo sapiens
atcaaattctat

SEQ ID NO: 5250705 - DNA, 19 bp, Homo sapiens
atcaaattctgtctgggga

SEQ ID NO: 5250706 - DNA, 13 bp, Homo sapiens
atcaaattgctta

SEQ ID NO: 5250707 - DNA, 19 bp, Homo sapiens
atctgtatataaaatattt

SEQ ID NO: 5250708 - DNA, 17 bp, Homo sapiens
atctgtatatcagctct

SEQ ID NO: 5250709 - DNA, 11 bp, Homo sapiens
atctgtatcta

SEQ ID NO: 5250710 - DNA, 20 bp, Homo sapiens
atctgtatctagaaagagat

SEQ ID NO: 5250711 - DNA, 23 bp, Homo sapiens
atctgtatgctggtagctagtga

SEQ ID NO: 5250712 - DNA, 13 bp, Homo sapiens
atctgtattggca

SEQ ID NO: 5250713 - DNA, 17 bp, Homo sapiens
atctgtattggcagcac

SEQ ID NO: 5250714 - DNA, 19 bp, Homo sapiens
atctgtattggcagcacag

SEQ ID NO: 5250715 - DNA, 20 bp, Homo sapiens
atctgtattggcagcacagc

SEQ ID NO: 5250716 - DNA, 15 bp, Homo sapiens
atctgtatttattat

SEQ ID NO: 5250717 - DNA, 19 bp, Homo sapiens
atctgtcaaaacactgtgg

SEQ ID NO: 5250718 - DNA, 22 bp, Homo sapiens
atctgtcaaaacactgtggaac

SEQ ID NO: 5250719 - DNA, 21 bp, Homo sapiens
atctgtcaaagaaaacttcca

SEQ ID NO: 5250720 - DNA, 18 bp, Homo sapiens
atctgtcacacaaggctg

SEQ ID NO: 5250721 - DNA, 20 bp, Homo sapiens
atctgtcacacctgtgcctc

SEQ ID NO: 5250722 - DNA, 18 bp, Homo sapiens
atctgtcagcatctggct

SEQ ID NO: 5250723 - DNA, 14 bp, Homo sapiens
atctgtcagcttcc

SEQ ID NO: 5250724 - DNA, 17 bp, Homo sapiens
atctgtcagcttcccaa

SEQ ID NO: 5250725 - DNA, 22 bp, Homo sapiens
atctgtcagcttcccaacaata

SEQ ID NO: 5250726 - DNA, 15 bp, Homo sapiens
atctgtcagtgagtc

SEQ ID NO: 5250727 - DNA, 21 bp, Homo sapiens
atctgtcatatagtaaacact

SEQ ID NO: 5250728 - DNA, 16 bp, Homo sapiens
atctgtcattatattc

SEQ ID NO: 5250729 - DNA, 18 bp, Homo sapiens
atctgtcattatattcta

SEQ ID NO: 5250730 - DNA, 21 bp, Homo sapiens
atctgtcattatcaaaagtga

SEQ ID NO: 5250731 - DNA, 12 bp, Homo sapiens
atctgtcatttg

SEQ ID NO: 5250732 - DNA, 17 bp, Homo sapiens
atctgtcatttgagcag

SEQ ID NO: 5250733 - DNA, 23 bp, Homo sapiens
atctgtccaaaggaggctggcag

SEQ ID NO: 5250734 - DNA, 13 bp, Homo sapiens
atctgtccaagga

SEQ ID NO: 5250735 - DNA, 14 bp, Homo sapiens
atctgtccaaggaa

SEQ ID NO: 5250736 - DNA, 20 bp, Homo sapiens
atctgtccagacaagccctg

SEQ ID NO: 5250737 - DNA, 21 bp, Homo sapiens
atctgtccagacaagccctgc

SEQ ID NO: 5250738 - DNA, 22 bp, Homo sapiens
atctgtccagacaagccctgct

SEQ ID NO: 5250739 - DNA, 15 bp, Homo sapiens
atctgtccatcctcc

SEQ ID NO: 5250740 - DNA, 17 bp, Homo sapiens
atctgtccatcctcctc

SEQ ID NO: 5250741 - DNA, 18 bp, Homo sapiens
atctgtccatcctcctct

SEQ ID NO: 5250742 - DNA, 20 bp, Homo sapiens
atctgtccatggcctttcta

SEQ ID NO: 5250743 - DNA, 21 bp, Homo sapiens
atctgtccatggcctttctaa

SEQ ID NO: 5250744 - DNA, 16 bp, Homo sapiens
atctgtcccactggga

SEQ ID NO: 5250745 - DNA, 16 bp, Homo sapiens
atctgtccctgcctca

SEQ ID NO: 5250746 - DNA, 17 bp, Homo sapiens
atctgtccgtccagagc

SEQ ID NO: 5250747 - DNA, 18 bp, Homo sapiens
atctgtccgtccagagcc

SEQ ID NO: 5250748 - DNA, 19 bp, Homo sapiens
atctgtccgtccagagccg

SEQ ID NO: 5250749 - DNA, 14 bp, Homo sapiens
atctgtcctcaccc

SEQ ID NO: 5250750 - DNA, 20 bp, Homo sapiens
atctgtcctcaccctgtggg

SEQ ID NO: 5250751 - DNA, 15 bp, Homo sapiens
atctgtcctcagcct

SEQ ID NO: 5250752 - DNA, 16 bp, Homo sapiens
atctgtcctcagcctt

SEQ ID NO: 5250753 - DNA, 17 bp, Homo sapiens
atctgtcctcagccttg

SEQ ID NO: 5250754 - DNA, 13 bp, Homo sapiens
atctgtcctgggg

SEQ ID NO: 5250755 - DNA, 14 bp, Homo sapiens
atctgtcctggggg

SEQ ID NO: 5250756 - DNA, 17 bp, Homo sapiens
atctgtctactttctct

SEQ ID NO: 5250757 - DNA, 19 bp, Homo sapiens
atctgtctactttctcttg

SEQ ID NO: 5250758 - DNA, 20 bp, Homo sapiens
atctgtctactttctcttgt

SEQ ID NO: 5250759 - DNA, 21 bp, Homo sapiens
atctgtctactttctcttgtt

SEQ ID NO: 5250760 - DNA, 20 bp, Homo sapiens
atctgtctagaatcctgctt

SEQ ID NO: 5250761 - DNA, 13 bp, Homo sapiens
atctgtctccaag

SEQ ID NO: 5250762 - DNA, 19 bp, Homo sapiens
atctgtctgagccctgccc

SEQ ID NO: 5250763 - DNA, 22 bp, Homo sapiens
atctgtctgagccctgccctca

SEQ ID NO: 5250764 - DNA, 18 bp, Homo sapiens
atctgtctgattctatgc

SEQ ID NO: 5250765 - DNA, 17 bp, Homo sapiens
atctgtctgctctgcat

SEQ ID NO: 5250766 - DNA, 23 bp, Homo sapiens
atctgtctgctggtcacttcttc

SEQ ID NO: 5250767 - DNA, 14 bp, Homo sapiens
atctgtctggaggg

SEQ ID NO: 5250768 - DNA, 22 bp, Homo sapiens
atctgtctggaggggagctctg

SEQ ID NO: 5250769 - DNA, 14 bp, Homo sapiens
atctgtctgtgcac

SEQ ID NO: 5250770 - DNA, 10 bp, Homo sapiens
atctgtcttc

SEQ ID NO: 5250771 - DNA, 21 bp, Homo sapiens
atctgtcttgccagccagaag

SEQ ID NO: 5250772 - DNA, 22 bp, Homo sapiens
atctgtcttgccagccagaagc

SEQ ID NO: 5250773 - DNA, 19 bp, Homo sapiens
atctgtcttggcattaaac

SEQ ID NO: 5250774 - DNA, 14 bp, Homo sapiens
atctgtcttgtaat

SEQ ID NO: 5250775 - DNA, 19 bp, Homo sapiens
atctgtctttatgatttca

SEQ ID NO: 5250776 - DNA, 11 bp, Homo sapiens
atctgtctttc

SEQ ID NO: 5250777 - DNA, 17 bp, Homo sapiens
atctgtgaaaggaaaga

SEQ ID NO: 5250778 - DNA, 13 bp, Homo sapiens
atctgtgaacttg

SEQ ID NO: 5250779 - DNA, 21 bp, Homo sapiens
atctgtgaagtagttctgttt

SEQ ID NO: 5250780 - DNA, 18 bp, Homo sapiens
atctgtgacctctgacaa

SEQ ID NO: 5250781 - DNA, 19 bp, Homo sapiens
atctgtgactataaagctg

SEQ ID NO: 5250782 - DNA, 20 bp, Homo sapiens
atctgtgactataaagctgt

SEQ ID NO: 5250783 - DNA, 18 bp, Homo sapiens
atctgtgaggtgctgatg

SEQ ID NO: 5250784 - DNA, 20 bp, Homo sapiens
atctgtgagtgaaagttgcc

SEQ ID NO: 5250785 - DNA, 13 bp, Homo sapiens
atctgtgagttct

SEQ ID NO: 5250786 - DNA, 19 bp, Homo sapiens
atctgtgatgacattccct

SEQ ID NO: 5250787 - DNA, 21 bp, Homo sapiens
atctgtgatgacattccctgc

SEQ ID NO: 5250788 - DNA, 14 bp, Homo sapiens
atctgtgatgggag

SEQ ID NO: 5250789 - DNA, 15 bp, Homo sapiens
atctgtgattccccc

SEQ ID NO: 5250790 - DNA, 14 bp, Homo sapiens
atctgtgatttctt

SEQ ID NO: 5250791 - DNA, 22 bp, Homo sapiens
atctgtgcaatggaatataaat

SEQ ID NO: 5250792 - DNA, 15 bp, Homo sapiens
atctgtgcagggctg

SEQ ID NO: 5250793 - DNA, 18 bp, Homo sapiens
atctgtgcagggctggtt

SEQ ID NO: 5250794 - DNA, 16 bp, Homo sapiens
atctgtgcattctcct

SEQ ID NO: 5250795 - DNA, 21 bp, Homo sapiens
atctgtgccatagaacaagat

SEQ ID NO: 5250796 - DNA, 13 bp, Homo sapiens
atctgtgccccat

SEQ ID NO: 5250797 - DNA, 23 bp, Homo sapiens
atctgtgccccatgcctgtccag

SEQ ID NO: 5250798 - DNA, 21 bp, Homo sapiens
atctgtgcctgcactgagagg

SEQ ID NO: 5250799 - DNA, 14 bp, Homo sapiens
atctgtgcctggga

SEQ ID NO: 5250800 - DNA, 17 bp, Homo sapiens
atctgtgcgtgaaacac

SEQ ID NO: 5250801 - DNA, 17 bp, Homo sapiens
atctgtgctttccagct

SEQ ID NO: 5250802 - DNA, 16 bp, Homo sapiens
atctgtggaaatgaca

SEQ ID NO: 5250803 - DNA, 22 bp, Homo sapiens
atctgtggagaatgtacacagt

SEQ ID NO: 5250804 - DNA, 13 bp, Homo sapiens
atctgtggagctg

SEQ ID NO: 5250805 - DNA, 20 bp, Homo sapiens
atctgtggagttcctgctcc

SEQ ID NO: 5250806 - DNA, 19 bp, Homo sapiens
atctgtggattcagcttct

SEQ ID NO: 5250807 - DNA, 22 bp, Homo sapiens
atctgtggattcagcttctgtt

SEQ ID NO: 5250808 - DNA, 22 bp, Homo sapiens
atctgtgggcatggtcaaaggc

SEQ ID NO: 5250809 - DNA, 14 bp, Homo sapiens
atctgtgtaaaatc

SEQ ID NO: 5250810 - DNA, 17 bp, Homo sapiens
atctgtgtaaaatctga

SEQ ID NO: 5250811 - DNA, 19 bp, Homo sapiens
atctgtgtaacctccacag

SEQ ID NO: 5250812 - DNA, 21 bp, Homo sapiens
atctgtgtaacctccacagta

SEQ ID NO: 5250813 - DNA, 15 bp, Homo sapiens
atctgtgtacaaaga

SEQ ID NO: 5250814 - DNA, 22 bp, Homo sapiens
atctgtgtacaaagaaataaca

SEQ ID NO: 5250815 - DNA, 17 bp, Homo sapiens
atctgtgtacaatttta

SEQ ID NO: 5250816 - DNA, 21 bp, Homo sapiens
atctgtgtatattatttggca

SEQ ID NO: 5250817 - DNA, 11 bp, Homo sapiens
atctgtgtatt

SEQ ID NO: 5250818 - DNA, 16 bp, Homo sapiens
atctgtgtctctggaa

SEQ ID NO: 5250819 - DNA, 14 bp, Homo sapiens
atctgtgtcttgtt

SEQ ID NO: 5250820 - DNA, 13 bp, Homo sapiens
atctgtgtgaaaa

SEQ ID NO: 5250821 - DNA, 15 bp, Homo sapiens
atctgtgtgaaaatg

SEQ ID NO: 5250822 - DNA, 21 bp, Homo sapiens
atctgtgtgcatatttgttac

SEQ ID NO: 5250823 - DNA, 23 bp, Homo sapiens
atctgtgtgcatatttgttactt

SEQ ID NO: 5250824 - DNA, 16 bp, Homo sapiens
atctgtgtgccctagg

SEQ ID NO: 5250825 - DNA, 21 bp, Homo sapiens
atctgtgtgcgtggtgtggcc

SEQ ID NO: 5250826 - DNA, 15 bp, Homo sapiens
atctgtgtgtatatt

SEQ ID NO: 5250827 - DNA, 14 bp, Homo sapiens
atctgtgtgtgaat

SEQ ID NO: 5250828 - DNA, 23 bp, Homo sapiens
atctgtgtgtgtggcgtggcccg

SEQ ID NO: 5250829 - DNA, 22 bp, Homo sapiens
atctgtgttacaatcgttctgt

SEQ ID NO: 5250830 - DNA, 13 bp, Homo sapiens
atctgtgttctaa

SEQ ID NO: 5250831 - DNA, 19 bp, Homo sapiens
atctgtgttgtctctctaa

SEQ ID NO: 5250832 - DNA, 22 bp, Homo sapiens
atctgttactccaaaaagaaat

SEQ ID NO: 5250833 - DNA, 23 bp, Homo sapiens
atctgttactccaaaaagaaata

SEQ ID NO: 5250834 - DNA, 14 bp, Homo sapiens
atctgttactgaaa

SEQ ID NO: 5250835 - DNA, 15 bp, Homo sapiens
atctgttactgaaat

SEQ ID NO: 5250836 - DNA, 15 bp, Homo sapiens
atctgttagcagagt

SEQ ID NO: 5250837 - DNA, 21 bp, Homo sapiens
atctgttagcagagtctgtct

SEQ ID NO: 5250838 - DNA, 23 bp, Homo sapiens
atctgttagcagagtctgtctct

SEQ ID NO: 5250839 - DNA, 17 bp, Homo sapiens
atctgttagcattattg

SEQ ID NO: 5250840 - DNA, 14 bp, Homo sapiens
atctgttagggcct

SEQ ID NO: 5250841 - DNA, 18 bp, Homo sapiens
atctgttaggttggggat

SEQ ID NO: 5250842 - DNA, 18 bp, Homo sapiens
atctgttatagctttaaa

SEQ ID NO: 5250843 - DNA, 23 bp, Homo sapiens
atctgttataggtcctttagaaa

SEQ ID NO: 5250844 - DNA, 14 bp, Homo sapiens
atctgttattcaaa

SEQ ID NO: 5250845 - DNA, 18 bp, Homo sapiens
atctgttattcaaatttg

SEQ ID NO: 5250846 - DNA, 14 bp, Homo sapiens
atctgttcatttct

SEQ ID NO: 5250847 - DNA, 18 bp, Homo sapiens
atctgttcccagcccctc

SEQ ID NO: 5250848 - DNA, 22 bp, Homo sapiens
atctgttcccctgtcctgtgaa

SEQ ID NO: 5250849 - DNA, 21 bp, Homo sapiens
atctgttctatggaccaaatg

SEQ ID NO: 5250850 - DNA, 17 bp, Homo sapiens
atctgttgataaatcca

SEQ ID NO: 5250851 - DNA, 18 bp, Homo sapiens
atctgttgcaaactcagc

SEQ ID NO: 5250852 - DNA, 14 bp, Homo sapiens
atctgttggagaaa

SEQ ID NO: 5250853 - DNA, 14 bp, Homo sapiens
atctgttgtaatat

SEQ ID NO: 5250854 - DNA, 20 bp, Homo sapiens
atctgttgtaatatcagtta

SEQ ID NO: 5250855 - DNA, 14 bp, Homo sapiens
atctgttgttccaa

SEQ ID NO: 5250856 - DNA, 22 bp, Homo sapiens
atctgttgttccaaatgtgtat

SEQ ID NO: 5250857 - DNA, 15 bp, Homo sapiens
atctgttgttttgtt

SEQ ID NO: 5250858 - DNA, 21 bp, Homo sapiens
atctgtttaaagtagattaga

SEQ ID NO: 5250859 - DNA, 17 bp, Homo sapiens
atctgtttacctggcag

SEQ ID NO: 5250860 - DNA, 14 bp, Homo sapiens
atctgtttattctg

SEQ ID NO: 5250861 - DNA, 15 bp, Homo sapiens
atctgtttattctgg

SEQ ID NO: 5250862 - DNA, 19 bp, Homo sapiens
atctgtttattctgggaaa

SEQ ID NO: 5250863 - DNA, 16 bp, Homo sapiens
atctgtttatttacaa

SEQ ID NO: 5250864 - DNA, 16 bp, Homo sapiens
atctgtttcaaactga

SEQ ID NO: 5250865 - DNA, 13 bp, Homo sapiens
atctgtttcaaca

SEQ ID NO: 5250866 - DNA, 22 bp, Homo sapiens
atctgtttgaagattatatgaa

SEQ ID NO: 5250867 - DNA, 14 bp, Homo sapiens
atctgtttgagaaa

SEQ ID NO: 5250868 - DNA, 21 bp, Homo sapiens
atctgtttgagaatatgatca

SEQ ID NO: 5250869 - DNA, 16 bp, Homo sapiens
atctgtttgaggagag

SEQ ID NO: 5250870 - DNA, 16 bp, Homo sapiens
atctgtttgcttctaa

SEQ ID NO: 5250871 - DNA, 21 bp, Homo sapiens
atctgtttgtatatttgcaaa

SEQ ID NO: 5250872 - DNA, 22 bp, Homo sapiens
atctgtttgtatatttgcaaac

SEQ ID NO: 5250873 - DNA, 14 bp, Homo sapiens
atctgttttaaatt

SEQ ID NO: 5250874 - DNA, 18 bp, Homo sapiens
atctgttttaaatttaaa

SEQ ID NO: 5250875 - DNA, 21 bp, Homo sapiens
atctgttttataccttgctta

SEQ ID NO: 5250876 - DNA, 13 bp, Homo sapiens
atctgttttcaac

SEQ ID NO: 5250877 - DNA, 16 bp, Homo sapiens
atctgttttctggaag

SEQ ID NO: 5250878 - DNA, 15 bp, Homo sapiens
atctgttttgtatat

SEQ ID NO: 5250879 - DNA, 18 bp, Homo sapiens
atctgtttttacgtatgt

SEQ ID NO: 5250880 - DNA, 14 bp, Homo sapiens
atcttaaaaacaac

SEQ ID NO: 5250881 - DNA, 17 bp, Homo sapiens
atcttaaaaagttgttc

SEQ ID NO: 5250882 - DNA, 15 bp, Homo sapiens
atcttaaaaatattg

SEQ ID NO: 5250883 - DNA, 18 bp, Homo sapiens
atcttaaaataattcata

SEQ ID NO: 5250884 - DNA, 13 bp, Homo sapiens
atcttaaacaatg

SEQ ID NO: 5250885 - DNA, 23 bp, Homo sapiens
atcaaatttgaataaaaatctta

SEQ ID NO: 5250886 - DNA, 21 bp, Homo sapiens
atcaaattttgagcaaagaaa

SEQ ID NO: 5250887 - DNA, 13 bp, Homo sapiens
atcaaatttttct

SEQ ID NO: 5250888 - DNA, 16 bp, Homo sapiens
atcaacaaaaattgtc

SEQ ID NO: 5250889 - DNA, 20 bp, Homo sapiens
atcaacaaaagggagaacat

SEQ ID NO: 5250890 - DNA, 17 bp, Homo sapiens
atcaacaacatccactg

SEQ ID NO: 5250891 - DNA, 23 bp, Homo sapiens
atcaacaataccttttttttcag

SEQ ID NO: 5250892 - DNA, 21 bp, Homo sapiens
atcaacaccaccgagctctgt

SEQ ID NO: 5250893 - DNA, 12 bp, Homo sapiens
atcaacactgca

SEQ ID NO: 5250894 - DNA, 21 bp, Homo sapiens
atcaacagaattgttcttttt

SEQ ID NO: 5250895 - DNA, 14 bp, Homo sapiens
atcaacagataaat

SEQ ID NO: 5250896 - DNA, 12 bp, Homo sapiens
atcaacagcagt

SEQ ID NO: 5250897 - DNA, 16 bp, Homo sapiens
atcaacagcagtgagt

SEQ ID NO: 5250898 - DNA, 12 bp, Homo sapiens
atcaacagccaa

SEQ ID NO: 5250899 - DNA, 19 bp, Homo sapiens
atcaacaggagggcagccc

SEQ ID NO: 5250900 - DNA, 13 bp, Homo sapiens
atcaacatctttt

SEQ ID NO: 5250901 - DNA, 15 bp, Homo sapiens
atcaacatcttttct

SEQ ID NO: 5250902 - DNA, 14 bp, Homo sapiens
atcaacattgaata

SEQ ID NO: 5250903 - DNA, 12 bp, Homo sapiens
atcaaccaaagt

SEQ ID NO: 5250904 - DNA, 20 bp, Homo sapiens
atcaaccaactgcacaatca

SEQ ID NO: 5250905 - DNA, 14 bp, Homo sapiens
atcaaccaagttac

SEQ ID NO: 5250906 - DNA, 16 bp, Homo sapiens
atcaaccaagttacac

SEQ ID NO: 5250907 - DNA, 15 bp, Homo sapiens
atcaaccaccatgga

SEQ ID NO: 5250908 - DNA, 13 bp, Homo sapiens
atcaaccaggcag

SEQ ID NO: 5250909 - DNA, 23 bp, Homo sapiens
atcaaccaggcagagttctgtgg

SEQ ID NO: 5250910 - DNA, 18 bp, Homo sapiens
atcaaccccagacactgg

SEQ ID NO: 5250911 - DNA, 19 bp, Homo sapiens
atcaaccccagacactggt

SEQ ID NO: 5250912 - DNA, 19 bp, Homo sapiens
atcaaccccagactcaaac

SEQ ID NO: 5250913 - DNA, 18 bp, Homo sapiens
atcaacctaggagcagtg

SEQ ID NO: 5250914 - DNA, 21 bp, Homo sapiens
atcaactaaagttgtacttta

SEQ ID NO: 5250915 - DNA, 22 bp, Homo sapiens
atcaactaaagttgtactttaa

SEQ ID NO: 5250916 - DNA, 21 bp, Homo sapiens
atcaactcccaacttcttcct

SEQ ID NO: 5250917 - DNA, 19 bp, Homo sapiens
atcaactctcactcctgaa

SEQ ID NO: 5250918 - DNA, 18 bp, Homo sapiens
atcaactctgaaagagca

SEQ ID NO: 5250919 - DNA, 13 bp, Homo sapiens
atcaactgaatga

SEQ ID NO: 5250920 - DNA, 21 bp, Homo sapiens
atcaactgcatcaagatgtga

SEQ ID NO: 5250921 - DNA, 22 bp, Homo sapiens
atcaactggagtctatgcttaa

SEQ ID NO: 5250922 - DNA, 22 bp, Homo sapiens
atcaactggggggaccaaatag

SEQ ID NO: 5250923 - DNA, 12 bp, Homo sapiens
atcaacttaaca

SEQ ID NO: 5250924 - DNA, 21 bp, Homo sapiens
atcaacttaccaggcaccaaa

SEQ ID NO: 5250925 - DNA, 22 bp, Homo sapiens
atcaacttagtcaataagaaaa

SEQ ID NO: 5250926 - DNA, 16 bp, Homo sapiens
atcaacttgaagcaag

SEQ ID NO: 5250927 - DNA, 14 bp, Homo sapiens
atcaactttaatca

SEQ ID NO: 5250928 - DNA, 19 bp, Homo sapiens
atcaactttactgtaatat

SEQ ID NO: 5250929 - DNA, 14 bp, Homo sapiens
atcaacttttatgc

SEQ ID NO: 5250930 - DNA, 12 bp, Homo sapiens
atcaacttttta

SEQ ID NO: 5250931 - DNA, 19 bp, Homo sapiens
atcaactttttattgcctt

SEQ ID NO: 5250932 - DNA, 22 bp, Homo sapiens
atcaactttttattgccttctc

SEQ ID NO: 5250933 - DNA, 21 bp, Homo sapiens
atcaagaaaaaaagggagaat

SEQ ID NO: 5250934 - DNA, 12 bp, Homo sapiens
atcaagaaagtc

SEQ ID NO: 5250935 - DNA, 18 bp, Homo sapiens
atcaagaaatactttcga

SEQ ID NO: 5250936 - DNA, 13 bp, Homo sapiens
atcaagaaatgct

SEQ ID NO: 5250937 - DNA, 19 bp, Homo sapiens
atcaagaaatgtctctgct

SEQ ID NO: 5250938 - DNA, 13 bp, Homo sapiens
atcaagaagggct

SEQ ID NO: 5250939 - DNA, 13 bp, Homo sapiens
atcaagagaaact

SEQ ID NO: 5250940 - DNA, 14 bp, Homo sapiens
atcaagagaaactt

SEQ ID NO: 5250941 - DNA, 16 bp, Homo sapiens
atcaagagaaacttca

SEQ ID NO: 5250942 - DNA, 13 bp, Homo sapiens
atcaagagaatca

SEQ ID NO: 5250943 - DNA, 17 bp, Homo sapiens
atcaagagcattgcttt

SEQ ID NO: 5250944 - DNA, 14 bp, Homo sapiens
atcaagagccttaa

SEQ ID NO: 5250945 - DNA, 15 bp, Homo sapiens
atcaagagctgccct

SEQ ID NO: 5250946 - DNA, 19 bp, Homo sapiens
atcaagagctgccctcctt

SEQ ID NO: 5250947 - DNA, 16 bp, Homo sapiens
atcaagaggctgagac

SEQ ID NO: 5250948 - DNA, 17 bp, Homo sapiens
atcaagaggctgagaca

SEQ ID NO: 5250949 - DNA, 20 bp, Homo sapiens
atcaagagtctctccagcct

SEQ ID NO: 5250950 - DNA, 21 bp, Homo sapiens
atcaagagtctctccagcctc

SEQ ID NO: 5250951 - DNA, 18 bp, Homo sapiens
atcaagagttttggagat

SEQ ID NO: 5250952 - DNA, 14 bp, Homo sapiens
atcaagatatatgt

SEQ ID NO: 5250953 - DNA, 22 bp, Homo sapiens
atcaagatcaaagaaccaggag

SEQ ID NO: 5250954 - DNA, 18 bp, Homo sapiens
atcaagatgtcagactgg

SEQ ID NO: 5250955 - DNA, 21 bp, Homo sapiens
atcaagatgtgacatgtttta

SEQ ID NO: 5250956 - DNA, 14 bp, Homo sapiens
atcaagattttagg

SEQ ID NO: 5250957 - DNA, 13 bp, Homo sapiens
atcaagatttttt

SEQ ID NO: 5250958 - DNA, 15 bp, Homo sapiens
atcaagcactaaaaa

SEQ ID NO: 5250959 - DNA, 17 bp, Homo sapiens
atcaagcaggaattatg

SEQ ID NO: 5250960 - DNA, 19 bp, Homo sapiens
atcaagcatgaaaggcttt

SEQ ID NO: 5250961 - DNA, 22 bp, Homo sapiens
atcaagcatggaacaaagcatg

SEQ ID NO: 5250962 - DNA, 14 bp, Homo sapiens
atcaagccagttct

SEQ ID NO: 5250963 - DNA, 14 bp, Homo sapiens
atcaagcccctgtc

SEQ ID NO: 5250964 - DNA, 17 bp, Homo sapiens
atcaagcccctgtctaa

SEQ ID NO: 5250965 - DNA, 16 bp, Homo sapiens
atcaagctagaaggcc

SEQ ID NO: 5250966 - DNA, 21 bp, Homo sapiens
atcaagcttcagtttcctggt

SEQ ID NO: 5250967 - DNA, 22 bp, Homo sapiens
atcaagcttcagtttcctggtc

SEQ ID NO: 5250968 - DNA, 21 bp, Homo sapiens
atcaaggaaaggctcatttaa

SEQ ID NO: 5250969 - DNA, 16 bp, Homo sapiens
atcaaggagcccagaa

SEQ ID NO: 5250970 - DNA, 16 bp, Homo sapiens
atcaaggataaatatc

SEQ ID NO: 5250971 - DNA, 15 bp, Homo sapiens
atcaaggatgttctg

SEQ ID NO: 5250972 - DNA, 21 bp, Homo sapiens
atcaaggcaaaaatatcagga

SEQ ID NO: 5250973 - DNA, 17 bp, Homo sapiens
atcaaggcaaaaggaat

SEQ ID NO: 5250974 - DNA, 16 bp, Homo sapiens
atcaaggcactaatgt

SEQ ID NO: 5250975 - DNA, 11 bp, Homo sapiens
atcaaggctgc

SEQ ID NO: 5250976 - DNA, 16 bp, Homo sapiens
atcaaggctgcctgga

SEQ ID NO: 5250977 - DNA, 18 bp, Homo sapiens
atcaaggctgcctggaga

SEQ ID NO: 5250978 - DNA, 20 bp, Homo sapiens
atcaaggctgcctggagaaa

SEQ ID NO: 5250979 - DNA, 18 bp, Homo sapiens
atcaagggagacaccagt

SEQ ID NO: 5250980 - DNA, 15 bp, Homo sapiens
atcaagggaggaagg

SEQ ID NO: 5250981 - DNA, 21 bp, Homo sapiens
atcaagggcctatcttggaga

SEQ ID NO: 5250982 - DNA, 19 bp, Homo sapiens
atcaaggggtcacttacag

SEQ ID NO: 5250983 - DNA, 23 bp, Homo sapiens
atcaaggggttcccactggctcc

SEQ ID NO: 5250984 - DNA, 21 bp, Homo sapiens
atcaagggtacactgccttct

SEQ ID NO: 5250985 - DNA, 15 bp, Homo sapiens
atcaagggtcaggcc

SEQ ID NO: 5250986 - DNA, 14 bp, Homo sapiens
atcaaggtccagtg

SEQ ID NO: 5250987 - DNA, 17 bp, Homo sapiens
atcaaggtccagtggaa

SEQ ID NO: 5250988 - DNA, 14 bp, Homo sapiens
atcaaggtcgtttt

SEQ ID NO: 5250989 - DNA, 18 bp, Homo sapiens
atcaaggtgctcttctca

SEQ ID NO: 5250990 - DNA, 14 bp, Homo sapiens
atcaaggtggaaat

SEQ ID NO: 5250991 - DNA, 19 bp, Homo sapiens
atcaaggttataatttttt

SEQ ID NO: 5250992 - DNA, 23 bp, Homo sapiens
atcaaggttataattttttttaa

SEQ ID NO: 5250993 - DNA, 21 bp, Homo sapiens
atcaagtagaacaaaaactat

SEQ ID NO: 5250994 - DNA, 17 bp, Homo sapiens
atcaagtagactactgt

SEQ ID NO: 5250995 - DNA, 19 bp, Homo sapiens
atcaagtagactactgttc

SEQ ID NO: 5250996 - DNA, 17 bp, Homo sapiens
atcaagtatagaaaatc

SEQ ID NO: 5250997 - DNA, 20 bp, Homo sapiens
atcaagtattactaaattga

SEQ ID NO: 5250998 - DNA, 14 bp, Homo sapiens
atcaagtattatac

SEQ ID NO: 5250999 - DNA, 15 bp, Homo sapiens
atcaagtcaaatgga

SEQ ID NO: 5251000 - DNA, 15 bp, Homo sapiens
atcaagtcaatcatt

SEQ ID NO: 5251001 - DNA, 17 bp, Homo sapiens
atcaagtcaatcatttc

SEQ ID NO: 5251002 - DNA, 18 bp, Homo sapiens
atcaagtcaatcatttct

SEQ ID NO: 5251003 - DNA, 19 bp, Homo sapiens
atcaagtcaatcatttctc

SEQ ID NO: 5251004 - DNA, 15 bp, Homo sapiens
atcaagtcccgaggc

SEQ ID NO: 5251005 - DNA, 15 bp, Homo sapiens
atcaagtctgtttac

SEQ ID NO: 5251006 - DNA, 23 bp, Homo sapiens
atcaagtctgtttactgcaaggt

SEQ ID NO: 5251007 - DNA, 15 bp, Homo sapiens
atcaagtgaacatta

SEQ ID NO: 5251008 - DNA, 17 bp, Homo sapiens
atcaagtgcacctacac

SEQ ID NO: 5251009 - DNA, 13 bp, Homo sapiens
atcaagtgcagtc

SEQ ID NO: 5251010 - DNA, 20 bp, Homo sapiens
atcaagtgcatttctgggcc

SEQ ID NO: 5251011 - DNA, 14 bp, Homo sapiens
atcaagtgtaatta

SEQ ID NO: 5251012 - DNA, 13 bp, Homo sapiens
atcaagtgtcttc

SEQ ID NO: 5251013 - DNA, 16 bp, Homo sapiens
atcaagtgtcttccat

SEQ ID NO: 5251014 - DNA, 15 bp, Homo sapiens
atcaagtgtgcttta

SEQ ID NO: 5251015 - DNA, 14 bp, Homo sapiens
atcaagttattttt

SEQ ID NO: 5251016 - DNA, 17 bp, Homo sapiens
atcaagttcagccaccg

SEQ ID NO: 5251017 - DNA, 22 bp, Homo sapiens
atcaagttctccccagggtaga

SEQ ID NO: 5251018 - DNA, 22 bp, Homo sapiens
atcaagttggcttctaatcaaa

SEQ ID NO: 5251019 - DNA, 23 bp, Homo sapiens
atcaagtttccaagcaaatgtta

SEQ ID NO: 5251020 - DNA, 17 bp, Homo sapiens
atcaataaaattctgta

SEQ ID NO: 5251021 - DNA, 18 bp, Homo sapiens
atcaataaaattctgtaa

SEQ ID NO: 5251022 - DNA, 19 bp, Homo sapiens
atcaataaacgatttaatt

SEQ ID NO: 5251023 - DNA, 15 bp, Homo sapiens
atcaataaactgtgt

SEQ ID NO: 5251024 - DNA, 18 bp, Homo sapiens
atcaataacagccgctcc

SEQ ID NO: 5251025 - DNA, 22 bp, Homo sapiens
atcaataacagccgctccagag

SEQ ID NO: 5251026 - DNA, 17 bp, Homo sapiens
atcaatacagcttcatt

SEQ ID NO: 5251027 - DNA, 21 bp, Homo sapiens
atcaatacccttggcactgat

SEQ ID NO: 5251028 - DNA, 13 bp, Homo sapiens
atcaatagttgaa

SEQ ID NO: 5251029 - DNA, 15 bp, Homo sapiens
atcaatatctaatat

SEQ ID NO: 5251030 - DNA, 13 bp, Homo sapiens
atcaatcaaaccc

SEQ ID NO: 5251031 - DNA, 15 bp, Homo sapiens
atcaatcaatggtgc

SEQ ID NO: 5251032 - DNA, 17 bp, Homo sapiens
atcaatcaggaatgagt

SEQ ID NO: 5251033 - DNA, 20 bp, Homo sapiens
atcaatcatgtcagtctgct

SEQ ID NO: 5251034 - DNA, 14 bp, Homo sapiens
atcaatcattgtac

SEQ ID NO: 5251035 - DNA, 15 bp, Homo sapiens
atcaatcattgtaca

SEQ ID NO: 5251036 - DNA, 21 bp, Homo sapiens
atcaatcattgtacagtttgt

SEQ ID NO: 5251037 - DNA, 19 bp, Homo sapiens
atcaatccaaattccctct

SEQ ID NO: 5251038 - DNA, 20 bp, Homo sapiens
atcaatccagcggttctcaa

SEQ ID NO: 5251039 - DNA, 13 bp, Homo sapiens
atcaatcctgatt

SEQ ID NO: 5251040 - DNA, 20 bp, Homo sapiens
atcaatcctgattcctctct

SEQ ID NO: 5251041 - DNA, 23 bp, Homo sapiens
atcaatcctgtgtggtttagtgt

SEQ ID NO: 5251042 - DNA, 16 bp, Homo sapiens
atcaatctgcagtttg

SEQ ID NO: 5251043 - DNA, 22 bp, Homo sapiens
atcaatctgcagtttgtgaact

SEQ ID NO: 5251044 - DNA, 13 bp, Homo sapiens
atcaatcttgtta

SEQ ID NO: 5251045 - DNA, 15 bp, Homo sapiens
atcaatcttgttact

SEQ ID NO: 5251046 - DNA, 16 bp, Homo sapiens
atcaatcttgttactg

SEQ ID NO: 5251047 - DNA, 18 bp, Homo sapiens
atcaatcttgttactgct

SEQ ID NO: 5251048 - DNA, 19 bp, Homo sapiens
atcaatcttgttactgctg

SEQ ID NO: 5251049 - DNA, 22 bp, Homo sapiens
atcaatctttaaaccaattgct

SEQ ID NO: 5251050 - DNA, 15 bp, Homo sapiens
atcaatctttagaaa

SEQ ID NO: 5251051 - DNA, 21 bp, Homo sapiens
atcaatctttagaaaaggcat

SEQ ID NO: 5251052 - DNA, 18 bp, Homo sapiens
atcaatgaagatttttaa

SEQ ID NO: 5251053 - DNA, 12 bp, Homo sapiens
atcaatgaagga

SEQ ID NO: 5251054 - DNA, 15 bp, Homo sapiens
atcaatgaatattga

SEQ ID NO: 5251055 - DNA, 16 bp, Homo sapiens
atcaatgaatattgaa

SEQ ID NO: 5251056 - DNA, 18 bp, Homo sapiens
atcaatgaatattgaagt

SEQ ID NO: 5251057 - DNA, 20 bp, Homo sapiens
atcaatgaatttgttctttc

SEQ ID NO: 5251058 - DNA, 18 bp, Homo sapiens
atcaatgataatgctaat

SEQ ID NO: 5251059 - DNA, 20 bp, Homo sapiens
atcaatggaaacagggcagt

SEQ ID NO: 5251060 - DNA, 23 bp, Homo sapiens
atcaatggcgcagtgcctctggt

SEQ ID NO: 5251061 - DNA, 19 bp, Homo sapiens
atcaatggctttgtacttg

SEQ ID NO: 5251062 - DNA, 22 bp, Homo sapiens
atcaatgggatatgattggttc

SEQ ID NO: 5251063 - DNA, 21 bp, Homo sapiens
atcaatgggattttctagttt

SEQ ID NO: 5251064 - DNA, 14 bp, Homo sapiens
atcttaaacaatgt

SEQ ID NO: 5251065 - DNA, 16 bp, Homo sapiens
atcttaaacaatgtat

SEQ ID NO: 5251066 - DNA, 23 bp, Homo sapiens
atcttaaacaatgtataaagatt

SEQ ID NO: 5251067 - DNA, 16 bp, Homo sapiens
atcttaaacccacata

SEQ ID NO: 5251068 - DNA, 18 bp, Homo sapiens
atcttaaacccacataaa

SEQ ID NO: 5251069 - DNA, 23 bp, Homo sapiens
atcttaaacccacataaacactt

SEQ ID NO: 5251070 - DNA, 23 bp, Homo sapiens
atcttaaactgttcttcattaga

SEQ ID NO: 5251071 - DNA, 13 bp, Homo sapiens
atcttaaagacaa

SEQ ID NO: 5251072 - DNA, 12 bp, Homo sapiens
atcttaaaggac

SEQ ID NO: 5251073 - DNA, 19 bp, Homo sapiens
atcttaaagtgtgtttcta

SEQ ID NO: 5251074 - DNA, 14 bp, Homo sapiens
atcttaaatatgaa

SEQ ID NO: 5251075 - DNA, 15 bp, Homo sapiens
atcttaaatatgaat

SEQ ID NO: 5251076 - DNA, 21 bp, Homo sapiens
atcttaaatatgaattctgtt

SEQ ID NO: 5251077 - DNA, 22 bp, Homo sapiens
atcttaaatcagaataaattaa

SEQ ID NO: 5251078 - DNA, 15 bp, Homo sapiens
atcttaaatctgtga

SEQ ID NO: 5251079 - DNA, 15 bp, Homo sapiens
atcttaaatgacagt

SEQ ID NO: 5251080 - DNA, 14 bp, Homo sapiens
atcttaacactgaa

SEQ ID NO: 5251081 - DNA, 19 bp, Homo sapiens
atcttaacttggctaacat

SEQ ID NO: 5251082 - DNA, 13 bp, Homo sapiens
atcttaagaatgt

SEQ ID NO: 5251083 - DNA, 21 bp, Homo sapiens
atcttaagagcttgatctgtg

SEQ ID NO: 5251084 - DNA, 20 bp, Homo sapiens
atcttaagaggatggatgaa

SEQ ID NO: 5251085 - DNA, 22 bp, Homo sapiens
atcttaagaggatggatgaatc

SEQ ID NO: 5251086 - DNA, 20 bp, Homo sapiens
atcttaagataatatttaaa

SEQ ID NO: 5251087 - DNA, 17 bp, Homo sapiens
atcttaagcagagataa

SEQ ID NO: 5251088 - DNA, 18 bp, Homo sapiens
atcttaagcagagataaa

SEQ ID NO: 5251089 - DNA, 16 bp, Homo sapiens
atcttaaggggcagct

SEQ ID NO: 5251090 - DNA, 20 bp, Homo sapiens
atcttaagtcataatgaata

SEQ ID NO: 5251091 - DNA, 16 bp, Homo sapiens
atcttaatacttgaac

SEQ ID NO: 5251092 - DNA, 18 bp, Homo sapiens
atcttaatctttatttta

SEQ ID NO: 5251093 - DNA, 21 bp, Homo sapiens
atcttaatgaatgagtctgtt

SEQ ID NO: 5251094 - DNA, 13 bp, Homo sapiens
atcttaatgtaaa

SEQ ID NO: 5251095 - DNA, 14 bp, Homo sapiens
atcttaatgtatat

SEQ ID NO: 5251096 - DNA, 17 bp, Homo sapiens
atcttaatgtatatcgt

SEQ ID NO: 5251097 - DNA, 17 bp, Homo sapiens
atcttaatgtctggtgt

SEQ ID NO: 5251098 - DNA, 23 bp, Homo sapiens
atcttaatgtctggtgtttgtca

SEQ ID NO: 5251099 - DNA, 15 bp, Homo sapiens
atcttaatgttactc

SEQ ID NO: 5251100 - DNA, 21 bp, Homo sapiens
atcttaatgttcctcaaagct

SEQ ID NO: 5251101 - DNA, 16 bp, Homo sapiens
atcttaattattgtac

SEQ ID NO: 5251102 - DNA, 18 bp, Homo sapiens
atcttaattctttgttct

SEQ ID NO: 5251103 - DNA, 17 bp, Homo sapiens
atcttaattgcaagtct

SEQ ID NO: 5251104 - DNA, 15 bp, Homo sapiens
atcttaatttattat

SEQ ID NO: 5251105 - DNA, 13 bp, Homo sapiens
atcttaattttgg

SEQ ID NO: 5251106 - DNA, 17 bp, Homo sapiens
atcttacaactccccca

SEQ ID NO: 5251107 - DNA, 17 bp, Homo sapiens
atcttacacgaagaaat

SEQ ID NO: 5251108 - DNA, 21 bp, Homo sapiens
atcttacagaagagtaaactg

SEQ ID NO: 5251109 - DNA, 13 bp, Homo sapiens
atcttacagccag

SEQ ID NO: 5251110 - DNA, 14 bp, Homo sapiens
atcttaccagatgc

SEQ ID NO: 5251111 - DNA, 16 bp, Homo sapiens
atcttaccagatgcta

SEQ ID NO: 5251112 - DNA, 21 bp, Homo sapiens
atcttacccttcaatgttaaa

SEQ ID NO: 5251113 - DNA, 17 bp, Homo sapiens
atcttacgctatttctg

SEQ ID NO: 5251114 - DNA, 22 bp, Homo sapiens
atcttacttgcaaaatggagac

SEQ ID NO: 5251115 - DNA, 21 bp, Homo sapiens
atcttagagtttacagtttgt

SEQ ID NO: 5251116 - DNA, 15 bp, Homo sapiens
atcttagattctctg

SEQ ID NO: 5251117 - DNA, 18 bp, Homo sapiens
atcttagattctctgtgt

SEQ ID NO: 5251118 - DNA, 20 bp, Homo sapiens
atcttagattctctgtgtct

SEQ ID NO: 5251119 - DNA, 19 bp, Homo sapiens
atcttagcatagcttatta

SEQ ID NO: 5251120 - DNA, 15 bp, Homo sapiens
atcttagctgccaag

SEQ ID NO: 5251121 - DNA, 15 bp, Homo sapiens
atcttagctggatat

SEQ ID NO: 5251122 - DNA, 16 bp, Homo sapiens
atcttagctggatata

SEQ ID NO: 5251123 - DNA, 22 bp, Homo sapiens
atcttagctggatataatgtat

SEQ ID NO: 5251124 - DNA, 15 bp, Homo sapiens
atcttagctttccac

SEQ ID NO: 5251125 - DNA, 18 bp, Homo sapiens
atcttagctttccacagg

SEQ ID NO: 5251126 - DNA, 23 bp, Homo sapiens
atcttaggcactttttaacattc

SEQ ID NO: 5251127 - DNA, 21 bp, Homo sapiens
atcttagggaactttgataca

SEQ ID NO: 5251128 - DNA, 18 bp, Homo sapiens
atcttaggggattatctt

SEQ ID NO: 5251129 - DNA, 21 bp, Homo sapiens
atcttagtgcctgagagtatt

SEQ ID NO: 5251130 - DNA, 16 bp, Homo sapiens
atcttagtgtatgatt

SEQ ID NO: 5251131 - DNA, 19 bp, Homo sapiens
atcttagtgtatgattact

SEQ ID NO: 5251132 - DNA, 18 bp, Homo sapiens
atcttagtttactggata

SEQ ID NO: 5251133 - DNA, 15 bp, Homo sapiens
atcttataactgttt

SEQ ID NO: 5251134 - DNA, 14 bp, Homo sapiens
atcttataatttaa

SEQ ID NO: 5251135 - DNA, 16 bp, Homo sapiens
atcttataatttaaaa

SEQ ID NO: 5251136 - DNA, 15 bp, Homo sapiens
atcttatactgaaaa

SEQ ID NO: 5251137 - DNA, 15 bp, Homo sapiens
atcttatagcacttt

SEQ ID NO: 5251138 - DNA, 17 bp, Homo sapiens
atcttatagcactttga

SEQ ID NO: 5251139 - DNA, 21 bp, Homo sapiens
atcttatagcactttgaaata

SEQ ID NO: 5251140 - DNA, 17 bp, Homo sapiens
atcttatagttctaggc

SEQ ID NO: 5251141 - DNA, 22 bp, Homo sapiens
atcttatatgggaaaccatgta

SEQ ID NO: 5251142 - DNA, 21 bp, Homo sapiens
atcttatattggtttgcacaa

SEQ ID NO: 5251143 - DNA, 18 bp, Homo sapiens
atcttatcatggtctcag

SEQ ID NO: 5251144 - DNA, 19 bp, Homo sapiens
atcttatcttgctttggag

SEQ ID NO: 5251145 - DNA, 16 bp, Homo sapiens
atcttatgcaaaactt

SEQ ID NO: 5251146 - DNA, 16 bp, Homo sapiens
atcttatgcttaaaat

SEQ ID NO: 5251147 - DNA, 21 bp, Homo sapiens
atcttatgttgatcgatgtta

SEQ ID NO: 5251148 - DNA, 13 bp, Homo sapiens
atcttattaaagt

SEQ ID NO: 5251149 - DNA, 14 bp, Homo sapiens
atcttattaaagtt

SEQ ID NO: 5251150 - DNA, 22 bp, Homo sapiens
atcttattaaagtttcaaaaat

SEQ ID NO: 5251151 - DNA, 20 bp, Homo sapiens
atcttattcattttctctaa

SEQ ID NO: 5251152 - DNA, 19 bp, Homo sapiens
atcttattgtttaatcttt

SEQ ID NO: 5251153 - DNA, 21 bp, Homo sapiens
atcttattgtttaatcttttt

SEQ ID NO: 5251154 - DNA, 13 bp, Homo sapiens
atcttatttagga

SEQ ID NO: 5251155 - DNA, 13 bp, Homo sapiens
atcttatttggaa

SEQ ID NO: 5251156 - DNA, 14 bp, Homo sapiens
atcttatttggaat

SEQ ID NO: 5251157 - DNA, 15 bp, Homo sapiens
atcttatttggaatt

SEQ ID NO: 5251158 - DNA, 23 bp, Homo sapiens
atcttattttcatgtatatgtgt

SEQ ID NO: 5251159 - DNA, 18 bp, Homo sapiens
atcttattttgtgaacta

SEQ ID NO: 5251160 - DNA, 15 bp, Homo sapiens
atcttatttttcctg

SEQ ID NO: 5251161 - DNA, 19 bp, Homo sapiens
atcttcaaaagtaatgcct

SEQ ID NO: 5251162 - DNA, 17 bp, Homo sapiens
atcttcaaactttcact

SEQ ID NO: 5251163 - DNA, 15 bp, Homo sapiens
atcttcaaagcttga

SEQ ID NO: 5251164 - DNA, 12 bp, Homo sapiens
atcttcaacaaa

SEQ ID NO: 5251165 - DNA, 14 bp, Homo sapiens
atcttcaacaaatt

SEQ ID NO: 5251166 - DNA, 19 bp, Homo sapiens
atcttcaactaatttttga

SEQ ID NO: 5251167 - DNA, 14 bp, Homo sapiens
atcttcaatatgaa

SEQ ID NO: 5251168 - DNA, 14 bp, Homo sapiens
atcttcaatccttg

SEQ ID NO: 5251169 - DNA, 15 bp, Homo sapiens
atcttcacattctga

SEQ ID NO: 5251170 - DNA, 22 bp, Homo sapiens
atcttcaccagaggaatcactc

SEQ ID NO: 5251171 - DNA, 17 bp, Homo sapiens
atcttcacccaggccta

SEQ ID NO: 5251172 - DNA, 14 bp, Homo sapiens
atcttcacctcaga

SEQ ID NO: 5251173 - DNA, 21 bp, Homo sapiens
atcttcacgacaatgttgaga

SEQ ID NO: 5251174 - DNA, 22 bp, Homo sapiens
atcttcactgtatatgtaaatt

SEQ ID NO: 5251175 - DNA, 18 bp, Homo sapiens
atcttcagaactgccctt

SEQ ID NO: 5251176 - DNA, 21 bp, Homo sapiens
atcttcagaactgcccttgct

SEQ ID NO: 5251177 - DNA, 18 bp, Homo sapiens
atcttcagagcaggggtc

SEQ ID NO: 5251178 - DNA, 13 bp, Homo sapiens
atcttcagcccag

SEQ ID NO: 5251179 - DNA, 15 bp, Homo sapiens
atcttcagcccaggc

SEQ ID NO: 5251180 - DNA, 24 bp, Homo sapiens
atcttcagctcccatagcgctggc

SEQ ID NO: 5251181 - DNA, 14 bp, Homo sapiens
atcttcagctggtg

SEQ ID NO: 5251182 - DNA, 19 bp, Homo sapiens
atcttcagctggtggatgg

SEQ ID NO: 5251183 - DNA, 20 bp, Homo sapiens
atcttcagctgtatgaaagg

SEQ ID NO: 5251184 - DNA, 15 bp, Homo sapiens
atcttcaggtgaaca

SEQ ID NO: 5251185 - DNA, 18 bp, Homo sapiens
atcttcaggtgaacactt

SEQ ID NO: 5251186 - DNA, 16 bp, Homo sapiens
atcttcagttgtctct

SEQ ID NO: 5251187 - DNA, 17 bp, Homo sapiens
atcttcagttgtctctg

SEQ ID NO: 5251188 - DNA, 16 bp, Homo sapiens
atcttcagtttctgaa

SEQ ID NO: 5251189 - DNA, 22 bp, Homo sapiens
atcttcagttttatctttaatc

SEQ ID NO: 5251190 - DNA, 15 bp, Homo sapiens
atcttcatataaact

SEQ ID NO: 5251191 - DNA, 18 bp, Homo sapiens
atcttcatgtaaattgac

SEQ ID NO: 5251192 - DNA, 12 bp, Homo sapiens
atcttcatgtcc

SEQ ID NO: 5251193 - DNA, 17 bp, Homo sapiens
atcttcatgtccagtga

SEQ ID NO: 5251194 - DNA, 20 bp, Homo sapiens
atcttccacctgtgccctca

SEQ ID NO: 5251195 - DNA, 23 bp, Homo sapiens
atcttccacctgtgccctcacca

SEQ ID NO: 5251196 - DNA, 19 bp, Homo sapiens
atcttccatatccgggtgc

SEQ ID NO: 5251197 - DNA, 15 bp, Homo sapiens
atcttccatatttgg

SEQ ID NO: 5251198 - DNA, 22 bp, Homo sapiens
atcttccatctgcatcttaaca

SEQ ID NO: 5251199 - DNA, 15 bp, Homo sapiens
atcttcccagtatta

SEQ ID NO: 5251200 - DNA, 13 bp, Homo sapiens
atcttcccataat

SEQ ID NO: 5251201 - DNA, 12 bp, Homo sapiens
atcttccccaag

SEQ ID NO: 5251202 - DNA, 14 bp, Homo sapiens
atcttccccagccc

SEQ ID NO: 5251203 - DNA, 23 bp, Homo sapiens
atcttccccagccctccccacct

SEQ ID NO: 5251204 - DNA, 14 bp, Homo sapiens
atcttcccccttcc

SEQ ID NO: 5251205 - DNA, 18 bp, Homo sapiens
atcttcccgcctcagcct

SEQ ID NO: 5251206 - DNA, 19 bp, Homo sapiens
atcttcccgcctcagcctc

SEQ ID NO: 5251207 - DNA, 21 bp, Homo sapiens
atcttccctagagggttcctg

SEQ ID NO: 5251208 - DNA, 14 bp, Homo sapiens
atcttccctctccc

SEQ ID NO: 5251209 - DNA, 20 bp, Homo sapiens
atcttccctgcccctgtgcc

SEQ ID NO: 5251210 - DNA, 22 bp, Homo sapiens
atcttccgtggtcagagtgcca

SEQ ID NO: 5251211 - DNA, 14 bp, Homo sapiens
atcttcctctgcag

SEQ ID NO: 5251212 - DNA, 19 bp, Homo sapiens
atcttcctctgctaaattg

SEQ ID NO: 5251213 - DNA, 12 bp, Homo sapiens
atcttcctgctg

SEQ ID NO: 5251214 - DNA, 16 bp, Homo sapiens
atcttcctgctgctgt

SEQ ID NO: 5251215 - DNA, 19 bp, Homo sapiens
atcttcctggcacaatgtt

SEQ ID NO: 5251216 - DNA, 20 bp, Homo sapiens
atcttcctggtcgaaagtta

SEQ ID NO: 5251217 - DNA, 23 bp, Homo sapiens
atcttcctggtcgaaagttagta

SEQ ID NO: 5251218 - DNA, 15 bp, Homo sapiens
atcttcctgtgtcct

SEQ ID NO: 5251219 - DNA, 20 bp, Homo sapiens
atcttccttctcagccttgg

SEQ ID NO: 5251220 - DNA, 22 bp, Homo sapiens
atcttcctttggggaagtttat

SEQ ID NO: 5251221 - DNA, 18 bp, Homo sapiens
atcttcgggaccaggatt

SEQ ID NO: 5251222 - DNA, 15 bp, Homo sapiens
atcttcggggtgtga

SEQ ID NO: 5251223 - DNA, 18 bp, Homo sapiens
atcttcggggtgtgatga

SEQ ID NO: 5251224 - DNA, 19 bp, Homo sapiens
atcttcgttagtaatctgt

SEQ ID NO: 5251225 - DNA, 15 bp, Homo sapiens
atcttcgttcttgtt

SEQ ID NO: 5251226 - DNA, 14 bp, Homo sapiens
atcttctactttta

SEQ ID NO: 5251227 - DNA, 19 bp, Homo sapiens
atcttctacttttaactaa

SEQ ID NO: 5251228 - DNA, 15 bp, Homo sapiens
atcttctatcttctt

SEQ ID NO: 5251229 - DNA, 16 bp, Homo sapiens
atcttctatcttcttt

SEQ ID NO: 5251230 - DNA, 15 bp, Homo sapiens
atcttctatttttat

SEQ ID NO: 5251231 - DNA, 18 bp, Homo sapiens
atcttctcaagttctaag

SEQ ID NO: 5251232 - DNA, 14 bp, Homo sapiens
atcttctcagctcc

SEQ ID NO: 5251233 - DNA, 22 bp, Homo sapiens
atcttctcagctcccatttcta

SEQ ID NO: 5251234 - DNA, 21 bp, Homo sapiens
atcttctcattcccatgtgga

SEQ ID NO: 5251235 - DNA, 13 bp, Homo sapiens
atcttctcattgt

SEQ ID NO: 5251236 - DNA, 22 bp, Homo sapiens
atcttctccatctggcagggtg

SEQ ID NO: 5251237 - DNA, 14 bp, Homo sapiens
atcttctccattct

SEQ ID NO: 5251238 - DNA, 16 bp, Homo sapiens
atcttctccccacagc

SEQ ID NO: 5251239 - DNA, 20 bp, Homo sapiens
atcttctccccacagcctct

SEQ ID NO: 5251240 - DNA, 20 bp, Homo sapiens
atcttctctactgtgtgaaa

SEQ ID NO: 5251241 - DNA, 17 bp, Homo sapiens
atcttctctatattttt

SEQ ID NO: 5251242 - DNA, 18 bp, Homo sapiens
atcaatggtgcaaaaaaa

SEQ ID NO: 5251243 - DNA, 18 bp, Homo sapiens
atcaatggttcaagtctt

SEQ ID NO: 5251244 - DNA, 14 bp, Homo sapiens
atcaatgtgtcttt

SEQ ID NO: 5251245 - DNA, 14 bp, Homo sapiens
atcaattaattttt

SEQ ID NO: 5251246 - DNA, 17 bp, Homo sapiens
atcaattatagtttctg

SEQ ID NO: 5251247 - DNA, 17 bp, Homo sapiens
atcaattattacattta

SEQ ID NO: 5251248 - DNA, 16 bp, Homo sapiens
atcaattcatatctat

SEQ ID NO: 5251249 - DNA, 17 bp, Homo sapiens
atcaattccctctctca

SEQ ID NO: 5251250 - DNA, 21 bp, Homo sapiens
atcaattctgatacagcctta

SEQ ID NO: 5251251 - DNA, 19 bp, Homo sapiens
atcaattgggttttgatct

SEQ ID NO: 5251252 - DNA, 15 bp, Homo sapiens
atcaatttaaaccca

SEQ ID NO: 5251253 - DNA, 16 bp, Homo sapiens
atcaatttaaatgttt

SEQ ID NO: 5251254 - DNA, 17 bp, Homo sapiens
atcaatttaaatgttta

SEQ ID NO: 5251255 - DNA, 16 bp, Homo sapiens
atcaatttctaatgtt

SEQ ID NO: 5251256 - DNA, 17 bp, Homo sapiens
atcaatttctaatgttt

SEQ ID NO: 5251257 - DNA, 20 bp, Homo sapiens
atcaatttctaatgtttact

SEQ ID NO: 5251258 - DNA, 20 bp, Homo sapiens
atcaatttgtaattgcttac

SEQ ID NO: 5251259 - DNA, 14 bp, Homo sapiens
atcaatttgtcatt

SEQ ID NO: 5251260 - DNA, 18 bp, Homo sapiens
atcaatttgtcattttga

SEQ ID NO: 5251261 - DNA, 22 bp, Homo sapiens
atcaatttgtcattttgaagct

SEQ ID NO: 5251262 - DNA, 15 bp, Homo sapiens
atcaattttaacatt

SEQ ID NO: 5251263 - DNA, 19 bp, Homo sapiens
atcaattttaacatttgat

SEQ ID NO: 5251264 - DNA, 23 bp, Homo sapiens
atcaattttcattaaacttgaag

SEQ ID NO: 5251265 - DNA, 24 bp, Homo sapiens
atcaatttttatacatatcagaaa

SEQ ID NO: 5251266 - DNA, 15 bp, Homo sapiens
atcaatttttcccag

SEQ ID NO: 5251267 - DNA, 14 bp, Homo sapiens
atcaatttttctta

SEQ ID NO: 5251268 - DNA, 11 bp, Homo sapiens
atcacaaaaac

SEQ ID NO: 5251269 - DNA, 13 bp, Homo sapiens
atcacaaaaacaa

SEQ ID NO: 5251270 - DNA, 12 bp, Homo sapiens
atcacaaaagaa

SEQ ID NO: 5251271 - DNA, 19 bp, Homo sapiens
atcacaaaagctgtgtctc

SEQ ID NO: 5251272 - DNA, 12 bp, Homo sapiens
atcacaaaatca

SEQ ID NO: 5251273 - DNA, 15 bp, Homo sapiens
atcacaaacatatgt

SEQ ID NO: 5251274 - DNA, 22 bp, Homo sapiens
atcacaaagctgtgaaatgtgc

SEQ ID NO: 5251275 - DNA, 20 bp, Homo sapiens
atcacaaagttgtttaacta

SEQ ID NO: 5251276 - DNA, 16 bp, Homo sapiens
atcacaaatgacttta

SEQ ID NO: 5251277 - DNA, 15 bp, Homo sapiens
atcacaacctaaatg

SEQ ID NO: 5251278 - DNA, 22 bp, Homo sapiens
atcacaacgtgcattgtgcttc

SEQ ID NO: 5251279 - DNA, 14 bp, Homo sapiens
atcacaacttttct

SEQ ID NO: 5251280 - DNA, 20 bp, Homo sapiens
atcacaagaatcacctcaaa

SEQ ID NO: 5251281 - DNA, 13 bp, Homo sapiens
atcacaagcaata

SEQ ID NO: 5251282 - DNA, 20 bp, Homo sapiens
atcacaagcaataattagga

SEQ ID NO: 5251283 - DNA, 21 bp, Homo sapiens
atcacaagcaataattaggat

SEQ ID NO: 5251284 - DNA, 17 bp, Homo sapiens
atcacaaggtcaggagt

SEQ ID NO: 5251285 - DNA, 13 bp, Homo sapiens
atcacaatacaga

SEQ ID NO: 5251286 - DNA, 14 bp, Homo sapiens
atcacaatattcag

SEQ ID NO: 5251287 - DNA, 16 bp, Homo sapiens
atcacaatgagaaaaa

SEQ ID NO: 5251288 - DNA, 14 bp, Homo sapiens
atcacacaatatag

SEQ ID NO: 5251289 - DNA, 14 bp, Homo sapiens
atcacacacatgga

SEQ ID NO: 5251290 - DNA, 13 bp, Homo sapiens
atcacacacattg

SEQ ID NO: 5251291 - DNA, 14 bp, Homo sapiens
atcacacagccact

SEQ ID NO: 5251292 - DNA, 13 bp, Homo sapiens
atcacacagtgtt

SEQ ID NO: 5251293 - DNA, 21 bp, Homo sapiens
atcacacatccagctgcccct

SEQ ID NO: 5251294 - DNA, 24 bp, Homo sapiens
atcacaccagttacttgtgttcat

SEQ ID NO: 5251295 - DNA, 21 bp, Homo sapiens
atcacaccatcgctggcccct

SEQ ID NO: 5251296 - DNA, 21 bp, Homo sapiens
atcacacccagcccatgtggc

SEQ ID NO: 5251297 - DNA, 16 bp, Homo sapiens
atcacacccatttaaa

SEQ ID NO: 5251298 - DNA, 19 bp, Homo sapiens
atcacacctcagtgggaag

SEQ ID NO: 5251299 - DNA, 14 bp, Homo sapiens
atcacactatttta

SEQ ID NO: 5251300 - DNA, 19 bp, Homo sapiens
atcacactcaaggacagga

SEQ ID NO: 5251301 - DNA, 22 bp, Homo sapiens
atcacactcaaggacaggagcc

SEQ ID NO: 5251302 - DNA, 15 bp, Homo sapiens
atcacacttatattt

SEQ ID NO: 5251303 - DNA, 21 bp, Homo sapiens
atcacacttatattttatgaa

SEQ ID NO: 5251304 - DNA, 21 bp, Homo sapiens
atcacacttcattgtaaatca

SEQ ID NO: 5251305 - DNA, 16 bp, Homo sapiens
atcacacttctgtgag

SEQ ID NO: 5251306 - DNA, 16 bp, Homo sapiens
atcacacttgcaaatg

SEQ ID NO: 5251307 - DNA, 17 bp, Homo sapiens
atcacacttgcaaatga

SEQ ID NO: 5251308 - DNA, 15 bp, Homo sapiens
atcacactttaatgt

SEQ ID NO: 5251309 - DNA, 13 bp, Homo sapiens
atcacagaaaaaa

SEQ ID NO: 5251310 - DNA, 15 bp, Homo sapiens
atcacagagacattc

SEQ ID NO: 5251311 - DNA, 22 bp, Homo sapiens
atcacagagacattcctccgag

SEQ ID NO: 5251312 - DNA, 19 bp, Homo sapiens
atcacagatgcatatagac

SEQ ID NO: 5251313 - DNA, 20 bp, Homo sapiens
atcacagatgggtattaaac

SEQ ID NO: 5251314 - DNA, 21 bp, Homo sapiens
atcacagatgggtattaaact

SEQ ID NO: 5251315 - DNA, 18 bp, Homo sapiens
atcacagatgtgcccaga

SEQ ID NO: 5251316 - DNA, 19 bp, Homo sapiens
atcacagatgtgcccagag

SEQ ID NO: 5251317 - DNA, 15 bp, Homo sapiens
atcacagatttccaa

SEQ ID NO: 5251318 - DNA, 20 bp, Homo sapiens
atcacagattttttctttaa

SEQ ID NO: 5251319 - DNA, 21 bp, Homo sapiens
atcacagcagaatgaagacct

SEQ ID NO: 5251320 - DNA, 15 bp, Homo sapiens
atcacagcagggcct

SEQ ID NO: 5251321 - DNA, 16 bp, Homo sapiens
atcacagccagcccag

SEQ ID NO: 5251322 - DNA, 15 bp, Homo sapiens
atcacagcccagccc

SEQ ID NO: 5251323 - DNA, 16 bp, Homo sapiens
atcacagccccaccct

SEQ ID NO: 5251324 - DNA, 17 bp, Homo sapiens
atcacagccccaccctt

SEQ ID NO: 5251325 - DNA, 21 bp, Homo sapiens
atcacagcctcacccctgccc

SEQ ID NO: 5251326 - DNA, 16 bp, Homo sapiens
atcacagcctccaggg

SEQ ID NO: 5251327 - DNA, 18 bp, Homo sapiens
atcacagcctccagggcc

SEQ ID NO: 5251328 - DNA, 19 bp, Homo sapiens
atcacagcctccagggccc

SEQ ID NO: 5251329 - DNA, 20 bp, Homo sapiens
atcacagctccctaggtagg

SEQ ID NO: 5251330 - DNA, 13 bp, Homo sapiens
atcacagctcctc

SEQ ID NO: 5251331 - DNA, 16 bp, Homo sapiens
atcacagctgctttct

SEQ ID NO: 5251332 - DNA, 21 bp, Homo sapiens
atcacaggagcaatcacagga

SEQ ID NO: 5251333 - DNA, 17 bp, Homo sapiens
atcacaggatgccagcc

SEQ ID NO: 5251334 - DNA, 18 bp, Homo sapiens
atcacaggatgccagccc

SEQ ID NO: 5251335 - DNA, 20 bp, Homo sapiens
atcacaggatgccagcccct

SEQ ID NO: 5251336 - DNA, 21 bp, Homo sapiens
atcacaggatgccagcccctg

SEQ ID NO: 5251337 - DNA, 23 bp, Homo sapiens
atcacaggctgggctgggcactg

SEQ ID NO: 5251338 - DNA, 20 bp, Homo sapiens
atcacagggcagagccggga

SEQ ID NO: 5251339 - DNA, 12 bp, Homo sapiens
atcacaggggcg

SEQ ID NO: 5251340 - DNA, 18 bp, Homo sapiens
atcacaggggcggggcag

SEQ ID NO: 5251341 - DNA, 23 bp, Homo sapiens
atcacagggttgggcccagatct

SEQ ID NO: 5251342 - DNA, 13 bp, Homo sapiens
atcacagtattat

SEQ ID NO: 5251343 - DNA, 19 bp, Homo sapiens
atcacagtattatctgtgt

SEQ ID NO: 5251344 - DNA, 16 bp, Homo sapiens
atcacagtcatcttta

SEQ ID NO: 5251345 - DNA, 19 bp, Homo sapiens
atcacagtctaatttttat

SEQ ID NO: 5251346 - DNA, 22 bp, Homo sapiens
atcacagtctaatttttattca

SEQ ID NO: 5251347 - DNA, 17 bp, Homo sapiens
atcacagtgggaagaat

SEQ ID NO: 5251348 - DNA, 20 bp, Homo sapiens
atcacagtgttatgtagtat

SEQ ID NO: 5251349 - DNA, 13 bp, Homo sapiens
atcacagtgtttt

SEQ ID NO: 5251350 - DNA, 21 bp, Homo sapiens
atcacagttttggttgcttta

SEQ ID NO: 5251351 - DNA, 22 bp, Homo sapiens
atcacagttttggttgctttaa

SEQ ID NO: 5251352 - DNA, 17 bp, Homo sapiens
atcacagtttttcctgg

SEQ ID NO: 5251353 - DNA, 20 bp, Homo sapiens
atcacataagagagatgaga

SEQ ID NO: 5251354 - DNA, 20 bp, Homo sapiens
atcacataattccagtcaca

SEQ ID NO: 5251355 - DNA, 12 bp, Homo sapiens
atcacatacaat

SEQ ID NO: 5251356 - DNA, 14 bp, Homo sapiens
atcacatacaattt

SEQ ID NO: 5251357 - DNA, 17 bp, Homo sapiens
atcacatacaatttgca

SEQ ID NO: 5251358 - DNA, 20 bp, Homo sapiens
atcacatacaatttgcactg

SEQ ID NO: 5251359 - DNA, 18 bp, Homo sapiens
atcacatatgtgcataga

SEQ ID NO: 5251360 - DNA, 15 bp, Homo sapiens
atcacatattctagt

SEQ ID NO: 5251361 - DNA, 20 bp, Homo sapiens
atcacatcttatttatttta

SEQ ID NO: 5251362 - DNA, 16 bp, Homo sapiens
atcacatgagacaatt

SEQ ID NO: 5251363 - DNA, 16 bp, Homo sapiens
atcacatgatgaaaaa

SEQ ID NO: 5251364 - DNA, 21 bp, Homo sapiens
atcacatgcccctcttagaag

SEQ ID NO: 5251365 - DNA, 14 bp, Homo sapiens
atcacatgtgaaaa

SEQ ID NO: 5251366 - DNA, 15 bp, Homo sapiens
atcacattaatttaa

SEQ ID NO: 5251367 - DNA, 22 bp, Homo sapiens
atcacattgagctgatataaat

SEQ ID NO: 5251368 - DNA, 13 bp, Homo sapiens
atcacatttgtga

SEQ ID NO: 5251369 - DNA, 14 bp, Homo sapiens
atcacatttgtgat

SEQ ID NO: 5251370 - DNA, 12 bp, Homo sapiens
atcacattttat

SEQ ID NO: 5251371 - DNA, 18 bp, Homo sapiens
atcaccaagtgtggaatt

SEQ ID NO: 5251372 - DNA, 19 bp, Homo sapiens
atcaccacagtaagttcct

SEQ ID NO: 5251373 - DNA, 12 bp, Homo sapiens
atcaccaccctt

SEQ ID NO: 5251374 - DNA, 15 bp, Homo sapiens
atcaccagcccggcc

SEQ ID NO: 5251375 - DNA, 16 bp, Homo sapiens
atcaccatagttttgt

SEQ ID NO: 5251376 - DNA, 21 bp, Homo sapiens
atcaccatctttgtcaaactt

SEQ ID NO: 5251377 - DNA, 17 bp, Homo sapiens
atcaccatgttagcctt

SEQ ID NO: 5251378 - DNA, 19 bp, Homo sapiens
atcaccatgttagccttag

SEQ ID NO: 5251379 - DNA, 15 bp, Homo sapiens
atcacccaggctgga

SEQ ID NO: 5251380 - DNA, 10 bp, Homo sapiens
atcacccagt

SEQ ID NO: 5251381 - DNA, 17 bp, Homo sapiens
atcacccagtcctggcc

SEQ ID NO: 5251382 - DNA, 20 bp, Homo sapiens
atcaccccaaccccccaaaa

SEQ ID NO: 5251383 - DNA, 15 bp, Homo sapiens
atcaccccagccccc

SEQ ID NO: 5251384 - DNA, 23 bp, Homo sapiens
atcaccccagcccccacagccct

SEQ ID NO: 5251385 - DNA, 23 bp, Homo sapiens
atcaccccctccctacacacaca

SEQ ID NO: 5251386 - DNA, 15 bp, Homo sapiens
atcacccctctgccc

SEQ ID NO: 5251387 - DNA, 19 bp, Homo sapiens
atcacccctggtggctgca

SEQ ID NO: 5251388 - DNA, 14 bp, Homo sapiens
atcaccctcagctg

SEQ ID NO: 5251389 - DNA, 16 bp, Homo sapiens
atcaccctcagctggc

SEQ ID NO: 5251390 - DNA, 11 bp, Homo sapiens
atcaccctcct

SEQ ID NO: 5251391 - DNA, 16 bp, Homo sapiens
atcaccctcttcctgt

SEQ ID NO: 5251392 - DNA, 17 bp, Homo sapiens
atcaccctgactgtggg

SEQ ID NO: 5251393 - DNA, 23 bp, Homo sapiens
atcacccttaccatgtgcctgat

SEQ ID NO: 5251394 - DNA, 14 bp, Homo sapiens
atcacccttccctg

SEQ ID NO: 5251395 - DNA, 22 bp, Homo sapiens
atcacccttccctgctcccacc

SEQ ID NO: 5251396 - DNA, 16 bp, Homo sapiens
atcaccctttccggca

SEQ ID NO: 5251397 - DNA, 18 bp, Homo sapiens
atcaccctttgccttagc

SEQ ID NO: 5251398 - DNA, 19 bp, Homo sapiens
atcaccctttgccttagca

SEQ ID NO: 5251399 - DNA, 19 bp, Homo sapiens
atcaccgaaaacgtggctg

SEQ ID NO: 5251400 - DNA, 21 bp, Homo sapiens
atcaccgaaaacgtggctgct

SEQ ID NO: 5251401 - DNA, 20 bp, Homo sapiens
atcaccgagagtagccgaga

SEQ ID NO: 5251402 - DNA, 21 bp, Homo sapiens
atcaccgattcttccttgcca

SEQ ID NO: 5251403 - DNA, 19 bp, Homo sapiens
atcaccgctgggtggtttt

SEQ ID NO: 5251404 - DNA, 16 bp, Homo sapiens
atcaccgtcccgcaca

SEQ ID NO: 5251405 - DNA, 19 bp, Homo sapiens
atcaccgtgggctccctga

SEQ ID NO: 5251406 - DNA, 22 bp, Homo sapiens
atcacctaagcacttctagaat

SEQ ID NO: 5251407 - DNA, 20 bp, Homo sapiens
atcacctagctgaatgtttt

SEQ ID NO: 5251408 - DNA, 23 bp, Homo sapiens
atcacctagctgaatgtttttct

SEQ ID NO: 5251409 - DNA, 15 bp, Homo sapiens
atcacctatttccat

SEQ ID NO: 5251410 - DNA, 22 bp, Homo sapiens
atcacctatttccattcaacaa

SEQ ID NO: 5251411 - DNA, 15 bp, Homo sapiens
atcacctcagatggc

SEQ ID NO: 5251412 - DNA, 23 bp, Homo sapiens
atcacctcagatggcagctttta

SEQ ID NO: 5251413 - DNA, 14 bp, Homo sapiens
atcacctcaggcca

SEQ ID NO: 5251414 - DNA, 15 bp, Homo sapiens
atcacctcattctga

SEQ ID NO: 5251415 - DNA, 20 bp, Homo sapiens
atcacctctggctttgtctc

SEQ ID NO: 5251416 - DNA, 15 bp, Homo sapiens
atcacctgaaacact

SEQ ID NO: 5251417 - DNA, 19 bp, Homo sapiens
atcacctgaaacactggac

SEQ ID NO: 5251418 - DNA, 23 bp, Homo sapiens
atcacctgaaacactggacctgg

SEQ ID NO: 5251419 - DNA, 15 bp, Homo sapiens
atcacctgaacccca

SEQ ID NO: 5251420 - DNA, 15 bp, Homo sapiens
atcttctctcatctg

SEQ ID NO: 5251421 - DNA, 23 bp, Homo sapiens
atcttctctcttgattgattttt

SEQ ID NO: 5251422 - DNA, 19 bp, Homo sapiens
atcttctctttttccagaa

SEQ ID NO: 5251423 - DNA, 16 bp, Homo sapiens
atcttctgccttctca

SEQ ID NO: 5251424 - DNA, 18 bp, Homo sapiens
atcttctgccttctcatg

SEQ ID NO: 5251425 - DNA, 19 bp, Homo sapiens
atcttctgctaaatttttg

SEQ ID NO: 5251426 - DNA, 13 bp, Homo sapiens
atcttctggaata

SEQ ID NO: 5251427 - DNA, 14 bp, Homo sapiens
atcttctggcttga

SEQ ID NO: 5251428 - DNA, 22 bp, Homo sapiens
atcttctggtttaaacttgttt

SEQ ID NO: 5251429 - DNA, 24 bp, Homo sapiens
atcttctgtgaaatataattgtac

SEQ ID NO: 5251430 - DNA, 14 bp, Homo sapiens
atcttctgtttttc

SEQ ID NO: 5251431 - DNA, 15 bp, Homo sapiens
atcttctgtttttct

SEQ ID NO: 5251432 - DNA, 18 bp, Homo sapiens
atcttctgtttttctcaa

SEQ ID NO: 5251433 - DNA, 20 bp, Homo sapiens
atcttctgtttttctcaaat

SEQ ID NO: 5251434 - DNA, 16 bp, Homo sapiens
atcttcttcaaataca

SEQ ID NO: 5251435 - DNA, 17 bp, Homo sapiens
atcttcttcaaatacaa

SEQ ID NO: 5251436 - DNA, 14 bp, Homo sapiens
atcttcttcaccat

SEQ ID NO: 5251437 - DNA, 23 bp, Homo sapiens
atcttcttcagattcagcatttg

SEQ ID NO: 5251438 - DNA, 13 bp, Homo sapiens
atcttcttcccag

SEQ ID NO: 5251439 - DNA, 23 bp, Homo sapiens
atcttcttcccttaactccaaga

SEQ ID NO: 5251440 - DNA, 17 bp, Homo sapiens
atcttcttgcatctaat

SEQ ID NO: 5251441 - DNA, 14 bp, Homo sapiens
atcttctttataat

SEQ ID NO: 5251442 - DNA, 21 bp, Homo sapiens
atcttctttcttccacccaca

SEQ ID NO: 5251443 - DNA, 21 bp, Homo sapiens
atcttctttggacttctgaag

SEQ ID NO: 5251444 - DNA, 15 bp, Homo sapiens
atcttcttttgggag

SEQ ID NO: 5251445 - DNA, 15 bp, Homo sapiens
atcttctttttcagg

SEQ ID NO: 5251446 - DNA, 18 bp, Homo sapiens
atcttgaaaatgccacca

SEQ ID NO: 5251447 - DNA, 18 bp, Homo sapiens
atcttgaaacttgtgaaa

SEQ ID NO: 5251448 - DNA, 18 bp, Homo sapiens
atcttgaaatcctggaaa

SEQ ID NO: 5251449 - DNA, 17 bp, Homo sapiens
atcttgaaatgaaagta

SEQ ID NO: 5251450 - DNA, 21 bp, Homo sapiens
atcttgaaattaagaaggcaa

SEQ ID NO: 5251451 - DNA, 20 bp, Homo sapiens
atcttgaaggaaaaattcaa

SEQ ID NO: 5251452 - DNA, 22 bp, Homo sapiens
atcttgaaggaaaaattcaata

SEQ ID NO: 5251453 - DNA, 16 bp, Homo sapiens
atcttgaagtcattgt

SEQ ID NO: 5251454 - DNA, 21 bp, Homo sapiens
atcttgaatactctgccctct

SEQ ID NO: 5251455 - DNA, 21 bp, Homo sapiens
atcttgaatatgggcggaagt

SEQ ID NO: 5251456 - DNA, 16 bp, Homo sapiens
atcttgaatatttgct

SEQ ID NO: 5251457 - DNA, 23 bp, Homo sapiens
atcttgacacggtgaaatccagg

SEQ ID NO: 5251458 - DNA, 14 bp, Homo sapiens
atcttgacatgtaa

SEQ ID NO: 5251459 - DNA, 19 bp, Homo sapiens
atcttgaccaagcaggaag

SEQ ID NO: 5251460 - DNA, 16 bp, Homo sapiens
atcttgactcactgca

SEQ ID NO: 5251461 - DNA, 16 bp, Homo sapiens
atcttgactttctgat

SEQ ID NO: 5251462 - DNA, 15 bp, Homo sapiens
atcttgagaaccttt

SEQ ID NO: 5251463 - DNA, 16 bp, Homo sapiens
atcttgagagagaaat

SEQ ID NO: 5251464 - DNA, 18 bp, Homo sapiens
atcttgagagagaaatgc

SEQ ID NO: 5251465 - DNA, 22 bp, Homo sapiens
atcttgagcaagttccttctgg

SEQ ID NO: 5251466 - DNA, 15 bp, Homo sapiens
atcttgatagctaaa

SEQ ID NO: 5251467 - DNA, 16 bp, Homo sapiens
atcttgatagctaaat

SEQ ID NO: 5251468 - DNA, 15 bp, Homo sapiens
atcttgatcattccg

SEQ ID NO: 5251469 - DNA, 22 bp, Homo sapiens
atcttgatctgctcagccctgg

SEQ ID NO: 5251470 - DNA, 15 bp, Homo sapiens
atcttgatggtgttt

SEQ ID NO: 5251471 - DNA, 15 bp, Homo sapiens
atcttgattaatgta

SEQ ID NO: 5251472 - DNA, 18 bp, Homo sapiens
atcttgattaatgtactt

SEQ ID NO: 5251473 - DNA, 23 bp, Homo sapiens
atcttgattaatgtactttttat

SEQ ID NO: 5251474 - DNA, 23 bp, Homo sapiens
atcttgatttcccaaaaacacta

SEQ ID NO: 5251475 - DNA, 18 bp, Homo sapiens
atcttgcaaatgttgtat

SEQ ID NO: 5251476 - DNA, 17 bp, Homo sapiens
atcttgcagttttgtaa

SEQ ID NO: 5251477 - DNA, 14 bp, Homo sapiens
atcttgcatgtaac

SEQ ID NO: 5251478 - DNA, 15 bp, Homo sapiens
atcttgccacatttc

SEQ ID NO: 5251479 - DNA, 16 bp, Homo sapiens
atcttgcccactggcc

SEQ ID NO: 5251480 - DNA, 24 bp, Homo sapiens
atcttgcccctccagagacaggaa

SEQ ID NO: 5251481 - DNA, 21 bp, Homo sapiens
atcttgcctaaatcccaagaa

SEQ ID NO: 5251482 - DNA, 22 bp, Homo sapiens
atcttgcctaaatcccaagaaa

SEQ ID NO: 5251483 - DNA, 16 bp, Homo sapiens
atcttgcctacttttc

SEQ ID NO: 5251484 - DNA, 19 bp, Homo sapiens
atcttgcctacttttcttt

SEQ ID NO: 5251485 - DNA, 18 bp, Homo sapiens
atcttgcctcattttgct

SEQ ID NO: 5251486 - DNA, 15 bp, Homo sapiens
atcttgcctccaggt

SEQ ID NO: 5251487 - DNA, 20 bp, Homo sapiens
atcttgcctgtctggctcag

SEQ ID NO: 5251488 - DNA, 16 bp, Homo sapiens
atcttgcgaatccaag

SEQ ID NO: 5251489 - DNA, 22 bp, Homo sapiens
atcttgcgaatccaagctccct

SEQ ID NO: 5251490 - DNA, 19 bp, Homo sapiens
atcttgctaccagtattta

SEQ ID NO: 5251491 - DNA, 20 bp, Homo sapiens
atcttgctcattcttcagtt

SEQ ID NO: 5251492 - DNA, 22 bp, Homo sapiens
atcttgctccaataaaggaaca

SEQ ID NO: 5251493 - DNA, 16 bp, Homo sapiens
atcttgctctatctca

SEQ ID NO: 5251494 - DNA, 20 bp, Homo sapiens
atcttgctctatctcacagc

SEQ ID NO: 5251495 - DNA, 23 bp, Homo sapiens
atcttgctctatctcacagcaca

SEQ ID NO: 5251496 - DNA, 15 bp, Homo sapiens
atcttgctctgctga

SEQ ID NO: 5251497 - DNA, 17 bp, Homo sapiens
atcttgctctgctgaca

SEQ ID NO: 5251498 - DNA, 19 bp, Homo sapiens
atcttgctctgctgacaga

SEQ ID NO: 5251499 - DNA, 14 bp, Homo sapiens
atcttgctctgtaa

SEQ ID NO: 5251500 - DNA, 15 bp, Homo sapiens
atcttgctctgtaat

SEQ ID NO: 5251501 - DNA, 17 bp, Homo sapiens
atcttgctctgtaatct

SEQ ID NO: 5251502 - DNA, 14 bp, Homo sapiens
atcttgctctgtgg

SEQ ID NO: 5251503 - DNA, 16 bp, Homo sapiens
atcttgctctgtggcc

SEQ ID NO: 5251504 - DNA, 17 bp, Homo sapiens
atcttgctgcaggccct

SEQ ID NO: 5251505 - DNA, 19 bp, Homo sapiens
atcttgctgcaggccctcc

SEQ ID NO: 5251506 - DNA, 17 bp, Homo sapiens
atcttgctggagaagca

SEQ ID NO: 5251507 - DNA, 21 bp, Homo sapiens
atcttgctggattaatgtttt

SEQ ID NO: 5251508 - DNA, 12 bp, Homo sapiens
atcttgctgtga

SEQ ID NO: 5251509 - DNA, 14 bp, Homo sapiens
atcttgctgtgaaa

SEQ ID NO: 5251510 - DNA, 15 bp, Homo sapiens
atcttgctgtgaaac

SEQ ID NO: 5251511 - DNA, 14 bp, Homo sapiens
atcttgcttcccta

SEQ ID NO: 5251512 - DNA, 23 bp, Homo sapiens
atcttgcttccctaatctatggt

SEQ ID NO: 5251513 - DNA, 19 bp, Homo sapiens
atcttgctttctttagaat

SEQ ID NO: 5251514 - DNA, 23 bp, Homo sapiens
atcttgctttctttgtttggctg

SEQ ID NO: 5251515 - DNA, 14 bp, Homo sapiens
atcttggactgaca

SEQ ID NO: 5251516 - DNA, 16 bp, Homo sapiens
atcttggactgacatt

SEQ ID NO: 5251517 - DNA, 23 bp, Homo sapiens
atcttggagctgcttggacggat

SEQ ID NO: 5251518 - DNA, 23 bp, Homo sapiens
atcttggcacatttaagagacag

SEQ ID NO: 5251519 - DNA, 12 bp, Homo sapiens
atcttggcaggg

SEQ ID NO: 5251520 - DNA, 13 bp, Homo sapiens
atcttggctatgt

SEQ ID NO: 5251521 - DNA, 14 bp, Homo sapiens
atcttggctcactg

SEQ ID NO: 5251522 - DNA, 21 bp, Homo sapiens
atcttggcttaatttaatgta

SEQ ID NO: 5251523 - DNA, 18 bp, Homo sapiens
atcttggcttcttaaaaa

SEQ ID NO: 5251524 - DNA, 19 bp, Homo sapiens
atcttggcttcttaaaaac

SEQ ID NO: 5251525 - DNA, 23 bp, Homo sapiens
atcttgggaacagggttactgta

SEQ ID NO: 5251526 - DNA, 22 bp, Homo sapiens
atcttgggaccaaaactgccta

SEQ ID NO: 5251527 - DNA, 20 bp, Homo sapiens
atcttgggattcctcccctg

SEQ ID NO: 5251528 - DNA, 22 bp, Homo sapiens
atcttggggacatctctttgaa

SEQ ID NO: 5251529 - DNA, 18 bp, Homo sapiens
atcttggggcaagactgc

SEQ ID NO: 5251530 - DNA, 19 bp, Homo sapiens
atcttggggctgatgaaga

SEQ ID NO: 5251531 - DNA, 12 bp, Homo sapiens
atcttgggtgta

SEQ ID NO: 5251532 - DNA, 21 bp, Homo sapiens
atcttggtagttctgtgcctc

SEQ ID NO: 5251533 - DNA, 22 bp, Homo sapiens
atcttggtagttctgtgcctcc

SEQ ID NO: 5251534 - DNA, 22 bp, Homo sapiens
atcttggtcctgtcaccctggc

SEQ ID NO: 5251535 - DNA, 16 bp, Homo sapiens
atcttggtgtaactta

SEQ ID NO: 5251536 - DNA, 19 bp, Homo sapiens
atcttggtgtaacttaaat

SEQ ID NO: 5251537 - DNA, 21 bp, Homo sapiens
atcttggttgatgccaaaaaa

SEQ ID NO: 5251538 - DNA, 14 bp, Homo sapiens
atcttggtttgcct

SEQ ID NO: 5251539 - DNA, 20 bp, Homo sapiens
atcttggtttgccttccaga

SEQ ID NO: 5251540 - DNA, 21 bp, Homo sapiens
atcttgtaagtatttaagtga

SEQ ID NO: 5251541 - DNA, 18 bp, Homo sapiens
atcttgtacaaactttgt

SEQ ID NO: 5251542 - DNA, 15 bp, Homo sapiens
atcttgtagacactt

SEQ ID NO: 5251543 - DNA, 18 bp, Homo sapiens
atcttgtagctttatcaa

SEQ ID NO: 5251544 - DNA, 20 bp, Homo sapiens
atcttgtagctttatcaaag

SEQ ID NO: 5251545 - DNA, 16 bp, Homo sapiens
atcttgtatacacata

SEQ ID NO: 5251546 - DNA, 23 bp, Homo sapiens
atcttgtatttgggccaaggtgt

SEQ ID NO: 5251547 - DNA, 11 bp, Homo sapiens
atcttgtcatg

SEQ ID NO: 5251548 - DNA, 12 bp, Homo sapiens
atcttgtcatgt

SEQ ID NO: 5251549 - DNA, 17 bp, Homo sapiens
atcttgtccccaacacc

SEQ ID NO: 5251550 - DNA, 16 bp, Homo sapiens
atcttgtccctaagta

SEQ ID NO: 5251551 - DNA, 14 bp, Homo sapiens
atcttgtctcaatg

SEQ ID NO: 5251552 - DNA, 16 bp, Homo sapiens
atcttgtctcactagt

SEQ ID NO: 5251553 - DNA, 14 bp, Homo sapiens
atcttgtcttttcc

SEQ ID NO: 5251554 - DNA, 14 bp, Homo sapiens
atcttgtgaaaata

SEQ ID NO: 5251555 - DNA, 15 bp, Homo sapiens
atcttgtgaaaataa

SEQ ID NO: 5251556 - DNA, 20 bp, Homo sapiens
atcttgtgaaatggccagga

SEQ ID NO: 5251557 - DNA, 18 bp, Homo sapiens
atcttgtgagtggataat

SEQ ID NO: 5251558 - DNA, 17 bp, Homo sapiens
atcttgtgcatgcaaaa

SEQ ID NO: 5251559 - DNA, 22 bp, Homo sapiens
atcttgtgctagaatacttttt

SEQ ID NO: 5251560 - DNA, 22 bp, Homo sapiens
atcttgtgctatgaaacaatct

SEQ ID NO: 5251561 - DNA, 22 bp, Homo sapiens
atcttgtgcttcttcacttacc

SEQ ID NO: 5251562 - DNA, 23 bp, Homo sapiens
atcttgtgtgattaacttattta

SEQ ID NO: 5251563 - DNA, 22 bp, Homo sapiens
atcttgtgttaacttgcctcca

SEQ ID NO: 5251564 - DNA, 17 bp, Homo sapiens
atcttgttaaattgctt

SEQ ID NO: 5251565 - DNA, 17 bp, Homo sapiens
atcttgttaatgcattt

SEQ ID NO: 5251566 - DNA, 21 bp, Homo sapiens
atcttgttactgctgattctt

SEQ ID NO: 5251567 - DNA, 18 bp, Homo sapiens
atcttgttattattgtta

SEQ ID NO: 5251568 - DNA, 21 bp, Homo sapiens
atcttgttattgaagtgttct

SEQ ID NO: 5251569 - DNA, 19 bp, Homo sapiens
atcttgttcaggaaaaggt

SEQ ID NO: 5251570 - DNA, 19 bp, Homo sapiens
atcttgttccaaggccagg

SEQ ID NO: 5251571 - DNA, 13 bp, Homo sapiens
atcttgttcttcc

SEQ ID NO: 5251572 - DNA, 16 bp, Homo sapiens
atcttgttctttgctg

SEQ ID NO: 5251573 - DNA, 16 bp, Homo sapiens
atcttgtttatagcaa

SEQ ID NO: 5251574 - DNA, 17 bp, Homo sapiens
atcttgtttatagcaaa

SEQ ID NO: 5251575 - DNA, 17 bp, Homo sapiens
atcttgttttaagcaaa

SEQ ID NO: 5251576 - DNA, 22 bp, Homo sapiens
atcttgttttaagcaaatgcat

SEQ ID NO: 5251577 - DNA, 15 bp, Homo sapiens
atcttgtttttccac

SEQ ID NO: 5251578 - DNA, 20 bp, Homo sapiens
atctttaaaagatgctttta

SEQ ID NO: 5251579 - DNA, 13 bp, Homo sapiens
atctttaaacatt

SEQ ID NO: 5251580 - DNA, 18 bp, Homo sapiens
atctttaaactggctggc

SEQ ID NO: 5251581 - DNA, 20 bp, Homo sapiens
atctttaaagacttgatgaa

SEQ ID NO: 5251582 - DNA, 20 bp, Homo sapiens
atctttaaatacagtcaact

SEQ ID NO: 5251583 - DNA, 11 bp, Homo sapiens
atctttaactg

SEQ ID NO: 5251584 - DNA, 17 bp, Homo sapiens
atctttaactgaactct

SEQ ID NO: 5251585 - DNA, 19 bp, Homo sapiens
atctttaactgaactctga

SEQ ID NO: 5251586 - DNA, 21 bp, Homo sapiens
atctttaagaatgcttaaaaa

SEQ ID NO: 5251587 - DNA, 13 bp, Homo sapiens
atctttaagcaga

SEQ ID NO: 5251588 - DNA, 16 bp, Homo sapiens
atctttaagtattgtt

SEQ ID NO: 5251589 - DNA, 20 bp, Homo sapiens
atctttaataacaatatata

SEQ ID NO: 5251590 - DNA, 14 bp, Homo sapiens
atctttaataagta

SEQ ID NO: 5251591 - DNA, 23 bp, Homo sapiens
atctttaatataatattatactg

SEQ ID NO: 5251592 - DNA, 17 bp, Homo sapiens
atctttacaaaactaca

SEQ ID NO: 5251593 - DNA, 21 bp, Homo sapiens
atctttacaagcaggcactgt

SEQ ID NO: 5251594 - DNA, 14 bp, Homo sapiens
atctttacatctat

SEQ ID NO: 5251595 - DNA, 16 bp, Homo sapiens
atctttaccaaaaacc

SEQ ID NO: 5251596 - DNA, 16 bp, Homo sapiens
atcacctgaattatta

SEQ ID NO: 5251597 - DNA, 19 bp, Homo sapiens
atcacctgaattattaatg

SEQ ID NO: 5251598 - DNA, 12 bp, Homo sapiens
atcacctgaggt

SEQ ID NO: 5251599 - DNA, 12 bp, Homo sapiens
atcacctgccct

SEQ ID NO: 5251600 - DNA, 13 bp, Homo sapiens
atcacctgccctg

SEQ ID NO: 5251601 - DNA, 14 bp, Homo sapiens
atcacctgcctgtt

SEQ ID NO: 5251602 - DNA, 15 bp, Homo sapiens
atcacctgcctgtta

SEQ ID NO: 5251603 - DNA, 14 bp, Homo sapiens
atcacctggagggc

SEQ ID NO: 5251604 - DNA, 12 bp, Homo sapiens
atcacctggctg

SEQ ID NO: 5251605 - DNA, 17 bp, Homo sapiens
atcacctggctgagcag

SEQ ID NO: 5251606 - DNA, 21 bp, Homo sapiens
atcacctggcttgtttatttt

SEQ ID NO: 5251607 - DNA, 13 bp, Homo sapiens
atcacctggtatt

SEQ ID NO: 5251608 - DNA, 14 bp, Homo sapiens
atcacctgtcatca

SEQ ID NO: 5251609 - DNA, 21 bp, Homo sapiens
atcacctgtcttgcctttttc

SEQ ID NO: 5251610 - DNA, 19 bp, Homo sapiens
atcaccttagaccaccaag

SEQ ID NO: 5251611 - DNA, 16 bp, Homo sapiens
atcaccttaggcaggg

SEQ ID NO: 5251612 - DNA, 17 bp, Homo sapiens
atcaccttaggcaggga

SEQ ID NO: 5251613 - DNA, 19 bp, Homo sapiens
atcaccttcctcctgtagt

SEQ ID NO: 5251614 - DNA, 19 bp, Homo sapiens
atcaccttttctaaaaagt

SEQ ID NO: 5251615 - DNA, 20 bp, Homo sapiens
atcaccttttctaaaaagtc

SEQ ID NO: 5251616 - DNA, 18 bp, Homo sapiens
atcacctttttgactttt

SEQ ID NO: 5251617 - DNA, 18 bp, Homo sapiens
atcacgagatcttccttc

SEQ ID NO: 5251618 - DNA, 18 bp, Homo sapiens
atcacgatccagtctgca

SEQ ID NO: 5251619 - DNA, 20 bp, Homo sapiens
atcacgccactgcactccag

SEQ ID NO: 5251620 - DNA, 23 bp, Homo sapiens
atcacgccactgcactccagcct

SEQ ID NO: 5251621 - DNA, 13 bp, Homo sapiens
atcacgctccccg

SEQ ID NO: 5251622 - DNA, 13 bp, Homo sapiens
atcacgctttcct

SEQ ID NO: 5251623 - DNA, 18 bp, Homo sapiens
atcacgctttttgaaaaa

SEQ ID NO: 5251624 - DNA, 18 bp, Homo sapiens
atcacggctcactgcagc

SEQ ID NO: 5251625 - DNA, 19 bp, Homo sapiens
atcacggctcactgcagcc

SEQ ID NO: 5251626 - DNA, 23 bp, Homo sapiens
atcacggcttttggtgaatttgt

SEQ ID NO: 5251627 - DNA, 14 bp, Homo sapiens
atcacgggcccgct

SEQ ID NO: 5251628 - DNA, 15 bp, Homo sapiens
atcacgggcccgctc

SEQ ID NO: 5251629 - DNA, 16 bp, Homo sapiens
atcacgggcccgctca

SEQ ID NO: 5251630 - DNA, 14 bp, Homo sapiens
atcacgtaaagcta

SEQ ID NO: 5251631 - DNA, 19 bp, Homo sapiens
atcacgtgtactggctcct

SEQ ID NO: 5251632 - DNA, 19 bp, Homo sapiens
atcactaaaagcatgaatt

SEQ ID NO: 5251633 - DNA, 20 bp, Homo sapiens
atcactaaaagcatgaattg

SEQ ID NO: 5251634 - DNA, 16 bp, Homo sapiens
atcactaaactttatt

SEQ ID NO: 5251635 - DNA, 21 bp, Homo sapiens
atcactaaactttatttgtaa

SEQ ID NO: 5251636 - DNA, 17 bp, Homo sapiens
atcactaaatatctagt

SEQ ID NO: 5251637 - DNA, 16 bp, Homo sapiens
atcactaacattatat

SEQ ID NO: 5251638 - DNA, 21 bp, Homo sapiens
atcactaacattatattgcaa

SEQ ID NO: 5251639 - DNA, 11 bp, Homo sapiens
atcactaagaa

SEQ ID NO: 5251640 - DNA, 16 bp, Homo sapiens
atcactaagaaagaaa

SEQ ID NO: 5251641 - DNA, 20 bp, Homo sapiens
atcactaagaaagaaaggaa

SEQ ID NO: 5251642 - DNA, 21 bp, Homo sapiens
atcactaagaaagaaaggaaa

SEQ ID NO: 5251643 - DNA, 17 bp, Homo sapiens
atcactaagctgtggct

SEQ ID NO: 5251644 - DNA, 18 bp, Homo sapiens
atcactacaaaaagaaga

SEQ ID NO: 5251645 - DNA, 20 bp, Homo sapiens
atcactacaaaaagaagagt

SEQ ID NO: 5251646 - DNA, 15 bp, Homo sapiens
atcactacagatctc

SEQ ID NO: 5251647 - DNA, 23 bp, Homo sapiens
atcactacctttatagctcatca

SEQ ID NO: 5251648 - DNA, 12 bp, Homo sapiens
atcactactgta

SEQ ID NO: 5251649 - DNA, 14 bp, Homo sapiens
atcactactgtatg

SEQ ID NO: 5251650 - DNA, 17 bp, Homo sapiens
atcactagaagaaaagc

SEQ ID NO: 5251651 - DNA, 17 bp, Homo sapiens
atcactagccctccttt

SEQ ID NO: 5251652 - DNA, 21 bp, Homo sapiens
atcactagtcaagaaaaatat

SEQ ID NO: 5251653 - DNA, 15 bp, Homo sapiens
atcactataaccatc

SEQ ID NO: 5251654 - DNA, 17 bp, Homo sapiens
atcactatgatttctga

SEQ ID NO: 5251655 - DNA, 15 bp, Homo sapiens
atcactatgcatttt

SEQ ID NO: 5251656 - DNA, 16 bp, Homo sapiens
atcactattcagaaga

SEQ ID NO: 5251657 - DNA, 17 bp, Homo sapiens
atcactattcttaagca

SEQ ID NO: 5251658 - DNA, 22 bp, Homo sapiens
atcactattcttaagcactttg

SEQ ID NO: 5251659 - DNA, 19 bp, Homo sapiens
atcactattgggcccccag

SEQ ID NO: 5251660 - DNA, 23 bp, Homo sapiens
atcactcaaccataacacttgat

SEQ ID NO: 5251661 - DNA, 16 bp, Homo sapiens
atcactcaagatgcct

SEQ ID NO: 5251662 - DNA, 23 bp, Homo sapiens
atcactcactcactccccactcc

SEQ ID NO: 5251663 - DNA, 18 bp, Homo sapiens
atcactcagagcagtctg

SEQ ID NO: 5251664 - DNA, 13 bp, Homo sapiens
atcactcagcccc

SEQ ID NO: 5251665 - DNA, 14 bp, Homo sapiens
atcactcatttatt

SEQ ID NO: 5251666 - DNA, 21 bp, Homo sapiens
atcactcccagcactcccctt

SEQ ID NO: 5251667 - DNA, 23 bp, Homo sapiens
atcactcccagcactccccttgc

SEQ ID NO: 5251668 - DNA, 14 bp, Homo sapiens
atcactcccctcca

SEQ ID NO: 5251669 - DNA, 13 bp, Homo sapiens
atcactccctgga

SEQ ID NO: 5251670 - DNA, 16 bp, Homo sapiens
atcactcctggaggct

SEQ ID NO: 5251671 - DNA, 16 bp, Homo sapiens
atcactctaaaaaaca

SEQ ID NO: 5251672 - DNA, 22 bp, Homo sapiens
atcactctaaaaaacattttta

SEQ ID NO: 5251673 - DNA, 18 bp, Homo sapiens
atcactctgcaatggaaa

SEQ ID NO: 5251674 - DNA, 21 bp, Homo sapiens
atcactctgttcattcctcca

SEQ ID NO: 5251675 - DNA, 23 bp, Homo sapiens
atcactcttgtactgcctgccac

SEQ ID NO: 5251676 - DNA, 16 bp, Homo sapiens
atcactcttgtggatg

SEQ ID NO: 5251677 - DNA, 22 bp, Homo sapiens
atcactgaaaaaatgtagcttt

SEQ ID NO: 5251678 - DNA, 15 bp, Homo sapiens
atcactgaaaactat

SEQ ID NO: 5251679 - DNA, 12 bp, Homo sapiens
atcactgaaaca

SEQ ID NO: 5251680 - DNA, 19 bp, Homo sapiens
atcactgaaacaaaaattg

SEQ ID NO: 5251681 - DNA, 22 bp, Homo sapiens
atcactgaaacctttaagaaaa

SEQ ID NO: 5251682 - DNA, 12 bp, Homo sapiens
atcactgaaata

SEQ ID NO: 5251683 - DNA, 19 bp, Homo sapiens
atcactgaacctctcagga

SEQ ID NO: 5251684 - DNA, 13 bp, Homo sapiens
atcactgagaaga

SEQ ID NO: 5251685 - DNA, 17 bp, Homo sapiens
atcactgagccatcatt

SEQ ID NO: 5251686 - DNA, 15 bp, Homo sapiens
atcactgagttttcc

SEQ ID NO: 5251687 - DNA, 18 bp, Homo sapiens
atcactgagttttccatg

SEQ ID NO: 5251688 - DNA, 16 bp, Homo sapiens
atcactgatgggaata

SEQ ID NO: 5251689 - DNA, 21 bp, Homo sapiens
atcactgatgggaataaaagt

SEQ ID NO: 5251690 - DNA, 17 bp, Homo sapiens
atcactgattccctctc

SEQ ID NO: 5251691 - DNA, 11 bp, Homo sapiens
atcactgcagc

SEQ ID NO: 5251692 - DNA, 18 bp, Homo sapiens
atcactgcagtcacctct

SEQ ID NO: 5251693 - DNA, 12 bp, Homo sapiens
atcactgccaca

SEQ ID NO: 5251694 - DNA, 21 bp, Homo sapiens
atcactgccacactctccatc

SEQ ID NO: 5251695 - DNA, 21 bp, Homo sapiens
atcactgccagagataaacta

SEQ ID NO: 5251696 - DNA, 23 bp, Homo sapiens
atcactgccagagataaactaat

SEQ ID NO: 5251697 - DNA, 17 bp, Homo sapiens
atcactgccttcgttta

SEQ ID NO: 5251698 - DNA, 20 bp, Homo sapiens
atcactgccttcgtttatat

SEQ ID NO: 5251699 - DNA, 18 bp, Homo sapiens
atcactgctccaggcctg

SEQ ID NO: 5251700 - DNA, 14 bp, Homo sapiens
atcactgctgctgg

SEQ ID NO: 5251701 - DNA, 19 bp, Homo sapiens
atcactgctgtccctcctg

SEQ ID NO: 5251702 - DNA, 12 bp, Homo sapiens
atcactggactg

SEQ ID NO: 5251703 - DNA, 18 bp, Homo sapiens
atcactggactgcatggg

SEQ ID NO: 5251704 - DNA, 10 bp, Homo sapiens
atcactggag

SEQ ID NO: 5251705 - DNA, 12 bp, Homo sapiens
atcactggagcc

SEQ ID NO: 5251706 - DNA, 13 bp, Homo sapiens
atcactggagccc

SEQ ID NO: 5251707 - DNA, 15 bp, Homo sapiens
atcactggagcccag

SEQ ID NO: 5251708 - DNA, 17 bp, Homo sapiens
atcactggagcccagga

SEQ ID NO: 5251709 - DNA, 18 bp, Homo sapiens
atcactggcaatgaaaaa

SEQ ID NO: 5251710 - DNA, 17 bp, Homo sapiens
atcactggcatggtggt

SEQ ID NO: 5251711 - DNA, 20 bp, Homo sapiens
atcactggctggcctgagca

SEQ ID NO: 5251712 - DNA, 18 bp, Homo sapiens
atcactgggcccagagga

SEQ ID NO: 5251713 - DNA, 20 bp, Homo sapiens
atcactggggatggtggcac

SEQ ID NO: 5251714 - DNA, 12 bp, Homo sapiens
atcactgtaaag

SEQ ID NO: 5251715 - DNA, 14 bp, Homo sapiens
atcactgtaaagac

SEQ ID NO: 5251716 - DNA, 18 bp, Homo sapiens
atcactgtagtctaagac

SEQ ID NO: 5251717 - DNA, 23 bp, Homo sapiens
atcactgtagtttagttctgttg

SEQ ID NO: 5251718 - DNA, 16 bp, Homo sapiens
atcactgtcaatattt

SEQ ID NO: 5251719 - DNA, 12 bp, Homo sapiens
atcactgtcttt

SEQ ID NO: 5251720 - DNA, 15 bp, Homo sapiens
atcactgtctttcct

SEQ ID NO: 5251721 - DNA, 19 bp, Homo sapiens
atcactgtctttcctagat

SEQ ID NO: 5251722 - DNA, 21 bp, Homo sapiens
atcactgtctttcctagatgg

SEQ ID NO: 5251723 - DNA, 21 bp, Homo sapiens
atcactgtctttgactgtgat

SEQ ID NO: 5251724 - DNA, 17 bp, Homo sapiens
atcactgtgaaaattga

SEQ ID NO: 5251725 - DNA, 13 bp, Homo sapiens
atcactgtgaaat

SEQ ID NO: 5251726 - DNA, 18 bp, Homo sapiens
atcactgtgaaatttcat

SEQ ID NO: 5251727 - DNA, 21 bp, Homo sapiens
atcactgtgaaatttcatgat

SEQ ID NO: 5251728 - DNA, 22 bp, Homo sapiens
atcactgtgaaccaacccccat

SEQ ID NO: 5251729 - DNA, 18 bp, Homo sapiens
atcactgtgctcagccac

SEQ ID NO: 5251730 - DNA, 16 bp, Homo sapiens
atcactgtggctgtct

SEQ ID NO: 5251731 - DNA, 17 bp, Homo sapiens
atcactgtggctgtctg

SEQ ID NO: 5251732 - DNA, 19 bp, Homo sapiens
atcactgtgtatatttgat

SEQ ID NO: 5251733 - DNA, 16 bp, Homo sapiens
atcactgtgtctcatg

SEQ ID NO: 5251734 - DNA, 20 bp, Homo sapiens
atcactgttgagttctgatt

SEQ ID NO: 5251735 - DNA, 20 bp, Homo sapiens
atcactgttgctttgaaaaa

SEQ ID NO: 5251736 - DNA, 20 bp, Homo sapiens
atcactgtttagaacacaca

SEQ ID NO: 5251737 - DNA, 15 bp, Homo sapiens
atcactgtttagatt

SEQ ID NO: 5251738 - DNA, 12 bp, Homo sapiens
atcactgtttgt

SEQ ID NO: 5251739 - DNA, 13 bp, Homo sapiens
atcacttaaaaca

SEQ ID NO: 5251740 - DNA, 18 bp, Homo sapiens
atcacttaaaacacgttt

SEQ ID NO: 5251741 - DNA, 22 bp, Homo sapiens
atcacttaaaacttttaaaact

SEQ ID NO: 5251742 - DNA, 20 bp, Homo sapiens
atcacttaaaggcacaaata

SEQ ID NO: 5251743 - DNA, 14 bp, Homo sapiens
atcacttaaagtca

SEQ ID NO: 5251744 - DNA, 15 bp, Homo sapiens
atcacttaacattcc

SEQ ID NO: 5251745 - DNA, 14 bp, Homo sapiens
atcacttaagcctg

SEQ ID NO: 5251746 - DNA, 20 bp, Homo sapiens
atcacttaatttgaaatcta

SEQ ID NO: 5251747 - DNA, 16 bp, Homo sapiens
atcacttacatttttg

SEQ ID NO: 5251748 - DNA, 18 bp, Homo sapiens
atcacttactatccattt

SEQ ID NO: 5251749 - DNA, 19 bp, Homo sapiens
atcacttagcgaacccttt

SEQ ID NO: 5251750 - DNA, 17 bp, Homo sapiens
atcacttcatacttcta

SEQ ID NO: 5251751 - DNA, 16 bp, Homo sapiens
atcacttcatgttttg

SEQ ID NO: 5251752 - DNA, 23 bp, Homo sapiens
atcacttgaacccgggaggcaga

SEQ ID NO: 5251753 - DNA, 14 bp, Homo sapiens
atcacttgtaaata

SEQ ID NO: 5251754 - DNA, 16 bp, Homo sapiens
atcacttgtaaataaa

SEQ ID NO: 5251755 - DNA, 14 bp, Homo sapiens
atcacttgtacaaa

SEQ ID NO: 5251756 - DNA, 22 bp, Homo sapiens
atcacttgtcaataaaatccat

SEQ ID NO: 5251757 - DNA, 19 bp, Homo sapiens
atcacttgtcctcttgcca

SEQ ID NO: 5251758 - DNA, 13 bp, Homo sapiens
atcacttgttgtt

SEQ ID NO: 5251759 - DNA, 15 bp, Homo sapiens
atcactttaagtttt

SEQ ID NO: 5251760 - DNA, 20 bp, Homo sapiens
atcactttacctgcaggctc

SEQ ID NO: 5251761 - DNA, 18 bp, Homo sapiens
atcactttctcagttttc

SEQ ID NO: 5251762 - DNA, 20 bp, Homo sapiens
atcactttgagcctgggaaa

SEQ ID NO: 5251763 - DNA, 23 bp, Homo sapiens
atcactttgagcctgggaaataa

SEQ ID NO: 5251764 - DNA, 12 bp, Homo sapiens
atcactttggtc

SEQ ID NO: 5251765 - DNA, 15 bp, Homo sapiens
atcactttgtattct

SEQ ID NO: 5251766 - DNA, 16 bp, Homo sapiens
atcactttgtattctc

SEQ ID NO: 5251767 - DNA, 16 bp, Homo sapiens
atcactttgttaaaaa

SEQ ID NO: 5251768 - DNA, 13 bp, Homo sapiens
atcactttttaaa

SEQ ID NO: 5251769 - DNA, 17 bp, Homo sapiens
atcactttttgaactaa

SEQ ID NO: 5251770 - DNA, 22 bp, Homo sapiens
atcactttttgaactaagaaac

SEQ ID NO: 5251771 - DNA, 16 bp, Homo sapiens
atcactttttggaatt

SEQ ID NO: 5251772 - DNA, 23 bp, Homo sapiens
atcagaaaacagggtccaggaat

SEQ ID NO: 5251773 - DNA, 13 bp, Homo sapiens
atcagaaaaccaa

SEQ ID NO: 5251774 - DNA, 20 bp, Homo sapiens
atcagaaaagctattaaagt

SEQ ID NO: 5251775 - DNA, 19 bp, Homo sapiens
atctttacgtactgtaact

SEQ ID NO: 5251776 - DNA, 23 bp, Homo sapiens
atctttacgtactgtaactgctc

SEQ ID NO: 5251777 - DNA, 21 bp, Homo sapiens
atctttagcagtttcctcagt

SEQ ID NO: 5251778 - DNA, 15 bp, Homo sapiens
atctttataaatgta

SEQ ID NO: 5251779 - DNA, 16 bp, Homo sapiens
atctttatacagattt

SEQ ID NO: 5251780 - DNA, 19 bp, Homo sapiens
atctttatatttcaataaa

SEQ ID NO: 5251781 - DNA, 22 bp, Homo sapiens
atctttatcctaaaaatctgga

SEQ ID NO: 5251782 - DNA, 15 bp, Homo sapiens
atctttatctcctgg

SEQ ID NO: 5251783 - DNA, 13 bp, Homo sapiens
atctttatgctgt

SEQ ID NO: 5251784 - DNA, 15 bp, Homo sapiens
atctttatgctgtat

SEQ ID NO: 5251785 - DNA, 12 bp, Homo sapiens
atctttattaaa

SEQ ID NO: 5251786 - DNA, 13 bp, Homo sapiens
atctttattaaaa

SEQ ID NO: 5251787 - DNA, 21 bp, Homo sapiens
atctttattatggaaaacatt

SEQ ID NO: 5251788 - DNA, 15 bp, Homo sapiens
atctttattcaaact

SEQ ID NO: 5251789 - DNA, 17 bp, Homo sapiens
atctttattcaaacttt

SEQ ID NO: 5251790 - DNA, 16 bp, Homo sapiens
atctttattgagaaag

SEQ ID NO: 5251791 - DNA, 14 bp, Homo sapiens
atctttattggctt

SEQ ID NO: 5251792 - DNA, 20 bp, Homo sapiens
atctttattttattattcag

SEQ ID NO: 5251793 - DNA, 12 bp, Homo sapiens
atctttcaatat

SEQ ID NO: 5251794 - DNA, 13 bp, Homo sapiens
atctttcaccttt

SEQ ID NO: 5251795 - DNA, 14 bp, Homo sapiens
atctttcacttgaa

SEQ ID NO: 5251796 - DNA, 21 bp, Homo sapiens
atctttcagaaataaaagtat

SEQ ID NO: 5251797 - DNA, 17 bp, Homo sapiens
atctttcagaaatataa

SEQ ID NO: 5251798 - DNA, 22 bp, Homo sapiens
atctttcagaaatataacacat

SEQ ID NO: 5251799 - DNA, 19 bp, Homo sapiens
atctttcagaatacaattc

SEQ ID NO: 5251800 - DNA, 17 bp, Homo sapiens
atctttcatacatatat

SEQ ID NO: 5251801 - DNA, 17 bp, Homo sapiens
atctttcatagttctgt

SEQ ID NO: 5251802 - DNA, 16 bp, Homo sapiens
atctttcatatggtag

SEQ ID NO: 5251803 - DNA, 23 bp, Homo sapiens
atctttcatatggtaggaaccaa

SEQ ID NO: 5251804 - DNA, 12 bp, Homo sapiens
atctttcatttc

SEQ ID NO: 5251805 - DNA, 22 bp, Homo sapiens
atctttcatttcgtatttctca

SEQ ID NO: 5251806 - DNA, 22 bp, Homo sapiens
atctttcattttgcacctgcag

SEQ ID NO: 5251807 - DNA, 12 bp, Homo sapiens
atctttccaaat

SEQ ID NO: 5251808 - DNA, 12 bp, Homo sapiens
atctttccagtt

SEQ ID NO: 5251809 - DNA, 18 bp, Homo sapiens
atctttccctaaagaaga

SEQ ID NO: 5251810 - DNA, 12 bp, Homo sapiens
atctttccctcc

SEQ ID NO: 5251811 - DNA, 13 bp, Homo sapiens
atctttccctcct

SEQ ID NO: 5251812 - DNA, 14 bp, Homo sapiens
atctttccctcctt

SEQ ID NO: 5251813 - DNA, 17 bp, Homo sapiens
atctttccctccttggt

SEQ ID NO: 5251814 - DNA, 13 bp, Homo sapiens
atctttccctctt

SEQ ID NO: 5251815 - DNA, 22 bp, Homo sapiens
atctttccctcttcggtgttct

SEQ ID NO: 5251816 - DNA, 22 bp, Homo sapiens
atctttcctagtacattttcac

SEQ ID NO: 5251817 - DNA, 11 bp, Homo sapiens
atctttcctcc

SEQ ID NO: 5251818 - DNA, 19 bp, Homo sapiens
atctttcctccaaactcct

SEQ ID NO: 5251819 - DNA, 18 bp, Homo sapiens
atctttcctcttctcatt

SEQ ID NO: 5251820 - DNA, 12 bp, Homo sapiens
atctttcctgtc

SEQ ID NO: 5251821 - DNA, 18 bp, Homo sapiens
atctttccttgtctctca

SEQ ID NO: 5251822 - DNA, 15 bp, Homo sapiens
atctttcctttgctc

SEQ ID NO: 5251823 - DNA, 16 bp, Homo sapiens
atctttcggtctcctt

SEQ ID NO: 5251824 - DNA, 24 bp, Homo sapiens
atctttcgttggttgtttctctga

SEQ ID NO: 5251825 - DNA, 15 bp, Homo sapiens
atctttctacagaga

SEQ ID NO: 5251826 - DNA, 21 bp, Homo sapiens
atctttctagcagcagatctg

SEQ ID NO: 5251827 - DNA, 18 bp, Homo sapiens
atctttctatataaaatg

SEQ ID NO: 5251828 - DNA, 23 bp, Homo sapiens
atctttctatataaaatgtattc

SEQ ID NO: 5251829 - DNA, 16 bp, Homo sapiens
atctttctatgctgct

SEQ ID NO: 5251830 - DNA, 13 bp, Homo sapiens
atctttctcatta

SEQ ID NO: 5251831 - DNA, 18 bp, Homo sapiens
atctttctcattaccagt

SEQ ID NO: 5251832 - DNA, 19 bp, Homo sapiens
atctttctccctcaactga

SEQ ID NO: 5251833 - DNA, 18 bp, Homo sapiens
atctttctcttccctgaa

SEQ ID NO: 5251834 - DNA, 21 bp, Homo sapiens
atctttctgcacacaaatatt

SEQ ID NO: 5251835 - DNA, 13 bp, Homo sapiens
atctttctgggag

SEQ ID NO: 5251836 - DNA, 11 bp, Homo sapiens
atctttcttct

SEQ ID NO: 5251837 - DNA, 13 bp, Homo sapiens
atctttcttgatc

SEQ ID NO: 5251838 - DNA, 14 bp, Homo sapiens
atctttctttacct

SEQ ID NO: 5251839 - DNA, 18 bp, Homo sapiens
atctttctttacctgaga

SEQ ID NO: 5251840 - DNA, 22 bp, Homo sapiens
atctttctttacctgagaccag

SEQ ID NO: 5251841 - DNA, 13 bp, Homo sapiens
atctttctttcca

SEQ ID NO: 5251842 - DNA, 15 bp, Homo sapiens
atctttctttccaaa

SEQ ID NO: 5251843 - DNA, 22 bp, Homo sapiens
atctttctttccaaaacatttc

SEQ ID NO: 5251844 - DNA, 20 bp, Homo sapiens
atctttctttcttagaaatt

SEQ ID NO: 5251845 - DNA, 18 bp, Homo sapiens
atctttctttttaagaaa

SEQ ID NO: 5251846 - DNA, 15 bp, Homo sapiens
atctttgaaaagaaa

SEQ ID NO: 5251847 - DNA, 21 bp, Homo sapiens
atctttgaacttctgactact

SEQ ID NO: 5251848 - DNA, 21 bp, Homo sapiens
atctttgacatggtgccttag

SEQ ID NO: 5251849 - DNA, 15 bp, Homo sapiens
atctttgacctcaat

SEQ ID NO: 5251850 - DNA, 13 bp, Homo sapiens
atctttgagacca

SEQ ID NO: 5251851 - DNA, 20 bp, Homo sapiens
atctttgagggctgacaagg

SEQ ID NO: 5251852 - DNA, 19 bp, Homo sapiens
atctttgagtgtattctat

SEQ ID NO: 5251853 - DNA, 16 bp, Homo sapiens
atctttgattcagaca

SEQ ID NO: 5251854 - DNA, 15 bp, Homo sapiens
atctttgattctcct

SEQ ID NO: 5251855 - DNA, 20 bp, Homo sapiens
atctttgcaagaaagtcaga

SEQ ID NO: 5251856 - DNA, 12 bp, Homo sapiens
atctttgcactg

SEQ ID NO: 5251857 - DNA, 19 bp, Homo sapiens
atctttgcaggttgctttg

SEQ ID NO: 5251858 - DNA, 14 bp, Homo sapiens
atctttgccaccct

SEQ ID NO: 5251859 - DNA, 15 bp, Homo sapiens
atctttgctcccagt

SEQ ID NO: 5251860 - DNA, 21 bp, Homo sapiens
atctttgctgttattgacagc

SEQ ID NO: 5251861 - DNA, 22 bp, Homo sapiens
atctttggacagaagcagctct

SEQ ID NO: 5251862 - DNA, 23 bp, Homo sapiens
atctttggacagaagcagctctt

SEQ ID NO: 5251863 - DNA, 12 bp, Homo sapiens
atctttgtaaat

SEQ ID NO: 5251864 - DNA, 16 bp, Homo sapiens
atctttgtaaatgcat

SEQ ID NO: 5251865 - DNA, 21 bp, Homo sapiens
atctttgtaccaaaattttaa

SEQ ID NO: 5251866 - DNA, 19 bp, Homo sapiens
atctttgtgaacattctgt

SEQ ID NO: 5251867 - DNA, 12 bp, Homo sapiens
atctttgtgaag

SEQ ID NO: 5251868 - DNA, 13 bp, Homo sapiens
atctttgtgaagg

SEQ ID NO: 5251869 - DNA, 21 bp, Homo sapiens
atctttgtgacaggaaagccc

SEQ ID NO: 5251870 - DNA, 13 bp, Homo sapiens
atctttgtggcca

SEQ ID NO: 5251871 - DNA, 23 bp, Homo sapiens
atctttgtggccaaggagctgct

SEQ ID NO: 5251872 - DNA, 18 bp, Homo sapiens
atctttgtggtttagttt

SEQ ID NO: 5251873 - DNA, 12 bp, Homo sapiens
atctttgttaaa

SEQ ID NO: 5251874 - DNA, 18 bp, Homo sapiens
atctttgttaaaatatag

SEQ ID NO: 5251875 - DNA, 21 bp, Homo sapiens
atctttgttaaggtcctgaaa

SEQ ID NO: 5251876 - DNA, 21 bp, Homo sapiens
atctttgttggctcagaaaat

SEQ ID NO: 5251877 - DNA, 18 bp, Homo sapiens
atctttgtttaaatgcca

SEQ ID NO: 5251878 - DNA, 17 bp, Homo sapiens
atcttttaaaatcatga

SEQ ID NO: 5251879 - DNA, 17 bp, Homo sapiens
atcttttaaagtgttac

SEQ ID NO: 5251880 - DNA, 18 bp, Homo sapiens
atcttttaaagtgttact

SEQ ID NO: 5251881 - DNA, 22 bp, Homo sapiens
atcttttaaagtgttacttttt

SEQ ID NO: 5251882 - DNA, 14 bp, Homo sapiens
atcttttaaattgc

SEQ ID NO: 5251883 - DNA, 22 bp, Homo sapiens
atcttttaaattgcaatatata

SEQ ID NO: 5251884 - DNA, 15 bp, Homo sapiens
atcttttacattttt

SEQ ID NO: 5251885 - DNA, 14 bp, Homo sapiens
atcttttagaagtg

SEQ ID NO: 5251886 - DNA, 20 bp, Homo sapiens
atcttttaggggaagtgaca

SEQ ID NO: 5251887 - DNA, 13 bp, Homo sapiens
atcttttataatg

SEQ ID NO: 5251888 - DNA, 13 bp, Homo sapiens
atcttttatgatt

SEQ ID NO: 5251889 - DNA, 18 bp, Homo sapiens
atcttttatgtttgaata

SEQ ID NO: 5251890 - DNA, 14 bp, Homo sapiens
atcttttattttgc

SEQ ID NO: 5251891 - DNA, 21 bp, Homo sapiens
atcttttcaaaggtacttgga

SEQ ID NO: 5251892 - DNA, 18 bp, Homo sapiens
atcttttcatttatcaag

SEQ ID NO: 5251893 - DNA, 17 bp, Homo sapiens
atcttttccacaaatat

SEQ ID NO: 5251894 - DNA, 19 bp, Homo sapiens
atcttttccacaaatatga

SEQ ID NO: 5251895 - DNA, 14 bp, Homo sapiens
atcttttctaatca

SEQ ID NO: 5251896 - DNA, 20 bp, Homo sapiens
atcttttctaatcacagtgt

SEQ ID NO: 5251897 - DNA, 20 bp, Homo sapiens
atcttttctacagcaaattt

SEQ ID NO: 5251898 - DNA, 22 bp, Homo sapiens
atcttttctttaaaataaaaaa

SEQ ID NO: 5251899 - DNA, 22 bp, Homo sapiens
atcttttctttagagaactgaa

SEQ ID NO: 5251900 - DNA, 17 bp, Homo sapiens
atcttttgaattcttga

SEQ ID NO: 5251901 - DNA, 19 bp, Homo sapiens
atcttttgacctgtggtgc

SEQ ID NO: 5251902 - DNA, 20 bp, Homo sapiens
atcttttggaagttttgcta

SEQ ID NO: 5251903 - DNA, 16 bp, Homo sapiens
atcttttgggaagcca

SEQ ID NO: 5251904 - DNA, 14 bp, Homo sapiens
atcttttgggggaa

SEQ ID NO: 5251905 - DNA, 18 bp, Homo sapiens
atcttttggtggagtcag

SEQ ID NO: 5251906 - DNA, 14 bp, Homo sapiens
atcttttggttatt

SEQ ID NO: 5251907 - DNA, 13 bp, Homo sapiens
atcttttgtaaat

SEQ ID NO: 5251908 - DNA, 15 bp, Homo sapiens
atcttttgtatagtt

SEQ ID NO: 5251909 - DNA, 21 bp, Homo sapiens
atcttttgtatatctaagact

SEQ ID NO: 5251910 - DNA, 13 bp, Homo sapiens
atcttttgtatta

SEQ ID NO: 5251911 - DNA, 16 bp, Homo sapiens
atcttttgtattaaga

SEQ ID NO: 5251912 - DNA, 22 bp, Homo sapiens
atcttttgtattaagaaaggaa

SEQ ID NO: 5251913 - DNA, 15 bp, Homo sapiens
atcttttgttctcct

SEQ ID NO: 5251914 - DNA, 11 bp, Homo sapiens
atctttttaaa

SEQ ID NO: 5251915 - DNA, 13 bp, Homo sapiens
atctttttaaaaa

SEQ ID NO: 5251916 - DNA, 15 bp, Homo sapiens
atctttttaaaacta

SEQ ID NO: 5251917 - DNA, 21 bp, Homo sapiens
atctttttaacctctgttcag

SEQ ID NO: 5251918 - DNA, 12 bp, Homo sapiens
atctttttacag

SEQ ID NO: 5251919 - DNA, 18 bp, Homo sapiens
atctttttaggccacctc

SEQ ID NO: 5251920 - DNA, 13 bp, Homo sapiens
atctttttataca

SEQ ID NO: 5251921 - DNA, 16 bp, Homo sapiens
atctttttatacacaa

SEQ ID NO: 5251922 - DNA, 15 bp, Homo sapiens
atctttttatgcaaa

SEQ ID NO: 5251923 - DNA, 13 bp, Homo sapiens
atctttttcactg

SEQ ID NO: 5251924 - DNA, 13 bp, Homo sapiens
atctttttcatca

SEQ ID NO: 5251925 - DNA, 18 bp, Homo sapiens
atctttttccagcttgag

SEQ ID NO: 5251926 - DNA, 14 bp, Homo sapiens
atctttttcttggg

SEQ ID NO: 5251927 - DNA, 15 bp, Homo sapiens
atctttttcttgggt

SEQ ID NO: 5251928 - DNA, 16 bp, Homo sapiens
atctttttctttttaa

SEQ ID NO: 5251929 - DNA, 15 bp, Homo sapiens
atctttttgaccctc

SEQ ID NO: 5251930 - DNA, 21 bp, Homo sapiens
atctttttgaccctcattctt

SEQ ID NO: 5251931 - DNA, 13 bp, Homo sapiens
atctttttgcttc

SEQ ID NO: 5251932 - DNA, 22 bp, Homo sapiens
atctttttgcttctactttcat

SEQ ID NO: 5251933 - DNA, 18 bp, Homo sapiens
atcttttttagcataaaa

SEQ ID NO: 5251934 - DNA, 21 bp, Homo sapiens
atcttttttagtgttaaagag

SEQ ID NO: 5251935 - DNA, 14 bp, Homo sapiens
atcttttttataac

SEQ ID NO: 5251936 - DNA, 17 bp, Homo sapiens
atcttttttcacaaatt

SEQ ID NO: 5251937 - DNA, 23 bp, Homo sapiens
atcttttttctaaacctgtgcct

SEQ ID NO: 5251938 - DNA, 21 bp, Homo sapiens
atcttttttgttaactgattt

SEQ ID NO: 5251939 - DNA, 23 bp, Homo sapiens
atctttttttcatttttaaatgt

SEQ ID NO: 5251940 - DNA, 23 bp, Homo sapiens
atcttttttttatataaatatat

SEQ ID NO: 5251941 - DNA, 20 bp, Homo sapiens
atcttttttttattccacat

SEQ ID NO: 5251942 - DNA, 18 bp, Homo sapiens
atgaaaaaaaaaaacaat

SEQ ID NO: 5251943 - DNA, 16 bp, Homo sapiens
atgaaaaaaaaagggg

SEQ ID NO: 5251944 - DNA, 17 bp, Homo sapiens
atgaaaaaaagggaaaa

SEQ ID NO: 5251945 - DNA, 15 bp, Homo sapiens
atgaaaaaaatatat

SEQ ID NO: 5251946 - DNA, 18 bp, Homo sapiens
atgaaaaaaatgatctat

SEQ ID NO: 5251947 - DNA, 22 bp, Homo sapiens
atgaaaaaatatatatcaaata

SEQ ID NO: 5251948 - DNA, 23 bp, Homo sapiens
atgaaaaaatatatatcaaatat

SEQ ID NO: 5251949 - DNA, 14 bp, Homo sapiens
atgaaaaaatgttc

SEQ ID NO: 5251950 - DNA, 20 bp, Homo sapiens
atgaaaaacaaaaataacat

SEQ ID NO: 5251951 - DNA, 17 bp, Homo sapiens
atgaaaaactatgtcag

SEQ ID NO: 5251952 - DNA, 23 bp, Homo sapiens
atgaaaaagaataaaaacttttg

SEQ ID NO: 5251953 - DNA, 15 bp, Homo sapiens
atgaaaaagattatt

SEQ ID NO: 5251954 - DNA, 14 bp, Homo sapiens
atgaaaaatacttt

SEQ ID NO: 5251955 - DNA, 15 bp, Homo sapiens
atcagaaaagggaag

SEQ ID NO: 5251956 - DNA, 11 bp, Homo sapiens
atcagaaaagt

SEQ ID NO: 5251957 - DNA, 15 bp, Homo sapiens
atcagaaaagtagaa

SEQ ID NO: 5251958 - DNA, 21 bp, Homo sapiens
atcagaaaagtagaattatat

SEQ ID NO: 5251959 - DNA, 23 bp, Homo sapiens
atcagaaaagtagaattatatct

SEQ ID NO: 5251960 - DNA, 12 bp, Homo sapiens
atcagaaacagt

SEQ ID NO: 5251961 - DNA, 13 bp, Homo sapiens
atcagaaagacat

SEQ ID NO: 5251962 - DNA, 15 bp, Homo sapiens
atcagaaagggaggg

SEQ ID NO: 5251963 - DNA, 15 bp, Homo sapiens
atcagaaatacagat

SEQ ID NO: 5251964 - DNA, 14 bp, Homo sapiens
atcagaaataggaa

SEQ ID NO: 5251965 - DNA, 14 bp, Homo sapiens
atcagaaattttct

SEQ ID NO: 5251966 - DNA, 18 bp, Homo sapiens
atcagaaattttctacag

SEQ ID NO: 5251967 - DNA, 13 bp, Homo sapiens
atcagaacagcag

SEQ ID NO: 5251968 - DNA, 13 bp, Homo sapiens
atcagaacagctg

SEQ ID NO: 5251969 - DNA, 21 bp, Homo sapiens
atcagaacattcagctctgga

SEQ ID NO: 5251970 - DNA, 22 bp, Homo sapiens
atcagaacattcagctctggag

SEQ ID NO: 5251971 - DNA, 23 bp, Homo sapiens
atcagaacattcagctctggaga

SEQ ID NO: 5251972 - DNA, 16 bp, Homo sapiens
atcagaacctgagcta

SEQ ID NO: 5251973 - DNA, 19 bp, Homo sapiens
atcagaactcctttctaag

SEQ ID NO: 5251974 - DNA, 21 bp, Homo sapiens
atcagaactgggaaaacagtg

SEQ ID NO: 5251975 - DNA, 12 bp, Homo sapiens
atcagaagagag

SEQ ID NO: 5251976 - DNA, 15 bp, Homo sapiens
atcagaagcaaggaa

SEQ ID NO: 5251977 - DNA, 16 bp, Homo sapiens
atcagaagcaaggaag

SEQ ID NO: 5251978 - DNA, 17 bp, Homo sapiens
atcagaagcctattgta

SEQ ID NO: 5251979 - DNA, 18 bp, Homo sapiens
atcagaagcctattgtaa

SEQ ID NO: 5251980 - DNA, 15 bp, Homo sapiens
atcagaaggctgggg

SEQ ID NO: 5251981 - DNA, 20 bp, Homo sapiens
atcagaaggctggggccagt

SEQ ID NO: 5251982 - DNA, 14 bp, Homo sapiens
atcagaagtaggaa

SEQ ID NO: 5251983 - DNA, 17 bp, Homo sapiens
atcagaagtaggaagga

SEQ ID NO: 5251984 - DNA, 21 bp, Homo sapiens
atcagaagtaggaaggaaaaa

SEQ ID NO: 5251985 - DNA, 22 bp, Homo sapiens
atcagaagtaggaaggaaaaaa

SEQ ID NO: 5251986 - DNA, 22 bp, Homo sapiens
atcagaagtatatctgtacaga

SEQ ID NO: 5251987 - DNA, 19 bp, Homo sapiens
atcagaagtcatcttgcta

SEQ ID NO: 5251988 - DNA, 12 bp, Homo sapiens
atcagaataaat

SEQ ID NO: 5251989 - DNA, 20 bp, Homo sapiens
atcagaataaccttcaaata

SEQ ID NO: 5251990 - DNA, 19 bp, Homo sapiens
atcagaatatcagaatatg

SEQ ID NO: 5251991 - DNA, 18 bp, Homo sapiens
atcagaatcgctaataga

SEQ ID NO: 5251992 - DNA, 23 bp, Homo sapiens
atcagaatctttaaagaggagcc

SEQ ID NO: 5251993 - DNA, 18 bp, Homo sapiens
atcagaatggaagagaga

SEQ ID NO: 5251994 - DNA, 23 bp, Homo sapiens
atcagaattgaaccgtcaatgtg

SEQ ID NO: 5251995 - DNA, 13 bp, Homo sapiens
atcagaatttgtg

SEQ ID NO: 5251996 - DNA, 14 bp, Homo sapiens
atcagaatttgtgt

SEQ ID NO: 5251997 - DNA, 12 bp, Homo sapiens
atcagacacaat

SEQ ID NO: 5251998 - DNA, 15 bp, Homo sapiens
atcagacatacagct

SEQ ID NO: 5251999 - DNA, 16 bp, Homo sapiens
atcagacattcagaga

SEQ ID NO: 5252000 - DNA, 19 bp, Homo sapiens
atcagaccaaggaacaaga

SEQ ID NO: 5252001 - DNA, 20 bp, Homo sapiens
atcagaccataatgttacat

SEQ ID NO: 5252002 - DNA, 14 bp, Homo sapiens
atcagaccctaccc

SEQ ID NO: 5252003 - DNA, 13 bp, Homo sapiens
atcagacctctga

SEQ ID NO: 5252004 - DNA, 15 bp, Homo sapiens
atcagacctctgatc

SEQ ID NO: 5252005 - DNA, 13 bp, Homo sapiens
atcagacctgtct

SEQ ID NO: 5252006 - DNA, 14 bp, Homo sapiens
atcagacctgtctt

SEQ ID NO: 5252007 - DNA, 16 bp, Homo sapiens
atcagacctgtcttcc

SEQ ID NO: 5252008 - DNA, 21 bp, Homo sapiens
atcagacctgtcttccaagga

SEQ ID NO: 5252009 - DNA, 21 bp, Homo sapiens
atcagactagccactcctgcc

SEQ ID NO: 5252010 - DNA, 16 bp, Homo sapiens
atcagactagtatcaa

SEQ ID NO: 5252011 - DNA, 19 bp, Homo sapiens
atcagactatgaagttttt

SEQ ID NO: 5252012 - DNA, 14 bp, Homo sapiens
atcagactcagttt

SEQ ID NO: 5252013 - DNA, 16 bp, Homo sapiens
atcagactcagttttt

SEQ ID NO: 5252014 - DNA, 21 bp, Homo sapiens
atcagactcagttttttgtaa

SEQ ID NO: 5252015 - DNA, 19 bp, Homo sapiens
atcagactcttggggaagc

SEQ ID NO: 5252016 - DNA, 19 bp, Homo sapiens
atcagacttcaccaaatat

SEQ ID NO: 5252017 - DNA, 16 bp, Homo sapiens
atcagacttgatttac

SEQ ID NO: 5252018 - DNA, 19 bp, Homo sapiens
atcagacttgcggccacag

SEQ ID NO: 5252019 - DNA, 13 bp, Homo sapiens
atcagagaataaa

SEQ ID NO: 5252020 - DNA, 16 bp, Homo sapiens
atcagagaataaacat

SEQ ID NO: 5252021 - DNA, 18 bp, Homo sapiens
atcagagaataaacatca

SEQ ID NO: 5252022 - DNA, 21 bp, Homo sapiens
atcagagcagcagtgaaaaca

SEQ ID NO: 5252023 - DNA, 15 bp, Homo sapiens
atcagagcaggacct

SEQ ID NO: 5252024 - DNA, 16 bp, Homo sapiens
atcagagcaggacctc

SEQ ID NO: 5252025 - DNA, 22 bp, Homo sapiens
atcagagcagtgattctctctt

SEQ ID NO: 5252026 - DNA, 14 bp, Homo sapiens
atcagagctgcagc

SEQ ID NO: 5252027 - DNA, 22 bp, Homo sapiens
atcagagctggcagcctccagt

SEQ ID NO: 5252028 - DNA, 14 bp, Homo sapiens
atcagaggacacct

SEQ ID NO: 5252029 - DNA, 16 bp, Homo sapiens
atcagaggagtaaata

SEQ ID NO: 5252030 - DNA, 13 bp, Homo sapiens
atcagaggcagag

SEQ ID NO: 5252031 - DNA, 21 bp, Homo sapiens
atcagaggcatttgagcagct

SEQ ID NO: 5252032 - DNA, 23 bp, Homo sapiens
atcagaggcatttgagcagctga

SEQ ID NO: 5252033 - DNA, 14 bp, Homo sapiens
atcagaggcctata

SEQ ID NO: 5252034 - DNA, 23 bp, Homo sapiens
atcagaggtcatcccttcctcct

SEQ ID NO: 5252035 - DNA, 16 bp, Homo sapiens
atcagaggtgtacact

SEQ ID NO: 5252036 - DNA, 18 bp, Homo sapiens
atcagaggtgtacactaa

SEQ ID NO: 5252037 - DNA, 20 bp, Homo sapiens
atcagagtagaaataaaagt

SEQ ID NO: 5252038 - DNA, 14 bp, Homo sapiens
atcagagtatctga

SEQ ID NO: 5252039 - DNA, 17 bp, Homo sapiens
atcagagttgctgcaaa

SEQ ID NO: 5252040 - DNA, 19 bp, Homo sapiens
atcagataagacatatctc

SEQ ID NO: 5252041 - DNA, 22 bp, Homo sapiens
atcagataagacatatctctaa

SEQ ID NO: 5252042 - DNA, 15 bp, Homo sapiens
atcagataatgccac

SEQ ID NO: 5252043 - DNA, 15 bp, Homo sapiens
atcagatacatcact

SEQ ID NO: 5252044 - DNA, 16 bp, Homo sapiens
atcagatacatcactg

SEQ ID NO: 5252045 - DNA, 16 bp, Homo sapiens
atcagatatgcttact

SEQ ID NO: 5252046 - DNA, 19 bp, Homo sapiens
atcagatattttcatattt

SEQ ID NO: 5252047 - DNA, 21 bp, Homo sapiens
atcagatattttcatatttaa

SEQ ID NO: 5252048 - DNA, 23 bp, Homo sapiens
atcagatcaagagttttggagat

SEQ ID NO: 5252049 - DNA, 22 bp, Homo sapiens
atcagatcatttcaaaactcat

SEQ ID NO: 5252050 - DNA, 13 bp, Homo sapiens
atcagatcttaca

SEQ ID NO: 5252051 - DNA, 16 bp, Homo sapiens
atcagatcttacaagt

SEQ ID NO: 5252052 - DNA, 16 bp, Homo sapiens
atcagatgaattgata

SEQ ID NO: 5252053 - DNA, 17 bp, Homo sapiens
atcagatgactctctcc

SEQ ID NO: 5252054 - DNA, 22 bp, Homo sapiens
atcagatgatggccatttctaa

SEQ ID NO: 5252055 - DNA, 22 bp, Homo sapiens
atcagatgcaattgctcccatc

SEQ ID NO: 5252056 - DNA, 12 bp, Homo sapiens
atcagatgcctg

SEQ ID NO: 5252057 - DNA, 15 bp, Homo sapiens
atcagatgcctgctt

SEQ ID NO: 5252058 - DNA, 21 bp, Homo sapiens
atcagatgctccaagattcta

SEQ ID NO: 5252059 - DNA, 14 bp, Homo sapiens
atcagatggaaata

SEQ ID NO: 5252060 - DNA, 15 bp, Homo sapiens
atcagattcttgctg

SEQ ID NO: 5252061 - DNA, 20 bp, Homo sapiens
atcagattgacagcatatag

SEQ ID NO: 5252062 - DNA, 14 bp, Homo sapiens
atcagattgctttt

SEQ ID NO: 5252063 - DNA, 15 bp, Homo sapiens
atcagattgcttttg

SEQ ID NO: 5252064 - DNA, 13 bp, Homo sapiens
atcagattgttaa

SEQ ID NO: 5252065 - DNA, 20 bp, Homo sapiens
atcagatttggtgatggaaa

SEQ ID NO: 5252066 - DNA, 19 bp, Homo sapiens
atcagatttgtaatggctc

SEQ ID NO: 5252067 - DNA, 15 bp, Homo sapiens
atcagcaaaaagact

SEQ ID NO: 5252068 - DNA, 23 bp, Homo sapiens
atcagcaaagaaaaaaaaaaaag

SEQ ID NO: 5252069 - DNA, 23 bp, Homo sapiens
atcagcaacaaccagcatccctt

SEQ ID NO: 5252070 - DNA, 16 bp, Homo sapiens
atcagcaacatcattc

SEQ ID NO: 5252071 - DNA, 17 bp, Homo sapiens
atcagcaatattgcctg

SEQ ID NO: 5252072 - DNA, 16 bp, Homo sapiens
atcagcaatgaagaac

SEQ ID NO: 5252073 - DNA, 16 bp, Homo sapiens
atcagcaatttcagaa

SEQ ID NO: 5252074 - DNA, 15 bp, Homo sapiens
atcagcacatatttt

SEQ ID NO: 5252075 - DNA, 13 bp, Homo sapiens
atcagcacgattt

SEQ ID NO: 5252076 - DNA, 15 bp, Homo sapiens
atcagcacgatttct

SEQ ID NO: 5252077 - DNA, 17 bp, Homo sapiens
atcagcacgatttctgt

SEQ ID NO: 5252078 - DNA, 22 bp, Homo sapiens
atcagcactagaaattgggcag

SEQ ID NO: 5252079 - DNA, 13 bp, Homo sapiens
atcagcactctgt

SEQ ID NO: 5252080 - DNA, 12 bp, Homo sapiens
atcagcactgaa

SEQ ID NO: 5252081 - DNA, 14 bp, Homo sapiens
atcagcactgaaaa

SEQ ID NO: 5252082 - DNA, 20 bp, Homo sapiens
atcagcaggatgtgtgggcc

SEQ ID NO: 5252083 - DNA, 23 bp, Homo sapiens
atcagcaggctccagttgaacac

SEQ ID NO: 5252084 - DNA, 11 bp, Homo sapiens
atcagcagtga

SEQ ID NO: 5252085 - DNA, 18 bp, Homo sapiens
atcagcatcaagtatgtg

SEQ ID NO: 5252086 - DNA, 22 bp, Homo sapiens
atcagcatccaaaagcaggaac

SEQ ID NO: 5252087 - DNA, 17 bp, Homo sapiens
atcagcatgttttctgc

SEQ ID NO: 5252088 - DNA, 18 bp, Homo sapiens
atcagcatgttttctgct

SEQ ID NO: 5252089 - DNA, 19 bp, Homo sapiens
atcagcatgttttctgctt

SEQ ID NO: 5252090 - DNA, 16 bp, Homo sapiens
atcagcattcaaaata

SEQ ID NO: 5252091 - DNA, 20 bp, Homo sapiens
atcagcattgtgacttggag

SEQ ID NO: 5252092 - DNA, 14 bp, Homo sapiens
atcagcattttaga

SEQ ID NO: 5252093 - DNA, 17 bp, Homo sapiens
atcagcatttttcttta

SEQ ID NO: 5252094 - DNA, 14 bp, Homo sapiens
atcagccagccttc

SEQ ID NO: 5252095 - DNA, 14 bp, Homo sapiens
atcagccattaaaa

SEQ ID NO: 5252096 - DNA, 16 bp, Homo sapiens
atcagccattaaaata

SEQ ID NO: 5252097 - DNA, 18 bp, Homo sapiens
atcagccattaaaataaa

SEQ ID NO: 5252098 - DNA, 19 bp, Homo sapiens
atcagccattaaaataaaa

SEQ ID NO: 5252099 - DNA, 21 bp, Homo sapiens
atcagccattaaaataaaaca

SEQ ID NO: 5252100 - DNA, 23 bp, Homo sapiens
atcagccattaaaataaaacaag

SEQ ID NO: 5252101 - DNA, 15 bp, Homo sapiens
atcagccatttgcca

SEQ ID NO: 5252102 - DNA, 20 bp, Homo sapiens
atcagcccaacgggaagcaa

SEQ ID NO: 5252103 - DNA, 15 bp, Homo sapiens
atcagcccccagcct

SEQ ID NO: 5252104 - DNA, 13 bp, Homo sapiens
atcagccccgcct

SEQ ID NO: 5252105 - DNA, 17 bp, Homo sapiens
atcagccccgcctgtca

SEQ ID NO: 5252106 - DNA, 22 bp, Homo sapiens
atcagccccgctcctcccctct

SEQ ID NO: 5252107 - DNA, 14 bp, Homo sapiens
atcagcccctcaaa

SEQ ID NO: 5252108 - DNA, 20 bp, Homo sapiens
atcagcccctcaaagggaga

SEQ ID NO: 5252109 - DNA, 23 bp, Homo sapiens
atcagcccctcaaagggagagaa

SEQ ID NO: 5252110 - DNA, 15 bp, Homo sapiens
atcagcccctgctgc

SEQ ID NO: 5252111 - DNA, 12 bp, Homo sapiens
atcagcccctgg

SEQ ID NO: 5252112 - DNA, 15 bp, Homo sapiens
atcagcccctgggaa

SEQ ID NO: 5252113 - DNA, 18 bp, Homo sapiens
atcagcccctgggaacag

SEQ ID NO: 5252114 - DNA, 21 bp, Homo sapiens
atcagcccggtgtgaggaggg

SEQ ID NO: 5252115 - DNA, 15 bp, Homo sapiens
atcagccctcacacc

SEQ ID NO: 5252116 - DNA, 20 bp, Homo sapiens
atcagcctaggggtcaggga

SEQ ID NO: 5252117 - DNA, 14 bp, Homo sapiens
atcagcctctggcc

SEQ ID NO: 5252118 - DNA, 15 bp, Homo sapiens
atcagcctcttaaag

SEQ ID NO: 5252119 - DNA, 18 bp, Homo sapiens
atcagcctgagtctcctg

SEQ ID NO: 5252120 - DNA, 11 bp, Homo sapiens
atcagcctggg

SEQ ID NO: 5252121 - DNA, 20 bp, Homo sapiens
atcagcctgggcaacatggt

SEQ ID NO: 5252122 - DNA, 21 bp, Homo sapiens
atcagcctgtctcttccatat

SEQ ID NO: 5252123 - DNA, 13 bp, Homo sapiens
atcagccttggga

SEQ ID NO: 5252124 - DNA, 15 bp, Homo sapiens
atcagccttttatgt

SEQ ID NO: 5252125 - DNA, 20 bp, Homo sapiens
atcagccttttatgtatttt

SEQ ID NO: 5252126 - DNA, 17 bp, Homo sapiens
atcagccttttcagcag

SEQ ID NO: 5252127 - DNA, 19 bp, Homo sapiens
atcagccttttcagcaggt

SEQ ID NO: 5252128 - DNA, 23 bp, Homo sapiens
atcagcggccccttgactctggg

SEQ ID NO: 5252129 - DNA, 18 bp, Homo sapiens
atcagcgggtctcctccc

SEQ ID NO: 5252130 - DNA, 12 bp, Homo sapiens
atcagcgtggcc

SEQ ID NO: 5252131 - DNA, 16 bp, Homo sapiens
atcagctacaattgta

SEQ ID NO: 5252132 - DNA, 20 bp, Homo sapiens
atcagctacccctgcagctg

SEQ ID NO: 5252133 - DNA, 21 bp, Homo sapiens
atcagctacttaagagaaatg

SEQ ID NO: 5252134 - DNA, 21 bp, Homo sapiens
atcagctagcaaaagaagtaa

SEQ ID NO: 5252135 - DNA, 15 bp, Homo sapiens
atgaaaaatacttta

SEQ ID NO: 5252136 - DNA, 17 bp, Homo sapiens
atgaaaaatatttctga

SEQ ID NO: 5252137 - DNA, 22 bp, Homo sapiens
atgaaaaatcaggcagaaatat

SEQ ID NO: 5252138 - DNA, 20 bp, Homo sapiens
atgaaaaatctcaattgaaa

SEQ ID NO: 5252139 - DNA, 19 bp, Homo sapiens
atgaaaaatgaaagatgat

SEQ ID NO: 5252140 - DNA, 16 bp, Homo sapiens
atgaaaaatgtaaata

SEQ ID NO: 5252141 - DNA, 18 bp, Homo sapiens
atgaaaaatgtaaatact

SEQ ID NO: 5252142 - DNA, 12 bp, Homo sapiens
atgaaaaattat

SEQ ID NO: 5252143 - DNA, 18 bp, Homo sapiens
atgaaaaattgctgactg

SEQ ID NO: 5252144 - DNA, 17 bp, Homo sapiens
atgaaaaatttaagcat

SEQ ID NO: 5252145 - DNA, 18 bp, Homo sapiens
atgaaaaatttaagcatt

SEQ ID NO: 5252146 - DNA, 20 bp, Homo sapiens
atgaaaaatttaagcattgt

SEQ ID NO: 5252147 - DNA, 14 bp, Homo sapiens
atgaaaacaaaatt

SEQ ID NO: 5252148 - DNA, 22 bp, Homo sapiens
atgaaaacaaataaaagttgaa

SEQ ID NO: 5252149 - DNA, 14 bp, Homo sapiens
atgaaaacacattt

SEQ ID NO: 5252150 - DNA, 15 bp, Homo sapiens
atgaaaacacatttt

SEQ ID NO: 5252151 - DNA, 17 bp, Homo sapiens
atgaaaacagaatgtct

SEQ ID NO: 5252152 - DNA, 18 bp, Homo sapiens
atgaaaacagtgtgtaaa

SEQ ID NO: 5252153 - DNA, 15 bp, Homo sapiens
atgaaaacattcaga

SEQ ID NO: 5252154 - DNA, 14 bp, Homo sapiens
atgaaaacattgat

SEQ ID NO: 5252155 - DNA, 13 bp, Homo sapiens
atgaaaaccagtg

SEQ ID NO: 5252156 - DNA, 18 bp, Homo sapiens
atgaaaacgttttattgt

SEQ ID NO: 5252157 - DNA, 19 bp, Homo sapiens
atgaaaacgttttattgtg

SEQ ID NO: 5252158 - DNA, 17 bp, Homo sapiens
atgaaaactaaggattt

SEQ ID NO: 5252159 - DNA, 12 bp, Homo sapiens
atgaaaactggg

SEQ ID NO: 5252160 - DNA, 15 bp, Homo sapiens
atgaaaactttttaa

SEQ ID NO: 5252161 - DNA, 16 bp, Homo sapiens
atgaaaagagaaactt

SEQ ID NO: 5252162 - DNA, 15 bp, Homo sapiens
atgaaaagatttaag

SEQ ID NO: 5252163 - DNA, 12 bp, Homo sapiens
atgaaaagccat

SEQ ID NO: 5252164 - DNA, 14 bp, Homo sapiens
atgaaaagccatat

SEQ ID NO: 5252165 - DNA, 18 bp, Homo sapiens
atgaaaagctagaattga

SEQ ID NO: 5252166 - DNA, 18 bp, Homo sapiens
atgaaaagctttgtttgt

SEQ ID NO: 5252167 - DNA, 12 bp, Homo sapiens
atgaaaaggaat

SEQ ID NO: 5252168 - DNA, 20 bp, Homo sapiens
atgaaaaggcagcatttgaa

SEQ ID NO: 5252169 - DNA, 21 bp, Homo sapiens
atgaaaaggttgcctgaaaaa

SEQ ID NO: 5252170 - DNA, 16 bp, Homo sapiens
atgaaaagtatattga

SEQ ID NO: 5252171 - DNA, 12 bp, Homo sapiens
atgaaaagttat

SEQ ID NO: 5252172 - DNA, 15 bp, Homo sapiens
atgaaaagttttcaa

SEQ ID NO: 5252173 - DNA, 14 bp, Homo sapiens
atgaaaataaaaca

SEQ ID NO: 5252174 - DNA, 16 bp, Homo sapiens
atgaaaataaaacaca

SEQ ID NO: 5252175 - DNA, 20 bp, Homo sapiens
atgaaaataaaacacacctc

SEQ ID NO: 5252176 - DNA, 15 bp, Homo sapiens
atgaaaataaagaat

SEQ ID NO: 5252177 - DNA, 21 bp, Homo sapiens
atgaaaataaataaaaataat

SEQ ID NO: 5252178 - DNA, 18 bp, Homo sapiens
atgaaaataactgaattt

SEQ ID NO: 5252179 - DNA, 15 bp, Homo sapiens
atgaaaatacatctt

SEQ ID NO: 5252180 - DNA, 24 bp, Homo sapiens
atgaaaataccatttagtaagaat

SEQ ID NO: 5252181 - DNA, 16 bp, Homo sapiens
atgaaaatagctattt

SEQ ID NO: 5252182 - DNA, 10 bp, Homo sapiens
atgaaaatat

SEQ ID NO: 5252183 - DNA, 12 bp, Homo sapiens
atgaaaatatct

SEQ ID NO: 5252184 - DNA, 12 bp, Homo sapiens
atgaaaatattt

SEQ ID NO: 5252185 - DNA, 20 bp, Homo sapiens
atgaaaatcctaccaacctc

SEQ ID NO: 5252186 - DNA, 19 bp, Homo sapiens
atgaaaatcctatatctgt

SEQ ID NO: 5252187 - DNA, 22 bp, Homo sapiens
atgaaaatcctatatctgtttg

SEQ ID NO: 5252188 - DNA, 17 bp, Homo sapiens
atgaaaatgaatagctt

SEQ ID NO: 5252189 - DNA, 19 bp, Homo sapiens
atgaaaatgagttgtgaaa

SEQ ID NO: 5252190 - DNA, 18 bp, Homo sapiens
atgaaaatgatgtagaca

SEQ ID NO: 5252191 - DNA, 20 bp, Homo sapiens
atgaaaatgatgtagacatt

SEQ ID NO: 5252192 - DNA, 20 bp, Homo sapiens
atgaaaatgcaacaacatgt

SEQ ID NO: 5252193 - DNA, 18 bp, Homo sapiens
atgaaaatggctgaagaa

SEQ ID NO: 5252194 - DNA, 15 bp, Homo sapiens
atgaaaatgtaactt

SEQ ID NO: 5252195 - DNA, 13 bp, Homo sapiens
atgaaaatgtcag

SEQ ID NO: 5252196 - DNA, 13 bp, Homo sapiens
atgaaaatgtctt

SEQ ID NO: 5252197 - DNA, 19 bp, Homo sapiens
atgaaaatgttacaagcta

SEQ ID NO: 5252198 - DNA, 22 bp, Homo sapiens
atgaaaatgttacaagctaaga

SEQ ID NO: 5252199 - DNA, 21 bp, Homo sapiens
atgaaaatgttgaaggaactt

SEQ ID NO: 5252200 - DNA, 20 bp, Homo sapiens
atgaaaattatactgagaac

SEQ ID NO: 5252201 - DNA, 11 bp, Homo sapiens
atgaaaattgt

SEQ ID NO: 5252202 - DNA, 15 bp, Homo sapiens
atgaaaattgtatta

SEQ ID NO: 5252203 - DNA, 15 bp, Homo sapiens
atgaaaattgtgtta

SEQ ID NO: 5252204 - DNA, 13 bp, Homo sapiens
atgaaaatttgag

SEQ ID NO: 5252205 - DNA, 18 bp, Homo sapiens
atgaaaatttgtttgaca

SEQ ID NO: 5252206 - DNA, 17 bp, Homo sapiens
atgaaaattttaaaaat

SEQ ID NO: 5252207 - DNA, 21 bp, Homo sapiens
atgaaaattttaccagcagaa

SEQ ID NO: 5252208 - DNA, 13 bp, Homo sapiens
atgaaacaaatat

SEQ ID NO: 5252209 - DNA, 17 bp, Homo sapiens
atgaaacaactcatgtc

SEQ ID NO: 5252210 - DNA, 21 bp, Homo sapiens
atgaaacaactcatgtcttta

SEQ ID NO: 5252211 - DNA, 12 bp, Homo sapiens
atgaaacaatct

SEQ ID NO: 5252212 - DNA, 18 bp, Homo sapiens
atgaaacaatcttccaaa

SEQ ID NO: 5252213 - DNA, 16 bp, Homo sapiens
atgaaacaatgaaatt

SEQ ID NO: 5252214 - DNA, 12 bp, Homo sapiens
atgaaacacctt

SEQ ID NO: 5252215 - DNA, 20 bp, Homo sapiens
atgaaacactcagttgttca

SEQ ID NO: 5252216 - DNA, 18 bp, Homo sapiens
atgaaacagaaacaaaaa

SEQ ID NO: 5252217 - DNA, 22 bp, Homo sapiens
atgaaacagaaacaaaaacact

SEQ ID NO: 5252218 - DNA, 16 bp, Homo sapiens
atgaaacagaacttga

SEQ ID NO: 5252219 - DNA, 23 bp, Homo sapiens
atgaaacagatgataaatattta

SEQ ID NO: 5252220 - DNA, 12 bp, Homo sapiens
atgaaacagcag

SEQ ID NO: 5252221 - DNA, 16 bp, Homo sapiens
atgaaacatatcatgg

SEQ ID NO: 5252222 - DNA, 17 bp, Homo sapiens
atgaaacatcatttcaa

SEQ ID NO: 5252223 - DNA, 12 bp, Homo sapiens
atgaaacattca

SEQ ID NO: 5252224 - DNA, 11 bp, Homo sapiens
atgaaaccaaa

SEQ ID NO: 5252225 - DNA, 16 bp, Homo sapiens
atgaaacccccacaca

SEQ ID NO: 5252226 - DNA, 23 bp, Homo sapiens
atgaaaccttattttttcccaaa

SEQ ID NO: 5252227 - DNA, 13 bp, Homo sapiens
atgaaactaaagc

SEQ ID NO: 5252228 - DNA, 15 bp, Homo sapiens
atgaaactaaagcaa

SEQ ID NO: 5252229 - DNA, 23 bp, Homo sapiens
atgaaactagaaagcagagattt

SEQ ID NO: 5252230 - DNA, 20 bp, Homo sapiens
atgaaactaggcttctgtaa

SEQ ID NO: 5252231 - DNA, 15 bp, Homo sapiens
atgaaactctttcat

SEQ ID NO: 5252232 - DNA, 16 bp, Homo sapiens
atgaaacttaagaatt

SEQ ID NO: 5252233 - DNA, 15 bp, Homo sapiens
atgaaacttctcagt

SEQ ID NO: 5252234 - DNA, 14 bp, Homo sapiens
atgaaactttgaaa

SEQ ID NO: 5252235 - DNA, 16 bp, Homo sapiens
atgaaacttttggaag

SEQ ID NO: 5252236 - DNA, 12 bp, Homo sapiens
atgaaagaaaat

SEQ ID NO: 5252237 - DNA, 12 bp, Homo sapiens
atgaaagaaacc

SEQ ID NO: 5252238 - DNA, 15 bp, Homo sapiens
atgaaagaatatatt

SEQ ID NO: 5252239 - DNA, 14 bp, Homo sapiens
atgaaagaatatct

SEQ ID NO: 5252240 - DNA, 13 bp, Homo sapiens
atgaaagactgta

SEQ ID NO: 5252241 - DNA, 16 bp, Homo sapiens
atgaaagactgtacaa

SEQ ID NO: 5252242 - DNA, 17 bp, Homo sapiens
atgaaagactgtacaaa

SEQ ID NO: 5252243 - DNA, 16 bp, Homo sapiens
atgaaagagaaaatat

SEQ ID NO: 5252244 - DNA, 14 bp, Homo sapiens
atgaaagagaattt

SEQ ID NO: 5252245 - DNA, 20 bp, Homo sapiens
atgaaagagccagactctgt

SEQ ID NO: 5252246 - DNA, 22 bp, Homo sapiens
atgaaagagccagactctgtct

SEQ ID NO: 5252247 - DNA, 12 bp, Homo sapiens
atgaaagatgat

SEQ ID NO: 5252248 - DNA, 21 bp, Homo sapiens
atgaaagcaacaaagaaatcc

SEQ ID NO: 5252249 - DNA, 22 bp, Homo sapiens
atgaaagctgattactgtcaat

SEQ ID NO: 5252250 - DNA, 21 bp, Homo sapiens
atgaaagctgtttcatttgtg

SEQ ID NO: 5252251 - DNA, 19 bp, Homo sapiens
atgaaaggaagtataaagt

SEQ ID NO: 5252252 - DNA, 15 bp, Homo sapiens
atgaaaggaataaaa

SEQ ID NO: 5252253 - DNA, 19 bp, Homo sapiens
atgaaaggagtaagaaatt

SEQ ID NO: 5252254 - DNA, 21 bp, Homo sapiens
atgaaaggcaggcctatttca

SEQ ID NO: 5252255 - DNA, 20 bp, Homo sapiens
atgaaagggaaagtcagctt

SEQ ID NO: 5252256 - DNA, 19 bp, Homo sapiens
atgaaagggcccagagagg

SEQ ID NO: 5252257 - DNA, 21 bp, Homo sapiens
atgaaagggtttgtaatactt

SEQ ID NO: 5252258 - DNA, 22 bp, Homo sapiens
atgaaagggtttgtaatacttt

SEQ ID NO: 5252259 - DNA, 23 bp, Homo sapiens
atgaaagggtttgtaatacttta

SEQ ID NO: 5252260 - DNA, 20 bp, Homo sapiens
atgaaaggtaatctgaaaca

SEQ ID NO: 5252261 - DNA, 15 bp, Homo sapiens
atgaaaggtactata

SEQ ID NO: 5252262 - DNA, 21 bp, Homo sapiens
atgaaagtagattcatgaaaa

SEQ ID NO: 5252263 - DNA, 18 bp, Homo sapiens
atgaaagtcaaatttact

SEQ ID NO: 5252264 - DNA, 19 bp, Homo sapiens
atgaaagtcttactgggcc

SEQ ID NO: 5252265 - DNA, 20 bp, Homo sapiens
atgaaagtcttgtgactagt

SEQ ID NO: 5252266 - DNA, 22 bp, Homo sapiens
atgaaagtgcaaagtgccctca

SEQ ID NO: 5252267 - DNA, 15 bp, Homo sapiens
atgaaagtgcctgcc

SEQ ID NO: 5252268 - DNA, 21 bp, Homo sapiens
atgaaagtgttaattttacct

SEQ ID NO: 5252269 - DNA, 21 bp, Homo sapiens
atgaaataaaactgtttttga

SEQ ID NO: 5252270 - DNA, 14 bp, Homo sapiens
atgaaataaaatat

SEQ ID NO: 5252271 - DNA, 14 bp, Homo sapiens
atgaaataaagaaa

SEQ ID NO: 5252272 - DNA, 22 bp, Homo sapiens
atgaaataaattggtgataagt

SEQ ID NO: 5252273 - DNA, 20 bp, Homo sapiens
atgaaataactccttcttgt

SEQ ID NO: 5252274 - DNA, 20 bp, Homo sapiens
atgaaataataaagagattt

SEQ ID NO: 5252275 - DNA, 15 bp, Homo sapiens
atgaaataatgtgaa

SEQ ID NO: 5252276 - DNA, 18 bp, Homo sapiens
atgaaatactccagcacc

SEQ ID NO: 5252277 - DNA, 23 bp, Homo sapiens
atgaaatagttattttaatacct

SEQ ID NO: 5252278 - DNA, 17 bp, Homo sapiens
atgaaatataaactgtg

SEQ ID NO: 5252279 - DNA, 23 bp, Homo sapiens
atgaaatataaattatctgaata

SEQ ID NO: 5252280 - DNA, 16 bp, Homo sapiens
atgaaatatagatgtt

SEQ ID NO: 5252281 - DNA, 17 bp, Homo sapiens
atgaaatatatgtgaaa

SEQ ID NO: 5252282 - DNA, 16 bp, Homo sapiens
atgaaatatattttct

SEQ ID NO: 5252283 - DNA, 21 bp, Homo sapiens
atgaaatattatgttaaaact

SEQ ID NO: 5252284 - DNA, 13 bp, Homo sapiens
atgaaatattgct

SEQ ID NO: 5252285 - DNA, 14 bp, Homo sapiens
atgaaatatttttg

SEQ ID NO: 5252286 - DNA, 15 bp, Homo sapiens
atgaaatcaaatgta

SEQ ID NO: 5252287 - DNA, 16 bp, Homo sapiens
atgaaatcaaatgtat

SEQ ID NO: 5252288 - DNA, 18 bp, Homo sapiens
atgaaatcaaatgtatgt

SEQ ID NO: 5252289 - DNA, 18 bp, Homo sapiens
atgaaatcaagttccagt

SEQ ID NO: 5252290 - DNA, 14 bp, Homo sapiens
atgaaatcatagta

SEQ ID NO: 5252291 - DNA, 16 bp, Homo sapiens
atgaaatcatagtata

SEQ ID NO: 5252292 - DNA, 18 bp, Homo sapiens
atgaaatcatagtatatg

SEQ ID NO: 5252293 - DNA, 19 bp, Homo sapiens
atgaaatccttgactggac

SEQ ID NO: 5252294 - DNA, 19 bp, Homo sapiens
atgaaatctcacagatgta

SEQ ID NO: 5252295 - DNA, 19 bp, Homo sapiens
atgaaatctgctagaaagt

SEQ ID NO: 5252296 - DNA, 16 bp, Homo sapiens
atgaaatcttcccagt

SEQ ID NO: 5252297 - DNA, 16 bp, Homo sapiens
atgaaatctttctttc

SEQ ID NO: 5252298 - DNA, 17 bp, Homo sapiens
atgaaatgactgtctaa

SEQ ID NO: 5252299 - DNA, 14 bp, Homo sapiens
atgaaatgacttct

SEQ ID NO: 5252300 - DNA, 23 bp, Homo sapiens
atgaaatgcactgtattgctcct

SEQ ID NO: 5252301 - DNA, 14 bp, Homo sapiens
atgaaatgcatttt

SEQ ID NO: 5252302 - DNA, 14 bp, Homo sapiens
atgaaatgccaaga

SEQ ID NO: 5252303 - DNA, 14 bp, Homo sapiens
atgaaatgccagac

SEQ ID NO: 5252304 - DNA, 23 bp, Homo sapiens
atgaaatgctatgtcatttcatg

SEQ ID NO: 5252305 - DNA, 21 bp, Homo sapiens
atgaaatggagtcatttgagt

SEQ ID NO: 5252306 - DNA, 18 bp, Homo sapiens
atgaaatggggattatta

SEQ ID NO: 5252307 - DNA, 14 bp, Homo sapiens
atgaaatgtacatg

SEQ ID NO: 5252308 - DNA, 20 bp, Homo sapiens
atgaaatgtcccctcaaact

SEQ ID NO: 5252309 - DNA, 22 bp, Homo sapiens
atgaaatgtcccctcaaactca

SEQ ID NO: 5252310 - DNA, 23 bp, Homo sapiens
atgaaatgtgaatttttattgtt

SEQ ID NO: 5252311 - DNA, 21 bp, Homo sapiens
atgaaatgtgcactttatcct

SEQ ID NO: 5252312 - DNA, 12 bp, Homo sapiens
atgaaatgtgtt

SEQ ID NO: 5252313 - DNA, 20 bp, Homo sapiens
atgaaatgtgttttgtcttt

SEQ ID NO: 5252314 - DNA, 21 bp, Homo sapiens
atgaaatgtgttttgtctttt

SEQ ID NO: 5252315 - DNA, 23 bp, Homo sapiens
atcagctagcaaaagaagtaaca

SEQ ID NO: 5252316 - DNA, 22 bp, Homo sapiens
atcagctattcccttctgatct

SEQ ID NO: 5252317 - DNA, 15 bp, Homo sapiens
atcagctatttactg

SEQ ID NO: 5252318 - DNA, 17 bp, Homo sapiens
atcagctattttgtgaa

SEQ ID NO: 5252319 - DNA, 12 bp, Homo sapiens
atcagctcccaa

SEQ ID NO: 5252320 - DNA, 22 bp, Homo sapiens
atcagctcccttcccctgcctg

SEQ ID NO: 5252321 - DNA, 14 bp, Homo sapiens
atcagctctcctgg

SEQ ID NO: 5252322 - DNA, 18 bp, Homo sapiens
atcagctctcctggctcc

SEQ ID NO: 5252323 - DNA, 13 bp, Homo sapiens
atcagctctctgc

SEQ ID NO: 5252324 - DNA, 13 bp, Homo sapiens
atcagctgaattc

SEQ ID NO: 5252325 - DNA, 17 bp, Homo sapiens
atcagctggacatactg

SEQ ID NO: 5252326 - DNA, 13 bp, Homo sapiens
atcagctggtggc

SEQ ID NO: 5252327 - DNA, 17 bp, Homo sapiens
atcagctttataataaa

SEQ ID NO: 5252328 - DNA, 18 bp, Homo sapiens
atcagctttcaaagcatt

SEQ ID NO: 5252329 - DNA, 15 bp, Homo sapiens
atcagctttccctgg

SEQ ID NO: 5252330 - DNA, 17 bp, Homo sapiens
atcagctttccctggct

SEQ ID NO: 5252331 - DNA, 20 bp, Homo sapiens
atcagctttccctggctcag

SEQ ID NO: 5252332 - DNA, 21 bp, Homo sapiens
atcagctttccctggctcagg

SEQ ID NO: 5252333 - DNA, 22 bp, Homo sapiens
atcagctttccctggctcaggg

SEQ ID NO: 5252334 - DNA, 14 bp, Homo sapiens
atcagcttttctga

SEQ ID NO: 5252335 - DNA, 21 bp, Homo sapiens
atcagcttttcttattccttt

SEQ ID NO: 5252336 - DNA, 21 bp, Homo sapiens
atcagctttttgtattaacaa

SEQ ID NO: 5252337 - DNA, 14 bp, Homo sapiens
atcaggaaagagag

SEQ ID NO: 5252338 - DNA, 21 bp, Homo sapiens
atcaggaaatatatatgtgtg

SEQ ID NO: 5252339 - DNA, 15 bp, Homo sapiens
atcaggaaccagggc

SEQ ID NO: 5252340 - DNA, 16 bp, Homo sapiens
atcaggaaccagggcc

SEQ ID NO: 5252341 - DNA, 14 bp, Homo sapiens
atcaggaagagaag

SEQ ID NO: 5252342 - DNA, 17 bp, Homo sapiens
atcaggaagagaaggag

SEQ ID NO: 5252343 - DNA, 15 bp, Homo sapiens
atcaggaagcctgtg

SEQ ID NO: 5252344 - DNA, 19 bp, Homo sapiens
atcaggaatattttccaaa

SEQ ID NO: 5252345 - DNA, 22 bp, Homo sapiens
atcaggaatattttccaaagag

SEQ ID NO: 5252346 - DNA, 20 bp, Homo sapiens
atcaggaatgagtcaatcag

SEQ ID NO: 5252347 - DNA, 15 bp, Homo sapiens
atcaggaccactcag

SEQ ID NO: 5252348 - DNA, 14 bp, Homo sapiens
atcaggaccctgga

SEQ ID NO: 5252349 - DNA, 19 bp, Homo sapiens
atcaggactgtgaccaaag

SEQ ID NO: 5252350 - DNA, 13 bp, Homo sapiens
atcaggagaaaaa

SEQ ID NO: 5252351 - DNA, 12 bp, Homo sapiens
atcaggagagca

SEQ ID NO: 5252352 - DNA, 11 bp, Homo sapiens
atcaggagccc

SEQ ID NO: 5252353 - DNA, 14 bp, Homo sapiens
atcaggagccccca

SEQ ID NO: 5252354 - DNA, 12 bp, Homo sapiens
atcaggagcctg

SEQ ID NO: 5252355 - DNA, 13 bp, Homo sapiens
atcaggagcctgc

SEQ ID NO: 5252356 - DNA, 17 bp, Homo sapiens
atcaggagcctgctaag

SEQ ID NO: 5252357 - DNA, 13 bp, Homo sapiens
atcaggaggaagt

SEQ ID NO: 5252358 - DNA, 20 bp, Homo sapiens
atcaggaggggtgttaaaac

SEQ ID NO: 5252359 - DNA, 14 bp, Homo sapiens
atcaggagtgacag

SEQ ID NO: 5252360 - DNA, 13 bp, Homo sapiens
atcaggatgaacc

SEQ ID NO: 5252361 - DNA, 19 bp, Homo sapiens
atcaggatgaacccaggac

SEQ ID NO: 5252362 - DNA, 14 bp, Homo sapiens
atcaggcaaggagg

SEQ ID NO: 5252363 - DNA, 18 bp, Homo sapiens
atcaggcaaggaggagga

SEQ ID NO: 5252364 - DNA, 13 bp, Homo sapiens
atcaggcacaggc

SEQ ID NO: 5252365 - DNA, 19 bp, Homo sapiens
atcaggcacaggcaggaag

SEQ ID NO: 5252366 - DNA, 21 bp, Homo sapiens
atcaggcacaggcaggaagag

SEQ ID NO: 5252367 - DNA, 12 bp, Homo sapiens
atcaggccaaga

SEQ ID NO: 5252368 - DNA, 21 bp, Homo sapiens
atcaggccaggccctctgccc

SEQ ID NO: 5252369 - DNA, 12 bp, Homo sapiens
atcaggccccac

SEQ ID NO: 5252370 - DNA, 18 bp, Homo sapiens
atcaggcctaatctcata

SEQ ID NO: 5252371 - DNA, 19 bp, Homo sapiens
atcaggcctagaggcctga

SEQ ID NO: 5252372 - DNA, 15 bp, Homo sapiens
atcaggctatgtatg

SEQ ID NO: 5252373 - DNA, 13 bp, Homo sapiens
atcaggctcccag

SEQ ID NO: 5252374 - DNA, 14 bp, Homo sapiens
atcaggctcccagg

SEQ ID NO: 5252375 - DNA, 17 bp, Homo sapiens
atcaggctcctcagcct

SEQ ID NO: 5252376 - DNA, 18 bp, Homo sapiens
atcaggctctgttcctca

SEQ ID NO: 5252377 - DNA, 15 bp, Homo sapiens
atcaggctttccttg

SEQ ID NO: 5252378 - DNA, 16 bp, Homo sapiens
atcaggcttttgtttc

SEQ ID NO: 5252379 - DNA, 22 bp, Homo sapiens
atcagggaaactaattgtattt

SEQ ID NO: 5252380 - DNA, 18 bp, Homo sapiens
atcagggaatccagctcc

SEQ ID NO: 5252381 - DNA, 23 bp, Homo sapiens
atcagggaggaaagtttctttga

SEQ ID NO: 5252382 - DNA, 21 bp, Homo sapiens
atcagggaggaagatgttcaa

SEQ ID NO: 5252383 - DNA, 22 bp, Homo sapiens
atcagggcaggcttgccaccgg

SEQ ID NO: 5252384 - DNA, 20 bp, Homo sapiens
atcagggcccaaataacagt

SEQ ID NO: 5252385 - DNA, 22 bp, Homo sapiens
atcagggccctgccccaggcct

SEQ ID NO: 5252386 - DNA, 19 bp, Homo sapiens
atcagggcctgccccctgg

SEQ ID NO: 5252387 - DNA, 21 bp, Homo sapiens
atcagggcctgccccctgggg

SEQ ID NO: 5252388 - DNA, 14 bp, Homo sapiens
atcagggcctgggg

SEQ ID NO: 5252389 - DNA, 20 bp, Homo sapiens
atcagggcctggggcctgag

SEQ ID NO: 5252390 - DNA, 22 bp, Homo sapiens
atcagggcctggggcctgagag

SEQ ID NO: 5252391 - DNA, 23 bp, Homo sapiens
atcagggcctggggcctgagaga

SEQ ID NO: 5252392 - DNA, 19 bp, Homo sapiens
atcagggcctttctcctcc

SEQ ID NO: 5252393 - DNA, 22 bp, Homo sapiens
atcagggcctttctcctcccca

SEQ ID NO: 5252394 - DNA, 15 bp, Homo sapiens
atcaggggccagaga

SEQ ID NO: 5252395 - DNA, 14 bp, Homo sapiens
atcagggggaagaa

SEQ ID NO: 5252396 - DNA, 18 bp, Homo sapiens
atcagggggaagaagcag

SEQ ID NO: 5252397 - DNA, 21 bp, Homo sapiens
atcagggtaaaaggtgcaggt

SEQ ID NO: 5252398 - DNA, 17 bp, Homo sapiens
atcagggttagtattgt

SEQ ID NO: 5252399 - DNA, 17 bp, Homo sapiens
atcaggtaccaaggaaa

SEQ ID NO: 5252400 - DNA, 18 bp, Homo sapiens
atcaggtaccaaggaaat

SEQ ID NO: 5252401 - DNA, 15 bp, Homo sapiens
atcaggtcaccgcga

SEQ ID NO: 5252402 - DNA, 18 bp, Homo sapiens
atcaggtcagagcccagg

SEQ ID NO: 5252403 - DNA, 16 bp, Homo sapiens
atcaggtcctcagaga

SEQ ID NO: 5252404 - DNA, 13 bp, Homo sapiens
atcaggtcctgct

SEQ ID NO: 5252405 - DNA, 14 bp, Homo sapiens
atcaggtcctgctc

SEQ ID NO: 5252406 - DNA, 18 bp, Homo sapiens
atcaggtgatccacctgc

SEQ ID NO: 5252407 - DNA, 13 bp, Homo sapiens
atcaggtgcccct

SEQ ID NO: 5252408 - DNA, 14 bp, Homo sapiens
atcaggtgcccctc

SEQ ID NO: 5252409 - DNA, 19 bp, Homo sapiens
atcaggtgctgccatccag

SEQ ID NO: 5252410 - DNA, 13 bp, Homo sapiens
atcaggtggggag

SEQ ID NO: 5252411 - DNA, 13 bp, Homo sapiens
atcaggtgtttta

SEQ ID NO: 5252412 - DNA, 16 bp, Homo sapiens
atcaggttgttaatgt

SEQ ID NO: 5252413 - DNA, 19 bp, Homo sapiens
atcaggtttccaatcaaca

SEQ ID NO: 5252414 - DNA, 20 bp, Homo sapiens
atcaggttttcttttaagaa

SEQ ID NO: 5252415 - DNA, 15 bp, Homo sapiens
atcagtaaacactgt

SEQ ID NO: 5252416 - DNA, 14 bp, Homo sapiens
atcagtaaataact

SEQ ID NO: 5252417 - DNA, 12 bp, Homo sapiens
atcagtaaatag

SEQ ID NO: 5252418 - DNA, 14 bp, Homo sapiens
atcagtaacagtat

SEQ ID NO: 5252419 - DNA, 22 bp, Homo sapiens
atcagtaacccccttaaattta

SEQ ID NO: 5252420 - DNA, 17 bp, Homo sapiens
atcagtaagaggtgtta

SEQ ID NO: 5252421 - DNA, 21 bp, Homo sapiens
atcagtaatgctaaatgtgta

SEQ ID NO: 5252422 - DNA, 14 bp, Homo sapiens
atcagtacaattct

SEQ ID NO: 5252423 - DNA, 13 bp, Homo sapiens
atcagtactccca

SEQ ID NO: 5252424 - DNA, 20 bp, Homo sapiens
atcagtacttttattaatat

SEQ ID NO: 5252425 - DNA, 17 bp, Homo sapiens
atcagtagatttctggc

SEQ ID NO: 5252426 - DNA, 18 bp, Homo sapiens
atcagtagccagcatctg

SEQ ID NO: 5252427 - DNA, 15 bp, Homo sapiens
atcagtagctgagtg

SEQ ID NO: 5252428 - DNA, 19 bp, Homo sapiens
atcagtagctgagtgcact

SEQ ID NO: 5252429 - DNA, 17 bp, Homo sapiens
atcagtagcttaagaaa

SEQ ID NO: 5252430 - DNA, 19 bp, Homo sapiens
atcagtaggaccaggccac

SEQ ID NO: 5252431 - DNA, 18 bp, Homo sapiens
atcagtagtttgcatttc

SEQ ID NO: 5252432 - DNA, 19 bp, Homo sapiens
atcagtagtttgcatttca

SEQ ID NO: 5252433 - DNA, 21 bp, Homo sapiens
atcagtagtttgcatttcaga

SEQ ID NO: 5252434 - DNA, 23 bp, Homo sapiens
atcagtagtttgcatttcagaaa

SEQ ID NO: 5252435 - DNA, 18 bp, Homo sapiens
atcagtataaacaaagtt

SEQ ID NO: 5252436 - DNA, 16 bp, Homo sapiens
atcagtatatttggtt

SEQ ID NO: 5252437 - DNA, 22 bp, Homo sapiens
atcagtatatttggtttctaga

SEQ ID NO: 5252438 - DNA, 17 bp, Homo sapiens
atcagtatgaagacact

SEQ ID NO: 5252439 - DNA, 22 bp, Homo sapiens
atcagtatgctgttttaataat

SEQ ID NO: 5252440 - DNA, 22 bp, Homo sapiens
atcagtattaatactaaaatat

SEQ ID NO: 5252441 - DNA, 21 bp, Homo sapiens
atcagtattccatcaggcaga

SEQ ID NO: 5252442 - DNA, 14 bp, Homo sapiens
atcagtattctgcc

SEQ ID NO: 5252443 - DNA, 16 bp, Homo sapiens
atcagtattgtgtaaa

SEQ ID NO: 5252444 - DNA, 17 bp, Homo sapiens
atcagtatttccttcca

SEQ ID NO: 5252445 - DNA, 16 bp, Homo sapiens
atcagtcaacagagag

SEQ ID NO: 5252446 - DNA, 13 bp, Homo sapiens
atcagtcaagctg

SEQ ID NO: 5252447 - DNA, 23 bp, Homo sapiens
atcagtcaatggaagaaatggct

SEQ ID NO: 5252448 - DNA, 15 bp, Homo sapiens
atcagtcatgaggaa

SEQ ID NO: 5252449 - DNA, 16 bp, Homo sapiens
atcagtcatgaggaaa

SEQ ID NO: 5252450 - DNA, 18 bp, Homo sapiens
atcagtcatgaggaaaga

SEQ ID NO: 5252451 - DNA, 15 bp, Homo sapiens
atcagtcccctccca

SEQ ID NO: 5252452 - DNA, 17 bp, Homo sapiens
atcagtcccctcccatc

SEQ ID NO: 5252453 - DNA, 21 bp, Homo sapiens
atcagtcctctttcaaaggta

SEQ ID NO: 5252454 - DNA, 20 bp, Homo sapiens
atcagtccttattatcccag

SEQ ID NO: 5252455 - DNA, 19 bp, Homo sapiens
atcagtcgttttagtgtct

SEQ ID NO: 5252456 - DNA, 20 bp, Homo sapiens
atcagtctatccacagagag

SEQ ID NO: 5252457 - DNA, 16 bp, Homo sapiens
atcagtctcagaatgt

SEQ ID NO: 5252458 - DNA, 18 bp, Homo sapiens
atcagtgaaaaacattag

SEQ ID NO: 5252459 - DNA, 14 bp, Homo sapiens
atcagtgacatctg

SEQ ID NO: 5252460 - DNA, 14 bp, Homo sapiens
atcagtgactgaaa

SEQ ID NO: 5252461 - DNA, 19 bp, Homo sapiens
atcagtgactgaaaccatt

SEQ ID NO: 5252462 - DNA, 13 bp, Homo sapiens
atcagtgaggagg

SEQ ID NO: 5252463 - DNA, 14 bp, Homo sapiens
atcagtgaggaggg

SEQ ID NO: 5252464 - DNA, 15 bp, Homo sapiens
atcagtgaggaggga

SEQ ID NO: 5252465 - DNA, 20 bp, Homo sapiens
atcagtgataattggtttga

SEQ ID NO: 5252466 - DNA, 17 bp, Homo sapiens
atcagtgatctatgttt

SEQ ID NO: 5252467 - DNA, 23 bp, Homo sapiens
atcagtgatctcactaaaaatat

SEQ ID NO: 5252468 - DNA, 10 bp, Homo sapiens
atcagtgcca

SEQ ID NO: 5252469 - DNA, 12 bp, Homo sapiens
atcagtgccagc

SEQ ID NO: 5252470 - DNA, 18 bp, Homo sapiens
atcagtgccccagatgta

SEQ ID NO: 5252471 - DNA, 13 bp, Homo sapiens
atcagtgccctcc

SEQ ID NO: 5252472 - DNA, 15 bp, Homo sapiens
atcagtgccctccag

SEQ ID NO: 5252473 - DNA, 17 bp, Homo sapiens
atcagtgccctccagga

SEQ ID NO: 5252474 - DNA, 20 bp, Homo sapiens
atcagtgcctctttgaaggt

SEQ ID NO: 5252475 - DNA, 17 bp, Homo sapiens
atcagtgcctggtgttc

SEQ ID NO: 5252476 - DNA, 21 bp, Homo sapiens
atcagtgcctggtgttctgaa

SEQ ID NO: 5252477 - DNA, 22 bp, Homo sapiens
atcagtgcctggtgttctgaag

SEQ ID NO: 5252478 - DNA, 15 bp, Homo sapiens
atcagtgctccctca

SEQ ID NO: 5252479 - DNA, 16 bp, Homo sapiens
atcagtgcttaatgtg

SEQ ID NO: 5252480 - DNA, 18 bp, Homo sapiens
atcagtggaactcaatat

SEQ ID NO: 5252481 - DNA, 16 bp, Homo sapiens
atcagtggacagtctg

SEQ ID NO: 5252482 - DNA, 17 bp, Homo sapiens
atcagtggatttcccat

SEQ ID NO: 5252483 - DNA, 20 bp, Homo sapiens
atcagtgggcaggataaact

SEQ ID NO: 5252484 - DNA, 23 bp, Homo sapiens
atcagtggggccccaaagcccag

SEQ ID NO: 5252485 - DNA, 17 bp, Homo sapiens
atcagtgggtcatatgt

SEQ ID NO: 5252486 - DNA, 16 bp, Homo sapiens
atcagtgtattgatgt

SEQ ID NO: 5252487 - DNA, 15 bp, Homo sapiens
atcagtgtctgtttc

SEQ ID NO: 5252488 - DNA, 22 bp, Homo sapiens
atcagtgtgccccccatcctgg

SEQ ID NO: 5252489 - DNA, 14 bp, Homo sapiens
atcagtgttaaaaa

SEQ ID NO: 5252490 - DNA, 13 bp, Homo sapiens
atcagtgttactg

SEQ ID NO: 5252491 - DNA, 14 bp, Homo sapiens
atcagtgttcttct

SEQ ID NO: 5252492 - DNA, 17 bp, Homo sapiens
atcagtgttcttctcaa

SEQ ID NO: 5252493 - DNA, 22 bp, Homo sapiens
atcagtgttcttctcaaggaca

SEQ ID NO: 5252494 - DNA, 10 bp, Homo sapiens
atcagtgttg

SEQ ID NO: 5252495 - DNA, 15 bp, Homo sapiens
atgaaatgttaacaa

SEQ ID NO: 5252496 - DNA, 16 bp, Homo sapiens
atgaaattaacaagaa

SEQ ID NO: 5252497 - DNA, 16 bp, Homo sapiens
atgaaattacttatca

SEQ ID NO: 5252498 - DNA, 21 bp, Homo sapiens
atgaaattcttttataaatat

SEQ ID NO: 5252499 - DNA, 23 bp, Homo sapiens
atgaaattgccaaaaaaatttat

SEQ ID NO: 5252500 - DNA, 18 bp, Homo sapiens
atgaaattggttttccag

SEQ ID NO: 5252501 - DNA, 22 bp, Homo sapiens
atgaaattgtctagcagagcag

SEQ ID NO: 5252502 - DNA, 14 bp, Homo sapiens
atgaaatttaaaca

SEQ ID NO: 5252503 - DNA, 17 bp, Homo sapiens
atgaaatttaagcacaa

SEQ ID NO: 5252504 - DNA, 17 bp, Homo sapiens
atgaaatttaatatagc

SEQ ID NO: 5252505 - DNA, 21 bp, Homo sapiens
atgaaatttaattacaaacaa

SEQ ID NO: 5252506 - DNA, 22 bp, Homo sapiens
atgaaatttaattacaaacaat

SEQ ID NO: 5252507 - DNA, 18 bp, Homo sapiens
atgaaattttaccaagtt

SEQ ID NO: 5252508 - DNA, 22 bp, Homo sapiens
atgaaattttctagactttctg

SEQ ID NO: 5252509 - DNA, 16 bp, Homo sapiens
atgaaattttgcctgc

SEQ ID NO: 5252510 - DNA, 16 bp, Homo sapiens
atgaaatttttgtaaa

SEQ ID NO: 5252511 - DNA, 18 bp, Homo sapiens
atgaacaaaatgaagtta

SEQ ID NO: 5252512 - DNA, 14 bp, Homo sapiens
atgaacaaaattat

SEQ ID NO: 5252513 - DNA, 15 bp, Homo sapiens
atgaacaaaattatt

SEQ ID NO: 5252514 - DNA, 16 bp, Homo sapiens
atgaacaaaattattt

SEQ ID NO: 5252515 - DNA, 19 bp, Homo sapiens
atgaacaaagaccaatttt

SEQ ID NO: 5252516 - DNA, 16 bp, Homo sapiens
atgaacaaatatgctt

SEQ ID NO: 5252517 - DNA, 20 bp, Homo sapiens
atgaacaaattctttagtac

SEQ ID NO: 5252518 - DNA, 15 bp, Homo sapiens
atgaacaaattgaac

SEQ ID NO: 5252519 - DNA, 14 bp, Homo sapiens
atgaacaatgtata

SEQ ID NO: 5252520 - DNA, 14 bp, Homo sapiens
atgaacaattgcta

SEQ ID NO: 5252521 - DNA, 13 bp, Homo sapiens
atgaacacaaatg

SEQ ID NO: 5252522 - DNA, 14 bp, Homo sapiens
atgaacacaaatgt

SEQ ID NO: 5252523 - DNA, 15 bp, Homo sapiens
atgaacacaaattat

SEQ ID NO: 5252524 - DNA, 13 bp, Homo sapiens
atgaacacactgt

SEQ ID NO: 5252525 - DNA, 23 bp, Homo sapiens
atgaacactatgcactgctgtaa

SEQ ID NO: 5252526 - DNA, 14 bp, Homo sapiens
atgaacactcccca

SEQ ID NO: 5252527 - DNA, 18 bp, Homo sapiens
atgaacacttaaattatg

SEQ ID NO: 5252528 - DNA, 14 bp, Homo sapiens
atgaacagaattta

SEQ ID NO: 5252529 - DNA, 12 bp, Homo sapiens
atgaacagactt

SEQ ID NO: 5252530 - DNA, 12 bp, Homo sapiens
atgaacagcaga

SEQ ID NO: 5252531 - DNA, 13 bp, Homo sapiens
atgaacagctcct

SEQ ID NO: 5252532 - DNA, 17 bp, Homo sapiens
atgaacagctctgagat

SEQ ID NO: 5252533 - DNA, 22 bp, Homo sapiens
atgaacagctctgagatcctgg

SEQ ID NO: 5252534 - DNA, 17 bp, Homo sapiens
atgaacagctgtgtctg

SEQ ID NO: 5252535 - DNA, 23 bp, Homo sapiens
atgaacagggcccaggcctggag

SEQ ID NO: 5252536 - DNA, 22 bp, Homo sapiens
atgaacagttctcccttcaact

SEQ ID NO: 5252537 - DNA, 14 bp, Homo sapiens
atgaacataatgaa

SEQ ID NO: 5252538 - DNA, 15 bp, Homo sapiens
atgaacatctctgtt

SEQ ID NO: 5252539 - DNA, 18 bp, Homo sapiens
atgaacatctctgttatt

SEQ ID NO: 5252540 - DNA, 17 bp, Homo sapiens
atgaacatctcttgaaa

SEQ ID NO: 5252541 - DNA, 18 bp, Homo sapiens
atgaacatctcttgaaac

SEQ ID NO: 5252542 - DNA, 17 bp, Homo sapiens
atgaacatgcagttcat

SEQ ID NO: 5252543 - DNA, 15 bp, Homo sapiens
atgaacatgttttag

SEQ ID NO: 5252544 - DNA, 13 bp, Homo sapiens
atgaacattccaa

SEQ ID NO: 5252545 - DNA, 13 bp, Homo sapiens
atgaacatttcaa

SEQ ID NO: 5252546 - DNA, 19 bp, Homo sapiens
atgaacatttcaaattgaa

SEQ ID NO: 5252547 - DNA, 20 bp, Homo sapiens
atgaaccacatggaacttaa

SEQ ID NO: 5252548 - DNA, 21 bp, Homo sapiens
atgaacccaggacgcttctga

SEQ ID NO: 5252549 - DNA, 22 bp, Homo sapiens
atgaacccaggacgcttctgaa

SEQ ID NO: 5252550 - DNA, 22 bp, Homo sapiens
atgaacccctggctccttcacc

SEQ ID NO: 5252551 - DNA, 18 bp, Homo sapiens
atgaacccgaggctgaga

SEQ ID NO: 5252552 - DNA, 18 bp, Homo sapiens
atgaaccctccttttctc

SEQ ID NO: 5252553 - DNA, 21 bp, Homo sapiens
atgaaccctccttttctctga

SEQ ID NO: 5252554 - DNA, 16 bp, Homo sapiens
atgaaccctcttgcca

SEQ ID NO: 5252555 - DNA, 11 bp, Homo sapiens
atgaaccctgc

SEQ ID NO: 5252556 - DNA, 12 bp, Homo sapiens
atgaaccctgcc

SEQ ID NO: 5252557 - DNA, 13 bp, Homo sapiens
atgaaccctgccc

SEQ ID NO: 5252558 - DNA, 19 bp, Homo sapiens
atgaaccctgccctgctct

SEQ ID NO: 5252559 - DNA, 16 bp, Homo sapiens
atgaaccctggcattt

SEQ ID NO: 5252560 - DNA, 21 bp, Homo sapiens
atgaacccttcctgagcttta

SEQ ID NO: 5252561 - DNA, 22 bp, Homo sapiens
atgaacccttcctgagctttat

SEQ ID NO: 5252562 - DNA, 20 bp, Homo sapiens
atgaaccgcaatatgggagg

SEQ ID NO: 5252563 - DNA, 15 bp, Homo sapiens
atgaacctattttca

SEQ ID NO: 5252564 - DNA, 18 bp, Homo sapiens
atgaacctattttcattt

SEQ ID NO: 5252565 - DNA, 22 bp, Homo sapiens
atgaacctattttcatttgtac

SEQ ID NO: 5252566 - DNA, 18 bp, Homo sapiens
atgaacctgcaagccttc

SEQ ID NO: 5252567 - DNA, 15 bp, Homo sapiens
atgaacgccaaggaa

SEQ ID NO: 5252568 - DNA, 15 bp, Homo sapiens
atgaacggtgagcat

SEQ ID NO: 5252569 - DNA, 18 bp, Homo sapiens
atgaacgttttctcttca

SEQ ID NO: 5252570 - DNA, 15 bp, Homo sapiens
atgaactaactgcca

SEQ ID NO: 5252571 - DNA, 20 bp, Homo sapiens
atgaactaccatctgatgtt

SEQ ID NO: 5252572 - DNA, 12 bp, Homo sapiens
atgaactagcca

SEQ ID NO: 5252573 - DNA, 13 bp, Homo sapiens
atgaactattccc

SEQ ID NO: 5252574 - DNA, 15 bp, Homo sapiens
atgaactcaatgcat

SEQ ID NO: 5252575 - DNA, 19 bp, Homo sapiens
atgaactcaatgcatgatg

SEQ ID NO: 5252576 - DNA, 22 bp, Homo sapiens
atgaactcaggtttccggctac

SEQ ID NO: 5252577 - DNA, 15 bp, Homo sapiens
atgaactgaagtttc

SEQ ID NO: 5252578 - DNA, 17 bp, Homo sapiens
atgaactgaagtttcac

SEQ ID NO: 5252579 - DNA, 13 bp, Homo sapiens
atgaactgcatgt

SEQ ID NO: 5252580 - DNA, 18 bp, Homo sapiens
atgaactgcttttcctca

SEQ ID NO: 5252581 - DNA, 12 bp, Homo sapiens
atgaactggagg

SEQ ID NO: 5252582 - DNA, 18 bp, Homo sapiens
atgaactggaggccagga

SEQ ID NO: 5252583 - DNA, 20 bp, Homo sapiens
atgaactggcttgtacattt

SEQ ID NO: 5252584 - DNA, 14 bp, Homo sapiens
atgaactgtaaatg

SEQ ID NO: 5252585 - DNA, 13 bp, Homo sapiens
atgaactgtatat

SEQ ID NO: 5252586 - DNA, 17 bp, Homo sapiens
atgaactgtatattatt

SEQ ID NO: 5252587 - DNA, 19 bp, Homo sapiens
atgaactgtattattgcaa

SEQ ID NO: 5252588 - DNA, 22 bp, Homo sapiens
atgaactgtattattgcaattt

SEQ ID NO: 5252589 - DNA, 13 bp, Homo sapiens
atgaactgtgaca

SEQ ID NO: 5252590 - DNA, 12 bp, Homo sapiens
atgaactgtgga

SEQ ID NO: 5252591 - DNA, 15 bp, Homo sapiens
atgaactgtggaatt

SEQ ID NO: 5252592 - DNA, 16 bp, Homo sapiens
atgaactgtgtttcca

SEQ ID NO: 5252593 - DNA, 13 bp, Homo sapiens
atgaacttaacat

SEQ ID NO: 5252594 - DNA, 20 bp, Homo sapiens
atgaacttaacatgctgtgt

SEQ ID NO: 5252595 - DNA, 17 bp, Homo sapiens
atgaacttattctgtag

SEQ ID NO: 5252596 - DNA, 18 bp, Homo sapiens
atgaacttccatttgtat

SEQ ID NO: 5252597 - DNA, 22 bp, Homo sapiens
atgaacttccatttgtattcaa

SEQ ID NO: 5252598 - DNA, 13 bp, Homo sapiens
atgaacttcgcat

SEQ ID NO: 5252599 - DNA, 22 bp, Homo sapiens
atgaacttcgcatcaaaagaca

SEQ ID NO: 5252600 - DNA, 22 bp, Homo sapiens
atgaacttgagctctgtaactt

SEQ ID NO: 5252601 - DNA, 20 bp, Homo sapiens
atgaacttgaggacacatgt

SEQ ID NO: 5252602 - DNA, 21 bp, Homo sapiens
atgaacttgaggacacatgtc

SEQ ID NO: 5252603 - DNA, 22 bp, Homo sapiens
atgaacttgaggacacatgtcc

SEQ ID NO: 5252604 - DNA, 13 bp, Homo sapiens
atgaactttaaaa

SEQ ID NO: 5252605 - DNA, 17 bp, Homo sapiens
atgaactttctcttcat

SEQ ID NO: 5252606 - DNA, 20 bp, Homo sapiens
atgaactttgtcagtgttgc

SEQ ID NO: 5252607 - DNA, 15 bp, Homo sapiens
atgaacttttacaga

SEQ ID NO: 5252608 - DNA, 18 bp, Homo sapiens
atgaacttttacagaatg

SEQ ID NO: 5252609 - DNA, 18 bp, Homo sapiens
atgaactttttaacaaat

SEQ ID NO: 5252610 - DNA, 15 bp, Homo sapiens
atgaagaaaaaatac

SEQ ID NO: 5252611 - DNA, 22 bp, Homo sapiens
atgaagaaaaaatacattttat

SEQ ID NO: 5252612 - DNA, 15 bp, Homo sapiens
atgaagaaaaaattt

SEQ ID NO: 5252613 - DNA, 15 bp, Homo sapiens
atgaagaaaaagtac

SEQ ID NO: 5252614 - DNA, 21 bp, Homo sapiens
atgaagaaaagtgggccagtg

SEQ ID NO: 5252615 - DNA, 22 bp, Homo sapiens
atgaagaaaagtgggccagtgt

SEQ ID NO: 5252616 - DNA, 15 bp, Homo sapiens
atgaagaaaatactt

SEQ ID NO: 5252617 - DNA, 19 bp, Homo sapiens
atgaagaaaatcacttagg

SEQ ID NO: 5252618 - DNA, 11 bp, Homo sapiens
atgaagaaaga

SEQ ID NO: 5252619 - DNA, 15 bp, Homo sapiens
atgaagaaagcccct

SEQ ID NO: 5252620 - DNA, 14 bp, Homo sapiens
atgaagaaagggag

SEQ ID NO: 5252621 - DNA, 20 bp, Homo sapiens
atgaagaaagggaggcccag

SEQ ID NO: 5252622 - DNA, 22 bp, Homo sapiens
atgaagaaagggaggcccagcc

SEQ ID NO: 5252623 - DNA, 14 bp, Homo sapiens
atgaagaaagtaaa

SEQ ID NO: 5252624 - DNA, 18 bp, Homo sapiens
atgaagaaagtcaaaaaa

SEQ ID NO: 5252625 - DNA, 21 bp, Homo sapiens
atgaagaaagtcaaaaaatta

SEQ ID NO: 5252626 - DNA, 14 bp, Homo sapiens
atgaagaaagtgga

SEQ ID NO: 5252627 - DNA, 19 bp, Homo sapiens
atgaagaacacagcatgtg

SEQ ID NO: 5252628 - DNA, 13 bp, Homo sapiens
atgaagaagaaaa

SEQ ID NO: 5252629 - DNA, 16 bp, Homo sapiens
atgaagaagaaaacat

SEQ ID NO: 5252630 - DNA, 13 bp, Homo sapiens
atgaagaagacaa

SEQ ID NO: 5252631 - DNA, 16 bp, Homo sapiens
atgaagaagcctttgt

SEQ ID NO: 5252632 - DNA, 16 bp, Homo sapiens
atgaagaaggagcaga

SEQ ID NO: 5252633 - DNA, 14 bp, Homo sapiens
atgaagaatagaaa

SEQ ID NO: 5252634 - DNA, 19 bp, Homo sapiens
atgaagaattgccaatctt

SEQ ID NO: 5252635 - DNA, 14 bp, Homo sapiens
atgaagacaatgat

SEQ ID NO: 5252636 - DNA, 20 bp, Homo sapiens
atgaagacaccagagtgtat

SEQ ID NO: 5252637 - DNA, 16 bp, Homo sapiens
atgaagacaggacagt

SEQ ID NO: 5252638 - DNA, 17 bp, Homo sapiens
atgaagacccagtgtaa

SEQ ID NO: 5252639 - DNA, 12 bp, Homo sapiens
atgaagacctaa

SEQ ID NO: 5252640 - DNA, 18 bp, Homo sapiens
atgaagacctaaatgacc

SEQ ID NO: 5252641 - DNA, 19 bp, Homo sapiens
atgaagacctaaatgacct

SEQ ID NO: 5252642 - DNA, 13 bp, Homo sapiens
atgaagacttaaa

SEQ ID NO: 5252643 - DNA, 15 bp, Homo sapiens
atgaagagaagctga

SEQ ID NO: 5252644 - DNA, 16 bp, Homo sapiens
atgaagagaagctgag

SEQ ID NO: 5252645 - DNA, 17 bp, Homo sapiens
atgaagagaagctgaga

SEQ ID NO: 5252646 - DNA, 21 bp, Homo sapiens
atgaagagaaggcacacagag

SEQ ID NO: 5252647 - DNA, 14 bp, Homo sapiens
atgaagagactctc

SEQ ID NO: 5252648 - DNA, 16 bp, Homo sapiens
atgaagagatttttca

SEQ ID NO: 5252649 - DNA, 15 bp, Homo sapiens
atgaagagccagccc

SEQ ID NO: 5252650 - DNA, 12 bp, Homo sapiens
atgaagagctgt

SEQ ID NO: 5252651 - DNA, 17 bp, Homo sapiens
atgaagaggaagttaaa

SEQ ID NO: 5252652 - DNA, 11 bp, Homo sapiens
atgaagaggag

SEQ ID NO: 5252653 - DNA, 18 bp, Homo sapiens
atgaagagtattaatgta

SEQ ID NO: 5252654 - DNA, 21 bp, Homo sapiens
atgaagataccatcagcaaag

SEQ ID NO: 5252655 - DNA, 22 bp, Homo sapiens
atgaagatatttttccattttt

SEQ ID NO: 5252656 - DNA, 24 bp, Homo sapiens
atgaagatgcattttaaatgtcta

SEQ ID NO: 5252657 - DNA, 18 bp, Homo sapiens
atgaagatgtagaggaga

SEQ ID NO: 5252658 - DNA, 21 bp, Homo sapiens
atgaagatgtctaatagttat

SEQ ID NO: 5252659 - DNA, 12 bp, Homo sapiens
atgaagatgttt

SEQ ID NO: 5252660 - DNA, 22 bp, Homo sapiens
atgaagatgtttcaaaaaatct

SEQ ID NO: 5252661 - DNA, 17 bp, Homo sapiens
atgaagatgtttttaga

SEQ ID NO: 5252662 - DNA, 18 bp, Homo sapiens
atgaagattaacactgag

SEQ ID NO: 5252663 - DNA, 13 bp, Homo sapiens
atgaagcaacaga

SEQ ID NO: 5252664 - DNA, 14 bp, Homo sapiens
atgaagcaagctgt

SEQ ID NO: 5252665 - DNA, 18 bp, Homo sapiens
atgaagcaagctgtgtta

SEQ ID NO: 5252666 - DNA, 15 bp, Homo sapiens
atgaagcaaggaaga

SEQ ID NO: 5252667 - DNA, 16 bp, Homo sapiens
atgaagcaaggaagat

SEQ ID NO: 5252668 - DNA, 22 bp, Homo sapiens
atgaagcagaatgagatgattt

SEQ ID NO: 5252669 - DNA, 16 bp, Homo sapiens
atgaagcagaggaagg

SEQ ID NO: 5252670 - DNA, 18 bp, Homo sapiens
atgaagcagaggaaggaa

SEQ ID NO: 5252671 - DNA, 20 bp, Homo sapiens
atgaagcagaggaaggaaac

SEQ ID NO: 5252672 - DNA, 15 bp, Homo sapiens
atgaagcagctttaa

SEQ ID NO: 5252673 - DNA, 14 bp, Homo sapiens
atgaagcaggaggc

SEQ ID NO: 5252674 - DNA, 13 bp, Homo sapiens
atgaagcagtatt

SEQ ID NO: 5252675 - DNA, 17 bp, Homo sapiens
atgaagcccaagtgaaa

SEQ ID NO: 5252676 - DNA, 12 bp, Homo sapiens
atcagtgttgat

SEQ ID NO: 5252677 - DNA, 24 bp, Homo sapiens
atcagtgttgattctagatgatca

SEQ ID NO: 5252678 - DNA, 21 bp, Homo sapiens
atcagtgttgttgctctagga

SEQ ID NO: 5252679 - DNA, 13 bp, Homo sapiens
atcagtgtttaca

SEQ ID NO: 5252680 - DNA, 14 bp, Homo sapiens
atcagtgtttatgt

SEQ ID NO: 5252681 - DNA, 22 bp, Homo sapiens
atcagtgtttatgtgctattaa

SEQ ID NO: 5252682 - DNA, 17 bp, Homo sapiens
atcagtgttttaaattc

SEQ ID NO: 5252683 - DNA, 22 bp, Homo sapiens
atcagttaagaaatttcacata

SEQ ID NO: 5252684 - DNA, 22 bp, Homo sapiens
atcagttacagtggcagtattg

SEQ ID NO: 5252685 - DNA, 23 bp, Homo sapiens
atcagttacccactcggtcccag

SEQ ID NO: 5252686 - DNA, 16 bp, Homo sapiens
atcagttactcagccc

SEQ ID NO: 5252687 - DNA, 18 bp, Homo sapiens
atcagttactcagccctg

SEQ ID NO: 5252688 - DNA, 15 bp, Homo sapiens
atcagttactggtat

SEQ ID NO: 5252689 - DNA, 15 bp, Homo sapiens
atcagttactggttt

SEQ ID NO: 5252690 - DNA, 14 bp, Homo sapiens
atcagttatatgat

SEQ ID NO: 5252691 - DNA, 16 bp, Homo sapiens
atcagttatatgatat

SEQ ID NO: 5252692 - DNA, 17 bp, Homo sapiens
atcagttatattcttta

SEQ ID NO: 5252693 - DNA, 21 bp, Homo sapiens
atcagttatattctttaaatt

SEQ ID NO: 5252694 - DNA, 17 bp, Homo sapiens
atcagttatcctttgtg

SEQ ID NO: 5252695 - DNA, 18 bp, Homo sapiens
atcagttatcctttgtga

SEQ ID NO: 5252696 - DNA, 16 bp, Homo sapiens
atcagttcaaaaggag

SEQ ID NO: 5252697 - DNA, 17 bp, Homo sapiens
atcagttcactgctgca

SEQ ID NO: 5252698 - DNA, 17 bp, Homo sapiens
atcagttcattagaaat

SEQ ID NO: 5252699 - DNA, 18 bp, Homo sapiens
atcagttcattagaaata

SEQ ID NO: 5252700 - DNA, 19 bp, Homo sapiens
atcagttcattagaaatat

SEQ ID NO: 5252701 - DNA, 17 bp, Homo sapiens
atcagttcctttgtgtg

SEQ ID NO: 5252702 - DNA, 23 bp, Homo sapiens
atcagttcttagattcaggggaa

SEQ ID NO: 5252703 - DNA, 16 bp, Homo sapiens
atcagttgattaagtt

SEQ ID NO: 5252704 - DNA, 21 bp, Homo sapiens
atcagttgcaataatacttct

SEQ ID NO: 5252705 - DNA, 13 bp, Homo sapiens
atcagttgcaggt

SEQ ID NO: 5252706 - DNA, 24 bp, Homo sapiens
atcagtttatcctgacatattcaa

SEQ ID NO: 5252707 - DNA, 18 bp, Homo sapiens
atcagtttattaaatctg

SEQ ID NO: 5252708 - DNA, 21 bp, Homo sapiens
atcagtttccatgaaagacct

SEQ ID NO: 5252709 - DNA, 14 bp, Homo sapiens
atcagttttcctag

SEQ ID NO: 5252710 - DNA, 16 bp, Homo sapiens
atcagttttggaatct

SEQ ID NO: 5252711 - DNA, 16 bp, Homo sapiens
atcagttttgtgtaca

SEQ ID NO: 5252712 - DNA, 14 bp, Homo sapiens
atcagtttttcata

SEQ ID NO: 5252713 - DNA, 21 bp, Homo sapiens
atcagttttttcacctggaag

SEQ ID NO: 5252714 - DNA, 19 bp, Homo sapiens
atcataaaagtgattcttt

SEQ ID NO: 5252715 - DNA, 22 bp, Homo sapiens
atcataaaagtgattctttttt

SEQ ID NO: 5252716 - DNA, 14 bp, Homo sapiens
atcataaacatttt

SEQ ID NO: 5252717 - DNA, 11 bp, Homo sapiens
atcataaagta

SEQ ID NO: 5252718 - DNA, 14 bp, Homo sapiens
atcataaagtcagt

SEQ ID NO: 5252719 - DNA, 17 bp, Homo sapiens
atcataacatagttgaa

SEQ ID NO: 5252720 - DNA, 14 bp, Homo sapiens
atcataaccacccc

SEQ ID NO: 5252721 - DNA, 17 bp, Homo sapiens
atcataacttaataaat

SEQ ID NO: 5252722 - DNA, 21 bp, Homo sapiens
atcataagatagttacattta

SEQ ID NO: 5252723 - DNA, 22 bp, Homo sapiens
atcataagatagttacatttat

SEQ ID NO: 5252724 - DNA, 23 bp, Homo sapiens
atcataagatagttacatttatg

SEQ ID NO: 5252725 - DNA, 20 bp, Homo sapiens
atcataaggagttggtgtaa

SEQ ID NO: 5252726 - DNA, 14 bp, Homo sapiens
atcataagtatttg

SEQ ID NO: 5252727 - DNA, 15 bp, Homo sapiens
atcataagtgaattt

SEQ ID NO: 5252728 - DNA, 16 bp, Homo sapiens
atcataagtgaattta

SEQ ID NO: 5252729 - DNA, 17 bp, Homo sapiens
atcataagttagatgtt

SEQ ID NO: 5252730 - DNA, 22 bp, Homo sapiens
atcataagttatgcctctgaca

SEQ ID NO: 5252731 - DNA, 17 bp, Homo sapiens
atcataatataaaacag

SEQ ID NO: 5252732 - DNA, 13 bp, Homo sapiens
atcataatgtaat

SEQ ID NO: 5252733 - DNA, 13 bp, Homo sapiens
atcataattacca

SEQ ID NO: 5252734 - DNA, 16 bp, Homo sapiens
atcatacaccagaaga

SEQ ID NO: 5252735 - DNA, 14 bp, Homo sapiens
atcatacagttttc

SEQ ID NO: 5252736 - DNA, 22 bp, Homo sapiens
atcatacgttgatagtttacaa

SEQ ID NO: 5252737 - DNA, 23 bp, Homo sapiens
atcatacgttgatagtttacaaa

SEQ ID NO: 5252738 - DNA, 22 bp, Homo sapiens
atcatactaccggctacatcaa

SEQ ID NO: 5252739 - DNA, 16 bp, Homo sapiens
atcatactgattttta

SEQ ID NO: 5252740 - DNA, 13 bp, Homo sapiens
atcatacttaact

SEQ ID NO: 5252741 - DNA, 19 bp, Homo sapiens
atcatacttaactttacta

SEQ ID NO: 5252742 - DNA, 14 bp, Homo sapiens
atcatagaaaaact

SEQ ID NO: 5252743 - DNA, 16 bp, Homo sapiens
atcatagaacagaaat

SEQ ID NO: 5252744 - DNA, 18 bp, Homo sapiens
atcatagacccatctgga

SEQ ID NO: 5252745 - DNA, 21 bp, Homo sapiens
atcatagattattataaacta

SEQ ID NO: 5252746 - DNA, 22 bp, Homo sapiens
atcatagattattataaactat

SEQ ID NO: 5252747 - DNA, 23 bp, Homo sapiens
atcatagattattataaactata

SEQ ID NO: 5252748 - DNA, 17 bp, Homo sapiens
atcatagatttctgatt

SEQ ID NO: 5252749 - DNA, 20 bp, Homo sapiens
atcatagcaagacctcatct

SEQ ID NO: 5252750 - DNA, 21 bp, Homo sapiens
atcatagcaagacctcatctc

SEQ ID NO: 5252751 - DNA, 21 bp, Homo sapiens
atcataggaagggaccaaggc

SEQ ID NO: 5252752 - DNA, 15 bp, Homo sapiens
atcataggaagtggc

SEQ ID NO: 5252753 - DNA, 17 bp, Homo sapiens
atcataggaagtggctg

SEQ ID NO: 5252754 - DNA, 21 bp, Homo sapiens
atcataggcaccttttactgt

SEQ ID NO: 5252755 - DNA, 17 bp, Homo sapiens
atcataggtatttcaaa

SEQ ID NO: 5252756 - DNA, 16 bp, Homo sapiens
atcatagtatatgatt

SEQ ID NO: 5252757 - DNA, 23 bp, Homo sapiens
atcatagtggcttaaaacaacac

SEQ ID NO: 5252758 - DNA, 23 bp, Homo sapiens
atcatagtgtacccatctttaat

SEQ ID NO: 5252759 - DNA, 21 bp, Homo sapiens
atcatagtttgctttgtttaa

SEQ ID NO: 5252760 - DNA, 18 bp, Homo sapiens
atcatataaaatttcagg

SEQ ID NO: 5252761 - DNA, 13 bp, Homo sapiens
atcatataagcaa

SEQ ID NO: 5252762 - DNA, 14 bp, Homo sapiens
atcatataagcaag

SEQ ID NO: 5252763 - DNA, 20 bp, Homo sapiens
atcatataataaatgtacat

SEQ ID NO: 5252764 - DNA, 19 bp, Homo sapiens
atcatatataataaattaa

SEQ ID NO: 5252765 - DNA, 22 bp, Homo sapiens
atcatatatatagttatgcata

SEQ ID NO: 5252766 - DNA, 17 bp, Homo sapiens
atcatatatgctttttt

SEQ ID NO: 5252767 - DNA, 19 bp, Homo sapiens
atcatatattaaaacaata

SEQ ID NO: 5252768 - DNA, 13 bp, Homo sapiens
atcatatctgtat

SEQ ID NO: 5252769 - DNA, 17 bp, Homo sapiens
atcatatgaatgttctt

SEQ ID NO: 5252770 - DNA, 20 bp, Homo sapiens
atcatatgaccattgaaaaa

SEQ ID NO: 5252771 - DNA, 22 bp, Homo sapiens
atcatatgtatctaaatgaaaa

SEQ ID NO: 5252772 - DNA, 23 bp, Homo sapiens
atcatattctcatggctttgtta

SEQ ID NO: 5252773 - DNA, 12 bp, Homo sapiens
atcatattgaga

SEQ ID NO: 5252774 - DNA, 18 bp, Homo sapiens
atcatattgagaataatt

SEQ ID NO: 5252775 - DNA, 23 bp, Homo sapiens
atcatattggtatatccttttct

SEQ ID NO: 5252776 - DNA, 19 bp, Homo sapiens
atcatattggtgctgagtg

SEQ ID NO: 5252777 - DNA, 15 bp, Homo sapiens
atcatattgtatgta

SEQ ID NO: 5252778 - DNA, 16 bp, Homo sapiens
atcatatttaatagga

SEQ ID NO: 5252779 - DNA, 17 bp, Homo sapiens
atcatatttgaaaacca

SEQ ID NO: 5252780 - DNA, 20 bp, Homo sapiens
atcatattttgttgtgcact

SEQ ID NO: 5252781 - DNA, 12 bp, Homo sapiens
atcatcaagaag

SEQ ID NO: 5252782 - DNA, 23 bp, Homo sapiens
atcatcaagcaggaattatgtcg

SEQ ID NO: 5252783 - DNA, 18 bp, Homo sapiens
atcatcacaattagggaa

SEQ ID NO: 5252784 - DNA, 18 bp, Homo sapiens
atcatcaccgattcttcc

SEQ ID NO: 5252785 - DNA, 19 bp, Homo sapiens
atcatcactgtaaagacaa

SEQ ID NO: 5252786 - DNA, 21 bp, Homo sapiens
atcatcagactagtatcaagt

SEQ ID NO: 5252787 - DNA, 15 bp, Homo sapiens
atcatcagggcctgg

SEQ ID NO: 5252788 - DNA, 15 bp, Homo sapiens
atcatcagtattgaa

SEQ ID NO: 5252789 - DNA, 18 bp, Homo sapiens
atcatcagtgcctctttg

SEQ ID NO: 5252790 - DNA, 16 bp, Homo sapiens
atcatcagtgtagaac

SEQ ID NO: 5252791 - DNA, 20 bp, Homo sapiens
atcatcataggtaacagtta

SEQ ID NO: 5252792 - DNA, 15 bp, Homo sapiens
atcatcatgtagaat

SEQ ID NO: 5252793 - DNA, 14 bp, Homo sapiens
atcatcattattat

SEQ ID NO: 5252794 - DNA, 18 bp, Homo sapiens
atcatcattcttgtggga

SEQ ID NO: 5252795 - DNA, 20 bp, Homo sapiens
atcatccacccgctgcccct

SEQ ID NO: 5252796 - DNA, 21 bp, Homo sapiens
atcatccacccgctgcccctc

SEQ ID NO: 5252797 - DNA, 21 bp, Homo sapiens
atcatccactgtgccatgtgc

SEQ ID NO: 5252798 - DNA, 17 bp, Homo sapiens
atcatccagactcctca

SEQ ID NO: 5252799 - DNA, 13 bp, Homo sapiens
atcatccaggcct

SEQ ID NO: 5252800 - DNA, 14 bp, Homo sapiens
atcatcccagctgc

SEQ ID NO: 5252801 - DNA, 16 bp, Homo sapiens
atcatccctccctgcc

SEQ ID NO: 5252802 - DNA, 17 bp, Homo sapiens
atcatccctccctgcct

SEQ ID NO: 5252803 - DNA, 19 bp, Homo sapiens
atcatccctttcccttggt

SEQ ID NO: 5252804 - DNA, 21 bp, Homo sapiens
atcatccctttctcccagtga

SEQ ID NO: 5252805 - DNA, 12 bp, Homo sapiens
atcatcctactg

SEQ ID NO: 5252806 - DNA, 17 bp, Homo sapiens
atcatcctataaagaaa

SEQ ID NO: 5252807 - DNA, 13 bp, Homo sapiens
atcatcctcatgt

SEQ ID NO: 5252808 - DNA, 20 bp, Homo sapiens
atcatcctcccgccaggagc

SEQ ID NO: 5252809 - DNA, 23 bp, Homo sapiens
atcatcctcccgccaggagcttc

SEQ ID NO: 5252810 - DNA, 16 bp, Homo sapiens
atcatcctttccagca

SEQ ID NO: 5252811 - DNA, 16 bp, Homo sapiens
atcatcctttgttctg

SEQ ID NO: 5252812 - DNA, 19 bp, Homo sapiens
atcatcctttgttctgagc

SEQ ID NO: 5252813 - DNA, 15 bp, Homo sapiens
atcatcgaaaattca

SEQ ID NO: 5252814 - DNA, 20 bp, Homo sapiens
atcatcgaaaattcatttca

SEQ ID NO: 5252815 - DNA, 13 bp, Homo sapiens
atcatcgccagag

SEQ ID NO: 5252816 - DNA, 20 bp, Homo sapiens
atcatcgccagaggtgcttc

SEQ ID NO: 5252817 - DNA, 22 bp, Homo sapiens
atcatcgccagaggtgcttcac

SEQ ID NO: 5252818 - DNA, 16 bp, Homo sapiens
atcatctaaatattat

SEQ ID NO: 5252819 - DNA, 21 bp, Homo sapiens
atcatctacctagatttaata

SEQ ID NO: 5252820 - DNA, 16 bp, Homo sapiens
atcatctataaagaag

SEQ ID NO: 5252821 - DNA, 18 bp, Homo sapiens
atcatctataaagaagaa

SEQ ID NO: 5252822 - DNA, 15 bp, Homo sapiens
atcatctatagaaag

SEQ ID NO: 5252823 - DNA, 19 bp, Homo sapiens
atcatctatagaaagctat

SEQ ID NO: 5252824 - DNA, 15 bp, Homo sapiens
atcatctattttgat

SEQ ID NO: 5252825 - DNA, 23 bp, Homo sapiens
atcatctattttgatgcagcatt

SEQ ID NO: 5252826 - DNA, 14 bp, Homo sapiens
atcatctcagctca

SEQ ID NO: 5252827 - DNA, 14 bp, Homo sapiens
atcatctccatcat

SEQ ID NO: 5252828 - DNA, 23 bp, Homo sapiens
atcatctccatcatatgcctgac

SEQ ID NO: 5252829 - DNA, 23 bp, Homo sapiens
atcatctcctgccttcctcctgg

SEQ ID NO: 5252830 - DNA, 21 bp, Homo sapiens
atcatctcctttgcagaatga

SEQ ID NO: 5252831 - DNA, 15 bp, Homo sapiens
atcatctctgccttt

SEQ ID NO: 5252832 - DNA, 13 bp, Homo sapiens
atcatctctgtga

SEQ ID NO: 5252833 - DNA, 22 bp, Homo sapiens
atcatctcttgataaaggagag

SEQ ID NO: 5252834 - DNA, 18 bp, Homo sapiens
atcatctcttttcccact

SEQ ID NO: 5252835 - DNA, 13 bp, Homo sapiens
atcatctgctgca

SEQ ID NO: 5252836 - DNA, 18 bp, Homo sapiens
atcatctggtttttaaaa

SEQ ID NO: 5252837 - DNA, 17 bp, Homo sapiens
atcatctgtaagctgtt

SEQ ID NO: 5252838 - DNA, 18 bp, Homo sapiens
atcatctgtgtgaaaatg

SEQ ID NO: 5252839 - DNA, 19 bp, Homo sapiens
atcatctgtgtgaaaatgg

SEQ ID NO: 5252840 - DNA, 14 bp, Homo sapiens
atcatctgtttgta

SEQ ID NO: 5252841 - DNA, 19 bp, Homo sapiens
atcatctgtttgtaatcat

SEQ ID NO: 5252842 - DNA, 19 bp, Homo sapiens
atcatcttgaatatttgct

SEQ ID NO: 5252843 - DNA, 18 bp, Homo sapiens
atcatcttggaactgcat

SEQ ID NO: 5252844 - DNA, 12 bp, Homo sapiens
atcatctttgct

SEQ ID NO: 5252845 - DNA, 20 bp, Homo sapiens
atcatgaaaagaggaacagg

SEQ ID NO: 5252846 - DNA, 16 bp, Homo sapiens
atcatgaaacacttct

SEQ ID NO: 5252847 - DNA, 19 bp, Homo sapiens
atcatgaaacacttctcat

SEQ ID NO: 5252848 - DNA, 16 bp, Homo sapiens
atcatgaaaccaaaaa

SEQ ID NO: 5252849 - DNA, 22 bp, Homo sapiens
atcatgaaacttgtttcactga

SEQ ID NO: 5252850 - DNA, 23 bp, Homo sapiens
atcatgaaacttgtttcactgaa

SEQ ID NO: 5252851 - DNA, 15 bp, Homo sapiens
atcatgaaatatgca

SEQ ID NO: 5252852 - DNA, 16 bp, Homo sapiens
atcatgaaattactta

SEQ ID NO: 5252853 - DNA, 16 bp, Homo sapiens
atgaagcccaataaac

SEQ ID NO: 5252854 - DNA, 16 bp, Homo sapiens
atgaagcccgtgtcct

SEQ ID NO: 5252855 - DNA, 20 bp, Homo sapiens
atgaagcccgtgtcctgcct

SEQ ID NO: 5252856 - DNA, 19 bp, Homo sapiens
atgaagccgaccttagatt

SEQ ID NO: 5252857 - DNA, 20 bp, Homo sapiens
atgaagcctccttagaaaaa

SEQ ID NO: 5252858 - DNA, 17 bp, Homo sapiens
atgaagcctgtgccacc

SEQ ID NO: 5252859 - DNA, 21 bp, Homo sapiens
atgaagcctgtgccacctgca

SEQ ID NO: 5252860 - DNA, 14 bp, Homo sapiens
atgaagccttctga

SEQ ID NO: 5252861 - DNA, 14 bp, Homo sapiens
atgaagccttgctg

SEQ ID NO: 5252862 - DNA, 23 bp, Homo sapiens
atgaagcctttggtgaattcctt

SEQ ID NO: 5252863 - DNA, 19 bp, Homo sapiens
atgaagcgaaacacagaga

SEQ ID NO: 5252864 - DNA, 17 bp, Homo sapiens
atgaagctaatgtgaat

SEQ ID NO: 5252865 - DNA, 14 bp, Homo sapiens
atgaagctacctca

SEQ ID NO: 5252866 - DNA, 15 bp, Homo sapiens
atgaagctctggcca

SEQ ID NO: 5252867 - DNA, 12 bp, Homo sapiens
atgaagctcttg

SEQ ID NO: 5252868 - DNA, 23 bp, Homo sapiens
atgaagctggaagcactgctgtg

SEQ ID NO: 5252869 - DNA, 15 bp, Homo sapiens
atgaagctggccctc

SEQ ID NO: 5252870 - DNA, 19 bp, Homo sapiens
atgaagctgtttttgtgct

SEQ ID NO: 5252871 - DNA, 13 bp, Homo sapiens
atgaagcttgtgt

SEQ ID NO: 5252872 - DNA, 22 bp, Homo sapiens
atgaagctttggccctcagtgg

SEQ ID NO: 5252873 - DNA, 17 bp, Homo sapiens
atgaaggaaagtgtatg

SEQ ID NO: 5252874 - DNA, 12 bp, Homo sapiens
atgaaggaattt

SEQ ID NO: 5252875 - DNA, 21 bp, Homo sapiens
atgaaggaatttgattgcttt

SEQ ID NO: 5252876 - DNA, 22 bp, Homo sapiens
atgaaggactattaattccaag

SEQ ID NO: 5252877 - DNA, 15 bp, Homo sapiens
atgaaggagacagca

SEQ ID NO: 5252878 - DNA, 19 bp, Homo sapiens
atgaaggctggaaggcagc

SEQ ID NO: 5252879 - DNA, 22 bp, Homo sapiens
atgaagggaaaattagctttta

SEQ ID NO: 5252880 - DNA, 14 bp, Homo sapiens
atgaagggccagca

SEQ ID NO: 5252881 - DNA, 22 bp, Homo sapiens
atgaaggggccagaccacgccc

SEQ ID NO: 5252882 - DNA, 17 bp, Homo sapiens
atgaaggtaaataaaaa

SEQ ID NO: 5252883 - DNA, 21 bp, Homo sapiens
atgaaggtaggtaaataggta

SEQ ID NO: 5252884 - DNA, 20 bp, Homo sapiens
atgaaggttaggatttaaca

SEQ ID NO: 5252885 - DNA, 17 bp, Homo sapiens
atgaaggtttttgtaaa

SEQ ID NO: 5252886 - DNA, 12 bp, Homo sapiens
atgaagtaaatt

SEQ ID NO: 5252887 - DNA, 16 bp, Homo sapiens
atgaagtaaattatgt

SEQ ID NO: 5252888 - DNA, 14 bp, Homo sapiens
atgaagtaagttct

SEQ ID NO: 5252889 - DNA, 21 bp, Homo sapiens
atgaagtaatatgcacacatt

SEQ ID NO: 5252890 - DNA, 11 bp, Homo sapiens
atgaagtactt

SEQ ID NO: 5252891 - DNA, 15 bp, Homo sapiens
atgaagtatactttt

SEQ ID NO: 5252892 - DNA, 16 bp, Homo sapiens
atgaagtatacttttc

SEQ ID NO: 5252893 - DNA, 16 bp, Homo sapiens
atgaagtatataatgg

SEQ ID NO: 5252894 - DNA, 14 bp, Homo sapiens
atgaagtatttcat

SEQ ID NO: 5252895 - DNA, 15 bp, Homo sapiens
atgaagtatttcatg

SEQ ID NO: 5252896 - DNA, 20 bp, Homo sapiens
atgaagtccaagcatttaga

SEQ ID NO: 5252897 - DNA, 18 bp, Homo sapiens
atgaagtcgttgtgaggg

SEQ ID NO: 5252898 - DNA, 20 bp, Homo sapiens
atgaagtgctacagaaagca

SEQ ID NO: 5252899 - DNA, 23 bp, Homo sapiens
atgaagtgctacagaaagcacaa

SEQ ID NO: 5252900 - DNA, 19 bp, Homo sapiens
atgaagttaagcacaacca

SEQ ID NO: 5252901 - DNA, 21 bp, Homo sapiens
atgaagttgattcatattgca

SEQ ID NO: 5252902 - DNA, 22 bp, Homo sapiens
atgaagttgattcatattgcat

SEQ ID NO: 5252903 - DNA, 19 bp, Homo sapiens
atgaagttggcacatttca

SEQ ID NO: 5252904 - DNA, 18 bp, Homo sapiens
atgaagttgtaagaaaag

SEQ ID NO: 5252905 - DNA, 21 bp, Homo sapiens
atgaagtttaaaacagtattt

SEQ ID NO: 5252906 - DNA, 15 bp, Homo sapiens
atgaagtttaaattc

SEQ ID NO: 5252907 - DNA, 16 bp, Homo sapiens
atgaagtttatacagt

SEQ ID NO: 5252908 - DNA, 19 bp, Homo sapiens
atgaagtttccttggctgg

SEQ ID NO: 5252909 - DNA, 23 bp, Homo sapiens
atgaagtttccttggctggtgca

SEQ ID NO: 5252910 - DNA, 18 bp, Homo sapiens
atgaagtttgaatgttaa

SEQ ID NO: 5252911 - DNA, 23 bp, Homo sapiens
atgaagtttttaaaaataaagga

SEQ ID NO: 5252912 - DNA, 21 bp, Homo sapiens
atgaataaaacaataaatgaa

SEQ ID NO: 5252913 - DNA, 15 bp, Homo sapiens
atgaataaaataatt

SEQ ID NO: 5252914 - DNA, 16 bp, Homo sapiens
atgaataaaatgttta

SEQ ID NO: 5252915 - DNA, 21 bp, Homo sapiens
atgaataaactgaatattttg

SEQ ID NO: 5252916 - DNA, 17 bp, Homo sapiens
atgaataaagaatgcca

SEQ ID NO: 5252917 - DNA, 23 bp, Homo sapiens
atgaataaagaatgccatttctc

SEQ ID NO: 5252918 - DNA, 15 bp, Homo sapiens
atgaataaagtgcaa

SEQ ID NO: 5252919 - DNA, 23 bp, Homo sapiens
atgaataactaagatatagaaac

SEQ ID NO: 5252920 - DNA, 16 bp, Homo sapiens
atgaataattatgttt

SEQ ID NO: 5252921 - DNA, 17 bp, Homo sapiens
atgaataatttattatt

SEQ ID NO: 5252922 - DNA, 22 bp, Homo sapiens
atgaataatttcccaattagga

SEQ ID NO: 5252923 - DNA, 13 bp, Homo sapiens
atgaatacaaatt

SEQ ID NO: 5252924 - DNA, 14 bp, Homo sapiens
atgaatacacagga

SEQ ID NO: 5252925 - DNA, 13 bp, Homo sapiens
atgaatacagcag

SEQ ID NO: 5252926 - DNA, 15 bp, Homo sapiens
atgaatacagcagca

SEQ ID NO: 5252927 - DNA, 22 bp, Homo sapiens
atgaataccaggatagctttat

SEQ ID NO: 5252928 - DNA, 18 bp, Homo sapiens
atgaatacgtcttgatca

SEQ ID NO: 5252929 - DNA, 22 bp, Homo sapiens
atgaatactatccatgtaataa

SEQ ID NO: 5252930 - DNA, 16 bp, Homo sapiens
atgaatactgaatttt

SEQ ID NO: 5252931 - DNA, 17 bp, Homo sapiens
atgaatagaagaaagaa

SEQ ID NO: 5252932 - DNA, 19 bp, Homo sapiens
atgaatagacataaattgt

SEQ ID NO: 5252933 - DNA, 17 bp, Homo sapiens
atgaatagcttgtttct

SEQ ID NO: 5252934 - DNA, 21 bp, Homo sapiens
atgaatagcttgtttctgtca

SEQ ID NO: 5252935 - DNA, 17 bp, Homo sapiens
atgaatagtacatgcag

SEQ ID NO: 5252936 - DNA, 16 bp, Homo sapiens
atgaatataatgaatg

SEQ ID NO: 5252937 - DNA, 22 bp, Homo sapiens
atgaatatatacataaaaattg

SEQ ID NO: 5252938 - DNA, 19 bp, Homo sapiens
atgaatatcaagaatagtt

SEQ ID NO: 5252939 - DNA, 21 bp, Homo sapiens
atgaatatcaggctattattt

SEQ ID NO: 5252940 - DNA, 21 bp, Homo sapiens
atgaatatcatgcaaataaat

SEQ ID NO: 5252941 - DNA, 16 bp, Homo sapiens
atgaatatctgcttta

SEQ ID NO: 5252942 - DNA, 23 bp, Homo sapiens
atgaatattacatgtaaagctgt

SEQ ID NO: 5252943 - DNA, 22 bp, Homo sapiens
atgaatattactctcaaaatct

SEQ ID NO: 5252944 - DNA, 13 bp, Homo sapiens
atgaatattgtaa

SEQ ID NO: 5252945 - DNA, 14 bp, Homo sapiens
atgaatatttcatt

SEQ ID NO: 5252946 - DNA, 15 bp, Homo sapiens
atgaatatttcattt

SEQ ID NO: 5252947 - DNA, 17 bp, Homo sapiens
atgaatatttcttaagt

SEQ ID NO: 5252948 - DNA, 21 bp, Homo sapiens
atgaatatttcttaagtatct

SEQ ID NO: 5252949 - DNA, 13 bp, Homo sapiens
atgaatattttca

SEQ ID NO: 5252950 - DNA, 14 bp, Homo sapiens
atgaatattttcaa

SEQ ID NO: 5252951 - DNA, 21 bp, Homo sapiens
atgaatattttcaagtttttc

SEQ ID NO: 5252952 - DNA, 20 bp, Homo sapiens
atgaatattttgataataat

SEQ ID NO: 5252953 - DNA, 21 bp, Homo sapiens
atgaatcaaaagtgcctcaag

SEQ ID NO: 5252954 - DNA, 16 bp, Homo sapiens
atgaatcaatgaaaaa

SEQ ID NO: 5252955 - DNA, 12 bp, Homo sapiens
atgaatcaatgg

SEQ ID NO: 5252956 - DNA, 21 bp, Homo sapiens
atgaatcaatgtgctccttca

SEQ ID NO: 5252957 - DNA, 13 bp, Homo sapiens
atgaatcactgtt

SEQ ID NO: 5252958 - DNA, 17 bp, Homo sapiens
atgaatcactgttttta

SEQ ID NO: 5252959 - DNA, 19 bp, Homo sapiens
atgaatcactgtttttaga

SEQ ID NO: 5252960 - DNA, 20 bp, Homo sapiens
atgaatcagtatgaagacac

SEQ ID NO: 5252961 - DNA, 12 bp, Homo sapiens
atgaatccaaat

SEQ ID NO: 5252962 - DNA, 19 bp, Homo sapiens
atgaatccaaatgtgaaag

SEQ ID NO: 5252963 - DNA, 16 bp, Homo sapiens
atgaatccaactgctt

SEQ ID NO: 5252964 - DNA, 15 bp, Homo sapiens
atgaatccccgaccc

SEQ ID NO: 5252965 - DNA, 21 bp, Homo sapiens
atgaatcgcaagttaacttgg

SEQ ID NO: 5252966 - DNA, 23 bp, Homo sapiens
atgaatcgcagacgcaagaggtt

SEQ ID NO: 5252967 - DNA, 20 bp, Homo sapiens
atgaatctcgttcccaaaga

SEQ ID NO: 5252968 - DNA, 14 bp, Homo sapiens
atgaatctgctcac

SEQ ID NO: 5252969 - DNA, 16 bp, Homo sapiens
atgaatctgctcactt

SEQ ID NO: 5252970 - DNA, 16 bp, Homo sapiens
atgaatcttatgcaaa

SEQ ID NO: 5252971 - DNA, 16 bp, Homo sapiens
atgaatcttttccact

SEQ ID NO: 5252972 - DNA, 16 bp, Homo sapiens
atgaatgaaaatacat

SEQ ID NO: 5252973 - DNA, 13 bp, Homo sapiens
atgaatgaaatat

SEQ ID NO: 5252974 - DNA, 15 bp, Homo sapiens
atgaatgaaatataa

SEQ ID NO: 5252975 - DNA, 23 bp, Homo sapiens
atgaatgaaatataaactgtgag

SEQ ID NO: 5252976 - DNA, 18 bp, Homo sapiens
atgaatgaacaaacctgt

SEQ ID NO: 5252977 - DNA, 18 bp, Homo sapiens
atgaatgaacccctggct

SEQ ID NO: 5252978 - DNA, 23 bp, Homo sapiens
atgaatgaacccctggctccttc

SEQ ID NO: 5252979 - DNA, 13 bp, Homo sapiens
atgaatgaatggc

SEQ ID NO: 5252980 - DNA, 15 bp, Homo sapiens
atgaatgaatggctt

SEQ ID NO: 5252981 - DNA, 22 bp, Homo sapiens
atgaatgacttccccaatatct

SEQ ID NO: 5252982 - DNA, 21 bp, Homo sapiens
atgaatgagcagttagaaata

SEQ ID NO: 5252983 - DNA, 22 bp, Homo sapiens
atgaatgagcattctgcagccc

SEQ ID NO: 5252984 - DNA, 16 bp, Homo sapiens
atgaatgagccaaaat

SEQ ID NO: 5252985 - DNA, 15 bp, Homo sapiens
atgaatgaggtctgg

SEQ ID NO: 5252986 - DNA, 16 bp, Homo sapiens
atgaatgagttttaca

SEQ ID NO: 5252987 - DNA, 22 bp, Homo sapiens
atgaatgataagcaggaaggat

SEQ ID NO: 5252988 - DNA, 20 bp, Homo sapiens
atgaatgatcattgaaagta

SEQ ID NO: 5252989 - DNA, 15 bp, Homo sapiens
atgaatgattaaatt

SEQ ID NO: 5252990 - DNA, 17 bp, Homo sapiens
atgaatgattaaattat

SEQ ID NO: 5252991 - DNA, 20 bp, Homo sapiens
atgaatgcaaaattgttttc

SEQ ID NO: 5252992 - DNA, 21 bp, Homo sapiens
atgaatgcaaaattgttttca

SEQ ID NO: 5252993 - DNA, 22 bp, Homo sapiens
atgaatgcagcactgctgcctc

SEQ ID NO: 5252994 - DNA, 13 bp, Homo sapiens
atgaatgcagtat

SEQ ID NO: 5252995 - DNA, 17 bp, Homo sapiens
atgaatgcattggccct

SEQ ID NO: 5252996 - DNA, 19 bp, Homo sapiens
atgaatgcccaggaagtaa

SEQ ID NO: 5252997 - DNA, 15 bp, Homo sapiens
atgaatgcctttcaa

SEQ ID NO: 5252998 - DNA, 13 bp, Homo sapiens
atgaatgctattt

SEQ ID NO: 5252999 - DNA, 16 bp, Homo sapiens
atgaatggacaaagct

SEQ ID NO: 5253000 - DNA, 18 bp, Homo sapiens
atgaatggactcatctta

SEQ ID NO: 5253001 - DNA, 23 bp, Homo sapiens
atgaatggctaagcaaaatgtga

SEQ ID NO: 5253002 - DNA, 14 bp, Homo sapiens
atgaatgggaaagt

SEQ ID NO: 5253003 - DNA, 17 bp, Homo sapiens
atgaatgggcaaaactg

SEQ ID NO: 5253004 - DNA, 21 bp, Homo sapiens
atgaatgggcaaaactgaatt

SEQ ID NO: 5253005 - DNA, 23 bp, Homo sapiens
atgaatgggcatttctaaaatgt

SEQ ID NO: 5253006 - DNA, 12 bp, Homo sapiens
atgaatggggag

SEQ ID NO: 5253007 - DNA, 21 bp, Homo sapiens
atgaatggtatggaactctct

SEQ ID NO: 5253008 - DNA, 22 bp, Homo sapiens
atgaatggtctagaaacatttc

SEQ ID NO: 5253009 - DNA, 20 bp, Homo sapiens
atgaatgtaaaagacactgg

SEQ ID NO: 5253010 - DNA, 12 bp, Homo sapiens
atgaatgtaaat

SEQ ID NO: 5253011 - DNA, 16 bp, Homo sapiens
atgaatgtaaatttgt

SEQ ID NO: 5253012 - DNA, 19 bp, Homo sapiens
atgaatgtaaatttgtact

SEQ ID NO: 5253013 - DNA, 21 bp, Homo sapiens
atgaatgtaaatttgtactat

SEQ ID NO: 5253014 - DNA, 22 bp, Homo sapiens
atgaatgtaaggatgagggaag

SEQ ID NO: 5253015 - DNA, 15 bp, Homo sapiens
atgaatgtactatgt

SEQ ID NO: 5253016 - DNA, 16 bp, Homo sapiens
atgaatgtatattttg

SEQ ID NO: 5253017 - DNA, 15 bp, Homo sapiens
atgaatgtatcagga

SEQ ID NO: 5253018 - DNA, 16 bp, Homo sapiens
atgaatgtatcaggaa

SEQ ID NO: 5253019 - DNA, 17 bp, Homo sapiens
atgaatgtatgtgcact

SEQ ID NO: 5253020 - DNA, 19 bp, Homo sapiens
atgaatgtcacttctggat

SEQ ID NO: 5253021 - DNA, 12 bp, Homo sapiens
atgaatgtcagt

SEQ ID NO: 5253022 - DNA, 18 bp, Homo sapiens
atgaatgtcagtgtgact

SEQ ID NO: 5253023 - DNA, 20 bp, Homo sapiens
atgaatgtcagtgtgactga

SEQ ID NO: 5253024 - DNA, 23 bp, Homo sapiens
atgaatgtcagttgttatttatt

SEQ ID NO: 5253025 - DNA, 14 bp, Homo sapiens
atgaatgtgaagcc

SEQ ID NO: 5253026 - DNA, 15 bp, Homo sapiens
atgaatgtgaagcct

SEQ ID NO: 5253027 - DNA, 13 bp, Homo sapiens
atgaatgttcctg

SEQ ID NO: 5253028 - DNA, 12 bp, Homo sapiens
atgaatgttctt

SEQ ID NO: 5253029 - DNA, 14 bp, Homo sapiens
atgaattaaagtgg

SEQ ID NO: 5253030 - DNA, 20 bp, Homo sapiens
atcatgaactggcttgtaca

SEQ ID NO: 5253031 - DNA, 21 bp, Homo sapiens
atcatgaactggcttgtacat

SEQ ID NO: 5253032 - DNA, 24 bp, Homo sapiens
atcatgaactggcttgtacatttt

SEQ ID NO: 5253033 - DNA, 12 bp, Homo sapiens
atcatgaagcct

SEQ ID NO: 5253034 - DNA, 13 bp, Homo sapiens
atcatgaagcctg

SEQ ID NO: 5253035 - DNA, 20 bp, Homo sapiens
atcatgaagtgatataaaag

SEQ ID NO: 5253036 - DNA, 15 bp, Homo sapiens
atcatgaataactga

SEQ ID NO: 5253037 - DNA, 21 bp, Homo sapiens
atcatgaattagttttatatg

SEQ ID NO: 5253038 - DNA, 17 bp, Homo sapiens
atcatgaattatataat

SEQ ID NO: 5253039 - DNA, 21 bp, Homo sapiens
atcatgaattcccttttaatc

SEQ ID NO: 5253040 - DNA, 23 bp, Homo sapiens
atcatgaattcccttttaatcaa

SEQ ID NO: 5253041 - DNA, 13 bp, Homo sapiens
atcatgaatttta

SEQ ID NO: 5253042 - DNA, 17 bp, Homo sapiens
atcatgagattgatgca

SEQ ID NO: 5253043 - DNA, 17 bp, Homo sapiens
atcatgagcctgctgga

SEQ ID NO: 5253044 - DNA, 17 bp, Homo sapiens
atcatgagcctgtttat

SEQ ID NO: 5253045 - DNA, 20 bp, Homo sapiens
atcatgaggtcaggagttcg

SEQ ID NO: 5253046 - DNA, 23 bp, Homo sapiens
atcatgagtgaataaatgtcttg

SEQ ID NO: 5253047 - DNA, 14 bp, Homo sapiens
atcatgatagactt

SEQ ID NO: 5253048 - DNA, 17 bp, Homo sapiens
atcatgatcacaactga

SEQ ID NO: 5253049 - DNA, 22 bp, Homo sapiens
atcatgatctgactttaattgt

SEQ ID NO: 5253050 - DNA, 17 bp, Homo sapiens
atcatgatggaaaaaat

SEQ ID NO: 5253051 - DNA, 21 bp, Homo sapiens
atcatgcaaaaaaaaaaatgt

SEQ ID NO: 5253052 - DNA, 20 bp, Homo sapiens
atcatgcaagtgctatgcca

SEQ ID NO: 5253053 - DNA, 19 bp, Homo sapiens
atcatgcactttttctcct

SEQ ID NO: 5253054 - DNA, 15 bp, Homo sapiens
atcatgcatagagtg

SEQ ID NO: 5253055 - DNA, 22 bp, Homo sapiens
atcatgcatcttactgaaggta

SEQ ID NO: 5253056 - DNA, 21 bp, Homo sapiens
atcatgcatgtcctgtaaagg

SEQ ID NO: 5253057 - DNA, 14 bp, Homo sapiens
atcatgcattgttg

SEQ ID NO: 5253058 - DNA, 23 bp, Homo sapiens
atcatgccgccgcagctggttgg

SEQ ID NO: 5253059 - DNA, 21 bp, Homo sapiens
atcatgcctacattagtgaga

SEQ ID NO: 5253060 - DNA, 17 bp, Homo sapiens
atcatgccttgataaat

SEQ ID NO: 5253061 - DNA, 14 bp, Homo sapiens
atcatgcgttttat

SEQ ID NO: 5253062 - DNA, 15 bp, Homo sapiens
atcatgctcatgtat

SEQ ID NO: 5253063 - DNA, 19 bp, Homo sapiens
atcatgctggaacctgcaa

SEQ ID NO: 5253064 - DNA, 22 bp, Homo sapiens
atcatgctggaacctgcaaaaa

SEQ ID NO: 5253065 - DNA, 23 bp, Homo sapiens
atcatgcttatgttaaactctgt

SEQ ID NO: 5253066 - DNA, 22 bp, Homo sapiens
atcatgctttaaagtgtaataa

SEQ ID NO: 5253067 - DNA, 18 bp, Homo sapiens
atcatgctttgaaaaatc

SEQ ID NO: 5253068 - DNA, 15 bp, Homo sapiens
atcatggaaatatta

SEQ ID NO: 5253069 - DNA, 17 bp, Homo sapiens
atcatggaagaaaagga

SEQ ID NO: 5253070 - DNA, 18 bp, Homo sapiens
atcatggaatatttatag

SEQ ID NO: 5253071 - DNA, 20 bp, Homo sapiens
atcatggaatggttataaaa

SEQ ID NO: 5253072 - DNA, 12 bp, Homo sapiens
atcatggagaaa

SEQ ID NO: 5253073 - DNA, 16 bp, Homo sapiens
atcatggagcaagaga

SEQ ID NO: 5253074 - DNA, 15 bp, Homo sapiens
atcatggagctgagg

SEQ ID NO: 5253075 - DNA, 22 bp, Homo sapiens
atcatggatcaaccaagttaca

SEQ ID NO: 5253076 - DNA, 22 bp, Homo sapiens
atcatggatttattttttgtaa

SEQ ID NO: 5253077 - DNA, 23 bp, Homo sapiens
atcatggatttattttttgtaac

SEQ ID NO: 5253078 - DNA, 13 bp, Homo sapiens
atcatggccagct

SEQ ID NO: 5253079 - DNA, 16 bp, Homo sapiens
atcatggcctcttgaa

SEQ ID NO: 5253080 - DNA, 22 bp, Homo sapiens
atcatggctaagcttaaaaaaa

SEQ ID NO: 5253081 - DNA, 15 bp, Homo sapiens
atcatggctcactgc

SEQ ID NO: 5253082 - DNA, 15 bp, Homo sapiens
atcatgggaatttta

SEQ ID NO: 5253083 - DNA, 14 bp, Homo sapiens
atcatgggcattgc

SEQ ID NO: 5253084 - DNA, 20 bp, Homo sapiens
atcatgggcattgctggact

SEQ ID NO: 5253085 - DNA, 24 bp, Homo sapiens
atcatggggggagcaccctgaggg

SEQ ID NO: 5253086 - DNA, 17 bp, Homo sapiens
atcatggtaatgacaga

SEQ ID NO: 5253087 - DNA, 18 bp, Homo sapiens
atcatggtatttgaccat

SEQ ID NO: 5253088 - DNA, 17 bp, Homo sapiens
atcatggtcctgaatgt

SEQ ID NO: 5253089 - DNA, 17 bp, Homo sapiens
atcatggtgtaataaga

SEQ ID NO: 5253090 - DNA, 12 bp, Homo sapiens
atcatggttttt

SEQ ID NO: 5253091 - DNA, 11 bp, Homo sapiens
atcatgtaaag

SEQ ID NO: 5253092 - DNA, 14 bp, Homo sapiens
atcatgtaaagaaa

SEQ ID NO: 5253093 - DNA, 16 bp, Homo sapiens
atcatgtaaatgatta

SEQ ID NO: 5253094 - DNA, 14 bp, Homo sapiens
atcatgtaaatgct

SEQ ID NO: 5253095 - DNA, 14 bp, Homo sapiens
atcatgtaaattac

SEQ ID NO: 5253096 - DNA, 15 bp, Homo sapiens
atcatgtaaggaagg

SEQ ID NO: 5253097 - DNA, 12 bp, Homo sapiens
atcatgtaatag

SEQ ID NO: 5253098 - DNA, 13 bp, Homo sapiens
atcatgtaatagt

SEQ ID NO: 5253099 - DNA, 14 bp, Homo sapiens
atcatgtacatttc

SEQ ID NO: 5253100 - DNA, 13 bp, Homo sapiens
atcatgtactttg

SEQ ID NO: 5253101 - DNA, 21 bp, Homo sapiens
atcatgtactttggcatcttt

SEQ ID NO: 5253102 - DNA, 17 bp, Homo sapiens
atcatgtagtatcaaat

SEQ ID NO: 5253103 - DNA, 18 bp, Homo sapiens
atcatgtagtatcaaata

SEQ ID NO: 5253104 - DNA, 19 bp, Homo sapiens
atcatgtagtatcaaatat

SEQ ID NO: 5253105 - DNA, 21 bp, Homo sapiens
atcatgtagtatcaaatatta

SEQ ID NO: 5253106 - DNA, 15 bp, Homo sapiens
atcatgtatctctct

SEQ ID NO: 5253107 - DNA, 17 bp, Homo sapiens
atcatgtatctctctgt

SEQ ID NO: 5253108 - DNA, 18 bp, Homo sapiens
atcatgtattttgtaaac

SEQ ID NO: 5253109 - DNA, 15 bp, Homo sapiens
atcatgtccatccct

SEQ ID NO: 5253110 - DNA, 24 bp, Homo sapiens
atcatgtccatcccttttcctgtc

SEQ ID NO: 5253111 - DNA, 14 bp, Homo sapiens
atcatgtccccaaa

SEQ ID NO: 5253112 - DNA, 20 bp, Homo sapiens
atcatgtccccaaacctgca

SEQ ID NO: 5253113 - DNA, 17 bp, Homo sapiens
atcatgtcgtaggtaaa

SEQ ID NO: 5253114 - DNA, 11 bp, Homo sapiens
atcatgtctgt

SEQ ID NO: 5253115 - DNA, 12 bp, Homo sapiens
atcatgtctgta

SEQ ID NO: 5253116 - DNA, 13 bp, Homo sapiens
atcatgtctgtat

SEQ ID NO: 5253117 - DNA, 15 bp, Homo sapiens
atcatgtctgtatac

SEQ ID NO: 5253118 - DNA, 14 bp, Homo sapiens
atcatgtctgtatc

SEQ ID NO: 5253119 - DNA, 22 bp, Homo sapiens
atcatgtctgtatccccagtgc

SEQ ID NO: 5253120 - DNA, 16 bp, Homo sapiens
atcatgtcttcatttt

SEQ ID NO: 5253121 - DNA, 21 bp, Homo sapiens
atcatgtgaacccgggacgca

SEQ ID NO: 5253122 - DNA, 18 bp, Homo sapiens
atcatgtgcgtcagtcca

SEQ ID NO: 5253123 - DNA, 21 bp, Homo sapiens
atcatgtgctcagaagaggaa

SEQ ID NO: 5253124 - DNA, 22 bp, Homo sapiens
atcatgtgctcagaagaggaaa

SEQ ID NO: 5253125 - DNA, 19 bp, Homo sapiens
atcatgtgtaatcaataaa

SEQ ID NO: 5253126 - DNA, 18 bp, Homo sapiens
atcatgtgtagagcccct

SEQ ID NO: 5253127 - DNA, 16 bp, Homo sapiens
atcatgtgtagatatt

SEQ ID NO: 5253128 - DNA, 17 bp, Homo sapiens
atcatgtgtagatatta

SEQ ID NO: 5253129 - DNA, 21 bp, Homo sapiens
atcatgtgtagatattatgta

SEQ ID NO: 5253130 - DNA, 23 bp, Homo sapiens
atcatgtgtgagataacttcctt

SEQ ID NO: 5253131 - DNA, 17 bp, Homo sapiens
atcatgtgtttctgtgt

SEQ ID NO: 5253132 - DNA, 15 bp, Homo sapiens
atcatgttacttgag

SEQ ID NO: 5253133 - DNA, 24 bp, Homo sapiens
atcatgttagagttacttctataa

SEQ ID NO: 5253134 - DNA, 14 bp, Homo sapiens
atcatgttagtaat

SEQ ID NO: 5253135 - DNA, 19 bp, Homo sapiens
atcatgttagtaatacctc

SEQ ID NO: 5253136 - DNA, 17 bp, Homo sapiens
atcatgttatgataaaa

SEQ ID NO: 5253137 - DNA, 21 bp, Homo sapiens
atcatgttgttgtgtgtatat

SEQ ID NO: 5253138 - DNA, 22 bp, Homo sapiens
atcatgttgttgtgtgtatatg

SEQ ID NO: 5253139 - DNA, 23 bp, Homo sapiens
atcatgttgttgtgtgtatatgt

SEQ ID NO: 5253140 - DNA, 23 bp, Homo sapiens
atcatgtttacagaggacagtat

SEQ ID NO: 5253141 - DNA, 16 bp, Homo sapiens
atcatgtttattttga

SEQ ID NO: 5253142 - DNA, 16 bp, Homo sapiens
atcatgtttctgagac

SEQ ID NO: 5253143 - DNA, 14 bp, Homo sapiens
atcatgtttctttg

SEQ ID NO: 5253144 - DNA, 15 bp, Homo sapiens
atcatgtttctttga

SEQ ID NO: 5253145 - DNA, 23 bp, Homo sapiens
atcatgtttctttgatcatgaat

SEQ ID NO: 5253146 - DNA, 18 bp, Homo sapiens
atcatgttttataatttg

SEQ ID NO: 5253147 - DNA, 17 bp, Homo sapiens
atcatgttttttctgca

SEQ ID NO: 5253148 - DNA, 19 bp, Homo sapiens
atcatgttttttctgcaat

SEQ ID NO: 5253149 - DNA, 14 bp, Homo sapiens
atcattaaaaatta

SEQ ID NO: 5253150 - DNA, 13 bp, Homo sapiens
atcattaaacaaa

SEQ ID NO: 5253151 - DNA, 15 bp, Homo sapiens
atcattaaacatgaa

SEQ ID NO: 5253152 - DNA, 17 bp, Homo sapiens
atcattaaacatgaatt

SEQ ID NO: 5253153 - DNA, 22 bp, Homo sapiens
atcattaaagcctgagtttgct

SEQ ID NO: 5253154 - DNA, 13 bp, Homo sapiens
atcattaaagttc

SEQ ID NO: 5253155 - DNA, 15 bp, Homo sapiens
atcattaaagttcta

SEQ ID NO: 5253156 - DNA, 23 bp, Homo sapiens
atcattaaatttttccttagcat

SEQ ID NO: 5253157 - DNA, 15 bp, Homo sapiens
atcattaagacaact

SEQ ID NO: 5253158 - DNA, 14 bp, Homo sapiens
atcattaatgtaat

SEQ ID NO: 5253159 - DNA, 24 bp, Homo sapiens
atcattaattagaaggttatcctt

SEQ ID NO: 5253160 - DNA, 16 bp, Homo sapiens
atcattacaatacagt

SEQ ID NO: 5253161 - DNA, 20 bp, Homo sapiens
atcattacaatacagtattt

SEQ ID NO: 5253162 - DNA, 17 bp, Homo sapiens
atcattacaattttctg

SEQ ID NO: 5253163 - DNA, 22 bp, Homo sapiens
atcattagagcttaaattgtca

SEQ ID NO: 5253164 - DNA, 19 bp, Homo sapiens
atcattattgtagtttgaa

SEQ ID NO: 5253165 - DNA, 15 bp, Homo sapiens
atcattatttatgta

SEQ ID NO: 5253166 - DNA, 12 bp, Homo sapiens
atcattatttga

SEQ ID NO: 5253167 - DNA, 12 bp, Homo sapiens
atcattcaagtg

SEQ ID NO: 5253168 - DNA, 23 bp, Homo sapiens
atcattcacggagatatgaagag

SEQ ID NO: 5253169 - DNA, 17 bp, Homo sapiens
atcattcacttcactgt

SEQ ID NO: 5253170 - DNA, 19 bp, Homo sapiens
atcattcacttcactgtgc

SEQ ID NO: 5253171 - DNA, 22 bp, Homo sapiens
atcattcacttcactgtgctgt

SEQ ID NO: 5253172 - DNA, 12 bp, Homo sapiens
atcattcagcaa

SEQ ID NO: 5253173 - DNA, 19 bp, Homo sapiens
atcattcagcaaatgcctt

SEQ ID NO: 5253174 - DNA, 15 bp, Homo sapiens
atcattcataatttt

SEQ ID NO: 5253175 - DNA, 12 bp, Homo sapiens
atcattcatctt

SEQ ID NO: 5253176 - DNA, 14 bp, Homo sapiens
atcattcattttct

SEQ ID NO: 5253177 - DNA, 22 bp, Homo sapiens
atcattccaattctaaatccga

SEQ ID NO: 5253178 - DNA, 22 bp, Homo sapiens
atcattccacactccttgtcaa

SEQ ID NO: 5253179 - DNA, 17 bp, Homo sapiens
atcattccactatacaa

SEQ ID NO: 5253180 - DNA, 22 bp, Homo sapiens
atcattcccttcgacagcattt

SEQ ID NO: 5253181 - DNA, 15 bp, Homo sapiens
atcattctaaagata

SEQ ID NO: 5253182 - DNA, 17 bp, Homo sapiens
atcattctaaagataga

SEQ ID NO: 5253183 - DNA, 13 bp, Homo sapiens
atcattctccttg

SEQ ID NO: 5253184 - DNA, 12 bp, Homo sapiens
atcattctctgt

SEQ ID NO: 5253185 - DNA, 14 bp, Homo sapiens
atcattctctgtct

SEQ ID NO: 5253186 - DNA, 24 bp, Homo sapiens
atcattctctgtctcatccatcat

SEQ ID NO: 5253187 - DNA, 12 bp, Homo sapiens
atcattctgtaa

SEQ ID NO: 5253188 - DNA, 13 bp, Homo sapiens
atcattctgtaaa

SEQ ID NO: 5253189 - DNA, 19 bp, Homo sapiens
atcattcttatttcatgaa

SEQ ID NO: 5253190 - DNA, 23 bp, Homo sapiens
atcattcttatttcatgaaaatt

SEQ ID NO: 5253191 - DNA, 16 bp, Homo sapiens
atcattctttcccctc

SEQ ID NO: 5253192 - DNA, 17 bp, Homo sapiens
atcattctttgtatctt

SEQ ID NO: 5253193 - DNA, 18 bp, Homo sapiens
atcattctttgtatctta

SEQ ID NO: 5253194 - DNA, 16 bp, Homo sapiens
atcattgaaacattta

SEQ ID NO: 5253195 - DNA, 13 bp, Homo sapiens
atcattgaaatct

SEQ ID NO: 5253196 - DNA, 19 bp, Homo sapiens
atcattgaaatctttttgc

SEQ ID NO: 5253197 - DNA, 19 bp, Homo sapiens
atcattgaagtatattctt

SEQ ID NO: 5253198 - DNA, 22 bp, Homo sapiens
atcattgcaaacaactgaaatg

SEQ ID NO: 5253199 - DNA, 21 bp, Homo sapiens
atcattgcactctagcctggg

SEQ ID NO: 5253200 - DNA, 19 bp, Homo sapiens
atcattgcagtatcagagg

SEQ ID NO: 5253201 - DNA, 18 bp, Homo sapiens
atcattgccctcttcaag

SEQ ID NO: 5253202 - DNA, 15 bp, Homo sapiens
atcattgccttgttg

SEQ ID NO: 5253203 - DNA, 16 bp, Homo sapiens
atcattgctcccctga

SEQ ID NO: 5253204 - DNA, 21 bp, Homo sapiens
atcattgctgtctgcagcctt

SEQ ID NO: 5253205 - DNA, 11 bp, Homo sapiens
atcattgctta

SEQ ID NO: 5253206 - DNA, 17 bp, Homo sapiens
atcattggataaatttg

SEQ ID NO: 5253207 - DNA, 22 bp, Homo sapiens
atcattggatcctactcaacaa

SEQ ID NO: 5253208 - DNA, 20 bp, Homo sapiens
atgaattaagaaagattaaa

SEQ ID NO: 5253209 - DNA, 15 bp, Homo sapiens
atgaattacatttgt

SEQ ID NO: 5253210 - DNA, 21 bp, Homo sapiens
atgaattagttttatatgctt

SEQ ID NO: 5253211 - DNA, 23 bp, Homo sapiens
atgaattatattcaatgcattta

SEQ ID NO: 5253212 - DNA, 14 bp, Homo sapiens
atgaattatgataa

SEQ ID NO: 5253213 - DNA, 19 bp, Homo sapiens
atgaattcaagaaaggaaa

SEQ ID NO: 5253214 - DNA, 20 bp, Homo sapiens
atgaattcaagaaaggaaat

SEQ ID NO: 5253215 - DNA, 13 bp, Homo sapiens
atgaattcatact

SEQ ID NO: 5253216 - DNA, 14 bp, Homo sapiens
atgaattcatactc

SEQ ID NO: 5253217 - DNA, 16 bp, Homo sapiens
atgaattcatactctg

SEQ ID NO: 5253218 - DNA, 23 bp, Homo sapiens
atgaattcatactctgttgcctc

SEQ ID NO: 5253219 - DNA, 18 bp, Homo sapiens
atgaattccaactcactt

SEQ ID NO: 5253220 - DNA, 20 bp, Homo sapiens
atgaattctctctaaaaata

SEQ ID NO: 5253221 - DNA, 13 bp, Homo sapiens
atgaattcttcaa

SEQ ID NO: 5253222 - DNA, 16 bp, Homo sapiens
atgaattgcattattt

SEQ ID NO: 5253223 - DNA, 22 bp, Homo sapiens
atgaattgctgtctagccttag

SEQ ID NO: 5253224 - DNA, 14 bp, Homo sapiens
atgaattggaactg

SEQ ID NO: 5253225 - DNA, 18 bp, Homo sapiens
atgaattgggaacattat

SEQ ID NO: 5253226 - DNA, 11 bp, Homo sapiens
atgaatttaaa

SEQ ID NO: 5253227 - DNA, 16 bp, Homo sapiens
atgaatttaaatataa

SEQ ID NO: 5253228 - DNA, 17 bp, Homo sapiens
atgaatttaaggcaaaa

SEQ ID NO: 5253229 - DNA, 19 bp, Homo sapiens
atgaatttaaggcaaaaaa

SEQ ID NO: 5253230 - DNA, 13 bp, Homo sapiens
atgaatttatcat

SEQ ID NO: 5253231 - DNA, 19 bp, Homo sapiens
atgaatttatcattttagt

SEQ ID NO: 5253232 - DNA, 22 bp, Homo sapiens
atgaatttattgcacattgttc

SEQ ID NO: 5253233 - DNA, 20 bp, Homo sapiens
atgaatttctaccagatgtg

SEQ ID NO: 5253234 - DNA, 18 bp, Homo sapiens
atgaatttgctaaataca

SEQ ID NO: 5253235 - DNA, 18 bp, Homo sapiens
atgaattttaaaagcata

SEQ ID NO: 5253236 - DNA, 15 bp, Homo sapiens
atgaattttaaagta

SEQ ID NO: 5253237 - DNA, 14 bp, Homo sapiens
atgaattttagctt

SEQ ID NO: 5253238 - DNA, 16 bp, Homo sapiens
atgaattttagctttt

SEQ ID NO: 5253239 - DNA, 18 bp, Homo sapiens
atgaattttcaagtaatt

SEQ ID NO: 5253240 - DNA, 22 bp, Homo sapiens
atgaattttcaagtaattgtga

SEQ ID NO: 5253241 - DNA, 18 bp, Homo sapiens
atgaattttccacgcagt

SEQ ID NO: 5253242 - DNA, 16 bp, Homo sapiens
atgaattttctgcagc

SEQ ID NO: 5253243 - DNA, 15 bp, Homo sapiens
atgaattttgtaagt

SEQ ID NO: 5253244 - DNA, 16 bp, Homo sapiens
atgaattttgtaagta

SEQ ID NO: 5253245 - DNA, 23 bp, Homo sapiens
atgaattttgtaagtataagaaa

SEQ ID NO: 5253246 - DNA, 23 bp, Homo sapiens
atgaattttgtatgctgaatttc

SEQ ID NO: 5253247 - DNA, 17 bp, Homo sapiens
atgaatttttattgaga

SEQ ID NO: 5253248 - DNA, 14 bp, Homo sapiens
atgaattttttaat

SEQ ID NO: 5253249 - DNA, 21 bp, Homo sapiens
atgaatttttttcatcttctc

SEQ ID NO: 5253250 - DNA, 15 bp, Homo sapiens
atgacaaaaataaca

SEQ ID NO: 5253251 - DNA, 17 bp, Homo sapiens
atgacaaaaataacact

SEQ ID NO: 5253252 - DNA, 23 bp, Homo sapiens
atgacaaaagatacaaaagcttt

SEQ ID NO: 5253253 - DNA, 15 bp, Homo sapiens
atgacaaaagtgaca

SEQ ID NO: 5253254 - DNA, 16 bp, Homo sapiens
atgacaaaattctttc

SEQ ID NO: 5253255 - DNA, 16 bp, Homo sapiens
atgacaaacatgatac

SEQ ID NO: 5253256 - DNA, 16 bp, Homo sapiens
atgacaaacctagctt

SEQ ID NO: 5253257 - DNA, 19 bp, Homo sapiens
atgacaaacctagctttta

SEQ ID NO: 5253258 - DNA, 21 bp, Homo sapiens
atgacaaacctagcttttaaa

SEQ ID NO: 5253259 - DNA, 14 bp, Homo sapiens
atgacaaagccatt

SEQ ID NO: 5253260 - DNA, 16 bp, Homo sapiens
atgacaaagttacaaa

SEQ ID NO: 5253261 - DNA, 17 bp, Homo sapiens
atgacaaataagtggaa

SEQ ID NO: 5253262 - DNA, 14 bp, Homo sapiens
atgacaaatattct

SEQ ID NO: 5253263 - DNA, 23 bp, Homo sapiens
atgacaaatattctgaatcacca

SEQ ID NO: 5253264 - DNA, 13 bp, Homo sapiens
atgacaaatgttt

SEQ ID NO: 5253265 - DNA, 15 bp, Homo sapiens
atgacaaatgtttct

SEQ ID NO: 5253266 - DNA, 13 bp, Homo sapiens
atgacaacactta

SEQ ID NO: 5253267 - DNA, 20 bp, Homo sapiens
atgacaacagaaaaacaatc

SEQ ID NO: 5253268 - DNA, 14 bp, Homo sapiens
atgacaacttctaa

SEQ ID NO: 5253269 - DNA, 16 bp, Homo sapiens
atgacaacttctaatt

SEQ ID NO: 5253270 - DNA, 22 bp, Homo sapiens
atgacaacttttaaagaaaaat

SEQ ID NO: 5253271 - DNA, 14 bp, Homo sapiens
atgacaagatggta

SEQ ID NO: 5253272 - DNA, 19 bp, Homo sapiens
atgacaagattaggaatat

SEQ ID NO: 5253273 - DNA, 15 bp, Homo sapiens
atgacaagccccagg

SEQ ID NO: 5253274 - DNA, 18 bp, Homo sapiens
atgacaagccccaggcag

SEQ ID NO: 5253275 - DNA, 14 bp, Homo sapiens
atgacaagctgtat

SEQ ID NO: 5253276 - DNA, 13 bp, Homo sapiens
atgacaataaatt

SEQ ID NO: 5253277 - DNA, 15 bp, Homo sapiens
atgacaatcatgtgt

SEQ ID NO: 5253278 - DNA, 17 bp, Homo sapiens
atgacaatcatgtgtgt

SEQ ID NO: 5253279 - DNA, 22 bp, Homo sapiens
atgacaatctaccaactgtccc

SEQ ID NO: 5253280 - DNA, 13 bp, Homo sapiens
atgacaatcttat

SEQ ID NO: 5253281 - DNA, 14 bp, Homo sapiens
atgacaatgatgat

SEQ ID NO: 5253282 - DNA, 16 bp, Homo sapiens
atgacaatttcaaaat

SEQ ID NO: 5253283 - DNA, 20 bp, Homo sapiens
atgacaatttcaaaatgcat

SEQ ID NO: 5253284 - DNA, 22 bp, Homo sapiens
atgacaatttcaaaatgcatgt

SEQ ID NO: 5253285 - DNA, 23 bp, Homo sapiens
atgacaatttcaaaatgcatgtg

SEQ ID NO: 5253286 - DNA, 15 bp, Homo sapiens
atgacaatttttgct

SEQ ID NO: 5253287 - DNA, 18 bp, Homo sapiens
atgacacagcttgtgaat

SEQ ID NO: 5253288 - DNA, 20 bp, Homo sapiens
atgacacagcttgtgaatgt

SEQ ID NO: 5253289 - DNA, 19 bp, Homo sapiens
atgacacatttaatgaaca

SEQ ID NO: 5253290 - DNA, 22 bp, Homo sapiens
atgacaccatcttttattcttt

SEQ ID NO: 5253291 - DNA, 15 bp, Homo sapiens
atgacacccaagggt

SEQ ID NO: 5253292 - DNA, 14 bp, Homo sapiens
atgacacccaccct

SEQ ID NO: 5253293 - DNA, 18 bp, Homo sapiens
atgacacccaccctgtgc

SEQ ID NO: 5253294 - DNA, 19 bp, Homo sapiens
atgacacccaccctgtgcc

SEQ ID NO: 5253295 - DNA, 23 bp, Homo sapiens
atgacacccaccctgtgccatca

SEQ ID NO: 5253296 - DNA, 15 bp, Homo sapiens
atgacacccatgcca

SEQ ID NO: 5253297 - DNA, 13 bp, Homo sapiens
atgacaccctggc

SEQ ID NO: 5253298 - DNA, 16 bp, Homo sapiens
atgacaccctggcctg

SEQ ID NO: 5253299 - DNA, 17 bp, Homo sapiens
atgacaccctggcctga

SEQ ID NO: 5253300 - DNA, 17 bp, Homo sapiens
atgacacgcgctctcca

SEQ ID NO: 5253301 - DNA, 15 bp, Homo sapiens
atgacacggtaggcc

SEQ ID NO: 5253302 - DNA, 18 bp, Homo sapiens
atgacacggtaggccaag

SEQ ID NO: 5253303 - DNA, 23 bp, Homo sapiens
atgacactcatataattatatgt

SEQ ID NO: 5253304 - DNA, 16 bp, Homo sapiens
atgacactgaaatgcc

SEQ ID NO: 5253305 - DNA, 17 bp, Homo sapiens
atgacactgaaatgcct

SEQ ID NO: 5253306 - DNA, 12 bp, Homo sapiens
atgacactgacc

SEQ ID NO: 5253307 - DNA, 16 bp, Homo sapiens
atgacactgagaacag

SEQ ID NO: 5253308 - DNA, 16 bp, Homo sapiens
atgacactgtttcctg

SEQ ID NO: 5253309 - DNA, 16 bp, Homo sapiens
atgacacttccaaaga

SEQ ID NO: 5253310 - DNA, 19 bp, Homo sapiens
atgacagaaaatatgtatt

SEQ ID NO: 5253311 - DNA, 20 bp, Homo sapiens
atgacagaaaatatgtatta

SEQ ID NO: 5253312 - DNA, 23 bp, Homo sapiens
atgacagaaaatatgtattaaca

SEQ ID NO: 5253313 - DNA, 18 bp, Homo sapiens
atgacagaatatacacat

SEQ ID NO: 5253314 - DNA, 21 bp, Homo sapiens
atgacagaatatacacatttt

SEQ ID NO: 5253315 - DNA, 12 bp, Homo sapiens
atgacagagcga

SEQ ID NO: 5253316 - DNA, 15 bp, Homo sapiens
atgacagaggctgca

SEQ ID NO: 5253317 - DNA, 21 bp, Homo sapiens
atgacagaggctgcacccctg

SEQ ID NO: 5253318 - DNA, 16 bp, Homo sapiens
atgacagaggtttgaa

SEQ ID NO: 5253319 - DNA, 21 bp, Homo sapiens
atgacagaggtttgaaggaga

SEQ ID NO: 5253320 - DNA, 17 bp, Homo sapiens
atgacagataacctaat

SEQ ID NO: 5253321 - DNA, 15 bp, Homo sapiens
atgacagatatattt

SEQ ID NO: 5253322 - DNA, 16 bp, Homo sapiens
atgacagatattttat

SEQ ID NO: 5253323 - DNA, 15 bp, Homo sapiens
atgacagatgcaagt

SEQ ID NO: 5253324 - DNA, 18 bp, Homo sapiens
atgacagatgcaagttat

SEQ ID NO: 5253325 - DNA, 23 bp, Homo sapiens
atgacagcacctgagaagaggaa

SEQ ID NO: 5253326 - DNA, 22 bp, Homo sapiens
atgacagccaccctcaccgcgg

SEQ ID NO: 5253327 - DNA, 13 bp, Homo sapiens
atgacagccagag

SEQ ID NO: 5253328 - DNA, 19 bp, Homo sapiens
atgacagccatttgtaatg

SEQ ID NO: 5253329 - DNA, 14 bp, Homo sapiens
atgacagctgttcc

SEQ ID NO: 5253330 - DNA, 19 bp, Homo sapiens
atgacaggaacccatcact

SEQ ID NO: 5253331 - DNA, 23 bp, Homo sapiens
atgacaggaacccatcactgtgt

SEQ ID NO: 5253332 - DNA, 12 bp, Homo sapiens
atgacaggacat

SEQ ID NO: 5253333 - DNA, 22 bp, Homo sapiens
atgacaggcatgaatcactgtg

SEQ ID NO: 5253334 - DNA, 19 bp, Homo sapiens
atgacaggcctgaagatat

SEQ ID NO: 5253335 - DNA, 23 bp, Homo sapiens
atgacaggcctgaagatattact

SEQ ID NO: 5253336 - DNA, 15 bp, Homo sapiens
atgacaggcctgtcc

SEQ ID NO: 5253337 - DNA, 19 bp, Homo sapiens
atgacaggctctcctggct

SEQ ID NO: 5253338 - DNA, 15 bp, Homo sapiens
atgacaggctgttca

SEQ ID NO: 5253339 - DNA, 13 bp, Homo sapiens
atgacagggcaga

SEQ ID NO: 5253340 - DNA, 18 bp, Homo sapiens
atgacagggcagagcagg

SEQ ID NO: 5253341 - DNA, 18 bp, Homo sapiens
atgacaggtgtgagccac

SEQ ID NO: 5253342 - DNA, 15 bp, Homo sapiens
atgacagtaatattg

SEQ ID NO: 5253343 - DNA, 22 bp, Homo sapiens
atgacagtaattgtgtttacat

SEQ ID NO: 5253344 - DNA, 14 bp, Homo sapiens
atgacagtagcata

SEQ ID NO: 5253345 - DNA, 19 bp, Homo sapiens
atgacagtccgtcaaaaca

SEQ ID NO: 5253346 - DNA, 19 bp, Homo sapiens
atgacagtgcttgcatcct

SEQ ID NO: 5253347 - DNA, 18 bp, Homo sapiens
atgacagtggaagttttt

SEQ ID NO: 5253348 - DNA, 23 bp, Homo sapiens
atgacagtgggcagcacctttct

SEQ ID NO: 5253349 - DNA, 15 bp, Homo sapiens
atgacagtgtgagac

SEQ ID NO: 5253350 - DNA, 17 bp, Homo sapiens
atgacagtgttccccga

SEQ ID NO: 5253351 - DNA, 22 bp, Homo sapiens
atgacagttatactgtcggttt

SEQ ID NO: 5253352 - DNA, 21 bp, Homo sapiens
atgacataaaatttacattta

SEQ ID NO: 5253353 - DNA, 17 bp, Homo sapiens
atgacatcaaaatgagt

SEQ ID NO: 5253354 - DNA, 18 bp, Homo sapiens
atgacatcaccacagttt

SEQ ID NO: 5253355 - DNA, 20 bp, Homo sapiens
atgacatcacttgtacaaaa

SEQ ID NO: 5253356 - DNA, 16 bp, Homo sapiens
atgacatccacatgca

SEQ ID NO: 5253357 - DNA, 23 bp, Homo sapiens
atgacatccacatgcacatgtat

SEQ ID NO: 5253358 - DNA, 16 bp, Homo sapiens
atgacatctcaggggc

SEQ ID NO: 5253359 - DNA, 20 bp, Homo sapiens
atgacatctttttaaagctt

SEQ ID NO: 5253360 - DNA, 21 bp, Homo sapiens
atgacatctttttaaagctta

SEQ ID NO: 5253361 - DNA, 14 bp, Homo sapiens
atgacatgaaatga

SEQ ID NO: 5253362 - DNA, 14 bp, Homo sapiens
atgacatgcactga

SEQ ID NO: 5253363 - DNA, 17 bp, Homo sapiens
atgacatgcactgaccc

SEQ ID NO: 5253364 - DNA, 15 bp, Homo sapiens
atgacatgccaccct

SEQ ID NO: 5253365 - DNA, 17 bp, Homo sapiens
atgacatgttatatatt

SEQ ID NO: 5253366 - DNA, 23 bp, Homo sapiens
atgacatgttatatattttttgt

SEQ ID NO: 5253367 - DNA, 20 bp, Homo sapiens
atgacatgttcctttaaggt

SEQ ID NO: 5253368 - DNA, 22 bp, Homo sapiens
atgacattaaagaagggttgag

SEQ ID NO: 5253369 - DNA, 19 bp, Homo sapiens
atgacattaaatgcaataa

SEQ ID NO: 5253370 - DNA, 16 bp, Homo sapiens
atgacattcatgcctg

SEQ ID NO: 5253371 - DNA, 13 bp, Homo sapiens
atgacattgctaa

SEQ ID NO: 5253372 - DNA, 18 bp, Homo sapiens
atgacatttatttttcat

SEQ ID NO: 5253373 - DNA, 16 bp, Homo sapiens
atgacatttcatctgg

SEQ ID NO: 5253374 - DNA, 17 bp, Homo sapiens
atgacatttctcaaagt

SEQ ID NO: 5253375 - DNA, 16 bp, Homo sapiens
atgacatttcttaaaa

SEQ ID NO: 5253376 - DNA, 13 bp, Homo sapiens
atgacatttttga

SEQ ID NO: 5253377 - DNA, 14 bp, Homo sapiens
atgacatttttgat

SEQ ID NO: 5253378 - DNA, 18 bp, Homo sapiens
atgaccaaagtcccttcc

SEQ ID NO: 5253379 - DNA, 23 bp, Homo sapiens
atgaccaaatatcaccaggactg

SEQ ID NO: 5253380 - DNA, 17 bp, Homo sapiens
atgaccaacctgtttct

SEQ ID NO: 5253381 - DNA, 22 bp, Homo sapiens
atgaccaagaaaaagaaaaaaa

SEQ ID NO: 5253382 - DNA, 23 bp, Homo sapiens
atgaccaatattatactaagaaa

SEQ ID NO: 5253383 - DNA, 15 bp, Homo sapiens
atgaccaatctctgt

SEQ ID NO: 5253384 - DNA, 17 bp, Homo sapiens
atgaccaatctctgtga

SEQ ID NO: 5253385 - DNA, 20 bp, Homo sapiens
atgaccaattttaacttaga

SEQ ID NO: 5253386 - DNA, 18 bp, Homo sapiens
atcattggccctcattcc

SEQ ID NO: 5253387 - DNA, 20 bp, Homo sapiens
atcattggccctcattccaa

SEQ ID NO: 5253388 - DNA, 13 bp, Homo sapiens
atcattgtacagt

SEQ ID NO: 5253389 - DNA, 13 bp, Homo sapiens
atcattgtagaaa

SEQ ID NO: 5253390 - DNA, 18 bp, Homo sapiens
atcattgtatatatgtgt

SEQ ID NO: 5253391 - DNA, 21 bp, Homo sapiens
atcattgtattaacgcaaata

SEQ ID NO: 5253392 - DNA, 16 bp, Homo sapiens
atcattgtattcttta

SEQ ID NO: 5253393 - DNA, 16 bp, Homo sapiens
atcattgtcagccttg

SEQ ID NO: 5253394 - DNA, 13 bp, Homo sapiens
atcattgtgaaat

SEQ ID NO: 5253395 - DNA, 15 bp, Homo sapiens
atcattgtgcccact

SEQ ID NO: 5253396 - DNA, 18 bp, Homo sapiens
atcattgtgcttaataat

SEQ ID NO: 5253397 - DNA, 18 bp, Homo sapiens
atcattgttcttttcaat

SEQ ID NO: 5253398 - DNA, 17 bp, Homo sapiens
atcatttaaaaagctca

SEQ ID NO: 5253399 - DNA, 19 bp, Homo sapiens
atcatttaaacatgcagaa

SEQ ID NO: 5253400 - DNA, 14 bp, Homo sapiens
atcatttaactgaa

SEQ ID NO: 5253401 - DNA, 14 bp, Homo sapiens
atcatttacaagac

SEQ ID NO: 5253402 - DNA, 18 bp, Homo sapiens
atcatttataatactgtt

SEQ ID NO: 5253403 - DNA, 14 bp, Homo sapiens
atcatttatttcat

SEQ ID NO: 5253404 - DNA, 13 bp, Homo sapiens
atcatttcagcca

SEQ ID NO: 5253405 - DNA, 15 bp, Homo sapiens
atcatttcagccaaa

SEQ ID NO: 5253406 - DNA, 16 bp, Homo sapiens
atcatttcaggagtta

SEQ ID NO: 5253407 - DNA, 13 bp, Homo sapiens
atcatttcatgct

SEQ ID NO: 5253408 - DNA, 14 bp, Homo sapiens
atcatttcatgctt

SEQ ID NO: 5253409 - DNA, 18 bp, Homo sapiens
atcatttcatgctttgat

SEQ ID NO: 5253410 - DNA, 16 bp, Homo sapiens
atcatttccagcaaaa

SEQ ID NO: 5253411 - DNA, 12 bp, Homo sapiens
atcatttctagt

SEQ ID NO: 5253412 - DNA, 17 bp, Homo sapiens
atcatttctgccatgat

SEQ ID NO: 5253413 - DNA, 19 bp, Homo sapiens
atcatttcttttccaaaat

SEQ ID NO: 5253414 - DNA, 14 bp, Homo sapiens
atcatttgaggaat

SEQ ID NO: 5253415 - DNA, 18 bp, Homo sapiens
atcatttgatttaaacaa

SEQ ID NO: 5253416 - DNA, 20 bp, Homo sapiens
atcatttgatttaaacaatg

SEQ ID NO: 5253417 - DNA, 13 bp, Homo sapiens
atcatttgcaatg

SEQ ID NO: 5253418 - DNA, 18 bp, Homo sapiens
atcatttgcagctgctgg

SEQ ID NO: 5253419 - DNA, 18 bp, Homo sapiens
atcatttggcttgctgtt

SEQ ID NO: 5253420 - DNA, 17 bp, Homo sapiens
atcatttggttaaatca

SEQ ID NO: 5253421 - DNA, 12 bp, Homo sapiens
atcatttgtgaa

SEQ ID NO: 5253422 - DNA, 19 bp, Homo sapiens
atcatttgttcaaagctgt

SEQ ID NO: 5253423 - DNA, 14 bp, Homo sapiens
atcatttgtttaaa

SEQ ID NO: 5253424 - DNA, 13 bp, Homo sapiens
atcattttaaaaa

SEQ ID NO: 5253425 - DNA, 20 bp, Homo sapiens
atcattttaaaaactttatt

SEQ ID NO: 5253426 - DNA, 18 bp, Homo sapiens
atcattttaaaatgtctt

SEQ ID NO: 5253427 - DNA, 15 bp, Homo sapiens
atcattttaattatt

SEQ ID NO: 5253428 - DNA, 13 bp, Homo sapiens
atcattttagaat

SEQ ID NO: 5253429 - DNA, 17 bp, Homo sapiens
atcattttatatgtcaa

SEQ ID NO: 5253430 - DNA, 21 bp, Homo sapiens
atcattttcattaaaaggaaa

SEQ ID NO: 5253431 - DNA, 14 bp, Homo sapiens
atcattttcccccc

SEQ ID NO: 5253432 - DNA, 14 bp, Homo sapiens
atcattttcctggg

SEQ ID NO: 5253433 - DNA, 15 bp, Homo sapiens
atcattttcctggga

SEQ ID NO: 5253434 - DNA, 14 bp, Homo sapiens
atcattttgatgta

SEQ ID NO: 5253435 - DNA, 21 bp, Homo sapiens
atcattttgatgtattattat

SEQ ID NO: 5253436 - DNA, 19 bp, Homo sapiens
atcattttgcctcttttct

SEQ ID NO: 5253437 - DNA, 20 bp, Homo sapiens
atcattttggaggctttgtt

SEQ ID NO: 5253438 - DNA, 22 bp, Homo sapiens
atcattttgggaaattcttgca

SEQ ID NO: 5253439 - DNA, 14 bp, Homo sapiens
atcattttgttttc

SEQ ID NO: 5253440 - DNA, 15 bp, Homo sapiens
atcatttttataacc

SEQ ID NO: 5253441 - DNA, 13 bp, Homo sapiens
atcatttttcact

SEQ ID NO: 5253442 - DNA, 12 bp, Homo sapiens
atcatttttcca

SEQ ID NO: 5253443 - DNA, 13 bp, Homo sapiens
atcatttttccag

SEQ ID NO: 5253444 - DNA, 18 bp, Homo sapiens
atcatttttgatgactac

SEQ ID NO: 5253445 - DNA, 14 bp, Homo sapiens
atcatttttgtaca

SEQ ID NO: 5253446 - DNA, 15 bp, Homo sapiens
atcatttttgtacag

SEQ ID NO: 5253447 - DNA, 14 bp, Homo sapiens
atcatttttgtata

SEQ ID NO: 5253448 - DNA, 18 bp, Homo sapiens
atcatttttgtataaaaa

SEQ ID NO: 5253449 - DNA, 23 bp, Homo sapiens
atcatttttgtataaaaaggaaa

SEQ ID NO: 5253450 - DNA, 15 bp, Homo sapiens
atcattttttcctgt

SEQ ID NO: 5253451 - DNA, 23 bp, Homo sapiens
atcattttttcctgtttgggaag

SEQ ID NO: 5253452 - DNA, 14 bp, Homo sapiens
atcatttttttaac

SEQ ID NO: 5253453 - DNA, 20 bp, Homo sapiens
atccaaaaaaagggaaggat

SEQ ID NO: 5253454 - DNA, 17 bp, Homo sapiens
atccaaaaaagcaaaca

SEQ ID NO: 5253455 - DNA, 18 bp, Homo sapiens
atccaaaacaaacatgca

SEQ ID NO: 5253456 - DNA, 17 bp, Homo sapiens
atccaaaacttctcttg

SEQ ID NO: 5253457 - DNA, 18 bp, Homo sapiens
atccaaaagaagccccca

SEQ ID NO: 5253458 - DNA, 16 bp, Homo sapiens
atccaaaagtggaagt

SEQ ID NO: 5253459 - DNA, 18 bp, Homo sapiens
atccaaaatagtcatgtt

SEQ ID NO: 5253460 - DNA, 14 bp, Homo sapiens
atccaaaatatttt

SEQ ID NO: 5253461 - DNA, 16 bp, Homo sapiens
atccaaaatgaatgca

SEQ ID NO: 5253462 - DNA, 19 bp, Homo sapiens
atccaaaatgtgtatttct

SEQ ID NO: 5253463 - DNA, 23 bp, Homo sapiens
atccaaaatgtgtatttcttata

SEQ ID NO: 5253464 - DNA, 13 bp, Homo sapiens
atccaaacactga

SEQ ID NO: 5253465 - DNA, 22 bp, Homo sapiens
atccaaacctaccttatagagc

SEQ ID NO: 5253466 - DNA, 17 bp, Homo sapiens
atccaaactactttctt

SEQ ID NO: 5253467 - DNA, 20 bp, Homo sapiens
atccaaacttggatttttga

SEQ ID NO: 5253468 - DNA, 20 bp, Homo sapiens
atccaaagaacttgatttgc

SEQ ID NO: 5253469 - DNA, 22 bp, Homo sapiens
atccaaagaacttgatttgcat

SEQ ID NO: 5253470 - DNA, 10 bp, Homo sapiens
atccaaagac

SEQ ID NO: 5253471 - DNA, 14 bp, Homo sapiens
atccaaagactgta

SEQ ID NO: 5253472 - DNA, 16 bp, Homo sapiens
atccaaagactgtact

SEQ ID NO: 5253473 - DNA, 18 bp, Homo sapiens
atccaaagactgtactgg

SEQ ID NO: 5253474 - DNA, 23 bp, Homo sapiens
atccaaagactgtactggccagt

SEQ ID NO: 5253475 - DNA, 16 bp, Homo sapiens
atccaaagcattgcag

SEQ ID NO: 5253476 - DNA, 21 bp, Homo sapiens
atccaaagcattgcagaacat

SEQ ID NO: 5253477 - DNA, 15 bp, Homo sapiens
atccaaaggaatcag

SEQ ID NO: 5253478 - DNA, 20 bp, Homo sapiens
atccaaagggaatactcaca

SEQ ID NO: 5253479 - DNA, 15 bp, Homo sapiens
atccaaataaaaata

SEQ ID NO: 5253480 - DNA, 22 bp, Homo sapiens
atccaaataaaaataacatcat

SEQ ID NO: 5253481 - DNA, 14 bp, Homo sapiens
atccaaataaagat

SEQ ID NO: 5253482 - DNA, 21 bp, Homo sapiens
atccaaatatcatataaacat

SEQ ID NO: 5253483 - DNA, 13 bp, Homo sapiens
atccaaatattgt

SEQ ID NO: 5253484 - DNA, 12 bp, Homo sapiens
atccaaatctag

SEQ ID NO: 5253485 - DNA, 16 bp, Homo sapiens
atccaaatctgtcctc

SEQ ID NO: 5253486 - DNA, 21 bp, Homo sapiens
atccaaatctgtcctctgtag

SEQ ID NO: 5253487 - DNA, 22 bp, Homo sapiens
atccaaatctgtcctctgtagt

SEQ ID NO: 5253488 - DNA, 14 bp, Homo sapiens
atccaaatgctgtg

SEQ ID NO: 5253489 - DNA, 18 bp, Homo sapiens
atccaaatgctgtgcaaa

SEQ ID NO: 5253490 - DNA, 23 bp, Homo sapiens
atccaaatgctgtgcaaacagtg

SEQ ID NO: 5253491 - DNA, 15 bp, Homo sapiens
atccaaatggctgct

SEQ ID NO: 5253492 - DNA, 15 bp, Homo sapiens
atccaaatgtaaagg

SEQ ID NO: 5253493 - DNA, 16 bp, Homo sapiens
atccaaatgtgaaaga

SEQ ID NO: 5253494 - DNA, 23 bp, Homo sapiens
atccaaattgtgcttctccccag

SEQ ID NO: 5253495 - DNA, 18 bp, Homo sapiens
atccaacaagaagaaata

SEQ ID NO: 5253496 - DNA, 19 bp, Homo sapiens
atccaacacaactatcaaa

SEQ ID NO: 5253497 - DNA, 14 bp, Homo sapiens
atccaacacaagtt

SEQ ID NO: 5253498 - DNA, 17 bp, Homo sapiens
atccaaccattttcatt

SEQ ID NO: 5253499 - DNA, 20 bp, Homo sapiens
atccaaccccccacctgcca

SEQ ID NO: 5253500 - DNA, 15 bp, Homo sapiens
atccaaccctgtcag

SEQ ID NO: 5253501 - DNA, 22 bp, Homo sapiens
atccaacctctttcctctctgg

SEQ ID NO: 5253502 - DNA, 19 bp, Homo sapiens
atccaactatttctttcat

SEQ ID NO: 5253503 - DNA, 13 bp, Homo sapiens
atccaactccagg

SEQ ID NO: 5253504 - DNA, 14 bp, Homo sapiens
atccaactccagga

SEQ ID NO: 5253505 - DNA, 17 bp, Homo sapiens
atccaactctctgagag

SEQ ID NO: 5253506 - DNA, 17 bp, Homo sapiens
atccaactggaaggctt

SEQ ID NO: 5253507 - DNA, 15 bp, Homo sapiens
atccaacttccaaga

SEQ ID NO: 5253508 - DNA, 14 bp, Homo sapiens
atccaactttcaca

SEQ ID NO: 5253509 - DNA, 16 bp, Homo sapiens
atccaactttttcata

SEQ ID NO: 5253510 - DNA, 21 bp, Homo sapiens
atccaagacaaactaaacttt

SEQ ID NO: 5253511 - DNA, 20 bp, Homo sapiens
atccaagagggactccaagc

SEQ ID NO: 5253512 - DNA, 20 bp, Homo sapiens
atccaagatgtttggacacc

SEQ ID NO: 5253513 - DNA, 15 bp, Homo sapiens
atccaagattctgct

SEQ ID NO: 5253514 - DNA, 16 bp, Homo sapiens
atccaagcaaatgtga

SEQ ID NO: 5253515 - DNA, 18 bp, Homo sapiens
atccaagcaaatgtgaat

SEQ ID NO: 5253516 - DNA, 12 bp, Homo sapiens
atccaagcctcc

SEQ ID NO: 5253517 - DNA, 15 bp, Homo sapiens
atccaagcctccaca

SEQ ID NO: 5253518 - DNA, 16 bp, Homo sapiens
atccaagcctccacag

SEQ ID NO: 5253519 - DNA, 19 bp, Homo sapiens
atccaagcctccacagcga

SEQ ID NO: 5253520 - DNA, 13 bp, Homo sapiens
atccaagctccct

SEQ ID NO: 5253521 - DNA, 17 bp, Homo sapiens
atccaagctccctgccc

SEQ ID NO: 5253522 - DNA, 19 bp, Homo sapiens
atccaagctccctgcccca

SEQ ID NO: 5253523 - DNA, 21 bp, Homo sapiens
atccaagctggtcccactcag

SEQ ID NO: 5253524 - DNA, 21 bp, Homo sapiens
atccaagcttaaccaaggctc

SEQ ID NO: 5253525 - DNA, 16 bp, Homo sapiens
atccaaggaaacatgc

SEQ ID NO: 5253526 - DNA, 20 bp, Homo sapiens
atccaaggaaacatgcagct

SEQ ID NO: 5253527 - DNA, 18 bp, Homo sapiens
atccaaggaaacatttta

SEQ ID NO: 5253528 - DNA, 19 bp, Homo sapiens
atccaaggaaacattttat

SEQ ID NO: 5253529 - DNA, 17 bp, Homo sapiens
atccaaggaaataatgt

SEQ ID NO: 5253530 - DNA, 14 bp, Homo sapiens
atccaaggcaaaca

SEQ ID NO: 5253531 - DNA, 14 bp, Homo sapiens
atccaaggggcagt

SEQ ID NO: 5253532 - DNA, 20 bp, Homo sapiens
atccaagtaccaatgctgtt

SEQ ID NO: 5253533 - DNA, 23 bp, Homo sapiens
atccaagtaccaatgctgttgta

SEQ ID NO: 5253534 - DNA, 12 bp, Homo sapiens
atccaagtgaac

SEQ ID NO: 5253535 - DNA, 13 bp, Homo sapiens
atccaagtggcct

SEQ ID NO: 5253536 - DNA, 14 bp, Homo sapiens
atccaagttaaatg

SEQ ID NO: 5253537 - DNA, 16 bp, Homo sapiens
atccaagttaaatgta

SEQ ID NO: 5253538 - DNA, 21 bp, Homo sapiens
atccaagttaaatgtagagtt

SEQ ID NO: 5253539 - DNA, 22 bp, Homo sapiens
atccaataaaaatcaggagcct

SEQ ID NO: 5253540 - DNA, 23 bp, Homo sapiens
atccaataaaaatcaggagcctg

SEQ ID NO: 5253541 - DNA, 22 bp, Homo sapiens
atccaataattttcctgtgaca

SEQ ID NO: 5253542 - DNA, 14 bp, Homo sapiens
atccaatactgccc

SEQ ID NO: 5253543 - DNA, 16 bp, Homo sapiens
atccaataggaatgct

SEQ ID NO: 5253544 - DNA, 16 bp, Homo sapiens
atccaatattttgcct

SEQ ID NO: 5253545 - DNA, 17 bp, Homo sapiens
atccaatattttgcctt

SEQ ID NO: 5253546 - DNA, 17 bp, Homo sapiens
atccaatcctcactggg

SEQ ID NO: 5253547 - DNA, 18 bp, Homo sapiens
atccaatcctcactgggt

SEQ ID NO: 5253548 - DNA, 13 bp, Homo sapiens
atccaatcctcag

SEQ ID NO: 5253549 - DNA, 19 bp, Homo sapiens
atccaatgatataggaaaa

SEQ ID NO: 5253550 - DNA, 22 bp, Homo sapiens
atccaatgctcaagaaacaact

SEQ ID NO: 5253551 - DNA, 21 bp, Homo sapiens
atccaatgttagagacttttt

SEQ ID NO: 5253552 - DNA, 13 bp, Homo sapiens
atccaattatgtg

SEQ ID NO: 5253553 - DNA, 14 bp, Homo sapiens
atccaattatgtga

SEQ ID NO: 5253554 - DNA, 18 bp, Homo sapiens
atccaattcatttcttct

SEQ ID NO: 5253555 - DNA, 16 bp, Homo sapiens
atccaattgctgcttg

SEQ ID NO: 5253556 - DNA, 13 bp, Homo sapiens
atccaattggata

SEQ ID NO: 5253557 - DNA, 16 bp, Homo sapiens
atccaatttattatag

SEQ ID NO: 5253558 - DNA, 20 bp, Homo sapiens
atccaattttgatcttttta

SEQ ID NO: 5253559 - DNA, 17 bp, Homo sapiens
atccacaaagccgtgcc

SEQ ID NO: 5253560 - DNA, 23 bp, Homo sapiens
atccacaaatatgctaaatgtta

SEQ ID NO: 5253561 - DNA, 14 bp, Homo sapiens
atccacaagccatt

SEQ ID NO: 5253562 - DNA, 17 bp, Homo sapiens
atccacaataaccaaga

SEQ ID NO: 5253563 - DNA, 17 bp, Homo sapiens
atccacacaaattcagt

SEQ ID NO: 5253564 - DNA, 18 bp, Homo sapiens
atccacacaacaccagga

SEQ ID NO: 5253565 - DNA, 16 bp, Homo sapiens
atccacacacagagga

SEQ ID NO: 5253566 - DNA, 16 bp, Homo sapiens
atccacacacagcagc

SEQ ID NO: 5253567 - DNA, 23 bp, Homo sapiens
atgaccacacccgaagtcctgtc

SEQ ID NO: 5253568 - DNA, 18 bp, Homo sapiens
atgaccacactccagctg

SEQ ID NO: 5253569 - DNA, 17 bp, Homo sapiens
atgaccacgggcctcag

SEQ ID NO: 5253570 - DNA, 23 bp, Homo sapiens
atgaccactcttggctattgaag

SEQ ID NO: 5253571 - DNA, 21 bp, Homo sapiens
atgaccagaaaacaaatcttc

SEQ ID NO: 5253572 - DNA, 18 bp, Homo sapiens
atgaccagagcaaaaatg

SEQ ID NO: 5253573 - DNA, 21 bp, Homo sapiens
atgaccagagcaaaaatgtaa

SEQ ID NO: 5253574 - DNA, 17 bp, Homo sapiens
atgaccagggatgctgg

SEQ ID NO: 5253575 - DNA, 18 bp, Homo sapiens
atgaccagtgataatgcc

SEQ ID NO: 5253576 - DNA, 20 bp, Homo sapiens
atgaccataaaattagacat

SEQ ID NO: 5253577 - DNA, 15 bp, Homo sapiens
atgaccatcctgtcc

SEQ ID NO: 5253578 - DNA, 18 bp, Homo sapiens
atgaccattgaaaaagga

SEQ ID NO: 5253579 - DNA, 22 bp, Homo sapiens
atgaccattgaaaaaggaaaaa

SEQ ID NO: 5253580 - DNA, 20 bp, Homo sapiens
atgaccattgagtccctgct

SEQ ID NO: 5253581 - DNA, 15 bp, Homo sapiens
atgacccaaagacca

SEQ ID NO: 5253582 - DNA, 15 bp, Homo sapiens
atgacccacactgcc

SEQ ID NO: 5253583 - DNA, 20 bp, Homo sapiens
atgacccacactgccagaag

SEQ ID NO: 5253584 - DNA, 14 bp, Homo sapiens
atgacccactaaag

SEQ ID NO: 5253585 - DNA, 18 bp, Homo sapiens
atgacccaggctgcctga

SEQ ID NO: 5253586 - DNA, 16 bp, Homo sapiens
atgacccaggctgggc

SEQ ID NO: 5253587 - DNA, 21 bp, Homo sapiens
atgaccccagaaactgaacca

SEQ ID NO: 5253588 - DNA, 22 bp, Homo sapiens
atgacccctcgtccacccccca

SEQ ID NO: 5253589 - DNA, 14 bp, Homo sapiens
atgacccctgccca

SEQ ID NO: 5253590 - DNA, 22 bp, Homo sapiens
atgacccctggccacagccttc

SEQ ID NO: 5253591 - DNA, 17 bp, Homo sapiens
atgaccccttctctctc

SEQ ID NO: 5253592 - DNA, 17 bp, Homo sapiens
atgacccggatgaactc

SEQ ID NO: 5253593 - DNA, 16 bp, Homo sapiens
atgaccctctgtcccc

SEQ ID NO: 5253594 - DNA, 20 bp, Homo sapiens
atgaccctctgtccccaggc

SEQ ID NO: 5253595 - DNA, 11 bp, Homo sapiens
atgaccctgga

SEQ ID NO: 5253596 - DNA, 22 bp, Homo sapiens
atgaccctgtcaagcttcatta

SEQ ID NO: 5253597 - DNA, 12 bp, Homo sapiens
atgaccctgtgc

SEQ ID NO: 5253598 - DNA, 18 bp, Homo sapiens
atgaccctgtgcctgtgt

SEQ ID NO: 5253599 - DNA, 21 bp, Homo sapiens
atgaccctgtgcctgtgtttc

SEQ ID NO: 5253600 - DNA, 14 bp, Homo sapiens
atgacccttttcat

SEQ ID NO: 5253601 - DNA, 16 bp, Homo sapiens
atgaccgagccctgga

SEQ ID NO: 5253602 - DNA, 19 bp, Homo sapiens
atgaccgcacgttctctgc

SEQ ID NO: 5253603 - DNA, 17 bp, Homo sapiens
atgaccggtttggagta

SEQ ID NO: 5253604 - DNA, 13 bp, Homo sapiens
atgacctaaatcc

SEQ ID NO: 5253605 - DNA, 18 bp, Homo sapiens
atgacctacagtgctgtg

SEQ ID NO: 5253606 - DNA, 22 bp, Homo sapiens
atgacctactagttttccttga

SEQ ID NO: 5253607 - DNA, 15 bp, Homo sapiens
atgacctatcagtat

SEQ ID NO: 5253608 - DNA, 16 bp, Homo sapiens
atgacctcaacaaaga

SEQ ID NO: 5253609 - DNA, 13 bp, Homo sapiens
atgacctcaagga

SEQ ID NO: 5253610 - DNA, 12 bp, Homo sapiens
atgacctcagca

SEQ ID NO: 5253611 - DNA, 21 bp, Homo sapiens
atgacctcagggctatgtgga

SEQ ID NO: 5253612 - DNA, 16 bp, Homo sapiens
atgacctcatgcatct

SEQ ID NO: 5253613 - DNA, 22 bp, Homo sapiens
atgacctccagaagtcccttca

SEQ ID NO: 5253614 - DNA, 19 bp, Homo sapiens
atgacctccagctttcctg

SEQ ID NO: 5253615 - DNA, 21 bp, Homo sapiens
atgacctccagctttcctgta

SEQ ID NO: 5253616 - DNA, 23 bp, Homo sapiens
atgacctctctacttccccttct

SEQ ID NO: 5253617 - DNA, 20 bp, Homo sapiens
atgacctctgtcctccctct

SEQ ID NO: 5253618 - DNA, 21 bp, Homo sapiens
atgacctgaaataatatattt

SEQ ID NO: 5253619 - DNA, 13 bp, Homo sapiens
atgacctgcagtc

SEQ ID NO: 5253620 - DNA, 11 bp, Homo sapiens
atgacctgccc

SEQ ID NO: 5253621 - DNA, 13 bp, Homo sapiens
atgacctgcccca

SEQ ID NO: 5253622 - DNA, 14 bp, Homo sapiens
atgacctgccctgg

SEQ ID NO: 5253623 - DNA, 20 bp, Homo sapiens
atgaccttaaggaaaagtaa

SEQ ID NO: 5253624 - DNA, 13 bp, Homo sapiens
atgaccttacatt

SEQ ID NO: 5253625 - DNA, 14 bp, Homo sapiens
atgaccttacattt

SEQ ID NO: 5253626 - DNA, 17 bp, Homo sapiens
atgaccttatccttcct

SEQ ID NO: 5253627 - DNA, 9 bp, Homo sapiens
atgaccttc

SEQ ID NO: 5253628 - DNA, 14 bp, Homo sapiens
atgaccttcccagg

SEQ ID NO: 5253629 - DNA, 17 bp, Homo sapiens
atgaccttcctcctcct

SEQ ID NO: 5253630 - DNA, 18 bp, Homo sapiens
atgaccttctaggaagct

SEQ ID NO: 5253631 - DNA, 23 bp, Homo sapiens
atgaccttgagttaacaggacag

SEQ ID NO: 5253632 - DNA, 20 bp, Homo sapiens
atgaccttgtaatgtaactg

SEQ ID NO: 5253633 - DNA, 21 bp, Homo sapiens
atgacctttcaataggaaaaa

SEQ ID NO: 5253634 - DNA, 13 bp, Homo sapiens
atgaccttttgga

SEQ ID NO: 5253635 - DNA, 20 bp, Homo sapiens
atgaccttttggcctttgta

SEQ ID NO: 5253636 - DNA, 16 bp, Homo sapiens
atgacctttttcactg

SEQ ID NO: 5253637 - DNA, 21 bp, Homo sapiens
atgacgacaaagctgctaaat

SEQ ID NO: 5253638 - DNA, 13 bp, Homo sapiens
atgacgcaaagag

SEQ ID NO: 5253639 - DNA, 21 bp, Homo sapiens
atgacgccagataaaatgttc

SEQ ID NO: 5253640 - DNA, 22 bp, Homo sapiens
atgacgccagataaaatgttca

SEQ ID NO: 5253641 - DNA, 13 bp, Homo sapiens
atgacgcctctgg

SEQ ID NO: 5253642 - DNA, 15 bp, Homo sapiens
atgacgcctctggac

SEQ ID NO: 5253643 - DNA, 18 bp, Homo sapiens
atgacgcctctggacctc

SEQ ID NO: 5253644 - DNA, 18 bp, Homo sapiens
atgacgcggctcaaaagg

SEQ ID NO: 5253645 - DNA, 19 bp, Homo sapiens
atgacggaagaacatagaa

SEQ ID NO: 5253646 - DNA, 13 bp, Homo sapiens
atgacggccaggc

SEQ ID NO: 5253647 - DNA, 16 bp, Homo sapiens
atgacggcctgcctgc

SEQ ID NO: 5253648 - DNA, 14 bp, Homo sapiens
atgacgggatgctc

SEQ ID NO: 5253649 - DNA, 19 bp, Homo sapiens
atgacgggttgtgagactt

SEQ ID NO: 5253650 - DNA, 20 bp, Homo sapiens
atgacggtaagtgttctcat

SEQ ID NO: 5253651 - DNA, 17 bp, Homo sapiens
atgacggtattatgctt

SEQ ID NO: 5253652 - DNA, 20 bp, Homo sapiens
atgacggtgttaattttgct

SEQ ID NO: 5253653 - DNA, 23 bp, Homo sapiens
atgacggtgttaattttgctaac

SEQ ID NO: 5253654 - DNA, 19 bp, Homo sapiens
atgacgtacaagtagttct

SEQ ID NO: 5253655 - DNA, 20 bp, Homo sapiens
atgacgtacaagtagttctg

SEQ ID NO: 5253656 - DNA, 14 bp, Homo sapiens
atgacgtgaatgtg

SEQ ID NO: 5253657 - DNA, 15 bp, Homo sapiens
atgacgtgaatgtgt

SEQ ID NO: 5253658 - DNA, 23 bp, Homo sapiens
atgacgtgactggcctgctggat

SEQ ID NO: 5253659 - DNA, 19 bp, Homo sapiens
atgacgtgtgtggctggga

SEQ ID NO: 5253660 - DNA, 21 bp, Homo sapiens
atgacgtgtgtggctgggacc

SEQ ID NO: 5253661 - DNA, 17 bp, Homo sapiens
atgacgtttaaggccac

SEQ ID NO: 5253662 - DNA, 23 bp, Homo sapiens
atgactaaaaatattataactta

SEQ ID NO: 5253663 - DNA, 14 bp, Homo sapiens
atgactaaagagag

SEQ ID NO: 5253664 - DNA, 15 bp, Homo sapiens
atgactaaagagaga

SEQ ID NO: 5253665 - DNA, 16 bp, Homo sapiens
atgactaaagagagaa

SEQ ID NO: 5253666 - DNA, 17 bp, Homo sapiens
atgactaaagagagaat

SEQ ID NO: 5253667 - DNA, 18 bp, Homo sapiens
atgactaaagtaccagat

SEQ ID NO: 5253668 - DNA, 16 bp, Homo sapiens
atgactaagccaagct

SEQ ID NO: 5253669 - DNA, 22 bp, Homo sapiens
atgactaatccttaataactat

SEQ ID NO: 5253670 - DNA, 23 bp, Homo sapiens
atgactaatccttaataactatg

SEQ ID NO: 5253671 - DNA, 20 bp, Homo sapiens
atgactaatgctttttagaa

SEQ ID NO: 5253672 - DNA, 21 bp, Homo sapiens
atgactaattagggtacattt

SEQ ID NO: 5253673 - DNA, 19 bp, Homo sapiens
atgactacctcagaacata

SEQ ID NO: 5253674 - DNA, 16 bp, Homo sapiens
atgactactacacact

SEQ ID NO: 5253675 - DNA, 23 bp, Homo sapiens
atgactacttagcatcctaagaa

SEQ ID NO: 5253676 - DNA, 20 bp, Homo sapiens
atgactagaaagtgaataaa

SEQ ID NO: 5253677 - DNA, 15 bp, Homo sapiens
atgactagaggcagg

SEQ ID NO: 5253678 - DNA, 22 bp, Homo sapiens
atgactagaggcagggagggga

SEQ ID NO: 5253679 - DNA, 20 bp, Homo sapiens
atgactagcaaacaaaaata

SEQ ID NO: 5253680 - DNA, 21 bp, Homo sapiens
atgactagtgcctagaaagca

SEQ ID NO: 5253681 - DNA, 22 bp, Homo sapiens
atgactagtgcctagaaagcaa

SEQ ID NO: 5253682 - DNA, 15 bp, Homo sapiens
atgactataaacatt

SEQ ID NO: 5253683 - DNA, 23 bp, Homo sapiens
atgactataaacattaaaagaag

SEQ ID NO: 5253684 - DNA, 17 bp, Homo sapiens
atgactattacttttct

SEQ ID NO: 5253685 - DNA, 23 bp, Homo sapiens
atgactattacttttctgtttag

SEQ ID NO: 5253686 - DNA, 12 bp, Homo sapiens
atgactattgta

SEQ ID NO: 5253687 - DNA, 17 bp, Homo sapiens
atgactattgtaatgcc

SEQ ID NO: 5253688 - DNA, 14 bp, Homo sapiens
atgactcaaagatg

SEQ ID NO: 5253689 - DNA, 23 bp, Homo sapiens
atgactcaagattcccaggagtt

SEQ ID NO: 5253690 - DNA, 17 bp, Homo sapiens
atgactcacatgatgca

SEQ ID NO: 5253691 - DNA, 19 bp, Homo sapiens
atgactcactccattccta

SEQ ID NO: 5253692 - DNA, 14 bp, Homo sapiens
atgactcaggagcc

SEQ ID NO: 5253693 - DNA, 22 bp, Homo sapiens
atgactcataggtccctgacat

SEQ ID NO: 5253694 - DNA, 16 bp, Homo sapiens
atgactcatgcctctg

SEQ ID NO: 5253695 - DNA, 20 bp, Homo sapiens
atgactccaccttctcacct

SEQ ID NO: 5253696 - DNA, 16 bp, Homo sapiens
atgactccagaatttc

SEQ ID NO: 5253697 - DNA, 14 bp, Homo sapiens
atgactccaggaag

SEQ ID NO: 5253698 - DNA, 17 bp, Homo sapiens
atgactcgaaactgaca

SEQ ID NO: 5253699 - DNA, 17 bp, Homo sapiens
atgactcgttacctgcc

SEQ ID NO: 5253700 - DNA, 15 bp, Homo sapiens
atgactctaaagaaa

SEQ ID NO: 5253701 - DNA, 16 bp, Homo sapiens
atgactctaaagaaac

SEQ ID NO: 5253702 - DNA, 16 bp, Homo sapiens
atgactctcattttat

SEQ ID NO: 5253703 - DNA, 12 bp, Homo sapiens
atgactctgcct

SEQ ID NO: 5253704 - DNA, 17 bp, Homo sapiens
atgactcttggagcctc

SEQ ID NO: 5253705 - DNA, 20 bp, Homo sapiens
atgactcttggagcctcttt

SEQ ID NO: 5253706 - DNA, 18 bp, Homo sapiens
atgactctttattgtctg

SEQ ID NO: 5253707 - DNA, 16 bp, Homo sapiens
atgactgaaaatgaac

SEQ ID NO: 5253708 - DNA, 16 bp, Homo sapiens
atgactgaaagcactg

SEQ ID NO: 5253709 - DNA, 16 bp, Homo sapiens
atgactgaatttctat

SEQ ID NO: 5253710 - DNA, 18 bp, Homo sapiens
atgactgacaaagacatc

SEQ ID NO: 5253711 - DNA, 16 bp, Homo sapiens
atgactgacactcaga

SEQ ID NO: 5253712 - DNA, 16 bp, Homo sapiens
atgactgagatttgta

SEQ ID NO: 5253713 - DNA, 17 bp, Homo sapiens
atgactgagatttgtaa

SEQ ID NO: 5253714 - DNA, 23 bp, Homo sapiens
atgactgagtctggcaaacatgt

SEQ ID NO: 5253715 - DNA, 13 bp, Homo sapiens
atgactgcacatg

SEQ ID NO: 5253716 - DNA, 16 bp, Homo sapiens
atgactgcacccagct

SEQ ID NO: 5253717 - DNA, 22 bp, Homo sapiens
atgactgcacccagctccaggg

SEQ ID NO: 5253718 - DNA, 21 bp, Homo sapiens
atgactgccaagactgctgtg

SEQ ID NO: 5253719 - DNA, 13 bp, Homo sapiens
atgactgctcagg

SEQ ID NO: 5253720 - DNA, 22 bp, Homo sapiens
atgactgctccccagccctggc

SEQ ID NO: 5253721 - DNA, 23 bp, Homo sapiens
atgactgctccccagccctggct

SEQ ID NO: 5253722 - DNA, 12 bp, Homo sapiens
atgactgcttgc

SEQ ID NO: 5253723 - DNA, 22 bp, Homo sapiens
atgactgcttgccctaagcaga

SEQ ID NO: 5253724 - DNA, 15 bp, Homo sapiens
atgactggaattttt

SEQ ID NO: 5253725 - DNA, 22 bp, Homo sapiens
atgactggaatttttattatgc

SEQ ID NO: 5253726 - DNA, 22 bp, Homo sapiens
atgactggagtaaaccatgtat

SEQ ID NO: 5253727 - DNA, 16 bp, Homo sapiens
atgactggcattttat

SEQ ID NO: 5253728 - DNA, 12 bp, Homo sapiens
atgactggctcc

SEQ ID NO: 5253729 - DNA, 14 bp, Homo sapiens
atgactggctcctg

SEQ ID NO: 5253730 - DNA, 16 bp, Homo sapiens
atgactggctgtctgc

SEQ ID NO: 5253731 - DNA, 20 bp, Homo sapiens
atgactggtgcgttcctaaa

SEQ ID NO: 5253732 - DNA, 20 bp, Homo sapiens
atgactgtcgccacacgcct

SEQ ID NO: 5253733 - DNA, 19 bp, Homo sapiens
atgactgtgaactgggcat

SEQ ID NO: 5253734 - DNA, 17 bp, Homo sapiens
atgactgtgattttcag

SEQ ID NO: 5253735 - DNA, 14 bp, Homo sapiens
atgactgtgttgta

SEQ ID NO: 5253736 - DNA, 11 bp, Homo sapiens
atgactgttga

SEQ ID NO: 5253737 - DNA, 21 bp, Homo sapiens
atgactgttgttcttataaga

SEQ ID NO: 5253738 - DNA, 21 bp, Homo sapiens
atgactgtttcttttgtaaag

SEQ ID NO: 5253739 - DNA, 21 bp, Homo sapiens
atgactgtttttcggacagtt

SEQ ID NO: 5253740 - DNA, 18 bp, Homo sapiens
atgacttaaggtgaagtg

SEQ ID NO: 5253741 - DNA, 15 bp, Homo sapiens
atgacttaattttag

SEQ ID NO: 5253742 - DNA, 19 bp, Homo sapiens
atgacttaattttagaaag

SEQ ID NO: 5253743 - DNA, 20 bp, Homo sapiens
atgacttaattttagaaaga

SEQ ID NO: 5253744 - DNA, 17 bp, Homo sapiens
atccacacacagcagct

SEQ ID NO: 5253745 - DNA, 20 bp, Homo sapiens
atccacacacagcagctcca

SEQ ID NO: 5253746 - DNA, 14 bp, Homo sapiens
atccacacacagta

SEQ ID NO: 5253747 - DNA, 14 bp, Homo sapiens
atccacacatgaat

SEQ ID NO: 5253748 - DNA, 20 bp, Homo sapiens
atccacagactccctcccct

SEQ ID NO: 5253749 - DNA, 17 bp, Homo sapiens
atccacagagagtccca

SEQ ID NO: 5253750 - DNA, 21 bp, Homo sapiens
atccacagagagtcccactgc

SEQ ID NO: 5253751 - DNA, 10 bp, Homo sapiens
atccacagct

SEQ ID NO: 5253752 - DNA, 23 bp, Homo sapiens
atccacagctatatcctgatgct

SEQ ID NO: 5253753 - DNA, 20 bp, Homo sapiens
atccacaggaaagtgttatt

SEQ ID NO: 5253754 - DNA, 14 bp, Homo sapiens
atccacaggattcc

SEQ ID NO: 5253755 - DNA, 15 bp, Homo sapiens
atccacaggattcca

SEQ ID NO: 5253756 - DNA, 17 bp, Homo sapiens
atccacagtattgttct

SEQ ID NO: 5253757 - DNA, 14 bp, Homo sapiens
atccacagttgtca

SEQ ID NO: 5253758 - DNA, 15 bp, Homo sapiens
atccacataaccctg

SEQ ID NO: 5253759 - DNA, 15 bp, Homo sapiens
atccacatgaaaata

SEQ ID NO: 5253760 - DNA, 18 bp, Homo sapiens
atccacatgcacatgtat

SEQ ID NO: 5253761 - DNA, 16 bp, Homo sapiens
atccacatgctctgca

SEQ ID NO: 5253762 - DNA, 19 bp, Homo sapiens
atccacatgctctgcagtc

SEQ ID NO: 5253763 - DNA, 13 bp, Homo sapiens
atccacattgttt

SEQ ID NO: 5253764 - DNA, 16 bp, Homo sapiens
atccacatttctaaaa

SEQ ID NO: 5253765 - DNA, 15 bp, Homo sapiens
atccaccaaactcct

SEQ ID NO: 5253766 - DNA, 20 bp, Homo sapiens
atccaccaatatcatgtgta

SEQ ID NO: 5253767 - DNA, 20 bp, Homo sapiens
atccaccaccccacccacct

SEQ ID NO: 5253768 - DNA, 14 bp, Homo sapiens
atccaccacctccc

SEQ ID NO: 5253769 - DNA, 14 bp, Homo sapiens
atccaccaccttgc

SEQ ID NO: 5253770 - DNA, 19 bp, Homo sapiens
atccaccactttaacctta

SEQ ID NO: 5253771 - DNA, 18 bp, Homo sapiens
atccaccagtgtgttgaa

SEQ ID NO: 5253772 - DNA, 20 bp, Homo sapiens
atccacccaaccctatctcc

SEQ ID NO: 5253773 - DNA, 18 bp, Homo sapiens
atccacccacctcggcct

SEQ ID NO: 5253774 - DNA, 18 bp, Homo sapiens
atccacccaccttggcct

SEQ ID NO: 5253775 - DNA, 15 bp, Homo sapiens
atccacccagcaggc

SEQ ID NO: 5253776 - DNA, 13 bp, Homo sapiens
atccacccagccc

SEQ ID NO: 5253777 - DNA, 18 bp, Homo sapiens
atccacccagtgctgcca

SEQ ID NO: 5253778 - DNA, 19 bp, Homo sapiens
atccacccagtgctgccat

SEQ ID NO: 5253779 - DNA, 20 bp, Homo sapiens
atccacccagtgctgccatg

SEQ ID NO: 5253780 - DNA, 10 bp, Homo sapiens
atccacccca

SEQ ID NO: 5253781 - DNA, 23 bp, Homo sapiens
atccaccccaatcctcccagaaa

SEQ ID NO: 5253782 - DNA, 11 bp, Homo sapiens
atccaccccca

SEQ ID NO: 5253783 - DNA, 22 bp, Homo sapiens
atccacccccaggtgcagcccc

SEQ ID NO: 5253784 - DNA, 11 bp, Homo sapiens
atccaccccct

SEQ ID NO: 5253785 - DNA, 15 bp, Homo sapiens
atccaccccctgccc

SEQ ID NO: 5253786 - DNA, 17 bp, Homo sapiens
atccacccctctggcac

SEQ ID NO: 5253787 - DNA, 17 bp, Homo sapiens
atccacccgctgcccct

SEQ ID NO: 5253788 - DNA, 22 bp, Homo sapiens
atccacccgggggagcccagtg

SEQ ID NO: 5253789 - DNA, 23 bp, Homo sapiens
atccacccgggggagcccagtga

SEQ ID NO: 5253790 - DNA, 20 bp, Homo sapiens
atccaccctcaaatgtcaga

SEQ ID NO: 5253791 - DNA, 12 bp, Homo sapiens
atccaccctgag

SEQ ID NO: 5253792 - DNA, 14 bp, Homo sapiens
atccaccctgagga

SEQ ID NO: 5253793 - DNA, 19 bp, Homo sapiens
atccacctcatcactggac

SEQ ID NO: 5253794 - DNA, 10 bp, Homo sapiens
atccacctcc

SEQ ID NO: 5253795 - DNA, 12 bp, Homo sapiens
atccacctccat

SEQ ID NO: 5253796 - DNA, 14 bp, Homo sapiens
atccacctccatct

SEQ ID NO: 5253797 - DNA, 23 bp, Homo sapiens
atccacctccctaccaaaaattg

SEQ ID NO: 5253798 - DNA, 19 bp, Homo sapiens
atccacctcggagcatggt

SEQ ID NO: 5253799 - DNA, 14 bp, Homo sapiens
atccacctgcacaa

SEQ ID NO: 5253800 - DNA, 15 bp, Homo sapiens
atccacctgcacaaa

SEQ ID NO: 5253801 - DNA, 19 bp, Homo sapiens
atccacctgcacaaacata

SEQ ID NO: 5253802 - DNA, 14 bp, Homo sapiens
atccacctgccttg

SEQ ID NO: 5253803 - DNA, 21 bp, Homo sapiens
atccacctgtctcagcctccc

SEQ ID NO: 5253804 - DNA, 19 bp, Homo sapiens
atccacctgtcttggcctc

SEQ ID NO: 5253805 - DNA, 21 bp, Homo sapiens
atccacctgtcttggcctccc

SEQ ID NO: 5253806 - DNA, 18 bp, Homo sapiens
atccacgcagcagcccct

SEQ ID NO: 5253807 - DNA, 18 bp, Homo sapiens
atccacgctcatcttgca

SEQ ID NO: 5253808 - DNA, 15 bp, Homo sapiens
atccacgctgggcct

SEQ ID NO: 5253809 - DNA, 20 bp, Homo sapiens
atccacgtagggggcagggg

SEQ ID NO: 5253810 - DNA, 14 bp, Homo sapiens
atccacgtggcctc

SEQ ID NO: 5253811 - DNA, 12 bp, Homo sapiens
atccactacagg

SEQ ID NO: 5253812 - DNA, 20 bp, Homo sapiens
atccactctaccctcccacc

SEQ ID NO: 5253813 - DNA, 23 bp, Homo sapiens
atccactctctcttgttcttact

SEQ ID NO: 5253814 - DNA, 20 bp, Homo sapiens
atccactggacactgtgaaa

SEQ ID NO: 5253815 - DNA, 13 bp, Homo sapiens
atccactgtgacg

SEQ ID NO: 5253816 - DNA, 13 bp, Homo sapiens
atccacttaagtt

SEQ ID NO: 5253817 - DNA, 15 bp, Homo sapiens
atccacttaagttct

SEQ ID NO: 5253818 - DNA, 17 bp, Homo sapiens
atccacttaagttcttt

SEQ ID NO: 5253819 - DNA, 15 bp, Homo sapiens
atccacttcaggagc

SEQ ID NO: 5253820 - DNA, 21 bp, Homo sapiens
atccacttcttaatgctttcc

SEQ ID NO: 5253821 - DNA, 15 bp, Homo sapiens
atccactttggggga

SEQ ID NO: 5253822 - DNA, 12 bp, Homo sapiens
atccagaaaact

SEQ ID NO: 5253823 - DNA, 15 bp, Homo sapiens
atccagaaaactgtg

SEQ ID NO: 5253824 - DNA, 21 bp, Homo sapiens
atccagaaacttgttcttcca

SEQ ID NO: 5253825 - DNA, 14 bp, Homo sapiens
atccagaaagaaaa

SEQ ID NO: 5253826 - DNA, 15 bp, Homo sapiens
atccagaaagaaaaa

SEQ ID NO: 5253827 - DNA, 23 bp, Homo sapiens
atccagaaataaagtctaagaga

SEQ ID NO: 5253828 - DNA, 15 bp, Homo sapiens
atccagaaatactta

SEQ ID NO: 5253829 - DNA, 15 bp, Homo sapiens
atccagaagagccca

SEQ ID NO: 5253830 - DNA, 17 bp, Homo sapiens
atccagaaggggagctt

SEQ ID NO: 5253831 - DNA, 22 bp, Homo sapiens
atccagaagtattgtttacatt

SEQ ID NO: 5253832 - DNA, 19 bp, Homo sapiens
atccagaagttttaacttc

SEQ ID NO: 5253833 - DNA, 16 bp, Homo sapiens
atccagacatcatgaa

SEQ ID NO: 5253834 - DNA, 22 bp, Homo sapiens
atccagacatcatgaattttac

SEQ ID NO: 5253835 - DNA, 15 bp, Homo sapiens
atccagacccggctg

SEQ ID NO: 5253836 - DNA, 20 bp, Homo sapiens
atccagacctggctccactc

SEQ ID NO: 5253837 - DNA, 20 bp, Homo sapiens
atccagactgtaagatgttg

SEQ ID NO: 5253838 - DNA, 23 bp, Homo sapiens
atccagactttctttttctacat

SEQ ID NO: 5253839 - DNA, 14 bp, Homo sapiens
atccagagaagcgc

SEQ ID NO: 5253840 - DNA, 16 bp, Homo sapiens
atccagagaccaaata

SEQ ID NO: 5253841 - DNA, 18 bp, Homo sapiens
atccagagacctgctcca

SEQ ID NO: 5253842 - DNA, 20 bp, Homo sapiens
atccagagacctgctccaga

SEQ ID NO: 5253843 - DNA, 20 bp, Homo sapiens
atccagagagaagcacccca

SEQ ID NO: 5253844 - DNA, 15 bp, Homo sapiens
atccagagagcagct

SEQ ID NO: 5253845 - DNA, 17 bp, Homo sapiens
atccagagaggctggat

SEQ ID NO: 5253846 - DNA, 17 bp, Homo sapiens
atccagagagtattcta

SEQ ID NO: 5253847 - DNA, 19 bp, Homo sapiens
atccagagattcattttct

SEQ ID NO: 5253848 - DNA, 14 bp, Homo sapiens
atccagagctgttt

SEQ ID NO: 5253849 - DNA, 23 bp, Homo sapiens
atccagaggtgagggaggcctga

SEQ ID NO: 5253850 - DNA, 21 bp, Homo sapiens
atccagagtccctgcctggac

SEQ ID NO: 5253851 - DNA, 18 bp, Homo sapiens
atccagatccagactgta

SEQ ID NO: 5253852 - DNA, 14 bp, Homo sapiens
atccagatctggga

SEQ ID NO: 5253853 - DNA, 19 bp, Homo sapiens
atccagatgaactgagaag

SEQ ID NO: 5253854 - DNA, 14 bp, Homo sapiens
atccagatgtggct

SEQ ID NO: 5253855 - DNA, 16 bp, Homo sapiens
atccagattcccaggc

SEQ ID NO: 5253856 - DNA, 22 bp, Homo sapiens
atccagattcccaggccaggct

SEQ ID NO: 5253857 - DNA, 18 bp, Homo sapiens
atccagcagattattcac

SEQ ID NO: 5253858 - DNA, 16 bp, Homo sapiens
atccagcagtctctgc

SEQ ID NO: 5253859 - DNA, 23 bp, Homo sapiens
atccagcagtgttgctcagctcc

SEQ ID NO: 5253860 - DNA, 16 bp, Homo sapiens
atccagcatgaaagat

SEQ ID NO: 5253861 - DNA, 12 bp, Homo sapiens
atccagcatgtg

SEQ ID NO: 5253862 - DNA, 14 bp, Homo sapiens
atccagcatgtgtg

SEQ ID NO: 5253863 - DNA, 20 bp, Homo sapiens
atccagcatgtgtgtgtctc

SEQ ID NO: 5253864 - DNA, 22 bp, Homo sapiens
atccagcatgtgtgtgtctcta

SEQ ID NO: 5253865 - DNA, 22 bp, Homo sapiens
atccagcattgttgagctgtca

SEQ ID NO: 5253866 - DNA, 12 bp, Homo sapiens
atccagccacgg

SEQ ID NO: 5253867 - DNA, 13 bp, Homo sapiens
atccagccacgga

SEQ ID NO: 5253868 - DNA, 14 bp, Homo sapiens
atccagccagaccc

SEQ ID NO: 5253869 - DNA, 14 bp, Homo sapiens
atccagccaggggt

SEQ ID NO: 5253870 - DNA, 19 bp, Homo sapiens
atccagcccaaacctggga

SEQ ID NO: 5253871 - DNA, 17 bp, Homo sapiens
atccagccccatagaaa

SEQ ID NO: 5253872 - DNA, 22 bp, Homo sapiens
atccagccgcaaatccataccc

SEQ ID NO: 5253873 - DNA, 13 bp, Homo sapiens
atccagcctccag

SEQ ID NO: 5253874 - DNA, 14 bp, Homo sapiens
atccagcctccagg

SEQ ID NO: 5253875 - DNA, 15 bp, Homo sapiens
atccagcctccaggg

SEQ ID NO: 5253876 - DNA, 18 bp, Homo sapiens
atccagcctccagggcat

SEQ ID NO: 5253877 - DNA, 14 bp, Homo sapiens
atccagcctctccc

SEQ ID NO: 5253878 - DNA, 17 bp, Homo sapiens
atccagcctctcccctg

SEQ ID NO: 5253879 - DNA, 21 bp, Homo sapiens
atccagcctctcccctgatta

SEQ ID NO: 5253880 - DNA, 17 bp, Homo sapiens
atccagcctggggtctg

SEQ ID NO: 5253881 - DNA, 13 bp, Homo sapiens
atccagcctgtgt

SEQ ID NO: 5253882 - DNA, 21 bp, Homo sapiens
atccagcggggcttctgggcg

SEQ ID NO: 5253883 - DNA, 19 bp, Homo sapiens
atccagcgtgcaccccgcc

SEQ ID NO: 5253884 - DNA, 15 bp, Homo sapiens
atccagctaccacca

SEQ ID NO: 5253885 - DNA, 21 bp, Homo sapiens
atccagctacttagctggcca

SEQ ID NO: 5253886 - DNA, 22 bp, Homo sapiens
atccagctacttagctggccaa

SEQ ID NO: 5253887 - DNA, 14 bp, Homo sapiens
atccagctcaaggg

SEQ ID NO: 5253888 - DNA, 11 bp, Homo sapiens
atccagctccc

SEQ ID NO: 5253889 - DNA, 13 bp, Homo sapiens
atccagctcccca

SEQ ID NO: 5253890 - DNA, 15 bp, Homo sapiens
atccagctgtgtgtt

SEQ ID NO: 5253891 - DNA, 22 bp, Homo sapiens
atccagcttctcatgttaaata

SEQ ID NO: 5253892 - DNA, 21 bp, Homo sapiens
atccaggaaagatgtcccaca

SEQ ID NO: 5253893 - DNA, 14 bp, Homo sapiens
atccaggaacacat

SEQ ID NO: 5253894 - DNA, 20 bp, Homo sapiens
atccaggaacacatgcacac

SEQ ID NO: 5253895 - DNA, 23 bp, Homo sapiens
atccaggaacacatgcacacaca

SEQ ID NO: 5253896 - DNA, 11 bp, Homo sapiens
atccaggaccc

SEQ ID NO: 5253897 - DNA, 15 bp, Homo sapiens
atccaggaccctgcc

SEQ ID NO: 5253898 - DNA, 20 bp, Homo sapiens
atccaggaccctgccaggca

SEQ ID NO: 5253899 - DNA, 22 bp, Homo sapiens
atccaggaccctgccaggcaca

SEQ ID NO: 5253900 - DNA, 21 bp, Homo sapiens
atccaggagcaacgccagtgg

SEQ ID NO: 5253901 - DNA, 14 bp, Homo sapiens
atccaggagccttg

SEQ ID NO: 5253902 - DNA, 12 bp, Homo sapiens
atccaggagctc

SEQ ID NO: 5253903 - DNA, 15 bp, Homo sapiens
atccaggcaatggcc

SEQ ID NO: 5253904 - DNA, 16 bp, Homo sapiens
atccaggcacagctga

SEQ ID NO: 5253905 - DNA, 17 bp, Homo sapiens
atccaggcacagctgag

SEQ ID NO: 5253906 - DNA, 18 bp, Homo sapiens
atccaggcagaaggagat

SEQ ID NO: 5253907 - DNA, 15 bp, Homo sapiens
atccaggcagatcca

SEQ ID NO: 5253908 - DNA, 15 bp, Homo sapiens
atccaggcaggagca

SEQ ID NO: 5253909 - DNA, 12 bp, Homo sapiens
atccaggccact

SEQ ID NO: 5253910 - DNA, 20 bp, Homo sapiens
atccaggcccctccctctcc

SEQ ID NO: 5253911 - DNA, 21 bp, Homo sapiens
atccaggcccctccctctcca

SEQ ID NO: 5253912 - DNA, 13 bp, Homo sapiens
atccaggcctgag

SEQ ID NO: 5253913 - DNA, 14 bp, Homo sapiens
atccaggcctgagg

SEQ ID NO: 5253914 - DNA, 23 bp, Homo sapiens
atccaggcgtgggacgtggtcag

SEQ ID NO: 5253915 - DNA, 24 bp, Homo sapiens
atccaggctggccagtgctgccca

SEQ ID NO: 5253916 - DNA, 18 bp, Homo sapiens
atccaggcttctcccgga

SEQ ID NO: 5253917 - DNA, 13 bp, Homo sapiens
atccagggacaga

SEQ ID NO: 5253918 - DNA, 19 bp, Homo sapiens
atccagggacagaggcccc

SEQ ID NO: 5253919 - DNA, 18 bp, Homo sapiens
atccagggatgccatctg

SEQ ID NO: 5253920 - DNA, 15 bp, Homo sapiens
atccagggcagcagg

SEQ ID NO: 5253921 - DNA, 16 bp, Homo sapiens
atccagggcagcaggc

SEQ ID NO: 5253922 - DNA, 18 bp, Homo sapiens
atccagggcagcaggcca

SEQ ID NO: 5253923 - DNA, 19 bp, Homo sapiens
atccagggcagcaggccag

SEQ ID NO: 5253924 - DNA, 21 bp, Homo sapiens
atgacttaattttagaaagaa

SEQ ID NO: 5253925 - DNA, 23 bp, Homo sapiens
atgacttaattttagaaagaaaa

SEQ ID NO: 5253926 - DNA, 21 bp, Homo sapiens
atgacttacaggctaaaatta

SEQ ID NO: 5253927 - DNA, 14 bp, Homo sapiens
atgacttacctgtt

SEQ ID NO: 5253928 - DNA, 16 bp, Homo sapiens
atgacttactgtacat

SEQ ID NO: 5253929 - DNA, 15 bp, Homo sapiens
atgacttagaaacaa

SEQ ID NO: 5253930 - DNA, 18 bp, Homo sapiens
atgacttatttctgctct

SEQ ID NO: 5253931 - DNA, 14 bp, Homo sapiens
atgacttcagtgaa

SEQ ID NO: 5253932 - DNA, 16 bp, Homo sapiens
atgacttcattaataa

SEQ ID NO: 5253933 - DNA, 13 bp, Homo sapiens
atgacttcccaac

SEQ ID NO: 5253934 - DNA, 23 bp, Homo sapiens
atgacttcccctgcctcctactc

SEQ ID NO: 5253935 - DNA, 18 bp, Homo sapiens
atgacttcctagggatct

SEQ ID NO: 5253936 - DNA, 19 bp, Homo sapiens
atgacttctccaggcagag

SEQ ID NO: 5253937 - DNA, 16 bp, Homo sapiens
atgacttctgccccag

SEQ ID NO: 5253938 - DNA, 15 bp, Homo sapiens
atgacttctgctgaa

SEQ ID NO: 5253939 - DNA, 18 bp, Homo sapiens
atgacttgaggcacaaat

SEQ ID NO: 5253940 - DNA, 19 bp, Homo sapiens
atgacttgaggcacaaatc

SEQ ID NO: 5253941 - DNA, 13 bp, Homo sapiens
atgacttgattgt

SEQ ID NO: 5253942 - DNA, 17 bp, Homo sapiens
atgacttgcagatgaaa

SEQ ID NO: 5253943 - DNA, 16 bp, Homo sapiens
atgacttgctactttt

SEQ ID NO: 5253944 - DNA, 21 bp, Homo sapiens
atgacttgctgtccaggcagc

SEQ ID NO: 5253945 - DNA, 20 bp, Homo sapiens
atgacttgggcacccccagc

SEQ ID NO: 5253946 - DNA, 22 bp, Homo sapiens
atgacttgggcacccccagcct

SEQ ID NO: 5253947 - DNA, 21 bp, Homo sapiens
atgacttggggacaccccaga

SEQ ID NO: 5253948 - DNA, 23 bp, Homo sapiens
atgactttatatggatgattcag

SEQ ID NO: 5253949 - DNA, 21 bp, Homo sapiens
atgactttattgcatctgggt

SEQ ID NO: 5253950 - DNA, 21 bp, Homo sapiens
atgactttcacatttggaatt

SEQ ID NO: 5253951 - DNA, 18 bp, Homo sapiens
atgactttcataataaat

SEQ ID NO: 5253952 - DNA, 18 bp, Homo sapiens
atgactttcctcagaaca

SEQ ID NO: 5253953 - DNA, 13 bp, Homo sapiens
atgactttcctta

SEQ ID NO: 5253954 - DNA, 19 bp, Homo sapiens
atgactttgcagatggaaa

SEQ ID NO: 5253955 - DNA, 11 bp, Homo sapiens
atgactttgga

SEQ ID NO: 5253956 - DNA, 18 bp, Homo sapiens
atgacttttaaaatttgt

SEQ ID NO: 5253957 - DNA, 17 bp, Homo sapiens
atgacttttccatgtat

SEQ ID NO: 5253958 - DNA, 20 bp, Homo sapiens
atgacttttgaattacagag

SEQ ID NO: 5253959 - DNA, 18 bp, Homo sapiens
atgactttttataaaatg

SEQ ID NO: 5253960 - DNA, 14 bp, Homo sapiens
atgacttttttaaa

SEQ ID NO: 5253961 - DNA, 17 bp, Homo sapiens
atgacttttttaaacta

SEQ ID NO: 5253962 - DNA, 21 bp, Homo sapiens
atgactttttttctgattcaa

SEQ ID NO: 5253963 - DNA, 18 bp, Homo sapiens
atgagaaaaaaacagcag

SEQ ID NO: 5253964 - DNA, 21 bp, Homo sapiens
atgagaaaaatattcaagtaa

SEQ ID NO: 5253965 - DNA, 16 bp, Homo sapiens
atgagaaacagctcag

SEQ ID NO: 5253966 - DNA, 22 bp, Homo sapiens
atgagaaactggcaaagcagaa

SEQ ID NO: 5253967 - DNA, 11 bp, Homo sapiens
atgagaaactt

SEQ ID NO: 5253968 - DNA, 22 bp, Homo sapiens
atgagaaactttgatctctgct

SEQ ID NO: 5253969 - DNA, 23 bp, Homo sapiens
atgagaaactttgatctctgctt

SEQ ID NO: 5253970 - DNA, 19 bp, Homo sapiens
atgagaaagccttcttttg

SEQ ID NO: 5253971 - DNA, 17 bp, Homo sapiens
atgagaaaggacagagc

SEQ ID NO: 5253972 - DNA, 20 bp, Homo sapiens
atgagaaaggacagagccag

SEQ ID NO: 5253973 - DNA, 13 bp, Homo sapiens
atgagaaagggag

SEQ ID NO: 5253974 - DNA, 21 bp, Homo sapiens
atgagaaaggttgaagcacca

SEQ ID NO: 5253975 - DNA, 17 bp, Homo sapiens
atgagaaatacagaaga

SEQ ID NO: 5253976 - DNA, 16 bp, Homo sapiens
atgagaaatataaaaa

SEQ ID NO: 5253977 - DNA, 15 bp, Homo sapiens
atgagaaatctaaaa

SEQ ID NO: 5253978 - DNA, 11 bp, Homo sapiens
atgagaaatgt

SEQ ID NO: 5253979 - DNA, 15 bp, Homo sapiens
atgagaaatgtaatg

SEQ ID NO: 5253980 - DNA, 22 bp, Homo sapiens
atgagaaattagtcacttaaaa

SEQ ID NO: 5253981 - DNA, 17 bp, Homo sapiens
atgagaaattgtgccaa

SEQ ID NO: 5253982 - DNA, 22 bp, Homo sapiens
atgagaaattgtgccaaagata

SEQ ID NO: 5253983 - DNA, 14 bp, Homo sapiens
atgagaacaaagct

SEQ ID NO: 5253984 - DNA, 23 bp, Homo sapiens
atgagaacaaagctgttaaactg

SEQ ID NO: 5253985 - DNA, 17 bp, Homo sapiens
atgagaacaagtcacag

SEQ ID NO: 5253986 - DNA, 17 bp, Homo sapiens
atgagaacagataaaga

SEQ ID NO: 5253987 - DNA, 13 bp, Homo sapiens
atgagaacatggt

SEQ ID NO: 5253988 - DNA, 17 bp, Homo sapiens
atgagaacatgttggta

SEQ ID NO: 5253989 - DNA, 19 bp, Homo sapiens
atgagaacatgttggtatt

SEQ ID NO: 5253990 - DNA, 16 bp, Homo sapiens
atgagaactaaataga

SEQ ID NO: 5253991 - DNA, 14 bp, Homo sapiens
atgagaactctgag

SEQ ID NO: 5253992 - DNA, 12 bp, Homo sapiens
atgagaagaaaa

SEQ ID NO: 5253993 - DNA, 18 bp, Homo sapiens
atgagaagaaaaatggaa

SEQ ID NO: 5253994 - DNA, 21 bp, Homo sapiens
atgagaagagggcctgtggga

SEQ ID NO: 5253995 - DNA, 11 bp, Homo sapiens
atgagaagagt

SEQ ID NO: 5253996 - DNA, 13 bp, Homo sapiens
atgagaagagttt

SEQ ID NO: 5253997 - DNA, 22 bp, Homo sapiens
atgagaagatcctgtcacaatt

SEQ ID NO: 5253998 - DNA, 13 bp, Homo sapiens
atgagaagccaag

SEQ ID NO: 5253999 - DNA, 14 bp, Homo sapiens
atgagaagccaagc

SEQ ID NO: 5254000 - DNA, 18 bp, Homo sapiens
atgagaaggaatttgagt

SEQ ID NO: 5254001 - DNA, 13 bp, Homo sapiens
atgagaagggaag

SEQ ID NO: 5254002 - DNA, 18 bp, Homo sapiens
atgagaagtaaattattt

SEQ ID NO: 5254003 - DNA, 11 bp, Homo sapiens
atgagaagtta

SEQ ID NO: 5254004 - DNA, 15 bp, Homo sapiens
atgagaatagaaacg

SEQ ID NO: 5254005 - DNA, 17 bp, Homo sapiens
atgagaatataccttat

SEQ ID NO: 5254006 - DNA, 16 bp, Homo sapiens
atgagaatcatgcact

SEQ ID NO: 5254007 - DNA, 11 bp, Homo sapiens
atgagaatcta

SEQ ID NO: 5254008 - DNA, 12 bp, Homo sapiens
atgagaatgtat

SEQ ID NO: 5254009 - DNA, 13 bp, Homo sapiens
atgagaatgtatt

SEQ ID NO: 5254010 - DNA, 20 bp, Homo sapiens
atgagaatgtcatttgctaa

SEQ ID NO: 5254011 - DNA, 19 bp, Homo sapiens
atgagaatgtgccatgtat

SEQ ID NO: 5254012 - DNA, 20 bp, Homo sapiens
atgagaatgtgccatgtata

SEQ ID NO: 5254013 - DNA, 20 bp, Homo sapiens
atgagaattacagaaaattt

SEQ ID NO: 5254014 - DNA, 16 bp, Homo sapiens
atgagaattcagctgc

SEQ ID NO: 5254015 - DNA, 18 bp, Homo sapiens
atgagaattttacttcca

SEQ ID NO: 5254016 - DNA, 21 bp, Homo sapiens
atgagaattttacttccatta

SEQ ID NO: 5254017 - DNA, 13 bp, Homo sapiens
atgagaattttat

SEQ ID NO: 5254018 - DNA, 15 bp, Homo sapiens
atgagacaaacatgc

SEQ ID NO: 5254019 - DNA, 13 bp, Homo sapiens
atgagacacagga

SEQ ID NO: 5254020 - DNA, 19 bp, Homo sapiens
atgagacagacattcacct

SEQ ID NO: 5254021 - DNA, 20 bp, Homo sapiens
atgagacaggacctaggata

SEQ ID NO: 5254022 - DNA, 20 bp, Homo sapiens
atgagacagggtcttgctct

SEQ ID NO: 5254023 - DNA, 22 bp, Homo sapiens
atgagacataggccatgaaaaa

SEQ ID NO: 5254024 - DNA, 18 bp, Homo sapiens
atgagaccactgttatca

SEQ ID NO: 5254025 - DNA, 17 bp, Homo sapiens
atgagacccagcccctt

SEQ ID NO: 5254026 - DNA, 21 bp, Homo sapiens
atgagacccattcctatttct

SEQ ID NO: 5254027 - DNA, 21 bp, Homo sapiens
atgagacccctttaaactgtc

SEQ ID NO: 5254028 - DNA, 23 bp, Homo sapiens
atgagacctcccccagggagggg

SEQ ID NO: 5254029 - DNA, 14 bp, Homo sapiens
atgagacctggaac

SEQ ID NO: 5254030 - DNA, 22 bp, Homo sapiens
atgagactattatgaaatcata

SEQ ID NO: 5254031 - DNA, 17 bp, Homo sapiens
atgagactgccctgccc

SEQ ID NO: 5254032 - DNA, 23 bp, Homo sapiens
atgagacttccaaacctgacaga

SEQ ID NO: 5254033 - DNA, 23 bp, Homo sapiens
atgagacttcctattaatttatt

SEQ ID NO: 5254034 - DNA, 19 bp, Homo sapiens
atgagacttgagtctattt

SEQ ID NO: 5254035 - DNA, 14 bp, Homo sapiens
atgagacttgcctt

SEQ ID NO: 5254036 - DNA, 15 bp, Homo sapiens
atgagacttgctctc

SEQ ID NO: 5254037 - DNA, 21 bp, Homo sapiens
atgagactttccgactgcttt

SEQ ID NO: 5254038 - DNA, 12 bp, Homo sapiens
atgagagaatgt

SEQ ID NO: 5254039 - DNA, 13 bp, Homo sapiens
atgagagacacac

SEQ ID NO: 5254040 - DNA, 21 bp, Homo sapiens
atgagagacacactgaagaag

SEQ ID NO: 5254041 - DNA, 19 bp, Homo sapiens
atgagagagagactgtgtg

SEQ ID NO: 5254042 - DNA, 14 bp, Homo sapiens
atgagagagtgtgg

SEQ ID NO: 5254043 - DNA, 16 bp, Homo sapiens
atgagagccaagtagt

SEQ ID NO: 5254044 - DNA, 14 bp, Homo sapiens
atgagagcccagag

SEQ ID NO: 5254045 - DNA, 16 bp, Homo sapiens
atgagagcccagaggt

SEQ ID NO: 5254046 - DNA, 20 bp, Homo sapiens
atgagagcccagaggtaaca

SEQ ID NO: 5254047 - DNA, 22 bp, Homo sapiens
atgagagcccagaggtaacaga

SEQ ID NO: 5254048 - DNA, 15 bp, Homo sapiens
atgagagcgacacag

SEQ ID NO: 5254049 - DNA, 16 bp, Homo sapiens
atgagagcgacacaga

SEQ ID NO: 5254050 - DNA, 17 bp, Homo sapiens
atgagagcgacacagac

SEQ ID NO: 5254051 - DNA, 16 bp, Homo sapiens
atgagaggaaatcacc

SEQ ID NO: 5254052 - DNA, 20 bp, Homo sapiens
atgagaggcacactgctaaa

SEQ ID NO: 5254053 - DNA, 18 bp, Homo sapiens
atgagagggccctgcctg

SEQ ID NO: 5254054 - DNA, 18 bp, Homo sapiens
atgagagttccagattgt

SEQ ID NO: 5254055 - DNA, 14 bp, Homo sapiens
atgagatacactga

SEQ ID NO: 5254056 - DNA, 16 bp, Homo sapiens
atgagatactttgcat

SEQ ID NO: 5254057 - DNA, 21 bp, Homo sapiens
atgagatatatctttatactt

SEQ ID NO: 5254058 - DNA, 16 bp, Homo sapiens
atgagatattaaacca

SEQ ID NO: 5254059 - DNA, 17 bp, Homo sapiens
atgagatattaaattct

SEQ ID NO: 5254060 - DNA, 18 bp, Homo sapiens
atgagatatttgtattta

SEQ ID NO: 5254061 - DNA, 18 bp, Homo sapiens
atgagatcactgaacttt

SEQ ID NO: 5254062 - DNA, 16 bp, Homo sapiens
atgagatcaggctctg

SEQ ID NO: 5254063 - DNA, 17 bp, Homo sapiens
atgagatcaggctctgc

SEQ ID NO: 5254064 - DNA, 18 bp, Homo sapiens
atgagatcaggctctgcc

SEQ ID NO: 5254065 - DNA, 20 bp, Homo sapiens
atgagatcagggcctgcccc

SEQ ID NO: 5254066 - DNA, 16 bp, Homo sapiens
atgagatcccagagtt

SEQ ID NO: 5254067 - DNA, 23 bp, Homo sapiens
atgagatcccagagttatttccc

SEQ ID NO: 5254068 - DNA, 13 bp, Homo sapiens
atgagatccttta

SEQ ID NO: 5254069 - DNA, 16 bp, Homo sapiens
atgagatctaatgtga

SEQ ID NO: 5254070 - DNA, 20 bp, Homo sapiens
atgagatctaatgtgaaaat

SEQ ID NO: 5254071 - DNA, 22 bp, Homo sapiens
atgagatctaggtgaggattga

SEQ ID NO: 5254072 - DNA, 13 bp, Homo sapiens
atgagatggttaa

SEQ ID NO: 5254073 - DNA, 16 bp, Homo sapiens
atgagatggttaaaaa

SEQ ID NO: 5254074 - DNA, 19 bp, Homo sapiens
atgagatggttaaaaaggc

SEQ ID NO: 5254075 - DNA, 22 bp, Homo sapiens
atgagatggttaaaaaggccaa

SEQ ID NO: 5254076 - DNA, 17 bp, Homo sapiens
atgagattaattccttt

SEQ ID NO: 5254077 - DNA, 20 bp, Homo sapiens
atgagattccctctcctccc

SEQ ID NO: 5254078 - DNA, 21 bp, Homo sapiens
atgagattccctctcctcccc

SEQ ID NO: 5254079 - DNA, 13 bp, Homo sapiens
atgagattgaatt

SEQ ID NO: 5254080 - DNA, 12 bp, Homo sapiens
atgagattggaa

SEQ ID NO: 5254081 - DNA, 24 bp, Homo sapiens
atgagattggtcattaaatactat

SEQ ID NO: 5254082 - DNA, 15 bp, Homo sapiens
atgagattgtacatt

SEQ ID NO: 5254083 - DNA, 18 bp, Homo sapiens
atgagattgttttatcat

SEQ ID NO: 5254084 - DNA, 22 bp, Homo sapiens
atgagatttactgctctagaaa

SEQ ID NO: 5254085 - DNA, 20 bp, Homo sapiens
atgagatttgccagcacagg

SEQ ID NO: 5254086 - DNA, 16 bp, Homo sapiens
atgagatttttaaaaa

SEQ ID NO: 5254087 - DNA, 13 bp, Homo sapiens
atgagcaaaacat

SEQ ID NO: 5254088 - DNA, 14 bp, Homo sapiens
atgagcaagactgg

SEQ ID NO: 5254089 - DNA, 16 bp, Homo sapiens
atgagcaaggacattg

SEQ ID NO: 5254090 - DNA, 19 bp, Homo sapiens
atgagcaaggacattgccc

SEQ ID NO: 5254091 - DNA, 19 bp, Homo sapiens
atgagcactcacaattgtt

SEQ ID NO: 5254092 - DNA, 14 bp, Homo sapiens
atgagcacttctaa

SEQ ID NO: 5254093 - DNA, 19 bp, Homo sapiens
atgagcagagagcaaagga

SEQ ID NO: 5254094 - DNA, 16 bp, Homo sapiens
atgagcagagcccgga

SEQ ID NO: 5254095 - DNA, 13 bp, Homo sapiens
atgagcagaggga

SEQ ID NO: 5254096 - DNA, 14 bp, Homo sapiens
atgagcagagggag

SEQ ID NO: 5254097 - DNA, 12 bp, Homo sapiens
atgagcaggagc

SEQ ID NO: 5254098 - DNA, 13 bp, Homo sapiens
atgagcaggagct

SEQ ID NO: 5254099 - DNA, 17 bp, Homo sapiens
atgagcagtcacactgt

SEQ ID NO: 5254100 - DNA, 16 bp, Homo sapiens
atgagcatcagagagt

SEQ ID NO: 5254101 - DNA, 17 bp, Homo sapiens
atgagcatcaggccagg

SEQ ID NO: 5254102 - DNA, 18 bp, Homo sapiens
atgagcatcaggccaggc

SEQ ID NO: 5254103 - DNA, 20 bp, Homo sapiens
atccagggcagcaggccaga

SEQ ID NO: 5254104 - DNA, 23 bp, Homo sapiens
atccagggcagcaggccagagaa

SEQ ID NO: 5254105 - DNA, 19 bp, Homo sapiens
atccagggctctgaccagt

SEQ ID NO: 5254106 - DNA, 13 bp, Homo sapiens
atccaggggaagc

SEQ ID NO: 5254107 - DNA, 17 bp, Homo sapiens
atccagggggcaagagg

SEQ ID NO: 5254108 - DNA, 22 bp, Homo sapiens
atccagggtatgacctagggaa

SEQ ID NO: 5254109 - DNA, 17 bp, Homo sapiens
atccagggtctggcaga

SEQ ID NO: 5254110 - DNA, 22 bp, Homo sapiens
atccagggtctggcagagcctc

SEQ ID NO: 5254111 - DNA, 24 bp, Homo sapiens
atccagggtctggcagagcctctg

SEQ ID NO: 5254112 - DNA, 16 bp, Homo sapiens
atccaggtacgcacag

SEQ ID NO: 5254113 - DNA, 19 bp, Homo sapiens
atccaggtacgcacagaca

SEQ ID NO: 5254114 - DNA, 15 bp, Homo sapiens
atccaggtcaacaga

SEQ ID NO: 5254115 - DNA, 16 bp, Homo sapiens
atccaggtcatgcagt

SEQ ID NO: 5254116 - DNA, 16 bp, Homo sapiens
atccaggtcctttcct

SEQ ID NO: 5254117 - DNA, 18 bp, Homo sapiens
atccaggtcctttccttc

SEQ ID NO: 5254118 - DNA, 21 bp, Homo sapiens
atccaggtcctttccttctcg

SEQ ID NO: 5254119 - DNA, 18 bp, Homo sapiens
atccaggtgggagagaca

SEQ ID NO: 5254120 - DNA, 18 bp, Homo sapiens
atccaggtgtgcccctcc

SEQ ID NO: 5254121 - DNA, 14 bp, Homo sapiens
atccagtaagcaca

SEQ ID NO: 5254122 - DNA, 17 bp, Homo sapiens
atccagtagggaaaata

SEQ ID NO: 5254123 - DNA, 14 bp, Homo sapiens
atccagtatcttga

SEQ ID NO: 5254124 - DNA, 15 bp, Homo sapiens
atccagtatcttgaa

SEQ ID NO: 5254125 - DNA, 16 bp, Homo sapiens
atccagtatcttgaag

SEQ ID NO: 5254126 - DNA, 17 bp, Homo sapiens
atccagtattatattat

SEQ ID NO: 5254127 - DNA, 22 bp, Homo sapiens
atccagtattgctgattttaaa

SEQ ID NO: 5254128 - DNA, 20 bp, Homo sapiens
atccagtcattttattttgt

SEQ ID NO: 5254129 - DNA, 18 bp, Homo sapiens
atccagtgcagttgtgat

SEQ ID NO: 5254130 - DNA, 17 bp, Homo sapiens
atccagtgcttccacag

SEQ ID NO: 5254131 - DNA, 19 bp, Homo sapiens
atccagtggggaaaaaaag

SEQ ID NO: 5254132 - DNA, 22 bp, Homo sapiens
atccagtgggttcctcccagtc

SEQ ID NO: 5254133 - DNA, 14 bp, Homo sapiens
atccagtggtgggt

SEQ ID NO: 5254134 - DNA, 15 bp, Homo sapiens
atccagtggtgggta

SEQ ID NO: 5254135 - DNA, 18 bp, Homo sapiens
atccagtgtataaatcca

SEQ ID NO: 5254136 - DNA, 17 bp, Homo sapiens
atccagtgtgagatact

SEQ ID NO: 5254137 - DNA, 23 bp, Homo sapiens
atccagtgtgcacccctccccat

SEQ ID NO: 5254138 - DNA, 16 bp, Homo sapiens
atccagttcatgagaa

SEQ ID NO: 5254139 - DNA, 18 bp, Homo sapiens
atccagttcctgctctct

SEQ ID NO: 5254140 - DNA, 19 bp, Homo sapiens
atccagttcctgctctctg

SEQ ID NO: 5254141 - DNA, 20 bp, Homo sapiens
atccagttcctgctctctgc

SEQ ID NO: 5254142 - DNA, 15 bp, Homo sapiens
atccagttgcaataa

SEQ ID NO: 5254143 - DNA, 16 bp, Homo sapiens
atccagttgcaataaa

SEQ ID NO: 5254144 - DNA, 20 bp, Homo sapiens
atccagttgcaataaaatag

SEQ ID NO: 5254145 - DNA, 22 bp, Homo sapiens
atccagttgcaataaaatagta

SEQ ID NO: 5254146 - DNA, 18 bp, Homo sapiens
atccagttggctttttaa

SEQ ID NO: 5254147 - DNA, 17 bp, Homo sapiens
atccagttttgtttgga

SEQ ID NO: 5254148 - DNA, 14 bp, Homo sapiens
atccagtttttcat

SEQ ID NO: 5254149 - DNA, 18 bp, Homo sapiens
atccataaactaagagaa

SEQ ID NO: 5254150 - DNA, 22 bp, Homo sapiens
atccataaagacaatcactgcc

SEQ ID NO: 5254151 - DNA, 15 bp, Homo sapiens
atccataatgatgga

SEQ ID NO: 5254152 - DNA, 23 bp, Homo sapiens
atccataatgatggatttaacag

SEQ ID NO: 5254153 - DNA, 16 bp, Homo sapiens
atccatacaaaactat

SEQ ID NO: 5254154 - DNA, 21 bp, Homo sapiens
atccatacagtcaagatacat

SEQ ID NO: 5254155 - DNA, 14 bp, Homo sapiens
atccatacatttgt

SEQ ID NO: 5254156 - DNA, 17 bp, Homo sapiens
atccataccccctgccc

SEQ ID NO: 5254157 - DNA, 23 bp, Homo sapiens
atccataccccctgccccagaga

SEQ ID NO: 5254158 - DNA, 12 bp, Homo sapiens
atccatagattt

SEQ ID NO: 5254159 - DNA, 19 bp, Homo sapiens
atccatagcacctccacat

SEQ ID NO: 5254160 - DNA, 19 bp, Homo sapiens
atccataggactaccgcag

SEQ ID NO: 5254161 - DNA, 20 bp, Homo sapiens
atccatagtaactgacatga

SEQ ID NO: 5254162 - DNA, 18 bp, Homo sapiens
atccatattgagtcaaat

SEQ ID NO: 5254163 - DNA, 13 bp, Homo sapiens
atccatattgcac

SEQ ID NO: 5254164 - DNA, 18 bp, Homo sapiens
atccatattttattactg

SEQ ID NO: 5254165 - DNA, 23 bp, Homo sapiens
atccatattttattactgtttat

SEQ ID NO: 5254166 - DNA, 17 bp, Homo sapiens
atccatcaatacctgta

SEQ ID NO: 5254167 - DNA, 21 bp, Homo sapiens
atccatcacccatctcactct

SEQ ID NO: 5254168 - DNA, 12 bp, Homo sapiens
atccatcagcaa

SEQ ID NO: 5254169 - DNA, 15 bp, Homo sapiens
atccatcagctccct

SEQ ID NO: 5254170 - DNA, 14 bp, Homo sapiens
atccatcagtgcca

SEQ ID NO: 5254171 - DNA, 14 bp, Homo sapiens
atccatcatcatgt

SEQ ID NO: 5254172 - DNA, 17 bp, Homo sapiens
atccatccagcttgcca

SEQ ID NO: 5254173 - DNA, 19 bp, Homo sapiens
atccatccctagaagagca

SEQ ID NO: 5254174 - DNA, 10 bp, Homo sapiens
atccatcctg

SEQ ID NO: 5254175 - DNA, 13 bp, Homo sapiens
atccatcctgagc

SEQ ID NO: 5254176 - DNA, 16 bp, Homo sapiens
atccatcctgagccaa

SEQ ID NO: 5254177 - DNA, 22 bp, Homo sapiens
atccatcctgcaaaggcccttg

SEQ ID NO: 5254178 - DNA, 13 bp, Homo sapiens
atccatcctgcga

SEQ ID NO: 5254179 - DNA, 13 bp, Homo sapiens
atccatcctgcta

SEQ ID NO: 5254180 - DNA, 20 bp, Homo sapiens
atccatcgtattaaaaaaca

SEQ ID NO: 5254181 - DNA, 14 bp, Homo sapiens
atccatctcagtca

SEQ ID NO: 5254182 - DNA, 21 bp, Homo sapiens
atccatctcagtcactttttc

SEQ ID NO: 5254183 - DNA, 22 bp, Homo sapiens
atccatcttccctacccttcct

SEQ ID NO: 5254184 - DNA, 14 bp, Homo sapiens
atccatcttgagcc

SEQ ID NO: 5254185 - DNA, 18 bp, Homo sapiens
atccatgacctagttttc

SEQ ID NO: 5254186 - DNA, 22 bp, Homo sapiens
atccatgagatagctattataa

SEQ ID NO: 5254187 - DNA, 20 bp, Homo sapiens
atccatgagggactcctcct

SEQ ID NO: 5254188 - DNA, 16 bp, Homo sapiens
atccatgatcacacag

SEQ ID NO: 5254189 - DNA, 15 bp, Homo sapiens
atccatgcactttaa

SEQ ID NO: 5254190 - DNA, 18 bp, Homo sapiens
atccatgcactttaattg

SEQ ID NO: 5254191 - DNA, 15 bp, Homo sapiens
atccatgcattatat

SEQ ID NO: 5254192 - DNA, 19 bp, Homo sapiens
atccatgcggccggcctgg

SEQ ID NO: 5254193 - DNA, 20 bp, Homo sapiens
atccatgcggccggcctggg

SEQ ID NO: 5254194 - DNA, 10 bp, Homo sapiens
atccatgctt

SEQ ID NO: 5254195 - DNA, 14 bp, Homo sapiens
atccatgcttcact

SEQ ID NO: 5254196 - DNA, 19 bp, Homo sapiens
atccatgggggcagggcat

SEQ ID NO: 5254197 - DNA, 18 bp, Homo sapiens
atccatggggggagaagt

SEQ ID NO: 5254198 - DNA, 22 bp, Homo sapiens
atccatggggtctctcacagac

SEQ ID NO: 5254199 - DNA, 23 bp, Homo sapiens
atccatggggtctctcacagaca

SEQ ID NO: 5254200 - DNA, 19 bp, Homo sapiens
atccatggtaaaaactagt

SEQ ID NO: 5254201 - DNA, 19 bp, Homo sapiens
atccatgtactttccctgt

SEQ ID NO: 5254202 - DNA, 20 bp, Homo sapiens
atccatgtgaccattctgcc

SEQ ID NO: 5254203 - DNA, 12 bp, Homo sapiens
atccatgtgtcc

SEQ ID NO: 5254204 - DNA, 14 bp, Homo sapiens
atccatgtgtcccc

SEQ ID NO: 5254205 - DNA, 21 bp, Homo sapiens
atccatgtgtcccccctgtgg

SEQ ID NO: 5254206 - DNA, 24 bp, Homo sapiens
atccatgtgtcccccctgtggtct

SEQ ID NO: 5254207 - DNA, 14 bp, Homo sapiens
atccatgtgttcca

SEQ ID NO: 5254208 - DNA, 18 bp, Homo sapiens
atccatgttagtttttac

SEQ ID NO: 5254209 - DNA, 21 bp, Homo sapiens
atccatgttgctgacttttcc

SEQ ID NO: 5254210 - DNA, 13 bp, Homo sapiens
atccattaattta

SEQ ID NO: 5254211 - DNA, 15 bp, Homo sapiens
atccattaatttaaa

SEQ ID NO: 5254212 - DNA, 16 bp, Homo sapiens
atccattacgtgcatt

SEQ ID NO: 5254213 - DNA, 17 bp, Homo sapiens
atccattacgtgcattt

SEQ ID NO: 5254214 - DNA, 23 bp, Homo sapiens
atccattacgtgcatttaaactc

SEQ ID NO: 5254215 - DNA, 16 bp, Homo sapiens
atccattaggccagca

SEQ ID NO: 5254216 - DNA, 14 bp, Homo sapiens
atccattatcatgt

SEQ ID NO: 5254217 - DNA, 15 bp, Homo sapiens
atccattatcatgtg

SEQ ID NO: 5254218 - DNA, 21 bp, Homo sapiens
atccattatcctttattttat

SEQ ID NO: 5254219 - DNA, 19 bp, Homo sapiens
atccattcacaagcctcct

SEQ ID NO: 5254220 - DNA, 22 bp, Homo sapiens
atccattcacaagcctcctgta

SEQ ID NO: 5254221 - DNA, 19 bp, Homo sapiens
atccattccagagctgcag

SEQ ID NO: 5254222 - DNA, 17 bp, Homo sapiens
atccattccaggtagct

SEQ ID NO: 5254223 - DNA, 17 bp, Homo sapiens
atccattcccaagaaat

SEQ ID NO: 5254224 - DNA, 19 bp, Homo sapiens
atccattcccaagaaatgc

SEQ ID NO: 5254225 - DNA, 22 bp, Homo sapiens
atccattcccaagatgcctgat

SEQ ID NO: 5254226 - DNA, 17 bp, Homo sapiens
atccattctctctgccc

SEQ ID NO: 5254227 - DNA, 15 bp, Homo sapiens
atccattctttctga

SEQ ID NO: 5254228 - DNA, 16 bp, Homo sapiens
atccattgtctcttca

SEQ ID NO: 5254229 - DNA, 14 bp, Homo sapiens
atccattgtggaaa

SEQ ID NO: 5254230 - DNA, 23 bp, Homo sapiens
atccatttaaactaaccttttat

SEQ ID NO: 5254231 - DNA, 22 bp, Homo sapiens
atccatttactgacacttcctg

SEQ ID NO: 5254232 - DNA, 16 bp, Homo sapiens
atccatttatttcatt

SEQ ID NO: 5254233 - DNA, 14 bp, Homo sapiens
atccatttcagttt

SEQ ID NO: 5254234 - DNA, 14 bp, Homo sapiens
atccatttctttta

SEQ ID NO: 5254235 - DNA, 15 bp, Homo sapiens
atccatttcttttac

SEQ ID NO: 5254236 - DNA, 23 bp, Homo sapiens
atccatttgaacagttggctgta

SEQ ID NO: 5254237 - DNA, 18 bp, Homo sapiens
atccatttgaataaaatg

SEQ ID NO: 5254238 - DNA, 17 bp, Homo sapiens
atccatttgcctttctg

SEQ ID NO: 5254239 - DNA, 18 bp, Homo sapiens
atccatttggacaaaatg

SEQ ID NO: 5254240 - DNA, 14 bp, Homo sapiens
atccatttggcaga

SEQ ID NO: 5254241 - DNA, 20 bp, Homo sapiens
atccatttggcagaactgct

SEQ ID NO: 5254242 - DNA, 13 bp, Homo sapiens
atccatttgtgca

SEQ ID NO: 5254243 - DNA, 21 bp, Homo sapiens
atccattttacacttgcttta

SEQ ID NO: 5254244 - DNA, 11 bp, Homo sapiens
atccattttag

SEQ ID NO: 5254245 - DNA, 14 bp, Homo sapiens
atccattttctaaa

SEQ ID NO: 5254246 - DNA, 23 bp, Homo sapiens
atccatttttaaggctgtgtgaa

SEQ ID NO: 5254247 - DNA, 13 bp, Homo sapiens
atcccaaaagtca

SEQ ID NO: 5254248 - DNA, 16 bp, Homo sapiens
atcccaaacttcggaa

SEQ ID NO: 5254249 - DNA, 22 bp, Homo sapiens
atcccaaactttaaaatgcgaa

SEQ ID NO: 5254250 - DNA, 16 bp, Homo sapiens
atcccaaaggacagcc

SEQ ID NO: 5254251 - DNA, 14 bp, Homo sapiens
atcccaaaggatga

SEQ ID NO: 5254252 - DNA, 22 bp, Homo sapiens
atcccaaaggatgagaatgtga

SEQ ID NO: 5254253 - DNA, 15 bp, Homo sapiens
atcccaaagtgcctt

SEQ ID NO: 5254254 - DNA, 15 bp, Homo sapiens
atcccaaagttgttg

SEQ ID NO: 5254255 - DNA, 15 bp, Homo sapiens
atcccaacagcccag

SEQ ID NO: 5254256 - DNA, 14 bp, Homo sapiens
atcccaacattctg

SEQ ID NO: 5254257 - DNA, 16 bp, Homo sapiens
atcccaacattctgca

SEQ ID NO: 5254258 - DNA, 16 bp, Homo sapiens
atcccaaccagtgcca

SEQ ID NO: 5254259 - DNA, 17 bp, Homo sapiens
atcccaactgtcttttt

SEQ ID NO: 5254260 - DNA, 14 bp, Homo sapiens
atcccaagaaatgg

SEQ ID NO: 5254261 - DNA, 13 bp, Homo sapiens
atcccaagatcat

SEQ ID NO: 5254262 - DNA, 21 bp, Homo sapiens
atcccaagatctgtgcagccc

SEQ ID NO: 5254263 - DNA, 18 bp, Homo sapiens
atcccaagcgtcccgtcc

SEQ ID NO: 5254264 - DNA, 11 bp, Homo sapiens
atcccaagtca

SEQ ID NO: 5254265 - DNA, 13 bp, Homo sapiens
atcccaagtcaaa

SEQ ID NO: 5254266 - DNA, 15 bp, Homo sapiens
atcccaagtgccagt

SEQ ID NO: 5254267 - DNA, 14 bp, Homo sapiens
atcccaagtgtctc

SEQ ID NO: 5254268 - DNA, 17 bp, Homo sapiens
atcccaataaagtcctc

SEQ ID NO: 5254269 - DNA, 17 bp, Homo sapiens
atcccaatctttctata

SEQ ID NO: 5254270 - DNA, 15 bp, Homo sapiens
atcccaattctgtcc

SEQ ID NO: 5254271 - DNA, 12 bp, Homo sapiens
atcccacacagg

SEQ ID NO: 5254272 - DNA, 12 bp, Homo sapiens
atcccacagcca

SEQ ID NO: 5254273 - DNA, 14 bp, Homo sapiens
atcccacagcccta

SEQ ID NO: 5254274 - DNA, 15 bp, Homo sapiens
atcccacatatttca

SEQ ID NO: 5254275 - DNA, 17 bp, Homo sapiens
atcccacatatttcaaa

SEQ ID NO: 5254276 - DNA, 22 bp, Homo sapiens
atcccacatatttcaaaaacat

SEQ ID NO: 5254277 - DNA, 20 bp, Homo sapiens
atcccacatcgtataaatat

SEQ ID NO: 5254278 - DNA, 14 bp, Homo sapiens
atcccacatgatct

SEQ ID NO: 5254279 - DNA, 20 bp, Homo sapiens
atcccacattcggaccctgc

SEQ ID NO: 5254280 - DNA, 14 bp, Homo sapiens
atcccaccaaatca

SEQ ID NO: 5254281 - DNA, 20 bp, Homo sapiens
atcccaccaaatcatcctga

SEQ ID NO: 5254282 - DNA, 19 bp, Homo sapiens
atgagcatcaggccaggcc

SEQ ID NO: 5254283 - DNA, 21 bp, Homo sapiens
atgagcatcaggccaggccct

SEQ ID NO: 5254284 - DNA, 15 bp, Homo sapiens
atgagcatcccagga

SEQ ID NO: 5254285 - DNA, 22 bp, Homo sapiens
atgagcatctcaaatgttttct

SEQ ID NO: 5254286 - DNA, 14 bp, Homo sapiens
atgagcatgtttag

SEQ ID NO: 5254287 - DNA, 21 bp, Homo sapiens
atgagcattggatacagcagt

SEQ ID NO: 5254288 - DNA, 21 bp, Homo sapiens
atgagccaataaagctcacac

SEQ ID NO: 5254289 - DNA, 21 bp, Homo sapiens
atgagccaccgcgcccagcct

SEQ ID NO: 5254290 - DNA, 23 bp, Homo sapiens
atgagccactgcacctgcccagc

SEQ ID NO: 5254291 - DNA, 22 bp, Homo sapiens
atgagccatattaattgcctgt

SEQ ID NO: 5254292 - DNA, 21 bp, Homo sapiens
atgagcccaccctgctgagat

SEQ ID NO: 5254293 - DNA, 11 bp, Homo sapiens
atgagcccaga

SEQ ID NO: 5254294 - DNA, 12 bp, Homo sapiens
atgagcccagag

SEQ ID NO: 5254295 - DNA, 14 bp, Homo sapiens
atgagcccagagaa

SEQ ID NO: 5254296 - DNA, 16 bp, Homo sapiens
atgagccccttcatcc

SEQ ID NO: 5254297 - DNA, 15 bp, Homo sapiens
atgagccctggctcc

SEQ ID NO: 5254298 - DNA, 20 bp, Homo sapiens
atgagccgctgtgagcccct

SEQ ID NO: 5254299 - DNA, 23 bp, Homo sapiens
atgagccgctgtgagcccctggt

SEQ ID NO: 5254300 - DNA, 12 bp, Homo sapiens
atgagcctcagc

SEQ ID NO: 5254301 - DNA, 11 bp, Homo sapiens
atgagcctgcc

SEQ ID NO: 5254302 - DNA, 14 bp, Homo sapiens
atgagcctgtccaa

SEQ ID NO: 5254303 - DNA, 20 bp, Homo sapiens
atgagcctgtttattgccat

SEQ ID NO: 5254304 - DNA, 14 bp, Homo sapiens
atgagccttaagaa

SEQ ID NO: 5254305 - DNA, 16 bp, Homo sapiens
atgagcctttgtgctt

SEQ ID NO: 5254306 - DNA, 18 bp, Homo sapiens
atgagcgaaaatgtatta

SEQ ID NO: 5254307 - DNA, 15 bp, Homo sapiens
atgagcgtcaaagaa

SEQ ID NO: 5254308 - DNA, 21 bp, Homo sapiens
atgagcgtcaaagaaaatgcc

SEQ ID NO: 5254309 - DNA, 16 bp, Homo sapiens
atgagcgtccaggtga

SEQ ID NO: 5254310 - DNA, 17 bp, Homo sapiens
atgagcgtccaggtgat

SEQ ID NO: 5254311 - DNA, 20 bp, Homo sapiens
atgagcgtcctaaggcatgt

SEQ ID NO: 5254312 - DNA, 18 bp, Homo sapiens
atgagcgtgacactcatt

SEQ ID NO: 5254313 - DNA, 15 bp, Homo sapiens
atgagctaaaaatat

SEQ ID NO: 5254314 - DNA, 23 bp, Homo sapiens
atgagctaaataagtcaccattg

SEQ ID NO: 5254315 - DNA, 20 bp, Homo sapiens
atgagctacaacaaaaggac

SEQ ID NO: 5254316 - DNA, 19 bp, Homo sapiens
atgagctacgcctgcctcc

SEQ ID NO: 5254317 - DNA, 17 bp, Homo sapiens
atgagctagtgtcttat

SEQ ID NO: 5254318 - DNA, 18 bp, Homo sapiens
atgagctatcctttcaaa

SEQ ID NO: 5254319 - DNA, 19 bp, Homo sapiens
atgagctatcctttcaaac

SEQ ID NO: 5254320 - DNA, 14 bp, Homo sapiens
atgagctatgtatt

SEQ ID NO: 5254321 - DNA, 16 bp, Homo sapiens
atgagctatgtattaa

SEQ ID NO: 5254322 - DNA, 23 bp, Homo sapiens
atgagctatttccattccagaat

SEQ ID NO: 5254323 - DNA, 23 bp, Homo sapiens
atgagctcagcctcgctttgagg

SEQ ID NO: 5254324 - DNA, 15 bp, Homo sapiens
atgagctccagaccc

SEQ ID NO: 5254325 - DNA, 22 bp, Homo sapiens
atgagctcctcttcctggcttc

SEQ ID NO: 5254326 - DNA, 11 bp, Homo sapiens
atgagctcctg

SEQ ID NO: 5254327 - DNA, 16 bp, Homo sapiens
atgagctcctgcggga

SEQ ID NO: 5254328 - DNA, 21 bp, Homo sapiens
atgagctcggggtccaccagt

SEQ ID NO: 5254329 - DNA, 22 bp, Homo sapiens
atgagctctgaaatcttcccat

SEQ ID NO: 5254330 - DNA, 14 bp, Homo sapiens
atgagctctgaaca

SEQ ID NO: 5254331 - DNA, 15 bp, Homo sapiens
atgagctctgaacaa

SEQ ID NO: 5254332 - DNA, 21 bp, Homo sapiens
atgagctggagctaaggccag

SEQ ID NO: 5254333 - DNA, 15 bp, Homo sapiens
atgagctggcaacca

SEQ ID NO: 5254334 - DNA, 20 bp, Homo sapiens
atgagctggcaaccagccag

SEQ ID NO: 5254335 - DNA, 23 bp, Homo sapiens
atgagctggcaaccagccagcgt

SEQ ID NO: 5254336 - DNA, 18 bp, Homo sapiens
atgagctgtgcacaaagt

SEQ ID NO: 5254337 - DNA, 22 bp, Homo sapiens
atgagctgtgcacaaagtggca

SEQ ID NO: 5254338 - DNA, 19 bp, Homo sapiens
atgagctgtgcgctgctct

SEQ ID NO: 5254339 - DNA, 14 bp, Homo sapiens
atgagcttaagaaa

SEQ ID NO: 5254340 - DNA, 23 bp, Homo sapiens
atgagcttaatgtctttgtgttt

SEQ ID NO: 5254341 - DNA, 22 bp, Homo sapiens
atgagcttatttcaaaaggaag

SEQ ID NO: 5254342 - DNA, 22 bp, Homo sapiens
atgagcttcaatataagaagca

SEQ ID NO: 5254343 - DNA, 17 bp, Homo sapiens
atgagcttgtaaatact

SEQ ID NO: 5254344 - DNA, 18 bp, Homo sapiens
atgagctttatgtaataa

SEQ ID NO: 5254345 - DNA, 20 bp, Homo sapiens
atgagctttatgtaataatg

SEQ ID NO: 5254346 - DNA, 19 bp, Homo sapiens
atgagctttctgaacagct

SEQ ID NO: 5254347 - DNA, 20 bp, Homo sapiens
atgagctttctgaacagctg

SEQ ID NO: 5254348 - DNA, 23 bp, Homo sapiens
atgagctttctgaacagctggtg

SEQ ID NO: 5254349 - DNA, 21 bp, Homo sapiens
atgaggaaaataatgtaattg

SEQ ID NO: 5254350 - DNA, 21 bp, Homo sapiens
atgaggaaaattcttaaaagg

SEQ ID NO: 5254351 - DNA, 16 bp, Homo sapiens
atgaggaaactactga

SEQ ID NO: 5254352 - DNA, 13 bp, Homo sapiens
atgaggaaataat

SEQ ID NO: 5254353 - DNA, 14 bp, Homo sapiens
atgaggaaatgtgt

SEQ ID NO: 5254354 - DNA, 22 bp, Homo sapiens
atgaggaacctcaaactgggta

SEQ ID NO: 5254355 - DNA, 21 bp, Homo sapiens
atgaggaactgtagatgatgt

SEQ ID NO: 5254356 - DNA, 22 bp, Homo sapiens
atgaggaactgtagatgatgta

SEQ ID NO: 5254357 - DNA, 15 bp, Homo sapiens
atgaggaagcaaaga

SEQ ID NO: 5254358 - DNA, 14 bp, Homo sapiens
atgaggaataatta

SEQ ID NO: 5254359 - DNA, 23 bp, Homo sapiens
atgaggaataattatttatttaa

SEQ ID NO: 5254360 - DNA, 12 bp, Homo sapiens
atgaggaatgta

SEQ ID NO: 5254361 - DNA, 15 bp, Homo sapiens
atgaggaatgtatat

SEQ ID NO: 5254362 - DNA, 12 bp, Homo sapiens
atgaggacagaa

SEQ ID NO: 5254363 - DNA, 16 bp, Homo sapiens
atgaggacagaaggac

SEQ ID NO: 5254364 - DNA, 15 bp, Homo sapiens
atgaggactcatata

SEQ ID NO: 5254365 - DNA, 14 bp, Homo sapiens
atgaggagagaagg

SEQ ID NO: 5254366 - DNA, 16 bp, Homo sapiens
atgaggagcagctggg

SEQ ID NO: 5254367 - DNA, 24 bp, Homo sapiens
atgaggaggatgtccctgggccag

SEQ ID NO: 5254368 - DNA, 22 bp, Homo sapiens
atgaggaggcagaaagcagagg

SEQ ID NO: 5254369 - DNA, 14 bp, Homo sapiens
atgaggaggggagc

SEQ ID NO: 5254370 - DNA, 15 bp, Homo sapiens
atgaggaggggaggg

SEQ ID NO: 5254371 - DNA, 12 bp, Homo sapiens
atgaggagggtg

SEQ ID NO: 5254372 - DNA, 22 bp, Homo sapiens
atgaggagggtgggggagggag

SEQ ID NO: 5254373 - DNA, 14 bp, Homo sapiens
atgaggagttgctg

SEQ ID NO: 5254374 - DNA, 17 bp, Homo sapiens
atgaggatataatgtgt

SEQ ID NO: 5254375 - DNA, 22 bp, Homo sapiens
atgaggatccagggcagcaggc

SEQ ID NO: 5254376 - DNA, 22 bp, Homo sapiens
atgaggatctgaaaacttggct

SEQ ID NO: 5254377 - DNA, 21 bp, Homo sapiens
atgaggatgcagagtcagcag

SEQ ID NO: 5254378 - DNA, 14 bp, Homo sapiens
atgaggcaaacagc

SEQ ID NO: 5254379 - DNA, 16 bp, Homo sapiens
atgaggcaactcagca

SEQ ID NO: 5254380 - DNA, 21 bp, Homo sapiens
atgaggcaatgtcaggaacag

SEQ ID NO: 5254381 - DNA, 14 bp, Homo sapiens
atgaggcatttggc

SEQ ID NO: 5254382 - DNA, 13 bp, Homo sapiens
atgaggcatttgt

SEQ ID NO: 5254383 - DNA, 21 bp, Homo sapiens
atgaggcatttgtttgaactg

SEQ ID NO: 5254384 - DNA, 14 bp, Homo sapiens
atgaggccagacca

SEQ ID NO: 5254385 - DNA, 15 bp, Homo sapiens
atgaggccctccaca

SEQ ID NO: 5254386 - DNA, 19 bp, Homo sapiens
atgaggccctccacacctg

SEQ ID NO: 5254387 - DNA, 14 bp, Homo sapiens
atgaggccctgcac

SEQ ID NO: 5254388 - DNA, 16 bp, Homo sapiens
atgaggccggacagag

SEQ ID NO: 5254389 - DNA, 20 bp, Homo sapiens
atgaggcctttccccagtgt

SEQ ID NO: 5254390 - DNA, 11 bp, Homo sapiens
atgaggctcac

SEQ ID NO: 5254391 - DNA, 19 bp, Homo sapiens
atgaggctggataggagag

SEQ ID NO: 5254392 - DNA, 19 bp, Homo sapiens
atgaggcttcttcctggat

SEQ ID NO: 5254393 - DNA, 15 bp, Homo sapiens
atgaggcttgctgag

SEQ ID NO: 5254394 - DNA, 13 bp, Homo sapiens
atgaggctttcca

SEQ ID NO: 5254395 - DNA, 14 bp, Homo sapiens
atgagggaaaagaa

SEQ ID NO: 5254396 - DNA, 15 bp, Homo sapiens
atgagggaaaagaaa

SEQ ID NO: 5254397 - DNA, 15 bp, Homo sapiens
atgagggaagcaata

SEQ ID NO: 5254398 - DNA, 13 bp, Homo sapiens
atgagggactgga

SEQ ID NO: 5254399 - DNA, 17 bp, Homo sapiens
atgagggagacagacca

SEQ ID NO: 5254400 - DNA, 17 bp, Homo sapiens
atgagggagatgccatg

SEQ ID NO: 5254401 - DNA, 16 bp, Homo sapiens
atgagggatcacaggg

SEQ ID NO: 5254402 - DNA, 19 bp, Homo sapiens
atgagggcagaaaccttgt

SEQ ID NO: 5254403 - DNA, 13 bp, Homo sapiens
atgagggcagcag

SEQ ID NO: 5254404 - DNA, 20 bp, Homo sapiens
atgagggcagcagccagccc

SEQ ID NO: 5254405 - DNA, 19 bp, Homo sapiens
atgagggccaccaggaagc

SEQ ID NO: 5254406 - DNA, 17 bp, Homo sapiens
atgagggcgtgaaacac

SEQ ID NO: 5254407 - DNA, 19 bp, Homo sapiens
atgagggcgtgaaacacaa

SEQ ID NO: 5254408 - DNA, 14 bp, Homo sapiens
atgagggctgagat

SEQ ID NO: 5254409 - DNA, 16 bp, Homo sapiens
atgaggggaaagggag

SEQ ID NO: 5254410 - DNA, 14 bp, Homo sapiens
atgaggggacccag

SEQ ID NO: 5254411 - DNA, 22 bp, Homo sapiens
atgaggggactgcatgcaagct

SEQ ID NO: 5254412 - DNA, 14 bp, Homo sapiens
atgaggggaggggg

SEQ ID NO: 5254413 - DNA, 22 bp, Homo sapiens
atgaggggattcccttccttct

SEQ ID NO: 5254414 - DNA, 16 bp, Homo sapiens
atgaggggccactgac

SEQ ID NO: 5254415 - DNA, 23 bp, Homo sapiens
atgaggggccactgacccacctg

SEQ ID NO: 5254416 - DNA, 23 bp, Homo sapiens
atgagggggtggttattggactc

SEQ ID NO: 5254417 - DNA, 21 bp, Homo sapiens
atgaggggttaatttatcagt

SEQ ID NO: 5254418 - DNA, 22 bp, Homo sapiens
atgaggggttcctcccctccag

SEQ ID NO: 5254419 - DNA, 13 bp, Homo sapiens
atgagggtcttgg

SEQ ID NO: 5254420 - DNA, 20 bp, Homo sapiens
atgagggtgtcggctgtgag

SEQ ID NO: 5254421 - DNA, 23 bp, Homo sapiens
atgagggtgtgagaagtgccttc

SEQ ID NO: 5254422 - DNA, 14 bp, Homo sapiens
atgagggtgtttcc

SEQ ID NO: 5254423 - DNA, 17 bp, Homo sapiens
atgagggtttcattgtg

SEQ ID NO: 5254424 - DNA, 15 bp, Homo sapiens
atgaggtaaaagagc

SEQ ID NO: 5254425 - DNA, 21 bp, Homo sapiens
atgaggtacaacctgttctgc

SEQ ID NO: 5254426 - DNA, 18 bp, Homo sapiens
atgaggtactgagagtga

SEQ ID NO: 5254427 - DNA, 20 bp, Homo sapiens
atgaggtagctatagttgca

SEQ ID NO: 5254428 - DNA, 19 bp, Homo sapiens
atgaggtagctgacacaga

SEQ ID NO: 5254429 - DNA, 14 bp, Homo sapiens
atgaggtcaccagg

SEQ ID NO: 5254430 - DNA, 18 bp, Homo sapiens
atgaggtcaccaggggag

SEQ ID NO: 5254431 - DNA, 18 bp, Homo sapiens
atgaggtcagagcctgca

SEQ ID NO: 5254432 - DNA, 20 bp, Homo sapiens
atgaggtcagagcctgcagt

SEQ ID NO: 5254433 - DNA, 17 bp, Homo sapiens
atgaggtcataaacact

SEQ ID NO: 5254434 - DNA, 17 bp, Homo sapiens
atgaggtcccaggcaga

SEQ ID NO: 5254435 - DNA, 19 bp, Homo sapiens
atgaggtcccaggcagaga

SEQ ID NO: 5254436 - DNA, 15 bp, Homo sapiens
atgaggtccctctag

SEQ ID NO: 5254437 - DNA, 16 bp, Homo sapiens
atgaggtccctctagc

SEQ ID NO: 5254438 - DNA, 21 bp, Homo sapiens
atgaggtcctcaggtcagctg

SEQ ID NO: 5254439 - DNA, 20 bp, Homo sapiens
atgaggtctcgaccctgtcc

SEQ ID NO: 5254440 - DNA, 15 bp, Homo sapiens
atgaggtctgaaatg

SEQ ID NO: 5254441 - DNA, 15 bp, Homo sapiens
atgaggtctgtttaa

SEQ ID NO: 5254442 - DNA, 13 bp, Homo sapiens
atgaggtctttaa
